United States Patent 11,369,692 (MATERIALS AND METHODS FOR TREATMENT OF DUCHENNE MUSCULAR DYSTROPHY) - sequence listing, part 39

SEQ ID NO: 1291001 - DNA, 22 bp, Artificial Sequence
  chemically synthesized
aatgtactttaatcatgaaata

SEQ ID NO: 1291002 - DNA, 22 bp, Artificial Sequence
  chemically synthesized
ataaaattaaaatctatttcat

SEQ ID NO: 1291003 - DNA, 22 bp, Artificial Sequence
  chemically synthesized
gataaaattaaaatctatttca

SEQ ID NO: 1291004 - DNA, 22 bp, Artificial Sequence
  chemically synthesized
taatcatgaaatagattttaat

SEQ ID NO: 1291005 - DNA, 22 bp, Artificial Sequence
  chemically synthesized
acatttgataaaattaaaatct

SEQ ID NO: 1291006 - DNA, 22 bp, Artificial Sequence
  chemically synthesized
aatcatgaaatagattttaatt

SEQ ID NO: 1291007 - DNA, 22 bp, Artificial Sequence
  chemically synthesized
atcatgaaatagattttaattt

SEQ ID NO: 1291008 - DNA, 22 bp, Artificial Sequence
  chemically synthesized
agtgtgagatactaacatttga

SEQ ID NO: 1291009 - DNA, 22 bp, Artificial Sequence
  chemically synthesized
aagtgtgagatactaacatttg

SEQ ID NO: 1291010 - DNA, 22 bp, Artificial Sequence
  chemically synthesized
taattttatcaaatgttagtat

SEQ ID NO: 1291011 - DNA, 22 bp, Artificial Sequence
  chemically synthesized
aattttatcaaatgttagtatc

SEQ ID NO: 1291012 - DNA, 22 bp, Artificial Sequence
  chemically synthesized
attttatcaaatgttagtatct

SEQ ID NO: 1291013 - DNA, 22 bp, Artificial Sequence
  chemically synthesized
tatttaagtgtgagatactaac

SEQ ID NO: 1291014 - DNA, 22 bp, Artificial Sequence
  chemically synthesized
atatttaagtgtgagatactaa

SEQ ID NO: 1291015 - DNA, 22 bp, Artificial Sequence
  chemically synthesized
tatcaaatgttagtatctcaca

SEQ ID NO: 1291016 - DNA, 22 bp, Artificial Sequence
  chemically synthesized
atcaaatgttagtatctcacac

SEQ ID NO: 1291017 - DNA, 22 bp, Artificial Sequence
  chemically synthesized
gtttatatttaagtgtgagata

SEQ ID NO: 1291018 - DNA, 22 bp, Artificial Sequence
  chemically synthesized
tcaaatgttagtatctcacact

SEQ ID NO: 1291019 - DNA, 22 bp, Artificial Sequence
  chemically synthesized
ggtttatatttaagtgtgagat

SEQ ID NO: 1291020 - DNA, 22 bp, Artificial Sequence
  chemically synthesized
tggtttatatttaagtgtgaga

SEQ ID NO: 1291021 - DNA, 22 bp, Artificial Sequence
  chemically synthesized
ttggtttatatttaagtgtgag

SEQ ID NO: 1291022 - DNA, 22 bp, Artificial Sequence
  chemically synthesized
gcttttggtttatatttaagtg

SEQ ID NO: 1291023 - DNA, 22 bp, Artificial Sequence
  chemically synthesized
agcttttggtttatatttaagt

SEQ ID NO: 1291024 - DNA, 22 bp, Artificial Sequence
  chemically synthesized
gtatctcacacttaaatataaa

SEQ ID NO: 1291025 - DNA, 22 bp, Artificial Sequence
  chemically synthesized
acacttaaatataaaccaaaag

SEQ ID NO: 1291026 - DNA, 22 bp, Artificial Sequence
  chemically synthesized
caagtgatcttagcttttggtt

SEQ ID NO: 1291027 - DNA, 22 bp, Artificial Sequence
  chemically synthesized
aaatataaaccaaaagctaaga

SEQ ID NO: 1291028 - DNA, 22 bp, Artificial Sequence
  chemically synthesized
aatataaaccaaaagctaagat

SEQ ID NO: 1291029 - DNA, 22 bp, Artificial Sequence
  chemically synthesized
aaattacaagtgatcttagctt

SEQ ID NO: 1291030 - DNA, 22 bp, Artificial Sequence
  chemically synthesized
ctcaaattacaagtgatcttag

SEQ ID NO: 1291031 - DNA, 22 bp, Artificial Sequence
  chemically synthesized
aagtcattcctcaaattacaag

SEQ ID NO: 1291032 - DNA, 22 bp, Artificial Sequence
  chemically synthesized
ttgaagtcattcctcaaattac

SEQ ID NO: 1291033 - DNA, 22 bp, Artificial Sequence
  chemically synthesized
agatcacttgtaatttgaggaa

SEQ ID NO: 1291034 - DNA, 22 bp, Artificial Sequence
  chemically synthesized
attattgaagtcattcctcaaa

SEQ ID NO: 1291035 - DNA, 22 bp, Artificial Sequence
  chemically synthesized
tcattattgaagtcattcctca

SEQ ID NO: 1291036 - DNA, 22 bp, Artificial Sequence
  chemically synthesized
ctcattattgaagtcattcctc

SEQ ID NO: 1291037 - DNA, 22 bp, Artificial Sequence
  chemically synthesized
tttctcattattgaagtcattc

SEQ ID NO: 1291038 - DNA, 22 bp, Artificial Sequence
  chemically synthesized
gtaatttgaggaatgacttcaa

SEQ ID NO: 1291039 - DNA, 22 bp, Artificial Sequence
  chemically synthesized
taatttgaggaatgacttcaat

SEQ ID NO: 1291040 - DNA, 22 bp, Artificial Sequence
  chemically synthesized
aggaactgtttctcattattga

SEQ ID NO: 1291041 - DNA, 22 bp, Artificial Sequence
  chemically synthesized
gaggaatgacttcaataatgag

SEQ ID NO: 1291042 - DNA, 22 bp, Artificial Sequence
  chemically synthesized
gaggaactgtttctcattattg

SEQ ID NO: 1291043 - DNA, 22 bp, Artificial Sequence
  chemically synthesized
aggaatgacttcaataatgaga

SEQ ID NO: 1291044 - DNA, 22 bp, Artificial Sequence
  chemically synthesized
tgaggaactgtttctcattatt

SEQ ID NO: 1291045 - DNA, 22 bp, Artificial Sequence
  chemically synthesized
ttttgaggaactgtttctcatt

SEQ ID NO: 1291046 - DNA, 22 bp, Artificial Sequence
  chemically synthesized
attttgaggaactgtttctcat

SEQ ID NO: 1291047 - DNA, 22 bp, Artificial Sequence
  chemically synthesized
tattttgaggaactgtttctca

SEQ ID NO: 1291048 - DNA, 22 bp, Artificial Sequence
  chemically synthesized
ctttattttgaggaactgtttc

SEQ ID NO: 1291049 - DNA, 22 bp, Artificial Sequence
  chemically synthesized
gctttattttgaggaactgttt

SEQ ID NO: 1291050 - DNA, 22 bp, Artificial Sequence
  chemically synthesized
caataatgagaaacagttcctc

SEQ ID NO: 1291051 - DNA, 22 bp, Artificial Sequence
  chemically synthesized
aataatgagaaacagttcctca

SEQ ID NO: 1291052 - DNA, 22 bp, Artificial Sequence
  chemically synthesized
tttgctttattttgaggaactg

SEQ ID NO: 1291053 - DNA, 22 bp, Artificial Sequence
  chemically synthesized
atttgctttattttgaggaact

SEQ ID NO: 1291054 - DNA, 22 bp, Artificial Sequence
  chemically synthesized
ttatttgctttattttgaggaa

SEQ ID NO: 1291055 - DNA, 22 bp, Artificial Sequence
  chemically synthesized
ttcttatttgctttattttgag

SEQ ID NO: 1291056 - DNA, 22 bp, Artificial Sequence
  chemically synthesized
gttcttatttgctttattttga

SEQ ID NO: 1291057 - DNA, 22 bp, Artificial Sequence
  chemically synthesized
ccatttgttcttatttgcttta

SEQ ID NO: 1291058 - DNA, 22 bp, Artificial Sequence
  chemically synthesized
cccatttgttcttatttgcttt

SEQ ID NO: 1291059 - DNA, 22 bp, Artificial Sequence
  chemically synthesized
ttcccatttgttcttatttgct

SEQ ID NO: 1291060 - DNA, 22 bp, Artificial Sequence
  chemically synthesized
cttcccatttgttcttatttgc

SEQ ID NO: 1291061 - DNA, 22 bp, Artificial Sequence
  chemically synthesized
ctcaaaataaagcaaataagaa

SEQ ID NO: 1291062 - DNA, 22 bp, Artificial Sequence
  chemically synthesized
aaaataaagcaaataagaacaa

SEQ ID NO: 1291063 - DNA, 22 bp, Artificial Sequence
  chemically synthesized
tcttcttcccatttgttcttat

SEQ ID NO: 1291064 - DNA, 22 bp, Artificial Sequence
  chemically synthesized
tgtcttcttcccatttgttctt

SEQ ID NO: 1291065 - DNA, 22 bp, Artificial Sequence
  chemically synthesized
ctgtcttcttcccatttgttct

SEQ ID NO: 1291066 - DNA, 22 bp, Artificial Sequence
  chemically synthesized
tctgtcttcttcccatttgttc

SEQ ID NO: 1291067 - DNA, 22 bp, Artificial Sequence
  chemically synthesized
atgttttctgtcttcttcccat

SEQ ID NO: 1291068 - DNA, 22 bp, Artificial Sequence
  chemically synthesized
ctcatgttttctgtcttcttcc

SEQ ID NO: 1291069 - DNA, 22 bp, Artificial Sequence
  chemically synthesized
cattgctcatgttttctgtctt

SEQ ID NO: 1291070 - DNA, 22 bp, Artificial Sequence
  chemically synthesized
gcattgctcatgttttctgtct

SEQ ID NO: 1291071 - DNA, 22 bp, Artificial Sequence
  chemically synthesized
cttgcattgctcatgttttctg

SEQ ID NO: 1291072 - DNA, 22 bp, Artificial Sequence
  chemically synthesized
tgcttgcattgctcatgttttc

SEQ ID NO: 1291073 - DNA, 22 bp, Artificial Sequence
  chemically synthesized
ctgcttgcattgctcatgtttt

SEQ ID NO: 1291074 - DNA, 22 bp, Artificial Sequence
  chemically synthesized
ttctgcttgcattgctcatgtt

SEQ ID NO: 1291075 - DNA, 22 bp, Artificial Sequence
  chemically synthesized
tcttctgcttgcattgctcatg

SEQ ID NO: 1291076 - DNA, 22 bp, Artificial Sequence
  chemically synthesized
ccataattctcttctgcttgca

SEQ ID NO: 1291077 - DNA, 22 bp, Artificial Sequence
  chemically synthesized
cccataattctcttctgcttgc

SEQ ID NO: 1291078 - DNA, 22 bp, Artificial Sequence
  chemically synthesized
tcccataattctcttctgcttg

SEQ ID NO: 1291079 - DNA, 22 bp, Artificial Sequence
  chemically synthesized
taattttcccataattctcttc

SEQ ID NO: 1291080 - DNA, 22 bp, Artificial Sequence
  chemically synthesized
aattataattttcccataattc

SEQ ID NO: 1291081 - DNA, 22 bp, Artificial Sequence
  chemically synthesized
tggacctcaattataattttcc

SEQ ID NO: 1291082 - DNA, 22 bp, Artificial Sequence
  chemically synthesized
tgtggacctcaattataatttt

SEQ ID NO: 1291083 - DNA, 22 bp, Artificial Sequence
  chemically synthesized
ctgtggacctcaattataattt

SEQ ID NO: 1291084 - DNA, 22 bp, Artificial Sequence
  chemically synthesized
tctgtggacctcaattataatt

SEQ ID NO: 1291085 - DNA, 22 bp, Artificial Sequence
  chemically synthesized
actttctgtggacctcaattat

SEQ ID NO: 1291086 - DNA, 22 bp, Artificial Sequence
  chemically synthesized
tgggaaaattataattgaggtc

SEQ ID NO: 1291087 - DNA, 22 bp, Artificial Sequence
  chemically synthesized
ctaactttctgtggacctcaat

SEQ ID NO: 1291088 - DNA, 22 bp, Artificial Sequence
  chemically synthesized
tcctaactttctgtggacctca

SEQ ID NO: 1291089 - DNA, 22 bp, Artificial Sequence
  chemically synthesized
tctcctaactttctgtggacct

SEQ ID NO: 1291090 - DNA, 22 bp, Artificial Sequence
  chemically synthesized
ctctcctaactttctgtggacc

SEQ ID NO: 1291091 - DNA, 22 bp, Artificial Sequence
  chemically synthesized
tttctctcctaactttctgtgg

SEQ ID NO: 1291092 - DNA, 22 bp, Artificial Sequence
  chemically synthesized
taattgaggtccacagaaagtt

SEQ ID NO: 1291093 - DNA, 22 bp, Artificial Sequence
  chemically synthesized
aggtccacagaaagttaggaga

SEQ ID NO: 1291094 - DNA, 22 bp, Artificial Sequence
  chemically synthesized
taaaatacaattatttctctcc

SEQ ID NO: 1291095 - DNA, 22 bp, Artificial Sequence
  chemically synthesized
ataaaatacaattatttctctc

SEQ ID NO: 1291096 - DNA, 22 bp, Artificial Sequence
  chemically synthesized
tataaaatacaattatttctct

SEQ ID NO: 1291097 - DNA, 22 bp, Artificial Sequence
  chemically synthesized
ttttataaaatacaattatttc

SEQ ID NO: 1291098 - DNA, 22 bp, Artificial Sequence
  chemically synthesized
gttttataaaatacaattattt

SEQ ID NO: 1291099 - DNA, 22 bp, Artificial Sequence
  chemically synthesized
ggagagaaataattgtatttta

SEQ ID NO: 1291100 - DNA, 22 bp, Artificial Sequence
  chemically synthesized
tcatgaccttgttttataaaat

SEQ ID NO: 1291101 - DNA, 22 bp, Artificial Sequence
  chemically synthesized
tattgtcatgaccttgttttat

SEQ ID NO: 1291102 - DNA, 22 bp, Artificial Sequence
  chemically synthesized
atattgtcatgaccttgtttta

SEQ ID NO: 1291103 - DNA, 22 bp, Artificial Sequence
  chemically synthesized
tatattgtcatgaccttgtttt

SEQ ID NO: 1291104 - DNA, 22 bp, Artificial Sequence
  chemically synthesized
ttatattgtcatgaccttgttt

SEQ ID NO: 1291105 - DNA, 22 bp, Artificial Sequence
  chemically synthesized
tttatattgtcatgaccttgtt

SEQ ID NO: 1291106 - DNA, 22 bp, Artificial Sequence
  chemically synthesized
ttttatattgtcatgaccttgt

SEQ ID NO: 1291107 - DNA, 22 bp, Artificial Sequence
  chemically synthesized
tattttataaaacaaggtcatg

SEQ ID NO: 1291108 - DNA, 22 bp, Artificial Sequence
  chemically synthesized
atttttttatattgtcatgacc

SEQ ID NO: 1291109 - DNA, 22 bp, Artificial Sequence
  chemically synthesized
tataaaacaaggtcatgacaat

SEQ ID NO: 1291110 - DNA, 22 bp, Artificial Sequence
  chemically synthesized
ataaaacaaggtcatgacaata

SEQ ID NO: 1291111 - DNA, 22 bp, Artificial Sequence
  chemically synthesized
ttcatttttttatattgtcatg

SEQ ID NO: 1291112 - DNA, 22 bp, Artificial Sequence
  chemically synthesized
taaaacaaggtcatgacaatat

SEQ ID NO: 1291113 - DNA, 22 bp, Artificial Sequence
  chemically synthesized
gttcatttttttatattgtcat

SEQ ID NO: 1291114 - DNA, 22 bp, Artificial Sequence
  chemically synthesized
tgttcatttttttatattgtca

SEQ ID NO: 1291115 - DNA, 22 bp, Artificial Sequence
  chemically synthesized
ttgttcatttttttatattgtc

SEQ ID NO: 1291116 - DNA, 22 bp, Artificial Sequence
  chemically synthesized
taggtgtttttgttcatttttt

SEQ ID NO: 1291117 - DNA, 22 bp, Artificial Sequence
  chemically synthesized
aataggatgtcaattataggtg

SEQ ID NO: 1291118 - DNA, 22 bp, Artificial Sequence
  chemically synthesized
accactaaataggatgtcaatt

SEQ ID NO: 1291119 - DNA, 22 bp, Artificial Sequence
  chemically synthesized
tcaccactaaataggatgtcaa

SEQ ID NO: 1291120 - DNA, 22 bp, Artificial Sequence
  chemically synthesized
ctcaccactaaataggatgtca

SEQ ID NO: 1291121 - DNA, 22 bp, Artificial Sequence
  chemically synthesized
tctcaccactaaataggatgtc

SEQ ID NO: 1291122 - DNA, 22 bp, Artificial Sequence
  chemically synthesized
attttctcaccactaaatagga

SEQ ID NO: 1291123 - DNA, 22 bp, Artificial Sequence
  chemically synthesized
cattttctcaccactaaatagg

SEQ ID NO: 1291124 - DNA, 22 bp, Artificial Sequence
  chemically synthesized
tcattttctcaccactaaatag

SEQ ID NO: 1291125 - DNA, 22 bp, Artificial Sequence
  chemically synthesized
taattgacatcctatttagtgg

SEQ ID NO: 1291126 - DNA, 22 bp, Artificial Sequence
  chemically synthesized
acatcctatttagtggtgagaa

SEQ ID NO: 1291127 - DNA, 22 bp, Artificial Sequence
  chemically synthesized
agaaagttttcattttctcacc

SEQ ID NO: 1291128 - DNA, 22 bp, Artificial Sequence
  chemically synthesized
ctgagaaagttttcattttctc

SEQ ID NO: 1291129 - DNA, 22 bp, Artificial Sequence
  chemically synthesized
cctgagaaagttttcattttct

SEQ ID NO: 1291130 - DNA, 22 bp, Artificial Sequence
  chemically synthesized
tttagtggtgagaaaatgaaaa

SEQ ID NO: 1291131 - DNA, 22 bp, Artificial Sequence
  chemically synthesized
agtggtgagaaaatgaaaactt

SEQ ID NO: 1291132 - DNA, 22 bp, Artificial Sequence
  chemically synthesized
atcttcctgagaaagttttcat

SEQ ID NO: 1291133 - DNA, 22 bp, Artificial Sequence
  chemically synthesized
gtggtgagaaaatgaaaacttt

SEQ ID NO: 1291134 - DNA, 22 bp, Artificial Sequence
  chemically synthesized
ctgatcttcctgagaaagtttt

SEQ ID NO: 1291135 - DNA, 22 bp, Artificial Sequence
  chemically synthesized
ttcctgatcttcctgagaaagt

SEQ ID NO: 1291136 - DNA, 22 bp, Artificial Sequence
  chemically synthesized
gttcctgatcttcctgagaaag

SEQ ID NO: 1291137 - DNA, 22 bp, Artificial Sequence
  chemically synthesized
tcttgttcctgatcttcctgag

SEQ ID NO: 1291138 - DNA, 22 bp, Artificial Sequence
  chemically synthesized
gtcttgttcctgatcttcctga

SEQ ID NO: 1291139 - DNA, 22 bp, Artificial Sequence
  chemically synthesized
tgtcttgttcctgatcttcctg

SEQ ID NO: 1291140 - DNA, 22 bp, Artificial Sequence
  chemically synthesized
ttgtcttgttcctgatcttcct

SEQ ID NO: 1291141 - DNA, 22 bp, Artificial Sequence
  chemically synthesized
tctcaggaagatcaggaacaag

SEQ ID NO: 1291142 - DNA, 22 bp, Artificial Sequence
  chemically synthesized
ctcaggaagatcaggaacaaga

SEQ ID NO: 1291143 - DNA, 22 bp, Artificial Sequence
  chemically synthesized
tcaggaagatcaggaacaagac

SEQ ID NO: 1291144 - DNA, 22 bp, Artificial Sequence
  chemically synthesized
aggaagatcaggaacaagacaa

SEQ ID NO: 1291145 - DNA, 22 bp, Artificial Sequence
  chemically synthesized
aaaaagagtggtaagagagaca

SEQ ID NO: 1291146 - DNA, 22 bp, Artificial Sequence
  chemically synthesized
caatatgatgttgaaaaagagt

SEQ ID NO: 1291147 - DNA, 22 bp, Artificial Sequence
  chemically synthesized
ccaatatgatgttgaaaaagag

SEQ ID NO: 1291148 - DNA, 22 bp, Artificial Sequence
  chemically synthesized
tcttaccactctttttcaacat

SEQ ID NO: 1291149 - DNA, 22 bp, Artificial Sequence
  chemically synthesized
ttaccactctttttcaacatca

SEQ ID NO: 1291150 - DNA, 22 bp, Artificial Sequence
  chemically synthesized
ggacttccaatatgatgttgaa

SEQ ID NO: 1291151 - DNA, 22 bp, Artificial Sequence
  chemically synthesized
accactctttttcaacatcata

SEQ ID NO: 1291152 - DNA, 22 bp, Artificial Sequence
  chemically synthesized
ccactctttttcaacatcatat

SEQ ID NO: 1291153 - DNA, 22 bp, Artificial Sequence
  chemically synthesized
gctaggacttccaatatgatgt

SEQ ID NO: 1291154 - DNA, 22 bp, Artificial Sequence
  chemically synthesized
tttttcaacatcatattggaag

SEQ ID NO: 1291155 - DNA, 22 bp, Artificial Sequence
  chemically synthesized
cattagctaggacttccaatat

SEQ ID NO: 1291156 - DNA, 22 bp, Artificial Sequence
  chemically synthesized
tttcaacatcatattggaagtc

SEQ ID NO: 1291157 - DNA, 22 bp, Artificial Sequence
  chemically synthesized
ttcaacatcatattggaagtcc

SEQ ID NO: 1291158 - DNA, 22 bp, Artificial Sequence
  chemically synthesized
ttgcattagctaggacttccaa

SEQ ID NO: 1291159 - DNA, 22 bp, Artificial Sequence
  chemically synthesized
tcaacatcatattggaagtcct

SEQ ID NO: 1291160 - DNA, 22 bp, Artificial Sequence
  chemically synthesized
attgcattagctaggacttcca

SEQ ID NO: 1291161 - DNA, 22 bp, Artificial Sequence
  chemically synthesized
caacatcatattggaagtccta

SEQ ID NO: 1291162 - DNA, 22 bp, Artificial Sequence
  chemically synthesized
aacatcatattggaagtcctag

SEQ ID NO: 1291163 - DNA, 22 bp, Artificial Sequence
  chemically synthesized
tcttattgcattagctaggact

SEQ ID NO: 1291164 - DNA, 22 bp, Artificial Sequence
  chemically synthesized
gtcttattgcattagctaggac

SEQ ID NO: 1291165 - DNA, 22 bp, Artificial Sequence
  chemically synthesized
tgtcttattgcattagctagga

SEQ ID NO: 1291166 - DNA, 22 bp, Artificial Sequence
  chemically synthesized
tttgtcttattgcattagctag

SEQ ID NO: 1291167 - DNA, 22 bp, Artificial Sequence
  chemically synthesized
ctttgtcttattgcattagcta

SEQ ID NO: 1291168 - DNA, 22 bp, Artificial Sequence
  chemically synthesized
tctttgtcttattgcattagct

SEQ ID NO: 1291169 - DNA, 22 bp, Artificial Sequence
  chemically synthesized
ttttctttgtcttattgcatta

SEQ ID NO: 1291170 - DNA, 22 bp, Artificial Sequence
  chemically synthesized
gaagtcctagctaatgcaataa

SEQ ID NO: 1291171 - DNA, 22 bp, Artificial Sequence
  chemically synthesized
gctaatgcaataagacaaagaa

SEQ ID NO: 1291172 - DNA, 22 bp, Artificial Sequence
  chemically synthesized
atgcaataagacaaagaaaata

SEQ ID NO: 1291173 - DNA, 22 bp, Artificial Sequence
  chemically synthesized
caatagatatgtctattttctt

SEQ ID NO: 1291174 - DNA, 22 bp, Artificial Sequence
  chemically synthesized
cattccaatagatatgtctatt

SEQ ID NO: 1291175 - DNA, 22 bp, Artificial Sequence
  chemically synthesized
tacattccaatagatatgtcta

SEQ ID NO: 1291176 - DNA, 22 bp, Artificial Sequence
  chemically synthesized
ctacattccaatagatatgtct

SEQ ID NO: 1291177 - DNA, 22 bp, Artificial Sequence
  chemically synthesized
atttctacattccaatagatat

SEQ ID NO: 1291178 - DNA, 22 bp, Artificial Sequence
  chemically synthesized
catttctacattccaatagata

SEQ ID NO: 1291179 - DNA, 22 bp, Artificial Sequence
  chemically synthesized
tgaagaaatacagcttcatttc

SEQ ID NO: 1291180 - DNA, 22 bp, Artificial Sequence
  chemically synthesized
ttggaatgtagaaatgaagctg

SEQ ID NO: 1291181 - DNA, 22 bp, Artificial Sequence
  chemically synthesized
gaatgtagaaatgaagctgtat

SEQ ID NO: 1291182 - DNA, 22 bp, Artificial Sequence
  chemically synthesized
catagatggtcatgtcatctat

SEQ ID NO: 1291183 - DNA, 22 bp, Artificial Sequence
  chemically synthesized
tacatagatggtcatgtcatct

SEQ ID NO: 1291184 - DNA, 22 bp, Artificial Sequence
  chemically synthesized
tatttcttcatagatgacatga

SEQ ID NO: 1291185 - DNA, 22 bp, Artificial Sequence
  chemically synthesized
ctacatagatggtcatgtcatc

SEQ ID NO: 1291186 - DNA, 22 bp, Artificial Sequence
  chemically synthesized
tctacatagatggtcatgtcat

SEQ ID NO: 1291187 - DNA, 22 bp, Artificial Sequence
  chemically synthesized
cttcatagatgacatgaccatc

SEQ ID NO: 1291188 - DNA, 22 bp, Artificial Sequence
  chemically synthesized
ttcatagatgacatgaccatct

SEQ ID NO: 1291189 - DNA, 22 bp, Artificial Sequence
  chemically synthesized
agattttctacatagatggtca

SEQ ID NO: 1291190 - DNA, 22 bp, Artificial Sequence
  chemically synthesized
catagatgacatgaccatctat

SEQ ID NO: 1291191 - DNA, 22 bp, Artificial Sequence
  chemically synthesized
cagattttctacatagatggtc

SEQ ID NO: 1291192 - DNA, 22 bp, Artificial Sequence
  chemically synthesized
atagatgacatgaccatctatg

SEQ ID NO: 1291193 - DNA, 22 bp, Artificial Sequence
  chemically synthesized
tcagattttctacatagatggt

SEQ ID NO: 1291194 - DNA, 22 bp, Artificial Sequence
  chemically synthesized
tttcagattttctacatagatg

SEQ ID NO: 1291195 - DNA, 22 bp, Artificial Sequence
  chemically synthesized
gattctttcagattttctacat

SEQ ID NO: 1291196 - DNA, 22 bp, Artificial Sequence
  chemically synthesized
cgattctttcagattttctaca

SEQ ID NO: 1291197 - DNA, 22 bp, Artificial Sequence
  chemically synthesized
tcgattctttcagattttctac

SEQ ID NO: 1291198 - DNA, 22 bp, Artificial Sequence
  chemically synthesized
ttcgattctttcagattttcta

SEQ ID NO: 1291199 - DNA, 22 bp, Artificial Sequence
  chemically synthesized
tttttcgattctttcagatttt

SEQ ID NO: 1291200 - DNA, 22 bp, Artificial Sequence
  chemically synthesized
tgtagaaaatctgaaagaatcg

SEQ ID NO: 1291201 - DNA, 22 bp, Artificial Sequence
  chemically synthesized
cagggttatttttcgattcttt

SEQ ID NO: 1291202 - DNA, 22 bp, Artificial Sequence
  chemically synthesized
ccagggttatttttcgattctt

SEQ ID NO: 1291203 - DNA, 22 bp, Artificial Sequence
  chemically synthesized
tttccagggttatttttcgatt

SEQ ID NO: 1291204 - DNA, 22 bp, Artificial Sequence
  chemically synthesized
ttatttccagggttatttttcg

SEQ ID NO: 1291205 - DNA, 22 bp, Artificial Sequence
  chemically synthesized
attatttccagggttatttttc

SEQ ID NO: 1291206 - DNA, 22 bp, Artificial Sequence
  chemically synthesized
cttattatttccagggttattt

SEQ ID NO: 1291207 - DNA, 22 bp, Artificial Sequence
  chemically synthesized
aaagaatcgaaaaataaccctg

SEQ ID NO: 1291208 - DNA, 22 bp, Artificial Sequence
  chemically synthesized
caattgcttattatttccaggg

SEQ ID NO: 1291209 - DNA, 22 bp, Artificial Sequence
  chemically synthesized
ctacaattgcttattatttcca

SEQ ID NO: 1291210 - DNA, 22 bp, Artificial Sequence
  chemically synthesized
gctacaattgcttattatttcc

SEQ ID NO: 1291211 - DNA, 22 bp, Artificial Sequence
  chemically synthesized
tgctacaattgcttattatttc

SEQ ID NO: 1291212 - DNA, 22 bp, Artificial Sequence
  chemically synthesized
caactttgctacaattgcttat

SEQ ID NO: 1291213 - DNA, 22 bp, Artificial Sequence
  chemically synthesized
gaaataataagcaattgtagca

SEQ ID NO: 1291214 - DNA, 22 bp, Artificial Sequence
  chemically synthesized
tgtcctgcaactttgctacaat

SEQ ID NO: 1291215 - DNA, 22 bp, Artificial Sequence
  chemically synthesized
gtgtcctgcaactttgctacaa

SEQ ID NO: 1291216 - DNA, 22 bp, Artificial Sequence
  chemically synthesized
atcttgtgtcctgcaactttgc

SEQ ID NO: 1291217 - DNA, 22 bp, Artificial Sequence
  chemically synthesized
tatattaatcttgtgtcctgca

SEQ ID NO: 1291218 - DNA, 22 bp, Artificial Sequence
  chemically synthesized
atatattaatcttgtgtcctgc

SEQ ID NO: 1291219 - DNA, 22 bp, Artificial Sequence
  chemically synthesized
tatatattaatcttgtgtcctg

SEQ ID NO: 1291220 - DNA, 22 bp, Artificial Sequence
  chemically synthesized
tagcaaagttgcaggacacaag

SEQ ID NO: 1291221 - DNA, 22 bp, Artificial Sequence
  chemically synthesized
aattttatatattaatcttgtg

SEQ ID NO: 1291222 - DNA, 22 bp, Artificial Sequence
  chemically synthesized
caggacacaagattaatatata

SEQ ID NO: 1291223 - DNA, 22 bp, Artificial Sequence
  chemically synthesized
gtgtgtaagaaacaattgaatt

SEQ ID NO: 1291224 - DNA, 22 bp, Artificial Sequence
  chemically synthesized
ctggtgtgtaagaaacaattga

SEQ ID NO: 1291225 - DNA, 22 bp, Artificial Sequence
  chemically synthesized
atatataaaattcaattgtttc

SEQ ID NO: 1291226 - DNA, 22 bp, Artificial Sequence
  chemically synthesized
actgctggtgtgtaagaaacaa

SEQ ID NO: 1291227 - DNA, 22 bp, Artificial Sequence
  chemically synthesized
ttcactgctggtgtgtaagaaa

SEQ ID NO: 1291228 - DNA, 22 bp, Artificial Sequence
  chemically synthesized
gttcactgctggtgtgtaagaa

SEQ ID NO: 1291229 - DNA, 22 bp, Artificial Sequence
  chemically synthesized
cacttgttcactgctggtgtgt

SEQ ID NO: 1291230 - DNA, 22 bp, Artificial Sequence
  chemically synthesized
aattgtttcttacacaccagca

SEQ ID NO: 1291231 - DNA, 22 bp, Artificial Sequence
  chemically synthesized
tttcttacacaccagcagtgaa

SEQ ID NO: 1291232 - DNA, 22 bp, Artificial Sequence
  chemically synthesized
aaattccacttgttcactgctg

SEQ ID NO: 1291233 - DNA, 22 bp, Artificial Sequence
  chemically synthesized
caaattccacttgttcactgct

SEQ ID NO: 1291234 - DNA, 22 bp, Artificial Sequence
  chemically synthesized
cttacacaccagcagtgaacaa

SEQ ID NO: 1291235 - DNA, 22 bp, Artificial Sequence
  chemically synthesized
ttacacaccagcagtgaacaag

SEQ ID NO: 1291236 - DNA, 22 bp, Artificial Sequence
  chemically synthesized
acacaccagcagtgaacaagtg

SEQ ID NO: 1291237 - DNA, 22 bp, Artificial Sequence
  chemically synthesized
catttcaaattccacttgttca

SEQ ID NO: 1291238 - DNA, 22 bp, Artificial Sequence
  chemically synthesized
cacaccagcagtgaacaagtgg

SEQ ID NO: 1291239 - DNA, 22 bp, Artificial Sequence
  chemically synthesized
acatttcaaattccacttgttc

SEQ ID NO: 1291240 - DNA, 22 bp, Artificial Sequence
  chemically synthesized
tacatttcaaattccacttgtt

SEQ ID NO: 1291241 - DNA, 22 bp, Artificial Sequence
  chemically synthesized
tgttttacatttcaaattccac

SEQ ID NO: 1291242 - DNA, 22 bp, Artificial Sequence
  chemically synthesized
gtgttttacatttcaaattcca

SEQ ID NO: 1291243 - DNA, 22 bp, Artificial Sequence
  chemically synthesized
tgtgttttacatttcaaattcc

SEQ ID NO: 1291244 - DNA, 22 bp, Artificial Sequence
  chemically synthesized
gtggaaatggctttgtgtttta

SEQ ID NO: 1291245 - DNA, 22 bp, Artificial Sequence
  chemically synthesized
gaaatgtaaaacacaaagccat

SEQ ID NO: 1291246 - DNA, 22 bp, Artificial Sequence
  chemically synthesized
aaatgtaaaacacaaagccatt

SEQ ID NO: 1291247 - DNA, 22 bp, Artificial Sequence
  chemically synthesized
aaaatgttagtggaaatggctt

SEQ ID NO: 1291248 - DNA, 22 bp, Artificial Sequence
  chemically synthesized
gaaaatgttagtggaaatggct

SEQ ID NO: 1291249 - DNA, 22 bp, Artificial Sequence
  chemically synthesized
tgaaaatgttagtggaaatggc

SEQ ID NO: 1291250 - DNA, 22 bp, Artificial Sequence
  chemically synthesized
ttgaaaatgttagtggaaatgg

SEQ ID NO: 1291251 - DNA, 22 bp, Artificial Sequence
  chemically synthesized
tttttgaaaatgttagtggaaa

SEQ ID NO: 1291252 - DNA, 22 bp, Artificial Sequence
  chemically synthesized
atttttgaaaatgttagtggaa

SEQ ID NO: 1291253 - DNA, 22 bp, Artificial Sequence
  chemically synthesized
tatttttgaaaatgttagtgga

SEQ ID NO: 1291254 - DNA, 22 bp, Artificial Sequence
  chemically synthesized
agtattttatttttgaaaatgt

SEQ ID NO: 1291255 - DNA, 22 bp, Artificial Sequence
  chemically synthesized
ctcagtattttatttttgaaaa

SEQ ID NO: 1291256 - DNA, 22 bp, Artificial Sequence
  chemically synthesized
ccactaacattttcaaaaataa

SEQ ID NO: 1291257 - DNA, 22 bp, Artificial Sequence
  chemically synthesized
ttcctcagtattttatttttga

SEQ ID NO: 1291258 - DNA, 22 bp, Artificial Sequence
  chemically synthesized
cactaacattttcaaaaataaa

SEQ ID NO: 1291259 - DNA, 22 bp, Artificial Sequence
  chemically synthesized
attcctcagtattttatttttg

SEQ ID NO: 1291260 - DNA, 22 bp, Artificial Sequence
  chemically synthesized
acattttcaaaaataaaatact

SEQ ID NO: 1291261 - DNA, 22 bp, Artificial Sequence
  chemically synthesized
gatttattcctcagtattttat

SEQ ID NO: 1291262 - DNA, 22 bp, Artificial Sequence
  chemically synthesized
agatttattcctcagtatttta

SEQ ID NO: 1291263 - DNA, 22 bp, Artificial Sequence
  chemically synthesized
tagatttattcctcagtatttt

SEQ ID NO: 1291264 - DNA, 22 bp, Artificial Sequence
  chemically synthesized
ttagatttattcctcagtattt

SEQ ID NO: 1291265 - DNA, 22 bp, Artificial Sequence
  chemically synthesized
tttagatttattcctcagtatt

SEQ ID NO: 1291266 - DNA, 22 bp, Artificial Sequence
  chemically synthesized
tcaaaaataaaatactgaggaa

SEQ ID NO: 1291267 - DNA, 22 bp, Artificial Sequence
  chemically synthesized
caaaaataaaatactgaggaat

SEQ ID NO: 1291268 - DNA, 22 bp, Artificial Sequence
  chemically synthesized
aaaaataaaatactgaggaata

SEQ ID NO: 1291269 - DNA, 22 bp, Artificial Sequence
  chemically synthesized
tatattttttagatttattcct

SEQ ID NO: 1291270 - DNA, 22 bp, Artificial Sequence
  chemically synthesized
gtatattttttagatttattcc

SEQ ID NO: 1291271 - DNA, 22 bp, Artificial Sequence
  chemically synthesized
taaagatcttgtatatttttta

SEQ ID NO: 1291272 - DNA, 22 bp, Artificial Sequence
  chemically synthesized
aggaataaatctaaaaaatata

SEQ ID NO: 1291273 - DNA, 22 bp, Artificial Sequence
  chemically synthesized
gtaaagatcttgtatatttttt

SEQ ID NO: 1291274 - DNA, 22 bp, Artificial Sequence
  chemically synthesized
ttgtaaagatcttgtatatttt

SEQ ID NO: 1291275 - DNA, 22 bp, Artificial Sequence
  chemically synthesized
cttgtaaagatcttgtatattt

SEQ ID NO: 1291276 - DNA, 22 bp, Artificial Sequence
  chemically synthesized
tcttgtaaagatcttgtatatt

SEQ ID NO: 1291277 - DNA, 22 bp, Artificial Sequence
  chemically synthesized
tagttttcttgtaaagatcttg

SEQ ID NO: 1291278 - DNA, 22 bp, Artificial Sequence
  chemically synthesized
gtagttttcttgtaaagatctt

SEQ ID NO: 1291279 - DNA, 22 bp, Artificial Sequence
  chemically synthesized
tgtagttttcttgtaaagatct

SEQ ID NO: 1291280 - DNA, 22 bp, Artificial Sequence
  chemically synthesized
aaaaatatacaagatctttaca

SEQ ID NO: 1291281 - DNA, 22 bp, Artificial Sequence
  chemically synthesized
atcagagttttgtagttttctt

SEQ ID NO: 1291282 - DNA, 22 bp, Artificial Sequence
  chemically synthesized
catcagagttttgtagttttct

SEQ ID NO: 1291283 - DNA, 22 bp, Artificial Sequence
  chemically synthesized
tcatcagagttttgtagttttc

SEQ ID NO: 1291284 - DNA, 22 bp, Artificial Sequence
  chemically synthesized
tacaagaaaactacaaaactct

SEQ ID NO: 1291285 - DNA, 22 bp, Artificial Sequence
  chemically synthesized
ataactttcatcagagttttgt

SEQ ID NO: 1291286 - DNA, 22 bp, Artificial Sequence
  chemically synthesized
acaagaaaactacaaaactctg

SEQ ID NO: 1291287 - DNA, 22 bp, Artificial Sequence
  chemically synthesized
caagaaaactacaaaactctga

SEQ ID NO: 1291288 - DNA, 22 bp, Artificial Sequence
  chemically synthesized
tgataactttcatcagagtttt

SEQ ID NO: 1291289 - DNA, 22 bp, Artificial Sequence
  chemically synthesized
ctctgataactttcatcagagt

SEQ ID NO: 1291290 - DNA, 22 bp, Artificial Sequence
  chemically synthesized
gttcctctgataactttcatca

SEQ ID NO: 1291291 - DNA, 22 bp, Artificial Sequence
  chemically synthesized
agttcctctgataactttcatc

SEQ ID NO: 1291292 - DNA, 22 bp, Artificial Sequence
  chemically synthesized
caaaactctgatgaaagttatc

SEQ ID NO: 1291293 - DNA, 22 bp, Artificial Sequence
  chemically synthesized
atttagttcctctgataacttt

SEQ ID NO: 1291294 - DNA, 22 bp, Artificial Sequence
  chemically synthesized
tgatgaaagttatcagaggaac

SEQ ID NO: 1291295 - DNA, 22 bp, Artificial Sequence
  chemically synthesized
accattcatttagttcctctga

SEQ ID NO: 1291296 - DNA, 22 bp, Artificial Sequence
  chemically synthesized
caccattcatttagttcctctg

SEQ ID NO: 1291297 - DNA, 22 bp, Artificial Sequence
  chemically synthesized
atgaaagttatcagaggaacta

SEQ ID NO: 1291298 - DNA, 22 bp, Artificial Sequence
  chemically synthesized
aatatttcaccattcatttagt

SEQ ID NO: 1291299 - DNA, 22 bp, Artificial Sequence
  chemically synthesized
tcagaggaactaaatgaatggt

SEQ ID NO: 1291300 - DNA, 22 bp, Artificial Sequence
  chemically synthesized
tccatgaacactgaatatttca

SEQ ID NO: 1291301 - DNA, 22 bp, Artificial Sequence
  chemically synthesized
tatccatgaacactgaatattt

SEQ ID NO: 1291302 - DNA, 22 bp, Artificial Sequence
  chemically synthesized
aatgaatggtgaaatattcagt

SEQ ID NO: 1291303 - DNA, 22 bp, Artificial Sequence
  chemically synthesized
ctatccatgaacactgaatatt

SEQ ID NO: 1291304 - DNA, 22 bp, Artificial Sequence
  chemically synthesized
tctatccatgaacactgaatat

SEQ ID NO: 1291305 - DNA, 22 bp, Artificial Sequence
  chemically synthesized
agtctttctatccatgaacact

SEQ ID NO: 1291306 - DNA, 22 bp, Artificial Sequence
  chemically synthesized
caatattgagtctttctatcca

SEQ ID NO: 1291307 - DNA, 22 bp, Artificial Sequence
  chemically synthesized
acaatattgagtctttctatcc

SEQ ID NO: 1291308 - DNA, 22 bp, Artificial Sequence
  chemically synthesized
tacaatattgagtctttctatc

SEQ ID NO: 1291309 - DNA, 22 bp, Artificial Sequence
  chemically synthesized
agtgttcatggatagaaagact

SEQ ID NO: 1291310 - DNA, 22 bp, Artificial Sequence
  chemically synthesized
tttacaatattgagtctttcta

SEQ ID NO: 1291311 - DNA, 22 bp, Artificial Sequence
  chemically synthesized
ctttacaatattgagtctttct

SEQ ID NO: 1291312 - DNA, 22 bp, Artificial Sequence
  chemically synthesized
acttctttacaatattgagtct

SEQ ID NO: 1291313 - DNA, 22 bp, Artificial Sequence
  chemically synthesized
atggatagaaagactcaatatt

SEQ ID NO: 1291314 - DNA, 22 bp, Artificial Sequence
  chemically synthesized
aggagaactgacttctttacaa

SEQ ID NO: 1291315 - DNA, 22 bp, Artificial Sequence
  chemically synthesized
gaggagaactgacttctttaca

SEQ ID NO: 1291316 - DNA, 22 bp, Artificial Sequence
  chemically synthesized
aatattgtaaagaagtcagttc

SEQ ID NO: 1291317 - DNA, 22 bp, Artificial Sequence
  chemically synthesized
tagatcaacttgaggagaactg

SEQ ID NO: 1291318 - DNA, 22 bp, Artificial Sequence
  chemically synthesized
taaagaagtcagttctcctcaa

SEQ ID NO: 1291319 - DNA, 22 bp, Artificial Sequence
  chemically synthesized
aatctgtagatcaacttgagga

SEQ ID NO: 1291320 - DNA, 22 bp, Artificial Sequence
  chemically synthesized
cgttaaatctgtagatcaactt

SEQ ID NO: 1291321 - DNA, 22 bp, Artificial Sequence
  chemically synthesized
ggattgcgttaaatctgtagat

SEQ ID NO: 1291322 - DNA, 22 bp, Artificial Sequence
  chemically synthesized
tcctcaagttgatctacagatt

SEQ ID NO: 1291323 - DNA, 22 bp, Artificial Sequence
  chemically synthesized
ctcaagttgatctacagattta

SEQ ID NO: 1291324 - DNA, 22 bp, Artificial Sequence
  chemically synthesized
attgggattgcgttaaatctgt

SEQ ID NO: 1291325 - DNA, 22 bp, Artificial Sequence
  chemically synthesized
gattgggattgcgttaaatctg

SEQ ID NO: 1291326 - DNA, 22 bp, Artificial Sequence
  chemically synthesized
aagttgatctacagatttaacg

SEQ ID NO: 1291327 - DNA, 22 bp, Artificial Sequence
  chemically synthesized
tgattgggattgcgttaaatct

SEQ ID NO: 1291328 - DNA, 22 bp, Artificial Sequence
  chemically synthesized
atctacagatttaacgcaatcc

SEQ ID NO: 1291329 - DNA, 22 bp, Artificial Sequence
  chemically synthesized
tgattttgattgggattgcgtt

SEQ ID NO: 1291330 - DNA, 22 bp, Artificial Sequence
  chemically synthesized
ctgtgattttgattgggattgc

SEQ ID NO: 1291331 - DNA, 22 bp, Artificial Sequence
  chemically synthesized
gctgtgattttgattgggattg

SEQ ID NO: 1291332 - DNA, 22 bp, Artificial Sequence
  chemically synthesized
cagatttaacgcaatcccaatc

SEQ ID NO: 1291333 - DNA, 22 bp, Artificial Sequence
  chemically synthesized
aacgcaatcccaatcaaaatca

SEQ ID NO: 1291334 - DNA, 22 bp, Artificial Sequence
  chemically synthesized
acgcaatcccaatcaaaatcac

SEQ ID NO: 1291335 - DNA, 22 bp, Artificial Sequence
  chemically synthesized
tataaggcaaggtaacttgctg

SEQ ID NO: 1291336 - DNA, 22 bp, Artificial Sequence
  chemically synthesized
tctatataaggcaaggtaactt

SEQ ID NO: 1291337 - DNA, 22 bp, Artificial Sequence
  chemically synthesized
gtctatataaggcaaggtaact

SEQ ID NO: 1291338 - DNA, 22 bp, Artificial Sequence
  chemically synthesized
gaaacggtttgtctatataagg

SEQ ID NO: 1291339 - DNA, 22 bp, Artificial Sequence
  chemically synthesized
agaaacggtttgtctatataag

SEQ ID NO: 1291340 - DNA, 22 bp, Artificial Sequence
  chemically synthesized
tagaaacggtttgtctatataa

SEQ ID NO: 1291341 - DNA, 22 bp, Artificial Sequence
  chemically synthesized
ccttgccttatatagacaaacc

SEQ ID NO: 1291342 - DNA, 22 bp, Artificial Sequence
  chemically synthesized
gccttatatagacaaaccgttt

SEQ ID NO: 1291343 - DNA, 22 bp, Artificial Sequence
  chemically synthesized
ccttatatagacaaaccgtttc

SEQ ID NO: 1291344 - DNA, 22 bp, Artificial Sequence
  chemically synthesized
atataaactttagaaacggttt

SEQ ID NO: 1291345 - DNA, 22 bp, Artificial Sequence
  chemically synthesized
catataaactttagaaacggtt

SEQ ID NO: 1291346 - DNA, 22 bp, Artificial Sequence
  chemically synthesized
tcatataaactttagaaacggt

SEQ ID NO: 1291347 - DNA, 22 bp, Artificial Sequence
  chemically synthesized
atatagacaaaccgtttctaaa

SEQ ID NO: 1291348 - DNA, 22 bp, Artificial Sequence
  chemically synthesized
tatagacaaaccgtttctaaag

SEQ ID NO: 1291349 - DNA, 22 bp, Artificial Sequence
  chemically synthesized
cctttcatataaactttagaaa

SEQ ID NO: 1291350 - DNA, 22 bp, Artificial Sequence
  chemically synthesized
gcctttcatataaactttagaa

SEQ ID NO: 1291351 - DNA, 22 bp, Artificial Sequence
  chemically synthesized
tgcctttcatataaactttaga

SEQ ID NO: 1291352 - DNA, 22 bp, Artificial Sequence
  chemically synthesized
ttgcctttcatataaactttag

SEQ ID NO: 1291353 - DNA, 22 bp, Artificial Sequence
  chemically synthesized
ggtcttttgcctttcatataaa

SEQ ID NO: 1291354 - DNA, 22 bp, Artificial Sequence
  chemically synthesized
tgggtcttttgcctttcatata

SEQ ID NO: 1291355 - DNA, 22 bp, Artificial Sequence
  chemically synthesized
ttctgggtcttttgcctttcat

SEQ ID NO: 1291356 - DNA, 22 bp, Artificial Sequence
  chemically synthesized
ctaaagtttatatgaaaggcaa

SEQ ID NO: 1291357 - DNA, 22 bp, Artificial Sequence
  chemically synthesized
taaagtttatatgaaaggcaaa

SEQ ID NO: 1291358 - DNA, 22 bp, Artificial Sequence
  chemically synthesized
aagtttatatgaaaggcaaaag

SEQ ID NO: 1291359 - DNA, 22 bp, Artificial Sequence
  chemically synthesized
tgtgggttattctgggtctttt

SEQ ID NO: 1291360 - DNA, 22 bp, Artificial Sequence
  chemically synthesized
atatgaaaggcaaaagacccag

SEQ ID NO: 1291361 - DNA, 22 bp, Artificial Sequence
  chemically synthesized
tatgaaaggcaaaagacccaga

SEQ ID NO: 1291362 - DNA, 22 bp, Artificial Sequence
  chemically synthesized
aatattgtgtgggttattctgg

SEQ ID NO: 1291363 - DNA, 22 bp, Artificial Sequence
  chemically synthesized
caatattgtgtgggttattctg

SEQ ID NO: 1291364 - DNA, 22 bp, Artificial Sequence
  chemically synthesized
cttcaatattgtgtgggttatt

SEQ ID NO: 1291365 - DNA, 22 bp, Artificial Sequence
  chemically synthesized
tccttcaatattgtgtgggtta

SEQ ID NO: 1291366 - DNA, 22 bp, Artificial Sequence
  chemically synthesized
ctccttcaatattgtgtgggtt

SEQ ID NO: 1291367 - DNA, 22 bp, Artificial Sequence
  chemically synthesized
ttctccttcaatattgtgtggg

SEQ ID NO: 1291368 - DNA, 22 bp, Artificial Sequence
  chemically synthesized
ttcttctccttcaatattgtgt

SEQ ID NO: 1291369 - DNA, 22 bp, Artificial Sequence
  chemically synthesized
gttcttctccttcaatattgtg

SEQ ID NO: 1291370 - DNA, 22 bp, Artificial Sequence
  chemically synthesized
tgttcttctccttcaatattgt

SEQ ID NO: 1291371 - DNA, 22 bp, Artificial Sequence
  chemically synthesized
caactttgttcttctccttcaa

SEQ ID NO: 1291372 - DNA, 22 bp, Artificial Sequence
  chemically synthesized
ccaactttgttcttctccttca

SEQ ID NO: 1291373 - DNA, 22 bp, Artificial Sequence
  chemically synthesized
tccaactttgttcttctccttc

SEQ ID NO: 1291374 - DNA, 22 bp, Artificial Sequence
  chemically synthesized
aaggagaagaacaaagttggaa

SEQ ID NO: 1291375 - DNA, 22 bp, Artificial Sequence
  chemically synthesized
tagtcagatagtgtcagttttc

SEQ ID NO: 1291376 - DNA, 22 bp, Artificial Sequence
  chemically synthesized
gtagtcagatagtgtcagtttt

SEQ ID NO: 1291377 - DNA, 22 bp, Artificial Sequence
  chemically synthesized
gaaaactgacactatctgacta

SEQ ID NO: 1291378 - DNA, 22 bp, Artificial Sequence
  chemically synthesized
atagtaagtcttgtagtcagat

SEQ ID NO: 1291379 - DNA, 22 bp, Artificial Sequence
  chemically synthesized
catagtaagtcttgtagtcaga

SEQ ID NO: 1291380 - DNA, 22 bp, Artificial Sequence
  chemically synthesized
acactatctgactacaagactt

SEQ ID NO: 1291381 - DNA, 22 bp, Artificial Sequence
  chemically synthesized
tcatttcatagtaagtcttgta

SEQ ID NO: 1291382 - DNA, 22 bp, Artificial Sequence
  chemically synthesized
ctgtcatttcatagtaagtctt

SEQ ID NO: 1291383 - DNA, 22 bp, Artificial Sequence
  chemically synthesized
tctgactacaagacttactatg

SEQ ID NO: 1291384 - DNA, 22 bp, Artificial Sequence
  chemically synthesized
attactgtcatttcatagtaag

SEQ ID NO: 1291385 - DNA, 22 bp, Artificial Sequence
  chemically synthesized
gattactgtcatttcatagtaa

SEQ ID NO: 1291386 - DNA, 22 bp, Artificial Sequence
  chemically synthesized
actacaagacttactatgaaat

SEQ ID NO: 1291387 - DNA, 22 bp, Artificial Sequence
  chemically synthesized
tcttgattactgtcatttcata

SEQ ID NO: 1291388 - DNA, 22 bp, Artificial Sequence
  chemically synthesized
caagacttactatgaaatgaca

SEQ ID NO: 1291389 - DNA, 22 bp, Artificial Sequence
  chemically synthesized
actatgaaatgacagtaatcaa

SEQ ID NO: 1291390 - DNA, 22 bp, Artificial Sequence
  chemically synthesized
ctatgaaatgacagtaatcaag

SEQ ID NO: 1291391 - DNA, 22 bp, Artificial Sequence
  chemically synthesized
ccaatacactgtcttgattact

SEQ ID NO: 1291392 - DNA, 22 bp, Artificial Sequence
  chemically synthesized
gccaatacactgtcttgattac

SEQ ID NO: 1291393 - DNA, 22 bp, Artificial Sequence
  chemically synthesized
tgccaatacactgtcttgatta

SEQ ID NO: 1291394 - DNA, 22 bp, Artificial Sequence
  chemically synthesized
tgaaatgacagtaatcaagaca

SEQ ID NO: 1291395 - DNA, 22 bp, Artificial Sequence
  chemically synthesized
ttttgccaatacactgtcttga

SEQ ID NO: 1291396 - DNA, 22 bp, Artificial Sequence
  chemically synthesized
ttattttgccaatacactgtct

SEQ ID NO: 1291397 - DNA, 22 bp, Artificial Sequence
  chemically synthesized
tctattattttgccaatacact

SEQ ID NO: 1291398 - DNA, 22 bp, Artificial Sequence
  chemically synthesized
gtctattattttgccaatacac

SEQ ID NO: 1291399 - DNA, 22 bp, Artificial Sequence
  chemically synthesized
atgtatttgtctattattttgc

SEQ ID NO: 1291400 - DNA, 22 bp, Artificial Sequence
  chemically synthesized
ttgatgtatttgtctattattt

SEQ ID NO: 1291401 - DNA, 22 bp, Artificial Sequence
  chemically synthesized
tattgatgtatttgtctattat

SEQ ID NO: 1291402 - DNA, 22 bp, Artificial Sequence
  chemically synthesized
ttctattgatgtatttgtctat

SEQ ID NO: 1291403 - DNA, 22 bp, Artificial Sequence
  chemically synthesized
tgttctattgatgtatttgtct

SEQ ID NO: 1291404 - DNA, 22 bp, Artificial Sequence
  chemically synthesized
gcaaaataatagacaaatacat

SEQ ID NO: 1291405 - DNA, 22 bp, Artificial Sequence
  chemically synthesized
ttctgttctattgatgtatttg

SEQ ID NO: 1291406 - DNA, 22 bp, Artificial Sequence
  chemically synthesized
cacactattctgttctattgat

SEQ ID NO: 1291407 - DNA, 22 bp, Artificial Sequence
  chemically synthesized
ccacactattctgttctattga

SEQ ID NO: 1291408 - DNA, 22 bp, Artificial Sequence
  chemically synthesized
tttccacactattctgttctat

SEQ ID NO: 1291409 - DNA, 22 bp, Artificial Sequence
  chemically synthesized
atgtgggtctatttccacacta

SEQ ID NO: 1291410 - DNA, 22 bp, Artificial Sequence
  chemically synthesized
tattcatgtgggtctatttcca

SEQ ID NO: 1291411 - DNA, 22 bp, Artificial Sequence
  chemically synthesized
tcaaagatcagtaaactgtatt

SEQ ID NO: 1291412 - DNA, 22 bp, Artificial Sequence
  chemically synthesized
gtcaaagatcagtaaactgtat

SEQ ID NO: 1291413 - DNA, 22 bp, Artificial Sequence
  chemically synthesized
gtttgtcaaagatcagtaaact

SEQ ID NO: 1291414 - DNA, 22 bp, Artificial Sequence
  chemically synthesized
ctcgtttgtcaaagatcagtaa

SEQ ID NO: 1291415 - DNA, 22 bp, Artificial Sequence
  chemically synthesized
ccattgctcgtttgtcaaagat

SEQ ID NO: 1291416 - DNA, 22 bp, Artificial Sequence
  chemically synthesized
ttgccattgctcgtttgtcaaa

SEQ ID NO: 1291417 - DNA, 22 bp, Artificial Sequence
  chemically synthesized
tattgccattgctcgtttgtca

SEQ ID NO: 1291418 - DNA, 22 bp, Artificial Sequence
  chemically synthesized
actgatctttgacaaacgagca

SEQ ID NO: 1291419 - DNA, 22 bp, Artificial Sequence
  chemically synthesized
ctgatctttgacaaacgagcaa

SEQ ID NO: 1291420 - DNA, 22 bp, Artificial Sequence
  chemically synthesized
cattctattgccattgctcgtt

SEQ ID NO: 1291421 - DNA, 22 bp, Artificial Sequence
  chemically synthesized
atctttgacaaacgagcaatgg

SEQ ID NO: 1291422 - DNA, 22 bp, Artificial Sequence
  chemically synthesized
ctccattctattgccattgctc

SEQ ID NO: 1291423 - DNA, 22 bp, Artificial Sequence
  chemically synthesized
gctccattctattgccattgct

SEQ ID NO: 1291424 - DNA, 22 bp, Artificial Sequence
  chemically synthesized
tgctccattctattgccattgc

SEQ ID NO: 1291425 - DNA, 22 bp, Artificial Sequence
  chemically synthesized
tgacaaacgagcaatggcaata

SEQ ID NO: 1291426 - DNA, 22 bp, Artificial Sequence
  chemically synthesized
gacaaacgagcaatggcaatag

SEQ ID NO: 1291427 - DNA, 22 bp, Artificial Sequence
  chemically synthesized
acaaacgagcaatggcaataga

SEQ ID NO: 1291428 - DNA, 22 bp, Artificial Sequence
  chemically synthesized
tctttgctccattctattgcca

SEQ ID NO: 1291429 - DNA, 22 bp, Artificial Sequence
  chemically synthesized
aaaaggctatctttgctccatt

SEQ ID NO: 1291430 - DNA, 22 bp, Artificial Sequence
  chemically synthesized
ttgaaaaggctatctttgctcc

SEQ ID NO: 1291431 - DNA, 22 bp, Artificial Sequence
  chemically synthesized
gttgaaaaggctatctttgctc

SEQ ID NO: 1291432 - DNA, 22 bp, Artificial Sequence
  chemically synthesized
tttgttgaaaaggctatctttg

SEQ ID NO: 1291433 - DNA, 22 bp, Artificial Sequence
  chemically synthesized
agcattatttgttgaaaaggct

SEQ ID NO: 1291434 - DNA, 22 bp, Artificial Sequence
  chemically synthesized
cagcattatttgttgaaaaggc

SEQ ID NO: 1291435 - DNA, 22 bp, Artificial Sequence
  chemically synthesized
tttcagcattatttgttgaaaa

SEQ ID NO: 1291436 - DNA, 22 bp, Artificial Sequence
  chemically synthesized
ttcaacaaataatgctgaaaca

SEQ ID NO: 1291437 - DNA, 22 bp, Artificial Sequence
  chemically synthesized
tcaacaaataatgctgaaacaa

SEQ ID NO: 1291438 - DNA, 22 bp, Artificial Sequence
  chemically synthesized
caacaaataatgctgaaacaac

SEQ ID NO: 1291439 - DNA, 22 bp, Artificial Sequence
  chemically synthesized
aacaaataatgctgaaacaact

SEQ ID NO: 1291440 - DNA, 22 bp, Artificial Sequence
  chemically synthesized
catgtagatgtccagttgtttc

SEQ ID NO: 1291441 - DNA, 22 bp, Artificial Sequence
  chemically synthesized
gcatgtagatgtccagttgttt

SEQ ID NO: 1291442 - DNA, 22 bp, Artificial Sequence
  chemically synthesized
tgcatgtagatgtccagttgtt

SEQ ID NO: 1291443 - DNA, 22 bp, Artificial Sequence
  chemically synthesized
ttgcatgtagatgtccagttgt

SEQ ID NO: 1291444 - DNA, 22 bp, Artificial Sequence
  chemically synthesized
tttgcatgtagatgtccagttg

SEQ ID NO: 1291445 - DNA, 22 bp, Artificial Sequence
  chemically synthesized
ttttgcatgtagatgtccagtt

SEQ ID NO: 1291446 - DNA, 22 bp, Artificial Sequence
  chemically synthesized
atttttttgcatgtagatgtcc

SEQ ID NO: 1291447 - DNA, 22 bp, Artificial Sequence
  chemically synthesized
aaacaactggacatctacatgc

SEQ ID NO: 1291448 - DNA, 22 bp, Artificial Sequence
  chemically synthesized
cattcatttttttgcatgtaga

SEQ ID NO: 1291449 - DNA, 22 bp, Artificial Sequence
  chemically synthesized
tgtctacattcatttttttgca

SEQ ID NO: 1291450 - DNA, 22 bp, Artificial Sequence
  chemically synthesized
gacatctacatgcaaaaaaatg

SEQ ID NO: 1291451 - DNA, 22 bp, Artificial Sequence
  chemically synthesized
catgcaaaaaaatgaatgtaga

SEQ ID NO: 1291452 - DNA, 22 bp, Artificial Sequence
  chemically synthesized
atagagtgcaaggtctatgtct

SEQ ID NO: 1291453 - DNA, 22 bp, Artificial Sequence
  chemically synthesized
atctgatagagtgcaaggtcta

SEQ ID NO: 1291454 - DNA, 22 bp, Artificial Sequence
  chemically synthesized
tgatctgatagagtgcaaggtc

SEQ ID NO: 1291455 - DNA, 22 bp, Artificial Sequence
  chemically synthesized
ctgatctgatagagtgcaaggt

SEQ ID NO: 1291456 - DNA, 22 bp, Artificial Sequence
  chemically synthesized
ttctgatctgatagagtgcaag

SEQ ID NO: 1291457 - DNA, 22 bp, Artificial Sequence
  chemically synthesized
tcttctgatctgatagagtgca

SEQ ID NO: 1291458 - DNA, 22 bp, Artificial Sequence
  chemically synthesized
tctctcttctgatctgatagag

SEQ ID NO: 1291459 - DNA, 22 bp, Artificial Sequence
  chemically synthesized
gtctctcttctgatctgataga

SEQ ID NO: 1291460 - DNA, 22 bp, Artificial Sequence
  chemically synthesized
tgtctctcttctgatctgatag

SEQ ID NO: 1291461 - DNA, 22 bp, Artificial Sequence
  chemically synthesized
atctttgtctctcttctgatct

SEQ ID NO: 1291462 - DNA, 22 bp, Artificial Sequence
  chemically synthesized
gatctttgtctctcttctgatc

SEQ ID NO: 1291463 - DNA, 22 bp, Artificial Sequence
  chemically synthesized
gcactctatcagatcagaagag

SEQ ID NO: 1291464 - DNA, 22 bp, Artificial Sequence
  chemically synthesized
cactctatcagatcagaagaga

SEQ ID NO: 1291465 - DNA, 22 bp, Artificial Sequence
  chemically synthesized
tatcagatcagaagagagacaa

SEQ ID NO: 1291466 - DNA, 22 bp, Artificial Sequence
  chemically synthesized
tcagatcagaagagagacaaag

SEQ ID NO: 1291467 - DNA, 22 bp, Artificial Sequence
  chemically synthesized
taaatccagtagcagtaacttg

SEQ ID NO: 1291468 - DNA, 22 bp, Artificial Sequence
  chemically synthesized
gtaaatccagtagcagtaactt

SEQ ID NO: 1291469 - DNA, 22 bp, Artificial Sequence
  chemically synthesized
acttgtaaatccagtagcagta

SEQ ID NO: 1291470 - DNA, 22 bp, Artificial Sequence
  chemically synthesized
ctgctactggatttacaagtta

SEQ ID NO: 1291471 - DNA, 22 bp, Artificial Sequence
  chemically synthesized
ctactggatttacaagttaacg

SEQ ID NO: 1291472 - DNA, 22 bp, Artificial Sequence
  chemically synthesized
ctggatttacaagttaacgttc

SEQ ID NO: 1291473 - DNA, 22 bp, Artificial Sequence
  chemically synthesized
gatttacaagttaacgttcact

SEQ ID NO: 1291474 - DNA, 22 bp, Artificial Sequence
  chemically synthesized
acaagttaacgttcactggttg

SEQ ID NO: 1291475 - DNA, 22 bp, Artificial Sequence
  chemically synthesized
tatgagtgtgtacaaccagtga

SEQ ID NO: 1291476 - DNA, 22 bp, Artificial Sequence
  chemically synthesized
caagttaacgttcactggttgt

SEQ ID NO: 1291477 - DNA, 22 bp, Artificial Sequence
  chemically synthesized
gcattgtatgagtgtgtacaac

SEQ ID NO: 1291478 - DNA, 22 bp, Artificial Sequence
  chemically synthesized
acgttcactggttgtacacact

SEQ ID NO: 1291479 - DNA, 22 bp, Artificial Sequence
  chemically synthesized
tagcattgtatgagtgtgtaca

SEQ ID NO: 1291480 - DNA, 22 bp, Artificial Sequence
  chemically synthesized
actggttgtacacactcataca

SEQ ID NO: 1291481 - DNA, 22 bp, Artificial Sequence
  chemically synthesized
gttgtacacactcatacaatgc

SEQ ID NO: 1291482 - DNA, 22 bp, Artificial Sequence
  chemically synthesized
tacacactcatacaatgctaga

SEQ ID NO: 1291483 - DNA, 22 bp, Artificial Sequence
  chemically synthesized
atacaatgctagaggcacttgt

SEQ ID NO: 1291484 - DNA, 22 bp, Artificial Sequence
  chemically synthesized
gaggcacttgtatcatctctca

SEQ ID NO: 1291485 - DNA, 22 bp, Artificial Sequence
  chemically synthesized
aaaaataaggaacaatgagaga

SEQ ID NO: 1291486 - DNA, 22 bp, Artificial Sequence
  chemically synthesized
ttaaaaaataaggaacaatgag

SEQ ID NO: 1291487 - DNA, 22 bp, Artificial Sequence
  chemically synthesized
tattaaaaaataaggaacaatg

SEQ ID NO: 1291488 - DNA, 22 bp, Artificial Sequence
  chemically synthesized
gtatcatctctcattgttcctt

SEQ ID NO: 1291489 - DNA, 22 bp, Artificial Sequence
  chemically synthesized
tatcatctctcattgttcctta

SEQ ID NO: 1291490 - DNA, 22 bp, Artificial Sequence
  chemically synthesized
tctctattaaaaaataaggaac

SEQ ID NO: 1291491 - DNA, 22 bp, Artificial Sequence
  chemically synthesized
atctctattaaaaaataaggaa

SEQ ID NO: 1291492 - DNA, 22 bp, Artificial Sequence
  chemically synthesized
tcattgttccttattttttaat

SEQ ID NO: 1291493 - DNA, 22 bp, Artificial Sequence
  chemically synthesized
attgttccttattttttaatag

SEQ ID NO: 1291494 - DNA, 22 bp, Artificial Sequence
  chemically synthesized
ttccttattttttaatagagat

SEQ ID NO: 1291495 - DNA, 22 bp, Artificial Sequence
  chemically synthesized
cttattttttaatagagataaa

SEQ ID NO: 1291496 - DNA, 22 bp, Artificial Sequence
  chemically synthesized
attttttaatagagataaatgt

SEQ ID NO: 1291497 - DNA, 22 bp, Artificial Sequence
  chemically synthesized
ttttttaatagagataaatgta

SEQ ID NO: 1291498 - DNA, 22 bp, Artificial Sequence
  chemically synthesized
tttaatagagataaatgtattt

SEQ ID NO: 1291499 - DNA, 22 bp, Artificial Sequence
  chemically synthesized
aagaacaagaataaatacattt

SEQ ID NO: 1291500 - DNA, 22 bp, Artificial Sequence
  chemically synthesized
ttaatagagataaatgtattta

SEQ ID NO: 1291501 - DNA, 22 bp, Artificial Sequence
  chemically synthesized
taatagagataaatgtatttat

SEQ ID NO: 1291502 - DNA, 22 bp, Artificial Sequence
  chemically synthesized
aatagagataaatgtatttatt

SEQ ID NO: 1291503 - DNA, 22 bp, Artificial Sequence
  chemically synthesized
atagagataaatgtatttattc

SEQ ID NO: 1291504 - DNA, 22 bp, Artificial Sequence
  chemically synthesized
tcctcaagaacaagaataaata

SEQ ID NO: 1291505 - DNA, 22 bp, Artificial Sequence
  chemically synthesized
atcctcaagaacaagaataaat

SEQ ID NO: 1291506 - DNA, 22 bp, Artificial Sequence
  chemically synthesized
aaatttatcctcaagaacaaga

SEQ ID NO: 1291507 - DNA, 22 bp, Artificial Sequence
  chemically synthesized
ctaaaatttatcctcaagaaca

SEQ ID NO: 1291508 - DNA, 22 bp, Artificial Sequence
  chemically synthesized
aactcctaaaatttatcctcaa

SEQ ID NO: 1291509 - DNA, 22 bp, Artificial Sequence
  chemically synthesized
caactcctaaaatttatcctca

SEQ ID NO: 1291510 - DNA, 22 bp, Artificial Sequence
  chemically synthesized
attcttgttcttgaggataaat

SEQ ID NO: 1291511 - DNA, 22 bp, Artificial Sequence
  chemically synthesized
tcaactcctaaaatttatcctc

SEQ ID NO: 1291512 - DNA, 22 bp, Artificial Sequence
  chemically synthesized
ttcttgttcttgaggataaatt

SEQ ID NO: 1291513 - DNA, 22 bp, Artificial Sequence
  chemically synthesized
ttttcaactcctaaaatttatc

SEQ ID NO: 1291514 - DNA, 22 bp, Artificial Sequence
  chemically synthesized
ttgttcttgaggataaatttta

SEQ ID NO: 1291515 - DNA, 22 bp, Artificial Sequence
  chemically synthesized
attttcaactcctaaaatttat

SEQ ID NO: 1291516 - DNA, 22 bp, Artificial Sequence
  chemically synthesized
gttcttgaggataaattttagg

SEQ ID NO: 1291517 - DNA, 22 bp, Artificial Sequence
  chemically synthesized
ttcttgaggataaattttagga

SEQ ID NO: 1291518 - DNA, 22 bp, Artificial Sequence
  chemically synthesized
ttgaggataaattttaggagtt

SEQ ID NO: 1291519 - DNA, 22 bp, Artificial Sequence
  chemically synthesized
gaggataaattttaggagttga

SEQ ID NO: 1291520 - DNA, 22 bp, Artificial Sequence
  chemically synthesized
aggataaattttaggagttgaa

SEQ ID NO: 1291521 - DNA, 22 bp, Artificial Sequence
  chemically synthesized
tggaaggagtatttattttcaa

SEQ ID NO: 1291522 - DNA, 22 bp, Artificial Sequence
  chemically synthesized
atggaaggagtatttattttca

SEQ ID NO: 1291523 - DNA, 22 bp, Artificial Sequence
  chemically synthesized
tatggaaggagtatttattttc

SEQ ID NO: 1291524 - DNA, 22 bp, Artificial Sequence
  chemically synthesized
ttatggaaggagtatttatttt

SEQ ID NO: 1291525 - DNA, 22 bp, Artificial Sequence
  chemically synthesized
taggagttgaaaataaatactc

SEQ ID NO: 1291526 - DNA, 22 bp, Artificial Sequence
  chemically synthesized
aggagttgaaaataaatactcc

SEQ ID NO: 1291527 - DNA, 22 bp, Artificial Sequence
  chemically synthesized
ggagttgaaaataaatactcct

SEQ ID NO: 1291528 - DNA, 22 bp, Artificial Sequence
  chemically synthesized
gtatgtttttatggaaggagta

SEQ ID NO: 1291529 - DNA, 22 bp, Artificial Sequence
  chemically synthesized
agtatgtttttatggaaggagt

SEQ ID NO: 1291530 - DNA, 22 bp, Artificial Sequence
  chemically synthesized
tagtatgtttttatggaaggag

SEQ ID NO: 1291531 - DNA, 22 bp, Artificial Sequence
  chemically synthesized
aaaataaatactccttccataa

SEQ ID NO: 1291532 - DNA, 22 bp, Artificial Sequence
  chemically synthesized
gttttagtatgtttttatggaa

SEQ ID NO: 1291533 - DNA, 22 bp, Artificial Sequence
  chemically synthesized
agttttagtatgtttttatgga

SEQ ID NO: 1291534 - DNA, 22 bp, Artificial Sequence
  chemically synthesized
tagttttagtatgtttttatgg

SEQ ID NO: 1291535 - DNA, 22 bp, Artificial Sequence
  chemically synthesized
cttccataaaaacatactaaaa

SEQ ID NO: 1291536 - DNA, 22 bp, Artificial Sequence
  chemically synthesized
aaaataattttagttttagtat

SEQ ID NO: 1291537 - DNA, 22 bp, Artificial Sequence
  chemically synthesized
ccataaaaacatactaaaacta

SEQ ID NO: 1291538 - DNA, 22 bp, Artificial Sequence
  chemically synthesized
cataaaaacatactaaaactaa

SEQ ID NO: 1291539 - DNA, 22 bp, Artificial Sequence
  chemically synthesized
ccatggaaaatcattgaaaata

SEQ ID NO: 1291540 - DNA, 22 bp, Artificial Sequence
  chemically synthesized
cccatggaaaatcattgaaaat

SEQ ID NO: 1291541 - DNA, 22 bp, Artificial Sequence
  chemically synthesized
aaactaaaattattttcaatga

SEQ ID NO: 1291542 - DNA, 22 bp, Artificial Sequence
  chemically synthesized
aaattattttcaatgattttcc

SEQ ID NO: 1291543 - DNA, 22 bp, Artificial Sequence
  chemically synthesized
ttttcaatgattttccatggga

SEQ ID NO: 1291544 - DNA, 22 bp, Artificial Sequence
  chemically synthesized
tcaatgattttccatgggaaat

SEQ ID NO: 1291545 - DNA, 22 bp, Artificial Sequence
  chemically synthesized
caatgattttccatgggaaatt

SEQ ID NO: 1291546 - DNA, 22 bp, Artificial Sequence
  chemically synthesized
aatgattttccatgggaaattt

SEQ ID NO: 1291547 - DNA, 22 bp, Artificial Sequence
  chemically synthesized
gtggcaaagtataggtaaattt

SEQ ID NO: 1291548 - DNA, 22 bp, Artificial Sequence
  chemically synthesized
ggtggcaaagtataggtaaatt

SEQ ID NO: 1291549 - DNA, 22 bp, Artificial Sequence
  chemically synthesized
tccatgggaaatttacctatac

SEQ ID NO: 1291550 - DNA, 22 bp, Artificial Sequence
  chemically synthesized
ccatgggaaatttacctatact

SEQ ID NO: 1291551 - DNA, 22 bp, Artificial Sequence
  chemically synthesized
catgggaaatttacctatactt

SEQ ID NO: 1291552 - DNA, 22 bp, Artificial Sequence
  chemically synthesized
caagagagagtttggtggcaaa

SEQ ID NO: 1291553 - DNA, 22 bp, Artificial Sequence
  chemically synthesized
ttgcaagagagagtttggtggc

SEQ ID NO: 1291554 - DNA, 22 bp, Artificial Sequence
  chemically synthesized
acctatactttgccaccaaact

SEQ ID NO: 1291555 - DNA, 22 bp, Artificial Sequence
  chemically synthesized
cctatactttgccaccaaactc

SEQ ID NO: 1291556 - DNA, 22 bp, Artificial Sequence
  chemically synthesized
tactttgccaccaaactctctc

SEQ ID NO: 1291557 - DNA, 22 bp, Artificial Sequence
  chemically synthesized
tgccaccaaactctctcttgca

SEQ ID NO: 1291558 - DNA, 22 bp, Artificial Sequence
  chemically synthesized
gccaccaaactctctcttgcaa

SEQ ID NO: 1291559 - DNA, 22 bp, Artificial Sequence
  chemically synthesized
ccaccaaactctctcttgcaat

SEQ ID NO: 1291560 - DNA, 22 bp, Artificial Sequence
  chemically synthesized
ggataagaaagactattgcaag

SEQ ID NO: 1291561 - DNA, 22 bp, Artificial Sequence
  chemically synthesized
ctgggataagaaagactattgc

SEQ ID NO: 1291562 - DNA, 22 bp, Artificial Sequence
  chemically synthesized
actgggataagaaagactattg

SEQ ID NO: 1291563 - DNA, 22 bp, Artificial Sequence
  chemically synthesized
tttactgggataagaaagacta

SEQ ID NO: 1291564 - DNA, 22 bp, Artificial Sequence
  chemically synthesized
tctcttgcaatagtctttctta

SEQ ID NO: 1291565 - DNA, 22 bp, Artificial Sequence
  chemically synthesized
tcttgcaatagtctttcttatc

SEQ ID NO: 1291566 - DNA, 22 bp, Artificial Sequence
  chemically synthesized
ttgcaatagtctttcttatccc

SEQ ID NO: 1291567 - DNA, 22 bp, Artificial Sequence
  chemically synthesized
gcaatagtctttcttatcccag

SEQ ID NO: 1291568 - DNA, 22 bp, Artificial Sequence
  chemically synthesized
caatagtctttcttatcccagt

SEQ ID NO: 1291569 - DNA, 22 bp, Artificial Sequence
  chemically synthesized
tcttatcccagtaaataaccat

SEQ ID NO: 1291570 - DNA, 22 bp, Artificial Sequence
  chemically synthesized
cttatcccagtaaataaccatc

SEQ ID NO: 1291571 - DNA, 22 bp, Artificial Sequence
  chemically synthesized
ttatcccagtaaataaccatcc

SEQ ID NO: 1291572 - DNA, 22 bp, Artificial Sequence
  chemically synthesized
atcccagtaaataaccatccca

SEQ ID NO: 1291573 - DNA, 22 bp, Artificial Sequence
  chemically synthesized
tcccagtaaataaccatcccat

SEQ ID NO: 1291574 - DNA, 22 bp, Artificial Sequence
  chemically synthesized
agcaaaaggaaggatgggatgg

SEQ ID NO: 1291575 - DNA, 22 bp, Artificial Sequence
  chemically synthesized
gagcaaaaggaaggatgggatg

SEQ ID NO: 1291576 - DNA, 22 bp, Artificial Sequence
  chemically synthesized
gcttgagcaaaaggaaggatgg

SEQ ID NO: 1291577 - DNA, 22 bp, Artificial Sequence
  chemically synthesized
agcttgagcaaaaggaaggatg

SEQ ID NO: 1291578 - DNA, 22 bp, Artificial Sequence
  chemically synthesized
tagcttgagcaaaaggaaggat

SEQ ID NO: 1291579 - DNA, 22 bp, Artificial Sequence
  chemically synthesized
ccttttgctcaagctaaaactg

SEQ ID NO: 1291580 - DNA, 22 bp, Artificial Sequence
  chemically synthesized
cttttgctcaagctaaaactgt

SEQ ID NO: 1291581 - DNA, 22 bp, Artificial Sequence
  chemically synthesized
ttgctcaagctaaaactgtttt

SEQ ID NO: 1291582 - DNA, 22 bp, Artificial Sequence
  chemically synthesized
agagagtggagaaaaacagttt

SEQ ID NO: 1291583 - DNA, 22 bp, Artificial Sequence
  chemically synthesized
tgctcaagctaaaactgttttt

SEQ ID NO: 1291584 - DNA, 22 bp, Artificial Sequence
  chemically synthesized
gctcaagctaaaactgtttttc

SEQ ID NO: 1291585 - DNA, 22 bp, Artificial Sequence
  chemically synthesized
ctcaagctaaaactgtttttct

SEQ ID NO: 1291586 - DNA, 22 bp, Artificial Sequence
  chemically synthesized
aagctaaaactgtttttctcca

SEQ ID NO: 1291587 - DNA, 22 bp, Artificial Sequence
  chemically synthesized
aaactgtttttctccactctct

SEQ ID NO: 1291588 - DNA, 22 bp, Artificial Sequence
  chemically synthesized
aaaatggagattgagagagtgg

SEQ ID NO: 1291589 - DNA, 22 bp, Artificial Sequence
  chemically synthesized
tttttctccactctctcaatct

SEQ ID NO: 1291590 - DNA, 22 bp, Artificial Sequence
  chemically synthesized
ttctccactctctcaatctcca

SEQ ID NO: 1291591 - DNA, 22 bp, Artificial Sequence
  chemically synthesized
gtggactaaaaatggagattga

SEQ ID NO: 1291592 - DNA, 22 bp, Artificial Sequence
  chemically synthesized
tctccactctctcaatctccat

SEQ ID NO: 1291593 - DNA, 22 bp, Artificial Sequence
  chemically synthesized
ctccactctctcaatctccatt

SEQ ID NO: 1291594 - DNA, 22 bp, Artificial Sequence
  chemically synthesized
tccactctctcaatctccattt

SEQ ID NO: 1291595 - DNA, 22 bp, Artificial Sequence
  chemically synthesized
ctggtggactaaaaatggagat

SEQ ID NO: 1291596 - DNA, 22 bp, Artificial Sequence
  chemically synthesized
gctggtggactaaaaatggaga

SEQ ID NO: 1291597 - DNA, 22 bp, Artificial Sequence
  chemically synthesized
cactctctcaatctccattttt

SEQ ID NO: 1291598 - DNA, 22 bp, Artificial Sequence
  chemically synthesized
tctcaatctccatttttagtcc

SEQ ID NO: 1291599 - DNA, 22 bp, Artificial Sequence
  chemically synthesized
tcaatctccatttttagtccac

SEQ ID NO: 1291600 - DNA, 22 bp, Artificial Sequence
  chemically synthesized
aatctccatttttagtccacca

SEQ ID NO: 1291601 - DNA, 22 bp, Artificial Sequence
  chemically synthesized
catttttagtccaccagcaaat

SEQ ID NO: 1291602 - DNA, 22 bp, Artificial Sequence
  chemically synthesized
ttagtccaccagcaaatcctgt

SEQ ID NO: 1291603 - DNA, 22 bp, Artificial Sequence
  chemically synthesized
aaagtagatgtaacaggatttg

SEQ ID NO: 1291604 - DNA, 22 bp, Artificial Sequence
  chemically synthesized
tagtccaccagcaaatcctgtt

SEQ ID NO: 1291605 - DNA, 22 bp, Artificial Sequence
  chemically synthesized
gaaagtagatgtaacaggattt

SEQ ID NO: 1291606 - DNA, 22 bp, Artificial Sequence
  chemically synthesized
agtccaccagcaaatcctgtta

SEQ ID NO: 1291607 - DNA, 22 bp, Artificial Sequence
  chemically synthesized
tgaaagtagatgtaacaggatt

SEQ ID NO: 1291608 - DNA, 22 bp, Artificial Sequence
  chemically synthesized
gtccaccagcaaatcctgttac

SEQ ID NO: 1291609 - DNA, 22 bp, Artificial Sequence
  chemically synthesized
gatacattttgaaagtagatgt

SEQ ID NO: 1291610 - DNA, 22 bp, Artificial Sequence
  chemically synthesized
ggatacattttgaaagtagatg

SEQ ID NO: 1291611 - DNA, 22 bp, Artificial Sequence
  chemically synthesized
tggatacattttgaaagtagat

SEQ ID NO: 1291612 - DNA, 22 bp, Artificial Sequence
  chemically synthesized
ttacatctactttcaaaatgta

SEQ ID NO: 1291613 - DNA, 22 bp, Artificial Sequence
  chemically synthesized
catctactttcaaaatgtatcc

SEQ ID NO: 1291614 - DNA, 22 bp, Artificial Sequence
  chemically synthesized
ctttcaaaatgtatccaaaatt

SEQ ID NO: 1291615 - DNA, 22 bp, Artificial Sequence
  chemically synthesized
gggagaaatgatcgaattttgg

SEQ ID NO: 1291616 - DNA, 22 bp, Artificial Sequence
  chemically synthesized
tcaaaatgtatccaaaattcga

SEQ ID NO: 1291617 - DNA, 22 bp, Artificial Sequence
  chemically synthesized
caaaatgtatccaaaattcgat

SEQ ID NO: 1291618 - DNA, 22 bp, Artificial Sequence
  chemically synthesized
aaaatgtatccaaaattcgatc

SEQ ID NO: 1291619 - DNA, 22 bp, Artificial Sequence
  chemically synthesized
atgtccatggatctggggagaa

SEQ ID NO: 1291620 - DNA, 22 bp, Artificial Sequence
  chemically synthesized
ggttgatgtccatggatctggg

SEQ ID NO: 1291621 - DNA, 22 bp, Artificial Sequence
  chemically synthesized
gatcatttctccccagatccat

SEQ ID NO: 1291622 - DNA, 22 bp, Artificial Sequence
  chemically synthesized
ggattaggttgatgtccatgga

SEQ ID NO: 1291623 - DNA, 22 bp, Artificial Sequence
  chemically synthesized
ctccccagatccatggacatca

SEQ ID NO: 1291624 - DNA, 22 bp, Artificial Sequence
  chemically synthesized
tccccagatccatggacatcaa

SEQ ID NO: 1291625 - DNA, 22 bp, Artificial Sequence
  chemically synthesized
cccagatccatggacatcaacc

SEQ ID NO: 1291626 - DNA, 22 bp, Artificial Sequence
  chemically synthesized
ggtgtgtgcgtgtggctaggat

SEQ ID NO: 1291627 - DNA, 22 bp, Artificial Sequence
  chemically synthesized
atcctagccacacgcacacacc

SEQ ID NO: 1291628 - DNA, 22 bp, Artificial Sequence
  chemically synthesized
gccacacgcacacacccagcct

SEQ ID NO: 1291629 - DNA, 22 bp, Artificial Sequence
  chemically synthesized
gaggataatgtagtaatgaagg

SEQ ID NO: 1291630 - DNA, 22 bp, Artificial Sequence
  chemically synthesized
cattactacattatcctctaac

SEQ ID NO: 1291631 - DNA, 22 bp, Artificial Sequence
  chemically synthesized
attactacattatcctctaact

SEQ ID NO: 1291632 - DNA, 22 bp, Artificial Sequence
  chemically synthesized
ctacattatcctctaactcatc

SEQ ID NO: 1291633 - DNA, 22 bp, Artificial Sequence
  chemically synthesized
cattatcctctaactcatctct

SEQ ID NO: 1291634 - DNA, 22 bp, Artificial Sequence
  chemically synthesized
tcctctaactcatctctctact

SEQ ID NO: 1291635 - DNA, 22 bp, Artificial Sequence
  chemically synthesized
taactcatctctctacttctac

SEQ ID NO: 1291636 - DNA, 22 bp, Artificial Sequence
  chemically synthesized
actcatctctctacttctacct

SEQ ID NO: 1291637 - DNA, 22 bp, Artificial Sequence
  chemically synthesized
gaatgtaggatgtaaaggtaga

SEQ ID NO: 1291638 - DNA, 22 bp, Artificial Sequence
  chemically synthesized
atctctctacttctacctttac

SEQ ID NO: 1291639 - DNA, 22 bp, Artificial Sequence
  chemically synthesized
tctacttctacctttacatcct

SEQ ID NO: 1291640 - DNA, 22 bp, Artificial Sequence
  chemically synthesized
tacttctacctttacatcctac

SEQ ID NO: 1291641 - DNA, 22 bp, Artificial Sequence
  chemically synthesized
cttctacctttacatcctacat

SEQ ID NO: 1291642 - DNA, 22 bp, Artificial Sequence
  chemically synthesized
ctacctttacatcctacattct

SEQ ID NO: 1291643 - DNA, 22 bp, Artificial Sequence
  chemically synthesized
tacctttacatcctacattcta

SEQ ID NO: 1291644 - DNA, 22 bp, Artificial Sequence
  chemically synthesized
cctttacatcctacattctaac

SEQ ID NO: 1291645 - DNA, 22 bp, Artificial Sequence
  chemically synthesized
tacatcctacattctaacttac

SEQ ID NO: 1291646 - DNA, 22 bp, Artificial Sequence
  chemically synthesized
acatcctacattctaacttaca

SEQ ID NO: 1291647 - DNA, 22 bp, Artificial Sequence
  chemically synthesized
catcctacattctaacttacat

SEQ ID NO: 1291648 - DNA, 22 bp, Artificial Sequence
  chemically synthesized
aacagtagccagaaataatgta

SEQ ID NO: 1291649 - DNA, 22 bp, Artificial Sequence
  chemically synthesized
cattctaacttacattatttct

SEQ ID NO: 1291650 - DNA, 22 bp, Artificial Sequence
  chemically synthesized
tgaacagtagccagaaataatg

SEQ ID NO: 1291651 - DNA, 22 bp, Artificial Sequence
  chemically synthesized
taacttacattatttctggcta

SEQ ID NO: 1291652 - DNA, 22 bp, Artificial Sequence
  chemically synthesized
acttacattatttctggctact

SEQ ID NO: 1291653 - DNA, 22 bp, Artificial Sequence
  chemically synthesized
agagttctgaacagtagccaga

SEQ ID NO: 1291654 - DNA, 22 bp, Artificial Sequence
  chemically synthesized
gagagttctgaacagtagccag

SEQ ID NO: 1291655 - DNA, 22 bp, Artificial Sequence
  chemically synthesized
tgagagttctgaacagtagcca

SEQ ID NO: 1291656 - DNA, 22 bp, Artificial Sequence
  chemically synthesized
acattatttctggctactgttc

SEQ ID NO: 1291657 - DNA, 22 bp, Artificial Sequence
  chemically synthesized
cattatttctggctactgttca

SEQ ID NO: 1291658 - DNA, 22 bp, Artificial Sequence
  chemically synthesized
tttctggctactgttcagaact

SEQ ID NO: 1291659 - DNA, 22 bp, Artificial Sequence
  chemically synthesized
ggagattttgagagttctgaac

SEQ ID NO: 1291660 - DNA, 22 bp, Artificial Sequence
  chemically synthesized
ctggctactgttcagaactctc

SEQ ID NO: 1291661 - DNA, 22 bp, Artificial Sequence
  chemically synthesized
tggctactgttcagaactctca

SEQ ID NO: 1291662 - DNA, 22 bp, Artificial Sequence
  chemically synthesized
gctactgttcagaactctcaaa

SEQ ID NO: 1291663 - DNA, 22 bp, Artificial Sequence
  chemically synthesized
ctgttcagaactctcaaaatct

SEQ ID NO: 1291664 - DNA, 22 bp, Artificial Sequence
  chemically synthesized
tgggagattaggagattttgag

SEQ ID NO: 1291665 - DNA, 22 bp, Artificial Sequence
  chemically synthesized
ttcagaactctcaaaatctcct

SEQ ID NO: 1291666 - DNA, 22 bp, Artificial Sequence
  chemically synthesized
agaactctcaaaatctcctaat

SEQ ID NO: 1291667 - DNA, 22 bp, Artificial Sequence
  chemically synthesized
tacattgtgggagattaggaga

SEQ ID NO: 1291668 - DNA, 22 bp, Artificial Sequence
  chemically synthesized
gtacattgtgggagattaggag

SEQ ID NO: 1291669 - DNA, 22 bp, Artificial Sequence
  chemically synthesized
gcttgtacattgtgggagatta

SEQ ID NO: 1291670 - DNA, 22 bp, Artificial Sequence
  chemically synthesized
tcaaaatctcctaatctcccac

SEQ ID NO: 1291671 - DNA, 22 bp, Artificial Sequence
  chemically synthesized
ggcttgtacattgtgggagatt

SEQ ID NO: 1291672 - DNA, 22 bp, Artificial Sequence
  chemically synthesized
aaaatctcctaatctcccacaa

SEQ ID NO: 1291673 - DNA, 22 bp, Artificial Sequence
  chemically synthesized
ctaatctcccacaatgtacaag

SEQ ID NO: 1291674 - DNA, 22 bp, Artificial Sequence
  chemically synthesized
taaaggtcttggcttgtacatt

SEQ ID NO: 1291675 - DNA, 22 bp, Artificial Sequence
  chemically synthesized
atctcccacaatgtacaagcca

SEQ ID NO: 1291676 - DNA, 22 bp, Artificial Sequence
  chemically synthesized
accattgtaaaggtcttggctt

SEQ ID NO: 1291677 - DNA, 22 bp, Artificial Sequence
  chemically synthesized
ccacaatgtacaagccaagacc

SEQ ID NO: 1291678 - DNA, 22 bp, Artificial Sequence
  chemically synthesized
ttgaccattgtaaaggtcttgg

SEQ ID NO: 1291679 - DNA, 22 bp, Artificial Sequence
  chemically synthesized
attgaccattgtaaaggtcttg

SEQ ID NO: 1291680 - DNA, 22 bp, Artificial Sequence
  chemically synthesized
tacaatggtcaataaggcccta

SEQ ID NO: 1291681 - DNA, 22 bp, Artificial Sequence
  chemically synthesized
acaatggtcaataaggccctat

SEQ ID NO: 1291682 - DNA, 22 bp, Artificial Sequence
  chemically synthesized
caatggtcaataaggccctatc

SEQ ID NO: 1291683 - DNA, 22 bp, Artificial Sequence
  chemically synthesized
gaaggacaaatcagatagggcc

SEQ ID NO: 1291684 - DNA, 22 bp, Artificial Sequence
  chemically synthesized
caagtggagtggtattagaagg

SEQ ID NO: 1291685 - DNA, 22 bp, Artificial Sequence
  chemically synthesized
tctgatttgtccttctaatacc

SEQ ID NO: 1291686 - DNA, 22 bp, Artificial Sequence
  chemically synthesized
atttgtccttctaataccactc

SEQ ID NO: 1291687 - DNA, 22 bp, Artificial Sequence
  chemically synthesized
gtccttctaataccactccact

SEQ ID NO: 1291688 - DNA, 22 bp, Artificial Sequence
  chemically synthesized
tccttctaataccactccactt

SEQ ID NO: 1291689 - DNA, 22 bp, Artificial Sequence
  chemically synthesized
ctaataccactccacttgcaga

SEQ ID NO: 1291690 - DNA, 22 bp, Artificial Sequence
  chemically synthesized
taataccactccacttgcagat

SEQ ID NO: 1291691 - DNA, 22 bp, Artificial Sequence
  chemically synthesized
ataccactccacttgcagatcc

SEQ ID NO: 1291692 - DNA, 22 bp, Artificial Sequence
  chemically synthesized
aggaagagcggtaggatctgca

SEQ ID NO: 1291693 - DNA, 22 bp, Artificial Sequence
  chemically synthesized
cacttgcagatcctaccgctct

SEQ ID NO: 1291694 - DNA, 22 bp, Artificial Sequence
  chemically synthesized
gcagatcctaccgctcttcctc

SEQ ID NO: 1291695 - DNA, 22 bp, Artificial Sequence
  chemically synthesized
cagatcctaccgctcttcctca

SEQ ID NO: 1291696 - DNA, 22 bp, Artificial Sequence
  chemically synthesized
gtgcagagtgactgaggaagag

SEQ ID NO: 1291697 - DNA, 22 bp, Artificial Sequence
  chemically synthesized
ccgctcttcctcagtcactctg

SEQ ID NO: 1291698 - DNA, 22 bp, Artificial Sequence
  chemically synthesized
ttcctcagtcactctgcaccag

SEQ ID NO: 1291699 - DNA, 22 bp, Artificial Sequence
  chemically synthesized
cctcagtcactctgcaccagcc

SEQ ID NO: 1291700 - DNA, 22 bp, Artificial Sequence
  chemically synthesized
ctcagtcactctgcaccagcca

SEQ ID NO: 1291701 - DNA, 22 bp, Artificial Sequence
  chemically synthesized
agtcactctgcaccagccatct

SEQ ID NO: 1291702 - DNA, 22 bp, Artificial Sequence
  chemically synthesized
tgggataacaagggagtcaaga

SEQ ID NO: 1291703 - DNA, 22 bp, Artificial Sequence
  chemically synthesized
tgcaccagccatcttgactccc

SEQ ID NO: 1291704 - DNA, 22 bp, Artificial Sequence
  chemically synthesized
gtgggataacaagggagtcaag

SEQ ID NO: 1291705 - DNA, 22 bp, Artificial Sequence
  chemically synthesized
caccagccatcttgactccctt

SEQ ID NO: 1291706 - DNA, 22 bp, Artificial Sequence
  chemically synthesized
gactcccttgttatcccacaaa

SEQ ID NO: 1291707 - DNA, 22 bp, Artificial Sequence
  chemically synthesized
actcccttgttatcccacaaac

SEQ ID NO: 1291708 - DNA, 22 bp, Artificial Sequence
  chemically synthesized
aggagggagtgcgtgtttgtgg

SEQ ID NO: 1291709 - DNA, 22 bp, Artificial Sequence
  chemically synthesized
ccttgttatcccacaaacacgc

SEQ ID NO: 1291710 - DNA, 22 bp, Artificial Sequence
  chemically synthesized
tgaggagggagtgcgtgtttgt

SEQ ID NO: 1291711 - DNA, 22 bp, Artificial Sequence
  chemically synthesized
gttatcccacaaacacgcactc

SEQ ID NO: 1291712 - DNA, 22 bp, Artificial Sequence
  chemically synthesized
ttatcccacaaacacgcactcc

SEQ ID NO: 1291713 - DNA, 22 bp, Artificial Sequence
  chemically synthesized
tcccacaaacacgcactccctc

SEQ ID NO: 1291714 - DNA, 22 bp, Artificial Sequence
  chemically synthesized
ggcagagggaagaatatgtaca

SEQ ID NO: 1291715 - DNA, 22 bp, Artificial Sequence
  chemically synthesized
cctcctcagagtgtacatattc

SEQ ID NO: 1291716 - DNA, 22 bp, Artificial Sequence
  chemically synthesized
taggcagagggaagaatatgta

SEQ ID NO: 1291717 - DNA, 22 bp, Artificial Sequence
  chemically synthesized
ctcagagtgtacatattcttcc

SEQ ID NO: 1291718 - DNA, 22 bp, Artificial Sequence
  chemically synthesized
agagtgtacatattcttccctc

SEQ ID NO: 1291719 - DNA, 22 bp, Artificial Sequence
  chemically synthesized
gagaagagagttctaggcagag

SEQ ID NO: 1291720 - DNA, 22 bp, Artificial Sequence
  chemically synthesized
ggagaagagagttctaggcaga

SEQ ID NO: 1291721 - DNA, 22 bp, Artificial Sequence
  chemically synthesized
ttccctctgcctagaactctct

SEQ ID NO: 1291722 - DNA, 22 bp, Artificial Sequence
  chemically synthesized
ccctctgcctagaactctcttc

SEQ ID NO: 1291723 - DNA, 22 bp, Artificial Sequence
  chemically synthesized
cctctgcctagaactctcttct

SEQ ID NO: 1291724 - DNA, 22 bp, Artificial Sequence
  chemically synthesized
caggtgtcttggagaagagagt

SEQ ID NO: 1291725 - DNA, 22 bp, Artificial Sequence
  chemically synthesized
gcaggtgtcttggagaagagag

SEQ ID NO: 1291726 - DNA, 22 bp, Artificial Sequence
  chemically synthesized
tgcctagaactctcttctccaa

SEQ ID NO: 1291727 - DNA, 22 bp, Artificial Sequence
  chemically synthesized
cctagaactctcttctccaaga

SEQ ID NO: 1291728 - DNA, 22 bp, Artificial Sequence
  chemically synthesized
gaactctcttctccaagacacc

SEQ ID NO: 1291729 - DNA, 22 bp, Artificial Sequence
  chemically synthesized
tcttctccaagacacctgcaag

SEQ ID NO: 1291730 - DNA, 22 bp, Artificial Sequence
  chemically synthesized
ttctccaagacacctgcaagat

SEQ ID NO: 1291731 - DNA, 22 bp, Artificial Sequence
  chemically synthesized
ctccaagacacctgcaagatgc

SEQ ID NO: 1291732 - DNA, 22 bp, Artificial Sequence
  chemically synthesized
tccaagacacctgcaagatgcc

SEQ ID NO: 1291733 - DNA, 22 bp, Artificial Sequence
  chemically synthesized
caagacacctgcaagatgccct

SEQ ID NO: 1291734 - DNA, 22 bp, Artificial Sequence
  chemically synthesized
aaggaaggaaaggagggcatct

SEQ ID NO: 1291735 - DNA, 22 bp, Artificial Sequence
  chemically synthesized
caagatgccctcctttccttcc

SEQ ID NO: 1291736 - DNA, 22 bp, Artificial Sequence
  chemically synthesized
agaggcatacaaaaaacctgaa

SEQ ID NO: 1291737 - DNA, 22 bp, Artificial Sequence
  chemically synthesized
aagaggcatacaaaaaacctga

SEQ ID NO: 1291738 - DNA, 22 bp, Artificial Sequence
  chemically synthesized
ctttccttccttcaggtttttt

SEQ ID NO: 1291739 - DNA, 22 bp, Artificial Sequence
  chemically synthesized
tccttccttcaggttttttgta

SEQ ID NO: 1291740 - DNA, 22 bp, Artificial Sequence
  chemically synthesized
acttaagaggcatacaaaaaac

SEQ ID NO: 1291741 - DNA, 22 bp, Artificial Sequence
  chemically synthesized
ccttccttcaggttttttgtat

SEQ ID NO: 1291742 - DNA, 22 bp, Artificial Sequence
  chemically synthesized
cttccttcaggttttttgtatg

SEQ ID NO: 1291743 - DNA, 22 bp, Artificial Sequence
  chemically synthesized
ccttcaggttttttgtatgcct

SEQ ID NO: 1291744 - DNA, 22 bp, Artificial Sequence
  chemically synthesized
cttcaggttttttgtatgcctc

SEQ ID NO: 1291745 - DNA, 22 bp, Artificial Sequence
  chemically synthesized
caggttttttgtatgcctctta

SEQ ID NO: 1291746 - DNA, 22 bp, Artificial Sequence
  chemically synthesized
aggttttttgtatgcctcttaa

SEQ ID NO: 1291747 - DNA, 22 bp, Artificial Sequence
  chemically synthesized
gaaaagcctcacttaagaggca

SEQ ID NO: 1291748 - DNA, 22 bp, Artificial Sequence
  chemically synthesized
tttgtatgcctcttaagtgagg

SEQ ID NO: 1291749 - DNA, 22 bp, Artificial Sequence
  chemically synthesized
ttgtatgcctcttaagtgaggc

SEQ ID NO: 1291750 - DNA, 22 bp, Artificial Sequence
  chemically synthesized
tgtatgcctcttaagtgaggct

SEQ ID NO: 1291751 - DNA, 22 bp, Artificial Sequence
  chemically synthesized
gtatgcctcttaagtgaggctt

SEQ ID NO: 1291752 - DNA, 22 bp, Artificial Sequence
  chemically synthesized
tatgcctcttaagtgaggcttt

SEQ ID NO: 1291753 - DNA, 22 bp, Artificial Sequence
  chemically synthesized
tgtagtgggtcctggaaaagcc

SEQ ID NO: 1291754 - DNA, 22 bp, Artificial Sequence
  chemically synthesized
atgtagtgggtcctggaaaagc

SEQ ID NO: 1291755 - DNA, 22 bp, Artificial Sequence
  chemically synthesized
tatgtagtgggtcctggaaaag

SEQ ID NO: 1291756 - DNA, 22 bp, Artificial Sequence
  chemically synthesized
ttaagtgaggcttttccaggac

SEQ ID NO: 1291757 - DNA, 22 bp, Artificial Sequence
  chemically synthesized
aagtgaggcttttccaggaccc

SEQ ID NO: 1291758 - DNA, 22 bp, Artificial Sequence
  chemically synthesized
agtgaggcttttccaggaccca

SEQ ID NO: 1291759 - DNA, 22 bp, Artificial Sequence
  chemically synthesized
ccattttatgtagtgggtcctg

SEQ ID NO: 1291760 - DNA, 22 bp, Artificial Sequence
  chemically synthesized
ttccaggacccactacataaaa

SEQ ID NO: 1291761 - DNA, 22 bp, Artificial Sequence
  chemically synthesized
tccaggacccactacataaaat

SEQ ID NO: 1291762 - DNA, 22 bp, Artificial Sequence
  chemically synthesized
ccaggacccactacataaaatg

SEQ ID NO: 1291763 - DNA, 22 bp, Artificial Sequence
  chemically synthesized
caggacccactacataaaatgg

SEQ ID NO: 1291764 - DNA, 22 bp, Artificial Sequence
  chemically synthesized
aaagggtaggttgccattttat

SEQ ID NO: 1291765 - DNA, 22 bp, Artificial Sequence
  chemically synthesized
caaagggtaggttgccatttta

SEQ ID NO: 1291766 - DNA, 22 bp, Artificial Sequence
  chemically synthesized
cataaaatggcaacctaccctt

SEQ ID NO: 1291767 - DNA, 22 bp, Artificial Sequence
  chemically synthesized
ccctttgaaatatccctattct

SEQ ID NO: 1291768 - DNA, 22 bp, Artificial Sequence
  chemically synthesized
tgaaatatccctattctaccct

SEQ ID NO: 1291769 - DNA, 22 bp, Artificial Sequence
  chemically synthesized
gaaatatccctattctaccctt

SEQ ID NO: 1291770 - DNA, 22 bp, Artificial Sequence
  chemically synthesized
aaatatccctattctaccctta

SEQ ID NO: 1291771 - DNA, 22 bp, Artificial Sequence
  chemically synthesized
agagaaaaaataaagcaggata

SEQ ID NO: 1291772 - DNA, 22 bp, Artificial Sequence
  chemically synthesized
ttctacccttatcctgctttat

SEQ ID NO: 1291773 - DNA, 22 bp, Artificial Sequence
  chemically synthesized
tacccttatcctgctttatttt

SEQ ID NO: 1291774 - DNA, 22 bp, Artificial Sequence
  chemically synthesized
cccttatcctgctttatttttt

SEQ ID NO: 1291775 - DNA, 22 bp, Artificial Sequence
  chemically synthesized
atcctgctttattttttctctt

SEQ ID NO: 1291776 - DNA, 22 bp, Artificial Sequence
  chemically synthesized
tcctgctttattttttctctta

SEQ ID NO: 1291777 - DNA, 22 bp, Artificial Sequence
  chemically synthesized
agagagtgacaagtgctaagag

SEQ ID NO: 1291778 - DNA, 22 bp, Artificial Sequence
  chemically synthesized
ctttattttttctcttagcact

SEQ ID NO: 1291779 - DNA, 22 bp, Artificial Sequence
  chemically synthesized
cagagagtgacaagtgctaaga

SEQ ID NO: 1291780 - DNA, 22 bp, Artificial Sequence
  chemically synthesized
tattttttctcttagcacttgt

SEQ ID NO: 1291781 - DNA, 22 bp, Artificial Sequence
  chemically synthesized
attttttctcttagcacttgtc

SEQ ID NO: 1291782 - DNA, 22 bp, Artificial Sequence
  chemically synthesized
ttttttctcttagcacttgtca

SEQ ID NO: 1291783 - DNA, 22 bp, Artificial Sequence
  chemically synthesized
tttctcttagcacttgtcactc

SEQ ID NO: 1291784 - DNA, 22 bp, Artificial Sequence
  chemically synthesized
ttctcttagcacttgtcactct

SEQ ID NO: 1291785 - DNA, 22 bp, Artificial Sequence
  chemically synthesized
tctcttagcacttgtcactctc

SEQ ID NO: 1291786 - DNA, 22 bp, Artificial Sequence
  chemically synthesized
ctcttagcacttgtcactctct

SEQ ID NO: 1291787 - DNA, 22 bp, Artificial Sequence
  chemically synthesized
tcttagcacttgtcactctctg

SEQ ID NO: 1291788 - DNA, 22 bp, Artificial Sequence
  chemically synthesized
ttagcacttgtcactctctgaa

SEQ ID NO: 1291789 - DNA, 22 bp, Artificial Sequence
  chemically synthesized
agcacttgtcactctctgaaat

SEQ ID NO: 1291790 - DNA, 22 bp, Artificial Sequence
  chemically synthesized
gcacttgtcactctctgaaatt

SEQ ID NO: 1291791 - DNA, 22 bp, Artificial Sequence
  chemically synthesized
caagtagaatatagaatttcag

SEQ ID NO: 1291792 - DNA, 22 bp, Artificial Sequence
  chemically synthesized
tgcaagtagaatatagaatttc

SEQ ID NO: 1291793 - DNA, 22 bp, Artificial Sequence
  chemically synthesized
gtcactctctgaaattctatat

SEQ ID NO: 1291794 - DNA, 22 bp, Artificial Sequence
  chemically synthesized
tctgcaagtagaatatagaatt

SEQ ID NO: 1291795 - DNA, 22 bp, Artificial Sequence
  chemically synthesized
tcactctctgaaattctatatt

SEQ ID NO: 1291796 - DNA, 22 bp, Artificial Sequence
  chemically synthesized
tctctgcaagtagaatatagaa

SEQ ID NO: 1291797 - DNA, 22 bp, Artificial Sequence
  chemically synthesized
ctctctgcaagtagaatataga

SEQ ID NO: 1291798 - DNA, 22 bp, Artificial Sequence
  chemically synthesized
tctctctgcaagtagaatatag

SEQ ID NO: 1291799 - DNA, 22 bp, Artificial Sequence
  chemically synthesized
ttctctctgcaagtagaatata

SEQ ID NO: 1291800 - DNA, 22 bp, Artificial Sequence
  chemically synthesized
tttctctctgcaagtagaatat

SEQ ID NO: 1291801 - DNA, 22 bp, Artificial Sequence
  chemically synthesized
tctgaaattctatattctactt

SEQ ID NO: 1291802 - DNA, 22 bp, Artificial Sequence
  chemically synthesized
tgaaattctatattctacttgc

SEQ ID NO: 1291803 - DNA, 22 bp, Artificial Sequence
  chemically synthesized
ttttttctctctgcaagtagaa

SEQ ID NO: 1291804 - DNA, 22 bp, Artificial Sequence
  chemically synthesized
gttttttctctctgcaagtaga

SEQ ID NO: 1291805 - DNA, 22 bp, Artificial Sequence
  chemically synthesized
aaattctatattctacttgcag

SEQ ID NO: 1291806 - DNA, 22 bp, Artificial Sequence
  chemically synthesized
tttgttttttctctctgcaagt

SEQ ID NO: 1291807 - DNA, 22 bp, Artificial Sequence
  chemically synthesized
gtttgttttttctctctgcaag

SEQ ID NO: 1291808 - DNA, 22 bp, Artificial Sequence
  chemically synthesized
tatattctacttgcagagagaa

SEQ ID NO: 1291809 - DNA, 22 bp, Artificial Sequence
  chemically synthesized
tattctacttgcagagagaaaa

SEQ ID NO: 1291810 - DNA, 22 bp, Artificial Sequence
  chemically synthesized
tcaacttgtttgttttttctct

SEQ ID NO: 1291811 - DNA, 22 bp, Artificial Sequence
  chemically synthesized
gtcaacttgtttgttttttctc

SEQ ID NO: 1291812 - DNA, 22 bp, Artificial Sequence
  chemically synthesized
tacttgcagagagaaaaaacaa

SEQ ID NO: 1291813 - DNA, 22 bp, Artificial Sequence
  chemically synthesized
tttgtcaacttgtttgtttttt

SEQ ID NO: 1291814 - DNA, 22 bp, Artificial Sequence
  chemically synthesized
cttgcagagagaaaaaacaaac

SEQ ID NO: 1291815 - DNA, 22 bp, Artificial Sequence
  chemically synthesized
gtttgtcaacttgtttgttttt

SEQ ID NO: 1291816 - DNA, 22 bp, Artificial Sequence
  chemically synthesized
gcagagagaaaaaacaaacaag

SEQ ID NO: 1291817 - DNA, 22 bp, Artificial Sequence
  chemically synthesized
cagagagaaaaaacaaacaagt

SEQ ID NO: 1291818 - DNA, 22 bp, Artificial Sequence
  chemically synthesized
tatttgtttgtcaacttgtttg

SEQ ID NO: 1291819 - DNA, 22 bp, Artificial Sequence
  chemically synthesized
tatatttgtttgtcaacttgtt

SEQ ID NO: 1291820 - DNA, 22 bp, Artificial Sequence
  chemically synthesized
tctatatttgtttgtcaacttg

SEQ ID NO: 1291821 - DNA, 22 bp, Artificial Sequence
  chemically synthesized
acgttctctatatttgtttgtc

SEQ ID NO: 1291822 - DNA, 22 bp, Artificial Sequence
  chemically synthesized
tctgacgttctctatatttgtt

SEQ ID NO: 1291823 - DNA, 22 bp, Artificial Sequence
  chemically synthesized
gcaaactatctgacgttctcta

SEQ ID NO: 1291824 - DNA, 22 bp, Artificial Sequence
  chemically synthesized
acaaacaaatatagagaacgtc

SEQ ID NO: 1291825 - DNA, 22 bp, Artificial Sequence
  chemically synthesized
agcaaactatctgacgttctct

SEQ ID NO: 1291826 - DNA, 22 bp, Artificial Sequence
  chemically synthesized
aaccaaagagggaaacatttag

SEQ ID NO: 1291827 - DNA, 22 bp, Artificial Sequence
  chemically synthesized
gcgagctaaaccaaagagggaa

SEQ ID NO: 1291828 - DNA, 22 bp, Artificial Sequence
  chemically synthesized
gctaaatgtttccctctttggt

SEQ ID NO: 1291829 - DNA, 22 bp, Artificial Sequence
  chemically synthesized
ctaaatgtttccctctttggtt

SEQ ID NO: 1291830 - DNA, 22 bp, Artificial Sequence
  chemically synthesized
gctagcgagctaaaccaaagag

SEQ ID NO: 1291831 - DNA, 22 bp, Artificial Sequence
  chemically synthesized
aatgtttccctctttggtttag

SEQ ID NO: 1291832 - DNA, 22 bp, Artificial Sequence
  chemically synthesized
ttagctagcgagctaaaccaaa

SEQ ID NO: 1291833 - DNA, 22 bp, Artificial Sequence
  chemically synthesized
ccctctttggtttagctcgcta

SEQ ID NO: 1291834 - DNA, 22 bp, Artificial Sequence
  chemically synthesized
cctctttggtttagctcgctag

SEQ ID NO: 1291835 - DNA, 22 bp, Artificial Sequence
  chemically synthesized
tttggtttagctcgctagctaa

SEQ ID NO: 1291836 - DNA, 22 bp, Artificial Sequence
  chemically synthesized
tggtttagctcgctagctaaca

SEQ ID NO: 1291837 - DNA, 22 bp, Artificial Sequence
  chemically synthesized
atcataaggccctgttagctag

SEQ ID NO: 1291838 - DNA, 22 bp, Artificial Sequence
  chemically synthesized
ggtttagctcgctagctaacag

SEQ ID NO: 1291839 - DNA, 22 bp, Artificial Sequence
  chemically synthesized
aatcataaggccctgttagcta

SEQ ID NO: 1291840 - DNA, 22 bp, Artificial Sequence
  chemically synthesized
gtttagctcgctagctaacagg

SEQ ID NO: 1291841 - DNA, 22 bp, Artificial Sequence
  chemically synthesized
taatcataaggccctgttagct

SEQ ID NO: 1291842 - DNA, 22 bp, Artificial Sequence
  chemically synthesized
agctcgctagctaacagggcct

SEQ ID NO: 1291843 - DNA, 22 bp, Artificial Sequence
  chemically synthesized
gctcgctagctaacagggcctt

SEQ ID NO: 1291844 - DNA, 22 bp, Artificial Sequence
  chemically synthesized
gctagctaacagggccttatga

SEQ ID NO: 1291845 - DNA, 22 bp, Artificial Sequence
  chemically synthesized
gctaacagggccttatgattaa

SEQ ID NO: 1291846 - DNA, 22 bp, Artificial Sequence
  chemically synthesized
agagatcaagtccctttaatca

SEQ ID NO: 1291847 - DNA, 22 bp, Artificial Sequence
  chemically synthesized
acagggccttatgattaaaggg

SEQ ID NO: 1291848 - DNA, 22 bp, Artificial Sequence
  chemically synthesized
atgattaaagggacttgatctc

SEQ ID NO: 1291849 - DNA, 22 bp, Artificial Sequence
  chemically synthesized
tgattaaagggacttgatctct

SEQ ID NO: 1291850 - DNA, 22 bp, Artificial Sequence
  chemically synthesized
aatataacagttaagagatcaa

SEQ ID NO: 1291851 - DNA, 22 bp, Artificial Sequence
  chemically synthesized
gaatataacagttaagagatca

SEQ ID NO: 1291852 - DNA, 22 bp, Artificial Sequence
  chemically synthesized
tgaatataacagttaagagatc

SEQ ID NO: 1291853 - DNA, 22 bp, Artificial Sequence
  chemically synthesized
aagggacttgatctcttaactg

SEQ ID NO: 1291854 - DNA, 22 bp, Artificial Sequence
  chemically synthesized
gtgttttgaatataacagttaa

SEQ ID NO: 1291855 - DNA, 22 bp, Artificial Sequence
  chemically synthesized
tagtgttttgaatataacagtt

SEQ ID NO: 1291856 - DNA, 22 bp, Artificial Sequence
  chemically synthesized
gatctcttaactgttatattca

SEQ ID NO: 1291857 - DNA, 22 bp, Artificial Sequence
  chemically synthesized
atctcttaactgttatattcaa

SEQ ID NO: 1291858 - DNA, 22 bp, Artificial Sequence
  chemically synthesized
ttaactgttatattcaaaacac

SEQ ID NO: 1291859 - DNA, 22 bp, Artificial Sequence
  chemically synthesized
aactgttatattcaaaacacta

SEQ ID NO: 1291860 - DNA, 22 bp, Artificial Sequence
  chemically synthesized
actgttatattcaaaacactag

SEQ ID NO: 1291861 - DNA, 22 bp, Artificial Sequence
  chemically synthesized
atatcaggtgctctagtgtttt

SEQ ID NO: 1291862 - DNA, 22 bp, Artificial Sequence
  chemically synthesized
catatcaggtgctctagtgttt

SEQ ID NO: 1291863 - DNA, 22 bp, Artificial Sequence
  chemically synthesized
ttatattcaaaacactagagca

SEQ ID NO: 1291864 - DNA, 22 bp, Artificial Sequence
  chemically synthesized
tttcatatcaggtgctctagtg

SEQ ID NO: 1291865 - DNA, 22 bp, Artificial Sequence
  chemically synthesized
tattcaaaacactagagcacct

SEQ ID NO: 1291866 - DNA, 22 bp, Artificial Sequence
  chemically synthesized
tctatttcatatcaggtgctct

SEQ ID NO: 1291867 - DNA, 22 bp, Artificial Sequence
  chemically synthesized
tatctatttcatatcaggtgct

SEQ ID NO: 1291868 - DNA, 22 bp, Artificial Sequence
  chemically synthesized
aaaacactagagcacctgatat

SEQ ID NO: 1291869 - DNA, 22 bp, Artificial Sequence
  chemically synthesized
tctatctatttcatatcaggtg

SEQ ID NO: 1291870 - DNA, 22 bp, Artificial Sequence
  chemically synthesized
cattctctatctatttcatatc

SEQ ID NO: 1291871 - DNA, 22 bp, Artificial Sequence
  chemically synthesized
gagcacctgatatgaaatagat

SEQ ID NO: 1291872 - DNA, 22 bp, Artificial Sequence
  chemically synthesized
atatgaaatagatagagaatgt

SEQ ID NO: 1291873 - DNA, 22 bp, Artificial Sequence
  chemically synthesized
acagaaatacacatgaagtcta

SEQ ID NO: 1291874 - DNA, 22 bp, Artificial Sequence
  chemically synthesized
gacagaaatacacatgaagtct

SEQ ID NO: 1291875 - DNA, 22 bp, Artificial Sequence
  chemically synthesized
tgacagaaatacacatgaagtc

SEQ ID NO: 1291876 - DNA, 22 bp, Artificial Sequence
  chemically synthesized
aggaaacatgctttgacagaaa

SEQ ID NO: 1291877 - DNA, 22 bp, Artificial Sequence
  chemically synthesized
aaggaaacatgctttgacagaa

SEQ ID NO: 1291878 - DNA, 22 bp, Artificial Sequence
  chemically synthesized
catgtgtatttctgtcaaagca

SEQ ID NO: 1291879 - DNA, 22 bp, Artificial Sequence
  chemically synthesized
atgtgtatttctgtcaaagcat

SEQ ID NO: 1291880 - DNA, 22 bp, Artificial Sequence
  chemically synthesized
tatttaaggaaacatgctttga

SEQ ID NO: 1291881 - DNA, 22 bp, Artificial Sequence
  chemically synthesized
atatttaaggaaacatgctttg

SEQ ID NO: 1291882 - DNA, 22 bp, Artificial Sequence
  chemically synthesized
ctgtcaaagcatgtttccttaa

SEQ ID NO: 1291883 - DNA, 22 bp, Artificial Sequence
  chemically synthesized
tgtcaaagcatgtttccttaaa

SEQ ID NO: 1291884 - DNA, 22 bp, Artificial Sequence
  chemically synthesized
caaataatttatatttaaggaa

SEQ ID NO: 1291885 - DNA, 22 bp, Artificial Sequence
  chemically synthesized
tcaaagcatgtttccttaaata

SEQ ID NO: 1291886 - DNA, 22 bp, Artificial Sequence
  chemically synthesized
acaaataatttatatttaagga

SEQ ID NO: 1291887 - DNA, 22 bp, Artificial Sequence
  chemically synthesized
tacaaataatttatatttaagg

SEQ ID NO: 1291888 - DNA, 22 bp, Artificial Sequence
  chemically synthesized
tcctttacaaataatttatatt

SEQ ID NO: 1291889 - DNA, 22 bp, Artificial Sequence
  chemically synthesized
atcctttacaaataatttatat

SEQ ID NO: 1291890 - DNA, 22 bp, Artificial Sequence
  chemically synthesized
ttatcctttacaaataatttat

SEQ ID NO: 1291891 - DNA, 22 bp, Artificial Sequence
  chemically synthesized
ccttaaatataaattatttgta

SEQ ID NO: 1291892 - DNA, 22 bp, Artificial Sequence
  chemically synthesized
cttaaatataaattatttgtaa

SEQ ID NO: 1291893 - DNA, 22 bp, Artificial Sequence
  chemically synthesized
aagttcttatcctttacaaata

SEQ ID NO: 1291894 - DNA, 22 bp, Artificial Sequence
  chemically synthesized
gaagttcttatcctttacaaat

SEQ ID NO: 1291895 - DNA, 22 bp, Artificial Sequence
  chemically synthesized
aaatataaattatttgtaaagg

SEQ ID NO: 1291896 - DNA, 22 bp, Artificial Sequence
  chemically synthesized
aatataaattatttgtaaagga

SEQ ID NO: 1291897 - DNA, 22 bp, Artificial Sequence
  chemically synthesized
tacttgaagttcttatccttta

SEQ ID NO: 1291898 - DNA, 22 bp, Artificial Sequence
  chemically synthesized
tttgtaaaggataagaacttca

SEQ ID NO: 1291899 - DNA, 22 bp, Artificial Sequence
  chemically synthesized
gtaaaggataagaacttcaagt

SEQ ID NO: 1291900 - DNA, 22 bp, Artificial Sequence
  chemically synthesized
taaaggataagaacttcaagta

SEQ ID NO: 1291901 - DNA, 22 bp, Artificial Sequence
  chemically synthesized
agtatcatatctgtacttgaag

SEQ ID NO: 1291902 - DNA, 22 bp, Artificial Sequence
  chemically synthesized
gagtatcatatctgtacttgaa

SEQ ID NO: 1291903 - DNA, 22 bp, Artificial Sequence
  chemically synthesized
tgagtatcatatctgtacttga

SEQ ID NO: 1291904 - DNA, 22 bp, Artificial Sequence
  chemically synthesized
caagtacagatatgatactcaa

SEQ ID NO: 1291905 - DNA, 22 bp, Artificial Sequence
  chemically synthesized
aagtacagatatgatactcaaa

SEQ ID NO: 1291906 - DNA, 22 bp, Artificial Sequence
  chemically synthesized
tgtcagtcagagaataaatatt

SEQ ID NO: 1291907 - DNA, 22 bp, Artificial Sequence
  chemically synthesized
ttatgtcagtcagagaataaat

SEQ ID NO: 1291908 - DNA, 22 bp, Artificial Sequence
  chemically synthesized
cagttattatgtcagtcagaga

SEQ ID NO: 1291909 - DNA, 22 bp, Artificial Sequence
  chemically synthesized
aaaatatttattctctgactga

SEQ ID NO: 1291910 - DNA, 22 bp, Artificial Sequence
  chemically synthesized
cctgcagttattatgtcagtca

SEQ ID NO: 1291911 - DNA, 22 bp, Artificial Sequence
  chemically synthesized
attctctgactgacataataac

SEQ ID NO: 1291912 - DNA, 22 bp, Artificial Sequence
  chemically synthesized
aaattacctgcagttattatgt

SEQ ID NO: 1291913 - DNA, 22 bp, Artificial Sequence
  chemically synthesized
ttctctgactgacataataact

SEQ ID NO: 1291914 - DNA, 22 bp, Artificial Sequence
  chemically synthesized
ttaaaattacctgcagttatta

SEQ ID NO: 1291915 - DNA, 22 bp, Artificial Sequence
  chemically synthesized
tctgactgacataataactgca

SEQ ID NO: 1291916 - DNA, 22 bp, Artificial Sequence
  chemically synthesized
tgactgacataataactgcagg

SEQ ID NO: 1291917 - DNA, 22 bp, Artificial Sequence
  chemically synthesized
actgacataataactgcaggta

SEQ ID NO: 1291918 - DNA, 22 bp, Artificial Sequence
  chemically synthesized
gtcctattaaaattacctgcag

SEQ ID NO: 1291919 - DNA, 22 bp, Artificial Sequence
  chemically synthesized
acataataactgcaggtaattt

SEQ ID NO: 1291920 - DNA, 22 bp, Artificial Sequence
  chemically synthesized
ataggaactagtcctattaaaa

SEQ ID NO: 1291921 - DNA, 22 bp, Artificial Sequence
  chemically synthesized
cataggaactagtcctattaaa

SEQ ID NO: 1291922 - DNA, 22 bp, Artificial Sequence
  chemically synthesized
tcataggaactagtcctattaa

SEQ ID NO: 1291923 - DNA, 22 bp, Artificial Sequence
  chemically synthesized
ttcataggaactagtcctatta

SEQ ID NO: 1291924 - DNA, 22 bp, Artificial Sequence
  chemically synthesized
caggtaattttaataggactag

SEQ ID NO: 1291925 - DNA, 22 bp, Artificial Sequence
  chemically synthesized
taataggactagttcctatgaa

SEQ ID NO: 1291926 - DNA, 22 bp, Artificial Sequence
  chemically synthesized
cggagagtacttttcataggaa

SEQ ID NO: 1291927 - DNA, 22 bp, Artificial Sequence
  chemically synthesized
aataggactagttcctatgaaa

SEQ ID NO: 1291928 - DNA, 22 bp, Artificial Sequence
  chemically synthesized
ataggactagttcctatgaaaa

SEQ ID NO: 1291929 - DNA, 22 bp, Artificial Sequence
  chemically synthesized
caaggtctacggagagtacttt

SEQ ID NO: 1291930 - DNA, 22 bp, Artificial Sequence
  chemically synthesized
gttcctatgaaaagtactctcc

SEQ ID NO: 1291931 - DNA, 22 bp, Artificial Sequence
  chemically synthesized
ctatgaaaagtactctccgtag

SEQ ID NO: 1291932 - DNA, 22 bp, Artificial Sequence
  chemically synthesized
gatctacaaggtctacggagag

SEQ ID NO: 1291933 - DNA, 22 bp, Artificial Sequence
  chemically synthesized
cgatctacaaggtctacggaga

SEQ ID NO: 1291934 - DNA, 22 bp, Artificial Sequence
  chemically synthesized
tgaaaagtactctccgtagacc

SEQ ID NO: 1291935 - DNA, 22 bp, Artificial Sequence
  chemically synthesized
tccgtagaccttgtagatcgaa

SEQ ID NO: 1291936 - DNA, 22 bp, Artificial Sequence
  chemically synthesized
cgtagaccttgtagatcgaaga

SEQ ID NO: 1291937 - DNA, 22 bp, Artificial Sequence
  chemically synthesized
aagaaaaaaaaatgtcttcgat

SEQ ID NO: 1291938 - DNA, 22 bp, Artificial Sequence
  chemically synthesized
gcctgaagaaaaaaaaatgtct

SEQ ID NO: 1291939 - DNA, 22 bp, Artificial Sequence
  chemically synthesized
gtagatcgaagacatttttttt

SEQ ID NO: 1291940 - DNA, 22 bp, Artificial Sequence
  chemically synthesized
tagatcgaagacattttttttt

SEQ ID NO: 1291941 - DNA, 22 bp, Artificial Sequence
  chemically synthesized
cctggcctgaagaaaaaaaaat

SEQ ID NO: 1291942 - DNA, 22 bp, Artificial Sequence
  chemically synthesized
acctggcctgaagaaaaaaaaa

SEQ ID NO: 1291943 - DNA, 22 bp, Artificial Sequence
  chemically synthesized
gtttacctggcctgaagaaaaa

SEQ ID NO: 1291944 - DNA, 22 bp, Artificial Sequence
  chemically synthesized
agtttacctggcctgaagaaaa

SEQ ID NO: 1291945 - DNA, 22 bp, Artificial Sequence
  chemically synthesized
atttagtttacctggcctgaag

SEQ ID NO: 1291946 - DNA, 22 bp, Artificial Sequence
  chemically synthesized
gatttagtttacctggcctgaa

SEQ ID NO: 1291947 - DNA, 22 bp, Artificial Sequence
  chemically synthesized
tgatttagtttacctggcctga

SEQ ID NO: 1291948 - DNA, 22 bp, Artificial Sequence
  chemically synthesized
tttgatttagtttacctggcct

SEQ ID NO: 1291949 - DNA, 22 bp, Artificial Sequence
  chemically synthesized
ctttgatttagtttacctggcc

SEQ ID NO: 1291950 - DNA, 22 bp, Artificial Sequence
  chemically synthesized
ttttttcttcaggccaggtaaa

SEQ ID NO: 1291951 - DNA, 22 bp, Artificial Sequence
  chemically synthesized
tctttgatttagtttacctggc

SEQ ID NO: 1291952 - DNA, 22 bp, Artificial Sequence
  chemically synthesized
tttttcttcaggccaggtaaac

SEQ ID NO: 1291953 - DNA, 22 bp, Artificial Sequence
  chemically synthesized
ttttcttcaggccaggtaaact

SEQ ID NO: 1291954 - DNA, 22 bp, Artificial Sequence
  chemically synthesized
tttctttgatttagtttacctg

SEQ ID NO: 1291955 - DNA, 22 bp, Artificial Sequence
  chemically synthesized
tttcttcaggccaggtaaacta

SEQ ID NO: 1291956 - DNA, 22 bp, Artificial Sequence
  chemically synthesized
ctttctttgatttagtttacct

SEQ ID NO: 1291957 - DNA, 22 bp, Artificial Sequence
  chemically synthesized
ttcttcaggccaggtaaactaa

SEQ ID NO: 1291958 - DNA, 22 bp, Artificial Sequence
  chemically synthesized
tcttcaggccaggtaaactaaa

SEQ ID NO: 1291959 - DNA, 22 bp, Artificial Sequence
  chemically synthesized
cttcaggccaggtaaactaaat

SEQ ID NO: 1291960 - DNA, 22 bp, Artificial Sequence
  chemically synthesized
ttcaggccaggtaaactaaatc

SEQ ID NO: 1291961 - DNA, 22 bp, Artificial Sequence
  chemically synthesized
caggccaggtaaactaaatcaa

SEQ ID NO: 1291962 - DNA, 22 bp, Artificial Sequence
  chemically synthesized
aggccaggtaaactaaatcaaa

SEQ ID NO: 1291963 - DNA, 22 bp, Artificial Sequence
  chemically synthesized
aatgtttctttctttgatttag

SEQ ID NO: 1291964 - DNA, 22 bp, Artificial Sequence
  chemically synthesized
ctaaatgtttctttctttgatt

SEQ ID NO: 1291965 - DNA, 22 bp, Artificial Sequence
  chemically synthesized
gctaaatgtttctttctttgat

SEQ ID NO: 1291966 - DNA, 22 bp, Artificial Sequence
  chemically synthesized
aatcaaagaaagaaacatttag

SEQ ID NO: 1291967 - DNA, 22 bp, Artificial Sequence
  chemically synthesized
cagatgaatttgctaaatgttt

SEQ ID NO: 1291968 - DNA, 22 bp, Artificial Sequence
  chemically synthesized
agcaaattcatctgcaactctc

SEQ ID NO: 1291969 - DNA, 22 bp, Artificial Sequence
  chemically synthesized
atgagaacaaatgagagttgca

SEQ ID NO: 1291970 - DNA, 22 bp, Artificial Sequence
  chemically synthesized
gcaaattcatctgcaactctca

SEQ ID NO: 1291971 - DNA, 22 bp, Artificial Sequence
  chemically synthesized
aatgagaacaaatgagagttgc

SEQ ID NO: 1291972 - DNA, 22 bp, Artificial Sequence
  chemically synthesized
taatgagaacaaatgagagttg

SEQ ID NO: 1291973 - DNA, 22 bp, Artificial Sequence
  chemically synthesized
ttaatgagaacaaatgagagtt

SEQ ID NO: 1291974 - DNA, 22 bp, Artificial Sequence
  chemically synthesized
tcttttaatgagaacaaatgag

SEQ ID NO: 1291975 - DNA, 22 bp, Artificial Sequence
  chemically synthesized
atctgcaactctcatttgttct

SEQ ID NO: 1291976 - DNA, 22 bp, Artificial Sequence
  chemically synthesized
gctgtcttttaatgagaacaaa

SEQ ID NO: 1291977 - DNA, 22 bp, Artificial Sequence
  chemically synthesized
caactctcatttgttctcatta

SEQ ID NO: 1291978 - DNA, 22 bp, Artificial Sequence
  chemically synthesized
gcattagctgtcttttaatgag

SEQ ID NO: 1291979 - DNA, 22 bp, Artificial Sequence
  chemically synthesized
agcattagctgtcttttaatga

SEQ ID NO: 1291980 - DNA, 22 bp, Artificial Sequence
  chemically synthesized
tcatttgttctcattaaaagac

SEQ ID NO: 1291981 - DNA, 22 bp, Artificial Sequence
  chemically synthesized
atttgttctcattaaaagacag

SEQ ID NO: 1291982 - DNA, 22 bp, Artificial Sequence
  chemically synthesized
gtttagcattagctgtctttta

SEQ ID NO: 1291983 - DNA, 22 bp, Artificial Sequence
  chemically synthesized
ggtttagcattagctgtctttt

SEQ ID NO: 1291984 - DNA, 22 bp, Artificial Sequence
  chemically synthesized
tggtttagcattagctgtcttt

SEQ ID NO: 1291985 - DNA, 22 bp, Artificial Sequence
  chemically synthesized
gttctcattaaaagacagctaa

SEQ ID NO: 1291986 - DNA, 22 bp, Artificial Sequence
  chemically synthesized
tttggtttagcattagctgtct

SEQ ID NO: 1291987 - DNA, 22 bp, Artificial Sequence
  chemically synthesized
ttctcattaaaagacagctaat

SEQ ID NO: 1291988 - DNA, 22 bp, Artificial Sequence
  chemically synthesized
ctctttggtttagcattagctg

SEQ ID NO: 1291989 - DNA, 22 bp, Artificial Sequence
  chemically synthesized
tcattaaaagacagctaatgct

SEQ ID NO: 1291990 - DNA, 22 bp, Artificial Sequence
  chemically synthesized
attaaaagacagctaatgctaa

SEQ ID NO: 1291991 - DNA, 22 bp, Artificial Sequence
  chemically synthesized
aaagacagctaatgctaaacca

SEQ ID NO: 1291992 - DNA, 22 bp, Artificial Sequence
  chemically synthesized
gaaatgtgtgaagttactcttt

SEQ ID NO: 1291993 - DNA, 22 bp, Artificial Sequence
  chemically synthesized
atgctaaaccaaagagtaactt

SEQ ID NO: 1291994 - DNA, 22 bp, Artificial Sequence
  chemically synthesized
attagaaatgtgtgaagttact

SEQ ID NO: 1291995 - DNA, 22 bp, Artificial Sequence
  chemically synthesized
cattagaaatgtgtgaagttac

SEQ ID NO: 1291996 - DNA, 22 bp, Artificial Sequence
  chemically synthesized
tcattagaaatgtgtgaagtta

SEQ ID NO: 1291997 - DNA, 22 bp, Artificial Sequence
  chemically synthesized
ttcattagaaatgtgtgaagtt

SEQ ID NO: 1291998 - DNA, 22 bp, Artificial Sequence
  chemically synthesized
aaccaaagagtaacttcacaca

SEQ ID NO: 1291999 - DNA, 22 bp, Artificial Sequence
  chemically synthesized
agagaccttttcattagaaatg

SEQ ID NO: 1292000 - DNA, 22 bp, Artificial Sequence
  chemically synthesized
cacacatttctaatgaaaaggt

SEQ ID NO: 1292001 - DNA, 22 bp, Artificial Sequence
  chemically synthesized
acacatttctaatgaaaaggtc

SEQ ID NO: 1292002 - DNA, 22 bp, Artificial Sequence
  chemically synthesized
ctaatgaaaaggtctcttagtt

SEQ ID NO: 1292003 - DNA, 22 bp, Artificial Sequence
  chemically synthesized
taatgaaaaggtctcttagttt

SEQ ID NO: 1292004 - DNA, 22 bp, Artificial Sequence
  chemically synthesized
atgaaaaggtctcttagtttgc

SEQ ID NO: 1292005 - DNA, 22 bp, Artificial Sequence
  chemically synthesized
tggccaggtgatgagtgcaaac

SEQ ID NO: 1292006 - DNA, 22 bp, Artificial Sequence
  chemically synthesized
ttagtttgcactcatcacctgg

SEQ ID NO: 1292007 - DNA, 22 bp, Artificial Sequence
  chemically synthesized
tccagaattgtggccaggtgat

SEQ ID NO: 1292008 - DNA, 22 bp, Artificial Sequence
  chemically synthesized
agtttgcactcatcacctggcc

SEQ ID NO: 1292009 - DNA, 22 bp, Artificial Sequence
  chemically synthesized
gtccagaattgtggccaggtga

SEQ ID NO: 1292010 - DNA, 22 bp, Artificial Sequence
  chemically synthesized
gtttgcactcatcacctggcca

SEQ ID NO: 1292011 - DNA, 22 bp, Artificial Sequence
  chemically synthesized
gcactcatcacctggccacaat

SEQ ID NO: 1292012 - DNA, 22 bp, Artificial Sequence
  chemically synthesized
cactcatcacctggccacaatt

SEQ ID NO: 1292013 - DNA, 22 bp, Artificial Sequence
  chemically synthesized
ggtcttgtccagaattgtggcc

SEQ ID NO: 1292014 - DNA, 22 bp, Artificial Sequence
  chemically synthesized
cggtcttgtccagaattgtggc

SEQ ID NO: 1292015 - DNA, 22 bp, Artificial Sequence
  chemically synthesized
tcggtcttgtccagaattgtgg

SEQ ID NO: 1292016 - DNA, 22 bp, Artificial Sequence
  chemically synthesized
atcacctggccacaattctgga

SEQ ID NO: 1292017 - DNA, 22 bp, Artificial Sequence
  chemically synthesized
gccacaattctggacaagaccg

SEQ ID NO: 1292018 - DNA, 22 bp, Artificial Sequence
  chemically synthesized
tggacaagaccgaaagtgatca

SEQ ID NO: 1292019 - DNA, 22 bp, Artificial Sequence
  chemically synthesized
gacaagaccgaaagtgatcact

SEQ ID NO: 1292020 - DNA, 22 bp, Artificial Sequence
  chemically synthesized
gtttattgatcactttttgtcc

SEQ ID NO: 1292021 - DNA, 22 bp, Artificial Sequence
  chemically synthesized
tttattgatcactttttgtcca

SEQ ID NO: 1292022 - DNA, 22 bp, Artificial Sequence
  chemically synthesized
attgatcactttttgtccattt

SEQ ID NO: 1292023 - DNA, 22 bp, Artificial Sequence
  chemically synthesized
ttgatcactttttgtccatttt

SEQ ID NO: 1292024 - DNA, 22 bp, Artificial Sequence
  chemically synthesized
atcactttttgtccatttttac

SEQ ID NO: 1292025 - DNA, 22 bp, Artificial Sequence
  chemically synthesized
tttgtccatttttactattact

SEQ ID NO: 1292026 - DNA, 22 bp, Artificial Sequence
  chemically synthesized
tatgcagagataagtaatagta

SEQ ID NO: 1292027 - DNA, 22 bp, Artificial Sequence
  chemically synthesized
ttgtccatttttactattactt

SEQ ID NO: 1292028 - DNA, 22 bp, Artificial Sequence
  chemically synthesized
tgtccatttttactattactta

SEQ ID NO: 1292029 - DNA, 22 bp, Artificial Sequence
  chemically synthesized
tatatgcagagataagtaatag

SEQ ID NO: 1292030 - DNA, 22 bp, Artificial Sequence
  chemically synthesized
gtccatttttactattacttat

SEQ ID NO: 1292031 - DNA, 22 bp, Artificial Sequence
  chemically synthesized
tccatttttactattacttatc

SEQ ID NO: 1292032 - DNA, 22 bp, Artificial Sequence
  chemically synthesized
ttactattacttatctctgcat

SEQ ID NO: 1292033 - DNA, 22 bp, Artificial Sequence
  chemically synthesized
tgccagttctatatgcagagat

SEQ ID NO: 1292034 - DNA, 22 bp, Artificial Sequence
  chemically synthesized
tactattacttatctctgcata

SEQ ID NO: 1292035 - DNA, 22 bp, Artificial Sequence
  chemically synthesized
actattacttatctctgcatat

SEQ ID NO: 1292036 - DNA, 22 bp, Artificial Sequence
  chemically synthesized
ctattacttatctctgcatata

SEQ ID NO: 1292037 - DNA, 22 bp, Artificial Sequence
  chemically synthesized
actatgccagttctatatgcag

SEQ ID NO: 1292038 - DNA, 22 bp, Artificial Sequence
  chemically synthesized
cactatgccagttctatatgca

SEQ ID NO: 1292039 - DNA, 22 bp, Artificial Sequence
  chemically synthesized
ttacttatctctgcatatagaa

SEQ ID NO: 1292040 - DNA, 22 bp, Artificial Sequence
  chemically synthesized
cttatctctgcatatagaactg

SEQ ID NO: 1292041 - DNA, 22 bp, Artificial Sequence
  chemically synthesized
atttcactatgccagttctata

SEQ ID NO: 1292042 - DNA, 22 bp, Artificial Sequence
  chemically synthesized
atctctgcatatagaactggca

SEQ ID NO: 1292043 - DNA, 22 bp, Artificial Sequence
  chemically synthesized
tctctgcatatagaactggcat

SEQ ID NO: 1292044 - DNA, 22 bp, Artificial Sequence
  chemically synthesized
gctaatttcactatgccagttc

SEQ ID NO: 1292045 - DNA, 22 bp, Artificial Sequence
  chemically synthesized
agctaatttcactatgccagtt

SEQ ID NO: 1292046 - DNA, 22 bp, Artificial Sequence
  chemically synthesized
tgcatatagaactggcatagtg

SEQ ID NO: 1292047 - DNA, 22 bp, Artificial Sequence
  chemically synthesized
atttagctaatttcactatgcc

SEQ ID NO: 1292048 - DNA, 22 bp, Artificial Sequence
  chemically synthesized
catatagaactggcatagtgaa

SEQ ID NO: 1292049 - DNA, 22 bp, Artificial Sequence
  chemically synthesized
tatcctaatttagctaatttca

SEQ ID NO: 1292050 - DNA, 22 bp, Artificial Sequence
  chemically synthesized
gtatcctaatttagctaatttc

SEQ ID NO: 1292051 - DNA, 22 bp, Artificial Sequence
  chemically synthesized
tttgtatcctaatttagctaat

SEQ ID NO: 1292052 - DNA, 22 bp, Artificial Sequence
  chemically synthesized
atttgtatcctaatttagctaa

SEQ ID NO: 1292053 - DNA, 22 bp, Artificial Sequence
  chemically synthesized
gcatagtgaaattagctaaatt

SEQ ID NO: 1292054 - DNA, 22 bp, Artificial Sequence
  chemically synthesized
cttatttgtatcctaatttagc

SEQ ID NO: 1292055 - DNA, 22 bp, Artificial Sequence
  chemically synthesized
gcttatttgtatcctaatttag

SEQ ID NO: 1292056 - DNA, 22 bp, Artificial Sequence
  chemically synthesized
tgcttatttgtatcctaattta

SEQ ID NO: 1292057 - DNA, 22 bp, Artificial Sequence
  chemically synthesized
aaagggctttgcttatttgtat

SEQ ID NO: 1292058 - DNA, 22 bp, Artificial Sequence
  chemically synthesized
gctaaattaggatacaaataag

SEQ ID NO: 1292059 - DNA, 22 bp, Artificial Sequence
  chemically synthesized
aaaagggctttgcttatttgta

SEQ ID NO: 1292060 - DNA, 22 bp, Artificial Sequence
  chemically synthesized
taaaagggctttgcttatttgt

SEQ ID NO: 1292061 - DNA, 22 bp, Artificial Sequence
  chemically synthesized
ttaaaagggctttgcttatttg

SEQ ID NO: 1292062 - DNA, 22 bp, Artificial Sequence
  chemically synthesized
aattaggatacaaataagcaaa

SEQ ID NO: 1292063 - DNA, 22 bp, Artificial Sequence
  chemically synthesized
ggatacaaataagcaaagccct

SEQ ID NO: 1292064 - DNA, 22 bp, Artificial Sequence
  chemically synthesized
gaacataaaaggcagagtatgg

SEQ ID NO: 1292065 - DNA, 22 bp, Artificial Sequence
  chemically synthesized
ggaacataaaaggcagagtatg

SEQ ID NO: 1292066 - DNA, 22 bp, Artificial Sequence
  chemically synthesized
ttaaaaaccatactctgccttt

SEQ ID NO: 1292067 - DNA, 22 bp, Artificial Sequence
  chemically synthesized
taaaaaccatactctgcctttt

SEQ ID NO: 1292068 - DNA, 22 bp, Artificial Sequence
  chemically synthesized
aaaaaccatactctgcctttta

SEQ ID NO: 1292069 - DNA, 22 bp, Artificial Sequence
  chemically synthesized
aaaaccatactctgccttttat

SEQ ID NO: 1292070 - DNA, 22 bp, Artificial Sequence
  chemically synthesized
tatgtatcttggaacataaaag

SEQ ID NO: 1292071 - DNA, 22 bp, Artificial Sequence
  chemically synthesized
gtatgtatcttggaacataaaa

SEQ ID NO: 1292072 - DNA, 22 bp, Artificial Sequence
  chemically synthesized
tgccttttatgttccaagatac

SEQ ID NO: 1292073 - DNA, 22 bp, Artificial Sequence
  chemically synthesized
ccttttatgttccaagatacat

SEQ ID NO: 1292074 - DNA, 22 bp, Artificial Sequence
  chemically synthesized
ttatgttccaagatacatacaa

SEQ ID NO: 1292075 - DNA, 22 bp, Artificial Sequence
  chemically synthesized
tatgttccaagatacatacaag

SEQ ID NO: 1292076 - DNA, 22 bp, Artificial Sequence
  chemically synthesized
atgttccaagatacatacaagt

SEQ ID NO: 1292077 - DNA, 22 bp, Artificial Sequence
  chemically synthesized
tgttccaagatacatacaagtc

SEQ ID NO: 1292078 - DNA, 22 bp, Artificial Sequence
  chemically synthesized
caagatacatacaagtctgccc

SEQ ID NO: 1292079 - DNA, 22 bp, Artificial Sequence
  chemically synthesized
taatgcacatggagggcagact

SEQ ID NO: 1292080 - DNA, 22 bp, Artificial Sequence
  chemically synthesized
gtaatgcacatggagggcagac

SEQ ID NO: 1292081 - DNA, 22 bp, Artificial Sequence
  chemically synthesized
ttgtaatgcacatggagggcag

SEQ ID NO: 1292082 - DNA, 22 bp, Artificial Sequence
  chemically synthesized
cttgtaatgcacatggagggca

SEQ ID NO: 1292083 - DNA, 22 bp, Artificial Sequence
  chemically synthesized
tcttgtaatgcacatggagggc

SEQ ID NO: 1292084 - DNA, 22 bp, Artificial Sequence
  chemically synthesized
tagaaacctttcttgtaatgca

SEQ ID NO: 1292085 - DNA, 22 bp, Artificial Sequence
  chemically synthesized
ccctccatgtgcattacaagaa

SEQ ID NO: 1292086 - DNA, 22 bp, Artificial Sequence
  chemically synthesized
actgtagaaacctttcttgtaa

SEQ ID NO: 1292087 - DNA, 22 bp, Artificial Sequence
  chemically synthesized
aactgtagaaacctttcttgta

SEQ ID NO: 1292088 - DNA, 22 bp, Artificial Sequence
  chemically synthesized
taactgtagaaacctttcttgt

SEQ ID NO: 1292089 - DNA, 22 bp, Artificial Sequence
  chemically synthesized
catgtgcattacaagaaaggtt

SEQ ID NO: 1292090 - DNA, 22 bp, Artificial Sequence
  chemically synthesized
atataactttaactgtagaaac

SEQ ID NO: 1292091 - DNA, 22 bp, Artificial Sequence
  chemically synthesized
caagaaaggtttctacagttaa

SEQ ID NO: 1292092 - DNA, 22 bp, Artificial Sequence
  chemically synthesized
acagtaatgtactgatataact

SEQ ID NO: 1292093 - DNA, 22 bp, Artificial Sequence
  chemically synthesized
ctacagttaaagttatatcagt

SEQ ID NO: 1292094 - DNA, 22 bp, Artificial Sequence
  chemically synthesized
tgacagtaatgtactgatataa

SEQ ID NO: 1292095 - DNA, 22 bp, Artificial Sequence
  chemically synthesized
tacagttaaagttatatcagta

SEQ ID NO: 1292096 - DNA, 22 bp, Artificial Sequence
  chemically synthesized
cagttaaagttatatcagtaca

SEQ ID NO: 1292097 - DNA, 22 bp, Artificial Sequence
  chemically synthesized
ctctgacagtaatgtactgata

SEQ ID NO: 1292098 - DNA, 22 bp, Artificial Sequence
  chemically synthesized
aagttatatcagtacattactg

SEQ ID NO: 1292099 - DNA, 22 bp, Artificial Sequence
  chemically synthesized
agatctactctgacagtaatgt

SEQ ID NO: 1292100 - DNA, 22 bp, Artificial Sequence
  chemically synthesized
tatcagtacattactgtcagag

SEQ ID NO: 1292101 - DNA, 22 bp, Artificial Sequence
  chemically synthesized
ctgtcagagtagatcttaattc

SEQ ID NO: 1292102 - DNA, 22 bp, Artificial Sequence
  chemically synthesized
tcagagtagatcttaattcttt

SEQ ID NO: 1292103 - DNA, 22 bp, Artificial Sequence
  chemically synthesized
tgatcatggtagccagaacaca

SEQ ID NO: 1292104 - DNA, 22 bp, Artificial Sequence
  chemically synthesized
aattctttgtgttctggctacc

SEQ ID NO: 1292105 - DNA, 22 bp, Artificial Sequence
  chemically synthesized
attctttgtgttctggctacca

SEQ ID NO: 1292106 - DNA, 22 bp, Artificial Sequence
  chemically synthesized
aaattatgatcatggtagccag

SEQ ID NO: 1292107 - DNA, 22 bp, Artificial Sequence
  chemically synthesized
caaattatgatcatggtagcca

SEQ ID NO: 1292108 - DNA, 22 bp, Artificial Sequence
  chemically synthesized
tttgtgttctggctaccatgat

SEQ ID NO: 1292109 - DNA, 22 bp, Artificial Sequence
  chemically synthesized
tgtgttctggctaccatgatca

SEQ ID NO: 1292110 - DNA, 22 bp, Artificial Sequence
  chemically synthesized
tatttcaaattatgatcatggt

SEQ ID NO: 1292111 - DNA, 22 bp, Artificial Sequence
  chemically synthesized
gtgttctggctaccatgatcat

SEQ ID NO: 1292112 - DNA, 22 bp, Artificial Sequence
  chemically synthesized
tgttctggctaccatgatcata

SEQ ID NO: 1292113 - DNA, 22 bp, Artificial Sequence
  chemically synthesized
gaattatatttcaaattatgat

SEQ ID NO: 1292114 - DNA, 22 bp, Artificial Sequence
  chemically synthesized
tggctaccatgatcataatttg

SEQ ID NO: 1292115 - DNA, 22 bp, Artificial Sequence
  chemically synthesized
gctaccatgatcataatttgaa

SEQ ID NO: 1292116 - DNA, 22 bp, Artificial Sequence
  chemically synthesized
ctagaattatatttcaaattat

SEQ ID NO: 1292117 - DNA, 22 bp, Artificial Sequence
  chemically synthesized
ccatgatcataatttgaaatat

SEQ ID NO: 1292118 - DNA, 22 bp, Artificial Sequence
  chemically synthesized
tggattcctagaattatatttc

SEQ ID NO: 1292119 - DNA, 22 bp, Artificial Sequence
  chemically synthesized
ctatggattcctagaattatat

SEQ ID NO: 1292120 - DNA, 22 bp, Artificial Sequence
  chemically synthesized
gaaatataattctaggaatcca

SEQ ID NO: 1292121 - DNA, 22 bp, Artificial Sequence
  chemically synthesized
ccaagattcctatggattccta

SEQ ID NO: 1292122 - DNA, 22 bp, Artificial Sequence
  chemically synthesized
aaatataattctaggaatccat

SEQ ID NO: 1292123 - DNA, 22 bp, Artificial Sequence
  chemically synthesized
accaagattcctatggattcct

SEQ ID NO: 1292124 - DNA, 22 bp, Artificial Sequence
  chemically synthesized
accttaccaagattcctatgga

SEQ ID NO: 1292125 - DNA, 22 bp, Artificial Sequence
  chemically synthesized
aaccttaccaagattcctatgg

SEQ ID NO: 1292126 - DNA, 22 bp, Artificial Sequence
  chemically synthesized
taaccttaccaagattcctatg

SEQ ID NO: 1292127 - DNA, 22 bp, Artificial Sequence
  chemically synthesized
ttaaccttaccaagattcctat

SEQ ID NO: 1292128 - DNA, 22 bp, Artificial Sequence
  chemically synthesized
taggaatccataggaatcttgg

SEQ ID NO: 1292129 - DNA, 22 bp, Artificial Sequence
  chemically synthesized
ggaatccataggaatcttggta

SEQ ID NO: 1292130 - DNA, 22 bp, Artificial Sequence
  chemically synthesized
catttttaaccttaccaagatt

SEQ ID NO: 1292131 - DNA, 22 bp, Artificial Sequence
  chemically synthesized
agggtgttgcatttttaacctt

SEQ ID NO: 1292132 - DNA, 22 bp, Artificial Sequence
  chemically synthesized
aagggtgttgcatttttaacct

SEQ ID NO: 1292133 - DNA, 22 bp, Artificial Sequence
  chemically synthesized
acttaagggtgttgcattttta

SEQ ID NO: 1292134 - DNA, 22 bp, Artificial Sequence
  chemically synthesized
cacttaagggtgttgcattttt

SEQ ID NO: 1292135 - DNA, 22 bp, Artificial Sequence
  chemically synthesized
ggtaaggttaaaaatgcaacac

SEQ ID NO: 1292136 - DNA, 22 bp, Artificial Sequence
  chemically synthesized
gtaaggttaaaaatgcaacacc

SEQ ID NO: 1292137 - DNA, 22 bp, Artificial Sequence
  chemically synthesized
tgcttcacttaagggtgttgca

SEQ ID NO: 1292138 - DNA, 22 bp, Artificial Sequence
  chemically synthesized
tgtgcttcacttaagggtgttg

SEQ ID NO: 1292139 - DNA, 22 bp, Artificial Sequence
  chemically synthesized
ctctgtgcttcacttaagggtg

SEQ ID NO: 1292140 - DNA, 22 bp, Artificial Sequence
  chemically synthesized
cctctgtgcttcacttaagggt

SEQ ID NO: 1292141 - DNA, 22 bp, Artificial Sequence
  chemically synthesized
aaaatgcaacacccttaagtga

SEQ ID NO: 1292142 - DNA, 22 bp, Artificial Sequence
  chemically synthesized
aaggtcttcctctgtgcttcac

SEQ ID NO: 1292143 - DNA, 22 bp, Artificial Sequence
  chemically synthesized
tgaaggtcttcctctgtgcttc

SEQ ID NO: 1292144 - DNA, 22 bp, Artificial Sequence
  chemically synthesized
aagtgaagcacagaggaagacc

SEQ ID NO: 1292145 - DNA, 22 bp, Artificial Sequence
  chemically synthesized
agtgaagcacagaggaagacct

SEQ ID NO: 1292146 - DNA, 22 bp, Artificial Sequence
  chemically synthesized
gtgacactctgaaggtcttcct

SEQ ID NO: 1292147 - DNA, 22 bp, Artificial Sequence
  chemically synthesized
agtgacactctgaaggtcttcc

SEQ ID NO: 1292148 - DNA, 22 bp, Artificial Sequence
  chemically synthesized
tagtgacactctgaaggtcttc

SEQ ID NO: 1292149 - DNA, 22 bp, Artificial Sequence
  chemically synthesized
attttagtgacactctgaaggt

SEQ ID NO: 1292150 - DNA, 22 bp, Artificial Sequence
  chemically synthesized
cattttagtgacactctgaagg

SEQ ID NO: 1292151 - DNA, 22 bp, Artificial Sequence
  chemically synthesized
agcagaaggatttcattttagt

SEQ ID NO: 1292152 - DNA, 22 bp, Artificial Sequence
  chemically synthesized
cagcagaaggatttcattttag

SEQ ID NO: 1292153 - DNA, 22 bp, Artificial Sequence
  chemically synthesized
cagagtgtcactaaaatgaaat

SEQ ID NO: 1292154 - DNA, 22 bp, Artificial Sequence
  chemically synthesized
agagtgtcactaaaatgaaatc

SEQ ID NO: 1292155 - DNA, 22 bp, Artificial Sequence
  chemically synthesized
cttcagcagaaggatttcattt

SEQ ID NO: 1292156 - DNA, 22 bp, Artificial Sequence
  chemically synthesized
gcttcagcagaaggatttcatt

SEQ ID NO: 1292157 - DNA, 22 bp, Artificial Sequence
  chemically synthesized
tgcttcagcagaaggatttcat

SEQ ID NO: 1292158 - DNA, 22 bp, Artificial Sequence
  chemically synthesized
ctttgcttcagcagaaggattt

SEQ ID NO: 1292159 - DNA, 22 bp, Artificial Sequence
  chemically synthesized
actttgcttcagcagaaggatt

SEQ ID NO: 1292160 - DNA, 22 bp, Artificial Sequence
  chemically synthesized
tactttgcttcagcagaaggat

SEQ ID NO: 1292161 - DNA, 22 bp, Artificial Sequence
  chemically synthesized
aaatgaaatccttctgctgaag

SEQ ID NO: 1292162 - DNA, 22 bp, Artificial Sequence
  chemically synthesized
tgctttactttgcttcagcaga

SEQ ID NO: 1292163 - DNA, 22 bp, Artificial Sequence
  chemically synthesized
gtgctttactttgcttcagcag

SEQ ID NO: 1292164 - DNA, 22 bp, Artificial Sequence
  chemically synthesized
tgtgctttactttgcttcagca

SEQ ID NO: 1292165 - DNA, 22 bp, Artificial Sequence
  chemically synthesized
ttgtgctttactttgcttcagc

SEQ ID NO: 1292166 - DNA, 22 bp, Artificial Sequence
  chemically synthesized
ttttgtgctttactttgcttca

SEQ ID NO: 1292167 - DNA, 22 bp, Artificial Sequence
  chemically synthesized
tcttttgtgctttactttgctt

SEQ ID NO: 1292168 - DNA, 22 bp, Artificial Sequence
  chemically synthesized
ctgctgaagcaaagtaaagcac

SEQ ID NO: 1292169 - DNA, 22 bp, Artificial Sequence
  chemically synthesized
aatctctcttttgtgctttact

SEQ ID NO: 1292170 - DNA, 22 bp, Artificial Sequence
  chemically synthesized
tgctgaagcaaagtaaagcaca

SEQ ID NO: 1292171 - DNA, 22 bp, Artificial Sequence
  chemically synthesized
caatctctcttttgtgctttac

SEQ ID NO: 1292172 - DNA, 22 bp, Artificial Sequence
  chemically synthesized
tcaatctctcttttgtgcttta

SEQ ID NO: 1292173 - DNA, 22 bp, Artificial Sequence
  chemically synthesized
ctgaagcaaagtaaagcacaaa

SEQ ID NO: 1292174 - DNA, 22 bp, Artificial Sequence
  chemically synthesized
aagcaaagtaaagcacaaaaga

SEQ ID NO: 1292175 - DNA, 22 bp, Artificial Sequence
  chemically synthesized
cagagtctttcaatctctcttt

SEQ ID NO: 1292176 - DNA, 22 bp, Artificial Sequence
  chemically synthesized
acctacagagtctttcaatctc

SEQ ID NO: 1292177 - DNA, 22 bp, Artificial Sequence
  chemically synthesized
caattgacctacagagtctttc

SEQ ID NO: 1292178 - DNA, 22 bp, Artificial Sequence
  chemically synthesized
ccaattgacctacagagtcttt

SEQ ID NO: 1292179 - DNA, 22 bp, Artificial Sequence
  chemically synthesized
aaagactctgtaggtcaattgg

SEQ ID NO: 1292180 - DNA, 22 bp, Artificial Sequence
  chemically synthesized
agaataaaacatttccaattga

SEQ ID NO: 1292181 - DNA, 22 bp, Artificial Sequence
  chemically synthesized
aagaataaaacatttccaattg

SEQ ID NO: 1292182 - DNA, 22 bp, Artificial Sequence
  chemically synthesized
ttaagaataaaacatttccaat

SEQ ID NO: 1292183 - DNA, 22 bp, Artificial Sequence
  chemically synthesized
cttaagaataaaacatttccaa

SEQ ID NO: 1292184 - DNA, 22 bp, Artificial Sequence
  chemically synthesized
tcttaagaataaaacatttcca

SEQ ID NO: 1292185 - DNA, 22 bp, Artificial Sequence
  chemically synthesized
tgtaggtcaattggaaatgttt

SEQ ID NO: 1292186 - DNA, 22 bp, Artificial Sequence
  chemically synthesized
ttcttaagaataaaacatttcc

SEQ ID NO: 1292187 - DNA, 22 bp, Artificial Sequence
  chemically synthesized
taggtcaattggaaatgtttta

SEQ ID NO: 1292188 - DNA, 22 bp, Artificial Sequence
  chemically synthesized
tatatttttcttaagaataaaa

SEQ ID NO: 1292189 - DNA, 22 bp, Artificial Sequence
  chemically synthesized
ctatatatttttcttaagaata

SEQ ID NO: 1292190 - DNA, 22 bp, Artificial Sequence
  chemically synthesized
gaaatgttttattcttaagaaa

SEQ ID NO: 1292191 - DNA, 22 bp, Artificial Sequence
  chemically synthesized
atgggctactatatatttttct

SEQ ID NO: 1292192 - DNA, 22 bp, Artificial Sequence
  chemically synthesized
catgggctactatatatttttc

SEQ ID NO: 1292193 - DNA, 22 bp, Artificial Sequence
  chemically synthesized
tcatgggctactatatattttt

SEQ ID NO: 1292194 - DNA, 22 bp, Artificial Sequence
  chemically synthesized
tattcttaagaaaaatatatag

SEQ ID NO: 1292195 - DNA, 22 bp, Artificial Sequence
  chemically synthesized
attcttaagaaaaatatatagt

SEQ ID NO: 1292196 - DNA, 22 bp, Artificial Sequence
  chemically synthesized
ttcttaagaaaaatatatagta

SEQ ID NO: 1292197 - DNA, 22 bp, Artificial Sequence
  chemically synthesized
ttaagaaaaatatatagtagcc

SEQ ID NO: 1292198 - DNA, 22 bp, Artificial Sequence
  chemically synthesized
caatcctttcatgggctactat

SEQ ID NO: 1292199 - DNA, 22 bp, Artificial Sequence
  chemically synthesized
aagaaaaatatatagtagccca

SEQ ID NO: 1292200 - DNA, 22 bp, Artificial Sequence
  chemically synthesized
agaaaaatatatagtagcccat

SEQ ID NO: 1292201 - DNA, 22 bp, Artificial Sequence
  chemically synthesized
actgcaatcctttcatgggcta

SEQ ID NO: 1292202 - DNA, 22 bp, Artificial Sequence
  chemically synthesized
cactgcaatcctttcatgggct

SEQ ID NO: 1292203 - DNA, 22 bp, Artificial Sequence
  chemically synthesized
tcactgcaatcctttcatgggc

SEQ ID NO: 1292204 - DNA, 22 bp, Artificial Sequence
  chemically synthesized
tttcactgcaatcctttcatgg

SEQ ID NO: 1292205 - DNA, 22 bp, Artificial Sequence
  chemically synthesized
ctttcactgcaatcctttcatg

SEQ ID NO: 1292206 - DNA, 22 bp, Artificial Sequence
  chemically synthesized
tatccgcaaatttctttcactg

SEQ ID NO: 1292207 - DNA, 22 bp, Artificial Sequence
  chemically synthesized
actgtatccgcaaatttctttc

SEQ ID NO: 1292208 - DNA, 22 bp, Artificial Sequence
  chemically synthesized
ttgactgtatccgcaaatttct

SEQ ID NO: 1292209 - DNA, 22 bp, Artificial Sequence
  chemically synthesized
ctattgactgtatccgcaaatt

SEQ ID NO: 1292210 - DNA, 22 bp, Artificial Sequence
  chemically synthesized
cagtgaaagaaatttgcggata

SEQ ID NO: 1292211 - DNA, 22 bp, Artificial Sequence
  chemically synthesized
tggcattactattgactgtatc

SEQ ID NO: 1292212 - DNA, 22 bp, Artificial Sequence
  chemically synthesized
gttgtggcattactattgactg

SEQ ID NO: 1292213 - DNA, 22 bp, Artificial Sequence
  chemically synthesized
gcggatacagtcaatagtaatg

SEQ ID NO: 1292214 - DNA, 22 bp, Artificial Sequence
  chemically synthesized
cggatacagtcaatagtaatgc

SEQ ID NO: 1292215 - DNA, 22 bp, Artificial Sequence
  chemically synthesized
gaaaaaaacagttcgttgtggc

SEQ ID NO: 1292216 - DNA, 22 bp, Artificial Sequence
  chemically synthesized
aaaggttagaaaaaaacagttc

SEQ ID NO: 1292217 - DNA, 22 bp, Artificial Sequence
  chemically synthesized
tgttcaaaggttagaaaaaaac

SEQ ID NO: 1292218 - DNA, 22 bp, Artificial Sequence
  chemically synthesized
atataattgtgttcaaaggtta

SEQ ID NO: 1292219 - DNA, 22 bp, Artificial Sequence
  chemically synthesized
tttttttctaacctttgaacac

SEQ ID NO: 1292220 - DNA, 22 bp, Artificial Sequence
  chemically synthesized
ttttctaacctttgaacacaat

SEQ ID NO: 1292221 - DNA, 22 bp, Artificial Sequence
  chemically synthesized
tttctaacctttgaacacaatt

SEQ ID NO: 1292222 - DNA, 22 bp, Artificial Sequence
  chemically synthesized
ttctaacctttgaacacaatta

SEQ ID NO: 1292223 - DNA, 22 bp, Artificial Sequence
  chemically synthesized
tctaacctttgaacacaattat

SEQ ID NO: 1292224 - DNA, 22 bp, Artificial Sequence
  chemically synthesized
ctaacctttgaacacaattata

SEQ ID NO: 1292225 - DNA, 22 bp, Artificial Sequence
  chemically synthesized
taacctttgaacacaattatat

SEQ ID NO: 1292226 - DNA, 22 bp, Artificial Sequence
  chemically synthesized
acctttgaacacaattatatta

SEQ ID NO: 1292227 - DNA, 22 bp, Artificial Sequence
  chemically synthesized
tgaacacaattatattaatatc

SEQ ID NO: 1292228 - DNA, 22 bp, Artificial Sequence
  chemically synthesized
gaacacaattatattaatatct

SEQ ID NO: 1292229 - DNA, 22 bp, Artificial Sequence
  chemically synthesized
aacacaattatattaatatctt

SEQ ID NO: 1292230 - DNA, 22 bp, Artificial Sequence
  chemically synthesized
agggcagataggtgatgaataa

SEQ ID NO: 1292231 - DNA, 22 bp, Artificial Sequence
  chemically synthesized
tattaatatctttattcatcac

SEQ ID NO: 1292232 - DNA, 22 bp, Artificial Sequence
  chemically synthesized
cagggcagataggtgatgaata

SEQ ID NO: 1292233 - DNA, 22 bp, Artificial Sequence
  chemically synthesized
atatctttattcatcacctatc

SEQ ID NO: 1292234 - DNA, 22 bp, Artificial Sequence
  chemically synthesized
tgtttcagggcagataggtgat

SEQ ID NO: 1292235 - DNA, 22 bp, Artificial Sequence
  chemically synthesized
gtgtttcagggcagataggtga

SEQ ID NO: 1292236 - DNA, 22 bp, Artificial Sequence
  chemically synthesized
tgtgtttcagggcagataggtg

SEQ ID NO: 1292237 - DNA, 22 bp, Artificial Sequence
  chemically synthesized
ttttgtgtttcagggcagatag

SEQ ID NO: 1292238 - DNA, 22 bp, Artificial Sequence
  chemically synthesized
tattcatcacctatctgccctg

SEQ ID NO: 1292239 - DNA, 22 bp, Artificial Sequence
  chemically synthesized
attcatcacctatctgccctga

SEQ ID NO: 1292240 - DNA, 22 bp, Artificial Sequence
  chemically synthesized
ttcatcacctatctgccctgaa

SEQ ID NO: 1292241 - DNA, 22 bp, Artificial Sequence
  chemically synthesized
gttattttgtgtttcagggcag

SEQ ID NO: 1292242 - DNA, 22 bp, Artificial Sequence
  chemically synthesized
atcacctatctgccctgaaaca

SEQ ID NO: 1292243 - DNA, 22 bp, Artificial Sequence
  chemically synthesized
acaatcctagttattttgtgtt

SEQ ID NO: 1292244 - DNA, 22 bp, Artificial Sequence
  chemically synthesized
aacaatcctagttattttgtgt

SEQ ID NO: 1292245 - DNA, 22 bp, Artificial Sequence
  chemically synthesized
tctgccctgaaacacaaaataa

SEQ ID NO: 1292246 - DNA, 22 bp, Artificial Sequence
  chemically synthesized
taacaatcctagttattttgtg

SEQ ID NO: 1292247 - DNA, 22 bp, Artificial Sequence
  chemically synthesized
ttaacaatcctagttattttgt

SEQ ID NO: 1292248 - DNA, 22 bp, Artificial Sequence
  chemically synthesized
ccctgaaacacaaaataactag

SEQ ID NO: 1292249 - DNA, 22 bp, Artificial Sequence
  chemically synthesized
aaacacaaaataactaggattg

SEQ ID NO: 1292250 - DNA, 22 bp, Artificial Sequence
  chemically synthesized
atgtatatatatatttttaaca

SEQ ID NO: 1292251 - DNA, 22 bp, Artificial Sequence
  chemically synthesized
tctgatgtatatatatattttt

SEQ ID NO: 1292252 - DNA, 22 bp, Artificial Sequence
  chemically synthesized
atctgatgtatatatatatttt

SEQ ID NO: 1292253 - DNA, 22 bp, Artificial Sequence
  chemically synthesized
ggattgttaaaaatatatatat

SEQ ID NO: 1292254 - DNA, 22 bp, Artificial Sequence
  chemically synthesized
ttaaaaatatatatatacatca

SEQ ID NO: 1292255 - DNA, 22 bp, Artificial Sequence
  chemically synthesized
aaaatacttatctgatgtatat

SEQ ID NO: 1292256 - DNA, 22 bp, Artificial Sequence
  chemically synthesized
aaaaatacttatctgatgtata

SEQ ID NO: 1292257 - DNA, 22 bp, Artificial Sequence
  chemically synthesized
aaaatatatatatacatcagat

SEQ ID NO: 1292258 - DNA, 22 bp, Artificial Sequence
  chemically synthesized
taagacttaaaaatacttatct

SEQ ID NO: 1292259 - DNA, 22 bp, Artificial Sequence
  chemically synthesized
ggttataagacttaaaaatact

SEQ ID NO: 1292260 - DNA, 22 bp, Artificial Sequence
  chemically synthesized
aggttataagacttaaaaatac

SEQ ID NO: 1292261 - DNA, 22 bp, Artificial Sequence
  chemically synthesized
taggttataagacttaaaaata

SEQ ID NO: 1292262 - DNA, 22 bp, Artificial Sequence
  chemically synthesized
ttttaggttataagacttaaaa

SEQ ID NO: 1292263 - DNA, 22 bp, Artificial Sequence
  chemically synthesized
ttaagtcttataacctaaaaca

SEQ ID NO: 1292264 - DNA, 22 bp, Artificial Sequence
  chemically synthesized
taagtcttataacctaaaacaa

SEQ ID NO: 1292265 - DNA, 22 bp, Artificial Sequence
  chemically synthesized
aagtcttataacctaaaacaac

SEQ ID NO: 1292266 - DNA, 22 bp, Artificial Sequence
  chemically synthesized
agtcttataacctaaaacaact

SEQ ID NO: 1292267 - DNA, 22 bp, Artificial Sequence
  chemically synthesized
ataacctaaaacaactatatat

SEQ ID NO: 1292268 - DNA, 22 bp, Artificial Sequence
  chemically synthesized
taacctaaaacaactatatata

SEQ ID NO: 1292269 - DNA, 22 bp, Artificial Sequence
  chemically synthesized
aaacaactatatatacgtatat

SEQ ID NO: 1292270 - DNA, 22 bp, Artificial Sequence
  chemically synthesized
tgtgtatatatacgtatatata

SEQ ID NO: 1292271 - DNA, 22 bp, Artificial Sequence
  chemically synthesized
atgtgtatatatacgtatatat

SEQ ID NO: 1292272 - DNA, 22 bp, Artificial Sequence
  chemically synthesized
tatatacgtatatatacgtata

SEQ ID NO: 1292273 - DNA, 22 bp, Artificial Sequence
  chemically synthesized
atatatgtatatatacgtgtat

SEQ ID NO: 1292274 - DNA, 22 bp, Artificial Sequence
  chemically synthesized
atatatgtatatatacatgtat

SEQ ID NO: 1292275 - DNA, 22 bp, Artificial Sequence
  chemically synthesized
atgtatatatacgtgtgtatat

SEQ ID NO: 1292276 - DNA, 22 bp, Artificial Sequence
  chemically synthesized
tgtatatatacgtgtgtatata

SEQ ID NO: 1292277 - DNA, 22 bp, Artificial Sequence
  chemically synthesized
tatgcatacacacatatacata

SEQ ID NO: 1292278 - DNA, 22 bp, Artificial Sequence
  chemically synthesized
tgtatatatacacgtatatata

SEQ ID NO: 1292279 - DNA, 22 bp, Artificial Sequence
  chemically synthesized
gtgtatatatacacgtatatat

SEQ ID NO: 1292280 - DNA, 22 bp, Artificial Sequence
  chemically synthesized
gtgtatgtatatatgcatatgt

SEQ ID NO: 1292281 - DNA, 22 bp, Artificial Sequence
  chemically synthesized
tgtatgtatatatgcatatgtg

SEQ ID NO: 1292282 - DNA, 22 bp, Artificial Sequence
  chemically synthesized
tacatatatacacacatatgta

SEQ ID NO: 1292283 - DNA, 22 bp, Artificial Sequence
  chemically synthesized
gtacatatatacacacatatgt

SEQ ID NO: 1292284 - DNA, 22 bp, Artificial Sequence
  chemically synthesized
cacacatatatgtacatataca

SEQ ID NO: 1292285 - DNA, 22 bp, Artificial Sequence
  chemically synthesized
acacacatatatgtacatatac

SEQ ID NO: 1292286 - DNA, 22 bp, Artificial Sequence
  chemically synthesized
tacacatatatgtacatatata

SEQ ID NO: 1292287 - DNA, 22 bp, Artificial Sequence
  chemically synthesized
atacacatatatgtacatatat

SEQ ID NO: 1292288 - DNA, 22 bp, Artificial Sequence
  chemically synthesized
aaaaatgtgtatatatatatat

SEQ ID NO: 1292289 - DNA, 22 bp, Artificial Sequence
  chemically synthesized
aaaaaatgtgtatatatatata

SEQ ID NO: 1292290 - DNA, 22 bp, Artificial Sequence
  chemically synthesized
taaaaaatgtgtatatatatat

SEQ ID NO: 1292291 - DNA, 22 bp, Artificial Sequence
  chemically synthesized
ttaaaaaatgtgtatatatata

SEQ ID NO: 1292292 - DNA, 22 bp, Artificial Sequence
  chemically synthesized
tttaaaaaatgtgtatatatat

SEQ ID NO: 1292293 - DNA, 22 bp, Artificial Sequence
  chemically synthesized
ttttttaaaaaatgtgtatata

SEQ ID NO: 1292294 - DNA, 22 bp, Artificial Sequence
  chemically synthesized
tacctattttttaaaaaatgtg

SEQ ID NO: 1292295 - DNA, 22 bp, Artificial Sequence
  chemically synthesized
aacctatacctattttttaaaa

SEQ ID NO: 1292296 - DNA, 22 bp, Artificial Sequence
  chemically synthesized
agaggctcaacctatacctatt

SEQ ID NO: 1292297 - DNA, 22 bp, Artificial Sequence
  chemically synthesized
gagaggctcaacctatacctat

SEQ ID NO: 1292298 - DNA, 22 bp, Artificial Sequence
  chemically synthesized
tttaaaaaataggtataggttg

SEQ ID NO: 1292299 - DNA, 22 bp, Artificial Sequence
  chemically synthesized
ttaaaaaataggtataggttga

SEQ ID NO: 1292300 - DNA, 22 bp, Artificial Sequence
  chemically synthesized
gatttgagaggctcaacctata

SEQ ID NO: 1292301 - DNA, 22 bp, Artificial Sequence
  chemically synthesized
taaaaaataggtataggttgag

SEQ ID NO: 1292302 - DNA, 22 bp, Artificial Sequence
  chemically synthesized
ggatttgagaggctcaacctat

SEQ ID NO: 1292303 - DNA, 22 bp, Artificial Sequence
  chemically synthesized
aaaaaataggtataggttgagc

SEQ ID NO: 1292304 - DNA, 22 bp, Artificial Sequence
  chemically synthesized
tggatttgagaggctcaaccta

SEQ ID NO: 1292305 - DNA, 22 bp, Artificial Sequence
  chemically synthesized
aaaaataggtataggttgagcc

SEQ ID NO: 1292306 - DNA, 22 bp, Artificial Sequence
  chemically synthesized
ttggatttgagaggctcaacct

SEQ ID NO: 1292307 - DNA, 22 bp, Artificial Sequence
  chemically synthesized
ggatttttggatttgagaggct

SEQ ID NO: 1292308 - DNA, 22 bp, Artificial Sequence
  chemically synthesized
gggatttttggatttgagaggc

SEQ ID NO: 1292309 - DNA, 22 bp, Artificial Sequence
  chemically synthesized
gatttgggatttttggatttga

SEQ ID NO: 1292310 - DNA, 22 bp, Artificial Sequence
  chemically synthesized
ggatttgggatttttggatttg

SEQ ID NO: 1292311 - DNA, 22 bp, Artificial Sequence
  chemically synthesized
tggatttgggatttttggattt

SEQ ID NO: 1292312 - DNA, 22 bp, Artificial Sequence
  chemically synthesized
agcctctcaaatccaaaaatcc

SEQ ID NO: 1292313 - DNA, 22 bp, Artificial Sequence
  chemically synthesized
ggagcattttggatttgggatt

SEQ ID NO: 1292314 - DNA, 22 bp, Artificial Sequence
  chemically synthesized
tcaaatccaaaaatcccaaatc

SEQ ID NO: 1292315 - DNA, 22 bp, Artificial Sequence
  chemically synthesized
gggagcattttggatttgggat

SEQ ID NO: 1292316 - DNA, 22 bp, Artificial Sequence
  chemically synthesized
aaatccaaaaatcccaaatcca

SEQ ID NO: 1292317 - DNA, 22 bp, Artificial Sequence
  chemically synthesized
atttgggagcattttggatttg

SEQ ID NO: 1292318 - DNA, 22 bp, Artificial Sequence
  chemically synthesized
tgatttgggagcattttggatt

SEQ ID NO: 1292319 - DNA, 22 bp, Artificial Sequence
  chemically synthesized
ctgatttgggagcattttggat

SEQ ID NO: 1292320 - DNA, 22 bp, Artificial Sequence
  chemically synthesized
aaaaggtttctgatttgggagc

SEQ ID NO: 1292321 - DNA, 22 bp, Artificial Sequence
  chemically synthesized
ccaaatcagaaaccttttgagg

SEQ ID NO: 1292322 - DNA, 22 bp, Artificial Sequence
  chemically synthesized
tgtgtcatgtcagccctcaaaa

SEQ ID NO: 1292323 - DNA, 22 bp, Artificial Sequence
  chemically synthesized
gtgtgtcatgtcagccctcaaa

SEQ ID NO: 1292324 - DNA, 22 bp, Artificial Sequence
  chemically synthesized
tgtgtgtcatgtcagccctcaa

SEQ ID NO: 1292325 - DNA, 22 bp, Artificial Sequence
  chemically synthesized
ctttgtgtgtcatgtcagccct

SEQ ID NO: 1292326 - DNA, 22 bp, Artificial Sequence
  chemically synthesized
cctttgtgtgtcatgtcagccc

SEQ ID NO: 1292327 - DNA, 22 bp, Artificial Sequence
  chemically synthesized
ttgagggctgacatgacacaca

SEQ ID NO: 1292328 - DNA, 22 bp, Artificial Sequence
  chemically synthesized
tgagggctgacatgacacacaa

SEQ ID NO: 1292329 - DNA, 22 bp, Artificial Sequence
  chemically synthesized
gagggctgacatgacacacaaa

SEQ ID NO: 1292330 - DNA, 22 bp, Artificial Sequence
  chemically synthesized
agggctgacatgacacacaaag

SEQ ID NO: 1292331 - DNA, 22 bp, Artificial Sequence
  chemically synthesized
caatgagcatttcctttgtgtg

SEQ ID NO: 1292332 - DNA, 22 bp, Artificial Sequence
  chemically synthesized
acatgacacacaaaggaaatgc

SEQ ID NO: 1292333 - DNA, 22 bp, Artificial Sequence
  chemically synthesized
aaatccagaatgctccaatgag

SEQ ID NO: 1292334 - DNA, 22 bp, Artificial Sequence
  chemically synthesized
attggagcattctggatttcag

SEQ ID NO: 1292335 - DNA, 22 bp, Artificial Sequence
  chemically synthesized
aagtccaaaaatctgaaatcca

SEQ ID NO: 1292336 - DNA, 22 bp, Artificial Sequence
  chemically synthesized
gagcattctggatttcagattt

SEQ ID NO: 1292337 - DNA, 22 bp, Artificial Sequence
  chemically synthesized
agcatctcaagtccaaaaatct

SEQ ID NO: 1292338 - DNA, 22 bp, Artificial Sequence
  chemically synthesized
tggatttcagatttttggactt

SEQ ID NO: 1292339 - DNA, 22 bp, Artificial Sequence
  chemically synthesized
gctgagcatctcaagtccaaaa

SEQ ID NO: 1292340 - DNA, 22 bp, Artificial Sequence
  chemically synthesized
gatttcagatttttggacttga

SEQ ID NO: 1292341 - DNA, 22 bp, Artificial Sequence
  chemically synthesized
ctggctgagcatctcaagtcca

SEQ ID NO: 1292342 - DNA, 22 bp, Artificial Sequence
  chemically synthesized
actggctgagcatctcaagtcc

SEQ ID NO: 1292343 - DNA, 22 bp, Artificial Sequence
  chemically synthesized
cagatttttggacttgagatgc

SEQ ID NO: 1292344 - DNA, 22 bp, Artificial Sequence
  chemically synthesized
agatttttggacttgagatgct

SEQ ID NO: 1292345 - DNA, 22 bp, Artificial Sequence
  chemically synthesized
tacttactggctgagcatctca

SEQ ID NO: 1292346 - DNA, 22 bp, Artificial Sequence
  chemically synthesized
ttggacttgagatgctcagcca

SEQ ID NO: 1292347 - DNA, 22 bp, Artificial Sequence
  chemically synthesized
cattatacttactggctgagca

SEQ ID NO: 1292348 - DNA, 22 bp, Artificial Sequence
  chemically synthesized
tggacttgagatgctcagccag

SEQ ID NO: 1292349 - DNA, 22 bp, Artificial Sequence
  chemically synthesized
gcattatacttactggctgagc

SEQ ID NO: 1292350 - DNA, 22 bp, Artificial Sequence
  chemically synthesized
ggacttgagatgctcagccagt

SEQ ID NO: 1292351 - DNA, 22 bp, Artificial Sequence
  chemically synthesized
gacttgagatgctcagccagta

SEQ ID NO: 1292352 - DNA, 22 bp, Artificial Sequence
  chemically synthesized
gagatgctcagccagtaagtat

SEQ ID NO: 1292353 - DNA, 22 bp, Artificial Sequence
  chemically synthesized
agatgctcagccagtaagtata

SEQ ID NO: 1292354 - DNA, 22 bp, Artificial Sequence
  chemically synthesized
gaatatttgcattatacttact

SEQ ID NO: 1292355 - DNA, 22 bp, Artificial Sequence
  chemically synthesized
ggaatatttgcattatacttac

SEQ ID NO: 1292356 - DNA, 22 bp, Artificial Sequence
  chemically synthesized
gtttggaatatttgcattatac

SEQ ID NO: 1292357 - DNA, 22 bp, Artificial Sequence
  chemically synthesized
cgtttggaatatttgcattata

SEQ ID NO: 1292358 - DNA, 22 bp, Artificial Sequence
  chemically synthesized
tcgtttggaatatttgcattat

SEQ ID NO: 1292359 - DNA, 22 bp, Artificial Sequence
  chemically synthesized
agccagtaagtataatgcaaat

SEQ ID NO: 1292360 - DNA, 22 bp, Artificial Sequence
  chemically synthesized
gattttcgtttggaatatttgc

SEQ ID NO: 1292361 - DNA, 22 bp, Artificial Sequence
  chemically synthesized
ggattttcgtttggaatatttg

SEQ ID NO: 1292362 - DNA, 22 bp, Artificial Sequence
  chemically synthesized
tggattttcgtttggaatattt

SEQ ID NO: 1292363 - DNA, 22 bp, Artificial Sequence
  chemically synthesized
aaattttggattttcgtttgga

SEQ ID NO: 1292364 - DNA, 22 bp, Artificial Sequence
  chemically synthesized
caaattttggattttcgtttgg

SEQ ID NO: 1292365 - DNA, 22 bp, Artificial Sequence
  chemically synthesized
caaacgaaaatccaaaatttga

SEQ ID NO: 1292366 - DNA, 22 bp, Artificial Sequence
  chemically synthesized
aaaatagaaatgtttcaaattt

SEQ ID NO: 1292367 - DNA, 22 bp, Artificial Sequence
  chemically synthesized
gaaaatagaaatgtttcaaatt

SEQ ID NO: 1292368 - DNA, 22 bp, Artificial Sequence
  chemically synthesized
gtccaaaacgtttgaaaataga

SEQ ID NO: 1292369 - DNA, 22 bp, Artificial Sequence
  chemically synthesized
cgtccaaaacgtttgaaaatag

SEQ ID NO: 1292370 - DNA, 22 bp, Artificial Sequence
  chemically synthesized
ttcgtccaaaacgtttgaaaat

SEQ ID NO: 1292371 - DNA, 22 bp, Artificial Sequence
  chemically synthesized
gaaacatttctattttcaaacg

SEQ ID NO: 1292372 - DNA, 22 bp, Artificial Sequence
  chemically synthesized
aaacatttctattttcaaacgt

SEQ ID NO: 1292373 - DNA, 22 bp, Artificial Sequence
  chemically synthesized
agcattcttcgtccaaaacgtt

SEQ ID NO: 1292374 - DNA, 22 bp, Artificial Sequence
  chemically synthesized
ctattttcaaacgttttggacg

SEQ ID NO: 1292375 - DNA, 22 bp, Artificial Sequence
  chemically synthesized
tattttcaaacgttttggacga

SEQ ID NO: 1292376 - DNA, 22 bp, Artificial Sequence
  chemically synthesized
attgagcattcttcgtccaaaa

SEQ ID NO: 1292377 - DNA, 22 bp, Artificial Sequence
  chemically synthesized
ttttcaaacgttttggacgaag

SEQ ID NO: 1292378 - DNA, 22 bp, Artificial Sequence
  chemically synthesized
tcaaacgttttggacgaagaat

SEQ ID NO: 1292379 - DNA, 22 bp, Artificial Sequence
  chemically synthesized
caaacgttttggacgaagaatg

SEQ ID NO: 1292380 - DNA, 22 bp, Artificial Sequence
  chemically synthesized
atactgattgagcattcttcgt

SEQ ID NO: 1292381 - DNA, 22 bp, Artificial Sequence
  chemically synthesized
aaacgttttggacgaagaatgc

SEQ ID NO: 1292382 - DNA, 22 bp, Artificial Sequence
  chemically synthesized
tggacgaagaatgctcaatcag

SEQ ID NO: 1292383 - DNA, 22 bp, Artificial Sequence
  chemically synthesized
ggacgaagaatgctcaatcagt

SEQ ID NO: 1292384 - DNA, 22 bp, Artificial Sequence
  chemically synthesized
gacgaagaatgctcaatcagta

SEQ ID NO: 1292385 - DNA, 22 bp, Artificial Sequence
  chemically synthesized
aaaatcaatcaatctgatactg

SEQ ID NO: 1292386 - DNA, 22 bp, Artificial Sequence
  chemically synthesized
aaagactcaaaatcaatcaatc

SEQ ID NO: 1292387 - DNA, 22 bp, Artificial Sequence
  chemically synthesized
aatcagtatcagattgattgat

SEQ ID NO: 1292388 - DNA, 22 bp, Artificial Sequence
  chemically synthesized
aatgagttaaaagactcaaaat

SEQ ID NO: 1292389 - DNA, 22 bp, Artificial Sequence
  chemically synthesized
attgattttgagtcttttaact

SEQ ID NO: 1292390 - DNA, 22 bp, Artificial Sequence
  chemically synthesized
aaaaactgaatgagttaaaaga

SEQ ID NO: 1292391 - DNA, 22 bp, Artificial Sequence
  chemically synthesized
attttgagtcttttaactcatt

SEQ ID NO: 1292392 - DNA, 22 bp, Artificial Sequence
  chemically synthesized
tactcaaaaactgaatgagtta

SEQ ID NO: 1292393 - DNA, 22 bp, Artificial Sequence
  chemically synthesized
tgagtcttttaactcattcagt

SEQ ID NO: 1292394 - DNA, 22 bp, Artificial Sequence
  chemically synthesized
gagtcttttaactcattcagtt

SEQ ID NO: 1292395 - DNA, 22 bp, Artificial Sequence
  chemically synthesized
agtcttttaactcattcagttt

SEQ ID NO: 1292396 - DNA, 22 bp, Artificial Sequence
  chemically synthesized
tggggactatactcaaaaactg

SEQ ID NO: 1292397 - DNA, 22 bp, Artificial Sequence
  chemically synthesized
gtggggactatactcaaaaact

SEQ ID NO: 1292398 - DNA, 22 bp, Artificial Sequence
  chemically synthesized
ttaactcattcagtttttgagt

SEQ ID NO: 1292399 - DNA, 22 bp, Artificial Sequence
  chemically synthesized
tgtggggactatactcaaaaac

SEQ ID NO: 1292400 - DNA, 22 bp, Artificial Sequence
  chemically synthesized
taactcattcagtttttgagta

SEQ ID NO: 1292401 - DNA, 22 bp, Artificial Sequence
  chemically synthesized
aactcattcagtttttgagtat

SEQ ID NO: 1292402 - DNA, 22 bp, Artificial Sequence
  chemically synthesized
actcattcagtttttgagtata

SEQ ID NO: 1292403 - DNA, 22 bp, Artificial Sequence
  chemically synthesized
ttttgtggggactatactcaaa

SEQ ID NO: 1292404 - DNA, 22 bp, Artificial Sequence
  chemically synthesized
attttgtggggactatactcaa

SEQ ID NO: 1292405 - DNA, 22 bp, Artificial Sequence
  chemically synthesized
attcagtttttgagtatagtcc

SEQ ID NO: 1292406 - DNA, 22 bp, Artificial Sequence
  chemically synthesized
ggatttattttgtggggactat

SEQ ID NO: 1292407 - DNA, 22 bp, Artificial Sequence
  chemically synthesized
agtttttgagtatagtccccac

SEQ ID NO: 1292408 - DNA, 22 bp, Artificial Sequence
  chemically synthesized
aattgggatttattttgtgggg

SEQ ID NO: 1292409 - DNA, 22 bp, Artificial Sequence
  chemically synthesized
ttgagtatagtccccacaaaat

SEQ ID NO: 1292410 - DNA, 22 bp, Artificial Sequence
  chemically synthesized
aaattgggatttattttgtggg

SEQ ID NO: 1292411 - DNA, 22 bp, Artificial Sequence
  chemically synthesized
tgagtatagtccccacaaaata

SEQ ID NO: 1292412 - DNA, 22 bp, Artificial Sequence
  chemically synthesized
gagtatagtccccacaaaataa

SEQ ID NO: 1292413 - DNA, 22 bp, Artificial Sequence
  chemically synthesized
agtatagtccccacaaaataaa

SEQ ID NO: 1292414 - DNA, 22 bp, Artificial Sequence
  chemically synthesized
atttaaattgggatttattttg

SEQ ID NO: 1292415 - DNA, 22 bp, Artificial Sequence
  chemically synthesized
gatttaaattgggatttatttt

SEQ ID NO: 1292416 - DNA, 22 bp, Artificial Sequence
  chemically synthesized
agaatcaatgcaagtacttgat

SEQ ID NO: 1292417 - DNA, 22 bp, Artificial Sequence
  chemically synthesized
cagttgagaatcaatgcaagta

SEQ ID NO: 1292418 - DNA, 22 bp, Artificial Sequence
  chemically synthesized
ccagttgagaatcaatgcaagt

SEQ ID NO: 1292419 - DNA, 22 bp, Artificial Sequence
  chemically synthesized
tccagttgagaatcaatgcaag

SEQ ID NO: 1292420 - DNA, 22 bp, Artificial Sequence
  chemically synthesized
ttccagttgagaatcaatgcaa

SEQ ID NO: 1292421 - DNA, 22 bp, Artificial Sequence
  chemically synthesized
aaatcaagtacttgcattgatt

SEQ ID NO: 1292422 - DNA, 22 bp, Artificial Sequence
  chemically synthesized
tttccagttgagaatcaatgca

SEQ ID NO: 1292423 - DNA, 22 bp, Artificial Sequence
  chemically synthesized
aatcaagtacttgcattgattc

SEQ ID NO: 1292424 - DNA, 22 bp, Artificial Sequence
  chemically synthesized
gcattgattctcaactggaaaa

SEQ ID NO: 1292425 - DNA, 22 bp, Artificial Sequence
  chemically synthesized
cattgattctcaactggaaaaa

SEQ ID NO: 1292426 - DNA, 22 bp, Artificial Sequence
  chemically synthesized
aaaggggaatgacctttttcca

SEQ ID NO: 1292427 - DNA, 22 bp, Artificial Sequence
  chemically synthesized
attctcaactggaaaaaggtca

SEQ ID NO: 1292428 - DNA, 22 bp, Artificial Sequence
  chemically synthesized
tcaactggaaaaaggtcattcc

SEQ ID NO: 1292429 - DNA, 22 bp, Artificial Sequence
  chemically synthesized
aaccctcaaaggggaatgacct

SEQ ID NO: 1292430 - DNA, 22 bp, Artificial Sequence
  chemically synthesized
aactggaaaaaggtcattcccc

SEQ ID NO: 1292431 - DNA, 22 bp, Artificial Sequence
  chemically synthesized
ttgaaccctcaaaggggaatga

SEQ ID NO: 1292432 - DNA, 22 bp, Artificial Sequence
  chemically synthesized
attgaaccctcaaaggggaatg

SEQ ID NO: 1292433 - DNA, 22 bp, Artificial Sequence
  chemically synthesized
gaaaaaggtcattcccctttga

SEQ ID NO: 1292434 - DNA, 22 bp, Artificial Sequence
  chemically synthesized
aggaatttattgaaccctcaaa

SEQ ID NO: 1292435 - DNA, 22 bp, Artificial Sequence
  chemically synthesized
ccctttgagggttcaataaatt

SEQ ID NO: 1292436 - DNA, 22 bp, Artificial Sequence
  chemically synthesized
tgagggttcaataaattcctca

SEQ ID NO: 1292437 - DNA, 22 bp, Artificial Sequence
  chemically synthesized
gagggttcaataaattcctcag

SEQ ID NO: 1292438 - DNA, 22 bp, Artificial Sequence
  chemically synthesized
gaggaaaccccactgaggaatt

SEQ ID NO: 1292439 - DNA, 22 bp, Artificial Sequence
  chemically synthesized
agggttcaataaattcctcagt

SEQ ID NO: 1292440 - DNA, 22 bp, Artificial Sequence
  chemically synthesized
aataaattcctcagtggggttt

SEQ ID NO: 1292441 - DNA, 22 bp, Artificial Sequence
  chemically synthesized
tagtagagaatgttggaggaaa

SEQ ID NO: 1292442 - DNA, 22 bp, Artificial Sequence
  chemically synthesized
ctcagtggggtttcctccaaca

SEQ ID NO: 1292443 - DNA, 22 bp, Artificial Sequence
  chemically synthesized
agtggggtttcctccaacattc

SEQ ID NO: 1292444 - DNA, 22 bp, Artificial Sequence
  chemically synthesized
atcaggtctgtagtagagaatg

SEQ ID NO: 1292445 - DNA, 22 bp, Artificial Sequence
  chemically synthesized
aatcaggtctgtagtagagaat

SEQ ID NO: 1292446 - DNA, 22 bp, Artificial Sequence
  chemically synthesized
cctccaacattctctactacag

SEQ ID NO: 1292447 - DNA, 22 bp, Artificial Sequence
  chemically synthesized
ctccaacattctctactacaga

SEQ ID NO: 1292448 - DNA, 22 bp, Artificial Sequence
  chemically synthesized
caacattctctactacagacct

SEQ ID NO: 1292449 - DNA, 22 bp, Artificial Sequence
  chemically synthesized
agtaatttaatcaggtctgtag

SEQ ID NO: 1292450 - DNA, 22 bp, Artificial Sequence
  chemically synthesized
cagtaatttaatcaggtctgta

SEQ ID NO: 1292451 - DNA, 22 bp, Artificial Sequence
  chemically synthesized
gaatttcagtaatttaatcagg

SEQ ID NO: 1292452 - DNA, 22 bp, Artificial Sequence
  chemically synthesized
tctactacagacctgattaaat

SEQ ID NO: 1292453 - DNA, 22 bp, Artificial Sequence
  chemically synthesized
tactacagacctgattaaatta

SEQ ID NO: 1292454 - DNA, 22 bp, Artificial Sequence
  chemically synthesized
ctacagacctgattaaattact

SEQ ID NO: 1292455 - DNA, 22 bp, Artificial Sequence
  chemically synthesized
cagacctgattaaattactgaa

SEQ ID NO: 1292456 - DNA, 22 bp, Artificial Sequence
  chemically synthesized
agaaccacagtgttagaatttc

SEQ ID NO: 1292457 - DNA, 22 bp, Artificial Sequence
  chemically synthesized
attaaattactgaaattctaac

SEQ ID NO: 1292458 - DNA, 22 bp, Artificial Sequence
  chemically synthesized
gagaaccacagtgttagaattt

SEQ ID NO: 1292459 - DNA, 22 bp, Artificial Sequence
  chemically synthesized
tgagaaccacagtgttagaatt

SEQ ID NO: 1292460 - DNA, 22 bp, Artificial Sequence
  chemically synthesized
aattactgaaattctaacactg

SEQ ID NO: 1292461 - DNA, 22 bp, Artificial Sequence
  chemically synthesized
ctgaaattctaacactgtggtt

SEQ ID NO: 1292462 - DNA, 22 bp, Artificial Sequence
  chemically synthesized
aaattctaacactgtggttctc

SEQ ID NO: 1292463 - DNA, 22 bp, Artificial Sequence
  chemically synthesized
taacactgtggttctcaaagtg

SEQ ID NO: 1292464 - DNA, 22 bp, Artificial Sequence
  chemically synthesized
acactgtggttctcaaagtgtg

SEQ ID NO: 1292465 - DNA, 22 bp, Artificial Sequence
  chemically synthesized
acggccaaagaaccacactttg

SEQ ID NO: 1292466 - DNA, 22 bp, Artificial Sequence
  chemically synthesized
tggttctcaaagtgtggttctt

SEQ ID NO: 1292467 - DNA, 22 bp, Artificial Sequence
  chemically synthesized
atgctgacggccaaagaaccac

SEQ ID NO: 1292468 - DNA, 22 bp, Artificial Sequence
  chemically synthesized
tcaaagtgtggttctttggccg

SEQ ID NO: 1292469 - DNA, 22 bp, Artificial Sequence
  chemically synthesized
aaagtgtggttctttggccgtc

SEQ ID NO: 1292470 - DNA, 22 bp, Artificial Sequence
  chemically synthesized
aggtgatgctgatgctgacggc

SEQ ID NO: 1292471 - DNA, 22 bp, Artificial Sequence
  chemically synthesized
tttggccgtcagcatcagcatc

SEQ ID NO: 1292472 - DNA, 22 bp, Artificial Sequence
  chemically synthesized
tggccgtcagcatcagcatcac

SEQ ID NO: 1292473 - DNA, 22 bp, Artificial Sequence
  chemically synthesized
acaggtcctcaggtgatgctga

SEQ ID NO: 1292474 - DNA, 22 bp, Artificial Sequence
  chemically synthesized
ggccgtcagcatcagcatcacc

SEQ ID NO: 1292475 - DNA, 22 bp, Artificial Sequence
  chemically synthesized
gccgtcagcatcagcatcacct

SEQ ID NO: 1292476 - DNA, 22 bp, Artificial Sequence
  chemically synthesized
taacaggtcctcaggtgatgct

SEQ ID NO: 1292477 - DNA, 22 bp, Artificial Sequence
  chemically synthesized
ctaacaggtcctcaggtgatgc

SEQ ID NO: 1292478 - DNA, 22 bp, Artificial Sequence
  chemically synthesized
aggacctgttagaaatccggat

SEQ ID NO: 1292479 - DNA, 22 bp, Artificial Sequence
  chemically synthesized
gggtgggacccaggaatccgga

SEQ ID NO: 1292480 - DNA, 22 bp, Artificial Sequence
  chemically synthesized
ttagaaatccggattcctgggt

SEQ ID NO: 1292481 - DNA, 22 bp, Artificial Sequence
  chemically synthesized
gaaatccggattcctgggtccc

SEQ ID NO: 1292482 - DNA, 22 bp, Artificial Sequence
  chemically synthesized
cataggtctagggtgggaccca

SEQ ID NO: 1292483 - DNA, 22 bp, Artificial Sequence
  chemically synthesized
attccataggtctagggtggga

SEQ ID NO: 1292484 - DNA, 22 bp, Artificial Sequence
  chemically synthesized
taattccataggtctagggtgg

SEQ ID NO: 1292485 - DNA, 22 bp, Artificial Sequence
  chemically synthesized
ctaattccataggtctagggtg

SEQ ID NO: 1292486 - DNA, 22 bp, Artificial Sequence
  chemically synthesized
ctgggtcccaccctagacctat

SEQ ID NO: 1292487 - DNA, 22 bp, Artificial Sequence
  chemically synthesized
ggtcccaccctagacctatgga

SEQ ID NO: 1292488 - DNA, 22 bp, Artificial Sequence
  chemically synthesized
gacctatggaattagaaactct

SEQ ID NO: 1292489 - DNA, 22 bp, Artificial Sequence
  chemically synthesized
aggcccatagtcagagtttcta

SEQ ID NO: 1292490 - DNA, 22 bp, Artificial Sequence
  chemically synthesized
ctgaggcccatagtcagagttt

SEQ ID NO: 1292491 - DNA, 22 bp, Artificial Sequence
  chemically synthesized
tggaattagaaactctgactat

SEQ ID NO: 1292492 - DNA, 22 bp, Artificial Sequence
  chemically synthesized
gaaactctgactatgggcctca

SEQ ID NO: 1292493 - DNA, 22 bp, Artificial Sequence
  chemically synthesized
aaacatggattgctgaggccca

SEQ ID NO: 1292494 - DNA, 22 bp, Artificial Sequence
  chemically synthesized
tgactatgggcctcagcaatcc

SEQ ID NO: 1292495 - DNA, 22 bp, Artificial Sequence
  chemically synthesized
actatgggcctcagcaatccat

SEQ ID NO: 1292496 - DNA, 22 bp, Artificial Sequence
  chemically synthesized
tgggcctcagcaatccatgttt

SEQ ID NO: 1292497 - DNA, 22 bp, Artificial Sequence
  chemically synthesized
gaaaatgtgttaaaacatggat

SEQ ID NO: 1292498 - DNA, 22 bp, Artificial Sequence
  chemically synthesized
cctagaaaatgtgttaaaacat

SEQ ID NO: 1292499 - DNA, 22 bp, Artificial Sequence
  chemically synthesized
agcaatccatgttttaacacat

SEQ ID NO: 1292500 - DNA, 22 bp, Artificial Sequence
  chemically synthesized
gaattacctagaaaatgtgtta

SEQ ID NO: 1292501 - DNA, 22 bp, Artificial Sequence
  chemically synthesized
taacacattttctaggtaattc

SEQ ID NO: 1292502 - DNA, 22 bp, Artificial Sequence
  chemically synthesized
aacacattttctaggtaattcc

SEQ ID NO: 1292503 - DNA, 22 bp, Artificial Sequence
  chemically synthesized
acacattttctaggtaattcca

SEQ ID NO: 1292504 - DNA, 22 bp, Artificial Sequence
  chemically synthesized
tctaggtaattccaatgcgttt

SEQ ID NO: 1292505 - DNA, 22 bp, Artificial Sequence
  chemically synthesized
ctaggtaattccaatgcgtttt

SEQ ID NO: 1292506 - DNA, 22 bp, Artificial Sequence
  chemically synthesized
taggtaattccaatgcgttttg

SEQ ID NO: 1292507 - DNA, 22 bp, Artificial Sequence
  chemically synthesized
caaaacgatgcagcaaaacgca

SEQ ID NO: 1292508 - DNA, 22 bp, Artificial Sequence
  chemically synthesized
ggtaattccaatgcgttttgct

SEQ ID NO: 1292509 - DNA, 22 bp, Artificial Sequence
  chemically synthesized
caatgcgttttgctgcatcgtt

SEQ ID NO: 1292510 - DNA, 22 bp, Artificial Sequence
  chemically synthesized
ataccatgcacactccaaaacg

SEQ ID NO: 1292511 - DNA, 22 bp, Artificial Sequence
  chemically synthesized
gataccatgcacactccaaaac

SEQ ID NO: 1292512 - DNA, 22 bp, Artificial Sequence
  chemically synthesized
tgctgcatcgttttggagtgtg

SEQ ID NO: 1292513 - DNA, 22 bp, Artificial Sequence
  chemically synthesized
tttgataccatgcacactccaa

SEQ ID NO: 1292514 - DNA, 22 bp, Artificial Sequence
  chemically synthesized
gctgcatcgttttggagtgtgc

SEQ ID NO: 1292515 - DNA, 22 bp, Artificial Sequence
  chemically synthesized
ctgcatcgttttggagtgtgca

SEQ ID NO: 1292516 - DNA, 22 bp, Artificial Sequence
  chemically synthesized
catcgttttggagtgtgcatgg

SEQ ID NO: 1292517 - DNA, 22 bp, Artificial Sequence
  chemically synthesized
tagagttgtttgataccatgca

SEQ ID NO: 1292518 - DNA, 22 bp, Artificial Sequence
  chemically synthesized
gtagagttgtttgataccatgc

SEQ ID NO: 1292519 - DNA, 22 bp, Artificial Sequence
  chemically synthesized
tgtagagttgtttgataccatg

SEQ ID NO: 1292520 - DNA, 22 bp, Artificial Sequence
  chemically synthesized
ttgtagagttgtttgataccat

SEQ ID NO: 1292521 - DNA, 22 bp, Artificial Sequence
  chemically synthesized
tggagtgtgcatggtatcaaac

SEQ ID NO: 1292522 - DNA, 22 bp, Artificial Sequence
  chemically synthesized
ggagtgtgcatggtatcaaaca

SEQ ID NO: 1292523 - DNA, 22 bp, Artificial Sequence
  chemically synthesized
gagtgtgcatggtatcaaacaa

SEQ ID NO: 1292524 - DNA, 22 bp, Artificial Sequence
  chemically synthesized
ccatttttgtagagttgtttga

SEQ ID NO: 1292525 - DNA, 22 bp, Artificial Sequence
  chemically synthesized
aaatggaaaagcaagcaggcta

SEQ ID NO: 1292526 - DNA, 22 bp, Artificial Sequence
  chemically synthesized
tacaaaaatggtagcctgcttg

SEQ ID NO: 1292527 - DNA, 22 bp, Artificial Sequence
  chemically synthesized
caaaaatggtagcctgcttgct

SEQ ID NO: 1292528 - DNA, 22 bp, Artificial Sequence
  chemically synthesized
cttgcttttccattttaggtct

SEQ ID NO: 1292529 - DNA, 22 bp, Artificial Sequence
  chemically synthesized
gcaatagacatagagacctaaa

SEQ ID NO: 1292530 - DNA, 22 bp, Artificial Sequence
  chemically synthesized
ggcaatagacatagagacctaa

SEQ ID NO: 1292531 - DNA, 22 bp, Artificial Sequence
  chemically synthesized
gcttttccattttaggtctcta

SEQ ID NO: 1292532 - DNA, 22 bp, Artificial Sequence
  chemically synthesized
cttttccattttaggtctctat

SEQ ID NO: 1292533 - DNA, 22 bp, Artificial Sequence
  chemically synthesized
ttccattttaggtctctatgtc

SEQ ID NO: 1292534 - DNA, 22 bp, Artificial Sequence
  chemically synthesized
catttggcaatagacatagaga

SEQ ID NO: 1292535 - DNA, 22 bp, Artificial Sequence
  chemically synthesized
tccattttaggtctctatgtct

SEQ ID NO: 1292536 - DNA, 22 bp, Artificial Sequence
  chemically synthesized
acatttggcaatagacatagag

SEQ ID NO: 1292537 - DNA, 22 bp, Artificial Sequence
  chemically synthesized
ccattttaggtctctatgtcta

SEQ ID NO: 1292538 - DNA, 22 bp, Artificial Sequence
  chemically synthesized
tacatttggcaatagacataga

SEQ ID NO: 1292539 - DNA, 22 bp, Artificial Sequence
  chemically synthesized
cattttaggtctctatgtctat

SEQ ID NO: 1292540 - DNA, 22 bp, Artificial Sequence
  chemically synthesized
ccctttacatttggcaatagac

SEQ ID NO: 1292541 - DNA, 22 bp, Artificial Sequence
  chemically synthesized
taggtctctatgtctattgcca

SEQ ID NO: 1292542 - DNA, 22 bp, Artificial Sequence
  chemically synthesized
aggtctctatgtctattgccaa

SEQ ID NO: 1292543 - DNA, 22 bp, Artificial Sequence
  chemically synthesized
ggtctctatgtctattgccaaa

SEQ ID NO: 1292544 - DNA, 22 bp, Artificial Sequence
  chemically synthesized
aagtctaccctttacatttggc

SEQ ID NO: 1292545 - DNA, 22 bp, Artificial Sequence
  chemically synthesized
tatgtctattgccaaatgtaaa

SEQ ID NO: 1292546 - DNA, 22 bp, Artificial Sequence
  chemically synthesized
tgtctattgccaaatgtaaagg

SEQ ID NO: 1292547 - DNA, 22 bp, Artificial Sequence
  chemically synthesized
gtctgaagtctaccctttacat

SEQ ID NO: 1292548 - DNA, 22 bp, Artificial Sequence
  chemically synthesized
ggtctgaagtctaccctttaca

SEQ ID NO: 1292549 - DNA, 22 bp, Artificial Sequence
  chemically synthesized
ttgccaaatgtaaagggtagac

SEQ ID NO: 1292550 - DNA, 22 bp, Artificial Sequence
  chemically synthesized
ccaaatgtaaagggtagacttc

SEQ ID NO: 1292551 - DNA, 22 bp, Artificial Sequence
  chemically synthesized
atgcaaaatttggtctgaagtc

SEQ ID NO: 1292552 - DNA, 22 bp, Artificial Sequence
  chemically synthesized
catgcaaaatttggtctgaagt

SEQ ID NO: 1292553 - DNA, 22 bp, Artificial Sequence
  chemically synthesized
atgcttcatgcaaaatttggtc

SEQ ID NO: 1292554 - DNA, 22 bp, Artificial Sequence
  chemically synthesized
cagaccaaattttgcatgaagc

SEQ ID NO: 1292555 - DNA, 22 bp, Artificial Sequence
  chemically synthesized
agaccaaattttgcatgaagca

SEQ ID NO: 1292556 - DNA, 22 bp, Artificial Sequence
  chemically synthesized
ccccaccaccactaatgcttca

SEQ ID NO: 1292557 - DNA, 22 bp, Artificial Sequence
  chemically synthesized
gactgccccaccaccactaatg

SEQ ID NO: 1292558 - DNA, 22 bp, Artificial Sequence
  chemically synthesized
tgcatgaagcattagtggtggt

SEQ ID NO: 1292559 - DNA, 22 bp, Artificial Sequence
  chemically synthesized
gcatgaagcattagtggtggtg

SEQ ID NO: 1292560 - DNA, 22 bp, Artificial Sequence
  chemically synthesized
catgaagcattagtggtggtgg

SEQ ID NO: 1292561 - DNA, 22 bp, Artificial Sequence
  chemically synthesized
gtggtggtggggcagtctaatt

SEQ ID NO: 1292562 - DNA, 22 bp, Artificial Sequence
  chemically synthesized
aaacaacaggcaatgatagaag

SEQ ID NO: 1292563 - DNA, 22 bp, Artificial Sequence
  chemically synthesized
taaaacaacaggcaatgataga

SEQ ID NO: 1292564 - DNA, 22 bp, Artificial Sequence
  chemically synthesized
attcttctatcattgcctgttg

SEQ ID NO: 1292565 - DNA, 22 bp, Artificial Sequence
  chemically synthesized
tgaagctctaaaacaacaggca

SEQ ID NO: 1292566 - DNA, 22 bp, Artificial Sequence
  chemically synthesized
ttctatcattgcctgttgtttt

SEQ ID NO: 1292567 - DNA, 22 bp, Artificial Sequence
  chemically synthesized
ctatcattgcctgttgttttag

SEQ ID NO: 1292568 - DNA, 22 bp, Artificial Sequence
  chemically synthesized
tatcattgcctgttgttttaga

SEQ ID NO: 1292569 - DNA, 22 bp, Artificial Sequence
  chemically synthesized
aagactgtgaagctctaaaaca

SEQ ID NO: 1292570 - DNA, 22 bp, Artificial Sequence
  chemically synthesized
tcattgcctgttgttttagagc

SEQ ID NO: 1292571 - DNA, 22 bp, Artificial Sequence
  chemically synthesized
attgaagactgtgaagctctaa

SEQ ID NO: 1292572 - DNA, 22 bp, Artificial Sequence
  chemically synthesized
tgattgaagactgtgaagctct

SEQ ID NO: 1292573 - DNA, 22 bp, Artificial Sequence
  chemically synthesized
cctgttgttttagagcttcaca

SEQ ID NO: 1292574 - DNA, 22 bp, Artificial Sequence
  chemically synthesized
ctgattgaagactgtgaagctc

SEQ ID NO: 1292575 - DNA, 22 bp, Artificial Sequence
  chemically synthesized
ttgttttagagcttcacagtct

SEQ ID NO: 1292576 - DNA, 22 bp, Artificial Sequence
  chemically synthesized
caacttctgattgaagactgtg

SEQ ID NO: 1292577 - DNA, 22 bp, Artificial Sequence
  chemically synthesized
ttttagagcttcacagtcttca

SEQ ID NO: 1292578 - DNA, 22 bp, Artificial Sequence
  chemically synthesized
gcaacttctgattgaagactgt

SEQ ID NO: 1292579 - DNA, 22 bp, Artificial Sequence
  chemically synthesized
tagagcttcacagtcttcaatc

SEQ ID NO: 1292580 - DNA, 22 bp, Artificial Sequence
  chemically synthesized
agagcttcacagtcttcaatca

SEQ ID NO: 1292581 - DNA, 22 bp, Artificial Sequence
  chemically synthesized
atttgcaacttctgattgaaga

SEQ ID NO: 1292582 - DNA, 22 bp, Artificial Sequence
  chemically synthesized
gagcttcacagtcttcaatcag

SEQ ID NO: 1292583 - DNA, 22 bp, Artificial Sequence
  chemically synthesized
cacagtcttcaatcagaagttg

SEQ ID NO: 1292584 - DNA, 22 bp, Artificial Sequence
  chemically synthesized
acagtcttcaatcagaagttgc

SEQ ID NO: 1292585 - DNA, 22 bp, Artificial Sequence
  chemically synthesized
gtcatgttaatttgcaacttct

SEQ ID NO: 1292586 - DNA, 22 bp, Artificial Sequence
  chemically synthesized
agtcatgttaatttgcaacttc

SEQ ID NO: 1292587 - DNA, 22 bp, Artificial Sequence
  chemically synthesized
caatcagaagttgcaaattaac

SEQ ID NO: 1292588 - DNA, 22 bp, Artificial Sequence
  chemically synthesized
aatcagaagttgcaaattaaca

SEQ ID NO: 1292589 - DNA, 22 bp, Artificial Sequence
  chemically synthesized
caaattaacatgactaagccat

SEQ ID NO: 1292590 - DNA, 22 bp, Artificial Sequence
  chemically synthesized
agccaacaataagataatggct

SEQ ID NO: 1292591 - DNA, 22 bp, Artificial Sequence
  chemically synthesized
acatgactaagccattatctta

SEQ ID NO: 1292592 - DNA, 22 bp, Artificial Sequence
  chemically synthesized
gttgagccaacaataagataat

SEQ ID NO: 1292593 - DNA, 22 bp, Artificial Sequence
  chemically synthesized
agccattatcttattgttggct

SEQ ID NO: 1292594 - DNA, 22 bp, Artificial Sequence
  chemically synthesized
tggggctggttgagccaacaat

SEQ ID NO: 1292595 - DNA, 22 bp, Artificial Sequence
  chemically synthesized
ttgtggggctggttgagccaac

SEQ ID NO: 1292596 - DNA, 22 bp, Artificial Sequence
  chemically synthesized
tcttattgttggctcaaccagc

SEQ ID NO: 1292597 - DNA, 22 bp, Artificial Sequence
  chemically synthesized
tattgttgtggggctggttgag

SEQ ID NO: 1292598 - DNA, 22 bp, Artificial Sequence
  chemically synthesized
attgttggctcaaccagcccca

SEQ ID NO: 1292599 - DNA, 22 bp, Artificial Sequence
  chemically synthesized
ttgttggctcaaccagccccac

SEQ ID NO: 1292600 - DNA, 22 bp, Artificial Sequence
  chemically synthesized
ttggctcaaccagccccacaac

SEQ ID NO: 1292601 - DNA, 22 bp, Artificial Sequence
  chemically synthesized
aagaattatattgttgtggggc

SEQ ID NO: 1292602 - DNA, 22 bp, Artificial Sequence
  chemically synthesized
gaagaattatattgttgtgggg

SEQ ID NO: 1292603 - DNA, 22 bp, Artificial Sequence
  chemically synthesized
gctcaaccagccccacaacaat

SEQ ID NO: 1292604 - DNA, 22 bp, Artificial Sequence
  chemically synthesized
ttgaagaattatattgttgtgg

SEQ ID NO: 1292605 - DNA, 22 bp, Artificial Sequence
  chemically synthesized
aaccagccccacaacaatataa

SEQ ID NO: 1292606 - DNA, 22 bp, Artificial Sequence
  chemically synthesized
tgagagggcatataatgccatt

SEQ ID NO: 1292607 - DNA, 22 bp, Artificial Sequence
  chemically synthesized
ttcaagaatggcattatatgcc

SEQ ID NO: 1292608 - DNA, 22 bp, Artificial Sequence
  chemically synthesized
caagaatggcattatatgccct

SEQ ID NO: 1292609 - DNA, 22 bp, Artificial Sequence
  chemically synthesized
aagaatggcattatatgccctc

SEQ ID NO: 1292610 - DNA, 22 bp, Artificial Sequence
  chemically synthesized
ggagtgaagaagagaggttgtg

SEQ ID NO: 1292611 - DNA, 22 bp, Artificial Sequence
  chemically synthesized
aggagtgaagaagagaggttgt

SEQ ID NO: 1292612 - DNA, 22 bp, Artificial Sequence
  chemically synthesized
tatgccctctcacaacctctct

SEQ ID NO: 1292613 - DNA, 22 bp, Artificial Sequence
  chemically synthesized
taggagtgaagaagagaggttg

SEQ ID NO: 1292614 - DNA, 22 bp, Artificial Sequence
  chemically synthesized
tcacaacctctcttcttcactc

SEQ ID NO: 1292615 - DNA, 22 bp, Artificial Sequence
  chemically synthesized
acaacctctcttcttcactcct

SEQ ID NO: 1292616 - DNA, 22 bp, Artificial Sequence
  chemically synthesized
tcttcttcactcctaaagatct

SEQ ID NO: 1292617 - DNA, 22 bp, Artificial Sequence
  chemically synthesized
ttcttcactcctaaagatctcc

SEQ ID NO: 1292618 - DNA, 22 bp, Artificial Sequence
  chemically synthesized
cttcactcctaaagatctccct

SEQ ID NO: 1292619 - DNA, 22 bp, Artificial Sequence
  chemically synthesized
ttcactcctaaagatctccctt

SEQ ID NO: 1292620 - DNA, 22 bp, Artificial Sequence
  chemically synthesized
cactcctaaagatctcccttgc

SEQ ID NO: 1292621 - DNA, 22 bp, Artificial Sequence
  chemically synthesized
actcctaaagatctcccttgct

SEQ ID NO: 1292622 - DNA, 22 bp, Artificial Sequence
  chemically synthesized
tcaggtgagtagtagcaaggga

SEQ ID NO: 1292623 - DNA, 22 bp, Artificial Sequence
  chemically synthesized
gtcaggtgagtagtagcaaggg

SEQ ID NO: 1292624 - DNA, 22 bp, Artificial Sequence
  chemically synthesized
ctaaagatctcccttgctacta

SEQ ID NO: 1292625 - DNA, 22 bp, Artificial Sequence
  chemically synthesized
aagatctcccttgctactactc

SEQ ID NO: 1292626 - DNA, 22 bp, Artificial Sequence
  chemically synthesized
ccttgctactactcacctgaca

SEQ ID NO: 1292627 - DNA, 22 bp, Artificial Sequence
  chemically synthesized
gctactactcacctgacaagtc

SEQ ID NO: 1292628 - DNA, 22 bp, Artificial Sequence
  chemically synthesized
ctactactcacctgacaagtca

SEQ ID NO: 1292629 - DNA, 22 bp, Artificial Sequence
  chemically synthesized
ctactcacctgacaagtcatac

SEQ ID NO: 1292630 - DNA, 22 bp, Artificial Sequence
  chemically synthesized
ctcacctgacaagtcatacttc

SEQ ID NO: 1292631 - DNA, 22 bp, Artificial Sequence
  chemically synthesized
acctgacaagtcatacttcttt

SEQ ID NO: 1292632 - DNA, 22 bp, Artificial Sequence
  chemically synthesized
acaagtcatacttctttgatta

SEQ ID NO: 1292633 - DNA, 22 bp, Artificial Sequence
  chemically synthesized
catgtagaaatgtgtaataatc

SEQ ID NO: 1292634 - DNA, 22 bp, Artificial Sequence
  chemically synthesized
ctttgattattacacatttcta

SEQ ID NO: 1292635 - DNA, 22 bp, Artificial Sequence
  chemically synthesized
tttgattattacacatttctac

SEQ ID NO: 1292636 - DNA, 22 bp, Artificial Sequence
  chemically synthesized
tgattattacacatttctacat

SEQ ID NO: 1292637 - DNA, 22 bp, Artificial Sequence
  chemically synthesized
gattattacacatttctacatg

SEQ ID NO: 1292638 - DNA, 22 bp, Artificial Sequence
  chemically synthesized
attattacacatttctacatgc

SEQ ID NO: 1292639 - DNA, 22 bp, Artificial Sequence
  chemically synthesized
ttacacatttctacatgcaatt

SEQ ID NO: 1292640 - DNA, 22 bp, Artificial Sequence
  chemically synthesized
cacatttctacatgcaattcct

SEQ ID NO: 1292641 - DNA, 22 bp, Artificial Sequence
  chemically synthesized
aagaaagatgaaggcagaagga

SEQ ID NO: 1292642 - DNA, 22 bp, Artificial Sequence
  chemically synthesized
ctacatgcaattccttctgcct

SEQ ID NO: 1292643 - DNA, 22 bp, Artificial Sequence
  chemically synthesized
caagaaagatgaaggcagaagg

SEQ ID NO: 1292644 - DNA, 22 bp, Artificial Sequence
  chemically synthesized
tacatgcaattccttctgcctt

SEQ ID NO: 1292645 - DNA, 22 bp, Artificial Sequence
  chemically synthesized
catgcaattccttctgccttca

SEQ ID NO: 1292646 - DNA, 22 bp, Artificial Sequence
  chemically synthesized
cttctgccttcatctttcttga

SEQ ID NO: 1292647 - DNA, 22 bp, Artificial Sequence
  chemically synthesized
cgcagagacaatttcaagaaag

SEQ ID NO: 1292648 - DNA, 22 bp, Artificial Sequence
  chemically synthesized
ctgccttcatctttcttgaaat

SEQ ID NO: 1292649 - DNA, 22 bp, Artificial Sequence
  chemically synthesized
tgccttcatctttcttgaaatt

SEQ ID NO: 1292650 - DNA, 22 bp, Artificial Sequence
  chemically synthesized
tctacgcagagacaatttcaag

SEQ ID NO: 1292651 - DNA, 22 bp, Artificial Sequence
  chemically synthesized
ccttcatctttcttgaaattgt

SEQ ID NO: 1292652 - DNA, 22 bp, Artificial Sequence
  chemically synthesized
catctttcttgaaattgtctct

SEQ ID NO: 1292653 - DNA, 22 bp, Artificial Sequence
  chemically synthesized
atctttcttgaaattgtctctg

SEQ ID NO: 1292654 - DNA, 22 bp, Artificial Sequence
  chemically synthesized
gtgttgtctacgcagagacaat

SEQ ID NO: 1292655 - DNA, 22 bp, Artificial Sequence
  chemically synthesized
tcttgaaattgtctctgcgtag

SEQ ID NO: 1292656 - DNA, 22 bp, Artificial Sequence
  chemically synthesized
gtctggtgttgtctacgcagag

SEQ ID NO: 1292657 - DNA, 22 bp, Artificial Sequence
  chemically synthesized
cttgaaattgtctctgcgtaga

SEQ ID NO: 1292658 - DNA, 22 bp, Artificial Sequence
  chemically synthesized
agtctggtgttgtctacgcaga

SEQ ID NO: 1292659 - DNA, 22 bp, Artificial Sequence
  chemically synthesized
ttgaaattgtctctgcgtagac

SEQ ID NO: 1292660 - DNA, 22 bp, Artificial Sequence
  chemically synthesized
gaaattgtctctgcgtagacaa

SEQ ID NO: 1292661 - DNA, 22 bp, Artificial Sequence
  chemically synthesized
aaattgtctctgcgtagacaac

SEQ ID NO: 1292662 - DNA, 22 bp, Artificial Sequence
  chemically synthesized
tctctgcgtagacaacaccaga

SEQ ID NO: 1292663 - DNA, 22 bp, Artificial Sequence
  chemically synthesized
tgcgtagacaacaccagactaa

SEQ ID NO: 1292664 - DNA, 22 bp, Artificial Sequence
  chemically synthesized
cgtagacaacaccagactaaat

SEQ ID NO: 1292665 - DNA, 22 bp, Artificial Sequence
  chemically synthesized
aaatatggtgacatttagtctg

SEQ ID NO: 1292666 - DNA, 22 bp, Artificial Sequence
  chemically synthesized
aaaatatggtgacatttagtct

SEQ ID NO: 1292667 - DNA, 22 bp, Artificial Sequence
  chemically synthesized
taaaatatggtgacatttagtc

SEQ ID NO: 1292668 - DNA, 22 bp, Artificial Sequence
  chemically synthesized
ttaaaatatggtgacatttagt

SEQ ID NO: 1292669 - DNA, 22 bp, Artificial Sequence
  chemically synthesized
tttaaaatatggtgacatttag

SEQ ID NO: 1292670 - DNA, 22 bp, Artificial Sequence
  chemically synthesized
aatgtcaccatattttaaaaag

SEQ ID NO: 1292671 - DNA, 22 bp, Artificial Sequence
  chemically synthesized
gagaggataatagctttttaaa

SEQ ID NO: 1292672 - DNA, 22 bp, Artificial Sequence
  chemically synthesized
ggagaggataatagctttttaa

SEQ ID NO: 1292673 - DNA, 22 bp, Artificial Sequence
  chemically synthesized
cttggagaggataatagctttt

SEQ ID NO: 1292674 - DNA, 22 bp, Artificial Sequence
  chemically synthesized
attgcttggagaggataatagc

SEQ ID NO: 1292675 - DNA, 22 bp, Artificial Sequence
  chemically synthesized
taaaaagctattatcctctcca

SEQ ID NO: 1292676 - DNA, 22 bp, Artificial Sequence
  chemically synthesized
aaaaagctattatcctctccaa

SEQ ID NO: 1292677 - DNA, 22 bp, Artificial Sequence
  chemically synthesized
aaaagctattatcctctccaag

SEQ ID NO: 1292678 - DNA, 22 bp, Artificial Sequence
  chemically synthesized
ttatcctctccaagcaattagt

SEQ ID NO: 1292679 - DNA, 22 bp, Artificial Sequence
  chemically synthesized
tcctctccaagcaattagtcat

SEQ ID NO: 1292680 - DNA, 22 bp, Artificial Sequence
  chemically synthesized
tccaagcaattagtcattctgt

SEQ ID NO: 1292681 - DNA, 22 bp, Artificial Sequence
  chemically synthesized
caagcaattagtcattctgtct

SEQ ID NO: 1292682 - DNA, 22 bp, Artificial Sequence
  chemically synthesized
tgggaacatagaagacagaatg

SEQ ID NO: 1292683 - DNA, 22 bp, Artificial Sequence
  chemically synthesized
gtcattctgtcttctatgttcc

SEQ ID NO: 1292684 - DNA, 22 bp, Artificial Sequence
  chemically synthesized
tgtcttctatgttcccacagca

SEQ ID NO: 1292685 - DNA, 22 bp, Artificial Sequence
  chemically synthesized
atgcaatagaaatgctgtggga

SEQ ID NO: 1292686 - DNA, 22 bp, Artificial Sequence
  chemically synthesized
aatgcaatagaaatgctgtggg

SEQ ID NO: 1292687 - DNA, 22 bp, Artificial Sequence
  chemically synthesized
tcttctatgttcccacagcatt

SEQ ID NO: 1292688 - DNA, 22 bp, Artificial Sequence
  chemically synthesized
taatgcaatagaaatgctgtgg

SEQ ID NO: 1292689 - DNA, 22 bp, Artificial Sequence
  chemically synthesized
ctatgttcccacagcatttcta

SEQ ID NO: 1292690 - DNA, 22 bp, Artificial Sequence
  chemically synthesized
tatgttcccacagcatttctat

SEQ ID NO: 1292691 - DNA, 22 bp, Artificial Sequence
  chemically synthesized
tgttcccacagcatttctattg

SEQ ID NO: 1292692 - DNA, 22 bp, Artificial Sequence
  chemically synthesized
ccacagcatttctattgcatta

SEQ ID NO: 1292693 - DNA, 22 bp, Artificial Sequence
  chemically synthesized
aaataaaacataatctttaatg

SEQ ID NO: 1292694 - DNA, 22 bp, Artificial Sequence
  chemically synthesized
ctattgcattaaagattatgtt

SEQ ID NO: 1292695 - DNA, 22 bp, Artificial Sequence
  chemically synthesized
tattgcattaaagattatgttt

SEQ ID NO: 1292696 - DNA, 22 bp, Artificial Sequence
  chemically synthesized
ttgcattaaagattatgtttta

SEQ ID NO: 1292697 - DNA, 22 bp, Artificial Sequence
  chemically synthesized
cattaaagattatgttttattt

SEQ ID NO: 1292698 - DNA, 22 bp, Artificial Sequence
  chemically synthesized
catcaacaaataattaaaataa

SEQ ID NO: 1292699 - DNA, 22 bp, Artificial Sequence
  chemically synthesized
aagattatgttttattttaatt

SEQ ID NO: 1292700 - DNA, 22 bp, Artificial Sequence
  chemically synthesized
tgttttattttaattatttgtt

SEQ ID NO: 1292701 - DNA, 22 bp, Artificial Sequence
  chemically synthesized
tattttaattatttgttgatgc

SEQ ID NO: 1292702 - DNA, 22 bp, Artificial Sequence
  chemically synthesized
attttaattatttgttgatgca

SEQ ID NO: 1292703 - DNA, 22 bp, Artificial Sequence
  chemically synthesized
ttttaattatttgttgatgcaa

SEQ ID NO: 1292704 - DNA, 22 bp, Artificial Sequence
  chemically synthesized
agaaaggaaacaattgcatcaa

SEQ ID NO: 1292705 - DNA, 22 bp, Artificial Sequence
  chemically synthesized
taattatttgttgatgcaattg

SEQ ID NO: 1292706 - DNA, 22 bp, Artificial Sequence
  chemically synthesized
aattatttgttgatgcaattgt

SEQ ID NO: 1292707 - DNA, 22 bp, Artificial Sequence
  chemically synthesized
attatttgttgatgcaattgtt

SEQ ID NO: 1292708 - DNA, 22 bp, Artificial Sequence
  chemically synthesized
tcatctgagaaaggaaacaatt

SEQ ID NO: 1292709 - DNA, 22 bp, Artificial Sequence
  chemically synthesized
tttgttgatgcaattgtttcct

SEQ ID NO: 1292710 - DNA, 22 bp, Artificial Sequence
  chemically synthesized
gttgatgcaattgtttcctttc

SEQ ID NO: 1292711 - DNA, 22 bp, Artificial Sequence
  chemically synthesized
ttgatgcaattgtttcctttct

SEQ ID NO: 1292712 - DNA, 22 bp, Artificial Sequence
  chemically synthesized
atgcaattgtttcctttctcag

SEQ ID NO: 1292713 - DNA, 22 bp, Artificial Sequence
  chemically synthesized
caagagattatcatctgagaaa

SEQ ID NO: 1292714 - DNA, 22 bp, Artificial Sequence
  chemically synthesized
tccaagagattatcatctgaga

SEQ ID NO: 1292715 - DNA, 22 bp, Artificial Sequence
  chemically synthesized
cctctccaagagattatcatct

SEQ ID NO: 1292716 - DNA, 22 bp, Artificial Sequence
  chemically synthesized
tttcctttctcagatgataatc

SEQ ID NO: 1292717 - DNA, 22 bp, Artificial Sequence
  chemically synthesized
ccctctccaagagattatcatc

SEQ ID NO: 1292718 - DNA, 22 bp, Artificial Sequence
  chemically synthesized
tccctctccaagagattatcat

SEQ ID NO: 1292719 - DNA, 22 bp, Artificial Sequence
  chemically synthesized
cctttctcagatgataatctct

SEQ ID NO: 1292720 - DNA, 22 bp, Artificial Sequence
  chemically synthesized
ctttctcagatgataatctctt

SEQ ID NO: 1292721 - DNA, 22 bp, Artificial Sequence
  chemically synthesized
tctcagatgataatctcttgga

SEQ ID NO: 1292722 - DNA, 22 bp, Artificial Sequence
  chemically synthesized
ctcagatgataatctcttggag

SEQ ID NO: 1292723 - DNA, 22 bp, Artificial Sequence
  chemically synthesized
tcagatgataatctcttggaga

SEQ ID NO: 1292724 - DNA, 22 bp, Artificial Sequence
  chemically synthesized
agatgataatctcttggagagg

SEQ ID NO: 1292725 - DNA, 22 bp, Artificial Sequence
  chemically synthesized
ttggagagggaaaaccatgttg

SEQ ID NO: 1292726 - DNA, 22 bp, Artificial Sequence
  chemically synthesized
ggagagggaaaaccatgttggg

SEQ ID NO: 1292727 - DNA, 22 bp, Artificial Sequence
  chemically synthesized
gagagggaaaaccatgttgggt

SEQ ID NO: 1292728 - DNA, 22 bp, Artificial Sequence
  chemically synthesized
tcatacagtgatgaaggcataa

SEQ ID NO: 1292729 - DNA, 22 bp, Artificial Sequence
  chemically synthesized
atcatactgtcatacagtgatg

SEQ ID NO: 1292730 - DNA, 22 bp, Artificial Sequence
  chemically synthesized
ggttatgccttcatcactgtat

SEQ ID NO: 1292731 - DNA, 22 bp, Artificial Sequence
  chemically synthesized
tgccttcatcactgtatgacag

SEQ ID NO: 1292732 - DNA, 22 bp, Artificial Sequence
  chemically synthesized
tgtgctaatcatactgtcatac

SEQ ID NO: 1292733 - DNA, 22 bp, Artificial Sequence
  chemically synthesized
catcactgtatgacagtatgat

SEQ ID NO: 1292734 - DNA, 22 bp, Artificial Sequence
  chemically synthesized
atcactgtatgacagtatgatt

SEQ ID NO: 1292735 - DNA, 22 bp, Artificial Sequence
  chemically synthesized
aatgccagctatgtgctaatca

SEQ ID NO: 1292736 - DNA, 22 bp, Artificial Sequence
  chemically synthesized
tatgacagtatgattagcacat

SEQ ID NO: 1292737 - DNA, 22 bp, Artificial Sequence
  chemically synthesized
ttgaatgccagctatgtgctaa

SEQ ID NO: 1292738 - DNA, 22 bp, Artificial Sequence
  chemically synthesized
attgaatgccagctatgtgcta

SEQ ID NO: 1292739 - DNA, 22 bp, Artificial Sequence
  chemically synthesized
acaaatacttattgaatgccag

SEQ ID NO: 1292740 - DNA, 22 bp, Artificial Sequence
  chemically synthesized
aacaaatacttattgaatgcca

SEQ ID NO: 1292741 - DNA, 22 bp, Artificial Sequence
  chemically synthesized
gcacatagctggcattcaataa

SEQ ID NO: 1292742 - DNA, 22 bp, Artificial Sequence
  chemically synthesized
aacatttaacaaatacttattg

SEQ ID NO: 1292743 - DNA, 22 bp, Artificial Sequence
  chemically synthesized
caacatttaacaaatacttatt

SEQ ID NO: 1292744 - DNA, 22 bp, Artificial Sequence
  chemically synthesized
tcaacatttaacaaatacttat

SEQ ID NO: 1292745 - DNA, 22 bp, Artificial Sequence
  chemically synthesized
gcattcaataagtatttgttaa

SEQ ID NO: 1292746 - DNA, 22 bp, Artificial Sequence
  chemically synthesized
aaataacctttcaacatttaac

SEQ ID NO: 1292747 - DNA, 22 bp, Artificial Sequence
  chemically synthesized
aataagtatttgttaaatgttg

SEQ ID NO: 1292748 - DNA, 22 bp, Artificial Sequence
  chemically synthesized
ctaaaataacctttcaacattt

SEQ ID NO: 1292749 - DNA, 22 bp, Artificial Sequence
  chemically synthesized
actaaaataacctttcaacatt

SEQ ID NO: 1292750 - DNA, 22 bp, Artificial Sequence
  chemically synthesized
gttaaatgttgaaaggttattt

SEQ ID NO: 1292751 - DNA, 22 bp, Artificial Sequence
  chemically synthesized
ttaaatgttgaaaggttatttt

SEQ ID NO: 1292752 - DNA, 22 bp, Artificial Sequence
  chemically synthesized
aatgttgaaaggttattttagt

SEQ ID NO: 1292753 - DNA, 22 bp, Artificial Sequence
  chemically synthesized
tcagagatatatgtttactaaa

SEQ ID NO: 1292754 - DNA, 22 bp, Artificial Sequence
  chemically synthesized
aaaggttattttagtaaacata

SEQ ID NO: 1292755 - DNA, 22 bp, Artificial Sequence
  chemically synthesized
ttttagtaaacatatatctctg

SEQ ID NO: 1292756 - DNA, 22 bp, Artificial Sequence
  chemically synthesized
gtaccatcctatcagagatata

SEQ ID NO: 1292757 - DNA, 22 bp, Artificial Sequence
  chemically synthesized
tggtaccatcctatcagagata

SEQ ID NO: 1292758 - DNA, 22 bp, Artificial Sequence
  chemically synthesized
tagtaaacatatatctctgata

SEQ ID NO: 1292759 - DNA, 22 bp, Artificial Sequence
  chemically synthesized
agtaaacatatatctctgatag

SEQ ID NO: 1292760 - DNA, 22 bp, Artificial Sequence
  chemically synthesized
gtaaacatatatctctgatagg

SEQ ID NO: 1292761 - DNA, 22 bp, Artificial Sequence
  chemically synthesized
acactctggtaccatcctatca

SEQ ID NO: 1292762 - DNA, 22 bp, Artificial Sequence
  chemically synthesized
tgataggatggtaccagagtgt

SEQ ID NO: 1292763 - DNA, 22 bp, Artificial Sequence
  chemically synthesized
ataggatggtaccagagtgtca

SEQ ID NO: 1292764 - DNA, 22 bp, Artificial Sequence
  chemically synthesized
gaaaagaacaattgacactctg

SEQ ID NO: 1292765 - DNA, 22 bp, Artificial Sequence
  chemically synthesized
agaaaagaacaattgacactct

SEQ ID NO: 1292766 - DNA, 22 bp, Artificial Sequence
  chemically synthesized
tttagaaaagaacaattgacac

SEQ ID NO: 1292767 - DNA, 22 bp, Artificial Sequence
  chemically synthesized
atttagaaaagaacaattgaca

SEQ ID NO: 1292768 - DNA, 22 bp, Artificial Sequence
  chemically synthesized
tatttagaaaagaacaattgac

SEQ ID NO: 1292769 - DNA, 22 bp, Artificial Sequence
  chemically synthesized
ttatttagaaaagaacaattga

SEQ ID NO: 1292770 - DNA, 22 bp, Artificial Sequence
  chemically synthesized
gtgaagcatttttatttagaaa

SEQ ID NO: 1292771 - DNA, 22 bp, Artificial Sequence
  chemically synthesized
ttcttttctaaataaaaatgct

SEQ ID NO: 1292772 - DNA, 22 bp, Artificial Sequence
  chemically synthesized
ttttctaaataaaaatgcttca

SEQ ID NO: 1292773 - DNA, 22 bp, Artificial Sequence
  chemically synthesized
ttctaaataaaaatgcttcact

SEQ ID NO: 1292774 - DNA, 22 bp, Artificial Sequence
  chemically synthesized
tctaaataaaaatgcttcacta

SEQ ID NO: 1292775 - DNA, 22 bp, Artificial Sequence
  chemically synthesized
ctaaataaaaatgcttcactaa

SEQ ID NO: 1292776 - DNA, 22 bp, Artificial Sequence
  chemically synthesized
taaataaaaatgcttcactaat

SEQ ID NO: 1292777 - DNA, 22 bp, Artificial Sequence
  chemically synthesized
aataaaaatgcttcactaatgt

SEQ ID NO: 1292778 - DNA, 22 bp, Artificial Sequence
  chemically synthesized
gcaaaacaacatacatggacat

SEQ ID NO: 1292779 - DNA, 22 bp, Artificial Sequence
  chemically synthesized
tagcaaaacaacatacatggac

SEQ ID NO: 1292780 - DNA, 22 bp, Artificial Sequence
  chemically synthesized
ctagcaaaacaacatacatgga

SEQ ID NO: 1292781 - DNA, 22 bp, Artificial Sequence
  chemically synthesized
tctagcaaaacaacatacatgg

SEQ ID NO: 1292782 - DNA, 22 bp, Artificial Sequence
  chemically synthesized
cactaatgtccatgtatgttgt

SEQ ID NO: 1292783 - DNA, 22 bp, Artificial Sequence
  chemically synthesized
ctttctagcaaaacaacataca

SEQ ID NO: 1292784 - DNA, 22 bp, Artificial Sequence
  chemically synthesized
actaatgtccatgtatgttgtt

SEQ ID NO: 1292785 - DNA, 22 bp, Artificial Sequence
  chemically synthesized
gctttctagcaaaacaacatac

SEQ ID NO: 1292786 - DNA, 22 bp, Artificial Sequence
  chemically synthesized
tgctttctagcaaaacaacata

SEQ ID NO: 1292787 - DNA, 22 bp, Artificial Sequence
  chemically synthesized
atgtccatgtatgttgttttgc

SEQ ID NO: 1292788 - DNA, 22 bp, Artificial Sequence
  chemically synthesized
ttttgctttctagcaaaacaac

SEQ ID NO: 1292789 - DNA, 22 bp, Artificial Sequence
  chemically synthesized
attttgctttctagcaaaacaa

SEQ ID NO: 1292790 - DNA, 22 bp, Artificial Sequence
  chemically synthesized
tattttgctttctagcaaaaca

SEQ ID NO: 1292791 - DNA, 22 bp, Artificial Sequence
  chemically synthesized
attttattttgctttctagcaa

SEQ ID NO: 1292792 - DNA, 22 bp, Artificial Sequence
  chemically synthesized
tctgattttattttgctttcta

SEQ ID NO: 1292793 - DNA, 22 bp, Artificial Sequence
  chemically synthesized
atctgattttattttgctttct

SEQ ID NO: 1292794 - DNA, 22 bp, Artificial Sequence
  chemically synthesized
tttatctgattttattttgctt

SEQ ID NO: 1292795 - DNA, 22 bp, Artificial Sequence
  chemically synthesized
ttttgctagaaagcaaaataaa

SEQ ID NO: 1292796 - DNA, 22 bp, Artificial Sequence
  chemically synthesized
tgctagaaagcaaaataaaatc

SEQ ID NO: 1292797 - DNA, 22 bp, Artificial Sequence
  chemically synthesized
gctagaaagcaaaataaaatca

SEQ ID NO: 1292798 - DNA, 22 bp, Artificial Sequence
  chemically synthesized
ctagaaagcaaaataaaatcag

SEQ ID NO: 1292799 - DNA, 22 bp, Artificial Sequence
  chemically synthesized
tccattatttatctgattttat

SEQ ID NO: 1292800 - DNA, 22 bp, Artificial Sequence
  chemically synthesized
gaaagcaaaataaaatcagata

SEQ ID NO: 1292801 - DNA, 22 bp, Artificial Sequence
  chemically synthesized
atgggcctatccattatttatc

SEQ ID NO: 1292802 - DNA, 22 bp, Artificial Sequence
  chemically synthesized
tggctgatgggcctatccatta

SEQ ID NO: 1292803 - DNA, 22 bp, Artificial Sequence
  chemically synthesized
atggctgatgggcctatccatt

SEQ ID NO: 1292804 - DNA, 22 bp, Artificial Sequence
  chemically synthesized
tatggctgatgggcctatccat

SEQ ID NO: 1292805 - DNA, 22 bp, Artificial Sequence
  chemically synthesized
tttatggctgatgggcctatcc

SEQ ID NO: 1292806 - DNA, 22 bp, Artificial Sequence
  chemically synthesized
gcaaaaaaaccaattctttatg

SEQ ID NO: 1292807 - DNA, 22 bp, Artificial Sequence
  chemically synthesized
ctagcaaaaaaaccaattcttt

SEQ ID NO: 1292808 - DNA, 22 bp, Artificial Sequence
  chemically synthesized
gcatgatagttgctagcaaaaa

SEQ ID NO: 1292809 - DNA, 22 bp, Artificial Sequence
  chemically synthesized
ccaattagcatgatagttgcta

SEQ ID NO: 1292810 - DNA, 22 bp, Artificial Sequence
  chemically synthesized
accaattagcatgatagttgct

SEQ ID NO: 1292811 - DNA, 22 bp, Artificial Sequence
  chemically synthesized
gtttttttgctagcaactatca

SEQ ID NO: 1292812 - DNA, 22 bp, Artificial Sequence
  chemically synthesized
ttttgctagcaactatcatgct

SEQ ID NO: 1292813 - DNA, 22 bp, Artificial Sequence
  chemically synthesized
tttgctagcaactatcatgcta

SEQ ID NO: 1292814 - DNA, 22 bp, Artificial Sequence
  chemically synthesized
ttgctagcaactatcatgctaa

SEQ ID NO: 1292815 - DNA, 22 bp, Artificial Sequence
  chemically synthesized
tgctagcaactatcatgctaat

SEQ ID NO: 1292816 - DNA, 22 bp, Artificial Sequence
  chemically synthesized
gctagcaactatcatgctaatt

SEQ ID NO: 1292817 - DNA, 22 bp, Artificial Sequence
  chemically synthesized
ctagcaactatcatgctaattg

SEQ ID NO: 1292818 - DNA, 22 bp, Artificial Sequence
  chemically synthesized
gcaactatcatgctaattggta

SEQ ID NO: 1292819 - DNA, 22 bp, Artificial Sequence
  chemically synthesized
catatgtaaatatttaccaatt

SEQ ID NO: 1292820 - DNA, 22 bp, Artificial Sequence
  chemically synthesized
gcatatgtaaatatttaccaat

SEQ ID NO: 1292821 - DNA, 22 bp, Artificial Sequence
  chemically synthesized
tcatgctaattggtaaatattt

SEQ ID NO: 1292822 - DNA, 22 bp, Artificial Sequence
  chemically synthesized
gcttgcatatgtaaatatttac

SEQ ID NO: 1292823 - DNA, 22 bp, Artificial Sequence
  chemically synthesized
agcttgcatatgtaaatattta

SEQ ID NO: 1292824 - DNA, 22 bp, Artificial Sequence
  chemically synthesized
attggtaaatatttacatatgc

SEQ ID NO: 1292825 - DNA, 22 bp, Artificial Sequence
  chemically synthesized
gtaaatatttacatatgcaagc

SEQ ID NO: 1292826 - DNA, 22 bp, Artificial Sequence
  chemically synthesized
agtgccaagcatatttagcttg

SEQ ID NO: 1292827 - DNA, 22 bp, Artificial Sequence
  chemically synthesized
acatatgcaagctaaatatgct

SEQ ID NO: 1292828 - DNA, 22 bp, Artificial Sequence
  chemically synthesized
catatgcaagctaaatatgctt

SEQ ID NO: 1292829 - DNA, 22 bp, Artificial Sequence
  chemically synthesized
gagtggtctcagtgccaagcat

SEQ ID NO: 1292830 - DNA, 22 bp, Artificial Sequence
  chemically synthesized
tggagtggtctcagtgccaagc

SEQ ID NO: 1292831 - DNA, 22 bp, Artificial Sequence
  chemically synthesized
tctggagtggtctcagtgccaa

SEQ ID NO: 1292832 - DNA, 22 bp, Artificial Sequence
  chemically synthesized
aatatgcttggcactgagacca

SEQ ID NO: 1292833 - DNA, 22 bp, Artificial Sequence
  chemically synthesized
tattctctggagtggtctcagt

SEQ ID NO: 1292834 - DNA, 22 bp, Artificial Sequence
  chemically synthesized
cacctatattctctggagtggt

SEQ ID NO: 1292835 - DNA, 22 bp, Artificial Sequence
  chemically synthesized
ggcactgagaccactccagaga

SEQ ID NO: 1292836 - DNA, 22 bp, Artificial Sequence
  chemically synthesized
gcactgagaccactccagagaa

SEQ ID NO: 1292837 - DNA, 22 bp, Artificial Sequence
  chemically synthesized
attacacctatattctctggag

SEQ ID NO: 1292838 - DNA, 22 bp, Artificial Sequence
  chemically synthesized
ttgattacacctatattctctg

SEQ ID NO: 1292839 - DNA, 22 bp, Artificial Sequence
  chemically synthesized
agaccactccagagaatatagg

SEQ ID NO: 1292840 - DNA, 22 bp, Artificial Sequence
  chemically synthesized
gaattattgattacacctatat

SEQ ID NO: 1292841 - DNA, 22 bp, Artificial Sequence
  chemically synthesized
cagagaatataggtgtaatcaa

SEQ ID NO: 1292842 - DNA, 22 bp, Artificial Sequence
  chemically synthesized
atacaagaaaattggaattatt

SEQ ID NO: 1292843 - DNA, 22 bp, Artificial Sequence
  chemically synthesized
tcatgtcctgatacaagaaaat

SEQ ID NO: 1292844 - DNA, 22 bp, Artificial Sequence
  chemically synthesized
ggttatcatgtcctgatacaag

SEQ ID NO: 1292845 - DNA, 22 bp, Artificial Sequence
  chemically synthesized
taggttatcatgtcctgataca

SEQ ID NO: 1292846 - DNA, 22 bp, Artificial Sequence
  chemically synthesized
caattttcttgtatcaggacat

SEQ ID NO: 1292847 - DNA, 22 bp, Artificial Sequence
  chemically synthesized
gtctctaggttatcatgtcctg

SEQ ID NO: 1292848 - DNA, 22 bp, Artificial Sequence
  chemically synthesized
ggtctctaggttatcatgtcct

SEQ ID NO: 1292849 - DNA, 22 bp, Artificial Sequence
  chemically synthesized
tggtctctaggttatcatgtcc

SEQ ID NO: 1292850 - DNA, 22 bp, Artificial Sequence
  chemically synthesized
tcttgtatcaggacatgataac

SEQ ID NO: 1292851 - DNA, 22 bp, Artificial Sequence
  chemically synthesized
cttgtatcaggacatgataacc

SEQ ID NO: 1292852 - DNA, 22 bp, Artificial Sequence
  chemically synthesized
ttgtatcaggacatgataacct

SEQ ID NO: 1292853 - DNA, 22 bp, Artificial Sequence
  chemically synthesized
gtatcaggacatgataacctag

SEQ ID NO: 1292854 - DNA, 22 bp, Artificial Sequence
  chemically synthesized
tatcaggacatgataacctaga

SEQ ID NO: 1292855 - DNA, 22 bp, Artificial Sequence
  chemically synthesized
gaaggtaaatgttttggtctct

SEQ ID NO: 1292856 - DNA, 22 bp, Artificial Sequence
  chemically synthesized
agaaggtaaatgttttggtctc

SEQ ID NO: 1292857 - DNA, 22 bp, Artificial Sequence
  chemically synthesized
tagaaggtaaatgttttggtct

SEQ ID NO: 1292858 - DNA, 22 bp, Artificial Sequence
  chemically synthesized
ttagaaggtaaatgttttggtc

SEQ ID NO: 1292859 - DNA, 22 bp, Artificial Sequence
  chemically synthesized
cttttagaaggtaaatgttttg

SEQ ID NO: 1292860 - DNA, 22 bp, Artificial Sequence
  chemically synthesized
gagaccaaaacatttaccttct

SEQ ID NO: 1292861 - DNA, 22 bp, Artificial Sequence
  chemically synthesized
acaattccttttagaaggtaaa

SEQ ID NO: 1292862 - DNA, 22 bp, Artificial Sequence
  chemically synthesized
gacaattccttttagaaggtaa

SEQ ID NO: 1292863 - DNA, 22 bp, Artificial Sequence
  chemically synthesized
agatcttgacaattccttttag

SEQ ID NO: 1292864 - DNA, 22 bp, Artificial Sequence
  chemically synthesized
ctgagatcttgacaattccttt

SEQ ID NO: 1292865 - DNA, 22 bp, Artificial Sequence
  chemically synthesized
accttctaaaaggaattgtcaa

SEQ ID NO: 1292866 - DNA, 22 bp, Artificial Sequence
  chemically synthesized
ccttctaaaaggaattgtcaag

SEQ ID NO: 1292867 - DNA, 22 bp, Artificial Sequence
  chemically synthesized
ctaaaaggaattgtcaagatct

SEQ ID NO: 1292868 - DNA, 22 bp, Artificial Sequence
  chemically synthesized
taaaaggaattgtcaagatctc

SEQ ID NO: 1292869 - DNA, 22 bp, Artificial Sequence
  chemically synthesized
aaaggaattgtcaagatctcag

SEQ ID NO: 1292870 - DNA, 22 bp, Artificial Sequence
  chemically synthesized
tcaacccagtgttactgagatc

SEQ ID NO: 1292871 - DNA, 22 bp, Artificial Sequence
  chemically synthesized
atcaacccagtgttactgagat

SEQ ID NO: 1292872 - DNA, 22 bp, Artificial Sequence
  chemically synthesized
tttatcaacccagtgttactga

SEQ ID NO: 1292873 - DNA, 22 bp, Artificial Sequence
  chemically synthesized
ctgtttatcaacccagtgttac

SEQ ID NO: 1292874 - DNA, 22 bp, Artificial Sequence
  chemically synthesized
tcaagatctcagtaacactggg

SEQ ID NO: 1292875 - DNA, 22 bp, Artificial Sequence
  chemically synthesized
agtaacactgggttgataaaca

SEQ ID NO: 1292876 - DNA, 22 bp, Artificial Sequence
  chemically synthesized
gaaatatgttgctgtttatcaa

SEQ ID NO: 1292877 - DNA, 22 bp, Artificial Sequence
  chemically synthesized
agaaatatgttgctgtttatca

SEQ ID NO: 1292878 - DNA, 22 bp, Artificial Sequence
  chemically synthesized
ttagaaatatgttgctgtttat

SEQ ID NO: 1292879 - DNA, 22 bp, Artificial Sequence
  chemically synthesized
cttagaaatatgttgctgttta

SEQ ID NO: 1292880 - DNA, 22 bp, Artificial Sequence
  chemically synthesized
ggttgataaacagcaacatatt

SEQ ID NO: 1292881 - DNA, 22 bp, Artificial Sequence
  chemically synthesized
ataaacagcaacatatttctaa

SEQ ID NO: 1292882 - DNA, 22 bp, Artificial Sequence
  chemically synthesized
atagtaaagaagtttcttagaa

SEQ ID NO: 1292883 - DNA, 22 bp, Artificial Sequence
  chemically synthesized
ttaatagtaaagaagtttctta

SEQ ID NO: 1292884 - DNA, 22 bp, Artificial Sequence
  chemically synthesized
ttgttaatagtaaagaagtttc

SEQ ID NO: 1292885 - DNA, 22 bp, Artificial Sequence
  chemically synthesized
attgttaatagtaaagaagttt

SEQ ID NO: 1292886 - DNA, 22 bp, Artificial Sequence
  chemically synthesized
ctaagaaacttctttactatta

SEQ ID NO: 1292887 - DNA, 22 bp, Artificial Sequence
  chemically synthesized
taagaaacttctttactattaa

SEQ ID NO: 1292888 - DNA, 22 bp, Artificial Sequence
  chemically synthesized
agaaacttctttactattaaca

SEQ ID NO: 1292889 - DNA, 22 bp, Artificial Sequence
  chemically synthesized
ctttactattaacaataagtga

SEQ ID NO: 1292890 - DNA, 22 bp, Artificial Sequence
  chemically synthesized
tttactattaacaataagtgat

SEQ ID NO: 1292891 - DNA, 22 bp, Artificial Sequence
  chemically synthesized
aaagaaagacaaatcacttatt

SEQ ID NO: 1292892 - DNA, 22 bp, Artificial Sequence
  chemically synthesized
caaagaaagacaaatcacttat

SEQ ID NO: 1292893 - DNA, 22 bp, Artificial Sequence
  chemically synthesized
tactattaacaataagtgattt

SEQ ID NO: 1292894 - DNA, 22 bp, Artificial Sequence
  chemically synthesized
tcaaagaaagacaaatcactta

SEQ ID NO: 1292895 - DNA, 22 bp, Artificial Sequence
  chemically synthesized
actattaacaataagtgatttg

SEQ ID NO: 1292896 - DNA, 22 bp, Artificial Sequence
  chemically synthesized
ctattaacaataagtgatttgt

SEQ ID NO: 1292897 - DNA, 22 bp, Artificial Sequence
  chemically synthesized
ttttcaaagaaagacaaatcac

SEQ ID NO: 1292898 - DNA, 22 bp, Artificial Sequence
  chemically synthesized
ttaacaataagtgatttgtctt

SEQ ID NO: 1292899 - DNA, 22 bp, Artificial Sequence
  chemically synthesized
actgttttcaaagaaagacaaa

SEQ ID NO: 1292900 - DNA, 22 bp, Artificial Sequence
  chemically synthesized
acaataagtgatttgtctttct

SEQ ID NO: 1292901 - DNA, 22 bp, Artificial Sequence
  chemically synthesized
tgataggtctcactgttttcaa

SEQ ID NO: 1292902 - DNA, 22 bp, Artificial Sequence
  chemically synthesized
gtctttctttgaaaacagtgag

SEQ ID NO: 1292903 - DNA, 22 bp, Artificial Sequence
  chemically synthesized
tctttctttgaaaacagtgaga

SEQ ID NO: 1292904 - DNA, 22 bp, Artificial Sequence
  chemically synthesized
tctttgaaaacagtgagaccta

SEQ ID NO: 1292905 - DNA, 22 bp, Artificial Sequence
  chemically synthesized
ctttgaaaacagtgagacctat

SEQ ID NO: 1292906 - DNA, 22 bp, Artificial Sequence
  chemically synthesized
tttgaaaacagtgagacctatc

SEQ ID NO: 1292907 - DNA, 22 bp, Artificial Sequence
  chemically synthesized
tgaaaacagtgagacctatcac

SEQ ID NO: 1292908 - DNA, 22 bp, Artificial Sequence
  chemically synthesized
gaaaacagtgagacctatcaca

SEQ ID NO: 1292909 - DNA, 22 bp, Artificial Sequence
  chemically synthesized
aaaacagtgagacctatcacaa

SEQ ID NO: 1292910 - DNA, 22 bp, Artificial Sequence
  chemically synthesized
gtgagacaaaaatggattgtga

SEQ ID NO: 1292911 - DNA, 22 bp, Artificial Sequence
  chemically synthesized
agttagtgagacaaaaatggat

SEQ ID NO: 1292912 - DNA, 22 bp, Artificial Sequence
  chemically synthesized
ctcagttagtgagacaaaaatg

SEQ ID NO: 1292913 - DNA, 22 bp, Artificial Sequence
  chemically synthesized
tcacaatccatttttgtctcac

SEQ ID NO: 1292914 - DNA, 22 bp, Artificial Sequence
  chemically synthesized
ttgtctcactaactgagtaata

SEQ ID NO: 1292915 - DNA, 22 bp, Artificial Sequence
  chemically synthesized
agtaacaaaggatattactcag

SEQ ID NO: 1292916 - DNA, 22 bp, Artificial Sequence
  chemically synthesized
tgtctcactaactgagtaatat

SEQ ID NO: 1292917 - DNA, 22 bp, Artificial Sequence
  chemically synthesized
gtctcactaactgagtaatatc

SEQ ID NO: 1292918 - DNA, 22 bp, Artificial Sequence
  chemically synthesized
tctcactaactgagtaatatcc

SEQ ID NO: 1292919 - DNA, 22 bp, Artificial Sequence
  chemically synthesized
actaactgagtaatatcctttg

SEQ ID NO: 1292920 - DNA, 22 bp, Artificial Sequence
  chemically synthesized
actgagtaatatcctttgttac

SEQ ID NO: 1292921 - DNA, 22 bp, Artificial Sequence
  chemically synthesized
caaagtacctaagtaacaaagg

SEQ ID NO: 1292922 - DNA, 22 bp, Artificial Sequence
  chemically synthesized
gcaaagtacctaagtaacaaag

SEQ ID NO: 1292923 - DNA, 22 bp, Artificial Sequence
  chemically synthesized
tgcaaagtacctaagtaacaaa

SEQ ID NO: 1292924 - DNA, 22 bp, Artificial Sequence
  chemically synthesized
agtaatatcctttgttacttag

SEQ ID NO: 1292925 - DNA, 22 bp, Artificial Sequence
  chemically synthesized
aaacaatctttgcaaagtacct

SEQ ID NO: 1292926 - DNA, 22 bp, Artificial Sequence
  chemically synthesized
ctgaaacaatctttgcaaagta

SEQ ID NO: 1292927 - DNA, 22 bp, Artificial Sequence
  chemically synthesized
tgttacttaggtactttgcaaa

SEQ ID NO: 1292928 - DNA, 22 bp, Artificial Sequence
  chemically synthesized
cctgaaacaatctttgcaaagt

SEQ ID NO: 1292929 - DNA, 22 bp, Artificial Sequence
  chemically synthesized
gttacttaggtactttgcaaag

SEQ ID NO: 1292930 - DNA, 22 bp, Artificial Sequence
  chemically synthesized
tcctgaaacaatctttgcaaag

SEQ ID NO: 1292931 - DNA, 22 bp, Artificial Sequence
  chemically synthesized
ttacttaggtactttgcaaaga

SEQ ID NO: 1292932 - DNA, 22 bp, Artificial Sequence
  chemically synthesized
cttaggtactttgcaaagattg

SEQ ID NO: 1292933 - DNA, 22 bp, Artificial Sequence
  chemically synthesized
aggtactttgcaaagattgttt

SEQ ID NO: 1292934 - DNA, 22 bp, Artificial Sequence
  chemically synthesized
aatgttttcctgaaacaatctt

SEQ ID NO: 1292935 - DNA, 22 bp, Artificial Sequence
  chemically synthesized
ggtactttgcaaagattgtttc

SEQ ID NO: 1292936 - DNA, 22 bp, Artificial Sequence
  chemically synthesized
gaatgttttcctgaaacaatct

SEQ ID NO: 1292937 - DNA, 22 bp, Artificial Sequence
  chemically synthesized
ccttgaatgttttcctgaaaca

SEQ ID NO: 1292938 - DNA, 22 bp, Artificial Sequence
  chemically synthesized
tgcaaagattgtttcaggaaaa

SEQ ID NO: 1292939 - DNA, 22 bp, Artificial Sequence
  chemically synthesized
gcaaagattgtttcaggaaaac

SEQ ID NO: 1292940 - DNA, 22 bp, Artificial Sequence
  chemically synthesized
caaagattgtttcaggaaaaca

SEQ ID NO: 1292941 - DNA, 22 bp, Artificial Sequence
  chemically synthesized
agaaccattcccttgaatgttt

SEQ ID NO: 1292942 - DNA, 22 bp, Artificial Sequence
  chemically synthesized
ctgagaaccattcccttgaatg

SEQ ID NO: 1292943 - DNA, 22 bp, Artificial Sequence
  chemically synthesized
tttcaggaaaacattcaaggga

SEQ ID NO: 1292944 - DNA, 22 bp, Artificial Sequence
  chemically synthesized
caggaaaacattcaagggaatg

SEQ ID NO: 1292945 - DNA, 22 bp, Artificial Sequence
  chemically synthesized
aggaaaacattcaagggaatgg

SEQ ID NO: 1292946 - DNA, 22 bp, Artificial Sequence
  chemically synthesized
atctactgagaaccattccctt

SEQ ID NO: 1292947 - DNA, 22 bp, Artificial Sequence
  chemically synthesized
aatctactgagaaccattccct

SEQ ID NO: 1292948 - DNA, 22 bp, Artificial Sequence
  chemically synthesized
aatggtttaatctactgagaac

SEQ ID NO: 1292949 - DNA, 22 bp, Artificial Sequence
  chemically synthesized
aagggaatggttctcagtagat

SEQ ID NO: 1292950 - DNA, 22 bp, Artificial Sequence
  chemically synthesized
tactaaatggtttaatctactg

SEQ ID NO: 1292951 - DNA, 22 bp, Artificial Sequence
  chemically synthesized
tcagtagattaaaccatttagt

SEQ ID NO: 1292952 - DNA, 22 bp, Artificial Sequence
  chemically synthesized
agtagattaaaccatttagtat

SEQ ID NO: 1292953 - DNA, 22 bp, Artificial Sequence
  chemically synthesized
gaatcaagatgattatactaaa

SEQ ID NO: 1292954 - DNA, 22 bp, Artificial Sequence
  chemically synthesized
ggaatcaagatgattatactaa

SEQ ID NO: 1292955 - DNA, 22 bp, Artificial Sequence
  chemically synthesized
tgtttggaatcaagatgattat

SEQ ID NO: 1292956 - DNA, 22 bp, Artificial Sequence
  chemically synthesized
aaccatttagtataatcatctt

SEQ ID NO: 1292957 - DNA, 22 bp, Artificial Sequence
  chemically synthesized
gtgtttggaatcaagatgatta

SEQ ID NO: 1292958 - DNA, 22 bp, Artificial Sequence
  chemically synthesized
agtataatcatcttgattccaa

SEQ ID NO: 1292959 - DNA, 22 bp, Artificial Sequence
  chemically synthesized
gtataatcatcttgattccaaa

SEQ ID NO: 1292960 - DNA, 22 bp, Artificial Sequence
  chemically synthesized
tcgaatgatgtgtttgtgtttg

SEQ ID NO: 1292961 - DNA, 22 bp, Artificial Sequence
  chemically synthesized
gtcgaatgatgtgtttgtgttt

SEQ ID NO: 1292962 - DNA, 22 bp, Artificial Sequence
  chemically synthesized
gattccaaacacaaacacatca

SEQ ID NO: 1292963 - DNA, 22 bp, Artificial Sequence
  chemically synthesized
attccaaacacaaacacatcat

SEQ ID NO: 1292964 - DNA, 22 bp, Artificial Sequence
  chemically synthesized
agatgacttgtcgaatgatgtg

SEQ ID NO: 1292965 - DNA, 22 bp, Artificial Sequence
  chemically synthesized
caaacacaaacacatcattcga

SEQ ID NO: 1292966 - DNA, 22 bp, Artificial Sequence
  chemically synthesized
gtgttaagatgacttgtcgaat

SEQ ID NO: 1292967 - DNA, 22 bp, Artificial Sequence
  chemically synthesized
ggtgttaagatgacttgtcgaa

SEQ ID NO: 1292968 - DNA, 22 bp, Artificial Sequence
  chemically synthesized
cacttggtgttaagatgacttg

SEQ ID NO: 1292969 - DNA, 22 bp, Artificial Sequence
  chemically synthesized
acatctacacttggtgttaaga

SEQ ID NO: 1292970 - DNA, 22 bp, Artificial Sequence
  chemically synthesized
gacaagtcatcttaacaccaag

SEQ ID NO: 1292971 - DNA, 22 bp, Artificial Sequence
  chemically synthesized
cctaacatctacacttggtgtt

SEQ ID NO: 1292972 - DNA, 22 bp, Artificial Sequence
  chemically synthesized
aacaccaagtgtagatgttagg

SEQ ID NO: 1292973 - DNA, 22 bp, Artificial Sequence
  chemically synthesized
gcatgtgaactccctaacatct

SEQ ID NO: 1292974 - DNA, 22 bp, Artificial Sequence
  chemically synthesized
acaccaagtgtagatgttaggg

SEQ ID NO: 1292975 - DNA, 22 bp, Artificial Sequence
  chemically synthesized
ctggcatgtgaactccctaaca

SEQ ID NO: 1292976 - DNA, 22 bp, Artificial Sequence
  chemically synthesized
actggcatgtgaactccctaac

SEQ ID NO: 1292977 - DNA, 22 bp, Artificial Sequence
  chemically synthesized
tactggcatgtgaactccctaa

SEQ ID NO: 1292978 - DNA, 22 bp, Artificial Sequence
  chemically synthesized
aaaataccactttactggcatg

SEQ ID NO: 1292979 - DNA, 22 bp, Artificial Sequence
  chemically synthesized
gggagttcacatgccagtaaag

SEQ ID NO: 1292980 - DNA, 22 bp, Artificial Sequence
  chemically synthesized
tacgaaattcaaaataccactt

SEQ ID NO: 1292981 - DNA, 22 bp, Artificial Sequence
  chemically synthesized
acatgccagtaaagtggtattt

SEQ ID NO: 1292982 - DNA, 22 bp, Artificial Sequence
  chemically synthesized
atacgaaattcaaaataccact

SEQ ID NO: 1292983 - DNA, 22 bp, Artificial Sequence
  chemically synthesized
tatacgaaattcaaaataccac

SEQ ID NO: 1292984 - DNA, 22 bp, Artificial Sequence
  chemically synthesized
aaacagttttatacgaaattca

SEQ ID NO: 1292985 - DNA, 22 bp, Artificial Sequence
  chemically synthesized
aaaacagttttatacgaaattc

SEQ ID NO: 1292986 - DNA, 22 bp, Artificial Sequence
  chemically synthesized
acttaaaacagttttatacgaa

SEQ ID NO: 1292987 - DNA, 22 bp, Artificial Sequence
  chemically synthesized
tgaatttcgtataaaactgttt

SEQ ID NO: 1292988 - DNA, 22 bp, Artificial Sequence
  chemically synthesized
aatattaacttaaaacagtttt

SEQ ID NO: 1292989 - DNA, 22 bp, Artificial Sequence
  chemically synthesized
gaatttcgtataaaactgtttt

SEQ ID NO: 1292990 - DNA, 22 bp, Artificial Sequence
  chemically synthesized
gaatattaacttaaaacagttt

SEQ ID NO: 1292991 - DNA, 22 bp, Artificial Sequence
  chemically synthesized
aatttcgtataaaactgtttta

SEQ ID NO: 1292992 - DNA, 22 bp, Artificial Sequence
  chemically synthesized
tttgaatattaacttaaaacag

SEQ ID NO: 1292993 - DNA, 22 bp, Artificial Sequence
  chemically synthesized
cgtataaaactgttttaagtta

SEQ ID NO: 1292994 - DNA, 22 bp, Artificial Sequence
  chemically synthesized
gtataaaactgttttaagttaa

SEQ ID NO: 1292995 - DNA, 22 bp, Artificial Sequence
  chemically synthesized
catgattatttgaatattaact

SEQ ID NO: 1292996 - DNA, 22 bp, Artificial Sequence
  chemically synthesized
acatgattatttgaatattaac

SEQ ID NO: 1292997 - DNA, 22 bp, Artificial Sequence
  chemically synthesized
tgtttacatgattatttgaata

SEQ ID NO: 1292998 - DNA, 22 bp, Artificial Sequence
  chemically synthesized
ttttaagttaatattcaaataa

SEQ ID NO: 1292999 - DNA, 22 bp, Artificial Sequence
  chemically synthesized
ttgtgtttacatgattatttga

SEQ ID NO: 1293000 - DNA, 22 bp, Artificial Sequence
  chemically synthesized
taagttaatattcaaataatca

SEQ ID NO: 1293001 - DNA, 22 bp, Artificial Sequence
  chemically synthesized
aagttaatattcaaataatcat

SEQ ID NO: 1293002 - DNA, 22 bp, Artificial Sequence
  chemically synthesized
agttaatattcaaataatcatg

SEQ ID NO: 1293003 - DNA, 22 bp, Artificial Sequence
  chemically synthesized
atattcaaataatcatgtaaac

SEQ ID NO: 1293004 - DNA, 22 bp, Artificial Sequence
  chemically synthesized
ataaacaaattattgtgtttac

SEQ ID NO: 1293005 - DNA, 22 bp, Artificial Sequence
  chemically synthesized
aaataatcatgtaaacacaata

SEQ ID NO: 1293006 - DNA, 22 bp, Artificial Sequence
  chemically synthesized
ctcataaacaaattattgtgtt

SEQ ID NO: 1293007 - DNA, 22 bp, Artificial Sequence
  chemically synthesized
ctactcataaacaaattattgt

SEQ ID NO: 1293008 - DNA, 22 bp, Artificial Sequence
  chemically synthesized
tactactcataaacaaattatt

SEQ ID NO: 1293009 - DNA, 22 bp, Artificial Sequence
  chemically synthesized
ctactactcataaacaaattat

SEQ ID NO: 1293010 - DNA, 22 bp, Artificial Sequence
  chemically synthesized
tttctactactcataaacaaat

SEQ ID NO: 1293011 - DNA, 22 bp, Artificial Sequence
  chemically synthesized
atttctactactcataaacaaa

SEQ ID NO: 1293012 - DNA, 22 bp, Artificial Sequence
  chemically synthesized
tatttctactactcataaacaa

SEQ ID NO: 1293013 - DNA, 22 bp, Artificial Sequence
  chemically synthesized
ttatttctactactcataaaca

SEQ ID NO: 1293014 - DNA, 22 bp, Artificial Sequence
  chemically synthesized
tttatttctactactcataaac

SEQ ID NO: 1293015 - DNA, 22 bp, Artificial Sequence
  chemically synthesized
ctttttatttctactactcata

SEQ ID NO: 1293016 - DNA, 22 bp, Artificial Sequence
  chemically synthesized
aaacattgctttttatttctac

SEQ ID NO: 1293017 - DNA, 22 bp, Artificial Sequence
  chemically synthesized
gtttatgagtagtagaaataaa

SEQ ID NO: 1293018 - DNA, 22 bp, Artificial Sequence
  chemically synthesized
caaacattgctttttatttcta

SEQ ID NO: 1293019 - DNA, 22 bp, Artificial Sequence
  chemically synthesized
tttatgagtagtagaaataaaa

SEQ ID NO: 1293020 - DNA, 22 bp, Artificial Sequence
  chemically synthesized
tcaaacattgctttttatttct

SEQ ID NO: 1293021 - DNA, 22 bp, Artificial Sequence
  chemically synthesized
atgagtagtagaaataaaaagc

SEQ ID NO: 1293022 - DNA, 22 bp, Artificial Sequence
  chemically synthesized
tgagtagtagaaataaaaagca

SEQ ID NO: 1293023 - DNA, 22 bp, Artificial Sequence
  chemically synthesized
tcattttcaaacattgcttttt

SEQ ID NO: 1293024 - DNA, 22 bp, Artificial Sequence
  chemically synthesized
aagtgatattgtcattttcaaa

SEQ ID NO: 1293025 - DNA, 22 bp, Artificial Sequence
  chemically synthesized
tctaaagtgatattgtcatttt

SEQ ID NO: 1293026 - DNA, 22 bp, Artificial Sequence
  chemically synthesized
gaaaatgacaatatcactttag

SEQ ID NO: 1293027 - DNA, 22 bp, Artificial Sequence
  chemically synthesized
cagtagagttatctaaagtgat

SEQ ID NO: 1293028 - DNA, 22 bp, Artificial Sequence
  chemically synthesized
aaaatgacaatatcactttaga

SEQ ID NO: 1293029 - DNA, 22 bp, Artificial Sequence
  chemically synthesized
gcagtagagttatctaaagtga

SEQ ID NO: 1293030 - DNA, 22 bp, Artificial Sequence
  chemically synthesized
gtttgcagtagagttatctaaa

SEQ ID NO: 1293031 - DNA, 22 bp, Artificial Sequence
  chemically synthesized
agtttgcagtagagttatctaa

SEQ ID NO: 1293032 - DNA, 22 bp, Artificial Sequence
  chemically synthesized
tagataactctactgcaaacta

SEQ ID NO: 1293033 - DNA, 22 bp, Artificial Sequence
  chemically synthesized
agataactctactgcaaactaa

SEQ ID NO: 1293034 - DNA, 22 bp, Artificial Sequence
  chemically synthesized
gataactctactgcaaactaag

SEQ ID NO: 1293035 - DNA, 22 bp, Artificial Sequence
  chemically synthesized
gtgagtgaagtaaacttagttt

SEQ ID NO: 1293036 - DNA, 22 bp, Artificial Sequence
  chemically synthesized
ggtgagtgaagtaaacttagtt

SEQ ID NO: 1293037 - DNA, 22 bp, Artificial Sequence
  chemically synthesized
tggtgagtgaagtaaacttagt

SEQ ID NO: 1293038 - DNA, 22 bp, Artificial Sequence
  chemically synthesized
tactgcaaactaagtttacttc

SEQ ID NO: 1293039 - DNA, 22 bp, Artificial Sequence
  chemically synthesized
cgttttggtgagtgaagtaaac

SEQ ID NO: 1293040 - DNA, 22 bp, Artificial Sequence
  chemically synthesized
ctgcaaactaagtttacttcac

SEQ ID NO: 1293041 - DNA, 22 bp, Artificial Sequence
  chemically synthesized
caaactaagtttacttcactca

SEQ ID NO: 1293042 - DNA, 22 bp, Artificial Sequence
  chemically synthesized
catactgcgttttggtgagtga

SEQ ID NO: 1293043 - DNA, 22 bp, Artificial Sequence
  chemically synthesized
acatactgcgttttggtgagtg

SEQ ID NO: 1293044 - DNA, 22 bp, Artificial Sequence
  chemically synthesized
tacatactgcgttttggtgagt

SEQ ID NO: 1293045 - DNA, 22 bp, Artificial Sequence
  chemically synthesized
ttacatactgcgttttggtgag

SEQ ID NO: 1293046 - DNA, 22 bp, Artificial Sequence
  chemically synthesized
agtttacttcactcaccaaaac

SEQ ID NO: 1293047 - DNA, 22 bp, Artificial Sequence
  chemically synthesized
tttacatactgcgttttggtga

SEQ ID NO: 1293048 - DNA, 22 bp, Artificial Sequence
  chemically synthesized
acttcactcaccaaaacgcagt

SEQ ID NO: 1293049 - DNA, 22 bp, Artificial Sequence
  chemically synthesized
cttcactcaccaaaacgcagta

SEQ ID NO: 1293050 - DNA, 22 bp, Artificial Sequence
  chemically synthesized
atattttttacatactgcgttt

SEQ ID NO: 1293051 - DNA, 22 bp, Artificial Sequence
  chemically synthesized
cactcaccaaaacgcagtatgt

SEQ ID NO: 1293052 - DNA, 22 bp, Artificial Sequence
  chemically synthesized
actcaccaaaacgcagtatgta

SEQ ID NO: 1293053 - DNA, 22 bp, Artificial Sequence
  chemically synthesized
aatgttaatattttttacatac

SEQ ID NO: 1293054 - DNA, 22 bp, Artificial Sequence
  chemically synthesized
accaaaacgcagtatgtaaaaa

SEQ ID NO: 1293055 - DNA, 22 bp, Artificial Sequence
  chemically synthesized
aaatgttaatattttttacata

SEQ ID NO: 1293056 - DNA, 22 bp, Artificial Sequence
  chemically synthesized
taaatgttaatattttttacat

SEQ ID NO: 1293057 - DNA, 22 bp, Artificial Sequence
  chemically synthesized
tactttaaatgttaatattttt

SEQ ID NO: 1293058 - DNA, 22 bp, Artificial Sequence
  chemically synthesized
gtactttaaatgttaatatttt

SEQ ID NO: 1293059 - DNA, 22 bp, Artificial Sequence
  chemically synthesized
tttgtactttaaatgttaatat

SEQ ID NO: 1293060 - DNA, 22 bp, Artificial Sequence
  chemically synthesized
agtcgagaactgtttgtacttt

SEQ ID NO: 1293061 - DNA, 22 bp, Artificial Sequence
  chemically synthesized
aagtcgagaactgtttgtactt

SEQ ID NO: 1293062 - DNA, 22 bp, Artificial Sequence
  chemically synthesized
acatttaaagtacaaacagttc

SEQ ID NO: 1293063 - DNA, 22 bp, Artificial Sequence
  chemically synthesized
aaagtacaaacagttctcgact

SEQ ID NO: 1293064 - DNA, 22 bp, Artificial Sequence
  chemically synthesized
aagtacaaacagttctcgactt

SEQ ID NO: 1293065 - DNA, 22 bp, Artificial Sequence
  chemically synthesized
taaggtcaaaatatcttaagtc

SEQ ID NO: 1293066 - DNA, 22 bp, Artificial Sequence
  chemically synthesized
ttataaggtcaaaatatcttaa

SEQ ID NO: 1293067 - DNA, 22 bp, Artificial Sequence
  chemically synthesized
cactattataaggtcaaaatat

SEQ ID NO: 1293068 - DNA, 22 bp, Artificial Sequence
  chemically synthesized
acactattataaggtcaaaata

SEQ ID NO: 1293069 - DNA, 22 bp, Artificial Sequence
  chemically synthesized
tcgacttaagatattttgacct

SEQ ID NO: 1293070 - DNA, 22 bp, Artificial Sequence
  chemically synthesized
gacttaagatattttgacctta

SEQ ID NO: 1293071 - DNA, 22 bp, Artificial Sequence
  chemically synthesized
aagatattttgaccttataata

SEQ ID NO: 1293072 - DNA, 22 bp, Artificial Sequence
  chemically synthesized
agatattttgaccttataatag

SEQ ID NO: 1293073 - DNA, 22 bp, Artificial Sequence
  chemically synthesized
aatgagtatcaccttacactat

SEQ ID NO: 1293074 - DNA, 22 bp, Artificial Sequence
  chemically synthesized
tgaccttataatagtgtaaggt

SEQ ID NO: 1293075 - DNA, 22 bp, Artificial Sequence
  chemically synthesized
gaccttataatagtgtaaggtg

SEQ ID NO: 1293076 - DNA, 22 bp, Artificial Sequence
  chemically synthesized
ctaaatgagtatcaccttacac

SEQ ID NO: 1293077 - DNA, 22 bp, Artificial Sequence
  chemically synthesized
accttataatagtgtaaggtga

SEQ ID NO: 1293078 - DNA, 22 bp, Artificial Sequence
  chemically synthesized
tactaaatgagtatcaccttac

SEQ ID NO: 1293079 - DNA, 22 bp, Artificial Sequence
  chemically synthesized
ctactaaatgagtatcacctta

SEQ ID NO: 1293080 - DNA, 22 bp, Artificial Sequence
  chemically synthesized
ataatagtgtaaggtgatactc

SEQ ID NO: 1293081 - DNA, 22 bp, Artificial Sequence
  chemically synthesized
taatagtgtaaggtgatactca

SEQ ID NO: 1293082 - DNA, 22 bp, Artificial Sequence
  chemically synthesized
aaaatacggtttctactaaatg

SEQ ID NO: 1293083 - DNA, 22 bp, Artificial Sequence
  chemically synthesized
atttagtagaaaccgtattttg

SEQ ID NO: 1293084 - DNA, 22 bp, Artificial Sequence
  chemically synthesized
agtagaaaccgtattttgagta

SEQ ID NO: 1293085 - DNA, 22 bp, Artificial Sequence
  chemically synthesized
gtagaaaccgtattttgagtac

SEQ ID NO: 1293086 - DNA, 22 bp, Artificial Sequence
  chemically synthesized
tgagtacccatacatgcattct

SEQ ID NO: 1293087 - DNA, 22 bp, Artificial Sequence
  chemically synthesized
aaagtgaaaaacagaatgcatg

SEQ ID NO: 1293088 - DNA, 22 bp, Artificial Sequence
  chemically synthesized
gagtacccatacatgcattctg

SEQ ID NO: 1293089 - DNA, 22 bp, Artificial Sequence
  chemically synthesized
agtacccatacatgcattctgt

SEQ ID NO: 1293090 - DNA, 22 bp, Artificial Sequence
  chemically synthesized
tactgaaagtgaaaaacagaat

SEQ ID NO: 1293091 - DNA, 22 bp, Artificial Sequence
  chemically synthesized
aatactgtactgaaagtgaaaa

SEQ ID NO: 1293092 - DNA, 22 bp, Artificial Sequence
  chemically synthesized
attgaatactgtactgaaagtg

SEQ ID NO: 1293093 - DNA, 22 bp, Artificial Sequence
  chemically synthesized
tgtttttcactttcagtacagt

SEQ ID NO: 1293094 - DNA, 22 bp, Artificial Sequence
  chemically synthesized
tttttcactttcagtacagtat

SEQ ID NO: 1293095 - DNA, 22 bp, Artificial Sequence
  chemically synthesized
atgtaattgattgaatactgta

SEQ ID NO: 1293096 - DNA, 22 bp, Artificial Sequence
  chemically synthesized
ttcactttcagtacagtattca

SEQ ID NO: 1293097 - DNA, 22 bp, Artificial Sequence
  chemically synthesized
tcactttcagtacagtattcaa

SEQ ID NO: 1293098 - DNA, 22 bp, Artificial Sequence
  chemically synthesized
cactttcagtacagtattcaat

SEQ ID NO: 1293099 - DNA, 22 bp, Artificial Sequence
  chemically synthesized
actttcagtacagtattcaatc

SEQ ID NO: 1293100 - DNA, 22 bp, Artificial Sequence
  chemically synthesized
gctcatgtaattgattgaatac

SEQ ID NO: 1293101 - DNA, 22 bp, Artificial Sequence
  chemically synthesized
tcagtacagtattcaatcaatt

SEQ ID NO: 1293102 - DNA, 22 bp, Artificial Sequence
  chemically synthesized
cagtacagtattcaatcaatta

SEQ ID NO: 1293103 - DNA, 22 bp, Artificial Sequence
  chemically synthesized
agtacagtattcaatcaattac

SEQ ID NO: 1293104 - DNA, 22 bp, Artificial Sequence
  chemically synthesized
taataaagctagctcatgtaat

SEQ ID NO: 1293105 - DNA, 22 bp, Artificial Sequence
  chemically synthesized
ataataaagctagctcatgtaa

SEQ ID NO: 1293106 - DNA, 22 bp, Artificial Sequence
  chemically synthesized
tataataaagctagctcatgta

SEQ ID NO: 1293107 - DNA, 22 bp, Artificial Sequence
  chemically synthesized
ttttataataaagctagctcat

SEQ ID NO: 1293108 - DNA, 22 bp, Artificial Sequence
  chemically synthesized
aatcaattacatgagctagctt

SEQ ID NO: 1293109 - DNA, 22 bp, Artificial Sequence
  chemically synthesized
catgagctagctttattataaa

SEQ ID NO: 1293110 - DNA, 22 bp, Artificial Sequence
  chemically synthesized
acacaaacctattttataataa

SEQ ID NO: 1293111 - DNA, 22 bp, Artificial Sequence
  chemically synthesized
cacacaaacctattttataata

SEQ ID NO: 1293112 - DNA, 22 bp, Artificial Sequence
  chemically synthesized
gctttattataaaataggtttg

SEQ ID NO: 1293113 - DNA, 22 bp, Artificial Sequence
  chemically synthesized
tattataaaataggtttgtgtg

SEQ ID NO: 1293114 - DNA, 22 bp, Artificial Sequence
  chemically synthesized
attataaaataggtttgtgtga

SEQ ID NO: 1293115 - DNA, 22 bp, Artificial Sequence
  chemically synthesized
ggcaaaatcatttcacacaaac

SEQ ID NO: 1293116 - DNA, 22 bp, Artificial Sequence
  chemically synthesized
ttataaaataggtttgtgtgaa

SEQ ID NO: 1293117 - DNA, 22 bp, Artificial Sequence
  chemically synthesized
taaaataggtttgtgtgaaatg

SEQ ID NO: 1293118 - DNA, 22 bp, Artificial Sequence
  chemically synthesized
gagctgggcaaaatcatttcac

SEQ ID NO: 1293119 - DNA, 22 bp, Artificial Sequence
  chemically synthesized
tcctagagctgggcaaaatcat

SEQ ID NO: 1293120 - DNA, 22 bp, Artificial Sequence
  chemically synthesized
gtgtgaaatgattttgcccagc

SEQ ID NO: 1293121 - DNA, 22 bp, Artificial Sequence
  chemically synthesized
tgtgaaatgattttgcccagct

SEQ ID NO: 1293122 - DNA, 22 bp, Artificial Sequence
  chemically synthesized
acactatcctagagctgggcaa

SEQ ID NO: 1293123 - DNA, 22 bp, Artificial Sequence
  chemically synthesized
aacactatcctagagctgggca

SEQ ID NO: 1293124 - DNA, 22 bp, Artificial Sequence
  chemically synthesized
gcttaacactatcctagagctg

SEQ ID NO: 1293125 - DNA, 22 bp, Artificial Sequence
  chemically synthesized
tgcccagctctaggatagtgtt

SEQ ID NO: 1293126 - DNA, 22 bp, Artificial Sequence
  chemically synthesized
gcccagctctaggatagtgtta

SEQ ID NO: 1293127 - DNA, 22 bp, Artificial Sequence
  chemically synthesized
aatgtgctggcttaacactatc

SEQ ID NO: 1293128 - DNA, 22 bp, Artificial Sequence
  chemically synthesized
cccagctctaggatagtgttaa

SEQ ID NO: 1293129 - DNA, 22 bp, Artificial Sequence
  chemically synthesized
aaatgtgctggcttaacactat

SEQ ID NO: 1293130 - DNA, 22 bp, Artificial Sequence
  chemically synthesized
taaatgtgctggcttaacacta

SEQ ID NO: 1293131 - DNA, 22 bp, Artificial Sequence
  chemically synthesized
ctttaaatgtgctggcttaaca

SEQ ID NO: 1293132 - DNA, 22 bp, Artificial Sequence
  chemically synthesized
taggatagtgttaagccagcac

SEQ ID NO: 1293133 - DNA, 22 bp, Artificial Sequence
  chemically synthesized
ccctactttaaatgtgctggct

SEQ ID NO: 1293134 - DNA, 22 bp, Artificial Sequence
  chemically synthesized
ggatagtgttaagccagcacat

SEQ ID NO: 1293135 - DNA, 22 bp, Artificial Sequence
  chemically synthesized
gcctaccctactttaaatgtgc

SEQ ID NO: 1293136 - DNA, 22 bp, Artificial Sequence
  chemically synthesized
agcctaccctactttaaatgtg

SEQ ID NO: 1293137 - DNA, 22 bp, Artificial Sequence
  chemically synthesized
agccagcacatttaaagtaggg

SEQ ID NO: 1293138 - DNA, 22 bp, Artificial Sequence
  chemically synthesized
gaaacaacatagcttagcctac

SEQ ID NO: 1293139 - DNA, 22 bp, Artificial Sequence
  chemically synthesized
cgaaacaacatagcttagccta

SEQ ID NO: 1293140 - DNA, 22 bp, Artificial Sequence
  chemically synthesized
aaagtagggtaggctaagctat

SEQ ID NO: 1293141 - DNA, 22 bp, Artificial Sequence
  chemically synthesized
aagtagggtaggctaagctatg

SEQ ID NO: 1293142 - DNA, 22 bp, Artificial Sequence
  chemically synthesized
accttcgaaacaacatagctta

SEQ ID NO: 1293143 - DNA, 22 bp, Artificial Sequence
  chemically synthesized
atatacctaaccttcgaaacaa

SEQ ID NO: 1293144 - DNA, 22 bp, Artificial Sequence
  chemically synthesized
aatatacctaaccttcgaaaca

SEQ ID NO: 1293145 - DNA, 22 bp, Artificial Sequence
  chemically synthesized
taatatacctaaccttcgaaac

SEQ ID NO: 1293146 - DNA, 22 bp, Artificial Sequence
  chemically synthesized
agctatgttgtttcgaaggtta

SEQ ID NO: 1293147 - DNA, 22 bp, Artificial Sequence
  chemically synthesized
tgttgtttcgaaggttaggtat

SEQ ID NO: 1293148 - DNA, 22 bp, Artificial Sequence
  chemically synthesized
tttcgaaggttaggtatattaa

SEQ ID NO: 1293149 - DNA, 22 bp, Artificial Sequence
  chemically synthesized
cgaaggttaggtatattaaagg

SEQ ID NO: 1293150 - DNA, 22 bp, Artificial Sequence
  chemically synthesized
gaaggttaggtatattaaaggc

SEQ ID NO: 1293151 - DNA, 22 bp, Artificial Sequence
  chemically synthesized
ggtatattaaaggcatttttga

SEQ ID NO: 1293152 - DNA, 22 bp, Artificial Sequence
  chemically synthesized
aaaatatcacaagtcaaaaatg

SEQ ID NO: 1293153 - DNA, 22 bp, Artificial Sequence
  chemically synthesized
aaggcatttttgacttgtgata

SEQ ID NO: 1293154 - DNA, 22 bp, Artificial Sequence
  chemically synthesized
ttgacttgtgatattttcaact

SEQ ID NO: 1293155 - DNA, 22 bp, Artificial Sequence
  chemically synthesized
tgacttgtgatattttcaactt

SEQ ID NO: 1293156 - DNA, 22 bp, Artificial Sequence
  chemically synthesized
taaacccatcataagttgaaaa

SEQ ID NO: 1293157 - DNA, 22 bp, Artificial Sequence
  chemically synthesized
gacttgtgatattttcaactta

SEQ ID NO: 1293158 - DNA, 22 bp, Artificial Sequence
  chemically synthesized
acttgtgatattttcaacttat

SEQ ID NO: 1293159 - DNA, 22 bp, Artificial Sequence
  chemically synthesized
gtgatattttcaacttatgatg

SEQ ID NO: 1293160 - DNA, 22 bp, Artificial Sequence
  chemically synthesized
tgatattttcaacttatgatgg

SEQ ID NO: 1293161 - DNA, 22 bp, Artificial Sequence
  chemically synthesized
ggtccctataaacccatcataa

SEQ ID NO: 1293162 - DNA, 22 bp, Artificial Sequence
  chemically synthesized
tcaacttatgatgggtttatag

SEQ ID NO: 1293163 - DNA, 22 bp, Artificial Sequence
  chemically synthesized
caacttatgatgggtttatagg

SEQ ID NO: 1293164 - DNA, 22 bp, Artificial Sequence
  chemically synthesized
tgtggttaggtccctataaacc

SEQ ID NO: 1293165 - DNA, 22 bp, Artificial Sequence
  chemically synthesized
aacttatgatgggtttataggg

SEQ ID NO: 1293166 - DNA, 22 bp, Artificial Sequence
  chemically synthesized
gtgtggttaggtccctataaac

SEQ ID NO: 1293167 - DNA, 22 bp, Artificial Sequence
  chemically synthesized
atgatgggtttatagggaccta

SEQ ID NO: 1293168 - DNA, 22 bp, Artificial Sequence
  chemically synthesized
aacttgtgtggttaggtcccta

SEQ ID NO: 1293169 - DNA, 22 bp, Artificial Sequence
  chemically synthesized
tgatgggtttatagggacctaa

SEQ ID NO: 1293170 - DNA, 22 bp, Artificial Sequence
  chemically synthesized
atagggacctaaccacacaagt

SEQ ID NO: 1293171 - DNA, 22 bp, Artificial Sequence
  chemically synthesized
tagggacctaaccacacaagtt

SEQ ID NO: 1293172 - DNA, 22 bp, Artificial Sequence
  chemically synthesized
atacaaatgcccctcaacttgt

SEQ ID NO: 1293173 - DNA, 22 bp, Artificial Sequence
  chemically synthesized
taatacaaatgcccctcaactt

SEQ ID NO: 1293174 - DNA, 22 bp, Artificial Sequence
  chemically synthesized
ctaatacaaatgcccctcaact

SEQ ID NO: 1293175 - DNA, 22 bp, Artificial Sequence
  chemically synthesized
accacacaagttgaggggcatt

SEQ ID NO: 1293176 - DNA, 22 bp, Artificial Sequence
  chemically synthesized
aatgatttctaatacaaatgcc

SEQ ID NO: 1293177 - DNA, 22 bp, Artificial Sequence
  chemically synthesized
tgaatgatttctaatacaaatg

SEQ ID NO: 1293178 - DNA, 22 bp, Artificial Sequence
  chemically synthesized
ctgaatgatttctaatacaaat

SEQ ID NO: 1293179 - DNA, 22 bp, Artificial Sequence
  chemically synthesized
tctgaatgatttctaatacaaa

SEQ ID NO: 1293180 - DNA, 22 bp, Artificial Sequence
  chemically synthesized
tttctgaatgatttctaataca

SEQ ID NO: 1293181 - DNA, 22 bp, Artificial Sequence
  chemically synthesized
aggggcatttgtattagaaatc

SEQ ID NO: 1293182 - DNA, 22 bp, Artificial Sequence
  chemically synthesized
attctttctgaatgatttctaa

SEQ ID NO: 1293183 - DNA, 22 bp, Artificial Sequence
  chemically synthesized
gttgattctttctgaatgattt

SEQ ID NO: 1293184 - DNA, 22 bp, Artificial Sequence
  chemically synthesized
agttgattctttctgaatgatt

SEQ ID NO: 1293185 - DNA, 22 bp, Artificial Sequence
  chemically synthesized
tagttgattctttctgaatgat

SEQ ID NO: 1293186 - DNA, 22 bp, Artificial Sequence
  chemically synthesized
ttagttgattctttctgaatga

SEQ ID NO: 1293187 - DNA, 22 bp, Artificial Sequence
  chemically synthesized
tttagttgattctttctgaatg

SEQ ID NO: 1293188 - DNA, 22 bp, Artificial Sequence
  chemically synthesized
gtattagaaatcattcagaaag

SEQ ID NO: 1293189 - DNA, 22 bp, Artificial Sequence
  chemically synthesized
tattagaaatcattcagaaaga

SEQ ID NO: 1293190 - DNA, 22 bp, Artificial Sequence
  chemically synthesized
gaaatcattcagaaagaatcaa

SEQ ID NO: 1293191 - DNA, 22 bp, Artificial Sequence
  chemically synthesized
ggaagttttttagttgattctt

SEQ ID NO: 1293192 - DNA, 22 bp, Artificial Sequence
  chemically synthesized
aggaagttttttagttgattct

SEQ ID NO: 1293193 - DNA, 22 bp, Artificial Sequence
  chemically synthesized
tttaggaagttttttagttgat

SEQ ID NO: 1293194 - DNA, 22 bp, Artificial Sequence
  chemically synthesized
agaaagaatcaactaaaaaact

SEQ ID NO: 1293195 - DNA, 22 bp, Artificial Sequence
  chemically synthesized
aaaaacttcctaaacaatggtt

SEQ ID NO: 1293196 - DNA, 22 bp, Artificial Sequence
  chemically synthesized
gtaaccccaaaatgcaaccatt

SEQ ID NO: 1293197 - DNA, 22 bp, Artificial Sequence
  chemically synthesized
agtaaccccaaaatgcaaccat

SEQ ID NO: 1293198 - DNA, 22 bp, Artificial Sequence
  chemically synthesized
cctaaacaatggttgcattttg

SEQ ID NO: 1293199 - DNA, 22 bp, Artificial Sequence
  chemically synthesized
ctaaacaatggttgcattttgg

SEQ ID NO: 1293200 - DNA, 22 bp, Artificial Sequence
  chemically synthesized
aatgtttagtaaccccaaaatg

SEQ ID NO: 1293201 - DNA, 22 bp, Artificial Sequence
  chemically synthesized
aacaatggttgcattttggggt

SEQ ID NO: 1293202 - DNA, 22 bp, Artificial Sequence
  chemically synthesized
gaatgtttagtaaccccaaaat

SEQ ID NO: 1293203 - DNA, 22 bp, Artificial Sequence
  chemically synthesized
tgaatgtttagtaaccccaaaa

SEQ ID NO: 1293204 - DNA, 22 bp, Artificial Sequence
  chemically synthesized
cctttgaatgtttagtaacccc

SEQ ID NO: 1293205 - DNA, 22 bp, Artificial Sequence
  chemically synthesized
atctacctttgaatgtttagta

SEQ ID NO: 1293206 - DNA, 22 bp, Artificial Sequence
  chemically synthesized
cattttggggttactaaacatt

SEQ ID NO: 1293207 - DNA, 22 bp, Artificial Sequence
  chemically synthesized
aatctacctttgaatgtttagt

SEQ ID NO: 1293208 - DNA, 22 bp, Artificial Sequence
  chemically synthesized
tggggttactaaacattcaaag

SEQ ID NO: 1293209 - DNA, 22 bp, Artificial Sequence
  chemically synthesized
ggggttactaaacattcaaagg

SEQ ID NO: 1293210 - DNA, 22 bp, Artificial Sequence
  chemically synthesized
gggttactaaacattcaaaggt

SEQ ID NO: 1293211 - DNA, 22 bp, Artificial Sequence
  chemically synthesized
acagaggatttaatctaccttt

SEQ ID NO: 1293212 - DNA, 22 bp, Artificial Sequence
  chemically synthesized
ctaaacattcaaaggtagatta

SEQ ID NO: 1293213 - DNA, 22 bp, Artificial Sequence
  chemically synthesized
ctcacagaggatttaatctacc

SEQ ID NO: 1293214 - DNA, 22 bp, Artificial Sequence
  chemically synthesized
actcacagaggatttaatctac

SEQ ID NO: 1293215 - DNA, 22 bp, Artificial Sequence
  chemically synthesized
aacattcaaaggtagattaaat

SEQ ID NO: 1293216 - DNA, 22 bp, Artificial Sequence
  chemically synthesized
gcttactcacagaggatttaat

SEQ ID NO: 1293217 - DNA, 22 bp, Artificial Sequence
  chemically synthesized
aaaggtagattaaatcctctgt

SEQ ID NO: 1293218 - DNA, 22 bp, Artificial Sequence
  chemically synthesized
aatgctcgcttactcacagagg

SEQ ID NO: 1293219 - DNA, 22 bp, Artificial Sequence
  chemically synthesized
aatcctctgtgagtaagcgagc

SEQ ID NO: 1293220 - DNA, 22 bp, Artificial Sequence
  chemically synthesized
tgtgagtaagcgagcatttaat

SEQ ID NO: 1293221 - DNA, 22 bp, Artificial Sequence
  chemically synthesized
aataacaggtggtattaaatgc

SEQ ID NO: 1293222 - DNA, 22 bp, Artificial Sequence
  chemically synthesized
tgagtaagcgagcatttaatac

SEQ ID NO: 1293223 - DNA, 22 bp, Artificial Sequence
  chemically synthesized
gagacagtgaagactcaataac

SEQ ID NO: 1293224 - DNA, 22 bp, Artificial Sequence
  chemically synthesized
aataccacctgttattgagtct

SEQ ID NO: 1293225 - DNA, 22 bp, Artificial Sequence
  chemically synthesized
ataccacctgttattgagtctt

SEQ ID NO: 1293226 - DNA, 22 bp, Artificial Sequence
  chemically synthesized
ttattgagtcttcactgtctcc

SEQ ID NO: 1293227 - DNA, 22 bp, Artificial Sequence
  chemically synthesized
ttgagtcttcactgtctccaac

SEQ ID NO: 1293228 - DNA, 22 bp, Artificial Sequence
  chemically synthesized
agtcttcactgtctccaacccc

SEQ ID NO: 1293229 - DNA, 22 bp, Artificial Sequence
  chemically synthesized
tgagaagcaggcaggggggttg

SEQ ID NO: 1293230 - DNA, 22 bp, Artificial Sequence
  chemically synthesized
cactgtctccaacccccctgcc

SEQ ID NO: 1293231 - DNA, 22 bp, Artificial Sequence
  chemically synthesized
actgtctccaacccccctgcct

SEQ ID NO: 1293232 - DNA, 22 bp, Artificial Sequence
  chemically synthesized
tctccaacccccctgcctgctt

SEQ ID NO: 1293233 - DNA, 22 bp, Artificial Sequence
  chemically synthesized
ataagtcctatgagaagcaggc

SEQ ID NO: 1293234 - DNA, 22 bp, Artificial Sequence
  chemically synthesized
caacccccctgcctgcttctca

SEQ ID NO: 1293235 - DNA, 22 bp, Artificial Sequence
  chemically synthesized
cctgcttctcataggacttatc

SEQ ID NO: 1293236 - DNA, 22 bp, Artificial Sequence
  chemically synthesized
cttctcataggacttatcaatt

SEQ ID NO: 1293237 - DNA, 22 bp, Artificial Sequence
  chemically synthesized
ggacaaatcatcaaattgataa

SEQ ID NO: 1293238 - DNA, 22 bp, Artificial Sequence
  chemically synthesized
gggacaaatcatcaaattgata

SEQ ID NO: 1293239 - DNA, 22 bp, Artificial Sequence
  chemically synthesized
ctcataggacttatcaatttga

SEQ ID NO: 1293240 - DNA, 22 bp, Artificial Sequence
  chemically synthesized
tgggacaaatcatcaaattgat

SEQ ID NO: 1293241 - DNA, 22 bp, Artificial Sequence
  chemically synthesized
tcataggacttatcaatttgat

SEQ ID NO: 1293242 - DNA, 22 bp, Artificial Sequence
  chemically synthesized
ttgggacaaatcatcaaattga

SEQ ID NO: 1293243 - DNA, 22 bp, Artificial Sequence
  chemically synthesized
ataggacttatcaatttgatga

SEQ ID NO: 1293244 - DNA, 22 bp, Artificial Sequence
  chemically synthesized
atcaatttgatgatttgtccca

SEQ ID NO: 1293245 - DNA, 22 bp, Artificial Sequence
  chemically synthesized
tcaatttgatgatttgtcccaa

SEQ ID NO: 1293246 - DNA, 22 bp, Artificial Sequence
  chemically synthesized
cccaataatgcatttttgggac

SEQ ID NO: 1293247 - DNA, 22 bp, Artificial Sequence
  chemically synthesized
gatgatttgtcccaaaaatgca

SEQ ID NO: 1293248 - DNA, 22 bp, Artificial Sequence
  chemically synthesized
atgatttgtcccaaaaatgcat

SEQ ID NO: 1293249 - DNA, 22 bp, Artificial Sequence
  chemically synthesized
cacctacccaataatgcatttt

SEQ ID NO: 1293250 - DNA, 22 bp, Artificial Sequence
  chemically synthesized
gtcccaaaaatgcattattggg

SEQ ID NO: 1293251 - DNA, 22 bp, Artificial Sequence
  chemically synthesized
tcccaaaaatgcattattgggt

SEQ ID NO: 1293252 - DNA, 22 bp, Artificial Sequence
  chemically synthesized
ggacaaaaattccacctaccca

SEQ ID NO: 1293253 - DNA, 22 bp, Artificial Sequence
  chemically synthesized
ttgggacaaaaattccacctac

SEQ ID NO: 1293254 - DNA, 22 bp, Artificial Sequence
  chemically synthesized
ttgttgggacaaaaattccacc

SEQ ID NO: 1293255 - DNA, 22 bp, Artificial Sequence
  chemically synthesized
ttattgttgggacaaaaattcc

SEQ ID NO: 1293256 - DNA, 22 bp, Artificial Sequence
  chemically synthesized
ttgggtaggtggaatttttgtc

SEQ ID NO: 1293257 - DNA, 22 bp, Artificial Sequence
  chemically synthesized
ggtaggtggaatttttgtccca

SEQ ID NO: 1293258 - DNA, 22 bp, Artificial Sequence
  chemically synthesized
catacctattattgttgggaca

SEQ ID NO: 1293259 - DNA, 22 bp, Artificial Sequence
  chemically synthesized
ccatacctattattgttgggac

SEQ ID NO: 1293260 - DNA, 22 bp, Artificial Sequence
  chemically synthesized
atgatatttccatacctattat

SEQ ID NO: 1293261 - DNA, 22 bp, Artificial Sequence
  chemically synthesized
ttgtcccaacaataataggtat

SEQ ID NO: 1293262 - DNA, 22 bp, Artificial Sequence
  chemically synthesized
tgtcccaacaataataggtatg

SEQ ID NO: 1293263 - DNA, 22 bp, Artificial Sequence
  chemically synthesized
gtcccaacaataataggtatgg

SEQ ID NO: 1293264 - DNA, 22 bp, Artificial Sequence
  chemically synthesized
tcccaacaataataggtatgga

SEQ ID NO: 1293265 - DNA, 22 bp, Artificial Sequence
  chemically synthesized
aaactcatgatatttccatacc

SEQ ID NO: 1293266 - DNA, 22 bp, Artificial Sequence
  chemically synthesized
taaaactcatgatatttccata

SEQ ID NO: 1293267 - DNA, 22 bp, Artificial Sequence
  chemically synthesized
ggacccaagaaaatggactcta

SEQ ID NO: 1293268 - DNA, 22 bp, Artificial Sequence
  chemically synthesized
tagagtccattttcttgggtcc

SEQ ID NO: 1293269 - DNA, 22 bp, Artificial Sequence
  chemically synthesized
agagtccattttcttgggtcct

SEQ ID NO: 1293270 - DNA, 22 bp, Artificial Sequence
  chemically synthesized
gagtccattttcttgggtccta

SEQ ID NO: 1293271 - DNA, 22 bp, Artificial Sequence
  chemically synthesized
tcttgggtcctagcttcatctc

SEQ ID NO: 1293272 - DNA, 22 bp, Artificial Sequence
  chemically synthesized
cttgggtcctagcttcatctct

SEQ ID NO: 1293273 - DNA, 22 bp, Artificial Sequence
  chemically synthesized
acagtaaataggagagatgaag

SEQ ID NO: 1293274 - DNA, 22 bp, Artificial Sequence
  chemically synthesized
ttgggtcctagcttcatctctc

SEQ ID NO: 1293275 - DNA, 22 bp, Artificial Sequence
  chemically synthesized
gggtcctagcttcatctctcct

SEQ ID NO: 1293276 - DNA, 22 bp, Artificial Sequence
  chemically synthesized
ctcacagtaaataggagagatg

SEQ ID NO: 1293277 - DNA, 22 bp, Artificial Sequence
  chemically synthesized
ggtcctagcttcatctctccta

SEQ ID NO: 1293278 - DNA, 22 bp, Artificial Sequence
  chemically synthesized
gctcacagtaaataggagagat

SEQ ID NO: 1293279 - DNA, 22 bp, Artificial Sequence
  chemically synthesized
gcttcatctctcctatttactg

SEQ ID NO: 1293280 - DNA, 22 bp, Artificial Sequence
  chemically synthesized
tgtggcttgctcacagtaaata

SEQ ID NO: 1293281 - DNA, 22 bp, Artificial Sequence
  chemically synthesized
atgtggcttgctcacagtaaat

SEQ ID NO: 1293282 - DNA, 22 bp, Artificial Sequence
  chemically synthesized
catctctcctatttactgtgag

SEQ ID NO: 1293283 - DNA, 22 bp, Artificial Sequence
  chemically synthesized
atctctcctatttactgtgagc

SEQ ID NO: 1293284 - DNA, 22 bp, Artificial Sequence
  chemically synthesized
tcctatttactgtgagcaagcc

SEQ ID NO: 1293285 - DNA, 22 bp, Artificial Sequence
  chemically synthesized
ctatttactgtgagcaagccac

SEQ ID NO: 1293286 - DNA, 22 bp, Artificial Sequence
  chemically synthesized
tttactgtgagcaagccacata

SEQ ID NO: 1293287 - DNA, 22 bp, Artificial Sequence
  chemically synthesized
actgtgagcaagccacataaat

SEQ ID NO: 1293288 - DNA, 22 bp, Artificial Sequence
  chemically synthesized
ctgtgagcaagccacataaatt

SEQ ID NO: 1293289 - DNA, 22 bp, Artificial Sequence
  chemically synthesized
tgagcaagccacataaattcac

SEQ ID NO: 1293290 - DNA, 22 bp, Artificial Sequence
  chemically synthesized
aagatgagtaaaatgtgaattt

SEQ ID NO: 1293291 - DNA, 22 bp, Artificial Sequence
  chemically synthesized
acattttactcatcttgaatac

SEQ ID NO: 1293292 - DNA, 22 bp, Artificial Sequence
  chemically synthesized
tactcatcttgaatacttgtat

SEQ ID NO: 1293293 - DNA, 22 bp, Artificial Sequence
  chemically synthesized
actcatcttgaatacttgtatc

SEQ ID NO: 1293294 - DNA, 22 bp, Artificial Sequence
  chemically synthesized
caataatcatatgatacaagta

SEQ ID NO: 1293295 - DNA, 22 bp, Artificial Sequence
  chemically synthesized
ctcatcttgaatacttgtatca

SEQ ID NO: 1293296 - DNA, 22 bp, Artificial Sequence
  chemically synthesized
ctccaataatcatatgatacaa

SEQ ID NO: 1293297 - DNA, 22 bp, Artificial Sequence
  chemically synthesized
atcttgaatacttgtatcatat

SEQ ID NO: 1293298 - DNA, 22 bp, Artificial Sequence
  chemically synthesized
gttgctccaataatcatatgat

SEQ ID NO: 1293299 - DNA, 22 bp, Artificial Sequence
  chemically synthesized
gaatacttgtatcatatgatta

SEQ ID NO: 1293300 - DNA, 22 bp, Artificial Sequence
  chemically synthesized
aatacttgtatcatatgattat

SEQ ID NO: 1293301 - DNA, 22 bp, Artificial Sequence
  chemically synthesized
gtatcatatgattattggagca

SEQ ID NO: 1293302 - DNA, 22 bp, Artificial Sequence
  chemically synthesized
tatcatatgattattggagcaa

SEQ ID NO: 1293303 - DNA, 22 bp, Artificial Sequence
  chemically synthesized
tatgtatatggttagttgctcc

SEQ ID NO: 1293304 - DNA, 22 bp, Artificial Sequence
  chemically synthesized
aaaattatatgtatatggttag

SEQ ID NO: 1293305 - DNA, 22 bp, Artificial Sequence
  chemically synthesized
ttggagcaactaaccatataca

SEQ ID NO: 1293306 - DNA, 22 bp, Artificial Sequence
  chemically synthesized
ctgaaaattatatgtatatggt

SEQ ID NO: 1293307 - DNA, 22 bp, Artificial Sequence
  chemically synthesized
gagcaactaaccatatacatat

SEQ ID NO: 1293308 - DNA, 22 bp, Artificial Sequence
  chemically synthesized
ataatcctactgaaaattatat

SEQ ID NO: 1293309 - DNA, 22 bp, Artificial Sequence
  chemically synthesized
accatatacatataattttcag

SEQ ID NO: 1293310 - DNA, 22 bp, Artificial Sequence
  chemically synthesized
tgtataccatgatgttaataat

SEQ ID NO: 1293311 - DNA, 22 bp, Artificial Sequence
  chemically synthesized
atgtataccatgatgttaataa

SEQ ID NO: 1293312 - DNA, 22 bp, Artificial Sequence
  chemically synthesized
tcagtaggattattaacatcat

SEQ ID NO: 1293313 - DNA, 22 bp, Artificial Sequence
  chemically synthesized
tttatgtataccatgatgttaa

SEQ ID NO: 1293314 - DNA, 22 bp, Artificial Sequence
  chemically synthesized
cagtaggattattaacatcatg

SEQ ID NO: 1293315 - DNA, 22 bp, Artificial Sequence
  chemically synthesized
gtttatgtataccatgatgtta

SEQ ID NO: 1293316 - DNA, 22 bp, Artificial Sequence
  chemically synthesized
agtaggattattaacatcatgg

SEQ ID NO: 1293317 - DNA, 22 bp, Artificial Sequence
  chemically synthesized
tgtttatgtataccatgatgtt

SEQ ID NO: 1293318 - DNA, 22 bp, Artificial Sequence
  chemically synthesized
ttgtttatgtataccatgatgt

SEQ ID NO: 1293319 - DNA, 22 bp, Artificial Sequence
  chemically synthesized
tttgtttatgtataccatgatg

SEQ ID NO: 1293320 - DNA, 22 bp, Artificial Sequence
  chemically synthesized
ggaactttttgtttatgtatac

SEQ ID NO: 1293321 - DNA, 22 bp, Artificial Sequence
  chemically synthesized
ttaacatcatggtatacataaa

SEQ ID NO: 1293322 - DNA, 22 bp, Artificial Sequence
  chemically synthesized
acatcatggtatacataaacaa

SEQ ID NO: 1293323 - DNA, 22 bp, Artificial Sequence
  chemically synthesized
agaaatagtgaggattgggaac

SEQ ID NO: 1293324 - DNA, 22 bp, Artificial Sequence
  chemically synthesized
cagaaatagtgaggattgggaa

SEQ ID NO: 1293325 - DNA, 22 bp, Artificial Sequence
  chemically synthesized
gtttcagaaatagtgaggattg

SEQ ID NO: 1293326 - DNA, 22 bp, Artificial Sequence
  chemically synthesized
ccaatcctcactatttctgaaa

SEQ ID NO: 1293327 - DNA, 22 bp, Artificial Sequence
  chemically synthesized
cggaaatcctcgtttcagaaat

SEQ ID NO: 1293328 - DNA, 22 bp, Artificial Sequence
  chemically synthesized
acggaaatcctcgtttcagaaa

SEQ ID NO: 1293329 - DNA, 22 bp, Artificial Sequence
  chemically synthesized
actatttctgaaacgaggattt

SEQ ID NO: 1293330 - DNA, 22 bp, Artificial Sequence
  chemically synthesized
tttctgaaacgaggatttccgt

SEQ ID NO: 1293331 - DNA, 22 bp, Artificial Sequence
  chemically synthesized
atacaggaaacttacggaaatc

SEQ ID NO: 1293332 - DNA, 22 bp, Artificial Sequence
  chemically synthesized
ctgaaacgaggatttccgtaag

SEQ ID NO: 1293333 - DNA, 22 bp, Artificial Sequence
  chemically synthesized
tgaaacgaggatttccgtaagt

SEQ ID NO: 1293334 - DNA, 22 bp, Artificial Sequence
  chemically synthesized
aaacgaggatttccgtaagttt

SEQ ID NO: 1293335 - DNA, 22 bp, Artificial Sequence
  chemically synthesized
gagagatgaatattgatacagg

SEQ ID NO: 1293336 - DNA, 22 bp, Artificial Sequence
  chemically synthesized
ggagagatgaatattgatacag

SEQ ID NO: 1293337 - DNA, 22 bp, Artificial Sequence
  chemically synthesized
ccgtaagtttcctgtatcaata

SEQ ID NO: 1293338 - DNA, 22 bp, Artificial Sequence
  chemically synthesized
tggagagatgaatattgataca

SEQ ID NO: 1293339 - DNA, 22 bp, Artificial Sequence
  chemically synthesized
cgtaagtttcctgtatcaatat

SEQ ID NO: 1293340 - DNA, 22 bp, Artificial Sequence
  chemically synthesized
ttttggagagatgaatattgat

SEQ ID NO: 1293341 - DNA, 22 bp, Artificial Sequence
  chemically synthesized
cctgtatcaatattcatctctc

SEQ ID NO: 1293342 - DNA, 22 bp, Artificial Sequence
  chemically synthesized
ctgtatcaatattcatctctcc

SEQ ID NO: 1293343 - DNA, 22 bp, Artificial Sequence
  chemically synthesized
gtgcaattattttggagagatg

SEQ ID NO: 1293344 - DNA, 22 bp, Artificial Sequence
  chemically synthesized
agtgcaattattttggagagat

SEQ ID NO: 1293345 - DNA, 22 bp, Artificial Sequence
  chemically synthesized
tatcaatattcatctctccaaa

SEQ ID NO: 1293346 - DNA, 22 bp, Artificial Sequence
  chemically synthesized
tttagtgcaattattttggaga

SEQ ID NO: 1293347 - DNA, 22 bp, Artificial Sequence
  chemically synthesized
aattatttagtgcaattatttt

SEQ ID NO: 1293348 - DNA, 22 bp, Artificial Sequence
  chemically synthesized
atctctccaaaataattgcact

SEQ ID NO: 1293349 - DNA, 22 bp, Artificial Sequence
  chemically synthesized
tccaaaataattgcactaaata

SEQ ID NO: 1293350 - DNA, 22 bp, Artificial Sequence
  chemically synthesized
gtaacaattgaattatttagtg

SEQ ID NO: 1293351 - DNA, 22 bp, Artificial Sequence
  chemically synthesized
caaaataattgcactaaataat

SEQ ID NO: 1293352 - DNA, 22 bp, Artificial Sequence
  chemically synthesized
ggtaacaattgaattatttagt

SEQ ID NO: 1293353 - DNA, 22 bp, Artificial Sequence
  chemically synthesized
tggtaacaattgaattatttag

SEQ ID NO: 1293354 - DNA, 22 bp, Artificial Sequence
  chemically synthesized
cactaaataattcaattgttac

SEQ ID NO: 1293355 - DNA, 22 bp, Artificial Sequence
  chemically synthesized
cacaagactttggtaacaattg

SEQ ID NO: 1293356 - DNA, 22 bp, Artificial Sequence
  chemically synthesized
aataattcaattgttaccaaag

SEQ ID NO: 1293357 - DNA, 22 bp, Artificial Sequence
  chemically synthesized
atgagcagcctgcacaagactt

SEQ ID NO: 1293358 - DNA, 22 bp, Artificial Sequence
  chemically synthesized
aattgttaccaaagtcttgtgc

SEQ ID NO: 1293359 - DNA, 22 bp, Artificial Sequence
  chemically synthesized
ttaccaaagtcttgtgcaggct

SEQ ID NO: 1293360 - DNA, 22 bp, Artificial Sequence
  chemically synthesized
gatgctgatgagcagcctgcac

SEQ ID NO: 1293361 - DNA, 22 bp, Artificial Sequence
  chemically synthesized
ccaaagtcttgtgcaggctgct

SEQ ID NO: 1293362 - DNA, 22 bp, Artificial Sequence
  chemically synthesized
tggatgctgatgagcagcctgc

SEQ ID NO: 1293363 - DNA, 22 bp, Artificial Sequence
  chemically synthesized
tgtctctggatgctgatgagca

SEQ ID NO: 1293364 - DNA, 22 bp, Artificial Sequence
  chemically synthesized
gtgcaggctgctcatcagcatc

SEQ ID NO: 1293365 - DNA, 22 bp, Artificial Sequence
  chemically synthesized
tgcaggctgctcatcagcatcc

SEQ ID NO: 1293366 - DNA, 22 bp, Artificial Sequence
  chemically synthesized
ctcatcagcatccagagacata

SEQ ID NO: 1293367 - DNA, 22 bp, Artificial Sequence
  chemically synthesized
atcagcatccagagacatagtt

SEQ ID NO: 1293368 - DNA, 22 bp, Artificial Sequence
  chemically synthesized
gagcagatgacgtacagtgaac

SEQ ID NO: 1293369 - DNA, 22 bp, Artificial Sequence
  chemically synthesized
aatcattagagcagatgacgta

SEQ ID NO: 1293370 - DNA, 22 bp, Artificial Sequence
  chemically synthesized
actgtacgtcatctgctctaat

SEQ ID NO: 1293371 - DNA, 22 bp, Artificial Sequence
  chemically synthesized
tacgtcatctgctctaatgatt

SEQ ID NO: 1293372 - DNA, 22 bp, Artificial Sequence
  chemically synthesized
ataataggaagaattaaatcat

SEQ ID NO: 1293373 - DNA, 22 bp, Artificial Sequence
  chemically synthesized
tctgataataggaagaattaaa

SEQ ID NO: 1293374 - DNA, 22 bp, Artificial Sequence
  chemically synthesized
atctgataataggaagaattaa

SEQ ID NO: 1293375 - DNA, 22 bp, Artificial Sequence
  chemically synthesized
tatctgataataggaagaatta

SEQ ID NO: 1293376 - DNA, 22 bp, Artificial Sequence
  chemically synthesized
ctctaatgatttaattcttcct

SEQ ID NO: 1293377 - DNA, 22 bp, Artificial Sequence
  chemically synthesized
ttatctgataataggaagaatt

SEQ ID NO: 1293378 - DNA, 22 bp, Artificial Sequence
  chemically synthesized
taatgatttaattcttcctatt

SEQ ID NO: 1293379 - DNA, 22 bp, Artificial Sequence
  chemically synthesized
tttttatctgataataggaaga

SEQ ID NO: 1293380 - DNA, 22 bp, Artificial Sequence
  chemically synthesized
gtttttatctgataataggaag

SEQ ID NO: 1293381 - DNA, 22 bp, Artificial Sequence
  chemically synthesized
atgatttaattcttcctattat

SEQ ID NO: 1293382 - DNA, 22 bp, Artificial Sequence
  chemically synthesized
tttgtttttatctgataatagg

SEQ ID NO: 1293383 - DNA, 22 bp, Artificial Sequence
  chemically synthesized
ctgtttgtttttatctgataat

SEQ ID NO: 1293384 - DNA, 22 bp, Artificial Sequence
  chemically synthesized
cctgtttgtttttatctgataa

SEQ ID NO: 1293385 - DNA, 22 bp, Artificial Sequence
  chemically synthesized
aattcttcctattatcagataa

SEQ ID NO: 1293386 - DNA, 22 bp, Artificial Sequence
  chemically synthesized
attcttcctattatcagataaa

SEQ ID NO: 1293387 - DNA, 22 bp, Artificial Sequence
  chemically synthesized
gcttcctgtttgtttttatctg

SEQ ID NO: 1293388 - DNA, 22 bp, Artificial Sequence
  chemically synthesized
ttcctattatcagataaaaaca

SEQ ID NO: 1293389 - DNA, 22 bp, Artificial Sequence
  chemically synthesized
cctattatcagataaaaacaaa

SEQ ID NO: 1293390 - DNA, 22 bp, Artificial Sequence
  chemically synthesized
ctattatcagataaaaacaaac

SEQ ID NO: 1293391 - DNA, 22 bp, Artificial Sequence
  chemically synthesized
ttatcagataaaaacaaacagg

SEQ ID NO: 1293392 - DNA, 22 bp, Artificial Sequence
  chemically synthesized
tgcccctggcttcctgtttgtt

SEQ ID NO: 1293393 - DNA, 22 bp, Artificial Sequence
  chemically synthesized
tcagataaaaacaaacaggaag

SEQ ID NO: 1293394 - DNA, 22 bp, Artificial Sequence
  chemically synthesized
ctgtgcccctggcttcctgttt

SEQ ID NO: 1293395 - DNA, 22 bp, Artificial Sequence
  chemically synthesized
aaatggctcctgtgcccctggc

SEQ ID NO: 1293396 - DNA, 22 bp, Artificial Sequence
  chemically synthesized
catagatctaaaatggctcctg

SEQ ID NO: 1293397 - DNA, 22 bp, Artificial Sequence
  chemically synthesized
acatagatctaaaatggctcct

SEQ ID NO: 1293398 - DNA, 22 bp, Artificial Sequence
  chemically synthesized
tacatagatctaaaatggctcc

SEQ ID NO: 1293399 - DNA, 22 bp, Artificial Sequence
  chemically synthesized
tgccatggaaggttttacatag

SEQ ID NO: 1293400 - DNA, 22 bp, Artificial Sequence
  chemically synthesized
ttgtgccatggaaggttttaca

SEQ ID NO: 1293401 - DNA, 22 bp, Artificial Sequence
  chemically synthesized
tagatctatgtaaaaccttcca

SEQ ID NO: 1293402 - DNA, 22 bp, Artificial Sequence
  chemically synthesized
agatctatgtaaaaccttccat

SEQ ID NO: 1293403 - DNA, 22 bp, Artificial Sequence
  chemically synthesized
gatctatgtaaaaccttccatg

SEQ ID NO: 1293404 - DNA, 22 bp, Artificial Sequence
  chemically synthesized
tgtaaaaccttccatggcacaa

SEQ ID NO: 1293405 - DNA, 22 bp, Artificial Sequence
  chemically synthesized
ccatggcacaatagctctgctc

SEQ ID NO: 1293406 - DNA, 22 bp, Artificial Sequence
  chemically synthesized
acagaagtaatcgagcagagct

SEQ ID NO: 1293407 - DNA, 22 bp, Artificial Sequence
  chemically synthesized
catggcacaatagctctgctcg

SEQ ID NO: 1293408 - DNA, 22 bp, Artificial Sequence
  chemically synthesized
aacagaagtaatcgagcagagc

SEQ ID NO: 1293409 - DNA, 22 bp, Artificial Sequence
  chemically synthesized
taacagaagtaatcgagcagag

SEQ ID NO: 1293410 - DNA, 22 bp, Artificial Sequence
  chemically synthesized
ctttaacagaagtaatcgagca

SEQ ID NO: 1293411 - DNA, 22 bp, Artificial Sequence
  chemically synthesized
tgctcgattacttctgttaaag

SEQ ID NO: 1293412 - DNA, 22 bp, Artificial Sequence
  chemically synthesized
tgcaatgtgcctgctttaacag

SEQ ID NO: 1293413 - DNA, 22 bp, Artificial Sequence
  chemically synthesized
ctcgattacttctgttaaagca

SEQ ID NO: 1293414 - DNA, 22 bp, Artificial Sequence
  chemically synthesized
ttgtgcaatgtgcctgctttaa

SEQ ID NO: 1293415 - DNA, 22 bp, Artificial Sequence
  chemically synthesized
gattacttctgttaaagcaggc

SEQ ID NO: 1293416 - DNA, 22 bp, Artificial Sequence
  chemically synthesized
cttctgttaaagcaggcacatt

SEQ ID NO: 1293417 - DNA, 22 bp, Artificial Sequence
  chemically synthesized
ctgttaaagcaggcacattgca

SEQ ID NO: 1293418 - DNA, 22 bp, Artificial Sequence
  chemically synthesized
tgttaaagcaggcacattgcac

SEQ ID NO: 1293419 - DNA, 22 bp, Artificial Sequence
  chemically synthesized
tatataactattgtgcaatgtg

SEQ ID NO: 1293420 - DNA, 22 bp, Artificial Sequence
  chemically synthesized
atatataactattgtgcaatgt

SEQ ID NO: 1293421 - DNA, 22 bp, Artificial Sequence
  chemically synthesized
ttaaagcaggcacattgcacaa

SEQ ID NO: 1293422 - DNA, 22 bp, Artificial Sequence
  chemically synthesized
aagcaggcacattgcacaatag

SEQ ID NO: 1293423 - DNA, 22 bp, Artificial Sequence
  chemically synthesized
acacatttatatataactattg

SEQ ID NO: 1293424 - DNA, 22 bp, Artificial Sequence
  chemically synthesized
cacaatagttatatataaatgt

SEQ ID NO: 1293425 - DNA, 22 bp, Artificial Sequence
  chemically synthesized
tatatagctaacacatttatat

SEQ ID NO: 1293426 - DNA, 22 bp, Artificial Sequence
  chemically synthesized
aatctgtatatagctaacacat

SEQ ID NO: 1293427 - DNA, 22 bp, Artificial Sequence
  chemically synthesized
taaatctgtatatagctaacac

SEQ ID NO: 1293428 - DNA, 22 bp, Artificial Sequence
  chemically synthesized
tatataaatgtgttagctatat

SEQ ID NO: 1293429 - DNA, 22 bp, Artificial Sequence
  chemically synthesized
tgtaagtgaattctaaatctgt

SEQ ID NO: 1293430 - DNA, 22 bp, Artificial Sequence
  chemically synthesized
gctatatacagatttagaattc

SEQ ID NO: 1293431 - DNA, 22 bp, Artificial Sequence
  chemically synthesized
cattgtgtaagtgaattctaaa

SEQ ID NO: 1293432 - DNA, 22 bp, Artificial Sequence
  chemically synthesized
ccattgtgtaagtgaattctaa

SEQ ID NO: 1293433 - DNA, 22 bp, Artificial Sequence
  chemically synthesized
tccattgtgtaagtgaattcta

SEQ ID NO: 1293434 - DNA, 22 bp, Artificial Sequence
  chemically synthesized
tatacagatttagaattcactt

SEQ ID NO: 1293435 - DNA, 22 bp, Artificial Sequence
  chemically synthesized
agaattcacttacacaatggaa

SEQ ID NO: 1293436 - DNA, 22 bp, Artificial Sequence
  chemically synthesized
gaattcacttacacaatggaaa

SEQ ID NO: 1293437 - DNA, 22 bp, Artificial Sequence
  chemically synthesized
acttacacaatggaaaggtaca

SEQ ID NO: 1293438 - DNA, 22 bp, Artificial Sequence
  chemically synthesized
acacaatggaaaggtacatata

SEQ ID NO: 1293439 - DNA, 22 bp, Artificial Sequence
  chemically synthesized
cacaatggaaaggtacatatat

SEQ ID NO: 1293440 - DNA, 22 bp, Artificial Sequence
  chemically synthesized
agtgaaggaggtaacaatatat

SEQ ID NO: 1293441 - DNA, 22 bp, Artificial Sequence
  chemically synthesized
cagtgaaggaggtaacaatata

SEQ ID NO: 1293442 - DNA, 22 bp, Artificial Sequence
  chemically synthesized
tttcagtgaaggaggtaacaat

SEQ ID NO: 1293443 - DNA, 22 bp, Artificial Sequence
  chemically synthesized
ttacctccttcactgaaataat

SEQ ID NO: 1293444 - DNA, 22 bp, Artificial Sequence
  chemically synthesized
cctccttcactgaaataatgtt

SEQ ID NO: 1293445 - DNA, 22 bp, Artificial Sequence
  chemically synthesized
ggacaaagtggcaaaacattat

SEQ ID NO: 1293446 - DNA, 22 bp, Artificial Sequence
  chemically synthesized
cttcactgaaataatgttttgc

SEQ ID NO: 1293447 - DNA, 22 bp, Artificial Sequence
  chemically synthesized
cactgaaataatgttttgccac

SEQ ID NO: 1293448 - DNA, 22 bp, Artificial Sequence
  chemically synthesized
actgaaataatgttttgccact

SEQ ID NO: 1293449 - DNA, 22 bp, Artificial Sequence
  chemically synthesized
aaataatgttttgccactttgt

SEQ ID NO: 1293450 - DNA, 22 bp, Artificial Sequence
  chemically synthesized
aaaaaggatgatactgggacaa

SEQ ID NO: 1293451 - DNA, 22 bp, Artificial Sequence
  chemically synthesized
aaaaaaggatgatactgggaca

SEQ ID NO: 1293452 - DNA, 22 bp, Artificial Sequence
  chemically synthesized
taaaaaaggatgatactgggac

SEQ ID NO: 1293453 - DNA, 22 bp, Artificial Sequence
  chemically synthesized
ttaaaaaaggatgatactggga

SEQ ID NO: 1293454 - DNA, 22 bp, Artificial Sequence
  chemically synthesized
tgccactttgtcccagtatcat

SEQ ID NO: 1293455 - DNA, 22 bp, Artificial Sequence
  chemically synthesized
gccactttgtcccagtatcatc

SEQ ID NO: 1293456 - DNA, 22 bp, Artificial Sequence
  chemically synthesized
ccactttgtcccagtatcatcc

SEQ ID NO: 1293457 - DNA, 22 bp, Artificial Sequence
  chemically synthesized
gaagtttttaaaaaaggatgat

SEQ ID NO: 1293458 - DNA, 22 bp, Artificial Sequence
  chemically synthesized
agaagtttttaaaaaaggatga

SEQ ID NO: 1293459 - DNA, 22 bp, Artificial Sequence
  chemically synthesized
tgtcccagtatcatcctttttt

SEQ ID NO: 1293460 - DNA, 22 bp, Artificial Sequence
  chemically synthesized
gtcccagtatcatcctttttta

SEQ ID NO: 1293461 - DNA, 22 bp, Artificial Sequence
  chemically synthesized
tcccagtatcatccttttttaa

SEQ ID NO: 1293462 - DNA, 22 bp, Artificial Sequence
  chemically synthesized
aaatgagcttagaagtttttaa

SEQ ID NO: 1293463 - DNA, 22 bp, Artificial Sequence
  chemically synthesized
aaaatgagcttagaagttttta

SEQ ID NO: 1293464 - DNA, 22 bp, Artificial Sequence
  chemically synthesized
tatttaaaatgagcttagaagt

SEQ ID NO: 1293465 - DNA, 22 bp, Artificial Sequence
  chemically synthesized
tatatttaaaatgagcttagaa

SEQ ID NO: 1293466 - DNA, 22 bp, Artificial Sequence
  chemically synthesized
ttttaaaaacttctaagctcat

SEQ ID NO: 1293467 - DNA, 22 bp, Artificial Sequence
  chemically synthesized
tttaaaaacttctaagctcatt

SEQ ID NO: 1293468 - DNA, 22 bp, Artificial Sequence
  chemically synthesized
ttaaaaacttctaagctcattt

SEQ ID NO: 1293469 - DNA, 22 bp, Artificial Sequence
  chemically synthesized
taaaaacttctaagctcatttt

SEQ ID NO: 1293470 - DNA, 22 bp, Artificial Sequence
  chemically synthesized
aaaaacttctaagctcatttta

SEQ ID NO: 1293471 - DNA, 22 bp, Artificial Sequence
  chemically synthesized
aaaacttctaagctcattttaa

SEQ ID NO: 1293472 - DNA, 22 bp, Artificial Sequence
  chemically synthesized
ctaagctcattttaaatataga

SEQ ID NO: 1293473 - DNA, 22 bp, Artificial Sequence
  chemically synthesized
taagctcattttaaatatagaa

SEQ ID NO: 1293474 - DNA, 22 bp, Artificial Sequence
  chemically synthesized
agctcattttaaatatagaata

SEQ ID NO: 1293475 - DNA, 22 bp, Artificial Sequence
  chemically synthesized
attttaaatatagaatatgttt

SEQ ID NO: 1293476 - DNA, 22 bp, Artificial Sequence
  chemically synthesized
taaatatagaatatgtttactg

SEQ ID NO: 1293477 - DNA, 22 bp, Artificial Sequence
  chemically synthesized
aaatatagaatatgtttactgg

SEQ ID NO: 1293478 - DNA, 22 bp, Artificial Sequence
  chemically synthesized
aatatagaatatgtttactggg

SEQ ID NO: 1293479 - DNA, 22 bp, Artificial Sequence
  chemically synthesized
actgggtgtgtgtatatgtatg

SEQ ID NO: 1293480 - DNA, 22 bp, Artificial Sequence
  chemically synthesized
ctgggtgtgtgtatatgtatgt

SEQ ID NO: 1293481 - DNA, 22 bp, Artificial Sequence
  chemically synthesized
ggtgtgtgtatatgtatgtgtg

SEQ ID NO: 1293482 - DNA, 22 bp, Artificial Sequence
  chemically synthesized
aacacgtacacacaaacacaca

SEQ ID NO: 1293483 - DNA, 22 bp, Artificial Sequence
  chemically synthesized
atgtcctcaacacgtacacaca

SEQ ID NO: 1293484 - DNA, 22 bp, Artificial Sequence
  chemically synthesized
tatgccaattcatgtcctcaac

SEQ ID NO: 1293485 - DNA, 22 bp, Artificial Sequence
  chemically synthesized
gtgtgtacgtgttgaggacatg

SEQ ID NO: 1293486 - DNA, 22 bp, Artificial Sequence
  chemically synthesized
tgtatgccaattcatgtcctca

SEQ ID NO: 1293487 - DNA, 22 bp, Artificial Sequence
  chemically synthesized
tgtgtacgtgttgaggacatga

SEQ ID NO: 1293488 - DNA, 22 bp, Artificial Sequence
  chemically synthesized
cactctgtatgccaattcatgt

SEQ ID NO: 1293489 - DNA, 22 bp, Artificial Sequence
  chemically synthesized
ttacactctgtatgccaattca

SEQ ID NO: 1293490 - DNA, 22 bp, Artificial Sequence
  chemically synthesized
tcctattacactctgtatgcca

SEQ ID NO: 1293491 - DNA, 22 bp, Artificial Sequence
  chemically synthesized
aggacatgaattggcatacaga

SEQ ID NO: 1293492 - DNA, 22 bp, Artificial Sequence
  chemically synthesized
ctatcctattacactctgtatg

SEQ ID NO: 1293493 - DNA, 22 bp, Artificial Sequence
  chemically synthesized
atgtgttactatcctattacac

SEQ ID NO: 1293494 - DNA, 22 bp, Artificial Sequence
  chemically synthesized
gcatacagagtgtaataggata

SEQ ID NO: 1293495 - DNA, 22 bp, Artificial Sequence
  chemically synthesized
ttcatgtgttactatcctatta

SEQ ID NO: 1293496 - DNA, 22 bp, Artificial Sequence
  chemically synthesized
attcatgtgttactatcctatt

SEQ ID NO: 1293497 - DNA, 22 bp, Artificial Sequence
  chemically synthesized
gcatcaaacagggaaaacagag

SEQ ID NO: 1293498 - DNA, 22 bp, Artificial Sequence
  chemically synthesized
ggcatcaaacagggaaaacaga

SEQ ID NO: 1293499 - DNA, 22 bp, Artificial Sequence
  chemically synthesized
ttggcatcaaacagggaaaaca

SEQ ID NO: 1293500 - DNA, 22 bp, Artificial Sequence
  chemically synthesized
cttggcatcaaacagggaaaac

SEQ ID NO: 1293501 - DNA, 22 bp, Artificial Sequence
  chemically synthesized
ccttcttggcatcaaacaggga

SEQ ID NO: 1293502 - DNA, 22 bp, Artificial Sequence
  chemically synthesized
gctaccttcttggcatcaaaca

SEQ ID NO: 1293503 - DNA, 22 bp, Artificial Sequence
  chemically synthesized
ggctaccttcttggcatcaaac

SEQ ID NO: 1293504 - DNA, 22 bp, Artificial Sequence
  chemically synthesized
tggctaccttcttggcatcaaa

SEQ ID NO: 1293505 - DNA, 22 bp, Artificial Sequence
  chemically synthesized
tgttttccctgtttgatgccaa

SEQ ID NO: 1293506 - DNA, 22 bp, Artificial Sequence
  chemically synthesized
ttttccctgtttgatgccaaga

SEQ ID NO: 1293507 - DNA, 22 bp, Artificial Sequence
  chemically synthesized
tccctgtttgatgccaagaagg

SEQ ID NO: 1293508 - DNA, 22 bp, Artificial Sequence
  chemically synthesized
tggttttggctaccttcttggc

SEQ ID NO: 1293509 - DNA, 22 bp, Artificial Sequence
  chemically synthesized
ccctgtttgatgccaagaaggt

SEQ ID NO: 1293510 - DNA, 22 bp, Artificial Sequence
  chemically synthesized
cctgtttgatgccaagaaggta

SEQ ID NO: 1293511 - DNA, 22 bp, Artificial Sequence
  chemically synthesized
attatggttttggctaccttct

SEQ ID NO: 1293512 - DNA, 22 bp, Artificial Sequence
  chemically synthesized
tttgatgccaagaaggtagcca

SEQ ID NO: 1293513 - DNA, 22 bp, Artificial Sequence
  chemically synthesized
ttgattatggttttggctacct

SEQ ID NO: 1293514 - DNA, 22 bp, Artificial Sequence
  chemically synthesized
attgattatggttttggctacc

SEQ ID NO: 1293515 - DNA, 22 bp, Artificial Sequence
  chemically synthesized
gatgccaagaaggtagccaaaa

SEQ ID NO: 1293516 - DNA, 22 bp, Artificial Sequence
  chemically synthesized
tattgattatggttttggctac

SEQ ID NO: 1293517 - DNA, 22 bp, Artificial Sequence
  chemically synthesized
atgccaagaaggtagccaaaac

SEQ ID NO: 1293518 - DNA, 22 bp, Artificial Sequence
  chemically synthesized
tttattgattatggttttggct

SEQ ID NO: 1293519 - DNA, 22 bp, Artificial Sequence
  chemically synthesized
ctttattgattatggttttggc

SEQ ID NO: 1293520 - DNA, 22 bp, Artificial Sequence
  chemically synthesized
atttctttattgattatggttt

SEQ ID NO: 1293521 - DNA, 22 bp, Artificial Sequence
  chemically synthesized
ttcatttctttattgattatgg

SEQ ID NO: 1293522 - DNA, 22 bp, Artificial Sequence
  chemically synthesized
gttcatttctttattgattatg

SEQ ID NO: 1293523 - DNA, 22 bp, Artificial Sequence
  chemically synthesized
gatacttgttcatttctttatt

SEQ ID NO: 1293524 - DNA, 22 bp, Artificial Sequence
  chemically synthesized
tggatacttgttcatttcttta

SEQ ID NO: 1293525 - DNA, 22 bp, Artificial Sequence
  chemically synthesized
ctctggatacttgttcatttct

SEQ ID NO: 1293526 - DNA, 22 bp, Artificial Sequence
  chemically synthesized
cctctggatacttgttcatttc

SEQ ID NO: 1293527 - DNA, 22 bp, Artificial Sequence
  chemically synthesized
tcctctggatacttgttcattt

SEQ ID NO: 1293528 - DNA, 22 bp, Artificial Sequence
  chemically synthesized
aagggtgattttcctctggata

SEQ ID NO: 1293529 - DNA, 22 bp, Artificial Sequence
  chemically synthesized
gaagggtgattttcctctggat

SEQ ID NO: 1293530 - DNA, 22 bp, Artificial Sequence
  chemically synthesized
tgaagggtgattttcctctgga

SEQ ID NO: 1293531 - DNA, 22 bp, Artificial Sequence
  chemically synthesized
ttgaagggtgattttcctctgg

SEQ ID NO: 1293532 - DNA, 22 bp, Artificial Sequence
  chemically synthesized
aagtttttgaagggtgattttc

SEQ ID NO: 1293533 - DNA, 22 bp, Artificial Sequence
  chemically synthesized
agaactaaagtttttgaagggt

SEQ ID NO: 1293534 - DNA, 22 bp, Artificial Sequence
  chemically synthesized
cagaactaaagtttttgaaggg

SEQ ID NO: 1293535 - DNA, 22 bp, Artificial Sequence
  chemically synthesized
tcagaactaaagtttttgaagg

SEQ ID NO: 1293536 - DNA, 22 bp, Artificial Sequence
  chemically synthesized
gattttcagaactaaagttttt

SEQ ID NO: 1293537 - DNA, 22 bp, Artificial Sequence
  chemically synthesized
caaaaactttagttctgaaaat

SEQ ID NO: 1293538 - DNA, 22 bp, Artificial Sequence
  chemically synthesized
acatgaatctagattttcagaa

SEQ ID NO: 1293539 - DNA, 22 bp, Artificial Sequence
  chemically synthesized
aaaaactttagttctgaaaatc

SEQ ID NO: 1293540 - DNA, 22 bp, Artificial Sequence
  chemically synthesized
aacatgaatctagattttcaga

SEQ ID NO: 1293541 - DNA, 22 bp, Artificial Sequence
  chemically synthesized
tagttctgaaaatctagattca

SEQ ID NO: 1293542 - DNA, 22 bp, Artificial Sequence
  chemically synthesized
agttctgaaaatctagattcat

SEQ ID NO: 1293543 - DNA, 22 bp, Artificial Sequence
  chemically synthesized
gttctgaaaatctagattcatg

SEQ ID NO: 1293544 - DNA, 22 bp, Artificial Sequence
  chemically synthesized
tgaaaatctagattcatgttaa

SEQ ID NO: 1293545 - DNA, 22 bp, Artificial Sequence
  chemically synthesized
aaaatctagattcatgttaagg

SEQ ID NO: 1293546 - DNA, 22 bp, Artificial Sequence
  chemically synthesized
ggacaatatatcaatccttaac

SEQ ID NO: 1293547 - DNA, 22 bp, Artificial Sequence
  chemically synthesized
gattcatgttaaggattgatat

SEQ ID NO: 1293548 - DNA, 22 bp, Artificial Sequence
  chemically synthesized
agttgggacaatatatcaatcc

SEQ ID NO: 1293549 - DNA, 22 bp, Artificial Sequence
  chemically synthesized
ttcagttgggacaatatatcaa

SEQ ID NO: 1293550 - DNA, 22 bp, Artificial Sequence
  chemically synthesized
atgttaaggattgatatattgt

SEQ ID NO: 1293551 - DNA, 22 bp, Artificial Sequence
  chemically synthesized
aggattgatatattgtcccaac

SEQ ID NO: 1293552 - DNA, 22 bp, Artificial Sequence
  chemically synthesized
atatattgtcccaactgaacag

SEQ ID NO: 1293553 - DNA, 22 bp, Artificial Sequence
  chemically synthesized
ccatatcccaatagcctgttca

SEQ ID NO: 1293554 - DNA, 22 bp, Artificial Sequence
  chemically synthesized
actcccatatcccaatagcctg

SEQ ID NO: 1293555 - DNA, 22 bp, Artificial Sequence
  chemically synthesized
tcccaactgaacaggctattgg

SEQ ID NO: 1293556 - DNA, 22 bp, Artificial Sequence
  chemically synthesized
aactcccatatcccaatagcct

SEQ ID NO: 1293557 - DNA, 22 bp, Artificial Sequence
  chemically synthesized
aacaggctattgggatatggga

SEQ ID NO: 1293558 - DNA, 22 bp, Artificial Sequence
  chemically synthesized
tccccgaatcttaactcccata

SEQ ID NO: 1293559 - DNA, 22 bp, Artificial Sequence
  chemically synthesized
cactgtccccgaatcttaactc

SEQ ID NO: 1293560 - DNA, 22 bp, Artificial Sequence
  chemically synthesized
ttgggatatgggagttaagatt

SEQ ID NO: 1293561 - DNA, 22 bp, Artificial Sequence
  chemically synthesized
ccactgtccccgaatcttaact

SEQ ID NO: 1293562 - DNA, 22 bp, Artificial Sequence
  chemically synthesized
ggatatgggagttaagattcgg

SEQ ID NO: 1293563 - DNA, 22 bp, Artificial Sequence
  chemically synthesized
caaatttccactgtccccgaat

SEQ ID NO: 1293564 - DNA, 22 bp, Artificial Sequence
  chemically synthesized
attgcaaatttccactgtcccc

SEQ ID NO: 1293565 - DNA, 22 bp, Artificial Sequence
  chemically synthesized
actgattgcaaatttccactgt

SEQ ID NO: 1293566 - DNA, 22 bp, Artificial Sequence
  chemically synthesized
agattcggggacagtggaaatt

SEQ ID NO: 1293567 - DNA, 22 bp, Artificial Sequence
  chemically synthesized
atctgactgattgcaaatttcc

SEQ ID NO: 1293568 - DNA, 22 bp, Artificial Sequence
  chemically synthesized
aatctgactgattgcaaatttc

SEQ ID NO: 1293569 - DNA, 22 bp, Artificial Sequence
  chemically synthesized
taatctgactgattgcaaattt

SEQ ID NO: 1293570 - DNA, 22 bp, Artificial Sequence
  chemically synthesized
ggggacagtggaaatttgcaat

SEQ ID NO: 1293571 - DNA, 22 bp, Artificial Sequence
  chemically synthesized
tttaatctgactgattgcaaat

SEQ ID NO: 1293572 - DNA, 22 bp, Artificial Sequence
  chemically synthesized
tctttaatctgactgattgcaa

SEQ ID NO: 1293573 - DNA, 22 bp, Artificial Sequence
  chemically synthesized
aacctctctttaatctgactga

SEQ ID NO: 1293574 - DNA, 22 bp, Artificial Sequence
  chemically synthesized
attaaacctctctttaatctga

SEQ ID NO: 1293575 - DNA, 22 bp, Artificial Sequence
  chemically synthesized
gcaatcagtcagattaaagaga

SEQ ID NO: 1293576 - DNA, 22 bp, Artificial Sequence
  chemically synthesized
caatcagtcagattaaagagag

SEQ ID NO: 1293577 - DNA, 22 bp, Artificial Sequence
  chemically synthesized
aggaagctcattaaacctctct

SEQ ID NO: 1293578 - DNA, 22 bp, Artificial Sequence
  chemically synthesized
gaggaagctcattaaacctctc

SEQ ID NO: 1293579 - DNA, 22 bp, Artificial Sequence
  chemically synthesized
tgtttgaggaagctcattaaac

SEQ ID NO: 1293580 - DNA, 22 bp, Artificial Sequence
  chemically synthesized
cctgtgtttgaggaagctcatt

SEQ ID NO: 1293581 - DNA, 22 bp, Artificial Sequence
  chemically synthesized
aagagaggtttaatgagcttcc

SEQ ID NO: 1293582 - DNA, 22 bp, Artificial Sequence
  chemically synthesized
ccctgtgtttgaggaagctcat

SEQ ID NO: 1293583 - DNA, 22 bp, Artificial Sequence
  chemically synthesized
tccctgtgtttgaggaagctca

SEQ ID NO: 1293584 - DNA, 22 bp, Artificial Sequence
  chemically synthesized
atccctttccctgtgtttgagg

SEQ ID NO: 1293585 - DNA, 22 bp, Artificial Sequence
  chemically synthesized
catccctttccctgtgtttgag

SEQ ID NO: 1293586 - DNA, 22 bp, Artificial Sequence
  chemically synthesized
aatgagcttcctcaaacacagg

SEQ ID NO: 1293587 - DNA, 22 bp, Artificial Sequence
  chemically synthesized
atgagcttcctcaaacacaggg

SEQ ID NO: 1293588 - DNA, 22 bp, Artificial Sequence
  chemically synthesized
acaacttcatccctttccctgt

SEQ ID NO: 1293589 - DNA, 22 bp, Artificial Sequence
  chemically synthesized
cacaacttcatccctttccctg

SEQ ID NO: 1293590 - DNA, 22 bp, Artificial Sequence
  chemically synthesized
cctcaaacacagggaaagggat

SEQ ID NO: 1293591 - DNA, 22 bp, Artificial Sequence
  chemically synthesized
ctcaaacacagggaaagggatg

SEQ ID NO: 1293592 - DNA, 22 bp, Artificial Sequence
  chemically synthesized
gccttcacaacttcatcccttt

SEQ ID NO: 1293593 - DNA, 22 bp, Artificial Sequence
  chemically synthesized
aaacacagggaaagggatgaag

SEQ ID NO: 1293594 - DNA, 22 bp, Artificial Sequence
  chemically synthesized
taaagggagtaggatgttggcc

SEQ ID NO: 1293595 - DNA, 22 bp, Artificial Sequence
  chemically synthesized
tgtaaagggagtaggatgttgg

SEQ ID NO: 1293596 - DNA, 22 bp, Artificial Sequence
  chemically synthesized
tgaaggccaacatcctactccc

SEQ ID NO: 1293597 - DNA, 22 bp, Artificial Sequence
  chemically synthesized
gaaactctgtaaagggagtagg

SEQ ID NO: 1293598 - DNA, 22 bp, Artificial Sequence
  chemically synthesized
ggaaactctgtaaagggagtag

SEQ ID NO: 1293599 - DNA, 22 bp, Artificial Sequence
  chemically synthesized
agcacaacatttggaaactctg

SEQ ID NO: 1293600 - DNA, 22 bp, Artificial Sequence
  chemically synthesized
ctccctttacagagtttccaaa

SEQ ID NO: 1293601 - DNA, 22 bp, Artificial Sequence
  chemically synthesized
tctcagcacaacatttggaaac

SEQ ID NO: 1293602 - DNA, 22 bp, Artificial Sequence
  chemically synthesized
cctttacagagtttccaaatgt

SEQ ID NO: 1293603 - DNA, 22 bp, Artificial Sequence
  chemically synthesized
tacagagtttccaaatgttgtg

SEQ ID NO: 1293604 - DNA, 22 bp, Artificial Sequence
  chemically synthesized
acagagtttccaaatgttgtgc

SEQ ID NO: 1293605 - DNA, 22 bp, Artificial Sequence
  chemically synthesized
cagagtttccaaatgttgtgct

SEQ ID NO: 1293606 - DNA, 22 bp, Artificial Sequence
  chemically synthesized
agtaggttgtctcagcacaaca

SEQ ID NO: 1293607 - DNA, 22 bp, Artificial Sequence
  chemically synthesized
aagtaggttgtctcagcacaac

SEQ ID NO: 1293608 - DNA, 22 bp, Artificial Sequence
  chemically synthesized
ccaaatgttgtgctgagacaac

SEQ ID NO: 1293609 - DNA, 22 bp, Artificial Sequence
  chemically synthesized
caaatgttgtgctgagacaacc

SEQ ID NO: 1293610 - DNA, 22 bp, Artificial Sequence
  chemically synthesized
cagccatttaagtaggttgtct

SEQ ID NO: 1293611 - DNA, 22 bp, Artificial Sequence
  chemically synthesized
tacagccatttaagtaggttgt

SEQ ID NO: 1293612 - DNA, 22 bp, Artificial Sequence
  chemically synthesized
tgctgagacaacctacttaaat

SEQ ID NO: 1293613 - DNA, 22 bp, Artificial Sequence
  chemically synthesized
gcctctacagccatttaagtag

SEQ ID NO: 1293614 - DNA, 22 bp, Artificial Sequence
  chemically synthesized
agacaacctacttaaatggctg

SEQ ID NO: 1293615 - DNA, 22 bp, Artificial Sequence
  chemically synthesized
gtatctggcctctacagccatt

SEQ ID NO: 1293616 - DNA, 22 bp, Artificial Sequence
  chemically synthesized
ggtatctggcctctacagccat

SEQ ID NO: 1293617 - DNA, 22 bp, Artificial Sequence
  chemically synthesized
tgcttggtatctggcctctaca

SEQ ID NO: 1293618 - DNA, 22 bp, Artificial Sequence
  chemically synthesized
cttaaatggctgtagaggccag

SEQ ID NO: 1293619 - DNA, 22 bp, Artificial Sequence
  chemically synthesized
tgtgcttggtatctggcctcta

SEQ ID NO: 1293620 - DNA, 22 bp, Artificial Sequence
  chemically synthesized
aaatggctgtagaggccagata

SEQ ID NO: 1293621 - DNA, 22 bp, Artificial Sequence
  chemically synthesized
aatggctgtagaggccagatac

SEQ ID NO: 1293622 - DNA, 22 bp, Artificial Sequence
  chemically synthesized
atgatgctctgtgcttggtatc

SEQ ID NO: 1293623 - DNA, 22 bp, Artificial Sequence
  chemically synthesized
tagaggccagataccaagcaca

SEQ ID NO: 1293624 - DNA, 22 bp, Artificial Sequence
  chemically synthesized
ctgatgatgctctgtgcttggt

SEQ ID NO: 1293625 - DNA, 22 bp, Artificial Sequence
  chemically synthesized
gctgatgatgctctgtgcttgg

SEQ ID NO: 1293626 - DNA, 22 bp, Artificial Sequence
  chemically synthesized
tgctgatgatgctctgtgcttg

SEQ ID NO: 1293627 - DNA, 22 bp, Artificial Sequence
  chemically synthesized
aacacggaaggttttgctgatg

SEQ ID NO: 1293628 - DNA, 22 bp, Artificial Sequence
  chemically synthesized
gaacacggaaggttttgctgat

SEQ ID NO: 1293629 - DNA, 22 bp, Artificial Sequence
  chemically synthesized
cttgaacacggaaggttttgct

SEQ ID NO: 1293630 - DNA, 22 bp, Artificial Sequence
  chemically synthesized
gcttgaacacggaaggttttgc

SEQ ID NO: 1293631 - DNA, 22 bp, Artificial Sequence
  chemically synthesized
ccttgcttgaacacggaaggtt

SEQ ID NO: 1293632 - DNA, 22 bp, Artificial Sequence
  chemically synthesized
tccacaatgccctgccttgctt

SEQ ID NO: 1293633 - DNA, 22 bp, Artificial Sequence
  chemically synthesized
gtccacaatgccctgccttgct

SEQ ID NO: 1293634 - DNA, 22 bp, Artificial Sequence
  chemically synthesized
ccgtgttcaagcaaggcagggc

SEQ ID NO: 1293635 - DNA, 22 bp, Artificial Sequence
  chemically synthesized
cgtgttcaagcaaggcagggca

SEQ ID NO: 1293636 - DNA, 22 bp, Artificial Sequence
  chemically synthesized
aagcaaggcagggcattgtgga

SEQ ID NO: 1293637 - DNA, 22 bp, Artificial Sequence
  chemically synthesized
cataaaggacagcttgtccaca

SEQ ID NO: 1293638 - DNA, 22 bp, Artificial Sequence
  chemically synthesized
tggacaagctgtcctttatgta

SEQ ID NO: 1293639 - DNA, 22 bp, Artificial Sequence
  chemically synthesized
atagccaagtaaacatgactac

SEQ ID NO: 1293640 - DNA, 22 bp, Artificial Sequence
  chemically synthesized
aatagccaagtaaacatgacta

SEQ ID NO: 1293641 - DNA, 22 bp, Artificial Sequence
  chemically synthesized
tcctttatgtagtcatgtttac

SEQ ID NO: 1293642 - DNA, 22 bp, Artificial Sequence
  chemically synthesized
tatgtagtcatgtttacttggc

SEQ ID NO: 1293643 - DNA, 22 bp, Artificial Sequence
  chemically synthesized
atatgcttaatagccaagtaaa

SEQ ID NO: 1293644 - DNA, 22 bp, Artificial Sequence
  chemically synthesized
atgtagtcatgtttacttggct

SEQ ID NO: 1293645 - DNA, 22 bp, Artificial Sequence
  chemically synthesized
tgtagtcatgtttacttggcta

SEQ ID NO: 1293646 - DNA, 22 bp, Artificial Sequence
  chemically synthesized
gtcatagctgatatgcttaata

SEQ ID NO: 1293647 - DNA, 22 bp, Artificial Sequence
  chemically synthesized
ggtcatagctgatatgcttaat

SEQ ID NO: 1293648 - DNA, 22 bp, Artificial Sequence
  chemically synthesized
tggtcatagctgatatgcttaa

SEQ ID NO: 1293649 - DNA, 22 bp, Artificial Sequence
  chemically synthesized
acttggctattaagcatatcag

SEQ ID NO: 1293650 - DNA, 22 bp, Artificial Sequence
  chemically synthesized
cttggctattaagcatatcagc

SEQ ID NO: 1293651 - DNA, 22 bp, Artificial Sequence
  chemically synthesized
ggctattaagcatatcagctat

SEQ ID NO: 1293652 - DNA, 22 bp, Artificial Sequence
  chemically synthesized
gctattaagcatatcagctatg

SEQ ID NO: 1293653 - DNA, 22 bp, Artificial Sequence
  chemically synthesized
agtgcattttggtcatagctga

SEQ ID NO: 1293654 - DNA, 22 bp, Artificial Sequence
  chemically synthesized
cagtgcattttggtcatagctg

SEQ ID NO: 1293655 - DNA, 22 bp, Artificial Sequence
  chemically synthesized
tcagtgcattttggtcatagct

SEQ ID NO: 1293656 - DNA, 22 bp, Artificial Sequence
  chemically synthesized
ttaagcatatcagctatgacca

SEQ ID NO: 1293657 - DNA, 22 bp, Artificial Sequence
  chemically synthesized
agcatatcagctatgaccaaaa

SEQ ID NO: 1293658 - DNA, 22 bp, Artificial Sequence
  chemically synthesized
gttttcagtgcattttggtcat

SEQ ID NO: 1293659 - DNA, 22 bp, Artificial Sequence
  chemically synthesized
taagtgtcctggttttcagtgc

SEQ ID NO: 1293660 - DNA, 22 bp, Artificial Sequence
  chemically synthesized
tgaccaaaatgcactgaaaacc

SEQ ID NO: 1293661 - DNA, 22 bp, Artificial Sequence
  chemically synthesized
aaaaccaggacacttacagtat

SEQ ID NO: 1293662 - DNA, 22 bp, Artificial Sequence
  chemically synthesized
caaagggccaggtagagtccag

SEQ ID NO: 1293663 - DNA, 22 bp, Artificial Sequence
  chemically synthesized
acagtattctggactctacctg

SEQ ID NO: 1293664 - DNA, 22 bp, Artificial Sequence
  chemically synthesized
cagtattctggactctacctgg

SEQ ID NO: 1293665 - DNA, 22 bp, Artificial Sequence
  chemically synthesized
cattccaaagggccaggtagag

SEQ ID NO: 1293666 - DNA, 22 bp, Artificial Sequence
  chemically synthesized
ccattccaaagggccaggtaga

SEQ ID NO: 1293667 - DNA, 22 bp, Artificial Sequence
  chemically synthesized
ccacttccattccaaagggcca

SEQ ID NO: 1293668 - DNA, 22 bp, Artificial Sequence
  chemically synthesized
tggactctacctggccctttgg

SEQ ID NO: 1293669 - DNA, 22 bp, Artificial Sequence
  chemically synthesized
cccacttccattccaaagggcc

SEQ ID NO: 1293670 - DNA, 22 bp, Artificial Sequence
  chemically synthesized
gactctacctggccctttggaa

SEQ ID NO: 1293671 - DNA, 22 bp, Artificial Sequence
  chemically synthesized
ttcccacttccattccaaaggg

SEQ ID NO: 1293672 - DNA, 22 bp, Artificial Sequence
  chemically synthesized
cttcccacttccattccaaagg

SEQ ID NO: 1293673 - DNA, 22 bp, Artificial Sequence
  chemically synthesized
cttcttcccacttccattccaa

SEQ ID NO: 1293674 - DNA, 22 bp, Artificial Sequence
  chemically synthesized
tacctggccctttggaatggaa

SEQ ID NO: 1293675 - DNA, 22 bp, Artificial Sequence
  chemically synthesized
tacttcttcccacttccattcc

SEQ ID NO: 1293676 - DNA, 22 bp, Artificial Sequence
  chemically synthesized
cctggccctttggaatggaagt

SEQ ID NO: 1293677 - DNA, 22 bp, Artificial Sequence
  chemically synthesized
ctacttcttcccacttccattc

SEQ ID NO: 1293678 - DNA, 22 bp, Artificial Sequence
  chemically synthesized
ttctacttcttcccacttccat

SEQ ID NO: 1293679 - DNA, 22 bp, Artificial Sequence
  chemically synthesized
gccctttggaatggaagtggga

SEQ ID NO: 1293680 - DNA, 22 bp, Artificial Sequence
  chemically synthesized
cattcttctacttcttcccact

SEQ ID NO: 1293681 - DNA, 22 bp, Artificial Sequence
  chemically synthesized
gcattcttctacttcttcccac

SEQ ID NO: 1293682 - DNA, 22 bp, Artificial Sequence
  chemically synthesized
tgcattcttctacttcttccca

SEQ ID NO: 1293683 - DNA, 22 bp, Artificial Sequence
  chemically synthesized
tggaatggaagtgggaagaagt

SEQ ID NO: 1293684 - DNA, 22 bp, Artificial Sequence
  chemically synthesized
ggaatggaagtgggaagaagta

SEQ ID NO: 1293685 - DNA, 22 bp, Artificial Sequence
  chemically synthesized
gaatggaagtgggaagaagtag

SEQ ID NO: 1293686 - DNA, 22 bp, Artificial Sequence
  chemically synthesized
cgtaacattttgcattcttcta

SEQ ID NO: 1293687 - DNA, 22 bp, Artificial Sequence
  chemically synthesized
aatctccgtaacattttgcatt

SEQ ID NO: 1293688 - DNA, 22 bp, Artificial Sequence
  chemically synthesized
gtgagaaattcaatctccgtaa

SEQ ID NO: 1293689 - DNA, 22 bp, Artificial Sequence
  chemically synthesized
actggtgagaaattcaatctcc

SEQ ID NO: 1293690 - DNA, 22 bp, Artificial Sequence
  chemically synthesized
cggagattgaatttctcaccag

SEQ ID NO: 1293691 - DNA, 22 bp, Artificial Sequence
  chemically synthesized
gtaaccccaacaatctgactgg

SEQ ID NO: 1293692 - DNA, 22 bp, Artificial Sequence
  chemically synthesized
aatttctcaccagtcagattgt

SEQ ID NO: 1293693 - DNA, 22 bp, Artificial Sequence
  chemically synthesized
ctcaccagtcagattgttgggg

SEQ ID NO: 1293694 - DNA, 22 bp, Artificial Sequence
  chemically synthesized
tcaccagtcagattgttggggt

SEQ ID NO: 1293695 - DNA, 22 bp, Artificial Sequence
  chemically synthesized
cagcaactagtaaccccaacaa

SEQ ID NO: 1293696 - DNA, 22 bp, Artificial Sequence
  chemically synthesized
accagtcagattgttggggtta

SEQ ID NO: 1293697 - DNA, 22 bp, Artificial Sequence
  chemically synthesized
ctgcagcaactagtaaccccaa

SEQ ID NO: 1293698 - DNA, 22 bp, Artificial Sequence
  chemically synthesized
ttcctgcagcaactagtaaccc

SEQ ID NO: 1293699 - DNA, 22 bp, Artificial Sequence
  chemically synthesized
aatctgttcctgcagcaactag

SEQ ID NO: 1293700 - DNA, 22 bp, Artificial Sequence
  chemically synthesized
ttggggttactagttgctgcag

SEQ ID NO: 1293701 - DNA, 22 bp, Artificial Sequence
  chemically synthesized
gttgaatctgttcctgcagcaa

SEQ ID NO: 1293702 - DNA, 22 bp, Artificial Sequence
  chemically synthesized
gggttactagttgctgcaggaa

SEQ ID NO: 1293703 - DNA, 22 bp, Artificial Sequence
  chemically synthesized
cattggttgaatctgttcctgc

SEQ ID NO: 1293704 - DNA, 22 bp, Artificial Sequence
  chemically synthesized
tacattggttgaatctgttcct

SEQ ID NO: 1293705 - DNA, 22 bp, Artificial Sequence
  chemically synthesized
ctagttgctgcaggaacagatt

SEQ ID NO: 1293706 - DNA, 22 bp, Artificial Sequence
  chemically synthesized
tctacattggttgaatctgttc

SEQ ID NO: 1293707 - DNA, 22 bp, Artificial Sequence
  chemically synthesized
ctctacattggttgaatctgtt

SEQ ID NO: 1293708 - DNA, 22 bp, Artificial Sequence
  chemically synthesized
gttgctgcaggaacagattcaa

SEQ ID NO: 1293709 - DNA, 22 bp, Artificial Sequence
  chemically synthesized
tttctctacattggttgaatct

SEQ ID NO: 1293710 - DNA, 22 bp, Artificial Sequence
  chemically synthesized
gtttctctacattggttgaatc

SEQ ID NO: 1293711 - DNA, 22 bp, Artificial Sequence
  chemically synthesized
ctgcaggaacagattcaaccaa

SEQ ID NO: 1293712 - DNA, 22 bp, Artificial Sequence
  chemically synthesized
cttgtttctctacattggttga

SEQ ID NO: 1293713 - DNA, 22 bp, Artificial Sequence
  chemically synthesized
caggaacagattcaaccaatgt

SEQ ID NO: 1293714 - DNA, 22 bp, Artificial Sequence
  chemically synthesized
ccttgtttctctacattggttg

SEQ ID NO: 1293715 - DNA, 22 bp, Artificial Sequence
  chemically synthesized
aaccaatgtagagaaacaagga

SEQ ID NO: 1293716 - DNA, 22 bp, Artificial Sequence
  chemically synthesized
taataagccatatttccttgtt

SEQ ID NO: 1293717 - DNA, 22 bp, Artificial Sequence
  chemically synthesized
gtaataagccatatttccttgt

SEQ ID NO: 1293718 - DNA, 22 bp, Artificial Sequence
  chemically synthesized
gtttgtaataagccatatttcc

SEQ ID NO: 1293719 - DNA, 22 bp, Artificial Sequence
  chemically synthesized
taacctagtttgtaataagcca

SEQ ID NO: 1293720 - DNA, 22 bp, Artificial Sequence
  chemically synthesized
tataacctagtttgtaataagc

SEQ ID NO: 1293721 - DNA, 22 bp, Artificial Sequence
  chemically synthesized
attctataacctagtttgtaat

SEQ ID NO: 1293722 - DNA, 22 bp, Artificial Sequence
  chemically synthesized
gattctataacctagtttgtaa

SEQ ID NO: 1293723 - DNA, 22 bp, Artificial Sequence
  chemically synthesized
tgattctataacctagtttgta

SEQ ID NO: 1293724 - DNA, 22 bp, Artificial Sequence
  chemically synthesized
attacaaactaggttatagaat

SEQ ID NO: 1293725 - DNA, 22 bp, Artificial Sequence
  chemically synthesized
ttacaaactaggttatagaatc

SEQ ID NO: 1293726 - DNA, 22 bp, Artificial Sequence
  chemically synthesized
caaactaggttatagaatcaaa

SEQ ID NO: 1293727 - DNA, 22 bp, Artificial Sequence
  chemically synthesized
aaatgcacatgaattttgattc

SEQ ID NO: 1293728 - DNA, 22 bp, Artificial Sequence
  chemically synthesized
ttgaaatgcacatgaattttga

SEQ ID NO: 1293729 - DNA, 22 bp, Artificial Sequence
  chemically synthesized
ggttatagaatcaaaattcatg

SEQ ID NO: 1293730 - DNA, 22 bp, Artificial Sequence
  chemically synthesized
tagaatcaaaattcatgtgcat

SEQ ID NO: 1293731 - DNA, 22 bp, Artificial Sequence
  chemically synthesized
atgatgctattgaaatgcacat

SEQ ID NO: 1293732 - DNA, 22 bp, Artificial Sequence
  chemically synthesized
catgatgctattgaaatgcaca

SEQ ID NO: 1293733 - DNA, 22 bp, Artificial Sequence
  chemically synthesized
cataatttcatgatgctattga

SEQ ID NO: 1293734 - DNA, 22 bp, Artificial Sequence
  chemically synthesized
atgtgcatttcaatagcatcat

SEQ ID NO: 1293735 - DNA, 22 bp, Artificial Sequence
  chemically synthesized
actccataatttcatgatgcta

SEQ ID NO: 1293736 - DNA, 22 bp, Artificial Sequence
  chemically synthesized
ctaactccataatttcatgatg

SEQ ID NO: 1293737 - DNA, 22 bp, Artificial Sequence
  chemically synthesized
tgttcctaactccataatttca

SEQ ID NO: 1293738 - DNA, 22 bp, Artificial Sequence
  chemically synthesized
caatagcatcatgaaattatgg

SEQ ID NO: 1293739 - DNA, 22 bp, Artificial Sequence
  chemically synthesized
aatagcatcatgaaattatgga

SEQ ID NO: 1293740 - DNA, 22 bp, Artificial Sequence
  chemically synthesized
taatcattgtgttcctaactcc

SEQ ID NO: 1293741 - DNA, 22 bp, Artificial Sequence
  chemically synthesized
attgtaatcattgtgttcctaa

SEQ ID NO: 1293742 - DNA, 22 bp, Artificial Sequence
  chemically synthesized
aattgtaatcattgtgttccta

SEQ ID NO: 1293743 - DNA, 22 bp, Artificial Sequence
  chemically synthesized
taattgtaatcattgtgttcct

SEQ ID NO: 1293744 - DNA, 22 bp, Artificial Sequence
  chemically synthesized
tggagttaggaacacaatgatt

SEQ ID NO: 1293745 - DNA, 22 bp, Artificial Sequence
  chemically synthesized
ggaacacaatgattacaattaa

SEQ ID NO: 1293746 - DNA, 22 bp, Artificial Sequence
  chemically synthesized
agaacatgatattttaattgta

SEQ ID NO: 1293747 - DNA, 22 bp, Artificial Sequence
  chemically synthesized
gagaacatgatattttaattgt

SEQ ID NO: 1293748 - DNA, 22 bp, Artificial Sequence
  chemically synthesized
ttgagaacatgatattttaatt

SEQ ID NO: 1293749 - DNA, 22 bp, Artificial Sequence
  chemically synthesized
cttgagaacatgatattttaat

SEQ ID NO: 1293750 - DNA, 22 bp, Artificial Sequence
  chemically synthesized
gtcttcttgagaacatgatatt

SEQ ID NO: 1293751 - DNA, 22 bp, Artificial Sequence
  chemically synthesized
cctggtcttcttgagaacatga

SEQ ID NO: 1293752 - DNA, 22 bp, Artificial Sequence
  chemically synthesized
caattaaaatatcatgttctca

SEQ ID NO: 1293753 - DNA, 22 bp, Artificial Sequence
  chemically synthesized
aaatatcatgttctcaagaaga

SEQ ID NO: 1293754 - DNA, 22 bp, Artificial Sequence
  chemically synthesized
catgatgttacctggtcttctt

SEQ ID NO: 1293755 - DNA, 22 bp, Artificial Sequence
  chemically synthesized
ccatgatgttacctggtcttct

SEQ ID NO: 1293756 - DNA, 22 bp, Artificial Sequence
  chemically synthesized
tccatgatgttacctggtcttc

SEQ ID NO: 1293757 - DNA, 22 bp, Artificial Sequence
  chemically synthesized
ttccatgatgttacctggtctt

SEQ ID NO: 1293758 - DNA, 22 bp, Artificial Sequence
  chemically synthesized
ttttccatgatgttacctggtc

SEQ ID NO: 1293759 - DNA, 22 bp, Artificial Sequence
  chemically synthesized
ttcttttccatgatgttacctg

SEQ ID NO: 1293760 - DNA, 22 bp, Artificial Sequence
  chemically synthesized
tcaagaagaccaggtaacatca

SEQ ID NO: 1293761 - DNA, 22 bp, Artificial Sequence
  chemically synthesized
tattcttttccatgatgttacc

SEQ ID NO: 1293762 - DNA, 22 bp, Artificial Sequence
  chemically synthesized
ctattcttttccatgatgttac

SEQ ID NO: 1293763 - DNA, 22 bp, Artificial Sequence
  chemically synthesized
aagaagaccaggtaacatcatg

SEQ ID NO: 1293764 - DNA, 22 bp, Artificial Sequence
  chemically synthesized
cttctattcttttccatgatgt

SEQ ID NO: 1293765 - DNA, 22 bp, Artificial Sequence
  chemically synthesized
acttctattcttttccatgatg

SEQ ID NO: 1293766 - DNA, 22 bp, Artificial Sequence
  chemically synthesized
tttacttctattcttttccatg

SEQ ID NO: 1293767 - DNA, 22 bp, Artificial Sequence
  chemically synthesized
atttacttctattcttttccat

SEQ ID NO: 1293768 - DNA, 22 bp, Artificial Sequence
  chemically synthesized
ttatttacttctattcttttcc

SEQ ID NO: 1293769 - DNA, 22 bp, Artificial Sequence
  chemically synthesized
cttatttacttctattcttttc

SEQ ID NO: 1293770 - DNA, 22 bp, Artificial Sequence
  chemically synthesized
cttcttatttacttctattctt

SEQ ID NO: 1293771 - DNA, 22 bp, Artificial Sequence
  chemically synthesized
tccttcttatttacttctattc

SEQ ID NO: 1293772 - DNA, 22 bp, Artificial Sequence
  chemically synthesized
aatctctccttcttatttactt

SEQ ID NO: 1293773 - DNA, 22 bp, Artificial Sequence
  chemically synthesized
ctgaatctctccttcttattta

SEQ ID NO: 1293774 - DNA, 22 bp, Artificial Sequence
  chemically synthesized
tactgaatctctccttcttatt

SEQ ID NO: 1293775 - DNA, 22 bp, Artificial Sequence
  chemically synthesized
ctactgaatctctccttcttat

SEQ ID NO: 1293776 - DNA, 22 bp, Artificial Sequence
  chemically synthesized
tctactgaatctctccttctta

SEQ ID NO: 1293777 - DNA, 22 bp, Artificial Sequence
  chemically synthesized
ttctactgaatctctccttctt

SEQ ID NO: 1293778 - DNA, 22 bp, Artificial Sequence
  chemically synthesized
tttctactgaatctctccttct

SEQ ID NO: 1293779 - DNA, 22 bp, Artificial Sequence
  chemically synthesized
ttttctactgaatctctccttc

SEQ ID NO: 1293780 - DNA, 22 bp, Artificial Sequence
  chemically synthesized
tgaatttttttctactgaatct

SEQ ID NO: 1293781 - DNA, 22 bp, Artificial Sequence
  chemically synthesized
atgaatttttttctactgaatc

SEQ ID NO: 1293782 - DNA, 22 bp, Artificial Sequence
  chemically synthesized
aaaaatgcatatatttatgaat

SEQ ID NO: 1293783 - DNA, 22 bp, Artificial Sequence
  chemically synthesized
agtagaaaaaaattcataaata

SEQ ID NO: 1293784 - DNA, 22 bp, Artificial Sequence
  chemically synthesized
aattgaaaaatgcatatattta

SEQ ID NO: 1293785 - DNA, 22 bp, Artificial Sequence
  chemically synthesized
aattgaattgaaaaatgcatat

SEQ ID NO: 1293786 - DNA, 22 bp, Artificial Sequence
  chemically synthesized
tgaattgaattgaaaaatgcat

SEQ ID NO: 1293787 - DNA, 22 bp, Artificial Sequence
  chemically synthesized
ctgaattgaattgaaaaatgca

SEQ ID NO: 1293788 - DNA, 22 bp, Artificial Sequence
  chemically synthesized
tctgaattgaattgaaaaatgc

SEQ ID NO: 1293789 - DNA, 22 bp, Artificial Sequence
  chemically synthesized
ataaatatatgcatttttcaat

SEQ ID NO: 1293790 - DNA, 22 bp, Artificial Sequence
  chemically synthesized
tgtaatgtattttctgaattga

SEQ ID NO: 1293791 - DNA, 22 bp, Artificial Sequence
  chemically synthesized
ttcaattcaattcagaaaatac

SEQ ID NO: 1293792 - DNA, 22 bp, Artificial Sequence
  chemically synthesized
tcattatgtaatgtattttctg

SEQ ID NO: 1293793 - DNA, 22 bp, Artificial Sequence
  chemically synthesized
tcaattcaattcagaaaataca

SEQ ID NO: 1293794 - DNA, 22 bp, Artificial Sequence
  chemically synthesized
gtcattatgtaatgtattttct

SEQ ID NO: 1293795 - DNA, 22 bp, Artificial Sequence
  chemically synthesized
caattcaattcagaaaatacat

SEQ ID NO: 1293796 - DNA, 22 bp, Artificial Sequence
  chemically synthesized
tgtcattatgtaatgtattttc

SEQ ID NO: 1293797 - DNA, 22 bp, Artificial Sequence
  chemically synthesized
aattcaattcagaaaatacatt

SEQ ID NO: 1293798 - DNA, 22 bp, Artificial Sequence
  chemically synthesized
ttgtcattatgtaatgtatttt

SEQ ID NO: 1293799 - DNA, 22 bp, Artificial Sequence
  chemically synthesized
aattcagaaaatacattacata

SEQ ID NO: 1293800 - DNA, 22 bp, Artificial Sequence
  chemically synthesized
ccatttttgtcattatgtaatg

SEQ ID NO: 1293801 - DNA, 22 bp, Artificial Sequence
  chemically synthesized
agaaaatacattacataatgac

SEQ ID NO: 1293802 - DNA, 22 bp, Artificial Sequence
  chemically synthesized
cataatgacaaaaatgggaata

SEQ ID NO: 1293803 - DNA, 22 bp, Artificial Sequence
  chemically synthesized
taaatagtaaatcatataaaca

SEQ ID NO: 1293804 - DNA, 22 bp, Artificial Sequence
  chemically synthesized
tgtgtttatatgatttactatt

SEQ ID NO: 1293805 - DNA, 22 bp, Artificial Sequence
  chemically synthesized
gtgtttatatgatttactattt

SEQ ID NO: 1293806 - DNA, 22 bp, Artificial Sequence
  chemically synthesized
tgtttatatgatttactattta

SEQ ID NO: 1293807 - DNA, 22 bp, Artificial Sequence
  chemically synthesized
atatgatttactatttataatg

SEQ ID NO: 1293808 - DNA, 22 bp, Artificial Sequence
  chemically synthesized
tatgatttactatttataatgc

SEQ ID NO: 1293809 - DNA, 22 bp, Artificial Sequence
  chemically synthesized
actatttataatgcccttttat

SEQ ID NO: 1293810 - DNA, 22 bp, Artificial Sequence
  chemically synthesized
ctatttataatgcccttttatt

SEQ ID NO: 1293811 - DNA, 22 bp, Artificial Sequence
  chemically synthesized
taacaaaacatataataaaagg

SEQ ID NO: 1293812 - DNA, 22 bp, Artificial Sequence
  chemically synthesized
gtaacaaaacatataataaaag

SEQ ID NO: 1293813 - DNA, 22 bp, Artificial Sequence
  chemically synthesized
tttataatgcccttttattata

SEQ ID NO: 1293814 - DNA, 22 bp, Artificial Sequence
  chemically synthesized
cttgtaacaaaacatataataa

SEQ ID NO: 1293815 - DNA, 22 bp, Artificial Sequence
  chemically synthesized
ataatgcccttttattatatgt

SEQ ID NO: 1293816 - DNA, 22 bp, Artificial Sequence
  chemically synthesized
taatgcccttttattatatgtt

SEQ ID NO: 1293817 - DNA, 22 bp, Artificial Sequence
  chemically synthesized
cctacttgtaacaaaacatata

SEQ ID NO: 1293818 - DNA, 22 bp, Artificial Sequence
  chemically synthesized
gcctacttgtaacaaaacatat

SEQ ID NO: 1293819 - DNA, 22 bp, Artificial Sequence
  chemically synthesized
ttgcctacttgtaacaaaacat

SEQ ID NO: 1293820 - DNA, 22 bp, Artificial Sequence
  chemically synthesized
ttattatatgttttgttacaag

SEQ ID NO: 1293821 - DNA, 22 bp, Artificial Sequence
  chemically synthesized
tattatatgttttgttacaagt

SEQ ID NO: 1293822 - DNA, 22 bp, Artificial Sequence
  chemically synthesized
attatatgttttgttacaagta

SEQ ID NO: 1293823 - DNA, 22 bp, Artificial Sequence
  chemically synthesized
tatgttcttgcctacttgtaac

SEQ ID NO: 1293824 - DNA, 22 bp, Artificial Sequence
  chemically synthesized
ttatatgttttgttacaagtag

SEQ ID NO: 1293825 - DNA, 22 bp, Artificial Sequence
  chemically synthesized
atatgttcttgcctacttgtaa

SEQ ID NO: 1293826 - DNA, 22 bp, Artificial Sequence
  chemically synthesized
ttatatgttcttgcctacttgt

SEQ ID NO: 1293827 - DNA, 22 bp, Artificial Sequence
  chemically synthesized
tatgttttgttacaagtaggca

SEQ ID NO: 1293828 - DNA, 22 bp, Artificial Sequence
  chemically synthesized
cttatatgttcttgcctacttg

SEQ ID NO: 1293829 - DNA, 22 bp, Artificial Sequence
  chemically synthesized
tcttatatgttcttgcctactt

SEQ ID NO: 1293830 - DNA, 22 bp, Artificial Sequence
  chemically synthesized
ttcttatatgttcttgcctact

SEQ ID NO: 1293831 - DNA, 22 bp, Artificial Sequence
  chemically synthesized
tttttcttatatgttcttgcct

SEQ ID NO: 1293832 - DNA, 22 bp, Artificial Sequence
  chemically synthesized
atttttcttatatgttcttgcc

SEQ ID NO: 1293833 - DNA, 22 bp, Artificial Sequence
  chemically synthesized
tgttacaagtaggcaagaacat

SEQ ID NO: 1293834 - DNA, 22 bp, Artificial Sequence
  chemically synthesized
gttacaagtaggcaagaacata

SEQ ID NO: 1293835 - DNA, 22 bp, Artificial Sequence
  chemically synthesized
ttacaagtaggcaagaacatat

SEQ ID NO: 1293836 - DNA, 22 bp, Artificial Sequence
  chemically synthesized
caagtaggcaagaacatataag

SEQ ID NO: 1293837 - DNA, 22 bp, Artificial Sequence
  chemically synthesized
agtcttatttttcttatatgtt

SEQ ID NO: 1293838 - DNA, 22 bp, Artificial Sequence
  chemically synthesized
tgagtcttatttttcttatatg

SEQ ID NO: 1293839 - DNA, 22 bp, Artificial Sequence
  chemically synthesized
tctgagtcttatttttcttata

SEQ ID NO: 1293840 - DNA, 22 bp, Artificial Sequence
  chemically synthesized
aaattctctgagtcttattttt

SEQ ID NO: 1293841 - DNA, 22 bp, Artificial Sequence
  chemically synthesized
aaaagaaaggtgaatataaaat

SEQ ID NO: 1293842 - DNA, 22 bp, Artificial Sequence
  chemically synthesized
agagaatttcaattttatattc

SEQ ID NO: 1293843 - DNA, 22 bp, Artificial Sequence
  chemically synthesized
gaaaagaaaggtgaatataaaa

SEQ ID NO: 1293844 - DNA, 22 bp, Artificial Sequence
  chemically synthesized
tttgaaaagaaaggtgaatata

SEQ ID NO: 1293845 - DNA, 22 bp, Artificial Sequence
  chemically synthesized
atttgaaaagaaaggtgaatat

SEQ ID NO: 1293846 - DNA, 22 bp, Artificial Sequence
  chemically synthesized
atttatttgaaaagaaaggtga

SEQ ID NO: 1293847 - DNA, 22 bp, Artificial Sequence
  chemically synthesized
caattttatattcacctttctt

SEQ ID NO: 1293848 - DNA, 22 bp, Artificial Sequence
  chemically synthesized
aatttatttgaaaagaaaggtg

SEQ ID NO: 1293849 - DNA, 22 bp, Artificial Sequence
  chemically synthesized
aattttatattcacctttcttt

SEQ ID NO: 1293850 - DNA, 22 bp, Artificial Sequence
  chemically synthesized
taatttatttgaaaagaaaggt

SEQ ID NO: 1293851 - DNA, 22 bp, Artificial Sequence
  chemically synthesized
tatattcacctttcttttcaaa

SEQ ID NO: 1293852 - DNA, 22 bp, Artificial Sequence
  chemically synthesized
atattcacctttcttttcaaat

SEQ ID NO: 1293853 - DNA, 22 bp, Artificial Sequence
  chemically synthesized
tattcacctttcttttcaaata

SEQ ID NO: 1293854 - DNA, 22 bp, Artificial Sequence
  chemically synthesized
tatccatactttaatttatttg

SEQ ID NO: 1293855 - DNA, 22 bp, Artificial Sequence
  chemically synthesized
acctttcttttcaaataaatta

SEQ ID NO: 1293856 - DNA, 22 bp, Artificial Sequence
  chemically synthesized
tcttttcaaataaattaaagta

SEQ ID NO: 1293857 - DNA, 22 bp, Artificial Sequence
  chemically synthesized
cttttcaaataaattaaagtat

SEQ ID NO: 1293858 - DNA, 22 bp, Artificial Sequence
  chemically synthesized
ttttcaaataaattaaagtatg

SEQ ID NO: 1293859 - DNA, 22 bp, Artificial Sequence
  chemically synthesized
ttcaaataaattaaagtatgga

SEQ ID NO: 1293860 - DNA, 22 bp, Artificial Sequence
  chemically synthesized
tcaaataaattaaagtatggat

SEQ ID NO: 1293861 - DNA, 22 bp, Artificial Sequence
  chemically synthesized
caaataaattaaagtatggata

SEQ ID NO: 1293862 - DNA, 22 bp, Artificial Sequence
  chemically synthesized
aaataaattaaagtatggatat

SEQ ID NO: 1293863 - DNA, 22 bp, Artificial Sequence
  chemically synthesized
ggagaaaacgttatatccatac

SEQ ID NO: 1293864 - DNA, 22 bp, Artificial Sequence
  chemically synthesized
aggagaaaacgttatatccata

SEQ ID NO: 1293865 - DNA, 22 bp, Artificial Sequence
  chemically synthesized
ccttaggagaaaacgttatatc

SEQ ID NO: 1293866 - DNA, 22 bp, Artificial Sequence
  chemically synthesized
taccttaggagaaaacgttata

SEQ ID NO: 1293867 - DNA, 22 bp, Artificial Sequence
  chemically synthesized
tctaccttaggagaaaacgtta

SEQ ID NO: 1293868 - DNA, 22 bp, Artificial Sequence
  chemically synthesized
aagtatggatataacgttttct

SEQ ID NO: 1293869 - DNA, 22 bp, Artificial Sequence
  chemically synthesized
ctctctaccttaggagaaaacg

SEQ ID NO: 1293870 - DNA, 22 bp, Artificial Sequence
  chemically synthesized
acactactctctaccttaggag

SEQ ID NO: 1293871 - DNA, 22 bp, Artificial Sequence
  chemically synthesized
cacactactctctaccttagga

SEQ ID NO: 1293872 - DNA, 22 bp, Artificial Sequence
  chemically synthesized
ttcacactactctctaccttag

SEQ ID NO: 1293873 - DNA, 22 bp, Artificial Sequence
  chemically synthesized
cttcacactactctctacctta

SEQ ID NO: 1293874 - DNA, 22 bp, Artificial Sequence
  chemically synthesized
tctcctaaggtagagagtagtg

SEQ ID NO: 1293875 - DNA, 22 bp, Artificial Sequence
  chemically synthesized
ctcctaaggtagagagtagtgt

SEQ ID NO: 1293876 - DNA, 22 bp, Artificial Sequence
  chemically synthesized
tcctaaggtagagagtagtgtg

SEQ ID NO: 1293877 - DNA, 22 bp, Artificial Sequence
  chemically synthesized
ctaaggtagagagtagtgtgaa

SEQ ID NO: 1293878 - DNA, 22 bp, Artificial Sequence
  chemically synthesized
ataaagcaggcttcttcacact

SEQ ID NO: 1293879 - DNA, 22 bp, Artificial Sequence
  chemically synthesized
aggtagagagtagtgtgaagaa

SEQ ID NO: 1293880 - DNA, 22 bp, Artificial Sequence
  chemically synthesized
gataaagcaggcttcttcacac

SEQ ID NO: 1293881 - DNA, 22 bp, Artificial Sequence
  chemically synthesized
tgataaagcaggcttcttcaca

SEQ ID NO: 1293882 - DNA, 22 bp, Artificial Sequence
  chemically synthesized
ttgataaagcaggcttcttcac

SEQ ID NO: 1293883 - DNA, 22 bp, Artificial Sequence
  chemically synthesized
tttgataaagcaggcttcttca

SEQ ID NO: 1293884 - DNA, 22 bp, Artificial Sequence
  chemically synthesized
ttttttgataaagcaggcttct

SEQ ID NO: 1293885 - DNA, 22 bp, Artificial Sequence
  chemically synthesized
ctttatcaaaaaataacgtgct

SEQ ID NO: 1293886 - DNA, 22 bp, Artificial Sequence
  chemically synthesized
cgcagccccaccagcacgttat

SEQ ID NO: 1293887 - DNA, 22 bp, Artificial Sequence
  chemically synthesized
tccgcagccccaccagcacgtt

SEQ ID NO: 1293888 - DNA, 22 bp, Artificial Sequence
  chemically synthesized
tatcaaaaaataacgtgctggt

SEQ ID NO: 1293889 - DNA, 22 bp, Artificial Sequence
  chemically synthesized
ctccgcagccccaccagcacgt

SEQ ID NO: 1293890 - DNA, 22 bp, Artificial Sequence
  chemically synthesized
atcaaaaaataacgtgctggtg

SEQ ID NO: 1293891 - DNA, 22 bp, Artificial Sequence
  chemically synthesized
tctccgcagccccaccagcacg

SEQ ID NO: 1293892 - DNA, 22 bp, Artificial Sequence
  chemically synthesized
tcaaaaaataacgtgctggtgg

SEQ ID NO: 1293893 - DNA, 22 bp, Artificial Sequence
  chemically synthesized
cattttctccgcagccccacca

SEQ ID NO: 1293894 - DNA, 22 bp, Artificial Sequence
  chemically synthesized
gtggggctgcggagaaaatgga

SEQ ID NO: 1293895 - DNA, 22 bp, Artificial Sequence
  chemically synthesized
cggagaaaatggaacacttata

SEQ ID NO: 1293896 - DNA, 22 bp, Artificial Sequence
  chemically synthesized
ccaccaacagtgtataagtgtt

SEQ ID NO: 1293897 - DNA, 22 bp, Artificial Sequence
  chemically synthesized
tcccaccaacagtgtataagtg

SEQ ID NO: 1293898 - DNA, 22 bp, Artificial Sequence
  chemically synthesized
ctctcccaccaacagtgtataa

SEQ ID NO: 1293899 - DNA, 22 bp, Artificial Sequence
  chemically synthesized
actctcccaccaacagtgtata

SEQ ID NO: 1293900 - DNA, 22 bp, Artificial Sequence
  chemically synthesized
atttactctcccaccaacagtg

SEQ ID NO: 1293901 - DNA, 22 bp, Artificial Sequence
  chemically synthesized
actcatttactctcccaccaac

SEQ ID NO: 1293902 - DNA, 22 bp, Artificial Sequence
  chemically synthesized
aactcatttactctcccaccaa

SEQ ID NO: 1293903 - DNA, 22 bp, Artificial Sequence
  chemically synthesized
atacactgttggtgggagagta

SEQ ID NO: 1293904 - DNA, 22 bp, Artificial Sequence
  chemically synthesized
tacactgttggtgggagagtaa

SEQ ID NO: 1293905 - DNA, 22 bp, Artificial Sequence
  chemically synthesized
cacaatggtttaactcatttac

SEQ ID NO: 1293906 - DNA, 22 bp, Artificial Sequence
  chemically synthesized
ttggtgggagagtaaatgagtt

SEQ ID NO: 1293907 - DNA, 22 bp, Artificial Sequence
  chemically synthesized
ccacaatggtttaactcattta

SEQ ID NO: 1293908 - DNA, 22 bp, Artificial Sequence
  chemically synthesized
gtgggagagtaaatgagttaaa

SEQ ID NO: 1293909 - DNA, 22 bp, Artificial Sequence
  chemically synthesized
acttccacaatggtttaactca

SEQ ID NO: 1293910 - DNA, 22 bp, Artificial Sequence
  chemically synthesized
cactgacttccacaatggttta

SEQ ID NO: 1293911 - DNA, 22 bp, Artificial Sequence
  chemically synthesized
aggaatcactacactgacttcc

SEQ ID NO: 1293912 - DNA, 22 bp, Artificial Sequence
  chemically synthesized
gaggaatcactacactgacttc

SEQ ID NO: 1293913 - DNA, 22 bp, Artificial Sequence
  chemically synthesized
tgaggaatcactacactgactt

SEQ ID NO: 1293914 - DNA, 22 bp, Artificial Sequence
  chemically synthesized
aaccattgtggaagtcagtgta

SEQ ID NO: 1293915 - DNA, 22 bp, Artificial Sequence
  chemically synthesized
tttgaggaatcactacactgac

SEQ ID NO: 1293916 - DNA, 22 bp, Artificial Sequence
  chemically synthesized
gctctttgaggaatcactacac

SEQ ID NO: 1293917 - DNA, 22 bp, Artificial Sequence
  chemically synthesized
agctctttgaggaatcactaca

SEQ ID NO: 1293918 - DNA, 22 bp, Artificial Sequence
  chemically synthesized
tagctctttgaggaatcactac

SEQ ID NO: 1293919 - DNA, 22 bp, Artificial Sequence
  chemically synthesized
tggaagtcagtgtagtgattcc

SEQ ID NO: 1293920 - DNA, 22 bp, Artificial Sequence
  chemically synthesized
ttagctctttgaggaatcacta

SEQ ID NO: 1293921 - DNA, 22 bp, Artificial Sequence
  chemically synthesized
tttttagctctttgaggaatca

SEQ ID NO: 1293922 - DNA, 22 bp, Artificial Sequence
  chemically synthesized
tgtttttagctctttgaggaat

SEQ ID NO: 1293923 - DNA, 22 bp, Artificial Sequence
  chemically synthesized
aatggtagttctgtttttagct

SEQ ID NO: 1293924 - DNA, 22 bp, Artificial Sequence
  chemically synthesized
ctcaaagagctaaaaacagaac

SEQ ID NO: 1293925 - DNA, 22 bp, Artificial Sequence
  chemically synthesized
ggttgaatggtagttctgtttt

SEQ ID NO: 1293926 - DNA, 22 bp, Artificial Sequence
  chemically synthesized
aaagagctaaaaacagaactac

SEQ ID NO: 1293927 - DNA, 22 bp, Artificial Sequence
  chemically synthesized
ctaggttgaatggtagttctgt

SEQ ID NO: 1293928 - DNA, 22 bp, Artificial Sequence
  chemically synthesized
aaaacagaactaccattcaacc

SEQ ID NO: 1293929 - DNA, 22 bp, Artificial Sequence
  chemically synthesized
ccattcaacctagcaatcccat

SEQ ID NO: 1293930 - DNA, 22 bp, Artificial Sequence
  chemically synthesized
ggtacatgcccagtaatgggat

SEQ ID NO: 1293931 - DNA, 22 bp, Artificial Sequence
  chemically synthesized
tgggtacatgcccagtaatggg

SEQ ID NO: 1293932 - DNA, 22 bp, Artificial Sequence
  chemically synthesized
aacctagcaatcccattactgg

SEQ ID NO: 1293933 - DNA, 22 bp, Artificial Sequence
  chemically synthesized
tctgggtacatgcccagtaatg

SEQ ID NO: 1293934 - DNA, 22 bp, Artificial Sequence
  chemically synthesized
ctctgggtacatgcccagtaat

SEQ ID NO: 1293935 - DNA, 22 bp, Artificial Sequence
  chemically synthesized
gcaatcccattactgggcatgt

SEQ ID NO: 1293936 - DNA, 22 bp, Artificial Sequence
  chemically synthesized
tatttctctgggtacatgccca

SEQ ID NO: 1293937 - DNA, 22 bp, Artificial Sequence
  chemically synthesized
atatttctctgggtacatgccc

SEQ ID NO: 1293938 - DNA, 22 bp, Artificial Sequence
  chemically synthesized
ctgggcatgtacccagagaaat

SEQ ID NO: 1293939 - DNA, 22 bp, Artificial Sequence
  chemically synthesized
ggcatgtacccagagaaatata

SEQ ID NO: 1293940 - DNA, 22 bp, Artificial Sequence
  chemically synthesized
taatagaatgatttatatttct

SEQ ID NO: 1293941 - DNA, 22 bp, Artificial Sequence
  chemically synthesized
ataatagaatgatttatatttc

SEQ ID NO: 1293942 - DNA, 22 bp, Artificial Sequence
  chemically synthesized
caatgaacatatgtatgcgtgt

SEQ ID NO: 1293943 - DNA, 22 bp, Artificial Sequence
  chemically synthesized
tattataagacacgcatacata

SEQ ID NO: 1293944 - DNA, 22 bp, Artificial Sequence
  chemically synthesized
ttataagacacgcatacatatg

SEQ ID NO: 1293945 - DNA, 22 bp, Artificial Sequence
  chemically synthesized
taagacacgcatacatatgttc

SEQ ID NO: 1293946 - DNA, 22 bp, Artificial Sequence
  chemically synthesized
taaatagtgctgcaatgaacat

SEQ ID NO: 1293947 - DNA, 22 bp, Artificial Sequence
  chemically synthesized
ttgtaaatagtgctgcaatgaa

SEQ ID NO: 1293948 - DNA, 22 bp, Artificial Sequence
  chemically synthesized
ctattgtaaatagtgctgcaat

SEQ ID NO: 1293949 - DNA, 22 bp, Artificial Sequence
  chemically synthesized
gctattgtaaatagtgctgcaa

SEQ ID NO: 1293950 - DNA, 22 bp, Artificial Sequence
  chemically synthesized
tgctattgtaaatagtgctgca

SEQ ID NO: 1293951 - DNA, 22 bp, Artificial Sequence
  chemically synthesized
cacgtctttgctattgtaaata

SEQ ID NO: 1293952 - DNA, 22 bp, Artificial Sequence
  chemically synthesized
attgcagcactatttacaatag

SEQ ID NO: 1293953 - DNA, 22 bp, Artificial Sequence
  chemically synthesized
attccacgtctttgctattgta

SEQ ID NO: 1293954 - DNA, 22 bp, Artificial Sequence
  chemically synthesized
cagcactatttacaatagcaaa

SEQ ID NO: 1293955 - DNA, 22 bp, Artificial Sequence
  chemically synthesized
agttgattccacgtctttgcta

SEQ ID NO: 1293956 - DNA, 22 bp, Artificial Sequence
  chemically synthesized
gagttgattccacgtctttgct

SEQ ID NO: 1293957 - DNA, 22 bp, Artificial Sequence
  chemically synthesized
tttacaatagcaaagacgtgga

SEQ ID NO: 1293958 - DNA, 22 bp, Artificial Sequence
  chemically synthesized
acaatagcaaagacgtggaatc

SEQ ID NO: 1293959 - DNA, 22 bp, Artificial Sequence
  chemically synthesized
caatagcaaagacgtggaatca

SEQ ID NO: 1293960 - DNA, 22 bp, Artificial Sequence
  chemically synthesized
acgggcatttgagttgattcca

SEQ ID NO: 1293961 - DNA, 22 bp, Artificial Sequence
  chemically synthesized
tcattgacgggcatttgagttg

SEQ ID NO: 1293962 - DNA, 22 bp, Artificial Sequence
  chemically synthesized
gtccagtctatcattgacgggc

SEQ ID NO: 1293963 - DNA, 22 bp, Artificial Sequence
  chemically synthesized
ggtccagtctatcattgacggg

SEQ ID NO: 1293964 - DNA, 22 bp, Artificial Sequence
  chemically synthesized
ttggtccagtctatcattgacg

SEQ ID NO: 1293965 - DNA, 22 bp, Artificial Sequence
  chemically synthesized
cttggtccagtctatcattgac

SEQ ID NO: 1293966 - DNA, 22 bp, Artificial Sequence
  chemically synthesized
tcttggtccagtctatcattga

SEQ ID NO: 1293967 - DNA, 22 bp, Artificial Sequence
  chemically synthesized
aaatgcccgtcaatgatagact

SEQ ID NO: 1293968 - DNA, 22 bp, Artificial Sequence
  chemically synthesized
catggtgtatatgtaccacatt

SEQ ID NO: 1293969 - DNA, 22 bp, Artificial Sequence
  chemically synthesized
gaccaagaaaatgtggtacata

SEQ ID NO: 1293970 - DNA, 22 bp, Artificial Sequence
  chemically synthesized
catagtattccatggtgtatat

SEQ ID NO: 1293971 - DNA, 22 bp, Artificial Sequence
  chemically synthesized
tggctacatagtattccatggt

SEQ ID NO: 1293972 - DNA, 22 bp, Artificial Sequence
  chemically synthesized
atggctacatagtattccatgg

SEQ ID NO: 1293973 - DNA, 22 bp, Artificial Sequence
  chemically synthesized
ttatggctacatagtattccat

SEQ ID NO: 1293974 - DNA, 22 bp, Artificial Sequence
  chemically synthesized
cttatggctacatagtattcca

SEQ ID NO: 1293975 - DNA, 22 bp, Artificial Sequence
  chemically synthesized
tcttatggctacatagtattcc

SEQ ID NO: 1293976 - DNA, 22 bp, Artificial Sequence
  chemically synthesized
tttcttatggctacatagtatt

SEQ ID NO: 1293977 - DNA, 22 bp, Artificial Sequence
  chemically synthesized
attctttcttatggctacatag

SEQ ID NO: 1293978 - DNA, 22 bp, Artificial Sequence
  chemically synthesized
tgtagccataagaaagaatgag

SEQ ID NO: 1293979 - DNA, 22 bp, Artificial Sequence
  chemically synthesized
caaaggacatgatctcattctt

SEQ ID NO: 1293980 - DNA, 22 bp, Artificial Sequence
  chemically synthesized
catccatgtccctgcaaaggac

SEQ ID NO: 1293981 - DNA, 22 bp, Artificial Sequence
  chemically synthesized
caactccatccatgtccctgca

SEQ ID NO: 1293982 - DNA, 22 bp, Artificial Sequence
  chemically synthesized
tgcagggacatggatggagttg

SEQ ID NO: 1293983 - DNA, 22 bp, Artificial Sequence
  chemically synthesized
gcagggacatggatggagttgg

SEQ ID NO: 1293984 - DNA, 22 bp, Artificial Sequence
  chemically synthesized
cagggacatggatggagttgga

SEQ ID NO: 1293985 - DNA, 22 bp, Artificial Sequence
  chemically synthesized
aggataatggcctccaactcca

SEQ ID NO: 1293986 - DNA, 22 bp, Artificial Sequence
  chemically synthesized
ctaaggataatggcctccaact

SEQ ID NO: 1293987 - DNA, 22 bp, Artificial Sequence
  chemically synthesized
gctaaggataatggcctccaac

SEQ ID NO: 1293988 - DNA, 22 bp, Artificial Sequence
  chemically synthesized
tgctaaggataatggcctccaa

SEQ ID NO: 1293989 - DNA, 22 bp, Artificial Sequence
  chemically synthesized
catcattttgctaaggataatg

SEQ ID NO: 1293990 - DNA, 22 bp, Artificial Sequence
  chemically synthesized
ctgcatcattttgctaaggata

SEQ ID NO: 1293991 - DNA, 22 bp, Artificial Sequence
  chemically synthesized
ttcctgcatcattttgctaagg

SEQ ID NO: 1293992 - DNA, 22 bp, Artificial Sequence
  chemically synthesized
gaggccattatccttagcaaaa

SEQ ID NO: 1293993 - DNA, 22 bp, Artificial Sequence
  chemically synthesized
tgttcctgcatcattttgctaa

SEQ ID NO: 1293994 - DNA, 22 bp, Artificial Sequence
  chemically synthesized
ctgttcctgcatcattttgcta

SEQ ID NO: 1293995 - DNA, 22 bp, Artificial Sequence
  chemically synthesized
tctgttcctgcatcattttgct

SEQ ID NO: 1293996 - DNA, 22 bp, Artificial Sequence
  chemically synthesized
gttttctgttcctgcatcattt

SEQ ID NO: 1293997 - DNA, 22 bp, Artificial Sequence
  chemically synthesized
ggttttctgttcctgcatcatt

SEQ ID NO: 1293998 - DNA, 22 bp, Artificial Sequence
  chemically synthesized
tccttagcaaaatgatgcagga

SEQ ID NO: 1293999 - DNA, 22 bp, Artificial Sequence
  chemically synthesized
agcaaaatgatgcaggaacaga

SEQ ID NO: 1294000 - DNA, 22 bp, Artificial Sequence
  chemically synthesized
gcaaaatgatgcaggaacagaa

SEQ ID NO: 1294001 - DNA, 22 bp, Artificial Sequence
  chemically synthesized
taagtgagaacatgcagtactt

SEQ ID NO: 1294002 - DNA, 22 bp, Artificial Sequence
  chemically synthesized
ccacctataagtgagaacatgc

SEQ ID NO: 1294003 - DNA, 22 bp, Artificial Sequence
  chemically synthesized
gctcccacctataagtgagaac

SEQ ID NO: 1294004 - DNA, 22 bp, Artificial Sequence
  chemically synthesized
agctcccacctataagtgagaa

SEQ ID NO: 1294005 - DNA, 22 bp, Artificial Sequence
  chemically synthesized
atcatttagctcccacctataa

SEQ ID NO: 1294006 - DNA, 22 bp, Artificial Sequence
  chemically synthesized
catgttctcacttataggtggg

SEQ ID NO: 1294007 - DNA, 22 bp, Artificial Sequence
  chemically synthesized
tcatcatttagctcccacctat

SEQ ID NO: 1294008 - DNA, 22 bp, Artificial Sequence
  chemically synthesized
tcacttataggtgggagctaaa

SEQ ID NO: 1294009 - DNA, 22 bp, Artificial Sequence
  chemically synthesized
acttataggtgggagctaaatg

SEQ ID NO: 1294010 - DNA, 22 bp, Artificial Sequence
  chemically synthesized
ataggtgggagctaaatgatga

SEQ ID NO: 1294011 - DNA, 22 bp, Artificial Sequence
  chemically synthesized
taggtgggagctaaatgatgag

SEQ ID NO: 1294012 - DNA, 22 bp, Artificial Sequence
  chemically synthesized
tgtgtccgtgtgttctcatcat

SEQ ID NO: 1294013 - DNA, 22 bp, Artificial Sequence
  chemically synthesized
tatgtgtccgtgtgttctcatc

SEQ ID NO: 1294014 - DNA, 22 bp, Artificial Sequence
  chemically synthesized
ccctctatgtgtccgtgtgttc

SEQ ID NO: 1294015 - DNA, 22 bp, Artificial Sequence
  chemically synthesized
ttcccctctatgtgtccgtgtg

SEQ ID NO: 1294016 - DNA, 22 bp, Artificial Sequence
  chemically synthesized
aatgatgagaacacacggacac

SEQ ID NO: 1294017 - DNA, 22 bp, Artificial Sequence
  chemically synthesized
cagtgtgtgttgttcccctcta

SEQ ID NO: 1294018 - DNA, 22 bp, Artificial Sequence
  chemically synthesized
cgataagctccagtgtgtgttg

SEQ ID NO: 1294019 - DNA, 22 bp, Artificial Sequence
  chemically synthesized
ccgataagctccagtgtgtgtt

SEQ ID NO: 1294020 - DNA, 22 bp, Artificial Sequence
  chemically synthesized
caccttccgataagctccagtg

SEQ ID NO: 1294021 - DNA, 22 bp, Artificial Sequence
  chemically synthesized
ccaccctccaccttccgataag

SEQ ID NO: 1294022 - DNA, 22 bp, Artificial Sequence
  chemically synthesized
ctcccaccctccaccttccgat

SEQ ID NO: 1294023 - DNA, 22 bp, Artificial Sequence
  chemically synthesized
cctcctcccaccctccaccttc

SEQ ID NO: 1294024 - DNA, 22 bp, Artificial Sequence
  chemically synthesized
gagcttatcggaaggtggaggg

SEQ ID NO: 1294025 - DNA, 22 bp, Artificial Sequence
  chemically synthesized
tccctcctcccaccctccacct

SEQ ID NO: 1294026 - DNA, 22 bp, Artificial Sequence
  chemically synthesized
atcggaaggtggagggtgggag

SEQ ID NO: 1294027 - DNA, 22 bp, Artificial Sequence
  chemically synthesized
atcctctccctcctcccaccct

SEQ ID NO: 1294028 - DNA, 22 bp, Artificial Sequence
  chemically synthesized
tcggaaggtggagggtgggagg

SEQ ID NO: 1294029 - DNA, 22 bp, Artificial Sequence
  chemically synthesized
ctgatcctctccctcctcccac

SEQ ID NO: 1294030 - DNA, 22 bp, Artificial Sequence
  chemically synthesized
cctgatcctctccctcctccca

SEQ ID NO: 1294031 - DNA, 22 bp, Artificial Sequence
  chemically synthesized
tcctgatcctctccctcctccc

SEQ ID NO: 1294032 - DNA, 22 bp, Artificial Sequence
  chemically synthesized
ttcctgatcctctccctcctcc

SEQ ID NO: 1294033 - DNA, 22 bp, Artificial Sequence
  chemically synthesized
tttttcctgatcctctccctcc

SEQ ID NO: 1294034 - DNA, 22 bp, Artificial Sequence
  chemically synthesized
attatttttcctgatcctctcc

SEQ ID NO: 1294035 - DNA, 22 bp, Artificial Sequence
  chemically synthesized
gtacccattaattatttttcct

SEQ ID NO: 1294036 - DNA, 22 bp, Artificial Sequence
  chemically synthesized
ggcctagtacccattaattatt

SEQ ID NO: 1294037 - DNA, 22 bp, Artificial Sequence
  chemically synthesized
atcacccagatattaggcctag

SEQ ID NO: 1294038 - DNA, 22 bp, Artificial Sequence
  chemically synthesized
catcacccagatattaggccta

SEQ ID NO: 1294039 - DNA, 22 bp, Artificial Sequence
  chemically synthesized
tttcatcacccagatattaggc

SEQ ID NO: 1294040 - DNA, 22 bp, Artificial Sequence
  chemically synthesized
atgggtactaggcctaatatct

SEQ ID NO: 1294041 - DNA, 22 bp, Artificial Sequence
  chemically synthesized
tacagattatttcatcacccag

SEQ ID NO: 1294042 - DNA, 22 bp, Artificial Sequence
  chemically synthesized
ggcctaatatctgggtgatgaa

SEQ ID NO: 1294043 - DNA, 22 bp, Artificial Sequence
  chemically synthesized
gttgtacagattatttcatcac

SEQ ID NO: 1294044 - DNA, 22 bp, Artificial Sequence
  chemically synthesized
atatctgggtgatgaaataatc

SEQ ID NO: 1294045 - DNA, 22 bp, Artificial Sequence
  chemically synthesized
ggtgatgaaataatctgtacaa

SEQ ID NO: 1294046 - DNA, 22 bp, Artificial Sequence
  chemically synthesized
tgtcacgggggttggttgtaca

SEQ ID NO: 1294047 - DNA, 22 bp, Artificial Sequence
  chemically synthesized
gtgtcacgggggttggttgtac

SEQ ID NO: 1294048 - DNA, 22 bp, Artificial Sequence
  chemically synthesized
tacaaccaacccccgtgacaca

SEQ ID NO: 1294049 - DNA, 22 bp, Artificial Sequence
  chemically synthesized
tataggtaaacttgtgtcacgg

SEQ ID NO: 1294050 - DNA, 22 bp, Artificial Sequence
  chemically synthesized
ttatataggtaaacttgtgtca

SEQ ID NO: 1294051 - DNA, 22 bp, Artificial Sequence
  chemically synthesized
gttatataggtaaacttgtgtc

SEQ ID NO: 1294052 - DNA, 22 bp, Artificial Sequence
  chemically synthesized
aggggtacatgtgcaggtttgt

SEQ ID NO: 1294053 - DNA, 22 bp, Artificial Sequence
  chemically synthesized
acctatataacaaacctgcaca

SEQ ID NO: 1294054 - DNA, 22 bp, Artificial Sequence
  chemically synthesized
cctatataacaaacctgcacat

SEQ ID NO: 1294055 - DNA, 22 bp, Artificial Sequence
  chemically synthesized
agttcaggggtacatgtgcagg

SEQ ID NO: 1294056 - DNA, 22 bp, Artificial Sequence
  chemically synthesized
aagttcaggggtacatgtgcag

SEQ ID NO: 1294057 - DNA, 22 bp, Artificial Sequence
  chemically synthesized
taagttcaggggtacatgtgca

SEQ ID NO: 1294058 - DNA, 22 bp, Artificial Sequence
  chemically synthesized
tataacaaacctgcacatgtac

SEQ ID NO: 1294059 - DNA, 22 bp, Artificial Sequence
  chemically synthesized
ttttaagttcaggggtacatgt

SEQ ID NO: 1294060 - DNA, 22 bp, Artificial Sequence
  chemically synthesized
attttaagttcaggggtacatg

SEQ ID NO: 1294061 - DNA, 22 bp, Artificial Sequence
  chemically synthesized
tattttaagttcaggggtacat

SEQ ID NO: 1294062 - DNA, 22 bp, Artificial Sequence
  chemically synthesized
ttattttaagttcaggggtaca

SEQ ID NO: 1294063 - DNA, 22 bp, Artificial Sequence
  chemically synthesized
acttttattttaagttcagggg

SEQ ID NO: 1294064 - DNA, 22 bp, Artificial Sequence
  chemically synthesized
aacttttattttaagttcaggg

SEQ ID NO: 1294065 - DNA, 22 bp, Artificial Sequence
  chemically synthesized
taacttttattttaagttcagg

SEQ ID NO: 1294066 - DNA, 22 bp, Artificial Sequence
  chemically synthesized
ttaacttttattttaagttcag

SEQ ID NO: 1294067 - DNA, 22 bp, Artificial Sequence
  chemically synthesized
cacatgtacccctgaacttaaa

SEQ ID NO: 1294068 - DNA, 22 bp, Artificial Sequence
  chemically synthesized
tttaacttttattttaagttca

SEQ ID NO: 1294069 - DNA, 22 bp, Artificial Sequence
  chemically synthesized
ttttaacttttattttaagttc

SEQ ID NO: 1294070 - DNA, 22 bp, Artificial Sequence
  chemically synthesized
tttttaacttttattttaagtt

SEQ ID NO: 1294071 - DNA, 22 bp, Artificial Sequence
  chemically synthesized
tttttttaacttttattttaag

SEQ ID NO: 1294072 - DNA, 22 bp, Artificial Sequence
  chemically synthesized
ctttttttaacttttattttaa

SEQ ID NO: 1294073 - DNA, 22 bp, Artificial Sequence
  chemically synthesized
tctttttttaacttttatttta

SEQ ID NO: 1294074 - DNA, 22 bp, Artificial Sequence
  chemically synthesized
aacttaaaataaaagttaaaaa

SEQ ID NO: 1294075 - DNA, 22 bp, Artificial Sequence
  chemically synthesized
aaaataaaagttaaaaaaagaa

SEQ ID NO: 1294076 - DNA, 22 bp, Artificial Sequence
  chemically synthesized
aaataaaagttaaaaaaagaaa

SEQ ID NO: 1294077 - DNA, 22 bp, Artificial Sequence
  chemically synthesized
agtcagtaaggtagcctttctt

SEQ ID NO: 1294078 - DNA, 22 bp, Artificial Sequence
  chemically synthesized
gagtcagtaaggtagcctttct

SEQ ID NO: 1294079 - DNA, 22 bp, Artificial Sequence
  chemically synthesized
tgagtcagtaaggtagcctttc

SEQ ID NO: 1294080 - DNA, 22 bp, Artificial Sequence
  chemically synthesized
ttgagtcagtaaggtagccttt

SEQ ID NO: 1294081 - DNA, 22 bp, Artificial Sequence
  chemically synthesized
aaaaaagaaaggctaccttact

SEQ ID NO: 1294082 - DNA, 22 bp, Artificial Sequence
  chemically synthesized
aacttttgagtcagtaaggtag

SEQ ID NO: 1294083 - DNA, 22 bp, Artificial Sequence
  chemically synthesized
acactaaacttttgagtcagta

SEQ ID NO: 1294084 - DNA, 22 bp, Artificial Sequence
  chemically synthesized
ccttactgactcaaaagtttag

SEQ ID NO: 1294085 - DNA, 22 bp, Artificial Sequence
  chemically synthesized
actgactcaaaagtttagtgtt

SEQ ID NO: 1294086 - DNA, 22 bp, Artificial Sequence
  chemically synthesized
ctgactcaaaagtttagtgtta

SEQ ID NO: 1294087 - DNA, 22 bp, Artificial Sequence
  chemically synthesized
actcaaaagtttagtgttaatt

SEQ ID NO: 1294088 - DNA, 22 bp, Artificial Sequence
  chemically synthesized
aaaagtttagtgttaatttacc

SEQ ID NO: 1294089 - DNA, 22 bp, Artificial Sequence
  chemically synthesized
agtgttaatttaccctacatca

SEQ ID NO: 1294090 - DNA, 22 bp, Artificial Sequence
  chemically synthesized
gtgttaatttaccctacatcat

SEQ ID NO: 1294091 - DNA, 22 bp, Artificial Sequence
  chemically synthesized
gccagcatgataagcatgatgt

SEQ ID NO: 1294092 - DNA, 22 bp, Artificial Sequence
  chemically synthesized
agccagcatgataagcatgatg

SEQ ID NO: 1294093 - DNA, 22 bp, Artificial Sequence
  chemically synthesized
tagccagcatgataagcatgat

SEQ ID NO: 1294094 - DNA, 22 bp, Artificial Sequence
  chemically synthesized
atttaccctacatcatgcttat

SEQ ID NO: 1294095 - DNA, 22 bp, Artificial Sequence
  chemically synthesized
ttagccagcatgataagcatga

SEQ ID NO: 1294096 - DNA, 22 bp, Artificial Sequence
  chemically synthesized
accctacatcatgcttatcatg

SEQ ID NO: 1294097 - DNA, 22 bp, Artificial Sequence
  chemically synthesized
ccttttagccagcatgataagc

SEQ ID NO: 1294098 - DNA, 22 bp, Artificial Sequence
  chemically synthesized
ccctacatcatgcttatcatgc

SEQ ID NO: 1294099 - DNA, 22 bp, Artificial Sequence
  chemically synthesized
accttttagccagcatgataag

SEQ ID NO: 1294100 - DNA, 22 bp, Artificial Sequence
  chemically synthesized
atttaccttttagccagcatga

SEQ ID NO: 1294101 - DNA, 22 bp, Artificial Sequence
  chemically synthesized
catcatgcttatcatgctggct

SEQ ID NO: 1294102 - DNA, 22 bp, Artificial Sequence
  chemically synthesized
aatttaccttttagccagcatg

SEQ ID NO: 1294103 - DNA, 22 bp, Artificial Sequence
  chemically synthesized
taatttaccttttagccagcat

SEQ ID NO: 1294104 - DNA, 22 bp, Artificial Sequence
  chemically synthesized
ttaatttaccttttagccagca

SEQ ID NO: 1294105 - DNA, 22 bp, Artificial Sequence
  chemically synthesized
tttaatttaccttttagccagc

SEQ ID NO: 1294106 - DNA, 22 bp, Artificial Sequence
  chemically synthesized
tttttaatttaccttttagcca

SEQ ID NO: 1294107 - DNA, 22 bp, Artificial Sequence
  chemically synthesized
ctttttaatttaccttttagcc

SEQ ID NO: 1294108 - DNA, 22 bp, Artificial Sequence
  chemically synthesized
atcatgctggctaaaaggtaaa

SEQ ID NO: 1294109 - DNA, 22 bp, Artificial Sequence
  chemically synthesized
tcatgctggctaaaaggtaaat

SEQ ID NO: 1294110 - DNA, 22 bp, Artificial Sequence
  chemically synthesized
caagatttctttttaatttacc

SEQ ID NO: 1294111 - DNA, 22 bp, Artificial Sequence
  chemically synthesized
gcaagatttctttttaatttac

SEQ ID NO: 1294112 - DNA, 22 bp, Artificial Sequence
  chemically synthesized
ttgcaagatttctttttaattt

SEQ ID NO: 1294113 - DNA, 22 bp, Artificial Sequence
  chemically synthesized
cttgcaagatttctttttaatt

SEQ ID NO: 1294114 - DNA, 22 bp, Artificial Sequence
  chemically synthesized
gctaaaaggtaaattaaaaaga

SEQ ID NO: 1294115 - DNA, 22 bp, Artificial Sequence
  chemically synthesized
aaaggtaaattaaaaagaaatc

SEQ ID NO: 1294116 - DNA, 22 bp, Artificial Sequence
  chemically synthesized
atatgacatacttcttgcaaga

SEQ ID NO: 1294117 - DNA, 22 bp, Artificial Sequence
  chemically synthesized
aaaagaaatcttgcaagaagta

SEQ ID NO: 1294118 - DNA, 22 bp, Artificial Sequence
  chemically synthesized
gcaagaagtatgtcatatcaat

SEQ ID NO: 1294119 - DNA, 22 bp, Artificial Sequence
  chemically synthesized
caagaagtatgtcatatcaatt

SEQ ID NO: 1294120 - DNA, 22 bp, Artificial Sequence
  chemically synthesized
ggcaatatcatgtgataaaata

SEQ ID NO: 1294121 - DNA, 22 bp, Artificial Sequence
  chemically synthesized
gggcaatatcatgtgataaaat

SEQ ID NO: 1294122 - DNA, 22 bp, Artificial Sequence
  chemically synthesized
tgggcaatatcatgtgataaaa

SEQ ID NO: 1294123 - DNA, 22 bp, Artificial Sequence
  chemically synthesized
tttgggcaatatcatgtgataa

SEQ ID NO: 1294124 - DNA, 22 bp, Artificial Sequence
  chemically synthesized
accctctttgggcaatatcatg

SEQ ID NO: 1294125 - DNA, 22 bp, Artificial Sequence
  chemically synthesized
attttatcacatgatattgccc

SEQ ID NO: 1294126 - DNA, 22 bp, Artificial Sequence
  chemically synthesized
ttttatcacatgatattgccca

SEQ ID NO: 1294127 - DNA, 22 bp, Artificial Sequence
  chemically synthesized
tatcacatgatattgcccaaag

SEQ ID NO: 1294128 - DNA, 22 bp, Artificial Sequence
  chemically synthesized
atcacatgatattgcccaaaga

SEQ ID NO: 1294129 - DNA, 22 bp, Artificial Sequence
  chemically synthesized
tcacatgatattgcccaaagag

SEQ ID NO: 1294130 - DNA, 22 bp, Artificial Sequence
  chemically synthesized
aaaatccaggactcaccctctt

SEQ ID NO: 1294131 - DNA, 22 bp, Artificial Sequence
  chemically synthesized
cccaaagagggtgagtcctgga

SEQ ID NO: 1294132 - DNA, 22 bp, Artificial Sequence
  chemically synthesized
ccgcaacatatatgtccacatt

SEQ ID NO: 1294133 - DNA, 22 bp, Artificial Sequence
  chemically synthesized
attgccgcaacatatatgtcca

SEQ ID NO: 1294134 - DNA, 22 bp, Artificial Sequence
  chemically synthesized
gatttttaatgtggacatatat

SEQ ID NO: 1294135 - DNA, 22 bp, Artificial Sequence
  chemically synthesized
cattgccgcaacatatatgtcc

SEQ ID NO: 1294136 - DNA, 22 bp, Artificial Sequence
  chemically synthesized
ttcattgccgcaacatatatgt

SEQ ID NO: 1294137 - DNA, 22 bp, Artificial Sequence
  chemically synthesized
ttaatgtggacatatatgttgc

SEQ ID NO: 1294138 - DNA, 22 bp, Artificial Sequence
  chemically synthesized
taatgtggacatatatgttgcg

SEQ ID NO: 1294139 - DNA, 22 bp, Artificial Sequence
  chemically synthesized
cctcttcattgccgcaacatat

SEQ ID NO: 1294140 - DNA, 22 bp, Artificial Sequence
  chemically synthesized
aatgtggacatatatgttgcgg

SEQ ID NO: 1294141 - DNA, 22 bp, Artificial Sequence
  chemically synthesized
acctcttcattgccgcaacata

SEQ ID NO: 1294142 - DNA, 22 bp, Artificial Sequence
  chemically synthesized
atgtggacatatatgttgcggc

SEQ ID NO: 1294143 - DNA, 22 bp, Artificial Sequence
  chemically synthesized
atttacctcttcattgccgcaa

SEQ ID NO: 1294144 - DNA, 22 bp, Artificial Sequence
  chemically synthesized
ccacaatagttcatttacctct

SEQ ID NO: 1294145 - DNA, 22 bp, Artificial Sequence
  chemically synthesized
cggcaatgaagaggtaaatgaa

SEQ ID NO: 1294146 - DNA, 22 bp, Artificial Sequence
  chemically synthesized
gcctgccacaatagttcattta

SEQ ID NO: 1294147 - DNA, 22 bp, Artificial Sequence
  chemically synthesized
gtgagacctggcctgccacaat

SEQ ID NO: 1294148 - DNA, 22 bp, Artificial Sequence
  chemically synthesized
cattagtgagacctggcctgcc

SEQ ID NO: 1294149 - DNA, 22 bp, Artificial Sequence
  chemically synthesized
ttgtggcaggccaggtctcact

SEQ ID NO: 1294150 - DNA, 22 bp, Artificial Sequence
  chemically synthesized
tggaggcctgcattagtgagac

SEQ ID NO: 1294151 - DNA, 22 bp, Artificial Sequence
  chemically synthesized
tggcaggccaggtctcactaat

SEQ ID NO: 1294152 - DNA, 22 bp, Artificial Sequence
  chemically synthesized
ttgtggaggcctgcattagtga

SEQ ID NO: 1294153 - DNA, 22 bp, Artificial Sequence
  chemically synthesized
aaacagttgttgtggaggcctg

SEQ ID NO: 1294154 - DNA, 22 bp, Artificial Sequence
  chemically synthesized
actaatgcaggcctccacaaca

SEQ ID NO: 1294155 - DNA, 22 bp, Artificial Sequence
  chemically synthesized
atgcaggcctccacaacaactg

SEQ ID NO: 1294156 - DNA, 22 bp, Artificial Sequence
  chemically synthesized
agtcagtgctgaaacagttgtt

SEQ ID NO: 1294157 - DNA, 22 bp, Artificial Sequence
  chemically synthesized
ccactcagtcagtgctgaaaca

SEQ ID NO: 1294158 - DNA, 22 bp, Artificial Sequence
  chemically synthesized
accactcagtcagtgctgaaac

SEQ ID NO: 1294159 - DNA, 22 bp, Artificial Sequence
  chemically synthesized
taccactcagtcagtgctgaaa

SEQ ID NO: 1294160 - DNA, 22 bp, Artificial Sequence
  chemically synthesized
cacaacaactgtttcagcactg

SEQ ID NO: 1294161 - DNA, 22 bp, Artificial Sequence
  chemically synthesized
atatgtaactttaccactcagt

SEQ ID NO: 1294162 - DNA, 22 bp, Artificial Sequence
  chemically synthesized
tttcagcactgactgagtggta

SEQ ID NO: 1294163 - DNA, 22 bp, Artificial Sequence
  chemically synthesized
aatatgtaactttaccactcag

SEQ ID NO: 1294164 - DNA, 22 bp, Artificial Sequence
  chemically synthesized
taatatgtaactttaccactca

SEQ ID NO: 1294165 - DNA, 22 bp, Artificial Sequence
  chemically synthesized
ttaatatgtaactttaccactc

SEQ ID NO: 1294166 - DNA, 22 bp, Artificial Sequence
  chemically synthesized
cagcactgactgagtggtaaag

SEQ ID NO: 1294167 - DNA, 22 bp, Artificial Sequence
  chemically synthesized
agcactgactgagtggtaaagt

SEQ ID NO: 1294168 - DNA, 22 bp, Artificial Sequence
  chemically synthesized
tcagcttttaatatgtaacttt

SEQ ID NO: 1294169 - DNA, 22 bp, Artificial Sequence
  chemically synthesized
actgagtggtaaagttacatat

SEQ ID NO: 1294170 - DNA, 22 bp, Artificial Sequence
  chemically synthesized
tatcagcttttaatatgtaact

SEQ ID NO: 1294171 - DNA, 22 bp, Artificial Sequence
  chemically synthesized
agtggtaaagttacatattaaa

SEQ ID NO: 1294172 - DNA, 22 bp, Artificial Sequence
  chemically synthesized
gctctatcagcttttaatatgt

SEQ ID NO: 1294173 - DNA, 22 bp, Artificial Sequence
  chemically synthesized
agggcgctggctctatcagctt

SEQ ID NO: 1294174 - DNA, 22 bp, Artificial Sequence
  chemically synthesized
aagggcgctggctctatcagct

SEQ ID NO: 1294175 - DNA, 22 bp, Artificial Sequence
  chemically synthesized
catattaaaagctgatagagcc

SEQ ID NO: 1294176 - DNA, 22 bp, Artificial Sequence
  chemically synthesized
tttaagggcgctggctctatca

SEQ ID NO: 1294177 - DNA, 22 bp, Artificial Sequence
  chemically synthesized
gtttaagggcgctggctctatc

SEQ ID NO: 1294178 - DNA, 22 bp, Artificial Sequence
  chemically synthesized
tgtttaagggcgctggctctat

SEQ ID NO: 1294179 - DNA, 22 bp, Artificial Sequence
  chemically synthesized
aaagctgatagagccagcgccc

SEQ ID NO: 1294180 - DNA, 22 bp, Artificial Sequence
  chemically synthesized
atagagccagcgcccttaaaca

SEQ ID NO: 1294181 - DNA, 22 bp, Artificial Sequence
  chemically synthesized
ccgtccagcctttgtttaaggg

SEQ ID NO: 1294182 - DNA, 22 bp, Artificial Sequence
  chemically synthesized
ttaccgtccagcctttgtttaa

SEQ ID NO: 1294183 - DNA, 22 bp, Artificial Sequence
  chemically synthesized
gttaccgtccagcctttgttta

SEQ ID NO: 1294184 - DNA, 22 bp, Artificial Sequence
  chemically synthesized
tgttaccgtccagcctttgttt

SEQ ID NO: 1294185 - DNA, 22 bp, Artificial Sequence
  chemically synthesized
ttgttaccgtccagcctttgtt

SEQ ID NO: 1294186 - DNA, 22 bp, Artificial Sequence
  chemically synthesized
gtgggcttttgttaccgtccag

SEQ ID NO: 1294187 - DNA, 22 bp, Artificial Sequence
  chemically synthesized
ggtgggcttttgttaccgtcca

SEQ ID NO: 1294188 - DNA, 22 bp, Artificial Sequence
  chemically synthesized
aaacaaaggctggacggtaaca

SEQ ID NO: 1294189 - DNA, 22 bp, Artificial Sequence
  chemically synthesized
ttggtgggcttttgttaccgtc

SEQ ID NO: 1294190 - DNA, 22 bp, Artificial Sequence
  chemically synthesized
aacaaaggctggacggtaacaa

SEQ ID NO: 1294191 - DNA, 22 bp, Artificial Sequence
  chemically synthesized
ggcaaaactcttggtgggcttt

SEQ ID NO: 1294192 - DNA, 22 bp, Artificial Sequence
  chemically synthesized
gacggtaacaaaagcccaccaa

SEQ ID NO: 1294193 - DNA, 22 bp, Artificial Sequence
  chemically synthesized
aaggcccaggaaaggcctgggc

SEQ ID NO: 1294194 - DNA, 22 bp, Artificial Sequence
  chemically synthesized
caaggcccaggaaaggcctggg

SEQ ID NO: 1294195 - DNA, 22 bp, Artificial Sequence
  chemically synthesized
tcatgcttcaaggcccaggaaa

SEQ ID NO: 1294196 - DNA, 22 bp, Artificial Sequence
  chemically synthesized
gtcatgcttcaaggcccaggaa

SEQ ID NO: 1294197 - DNA, 22 bp, Artificial Sequence
  chemically synthesized
tgcccaggcctttcctgggcct

SEQ ID NO: 1294198 - DNA, 22 bp, Artificial Sequence
  chemically synthesized
gcccaggcctttcctgggcctt

SEQ ID NO: 1294199 - DNA, 22 bp, Artificial Sequence
  chemically synthesized
cccaggcctttcctgggccttg

SEQ ID NO: 1294200 - DNA, 22 bp, Artificial Sequence
  chemically synthesized
tcttgtcatgcttcaaggccca

SEQ ID NO: 1294201 - DNA, 22 bp, Artificial Sequence
  chemically synthesized
attatcttgtcatgcttcaagg

SEQ ID NO: 1294202 - DNA, 22 bp, Artificial Sequence
  chemically synthesized
cattatcttgtcatgcttcaag

SEQ ID NO: 1294203 - DNA, 22 bp, Artificial Sequence
  chemically synthesized
cttcattatcttgtcatgcttc

SEQ ID NO: 1294204 - DNA, 22 bp, Artificial Sequence
  chemically synthesized
tcctgggccttgaagcatgaca

SEQ ID NO: 1294205 - DNA, 22 bp, Artificial Sequence
  chemically synthesized
cctgggccttgaagcatgacaa

SEQ ID NO: 1294206 - DNA, 22 bp, Artificial Sequence
  chemically synthesized
ctgggccttgaagcatgacaag

SEQ ID NO: 1294207 - DNA, 22 bp, Artificial Sequence
  chemically synthesized
ggccttgaagcatgacaagata

SEQ ID NO: 1294208 - DNA, 22 bp, Artificial Sequence
  chemically synthesized
agaattccttcattatcttgtc

SEQ ID NO: 1294209 - DNA, 22 bp, Artificial Sequence
  chemically synthesized
ttaagaattccttcattatctt

SEQ ID NO: 1294210 - DNA, 22 bp, Artificial Sequence
  chemically synthesized
gaagcatgacaagataatgaag

SEQ ID NO: 1294211 - DNA, 22 bp, Artificial Sequence
  chemically synthesized
aagcatgacaagataatgaagg

SEQ ID NO: 1294212 - DNA, 22 bp, Artificial Sequence
  chemically synthesized
aaagggtcctgttaagaattcc

SEQ ID NO: 1294213 - DNA, 22 bp, Artificial Sequence
  chemically synthesized
taaaagggtcctgttaagaatt

SEQ ID NO: 1294214 - DNA, 22 bp, Artificial Sequence
  chemically synthesized
attctaaaagggtcctgttaag

SEQ ID NO: 1294215 - DNA, 22 bp, Artificial Sequence
  chemically synthesized
aattctaaaagggtcctgttaa

SEQ ID NO: 1294216 - DNA, 22 bp, Artificial Sequence
  chemically synthesized
taattctaaaagggtcctgtta

SEQ ID NO: 1294217 - DNA, 22 bp, Artificial Sequence
  chemically synthesized
ttaattctaaaagggtcctgtt

SEQ ID NO: 1294218 - DNA, 22 bp, Artificial Sequence
  chemically synthesized
tttaattctaaaagggtcctgt

SEQ ID NO: 1294219 - DNA, 22 bp, Artificial Sequence
  chemically synthesized
ttttaattctaaaagggtcctg

SEQ ID NO: 1294220 - DNA, 22 bp, Artificial Sequence
  chemically synthesized
ttaacaggacccttttagaatt

SEQ ID NO: 1294221 - DNA, 22 bp, Artificial Sequence
  chemically synthesized
aacaggacccttttagaattaa

SEQ ID NO: 1294222 - DNA, 22 bp, Artificial Sequence
  chemically synthesized
acaggacccttttagaattaaa

SEQ ID NO: 1294223 - DNA, 22 bp, Artificial Sequence
  chemically synthesized
agacccccaataaagctttttt

SEQ ID NO: 1294224 - DNA, 22 bp, Artificial Sequence
  chemically synthesized
cagacccccaataaagcttttt

SEQ ID NO: 1294225 - DNA, 22 bp, Artificial Sequence
  chemically synthesized
ttcagacccccaataaagcttt

SEQ ID NO: 1294226 - DNA, 22 bp, Artificial Sequence
  chemically synthesized
ttagaattaaaaaagctttatt

SEQ ID NO: 1294227 - DNA, 22 bp, Artificial Sequence
  chemically synthesized
cttcagacccccaataaagctt

SEQ ID NO: 1294228 - DNA, 22 bp, Artificial Sequence
  chemically synthesized
tagaattaaaaaagctttattg

SEQ ID NO: 1294229 - DNA, 22 bp, Artificial Sequence
  chemically synthesized
agaattaaaaaagctttattgg

SEQ ID NO: 1294230 - DNA, 22 bp, Artificial Sequence
  chemically synthesized
gaattaaaaaagctttattggg

SEQ ID NO: 1294231 - DNA, 22 bp, Artificial Sequence
  chemically synthesized
gggagtttcttcagacccccaa

SEQ ID NO: 1294232 - DNA, 22 bp, Artificial Sequence
  chemically synthesized
aaaaagctttattgggggtctg

SEQ ID NO: 1294233 - DNA, 22 bp, Artificial Sequence
  chemically synthesized
tattgggggtctgaagaaactc

SEQ ID NO: 1294234 - DNA, 22 bp, Artificial Sequence
  chemically synthesized
tggagtcctggggagtttcttc

SEQ ID NO: 1294235 - DNA, 22 bp, Artificial Sequence
  chemically synthesized
attgggggtctgaagaaactcc

SEQ ID NO: 1294236 - DNA, 22 bp, Artificial Sequence
  chemically synthesized
gtggagtcctggggagtttctt

SEQ ID NO: 1294237 - DNA, 22 bp, Artificial Sequence
  chemically synthesized
ttgggggtctgaagaaactccc

SEQ ID NO: 1294238 - DNA, 22 bp, Artificial Sequence
  chemically synthesized
tttgtggagtcctggggagttt

SEQ ID NO: 1294239 - DNA, 22 bp, Artificial Sequence
  chemically synthesized
ggggtctgaagaaactccccag

SEQ ID NO: 1294240 - DNA, 22 bp, Artificial Sequence
  chemically synthesized
gtttgtggagtcctggggagtt

SEQ ID NO: 1294241 - DNA, 22 bp, Artificial Sequence
  chemically synthesized
aagaaactccccaggactccac

SEQ ID NO: 1294242 - DNA, 22 bp, Artificial Sequence
  chemically synthesized
cccaggactccacaaacaagtt

SEQ ID NO: 1294243 - DNA, 22 bp, Artificial Sequence
  chemically synthesized
agatgcccagtaaacttgtttg

SEQ ID NO: 1294244 - DNA, 22 bp, Artificial Sequence
  chemically synthesized
cagatgcccagtaaacttgttt

SEQ ID NO: 1294245 - DNA, 22 bp, Artificial Sequence
  chemically synthesized
cttcagatgcccagtaaacttg

SEQ ID NO: 1294246 - DNA, 22 bp, Artificial Sequence
  chemically synthesized
cacaaacaagtttactgggcat

SEQ ID NO: 1294247 - DNA, 22 bp, Artificial Sequence
  chemically synthesized
ggggagttccttcagatgccca

SEQ ID NO: 1294248 - DNA, 22 bp, Artificial Sequence
  chemically synthesized
gggggagttccttcagatgccc

SEQ ID NO: 1294249 - DNA, 22 bp, Artificial Sequence
  chemically synthesized
actgggcatctgaaggaactcc

SEQ ID NO: 1294250 - DNA, 22 bp, Artificial Sequence
  chemically synthesized
ctgggcatctgaaggaactccc

SEQ ID NO: 1294251 - DNA, 22 bp, Artificial Sequence
  chemically synthesized
ggcatctgaaggaactccccca

SEQ ID NO: 1294252 - DNA, 22 bp, Artificial Sequence
  chemically synthesized
aatcatggagtttgggggagtt

SEQ ID NO: 1294253 - DNA, 22 bp, Artificial Sequence
  chemically synthesized
cggctaaatcatggagtttggg

SEQ ID NO: 1294254 - DNA, 22 bp, Artificial Sequence
  chemically synthesized
aaggaactcccccaaactccat

SEQ ID NO: 1294255 - DNA, 22 bp, Artificial Sequence
  chemically synthesized
tctccggctaaatcatggagtt

SEQ ID NO: 1294256 - DNA, 22 bp, Artificial Sequence
  chemically synthesized
atctccggctaaatcatggagt

SEQ ID NO: 1294257 - DNA, 22 bp, Artificial Sequence
  chemically synthesized
tcttatctccggctaaatcatg

SEQ ID NO: 1294258 - DNA, 22 bp, Artificial Sequence
  chemically synthesized
atcttatctccggctaaatcat

SEQ ID NO: 1294259 - DNA, 22 bp, Artificial Sequence
  chemically synthesized
ccccaaactccatgatttagcc

SEQ ID NO: 1294260 - DNA, 22 bp, Artificial Sequence
  chemically synthesized
cccttatcttatctccggctaa

SEQ ID NO: 1294261 - DNA, 22 bp, Artificial Sequence
  chemically synthesized
catgatttagccggagataaga

SEQ ID NO: 1294262 - DNA, 22 bp, Artificial Sequence
  chemically synthesized
ggatgattacccttatcttatc

SEQ ID NO: 1294263 - DNA, 22 bp, Artificial Sequence
  chemically synthesized
agccggagataagataagggta

SEQ ID NO: 1294264 - DNA, 22 bp, Artificial Sequence
  chemically synthesized
gccggagataagataagggtaa

SEQ ID NO: 1294265 - DNA, 22 bp, Artificial Sequence
  chemically synthesized
aatgggtccaggtgctgggatg

SEQ ID NO: 1294266 - DNA, 22 bp, Artificial Sequence
  chemically synthesized
tctaaatgggtccaggtgctgg

SEQ ID NO: 1294267 - DNA, 22 bp, Artificial Sequence
  chemically synthesized
atctaaatgggtccaggtgctg

SEQ ID NO: 1294268 - DNA, 22 bp, Artificial Sequence
  chemically synthesized
tatctaaatgggtccaggtgct

SEQ ID NO: 1294269 - DNA, 22 bp, Artificial Sequence
  chemically synthesized
ctttatctaaatgggtccaggt

SEQ ID NO: 1294270 - DNA, 22 bp, Artificial Sequence
  chemically synthesized
actttatctaaatgggtccagg

SEQ ID NO: 1294271 - DNA, 22 bp, Artificial Sequence
  chemically synthesized
agtaaatttactttatctaaat

SEQ ID NO: 1294272 - DNA, 22 bp, Artificial Sequence
  chemically synthesized
gacccatttagataaagtaaat

SEQ ID NO: 1294273 - DNA, 22 bp, Artificial Sequence
  chemically synthesized
gagcctcagtaaatttacttta

SEQ ID NO: 1294274 - DNA, 22 bp, Artificial Sequence
  chemically synthesized
tggagcctcagtaaatttactt

SEQ ID NO: 1294275 - DNA, 22 bp, Artificial Sequence
  chemically synthesized
ctctggagcctcagtaaattta

SEQ ID NO: 1294276 - DNA, 22 bp, Artificial Sequence
  chemically synthesized
agataaagtaaatttactgagg

SEQ ID NO: 1294277 - DNA, 22 bp, Artificial Sequence
  chemically synthesized
gataaagtaaatttactgaggc

SEQ ID NO: 1294278 - DNA, 22 bp, Artificial Sequence
  chemically synthesized
aagacattcctctggagcctca

SEQ ID NO: 1294279 - DNA, 22 bp, Artificial Sequence
  chemically synthesized
ctgaagacattcctctggagcc

SEQ ID NO: 1294280 - DNA, 22 bp, Artificial Sequence
  chemically synthesized
attcctgaagacattcctctgg

SEQ ID NO: 1294281 - DNA, 22 bp, Artificial Sequence
  chemically synthesized
actgaggctccagaggaatgtc

SEQ ID NO: 1294282 - DNA, 22 bp, Artificial Sequence
  chemically synthesized
ctgaggctccagaggaatgtct

SEQ ID NO: 1294283 - DNA, 22 bp, Artificial Sequence
  chemically synthesized
aggctccagaggaatgtcttca

SEQ ID NO: 1294284 - DNA, 22 bp, Artificial Sequence
  chemically synthesized
agatctgattcctgaagacatt

SEQ ID NO: 1294285 - DNA, 22 bp, Artificial Sequence
  chemically synthesized
cagaggaatgtcttcaggaatc

SEQ ID NO: 1294286 - DNA, 22 bp, Artificial Sequence
  chemically synthesized
taactaagatctgattcctgaa

SEQ ID NO: 1294287 - DNA, 22 bp, Artificial Sequence
  chemically synthesized
atctgtaactaagatctgattc

SEQ ID NO: 1294288 - DNA, 22 bp, Artificial Sequence
  chemically synthesized
tgatctgtaactaagatctgat

SEQ ID NO: 1294289 - DNA, 22 bp, Artificial Sequence
  chemically synthesized
ctgatctgtaactaagatctga

SEQ ID NO: 1294290 - DNA, 22 bp, Artificial Sequence
  chemically synthesized
ttctgatctgtaactaagatct

SEQ ID NO: 1294291 - DNA, 22 bp, Artificial Sequence
  chemically synthesized
cttctgatctgtaactaagatc

SEQ ID NO: 1294292 - DNA, 22 bp, Artificial Sequence
  chemically synthesized
caggaatcagatcttagttaca

SEQ ID NO: 1294293 - DNA, 22 bp, Artificial Sequence
  chemically synthesized
aggaatcagatcttagttacag

SEQ ID NO: 1294294 - DNA, 22 bp, Artificial Sequence
  chemically synthesized
acttcttctgatctgtaactaa

SEQ ID NO: 1294295 - DNA, 22 bp, Artificial Sequence
  chemically synthesized
agttacagatcagaagaagtta

SEQ ID NO: 1294296 - DNA, 22 bp, Artificial Sequence
  chemically synthesized
gttacagatcagaagaagttaa

SEQ ID NO: 1294297 - DNA, 22 bp, Artificial Sequence
  chemically synthesized
aagacataaatgattaacttct

SEQ ID NO: 1294298 - DNA, 22 bp, Artificial Sequence
  chemically synthesized
cagatcagaagaagttaatcat

SEQ ID NO: 1294299 - DNA, 22 bp, Artificial Sequence
  chemically synthesized
atcatttatgtctttagatgga

SEQ ID NO: 1294300 - DNA, 22 bp, Artificial Sequence
  chemically synthesized
catgtaagtgtgtatccatcta

SEQ ID NO: 1294301 - DNA, 22 bp, Artificial Sequence
  chemically synthesized
atgtctttagatggatacacac

SEQ ID NO: 1294302 - DNA, 22 bp, Artificial Sequence
  chemically synthesized
tgtctttagatggatacacact

SEQ ID NO: 1294303 - DNA, 22 bp, Artificial Sequence
  chemically synthesized
tatgtctacatgtaagtgtgta

SEQ ID NO: 1294304 - DNA, 22 bp, Artificial Sequence
  chemically synthesized
tagatggatacacacttacatg

SEQ ID NO: 1294305 - DNA, 22 bp, Artificial Sequence
  chemically synthesized
agatggatacacacttacatgt

SEQ ID NO: 1294306 - DNA, 22 bp, Artificial Sequence
  chemically synthesized
cgctgtatgtctacatgtaagt

SEQ ID NO: 1294307 - DNA, 22 bp, Artificial Sequence
  chemically synthesized
gatggatacacacttacatgta

SEQ ID NO: 1294308 - DNA, 22 bp, Artificial Sequence
  chemically synthesized
tacgctgtatgtctacatgtaa

SEQ ID NO: 1294309 - DNA, 22 bp, Artificial Sequence
  chemically synthesized
ctacgctgtatgtctacatgta

SEQ ID NO: 1294310 - DNA, 22 bp, Artificial Sequence
  chemically synthesized
tataccttctacgctgtatgtc

SEQ ID NO: 1294311 - DNA, 22 bp, Artificial Sequence
  chemically synthesized
atataccttctacgctgtatgt

SEQ ID NO: 1294312 - DNA, 22 bp, Artificial Sequence
  chemically synthesized
acatgtagacatacagcgtaga

SEQ ID NO: 1294313 - DNA, 22 bp, Artificial Sequence
  chemically synthesized
catgtagacatacagcgtagaa

SEQ ID NO: 1294314 - DNA, 22 bp, Artificial Sequence
  chemically synthesized
cagagcttatataccttctacg

SEQ ID NO: 1294315 - DNA, 22 bp, Artificial Sequence
  chemically synthesized
ccagagcttatataccttctac

SEQ ID NO: 1294316 - DNA, 22 bp, Artificial Sequence
  chemically synthesized
tccagagcttatataccttcta

SEQ ID NO: 1294317 - DNA, 22 bp, Artificial Sequence
  chemically synthesized
taaagttttccagagcttatat

SEQ ID NO: 1294318 - DNA, 22 bp, Artificial Sequence
  chemically synthesized
aaaactataaagttttccagag

SEQ ID NO: 1294319 - DNA, 22 bp, Artificial Sequence
  chemically synthesized
tggaaaactttatagttttgag

SEQ ID NO: 1294320 - DNA, 22 bp, Artificial Sequence
  chemically synthesized
tccccagaccaactcaaaacta

SEQ ID NO: 1294321 - DNA, 22 bp, Artificial Sequence
  chemically synthesized
gaaaactttatagttttgagtt

SEQ ID NO: 1294322 - DNA, 22 bp, Artificial Sequence
  chemically synthesized
gaaattatccccagaccaactc

SEQ ID NO: 1294323 - DNA, 22 bp, Artificial Sequence
  chemically synthesized
tatagttttgagttggtctggg

SEQ ID NO: 1294324 - DNA, 22 bp, Artificial Sequence
  chemically synthesized
atagttttgagttggtctgggg

SEQ ID NO: 1294325 - DNA, 22 bp, Artificial Sequence
  chemically synthesized
tagttttgagttggtctgggga

SEQ ID NO: 1294326 - DNA, 22 bp, Artificial Sequence
  chemically synthesized
tgagttggtctggggataattt

SEQ ID NO: 1294327 - DNA, 22 bp, Artificial Sequence
  chemically synthesized
gagttggtctggggataatttc

SEQ ID NO: 1294328 - DNA, 22 bp, Artificial Sequence
  chemically synthesized
agttggtctggggataatttcc

SEQ ID NO: 1294329 - DNA, 22 bp, Artificial Sequence
  chemically synthesized
cagggagaagacctggaaatta

SEQ ID NO: 1294330 - DNA, 22 bp, Artificial Sequence
  chemically synthesized
gtctggggataatttccaggtc

SEQ ID NO: 1294331 - DNA, 22 bp, Artificial Sequence
  chemically synthesized
gggataatttccaggtcttctc

SEQ ID NO: 1294332 - DNA, 22 bp, Artificial Sequence
  chemically synthesized
taagtggttacagggagaagac

SEQ ID NO: 1294333 - DNA, 22 bp, Artificial Sequence
  chemically synthesized
tgtaagtggttacagggagaag

SEQ ID NO: 1294334 - DNA, 22 bp, Artificial Sequence
  chemically synthesized
ctgtaagtggttacagggagaa

SEQ ID NO: 1294335 - DNA, 22 bp, Artificial Sequence
  chemically synthesized
tttctgtaagtggttacaggga

SEQ ID NO: 1294336 - DNA, 22 bp, Artificial Sequence
  chemically synthesized
atttctgtaagtggttacaggg

SEQ ID NO: 1294337 - DNA, 22 bp, Artificial Sequence
  chemically synthesized
ccaggtcttctccctgtaacca

SEQ ID NO: 1294338 - DNA, 22 bp, Artificial Sequence
  chemically synthesized
tatttctgtaagtggttacagg

SEQ ID NO: 1294339 - DNA, 22 bp, Artificial Sequence
  chemically synthesized
caggtcttctccctgtaaccac

SEQ ID NO: 1294340 - DNA, 22 bp, Artificial Sequence
  chemically synthesized
ttatttctgtaagtggttacag

SEQ ID NO: 1294341 - DNA, 22 bp, Artificial Sequence
  chemically synthesized
ctccctgtaaccacttacagaa

SEQ ID NO: 1294342 - DNA, 22 bp, Artificial Sequence
  chemically synthesized
tccctgtaaccacttacagaaa

SEQ ID NO: 1294343 - DNA, 22 bp, Artificial Sequence
  chemically synthesized
cctgtaaccacttacagaaata

SEQ ID NO: 1294344 - DNA, 22 bp, Artificial Sequence
  chemically synthesized
taaccacttacagaaataaaaa

SEQ ID NO: 1294345 - DNA, 22 bp, Artificial Sequence
  chemically synthesized
acagaaataaaaactctctcct

SEQ ID NO: 1294346 - DNA, 22 bp, Artificial Sequence
  chemically synthesized
cagaaataaaaactctctcctt

SEQ ID NO: 1294347 - DNA, 22 bp, Artificial Sequence
  chemically synthesized
tctccttttcccgttcatctgc

SEQ ID NO: 1294348 - DNA, 22 bp, Artificial Sequence
  chemically synthesized
tccttttcccgttcatctgcat

SEQ ID NO: 1294349 - DNA, 22 bp, Artificial Sequence
  chemically synthesized
cttttcccgttcatctgcatct

SEQ ID NO: 1294350 - DNA, 22 bp, Artificial Sequence
  chemically synthesized
tggcccaataacgagatgcaga

SEQ ID NO: 1294351 - DNA, 22 bp, Artificial Sequence
  chemically synthesized
gtggcccaataacgagatgcag

SEQ ID NO: 1294352 - DNA, 22 bp, Artificial Sequence
  chemically synthesized
ttcccgttcatctgcatctcgt

SEQ ID NO: 1294353 - DNA, 22 bp, Artificial Sequence
  chemically synthesized
tcccgttcatctgcatctcgtt

SEQ ID NO: 1294354 - DNA, 22 bp, Artificial Sequence
  chemically synthesized
ttgtggcccaataacgagatgc

SEQ ID NO: 1294355 - DNA, 22 bp, Artificial Sequence
  chemically synthesized
cccgttcatctgcatctcgtta

SEQ ID NO: 1294356 - DNA, 22 bp, Artificial Sequence
  chemically synthesized
ccgttcatctgcatctcgttat

SEQ ID NO: 1294357 - DNA, 22 bp, Artificial Sequence
  chemically synthesized
ttcttgtggcccaataacgaga

SEQ ID NO: 1294358 - DNA, 22 bp, Artificial Sequence
  chemically synthesized
attcttgtggcccaataacgag

SEQ ID NO: 1294359 - DNA, 22 bp, Artificial Sequence
  chemically synthesized
cttattcttgtggcccaataac

SEQ ID NO: 1294360 - DNA, 22 bp, Artificial Sequence
  chemically synthesized
atctgcatctcgttattgggcc

SEQ ID NO: 1294361 - DNA, 22 bp, Artificial Sequence
  chemically synthesized
ggctgcttattcttgtggccca

SEQ ID NO: 1294362 - DNA, 22 bp, Artificial Sequence
  chemically synthesized
catctcgttattgggccacaag

SEQ ID NO: 1294363 - DNA, 22 bp, Artificial Sequence
  chemically synthesized
gttattgggccacaagaataag

SEQ ID NO: 1294364 - DNA, 22 bp, Artificial Sequence
  chemically synthesized
aggattgggctgcttattcttg

SEQ ID NO: 1294365 - DNA, 22 bp, Artificial Sequence
  chemically synthesized
ttgggccacaagaataagcagc

SEQ ID NO: 1294366 - DNA, 22 bp, Artificial Sequence
  chemically synthesized
ggccacaagaataagcagccca

SEQ ID NO: 1294367 - DNA, 22 bp, Artificial Sequence
  chemically synthesized
gaccaaactgaggattgggctg

SEQ ID NO: 1294368 - DNA, 22 bp, Artificial Sequence
  chemically synthesized
ctggaccaaactgaggattggg

SEQ ID NO: 1294369 - DNA, 22 bp, Artificial Sequence
  chemically synthesized
agtttggtccaggaacactatc

SEQ ID NO: 1294370 - DNA, 22 bp, Artificial Sequence
  chemically synthesized
ggtccaggaacactatcatatc

SEQ ID NO: 1294371 - DNA, 22 bp, Artificial Sequence
  chemically synthesized
acaaaagcccatgatatgatag

SEQ ID NO: 1294372 - DNA, 22 bp, Artificial Sequence
  chemically synthesized
gtccaggaacactatcatatca

SEQ ID NO: 1294373 - DNA, 22 bp, Artificial Sequence
  chemically synthesized
cacaaaagcccatgatatgata

SEQ ID NO: 1294374 - DNA, 22 bp, Artificial Sequence
  chemically synthesized
atgtcttcacaaaagcccatga

SEQ ID NO: 1294375 - DNA, 22 bp, Artificial Sequence
  chemically synthesized
tctaatgtcttcacaaaagccc

SEQ ID NO: 1294376 - DNA, 22 bp, Artificial Sequence
  chemically synthesized
gtctaatgtcttcacaaaagcc

SEQ ID NO: 1294377 - DNA, 22 bp, Artificial Sequence
  chemically synthesized
tgtctaatgtcttcacaaaagc

SEQ ID NO: 1294378 - DNA, 22 bp, Artificial Sequence
  chemically synthesized
tcatatcatgggcttttgtgaa

SEQ ID NO: 1294379 - DNA, 22 bp, Artificial Sequence
  chemically synthesized
gttttgtctaatgtcttcacaa

SEQ ID NO: 1294380 - DNA, 22 bp, Artificial Sequence
  chemically synthesized
ttgtgaagacattagacaaaac

SEQ ID NO: 1294381 - DNA, 22 bp, Artificial Sequence
  chemically synthesized
tgtgaagacattagacaaaact

SEQ ID NO: 1294382 - DNA, 22 bp, Artificial Sequence
  chemically synthesized
gtgaagacattagacaaaacta

SEQ ID NO: 1294383 - DNA, 22 bp, Artificial Sequence
  chemically synthesized
tgaagacattagacaaaactaa

SEQ ID NO: 1294384 - DNA, 22 bp, Artificial Sequence
  chemically synthesized
aatgaagtagaaatgcataatt

SEQ ID NO: 1294385 - DNA, 22 bp, Artificial Sequence
  chemically synthesized
aaatgaagtagaaatgcataat

SEQ ID NO: 1294386 - DNA, 22 bp, Artificial Sequence
  chemically synthesized
gacaaaactaattatgcatttc

SEQ ID NO: 1294387 - DNA, 22 bp, Artificial Sequence
  chemically synthesized
acttaaatgaagtagaaatgca

SEQ ID NO: 1294388 - DNA, 22 bp, Artificial Sequence
  chemically synthesized
gacttaaatgaagtagaaatgc

SEQ ID NO: 1294389 - DNA, 22 bp, Artificial Sequence
  chemically synthesized
attatgcatttctacttcattt

SEQ ID NO: 1294390 - DNA, 22 bp, Artificial Sequence
  chemically synthesized
tgcatttctacttcatttaagt

SEQ ID NO: 1294391 - DNA, 22 bp, Artificial Sequence
  chemically synthesized
ctacttcatttaagtcaaacat

SEQ ID NO: 1294392 - DNA, 22 bp, Artificial Sequence
  chemically synthesized
tacttcatttaagtcaaacatg

SEQ ID NO: 1294393 - DNA, 22 bp, Artificial Sequence
  chemically synthesized
caacatagtatgcatgtttgac

SEQ ID NO: 1294394 - DNA, 22 bp, Artificial Sequence
  chemically synthesized
ccaacatagtatgcatgtttga

SEQ ID NO: 1294395 - DNA, 22 bp, Artificial Sequence
  chemically synthesized
cttcatttaagtcaaacatgca

SEQ ID NO: 1294396 - DNA, 22 bp, Artificial Sequence
  chemically synthesized
tccaacatagtatgcatgtttg

SEQ ID NO: 1294397 - DNA, 22 bp, Artificial Sequence
  chemically synthesized
ttccaacatagtatgcatgttt

SEQ ID NO: 1294398 - DNA, 22 bp, Artificial Sequence
  chemically synthesized
tttccaacatagtatgcatgtt

SEQ ID NO: 1294399 - DNA, 22 bp, Artificial Sequence
  chemically synthesized
catttaagtcaaacatgcatac

SEQ ID NO: 1294400 - DNA, 22 bp, Artificial Sequence
  chemically synthesized
ttttccaacatagtatgcatgt

SEQ ID NO: 1294401 - DNA, 22 bp, Artificial Sequence
  chemically synthesized
atttaagtcaaacatgcatact

SEQ ID NO: 1294402 - DNA, 22 bp, Artificial Sequence
  chemically synthesized
atttttttccaacatagtatgc

SEQ ID NO: 1294403 - DNA, 22 bp, Artificial Sequence
  chemically synthesized
aagtcaaacatgcatactatgt

SEQ ID NO: 1294404 - DNA, 22 bp, Artificial Sequence
  chemically synthesized
agtcaaacatgcatactatgtt

SEQ ID NO: 1294405 - DNA, 22 bp, Artificial Sequence
  chemically synthesized
tctgatttttttccaacatagt

SEQ ID NO: 1294406 - DNA, 22 bp, Artificial Sequence
  chemically synthesized
tgtctgatttttttccaacata

SEQ ID NO: 1294407 - DNA, 22 bp, Artificial Sequence
  chemically synthesized
ctgtctgatttttttccaacat

SEQ ID NO: 1294408 - DNA, 22 bp, Artificial Sequence
  chemically synthesized
ttctgtctgatttttttccaac

SEQ ID NO: 1294409 - DNA, 22 bp, Artificial Sequence
  chemically synthesized
actcttctgtctgatttttttc

SEQ ID NO: 1294410 - DNA, 22 bp, Artificial Sequence
  chemically synthesized
tgttggaaaaaaatcagacaga

SEQ ID NO: 1294411 - DNA, 22 bp, Artificial Sequence
  chemically synthesized
catactcactcttctgtctgat

SEQ ID NO: 1294412 - DNA, 22 bp, Artificial Sequence
  chemically synthesized
ccatactcactcttctgtctga

SEQ ID NO: 1294413 - DNA, 22 bp, Artificial Sequence
  chemically synthesized
tttccatactcactcttctgtc

SEQ ID NO: 1294414 - DNA, 22 bp, Artificial Sequence
  chemically synthesized
gaaaaaaatcagacagaagagt

SEQ ID NO: 1294415 - DNA, 22 bp, Artificial Sequence
  chemically synthesized
atttccatactcactcttctgt

SEQ ID NO: 1294416 - DNA, 22 bp, Artificial Sequence
  chemically synthesized
tatttccatactcactcttctg

SEQ ID NO: 1294417 - DNA, 22 bp, Artificial Sequence
  chemically synthesized
gtaatcatctttatttccatac

SEQ ID NO: 1294418 - DNA, 22 bp, Artificial Sequence
  chemically synthesized
agtaatcatctttatttccata

SEQ ID NO: 1294419 - DNA, 22 bp, Artificial Sequence
  chemically synthesized
aatttagtaatcatctttattt

SEQ ID NO: 1294420 - DNA, 22 bp, Artificial Sequence
  chemically synthesized
tactgaatttagtaatcatctt

SEQ ID NO: 1294421 - DNA, 22 bp, Artificial Sequence
  chemically synthesized
atcctatactgaatttagtaat

SEQ ID NO: 1294422 - DNA, 22 bp, Artificial Sequence
  chemically synthesized
gatcctatactgaatttagtaa

SEQ ID NO: 1294423 - DNA, 22 bp, Artificial Sequence
  chemically synthesized
tgatcctatactgaatttagta

SEQ ID NO: 1294424 - DNA, 22 bp, Artificial Sequence
  chemically synthesized
ctaaattcagtataggatcaaa

SEQ ID NO: 1294425 - DNA, 22 bp, Artificial Sequence
  chemically synthesized
aattcagtataggatcaaaacc

SEQ ID NO: 1294426 - DNA, 22 bp, Artificial Sequence
  chemically synthesized
agtataggatcaaaaccatcat

SEQ ID NO: 1294427 - DNA, 22 bp, Artificial Sequence
  chemically synthesized
ccaatgagtgatatgatggttt

SEQ ID NO: 1294428 - DNA, 22 bp, Artificial Sequence
  chemically synthesized
tctcccaatgagtgatatgatg

SEQ ID NO: 1294429 - DNA, 22 bp, Artificial Sequence
  chemically synthesized
agagagataaactatctcccaa

SEQ ID NO: 1294430 - DNA, 22 bp, Artificial Sequence
  chemically synthesized
aattgagagagataaactatct

SEQ ID NO: 1294431 - DNA, 22 bp, Artificial Sequence
  chemically synthesized
attgggagatagtttatctctc

SEQ ID NO: 1294432 - DNA, 22 bp, Artificial Sequence
  chemically synthesized
ccagctcaattgagagagataa

SEQ ID NO: 1294433 - DNA, 22 bp, Artificial Sequence
  chemically synthesized
ggagatagtttatctctctcaa

SEQ ID NO: 1294434 - DNA, 22 bp, Artificial Sequence
  chemically synthesized
ctgccagctcaattgagagaga

SEQ ID NO: 1294435 - DNA, 22 bp, Artificial Sequence
  chemically synthesized
actgccagctcaattgagagag

SEQ ID NO: 1294436 - DNA, 22 bp, Artificial Sequence
  chemically synthesized
atctctctcaattgagctggca

SEQ ID NO: 1294437 - DNA, 22 bp, Artificial Sequence
  chemically synthesized
tctctctcaattgagctggcag

SEQ ID NO: 1294438 - DNA, 22 bp, Artificial Sequence
  chemically synthesized
tctcaattgagctggcagtaaa

SEQ ID NO: 1294439 - DNA, 22 bp, Artificial Sequence
  chemically synthesized
tgggaaaaaatatttactgcca

SEQ ID NO: 1294440 - DNA, 22 bp, Artificial Sequence
  chemically synthesized
atgggaaaaaatatttactgcc

SEQ ID NO: 1294441 - DNA, 22 bp, Artificial Sequence
  chemically synthesized
tcaattgagctggcagtaaata

SEQ ID NO: 1294442 - DNA, 22 bp, Artificial Sequence
  chemically synthesized
tatgggaaaaaatatttactgc

SEQ ID NO: 1294443 - DNA, 22 bp, Artificial Sequence
  chemically synthesized
aattgagctggcagtaaatatt

SEQ ID NO: 1294444 - DNA, 22 bp, Artificial Sequence
  chemically synthesized
agctggcagtaaatattttttc

SEQ ID NO: 1294445 - DNA, 22 bp, Artificial Sequence
  chemically synthesized
agaaaaaattttatgggaaaaa

SEQ ID NO: 1294446 - DNA, 22 bp, Artificial Sequence
  chemically synthesized
gcagtaaatattttttcccata

SEQ ID NO: 1294447 - DNA, 22 bp, Artificial Sequence
  chemically synthesized
gagaaaaaattttatgggaaaa

SEQ ID NO: 1294448 - DNA, 22 bp, Artificial Sequence
  chemically synthesized
tgtttgagaaaaaattttatgg

SEQ ID NO: 1294449 - DNA, 22 bp, Artificial Sequence
  chemically synthesized
gtgtttgagaaaaaattttatg

SEQ ID NO: 1294450 - DNA, 22 bp, Artificial Sequence
  chemically synthesized
atgtttgtgtttgagaaaaaat

SEQ ID NO: 1294451 - DNA, 22 bp, Artificial Sequence
  chemically synthesized
tttcccataaaattttttctca

SEQ ID NO: 1294452 - DNA, 22 bp, Artificial Sequence
  chemically synthesized
gatgtttgtgtttgagaaaaaa

SEQ ID NO: 1294453 - DNA, 22 bp, Artificial Sequence
  chemically synthesized
ttcccataaaattttttctcaa

SEQ ID NO: 1294454 - DNA, 22 bp, Artificial Sequence
  chemically synthesized
tcccataaaattttttctcaaa

SEQ ID NO: 1294455 - DNA, 22 bp, Artificial Sequence
  chemically synthesized
cccataaaattttttctcaaac

SEQ ID NO: 1294456 - DNA, 22 bp, Artificial Sequence
  chemically synthesized
ccataaaattttttctcaaaca

SEQ ID NO: 1294457 - DNA, 22 bp, Artificial Sequence
  chemically synthesized
tttctcaaacacaaacatcaag

SEQ ID NO: 1294458 - DNA, 22 bp, Artificial Sequence
  chemically synthesized
tcataaaatgtgcttgatgttt

SEQ ID NO: 1294459 - DNA, 22 bp, Artificial Sequence
  chemically synthesized
ttctcaaacacaaacatcaagc

SEQ ID NO: 1294460 - DNA, 22 bp, Artificial Sequence
  chemically synthesized
gtcataaaatgtgcttgatgtt

SEQ ID NO: 1294461 - DNA, 22 bp, Artificial Sequence
  chemically synthesized
tctcaaacacaaacatcaagca

SEQ ID NO: 1294462 - DNA, 22 bp, Artificial Sequence
  chemically synthesized
tgtcataaaatgtgcttgatgt

SEQ ID NO: 1294463 - DNA, 22 bp, Artificial Sequence
  chemically synthesized
ctcaaacacaaacatcaagcac

SEQ ID NO: 1294464 - DNA, 22 bp, Artificial Sequence
  chemically synthesized
tcaaacacaaacatcaagcaca

SEQ ID NO: 1294465 - DNA, 22 bp, Artificial Sequence
  chemically synthesized
aaacacaaacatcaagcacatt

SEQ ID NO: 1294466 - DNA, 22 bp, Artificial Sequence
  chemically synthesized
aaaacatgaccaaaaataattt

SEQ ID NO: 1294467 - DNA, 22 bp, Artificial Sequence
  chemically synthesized
gaaaacatgaccaaaaataatt

SEQ ID NO: 1294468 - DNA, 22 bp, Artificial Sequence
  chemically synthesized
tgaaaacatgaccaaaaataat

SEQ ID NO: 1294469 - DNA, 22 bp, Artificial Sequence
  chemically synthesized
tatgacaaaattatttttggtc

SEQ ID NO: 1294470 - DNA, 22 bp, Artificial Sequence
  chemically synthesized
atgacaaaattatttttggtca

SEQ ID NO: 1294471 - DNA, 22 bp, Artificial Sequence
  chemically synthesized
tgacaaaattatttttggtcat

SEQ ID NO: 1294472 - DNA, 22 bp, Artificial Sequence
  chemically synthesized
tttttggtcatgttttcaaaac

SEQ ID NO: 1294473 - DNA, 22 bp, Artificial Sequence
  chemically synthesized
ttggtcatgttttcaaaactgt

SEQ ID NO: 1294474 - DNA, 22 bp, Artificial Sequence
  chemically synthesized
ataaagggaagtacagttttga

SEQ ID NO: 1294475 - DNA, 22 bp, Artificial Sequence
  chemically synthesized
tggtcatgttttcaaaactgta

SEQ ID NO: 1294476 - DNA, 22 bp, Artificial Sequence
  chemically synthesized
aataaagggaagtacagttttg

SEQ ID NO: 1294477 - DNA, 22 bp, Artificial Sequence
  chemically synthesized
ggtcatgttttcaaaactgtac

SEQ ID NO: 1294478 - DNA, 22 bp, Artificial Sequence
  chemically synthesized
gtcatgttttcaaaactgtact

SEQ ID NO: 1294479 - DNA, 22 bp, Artificial Sequence
  chemically synthesized
tcaaaactgtacttccctttat

SEQ ID NO: 1294480 - DNA, 22 bp, Artificial Sequence
  chemically synthesized
caaaactgtacttccctttatt

SEQ ID NO: 1294481 - DNA, 22 bp, Artificial Sequence
  chemically synthesized
aaaactgtacttccctttatta

SEQ ID NO: 1294482 - DNA, 22 bp, Artificial Sequence
  chemically synthesized
atccatgccggcttaataaagg

SEQ ID NO: 1294483 - DNA, 22 bp, Artificial Sequence
  chemically synthesized
ctcatccatgccggcttaataa

SEQ ID NO: 1294484 - DNA, 22 bp, Artificial Sequence
  chemically synthesized
gctcatccatgccggcttaata

SEQ ID NO: 1294485 - DNA, 22 bp, Artificial Sequence
  chemically synthesized
tacttccctttattaagccggc

SEQ ID NO: 1294486 - DNA, 22 bp, Artificial Sequence
  chemically synthesized
ccctttattaagccggcatgga

SEQ ID NO: 1294487 - DNA, 22 bp, Artificial Sequence
  chemically synthesized
cctttattaagccggcatggat

SEQ ID NO: 1294488 - DNA, 22 bp, Artificial Sequence
  chemically synthesized
taaaaatcttgctcatccatgc

SEQ ID NO: 1294489 - DNA, 22 bp, Artificial Sequence
  chemically synthesized
tattaagccggcatggatgagc

SEQ ID NO: 1294490 - DNA, 22 bp, Artificial Sequence
  chemically synthesized
attaagccggcatggatgagca

SEQ ID NO: 1294491 - DNA, 22 bp, Artificial Sequence
  chemically synthesized
ttaagccggcatggatgagcaa

SEQ ID NO: 1294492 - DNA, 22 bp, Artificial Sequence
  chemically synthesized
gcattataaaaatcttgctcat

SEQ ID NO: 1294493 - DNA, 22 bp, Artificial Sequence
  chemically synthesized
agccggcatggatgagcaagat

SEQ ID NO: 1294494 - DNA, 22 bp, Artificial Sequence
  chemically synthesized
tgacaaatatgattcgcattat

SEQ ID NO: 1294495 - DNA, 22 bp, Artificial Sequence
  chemically synthesized
tatgacaaatatgattcgcatt

SEQ ID NO: 1294496 - DNA, 22 bp, Artificial Sequence
  chemically synthesized
ttataatgcgaatcatatttgt

SEQ ID NO: 1294497 - DNA, 22 bp, Artificial Sequence
  chemically synthesized
tataatgcgaatcatatttgtc

SEQ ID NO: 1294498 - DNA, 22 bp, Artificial Sequence
  chemically synthesized
ataatgcgaatcatatttgtca

SEQ ID NO: 1294499 - DNA, 22 bp, Artificial Sequence
  chemically synthesized
gtgtatactctatgacaaatat

SEQ ID NO: 1294500 - DNA, 22 bp, Artificial Sequence
  chemically synthesized
taatgcgaatcatatttgtcat

SEQ ID NO: 1294501 - DNA, 22 bp, Artificial Sequence
  chemically synthesized
aaaagcctcgtgtatactctat

SEQ ID NO: 1294502 - DNA, 22 bp, Artificial Sequence
  chemically synthesized
aaaaagcctcgtgtatactcta

SEQ ID NO: 1294503 - DNA, 22 bp, Artificial Sequence
  chemically synthesized
taaaaagcctcgtgtatactct

SEQ ID NO: 1294504 - DNA, 22 bp, Artificial Sequence
  chemically synthesized
gtcatagagtatacacgaggct

SEQ ID NO: 1294505 - DNA, 22 bp, Artificial Sequence
  chemically synthesized
tcatagagtatacacgaggctt

SEQ ID NO: 1294506 - DNA, 22 bp, Artificial Sequence
  chemically synthesized
taatcctttaaaaagcctcgtg

SEQ ID NO: 1294507 - DNA, 22 bp, Artificial Sequence
  chemically synthesized
atatgttataatcctttaaaaa

SEQ ID NO: 1294508 - DNA, 22 bp, Artificial Sequence
  chemically synthesized
ttgatatgttataatcctttaa

SEQ ID NO: 1294509 - DNA, 22 bp, Artificial Sequence
  chemically synthesized
attgatatgttataatccttta

SEQ ID NO: 1294510 - DNA, 22 bp, Artificial Sequence
  chemically synthesized
tttaaaggattataacatatca

SEQ ID NO: 1294511 - DNA, 22 bp, Artificial Sequence
  chemically synthesized
catgtaatttattgatatgtta

SEQ ID NO: 1294512 - DNA, 22 bp, Artificial Sequence
  chemically synthesized
ttaaaggattataacatatcaa

SEQ ID NO: 1294513 - DNA, 22 bp, Artificial Sequence
  chemically synthesized
ccatgtaatttattgatatgtt

SEQ ID NO: 1294514 - DNA, 22 bp, Artificial Sequence
  chemically synthesized
taaaggattataacatatcaat

SEQ ID NO: 1294515 - DNA, 22 bp, Artificial Sequence
  chemically synthesized
tccatgtaatttattgatatgt

SEQ ID NO: 1294516 - DNA, 22 bp, Artificial Sequence
  chemically synthesized
aaaggattataacatatcaata

SEQ ID NO: 1294517 - DNA, 22 bp, Artificial Sequence
  chemically synthesized
aaggattataacatatcaataa

SEQ ID NO: 1294518 - DNA, 22 bp, Artificial Sequence
  chemically synthesized
tttccatgtaatttattgatat

SEQ ID NO: 1294519 - DNA, 22 bp, Artificial Sequence
  chemically synthesized
taacatatcaataaattacatg

SEQ ID NO: 1294520 - DNA, 22 bp, Artificial Sequence
  chemically synthesized
agagtaaatattctttccatgt

SEQ ID NO: 1294521 - DNA, 22 bp, Artificial Sequence
  chemically synthesized
attcagagtaaatattctttcc

SEQ ID NO: 1294522 - DNA, 22 bp, Artificial Sequence
  chemically synthesized
catggaaagaatatttactctg

SEQ ID NO: 1294523 - DNA, 22 bp, Artificial Sequence
  chemically synthesized
gataagattaattcagagtaaa

SEQ ID NO: 1294524 - DNA, 22 bp, Artificial Sequence
  chemically synthesized
tagataagattaattcagagta

SEQ ID NO: 1294525 - DNA, 22 bp, Artificial Sequence
  chemically synthesized
ctagataagattaattcagagt

SEQ ID NO: 1294526 - DNA, 22 bp, Artificial Sequence
  chemically synthesized
actctgaattaatcttatctag

SEQ ID NO: 1294527 - DNA, 22 bp, Artificial Sequence
  chemically synthesized
ctctgaattaatcttatctaga

SEQ ID NO: 1294528 - DNA, 22 bp, Artificial Sequence
  chemically synthesized
tgaattaatcttatctagaaat

SEQ ID NO: 1294529 - DNA, 22 bp, Artificial Sequence
  chemically synthesized
aattaatcttatctagaaatgg

SEQ ID NO: 1294530 - DNA, 22 bp, Artificial Sequence
  chemically synthesized
cacataaacacaaaaccatttc

SEQ ID NO: 1294531 - DNA, 22 bp, Artificial Sequence
  chemically synthesized
atcttatctagaaatggttttg

SEQ ID NO: 1294532 - DNA, 22 bp, Artificial Sequence
  chemically synthesized
tctccacataaacacaaaacca

SEQ ID NO: 1294533 - DNA, 22 bp, Artificial Sequence
  chemically synthesized
atctccacataaacacaaaacc

SEQ ID NO: 1294534 - DNA, 22 bp, Artificial Sequence
  chemically synthesized
atctagaaatggttttgtgttt

SEQ ID NO: 1294535 - DNA, 22 bp, Artificial Sequence
  chemically synthesized
tctagaaatggttttgtgttta

SEQ ID NO: 1294536 - DNA, 22 bp, Artificial Sequence
  chemically synthesized
gaaatggttttgtgtttatgtg

SEQ ID NO: 1294537 - DNA, 22 bp, Artificial Sequence
  chemically synthesized
aacaatatttatctccacataa

SEQ ID NO: 1294538 - DNA, 22 bp, Artificial Sequence
  chemically synthesized
tgtgtttatgtggagataaata

SEQ ID NO: 1294539 - DNA, 22 bp, Artificial Sequence
  chemically synthesized
gtgtttatgtggagataaatat

SEQ ID NO: 1294540 - DNA, 22 bp, Artificial Sequence
  chemically synthesized
tgtttatgtggagataaatatt

SEQ ID NO: 1294541 - DNA, 22 bp, Artificial Sequence
  chemically synthesized
atgtggagataaatattgttca

SEQ ID NO: 1294542 - DNA, 22 bp, Artificial Sequence
  chemically synthesized
tatagagataactgaacaatat

SEQ ID NO: 1294543 - DNA, 22 bp, Artificial Sequence
  chemically synthesized
tgtggagataaatattgttcag

SEQ ID NO: 1294544 - DNA, 22 bp, Artificial Sequence
  chemically synthesized
ttatatagagataactgaacaa

SEQ ID NO: 1294545 - DNA, 22 bp, Artificial Sequence
  chemically synthesized
tcacatctattatatagagata

SEQ ID NO: 1294546 - DNA, 22 bp, Artificial Sequence
  chemically synthesized
atcacatctattatatagagat

SEQ ID NO: 1294547 - DNA, 22 bp, Artificial Sequence
  chemically synthesized
ttcagttatctctatataatag

SEQ ID NO: 1294548 - DNA, 22 bp, Artificial Sequence
  chemically synthesized
agttatctctatataatagatg

SEQ ID NO: 1294549 - DNA, 22 bp, Artificial Sequence
  chemically synthesized
gaatgtgatttatcacatctat

SEQ ID NO: 1294550 - DNA, 22 bp, Artificial Sequence
  chemically synthesized
tctctatataatagatgtgata

SEQ ID NO: 1294551 - DNA, 22 bp, Artificial Sequence
  chemically synthesized
ctagaatgtgatttatcacatc

SEQ ID NO: 1294552 - DNA, 22 bp, Artificial Sequence
  chemically synthesized
tactagaatgtgatttatcaca

SEQ ID NO: 1294553 - DNA, 22 bp, Artificial Sequence
  chemically synthesized
tatataatagatgtgataaatc

SEQ ID NO: 1294554 - DNA, 22 bp, Artificial Sequence
  chemically synthesized
tataatagatgtgataaatcac

SEQ ID NO: 1294555 - DNA, 22 bp, Artificial Sequence
  chemically synthesized
caaaaaattctactagaatgtg

SEQ ID NO: 1294556 - DNA, 22 bp, Artificial Sequence
  chemically synthesized
attccaaaaaattctactagaa

SEQ ID NO: 1294557 - DNA, 22 bp, Artificial Sequence
  chemically synthesized
gattccaaaaaattctactaga

SEQ ID NO: 1294558 - DNA, 22 bp, Artificial Sequence
  chemically synthesized
tgattccaaaaaattctactag

SEQ ID NO: 1294559 - DNA, 22 bp, Artificial Sequence
  chemically synthesized
actttgattccaaaaaattcta

SEQ ID NO: 1294560 - DNA, 22 bp, Artificial Sequence
  chemically synthesized
ttaactttgattccaaaaaatt

SEQ ID NO: 1294561 - DNA, 22 bp, Artificial Sequence
  chemically synthesized
tattaactttgattccaaaaaa

SEQ ID NO: 1294562 - DNA, 22 bp, Artificial Sequence
  chemically synthesized
ctattaactttgattccaaaaa

SEQ ID NO: 1294563 - DNA, 22 bp, Artificial Sequence
  chemically synthesized
tagtagaattttttggaatcaa

SEQ ID NO: 1294564 - DNA, 22 bp, Artificial Sequence
  chemically synthesized
gtagaattttttggaatcaaag

SEQ ID NO: 1294565 - DNA, 22 bp, Artificial Sequence
  chemically synthesized
aaataagtcttctattaacttt

SEQ ID NO: 1294566 - DNA, 22 bp, Artificial Sequence
  chemically synthesized
aaaataagtcttctattaactt

SEQ ID NO: 1294567 - DNA, 22 bp, Artificial Sequence
  chemically synthesized
taaaataagtcttctattaact

SEQ ID NO: 1294568 - DNA, 22 bp, Artificial Sequence
  chemically synthesized
tttggaatcaaagttaatagaa

SEQ ID NO: 1294569 - DNA, 22 bp, Artificial Sequence
  chemically synthesized
ttaaaataagtcttctattaac

SEQ ID NO: 1294570 - DNA, 22 bp, Artificial Sequence
  chemically synthesized
ttggaatcaaagttaatagaag

SEQ ID NO: 1294571 - DNA, 22 bp, Artificial Sequence
  chemically synthesized
tttaaaataagtcttctattaa

SEQ ID NO: 1294572 - DNA, 22 bp, Artificial Sequence
  chemically synthesized
tggaatcaaagttaatagaaga

SEQ ID NO: 1294573 - DNA, 22 bp, Artificial Sequence
  chemically synthesized
ggaatcaaagttaatagaagac

SEQ ID NO: 1294574 - DNA, 22 bp, Artificial Sequence
  chemically synthesized
tttttaaaataagtcttctatt

SEQ ID NO: 1294575 - DNA, 22 bp, Artificial Sequence
  chemically synthesized
gaatcaaagttaatagaagact

SEQ ID NO: 1294576 - DNA, 22 bp, Artificial Sequence
  chemically synthesized
tctctttttaaaataagtcttc

SEQ ID NO: 1294577 - DNA, 22 bp, Artificial Sequence
  chemically synthesized
atagaagacttattttaaaaag

SEQ ID NO: 1294578 - DNA, 22 bp, Artificial Sequence
  chemically synthesized
aaaataagccctatctcttttt

SEQ ID NO: 1294579 - DNA, 22 bp, Artificial Sequence
  chemically synthesized
aaaaataagccctatctctttt

SEQ ID NO: 1294580 - DNA, 22 bp, Artificial Sequence
  chemically synthesized
taaaaataagccctatctcttt

SEQ ID NO: 1294581 - DNA, 22 bp, Artificial Sequence
  chemically synthesized
attttaaaaagagatagggctt

SEQ ID NO: 1294582 - DNA, 22 bp, Artificial Sequence
  chemically synthesized
ttttaaaaagagatagggctta

SEQ ID NO: 1294583 - DNA, 22 bp, Artificial Sequence
  chemically synthesized
taaaaagagatagggcttattt

SEQ ID NO: 1294584 - DNA, 22 bp, Artificial Sequence
  chemically synthesized
gtaccattttaaaaataagccc

SEQ ID NO: 1294585 - DNA, 22 bp, Artificial Sequence
  chemically synthesized
aaaaagagatagggcttatttt

SEQ ID NO: 1294586 - DNA, 22 bp, Artificial Sequence
  chemically synthesized
aaaagagatagggcttattttt

SEQ ID NO: 1294587 - DNA, 22 bp, Artificial Sequence
  chemically synthesized
ctggtaccattttaaaaataag

SEQ ID NO: 1294588 - DNA, 22 bp, Artificial Sequence
  chemically synthesized
cctggtaccattttaaaaataa

SEQ ID NO: 1294589 - DNA, 22 bp, Artificial Sequence
  chemically synthesized
tcctggtaccattttaaaaata

SEQ ID NO: 1294590 - DNA, 22 bp, Artificial Sequence
  chemically synthesized
cactttcctggtaccattttaa

SEQ ID NO: 1294591 - DNA, 22 bp, Artificial Sequence
  chemically synthesized
ccactttcctggtaccatttta

SEQ ID NO: 1294592 - DNA, 22 bp, Artificial Sequence
  chemically synthesized
tccactttcctggtaccatttt

SEQ ID NO: 1294593 - DNA, 22 bp, Artificial Sequence
  chemically synthesized
attttccactttcctggtacca

SEQ ID NO: 1294594 - DNA, 22 bp, Artificial Sequence
  chemically synthesized
atttttaaaatggtaccaggaa

SEQ ID NO: 1294595 - DNA, 22 bp, Artificial Sequence
  chemically synthesized
tttttaaaatggtaccaggaaa

SEQ ID NO: 1294596 - DNA, 22 bp, Artificial Sequence
  chemically synthesized
actgattttccactttcctggt

SEQ ID NO: 1294597 - DNA, 22 bp, Artificial Sequence
  chemically synthesized
ttaaaatggtaccaggaaagtg

SEQ ID NO: 1294598 - DNA, 22 bp, Artificial Sequence
  chemically synthesized
taaaatggtaccaggaaagtgg

SEQ ID NO: 1294599 - DNA, 22 bp, Artificial Sequence
  chemically synthesized
aaaatggtaccaggaaagtgga

SEQ ID NO: 1294600 - DNA, 22 bp, Artificial Sequence
  chemically synthesized
aaatggtaccaggaaagtggaa

SEQ ID NO: 1294601 - DNA, 22 bp, Artificial Sequence
  chemically synthesized
cagtaaatctaactgattttcc

SEQ ID NO: 1294602 - DNA, 22 bp, Artificial Sequence
  chemically synthesized
gcagtaaatctaactgattttc

SEQ ID NO: 1294603 - DNA, 22 bp, Artificial Sequence
  chemically synthesized
tgcagtaaatctaactgatttt

SEQ ID NO: 1294604 - DNA, 22 bp, Artificial Sequence
  chemically synthesized
aagccaaatgtgtctttgcagt

SEQ ID NO: 1294605 - DNA, 22 bp, Artificial Sequence
  chemically synthesized
gaagccaaatgtgtctttgcag

SEQ ID NO: 1294606 - DNA, 22 bp, Artificial Sequence
  chemically synthesized
gatttactgcaaagacacattt

SEQ ID NO: 1294607 - DNA, 22 bp, Artificial Sequence
  chemically synthesized
actgcaaagacacatttggctt

SEQ ID NO: 1294608 - DNA, 22 bp, Artificial Sequence
  chemically synthesized
tggcgtcatttgaagccaaatg

SEQ ID NO: 1294609 - DNA, 22 bp, Artificial Sequence
  chemically synthesized
ctgcaaagacacatttggcttc

SEQ ID NO: 1294610 - DNA, 22 bp, Artificial Sequence
  chemically synthesized
ttgtggcgtcatttgaagccaa

SEQ ID NO: 1294611 - DNA, 22 bp, Artificial Sequence
  chemically synthesized
caaagacacatttggcttcaaa

SEQ ID NO: 1294612 - DNA, 22 bp, Artificial Sequence
  chemically synthesized
ttgttgtggcgtcatttgaagc

SEQ ID NO: 1294613 - DNA, 22 bp, Artificial Sequence
  chemically synthesized
gttgttgtggcgtcatttgaag

SEQ ID NO: 1294614 - DNA, 22 bp, Artificial Sequence
  chemically synthesized
ggcttcaaatgacgccacaaca

SEQ ID NO: 1294615 - DNA, 22 bp, Artificial Sequence
  chemically synthesized
gcttcaaatgacgccacaacaa

SEQ ID NO: 1294616 - DNA, 22 bp, Artificial Sequence
  chemically synthesized
aatgtatccttgttgttgtggc

SEQ ID NO: 1294617 - DNA, 22 bp, Artificial Sequence
  chemically synthesized
caaatgacgccacaacaacaag

SEQ ID NO: 1294618 - DNA, 22 bp, Artificial Sequence
  chemically synthesized
aaatgacgccacaacaacaagg

SEQ ID NO: 1294619 - DNA, 22 bp, Artificial Sequence
  chemically synthesized
aaggaaataaatgtgattaaat

SEQ ID NO: 1294620 - DNA, 22 bp, Artificial Sequence
  chemically synthesized
aaaggaaataaatgtgattaaa

SEQ ID NO: 1294621 - DNA, 22 bp, Artificial Sequence
  chemically synthesized
cggaagggatatttaaaggaaa

SEQ ID NO: 1294622 - DNA, 22 bp, Artificial Sequence
  chemically synthesized
aatcacatttatttcctttaaa

SEQ ID NO: 1294623 - DNA, 22 bp, Artificial Sequence
  chemically synthesized
atcacatttatttcctttaaat

SEQ ID NO: 1294624 - DNA, 22 bp, Artificial Sequence
  chemically synthesized
taaagctacggaagggatattt

SEQ ID NO: 1294625 - DNA, 22 bp, Artificial Sequence
  chemically synthesized
gtaaagctacggaagggatatt

SEQ ID NO: 1294626 - DNA, 22 bp, Artificial Sequence
  chemically synthesized
tgtaaagctacggaagggatat

SEQ ID NO: 1294627 - DNA, 22 bp, Artificial Sequence
  chemically synthesized
atttcctttaaatatcccttcc

SEQ ID NO: 1294628 - DNA, 22 bp, Artificial Sequence
  chemically synthesized
tttcctttaaatatcccttccg

SEQ ID NO: 1294629 - DNA, 22 bp, Artificial Sequence
  chemically synthesized
ttttgtaaagctacggaaggga

SEQ ID NO: 1294630 - DNA, 22 bp, Artificial Sequence
  chemically synthesized
cctttaaatatcccttccgtag

SEQ ID NO: 1294631 - DNA, 22 bp, Artificial Sequence
  chemically synthesized
ctttaaatatcccttccgtagc

SEQ ID NO: 1294632 - DNA, 22 bp, Artificial Sequence
  chemically synthesized
ttattttgtaaagctacggaag

SEQ ID NO: 1294633 - DNA, 22 bp, Artificial Sequence
  chemically synthesized
gttattttgtaaagctacggaa

SEQ ID NO: 1294634 - DNA, 22 bp, Artificial Sequence
  chemically synthesized
taaatatcccttccgtagcttt

SEQ ID NO: 1294635 - DNA, 22 bp, Artificial Sequence
  chemically synthesized
aaatatcccttccgtagcttta

SEQ ID NO: 1294636 - DNA, 22 bp, Artificial Sequence
  chemically synthesized
cttgttattttgtaaagctacg

SEQ ID NO: 1294637 - DNA, 22 bp, Artificial Sequence
  chemically synthesized
aatatcccttccgtagctttac

SEQ ID NO: 1294638 - DNA, 22 bp, Artificial Sequence
  chemically synthesized
ccttgttattttgtaaagctac

SEQ ID NO: 1294639 - DNA, 22 bp, Artificial Sequence
  chemically synthesized
ccgtagctttacaaaataacaa

SEQ ID NO: 1294640 - DNA, 22 bp, Artificial Sequence
  chemically synthesized
cgtagctttacaaaataacaag

SEQ ID NO: 1294641 - DNA, 22 bp, Artificial Sequence
  chemically synthesized
tacaaaataacaaggaaatatt

SEQ ID NO: 1294642 - DNA, 22 bp, Artificial Sequence
  chemically synthesized
acaaaataacaaggaaatattt

SEQ ID NO: 1294643 - DNA, 22 bp, Artificial Sequence
  chemically synthesized
caaaataacaaggaaatatttt

SEQ ID NO: 1294644 - DNA, 22 bp, Artificial Sequence
  chemically synthesized
tagagagacaacaaaatatttc

SEQ ID NO: 1294645 - DNA, 22 bp, Artificial Sequence
  chemically synthesized
taaattatagagagacaacaaa

SEQ ID NO: 1294646 - DNA, 22 bp, Artificial Sequence
  chemically synthesized
gtaaattatagagagacaacaa

SEQ ID NO: 1294647 - DNA, 22 bp, Artificial Sequence
  chemically synthesized
tataatatttgtaaattataga

SEQ ID NO: 1294648 - DNA, 22 bp, Artificial Sequence
  chemically synthesized
atataatatttgtaaattatag

SEQ ID NO: 1294649 - DNA, 22 bp, Artificial Sequence
  chemically synthesized
tgttgtctctctataatttaca

SEQ ID NO: 1294650 - DNA, 22 bp, Artificial Sequence
  chemically synthesized
gttgtctctctataatttacaa

SEQ ID NO: 1294651 - DNA, 22 bp, Artificial Sequence
  chemically synthesized
ttgtctctctataatttacaaa

SEQ ID NO: 1294652 - DNA, 22 bp, Artificial Sequence
  chemically synthesized
tctctctataatttacaaatat

SEQ ID NO: 1294653 - DNA, 22 bp, Artificial Sequence
  chemically synthesized
tctataatttacaaatattata

SEQ ID NO: 1294654 - DNA, 22 bp, Artificial Sequence
  chemically synthesized
tacacacatttatataatattt

SEQ ID NO: 1294655 - DNA, 22 bp, Artificial Sequence
  chemically synthesized
atacacacatttatataatatt

SEQ ID NO: 1294656 - DNA, 22 bp, Artificial Sequence
  chemically synthesized
tataatttacaaatattatata

SEQ ID NO: 1294657 - DNA, 22 bp, Artificial Sequence
  chemically synthesized
tatacacacatttatataatat

SEQ ID NO: 1294658 - DNA, 22 bp, Artificial Sequence
  chemically synthesized
ttatacacacatttatataata

SEQ ID NO: 1294659 - DNA, 22 bp, Artificial Sequence
  chemically synthesized
taatttacaaatattatataaa

SEQ ID NO: 1294660 - DNA, 22 bp, Artificial Sequence
  chemically synthesized
ccttttatacacacatttatat

SEQ ID NO: 1294661 - DNA, 22 bp, Artificial Sequence
  chemically synthesized
acaaatattatataaatgtgtg

SEQ ID NO: 1294662 - DNA, 22 bp, Artificial Sequence
  chemically synthesized
caaatattatataaatgtgtgt

SEQ ID NO: 1294663 - DNA, 22 bp, Artificial Sequence
  chemically synthesized
attgccttttatacacacattt

SEQ ID NO: 1294664 - DNA, 22 bp, Artificial Sequence
  chemically synthesized
cattgccttttatacacacatt

SEQ ID NO: 1294665 - DNA, 22 bp, Artificial Sequence
  chemically synthesized
tcattgccttttatacacacat

SEQ ID NO: 1294666 - DNA, 22 bp, Artificial Sequence
  chemically synthesized
ttcattgccttttatacacaca

SEQ ID NO: 1294667 - DNA, 22 bp, Artificial Sequence
  chemically synthesized
tataaatgtgtgtataaaaggc

SEQ ID NO: 1294668 - DNA, 22 bp, Artificial Sequence
  chemically synthesized
ccacacagacagatgataattt

SEQ ID NO: 1294669 - DNA, 22 bp, Artificial Sequence
  chemically synthesized
accacacagacagatgataatt

SEQ ID NO: 1294670 - DNA, 22 bp, Artificial Sequence
  chemically synthesized
taccacacagacagatgataat

SEQ ID NO: 1294671 - DNA, 22 bp, Artificial Sequence
  chemically synthesized
ctttaccacacagacagatgat

SEQ ID NO: 1294672 - DNA, 22 bp, Artificial Sequence
  chemically synthesized
tgtctactttaccacacagaca

SEQ ID NO: 1294673 - DNA, 22 bp, Artificial Sequence
  chemically synthesized
tctgtgtctactttaccacaca

SEQ ID NO: 1294674 - DNA, 22 bp, Artificial Sequence
  chemically synthesized
tcatctgtctgtgtggtaaagt

SEQ ID NO: 1294675 - DNA, 22 bp, Artificial Sequence
  chemically synthesized
atgtctatctgtgtctacttta

SEQ ID NO: 1294676 - DNA, 22 bp, Artificial Sequence
  chemically synthesized
tctgtgtggtaaagtagacaca

SEQ ID NO: 1294677 - DNA, 22 bp, Artificial Sequence
  chemically synthesized
tgtggtaaagtagacacagata

SEQ ID NO: 1294678 - DNA, 22 bp, Artificial Sequence
  chemically synthesized
tagtcgtattaatgtctatctg

SEQ ID NO: 1294679 - DNA, 22 bp, Artificial Sequence
  chemically synthesized
atagtcgtattaatgtctatct

SEQ ID NO: 1294680 - DNA, 22 bp, Artificial Sequence
  chemically synthesized
tatagtcgtattaatgtctatc

SEQ ID NO: 1294681 - DNA, 22 bp, Artificial Sequence
  chemically synthesized
ttatagtcgtattaatgtctat

SEQ ID NO: 1294682 - DNA, 22 bp, Artificial Sequence
  chemically synthesized
atttttatagtcgtattaatgt

SEQ ID NO: 1294683 - DNA, 22 bp, Artificial Sequence
  chemically synthesized
atattcatttttatagtcgtat

SEQ ID NO: 1294684 - DNA, 22 bp, Artificial Sequence
  chemically synthesized
actcatattcatttttatagtc

SEQ ID NO: 1294685 - DNA, 22 bp, Artificial Sequence
  chemically synthesized
atacgactataaaaatgaatat

SEQ ID NO: 1294686 - DNA, 22 bp, Artificial Sequence
  chemically synthesized
ataaatctaactcatattcatt

SEQ ID NO: 1294687 - DNA, 22 bp, Artificial Sequence
  chemically synthesized
actaataaatctaactcatatt

SEQ ID NO: 1294688 - DNA, 22 bp, Artificial Sequence
  chemically synthesized
taaaaatgaatatgagttagat

SEQ ID NO: 1294689 - DNA, 22 bp, Artificial Sequence
  chemically synthesized
taaaaatgcctcactaataaat

SEQ ID NO: 1294690 - DNA, 22 bp, Artificial Sequence
  chemically synthesized
atacaactataaaaatgcctca

SEQ ID NO: 1294691 - DNA, 22 bp, Artificial Sequence
  chemically synthesized
gatttattagtgaggcattttt

SEQ ID NO: 1294692 - DNA, 22 bp, Artificial Sequence
  chemically synthesized
attagtgaggcatttttatagt

SEQ ID NO: 1294693 - DNA, 22 bp, Artificial Sequence
  chemically synthesized
ttagtgaggcatttttatagtt

SEQ ID NO: 1294694 - DNA, 22 bp, Artificial Sequence
  chemically synthesized
gtgaggcatttttatagttgta

SEQ ID NO: 1294695 - DNA, 22 bp, Artificial Sequence
  chemically synthesized
gacacaggcacacacacattca

SEQ ID NO: 1294696 - DNA, 22 bp, Artificial Sequence
  chemically synthesized
ttatagttgtatgaatgtgtgt

SEQ ID NO: 1294697 - DNA, 22 bp, Artificial Sequence
  chemically synthesized
tatagttgtatgaatgtgtgtg

SEQ ID NO: 1294698 - DNA, 22 bp, Artificial Sequence
  chemically synthesized
atagttgtatgaatgtgtgtgt

SEQ ID NO: 1294699 - DNA, 22 bp, Artificial Sequence
  chemically synthesized
tagttgtatgaatgtgtgtgtg

SEQ ID NO: 1294700 - DNA, 22 bp, Artificial Sequence
  chemically synthesized
tatgaatgtgtgtgtgcctgtg

SEQ ID NO: 1294701 - DNA, 22 bp, Artificial Sequence
  chemically synthesized
tgtggtaaattagacacaggca

SEQ ID NO: 1294702 - DNA, 22 bp, Artificial Sequence
  chemically synthesized
tctgtgtggtaaattagacaca

SEQ ID NO: 1294703 - DNA, 22 bp, Artificial Sequence
  chemically synthesized
tgtctgtgtggtaaattagaca

SEQ ID NO: 1294704 - DNA, 22 bp, Artificial Sequence
  chemically synthesized
tgtctaatttaccacacagaca

SEQ ID NO: 1294705 - DNA, 22 bp, Artificial Sequence
  chemically synthesized
atttaccacacagacagaattt

SEQ ID NO: 1294706 - DNA, 22 bp, Artificial Sequence
  chemically synthesized
accacacagacagaatttttca

SEQ ID NO: 1294707 - DNA, 22 bp, Artificial Sequence
  chemically synthesized
ccacacagacagaatttttcat

SEQ ID NO: 1294708 - DNA, 22 bp, Artificial Sequence
  chemically synthesized
aaaagagaaaaaagagaatgaa

SEQ ID NO: 1294709 - DNA, 22 bp, Artificial Sequence
  chemically synthesized
aaaaagagaaaaaagagaatga

SEQ ID NO: 1294710 - DNA, 22 bp, Artificial Sequence
  chemically synthesized
taaaaagagaaaaaagagaatg

SEQ ID NO: 1294711 - DNA, 22 bp, Artificial Sequence
  chemically synthesized
ttcattctcttttttctctttt

SEQ ID NO: 1294712 - DNA, 22 bp, Artificial Sequence
  chemically synthesized
aagaagactttaaaaagagaaa

SEQ ID NO: 1294713 - DNA, 22 bp, Artificial Sequence
  chemically synthesized
tcattctcttttttctcttttt

SEQ ID NO: 1294714 - DNA, 22 bp, Artificial Sequence
  chemically synthesized
cattctcttttttctcttttta

SEQ ID NO: 1294715 - DNA, 22 bp, Artificial Sequence
  chemically synthesized
attctcttttttctctttttaa

SEQ ID NO: 1294716 - DNA, 22 bp, Artificial Sequence
  chemically synthesized
tgttgaagaagactttaaaaag

SEQ ID NO: 1294717 - DNA, 22 bp, Artificial Sequence
  chemically synthesized
tcttttttctctttttaaagtc

SEQ ID NO: 1294718 - DNA, 22 bp, Artificial Sequence
  chemically synthesized
ttttttctctttttaaagtctt

SEQ ID NO: 1294719 - DNA, 22 bp, Artificial Sequence
  chemically synthesized
ttttctctttttaaagtcttct

SEQ ID NO: 1294720 - DNA, 22 bp, Artificial Sequence
  chemically synthesized
tttctctttttaaagtcttctt

SEQ ID NO: 1294721 - DNA, 22 bp, Artificial Sequence
  chemically synthesized
ttctctttttaaagtcttcttc

SEQ ID NO: 1294722 - DNA, 22 bp, Artificial Sequence
  chemically synthesized
tctctttttaaagtcttcttca

SEQ ID NO: 1294723 - DNA, 22 bp, Artificial Sequence
  chemically synthesized
ctctttttaaagtcttcttcaa

SEQ ID NO: 1294724 - DNA, 22 bp, Artificial Sequence
  chemically synthesized
tctttttaaagtcttcttcaac

SEQ ID NO: 1294725 - DNA, 22 bp, Artificial Sequence
  chemically synthesized
tttttaaagtcttcttcaacac

SEQ ID NO: 1294726 - DNA, 22 bp, Artificial Sequence
  chemically synthesized
ggtggaaaaattgtgttgaaga

SEQ ID NO: 1294727 - DNA, 22 bp, Artificial Sequence
  chemically synthesized
tttaaagtcttcttcaacacaa

SEQ ID NO: 1294728 - DNA, 22 bp, Artificial Sequence
  chemically synthesized
ttaaagtcttcttcaacacaat

SEQ ID NO: 1294729 - DNA, 22 bp, Artificial Sequence
  chemically synthesized
taaagtcttcttcaacacaatt

SEQ ID NO: 1294730 - DNA, 22 bp, Artificial Sequence
  chemically synthesized
aaagtcttcttcaacacaattt

SEQ ID NO: 1294731 - DNA, 22 bp, Artificial Sequence
  chemically synthesized
aagtcttcttcaacacaatttt

SEQ ID NO: 1294732 - DNA, 22 bp, Artificial Sequence
  chemically synthesized
cttcaacacaatttttccaccc

SEQ ID NO: 1294733 - DNA, 22 bp, Artificial Sequence
  chemically synthesized
ttcaacacaatttttccaccca

SEQ ID NO: 1294734 - DNA, 22 bp, Artificial Sequence
  chemically synthesized
caacacaatttttccacccagt

SEQ ID NO: 1294735 - DNA, 22 bp, Artificial Sequence
  chemically synthesized
aacacaatttttccacccagtt

SEQ ID NO: 1294736 - DNA, 22 bp, Artificial Sequence
  chemically synthesized
tagaaacagaagaaaaactggg

SEQ ID NO: 1294737 - DNA, 22 bp, Artificial Sequence
  chemically synthesized
actgtagaaacagaagaaaaac

SEQ ID NO: 1294738 - DNA, 22 bp, Artificial Sequence
  chemically synthesized
ttccacccagtttttcttctgt

SEQ ID NO: 1294739 - DNA, 22 bp, Artificial Sequence
  chemically synthesized
tccacccagtttttcttctgtt

SEQ ID NO: 1294740 - DNA, 22 bp, Artificial Sequence
  chemically synthesized
ccacccagtttttcttctgttt

SEQ ID NO: 1294741 - DNA, 22 bp, Artificial Sequence
  chemically synthesized
tgctaactgtagaaacagaaga

SEQ ID NO: 1294742 - DNA, 22 bp, Artificial Sequence
  chemically synthesized
cacccagtttttcttctgtttc

SEQ ID NO: 1294743 - DNA, 22 bp, Artificial Sequence
  chemically synthesized
aatctatgctaactgtagaaac

SEQ ID NO: 1294744 - DNA, 22 bp, Artificial Sequence
  chemically synthesized
ttcttctgtttctacagttagc

SEQ ID NO: 1294745 - DNA, 22 bp, Artificial Sequence
  chemically synthesized
tcttctgtttctacagttagca

SEQ ID NO: 1294746 - DNA, 22 bp, Artificial Sequence
  chemically synthesized
cttctgtttctacagttagcat

SEQ ID NO: 1294747 - DNA, 22 bp, Artificial Sequence
  chemically synthesized
ttctgtttctacagttagcata

SEQ ID NO: 1294748 - DNA, 22 bp, Artificial Sequence
  chemically synthesized
ctgtttctacagttagcataga

SEQ ID NO: 1294749 - DNA, 22 bp, Artificial Sequence
  chemically synthesized
tgtttctacagttagcatagat

SEQ ID NO: 1294750 - DNA, 22 bp, Artificial Sequence
  chemically synthesized
tttctacagttagcatagattt

SEQ ID NO: 1294751 - DNA, 22 bp, Artificial Sequence
  chemically synthesized
ctacagttagcatagatttaat

SEQ ID NO: 1294752 - DNA, 22 bp, Artificial Sequence
  chemically synthesized
tacagttagcatagatttaatg

SEQ ID NO: 1294753 - DNA, 22 bp, Artificial Sequence
  chemically synthesized
cagttagcatagatttaatgat

SEQ ID NO: 1294754 - DNA, 22 bp, Artificial Sequence
  chemically synthesized
ggtcagtagtacaaatcattaa

SEQ ID NO: 1294755 - DNA, 22 bp, Artificial Sequence
  chemically synthesized
gcatagatttaatgatttgtac

SEQ ID NO: 1294756 - DNA, 22 bp, Artificial Sequence
  chemically synthesized
aatgatttgtactactgaccta

SEQ ID NO: 1294757 - DNA, 22 bp, Artificial Sequence
  chemically synthesized
atgatttgtactactgacctag

SEQ ID NO: 1294758 - DNA, 22 bp, Artificial Sequence
  chemically synthesized
gtactactgacctagtatattt

SEQ ID NO: 1294759 - DNA, 22 bp, Artificial Sequence
  chemically synthesized
tataaatataataaatatacta

SEQ ID NO: 1294760 - DNA, 22 bp, Artificial Sequence
  chemically synthesized
tactactgacctagtatattta

SEQ ID NO: 1294761 - DNA, 22 bp, Artificial Sequence
  chemically synthesized
ctgacctagtatatttattata

SEQ ID NO: 1294762 - DNA, 22 bp, Artificial Sequence
  chemically synthesized
gtacactatataaatataataa

SEQ ID NO: 1294763 - DNA, 22 bp, Artificial Sequence
  chemically synthesized
acctagtatatttattatattt

SEQ ID NO: 1294764 - DNA, 22 bp, Artificial Sequence
  chemically synthesized
ctagtacactatataaatataa

SEQ ID NO: 1294765 - DNA, 22 bp, Artificial Sequence
  chemically synthesized
gtatatttattatatttatata

SEQ ID NO: 1294766 - DNA, 22 bp, Artificial Sequence
  chemically synthesized
ttactagtacactatataaata

SEQ ID NO: 1294767 - DNA, 22 bp, Artificial Sequence
  chemically synthesized
attactagtacactatataaat

SEQ ID NO: 1294768 - DNA, 22 bp, Artificial Sequence
  chemically synthesized
tttattactagtacactatata

SEQ ID NO: 1294769 - DNA, 22 bp, Artificial Sequence
  chemically synthesized
attatatttatatagtgtacta

SEQ ID NO: 1294770 - DNA, 22 bp, Artificial Sequence
  chemically synthesized
attgtttattactagtacacta

SEQ ID NO: 1294771 - DNA, 22 bp, Artificial Sequence
  chemically synthesized
ttatatttatatagtgtactag

SEQ ID NO: 1294772 - DNA, 22 bp, Artificial Sequence
  chemically synthesized
tatttatatagtgtactagtaa

SEQ ID NO: 1294773 - DNA, 22 bp, Artificial Sequence
  chemically synthesized
atatagtgtactagtaataaac

SEQ ID NO: 1294774 - DNA, 22 bp, Artificial Sequence
  chemically synthesized
tataatctcattgtttattact

SEQ ID NO: 1294775 - DNA, 22 bp, Artificial Sequence
  chemically synthesized
tatagtgtactagtaataaaca

SEQ ID NO: 1294776 - DNA, 22 bp, Artificial Sequence
  chemically synthesized
tatataatctcattgtttatta

SEQ ID NO: 1294777 - DNA, 22 bp, Artificial Sequence
  chemically synthesized
ctatataatctcattgtttatt

SEQ ID NO: 1294778 - DNA, 22 bp, Artificial Sequence
  chemically synthesized
gtaataaacaatgagattatat

SEQ ID NO: 1294779 - DNA, 22 bp, Artificial Sequence
  chemically synthesized
tatagaagatatacattcctgc

SEQ ID NO: 1294780 - DNA, 22 bp, Artificial Sequence
  chemically synthesized
aaatgtgagcccatcaaaggca

SEQ ID NO: 1294781 - DNA, 22 bp, Artificial Sequence
  chemically synthesized
taaaatgtgagcccatcaaagg

SEQ ID NO: 1294782 - DNA, 22 bp, Artificial Sequence
  chemically synthesized
ctgcctttgatgggctcacatt

SEQ ID NO: 1294783 - DNA, 22 bp, Artificial Sequence
  chemically synthesized
cctttgatgggctcacatttta

SEQ ID NO: 1294784 - DNA, 22 bp, Artificial Sequence
  chemically synthesized
tgaagaaagctctaaaatgtga

SEQ ID NO: 1294785 - DNA, 22 bp, Artificial Sequence
  chemically synthesized
atgaagaaagctctaaaatgtg

SEQ ID NO: 1294786 - DNA, 22 bp, Artificial Sequence
  chemically synthesized
tatgaagaaagctctaaaatgt

SEQ ID NO: 1294787 - DNA, 22 bp, Artificial Sequence
  chemically synthesized
tgatgggctcacattttagagc

SEQ ID NO: 1294788 - DNA, 22 bp, Artificial Sequence
  chemically synthesized
gatgggctcacattttagagct

SEQ ID NO: 1294789 - DNA, 22 bp, Artificial Sequence
  chemically synthesized
atgggctcacattttagagctt

SEQ ID NO: 1294790 - DNA, 22 bp, Artificial Sequence
  chemically synthesized
gtaacctttatgaagaaagctc

SEQ ID NO: 1294791 - DNA, 22 bp, Artificial Sequence
  chemically synthesized
acattttagagctttcttcata

SEQ ID NO: 1294792 - DNA, 22 bp, Artificial Sequence
  chemically synthesized
tagagctttcttcataaaggtt

SEQ ID NO: 1294793 - DNA, 22 bp, Artificial Sequence
  chemically synthesized
agagctttcttcataaaggtta

SEQ ID NO: 1294794 - DNA, 22 bp, Artificial Sequence
  chemically synthesized
gagggaatctggtaacctttat

SEQ ID NO: 1294795 - DNA, 22 bp, Artificial Sequence
  chemically synthesized
gagctttcttcataaaggttac

SEQ ID NO: 1294796 - DNA, 22 bp, Artificial Sequence
  chemically synthesized
agctagagggaatctggtaacc

SEQ ID NO: 1294797 - DNA, 22 bp, Artificial Sequence
  chemically synthesized
tcttcataaaggttaccagatt

SEQ ID NO: 1294798 - DNA, 22 bp, Artificial Sequence
  chemically synthesized
cttcataaaggttaccagattc

SEQ ID NO: 1294799 - DNA, 22 bp, Artificial Sequence
  chemically synthesized
ttcataaaggttaccagattcc

SEQ ID NO: 1294800 - DNA, 22 bp, Artificial Sequence
  chemically synthesized
cataaaggttaccagattccct

SEQ ID NO: 1294801 - DNA, 22 bp, Artificial Sequence
  chemically synthesized
ataaaggttaccagattccctc

SEQ ID NO: 1294802 - DNA, 22 bp, Artificial Sequence
  chemically synthesized
agaaggcagtaatctgagctag

SEQ ID NO: 1294803 - DNA, 22 bp, Artificial Sequence
  chemically synthesized
ccagattccctctagctcagat

SEQ ID NO: 1294804 - DNA, 22 bp, Artificial Sequence
  chemically synthesized
cctctagctcagattactgcct

SEQ ID NO: 1294805 - DNA, 22 bp, Artificial Sequence
  chemically synthesized
tagctcagattactgccttctc

SEQ ID NO: 1294806 - DNA, 22 bp, Artificial Sequence
  chemically synthesized
gctcagattactgccttctcag

SEQ ID NO: 1294807 - DNA, 22 bp, Artificial Sequence
  chemically synthesized
agtgtgggtggtctgagaaggc

SEQ ID NO: 1294808 - DNA, 22 bp, Artificial Sequence
  chemically synthesized
agattactgccttctcagacca

SEQ ID NO: 1294809 - DNA, 22 bp, Artificial Sequence
  chemically synthesized
agtgggctcagtgtgggtggtc

SEQ ID NO: 1294810 - DNA, 22 bp, Artificial Sequence
  chemically synthesized
ctgccttctcagaccacccaca

SEQ ID NO: 1294811 - DNA, 22 bp, Artificial Sequence
  chemically synthesized
ccttctcagaccacccacactg

SEQ ID NO: 1294812 - DNA, 22 bp, Artificial Sequence
  chemically synthesized
gaactgagtgggctcagtgtgg

SEQ ID NO: 1294813 - DNA, 22 bp, Artificial Sequence
  chemically synthesized
ctcagaccacccacactgagcc

SEQ ID NO: 1294814 - DNA, 22 bp, Artificial Sequence
  chemically synthesized
tcagaccacccacactgagccc

SEQ ID NO: 1294815 - DNA, 22 bp, Artificial Sequence
  chemically synthesized
agaccacccacactgagcccac

SEQ ID NO: 1294816 - DNA, 22 bp, Artificial Sequence
  chemically synthesized
ataaatggagttagaactgagt

SEQ ID NO: 1294817 - DNA, 22 bp, Artificial Sequence
  chemically synthesized
attgataaatggagttagaact

SEQ ID NO: 1294818 - DNA, 22 bp, Artificial Sequence
  chemically synthesized
agcccactcagttctaactcca

SEQ ID NO: 1294819 - DNA, 22 bp, Artificial Sequence
  chemically synthesized
gttaattgataaatggagttag

SEQ ID NO: 1294820 - DNA, 22 bp, Artificial Sequence
  chemically synthesized
ggttaattgataaatggagtta

SEQ ID NO: 1294821 - DNA, 22 bp, Artificial Sequence
  chemically synthesized
tggttaattgataaatggagtt

SEQ ID NO: 1294822 - DNA, 22 bp, Artificial Sequence
  chemically synthesized
ttggttaattgataaatggagt

SEQ ID NO: 1294823 - DNA, 22 bp, Artificial Sequence
  chemically synthesized
agttctaactccatttatcaat

SEQ ID NO: 1294824 - DNA, 22 bp, Artificial Sequence
  chemically synthesized
ggagtttttggttaattgataa

SEQ ID NO: 1294825 - DNA, 22 bp, Artificial Sequence
  chemically synthesized
gggagtttttggttaattgata

SEQ ID NO: 1294826 - DNA, 22 bp, Artificial Sequence
  chemically synthesized
taactccatttatcaattaacc

SEQ ID NO: 1294827 - DNA, 22 bp, Artificial Sequence
  chemically synthesized
tttgggagtttttggttaattg

SEQ ID NO: 1294828 - DNA, 22 bp, Artificial Sequence
  chemically synthesized
actccatttatcaattaaccaa

SEQ ID NO: 1294829 - DNA, 22 bp, Artificial Sequence
  chemically synthesized
catttatcaattaaccaaaaac

SEQ ID NO: 1294830 - DNA, 22 bp, Artificial Sequence
  chemically synthesized
cacagttatttgggagtttttg

SEQ ID NO: 1294831 - DNA, 22 bp, Artificial Sequence
  chemically synthesized
atcaattaaccaaaaactccca

SEQ ID NO: 1294832 - DNA, 22 bp, Artificial Sequence
  chemically synthesized
tcaattaaccaaaaactcccaa

SEQ ID NO: 1294833 - DNA, 22 bp, Artificial Sequence
  chemically synthesized
accaaaaactcccaaataactg

SEQ ID NO: 1294834 - DNA, 22 bp, Artificial Sequence
  chemically synthesized
atggaacctacacagttatttg

SEQ ID NO: 1294835 - DNA, 22 bp, Artificial Sequence
  chemically synthesized
aactcatggaacctacacagtt

SEQ ID NO: 1294836 - DNA, 22 bp, Artificial Sequence
  chemically synthesized
ctgaactcatggaacctacaca

SEQ ID NO: 1294837 - DNA, 22 bp, Artificial Sequence
  chemically synthesized
ccaaataactgtgtaggttcca

SEQ ID NO: 1294838 - DNA, 22 bp, Artificial Sequence
  chemically synthesized
aagtggaatctcctgaactcat

SEQ ID NO: 1294839 - DNA, 22 bp, Artificial Sequence
  chemically synthesized
tgtaggttccatgagttcagga

SEQ ID NO: 1294840 - DNA, 22 bp, Artificial Sequence
  chemically synthesized
gttgaagtggaatctcctgaac

SEQ ID NO: 1294841 - DNA, 22 bp, Artificial Sequence
  chemically synthesized
catgagttcaggagattccact

SEQ ID NO: 1294842 - DNA, 22 bp, Artificial Sequence
  chemically synthesized
aggagattccacttcaactaat

SEQ ID NO: 1294843 - DNA, 22 bp, Artificial Sequence
  chemically synthesized
taggatacacagattagttgaa

SEQ ID NO: 1294844 - DNA, 22 bp, Artificial Sequence
  chemically synthesized
gccctgtaggatacacagatta

SEQ ID NO: 1294845 - DNA, 22 bp, Artificial Sequence
  chemically synthesized
tagccctgtaggatacacagat

SEQ ID NO: 1294846 - DNA, 22 bp, Artificial Sequence
  chemically synthesized
cacttcaactaatctgtgtatc

SEQ ID NO: 1294847 - DNA, 22 bp, Artificial Sequence
  chemically synthesized
caactaatctgtgtatcctaca

SEQ ID NO: 1294848 - DNA, 22 bp, Artificial Sequence
  chemically synthesized
aactaatctgtgtatcctacag

SEQ ID NO: 1294849 - DNA, 22 bp, Artificial Sequence
  chemically synthesized
agcagaattctagccctgtagg

SEQ ID NO: 1294850 - DNA, 22 bp, Artificial Sequence
  chemically synthesized
cagcagaattctagccctgtag

SEQ ID NO: 1294851 - DNA, 22 bp, Artificial Sequence
  chemically synthesized
atctgtgtatcctacagggcta

SEQ ID NO: 1294852 - DNA, 22 bp, Artificial Sequence
  chemically synthesized
tcagcagaattctagccctgta

SEQ ID NO: 1294853 - DNA, 22 bp, Artificial Sequence
  chemically synthesized
tgtatcctacagggctagaatt

SEQ ID NO: 1294854 - DNA, 22 bp, Artificial Sequence
  chemically synthesized
catgcctttcagcagaattcta

SEQ ID NO: 1294855 - DNA, 22 bp, Artificial Sequence
  chemically synthesized
cagggctagaattctgctgaaa

SEQ ID NO: 1294856 - DNA, 22 bp, Artificial Sequence
  chemically synthesized
catcgctgcatgcctttcagca

SEQ ID NO: 1294857 - DNA, 22 bp, Artificial Sequence
  chemically synthesized
ttgcatcgctgcatgcctttca

SEQ ID NO: 1294858 - DNA, 22 bp, Artificial Sequence
  chemically synthesized
attgcatcgctgcatgcctttc

SEQ ID NO: 1294859 - DNA, 22 bp, Artificial Sequence
  chemically synthesized
gaattctgctgaaaggcatgca

SEQ ID NO: 1294860 - DNA, 22 bp, Artificial Sequence
  chemically synthesized
gcaatttattgcatcgctgcat

SEQ ID NO: 1294861 - DNA, 22 bp, Artificial Sequence
  chemically synthesized
tgctgaaaggcatgcagcgatg

SEQ ID NO: 1294862 - DNA, 22 bp, Artificial Sequence
  chemically synthesized
ggcaatttattgcatcgctgca

SEQ ID NO: 1294863 - DNA, 22 bp, Artificial Sequence
  chemically synthesized
ctgaaaggcatgcagcgatgca

SEQ ID NO: 1294864 - DNA, 22 bp, Artificial Sequence
  chemically synthesized
aaaggcatgcagcgatgcaata

SEQ ID NO: 1294865 - DNA, 22 bp, Artificial Sequence
  chemically synthesized
tgatatatatatcatttggcaa

SEQ ID NO: 1294866 - DNA, 22 bp, Artificial Sequence
  chemically synthesized
ccaaatgatatatatatcacaa

SEQ ID NO: 1294867 - DNA, 22 bp, Artificial Sequence
  chemically synthesized
gtgaaaccaaaagataaacata

SEQ ID NO: 1294868 - DNA, 22 bp, Artificial Sequence
  chemically synthesized
ggtgaaaccaaaagataaacat

SEQ ID NO: 1294869 - DNA, 22 bp, Artificial Sequence
  chemically synthesized
agccacttggtgaaaccaaaag

SEQ ID NO: 1294870 - DNA, 22 bp, Artificial Sequence
  chemically synthesized
aagccacttggtgaaaccaaaa

SEQ ID NO: 1294871 - DNA, 22 bp, Artificial Sequence
  chemically synthesized
tgtttatcttttggtttcacca

SEQ ID NO: 1294872 - DNA, 22 bp, Artificial Sequence
  chemically synthesized
agtttaagccacttggtgaaac

SEQ ID NO: 1294873 - DNA, 22 bp, Artificial Sequence
  chemically synthesized
atcttttggtttcaccaagtgg

SEQ ID NO: 1294874 - DNA, 22 bp, Artificial Sequence
  chemically synthesized
attcagtttaagccacttggtg

SEQ ID NO: 1294875 - DNA, 22 bp, Artificial Sequence
  chemically synthesized
tcttttggtttcaccaagtggc

SEQ ID NO: 1294876 - DNA, 22 bp, Artificial Sequence
  chemically synthesized
gttgattcagtttaagccactt

SEQ ID NO: 1294877 - DNA, 22 bp, Artificial Sequence
  chemically synthesized
ttggtttcaccaagtggcttaa

SEQ ID NO: 1294878 - DNA, 22 bp, Artificial Sequence
  chemically synthesized
tggtttcaccaagtggcttaaa

SEQ ID NO: 1294879 - DNA, 22 bp, Artificial Sequence
  chemically synthesized
ggtttcaccaagtggcttaaac

SEQ ID NO: 1294880 - DNA, 22 bp, Artificial Sequence
  chemically synthesized
gtttcaccaagtggcttaaact

SEQ ID NO: 1294881 - DNA, 22 bp, Artificial Sequence
  chemically synthesized
caccaagtggcttaaactgaat

SEQ ID NO: 1294882 - DNA, 22 bp, Artificial Sequence
  chemically synthesized
accaagtggcttaaactgaatc

SEQ ID NO: 1294883 - DNA, 22 bp, Artificial Sequence
  chemically synthesized
gaggaagctagttgattcagtt

SEQ ID NO: 1294884 - DNA, 22 bp, Artificial Sequence
  chemically synthesized
agaggaagctagttgattcagt

SEQ ID NO: 1294885 - DNA, 22 bp, Artificial Sequence
  chemically synthesized
aaactgaatcaactagcttcct

SEQ ID NO: 1294886 - DNA, 22 bp, Artificial Sequence
  chemically synthesized
aactgaatcaactagcttcctc

SEQ ID NO: 1294887 - DNA, 22 bp, Artificial Sequence
  chemically synthesized
aatcaactagcttcctctaaat

SEQ ID NO: 1294888 - DNA, 22 bp, Artificial Sequence
  chemically synthesized
aagaagatgggaatttagagga

SEQ ID NO: 1294889 - DNA, 22 bp, Artificial Sequence
  chemically synthesized
gaagaagatgggaatttagagg

SEQ ID NO: 1294890 - DNA, 22 bp, Artificial Sequence
  chemically synthesized
tgaagaagatgggaatttagag

SEQ ID NO: 1294891 - DNA, 22 bp, Artificial Sequence
  chemically synthesized
ttgaagaagatgggaatttaga

SEQ ID NO: 1294892 - DNA, 22 bp, Artificial Sequence
  chemically synthesized
gcttcctctaaattcccatctt

SEQ ID NO: 1294893 - DNA, 22 bp, Artificial Sequence
  chemically synthesized
gacacttttgaagaagatggga

SEQ ID NO: 1294894 - DNA, 22 bp, Artificial Sequence
  chemically synthesized
agacacttttgaagaagatggg

SEQ ID NO: 1294895 - DNA, 22 bp, Artificial Sequence
  chemically synthesized
tagacacttttgaagaagatgg

SEQ ID NO: 1294896 - DNA, 22 bp, Artificial Sequence
  chemically synthesized
cctctaaattcccatcttcttc

SEQ ID NO: 1294897 - DNA, 22 bp, Artificial Sequence
  chemically synthesized
ttagacacttttgaagaagatg

SEQ ID NO: 1294898 - DNA, 22 bp, Artificial Sequence
  chemically synthesized
ctctaaattcccatcttcttca

SEQ ID NO: 1294899 - DNA, 22 bp, Artificial Sequence
  chemically synthesized
ttttagacacttttgaagaaga

SEQ ID NO: 1294900 - DNA, 22 bp, Artificial Sequence
  chemically synthesized
taaattcccatcttcttcaaaa

SEQ ID NO: 1294901 - DNA, 22 bp, Artificial Sequence
  chemically synthesized
aattcccatcttcttcaaaagt

SEQ ID NO: 1294902 - DNA, 22 bp, Artificial Sequence
  chemically synthesized
cattcttttagacacttttgaa

SEQ ID NO: 1294903 - DNA, 22 bp, Artificial Sequence
  chemically synthesized
ccatcttcttcaaaagtgtcta

SEQ ID NO: 1294904 - DNA, 22 bp, Artificial Sequence
  chemically synthesized
agtgactgcattcttttagaca

SEQ ID NO: 1294905 - DNA, 22 bp, Artificial Sequence
  chemically synthesized
cttcaaaagtgtctaaaagaat

SEQ ID NO: 1294906 - DNA, 22 bp, Artificial Sequence
  chemically synthesized
ttcaaaagtgtctaaaagaatg

SEQ ID NO: 1294907 - DNA, 22 bp, Artificial Sequence
  chemically synthesized
gctaagtgactgcattctttta

SEQ ID NO: 1294908 - DNA, 22 bp, Artificial Sequence
  chemically synthesized
agctaagtgactgcattctttt

SEQ ID NO: 1294909 - DNA, 22 bp, Artificial Sequence
  chemically synthesized
caaaagtgtctaaaagaatgca

SEQ ID NO: 1294910 - DNA, 22 bp, Artificial Sequence
  chemically synthesized
aaaagtgtctaaaagaatgcag

SEQ ID NO: 1294911 - DNA, 22 bp, Artificial Sequence
  chemically synthesized
tcaaaacttagctaagtgactg

SEQ ID NO: 1294912 - DNA, 22 bp, Artificial Sequence
  chemically synthesized
tgtcaaaacttagctaagtgac

SEQ ID NO: 1294913 - DNA, 22 bp, Artificial Sequence
  chemically synthesized
ctgtcaaaacttagctaagtga

SEQ ID NO: 1294914 - DNA, 22 bp, Artificial Sequence
  chemically synthesized
aaagaatgcagtcacttagcta

SEQ ID NO: 1294915 - DNA, 22 bp, Artificial Sequence
  chemically synthesized
tctgtcaaaacttagctaagtg

SEQ ID NO: 1294916 - DNA, 22 bp, Artificial Sequence
  chemically synthesized
ttctgtcaaaacttagctaagt

SEQ ID NO: 1294917 - DNA, 22 bp, Artificial Sequence
  chemically synthesized
ttttctgtcaaaacttagctaa

SEQ ID NO: 1294918 - DNA, 22 bp, Artificial Sequence
  chemically synthesized
ttcttttctgtcaaaacttagc

SEQ ID NO: 1294919 - DNA, 22 bp, Artificial Sequence
  chemically synthesized
attcttttctgtcaaaacttag

SEQ ID NO: 1294920 - DNA, 22 bp, Artificial Sequence
  chemically synthesized
ttattcttttctgtcaaaactt

SEQ ID NO: 1294921 - DNA, 22 bp, Artificial Sequence
  chemically synthesized
cttattcttttctgtcaaaact

SEQ ID NO: 1294922 - DNA, 22 bp, Artificial Sequence
  chemically synthesized
tcttattcttttctgtcaaaac

SEQ ID NO: 1294923 - DNA, 22 bp, Artificial Sequence
  chemically synthesized
ttcttattcttttctgtcaaaa

SEQ ID NO: 1294924 - DNA, 22 bp, Artificial Sequence
  chemically synthesized
ttttcttattcttttctgtcaa

SEQ ID NO: 1294925 - DNA, 22 bp, Artificial Sequence
  chemically synthesized
agctaagttttgacagaaaaga

SEQ ID NO: 1294926 - DNA, 22 bp, Artificial Sequence
  chemically synthesized
ctcttttcttattcttttctgt

SEQ ID NO: 1294927 - DNA, 22 bp, Artificial Sequence
  chemically synthesized
gctaagttttgacagaaaagaa

SEQ ID NO: 1294928 - DNA, 22 bp, Artificial Sequence
  chemically synthesized
cctcttttcttattcttttctg

SEQ ID NO: 1294929 - DNA, 22 bp, Artificial Sequence
  chemically synthesized
tcctcttttcttattcttttct

SEQ ID NO: 1294930 - DNA, 22 bp, Artificial Sequence
  chemically synthesized
ttcctcttttcttattcttttc

SEQ ID NO: 1294931 - DNA, 22 bp, Artificial Sequence
  chemically synthesized
tttcctcttttcttattctttt

SEQ ID NO: 1294932 - DNA, 22 bp, Artificial Sequence
  chemically synthesized
agttttgacagaaaagaataag

SEQ ID NO: 1294933 - DNA, 22 bp, Artificial Sequence
  chemically synthesized
tgacagaaaagaataagaaaag

SEQ ID NO: 1294934 - DNA, 22 bp, Artificial Sequence
  chemically synthesized
gacagaaaagaataagaaaaga

SEQ ID NO: 1294935 - DNA, 22 bp, Artificial Sequence
  chemically synthesized
acagaaaagaataagaaaagag

SEQ ID NO: 1294936 - DNA, 22 bp, Artificial Sequence
  chemically synthesized
caaagaatctttttcctctttt

SEQ ID NO: 1294937 - DNA, 22 bp, Artificial Sequence
  chemically synthesized
gcaaagaatctttttcctcttt

SEQ ID NO: 1294938 - DNA, 22 bp, Artificial Sequence
  chemically synthesized
agaacttgcaaagaatcttttt

SEQ ID NO: 1294939 - DNA, 22 bp, Artificial Sequence
  chemically synthesized
gagaacttgcaaagaatctttt

SEQ ID NO: 1294940 - DNA, 22 bp, Artificial Sequence
  chemically synthesized
tgagaacttgcaaagaatcttt

SEQ ID NO: 1294941 - DNA, 22 bp, Artificial Sequence
  chemically synthesized
attttgagaacttgcaaagaat

SEQ ID NO: 1294942 - DNA, 22 bp, Artificial Sequence
  chemically synthesized
taattttgagaacttgcaaaga

SEQ ID NO: 1294943 - DNA, 22 bp, Artificial Sequence
  chemically synthesized
ctaattttgagaacttgcaaag

SEQ ID NO: 1294944 - DNA, 22 bp, Artificial Sequence
  chemically synthesized
acttctaattttgagaacttgc

SEQ ID NO: 1294945 - DNA, 22 bp, Artificial Sequence
  chemically synthesized
tgcactaacttctaattttgag

SEQ ID NO: 1294946 - DNA, 22 bp, Artificial Sequence
  chemically synthesized
tttgcaagttctcaaaattaga

SEQ ID NO: 1294947 - DNA, 22 bp, Artificial Sequence
  chemically synthesized
tgcaagttctcaaaattagaag

SEQ ID NO: 1294948 - DNA, 22 bp, Artificial Sequence
  chemically synthesized
gcaagttctcaaaattagaagt

SEQ ID NO: 1294949 - DNA, 22 bp, Artificial Sequence
  chemically synthesized
caagttctcaaaattagaagtt

SEQ ID NO: 1294950 - DNA, 22 bp, Artificial Sequence
  chemically synthesized
tcaaaattagaagttagtgcac

SEQ ID NO: 1294951 - DNA, 22 bp, Artificial Sequence
  chemically synthesized
aaaattagaagttagtgcacag

SEQ ID NO: 1294952 - DNA, 22 bp, Artificial Sequence
  chemically synthesized
gaagttagtgcacaggtatata

SEQ ID NO: 1294953 - DNA, 22 bp, Artificial Sequence
  chemically synthesized
aaggtaaaatgtatatatacct

SEQ ID NO: 1294954 - DNA, 22 bp, Artificial Sequence
  chemically synthesized
aaaggtaaaatgtatatatacc

SEQ ID NO: 1294955 - DNA, 22 bp, Artificial Sequence
  chemically synthesized
tttaaaggtaaaatgtatatat

SEQ ID NO: 1294956 - DNA, 22 bp, Artificial Sequence
  chemically synthesized
atttaaaggtaaaatgtatata

SEQ ID NO: 1294957 - DNA, 22 bp, Artificial Sequence
  chemically synthesized
gtgcacaggtatatatacattt

SEQ ID NO: 1294958 - DNA, 22 bp, Artificial Sequence
  chemically synthesized
caaagacagaggagaaaactta

SEQ ID NO: 1294959 - DNA, 22 bp, Artificial Sequence
  chemically synthesized
acaaagacagaggagaaaactt

SEQ ID NO: 1294960 - DNA, 22 bp, Artificial Sequence
  chemically synthesized
tacctttaaataagttttctcc

SEQ ID NO: 1294961 - DNA, 22 bp, Artificial Sequence
  chemically synthesized
acctttaaataagttttctcct

SEQ ID NO: 1294962 - DNA, 22 bp, Artificial Sequence
  chemically synthesized
cctttaaataagttttctcctc

SEQ ID NO: 1294963 - DNA, 22 bp, Artificial Sequence
  chemically synthesized
taaataagttttctcctctgtc

SEQ ID NO: 1294964 - DNA, 22 bp, Artificial Sequence
  chemically synthesized
aaataagttttctcctctgtct

SEQ ID NO: 1294965 - DNA, 22 bp, Artificial Sequence
  chemically synthesized
aataagttttctcctctgtctt

SEQ ID NO: 1294966 - DNA, 22 bp, Artificial Sequence
  chemically synthesized
tctcctctgtctttgtaaactt

SEQ ID NO: 1294967 - DNA, 22 bp, Artificial Sequence
  chemically synthesized
ctcctctgtctttgtaaacttt

SEQ ID NO: 1294968 - DNA, 22 bp, Artificial Sequence
  chemically synthesized
tcctctgtctttgtaaactttt

SEQ ID NO: 1294969 - DNA, 22 bp, Artificial Sequence
  chemically synthesized
ctctgtctttgtaaacttttat

SEQ ID NO: 1294970 - DNA, 22 bp, Artificial Sequence
  chemically synthesized
tgtctttgtaaacttttatttc

SEQ ID NO: 1294971 - DNA, 22 bp, Artificial Sequence
  chemically synthesized
ggtgtcaggaatagaaataaaa

SEQ ID NO: 1294972 - DNA, 22 bp, Artificial Sequence
  chemically synthesized
tctttgtaaacttttatttcta

SEQ ID NO: 1294973 - DNA, 22 bp, Artificial Sequence
  chemically synthesized
tgtaaacttttatttctattcc

SEQ ID NO: 1294974 - DNA, 22 bp, Artificial Sequence
  chemically synthesized
gtaaacttttatttctattcct

SEQ ID NO: 1294975 - DNA, 22 bp, Artificial Sequence
  chemically synthesized
taaacttttatttctattcctg

SEQ ID NO: 1294976 - DNA, 22 bp, Artificial Sequence
  chemically synthesized
ttatttctattcctgacaccta

SEQ ID NO: 1294977 - DNA, 22 bp, Artificial Sequence
  chemically synthesized
tcaagcatatcctaggtgtcag

SEQ ID NO: 1294978 - DNA, 22 bp, Artificial Sequence
  chemically synthesized
tatttctattcctgacacctag

SEQ ID NO: 1294979 - DNA, 22 bp, Artificial Sequence
  chemically synthesized
atttctattcctgacacctagg

SEQ ID NO: 1294980 - DNA, 22 bp, Artificial Sequence
  chemically synthesized
tttctattcctgacacctagga

SEQ ID NO: 1294981 - DNA, 22 bp, Artificial Sequence
  chemically synthesized
ttatcaagcatatcctaggtgt

SEQ ID NO: 1294982 - DNA, 22 bp, Artificial Sequence
  chemically synthesized
tattatcaagcatatcctaggt

SEQ ID NO: 1294983 - DNA, 22 bp, Artificial Sequence
  chemically synthesized
ctattcctgacacctaggatat

SEQ ID NO: 1294984 - DNA, 22 bp, Artificial Sequence
  chemically synthesized
tattcctgacacctaggatatg

SEQ ID NO: 1294985 - DNA, 22 bp, Artificial Sequence
  chemically synthesized
ttcctgacacctaggatatgct

SEQ ID NO: 1294986 - DNA, 22 bp, Artificial Sequence
  chemically synthesized
ctgacacctaggatatgcttga

SEQ ID NO: 1294987 - DNA, 22 bp, Artificial Sequence
  chemically synthesized
acacctaggatatgcttgataa

SEQ ID NO: 1294988 - DNA, 22 bp, Artificial Sequence
  chemically synthesized
aagtacagaaattctattatca

SEQ ID NO: 1294989 - DNA, 22 bp, Artificial Sequence
  chemically synthesized
caagtacagaaattctattatc

SEQ ID NO: 1294990 - DNA, 22 bp, Artificial Sequence
  chemically synthesized
tcaagtacagaaattctattat

SEQ ID NO: 1294991 - DNA, 22 bp, Artificial Sequence
  chemically synthesized
ggatatgcttgataatagaatt

SEQ ID NO: 1294992 - DNA, 22 bp, Artificial Sequence
  chemically synthesized
tttcaagtacagaaattctatt

SEQ ID NO: 1294993 - DNA, 22 bp, Artificial Sequence
  chemically synthesized
gataatagaatttctgtacttg

SEQ ID NO: 1294994 - DNA, 22 bp, Artificial Sequence
  chemically synthesized
ataatagaatttctgtacttga

SEQ ID NO: 1294995 - DNA, 22 bp, Artificial Sequence
  chemically synthesized
atcaggagagtcaccattcttt

SEQ ID NO: 1294996 - DNA, 22 bp, Artificial Sequence
  chemically synthesized
ctgtacttgaaagaatggtgac

SEQ ID NO: 1294997 - DNA, 22 bp, Artificial Sequence
  chemically synthesized
tgtacttgaaagaatggtgact

SEQ ID NO: 1294998 - DNA, 22 bp, Artificial Sequence
  chemically synthesized
tacttgaaagaatggtgactct

SEQ ID NO: 1294999 - DNA, 22 bp, Artificial Sequence
  chemically synthesized
taactgatcaggagagtcacca

SEQ ID NO: 1295000 - DNA, 22 bp, Artificial Sequence
  chemically synthesized
ttataactgatcaggagagtca

SEQ ID NO: 1295001 - DNA, 22 bp, Artificial Sequence
  chemically synthesized
gaaagaatggtgactctcctga

SEQ ID NO: 1295002 - DNA, 22 bp, Artificial Sequence
  chemically synthesized
aaagaatggtgactctcctgat

SEQ ID NO: 1295003 - DNA, 22 bp, Artificial Sequence
  chemically synthesized
agtctgttataactgatcagga

SEQ ID NO: 1295004 - DNA, 22 bp, Artificial Sequence
  chemically synthesized
cctaagtctgttataactgatc

SEQ ID NO: 1295005 - DNA, 22 bp, Artificial Sequence
  chemically synthesized
tccctaagtctgttataactga

SEQ ID NO: 1295006 - DNA, 22 bp, Artificial Sequence
  chemically synthesized
tcctgatcagttataacagact

SEQ ID NO: 1295007 - DNA, 22 bp, Artificial Sequence
  chemically synthesized
ctgatcagttataacagactta

SEQ ID NO: 1295008 - DNA, 22 bp, Artificial Sequence
  chemically synthesized
caaatgttctccctaagtctgt

SEQ ID NO: 1295009 - DNA, 22 bp, Artificial Sequence
  chemically synthesized
atcagttataacagacttaggg

SEQ ID NO: 1295010 - DNA, 22 bp, Artificial Sequence
  chemically synthesized
tattacaaatgttctccctaag

SEQ ID NO: 1295011 - DNA, 22 bp, Artificial Sequence
  chemically synthesized
atattacaaatgttctccctaa

SEQ ID NO: 1295012 - DNA, 22 bp, Artificial Sequence
  chemically synthesized
taacagacttagggagaacatt

SEQ ID NO: 1295013 - DNA, 22 bp, Artificial Sequence
  chemically synthesized
atttatattacaaatgttctcc

SEQ ID NO: 1295014 - DNA, 22 bp, Artificial Sequence
  chemically synthesized
catttatattacaaatgttctc

SEQ ID NO: 1295015 - DNA, 22 bp, Artificial Sequence
  chemically synthesized
tcatttatattacaaatgttct

SEQ ID NO: 1295016 - DNA, 22 bp, Artificial Sequence
  chemically synthesized
ttcatttatattacaaatgttc

SEQ ID NO: 1295017 - DNA, 22 bp, Artificial Sequence
  chemically synthesized
acacttttcatttatattacaa

SEQ ID NO: 1295018 - DNA, 22 bp, Artificial Sequence
  chemically synthesized
agggagaacatttgtaatataa

SEQ ID NO: 1295019 - DNA, 22 bp, Artificial Sequence
  chemically synthesized
gggagaacatttgtaatataaa

SEQ ID NO: 1295020 - DNA, 22 bp, Artificial Sequence
  chemically synthesized
aactcacacttttcatttatat

SEQ ID NO: 1295021 - DNA, 22 bp, Artificial Sequence
  chemically synthesized
actcaactcacacttttcattt

SEQ ID NO: 1295022 - DNA, 22 bp, Artificial Sequence
  chemically synthesized
taactcaactcacacttttcat

SEQ ID NO: 1295023 - DNA, 22 bp, Artificial Sequence
  chemically synthesized
gtaatataaatgaaaagtgtga

SEQ ID NO: 1295024 - DNA, 22 bp, Artificial Sequence
  chemically synthesized
taatataaatgaaaagtgtgag

SEQ ID NO: 1295025 - DNA, 22 bp, Artificial Sequence
  chemically synthesized
catcctctaactcaactcacac

SEQ ID NO: 1295026 - DNA, 22 bp, Artificial Sequence
  chemically synthesized
gcatcctctaactcaactcaca

SEQ ID NO: 1295027 - DNA, 22 bp, Artificial Sequence
  chemically synthesized
caaaatatttgcatcctctaac

SEQ ID NO: 1295028 - DNA, 22 bp, Artificial Sequence
  chemically synthesized
ccaaaatatttgcatcctctaa

SEQ ID NO: 1295029 - DNA, 22 bp, Artificial Sequence
  chemically synthesized
ttccaaaatatttgcatcctct

SEQ ID NO: 1295030 - DNA, 22 bp, Artificial Sequence
  chemically synthesized
cttccaaaatatttgcatcctc

SEQ ID NO: 1295031 - DNA, 22 bp, Artificial Sequence
  chemically synthesized
tcttccaaaatatttgcatcct

SEQ ID NO: 1295032 - DNA, 22 bp, Artificial Sequence
  chemically synthesized
ttttcttccaaaatatttgcat

SEQ ID NO: 1295033 - DNA, 22 bp, Artificial Sequence
  chemically synthesized
agttagaggatgcaaatatttt

SEQ ID NO: 1295034 - DNA, 22 bp, Artificial Sequence
  chemically synthesized
ttgttttcttccaaaatatttg

SEQ ID NO: 1295035 - DNA, 22 bp, Artificial Sequence
  chemically synthesized
attgttttcttccaaaatattt

SEQ ID NO: 1295036 - DNA, 22 bp, Artificial Sequence
  chemically synthesized
gaggatgcaaatattttggaag

SEQ ID NO: 1295037 - DNA, 22 bp, Artificial Sequence
  chemically synthesized
acatatatgagcacatttattg

SEQ ID NO: 1295038 - DNA, 22 bp, Artificial Sequence
  chemically synthesized
tggaagaaaacaataaatgtgc

SEQ ID NO: 1295039 - DNA, 22 bp, Artificial Sequence
  chemically synthesized
ggaagaaaacaataaatgtgct

SEQ ID NO: 1295040 - DNA, 22 bp, Artificial Sequence
  chemically synthesized
gaagaaaacaataaatgtgctc

SEQ ID NO: 1295041 - DNA, 22 bp, Artificial Sequence
  chemically synthesized
taaaatattcacatatatgagc

SEQ ID NO: 1295042 - DNA, 22 bp, Artificial Sequence
  chemically synthesized
aaactgtaaaatattcacatat

SEQ ID NO: 1295043 - DNA, 22 bp, Artificial Sequence
  chemically synthesized
aaaactgtaaaatattcacata

SEQ ID NO: 1295044 - DNA, 22 bp, Artificial Sequence
  chemically synthesized
atatatgtgaatattttacagt

SEQ ID NO: 1295045 - DNA, 22 bp, Artificial Sequence
  chemically synthesized
tgaatgcccatatcttaaaact

SEQ ID NO: 1295046 - DNA, 22 bp, Artificial Sequence
  chemically synthesized
atgaatgcccatatcttaaaac

SEQ ID NO: 1295047 - DNA, 22 bp, Artificial Sequence
  chemically synthesized
tccttatgaatgcccatatctt

SEQ ID NO: 1295048 - DNA, 22 bp, Artificial Sequence
  chemically synthesized
tgtccttatgaatgcccatatc

SEQ ID NO: 1295049 - DNA, 22 bp, Artificial Sequence
  chemically synthesized
tacagttttaagatatgggcat

SEQ ID NO: 1295050 - DNA, 22 bp, Artificial Sequence
  chemically synthesized
ctgtccttatgaatgcccatat

SEQ ID NO: 1295051 - DNA, 22 bp, Artificial Sequence
  chemically synthesized
acagttttaagatatgggcatt

SEQ ID NO: 1295052 - DNA, 22 bp, Artificial Sequence
  chemically synthesized
tctgtccttatgaatgcccata

SEQ ID NO: 1295053 - DNA, 22 bp, Artificial Sequence
  chemically synthesized
cagttttaagatatgggcattc

SEQ ID NO: 1295054 - DNA, 22 bp, Artificial Sequence
  chemically synthesized
ttctgtccttatgaatgcccat

SEQ ID NO: 1295055 - DNA, 22 bp, Artificial Sequence
  chemically synthesized
tttctgtccttatgaatgccca

SEQ ID NO: 1295056 - DNA, 22 bp, Artificial Sequence
  chemically synthesized
ttttctgtccttatgaatgccc

SEQ ID NO: 1295057 - DNA, 22 bp, Artificial Sequence
  chemically synthesized
taagatatgggcattcataagg

SEQ ID NO: 1295058 - DNA, 22 bp, Artificial Sequence
  chemically synthesized
aagatatgggcattcataagga

SEQ ID NO: 1295059 - DNA, 22 bp, Artificial Sequence
  chemically synthesized
agatatgggcattcataaggac

SEQ ID NO: 1295060 - DNA, 22 bp, Artificial Sequence
  chemically synthesized
ggtatatttttttctgtcctta

SEQ ID NO: 1295061 - DNA, 22 bp, Artificial Sequence
  chemically synthesized
agagcaattcggtatatttttt

SEQ ID NO: 1295062 - DNA, 22 bp, Artificial Sequence
  chemically synthesized
ataaggacagaaaaaaatatac

SEQ ID NO: 1295063 - DNA, 22 bp, Artificial Sequence
  chemically synthesized
cctcagagcaattcggtatatt

SEQ ID NO: 1295064 - DNA, 22 bp, Artificial Sequence
  chemically synthesized
gcactgcctcagagcaattcgg

SEQ ID NO: 1295065 - DNA, 22 bp, Artificial Sequence
  chemically synthesized
ttagcactgcctcagagcaatt

SEQ ID NO: 1295066 - DNA, 22 bp, Artificial Sequence
  chemically synthesized
tatattgttagcactgcctcag

SEQ ID NO: 1295067 - DNA, 22 bp, Artificial Sequence
  chemically synthesized
atatattgttagcactgcctca

SEQ ID NO: 1295068 - DNA, 22 bp, Artificial Sequence
  chemically synthesized
tttatatattgttagcactgcc

SEQ ID NO: 1295069 - DNA, 22 bp, Artificial Sequence
  chemically synthesized
tatttatatattgttagcactg

SEQ ID NO: 1295070 - DNA, 22 bp, Artificial Sequence
  chemically synthesized
ctctgaggcagtgctaacaata

SEQ ID NO: 1295071 - DNA, 22 bp, Artificial Sequence
  chemically synthesized
tgaggcagtgctaacaatatat

SEQ ID NO: 1295072 - DNA, 22 bp, Artificial Sequence
  chemically synthesized
aggcagtgctaacaatatataa

SEQ ID NO: 1295073 - DNA, 22 bp, Artificial Sequence
  chemically synthesized
atatccaatccatcctctattt

SEQ ID NO: 1295074 - DNA, 22 bp, Artificial Sequence
  chemically synthesized
gatatccaatccatcctctatt

SEQ ID NO: 1295075 - DNA, 22 bp, Artificial Sequence
  chemically synthesized
acaatatataaatagaggatgg

SEQ ID NO: 1295076 - DNA, 22 bp, Artificial Sequence
  chemically synthesized
atatagaaatcaaagcttgata

SEQ ID NO: 1295077 - DNA, 22 bp, Artificial Sequence
  chemically synthesized
ttaatatagaaatcaaagcttg

SEQ ID NO: 1295078 - DNA, 22 bp, Artificial Sequence
  chemically synthesized
acctgttaatatagaaatcaaa

SEQ ID NO: 1295079 - DNA, 22 bp, Artificial Sequence
  chemically synthesized
gatatcaagctttgatttctat

SEQ ID NO: 1295080 - DNA, 22 bp, Artificial Sequence
  chemically synthesized
tcacaactcacctgttaatata

SEQ ID NO: 1295081 - DNA, 22 bp, Artificial Sequence
  chemically synthesized
atcacaactcacctgttaatat

SEQ ID NO: 1295082 - DNA, 22 bp, Artificial Sequence
  chemically synthesized
tgatttctatattaacaggtga

SEQ ID NO: 1295083 - DNA, 22 bp, Artificial Sequence
  chemically synthesized
gatttctatattaacaggtgag

SEQ ID NO: 1295084 - DNA, 22 bp, Artificial Sequence
  chemically synthesized
atttctatattaacaggtgagt

SEQ ID NO: 1295085 - DNA, 22 bp, Artificial Sequence
  chemically synthesized
tcatttatcacaactcacctgt

SEQ ID NO: 1295086 - DNA, 22 bp, Artificial Sequence
  chemically synthesized
ctatattaacaggtgagttgtg

SEQ ID NO: 1295087 - DNA, 22 bp, Artificial Sequence
  chemically synthesized
tatattaacaggtgagttgtga

SEQ ID NO: 1295088 - DNA, 22 bp, Artificial Sequence
  chemically synthesized
cattatcatttatcacaactca

SEQ ID NO: 1295089 - DNA, 22 bp, Artificial Sequence
  chemically synthesized
ccattatcatttatcacaactc

SEQ ID NO: 1295090 - DNA, 22 bp, Artificial Sequence
  chemically synthesized
tattaacaggtgagttgtgata

SEQ ID NO: 1295091 - DNA, 22 bp, Artificial Sequence
  chemically synthesized
tccattatcatttatcacaact

SEQ ID NO: 1295092 - DNA, 22 bp, Artificial Sequence
  chemically synthesized
ttccattatcatttatcacaac

SEQ ID NO: 1295093 - DNA, 22 bp, Artificial Sequence
  chemically synthesized
acaggtgagttgtgataaatga

SEQ ID NO: 1295094 - DNA, 22 bp, Artificial Sequence
  chemically synthesized
accttttccattatcatttatc

SEQ ID NO: 1295095 - DNA, 22 bp, Artificial Sequence
  chemically synthesized
tgcattaaccttttccattatc

SEQ ID NO: 1295096 - DNA, 22 bp, Artificial Sequence
  chemically synthesized
tgtgcattaaccttttccatta

SEQ ID NO: 1295097 - DNA, 22 bp, Artificial Sequence
  chemically synthesized
tgataaatgataatggaaaagg

SEQ ID NO: 1295098 - DNA, 22 bp, Artificial Sequence
  chemically synthesized
gctctgtgcattaaccttttcc

SEQ ID NO: 1295099 - DNA, 22 bp, Artificial Sequence
  chemically synthesized
cgctctgtgcattaaccttttc

SEQ ID NO: 1295100 - DNA, 22 bp, Artificial Sequence
  chemically synthesized
aaatagatcttcgctctgtgca

SEQ ID NO: 1295101 - DNA, 22 bp, Artificial Sequence
  chemically synthesized
ccgcaagttgaaatagatcttc

SEQ ID NO: 1295102 - DNA, 22 bp, Artificial Sequence
  chemically synthesized
atgcacagagcgaagatctatt

SEQ ID NO: 1295103 - DNA, 22 bp, Artificial Sequence
  chemically synthesized
attcccgcaagttgaaatagat

SEQ ID NO: 1295104 - DNA, 22 bp, Artificial Sequence
  chemically synthesized
tgtatcctcattcccgcaagtt

SEQ ID NO: 1295105 - DNA, 22 bp, Artificial Sequence
  chemically synthesized
tttcaacttgcgggaatgagga

SEQ ID NO: 1295106 - DNA, 22 bp, Artificial Sequence
  chemically synthesized
caacttgcgggaatgaggatac

SEQ ID NO: 1295107 - DNA, 22 bp, Artificial Sequence
  chemically synthesized
aacttgcgggaatgaggataca

SEQ ID NO: 1295108 - DNA, 22 bp, Artificial Sequence
  chemically synthesized
gcgggaatgaggatacacagta

SEQ ID NO: 1295109 - DNA, 22 bp, Artificial Sequence
  chemically synthesized
cgggaatgaggatacacagtac

SEQ ID NO: 1295110 - DNA, 22 bp, Artificial Sequence
  chemically synthesized
aaaggtgtgtaaacatgacaag

SEQ ID NO: 1295111 - DNA, 22 bp, Artificial Sequence
  chemically synthesized
aaaaggtgtgtaaacatgacaa

SEQ ID NO: 1295112 - DNA, 22 bp, Artificial Sequence
  chemically synthesized
taaaaggtgtgtaaacatgaca

SEQ ID NO: 1295113 - DNA, 22 bp, Artificial Sequence
  chemically synthesized
ttaaaaggtgtgtaaacatgac

SEQ ID NO: 1295114 - DNA, 22 bp, Artificial Sequence
  chemically synthesized
gagtaatttttaaaaggtgtgt

SEQ ID NO: 1295115 - DNA, 22 bp, Artificial Sequence
  chemically synthesized
gtcatgtttacacaccttttaa

SEQ ID NO: 1295116 - DNA, 22 bp, Artificial Sequence
  chemically synthesized
tcatgtttacacaccttttaaa

SEQ ID NO: 1295117 - DNA, 22 bp, Artificial Sequence
  chemically synthesized
aactagagtaatttttaaaagg

SEQ ID NO: 1295118 - DNA, 22 bp, Artificial Sequence
  chemically synthesized
aattgaactagagtaattttta

SEQ ID NO: 1295119 - DNA, 22 bp, Artificial Sequence
  chemically synthesized
gaattgaactagagtaattttt

SEQ ID NO: 1295120 - DNA, 22 bp, Artificial Sequence
  chemically synthesized
acacaccttttaaaaattactc

SEQ ID NO: 1295121 - DNA, 22 bp, Artificial Sequence
  chemically synthesized
tgaattgaactagagtaatttt

SEQ ID NO: 1295122 - DNA, 22 bp, Artificial Sequence
  chemically synthesized
cacaccttttaaaaattactct

SEQ ID NO: 1295123 - DNA, 22 bp, Artificial Sequence
  chemically synthesized
aatctttgaattgaactagagt

SEQ ID NO: 1295124 - DNA, 22 bp, Artificial Sequence
  chemically synthesized
tgaatctttgaattgaactaga

SEQ ID NO: 1295125 - DNA, 22 bp, Artificial Sequence
  chemically synthesized
ttaaaaattactctagttcaat

SEQ ID NO: 1295126 - DNA, 22 bp, Artificial Sequence
  chemically synthesized
taaaaattactctagttcaatt

SEQ ID NO: 1295127 - DNA, 22 bp, Artificial Sequence
  chemically synthesized
aaaaattactctagttcaattc

SEQ ID NO: 1295128 - DNA, 22 bp, Artificial Sequence
  chemically synthesized
aaaattactctagttcaattca

SEQ ID NO: 1295129 - DNA, 22 bp, Artificial Sequence
  chemically synthesized
ctctagttcaattcaaagattc

SEQ ID NO: 1295130 - DNA, 22 bp, Artificial Sequence
  chemically synthesized
tagttcaattcaaagattcaga

SEQ ID NO: 1295131 - DNA, 22 bp, Artificial Sequence
  chemically synthesized
gttcaattcaaagattcagagt

SEQ ID NO: 1295132 - DNA, 22 bp, Artificial Sequence
  chemically synthesized
aattcaaagattcagagtattg

SEQ ID NO: 1295133 - DNA, 22 bp, Artificial Sequence
  chemically synthesized
aaatagtaaatgtaacaatact

SEQ ID NO: 1295134 - DNA, 22 bp, Artificial Sequence
  chemically synthesized
aaagattcagagtattgttaca

SEQ ID NO: 1295135 - DNA, 22 bp, Artificial Sequence
  chemically synthesized
tgaaatagtaaatgtaacaata

SEQ ID NO: 1295136 - DNA, 22 bp, Artificial Sequence
  chemically synthesized
ctgaaatagtaaatgtaacaat

SEQ ID NO: 1295137 - DNA, 22 bp, Artificial Sequence
  chemically synthesized
tctgaaatagtaaatgtaacaa

SEQ ID NO: 1295138 - DNA, 22 bp, Artificial Sequence
  chemically synthesized
agagtattgttacatttactat

SEQ ID NO: 1295139 - DNA, 22 bp, Artificial Sequence
  chemically synthesized
tgaagaaattttctgaaatagt

SEQ ID NO: 1295140 - DNA, 22 bp, Artificial Sequence
  chemically synthesized
ttacatttactatttcagaaaa

SEQ ID NO: 1295141 - DNA, 22 bp, Artificial Sequence
  chemically synthesized
catttactatttcagaaaattt

SEQ ID NO: 1295142 - DNA, 22 bp, Artificial Sequence
  chemically synthesized
actatttcagaaaatttcttca

SEQ ID NO: 1295143 - DNA, 22 bp, Artificial Sequence
  chemically synthesized
ctatttcagaaaatttcttcac

SEQ ID NO: 1295144 - DNA, 22 bp, Artificial Sequence
  chemically synthesized
tttcagaaaatttcttcacaat

SEQ ID NO: 1295145 - DNA, 22 bp, Artificial Sequence
  chemically synthesized
cagaaaatttcttcacaattct

SEQ ID NO: 1295146 - DNA, 22 bp, Artificial Sequence
  chemically synthesized
agaaaatttcttcacaattctg

SEQ ID NO: 1295147 - DNA, 22 bp, Artificial Sequence
  chemically synthesized
aaacaaacatacagacaaatca

SEQ ID NO: 1295148 - DNA, 22 bp, Artificial Sequence
  chemically synthesized
cttcacaattctgatttgtctg

SEQ ID NO: 1295149 - DNA, 22 bp, Artificial Sequence
  chemically synthesized
caaacaaacatacagacaaatc

SEQ ID NO: 1295150 - DNA, 22 bp, Artificial Sequence
  chemically synthesized
ttcacaattctgatttgtctgt

SEQ ID NO: 1295151 - DNA, 22 bp, Artificial Sequence
  chemically synthesized
tcaaacaaacatacagacaaat

SEQ ID NO: 1295152 - DNA, 22 bp, Artificial Sequence
  chemically synthesized
cacaattctgatttgtctgtat

SEQ ID NO: 1295153 - DNA, 22 bp, Artificial Sequence
  chemically synthesized
acaattctgatttgtctgtatg

SEQ ID NO: 1295154 - DNA, 22 bp, Artificial Sequence
  chemically synthesized
tgatttgtctgtatgtttgttt

SEQ ID NO: 1295155 - DNA, 22 bp, Artificial Sequence
  chemically synthesized
atttgtctgtatgtttgtttga

SEQ ID NO: 1295156 - DNA, 22 bp, Artificial Sequence
  chemically synthesized
gtctgtatgtttgtttgaaaat

SEQ ID NO: 1295157 - DNA, 22 bp, Artificial Sequence
  chemically synthesized
tctgtatgtttgtttgaaaata

SEQ ID NO: 1295158 - DNA, 22 bp, Artificial Sequence
  chemically synthesized
tatgtttgtttgaaaatatgtc

SEQ ID NO: 1295159 - DNA, 22 bp, Artificial Sequence
  chemically synthesized
aagcagacaagagacatatttt

SEQ ID NO: 1295160 - DNA, 22 bp, Artificial Sequence
  chemically synthesized
tgaagcagacaagagacatatt

SEQ ID NO: 1295161 - DNA, 22 bp, Artificial Sequence
  chemically synthesized
gtttgaaaatatgtctcttgtc

SEQ ID NO: 1295162 - DNA, 22 bp, Artificial Sequence
  chemically synthesized
tttgaaaatatgtctcttgtct

SEQ ID NO: 1295163 - DNA, 22 bp, Artificial Sequence
  chemically synthesized
gaattctgaagcagacaagaga

SEQ ID NO: 1295164 - DNA, 22 bp, Artificial Sequence
  chemically synthesized
ggaattctgaagcagacaagag

SEQ ID NO: 1295165 - DNA, 22 bp, Artificial Sequence
  chemically synthesized
tggaattctgaagcagacaaga

SEQ ID NO: 1295166 - DNA, 22 bp, Artificial Sequence
  chemically synthesized
gaaaatatgtctcttgtctgct

SEQ ID NO: 1295167 - DNA, 22 bp, Artificial Sequence
  chemically synthesized
aaaatatgtctcttgtctgctt

SEQ ID NO: 1295168 - DNA, 22 bp, Artificial Sequence
  chemically synthesized
agttttggaattctgaagcaga

SEQ ID NO: 1295169 - DNA, 22 bp, Artificial Sequence
  chemically synthesized
aagttttggaattctgaagcag

SEQ ID NO: 1295170 - DNA, 22 bp, Artificial Sequence
  chemically synthesized
taagttttggaattctgaagca

SEQ ID NO: 1295171 - DNA, 22 bp, Artificial Sequence
  chemically synthesized
ttaagttttggaattctgaagc

SEQ ID NO: 1295172 - DNA, 22 bp, Artificial Sequence
  chemically synthesized
ttgtctgcttcagaattccaaa

SEQ ID NO: 1295173 - DNA, 22 bp, Artificial Sequence
  chemically synthesized
acatttttaagttttggaattc

SEQ ID NO: 1295174 - DNA, 22 bp, Artificial Sequence
  chemically synthesized
gtctgcttcagaattccaaaac

SEQ ID NO: 1295175 - DNA, 22 bp, Artificial Sequence
  chemically synthesized
tctgcttcagaattccaaaact

SEQ ID NO: 1295176 - DNA, 22 bp, Artificial Sequence
  chemically synthesized
cttcagaattccaaaacttaaa

SEQ ID NO: 1295177 - DNA, 22 bp, Artificial Sequence
  chemically synthesized
gcatcattgacatttttaagtt

SEQ ID NO: 1295178 - DNA, 22 bp, Artificial Sequence
  chemically synthesized
cagaattccaaaacttaaaaat

SEQ ID NO: 1295179 - DNA, 22 bp, Artificial Sequence
  chemically synthesized
agaattccaaaacttaaaaatg

SEQ ID NO: 1295180 - DNA, 22 bp, Artificial Sequence
  chemically synthesized
caaaacttaaaaatgtcaatga

SEQ ID NO: 1295181 - DNA, 22 bp, Artificial Sequence
  chemically synthesized
tatatactggcatcattgacat

SEQ ID NO: 1295182 - DNA, 22 bp, Artificial Sequence
  chemically synthesized
ctgtatatactggcatcattga

SEQ ID NO: 1295183 - DNA, 22 bp, Artificial Sequence
  chemically synthesized
attgctgtatatactggcatca

SEQ ID NO: 1295184 - DNA, 22 bp, Artificial Sequence
  chemically synthesized
aaaaatgtcaatgatgccagta

SEQ ID NO: 1295185 - DNA, 22 bp, Artificial Sequence
  chemically synthesized
aattgctgtatatactggcatc

SEQ ID NO: 1295186 - DNA, 22 bp, Artificial Sequence
  chemically synthesized
aaaatgtcaatgatgccagtat

SEQ ID NO: 1295187 - DNA, 22 bp, Artificial Sequence
  chemically synthesized
tatatagtttaattgctgtata

SEQ ID NO: 1295188 - DNA, 22 bp, Artificial Sequence
  chemically synthesized
taagatggttatatatagttta

SEQ ID NO: 1295189 - DNA, 22 bp, Artificial Sequence
  chemically synthesized
ataagatggttatatatagttt

SEQ ID NO: 1295190 - DNA, 22 bp, Artificial Sequence
  chemically synthesized
cgaatatttataagatggttat

SEQ ID NO: 1295191 - DNA, 22 bp, Artificial Sequence
  chemically synthesized
tccgaatatttataagatggtt

SEQ ID NO: 1295192 - DNA, 22 bp, Artificial Sequence
  chemically synthesized
aactatatataaccatcttata

SEQ ID NO: 1295193 - DNA, 22 bp, Artificial Sequence
  chemically synthesized
tatataaccatcttataaatat

SEQ ID NO: 1295194 - DNA, 22 bp, Artificial Sequence
  chemically synthesized
ataattctccgaatatttataa

SEQ ID NO: 1295195 - DNA, 22 bp, Artificial Sequence
  chemically synthesized
ttcataattctccgaatattta

SEQ ID NO: 1295196 - DNA, 22 bp, Artificial Sequence
  chemically synthesized
ggaaagttattcataattctcc

SEQ ID NO: 1295197 - DNA, 22 bp, Artificial Sequence
  chemically synthesized
aggaaagttattcataattctc

SEQ ID NO: 1295198 - DNA, 22 bp, Artificial Sequence
  chemically synthesized
ataaatattcggagaattatga

SEQ ID NO: 1295199 - DNA, 22 bp, Artificial Sequence
  chemically synthesized
taaatattcggagaattatgaa

SEQ ID NO: 1295200 - DNA, 22 bp, Artificial Sequence
  chemically synthesized
ggatatttaggaaagttattca

SEQ ID NO: 1295201 - DNA, 22 bp, Artificial Sequence
  chemically synthesized
ggagaattatgaataactttcc

SEQ ID NO: 1295202 - DNA, 22 bp, Artificial Sequence
  chemically synthesized
tgaataactttcctaaatatcc

SEQ ID NO: 1295203 - DNA, 22 bp, Artificial Sequence
  chemically synthesized
tcctaaatatcctaggtttact

SEQ ID NO: 1295204 - DNA, 22 bp, Artificial Sequence
  chemically synthesized
cctaaatatcctaggtttactt

SEQ ID NO: 1295205 - DNA, 22 bp, Artificial Sequence
  chemically synthesized
ctaaatatcctaggtttacttt

SEQ ID NO: 1295206 - DNA, 22 bp, Artificial Sequence
  chemically synthesized
aatatcctaggtttacttttta

SEQ ID NO: 1295207 - DNA, 22 bp, Artificial Sequence
  chemically synthesized
ggtttactttttatttattctt

SEQ ID NO: 1295208 - DNA, 22 bp, Artificial Sequence
  chemically synthesized
actttttatttattcttctata

SEQ ID NO: 1295209 - DNA, 22 bp, Artificial Sequence
  chemically synthesized
ctttttatttattcttctatat

SEQ ID NO: 1295210 - DNA, 22 bp, Artificial Sequence
  chemically synthesized
tttatttattcttctatatttg

SEQ ID NO: 1295211 - DNA, 22 bp, Artificial Sequence
  chemically synthesized
ttatttattcttctatatttgt

SEQ ID NO: 1295212 - DNA, 22 bp, Artificial Sequence
  chemically synthesized
tatttattcttctatatttgtg

SEQ ID NO: 1295213 - DNA, 22 bp, Artificial Sequence
  chemically synthesized
atttattcttctatatttgtgt

SEQ ID NO: 1295214 - DNA, 22 bp, Artificial Sequence
  chemically synthesized
tttattcttctatatttgtgtt

SEQ ID NO: 1295215 - DNA, 22 bp, Artificial Sequence
  chemically synthesized
attcttctatatttgtgttgtt

SEQ ID NO: 1295216 - DNA, 22 bp, Artificial Sequence
  chemically synthesized
ttcttctatatttgtgttgtta

SEQ ID NO: 1295217 - DNA, 22 bp, Artificial Sequence
  chemically synthesized
agtgaaataaaatataacaaca

SEQ ID NO: 1295218 - DNA, 22 bp, Artificial Sequence
  chemically synthesized
ttctatatttgtgttgttatat

SEQ ID NO: 1295219 - DNA, 22 bp, Artificial Sequence
  chemically synthesized
ctatatttgtgttgttatattt

SEQ ID NO: 1295220 - DNA, 22 bp, Artificial Sequence
  chemically synthesized
tatatttgtgttgttatatttt

SEQ ID NO: 1295221 - DNA, 22 bp, Artificial Sequence
  chemically synthesized
gctaagtgaaataaaatataac

SEQ ID NO: 1295222 - DNA, 22 bp, Artificial Sequence
  chemically synthesized
agctaagtgaaataaaatataa

SEQ ID NO: 1295223 - DNA, 22 bp, Artificial Sequence
  chemically synthesized
tatttgtgttgttatattttat

SEQ ID NO: 1295224 - DNA, 22 bp, Artificial Sequence
  chemically synthesized
tagctaagtgaaataaaatata

SEQ ID NO: 1295225 - DNA, 22 bp, Artificial Sequence
  chemically synthesized
ttagctaagtgaaataaaatat

SEQ ID NO: 1295226 - DNA, 22 bp, Artificial Sequence
  chemically synthesized
tttagctaagtgaaataaaata

SEQ ID NO: 1295227 - DNA, 22 bp, Artificial Sequence
  chemically synthesized
ttttagctaagtgaaataaaat

SEQ ID NO: 1295228 - DNA, 22 bp, Artificial Sequence
  chemically synthesized
tttttagctaagtgaaataaaa

SEQ ID NO: 1295229 - DNA, 22 bp, Artificial Sequence
  chemically synthesized
gtgttgttatattttatttcac

SEQ ID NO: 1295230 - DNA, 22 bp, Artificial Sequence
  chemically synthesized
tgttgttatattttatttcact

SEQ ID NO: 1295231 - DNA, 22 bp, Artificial Sequence
  chemically synthesized
aactttttttagctaagtgaaa

SEQ ID NO: 1295232 - DNA, 22 bp, Artificial Sequence
  chemically synthesized
ttatattttatttcacttagct

SEQ ID NO: 1295233 - DNA, 22 bp, Artificial Sequence
  chemically synthesized
tattttatttcacttagctaaa

SEQ ID NO: 1295234 - DNA, 22 bp, Artificial Sequence
  chemically synthesized
aatcctcaactttttttagcta

SEQ ID NO: 1295235 - DNA, 22 bp, Artificial Sequence
  chemically synthesized
aaatcctcaactttttttagct

SEQ ID NO: 1295236 - DNA, 22 bp, Artificial Sequence
  chemically synthesized
taaatcctcaactttttttagc

SEQ ID NO: 1295237 - DNA, 22 bp, Artificial Sequence
  chemically synthesized
tatttcacttagctaaaaaaag

SEQ ID NO: 1295238 - DNA, 22 bp, Artificial Sequence
  chemically synthesized
ttaaatcctcaactttttttag

SEQ ID NO: 1295239 - DNA, 22 bp, Artificial Sequence
  chemically synthesized
atttcacttagctaaaaaaagt

SEQ ID NO: 1295240 - DNA, 22 bp, Artificial Sequence
  chemically synthesized
tttaaatcctcaacttttttta

SEQ ID NO: 1295241 - DNA, 22 bp, Artificial Sequence
  chemically synthesized
tttcacttagctaaaaaaagtt

SEQ ID NO: 1295242 - DNA, 22 bp, Artificial Sequence
  chemically synthesized
cacttagctaaaaaaagttgag

SEQ ID NO: 1295243 - DNA, 22 bp, Artificial Sequence
  chemically synthesized
acttagctaaaaaaagttgagg

SEQ ID NO: 1295244 - DNA, 22 bp, Artificial Sequence
  chemically synthesized
agctaaaaaaagttgaggattt

SEQ ID NO: 1295245 - DNA, 22 bp, Artificial Sequence
  chemically synthesized
aaaacgttttttaaatcctcaa

SEQ ID NO: 1295246 - DNA, 22 bp, Artificial Sequence
  chemically synthesized
gctaaaaaaagttgaggattta

SEQ ID NO: 1295247 - DNA, 22 bp, Artificial Sequence
  chemically synthesized
aaaaacgttttttaaatcctca

SEQ ID NO: 1295248 - DNA, 22 bp, Artificial Sequence
  chemically synthesized
taaaaacgttttttaaatcctc

SEQ ID NO: 1295249 - DNA, 22 bp, Artificial Sequence
  chemically synthesized
aaaaaagttgaggatttaaaaa

SEQ ID NO: 1295250 - DNA, 22 bp, Artificial Sequence
  chemically synthesized
aggatttaaaaaacgtttttaa

SEQ ID NO: 1295251 - DNA, 22 bp, Artificial Sequence
  chemically synthesized
aaaaaacgtttttaaaatacat

SEQ ID NO: 1295252 - DNA, 22 bp, Artificial Sequence
  chemically synthesized
aaaaacgtttttaaaatacatg

SEQ ID NO: 1295253 - DNA, 22 bp, Artificial Sequence
  chemically synthesized
cagacgtaaacagaaacatgta

SEQ ID NO: 1295254 - DNA, 22 bp, Artificial Sequence
  chemically synthesized
ttacagacgtaaacagaaacat

SEQ ID NO: 1295255 - DNA, 22 bp, Artificial Sequence
  chemically synthesized
tattacagacgtaaacagaaac

SEQ ID NO: 1295256 - DNA, 22 bp, Artificial Sequence
  chemically synthesized
ttaaaatacatgtttctgttta

SEQ ID NO: 1295257 - DNA, 22 bp, Artificial Sequence
  chemically synthesized
ctattacagacgtaaacagaaa

SEQ ID NO: 1295258 - DNA, 22 bp, Artificial Sequence
  chemically synthesized
taaaatacatgtttctgtttac

SEQ ID NO: 1295259 - DNA, 22 bp, Artificial Sequence
  chemically synthesized
aaaatacatgtttctgtttacg

SEQ ID NO: 1295260 - DNA, 22 bp, Artificial Sequence
  chemically synthesized
aaatacatgtttctgtttacgt

SEQ ID NO: 1295261 - DNA, 22 bp, Artificial Sequence
  chemically synthesized
acaaatttctattacagacgta

SEQ ID NO: 1295262 - DNA, 22 bp, Artificial Sequence
  chemically synthesized
ctgtttacgtctgtaatagaaa

SEQ ID NO: 1295263 - DNA, 22 bp, Artificial Sequence
  chemically synthesized
tgtttacgtctgtaatagaaat

SEQ ID NO: 1295264 - DNA, 22 bp, Artificial Sequence
  chemically synthesized
aataattaacaaatttctatta

SEQ ID NO: 1295265 - DNA, 22 bp, Artificial Sequence
  chemically synthesized
tttacgtctgtaatagaaattt

SEQ ID NO: 1295266 - DNA, 22 bp, Artificial Sequence
  chemically synthesized
ctgaataattaacaaatttcta

SEQ ID NO: 1295267 - DNA, 22 bp, Artificial Sequence
  chemically synthesized
gctgaataattaacaaatttct

SEQ ID NO: 1295268 - DNA, 22 bp, Artificial Sequence
  chemically synthesized
acgtctgtaatagaaatttgtt

SEQ ID NO: 1295269 - DNA, 22 bp, Artificial Sequence
  chemically synthesized
cgtctgtaatagaaatttgtta

SEQ ID NO: 1295270 - DNA, 22 bp, Artificial Sequence
  chemically synthesized
cttgctgaataattaacaaatt

SEQ ID NO: 1295271 - DNA, 22 bp, Artificial Sequence
  chemically synthesized
acttgctgaataattaacaaat

SEQ ID NO: 1295272 - DNA, 22 bp, Artificial Sequence
  chemically synthesized
tttacttgctgaataattaaca

SEQ ID NO: 1295273 - DNA, 22 bp, Artificial Sequence
  chemically synthesized
taatagaaatttgttaattatt

SEQ ID NO: 1295274 - DNA, 22 bp, Artificial Sequence
  chemically synthesized
atttacttgctgaataattaac

SEQ ID NO: 1295275 - DNA, 22 bp, Artificial Sequence
  chemically synthesized
tatttacttgctgaataattaa

SEQ ID NO: 1295276 - DNA, 22 bp, Artificial Sequence
  chemically synthesized
attttatttacttgctgaataa

SEQ ID NO: 1295277 - DNA, 22 bp, Artificial Sequence
  chemically synthesized
gttaattattcagcaagtaaat

SEQ ID NO: 1295278 - DNA, 22 bp, Artificial Sequence
  chemically synthesized
ttaattattcagcaagtaaata

SEQ ID NO: 1295279 - DNA, 22 bp, Artificial Sequence
  chemically synthesized
ataaaagttcattttatttact

SEQ ID NO: 1295280 - DNA, 22 bp, Artificial Sequence
  chemically synthesized
attattcagcaagtaaataaaa

SEQ ID NO: 1295281 - DNA, 22 bp, Artificial Sequence
  chemically synthesized
actaataaaagttcattttatt

SEQ ID NO: 1295282 - DNA, 22 bp, Artificial Sequence
  chemically synthesized
ttcagcaagtaaataaaatgaa

SEQ ID NO: 1295283 - DNA, 22 bp, Artificial Sequence
  chemically synthesized
aactaataaaagttcattttat

SEQ ID NO: 1295284 - DNA, 22 bp, Artificial Sequence
  chemically synthesized
taactaataaaagttcatttta

SEQ ID NO: 1295285 - DNA, 22 bp, Artificial Sequence
  chemically synthesized
agcaagtaaataaaatgaactt

SEQ ID NO: 1295286 - DNA, 22 bp, Artificial Sequence
  chemically synthesized
aattttaactaataaaagttca

SEQ ID NO: 1295287 - DNA, 22 bp, Artificial Sequence
  chemically synthesized
ctgaattttaactaataaaagt

SEQ ID NO: 1295288 - DNA, 22 bp, Artificial Sequence
  chemically synthesized
actgaattttaactaataaaag

SEQ ID NO: 1295289 - DNA, 22 bp, Artificial Sequence
  chemically synthesized
acttactgaattttaactaata

SEQ ID NO: 1295290 - DNA, 22 bp, Artificial Sequence
  chemically synthesized
aacttactgaattttaactaat

SEQ ID NO: 1295291 - DNA, 22 bp, Artificial Sequence
  chemically synthesized
atttaacttactgaattttaac

SEQ ID NO: 1295292 - DNA, 22 bp, Artificial Sequence
  chemically synthesized
aatttaacttactgaattttaa

SEQ ID NO: 1295293 - DNA, 22 bp, Artificial Sequence
  chemically synthesized
taatttaacttactgaatttta

SEQ ID NO: 1295294 - DNA, 22 bp, Artificial Sequence
  chemically synthesized
tttaatttaacttactgaattt

SEQ ID NO: 1295295 - DNA, 22 bp, Artificial Sequence
  chemically synthesized
ttattagttaaaattcagtaag

SEQ ID NO: 1295296 - DNA, 22 bp, Artificial Sequence
  chemically synthesized
tattagttaaaattcagtaagt

SEQ ID NO: 1295297 - DNA, 22 bp, Artificial Sequence
  chemically synthesized
attagttaaaattcagtaagtt

SEQ ID NO: 1295298 - DNA, 22 bp, Artificial Sequence
  chemically synthesized
ttagttaaaattcagtaagtta

SEQ ID NO: 1295299 - DNA, 22 bp, Artificial Sequence
  chemically synthesized
gttaaaattcagtaagttaaat

SEQ ID NO: 1295300 - DNA, 22 bp, Artificial Sequence
  chemically synthesized
ccatgtactctttaatttaact

SEQ ID NO: 1295301 - DNA, 22 bp, Artificial Sequence
  chemically synthesized
aaattcagtaagttaaattaaa

SEQ ID NO: 1295302 - DNA, 22 bp, Artificial Sequence
  chemically synthesized
agtaagttaaattaaagagtac

SEQ ID NO: 1295303 - DNA, 22 bp, Artificial Sequence
  chemically synthesized
gtagtagaatgttgccatgtac

SEQ ID NO: 1295304 - DNA, 22 bp, Artificial Sequence
  chemically synthesized
ggtagtagaatgttgccatgta

SEQ ID NO: 1295305 - DNA, 22 bp, Artificial Sequence
  chemically synthesized
aattaaagagtacatggcaaca

SEQ ID NO: 1295306 - DNA, 22 bp, Artificial Sequence
  chemically synthesized
aagagtacatggcaacattcta

SEQ ID NO: 1295307 - DNA, 22 bp, Artificial Sequence
  chemically synthesized
tggtatttggtagtagaatgtt

SEQ ID NO: 1295308 - DNA, 22 bp, Artificial Sequence
  chemically synthesized
gtggtatttggtagtagaatgt

SEQ ID NO: 1295309 - DNA, 22 bp, Artificial Sequence
  chemically synthesized
tgtggtatttggtagtagaatg

SEQ ID NO: 1295310 - DNA, 22 bp, Artificial Sequence
  chemically synthesized
tttgtggtatttggtagtagaa

SEQ ID NO: 1295311 - DNA, 22 bp, Artificial Sequence
  chemically synthesized
ttctttgtggtatttggtagta

SEQ ID NO: 1295312 - DNA, 22 bp, Artificial Sequence
  chemically synthesized
tactaccaaataccacaaagaa

SEQ ID NO: 1295313 - DNA, 22 bp, Artificial Sequence
  chemically synthesized
gaatatcgtctattctttgtgg

SEQ ID NO: 1295314 - DNA, 22 bp, Artificial Sequence
  chemically synthesized
agaatatcgtctattctttgtg

SEQ ID NO: 1295315 - DNA, 22 bp, Artificial Sequence
  chemically synthesized
ctaccaaataccacaaagaata

SEQ ID NO: 1295316 - DNA, 22 bp, Artificial Sequence
  chemically synthesized
tagaatatcgtctattctttgt

SEQ ID NO: 1295317 - DNA, 22 bp, Artificial Sequence
  chemically synthesized
ttagaatatcgtctattctttg

SEQ ID NO: 1295318 - DNA, 22 bp, Artificial Sequence
  chemically synthesized
ccaaataccacaaagaatagac

SEQ ID NO: 1295319 - DNA, 22 bp, Artificial Sequence
  chemically synthesized
tgacaaacatttttagaatatc

SEQ ID NO: 1295320 - DNA, 22 bp, Artificial Sequence
  chemically synthesized
tatgacaaacatttttagaata

SEQ ID NO: 1295321 - DNA, 22 bp, Artificial Sequence
  chemically synthesized
ctatgacaaacatttttagaat

SEQ ID NO: 1295322 - DNA, 22 bp, Artificial Sequence
  chemically synthesized
tctatgacaaacatttttagaa

SEQ ID NO: 1295323 - DNA, 22 bp, Artificial Sequence
  chemically synthesized
ttctatgacaaacatttttaga

SEQ ID NO: 1295324 - DNA, 22 bp, Artificial Sequence
  chemically synthesized
ccttttctatgacaaacatttt

SEQ ID NO: 1295325 - DNA, 22 bp, Artificial Sequence
  chemically synthesized
tcccttttctatgacaaacatt

SEQ ID NO: 1295326 - DNA, 22 bp, Artificial Sequence
  chemically synthesized
taaaaatgtttgtcatagaaaa

SEQ ID NO: 1295327 - DNA, 22 bp, Artificial Sequence
  chemically synthesized
aaaagttctcccttttctatga

SEQ ID NO: 1295328 - DNA, 22 bp, Artificial Sequence
  chemically synthesized
aaaatgtttgtcatagaaaagg

SEQ ID NO: 1295329 - DNA, 22 bp, Artificial Sequence
  chemically synthesized
gtcatagaaaagggagaacttt

SEQ ID NO: 1295330 - DNA, 22 bp, Artificial Sequence
  chemically synthesized
tcatagaaaagggagaactttt

SEQ ID NO: 1295331 - DNA, 22 bp, Artificial Sequence
  chemically synthesized
ggagatccaatctcaaaagttc

SEQ ID NO: 1295332 - DNA, 22 bp, Artificial Sequence
  chemically synthesized
ttgagattggatctcctagtgg

SEQ ID NO: 1295333 - DNA, 22 bp, Artificial Sequence
  chemically synthesized
tgagattggatctcctagtgga

SEQ ID NO: 1295334 - DNA, 22 bp, Artificial Sequence
  chemically synthesized
gagattggatctcctagtggat

SEQ ID NO: 1295335 - DNA, 22 bp, Artificial Sequence
  chemically synthesized
agattggatctcctagtggatt

SEQ ID NO: 1295336 - DNA, 22 bp, Artificial Sequence
  chemically synthesized
gatctcctagtggattgttttg

SEQ ID NO: 1295337 - DNA, 22 bp, Artificial Sequence
  chemically synthesized
atgataatggagccaaaacaat

SEQ ID NO: 1295338 - DNA, 22 bp, Artificial Sequence
  chemically synthesized
ctagtggattgttttggctcca

SEQ ID NO: 1295339 - DNA, 22 bp, Artificial Sequence
  chemically synthesized
gtggattgttttggctccatta

SEQ ID NO: 1295340 - DNA, 22 bp, Artificial Sequence
  chemically synthesized
taaaattcatgataatggagcc

SEQ ID NO: 1295341 - DNA, 22 bp, Artificial Sequence
  chemically synthesized
gtaaaattcatgataatggagc

SEQ ID NO: 1295342 - DNA, 22 bp, Artificial Sequence
  chemically synthesized
tgtaaaattcatgataatggag

SEQ ID NO: 1295343 - DNA, 22 bp, Artificial Sequence
  chemically synthesized
attttgtaaaattcatgataat

SEQ ID NO: 1295344 - DNA, 22 bp, Artificial Sequence
  chemically synthesized
ttttggctccattatcatgaat

SEQ ID NO: 1295345 - DNA, 22 bp, Artificial Sequence
  chemically synthesized
tggctccattatcatgaatttt

SEQ ID NO: 1295346 - DNA, 22 bp, Artificial Sequence
  chemically synthesized
ggctccattatcatgaatttta

SEQ ID NO: 1295347 - DNA, 22 bp, Artificial Sequence
  chemically synthesized
gctccattatcatgaattttac

SEQ ID NO: 1295348 - DNA, 22 bp, Artificial Sequence
  chemically synthesized
tgggtctgattttgtaaaattc

SEQ ID NO: 1295349 - DNA, 22 bp, Artificial Sequence
  chemically synthesized
tatgggtctgattttgtaaaat

SEQ ID NO: 1295350 - DNA, 22 bp, Artificial Sequence
  chemically synthesized
cattatcatgaattttacaaaa

SEQ ID NO: 1295351 - DNA, 22 bp, Artificial Sequence
  chemically synthesized
cctctatgggtctgattttgta

SEQ ID NO: 1295352 - DNA, 22 bp, Artificial Sequence
  chemically synthesized
tcatgaattttacaaaatcaga

SEQ ID NO: 1295353 - DNA, 22 bp, Artificial Sequence
  chemically synthesized
ctccctctatgggtctgatttt

SEQ ID NO: 1295354 - DNA, 22 bp, Artificial Sequence
  chemically synthesized
tgaattactccctctatgggtc

SEQ ID NO: 1295355 - DNA, 22 bp, Artificial Sequence
  chemically synthesized
tacaaaatcagacccatagagg

SEQ ID NO: 1295356 - DNA, 22 bp, Artificial Sequence
  chemically synthesized
acaaaatcagacccatagaggg

SEQ ID NO: 1295357 - DNA, 22 bp, Artificial Sequence
  chemically synthesized
caaaatcagacccatagaggga

SEQ ID NO: 1295358 - DNA, 22 bp, Artificial Sequence
  chemically synthesized
atagctatgaattactccctct

SEQ ID NO: 1295359 - DNA, 22 bp, Artificial Sequence
  chemically synthesized
aatagctatgaattactccctc

SEQ ID NO: 1295360 - DNA, 22 bp, Artificial Sequence
  chemically synthesized
ttaatagctatgaattactccc

SEQ ID NO: 1295361 - DNA, 22 bp, Artificial Sequence
  chemically synthesized
aaactcttaatagctatgaatt

SEQ ID NO: 1295362 - DNA, 22 bp, Artificial Sequence
  chemically synthesized
aaatgcctgaaactcttaatag

SEQ ID NO: 1295363 - DNA, 22 bp, Artificial Sequence
  chemically synthesized
ctaaaatgcctgaaactcttaa

SEQ ID NO: 1295364 - DNA, 22 bp, Artificial Sequence
  chemically synthesized
tactaaaatgcctgaaactctt

SEQ ID NO: 1295365 - DNA, 22 bp, Artificial Sequence
  chemically synthesized
ctactaaaatgcctgaaactct

SEQ ID NO: 1295366 - DNA, 22 bp, Artificial Sequence
  chemically synthesized
atagctattaagagtttcaggc

SEQ ID NO: 1295367 - DNA, 22 bp, Artificial Sequence
  chemically synthesized
ttaagagtttcaggcattttag

SEQ ID NO: 1295368 - DNA, 22 bp, Artificial Sequence
  chemically synthesized
agagtttcaggcattttagtag

SEQ ID NO: 1295369 - DNA, 22 bp, Artificial Sequence
  chemically synthesized
aaagtgaaaatttctactaaaa

SEQ ID NO: 1295370 - DNA, 22 bp, Artificial Sequence
  chemically synthesized
caggcattttagtagaaatttt

SEQ ID NO: 1295371 - DNA, 22 bp, Artificial Sequence
  chemically synthesized
aggcattttagtagaaattttc

SEQ ID NO: 1295372 - DNA, 22 bp, Artificial Sequence
  chemically synthesized
aagagtcactaaaagtgaaaat

SEQ ID NO: 1295373 - DNA, 22 bp, Artificial Sequence
  chemically synthesized
aaagagtcactaaaagtgaaaa

SEQ ID NO: 1295374 - DNA, 22 bp, Artificial Sequence
  chemically synthesized
tagtagaaattttcacttttag

SEQ ID NO: 1295375 - DNA, 22 bp, Artificial Sequence
  chemically synthesized
agtagaaattttcacttttagt

SEQ ID NO: 1295376 - DNA, 22 bp, Artificial Sequence
  chemically synthesized
gtagaaattttcacttttagtg

SEQ ID NO: 1295377 - DNA, 22 bp, Artificial Sequence
  chemically synthesized
taatgatttaaagagtcactaa

SEQ ID NO: 1295378 - DNA, 22 bp, Artificial Sequence
  chemically synthesized
ttgtaatgatttaaagagtcac

SEQ ID NO: 1295379 - DNA, 22 bp, Artificial Sequence
  chemically synthesized
attgtaatgatttaaagagtca

SEQ ID NO: 1295380 - DNA, 22 bp, Artificial Sequence
  chemically synthesized
tcacttttagtgactctttaaa

SEQ ID NO: 1295381 - DNA, 22 bp, Artificial Sequence
  chemically synthesized
ttattgtaatgatttaaagagt

SEQ ID NO: 1295382 - DNA, 22 bp, Artificial Sequence
  chemically synthesized
cacttttagtgactctttaaat

SEQ ID NO: 1295383 - DNA, 22 bp, Artificial Sequence
  chemically synthesized
cttattgtaatgatttaaagag

SEQ ID NO: 1295384 - DNA, 22 bp, Artificial Sequence
  chemically synthesized
acttttagtgactctttaaatc

SEQ ID NO: 1295385 - DNA, 22 bp, Artificial Sequence
  chemically synthesized
tttcttattgtaatgatttaaa

SEQ ID NO: 1295386 - DNA, 22 bp, Artificial Sequence
  chemically synthesized
gtttcttattgtaatgatttaa

SEQ ID NO: 1295387 - DNA, 22 bp, Artificial Sequence
  chemically synthesized
ttagtgactctttaaatcatta

SEQ ID NO: 1295388 - DNA, 22 bp, Artificial Sequence
  chemically synthesized
tgtttcttattgtaatgattta

SEQ ID NO: 1295389 - DNA, 22 bp, Artificial Sequence
  chemically synthesized
tagtgactctttaaatcattac

SEQ ID NO: 1295390 - DNA, 22 bp, Artificial Sequence
  chemically synthesized
agtgactctttaaatcattaca

SEQ ID NO: 1295391 - DNA, 22 bp, Artificial Sequence
  chemically synthesized
gtgactctttaaatcattacaa

SEQ ID NO: 1295392 - DNA, 22 bp, Artificial Sequence
  chemically synthesized
tttaaatcattacaataagaaa

SEQ ID NO: 1295393 - DNA, 22 bp, Artificial Sequence
  chemically synthesized
taaatcattacaataagaaaca

SEQ ID NO: 1295394 - DNA, 22 bp, Artificial Sequence
  chemically synthesized
aaatcattacaataagaaacaa

SEQ ID NO: 1295395 - DNA, 22 bp, Artificial Sequence
  chemically synthesized
atagtggatattttgtttctta

SEQ ID NO: 1295396 - DNA, 22 bp, Artificial Sequence
  chemically synthesized
aatcattacaataagaaacaaa

SEQ ID NO: 1295397 - DNA, 22 bp, Artificial Sequence
  chemically synthesized
gatagtggatattttgtttctt

SEQ ID NO: 1295398 - DNA, 22 bp, Artificial Sequence
  chemically synthesized
tgatagtggatattttgtttct

SEQ ID NO: 1295399 - DNA, 22 bp, Artificial Sequence
  chemically synthesized
caataagaaacaaaatatccac

SEQ ID NO: 1295400 - DNA, 22 bp, Artificial Sequence
  chemically synthesized
agagtggcatagttttgatagt

SEQ ID NO: 1295401 - DNA, 22 bp, Artificial Sequence
  chemically synthesized
aagagtggcatagttttgatag

SEQ ID NO: 1295402 - DNA, 22 bp, Artificial Sequence
  chemically synthesized
taagagtggcatagttttgata

SEQ ID NO: 1295403 - DNA, 22 bp, Artificial Sequence
  chemically synthesized
aacccaaggctttaagagtggc

SEQ ID NO: 1295404 - DNA, 22 bp, Artificial Sequence
  chemically synthesized
aaacccaaggctttaagagtgg

SEQ ID NO: 1295405 - DNA, 22 bp, Artificial Sequence
  chemically synthesized
tcaaaactatgccactcttaaa

SEQ ID NO: 1295406 - DNA, 22 bp, Artificial Sequence
  chemically synthesized
tgccactcttaaagccttgggt

SEQ ID NO: 1295407 - DNA, 22 bp, Artificial Sequence
  chemically synthesized
ataaaatatggcccttaaaccc

SEQ ID NO: 1295408 - DNA, 22 bp, Artificial Sequence
  chemically synthesized
ttaaagccttgggtttaagggc

SEQ ID NO: 1295409 - DNA, 22 bp, Artificial Sequence
  chemically synthesized
aaagccttgggtttaagggcca

SEQ ID NO: 1295410 - DNA, 22 bp, Artificial Sequence
  chemically synthesized
aagccttgggtttaagggccat

SEQ ID NO: 1295411 - DNA, 22 bp, Artificial Sequence
  chemically synthesized
gggtttaagggccatattttat

SEQ ID NO: 1295412 - DNA, 22 bp, Artificial Sequence
  chemically synthesized
ggtttaagggccatattttatt

SEQ ID NO: 1295413 - DNA, 22 bp, Artificial Sequence
  chemically synthesized
aagggccatattttattagctt

SEQ ID NO: 1295414 - DNA, 22 bp, Artificial Sequence
  chemically synthesized
agggccatattttattagcttt

SEQ ID NO: 1295415 - DNA, 22 bp, Artificial Sequence
  chemically synthesized
gataatggaaaaataaagctaa

SEQ ID NO: 1295416 - DNA, 22 bp, Artificial Sequence
  chemically synthesized
tattagctttatttttccatta

SEQ ID NO: 1295417 - DNA, 22 bp, Artificial Sequence
  chemically synthesized
attagctttatttttccattat

SEQ ID NO: 1295418 - DNA, 22 bp, Artificial Sequence
  chemically synthesized
ttagctttatttttccattatc

SEQ ID NO: 1295419 - DNA, 22 bp, Artificial Sequence
  chemically synthesized
agacatcaaatctagataatgg

SEQ ID NO: 1295420 - DNA, 22 bp, Artificial Sequence
  chemically synthesized
gctttatttttccattatctag

SEQ ID NO: 1295421 - DNA, 22 bp, Artificial Sequence
  chemically synthesized
attgagacatcaaatctagata

SEQ ID NO: 1295422 - DNA, 22 bp, Artificial Sequence
  chemically synthesized
tatttttccattatctagattt

SEQ ID NO: 1295423 - DNA, 22 bp, Artificial Sequence
  chemically synthesized
aattgagacatcaaatctagat

SEQ ID NO: 1295424 - DNA, 22 bp, Artificial Sequence
  chemically synthesized
atttttccattatctagatttg

SEQ ID NO: 1295425 - DNA, 22 bp, Artificial Sequence
  chemically synthesized
tttttccattatctagatttga

SEQ ID NO: 1295426 - DNA, 22 bp, Artificial Sequence
  chemically synthesized
cttaattgagacatcaaatcta

SEQ ID NO: 1295427 - DNA, 22 bp, Artificial Sequence
  chemically synthesized
ttccattatctagatttgatgt

SEQ ID NO: 1295428 - DNA, 22 bp, Artificial Sequence
  chemically synthesized
tccattatctagatttgatgtc

SEQ ID NO: 1295429 - DNA, 22 bp, Artificial Sequence
  chemically synthesized
ccattatctagatttgatgtct

SEQ ID NO: 1295430 - DNA, 22 bp, Artificial Sequence
  chemically synthesized
attgcttaattgagacatcaaa

SEQ ID NO: 1295431 - DNA, 22 bp, Artificial Sequence
  chemically synthesized
cattatctagatttgatgtctc

SEQ ID NO: 1295432 - DNA, 22 bp, Artificial Sequence
  chemically synthesized
tctagatttgatgtctcaatta

SEQ ID NO: 1295433 - DNA, 22 bp, Artificial Sequence
  chemically synthesized
gatttgatgtctcaattaagca

SEQ ID NO: 1295434 - DNA, 22 bp, Artificial Sequence
  chemically synthesized
gatgtctcaattaagcaatcaa

SEQ ID NO: 1295435 - DNA, 22 bp, Artificial Sequence
  chemically synthesized
tatatgtatatattgattgctt

SEQ ID NO: 1295436 - DNA, 22 bp, Artificial Sequence
  chemically synthesized
atgtctcaattaagcaatcaat

SEQ ID NO: 1295437 - DNA, 22 bp, Artificial Sequence
  chemically synthesized
gtatatgtatatattgattgct

SEQ ID NO: 1295438 - DNA, 22 bp, Artificial Sequence
  chemically synthesized
aattaagcaatcaatatataca

SEQ ID NO: 1295439 - DNA, 22 bp, Artificial Sequence
  chemically synthesized
agcaatcaatatatacatatac

SEQ ID NO: 1295440 - DNA, 22 bp, Artificial Sequence
  chemically synthesized
catcatgaatgtttgtatatgt

SEQ ID NO: 1295441 - DNA, 22 bp, Artificial Sequence
  chemically synthesized
ccatcatgaatgtttgtatatg

SEQ ID NO: 1295442 - DNA, 22 bp, Artificial Sequence
  chemically synthesized
tgtttccatcatgaatgtttgt

SEQ ID NO: 1295443 - DNA, 22 bp, Artificial Sequence
  chemically synthesized
atgtttccatcatgaatgtttg

SEQ ID NO: 1295444 - DNA, 22 bp, Artificial Sequence
  chemically synthesized
ttatgtttccatcatgaatgtt

SEQ ID NO: 1295445 - DNA, 22 bp, Artificial Sequence
  chemically synthesized
cttatgtttccatcatgaatgt

SEQ ID NO: 1295446 - DNA, 22 bp, Artificial Sequence
  chemically synthesized
tcttatgtttccatcatgaatg

SEQ ID NO: 1295447 - DNA, 22 bp, Artificial Sequence
  chemically synthesized
gtgagtcggttttcttatgttt

SEQ ID NO: 1295448 - DNA, 22 bp, Artificial Sequence
  chemically synthesized
ggtgagtcggttttcttatgtt

SEQ ID NO: 1295449 - DNA, 22 bp, Artificial Sequence
  chemically synthesized
atgatggaaacataagaaaacc

SEQ ID NO: 1295450 - DNA, 22 bp, Artificial Sequence
  chemically synthesized
ggtaaatcaatcaaatgtttgg

SEQ ID NO: 1295451 - DNA, 22 bp, Artificial Sequence
  chemically synthesized
gggtaaatcaatcaaatgtttg

SEQ ID NO: 1295452 - DNA, 22 bp, Artificial Sequence
  chemically synthesized
gatttgggtaaatcaatcaaat

SEQ ID NO: 1295453 - DNA, 22 bp, Artificial Sequence
  chemically synthesized
tcgatttgggtaaatcaatcaa

SEQ ID NO: 1295454 - DNA, 22 bp, Artificial Sequence
  chemically synthesized
accaaacatttgattgatttac

SEQ ID NO: 1295455 - DNA, 22 bp, Artificial Sequence
  chemically synthesized
ttctcgatttgggtaaatcaat

SEQ ID NO: 1295456 - DNA, 22 bp, Artificial Sequence
  chemically synthesized
ttattctcgatttgggtaaatc

SEQ ID NO: 1295457 - DNA, 22 bp, Artificial Sequence
  chemically synthesized
attattattctcgatttgggta

SEQ ID NO: 1295458 - DNA, 22 bp, Artificial Sequence
  chemically synthesized
aattattattctcgatttgggt

SEQ ID NO: 1295459 - DNA, 22 bp, Artificial Sequence
  chemically synthesized
taattattattctcgatttggg

SEQ ID NO: 1295460 - DNA, 22 bp, Artificial Sequence
  chemically synthesized
gattgatttacccaaatcgaga

SEQ ID NO: 1295461 - DNA, 22 bp, Artificial Sequence
  chemically synthesized
attgatttacccaaatcgagaa

SEQ ID NO: 1295462 - DNA, 22 bp, Artificial Sequence
  chemically synthesized
cattttaattattattctcgat

SEQ ID NO: 1295463 - DNA, 22 bp, Artificial Sequence
  chemically synthesized
gcattttaattattattctcga

SEQ ID NO: 1295464 - DNA, 22 bp, Artificial Sequence
  chemically synthesized
atttacccaaatcgagaataat

SEQ ID NO: 1295465 - DNA, 22 bp, Artificial Sequence
  chemically synthesized
acccaaatcgagaataataatt

SEQ ID NO: 1295466 - DNA, 22 bp, Artificial Sequence
  chemically synthesized
cccaaatcgagaataataatta

SEQ ID NO: 1295467 - DNA, 22 bp, Artificial Sequence
  chemically synthesized
aaagacttgcattttaattatt

SEQ ID NO: 1295468 - DNA, 22 bp, Artificial Sequence
  chemically synthesized
aaaagacttgcattttaattat

SEQ ID NO: 1295469 - DNA, 22 bp, Artificial Sequence
  chemically synthesized
ggatgtcaaagtttaaaagact

SEQ ID NO: 1295470 - DNA, 22 bp, Artificial Sequence
  chemically synthesized
ttgggatgtcaaagtttaaaag

SEQ ID NO: 1295471 - DNA, 22 bp, Artificial Sequence
  chemically synthesized
attgggatgtcaaagtttaaaa

SEQ ID NO: 1295472 - DNA, 22 bp, Artificial Sequence
  chemically synthesized
aaatgcaagtcttttaaacttt

SEQ ID NO: 1295473 - DNA, 22 bp, Artificial Sequence
  chemically synthesized
ttaaactttgacatcccaataa

SEQ ID NO: 1295474 - DNA, 22 bp, Artificial Sequence
  chemically synthesized
taaactttgacatcccaataaa

SEQ ID NO: 1295475 - DNA, 22 bp, Artificial Sequence
  chemically synthesized
aaactttgacatcccaataaac

SEQ ID NO: 1295476 - DNA, 22 bp, Artificial Sequence
  chemically synthesized
aactttgacatcccaataaacc

SEQ ID NO: 1295477 - DNA, 22 bp, Artificial Sequence
  chemically synthesized
tgacatcccaataaacctccat

SEQ ID NO: 1295478 - DNA, 22 bp, Artificial Sequence
  chemically synthesized
ggaatgcaatatatggaggttt

SEQ ID NO: 1295479 - DNA, 22 bp, Artificial Sequence
  chemically synthesized
gacatcccaataaacctccata

SEQ ID NO: 1295480 - DNA, 22 bp, Artificial Sequence
  chemically synthesized
acatcccaataaacctccatat

SEQ ID NO: 1295481 - DNA, 22 bp, Artificial Sequence
  chemically synthesized
gtattaggaatgcaatatatgg

SEQ ID NO: 1295482 - DNA, 22 bp, Artificial Sequence
  chemically synthesized
aaaactagtattaggaatgcaa

SEQ ID NO: 1295483 - DNA, 22 bp, Artificial Sequence
  chemically synthesized
gaaaactagtattaggaatgca

SEQ ID NO: 1295484 - DNA, 22 bp, Artificial Sequence
  chemically synthesized
ccttgaaaactagtattaggaa

SEQ ID NO: 1295485 - DNA, 22 bp, Artificial Sequence
  chemically synthesized
catatattgcattcctaatact

SEQ ID NO: 1295486 - DNA, 22 bp, Artificial Sequence
  chemically synthesized
accttgaaaactagtattagga

SEQ ID NO: 1295487 - DNA, 22 bp, Artificial Sequence
  chemically synthesized
ttaccttgaaaactagtattag

SEQ ID NO: 1295488 - DNA, 22 bp, Artificial Sequence
  chemically synthesized
cattcctaatactagttttcaa

SEQ ID NO: 1295489 - DNA, 22 bp, Artificial Sequence
  chemically synthesized
ctaatactagttttcaaggtaa

SEQ ID NO: 1295490 - DNA, 22 bp, Artificial Sequence
  chemically synthesized
atactagttttcaaggtaagaa

SEQ ID NO: 1295491 - DNA, 22 bp, Artificial Sequence
  chemically synthesized
gttttcaaggtaagaatatctt

SEQ ID NO: 1295492 - DNA, 22 bp, Artificial Sequence
  chemically synthesized
tcaaggtaagaatatcttgctc

SEQ ID NO: 1295493 - DNA, 22 bp, Artificial Sequence
  chemically synthesized
taggtggacacagagcaagata

SEQ ID NO: 1295494 - DNA, 22 bp, Artificial Sequence
  chemically synthesized
caaggtaagaatatcttgctct

SEQ ID NO: 1295495 - DNA, 22 bp, Artificial Sequence
  chemically synthesized
aaggtaagaatatcttgctctg

SEQ ID NO: 1295496 - DNA, 22 bp, Artificial Sequence
  chemically synthesized
gatgattataggtggacacaga

SEQ ID NO: 1295497 - DNA, 22 bp, Artificial Sequence
  chemically synthesized
tagatgattataggtggacaca

SEQ ID NO: 1295498 - DNA, 22 bp, Artificial Sequence
  chemically synthesized
gctctgtgtccacctataatca

SEQ ID NO: 1295499 - DNA, 22 bp, Artificial Sequence
  chemically synthesized
ctctgtgtccacctataatcat

SEQ ID NO: 1295500 - DNA, 22 bp, Artificial Sequence
  chemically synthesized
tgtgtccacctataatcatcta

SEQ ID NO: 1295501 - DNA, 22 bp, Artificial Sequence
  chemically synthesized
tgtccacctataatcatctaga

SEQ ID NO: 1295502 - DNA, 22 bp, Artificial Sequence
  chemically synthesized
atcaatagcgtgactctagatg

SEQ ID NO: 1295503 - DNA, 22 bp, Artificial Sequence
  chemically synthesized
aatcaatagcgtgactctagat

SEQ ID NO: 1295504 - DNA, 22 bp, Artificial Sequence
  chemically synthesized
taatcaatagcgtgactctaga

SEQ ID NO: 1295505 - DNA, 22 bp, Artificial Sequence
  chemically synthesized
ttaatcaatagcgtgactctag

SEQ ID NO: 1295506 - DNA, 22 bp, Artificial Sequence
  chemically synthesized
taatcatctagagtcacgctat

SEQ ID NO: 1295507 - DNA, 22 bp, Artificial Sequence
  chemically synthesized
aatttttaatcaatagcgtgac

SEQ ID NO: 1295508 - DNA, 22 bp, Artificial Sequence
  chemically synthesized
gagtcacgctattgattaaaaa

SEQ ID NO: 1295509 - DNA, 22 bp, Artificial Sequence
  chemically synthesized
caaatacaactcaatttttaat

SEQ ID NO: 1295510 - DNA, 22 bp, Artificial Sequence
  chemically synthesized
gcaaatacaactcaatttttaa

SEQ ID NO: 1295511 - DNA, 22 bp, Artificial Sequence
  chemically synthesized
atttgcaaatacaactcaattt

SEQ ID NO: 1295512 - DNA, 22 bp, Artificial Sequence
  chemically synthesized
aatttgcaaatacaactcaatt

SEQ ID NO: 1295513 - DNA, 22 bp, Artificial Sequence
  chemically synthesized
ttgattaaaaattgagttgtat

SEQ ID NO: 1295514 - DNA, 22 bp, Artificial Sequence
  chemically synthesized
cttaatttgcaaatacaactca

SEQ ID NO: 1295515 - DNA, 22 bp, Artificial Sequence
  chemically synthesized
acttaatttgcaaatacaactc

SEQ ID NO: 1295516 - DNA, 22 bp, Artificial Sequence
  chemically synthesized
attaaaaattgagttgtatttg

SEQ ID NO: 1295517 - DNA, 22 bp, Artificial Sequence
  chemically synthesized
aaaattgagttgtatttgcaaa

SEQ ID NO: 1295518 - DNA, 22 bp, Artificial Sequence
  chemically synthesized
atatttacttaatttgcaaata

SEQ ID NO: 1295519 - DNA, 22 bp, Artificial Sequence
  chemically synthesized
aatatttacttaatttgcaaat

SEQ ID NO: 1295520 - DNA, 22 bp, Artificial Sequence
  chemically synthesized
ttaatatttacttaatttgcaa

SEQ ID NO: 1295521 - DNA, 22 bp, Artificial Sequence
  chemically synthesized
agttgtatttgcaaattaagta

SEQ ID NO: 1295522 - DNA, 22 bp, Artificial Sequence
  chemically synthesized
tatttgcaaattaagtaaatat

SEQ ID NO: 1295523 - DNA, 22 bp, Artificial Sequence
  chemically synthesized
aatccatactcttaatatttac

SEQ ID NO: 1295524 - DNA, 22 bp, Artificial Sequence
  chemically synthesized
caatccatactcttaatattta

SEQ ID NO: 1295525 - DNA, 22 bp, Artificial Sequence
  chemically synthesized
gcaaattaagtaaatattaaga

SEQ ID NO: 1295526 - DNA, 22 bp, Artificial Sequence
  chemically synthesized
caaattaagtaaatattaagag

SEQ ID NO: 1295527 - DNA, 22 bp, Artificial Sequence
  chemically synthesized
tgcaggcttcaatccatactct

SEQ ID NO: 1295528 - DNA, 22 bp, Artificial Sequence
  chemically synthesized
agtaaatattaagagtatggat

SEQ ID NO: 1295529 - DNA, 22 bp, Artificial Sequence
  chemically synthesized
gtgcaggcttcaatccatactc

SEQ ID NO: 1295530 - DNA, 22 bp, Artificial Sequence
  chemically synthesized
tgtgcaggcttcaatccatact

SEQ ID NO: 1295531 - DNA, 22 bp, Artificial Sequence
  chemically synthesized
ttgtgcaggcttcaatccatac

SEQ ID NO: 1295532 - DNA, 22 bp, Artificial Sequence
  chemically synthesized
tttttgtgcaggcttcaatcca

SEQ ID NO: 1295533 - DNA, 22 bp, Artificial Sequence
  chemically synthesized
gtttttgtgcaggcttcaatcc

SEQ ID NO: 1295534 - DNA, 22 bp, Artificial Sequence
  chemically synthesized
agagtatggattgaagcctgca

SEQ ID NO: 1295535 - DNA, 22 bp, Artificial Sequence
  chemically synthesized
atcttgtttttgtgcaggcttc

SEQ ID NO: 1295536 - DNA, 22 bp, Artificial Sequence
  chemically synthesized
aagcctgcacaaaaacaagatg

SEQ ID NO: 1295537 - DNA, 22 bp, Artificial Sequence
  chemically synthesized
aagacaataagttcatcttgtt

SEQ ID NO: 1295538 - DNA, 22 bp, Artificial Sequence
  chemically synthesized
cacaaaaacaagatgaacttat

SEQ ID NO: 1295539 - DNA, 22 bp, Artificial Sequence
  chemically synthesized
aaatgattaaagacaataagtt

SEQ ID NO: 1295540 - DNA, 22 bp, Artificial Sequence
  chemically synthesized
caaatgattaaagacaataagt

SEQ ID NO: 1295541 - DNA, 22 bp, Artificial Sequence
  chemically synthesized
gagcatatttcaaatgattaaa

SEQ ID NO: 1295542 - DNA, 22 bp, Artificial Sequence
  chemically synthesized
agagcatatttcaaatgattaa

SEQ ID NO: 1295543 - DNA, 22 bp, Artificial Sequence
  chemically synthesized
attgtctttaatcatttgaaat

SEQ ID NO: 1295544 - DNA, 22 bp, Artificial Sequence
  chemically synthesized
ttgtctttaatcatttgaaata

SEQ ID NO: 1295545 - DNA, 22 bp, Artificial Sequence
  chemically synthesized
tagtttagagcatatttcaaat

SEQ ID NO: 1295546 - DNA, 22 bp, Artificial Sequence
  chemically synthesized
tctttaatcatttgaaatatgc

SEQ ID NO: 1295547 - DNA, 22 bp, Artificial Sequence
  chemically synthesized
taatcatttgaaatatgctcta

SEQ ID NO: 1295548 - DNA, 22 bp, Artificial Sequence
  chemically synthesized
aatcatttgaaatatgctctaa

SEQ ID NO: 1295549 - DNA, 22 bp, Artificial Sequence
  chemically synthesized
agccactatagtttagagcata

SEQ ID NO: 1295550 - DNA, 22 bp, Artificial Sequence
  chemically synthesized
atcatttgaaatatgctctaaa

SEQ ID NO: 1295551 - DNA, 22 bp, Artificial Sequence
  chemically synthesized
gaaatatgctctaaactatagt

SEQ ID NO: 1295552 - DNA, 22 bp, Artificial Sequence
  chemically synthesized
aaatatgctctaaactatagtg

SEQ ID NO: 1295553 - DNA, 22 bp, Artificial Sequence
  chemically synthesized
ggtgtattcagccactatagtt

SEQ ID NO: 1295554 - DNA, 22 bp, Artificial Sequence
  chemically synthesized
gggtgtattcagccactatagt

SEQ ID NO: 1295555 - DNA, 22 bp, Artificial Sequence
  chemically synthesized
tgggtgtattcagccactatag

SEQ ID NO: 1295556 - DNA, 22 bp, Artificial Sequence
  chemically synthesized
ctttgggtgtattcagccacta

SEQ ID NO: 1295557 - DNA, 22 bp, Artificial Sequence
  chemically synthesized
taaactatagtggctgaataca

SEQ ID NO: 1295558 - DNA, 22 bp, Artificial Sequence
  chemically synthesized
aactatagtggctgaatacacc

SEQ ID NO: 1295559 - DNA, 22 bp, Artificial Sequence
  chemically synthesized
tagtggctgaatacacccaaag

SEQ ID NO: 1295560 - DNA, 22 bp, Artificial Sequence
  chemically synthesized
aagaaaagcaatataattgctt

SEQ ID NO: 1295561 - DNA, 22 bp, Artificial Sequence
  chemically synthesized
aatacacccaaagcaattatat

SEQ ID NO: 1295562 - DNA, 22 bp, Artificial Sequence
  chemically synthesized
ccaagttcaagaaaagcaatat

SEQ ID NO: 1295563 - DNA, 22 bp, Artificial Sequence
  chemically synthesized
accaagttcaagaaaagcaata

SEQ ID NO: 1295564 - DNA, 22 bp, Artificial Sequence
  chemically synthesized
taccaagttcaagaaaagcaat

SEQ ID NO: 1295565 - DNA, 22 bp, Artificial Sequence
  chemically synthesized
gtctttaccaagttcaagaaaa

SEQ ID NO: 1295566 - DNA, 22 bp, Artificial Sequence
  chemically synthesized
ggtctttaccaagttcaagaaa

SEQ ID NO: 1295567 - DNA, 22 bp, Artificial Sequence
  chemically synthesized
ttggtctttaccaagttcaaga

SEQ ID NO: 1295568 - DNA, 22 bp, Artificial Sequence
  chemically synthesized
tattgcttttcttgaacttggt

SEQ ID NO: 1295569 - DNA, 22 bp, Artificial Sequence
  chemically synthesized
tccctcttggtctttaccaagt

SEQ ID NO: 1295570 - DNA, 22 bp, Artificial Sequence
  chemically synthesized
gtccctcttggtctttaccaag

SEQ ID NO: 1295571 - DNA, 22 bp, Artificial Sequence
  chemically synthesized
cttttcttgaacttggtaaaga

SEQ ID NO: 1295572 - DNA, 22 bp, Artificial Sequence
  chemically synthesized
tgtccctcttggtctttaccaa

SEQ ID NO: 1295573 - DNA, 22 bp, Artificial Sequence
  chemically synthesized
ttgtccctcttggtctttacca

SEQ ID NO: 1295574 - DNA, 22 bp, Artificial Sequence
  chemically synthesized
tttgtccctcttggtctttacc

SEQ ID NO: 1295575 - DNA, 22 bp, Artificial Sequence
  chemically synthesized
ttcttgaacttggtaaagacca

SEQ ID NO: 1295576 - DNA, 22 bp, Artificial Sequence
  chemically synthesized
ttttgtccctcttggtctttac

SEQ ID NO: 1295577 - DNA, 22 bp, Artificial Sequence
  chemically synthesized
tcttgaacttggtaaagaccaa

SEQ ID NO: 1295578 - DNA, 22 bp, Artificial Sequence
  chemically synthesized
cttgaacttggtaaagaccaag

SEQ ID NO: 1295579 - DNA, 22 bp, Artificial Sequence
  chemically synthesized
ttgaacttggtaaagaccaaga

SEQ ID NO: 1295580 - DNA, 22 bp, Artificial Sequence
  chemically synthesized
gaacttggtaaagaccaagagg

SEQ ID NO: 1295581 - DNA, 22 bp, Artificial Sequence
  chemically synthesized
aacttggtaaagaccaagaggg

SEQ ID NO: 1295582 - DNA, 22 bp, Artificial Sequence
  chemically synthesized
tcatttttttgtccctcttggt

SEQ ID NO: 1295583 - DNA, 22 bp, Artificial Sequence
  chemically synthesized
ggtaaagaccaagagggacaaa

SEQ ID NO: 1295584 - DNA, 22 bp, Artificial Sequence
  chemically synthesized
gtaaagaccaagagggacaaaa

SEQ ID NO: 1295585 - DNA, 22 bp, Artificial Sequence
  chemically synthesized
tgaaaattatcatttttttgtc

SEQ ID NO: 1295586 - DNA, 22 bp, Artificial Sequence
  chemically synthesized
ttgtgaaaattatcattttttt

SEQ ID NO: 1295587 - DNA, 22 bp, Artificial Sequence
  chemically synthesized
gttgtgaaaattatcatttttt

SEQ ID NO: 1295588 - DNA, 22 bp, Artificial Sequence
  chemically synthesized
tgttgtgaaaattatcattttt

SEQ ID NO: 1295589 - DNA, 22 bp, Artificial Sequence
  chemically synthesized
tcacaacaaaattccctcatat

SEQ ID NO: 1295590 - DNA, 22 bp, Artificial Sequence
  chemically synthesized
cacaacaaaattccctcatatc

SEQ ID NO: 1295591 - DNA, 22 bp, Artificial Sequence
  chemically synthesized
acaacaaaattccctcatatct

SEQ ID NO: 1295592 - DNA, 22 bp, Artificial Sequence
  chemically synthesized
gaatatgtcacccagcagaaga

SEQ ID NO: 1295593 - DNA, 22 bp, Artificial Sequence
  chemically synthesized
cctcatatcttcttctgctggg

SEQ ID NO: 1295594 - DNA, 22 bp, Artificial Sequence
  chemically synthesized
atatcttcttctgctgggtgac

SEQ ID NO: 1295595 - DNA, 22 bp, Artificial Sequence
  chemically synthesized
cttctgctgggtgacatattct

SEQ ID NO: 1295596 - DNA, 22 bp, Artificial Sequence
  chemically synthesized
catcaagtagctagaatatgtc

SEQ ID NO: 1295597 - DNA, 22 bp, Artificial Sequence
  chemically synthesized
ttctgctgggtgacatattcta

SEQ ID NO: 1295598 - DNA, 22 bp, Artificial Sequence
  chemically synthesized
ccatcaagtagctagaatatgt

SEQ ID NO: 1295599 - DNA, 22 bp, Artificial Sequence
  chemically synthesized
ctgctgggtgacatattctagc

SEQ ID NO: 1295600 - DNA, 22 bp, Artificial Sequence
  chemically synthesized
tgctgggtgacatattctagct

SEQ ID NO: 1295601 - DNA, 22 bp, Artificial Sequence
  chemically synthesized
ctgggtgacatattctagctac

SEQ ID NO: 1295602 - DNA, 22 bp, Artificial Sequence
  chemically synthesized
caatcttccatcaagtagctag

SEQ ID NO: 1295603 - DNA, 22 bp, Artificial Sequence
  chemically synthesized
ggtgacatattctagctacttg

SEQ ID NO: 1295604 - DNA, 22 bp, Artificial Sequence
  chemically synthesized
tagctgcaatcttccatcaagt

SEQ ID NO: 1295605 - DNA, 22 bp, Artificial Sequence
  chemically synthesized
atagctgcaatcttccatcaag

SEQ ID NO: 1295606 - DNA, 22 bp, Artificial Sequence
  chemically synthesized
tagctacttgatggaagattgc

SEQ ID NO: 1295607 - DNA, 22 bp, Artificial Sequence
  chemically synthesized
agagtttatagctgcaatcttc

SEQ ID NO: 1295608 - DNA, 22 bp, Artificial Sequence
  chemically synthesized
gctacttgatggaagattgcag

SEQ ID NO: 1295609 - DNA, 22 bp, Artificial Sequence
  chemically synthesized
cttgatggaagattgcagctat

SEQ ID NO: 1295610 - DNA, 22 bp, Artificial Sequence
  chemically synthesized
gatggaagattgcagctataaa

SEQ ID NO: 1295611 - DNA, 22 bp, Artificial Sequence
  chemically synthesized
atggaagattgcagctataaac

SEQ ID NO: 1295612 - DNA, 22 bp, Artificial Sequence
  chemically synthesized
atgacatgagtcctcagagttt

SEQ ID NO: 1295613 - DNA, 22 bp, Artificial Sequence
  chemically synthesized
aatgacatgagtcctcagagtt

SEQ ID NO: 1295614 - DNA, 22 bp, Artificial Sequence
  chemically synthesized
taatgacatgagtcctcagagt

SEQ ID NO: 1295615 - DNA, 22 bp, Artificial Sequence
  chemically synthesized
tttaatgacatgagtcctcaga

SEQ ID NO: 1295616 - DNA, 22 bp, Artificial Sequence
  chemically synthesized
cagctataaactctgaggactc

SEQ ID NO: 1295617 - DNA, 22 bp, Artificial Sequence
  chemically synthesized
ctttaatgacatgagtcctcag

SEQ ID NO: 1295618 - DNA, 22 bp, Artificial Sequence
  chemically synthesized
taaactctgaggactcatgtca

SEQ ID NO: 1295619 - DNA, 22 bp, Artificial Sequence
  chemically synthesized
tgaggactcatgtcattaaaga

SEQ ID NO: 1295620 - DNA, 22 bp, Artificial Sequence
  chemically synthesized
acaatgtgagtttctttaatga

SEQ ID NO: 1295621 - DNA, 22 bp, Artificial Sequence
  chemically synthesized
gacaatgtgagtttctttaatg

SEQ ID NO: 1295622 - DNA, 22 bp, Artificial Sequence
  chemically synthesized
aggactcatgtcattaaagaaa

SEQ ID NO: 1295623 - DNA, 22 bp, Artificial Sequence
  chemically synthesized
ttgacaatgtgagtttctttaa

SEQ ID NO: 1295624 - DNA, 22 bp, Artificial Sequence
  chemically synthesized
cttgacaatgtgagtttcttta

SEQ ID NO: 1295625 - DNA, 22 bp, Artificial Sequence
  chemically synthesized
ttcttgacaatgtgagtttctt

SEQ ID NO: 1295626 - DNA, 22 bp, Artificial Sequence
  chemically synthesized
atgtcattaaagaaactcacat

SEQ ID NO: 1295627 - DNA, 22 bp, Artificial Sequence
  chemically synthesized
attcttcttgacaatgtgagtt

SEQ ID NO: 1295628 - DNA, 22 bp, Artificial Sequence
  chemically synthesized
gattcttcttgacaatgtgagt

SEQ ID NO: 1295629 - DNA, 22 bp, Artificial Sequence
  chemically synthesized
tgattcttcttgacaatgtgag

SEQ ID NO: 1295630 - DNA, 22 bp, Artificial Sequence
  chemically synthesized
aagaaactcacattgtcaagaa

SEQ ID NO: 1295631 - DNA, 22 bp, Artificial Sequence
  chemically synthesized
acattgtcaagaagaatcaaag

SEQ ID NO: 1295632 - DNA, 22 bp, Artificial Sequence
  chemically synthesized
tataaaatgtatatctttgatt

SEQ ID NO: 1295633 - DNA, 22 bp, Artificial Sequence
  chemically synthesized
tcaagaagaatcaaagatatac

SEQ ID NO: 1295634 - DNA, 22 bp, Artificial Sequence
  chemically synthesized
attatataaaatgtatatcttt

SEQ ID NO: 1295635 - DNA, 22 bp, Artificial Sequence
  chemically synthesized
aattatataaaatgtatatctt

SEQ ID NO: 1295636 - DNA, 22 bp, Artificial Sequence
  chemically synthesized
tttaattatataaaatgtatat

SEQ ID NO: 1295637 - DNA, 22 bp, Artificial Sequence
  chemically synthesized
tatataattaaatagtgtatct

SEQ ID NO: 1295638 - DNA, 22 bp, Artificial Sequence
  chemically synthesized
atataattaaatagtgtatctt

SEQ ID NO: 1295639 - DNA, 22 bp, Artificial Sequence
  chemically synthesized
tataattaaatagtgtatcttt

SEQ ID NO: 1295640 - DNA, 22 bp, Artificial Sequence
  chemically synthesized
aatagtgtatctttgccatatc

SEQ ID NO: 1295641 - DNA, 22 bp, Artificial Sequence
  chemically synthesized
aggagtaagcagcagaagatat

SEQ ID NO: 1295642 - DNA, 22 bp, Artificial Sequence
  chemically synthesized
aaggagtaagcagcagaagata

SEQ ID NO: 1295643 - DNA, 22 bp, Artificial Sequence
  chemically synthesized
tttaaggagtaagcagcagaag

SEQ ID NO: 1295644 - DNA, 22 bp, Artificial Sequence
  chemically synthesized
atttaaggagtaagcagcagaa

SEQ ID NO: 1295645 - DNA, 22 bp, Artificial Sequence
  chemically synthesized
ttatttaaggagtaagcagcag

SEQ ID NO: 1295646 - DNA, 22 bp, Artificial Sequence
  chemically synthesized
tgccatatcttctgctgcttac

SEQ ID NO: 1295647 - DNA, 22 bp, Artificial Sequence
  chemically synthesized
gccatatcttctgctgcttact

SEQ ID NO: 1295648 - DNA, 22 bp, Artificial Sequence
  chemically synthesized
ccatatcttctgctgcttactc

SEQ ID NO: 1295649 - DNA, 22 bp, Artificial Sequence
  chemically synthesized
actcttatttaaggagtaagca

SEQ ID NO: 1295650 - DNA, 22 bp, Artificial Sequence
  chemically synthesized
tgttcactcttatttaaggagt

SEQ ID NO: 1295651 - DNA, 22 bp, Artificial Sequence
  chemically synthesized
ctgctgcttactccttaaataa

SEQ ID NO: 1295652 - DNA, 22 bp, Artificial Sequence
  chemically synthesized
tgctgcttactccttaaataag

SEQ ID NO: 1295653 - DNA, 22 bp, Artificial Sequence
  chemically synthesized
ctgcttactccttaaataagag

SEQ ID NO: 1295654 - DNA, 22 bp, Artificial Sequence
  chemically synthesized
cttactccttaaataagagtga

SEQ ID NO: 1295655 - DNA, 22 bp, Artificial Sequence
  chemically synthesized
gaaatattatgttcactcttat

SEQ ID NO: 1295656 - DNA, 22 bp, Artificial Sequence
  chemically synthesized
actccttaaataagagtgaaca

SEQ ID NO: 1295657 - DNA, 22 bp, Artificial Sequence
  chemically synthesized
ctccttaaataagagtgaacat

SEQ ID NO: 1295658 - DNA, 22 bp, Artificial Sequence
  chemically synthesized
cttaaataagagtgaacataat

SEQ ID NO: 1295659 - DNA, 22 bp, Artificial Sequence
  chemically synthesized
aaataagagtgaacataatatt

SEQ ID NO: 1295660 - DNA, 22 bp, Artificial Sequence
  chemically synthesized
tgcaaatctggaaatattatgt

SEQ ID NO: 1295661 - DNA, 22 bp, Artificial Sequence
  chemically synthesized
aataagagtgaacataatattt

SEQ ID NO: 1295662 - DNA, 22 bp, Artificial Sequence
  chemically synthesized
gctgtgcaaatctggaaatatt

SEQ ID NO: 1295663 - DNA, 22 bp, Artificial Sequence
  chemically synthesized
agctgtgcaaatctggaaatat

SEQ ID NO: 1295664 - DNA, 22 bp, Artificial Sequence
  chemically synthesized
tagctgtgcaaatctggaaata

SEQ ID NO: 1295665 - DNA, 22 bp, Artificial Sequence
  chemically synthesized
ttttagctgtgcaaatctggaa

SEQ ID NO: 1295666 - DNA, 22 bp, Artificial Sequence
  chemically synthesized
attttagctgtgcaaatctgga

SEQ ID NO: 1295667 - DNA, 22 bp, Artificial Sequence
  chemically synthesized
tattttagctgtgcaaatctgg

SEQ ID NO: 1295668 - DNA, 22 bp, Artificial Sequence
  chemically synthesized
ccagatttgcacagctaaaata

SEQ ID NO: 1295669 - DNA, 22 bp, Artificial Sequence
  chemically synthesized
atagtgtcattttattttagct

SEQ ID NO: 1295670 - DNA, 22 bp, Artificial Sequence
  chemically synthesized
cagatttgcacagctaaaataa

SEQ ID NO: 1295671 - DNA, 22 bp, Artificial Sequence
  chemically synthesized
tcatagtgtcattttattttag

SEQ ID NO: 1295672 - DNA, 22 bp, Artificial Sequence
  chemically synthesized
tctcatagtgtcattttatttt

SEQ ID NO: 1295673 - DNA, 22 bp, Artificial Sequence
  chemically synthesized
ctctcatagtgtcattttattt

SEQ ID NO: 1295674 - DNA, 22 bp, Artificial Sequence
  chemically synthesized
gcacagctaaaataaaatgaca

SEQ ID NO: 1295675 - DNA, 22 bp, Artificial Sequence
  chemically synthesized
tttctctcatagtgtcatttta

SEQ ID NO: 1295676 - DNA, 22 bp, Artificial Sequence
  chemically synthesized
cacagctaaaataaaatgacac

SEQ ID NO: 1295677 - DNA, 22 bp, Artificial Sequence
  chemically synthesized
atttctctcatagtgtcatttt

SEQ ID NO: 1295678 - DNA, 22 bp, Artificial Sequence
  chemically synthesized
tatttctctcatagtgtcattt

SEQ ID NO: 1295679 - DNA, 22 bp, Artificial Sequence
  chemically synthesized
aaataaaatgacactatgagag

SEQ ID NO: 1295680 - DNA, 22 bp, Artificial Sequence
  chemically synthesized
aaaatccgttttatttctctca

SEQ ID NO: 1295681 - DNA, 22 bp, Artificial Sequence
  chemically synthesized
aaaaatccgttttatttctctc

SEQ ID NO: 1295682 - DNA, 22 bp, Artificial Sequence
  chemically synthesized
tgtatcttaaaaatccgtttta

SEQ ID NO: 1295683 - DNA, 22 bp, Artificial Sequence
  chemically synthesized
tgagagaaataaaacggatttt

SEQ ID NO: 1295684 - DNA, 22 bp, Artificial Sequence
  chemically synthesized
tgtacctgtgtatcttaaaaat

SEQ ID NO: 1295685 - DNA, 22 bp, Artificial Sequence
  chemically synthesized
aaaatggactatgtacctgtgt

SEQ ID NO: 1295686 - DNA, 22 bp, Artificial Sequence
  chemically synthesized
caaaatggactatgtacctgtg

SEQ ID NO: 1295687 - DNA, 22 bp, Artificial Sequence
  chemically synthesized
tcaaaatggactatgtacctgt

SEQ ID NO: 1295688 - DNA, 22 bp, Artificial Sequence
  chemically synthesized
ttaagatacacaggtacatagt

SEQ ID NO: 1295689 - DNA, 22 bp, Artificial Sequence
  chemically synthesized
taagatacacaggtacatagtc

SEQ ID NO: 1295690 - DNA, 22 bp, Artificial Sequence
  chemically synthesized
aagatacacaggtacatagtcc

SEQ ID NO: 1295691 - DNA, 22 bp, Artificial Sequence
  chemically synthesized
agatacacaggtacatagtcca

SEQ ID NO: 1295692 - DNA, 22 bp, Artificial Sequence
  chemically synthesized
tgaaattttcaaaatggactat

SEQ ID NO: 1295693 - DNA, 22 bp, Artificial Sequence
  chemically synthesized
agttgtgaaattttcaaaatgg

SEQ ID NO: 1295694 - DNA, 22 bp, Artificial Sequence
  chemically synthesized
agatctaagttgtgaaattttc

SEQ ID NO: 1295695 - DNA, 22 bp, Artificial Sequence
  chemically synthesized
aagatctaagttgtgaaatttt

SEQ ID NO: 1295696 - DNA, 22 bp, Artificial Sequence
  chemically synthesized
taagatctaagttgtgaaattt

SEQ ID NO: 1295697 - DNA, 22 bp, Artificial Sequence
  chemically synthesized
ttaagatctaagttgtgaaatt

SEQ ID NO: 1295698 - DNA, 22 bp, Artificial Sequence
  chemically synthesized
cttttaagatctaagttgtgaa

SEQ ID NO: 1295699 - DNA, 22 bp, Artificial Sequence
  chemically synthesized
acttttaagatctaagttgtga

SEQ ID NO: 1295700 - DNA, 22 bp, Artificial Sequence
  chemically synthesized
tacttttaagatctaagttgtg

SEQ ID NO: 1295701 - DNA, 22 bp, Artificial Sequence
  chemically synthesized
tgaaaatttcacaacttagatc

SEQ ID NO: 1295702 - DNA, 22 bp, Artificial Sequence
  chemically synthesized
ctttacttttaagatctaagtt

SEQ ID NO: 1295703 - DNA, 22 bp, Artificial Sequence
  chemically synthesized
gaaaatttcacaacttagatct

SEQ ID NO: 1295704 - DNA, 22 bp, Artificial Sequence
  chemically synthesized
aaaatttcacaacttagatctt

SEQ ID NO: 1295705 - DNA, 22 bp, Artificial Sequence
  chemically synthesized
ttactttacttttaagatctaa

SEQ ID NO: 1295706 - DNA, 22 bp, Artificial Sequence
  chemically synthesized
gttactttacttttaagatcta

SEQ ID NO: 1295707 - DNA, 22 bp, Artificial Sequence
  chemically synthesized
cacaacttagatcttaaaagta

SEQ ID NO: 1295708 - DNA, 22 bp, Artificial Sequence
  chemically synthesized
acaacttagatcttaaaagtaa

SEQ ID NO: 1295709 - DNA, 22 bp, Artificial Sequence
  chemically synthesized
agatcttaaaagtaaagtaaca

SEQ ID NO: 1295710 - DNA, 22 bp, Artificial Sequence
  chemically synthesized
gatcttaaaagtaaagtaacaa

SEQ ID NO: 1295711 - DNA, 22 bp, Artificial Sequence
  chemically synthesized
aggtaagaatggtttgttactt

SEQ ID NO: 1295712 - DNA, 22 bp, Artificial Sequence
  chemically synthesized
taaggtaagaatggtttgttac

SEQ ID NO: 1295713 - DNA, 22 bp, Artificial Sequence
  chemically synthesized
ctaaggtaagaatggtttgtta

SEQ ID NO: 1295714 - DNA, 22 bp, Artificial Sequence
  chemically synthesized
tctaaggtaagaatggtttgtt

SEQ ID NO: 1295715 - DNA, 22 bp, Artificial Sequence
  chemically synthesized
aaaagtaaagtaacaaaccatt

SEQ ID NO: 1295716 - DNA, 22 bp, Artificial Sequence
  chemically synthesized
aaagtaaagtaacaaaccattc

SEQ ID NO: 1295717 - DNA, 22 bp, Artificial Sequence
  chemically synthesized
ttaccttagaaaattgtgcatt

SEQ ID NO: 1295718 - DNA, 22 bp, Artificial Sequence
  chemically synthesized
acaaaatgggtaaatgcacaat

SEQ ID NO: 1295719 - DNA, 22 bp, Artificial Sequence
  chemically synthesized
accttagaaaattgtgcattta

SEQ ID NO: 1295720 - DNA, 22 bp, Artificial Sequence
  chemically synthesized
ccttagaaaattgtgcatttac

SEQ ID NO: 1295721 - DNA, 22 bp, Artificial Sequence
  chemically synthesized
agaaaattgtgcatttacccat

SEQ ID NO: 1295722 - DNA, 22 bp, Artificial Sequence
  chemically synthesized
gaaaattgtgcatttacccatt

SEQ ID NO: 1295723 - DNA, 22 bp, Artificial Sequence
  chemically synthesized
aaaagaaaacattcacaaaatg

SEQ ID NO: 1295724 - DNA, 22 bp, Artificial Sequence
  chemically synthesized
tgcatttacccattttgtgaat

SEQ ID NO: 1295725 - DNA, 22 bp, Artificial Sequence
  chemically synthesized
acccattttgtgaatgttttct

SEQ ID NO: 1295726 - DNA, 22 bp, Artificial Sequence
  chemically synthesized
cccattttgtgaatgttttctt

SEQ ID NO: 1295727 - DNA, 22 bp, Artificial Sequence
  chemically synthesized
tgtgaatgttttcttttgaaca

SEQ ID NO: 1295728 - DNA, 22 bp, Artificial Sequence
  chemically synthesized
gtgaatgttttcttttgaacat

SEQ ID NO: 1295729 - DNA, 22 bp, Artificial Sequence
  chemically synthesized
tgaatgttttcttttgaacatc

SEQ ID NO: 1295730 - DNA, 22 bp, Artificial Sequence
  chemically synthesized
gatgaaagagaagatgttcaaa

SEQ ID NO: 1295731 - DNA, 22 bp, Artificial Sequence
  chemically synthesized
agatgaaagagaagatgttcaa

SEQ ID NO: 1295732 - DNA, 22 bp, Artificial Sequence
  chemically synthesized
tagatgaaagagaagatgttca

SEQ ID NO: 1295733 - DNA, 22 bp, Artificial Sequence
  chemically synthesized
cattttagatgaaagagaagat

SEQ ID NO: 1295734 - DNA, 22 bp, Artificial Sequence
  chemically synthesized
gcattttagatgaaagagaaga

SEQ ID NO: 1295735 - DNA, 22 bp, Artificial Sequence
  chemically synthesized
tcttttgaacatcttctctttc

SEQ ID NO: 1295736 - DNA, 22 bp, Artificial Sequence
  chemically synthesized
tgcattttagatgaaagagaag

SEQ ID NO: 1295737 - DNA, 22 bp, Artificial Sequence
  chemically synthesized
cttttgaacatcttctctttca

SEQ ID NO: 1295738 - DNA, 22 bp, Artificial Sequence
  chemically synthesized
ttttgaacatcttctctttcat

SEQ ID NO: 1295739 - DNA, 22 bp, Artificial Sequence
  chemically synthesized
ttttgcattttagatgaaagag

SEQ ID NO: 1295740 - DNA, 22 bp, Artificial Sequence
  chemically synthesized
ttgaacatcttctctttcatct

SEQ ID NO: 1295741 - DNA, 22 bp, Artificial Sequence
  chemically synthesized
attttgcattttagatgaaaga

SEQ ID NO: 1295742 - DNA, 22 bp, Artificial Sequence
  chemically synthesized
tgaacatcttctctttcatcta

SEQ ID NO: 1295743 - DNA, 22 bp, Artificial Sequence
  chemically synthesized
tattttgcattttagatgaaag

SEQ ID NO: 1295744 - DNA, 22 bp, Artificial Sequence
  chemically synthesized
gaacatcttctctttcatctaa

SEQ ID NO: 1295745 - DNA, 22 bp, Artificial Sequence
  chemically synthesized
ttattttgcattttagatgaaa

SEQ ID NO: 1295746 - DNA, 22 bp, Artificial Sequence
  chemically synthesized
aacatcttctctttcatctaaa

SEQ ID NO: 1295747 - DNA, 22 bp, Artificial Sequence
  chemically synthesized
tttattttgcattttagatgaa

SEQ ID NO: 1295748 - DNA, 22 bp, Artificial Sequence
  chemically synthesized
ttttattttgcattttagatga

SEQ ID NO: 1295749 - DNA, 22 bp, Artificial Sequence
  chemically synthesized
tttttttattttgcattttaga

SEQ ID NO: 1295750 - DNA, 22 bp, Artificial Sequence
  chemically synthesized
atttttttattttgcattttag

SEQ ID NO: 1295751 - DNA, 22 bp, Artificial Sequence
  chemically synthesized
tatttttttattttgcatttta

SEQ ID NO: 1295752 - DNA, 22 bp, Artificial Sequence
  chemically synthesized
ttatttttttattttgcatttt

SEQ ID NO: 1295753 - DNA, 22 bp, Artificial Sequence
  chemically synthesized
ctctttcatctaaaatgcaaaa

SEQ ID NO: 1295754 - DNA, 22 bp, Artificial Sequence
  chemically synthesized
tctttcatctaaaatgcaaaat

SEQ ID NO: 1295755 - DNA, 22 bp, Artificial Sequence
  chemically synthesized
tttcatctaaaatgcaaaataa

SEQ ID NO: 1295756 - DNA, 22 bp, Artificial Sequence
  chemically synthesized
acttttatttttttattttgca

SEQ ID NO: 1295757 - DNA, 22 bp, Artificial Sequence
  chemically synthesized
tcatctaaaatgcaaaataaaa

SEQ ID NO: 1295758 - DNA, 22 bp, Artificial Sequence
  chemically synthesized
catctaaaatgcaaaataaaaa

SEQ ID NO: 1295759 - DNA, 22 bp, Artificial Sequence
  chemically synthesized
ctaacttttatttttttatttt

SEQ ID NO: 1295760 - DNA, 22 bp, Artificial Sequence
  chemically synthesized
atctaaaatgcaaaataaaaaa

SEQ ID NO: 1295761 - DNA, 22 bp, Artificial Sequence
  chemically synthesized
cctaacttttatttttttattt

SEQ ID NO: 1295762 - DNA, 22 bp, Artificial Sequence
  chemically synthesized
cttcctaacttttattttttta

SEQ ID NO: 1295763 - DNA, 22 bp, Artificial Sequence
  chemically synthesized
aaatgcaaaataaaaaaataaa

SEQ ID NO: 1295764 - DNA, 22 bp, Artificial Sequence
  chemically synthesized
aagttgcttcctaacttttatt

SEQ ID NO: 1295765 - DNA, 22 bp, Artificial Sequence
  chemically synthesized
aaagttgcttcctaacttttat

SEQ ID NO: 1295766 - DNA, 22 bp, Artificial Sequence
  chemically synthesized
tatttaaagttgcttcctaact

SEQ ID NO: 1295767 - DNA, 22 bp, Artificial Sequence
  chemically synthesized
taaaatatgaattatatttaaa

SEQ ID NO: 1295768 - DNA, 22 bp, Artificial Sequence
  chemically synthesized
ggaagcaactttaaatataatt

SEQ ID NO: 1295769 - DNA, 22 bp, Artificial Sequence
  chemically synthesized
gttgtaaaatatgaattatatt

SEQ ID NO: 1295770 - DNA, 22 bp, Artificial Sequence
  chemically synthesized
ggttgtaaaatatgaattatat

SEQ ID NO: 1295771 - DNA, 22 bp, Artificial Sequence
  chemically synthesized
tggttgtaaaatatgaattata

SEQ ID NO: 1295772 - DNA, 22 bp, Artificial Sequence
  chemically synthesized
ctttggttgtaaaatatgaatt

SEQ ID NO: 1295773 - DNA, 22 bp, Artificial Sequence
  chemically synthesized
taaatataattcatattttaca

SEQ ID NO: 1295774 - DNA, 22 bp, Artificial Sequence
  chemically synthesized
aaatataattcatattttacaa

SEQ ID NO: 1295775 - DNA, 22 bp, Artificial Sequence
  chemically synthesized
aatataattcatattttacaac

SEQ ID NO: 1295776 - DNA, 22 bp, Artificial Sequence
  chemically synthesized
atattttacaaccaaagtaact

SEQ ID NO: 1295777 - DNA, 22 bp, Artificial Sequence
  chemically synthesized
acacatcataatggaaagttac

SEQ ID NO: 1295778 - DNA, 22 bp, Artificial Sequence
  chemically synthesized
tacaaccaaagtaactttccat

SEQ ID NO: 1295779 - DNA, 22 bp, Artificial Sequence
  chemically synthesized
acaaccaaagtaactttccatt

SEQ ID NO: 1295780 - DNA, 22 bp, Artificial Sequence
  chemically synthesized
caaccaaagtaactttccatta

SEQ ID NO: 1295781 - DNA, 22 bp, Artificial Sequence
  chemically synthesized
aatgtaaaaaaacactaacaca

SEQ ID NO: 1295782 - DNA, 22 bp, Artificial Sequence
  chemically synthesized
tccattatgatgtgttagtgtt

SEQ ID NO: 1295783 - DNA, 22 bp, Artificial Sequence
  chemically synthesized
ccattatgatgtgttagtgttt

SEQ ID NO: 1295784 - DNA, 22 bp, Artificial Sequence
  chemically synthesized
cattatgatgtgttagtgtttt

SEQ ID NO: 1295785 - DNA, 22 bp, Artificial Sequence
  chemically synthesized
tgatgtgttagtgtttttttac

SEQ ID NO: 1295786 - DNA, 22 bp, Artificial Sequence
  chemically synthesized
tcaatgaatgtaatactaaatg

SEQ ID NO: 1295787 - DNA, 22 bp, Artificial Sequence
  chemically synthesized
gtgtttttttacatttagtatt

SEQ ID NO: 1295788 - DNA, 22 bp, Artificial Sequence
  chemically synthesized
atcaatgaatgtaatactaaat

SEQ ID NO: 1295789 - DNA, 22 bp, Artificial Sequence
  chemically synthesized
catttatcaatgaatgtaatac

SEQ ID NO: 1295790 - DNA, 22 bp, Artificial Sequence
  chemically synthesized
ttttacatttagtattacattc

SEQ ID NO: 1295791 - DNA, 22 bp, Artificial Sequence
  chemically synthesized
tttacatttagtattacattca

SEQ ID NO: 1295792 - DNA, 22 bp, Artificial Sequence
  chemically synthesized
ttacatttagtattacattcat

SEQ ID NO: 1295793 - DNA, 22 bp, Artificial Sequence
  chemically synthesized
tacatttagtattacattcatt

SEQ ID NO: 1295794 - DNA, 22 bp, Artificial Sequence
  chemically synthesized
attccatttatcaatgaatgta

SEQ ID NO: 1295795 - DNA, 22 bp, Artificial Sequence
  chemically synthesized
acatttagtattacattcattg

SEQ ID NO: 1295796 - DNA, 22 bp, Artificial Sequence
  chemically synthesized
aattccatttatcaatgaatgt

SEQ ID NO: 1295797 - DNA, 22 bp, Artificial Sequence
  chemically synthesized
catttagtattacattcattga

SEQ ID NO: 1295798 - DNA, 22 bp, Artificial Sequence
  chemically synthesized
agtattacattcattgataaat

SEQ ID NO: 1295799 - DNA, 22 bp, Artificial Sequence
  chemically synthesized
atgtttaattccatttatcaat

SEQ ID NO: 1295800 - DNA, 22 bp, Artificial Sequence
  chemically synthesized
gtattacattcattgataaatg

SEQ ID NO: 1295801 - DNA, 22 bp, Artificial Sequence
  chemically synthesized
cattcattgataaatggaatta

SEQ ID NO: 1295802 - DNA, 22 bp, Artificial Sequence
  chemically synthesized
attgataaatggaattaaacat

SEQ ID NO: 1295803 - DNA, 22 bp, Artificial Sequence
  chemically synthesized
ataaatggaattaaacatgagt

SEQ ID NO: 1295804 - DNA, 22 bp, Artificial Sequence
  chemically synthesized
gatgccccaaaccagcatcact

SEQ ID NO: 1295805 - DNA, 22 bp, Artificial Sequence
  chemically synthesized
ggatgccccaaaccagcatcac

SEQ ID NO: 1295806 - DNA, 22 bp, Artificial Sequence
  chemically synthesized
atttggatgccccaaaccagca

SEQ ID NO: 1295807 - DNA, 22 bp, Artificial Sequence
  chemically synthesized
aacatgagtgatgctggtttgg

SEQ ID NO: 1295808 - DNA, 22 bp, Artificial Sequence
  chemically synthesized
aatttggatgccccaaaccagc

SEQ ID NO: 1295809 - DNA, 22 bp, Artificial Sequence
  chemically synthesized
taatttggatgccccaaaccag

SEQ ID NO: 1295810 - DNA, 22 bp, Artificial Sequence
  chemically synthesized
agaagtaattttaatttggatg

SEQ ID NO: 1295811 - DNA, 22 bp, Artificial Sequence
  chemically synthesized
cagaagtaattttaatttggat

SEQ ID NO: 1295812 - DNA, 22 bp, Artificial Sequence
  chemically synthesized
tcagaagtaattttaatttgga

SEQ ID NO: 1295813 - DNA, 22 bp, Artificial Sequence
  chemically synthesized
ttcagaagtaattttaatttgg

SEQ ID NO: 1295814 - DNA, 22 bp, Artificial Sequence
  chemically synthesized
gtttggggcatccaaattaaaa

SEQ ID NO: 1295815 - DNA, 22 bp, Artificial Sequence
  chemically synthesized
ggggcatccaaattaaaattac

SEQ ID NO: 1295816 - DNA, 22 bp, Artificial Sequence
  chemically synthesized
gggcatccaaattaaaattact

SEQ ID NO: 1295817 - DNA, 22 bp, Artificial Sequence
  chemically synthesized
gccatttttcagaagtaatttt

SEQ ID NO: 1295818 - DNA, 22 bp, Artificial Sequence
  chemically synthesized
aaattacttctgaaaaatggcc

SEQ ID NO: 1295819 - DNA, 22 bp, Artificial Sequence
  chemically synthesized
cttctgaaaaatggccaggcgc

SEQ ID NO: 1295820 - DNA, 22 bp, Artificial Sequence
  chemically synthesized
ctgaaaaatggccaggcgcggt

SEQ ID NO: 1295821 - DNA, 22 bp, Artificial Sequence
  chemically synthesized
tgaaaaatggccaggcgcggtg

SEQ ID NO: 1295822 - DNA, 22 bp, Artificial Sequence
  chemically synthesized
aaaaatggccaggcgcggtggc

SEQ ID NO: 1295823 - DNA, 22 bp, Artificial Sequence
  chemically synthesized
ggatcacaggcgtgagccaccg

SEQ ID NO: 1295824 - DNA, 22 bp, Artificial Sequence
  chemically synthesized
ttgggatcacaggcgtgagcca

SEQ ID NO: 1295825 - DNA, 22 bp, Artificial Sequence
  chemically synthesized
ccaaactgttgggatcacaggc

SEQ ID NO: 1295826 - DNA, 22 bp, Artificial Sequence
  chemically synthesized
gcctcccaaactgttgggatca

SEQ ID NO: 1295827 - DNA, 22 bp, Artificial Sequence
  chemically synthesized
actggcctcccaaactgttggg

SEQ ID NO: 1295828 - DNA, 22 bp, Artificial Sequence
  chemically synthesized
acgcctgtgatcccaacagttt

SEQ ID NO: 1295829 - DNA, 22 bp, Artificial Sequence
  chemically synthesized
tgatcccaacagtttgggaggc

SEQ ID NO: 1295830 - DNA, 22 bp, Artificial Sequence
  chemically synthesized
aagtgatccgtcctcactggcc

SEQ ID NO: 1295831 - DNA, 22 bp, Artificial Sequence
  chemically synthesized
gcctcaagtgatccgtcctcac

SEQ ID NO: 1295832 - DNA, 22 bp, Artificial Sequence
  chemically synthesized
gggaggccagtgaggacggatc

SEQ ID NO: 1295833 - DNA, 22 bp, Artificial Sequence
  chemically synthesized
ctggcctcaagtgatccgtcct

SEQ ID NO: 1295834 - DNA, 22 bp, Artificial Sequence
  chemically synthesized
ggaggccagtgaggacggatca

SEQ ID NO: 1295835 - DNA, 22 bp, Artificial Sequence
  chemically synthesized
aaactactggcctcaagtgatc

SEQ ID NO: 1295836 - DNA, 22 bp, Artificial Sequence
  chemically synthesized
gtctcaaactactggcctcaag

SEQ ID NO: 1295837 - DNA, 22 bp, Artificial Sequence
  chemically synthesized
gctggtctcaaactactggcct

SEQ ID NO: 1295838 - DNA, 22 bp, Artificial Sequence
  chemically synthesized
gcctggctggtctcaaactact

SEQ ID NO: 1295839 - DNA, 22 bp, Artificial Sequence
  chemically synthesized
gaggccagtagtttgagaccag

SEQ ID NO: 1295840 - DNA, 22 bp, Artificial Sequence
  chemically synthesized
aggccagtagtttgagaccagc

SEQ ID NO: 1295841 - DNA, 22 bp, Artificial Sequence
  chemically synthesized
gccatgttggcctggctggtct

SEQ ID NO: 1295842 - DNA, 22 bp, Artificial Sequence
  chemically synthesized
cgccatgttggcctggctggtc

SEQ ID NO: 1295843 - DNA, 22 bp, Artificial Sequence
  chemically synthesized
gagaccagccaggccaacatgg

SEQ ID NO: 1295844 - DNA, 22 bp, Artificial Sequence
  chemically synthesized
agaccagccaggccaacatggc

SEQ ID NO: 1295845 - DNA, 22 bp, Artificial Sequence
  chemically synthesized
agtagagatggggtttcgccat

SEQ ID NO: 1295846 - DNA, 22 bp, Artificial Sequence
  chemically synthesized
cagtagagatggggtttcgcca

SEQ ID NO: 1295847 - DNA, 22 bp, Artificial Sequence
  chemically synthesized
tcagtagagatggggtttcgcc

SEQ ID NO: 1295848 - DNA, 22 bp, Artificial Sequence
  chemically synthesized
tattttcagtagagatggggtt

SEQ ID NO: 1295849 - DNA, 22 bp, Artificial Sequence
  chemically synthesized
gtattttcagtagagatggggt

SEQ ID NO: 1295850 - DNA, 22 bp, Artificial Sequence
  chemically synthesized
tgtattttcagtagagatgggg

SEQ ID NO: 1295851 - DNA, 22 bp, Artificial Sequence
  chemically synthesized
ttgtattttcagtagagatggg

SEQ ID NO: 1295852 - DNA, 22 bp, Artificial Sequence
  chemically synthesized
atttttgtattttcagtagaga

SEQ ID NO: 1295853 - DNA, 22 bp, Artificial Sequence
  chemically synthesized
gctaatttttgtattttcagta

SEQ ID NO: 1295854 - DNA, 22 bp, Artificial Sequence
  chemically synthesized
tactgaaaatacaaaaattagc

SEQ ID NO: 1295855 - DNA, 22 bp, Artificial Sequence
  chemically synthesized
ctgaaaatacaaaaattagcca

SEQ ID NO: 1295856 - DNA, 22 bp, Artificial Sequence
  chemically synthesized
aaaatacaaaaattagccaggc

SEQ ID NO: 1295857 - DNA, 22 bp, Artificial Sequence
  chemically synthesized
caggtgcatgccaccatgcctg

SEQ ID NO: 1295858 - DNA, 22 bp, Artificial Sequence
  chemically synthesized
ggattacaggtgcatgccacca

SEQ ID NO: 1295859 - DNA, 22 bp, Artificial Sequence
  chemically synthesized
gccaggcatggtggcatgcacc

SEQ ID NO: 1295860 - DNA, 22 bp, Artificial Sequence
  chemically synthesized
ccaagtagctgggattacaggt

SEQ ID NO: 1295861 - DNA, 22 bp, Artificial Sequence
  chemically synthesized
agcctcccaagtagctgggatt

SEQ ID NO: 1295862 - DNA, 22 bp, Artificial Sequence
  chemically synthesized
cctcagcctcccaagtagctgg

SEQ ID NO: 1295863 - DNA, 22 bp, Artificial Sequence
  chemically synthesized
ctgcctcagcctcccaagtagc

SEQ ID NO: 1295864 - DNA, 22 bp, Artificial Sequence
  chemically synthesized
tcctgcctcagcctcccaagta

SEQ ID NO: 1295865 - DNA, 22 bp, Artificial Sequence
  chemically synthesized
taatcccagctacttgggaggc

SEQ ID NO: 1295866 - DNA, 22 bp, Artificial Sequence
  chemically synthesized
aaatgattctcctgcctcagcc

SEQ ID NO: 1295867 - DNA, 22 bp, Artificial Sequence
  chemically synthesized
cttgggaggctgaggcaggaga

SEQ ID NO: 1295868 - DNA, 22 bp, Artificial Sequence
  chemically synthesized
gattcaaatgattctcctgcct

SEQ ID NO: 1295869 - DNA, 22 bp, Artificial Sequence
  chemically synthesized
gggaggctgaggcaggagaatc

SEQ ID NO: 1295870 - DNA, 22 bp, Artificial Sequence
  chemically synthesized
ctggattcaaatgattctcctg

SEQ ID NO: 1295871 - DNA, 22 bp, Artificial Sequence
  chemically synthesized
ggaggctgaggcaggagaatca

SEQ ID NO: 1295872 - DNA, 22 bp, Artificial Sequence
  chemically synthesized
cacctcctggattcaaatgatt

SEQ ID NO: 1295873 - DNA, 22 bp, Artificial Sequence
  chemically synthesized
aggcaggagaatcatttgaatc

SEQ ID NO: 1295874 - DNA, 22 bp, Artificial Sequence
  chemically synthesized
caacctccacctcctggattca

SEQ ID NO: 1295875 - DNA, 22 bp, Artificial Sequence
  chemically synthesized
actgcaacctccacctcctgga

SEQ ID NO: 1295876 - DNA, 22 bp, Artificial Sequence
  chemically synthesized
ggctcactgcaacctccacctc

SEQ ID NO: 1295877 - DNA, 22 bp, Artificial Sequence
  chemically synthesized
gaatccaggaggtggaggttgc

SEQ ID NO: 1295878 - DNA, 22 bp, Artificial Sequence
  chemically synthesized
aatccaggaggtggaggttgca

SEQ ID NO: 1295879 - DNA, 22 bp, Artificial Sequence
  chemically synthesized
gagtgcagtgccatgatctcgg

SEQ ID NO: 1295880 - DNA, 22 bp, Artificial Sequence
  chemically synthesized
cagtgagccgagatcatggcac

SEQ ID NO: 1295881 - DNA, 22 bp, Artificial Sequence
  chemically synthesized
tcgcccacgctggagtgcagtg

SEQ ID NO: 1295882 - DNA, 22 bp, Artificial Sequence
  chemically synthesized
tgtcgcccacgctggagtgcag

SEQ ID NO: 1295883 - DNA, 22 bp, Artificial Sequence
  chemically synthesized
ctctgtcgcccacgctggagtg

SEQ ID NO: 1295884 - DNA, 22 bp, Artificial Sequence
  chemically synthesized
gctctgtcgcccacgctggagt

SEQ ID NO: 1295885 - DNA, 22 bp, Artificial Sequence
  chemically synthesized
cactccagcgtgggcgacagag

SEQ ID NO: 1295886 - DNA, 22 bp, Artificial Sequence
  chemically synthesized
aggcgggatcttgctctgtcgc

SEQ ID NO: 1295887 - DNA, 22 bp, Artificial Sequence
  chemically synthesized
cagcgtgggcgacagagcaaga

SEQ ID NO: 1295888 - DNA, 22 bp, Artificial Sequence
  chemically synthesized
caaatctgaggcgggatcttgc

SEQ ID NO: 1295889 - DNA, 22 bp, Artificial Sequence
  chemically synthesized
agatattacaaatctgaggcgg

SEQ ID NO: 1295890 - DNA, 22 bp, Artificial Sequence
  chemically synthesized
cagatattacaaatctgaggcg

SEQ ID NO: 1295891 - DNA, 22 bp, Artificial Sequence
  chemically synthesized
tcagatattacaaatctgaggc

SEQ ID NO: 1295892 - DNA, 22 bp, Artificial Sequence
  chemically synthesized
ttcagatattacaaatctgagg

SEQ ID NO: 1295893 - DNA, 22 bp, Artificial Sequence
  chemically synthesized
tttttcagatattacaaatctg

SEQ ID NO: 1295894 - DNA, 22 bp, Artificial Sequence
  chemically synthesized
attgtttttcagatattacaaa

SEQ ID NO: 1295895 - DNA, 22 bp, Artificial Sequence
  chemically synthesized
agatttgtaatatctgaaaaac

SEQ ID NO: 1295896 - DNA, 22 bp, Artificial Sequence
  chemically synthesized
gtcatattaattgtttttcaga

SEQ ID NO: 1295897 - DNA, 22 bp, Artificial Sequence
  chemically synthesized
ggtcatattaattgtttttcag

SEQ ID NO: 1295898 - DNA, 22 bp, Artificial Sequence
  chemically synthesized
gtaatatctgaaaaacaattaa

SEQ ID NO: 1295899 - DNA, 22 bp, Artificial Sequence
  chemically synthesized
taatatctgaaaaacaattaat

SEQ ID NO: 1295900 - DNA, 22 bp, Artificial Sequence
  chemically synthesized
tgggtttggtcatattaattgt

SEQ ID NO: 1295901 - DNA, 22 bp, Artificial Sequence
  chemically synthesized
aaaaacaattaatatgaccaaa

SEQ ID NO: 1295902 - DNA, 22 bp, Artificial Sequence
  chemically synthesized
aacgactatgggtttggtcata

SEQ ID NO: 1295903 - DNA, 22 bp, Artificial Sequence
  chemically synthesized
gaacgactatgggtttggtcat

SEQ ID NO: 1295904 - DNA, 22 bp, Artificial Sequence
  chemically synthesized
atatgaccaaacccatagtcgt

SEQ ID NO: 1295905 - DNA, 22 bp, Artificial Sequence
  chemically synthesized
taatcatacagtatttgaacga

SEQ ID NO: 1295906 - DNA, 22 bp, Artificial Sequence
  chemically synthesized
ataatcatacagtatttgaacg

SEQ ID NO: 1295907 - DNA, 22 bp, Artificial Sequence
  chemically synthesized
tataatcatacagtatttgaac

SEQ ID NO: 1295908 - DNA, 22 bp, Artificial Sequence
  chemically synthesized
ttataatcatacagtatttgaa

SEQ ID NO: 1295909 - DNA, 22 bp, Artificial Sequence
  chemically synthesized
tttataatcatacagtatttga

SEQ ID NO: 1295910 - DNA, 22 bp, Artificial Sequence
  chemically synthesized
ttttataatcatacagtatttg

SEQ ID NO: 1295911 - DNA, 22 bp, Artificial Sequence
  chemically synthesized
tttttttataatcatacagtat

SEQ ID NO: 1295912 - DNA, 22 bp, Artificial Sequence
  chemically synthesized
aaatactgtatgattataaaaa

SEQ ID NO: 1295913 - DNA, 22 bp, Artificial Sequence
  chemically synthesized
agaggagactatttttttataa

SEQ ID NO: 1295914 - DNA, 22 bp, Artificial Sequence
  chemically synthesized
ttcagaggagactattttttta

SEQ ID NO: 1295915 - DNA, 22 bp, Artificial Sequence
  chemically synthesized
ttattcagaggagactattttt

SEQ ID NO: 1295916 - DNA, 22 bp, Artificial Sequence
  chemically synthesized
tatgattataaaaaaatagtct

SEQ ID NO: 1295917 - DNA, 22 bp, Artificial Sequence
  chemically synthesized
taaaaaaatagtctcctctgaa

SEQ ID NO: 1295918 - DNA, 22 bp, Artificial Sequence
  chemically synthesized
gcgaataaatactgttattcag

SEQ ID NO: 1295919 - DNA, 22 bp, Artificial Sequence
  chemically synthesized
ataactggcgaataaatactgt

SEQ ID NO: 1295920 - DNA, 22 bp, Artificial Sequence
  chemically synthesized
ctctgaataacagtatttattc

SEQ ID NO: 1295921 - DNA, 22 bp, Artificial Sequence
  chemically synthesized
ttcataactggcgaataaatac

SEQ ID NO: 1295922 - DNA, 22 bp, Artificial Sequence
  chemically synthesized
tgaataacagtatttattcgcc

SEQ ID NO: 1295923 - DNA, 22 bp, Artificial Sequence
  chemically synthesized
aataacagtatttattcgccag

SEQ ID NO: 1295924 - DNA, 22 bp, Artificial Sequence
  chemically synthesized
gagtatctattcataactggcg

SEQ ID NO: 1295925 - DNA, 22 bp, Artificial Sequence
  chemically synthesized
tactggagtatctattcataac

SEQ ID NO: 1295926 - DNA, 22 bp, Artificial Sequence
  chemically synthesized
attcgccagttatgaatagata

SEQ ID NO: 1295927 - DNA, 22 bp, Artificial Sequence
  chemically synthesized
attatactggagtatctattca

SEQ ID NO: 1295928 - DNA, 22 bp, Artificial Sequence
  chemically synthesized
ttcgccagttatgaatagatac

SEQ ID NO: 1295929 - DNA, 22 bp, Artificial Sequence
  chemically synthesized
aattatactggagtatctattc

SEQ ID NO: 1295930 - DNA, 22 bp, Artificial Sequence
  chemically synthesized
taattatactggagtatctatt

SEQ ID NO: 1295931 - DNA, 22 bp, Artificial Sequence
  chemically synthesized
ttaattatactggagtatctat

SEQ ID NO: 1295932 - DNA, 22 bp, Artificial Sequence
  chemically synthesized
gccagttatgaatagatactcc

SEQ ID NO: 1295933 - DNA, 22 bp, Artificial Sequence
  chemically synthesized
ttttaattatactggagtatct

SEQ ID NO: 1295934 - DNA, 22 bp, Artificial Sequence
  chemically synthesized
cttttaattatactggagtatc

SEQ ID NO: 1295935 - DNA, 22 bp, Artificial Sequence
  chemically synthesized
tgaatagatactccagtataat

SEQ ID NO: 1295936 - DNA, 22 bp, Artificial Sequence
  chemically synthesized
agagtttcttttaattatactg

SEQ ID NO: 1295937 - DNA, 22 bp, Artificial Sequence
  chemically synthesized
cagtataattaaaagaaactct

SEQ ID NO: 1295938 - DNA, 22 bp, Artificial Sequence
  chemically synthesized
ggagtaaatgacagctgagagt

SEQ ID NO: 1295939 - DNA, 22 bp, Artificial Sequence
  chemically synthesized
cggagtaaatgacagctgagag

SEQ ID NO: 1295940 - DNA, 22 bp, Artificial Sequence
  chemically synthesized
tcggagtaaatgacagctgaga

SEQ ID NO: 1295941 - DNA, 22 bp, Artificial Sequence
  chemically synthesized
ttcggagtaaatgacagctgag

SEQ ID NO: 1295942 - DNA, 22 bp, Artificial Sequence
  chemically synthesized
aaagaaactctcagctgtcatt

SEQ ID NO: 1295943 - DNA, 22 bp, Artificial Sequence
  chemically synthesized
cgaaatagtttttcggagtaaa

SEQ ID NO: 1295944 - DNA, 22 bp, Artificial Sequence
  chemically synthesized
tcagctgtcatttactccgaaa

SEQ ID NO: 1295945 - DNA, 22 bp, Artificial Sequence
  chemically synthesized
agctgtcatttactccgaaaaa

SEQ ID NO: 1295946 - DNA, 22 bp, Artificial Sequence
  chemically synthesized
tcatttactccgaaaaactatt

SEQ ID NO: 1295947 - DNA, 22 bp, Artificial Sequence
  chemically synthesized
actccgaaaaactatttcggag

SEQ ID NO: 1295948 - DNA, 22 bp, Artificial Sequence
  chemically synthesized
ctccgaaaaactatttcggagc

SEQ ID NO: 1295949 - DNA, 22 bp, Artificial Sequence
  chemically synthesized
cgaaaaactatttcggagcctt

SEQ ID NO: 1295950 - DNA, 22 bp, Artificial Sequence
  chemically synthesized
ggtggatggcatggggaaaggc

SEQ ID NO: 1295951 - DNA, 22 bp, Artificial Sequence
  chemically synthesized
tttcggagcctttccccatgcc

SEQ ID NO: 1295952 - DNA, 22 bp, Artificial Sequence
  chemically synthesized
cggagcctttccccatgccatc

SEQ ID NO: 1295953 - DNA, 22 bp, Artificial Sequence
  chemically synthesized
catggttgggtggatggcatgg

SEQ ID NO: 1295954 - DNA, 22 bp, Artificial Sequence
  chemically synthesized
ggagcctttccccatgccatcc

SEQ ID NO: 1295955 - DNA, 22 bp, Artificial Sequence
  chemically synthesized
tccatggttgggtggatggcat

SEQ ID NO: 1295956 - DNA, 22 bp, Artificial Sequence
  chemically synthesized
ctccatggttgggtggatggca

SEQ ID NO: 1295957 - DNA, 22 bp, Artificial Sequence
  chemically synthesized
tccccatgccatccacccaacc

SEQ ID NO: 1295958 - DNA, 22 bp, Artificial Sequence
  chemically synthesized
ccccatgccatccacccaacca

SEQ ID NO: 1295959 - DNA, 22 bp, Artificial Sequence
  chemically synthesized
cccatgccatccacccaaccat

SEQ ID NO: 1295960 - DNA, 22 bp, Artificial Sequence
  chemically synthesized
caaaggaaggaataatcatttc

SEQ ID NO: 1295961 - DNA, 22 bp, Artificial Sequence
  chemically synthesized
gagtatgtagatgctgcaaagg

SEQ ID NO: 1295962 - DNA, 22 bp, Artificial Sequence
  chemically synthesized
ttccttcctttgcagcatctac

SEQ ID NO: 1295963 - DNA, 22 bp, Artificial Sequence
  chemically synthesized
cttcctttgcagcatctacata

SEQ ID NO: 1295964 - DNA, 22 bp, Artificial Sequence
  chemically synthesized
cctttgcagcatctacatactc

SEQ ID NO: 1295965 - DNA, 22 bp, Artificial Sequence
  chemically synthesized
ctttgcagcatctacatactct

SEQ ID NO: 1295966 - DNA, 22 bp, Artificial Sequence
  chemically synthesized
tgcagcatctacatactctaac

SEQ ID NO: 1295967 - DNA, 22 bp, Artificial Sequence
  chemically synthesized
gcagcatctacatactctaaca

SEQ ID NO: 1295968 - DNA, 22 bp, Artificial Sequence
  chemically synthesized
cagcatctacatactctaacat

SEQ ID NO: 1295969 - DNA, 22 bp, Artificial Sequence
  chemically synthesized
catagtgagatcaggcccatgt

SEQ ID NO: 1295970 - DNA, 22 bp, Artificial Sequence
  chemically synthesized
ccatagtgagatcaggcccatg

SEQ ID NO: 1295971 - DNA, 22 bp, Artificial Sequence
  chemically synthesized
catactctaacatgggcctgat

SEQ ID NO: 1295972 - DNA, 22 bp, Artificial Sequence
  chemically synthesized
ttccatagtgagatcaggccca

SEQ ID NO: 1295973 - DNA, 22 bp, Artificial Sequence
  chemically synthesized
taacatgggcctgatctcacta

SEQ ID NO: 1295974 - DNA, 22 bp, Artificial Sequence
  chemically synthesized
acatgggcctgatctcactatg

SEQ ID NO: 1295975 - DNA, 22 bp, Artificial Sequence
  chemically synthesized
atcaggaaacctcttccatagt

SEQ ID NO: 1295976 - DNA, 22 bp, Artificial Sequence
  chemically synthesized
ctcatcaggaaacctcttccat

SEQ ID NO: 1295977 - DNA, 22 bp, Artificial Sequence
  chemically synthesized
ctgctcatcaggaaacctcttc

SEQ ID NO: 1295978 - DNA, 22 bp, Artificial Sequence
  chemically synthesized
atctcactatggaagaggtttc

SEQ ID NO: 1295979 - DNA, 22 bp, Artificial Sequence
  chemically synthesized
actatggaagaggtttcctgat

SEQ ID NO: 1295980 - DNA, 22 bp, Artificial Sequence
  chemically synthesized
tggaagaggtttcctgatgagc

SEQ ID NO: 1295981 - DNA, 22 bp, Artificial Sequence
  chemically synthesized
aaccatgctcctgctcatcagg

SEQ ID NO: 1295982 - DNA, 22 bp, Artificial Sequence
  chemically synthesized
cctgatgagcaggagcatggtt

SEQ ID NO: 1295983 - DNA, 22 bp, Artificial Sequence
  chemically synthesized
ctgatgagcaggagcatggttt

SEQ ID NO: 1295984 - DNA, 22 bp, Artificial Sequence
  chemically synthesized
atgagcaggagcatggtttagt

SEQ ID NO: 1295985 - DNA, 22 bp, Artificial Sequence
  chemically synthesized
ggaagcaaagataactaaacca

SEQ ID NO: 1295986 - DNA, 22 bp, Artificial Sequence
  chemically synthesized
tgggaagcaaagataactaaac

SEQ ID NO: 1295987 - DNA, 22 bp, Artificial Sequence
  chemically synthesized
agttctgggaagcaaagataac

SEQ ID NO: 1295988 - DNA, 22 bp, Artificial Sequence
  chemically synthesized
agttatctttgcttcccagaac

SEQ ID NO: 1295989 - DNA, 22 bp, Artificial Sequence
  chemically synthesized
gttatctttgcttcccagaact

SEQ ID NO: 1295990 - DNA, 22 bp, Artificial Sequence
  chemically synthesized
agacagtgtgctaagttctggg

SEQ ID NO: 1295991 - DNA, 22 bp, Artificial Sequence
  chemically synthesized
tctttgcttcccagaacttagc

SEQ ID NO: 1295992 - DNA, 22 bp, Artificial Sequence
  chemically synthesized
ttcagacagtgtgctaagttct

SEQ ID NO: 1295993 - DNA, 22 bp, Artificial Sequence
  chemically synthesized
gttcagacagtgtgctaagttc

SEQ ID NO: 1295994 - DNA, 22 bp, Artificial Sequence
  chemically synthesized
tgcttcccagaacttagcacac

SEQ ID NO: 1295995 - DNA, 22 bp, Artificial Sequence
  chemically synthesized
gcttcccagaacttagcacact

SEQ ID NO: 1295996 - DNA, 22 bp, Artificial Sequence
  chemically synthesized
atttgttcagacagtgtgctaa

SEQ ID NO: 1295997 - DNA, 22 bp, Artificial Sequence
  chemically synthesized
cttcccagaacttagcacactg

SEQ ID NO: 1295998 - DNA, 22 bp, Artificial Sequence
  chemically synthesized
aatttgttcagacagtgtgcta

SEQ ID NO: 1295999 - DNA, 22 bp, Artificial Sequence
  chemically synthesized
ttaatttgttcagacagtgtgc

SEQ ID NO: 1296000 - DNA, 22 bp, Artificial Sequence
  chemically synthesized
cccagaacttagcacactgtct

SEQ ID NO: 1296001 - DNA, 22 bp, Artificial Sequence
  chemically synthesized
ccagaacttagcacactgtctg

SEQ ID NO: 1296002 - DNA, 22 bp, Artificial Sequence
  chemically synthesized
agctcttaatttgttcagacag

SEQ ID NO: 1296003 - DNA, 22 bp, Artificial Sequence
  chemically synthesized
tgagctcttaatttgttcagac

SEQ ID NO: 1296004 - DNA, 22 bp, Artificial Sequence
  chemically synthesized
ctgagctcttaatttgttcaga

SEQ ID NO: 1296005 - DNA, 22 bp, Artificial Sequence
  chemically synthesized
tctgagctcttaatttgttcag

SEQ ID NO: 1296006 - DNA, 22 bp, Artificial Sequence
  chemically synthesized
agcacactgtctgaacaaatta

SEQ ID NO: 1296007 - DNA, 22 bp, Artificial Sequence
  chemically synthesized
gcacactgtctgaacaaattaa

SEQ ID NO: 1296008 - DNA, 22 bp, Artificial Sequence
  chemically synthesized
tctgaacaaattaagagctcag

SEQ ID NO: 1296009 - DNA, 22 bp, Artificial Sequence
  chemically synthesized
tcagatgtattttctgagctct

SEQ ID NO: 1296010 - DNA, 22 bp, Artificial Sequence
  chemically synthesized
gtcagatgtattttctgagctc

SEQ ID NO: 1296011 - DNA, 22 bp, Artificial Sequence
  chemically synthesized
aacaaattaagagctcagaaaa

SEQ ID NO: 1296012 - DNA, 22 bp, Artificial Sequence
  chemically synthesized
agagctcagaaaatacatctga

SEQ ID NO: 1296013 - DNA, 22 bp, Artificial Sequence
  chemically synthesized
aagcatgcacgtatttgtcaga

SEQ ID NO: 1296014 - DNA, 22 bp, Artificial Sequence
  chemically synthesized
aaagcatgcacgtatttgtcag

SEQ ID NO: 1296015 - DNA, 22 bp, Artificial Sequence
  chemically synthesized
agaaaatacatctgacaaatac

SEQ ID NO: 1296016 - DNA, 22 bp, Artificial Sequence
  chemically synthesized
cttaaagcatgcacgtatttgt

SEQ ID NO: 1296017 - DNA, 22 bp, Artificial Sequence
  chemically synthesized
ccttaaagcatgcacgtatttg

SEQ ID NO: 1296018 - DNA, 22 bp, Artificial Sequence
  chemically synthesized
cccttccttaaagcatgcacgt

SEQ ID NO: 1296019 - DNA, 22 bp, Artificial Sequence
  chemically synthesized
acaaatacgtgcatgctttaag

SEQ ID NO: 1296020 - DNA, 22 bp, Artificial Sequence
  chemically synthesized
tagaatctccccttccttaaag

SEQ ID NO: 1296021 - DNA, 22 bp, Artificial Sequence
  chemically synthesized
gagttgtagaatctccccttcc

SEQ ID NO: 1296022 - DNA, 22 bp, Artificial Sequence
  chemically synthesized
agagttgtagaatctccccttc

SEQ ID NO: 1296023 - DNA, 22 bp, Artificial Sequence
  chemically synthesized
tagagttgtagaatctcccctt

SEQ ID NO: 1296024 - DNA, 22 bp, Artificial Sequence
  chemically synthesized
taaggaaggggagattctacaa

SEQ ID NO: 1296025 - DNA, 22 bp, Artificial Sequence
  chemically synthesized
gaaattttagagttgtagaatc

SEQ ID NO: 1296026 - DNA, 22 bp, Artificial Sequence
  chemically synthesized
aaggaaggggagattctacaac

SEQ ID NO: 1296027 - DNA, 22 bp, Artificial Sequence
  chemically synthesized
aggaaggggagattctacaact

SEQ ID NO: 1296028 - DNA, 22 bp, Artificial Sequence
  chemically synthesized
tacaactctaaaatttctagga

SEQ ID NO: 1296029 - DNA, 22 bp, Artificial Sequence
  chemically synthesized
gatgaaaagaggtcctagaaat

SEQ ID NO: 1296030 - DNA, 22 bp, Artificial Sequence
  chemically synthesized
agatgaaaagaggtcctagaaa

SEQ ID NO: 1296031 - DNA, 22 bp, Artificial Sequence
  chemically synthesized
caactctaaaatttctaggacc

SEQ ID NO: 1296032 - DNA, 22 bp, Artificial Sequence
  chemically synthesized
tagatgaaaagaggtcctagaa

SEQ ID NO: 1296033 - DNA, 22 bp, Artificial Sequence
  chemically synthesized
ttagatgaaaagaggtcctaga

SEQ ID NO: 1296034 - DNA, 22 bp, Artificial Sequence
  chemically synthesized
acttttagatgaaaagaggtcc

SEQ ID NO: 1296035 - DNA, 22 bp, Artificial Sequence
  chemically synthesized
taaaatttctaggacctctttt

SEQ ID NO: 1296036 - DNA, 22 bp, Artificial Sequence
  chemically synthesized
tgacttttagatgaaaagaggt

SEQ ID NO: 1296037 - DNA, 22 bp, Artificial Sequence
  chemically synthesized
aaatttctaggacctcttttca

SEQ ID NO: 1296038 - DNA, 22 bp, Artificial Sequence
  chemically synthesized
ctaggacctcttttcatctaaa

SEQ ID NO: 1296039 - DNA, 22 bp, Artificial Sequence
  chemically synthesized
taggacctcttttcatctaaaa

SEQ ID NO: 1296040 - DNA, 22 bp, Artificial Sequence
  chemically synthesized
aaatgttctgacttttagatga

SEQ ID NO: 1296041 - DNA, 22 bp, Artificial Sequence
  chemically synthesized
gaaatgttctgacttttagatg

SEQ ID NO: 1296042 - DNA, 22 bp, Artificial Sequence
  chemically synthesized
ggacctcttttcatctaaaagt

SEQ ID NO: 1296043 - DNA, 22 bp, Artificial Sequence
  chemically synthesized
tttgaaatgttctgacttttag

SEQ ID NO: 1296044 - DNA, 22 bp, Artificial Sequence
  chemically synthesized
atttgaaatgttctgactttta

SEQ ID NO: 1296045 - DNA, 22 bp, Artificial Sequence
  chemically synthesized
tatttgaaatgttctgactttt

SEQ ID NO: 1296046 - DNA, 22 bp, Artificial Sequence
  chemically synthesized
ttatttgaaatgttctgacttt

SEQ ID NO: 1296047 - DNA, 22 bp, Artificial Sequence
  chemically synthesized
ttttcatctaaaagtcagaaca

SEQ ID NO: 1296048 - DNA, 22 bp, Artificial Sequence
  chemically synthesized
ttcatctaaaagtcagaacatt

SEQ ID NO: 1296049 - DNA, 22 bp, Artificial Sequence
  chemically synthesized
tcatctaaaagtcagaacattt

SEQ ID NO: 1296050 - DNA, 22 bp, Artificial Sequence
  chemically synthesized
catttttatttgaaatgttctg

SEQ ID NO: 1296051 - DNA, 22 bp, Artificial Sequence
  chemically synthesized
catctaaaagtcagaacatttc

SEQ ID NO: 1296052 - DNA, 22 bp, Artificial Sequence
  chemically synthesized
gcatttttatttgaaatgttct

SEQ ID NO: 1296053 - DNA, 22 bp, Artificial Sequence
  chemically synthesized
atctaaaagtcagaacatttca

SEQ ID NO: 1296054 - DNA, 22 bp, Artificial Sequence
  chemically synthesized
aaagtcagaacatttcaaataa

SEQ ID NO: 1296055 - DNA, 22 bp, Artificial Sequence
  chemically synthesized
caaataaaaatgcaaatgatac

SEQ ID NO: 1296056 - DNA, 22 bp, Artificial Sequence
  chemically synthesized
aaataaaaatgcaaatgatact

SEQ ID NO: 1296057 - DNA, 22 bp, Artificial Sequence
  chemically synthesized
tatgtaaggcatgaagagtatc

SEQ ID NO: 1296058 - DNA, 22 bp, Artificial Sequence
  chemically synthesized
atatgtaaggcatgaagagtat

SEQ ID NO: 1296059 - DNA, 22 bp, Artificial Sequence
  chemically synthesized
agtatttatatgtaaggcatga

SEQ ID NO: 1296060 - DNA, 22 bp, Artificial Sequence
  chemically synthesized
gagtatttatatgtaaggcatg

SEQ ID NO: 1296061 - DNA, 22 bp, Artificial Sequence
  chemically synthesized
tgagtatttatatgtaaggcat

SEQ ID NO: 1296062 - DNA, 22 bp, Artificial Sequence
  chemically synthesized
tttgagtatttatatgtaaggc

SEQ ID NO: 1296063 - DNA, 22 bp, Artificial Sequence
  chemically synthesized
ctttgagtatttatatgtaagg

SEQ ID NO: 1296064 - DNA, 22 bp, Artificial Sequence
  chemically synthesized
tctttgagtatttatatgtaag

SEQ ID NO: 1296065 - DNA, 22 bp, Artificial Sequence
  chemically synthesized
ttctttgagtatttatatgtaa

SEQ ID NO: 1296066 - DNA, 22 bp, Artificial Sequence
  chemically synthesized
tttctttgagtatttatatgta

SEQ ID NO: 1296067 - DNA, 22 bp, Artificial Sequence
  chemically synthesized
ttttctttgagtatttatatgt

SEQ ID NO: 1296068 - DNA, 22 bp, Artificial Sequence
  chemically synthesized
ttcatgccttacatataaatac

SEQ ID NO: 1296069 - DNA, 22 bp, Artificial Sequence
  chemically synthesized
catgccttacatataaatactc

SEQ ID NO: 1296070 - DNA, 22 bp, Artificial Sequence
  chemically synthesized
atgccttacatataaatactca

SEQ ID NO: 1296071 - DNA, 22 bp, Artificial Sequence
  chemically synthesized
gggacttttttctttgagtatt

SEQ ID NO: 1296072 - DNA, 22 bp, Artificial Sequence
  chemically synthesized
ggggacttttttctttgagtat

SEQ ID NO: 1296073 - DNA, 22 bp, Artificial Sequence
  chemically synthesized
tggggacttttttctttgagta

SEQ ID NO: 1296074 - DNA, 22 bp, Artificial Sequence
  chemically synthesized
acatataaatactcaaagaaaa

SEQ ID NO: 1296075 - DNA, 22 bp, Artificial Sequence
  chemically synthesized
catataaatactcaaagaaaaa

SEQ ID NO: 1296076 - DNA, 22 bp, Artificial Sequence
  chemically synthesized
gtataaatctttggggactttt

SEQ ID NO: 1296077 - DNA, 22 bp, Artificial Sequence
  chemically synthesized
agtataaatctttggggacttt

SEQ ID NO: 1296078 - DNA, 22 bp, Artificial Sequence
  chemically synthesized
aaagaaaaaagtccccaaagat

SEQ ID NO: 1296079 - DNA, 22 bp, Artificial Sequence
  chemically synthesized
atcccttagtataaatctttgg

SEQ ID NO: 1296080 - DNA, 22 bp, Artificial Sequence
  chemically synthesized
cctaatcccttagtataaatct

SEQ ID NO: 1296081 - DNA, 22 bp, Artificial Sequence
  chemically synthesized
tccctaatcccttagtataaat

SEQ ID NO: 1296082 - DNA, 22 bp, Artificial Sequence
  chemically synthesized
ctccctaatcccttagtataaa

SEQ ID NO: 1296083 - DNA, 22 bp, Artificial Sequence
  chemically synthesized
tctccctaatcccttagtataa

SEQ ID NO: 1296084 - DNA, 22 bp, Artificial Sequence
  chemically synthesized
ttctccctaatcccttagtata

SEQ ID NO: 1296085 - DNA, 22 bp, Artificial Sequence
  chemically synthesized
ataatttttctccctaatccct

SEQ ID NO: 1296086 - DNA, 22 bp, Artificial Sequence
  chemically synthesized
aataatttttctccctaatccc

SEQ ID NO: 1296087 - DNA, 22 bp, Artificial Sequence
  chemically synthesized
taataatttttctccctaatcc

SEQ ID NO: 1296088 - DNA, 22 bp, Artificial Sequence
  chemically synthesized
ttaataatttttctccctaatc

SEQ ID NO: 1296089 - DNA, 22 bp, Artificial Sequence
  chemically synthesized
tttaataatttttctccctaat

SEQ ID NO: 1296090 - DNA, 22 bp, Artificial Sequence
  chemically synthesized
atactaagggattagggagaaa

SEQ ID NO: 1296091 - DNA, 22 bp, Artificial Sequence
  chemically synthesized
tactaagggattagggagaaaa

SEQ ID NO: 1296092 - DNA, 22 bp, Artificial Sequence
  chemically synthesized
ttttttaataatttttctccct

SEQ ID NO: 1296093 - DNA, 22 bp, Artificial Sequence
  chemically synthesized
agggattagggagaaaaattat

SEQ ID NO: 1296094 - DNA, 22 bp, Artificial Sequence
  chemically synthesized
agtgaagctgttttttaataat

SEQ ID NO: 1296095 - DNA, 22 bp, Artificial Sequence
  chemically synthesized
gggagaaaaattattaaaaaac

SEQ ID NO: 1296096 - DNA, 22 bp, Artificial Sequence
  chemically synthesized
tagaagcatgaattcagtgaag

SEQ ID NO: 1296097 - DNA, 22 bp, Artificial Sequence
  chemically synthesized
ttaaaaaacagcttcactgaat

SEQ ID NO: 1296098 - DNA, 22 bp, Artificial Sequence
  chemically synthesized
gtagaagcatgaattcagtgaa

SEQ ID NO: 1296099 - DNA, 22 bp, Artificial Sequence
  chemically synthesized
aaaaacagcttcactgaattca

SEQ ID NO: 1296100 - DNA, 22 bp, Artificial Sequence
  chemically synthesized
cactgaattcatgcttctacaa

SEQ ID NO: 1296101 - DNA, 22 bp, Artificial Sequence
  chemically synthesized
actgaattcatgcttctacaaa

SEQ ID NO: 1296102 - DNA, 22 bp, Artificial Sequence
  chemically synthesized
ggggcaaaaagatcatttgtag

SEQ ID NO: 1296103 - DNA, 22 bp, Artificial Sequence
  chemically synthesized
aattcatgcttctacaaatgat

SEQ ID NO: 1296104 - DNA, 22 bp, Artificial Sequence
  chemically synthesized
aggggcaaaaagatcatttgta

SEQ ID NO: 1296105 - DNA, 22 bp, Artificial Sequence
  chemically synthesized
atgcttctacaaatgatctttt

SEQ ID NO: 1296106 - DNA, 22 bp, Artificial Sequence
  chemically synthesized
cagtttaggggcaaaaagatca

SEQ ID NO: 1296107 - DNA, 22 bp, Artificial Sequence
  chemically synthesized
ccagtttaggggcaaaaagatc

SEQ ID NO: 1296108 - DNA, 22 bp, Artificial Sequence
  chemically synthesized
ctacaaatgatctttttgcccc

SEQ ID NO: 1296109 - DNA, 22 bp, Artificial Sequence
  chemically synthesized
atttccagtttaggggcaaaaa

SEQ ID NO: 1296110 - DNA, 22 bp, Artificial Sequence
  chemically synthesized
tacaaatgatctttttgcccct

SEQ ID NO: 1296111 - DNA, 22 bp, Artificial Sequence
  chemically synthesized
caaatgatctttttgcccctaa

SEQ ID NO: 1296112 - DNA, 22 bp, Artificial Sequence
  chemically synthesized
atactaatttccagtttagggg

SEQ ID NO: 1296113 - DNA, 22 bp, Artificial Sequence
  chemically synthesized
aatactaatttccagtttaggg

SEQ ID NO: 1296114 - DNA, 22 bp, Artificial Sequence
  chemically synthesized
acttaatactaatttccagttt

SEQ ID NO: 1296115 - DNA, 22 bp, Artificial Sequence
  chemically synthesized
gacttaatactaatttccagtt

SEQ ID NO: 1296116 - DNA, 22 bp, Artificial Sequence
  chemically synthesized
tttgcccctaaactggaaatta

SEQ ID NO: 1296117 - DNA, 22 bp, Artificial Sequence
  chemically synthesized
ttgcccctaaactggaaattag

SEQ ID NO: 1296118 - DNA, 22 bp, Artificial Sequence
  chemically synthesized
tgcccctaaactggaaattagt

SEQ ID NO: 1296119 - DNA, 22 bp, Artificial Sequence
  chemically synthesized
gcccctaaactggaaattagta

SEQ ID NO: 1296120 - DNA, 22 bp, Artificial Sequence
  chemically synthesized
cccctaaactggaaattagtat

SEQ ID NO: 1296121 - DNA, 22 bp, Artificial Sequence
  chemically synthesized
tccatttgacttaatactaatt

SEQ ID NO: 1296122 - DNA, 22 bp, Artificial Sequence
  chemically synthesized
tgtccatttgacttaatactaa

SEQ ID NO: 1296123 - DNA, 22 bp, Artificial Sequence
  chemically synthesized
ctgtccatttgacttaatacta

SEQ ID NO: 1296124 - DNA, 22 bp, Artificial Sequence
  chemically synthesized
tctgtccatttgacttaatact

SEQ ID NO: 1296125 - DNA, 22 bp, Artificial Sequence
  chemically synthesized
aactggaaattagtattaagtc

SEQ ID NO: 1296126 - DNA, 22 bp, Artificial Sequence
  chemically synthesized
ttctgtccatttgacttaatac

SEQ ID NO: 1296127 - DNA, 22 bp, Artificial Sequence
  chemically synthesized
gaaattagtattaagtcaaatg

SEQ ID NO: 1296128 - DNA, 22 bp, Artificial Sequence
  chemically synthesized
atgatttttctgtccatttgac

SEQ ID NO: 1296129 - DNA, 22 bp, Artificial Sequence
  chemically synthesized
gtattaagtcaaatggacagaa

SEQ ID NO: 1296130 - DNA, 22 bp, Artificial Sequence
  chemically synthesized
agtcaaatggacagaaaaatca

SEQ ID NO: 1296131 - DNA, 22 bp, Artificial Sequence
  chemically synthesized
atatatcaagattgatgatttt

SEQ ID NO: 1296132 - DNA, 22 bp, Artificial Sequence
  chemically synthesized
aatatatcaagattgatgattt

SEQ ID NO: 1296133 - DNA, 22 bp, Artificial Sequence
  chemically synthesized
taatatatcaagattgatgatt

SEQ ID NO: 1296134 - DNA, 22 bp, Artificial Sequence
  chemically synthesized
gagaaaaacattttaatatatc

SEQ ID NO: 1296135 - DNA, 22 bp, Artificial Sequence
  chemically synthesized
ggagaaaaacattttaatatat

SEQ ID NO: 1296136 - DNA, 22 bp, Artificial Sequence
  chemically synthesized
cttggagaaaaacattttaata

SEQ ID NO: 1296137 - DNA, 22 bp, Artificial Sequence
  chemically synthesized
gcttggagaaaaacattttaat

SEQ ID NO: 1296138 - DNA, 22 bp, Artificial Sequence
  chemically synthesized
tgcttggagaaaaacattttaa

SEQ ID NO: 1296139 - DNA, 22 bp, Artificial Sequence
  chemically synthesized
ttgcttggagaaaaacatttta

SEQ ID NO: 1296140 - DNA, 22 bp, Artificial Sequence
  chemically synthesized
gatatattaaaatgtttttctc

SEQ ID NO: 1296141 - DNA, 22 bp, Artificial Sequence
  chemically synthesized
atatattaaaatgtttttctcc

SEQ ID NO: 1296142 - DNA, 22 bp, Artificial Sequence
  chemically synthesized
aaaaaatagtcttttgcttgga

SEQ ID NO: 1296143 - DNA, 22 bp, Artificial Sequence
  chemically synthesized
aaatgtttttctccaagcaaaa

SEQ ID NO: 1296144 - DNA, 22 bp, Artificial Sequence
  chemically synthesized
ttctccaagcaaaagactattt

SEQ ID NO: 1296145 - DNA, 22 bp, Artificial Sequence
  chemically synthesized
caataattaaaaaaatagtctt

SEQ ID NO: 1296146 - DNA, 22 bp, Artificial Sequence
  chemically synthesized
tctccaagcaaaagactatttt

SEQ ID NO: 1296147 - DNA, 22 bp, Artificial Sequence
  chemically synthesized
acaataattaaaaaaatagtct

SEQ ID NO: 1296148 - DNA, 22 bp, Artificial Sequence
  chemically synthesized
ctccaagcaaaagactattttt

SEQ ID NO: 1296149 - DNA, 22 bp, Artificial Sequence
  chemically synthesized
tccaagcaaaagactatttttt

SEQ ID NO: 1296150 - DNA, 22 bp, Artificial Sequence
  chemically synthesized
caagcaaaagactattttttta

SEQ ID NO: 1296151 - DNA, 22 bp, Artificial Sequence
  chemically synthesized
tatttacaataattaaaaaaat

SEQ ID NO: 1296152 - DNA, 22 bp, Artificial Sequence
  chemically synthesized
atatgattatatttacaataat

SEQ ID NO: 1296153 - DNA, 22 bp, Artificial Sequence
  chemically synthesized
tttttttaattattgtaaatat

SEQ ID NO: 1296154 - DNA, 22 bp, Artificial Sequence
  chemically synthesized
actaatatgattatatttacaa

SEQ ID NO: 1296155 - DNA, 22 bp, Artificial Sequence
  chemically synthesized
ttttaattattgtaaatataat

SEQ ID NO: 1296156 - DNA, 22 bp, Artificial Sequence
  chemically synthesized
tttaattattgtaaatataatc

SEQ ID NO: 1296157 - DNA, 22 bp, Artificial Sequence
  chemically synthesized
ttaattattgtaaatataatca

SEQ ID NO: 1296158 - DNA, 22 bp, Artificial Sequence
  chemically synthesized
taattattgtaaatataatcat

SEQ ID NO: 1296159 - DNA, 22 bp, Artificial Sequence
  chemically synthesized
aattattgtaaatataatcata

SEQ ID NO: 1296160 - DNA, 22 bp, Artificial Sequence
  chemically synthesized
aacattaactaatatgattata

SEQ ID NO: 1296161 - DNA, 22 bp, Artificial Sequence
  chemically synthesized
attattgtaaatataatcatat

SEQ ID NO: 1296162 - DNA, 22 bp, Artificial Sequence
  chemically synthesized
ctgaacattaactaatatgatt

SEQ ID NO: 1296163 - DNA, 22 bp, Artificial Sequence
  chemically synthesized
actgaacattaactaatatgat

SEQ ID NO: 1296164 - DNA, 22 bp, Artificial Sequence
  chemically synthesized
ttgtaaatataatcatattagt

SEQ ID NO: 1296165 - DNA, 22 bp, Artificial Sequence
  chemically synthesized
taaatataatcatattagttaa

SEQ ID NO: 1296166 - DNA, 22 bp, Artificial Sequence
  chemically synthesized
atttactgaacattaactaata

SEQ ID NO: 1296167 - DNA, 22 bp, Artificial Sequence
  chemically synthesized
agatgcattcatttactgaaca

SEQ ID NO: 1296168 - DNA, 22 bp, Artificial Sequence
  chemically synthesized
tcagatgcattcatttactgaa

SEQ ID NO: 1296169 - DNA, 22 bp, Artificial Sequence
  chemically synthesized
gttaatgttcagtaaatgaatg

SEQ ID NO: 1296170 - DNA, 22 bp, Artificial Sequence
  chemically synthesized
aatatctctcagatgcattcat

SEQ ID NO: 1296171 - DNA, 22 bp, Artificial Sequence
  chemically synthesized
atgttcagtaaatgaatgcatc

SEQ ID NO: 1296172 - DNA, 22 bp, Artificial Sequence
  chemically synthesized
aaatatctctcagatgcattca

SEQ ID NO: 1296173 - DNA, 22 bp, Artificial Sequence
  chemically synthesized
taaatatctctcagatgcattc

SEQ ID NO: 1296174 - DNA, 22 bp, Artificial Sequence
  chemically synthesized
agtaaatgaatgcatctgagag

SEQ ID NO: 1296175 - DNA, 22 bp, Artificial Sequence
  chemically synthesized
tcaattttaaatatctctcaga

SEQ ID NO: 1296176 - DNA, 22 bp, Artificial Sequence
  chemically synthesized
atcaattttaaatatctctcag

SEQ ID NO: 1296177 - DNA, 22 bp, Artificial Sequence
  chemically synthesized
agagatatttaaaattgataaa

SEQ ID NO: 1296178 - DNA, 22 bp, Artificial Sequence
  chemically synthesized
aaaattgataaattttatattt

SEQ ID NO: 1296179 - DNA, 22 bp, Artificial Sequence
  chemically synthesized
aaattgataaattttatatttt

SEQ ID NO: 1296180 - DNA, 22 bp, Artificial Sequence
  chemically synthesized
atccaagtagataaaatataaa

SEQ ID NO: 1296181 - DNA, 22 bp, Artificial Sequence
  chemically synthesized
aatccaagtagataaaatataa

SEQ ID NO: 1296182 - DNA, 22 bp, Artificial Sequence
  chemically synthesized
taatccaagtagataaaatata

SEQ ID NO: 1296183 - DNA, 22 bp, Artificial Sequence
  chemically synthesized
ttaatccaagtagataaaatat

SEQ ID NO: 1296184 - DNA, 22 bp, Artificial Sequence
  chemically synthesized
ttttaatccaagtagataaaat

SEQ ID NO: 1296185 - DNA, 22 bp, Artificial Sequence
  chemically synthesized
ataaattttatattttatctac

SEQ ID NO: 1296186 - DNA, 22 bp, Artificial Sequence
  chemically synthesized
tatattttatctacttggatta

SEQ ID NO: 1296187 - DNA, 22 bp, Artificial Sequence
  chemically synthesized
atattttatctacttggattaa

SEQ ID NO: 1296188 - DNA, 22 bp, Artificial Sequence
  chemically synthesized
ataacggttcttttaatccaag

SEQ ID NO: 1296189 - DNA, 22 bp, Artificial Sequence
  chemically synthesized
tattttatctacttggattaaa

SEQ ID NO: 1296190 - DNA, 22 bp, Artificial Sequence
  chemically synthesized
aataacggttcttttaatccaa

SEQ ID NO: 1296191 - DNA, 22 bp, Artificial Sequence
  chemically synthesized
taataacggttcttttaatcca

SEQ ID NO: 1296192 - DNA, 22 bp, Artificial Sequence
  chemically synthesized
tatctacttggattaaaagaac

SEQ ID NO: 1296193 - DNA, 22 bp, Artificial Sequence
  chemically synthesized
atctacttggattaaaagaacc

SEQ ID NO: 1296194 - DNA, 22 bp, Artificial Sequence
  chemically synthesized
tctacttggattaaaagaaccg

SEQ ID NO: 1296195 - DNA, 22 bp, Artificial Sequence
  chemically synthesized
cttggattaaaagaaccgttat

SEQ ID NO: 1296196 - DNA, 22 bp, Artificial Sequence
  chemically synthesized
taaagggcattttaataacggt

SEQ ID NO: 1296197 - DNA, 22 bp, Artificial Sequence
  chemically synthesized
ggattaaaagaaccgttattaa

SEQ ID NO: 1296198 - DNA, 22 bp, Artificial Sequence
  chemically synthesized
gtaaagggcattttaataacgg

SEQ ID NO: 1296199 - DNA, 22 bp, Artificial Sequence
  chemically synthesized
gattaaaagaaccgttattaaa

SEQ ID NO: 1296200 - DNA, 22 bp, Artificial Sequence
  chemically synthesized
tgtaaagggcattttaataacg

SEQ ID NO: 1296201 - DNA, 22 bp, Artificial Sequence
  chemically synthesized
ctttgtaaagggcattttaata

SEQ ID NO: 1296202 - DNA, 22 bp, Artificial Sequence
  chemically synthesized
aaagaaccgttattaaaatgcc

SEQ ID NO: 1296203 - DNA, 22 bp, Artificial Sequence
  chemically synthesized
ttaaaatgccctttacaaagta

SEQ ID NO: 1296204 - DNA, 22 bp, Artificial Sequence
  chemically synthesized
aaatgccctttacaaagtaatc

SEQ ID NO: 1296205 - DNA, 22 bp, Artificial Sequence
  chemically synthesized
tacaaagtaatcatatttgctc

SEQ ID NO: 1296206 - DNA, 22 bp, Artificial Sequence
  chemically synthesized
aaaaatatatgagagcaaatat

SEQ ID NO: 1296207 - DNA, 22 bp, Artificial Sequence
  chemically synthesized
acaaagtaatcatatttgctct

SEQ ID NO: 1296208 - DNA, 22 bp, Artificial Sequence
  chemically synthesized
caaagtaatcatatttgctctc

SEQ ID NO: 1296209 - DNA, 22 bp, Artificial Sequence
  chemically synthesized
ctgaaaaatatatgagagcaaa

SEQ ID NO: 1296210 - DNA, 22 bp, Artificial Sequence
  chemically synthesized
ctactgaaaaatatatgagagc

SEQ ID NO: 1296211 - DNA, 22 bp, Artificial Sequence
  chemically synthesized
actactgaaaaatatatgagag

SEQ ID NO: 1296212 - DNA, 22 bp, Artificial Sequence
  chemically synthesized
gctctcatatatttttcagtag

SEQ ID NO: 1296213 - DNA, 22 bp, Artificial Sequence
  chemically synthesized
ctctcatatatttttcagtagt

SEQ ID NO: 1296214 - DNA, 22 bp, Artificial Sequence
  chemically synthesized
tcatatatttttcagtagtaaa

SEQ ID NO: 1296215 - DNA, 22 bp, Artificial Sequence
  chemically synthesized
atatatttttcagtagtaaatc

SEQ ID NO: 1296216 - DNA, 22 bp, Artificial Sequence
  chemically synthesized
agagaagcaacggagatttact

SEQ ID NO: 1296217 - DNA, 22 bp, Artificial Sequence
  chemically synthesized
aagagaagcaacggagatttac

SEQ ID NO: 1296218 - DNA, 22 bp, Artificial Sequence
  chemically synthesized
taagagaagcaacggagattta

SEQ ID NO: 1296219 - DNA, 22 bp, Artificial Sequence
  chemically synthesized
ttaagagaagcaacggagattt

SEQ ID NO: 1296220 - DNA, 22 bp, Artificial Sequence
  chemically synthesized
ttcagtagtaaatctccgttgc

SEQ ID NO: 1296221 - DNA, 22 bp, Artificial Sequence
  chemically synthesized
tcagtagtaaatctccgttgct

SEQ ID NO: 1296222 - DNA, 22 bp, Artificial Sequence
  chemically synthesized
cagtagtaaatctccgttgctt

SEQ ID NO: 1296223 - DNA, 22 bp, Artificial Sequence
  chemically synthesized
tgtttttaagagaagcaacgga

SEQ ID NO: 1296224 - DNA, 22 bp, Artificial Sequence
  chemically synthesized
agtagtaaatctccgttgcttc

SEQ ID NO: 1296225 - DNA, 22 bp, Artificial Sequence
  chemically synthesized
atgtttttaagagaagcaacgg

SEQ ID NO: 1296226 - DNA, 22 bp, Artificial Sequence
  chemically synthesized
cttatgtttttaagagaagcaa

SEQ ID NO: 1296227 - DNA, 22 bp, Artificial Sequence
  chemically synthesized
cgttgcttctcttaaaaacata

SEQ ID NO: 1296228 - DNA, 22 bp, Artificial Sequence
  chemically synthesized
tgcgaaagtgattccttatgtt

SEQ ID NO: 1296229 - DNA, 22 bp, Artificial Sequence
  chemically synthesized
cttctcttaaaaacataaggaa

SEQ ID NO: 1296230 - DNA, 22 bp, Artificial Sequence
  chemically synthesized
ttatgcgaaagtgattccttat

SEQ ID NO: 1296231 - DNA, 22 bp, Artificial Sequence
  chemically synthesized
ctcttaaaaacataaggaatca

SEQ ID NO: 1296232 - DNA, 22 bp, Artificial Sequence
  chemically synthesized
gttatgcgaaagtgattcctta

SEQ ID NO: 1296233 - DNA, 22 bp, Artificial Sequence
  chemically synthesized
tcttaaaaacataaggaatcac

SEQ ID NO: 1296234 - DNA, 22 bp, Artificial Sequence
  chemically synthesized
ttaaaaacataaggaatcactt

SEQ ID NO: 1296235 - DNA, 22 bp, Artificial Sequence
  chemically synthesized
aaaaacataaggaatcactttc

SEQ ID NO: 1296236 - DNA, 22 bp, Artificial Sequence
  chemically synthesized
aaaacataaggaatcactttcg

SEQ ID NO: 1296237 - DNA, 22 bp, Artificial Sequence
  chemically synthesized
gtgcatgcatatatttgttatg

SEQ ID NO: 1296238 - DNA, 22 bp, Artificial Sequence
  chemically synthesized
ggtgcatgcatatatttgttat

SEQ ID NO: 1296239 - DNA, 22 bp, Artificial Sequence
  chemically synthesized
tggtgcatgcatatatttgtta

SEQ ID NO: 1296240 - DNA, 22 bp, Artificial Sequence
  chemically synthesized
ttggtgcatgcatatatttgtt

SEQ ID NO: 1296241 - DNA, 22 bp, Artificial Sequence
  chemically synthesized
tcgcataacaaatatatgcatg

SEQ ID NO: 1296242 - DNA, 22 bp, Artificial Sequence
  chemically synthesized
cgcataacaaatatatgcatgc

SEQ ID NO: 1296243 - DNA, 22 bp, Artificial Sequence
  chemically synthesized
gcataacaaatatatgcatgca

SEQ ID NO: 1296244 - DNA, 22 bp, Artificial Sequence
  chemically synthesized
aagataaacagatatttttggt

SEQ ID NO: 1296245 - DNA, 22 bp, Artificial Sequence
  chemically synthesized
aaagataaacagatatttttgg

SEQ ID NO: 1296246 - DNA, 22 bp, Artificial Sequence
  chemically synthesized
tgatttaaagataaacagatat

SEQ ID NO: 1296247 - DNA, 22 bp, Artificial Sequence
  chemically synthesized
gtattgtgatttaaagataaac

SEQ ID NO: 1296248 - DNA, 22 bp, Artificial Sequence
  chemically synthesized
tagattagtattgtgatttaaa

SEQ ID NO: 1296249 - DNA, 22 bp, Artificial Sequence
  chemically synthesized
atagattagtattgtgatttaa

SEQ ID NO: 1296250 - DNA, 22 bp, Artificial Sequence
  chemically synthesized
cttatagattagtattgtgatt

SEQ ID NO: 1296251 - DNA, 22 bp, Artificial Sequence
  chemically synthesized
tttatctttaaatcacaatact

SEQ ID NO: 1296252 - DNA, 22 bp, Artificial Sequence
  chemically synthesized
atctttaaatcacaatactaat

SEQ ID NO: 1296253 - DNA, 22 bp, Artificial Sequence
  chemically synthesized
tctttaaatcacaatactaatc

SEQ ID NO: 1296254 - DNA, 22 bp, Artificial Sequence
  chemically synthesized
taaatcacaatactaatctata

SEQ ID NO: 1296255 - DNA, 22 bp, Artificial Sequence
  chemically synthesized
aaggaatctacttatagattag

SEQ ID NO: 1296256 - DNA, 22 bp, Artificial Sequence
  chemically synthesized
aaatcacaatactaatctataa

SEQ ID NO: 1296257 - DNA, 22 bp, Artificial Sequence
  chemically synthesized
aatcacaatactaatctataag

SEQ ID NO: 1296258 - DNA, 22 bp, Artificial Sequence
  chemically synthesized
actaaaggaatctacttataga

SEQ ID NO: 1296259 - DNA, 22 bp, Artificial Sequence
  chemically synthesized
atattgactaaaggaatctact

SEQ ID NO: 1296260 - DNA, 22 bp, Artificial Sequence
  chemically synthesized
tcatattgactaaaggaatcta

SEQ ID NO: 1296261 - DNA, 22 bp, Artificial Sequence
  chemically synthesized
ctcatattgactaaaggaatct

SEQ ID NO: 1296262 - DNA, 22 bp, Artificial Sequence
  chemically synthesized
atctataagtagattcctttag

SEQ ID NO: 1296263 - DNA, 22 bp, Artificial Sequence
  chemically synthesized
tttctcatattgactaaaggaa

SEQ ID NO: 1296264 - DNA, 22 bp, Artificial Sequence
  chemically synthesized
ttatttctcatattgactaaag

SEQ ID NO: 1296265 - DNA, 22 bp, Artificial Sequence
  chemically synthesized
taagtagattcctttagtcaat

SEQ ID NO: 1296266 - DNA, 22 bp, Artificial Sequence
  chemically synthesized
actgttatttctcatattgact

SEQ ID NO: 1296267 - DNA, 22 bp, Artificial Sequence
  chemically synthesized
ttcactgttatttctcatattg

SEQ ID NO: 1296268 - DNA, 22 bp, Artificial Sequence
  chemically synthesized
attcactgttatttctcatatt

SEQ ID NO: 1296269 - DNA, 22 bp, Artificial Sequence
  chemically synthesized
tttattcactgttatttctcat

SEQ ID NO: 1296270 - DNA, 22 bp, Artificial Sequence
  chemically synthesized
ctttagtcaatatgagaaataa

SEQ ID NO: 1296271 - DNA, 22 bp, Artificial Sequence
  chemically synthesized
atttattcactgttatttctca

SEQ ID NO: 1296272 - DNA, 22 bp, Artificial Sequence
  chemically synthesized
tagtcaatatgagaaataacag

SEQ ID NO: 1296273 - DNA, 22 bp, Artificial Sequence
  chemically synthesized
agtcaatatgagaaataacagt

SEQ ID NO: 1296274 - DNA, 22 bp, Artificial Sequence
  chemically synthesized
gtcaatatgagaaataacagtg

SEQ ID NO: 1296275 - DNA, 22 bp, Artificial Sequence
  chemically synthesized
aaatttatttattcactgttat

SEQ ID NO: 1296276 - DNA, 22 bp, Artificial Sequence
  chemically synthesized
gaaatttatttattcactgtta

SEQ ID NO: 1296277 - DNA, 22 bp, Artificial Sequence
  chemically synthesized
agatgacagtttgaaatttatt

SEQ ID NO: 1296278 - DNA, 22 bp, Artificial Sequence
  chemically synthesized
acctaagatgacagtttgaaat

SEQ ID NO: 1296279 - DNA, 22 bp, Artificial Sequence
  chemically synthesized
tcacctaagatgacagtttgaa

SEQ ID NO: 1296280 - DNA, 22 bp, Artificial Sequence
  chemically synthesized
ctcacctaagatgacagtttga

SEQ ID NO: 1296281 - DNA, 22 bp, Artificial Sequence
  chemically synthesized
aataaaatttctcacctaagat

SEQ ID NO: 1296282 - DNA, 22 bp, Artificial Sequence
  chemically synthesized
caaactgtcatcttaggtgaga

SEQ ID NO: 1296283 - DNA, 22 bp, Artificial Sequence
  chemically synthesized
aaactgtcatcttaggtgagaa

SEQ ID NO: 1296284 - DNA, 22 bp, Artificial Sequence
  chemically synthesized
taatgctaaataaaatttctca

SEQ ID NO: 1296285 - DNA, 22 bp, Artificial Sequence
  chemically synthesized
gtaatgctaaataaaatttctc

SEQ ID NO: 1296286 - DNA, 22 bp, Artificial Sequence
  chemically synthesized
tcatcttaggtgagaaatttta

SEQ ID NO: 1296287 - DNA, 22 bp, Artificial Sequence
  chemically synthesized
tgtaatgctaaataaaatttct

SEQ ID NO: 1296288 - DNA, 22 bp, Artificial Sequence
  chemically synthesized
aggtgagaaattttatttagca

SEQ ID NO: 1296289 - DNA, 22 bp, Artificial Sequence
  chemically synthesized
ggtgagaaattttatttagcat

SEQ ID NO: 1296290 - DNA, 22 bp, Artificial Sequence
  chemically synthesized
aataagaaaaatgtattttgta

SEQ ID NO: 1296291 - DNA, 22 bp, Artificial Sequence
  chemically synthesized
tatttagcattacaaaatacat

SEQ ID NO: 1296292 - DNA, 22 bp, Artificial Sequence
  chemically synthesized
atttagcattacaaaatacatt

SEQ ID NO: 1296293 - DNA, 22 bp, Artificial Sequence
  chemically synthesized
tttagcattacaaaatacattt

SEQ ID NO: 1296294 - DNA, 22 bp, Artificial Sequence
  chemically synthesized
agcattacaaaatacatttttc

SEQ ID NO: 1296295 - DNA, 22 bp, Artificial Sequence
  chemically synthesized
gcattacaaaatacatttttct

SEQ ID NO: 1296296 - DNA, 22 bp, Artificial Sequence
  chemically synthesized
caaaatacatttttcttattta

SEQ ID NO: 1296297 - DNA, 22 bp, Artificial Sequence
  chemically synthesized
tgtgaataacataattaaataa

SEQ ID NO: 1296298 - DNA, 22 bp, Artificial Sequence
  chemically synthesized
gtgtgaataacataattaaata

SEQ ID NO: 1296299 - DNA, 22 bp, Artificial Sequence
  chemically synthesized
ttcttatttaattatgttattc

SEQ ID NO: 1296300 - DNA, 22 bp, Artificial Sequence
  chemically synthesized
tcttatttaattatgttattca

SEQ ID NO: 1296301 - DNA, 22 bp, Artificial Sequence
  chemically synthesized
cttatttaattatgttattcac

SEQ ID NO: 1296302 - DNA, 22 bp, Artificial Sequence
  chemically synthesized
ttatttaattatgttattcaca

SEQ ID NO: 1296303 - DNA, 22 bp, Artificial Sequence
  chemically synthesized
atttaattatgttattcacaca

SEQ ID NO: 1296304 - DNA, 22 bp, Artificial Sequence
  chemically synthesized
tttaattatgttattcacacaa

SEQ ID NO: 1296305 - DNA, 22 bp, Artificial Sequence
  chemically synthesized
aattatgttattcacacaagct

SEQ ID NO: 1296306 - DNA, 22 bp, Artificial Sequence
  chemically synthesized
attatgttattcacacaagctt

SEQ ID NO: 1296307 - DNA, 22 bp, Artificial Sequence
  chemically synthesized
aacatacatatagaagcttgtg

SEQ ID NO: 1296308 - DNA, 22 bp, Artificial Sequence
  chemically synthesized
tgttattcacacaagcttctat

SEQ ID NO: 1296309 - DNA, 22 bp, Artificial Sequence
  chemically synthesized
atattgaacatacatatagaag

SEQ ID NO: 1296310 - DNA, 22 bp, Artificial Sequence
  chemically synthesized
ttcacacaagcttctatatgta

SEQ ID NO: 1296311 - DNA, 22 bp, Artificial Sequence
  chemically synthesized
acacaagcttctatatgtatgt

SEQ ID NO: 1296312 - DNA, 22 bp, Artificial Sequence
  chemically synthesized
ctatatgtatgttcaatatcaa

SEQ ID NO: 1296313 - DNA, 22 bp, Artificial Sequence
  chemically synthesized
tatatgtatgttcaatatcaac

SEQ ID NO: 1296314 - DNA, 22 bp, Artificial Sequence
  chemically synthesized
tatgtatgttcaatatcaacat

SEQ ID NO: 1296315 - DNA, 22 bp, Artificial Sequence
  chemically synthesized
tcatataccatatgaataatgt

SEQ ID NO: 1296316 - DNA, 22 bp, Artificial Sequence
  chemically synthesized
atcatataccatatgaataatg

SEQ ID NO: 1296317 - DNA, 22 bp, Artificial Sequence
  chemically synthesized
aatatcaacattattcatatgg

SEQ ID NO: 1296318 - DNA, 22 bp, Artificial Sequence
  chemically synthesized
agatttatcatataccatatga

SEQ ID NO: 1296319 - DNA, 22 bp, Artificial Sequence
  chemically synthesized
tagctaagatttatcatatacc

SEQ ID NO: 1296320 - DNA, 22 bp, Artificial Sequence
  chemically synthesized
ttcatatggtatatgataaatc

SEQ ID NO: 1296321 - DNA, 22 bp, Artificial Sequence
  chemically synthesized
catattgtagctaagatttatc

SEQ ID NO: 1296322 - DNA, 22 bp, Artificial Sequence
  chemically synthesized
atatggtatatgataaatctta

SEQ ID NO: 1296323 - DNA, 22 bp, Artificial Sequence
  chemically synthesized
ccatattgtagctaagatttat

SEQ ID NO: 1296324 - DNA, 22 bp, Artificial Sequence
  chemically synthesized
tcaacaaaggaaatacttccat

SEQ ID NO: 1296325 - DNA, 22 bp, Artificial Sequence
  chemically synthesized
gtcaacaaaggaaatacttcca

SEQ ID NO: 1296326 - DNA, 22 bp, Artificial Sequence
  chemically synthesized
agctacaatatggaagtatttc

SEQ ID NO: 1296327 - DNA, 22 bp, Artificial Sequence
  chemically synthesized
gctacaatatggaagtatttcc

SEQ ID NO: 1296328 - DNA, 22 bp, Artificial Sequence
  chemically synthesized
acccttgtcaacaaaggaaata

SEQ ID NO: 1296329 - DNA, 22 bp, Artificial Sequence
  chemically synthesized
caatatggaagtatttcctttg

SEQ ID NO: 1296330 - DNA, 22 bp, Artificial Sequence
  chemically synthesized
ttcacccttgtcaacaaaggaa

SEQ ID NO: 1296331 - DNA, 22 bp, Artificial Sequence
  chemically synthesized
attcacccttgtcaacaaagga

SEQ ID NO: 1296332 - DNA, 22 bp, Artificial Sequence
  chemically synthesized
tttattcacccttgtcaacaaa

SEQ ID NO: 1296333 - DNA, 22 bp, Artificial Sequence
  chemically synthesized
atttattcacccttgtcaacaa

SEQ ID NO: 1296334 - DNA, 22 bp, Artificial Sequence
  chemically synthesized
tatttattcacccttgtcaaca

SEQ ID NO: 1296335 - DNA, 22 bp, Artificial Sequence
  chemically synthesized
ttatttattcacccttgtcaac

SEQ ID NO: 1296336 - DNA, 22 bp, Artificial Sequence
  chemically synthesized
tttttatttattcacccttgtc

SEQ ID NO: 1296337 - DNA, 22 bp, Artificial Sequence
  chemically synthesized
cctttgttgacaagggtgaata

SEQ ID NO: 1296338 - DNA, 22 bp, Artificial Sequence
  chemically synthesized
tctgtttttatttattcaccct

SEQ ID NO: 1296339 - DNA, 22 bp, Artificial Sequence
  chemically synthesized
ctttgttgacaagggtgaataa

SEQ ID NO: 1296340 - DNA, 22 bp, Artificial Sequence
  chemically synthesized
ctatctgtttttatttattcac

SEQ ID NO: 1296341 - DNA, 22 bp, Artificial Sequence
  chemically synthesized
tgttgacaagggtgaataaata

SEQ ID NO: 1296342 - DNA, 22 bp, Artificial Sequence
  chemically synthesized
gttgacaagggtgaataaataa

SEQ ID NO: 1296343 - DNA, 22 bp, Artificial Sequence
  chemically synthesized
ttgacaagggtgaataaataaa

SEQ ID NO: 1296344 - DNA, 22 bp, Artificial Sequence
  chemically synthesized
ttactatctgtttttatttatt

SEQ ID NO: 1296345 - DNA, 22 bp, Artificial Sequence
  chemically synthesized
acaagggtgaataaataaaaac

SEQ ID NO: 1296346 - DNA, 22 bp, Artificial Sequence
  chemically synthesized
aaaactattactatctgttttt

SEQ ID NO: 1296347 - DNA, 22 bp, Artificial Sequence
  chemically synthesized
gaaaactattactatctgtttt

SEQ ID NO: 1296348 - DNA, 22 bp, Artificial Sequence
  chemically synthesized
gaataggtttgaaaactattac

SEQ ID NO: 1296349 - DNA, 22 bp, Artificial Sequence
  chemically synthesized
aaggaggctagaataggtttga

SEQ ID NO: 1296350 - DNA, 22 bp, Artificial Sequence
  chemically synthesized
gaaggaggctagaataggtttg

SEQ ID NO: 1296351 - DNA, 22 bp, Artificial Sequence
  chemically synthesized
tcaaacctattctagcctcctt

SEQ ID NO: 1296352 - DNA, 22 bp, Artificial Sequence
  chemically synthesized
caaacctattctagcctccttc

SEQ ID NO: 1296353 - DNA, 22 bp, Artificial Sequence
  chemically synthesized
aaacctattctagcctccttca

SEQ ID NO: 1296354 - DNA, 22 bp, Artificial Sequence
  chemically synthesized
tgaaagtaaagatttgaaggag

SEQ ID NO: 1296355 - DNA, 22 bp, Artificial Sequence
  chemically synthesized
atgaaagtaaagatttgaagga

SEQ ID NO: 1296356 - DNA, 22 bp, Artificial Sequence
  chemically synthesized
tatgaaagtaaagatttgaagg

SEQ ID NO: 1296357 - DNA, 22 bp, Artificial Sequence
  chemically synthesized
ttctagcctccttcaaatcttt

SEQ ID NO: 1296358 - DNA, 22 bp, Artificial Sequence
  chemically synthesized
attttatgaaagtaaagatttg

SEQ ID NO: 1296359 - DNA, 22 bp, Artificial Sequence
  chemically synthesized
tagcctccttcaaatctttact

SEQ ID NO: 1296360 - DNA, 22 bp, Artificial Sequence
  chemically synthesized
gcctccttcaaatctttacttt

SEQ ID NO: 1296361 - DNA, 22 bp, Artificial Sequence
  chemically synthesized
gtattaattttatgaaagtaaa

SEQ ID NO: 1296362 - DNA, 22 bp, Artificial Sequence
  chemically synthesized
cttcaaatctttactttcataa

SEQ ID NO: 1296363 - DNA, 22 bp, Artificial Sequence
  chemically synthesized
caaatctttactttcataaaat

SEQ ID NO: 1296364 - DNA, 22 bp, Artificial Sequence
  chemically synthesized
aaatctttactttcataaaatt

SEQ ID NO: 1296365 - DNA, 22 bp, Artificial Sequence
  chemically synthesized
gaagggctagtattaattttat

SEQ ID NO: 1296366 - DNA, 22 bp, Artificial Sequence
  chemically synthesized
ggaagggctagtattaatttta

SEQ ID NO: 1296367 - DNA, 22 bp, Artificial Sequence
  chemically synthesized
tggaagggctagtattaatttt

SEQ ID NO: 1296368 - DNA, 22 bp, Artificial Sequence
  chemically synthesized
tactttcataaaattaatacta

SEQ ID NO: 1296369 - DNA, 22 bp, Artificial Sequence
  chemically synthesized
ttttggaagggctagtattaat

SEQ ID NO: 1296370 - DNA, 22 bp, Artificial Sequence
  chemically synthesized
actttcataaaattaatactag

SEQ ID NO: 1296371 - DNA, 22 bp, Artificial Sequence
  chemically synthesized
ctttcataaaattaatactagc

SEQ ID NO: 1296372 - DNA, 22 bp, Artificial Sequence
  chemically synthesized
tcataaaattaatactagccct

SEQ ID NO: 1296373 - DNA, 22 bp, Artificial Sequence
  chemically synthesized
cataaaattaatactagccctt

SEQ ID NO: 1296374 - DNA, 22 bp, Artificial Sequence
  chemically synthesized
aaattattttggaagggctagt

SEQ ID NO: 1296375 - DNA, 22 bp, Artificial Sequence
  chemically synthesized
ataaaattaatactagcccttc

SEQ ID NO: 1296376 - DNA, 22 bp, Artificial Sequence
  chemically synthesized
aaaattattttggaagggctag

SEQ ID NO: 1296377 - DNA, 22 bp, Artificial Sequence
  chemically synthesized
taaaattattttggaagggcta

SEQ ID NO: 1296378 - DNA, 22 bp, Artificial Sequence
  chemically synthesized
ttaaaattattttggaagggct

SEQ ID NO: 1296379 - DNA, 22 bp, Artificial Sequence
  chemically synthesized
tttaaaattattttggaagggc

SEQ ID NO: 1296380 - DNA, 22 bp, Artificial Sequence
  chemically synthesized
tttttaaaattattttggaagg

SEQ ID NO: 1296381 - DNA, 22 bp, Artificial Sequence
  chemically synthesized
ctttttaaaattattttggaag

SEQ ID NO: 1296382 - DNA, 22 bp, Artificial Sequence
  chemically synthesized
atactagcccttccaaaataat

SEQ ID NO: 1296383 - DNA, 22 bp, Artificial Sequence
  chemically synthesized
catttctttttaaaattatttt

SEQ ID NO: 1296384 - DNA, 22 bp, Artificial Sequence
  chemically synthesized
gcccttccaaaataattttaaa

SEQ ID NO: 1296385 - DNA, 22 bp, Artificial Sequence
  chemically synthesized
aaatgttccatttctttttaaa

SEQ ID NO: 1296386 - DNA, 22 bp, Artificial Sequence
  chemically synthesized
gaaatgttccatttctttttaa

SEQ ID NO: 1296387 - DNA, 22 bp, Artificial Sequence
  chemically synthesized
ccaaaataattttaaaaagaaa

SEQ ID NO: 1296388 - DNA, 22 bp, Artificial Sequence
  chemically synthesized
caaaataattttaaaaagaaat

SEQ ID NO: 1296389 - DNA, 22 bp, Artificial Sequence
  chemically synthesized
accatttgaaatgttccatttc

SEQ ID NO: 1296390 - DNA, 22 bp, Artificial Sequence
  chemically synthesized
gaccatttgaaatgttccattt

SEQ ID NO: 1296391 - DNA, 22 bp, Artificial Sequence
  chemically synthesized
tgaccatttgaaatgttccatt

SEQ ID NO: 1296392 - DNA, 22 bp, Artificial Sequence
  chemically synthesized
taaaaagaaatggaacatttca

SEQ ID NO: 1296393 - DNA, 22 bp, Artificial Sequence
  chemically synthesized
attttgaccatttgaaatgttc

SEQ ID NO: 1296394 - DNA, 22 bp, Artificial Sequence
  chemically synthesized
aaaaagaaatggaacatttcaa

SEQ ID NO: 1296395 - DNA, 22 bp, Artificial Sequence
  chemically synthesized
aattttgaccatttgaaatgtt

SEQ ID NO: 1296396 - DNA, 22 bp, Artificial Sequence
  chemically synthesized
aaaagaaatggaacatttcaaa

SEQ ID NO: 1296397 - DNA, 22 bp, Artificial Sequence
  chemically synthesized
tgaagatggtttaattttgacc

SEQ ID NO: 1296398 - DNA, 22 bp, Artificial Sequence
  chemically synthesized
caaatggtcaaaattaaaccat

SEQ ID NO: 1296399 - DNA, 22 bp, Artificial Sequence
  chemically synthesized
aaatggtcaaaattaaaccatc

SEQ ID NO: 1296400 - DNA, 22 bp, Artificial Sequence
  chemically synthesized
cataaagtctatgaagatggtt

SEQ ID NO: 1296401 - DNA, 22 bp, Artificial Sequence
  chemically synthesized
ctccataaagtctatgaagatg

SEQ ID NO: 1296402 - DNA, 22 bp, Artificial Sequence
  chemically synthesized
cctccataaagtctatgaagat

SEQ ID NO: 1296403 - DNA, 22 bp, Artificial Sequence
  chemically synthesized
aaccatcttcatagactttatg

SEQ ID NO: 1296404 - DNA, 22 bp, Artificial Sequence
  chemically synthesized
accaatcttcctccataaagtc

SEQ ID NO: 1296405 - DNA, 22 bp, Artificial Sequence
  chemically synthesized
catagactttatggaggaagat

SEQ ID NO: 1296406 - DNA, 22 bp, Artificial Sequence
  chemically synthesized
atagactttatggaggaagatt

SEQ ID NO: 1296407 - DNA, 22 bp, Artificial Sequence
  chemically synthesized
ataaatgatgcgttgaccaatc

SEQ ID NO: 1296408 - DNA, 22 bp, Artificial Sequence
  chemically synthesized
tatggaggaagattggtcaacg

SEQ ID NO: 1296409 - DNA, 22 bp, Artificial Sequence
  chemically synthesized
atggaggaagattggtcaacgc

SEQ ID NO: 1296410 - DNA, 22 bp, Artificial Sequence
  chemically synthesized
ctgataaatgatgcgttgacca

SEQ ID NO: 1296411 - DNA, 22 bp, Artificial Sequence
  chemically synthesized
tggaggaagattggtcaacgca

SEQ ID NO: 1296412 - DNA, 22 bp, Artificial Sequence
  chemically synthesized
gtcaacgcatcatttatcagta

SEQ ID NO: 1296413 - DNA, 22 bp, Artificial Sequence
  chemically synthesized
ggaatatatgtatatactactg

SEQ ID NO: 1296414 - DNA, 22 bp, Artificial Sequence
  chemically synthesized
aggaatatatgtatatactact

SEQ ID NO: 1296415 - DNA, 22 bp, Artificial Sequence
  chemically synthesized
taggaatatatgtatatactac

SEQ ID NO: 1296416 - DNA, 22 bp, Artificial Sequence
  chemically synthesized
ttaggaatatatgtatatacta

SEQ ID NO: 1296417 - DNA, 22 bp, Artificial Sequence
  chemically synthesized
cttttaggaatatatgtatata

SEQ ID NO: 1296418 - DNA, 22 bp, Artificial Sequence
  chemically synthesized
acttttaggaatatatgtatat

SEQ ID NO: 1296419 - DNA, 22 bp, Artificial Sequence
  chemically synthesized
atcagtagtatatacatatatt

SEQ ID NO: 1296420 - DNA, 22 bp, Artificial Sequence
  chemically synthesized
tcagtagtatatacatatattc

SEQ ID NO: 1296421 - DNA, 22 bp, Artificial Sequence
  chemically synthesized
caaataaggtcatttactttta

SEQ ID NO: 1296422 - DNA, 22 bp, Artificial Sequence
  chemically synthesized
ctaaaagtaaatgaccttattt

SEQ ID NO: 1296423 - DNA, 22 bp, Artificial Sequence
  chemically synthesized
aaagtaaatgaccttatttgca

SEQ ID NO: 1296424 - DNA, 22 bp, Artificial Sequence
  chemically synthesized
atttgcaattccacttatattt

SEQ ID NO: 1296425 - DNA, 22 bp, Artificial Sequence
  chemically synthesized
tttgcaattccacttatatttc

SEQ ID NO: 1296426 - DNA, 22 bp, Artificial Sequence
  chemically synthesized
gcaattccacttatatttccta

SEQ ID NO: 1296427 - DNA, 22 bp, Artificial Sequence
  chemically synthesized
caattccacttatatttcctac

SEQ ID NO: 1296428 - DNA, 22 bp, Artificial Sequence
  chemically synthesized
cacttatatttcctacatgtgc

SEQ ID NO: 1296429 - DNA, 22 bp, Artificial Sequence
  chemically synthesized
acagaaagtacgcatgcacatg

SEQ ID NO: 1296430 - DNA, 22 bp, Artificial Sequence
  chemically synthesized
atatttcctacatgtgcatgcg

SEQ ID NO: 1296431 - DNA, 22 bp, Artificial Sequence
  chemically synthesized
tgacagaaagtacgcatgcaca

SEQ ID NO: 1296432 - DNA, 22 bp, Artificial Sequence
  chemically synthesized
tatttcctacatgtgcatgcgt

SEQ ID NO: 1296433 - DNA, 22 bp, Artificial Sequence
  chemically synthesized
ctgacagaaagtacgcatgcac

SEQ ID NO: 1296434 - DNA, 22 bp, Artificial Sequence
  chemically synthesized
tctgacagaaagtacgcatgca

SEQ ID NO: 1296435 - DNA, 22 bp, Artificial Sequence
  chemically synthesized
ctttctgacagaaagtacgcat

SEQ ID NO: 1296436 - DNA, 22 bp, Artificial Sequence
  chemically synthesized
cctacatgtgcatgcgtacttt

SEQ ID NO: 1296437 - DNA, 22 bp, Artificial Sequence
  chemically synthesized
ctacatgtgcatgcgtactttc

SEQ ID NO: 1296438 - DNA, 22 bp, Artificial Sequence
  chemically synthesized
tgctttctgacagaaagtacgc

SEQ ID NO: 1296439 - DNA, 22 bp, Artificial Sequence
  chemically synthesized
tctgctttctgacagaaagtac

SEQ ID NO: 1296440 - DNA, 22 bp, Artificial Sequence
  chemically synthesized
catgtgcatgcgtactttctgt

SEQ ID NO: 1296441 - DNA, 22 bp, Artificial Sequence
  chemically synthesized
ctctctgctttctgacagaaag

SEQ ID NO: 1296442 - DNA, 22 bp, Artificial Sequence
  chemically synthesized
actctctgctttctgacagaaa

SEQ ID NO: 1296443 - DNA, 22 bp, Artificial Sequence
  chemically synthesized
atttactctctgctttctgaca

SEQ ID NO: 1296444 - DNA, 22 bp, Artificial Sequence
  chemically synthesized
actcatttactctctgctttct

SEQ ID NO: 1296445 - DNA, 22 bp, Artificial Sequence
  chemically synthesized
aactgactcatttactctctgc

SEQ ID NO: 1296446 - DNA, 22 bp, Artificial Sequence
  chemically synthesized
tctgtcagaaagcagagagtaa

SEQ ID NO: 1296447 - DNA, 22 bp, Artificial Sequence
  chemically synthesized
caactgactcatttactctctg

SEQ ID NO: 1296448 - DNA, 22 bp, Artificial Sequence
  chemically synthesized
ctgtcagaaagcagagagtaaa

SEQ ID NO: 1296449 - DNA, 22 bp, Artificial Sequence
  chemically synthesized
tcaactgactcatttactctct

SEQ ID NO: 1296450 - DNA, 22 bp, Artificial Sequence
  chemically synthesized
tgtcagaaagcagagagtaaat

SEQ ID NO: 1296451 - DNA, 22 bp, Artificial Sequence
  chemically synthesized
tcagaaagcagagagtaaatga

SEQ ID NO: 1296452 - DNA, 22 bp, Artificial Sequence
  chemically synthesized
aatgtatgctttcaactgactc

SEQ ID NO: 1296453 - DNA, 22 bp, Artificial Sequence
  chemically synthesized
aaagacatctgaatgtatgctt

SEQ ID NO: 1296454 - DNA, 22 bp, Artificial Sequence
  chemically synthesized
caaagacatctgaatgtatgct

SEQ ID NO: 1296455 - DNA, 22 bp, Artificial Sequence
  chemically synthesized
ggtatgtttcaaagacatctga

SEQ ID NO: 1296456 - DNA, 22 bp, Artificial Sequence
  chemically synthesized
aaagcatacattcagatgtctt

SEQ ID NO: 1296457 - DNA, 22 bp, Artificial Sequence
  chemically synthesized
gggtatgtttcaaagacatctg

SEQ ID NO: 1296458 - DNA, 22 bp, Artificial Sequence
  chemically synthesized
tgggtatgtttcaaagacatct

SEQ ID NO: 1296459 - DNA, 22 bp, Artificial Sequence
  chemically synthesized
gcagagggttttgggtatgttt

SEQ ID NO: 1296460 - DNA, 22 bp, Artificial Sequence
  chemically synthesized
agatgtctttgaaacataccca

SEQ ID NO: 1296461 - DNA, 22 bp, Artificial Sequence
  chemically synthesized
ggcagagggttttgggtatgtt

SEQ ID NO: 1296462 - DNA, 22 bp, Artificial Sequence
  chemically synthesized
tggcagagggttttgggtatgt

SEQ ID NO: 1296463 - DNA, 22 bp, Artificial Sequence
  chemically synthesized
ttggcagagggttttgggtatg

SEQ ID NO: 1296464 - DNA, 22 bp, Artificial Sequence
  chemically synthesized
agcttttggcagagggttttgg

SEQ ID NO: 1296465 - DNA, 22 bp, Artificial Sequence
  chemically synthesized
tgaaacatacccaaaaccctct

SEQ ID NO: 1296466 - DNA, 22 bp, Artificial Sequence
  chemically synthesized
gaaacatacccaaaaccctctg

SEQ ID NO: 1296467 - DNA, 22 bp, Artificial Sequence
  chemically synthesized
aaacatacccaaaaccctctgc

SEQ ID NO: 1296468 - DNA, 22 bp, Artificial Sequence
  chemically synthesized
atattgagcttttggcagaggg

SEQ ID NO: 1296469 - DNA, 22 bp, Artificial Sequence
  chemically synthesized
aaaagacctcatattgagcttt

SEQ ID NO: 1296470 - DNA, 22 bp, Artificial Sequence
  chemically synthesized
caaaagacctcatattgagctt

SEQ ID NO: 1296471 - DNA, 22 bp, Artificial Sequence
  chemically synthesized
tgccaaaagctcaatatgaggt

SEQ ID NO: 1296472 - DNA, 22 bp, Artificial Sequence
  chemically synthesized
ccaaaagctcaatatgaggtct

SEQ ID NO: 1296473 - DNA, 22 bp, Artificial Sequence
  chemically synthesized
aatcacttcaaaagacctcata

SEQ ID NO: 1296474 - DNA, 22 bp, Artificial Sequence
  chemically synthesized
gattaaatcacttcaaaagacc

SEQ ID NO: 1296475 - DNA, 22 bp, Artificial Sequence
  chemically synthesized
tagattaaatcacttcaaaaga

SEQ ID NO: 1296476 - DNA, 22 bp, Artificial Sequence
  chemically synthesized
aatatgaggtcttttgaagtga

SEQ ID NO: 1296477 - DNA, 22 bp, Artificial Sequence
  chemically synthesized
aaagcctctagattaaatcact

SEQ ID NO: 1296478 - DNA, 22 bp, Artificial Sequence
  chemically synthesized
aaaagcctctagattaaatcac

SEQ ID NO: 1296479 - DNA, 22 bp, Artificial Sequence
  chemically synthesized
acttaaaagcctctagattaaa

SEQ ID NO: 1296480 - DNA, 22 bp, Artificial Sequence
  chemically synthesized
cacttaaaagcctctagattaa

SEQ ID NO: 1296481 - DNA, 22 bp, Artificial Sequence
  chemically synthesized
tcacttaaaagcctctagatta

SEQ ID NO: 1296482 - DNA, 22 bp, Artificial Sequence
  chemically synthesized
ttgaagtgatttaatctagagg

SEQ ID NO: 1296483 - DNA, 22 bp, Artificial Sequence
  chemically synthesized
ttcacttaaaagcctctagatt

SEQ ID NO: 1296484 - DNA, 22 bp, Artificial Sequence
  chemically synthesized
tgaagtgatttaatctagaggc

SEQ ID NO: 1296485 - DNA, 22 bp, Artificial Sequence
  chemically synthesized
gaagtgatttaatctagaggct

SEQ ID NO: 1296486 - DNA, 22 bp, Artificial Sequence
  chemically synthesized
aagtgatttaatctagaggctt

SEQ ID NO: 1296487 - DNA, 22 bp, Artificial Sequence
  chemically synthesized
cgtatttttcacttaaaagcct

SEQ ID NO: 1296488 - DNA, 22 bp, Artificial Sequence
  chemically synthesized
ctacgtatttttcacttaaaag

SEQ ID NO: 1296489 - DNA, 22 bp, Artificial Sequence
  chemically synthesized
aatctagaggcttttaagtgaa

SEQ ID NO: 1296490 - DNA, 22 bp, Artificial Sequence
  chemically synthesized
tactacgtatttttcacttaaa

SEQ ID NO: 1296491 - DNA, 22 bp, Artificial Sequence
  chemically synthesized
atctagaggcttttaagtgaaa

SEQ ID NO: 1296492 - DNA, 22 bp, Artificial Sequence
  chemically synthesized
ttctactacgtatttttcactt

SEQ ID NO: 1296493 - DNA, 22 bp, Artificial Sequence
  chemically synthesized
attctactacgtatttttcact

SEQ ID NO: 1296494 - DNA, 22 bp, Artificial Sequence
  chemically synthesized
tattctactacgtatttttcac

SEQ ID NO: 1296495 - DNA, 22 bp, Artificial Sequence
  chemically synthesized
gaggcttttaagtgaaaaatac

SEQ ID NO: 1296496 - DNA, 22 bp, Artificial Sequence
  chemically synthesized
ttaagtgaaaaatacgtagtag

SEQ ID NO: 1296497 - DNA, 22 bp, Artificial Sequence
  chemically synthesized
taagtgaaaaatacgtagtaga

SEQ ID NO: 1296498 - DNA, 22 bp, Artificial Sequence
  chemically synthesized
aagtgaaaaatacgtagtagaa

SEQ ID NO: 1296499 - DNA, 22 bp, Artificial Sequence
  chemically synthesized
agtgaaaaatacgtagtagaat

SEQ ID NO: 1296500 - DNA, 22 bp, Artificial Sequence
  chemically synthesized
aaaagaataaaaattttattct

SEQ ID NO: 1296501 - DNA, 22 bp, Artificial Sequence
  chemically synthesized
tccatataattgaaaagaataa

SEQ ID NO: 1296502 - DNA, 22 bp, Artificial Sequence
  chemically synthesized
gtccatataattgaaaagaata

SEQ ID NO: 1296503 - DNA, 22 bp, Artificial Sequence
  chemically synthesized
cttgtccatataattgaaaaga

SEQ ID NO: 1296504 - DNA, 22 bp, Artificial Sequence
  chemically synthesized
ctccttgtccatataattgaaa

SEQ ID NO: 1296505 - DNA, 22 bp, Artificial Sequence
  chemically synthesized
ttattcttttcaattatatgga

SEQ ID NO: 1296506 - DNA, 22 bp, Artificial Sequence
  chemically synthesized
tattcttttcaattatatggac

SEQ ID NO: 1296507 - DNA, 22 bp, Artificial Sequence
  chemically synthesized
attcttttcaattatatggaca

SEQ ID NO: 1296508 - DNA, 22 bp, Artificial Sequence
  chemically synthesized
aaaattactccttgtccatata

SEQ ID NO: 1296509 - DNA, 22 bp, Artificial Sequence
  chemically synthesized
ttcttttcaattatatggacaa

SEQ ID NO: 1296510 - DNA, 22 bp, Artificial Sequence
  chemically synthesized
ttttcaattatatggacaagga

SEQ ID NO: 1296511 - DNA, 22 bp, Artificial Sequence
  chemically synthesized
cctaaaaattactccttgtcca

SEQ ID NO: 1296512 - DNA, 22 bp, Artificial Sequence
  chemically synthesized
acctaaaaattactccttgtcc

SEQ ID NO: 1296513 - DNA, 22 bp, Artificial Sequence
  chemically synthesized
ttcaattatatggacaaggagt

SEQ ID NO: 1296514 - DNA, 22 bp, Artificial Sequence
  chemically synthesized
tcaattatatggacaaggagta

SEQ ID NO: 1296515 - DNA, 22 bp, Artificial Sequence
  chemically synthesized
caattatatggacaaggagtaa

SEQ ID NO: 1296516 - DNA, 22 bp, Artificial Sequence
  chemically synthesized
aattatatggacaaggagtaat

SEQ ID NO: 1296517 - DNA, 22 bp, Artificial Sequence
  chemically synthesized
gatgcttacctaaaaattactc

SEQ ID NO: 1296518 - DNA, 22 bp, Artificial Sequence
  chemically synthesized
cgatgcttacctaaaaattact

SEQ ID NO: 1296519 - DNA, 22 bp, Artificial Sequence
  chemically synthesized
tatggacaaggagtaattttta

SEQ ID NO: 1296520 - DNA, 22 bp, Artificial Sequence
  chemically synthesized
ccttcgatgcttacctaaaaat

SEQ ID NO: 1296521 - DNA, 22 bp, Artificial Sequence
  chemically synthesized
gtgctgccttcgatgcttacct

SEQ ID NO: 1296522 - DNA, 22 bp, Artificial Sequence
  chemically synthesized
cgtgctgccttcgatgcttacc

SEQ ID NO: 1296523 - DNA, 22 bp, Artificial Sequence
  chemically synthesized
tcgtgctgccttcgatgcttac

SEQ ID NO: 1296524 - DNA, 22 bp, Artificial Sequence
  chemically synthesized
ttaggtaagcatcgaaggcagc

SEQ ID NO: 1296525 - DNA, 22 bp, Artificial Sequence
  chemically synthesized
taggtaagcatcgaaggcagca

SEQ ID NO: 1296526 - DNA, 22 bp, Artificial Sequence
  chemically synthesized
aggtaagcatcgaaggcagcac

SEQ ID NO: 1296527 - DNA, 22 bp, Artificial Sequence
  chemically synthesized
ggtaagcatcgaaggcagcacg

SEQ ID NO: 1296528 - DNA, 22 bp, Artificial Sequence
  chemically synthesized
cacataatgtcaaggttttcgt

SEQ ID NO: 1296529 - DNA, 22 bp, Artificial Sequence
  chemically synthesized
gcacataatgtcaaggttttcg

SEQ ID NO: 1296530 - DNA, 22 bp, Artificial Sequence
  chemically synthesized
tgcacataatgtcaaggttttc

SEQ ID NO: 1296531 - DNA, 22 bp, Artificial Sequence
  chemically synthesized
gacattatgtgcaaagtgttac

SEQ ID NO: 1296532 - DNA, 22 bp, Artificial Sequence
  chemically synthesized
cacagtaaataagtaacacttt

SEQ ID NO: 1296533 - DNA, 22 bp, Artificial Sequence
  chemically synthesized
acattatgtgcaaagtgttact

SEQ ID NO: 1296534 - DNA, 22 bp, Artificial Sequence
  chemically synthesized
acacagtaaataagtaacactt

SEQ ID NO: 1296535 - DNA, 22 bp, Artificial Sequence
  chemically synthesized
tttacacagtaaataagtaaca

SEQ ID NO: 1296536 - DNA, 22 bp, Artificial Sequence
  chemically synthesized
tgtgcaaagtgttacttattta

SEQ ID NO: 1296537 - DNA, 22 bp, Artificial Sequence
  chemically synthesized
gtgttatttacacagtaaataa

SEQ ID NO: 1296538 - DNA, 22 bp, Artificial Sequence
  chemically synthesized
agtgttatttacacagtaaata

SEQ ID NO: 1296539 - DNA, 22 bp, Artificial Sequence
  chemically synthesized
acatttagtgttatttacacag

SEQ ID NO: 1296540 - DNA, 22 bp, Artificial Sequence
  chemically synthesized
cttatttactgtgtaaataaca

SEQ ID NO: 1296541 - DNA, 22 bp, Artificial Sequence
  chemically synthesized
aagctcacatttagtgttattt

SEQ ID NO: 1296542 - DNA, 22 bp, Artificial Sequence
  chemically synthesized
atttactgtgtaaataacacta

SEQ ID NO: 1296543 - DNA, 22 bp, Artificial Sequence
  chemically synthesized
tttactgtgtaaataacactaa

SEQ ID NO: 1296544 - DNA, 22 bp, Artificial Sequence
  chemically synthesized
actgtgtaaataacactaaatg

SEQ ID NO: 1296545 - DNA, 22 bp, Artificial Sequence
  chemically synthesized
ctgtgtaaataacactaaatgt

SEQ ID NO: 1296546 - DNA, 22 bp, Artificial Sequence
  chemically synthesized
tatgttgaagctcacatttagt

SEQ ID NO: 1296547 - DNA, 22 bp, Artificial Sequence
  chemically synthesized
atatgttgaagctcacatttag

SEQ ID NO: 1296548 - DNA, 22 bp, Artificial Sequence
  chemically synthesized
tgtaaataacactaaatgtgag

SEQ ID NO: 1296549 - DNA, 22 bp, Artificial Sequence
  chemically synthesized
gcaaagatgtttatatgttgaa

SEQ ID NO: 1296550 - DNA, 22 bp, Artificial Sequence
  chemically synthesized
aatgtgagcttcaacatataaa

SEQ ID NO: 1296551 - DNA, 22 bp, Artificial Sequence
  chemically synthesized
caacatataaacatctttgcta

SEQ ID NO: 1296552 - DNA, 22 bp, Artificial Sequence
  chemically synthesized
aacatataaacatctttgctag

SEQ ID NO: 1296553 - DNA, 22 bp, Artificial Sequence
  chemically synthesized
aagacgtagaggtgagagagga

SEQ ID NO: 1296554 - DNA, 22 bp, Artificial Sequence
  chemically synthesized
tgctagttgtcctctctcacct

SEQ ID NO: 1296555 - DNA, 22 bp, Artificial Sequence
  chemically synthesized
gctagttgtcctctctcacctc

SEQ ID NO: 1296556 - DNA, 22 bp, Artificial Sequence
  chemically synthesized
ctagttgtcctctctcacctct

SEQ ID NO: 1296557 - DNA, 22 bp, Artificial Sequence
  chemically synthesized
tattaaagacgtagaggtgaga

SEQ ID NO: 1296558 - DNA, 22 bp, Artificial Sequence
  chemically synthesized
gtattaaagacgtagaggtgag

SEQ ID NO: 1296559 - DNA, 22 bp, Artificial Sequence
  chemically synthesized
gttgtcctctctcacctctacg

SEQ ID NO: 1296560 - DNA, 22 bp, Artificial Sequence
  chemically synthesized
ttgtattaaagacgtagaggtg

SEQ ID NO: 1296561 - DNA, 22 bp, Artificial Sequence
  chemically synthesized
cttgtattaaagacgtagaggt

SEQ ID NO: 1296562 - DNA, 22 bp, Artificial Sequence
  chemically synthesized
tcttgtattaaagacgtagagg

SEQ ID NO: 1296563 - DNA, 22 bp, Artificial Sequence
  chemically synthesized
ttcttgtattaaagacgtagag

SEQ ID NO: 1296564 - DNA, 22 bp, Artificial Sequence
  chemically synthesized
tcctctctcacctctacgtctt

SEQ ID NO: 1296565 - DNA, 22 bp, Artificial Sequence
  chemically synthesized
tctcacctctacgtctttaata

SEQ ID NO: 1296566 - DNA, 22 bp, Artificial Sequence
  chemically synthesized
tcacctctacgtctttaataca

SEQ ID NO: 1296567 - DNA, 22 bp, Artificial Sequence
  chemically synthesized
aagacatttttcttgtattaaa

SEQ ID NO: 1296568 - DNA, 22 bp, Artificial Sequence
  chemically synthesized
acctctacgtctttaatacaag

SEQ ID NO: 1296569 - DNA, 22 bp, Artificial Sequence
  chemically synthesized
attgaagacatttttcttgtat

SEQ ID NO: 1296570 - DNA, 22 bp, Artificial Sequence
  chemically synthesized
tacgtctttaatacaagaaaaa

SEQ ID NO: 1296571 - DNA, 22 bp, Artificial Sequence
  chemically synthesized
cgtctttaatacaagaaaaatg

SEQ ID NO: 1296572 - DNA, 22 bp, Artificial Sequence
  chemically synthesized
taatacaagaaaaatgtcttca

SEQ ID NO: 1296573 - DNA, 22 bp, Artificial Sequence
  chemically synthesized
aatacaagaaaaatgtcttcaa

SEQ ID NO: 1296574 - DNA, 22 bp, Artificial Sequence
  chemically synthesized
atacaagaaaaatgtcttcaat

SEQ ID NO: 1296575 - DNA, 22 bp, Artificial Sequence
  chemically synthesized
taccaaaataagacaataattc

SEQ ID NO: 1296576 - DNA, 22 bp, Artificial Sequence
  chemically synthesized
ctataccaaaataagacaataa

SEQ ID NO: 1296577 - DNA, 22 bp, Artificial Sequence
  chemically synthesized
caatgaattattgtcttatttt

SEQ ID NO: 1296578 - DNA, 22 bp, Artificial Sequence
  chemically synthesized
aatgaattattgtcttattttg

SEQ ID NO: 1296579 - DNA, 22 bp, Artificial Sequence
  chemically synthesized
ttgtcttattttggtatagtag

SEQ ID NO: 1296580 - DNA, 22 bp, Artificial Sequence
  chemically synthesized
aagaaaatatatgctactatac

SEQ ID NO: 1296581 - DNA, 22 bp, Artificial Sequence
  chemically synthesized
tcttattttggtatagtagcat

SEQ ID NO: 1296582 - DNA, 22 bp, Artificial Sequence
  chemically synthesized
tgttgaagaaaatatatgctac

SEQ ID NO: 1296583 - DNA, 22 bp, Artificial Sequence
  chemically synthesized
attttggtatagtagcatatat

SEQ ID NO: 1296584 - DNA, 22 bp, Artificial Sequence
  chemically synthesized
ttttggtatagtagcatatatt

SEQ ID NO: 1296585 - DNA, 22 bp, Artificial Sequence
  chemically synthesized
ttatgttgaagaaaatatatgc

SEQ ID NO: 1296586 - DNA, 22 bp, Artificial Sequence
  chemically synthesized
tggtatagtagcatatattttc

SEQ ID NO: 1296587 - DNA, 22 bp, Artificial Sequence
  chemically synthesized
ggtatagtagcatatattttct

SEQ ID NO: 1296588 - DNA, 22 bp, Artificial Sequence
  chemically synthesized
gtatagtagcatatattttctt

SEQ ID NO: 1296589 - DNA, 22 bp, Artificial Sequence
  chemically synthesized
ataattattatgttgaagaaaa

SEQ ID NO: 1296590 - DNA, 22 bp, Artificial Sequence
  chemically synthesized
tattaataattattatgttgaa

SEQ ID NO: 1296591 - DNA, 22 bp, Artificial Sequence
  chemically synthesized
attgtattaataattattatgt

SEQ ID NO: 1296592 - DNA, 22 bp, Artificial Sequence
  chemically synthesized
tcttcaacataataattattaa

SEQ ID NO: 1296593 - DNA, 22 bp, Artificial Sequence
  chemically synthesized
cttcaacataataattattaat

SEQ ID NO: 1296594 - DNA, 22 bp, Artificial Sequence
  chemically synthesized
ttcaacataataattattaata

SEQ ID NO: 1296595 - DNA, 22 bp, Artificial Sequence
  chemically synthesized
caacataataattattaataca

SEQ ID NO: 1296596 - DNA, 22 bp, Artificial Sequence
  chemically synthesized
aacataataattattaatacaa

SEQ ID NO: 1296597 - DNA, 22 bp, Artificial Sequence
  chemically synthesized
taataataatacaattaattgt

SEQ ID NO: 1296598 - DNA, 22 bp, Artificial Sequence
  chemically synthesized
ataataataatacaattaattg

SEQ ID NO: 1296599 - DNA, 22 bp, Artificial Sequence
  chemically synthesized
tataataataatacaattaatt

SEQ ID NO: 1296600 - DNA, 22 bp, Artificial Sequence
  chemically synthesized
ttaatacaattaattgtattat

SEQ ID NO: 1296601 - DNA, 22 bp, Artificial Sequence
  chemically synthesized
tgtattttataataataataca

SEQ ID NO: 1296602 - DNA, 22 bp, Artificial Sequence
  chemically synthesized
atacaattaattgtattattat

SEQ ID NO: 1296603 - DNA, 22 bp, Artificial Sequence
  chemically synthesized
ttatgtattttataataataat

SEQ ID NO: 1296604 - DNA, 22 bp, Artificial Sequence
  chemically synthesized
attgtattattattataaaata

SEQ ID NO: 1296605 - DNA, 22 bp, Artificial Sequence
  chemically synthesized
agaattgttatgtattttataa

SEQ ID NO: 1296606 - DNA, 22 bp, Artificial Sequence
  chemically synthesized
tattattattataaaatacata

SEQ ID NO: 1296607 - DNA, 22 bp, Artificial Sequence
  chemically synthesized
ttattataaaatacataacaat

SEQ ID NO: 1296608 - DNA, 22 bp, Artificial Sequence
  chemically synthesized
ttataaaatacataacaattct

SEQ ID NO: 1296609 - DNA, 22 bp, Artificial Sequence
  chemically synthesized
taaaatacataacaattcttag

SEQ ID NO: 1296610 - DNA, 22 bp, Artificial Sequence
  chemically synthesized
tgaatagtaaggcactaagaat

SEQ ID NO: 1296611 - DNA, 22 bp, Artificial Sequence
  chemically synthesized
atgaatagtaaggcactaagaa

SEQ ID NO: 1296612 - DNA, 22 bp, Artificial Sequence
  chemically synthesized
aaacaaacttatgaatagtaag

SEQ ID NO: 1296613 - DNA, 22 bp, Artificial Sequence
  chemically synthesized
ttagtgccttactattcataag

SEQ ID NO: 1296614 - DNA, 22 bp, Artificial Sequence
  chemically synthesized
agtgccttactattcataagtt

SEQ ID NO: 1296615 - DNA, 22 bp, Artificial Sequence
  chemically synthesized
gtgccttactattcataagttt

SEQ ID NO: 1296616 - DNA, 22 bp, Artificial Sequence
  chemically synthesized
agaagacataattaaaacaaac

SEQ ID NO: 1296617 - DNA, 22 bp, Artificial Sequence
  chemically synthesized
actattcataagtttgttttaa

SEQ ID NO: 1296618 - DNA, 22 bp, Artificial Sequence
  chemically synthesized
ctattcataagtttgttttaat

SEQ ID NO: 1296619 - DNA, 22 bp, Artificial Sequence
  chemically synthesized
ttcataagtttgttttaattat

SEQ ID NO: 1296620 - DNA, 22 bp, Artificial Sequence
  chemically synthesized
ataagtttgttttaattatgtc

SEQ ID NO: 1296621 - DNA, 22 bp, Artificial Sequence
  chemically synthesized
catacagattgagaagacataa

SEQ ID NO: 1296622 - DNA, 22 bp, Artificial Sequence
  chemically synthesized
gttttaattatgtcttctcaat

SEQ ID NO: 1296623 - DNA, 22 bp, Artificial Sequence
  chemically synthesized
ttttaattatgtcttctcaatc

SEQ ID NO: 1296624 - DNA, 22 bp, Artificial Sequence
  chemically synthesized
taattatgtcttctcaatctgt

SEQ ID NO: 1296625 - DNA, 22 bp, Artificial Sequence
  chemically synthesized
aattatgtcttctcaatctgta

SEQ ID NO: 1296626 - DNA, 22 bp, Artificial Sequence
  chemically synthesized
attatgtcttctcaatctgtat

SEQ ID NO: 1296627 - DNA, 22 bp, Artificial Sequence
  chemically synthesized
tgtcttctcaatctgtatgtaa

SEQ ID NO: 1296628 - DNA, 22 bp, Artificial Sequence
  chemically synthesized
tgtataaagtagtaaattacat

SEQ ID NO: 1296629 - DNA, 22 bp, Artificial Sequence
  chemically synthesized
atgtataaagtagtaaattaca

SEQ ID NO: 1296630 - DNA, 22 bp, Artificial Sequence
  chemically synthesized
ctcaatctgtatgtaatttact

SEQ ID NO: 1296631 - DNA, 22 bp, Artificial Sequence
  chemically synthesized
tcaatctgtatgtaatttacta

SEQ ID NO: 1296632 - DNA, 22 bp, Artificial Sequence
  chemically synthesized
aatctgtatgtaatttactact

SEQ ID NO: 1296633 - DNA, 22 bp, Artificial Sequence
  chemically synthesized
tgtttatgtataaagtagtaaa

SEQ ID NO: 1296634 - DNA, 22 bp, Artificial Sequence
  chemically synthesized
gtgtttatgtataaagtagtaa

SEQ ID NO: 1296635 - DNA, 22 bp, Artificial Sequence
  chemically synthesized
tatgtaatttactactttatac

SEQ ID NO: 1296636 - DNA, 22 bp, Artificial Sequence
  chemically synthesized
agcttgtgtttatgtataaagt

SEQ ID NO: 1296637 - DNA, 22 bp, Artificial Sequence
  chemically synthesized
tcagcttgtgtttatgtataaa

SEQ ID NO: 1296638 - DNA, 22 bp, Artificial Sequence
  chemically synthesized
ctcagcttgtgtttatgtataa

SEQ ID NO: 1296639 - DNA, 22 bp, Artificial Sequence
  chemically synthesized
cttctcagcttgtgtttatgta

SEQ ID NO: 1296640 - DNA, 22 bp, Artificial Sequence
  chemically synthesized
actactttatacataaacacaa

SEQ ID NO: 1296641 - DNA, 22 bp, Artificial Sequence
  chemically synthesized
ttccttctcagcttgtgtttat

SEQ ID NO: 1296642 - DNA, 22 bp, Artificial Sequence
  chemically synthesized
ctactttatacataaacacaag

SEQ ID NO: 1296643 - DNA, 22 bp, Artificial Sequence
  chemically synthesized
attccttctcagcttgtgttta

SEQ ID NO: 1296644 - DNA, 22 bp, Artificial Sequence
  chemically synthesized
tattccttctcagcttgtgttt

SEQ ID NO: 1296645 - DNA, 22 bp, Artificial Sequence
  chemically synthesized
ctttatacataaacacaagctg

SEQ ID NO: 1296646 - DNA, 22 bp, Artificial Sequence
  chemically synthesized
tatacataaacacaagctgaga

SEQ ID NO: 1296647 - DNA, 22 bp, Artificial Sequence
  chemically synthesized
atacataaacacaagctgagaa

SEQ ID NO: 1296648 - DNA, 22 bp, Artificial Sequence
  chemically synthesized
tacataaacacaagctgagaag

SEQ ID NO: 1296649 - DNA, 22 bp, Artificial Sequence
  chemically synthesized
atagctttattccttctcagct

SEQ ID NO: 1296650 - DNA, 22 bp, Artificial Sequence
  chemically synthesized
aatagctttattccttctcagc

SEQ ID NO: 1296651 - DNA, 22 bp, Artificial Sequence
  chemically synthesized
tcacttaatagctttattcctt

SEQ ID NO: 1296652 - DNA, 22 bp, Artificial Sequence
  chemically synthesized
tgtcacttaatagctttattcc

SEQ ID NO: 1296653 - DNA, 22 bp, Artificial Sequence
  chemically synthesized
ctgtcacttaatagctttattc

SEQ ID NO: 1296654 - DNA, 22 bp, Artificial Sequence
  chemically synthesized
atttctgtcacttaatagcttt

SEQ ID NO: 1296655 - DNA, 22 bp, Artificial Sequence
  chemically synthesized
agaaggaataaagctattaagt

SEQ ID NO: 1296656 - DNA, 22 bp, Artificial Sequence
  chemically synthesized
tatcaagttcatttctgtcact

SEQ ID NO: 1296657 - DNA, 22 bp, Artificial Sequence
  chemically synthesized
ttaagtgacagaaatgaacttg

SEQ ID NO: 1296658 - DNA, 22 bp, Artificial Sequence
  chemically synthesized
agaaaatctgtatcaagttcat

SEQ ID NO: 1296659 - DNA, 22 bp, Artificial Sequence
  chemically synthesized
agtgacagaaatgaacttgata

SEQ ID NO: 1296660 - DNA, 22 bp, Artificial Sequence
  chemically synthesized
attcagaaaatctgtatcaagt

SEQ ID NO: 1296661 - DNA, 22 bp, Artificial Sequence
  chemically synthesized
gattcagaaaatctgtatcaag

SEQ ID NO: 1296662 - DNA, 22 bp, Artificial Sequence
  chemically synthesized
tgattcagaaaatctgtatcaa

SEQ ID NO: 1296663 - DNA, 22 bp, Artificial Sequence
  chemically synthesized
gatacagattttctgaatcaaa

SEQ ID NO: 1296664 - DNA, 22 bp, Artificial Sequence
  chemically synthesized
atacagattttctgaatcaaag

SEQ ID NO: 1296665 - DNA, 22 bp, Artificial Sequence
  chemically synthesized
gtcaatgtgaaaagccatggac

SEQ ID NO: 1296666 - DNA, 22 bp, Artificial Sequence
  chemically synthesized
tctgaatcaaagtccatggctt

SEQ ID NO: 1296667 - DNA, 22 bp, Artificial Sequence
  chemically synthesized
ctgaatcaaagtccatggcttt

SEQ ID NO: 1296668 - DNA, 22 bp, Artificial Sequence
  chemically synthesized
tgaatcaaagtccatggctttt

SEQ ID NO: 1296669 - DNA, 22 bp, Artificial Sequence
  chemically synthesized
aatcaaagtccatggcttttca

SEQ ID NO: 1296670 - DNA, 22 bp, Artificial Sequence
  chemically synthesized
taatgtaaatgatagatatctg

SEQ ID NO: 1296671 - DNA, 22 bp, Artificial Sequence
  chemically synthesized
ttcacattgaccagatatctat

SEQ ID NO: 1296672 - DNA, 22 bp, Artificial Sequence
  chemically synthesized
tcacattgaccagatatctatc

SEQ ID NO: 1296673 - DNA, 22 bp, Artificial Sequence
  chemically synthesized
cacattgaccagatatctatca

SEQ ID NO: 1296674 - DNA, 22 bp, Artificial Sequence
  chemically synthesized
acattgaccagatatctatcat

SEQ ID NO: 1296675 - DNA, 22 bp, Artificial Sequence
  chemically synthesized
tgcaattataatgtaaatgata

SEQ ID NO: 1296676 - DNA, 22 bp, Artificial Sequence
  chemically synthesized
accagatatctatcatttacat

SEQ ID NO: 1296677 - DNA, 22 bp, Artificial Sequence
  chemically synthesized
attatgcaattataatgtaaat

SEQ ID NO: 1296678 - DNA, 22 bp, Artificial Sequence
  chemically synthesized
ttaattatgcaattataatgta

SEQ ID NO: 1296679 - DNA, 22 bp, Artificial Sequence
  chemically synthesized
tattgttaattatgcaattata

SEQ ID NO: 1296680 - DNA, 22 bp, Artificial Sequence
  chemically synthesized
tcatttacattataattgcata

SEQ ID NO: 1296681 - DNA, 22 bp, Artificial Sequence
  chemically synthesized
tgtattgttaattatgcaatta

SEQ ID NO: 1296682 - DNA, 22 bp, Artificial Sequence
  chemically synthesized
acattataattgcataattaac

SEQ ID NO: 1296683 - DNA, 22 bp, Artificial Sequence
  chemically synthesized
cattataattgcataattaaca

SEQ ID NO: 1296684 - DNA, 22 bp, Artificial Sequence
  chemically synthesized
tggtattctgtattgttaatta

SEQ ID NO: 1296685 - DNA, 22 bp, Artificial Sequence
  chemically synthesized
atggtattctgtattgttaatt

SEQ ID NO: 1296686 - DNA, 22 bp, Artificial Sequence
  chemically synthesized
taattgcataattaacaataca

SEQ ID NO: 1296687 - DNA, 22 bp, Artificial Sequence
  chemically synthesized
tcttatggtattctgtattgtt

SEQ ID NO: 1296688 - DNA, 22 bp, Artificial Sequence
  chemically synthesized
attatcttatggtattctgtat

SEQ ID NO: 1296689 - DNA, 22 bp, Artificial Sequence
  chemically synthesized
cataattaacaatacagaatac

SEQ ID NO: 1296690 - DNA, 22 bp, Artificial Sequence
  chemically synthesized
tgattatcttatggtattctgt

SEQ ID NO: 1296691 - DNA, 22 bp, Artificial Sequence
  chemically synthesized
tgactctgattatcttatggta

SEQ ID NO: 1296692 - DNA, 22 bp, Artificial Sequence
  chemically synthesized
acaatacagaataccataagat

SEQ ID NO: 1296693 - DNA, 22 bp, Artificial Sequence
  chemically synthesized
gtgactctgattatcttatggt

SEQ ID NO: 1296694 - DNA, 22 bp, Artificial Sequence
  chemically synthesized
tgtgactctgattatcttatgg

SEQ ID NO: 1296695 - DNA, 22 bp, Artificial Sequence
  chemically synthesized
ttgtgactctgattatcttatg

SEQ ID NO: 1296696 - DNA, 22 bp, Artificial Sequence
  chemically synthesized
accttttgtgactctgattatc

SEQ ID NO: 1296697 - DNA, 22 bp, Artificial Sequence
  chemically synthesized
atatgttcaccttttgtgactc

SEQ ID NO: 1296698 - DNA, 22 bp, Artificial Sequence
  chemically synthesized
cgttaatatgttcaccttttgt

SEQ ID NO: 1296699 - DNA, 22 bp, Artificial Sequence
  chemically synthesized
gcgttaatatgttcaccttttg

SEQ ID NO: 1296700 - DNA, 22 bp, Artificial Sequence
  chemically synthesized
catttgcgttaatatgttcacc

SEQ ID NO: 1296701 - DNA, 22 bp, Artificial Sequence
  chemically synthesized
gcatttgcgttaatatgttcac

SEQ ID NO: 1296702 - DNA, 22 bp, Artificial Sequence
  chemically synthesized
tgcatttgcgttaatatgttca

SEQ ID NO: 1296703 - DNA, 22 bp, Artificial Sequence
  chemically synthesized
ttttgcatttgcgttaatatgt

SEQ ID NO: 1296704 - DNA, 22 bp, Artificial Sequence
  chemically synthesized
atggttgttttgcatttgcgtt

SEQ ID NO: 1296705 - DNA, 22 bp, Artificial Sequence
  chemically synthesized
catggttgttttgcatttgcgt

SEQ ID NO: 1296706 - DNA, 22 bp, Artificial Sequence
  chemically synthesized
atttcatggttgttttgcattt

SEQ ID NO: 1296707 - DNA, 22 bp, Artificial Sequence
  chemically synthesized
tgatttcatggttgttttgcat

SEQ ID NO: 1296708 - DNA, 22 bp, Artificial Sequence
  chemically synthesized
acgcaaatgcaaaacaaccatg

SEQ ID NO: 1296709 - DNA, 22 bp, Artificial Sequence
  chemically synthesized
aaaatagaagctctgatttcat

SEQ ID NO: 1296710 - DNA, 22 bp, Artificial Sequence
  chemically synthesized
ttcaaaatagaagctctgattt

SEQ ID NO: 1296711 - DNA, 22 bp, Artificial Sequence
  chemically synthesized
agttgttcaaaatagaagctct

SEQ ID NO: 1296712 - DNA, 22 bp, Artificial Sequence
  chemically synthesized
gagttgttcaaaatagaagctc

SEQ ID NO: 1296713 - DNA, 22 bp, Artificial Sequence
  chemically synthesized
cttgagttgttcaaaatagaag

SEQ ID NO: 1296714 - DNA, 22 bp, Artificial Sequence
  chemically synthesized
ctattttgaacaactcaaggag

SEQ ID NO: 1296715 - DNA, 22 bp, Artificial Sequence
  chemically synthesized
tattttgaacaactcaaggagg

SEQ ID NO: 1296716 - DNA, 22 bp, Artificial Sequence
  chemically synthesized
ttttgaacaactcaaggaggtt

SEQ ID NO: 1296717 - DNA, 22 bp, Artificial Sequence
  chemically synthesized
caacatacatggaacctccttg

SEQ ID NO: 1296718 - DNA, 22 bp, Artificial Sequence
  chemically synthesized
tgaacaactcaaggaggttcca

SEQ ID NO: 1296719 - DNA, 22 bp, Artificial Sequence
  chemically synthesized
gaacaactcaaggaggttccat

SEQ ID NO: 1296720 - DNA, 22 bp, Artificial Sequence
  chemically synthesized
aacaactcaaggaggttccatg

SEQ ID NO: 1296721 - DNA, 22 bp, Artificial Sequence
  chemically synthesized
acataggttacaacatacatgg

SEQ ID NO: 1296722 - DNA, 22 bp, Artificial Sequence
  chemically synthesized
aaggaggttccatgtatgttgt

SEQ ID NO: 1296723 - DNA, 22 bp, Artificial Sequence
  chemically synthesized
ttcacataggttacaacataca

SEQ ID NO: 1296724 - DNA, 22 bp, Artificial Sequence
  chemically synthesized
catgtatgttgtaacctatgtg

SEQ ID NO: 1296725 - DNA, 22 bp, Artificial Sequence
  chemically synthesized
caggacgctattcacataggtt

SEQ ID NO: 1296726 - DNA, 22 bp, Artificial Sequence
  chemically synthesized
ccaaattccaggacgctattca

SEQ ID NO: 1296727 - DNA, 22 bp, Artificial Sequence
  chemically synthesized
taacctatgtgaatagcgtcct

SEQ ID NO: 1296728 - DNA, 22 bp, Artificial Sequence
  chemically synthesized
tgcattgccaaattccaggacg

SEQ ID NO: 1296729 - DNA, 22 bp, Artificial Sequence
  chemically synthesized
tgtgaatagcgtcctggaattt

SEQ ID NO: 1296730 - DNA, 22 bp, Artificial Sequence
  chemically synthesized
atacagacaaataagttatgca

SEQ ID NO: 1296731 - DNA, 22 bp, Artificial Sequence
  chemically synthesized
gaatttggcaatgcataactta

SEQ ID NO: 1296732 - DNA, 22 bp, Artificial Sequence
  chemically synthesized
ggcaatgcataacttatttgtc

SEQ ID NO: 1296733 - DNA, 22 bp, Artificial Sequence
  chemically synthesized
gcaatgcataacttatttgtct

SEQ ID NO: 1296734 - DNA, 22 bp, Artificial Sequence
  chemically synthesized
gatcagttcatacagacaaata

SEQ ID NO: 1296735 - DNA, 22 bp, Artificial Sequence
  chemically synthesized
tagatcagttcatacagacaaa

SEQ ID NO: 1296736 - DNA, 22 bp, Artificial Sequence
  chemically synthesized
agttctagatcagttcatacag

SEQ ID NO: 1296737 - DNA, 22 bp, Artificial Sequence
  chemically synthesized
ttcagttctagatcagttcata

SEQ ID NO: 1296738 - DNA, 22 bp, Artificial Sequence
  chemically synthesized
atttgtctgtatgaactgatct

SEQ ID NO: 1296739 - DNA, 22 bp, Artificial Sequence
  chemically synthesized
tttgtctgtatgaactgatcta

SEQ ID NO: 1296740 - DNA, 22 bp, Artificial Sequence
  chemically synthesized
attattcagttctagatcagtt

SEQ ID NO: 1296741 - DNA, 22 bp, Artificial Sequence
  chemically synthesized
gtctgtatgaactgatctagaa

SEQ ID NO: 1296742 - DNA, 22 bp, Artificial Sequence
  chemically synthesized
tctgtatgaactgatctagaac

SEQ ID NO: 1296743 - DNA, 22 bp, Artificial Sequence
  chemically synthesized
tatgaactgatctagaactgaa

SEQ ID NO: 1296744 - DNA, 22 bp, Artificial Sequence
  chemically synthesized
aagaaggctcattattcagttc

SEQ ID NO: 1296745 - DNA, 22 bp, Artificial Sequence
  chemically synthesized
atctagaactgaataatgagcc

SEQ ID NO: 1296746 - DNA, 22 bp, Artificial Sequence
  chemically synthesized
gaactgaataatgagccttctt

SEQ ID NO: 1296747 - DNA, 22 bp, Artificial Sequence
  chemically synthesized
aataatgagccttctttaatgg

SEQ ID NO: 1296748 - DNA, 22 bp, Artificial Sequence
  chemically synthesized
acaaccatatcatccagcacca

SEQ ID NO: 1296749 - DNA, 22 bp, Artificial Sequence
  chemically synthesized
ctttaatggtgctggatgatat

SEQ ID NO: 1296750 - DNA, 22 bp, Artificial Sequence
  chemically synthesized
tttaatggtgctggatgatatg

SEQ ID NO: 1296751 - DNA, 22 bp, Artificial Sequence
  chemically synthesized
aagtattaacaaccatatcatc

SEQ ID NO: 1296752 - DNA, 22 bp, Artificial Sequence
  chemically synthesized
taatggtgctggatgatatggt

SEQ ID NO: 1296753 - DNA, 22 bp, Artificial Sequence
  chemically synthesized
gaagtattaacaaccatatcat

SEQ ID NO: 1296754 - DNA, 22 bp, Artificial Sequence
  chemically synthesized
aatggtgctggatgatatggtt

SEQ ID NO: 1296755 - DNA, 22 bp, Artificial Sequence
  chemically synthesized
atggtgctggatgatatggttg

SEQ ID NO: 1296756 - DNA, 22 bp, Artificial Sequence
  chemically synthesized
tttgaagtattaacaaccatat

SEQ ID NO: 1296757 - DNA, 22 bp, Artificial Sequence
  chemically synthesized
ttatttgaagtattaacaacca

SEQ ID NO: 1296758 - DNA, 22 bp, Artificial Sequence
  chemically synthesized
gatgatatggttgttaatactt

SEQ ID NO: 1296759 - DNA, 22 bp, Artificial Sequence
  chemically synthesized
ttaatacttcaaataataatgc

SEQ ID NO: 1296760 - DNA, 22 bp, Artificial Sequence
  chemically synthesized
gtaaatgtaaaagcattattat

SEQ ID NO: 1296761 - DNA, 22 bp, Artificial Sequence
  chemically synthesized
atacttcaaataataatgcttt

SEQ ID NO: 1296762 - DNA, 22 bp, Artificial Sequence
  chemically synthesized
caaataataatgcttttacatt

SEQ ID NO: 1296763 - DNA, 22 bp, Artificial Sequence
  chemically synthesized
aaataataatgcttttacattt

SEQ ID NO: 1296764 - DNA, 22 bp, Artificial Sequence
  chemically synthesized
aaataccaaatatcaattagta

SEQ ID NO: 1296765 - DNA, 22 bp, Artificial Sequence
  chemically synthesized
ttacatttactaattgatattt

SEQ ID NO: 1296766 - DNA, 22 bp, Artificial Sequence
  chemically synthesized
tacatttactaattgatatttg

SEQ ID NO: 1296767 - DNA, 22 bp, Artificial Sequence
  chemically synthesized
acatttactaattgatatttgg

SEQ ID NO: 1296768 - DNA, 22 bp, Artificial Sequence
  chemically synthesized
catttactaattgatatttggt

SEQ ID NO: 1296769 - DNA, 22 bp, Artificial Sequence
  chemically synthesized
actaattgatatttggtatttc

SEQ ID NO: 1296770 - DNA, 22 bp, Artificial Sequence
  chemically synthesized
ctaattgatatttggtatttca

SEQ ID NO: 1296771 - DNA, 22 bp, Artificial Sequence
  chemically synthesized
attgatatttggtatttcaatt

SEQ ID NO: 1296772 - DNA, 22 bp, Artificial Sequence
  chemically synthesized
atatttggtatttcaattttcg

SEQ ID NO: 1296773 - DNA, 22 bp, Artificial Sequence
  chemically synthesized
cataatgatatataagacgaaa

SEQ ID NO: 1296774 - DNA, 22 bp, Artificial Sequence
  chemically synthesized
ggtatttcaattttcgtcttat

SEQ ID NO: 1296775 - DNA, 22 bp, Artificial Sequence
  chemically synthesized
ccataatgatatataagacgaa

SEQ ID NO: 1296776 - DNA, 22 bp, Artificial Sequence
  chemically synthesized
gtatttcaattttcgtcttata

SEQ ID NO: 1296777 - DNA, 22 bp, Artificial Sequence
  chemically synthesized
caattttcgtcttatatatcat

SEQ ID NO: 1296778 - DNA, 22 bp, Artificial Sequence
  chemically synthesized
aattttcgtcttatatatcatt

SEQ ID NO: 1296779 - DNA, 22 bp, Artificial Sequence
  chemically synthesized
aaatgtttccataatgatatat

SEQ ID NO: 1296780 - DNA, 22 bp, Artificial Sequence
  chemically synthesized
tcgtcttatatatcattatgga

SEQ ID NO: 1296781 - DNA, 22 bp, Artificial Sequence
  chemically synthesized
cgtcttatatatcattatggaa

SEQ ID NO: 1296782 - DNA, 22 bp, Artificial Sequence
  chemically synthesized
gtcttatatatcattatggaaa

SEQ ID NO: 1296783 - DNA, 22 bp, Artificial Sequence
  chemically synthesized
gatgttaaaatgtttccataat

SEQ ID NO: 1296784 - DNA, 22 bp, Artificial Sequence
  chemically synthesized
ggatgttaaaatgtttccataa

SEQ ID NO: 1296785 - DNA, 22 bp, Artificial Sequence
  chemically synthesized
tggatgttaaaatgtttccata

SEQ ID NO: 1296786 - DNA, 22 bp, Artificial Sequence
  chemically synthesized
ttggatgttaaaatgtttccat

SEQ ID NO: 1296787 - DNA, 22 bp, Artificial Sequence
  chemically synthesized
atatatcattatggaaacattt

SEQ ID NO: 1296788 - DNA, 22 bp, Artificial Sequence
  chemically synthesized
tatatcattatggaaacatttt

SEQ ID NO: 1296789 - DNA, 22 bp, Artificial Sequence
  chemically synthesized
atttttggatgttaaaatgttt

SEQ ID NO: 1296790 - DNA, 22 bp, Artificial Sequence
  chemically synthesized
attgatttttggatgttaaaat

SEQ ID NO: 1296791 - DNA, 22 bp, Artificial Sequence
  chemically synthesized
gattgatttttggatgttaaaa

SEQ ID NO: 1296792 - DNA, 22 bp, Artificial Sequence
  chemically synthesized
tgattgatttttggatgttaaa

SEQ ID NO: 1296793 - DNA, 22 bp, Artificial Sequence
  chemically synthesized
tggaaacattttaacatccaaa

SEQ ID NO: 1296794 - DNA, 22 bp, Artificial Sequence
  chemically synthesized
taacatccaaaaatcaatcaaa

SEQ ID NO: 1296795 - DNA, 22 bp, Artificial Sequence
  chemically synthesized
aacatccaaaaatcaatcaaaa

SEQ ID NO: 1296796 - DNA, 22 bp, Artificial Sequence
  chemically synthesized
acatccaaaaatcaatcaaaat

SEQ ID NO: 1296797 - DNA, 22 bp, Artificial Sequence
  chemically synthesized
aaagtgtggacacaaaaatttt

SEQ ID NO: 1296798 - DNA, 22 bp, Artificial Sequence
  chemically synthesized
aaaagtgtggacacaaaaattt

SEQ ID NO: 1296799 - DNA, 22 bp, Artificial Sequence
  chemically synthesized
tggggaatttaaaagtgtggac

SEQ ID NO: 1296800 - DNA, 22 bp, Artificial Sequence
  chemically synthesized
atggggaatttaaaagtgtgga

SEQ ID NO: 1296801 - DNA, 22 bp, Artificial Sequence
  chemically synthesized
ttgtgtccacacttttaaattc

SEQ ID NO: 1296802 - DNA, 22 bp, Artificial Sequence
  chemically synthesized
tgtgtccacacttttaaattcc

SEQ ID NO: 1296803 - DNA, 22 bp, Artificial Sequence
  chemically synthesized
gtgtccacacttttaaattccc

SEQ ID NO: 1296804 - DNA, 22 bp, Artificial Sequence
  chemically synthesized
tgtccacacttttaaattcccc

SEQ ID NO: 1296805 - DNA, 22 bp, Artificial Sequence
  chemically synthesized
taagaaatatgtatttatgggg

SEQ ID NO: 1296806 - DNA, 22 bp, Artificial Sequence
  chemically synthesized
gttataagaaatatgtatttat

SEQ ID NO: 1296807 - DNA, 22 bp, Artificial Sequence
  chemically synthesized
ttaaattccccataaatacata

SEQ ID NO: 1296808 - DNA, 22 bp, Artificial Sequence
  chemically synthesized
ggttataagaaatatgtattta

SEQ ID NO: 1296809 - DNA, 22 bp, Artificial Sequence
  chemically synthesized
taaattccccataaatacatat

SEQ ID NO: 1296810 - DNA, 22 bp, Artificial Sequence
  chemically synthesized
tggttataagaaatatgtattt

SEQ ID NO: 1296811 - DNA, 22 bp, Artificial Sequence
  chemically synthesized
aaattccccataaatacatatt

SEQ ID NO: 1296812 - DNA, 22 bp, Artificial Sequence
  chemically synthesized
aattccccataaatacatattt

SEQ ID NO: 1296813 - DNA, 22 bp, Artificial Sequence
  chemically synthesized
ttttggttataagaaatatgta

SEQ ID NO: 1296814 - DNA, 22 bp, Artificial Sequence
  chemically synthesized
cccataaatacatatttcttat

SEQ ID NO: 1296815 - DNA, 22 bp, Artificial Sequence
  chemically synthesized
cttataaccaaaataatattct

SEQ ID NO: 1296816 - DNA, 22 bp, Artificial Sequence
  chemically synthesized
ttataaccaaaataatattctt

SEQ ID NO: 1296817 - DNA, 22 bp, Artificial Sequence
  chemically synthesized
ataaccaaaataatattctttc

SEQ ID NO: 1296818 - DNA, 22 bp, Artificial Sequence
  chemically synthesized
taaccaaaataatattctttct

SEQ ID NO: 1296819 - DNA, 22 bp, Artificial Sequence
  chemically synthesized
tgataaaataagtgaaaaagaa

SEQ ID NO: 1296820 - DNA, 22 bp, Artificial Sequence
  chemically synthesized
atgataaaataagtgaaaaaga

SEQ ID NO: 1296821 - DNA, 22 bp, Artificial Sequence
  chemically synthesized
tttctttttcacttattttatc

SEQ ID NO: 1296822 - DNA, 22 bp, Artificial Sequence
  chemically synthesized
tatgagatttatgataaaataa

SEQ ID NO: 1296823 - DNA, 22 bp, Artificial Sequence
  chemically synthesized
atatgagatttatgataaaata

SEQ ID NO: 1296824 - DNA, 22 bp, Artificial Sequence
  chemically synthesized
tctttttcacttattttatcat

SEQ ID NO: 1296825 - DNA, 22 bp, Artificial Sequence
  chemically synthesized
ctttttcacttattttatcata

SEQ ID NO: 1296826 - DNA, 22 bp, Artificial Sequence
  chemically synthesized
tttttcacttattttatcataa

SEQ ID NO: 1296827 - DNA, 22 bp, Artificial Sequence
  chemically synthesized
tttcacttattttatcataaat

SEQ ID NO: 1296828 - DNA, 22 bp, Artificial Sequence
  chemically synthesized
ttcacttattttatcataaatc

SEQ ID NO: 1296829 - DNA, 22 bp, Artificial Sequence
  chemically synthesized
tcacttattttatcataaatct

SEQ ID NO: 1296830 - DNA, 22 bp, Artificial Sequence
  chemically synthesized
cacttattttatcataaatctc

SEQ ID NO: 1296831 - DNA, 22 bp, Artificial Sequence
  chemically synthesized
acttattttatcataaatctca

SEQ ID NO: 1296832 - DNA, 22 bp, Artificial Sequence
  chemically synthesized
attttatcataaatctcatata

SEQ ID NO: 1296833 - DNA, 22 bp, Artificial Sequence
  chemically synthesized
ttttatcataaatctcatataa

SEQ ID NO: 1296834 - DNA, 22 bp, Artificial Sequence
  chemically synthesized
tatcataaatctcatataagct

SEQ ID NO: 1296835 - DNA, 22 bp, Artificial Sequence
  chemically synthesized
atcataaatctcatataagctg

SEQ ID NO: 1296836 - DNA, 22 bp, Artificial Sequence
  chemically synthesized
tcataaatctcatataagctgc

SEQ ID NO: 1296837 - DNA, 22 bp, Artificial Sequence
  chemically synthesized
atagcaaacaaaaggaaagagc

SEQ ID NO: 1296838 - DNA, 22 bp, Artificial Sequence
  chemically synthesized
taatagcaaacaaaaggaaaga

SEQ ID NO: 1296839 - DNA, 22 bp, Artificial Sequence
  chemically synthesized
atataagctgctctttcctttt

SEQ ID NO: 1296840 - DNA, 22 bp, Artificial Sequence
  chemically synthesized
gtctctaatagcaaacaaaagg

SEQ ID NO: 1296841 - DNA, 22 bp, Artificial Sequence
  chemically synthesized
agtctctaatagcaaacaaaag

SEQ ID NO: 1296842 - DNA, 22 bp, Artificial Sequence
  chemically synthesized
ctctttccttttgtttgctatt

SEQ ID NO: 1296843 - DNA, 22 bp, Artificial Sequence
  chemically synthesized
tgatttagtctctaatagcaaa

SEQ ID NO: 1296844 - DNA, 22 bp, Artificial Sequence
  chemically synthesized
tttccttttgtttgctattaga

SEQ ID NO: 1296845 - DNA, 22 bp, Artificial Sequence
  chemically synthesized
ttgtgatttagtctctaatagc

SEQ ID NO: 1296846 - DNA, 22 bp, Artificial Sequence
  chemically synthesized
tccttttgtttgctattagaga

SEQ ID NO: 1296847 - DNA, 22 bp, Artificial Sequence
  chemically synthesized
attgtgatttagtctctaatag

SEQ ID NO: 1296848 - DNA, 22 bp, Artificial Sequence
  chemically synthesized
ccttttgtttgctattagagac

SEQ ID NO: 1296849 - DNA, 22 bp, Artificial Sequence
  chemically synthesized
cttttgtttgctattagagact

SEQ ID NO: 1296850 - DNA, 22 bp, Artificial Sequence
  chemically synthesized
ttgtttgctattagagactaaa

SEQ ID NO: 1296851 - DNA, 22 bp, Artificial Sequence
  chemically synthesized
tgtttgctattagagactaaat

SEQ ID NO: 1296852 - DNA, 22 bp, Artificial Sequence
  chemically synthesized
gtttgctattagagactaaatc

SEQ ID NO: 1296853 - DNA, 22 bp, Artificial Sequence
  chemically synthesized
tttgctattagagactaaatca

SEQ ID NO: 1296854 - DNA, 22 bp, Artificial Sequence
  chemically synthesized
gctattagagactaaatcacaa

SEQ ID NO: 1296855 - DNA, 22 bp, Artificial Sequence
  chemically synthesized
ctattagagactaaatcacaat

SEQ ID NO: 1296856 - DNA, 22 bp, Artificial Sequence
  chemically synthesized
ttagagactaaatcacaataaa

SEQ ID NO: 1296857 - DNA, 22 bp, Artificial Sequence
  chemically synthesized
gagactaaatcacaataaacat

SEQ ID NO: 1296858 - DNA, 22 bp, Artificial Sequence
  chemically synthesized
aatcacaataaacatgctcatg

SEQ ID NO: 1296859 - DNA, 22 bp, Artificial Sequence
  chemically synthesized
taaaaacaaaaaagaagtgagt

SEQ ID NO: 1296860 - DNA, 22 bp, Artificial Sequence
  chemically synthesized
atgcactcacttcttttttgtt

SEQ ID NO: 1296861 - DNA, 22 bp, Artificial Sequence
  chemically synthesized
gaagacaattataaaaacaaaa

SEQ ID NO: 1296862 - DNA, 22 bp, Artificial Sequence
  chemically synthesized
cgaagacaattataaaaacaaa

SEQ ID NO: 1296863 - DNA, 22 bp, Artificial Sequence
  chemically synthesized
tcgaagacaattataaaaacaa

SEQ ID NO: 1296864 - DNA, 22 bp, Artificial Sequence
  chemically synthesized
ttcgaagacaattataaaaaca

SEQ ID NO: 1296865 - DNA, 22 bp, Artificial Sequence
  chemically synthesized
tttcgaagacaattataaaaac

SEQ ID NO: 1296866 - DNA, 22 bp, Artificial Sequence
  chemically synthesized
acttcttttttgtttttataat

SEQ ID NO: 1296867 - DNA, 22 bp, Artificial Sequence
  chemically synthesized
cttttttgtttttataattgtc

SEQ ID NO: 1296868 - DNA, 22 bp, Artificial Sequence
  chemically synthesized
ttttttgtttttataattgtct

SEQ ID NO: 1296869 - DNA, 22 bp, Artificial Sequence
  chemically synthesized
ataattttttcgaagacaatta

SEQ ID NO: 1296870 - DNA, 22 bp, Artificial Sequence
  chemically synthesized
ttttgtttttataattgtcttc

SEQ ID NO: 1296871 - DNA, 22 bp, Artificial Sequence
  chemically synthesized
tttgtttttataattgtcttcg

SEQ ID NO: 1296872 - DNA, 22 bp, Artificial Sequence
  chemically synthesized
ttgtttttataattgtcttcga

SEQ ID NO: 1296873 - DNA, 22 bp, Artificial Sequence
  chemically synthesized
tgtttttataattgtcttcgaa

SEQ ID NO: 1296874 - DNA, 22 bp, Artificial Sequence
  chemically synthesized
gtttttataattgtcttcgaaa

SEQ ID NO: 1296875 - DNA, 22 bp, Artificial Sequence
  chemically synthesized
aactgataattttttcgaagac

SEQ ID NO: 1296876 - DNA, 22 bp, Artificial Sequence
  chemically synthesized
tttttataattgtcttcgaaaa

SEQ ID NO: 1296877 - DNA, 22 bp, Artificial Sequence
  chemically synthesized
ttataattgtcttcgaaaaaat

SEQ ID NO: 1296878 - DNA, 22 bp, Artificial Sequence
  chemically synthesized
tataattgtcttcgaaaaaatt

SEQ ID NO: 1296879 - DNA, 22 bp, Artificial Sequence
  chemically synthesized
ataattgtcttcgaaaaaatta

SEQ ID NO: 1296880 - DNA, 22 bp, Artificial Sequence
  chemically synthesized
taattgtcttcgaaaaaattat

SEQ ID NO: 1296881 - DNA, 22 bp, Artificial Sequence
  chemically synthesized
ataatgttgaactgataatttt

SEQ ID NO: 1296882 - DNA, 22 bp, Artificial Sequence
  chemically synthesized
cataatgttgaactgataattt

SEQ ID NO: 1296883 - DNA, 22 bp, Artificial Sequence
  chemically synthesized
tcataatgttgaactgataatt

SEQ ID NO: 1296884 - DNA, 22 bp, Artificial Sequence
  chemically synthesized
tcttcgaaaaaattatcagttc

SEQ ID NO: 1296885 - DNA, 22 bp, Artificial Sequence
  chemically synthesized
cgaaaaaattatcagttcaaca

SEQ ID NO: 1296886 - DNA, 22 bp, Artificial Sequence
  chemically synthesized
gaaaaaattatcagttcaacat

SEQ ID NO: 1296887 - DNA, 22 bp, Artificial Sequence
  chemically synthesized
tcagttcaacattatgaaaacc

SEQ ID NO: 1296888 - DNA, 22 bp, Artificial Sequence
  chemically synthesized
gcaaaagtcataaaggttttca

SEQ ID NO: 1296889 - DNA, 22 bp, Artificial Sequence
  chemically synthesized
agcaaaagtcataaaggttttc

SEQ ID NO: 1296890 - DNA, 22 bp, Artificial Sequence
  chemically synthesized
aacattatgaaaacctttatga

SEQ ID NO: 1296891 - DNA, 22 bp, Artificial Sequence
  chemically synthesized
tgaaaacctttatgacttttgc

SEQ ID NO: 1296892 - DNA, 22 bp, Artificial Sequence
  chemically synthesized
taaagatatttagcaaaagtca

SEQ ID NO: 1296893 - DNA, 22 bp, Artificial Sequence
  chemically synthesized
tatgacttttgctaaatatctt

SEQ ID NO: 1296894 - DNA, 22 bp, Artificial Sequence
  chemically synthesized
gaaagtattataaagatattta

SEQ ID NO: 1296895 - DNA, 22 bp, Artificial Sequence
  chemically synthesized
atgacttttgctaaatatcttt

SEQ ID NO: 1296896 - DNA, 22 bp, Artificial Sequence
  chemically synthesized
ggaaagtattataaagatattt

SEQ ID NO: 1296897 - DNA, 22 bp, Artificial Sequence
  chemically synthesized
tgacttttgctaaatatcttta

SEQ ID NO: 1296898 - DNA, 22 bp, Artificial Sequence
  chemically synthesized
ttgctaaatatctttataatac

SEQ ID NO: 1296899 - DNA, 22 bp, Artificial Sequence
  chemically synthesized
tgctaaatatctttataatact

SEQ ID NO: 1296900 - DNA, 22 bp, Artificial Sequence
  chemically synthesized
gctaaatatctttataatactt

SEQ ID NO: 1296901 - DNA, 22 bp, Artificial Sequence
  chemically synthesized
ctaaatatctttataatacttt

SEQ ID NO: 1296902 - DNA, 22 bp, Artificial Sequence
  chemically synthesized
aatatctttataatactttcca

SEQ ID NO: 1296903 - DNA, 22 bp, Artificial Sequence
  chemically synthesized
tataatactttccaagtgatca

SEQ ID NO: 1296904 - DNA, 22 bp, Artificial Sequence
  chemically synthesized
ataatactttccaagtgatcac

SEQ ID NO: 1296905 - DNA, 22 bp, Artificial Sequence
  chemically synthesized
taatactttccaagtgatcaca

SEQ ID NO: 1296906 - DNA, 22 bp, Artificial Sequence
  chemically synthesized
ccagtagaagtgggtgtgatca

SEQ ID NO: 1296907 - DNA, 22 bp, Artificial Sequence
  chemically synthesized
ctaccagtagaagtgggtgtga

SEQ ID NO: 1296908 - DNA, 22 bp, Artificial Sequence
  chemically synthesized
tgctaccagtagaagtgggtgt

SEQ ID NO: 1296909 - DNA, 22 bp, Artificial Sequence
  chemically synthesized
tccaagtgatcacacccacttc

SEQ ID NO: 1296910 - DNA, 22 bp, Artificial Sequence
  chemically synthesized
ctgctaccagtagaagtgggtg

SEQ ID NO: 1296911 - DNA, 22 bp, Artificial Sequence
  chemically synthesized
ccaagtgatcacacccacttct

SEQ ID NO: 1296912 - DNA, 22 bp, Artificial Sequence
  chemically synthesized
tctgctaccagtagaagtgggt

SEQ ID NO: 1296913 - DNA, 22 bp, Artificial Sequence
  chemically synthesized
caagtgatcacacccacttcta

SEQ ID NO: 1296914 - DNA, 22 bp, Artificial Sequence
  chemically synthesized
tttctgctaccagtagaagtgg

SEQ ID NO: 1296915 - DNA, 22 bp, Artificial Sequence
  chemically synthesized
attctttctgctaccagtagaa

SEQ ID NO: 1296916 - DNA, 22 bp, Artificial Sequence
  chemically synthesized
ccaacctcattctttctgctac

SEQ ID NO: 1296917 - DNA, 22 bp, Artificial Sequence
  chemically synthesized
ctactggtagcagaaagaatga

SEQ ID NO: 1296918 - DNA, 22 bp, Artificial Sequence
  chemically synthesized
tactggtagcagaaagaatgag

SEQ ID NO: 1296919 - DNA, 22 bp, Artificial Sequence
  chemically synthesized
ctggtagcagaaagaatgaggt

SEQ ID NO: 1296920 - DNA, 22 bp, Artificial Sequence
  chemically synthesized
gtagcagaaagaatgaggttgg

SEQ ID NO: 1296921 - DNA, 22 bp, Artificial Sequence
  chemically synthesized
agatgataattcccaacctcat

SEQ ID NO: 1296922 - DNA, 22 bp, Artificial Sequence
  chemically synthesized
cggctgagatgataattcccaa

SEQ ID NO: 1296923 - DNA, 22 bp, Artificial Sequence
  chemically synthesized
ggaattatcatctcagccgcag

SEQ ID NO: 1296924 - DNA, 22 bp, Artificial Sequence
  chemically synthesized
tgaatgacatacctgcggctga

SEQ ID NO: 1296925 - DNA, 22 bp, Artificial Sequence
  chemically synthesized
ctatgaatgacatacctgcggc

SEQ ID NO: 1296926 - DNA, 22 bp, Artificial Sequence
  chemically synthesized
tcatctcagccgcaggtatgtc

SEQ ID NO: 1296927 - DNA, 22 bp, Artificial Sequence
  chemically synthesized
agccgcaggtatgtcattcata

SEQ ID NO: 1296928 - DNA, 22 bp, Artificial Sequence
  chemically synthesized
aagcaacgaaactcctatgaat

SEQ ID NO: 1296929 - DNA, 22 bp, Artificial Sequence
  chemically synthesized
ataggagtttcgttgctttagt

SEQ ID NO: 1296930 - DNA, 22 bp, Artificial Sequence
  chemically synthesized
cgttgctttagtcttttacggt

SEQ ID NO: 1296931 - DNA, 22 bp, Artificial Sequence
  chemically synthesized
gttgctttagtcttttacggta

SEQ ID NO: 1296932 - DNA, 22 bp, Artificial Sequence
  chemically synthesized
aacaaagcagcaataccgtaaa

SEQ ID NO: 1296933 - DNA, 22 bp, Artificial Sequence
  chemically synthesized
ctttagtcttttacggtattgc

SEQ ID NO: 1296934 - DNA, 22 bp, Artificial Sequence
  chemically synthesized
tagtcttttacggtattgctgc

SEQ ID NO: 1296935 - DNA, 22 bp, Artificial Sequence
  chemically synthesized
catctaaacaaagcagcaatac

SEQ ID NO: 1296936 - DNA, 22 bp, Artificial Sequence
  chemically synthesized
agtcttttacggtattgctgct

SEQ ID NO: 1296937 - DNA, 22 bp, Artificial Sequence
  chemically synthesized
acatctaaacaaagcagcaata

SEQ ID NO: 1296938 - DNA, 22 bp, Artificial Sequence
  chemically synthesized
gtcttttacggtattgctgctt

SEQ ID NO: 1296939 - DNA, 22 bp, Artificial Sequence
  chemically synthesized
cttacatctaaacaaagcagca

SEQ ID NO: 1296940 - DNA, 22 bp, Artificial Sequence
  chemically synthesized
ttacggtattgctgctttgttt

SEQ ID NO: 1296941 - DNA, 22 bp, Artificial Sequence
  chemically synthesized
tacggtattgctgctttgttta

SEQ ID NO: 1296942 - DNA, 22 bp, Artificial Sequence
  chemically synthesized
acggtattgctgctttgtttag

SEQ ID NO: 1296943 - DNA, 22 bp, Artificial Sequence
  chemically synthesized
cggtattgctgctttgtttaga

SEQ ID NO: 1296944 - DNA, 22 bp, Artificial Sequence
  chemically synthesized
ctgctttgtttagatgtaagga

SEQ ID NO: 1296945 - DNA, 22 bp, Artificial Sequence
  chemically synthesized
ctttgtttagatgtaaggagat

SEQ ID NO: 1296946 - DNA, 22 bp, Artificial Sequence
  chemically synthesized
tgtttagatgtaaggagatcct

SEQ ID NO: 1296947 - DNA, 22 bp, Artificial Sequence
  chemically synthesized
aagcaaacatcaaggatctcct

SEQ ID NO: 1296948 - DNA, 22 bp, Artificial Sequence
  chemically synthesized
gtttagatgtaaggagatcctt

SEQ ID NO: 1296949 - DNA, 22 bp, Artificial Sequence
  chemically synthesized
tttagatgtaaggagatccttg

SEQ ID NO: 1296950 - DNA, 22 bp, Artificial Sequence
  chemically synthesized
agatgtaaggagatccttgatg

SEQ ID NO: 1296951 - DNA, 22 bp, Artificial Sequence
  chemically synthesized
gatgtaaggagatccttgatgt

SEQ ID NO: 1296952 - DNA, 22 bp, Artificial Sequence
  chemically synthesized
tgattaaagcaaacatcaagga

SEQ ID NO: 1296953 - DNA, 22 bp, Artificial Sequence
  chemically synthesized
attatgattaaagcaaacatca

SEQ ID NO: 1296954 - DNA, 22 bp, Artificial Sequence
  chemically synthesized
gtaatcaaattaattatgatta

SEQ ID NO: 1296955 - DNA, 22 bp, Artificial Sequence
  chemically synthesized
gatgtttgctttaatcataatt

SEQ ID NO: 1296956 - DNA, 22 bp, Artificial Sequence
  chemically synthesized
atgtttgctttaatcataatta

SEQ ID NO: 1296957 - DNA, 22 bp, Artificial Sequence
  chemically synthesized
attagtaatcaaattaattatg

SEQ ID NO: 1296958 - DNA, 22 bp, Artificial Sequence
  chemically synthesized
cattagtaatcaaattaattat

SEQ ID NO: 1296959 - DNA, 22 bp, Artificial Sequence
  chemically synthesized
gctttaatcataattaatttga

SEQ ID NO: 1296960 - DNA, 22 bp, Artificial Sequence
  chemically synthesized
cttcattagtaatcaaattaat

SEQ ID NO: 1296961 - DNA, 22 bp, Artificial Sequence
  chemically synthesized
ctttaatcataattaatttgat

SEQ ID NO: 1296962 - DNA, 22 bp, Artificial Sequence
  chemically synthesized
tacttcattagtaatcaaatta

SEQ ID NO: 1296963 - DNA, 22 bp, Artificial Sequence
  chemically synthesized
ctacttcattagtaatcaaatt

SEQ ID NO: 1296964 - DNA, 22 bp, Artificial Sequence
  chemically synthesized
taatcataattaatttgattac

SEQ ID NO: 1296965 - DNA, 22 bp, Artificial Sequence
  chemically synthesized
aatcataattaatttgattact

SEQ ID NO: 1296966 - DNA, 22 bp, Artificial Sequence
  chemically synthesized
atcataattaatttgattacta

SEQ ID NO: 1296967 - DNA, 22 bp, Artificial Sequence
  chemically synthesized
atttgattactaatgaagtaga

SEQ ID NO: 1296968 - DNA, 22 bp, Artificial Sequence
  chemically synthesized
gattactaatgaagtagaagat

SEQ ID NO: 1296969 - DNA, 22 bp, Artificial Sequence
  chemically synthesized
attactaatgaagtagaagatg

SEQ ID NO: 1296970 - DNA, 22 bp, Artificial Sequence
  chemically synthesized
ctaatgaagtagaagatgtttc

SEQ ID NO: 1296971 - DNA, 22 bp, Artificial Sequence
  chemically synthesized
atgaagtagaagatgtttcatg

SEQ ID NO: 1296972 - DNA, 22 bp, Artificial Sequence
  chemically synthesized
catgcatttatttattctgtat

SEQ ID NO: 1296973 - DNA, 22 bp, Artificial Sequence
  chemically synthesized
atgcatttatttattctgtatg

SEQ ID NO: 1296974 - DNA, 22 bp, Artificial Sequence
  chemically synthesized
acaaaaataggaacatacagaa

SEQ ID NO: 1296975 - DNA, 22 bp, Artificial Sequence
  chemically synthesized
gacaaaaataggaacatacaga

SEQ ID NO: 1296976 - DNA, 22 bp, Artificial Sequence
  chemically synthesized
tgacaaaaataggaacatacag

SEQ ID NO: 1296977 - DNA, 22 bp, Artificial Sequence
  chemically synthesized
atttattctgtatgttcctatt

SEQ ID NO: 1296978 - DNA, 22 bp, Artificial Sequence
  chemically synthesized
tttattctgtatgttcctattt

SEQ ID NO: 1296979 - DNA, 22 bp, Artificial Sequence
  chemically synthesized
attctgtatgttcctatttttg

SEQ ID NO: 1296980 - DNA, 22 bp, Artificial Sequence
  chemically synthesized
ttctgtatgttcctatttttgt

SEQ ID NO: 1296981 - DNA, 22 bp, Artificial Sequence
  chemically synthesized
tgtatgttcctatttttgtcaa

SEQ ID NO: 1296982 - DNA, 22 bp, Artificial Sequence
  chemically synthesized
tatgttcctatttttgtcaaaa

SEQ ID NO: 1296983 - DNA, 22 bp, Artificial Sequence
  chemically synthesized
ctatttttgtcaaaatacttgt

SEQ ID NO: 1296984 - DNA, 22 bp, Artificial Sequence
  chemically synthesized
tttttgtcaaaatacttgttta

SEQ ID NO: 1296985 - DNA, 22 bp, Artificial Sequence
  chemically synthesized
ttgtcaaaatacttgtttacat

SEQ ID NO: 1296986 - DNA, 22 bp, Artificial Sequence
  chemically synthesized
tgtcaaaatacttgtttacatc

SEQ ID NO: 1296987 - DNA, 22 bp, Artificial Sequence
  chemically synthesized
gtcaaaatacttgtttacatcc

SEQ ID NO: 1296988 - DNA, 22 bp, Artificial Sequence
  chemically synthesized
tcaaaatacttgtttacatcct

SEQ ID NO: 1296989 - DNA, 22 bp, Artificial Sequence
  chemically synthesized
aatagataaatgagccaggatg

SEQ ID NO: 1296990 - DNA, 22 bp, Artificial Sequence
  chemically synthesized
gtttacatcctggctcatttat

SEQ ID NO: 1296991 - DNA, 22 bp, Artificial Sequence
  chemically synthesized
aatgctcaatagataaatgagc

SEQ ID NO: 1296992 - DNA, 22 bp, Artificial Sequence
  chemically synthesized
tttacatcctggctcatttatc

SEQ ID NO: 1296993 - DNA, 22 bp, Artificial Sequence
  chemically synthesized
acatcctggctcatttatctat

SEQ ID NO: 1296994 - DNA, 22 bp, Artificial Sequence
  chemically synthesized
catcctggctcatttatctatt

SEQ ID NO: 1296995 - DNA, 22 bp, Artificial Sequence
  chemically synthesized
aaatattaaatgctcaatagat

SEQ ID NO: 1296996 - DNA, 22 bp, Artificial Sequence
  chemically synthesized
aaaatattaaatgctcaataga

SEQ ID NO: 1296997 - DNA, 22 bp, Artificial Sequence
  chemically synthesized
taaaatattaaatgctcaatag

SEQ ID NO: 1296998 - DNA, 22 bp, Artificial Sequence
  chemically synthesized
gctcatttatctattgagcatt

SEQ ID NO: 1296999 - DNA, 22 bp, Artificial Sequence
  chemically synthesized
attttaaaatattaaatgctca

SEQ ID NO: 1297000 - DNA, 22 bp, Artificial Sequence
  chemically synthesized
atttatctattgagcatttaat

SEQ ID NO: 1297001 - DNA, 22 bp, Artificial Sequence
  chemically synthesized
atctattgagcatttaatattt

SEQ ID NO: 1297002 - DNA, 22 bp, Artificial Sequence
  chemically synthesized
caattaattttaaaatattaaa

SEQ ID NO: 1297003 - DNA, 22 bp, Artificial Sequence
  chemically synthesized
tctattgagcatttaatatttt

SEQ ID NO: 1297004 - DNA, 22 bp, Artificial Sequence
  chemically synthesized
attccaattaattttaaaatat

SEQ ID NO: 1297005 - DNA, 22 bp, Artificial Sequence
  chemically synthesized
ttgagcatttaatattttaaaa

SEQ ID NO: 1297006 - DNA, 22 bp, Artificial Sequence
  chemically synthesized
agcatttaatattttaaaatta

SEQ ID NO: 1297007 - DNA, 22 bp, Artificial Sequence
  chemically synthesized
tctcattccaattaattttaaa

SEQ ID NO: 1297008 - DNA, 22 bp, Artificial Sequence
  chemically synthesized
aatattttaaaattaattggaa

SEQ ID NO: 1297009 - DNA, 22 bp, Artificial Sequence
  chemically synthesized
atattttaaaattaattggaat

SEQ ID NO: 1297010 - DNA, 22 bp, Artificial Sequence
  chemically synthesized
taaaattaattggaatgagata

SEQ ID NO: 1297011 - DNA, 22 bp, Artificial Sequence
  chemically synthesized
ccaatatataattatctcattc

SEQ ID NO: 1297012 - DNA, 22 bp, Artificial Sequence
  chemically synthesized
aaaattaattggaatgagataa

SEQ ID NO: 1297013 - DNA, 22 bp, Artificial Sequence
  chemically synthesized
aaattaattggaatgagataat

SEQ ID NO: 1297014 - DNA, 22 bp, Artificial Sequence
  chemically synthesized
agaattaccaatatataattat

SEQ ID NO: 1297015 - DNA, 22 bp, Artificial Sequence
  chemically synthesized
attggaatgagataattatata

SEQ ID NO: 1297016 - DNA, 22 bp, Artificial Sequence
  chemically synthesized
aagaattaccaatatataatta

SEQ ID NO: 1297017 - DNA, 22 bp, Artificial Sequence
  chemically synthesized
gaatgagataattatatattgg

SEQ ID NO: 1297018 - DNA, 22 bp, Artificial Sequence
  chemically synthesized
aaatgtttaagaattaccaata

SEQ ID NO: 1297019 - DNA, 22 bp, Artificial Sequence
  chemically synthesized
gaaatgtttaagaattaccaat

SEQ ID NO: 1297020 - DNA, 22 bp, Artificial Sequence
  chemically synthesized
tatattggtaattcttaaacat

SEQ ID NO: 1297021 - DNA, 22 bp, Artificial Sequence
  chemically synthesized
gtaattcttaaacatttcaagt

SEQ ID NO: 1297022 - DNA, 22 bp, Artificial Sequence
  chemically synthesized
ttaaacatttcaagtcatgggc

SEQ ID NO: 1297023 - DNA, 22 bp, Artificial Sequence
  chemically synthesized
aaacatttcaagtcatgggctc

SEQ ID NO: 1297024 - DNA, 22 bp, Artificial Sequence
  chemically synthesized
aacatttcaagtcatgggctcc

SEQ ID NO: 1297025 - DNA, 22 bp, Artificial Sequence
  chemically synthesized
atcagataatcaaatggagccc

SEQ ID NO: 1297026 - DNA, 22 bp, Artificial Sequence
  chemically synthesized
catcagataatcaaatggagcc

SEQ ID NO: 1297027 - DNA, 22 bp, Artificial Sequence
  chemically synthesized
tcatcagataatcaaatggagc

SEQ ID NO: 1297028 - DNA, 22 bp, Artificial Sequence
  chemically synthesized
caagtcatgggctccatttgat

SEQ ID NO: 1297029 - DNA, 22 bp, Artificial Sequence
  chemically synthesized
aagtcatgggctccatttgatt

SEQ ID NO: 1297030 - DNA, 22 bp, Artificial Sequence
  chemically synthesized
ttttcatcagataatcaaatgg

SEQ ID NO: 1297031 - DNA, 22 bp, Artificial Sequence
  chemically synthesized
attattttcatcagataatcaa

SEQ ID NO: 1297032 - DNA, 22 bp, Artificial Sequence
  chemically synthesized
catttgattatctgatgaaaat

SEQ ID NO: 1297033 - DNA, 22 bp, Artificial Sequence
  chemically synthesized
tagagaaggttcattattttca

SEQ ID NO: 1297034 - DNA, 22 bp, Artificial Sequence
  chemically synthesized
gattatctgatgaaaataatga

SEQ ID NO: 1297035 - DNA, 22 bp, Artificial Sequence
  chemically synthesized
tatagagaaggttcattatttt

SEQ ID NO: 1297036 - DNA, 22 bp, Artificial Sequence
  chemically synthesized
attatctgatgaaaataatgaa

SEQ ID NO: 1297037 - DNA, 22 bp, Artificial Sequence
  chemically synthesized
ctatagagaaggttcattattt

SEQ ID NO: 1297038 - DNA, 22 bp, Artificial Sequence
  chemically synthesized
tctatagagaaggttcattatt

SEQ ID NO: 1297039 - DNA, 22 bp, Artificial Sequence
  chemically synthesized
ttctatagagaaggttcattat

SEQ ID NO: 1297040 - DNA, 22 bp, Artificial Sequence
  chemically synthesized
tctgatgaaaataatgaacctt

SEQ ID NO: 1297041 - DNA, 22 bp, Artificial Sequence
  chemically synthesized
atgaaaataatgaaccttctct

SEQ ID NO: 1297042 - DNA, 22 bp, Artificial Sequence
  chemically synthesized
ctctatagaaaaatgtctacac

SEQ ID NO: 1297043 - DNA, 22 bp, Artificial Sequence
  chemically synthesized
tctatagaaaaatgtctacaca

SEQ ID NO: 1297044 - DNA, 22 bp, Artificial Sequence
  chemically synthesized
tatagaaaaatgtctacacata

SEQ ID NO: 1297045 - DNA, 22 bp, Artificial Sequence
  chemically synthesized
tatgcaaatatgtatgtgtaga

SEQ ID NO: 1297046 - DNA, 22 bp, Artificial Sequence
  chemically synthesized
tagaaaaatgtctacacataca

SEQ ID NO: 1297047 - DNA, 22 bp, Artificial Sequence
  chemically synthesized
tgaaactatatgcaaatatgta

SEQ ID NO: 1297048 - DNA, 22 bp, Artificial Sequence
  chemically synthesized
tatgaaactatatgcaaatatg

SEQ ID NO: 1297049 - DNA, 22 bp, Artificial Sequence
  chemically synthesized
cacatacatatttgcatatagt

SEQ ID NO: 1297050 - DNA, 22 bp, Artificial Sequence
  chemically synthesized
gcatatagtttcatagagttca

SEQ ID NO: 1297051 - DNA, 22 bp, Artificial Sequence
  chemically synthesized
caaggaggtcagtgaactctat

SEQ ID NO: 1297052 - DNA, 22 bp, Artificial Sequence
  chemically synthesized
catatagtttcatagagttcac

SEQ ID NO: 1297053 - DNA, 22 bp, Artificial Sequence
  chemically synthesized
tgcaaggaggtcagtgaactct

SEQ ID NO: 1297054 - DNA, 22 bp, Artificial Sequence
  chemically synthesized
ctgcaaggaggtcagtgaactc

SEQ ID NO: 1297055 - DNA, 22 bp, Artificial Sequence
  chemically synthesized
tctgcaaggaggtcagtgaact

SEQ ID NO: 1297056 - DNA, 22 bp, Artificial Sequence
  chemically synthesized
catagagttcactgacctcctt

SEQ ID NO: 1297057 - DNA, 22 bp, Artificial Sequence
  chemically synthesized
atagagttcactgacctccttg

SEQ ID NO: 1297058 - DNA, 22 bp, Artificial Sequence
  chemically synthesized
taggagttttctgcaaggaggt

SEQ ID NO: 1297059 - DNA, 22 bp, Artificial Sequence
  chemically synthesized
tggttataggagttttctgcaa

SEQ ID NO: 1297060 - DNA, 22 bp, Artificial Sequence
  chemically synthesized
atggttataggagttttctgca

SEQ ID NO: 1297061 - DNA, 22 bp, Artificial Sequence
  chemically synthesized
actgacctccttgcagaaaact

SEQ ID NO: 1297062 - DNA, 22 bp, Artificial Sequence
  chemically synthesized
tatggttataggagttttctgc

SEQ ID NO: 1297063 - DNA, 22 bp, Artificial Sequence
  chemically synthesized
acctccttgcagaaaactccta

SEQ ID NO: 1297064 - DNA, 22 bp, Artificial Sequence
  chemically synthesized
gattttatggttataggagttt

SEQ ID NO: 1297065 - DNA, 22 bp, Artificial Sequence
  chemically synthesized
ggattttatggttataggagtt

SEQ ID NO: 1297066 - DNA, 22 bp, Artificial Sequence
  chemically synthesized
cttgcagaaaactcctataacc

SEQ ID NO: 1297067 - DNA, 22 bp, Artificial Sequence
  chemically synthesized
acttggattttatggttatagg

SEQ ID NO: 1297068 - DNA, 22 bp, Artificial Sequence
  chemically synthesized
gcagaaaactcctataaccata

SEQ ID NO: 1297069 - DNA, 22 bp, Artificial Sequence
  chemically synthesized
cagaaaactcctataaccataa

SEQ ID NO: 1297070 - DNA, 22 bp, Artificial Sequence
  chemically synthesized
atcgttaacttggattttatgg

SEQ ID NO: 1297071 - DNA, 22 bp, Artificial Sequence
  chemically synthesized
gatcgttaacttggattttatg

SEQ ID NO: 1297072 - DNA, 22 bp, Artificial Sequence
  chemically synthesized
tgatcgttaacttggattttat

SEQ ID NO: 1297073 - DNA, 22 bp, Artificial Sequence
  chemically synthesized
ctataaccataaaatccaagtt

SEQ ID NO: 1297074 - DNA, 22 bp, Artificial Sequence
  chemically synthesized
attttgatcgttaacttggatt

SEQ ID NO: 1297075 - DNA, 22 bp, Artificial Sequence
  chemically synthesized
aattttgatcgttaacttggat

SEQ ID NO: 1297076 - DNA, 22 bp, Artificial Sequence
  chemically synthesized
taaccataaaatccaagttaac

SEQ ID NO: 1297077 - DNA, 22 bp, Artificial Sequence
  chemically synthesized
aaagtgagtagcttaattttga

SEQ ID NO: 1297078 - DNA, 22 bp, Artificial Sequence
  chemically synthesized
actaaaagtgagtagcttaatt

SEQ ID NO: 1297079 - DNA, 22 bp, Artificial Sequence
  chemically synthesized
acgatcaaaattaagctactca

SEQ ID NO: 1297080 - DNA, 22 bp, Artificial Sequence
  chemically synthesized
actgactaaaagtgagtagctt

SEQ ID NO: 1297081 - DNA, 22 bp, Artificial Sequence
  chemically synthesized
agctactcacttttagtcagtg

SEQ ID NO: 1297082 - DNA, 22 bp, Artificial Sequence
  chemically synthesized
ggaaaatatgtccattcactga

SEQ ID NO: 1297083 - DNA, 22 bp, Artificial Sequence
  chemically synthesized
ctcacttttagtcagtgaatgg

SEQ ID NO: 1297084 - DNA, 22 bp, Artificial Sequence
  chemically synthesized
gggaaaatatgtccattcactg

SEQ ID NO: 1297085 - DNA, 22 bp, Artificial Sequence
  chemically synthesized
acttttagtcagtgaatggaca

SEQ ID NO: 1297086 - DNA, 22 bp, Artificial Sequence
  chemically synthesized
ttagtcagtgaatggacatatt

SEQ ID NO: 1297087 - DNA, 22 bp, Artificial Sequence
  chemically synthesized
tagtcagtgaatggacatattt

SEQ ID NO: 1297088 - DNA, 22 bp, Artificial Sequence
  chemically synthesized
agtcagtgaatggacatatttt

SEQ ID NO: 1297089 - DNA, 22 bp, Artificial Sequence
  chemically synthesized
gtcagtgaatggacatattttc

SEQ ID NO: 1297090 - DNA, 22 bp, Artificial Sequence
  chemically synthesized
aaaggcatatgaccacttggga

SEQ ID NO: 1297091 - DNA, 22 bp, Artificial Sequence
  chemically synthesized
tcccaagtggtcatatgccttt

SEQ ID NO: 1297092 - DNA, 22 bp, Artificial Sequence
  chemically synthesized
aaataaaaattaaaaggcatat

SEQ ID NO: 1297093 - DNA, 22 bp, Artificial Sequence
  chemically synthesized
cccaagtggtcatatgcctttt

SEQ ID NO: 1297094 - DNA, 22 bp, Artificial Sequence
  chemically synthesized
ccaagtggtcatatgcctttta

SEQ ID NO: 1297095 - DNA, 22 bp, Artificial Sequence
  chemically synthesized
gcatactaaaataaaaattaaa

SEQ ID NO: 1297096 - DNA, 22 bp, Artificial Sequence
  chemically synthesized
agcatactaaaataaaaattaa

SEQ ID NO: 1297097 - DNA, 22 bp, Artificial Sequence
  chemically synthesized
tagcatactaaaataaaaatta

SEQ ID NO: 1297098 - DNA, 22 bp, Artificial Sequence
  chemically synthesized
ttaatttttattttagtatgct

SEQ ID NO: 1297099 - DNA, 22 bp, Artificial Sequence
  chemically synthesized
taatttttattttagtatgcta

SEQ ID NO: 1297100 - DNA, 22 bp, Artificial Sequence
  chemically synthesized
aatttttattttagtatgctaa

SEQ ID NO: 1297101 - DNA, 22 bp, Artificial Sequence
  chemically synthesized
atttttattttagtatgctaaa

SEQ ID NO: 1297102 - DNA, 22 bp, Artificial Sequence
  chemically synthesized
ttattttagtatgctaaaattt

SEQ ID NO: 1297103 - DNA, 22 bp, Artificial Sequence
  chemically synthesized
tattttagtatgctaaaatttt

SEQ ID NO: 1297104 - DNA, 22 bp, Artificial Sequence
  chemically synthesized
attttagtatgctaaaatttta

SEQ ID NO: 1297105 - DNA, 22 bp, Artificial Sequence
  chemically synthesized
ttttagtatgctaaaattttat

SEQ ID NO: 1297106 - DNA, 22 bp, Artificial Sequence
  chemically synthesized
aagtaaatacgtataaaatttt

SEQ ID NO: 1297107 - DNA, 22 bp, Artificial Sequence
  chemically synthesized
tagtatgctaaaattttatacg

SEQ ID NO: 1297108 - DNA, 22 bp, Artificial Sequence
  chemically synthesized
agtatgctaaaattttatacgt

SEQ ID NO: 1297109 - DNA, 22 bp, Artificial Sequence
  chemically synthesized
gtatgctaaaattttatacgta

SEQ ID NO: 1297110 - DNA, 22 bp, Artificial Sequence
  chemically synthesized
aaattttatacgtatttacttg

SEQ ID NO: 1297111 - DNA, 22 bp, Artificial Sequence
  chemically synthesized
tatacgtatttacttgaattga

SEQ ID NO: 1297112 - DNA, 22 bp, Artificial Sequence
  chemically synthesized
atacgtatttacttgaattgat

SEQ ID NO: 1297113 - DNA, 22 bp, Artificial Sequence
  chemically synthesized
tacgtatttacttgaattgata

SEQ ID NO: 1297114 - DNA, 22 bp, Artificial Sequence
  chemically synthesized
acttgaattgatatatttttat

SEQ ID NO: 1297115 - DNA, 22 bp, Artificial Sequence
  chemically synthesized
cttgaattgatatatttttatt

SEQ ID NO: 1297116 - DNA, 22 bp, Artificial Sequence
  chemically synthesized
gaattgatatatttttattgct

SEQ ID NO: 1297117 - DNA, 22 bp, Artificial Sequence
  chemically synthesized
aattgatatatttttattgcta

SEQ ID NO: 1297118 - DNA, 22 bp, Artificial Sequence
  chemically synthesized
agcaatatgacaaatagcaata

SEQ ID NO: 1297119 - DNA, 22 bp, Artificial Sequence
  chemically synthesized
aagcaatatgacaaatagcaat

SEQ ID NO: 1297120 - DNA, 22 bp, Artificial Sequence
  chemically synthesized
taagcaatatgacaaatagcaa

SEQ ID NO: 1297121 - DNA, 22 bp, Artificial Sequence
  chemically synthesized
atatatttttattgctatttgt

SEQ ID NO: 1297122 - DNA, 22 bp, Artificial Sequence
  chemically synthesized
ttaagcaatatgacaaatagca

SEQ ID NO: 1297123 - DNA, 22 bp, Artificial Sequence
  chemically synthesized
ttattgctatttgtcatattgc

SEQ ID NO: 1297124 - DNA, 22 bp, Artificial Sequence
  chemically synthesized
tattgctatttgtcatattgct

SEQ ID NO: 1297125 - DNA, 22 bp, Artificial Sequence
  chemically synthesized
attgctatttgtcatattgctt

SEQ ID NO: 1297126 - DNA, 22 bp, Artificial Sequence
  chemically synthesized
ttgctatttgtcatattgctta

SEQ ID NO: 1297127 - DNA, 22 bp, Artificial Sequence
  chemically synthesized
aaatagtcaacttttaagcaat

SEQ ID NO: 1297128 - DNA, 22 bp, Artificial Sequence
  chemically synthesized
ctatttgtcatattgcttaaaa

SEQ ID NO: 1297129 - DNA, 22 bp, Artificial Sequence
  chemically synthesized
aaaatagtcaacttttaagcaa

SEQ ID NO: 1297130 - DNA, 22 bp, Artificial Sequence
  chemically synthesized
tttgtcatattgcttaaaagtt

SEQ ID NO: 1297131 - DNA, 22 bp, Artificial Sequence
  chemically synthesized
gtcatattgcttaaaagttgac

SEQ ID NO: 1297132 - DNA, 22 bp, Artificial Sequence
  chemically synthesized
tcatattgcttaaaagttgact

SEQ ID NO: 1297133 - DNA, 22 bp, Artificial Sequence
  chemically synthesized
agggtatacagcttaaaatagt

SEQ ID NO: 1297134 - DNA, 22 bp, Artificial Sequence
  chemically synthesized
cttaaaagttgactattttaag

SEQ ID NO: 1297135 - DNA, 22 bp, Artificial Sequence
  chemically synthesized
aaaagttgactattttaagctg

SEQ ID NO: 1297136 - DNA, 22 bp, Artificial Sequence
  chemically synthesized
actaagggtatacagcttaaaa

SEQ ID NO: 1297137 - DNA, 22 bp, Artificial Sequence
  chemically synthesized
aaagttgactattttaagctgt

SEQ ID NO: 1297138 - DNA, 22 bp, Artificial Sequence
  chemically synthesized
ggttaactaagggtatacagct

SEQ ID NO: 1297139 - DNA, 22 bp, Artificial Sequence
  chemically synthesized
aggttaactaagggtatacagc

SEQ ID NO: 1297140 - DNA, 22 bp, Artificial Sequence
  chemically synthesized
taggttaactaagggtatacag

SEQ ID NO: 1297141 - DNA, 22 bp, Artificial Sequence
  chemically synthesized
actattttaagctgtataccct

SEQ ID NO: 1297142 - DNA, 22 bp, Artificial Sequence
  chemically synthesized
ttttaagctgtatacccttagt

SEQ ID NO: 1297143 - DNA, 22 bp, Artificial Sequence
  chemically synthesized
taagctgtatacccttagttaa

SEQ ID NO: 1297144 - DNA, 22 bp, Artificial Sequence
  chemically synthesized
aagctgtatacccttagttaac

SEQ ID NO: 1297145 - DNA, 22 bp, Artificial Sequence
  chemically synthesized
agctgtatacccttagttaacc

SEQ ID NO: 1297146 - DNA, 22 bp, Artificial Sequence
  chemically synthesized
tatacccttagttaacctaaag

SEQ ID NO: 1297147 - DNA, 22 bp, Artificial Sequence
  chemically synthesized
agttaacctaaagccaccatac

SEQ ID NO: 1297148 - DNA, 22 bp, Artificial Sequence
  chemically synthesized
gttaacctaaagccaccataca

SEQ ID NO: 1297149 - DNA, 22 bp, Artificial Sequence
  chemically synthesized
acctaaagccaccatacataca

SEQ ID NO: 1297150 - DNA, 22 bp, Artificial Sequence
  chemically synthesized
tatatgtgtgatgtgtatgtat

SEQ ID NO: 1297151 - DNA, 22 bp, Artificial Sequence
  chemically synthesized
atatatgtgtgatgtgtatgta

SEQ ID NO: 1297152 - DNA, 22 bp, Artificial Sequence
  chemically synthesized
aagccaccatacatacacatca

SEQ ID NO: 1297153 - DNA, 22 bp, Artificial Sequence
  chemically synthesized
gaacaatttatatatgtgtgat

SEQ ID NO: 1297154 - DNA, 22 bp, Artificial Sequence
  chemically synthesized
tagaacaatttatatatgtgtg

SEQ ID NO: 1297155 - DNA, 22 bp, Artificial Sequence
  chemically synthesized
ctagaacaatttatatatgtgt

SEQ ID NO: 1297156 - DNA, 22 bp, Artificial Sequence
  chemically synthesized
acgtatcaaaatagtttctaga

SEQ ID NO: 1297157 - DNA, 22 bp, Artificial Sequence
  chemically synthesized
ttctagaaactattttgatacg

SEQ ID NO: 1297158 - DNA, 22 bp, Artificial Sequence
  chemically synthesized
tagaaactattttgatacgtta

SEQ ID NO: 1297159 - DNA, 22 bp, Artificial Sequence
  chemically synthesized
gaaactattttgatacgttaac

SEQ ID NO: 1297160 - DNA, 22 bp, Artificial Sequence
  chemically synthesized
cagaaatagacatcatgttaac

SEQ ID NO: 1297161 - DNA, 22 bp, Artificial Sequence
  chemically synthesized
ttttgatacgttaacatgatgt

SEQ ID NO: 1297162 - DNA, 22 bp, Artificial Sequence
  chemically synthesized
tgatacgttaacatgatgtcta

SEQ ID NO: 1297163 - DNA, 22 bp, Artificial Sequence
  chemically synthesized
gatacgttaacatgatgtctat

SEQ ID NO: 1297164 - DNA, 22 bp, Artificial Sequence
  chemically synthesized
atacgttaacatgatgtctatt

SEQ ID NO: 1297165 - DNA, 22 bp, Artificial Sequence
  chemically synthesized
tgtgactacagaaatagacatc

SEQ ID NO: 1297166 - DNA, 22 bp, Artificial Sequence
  chemically synthesized
tagactatgtgactacagaaat

SEQ ID NO: 1297167 - DNA, 22 bp, Artificial Sequence
  chemically synthesized
acatgatgtctatttctgtagt

SEQ ID NO: 1297168 - DNA, 22 bp, Artificial Sequence
  chemically synthesized
ctatagactatgtgactacaga

SEQ ID NO: 1297169 - DNA, 22 bp, Artificial Sequence
  chemically synthesized
actatagactatgtgactacag

SEQ ID NO: 1297170 - DNA, 22 bp, Artificial Sequence
  chemically synthesized
tactatagactatgtgactaca

SEQ ID NO: 1297171 - DNA, 22 bp, Artificial Sequence
  chemically synthesized
tttctgtagtcacatagtctat

SEQ ID NO: 1297172 - DNA, 22 bp, Artificial Sequence
  chemically synthesized
atatgttttactatagactatg

SEQ ID NO: 1297173 - DNA, 22 bp, Artificial Sequence
  chemically synthesized
ctgtagtcacatagtctatagt

SEQ ID NO: 1297174 - DNA, 22 bp, Artificial Sequence
  chemically synthesized
tgtagtcacatagtctatagta

SEQ ID NO: 1297175 - DNA, 22 bp, Artificial Sequence
  chemically synthesized
tagtcacatagtctatagtaaa

SEQ ID NO: 1297176 - DNA, 22 bp, Artificial Sequence
  chemically synthesized
cacattaatatgttttactata

SEQ ID NO: 1297177 - DNA, 22 bp, Artificial Sequence
  chemically synthesized
attgcacattaatatgttttac

SEQ ID NO: 1297178 - DNA, 22 bp, Artificial Sequence
  chemically synthesized
ctgattgcacattaatatgttt

SEQ ID NO: 1297179 - DNA, 22 bp, Artificial Sequence
  chemically synthesized
ttgctgattgcacattaatatg

SEQ ID NO: 1297180 - DNA, 22 bp, Artificial Sequence
  chemically synthesized
gttgctgattgcacattaatat

SEQ ID NO: 1297181 - DNA, 22 bp, Artificial Sequence
  chemically synthesized
tgttgctgattgcacattaata

SEQ ID NO: 1297182 - DNA, 22 bp, Artificial Sequence
  chemically synthesized
tagtaaaacatattaatgtgca

SEQ ID NO: 1297183 - DNA, 22 bp, Artificial Sequence
  chemically synthesized
ctttgttgctgattgcacatta

SEQ ID NO: 1297184 - DNA, 22 bp, Artificial Sequence
  chemically synthesized
gctttgttgctgattgcacatt

SEQ ID NO: 1297185 - DNA, 22 bp, Artificial Sequence
  chemically synthesized
atttgctttgttgctgattgca

SEQ ID NO: 1297186 - DNA, 22 bp, Artificial Sequence
  chemically synthesized
tcatttgctttgttgctgattg

SEQ ID NO: 1297187 - DNA, 22 bp, Artificial Sequence
  chemically synthesized
ctcatttgctttgttgctgatt

SEQ ID NO: 1297188 - DNA, 22 bp, Artificial Sequence
  chemically synthesized
tctcatttgctttgttgctgat

SEQ ID NO: 1297189 - DNA, 22 bp, Artificial Sequence
  chemically synthesized
ttctcatttgctttgttgctga

SEQ ID NO: 1297190 - DNA, 22 bp, Artificial Sequence
  chemically synthesized
ttttctcatttgctttgttgct

SEQ ID NO: 1297191 - DNA, 22 bp, Artificial Sequence
  chemically synthesized
atgtgcaatcagcaacaaagca

SEQ ID NO: 1297192 - DNA, 22 bp, Artificial Sequence
  chemically synthesized
ttcttttctcatttgctttgtt

SEQ ID NO: 1297193 - DNA, 22 bp, Artificial Sequence
  chemically synthesized
attcttttctcatttgctttgt

SEQ ID NO: 1297194 - DNA, 22 bp, Artificial Sequence
  chemically synthesized
tattcttttctcatttgctttg

SEQ ID NO: 1297195 - DNA, 22 bp, Artificial Sequence
  chemically synthesized
tcactttattcttttctcattt

SEQ ID NO: 1297196 - DNA, 22 bp, Artificial Sequence
  chemically synthesized
taataaaacagctatcacttta

SEQ ID NO: 1297197 - DNA, 22 bp, Artificial Sequence
  chemically synthesized
gtaataaaacagctatcacttt

SEQ ID NO: 1297198 - DNA, 22 bp, Artificial Sequence
  chemically synthesized
tgtaataaaacagctatcactt

SEQ ID NO: 1297199 - DNA, 22 bp, Artificial Sequence
  chemically synthesized
aacaggagcatataatcatttt

SEQ ID NO: 1297200 - DNA, 22 bp, Artificial Sequence
  chemically synthesized
ttttattacaaaatgattatat

SEQ ID NO: 1297201 - DNA, 22 bp, Artificial Sequence
  chemically synthesized
tattacaaaatgattatatgct

SEQ ID NO: 1297202 - DNA, 22 bp, Artificial Sequence
  chemically synthesized
attacaaaatgattatatgctc

SEQ ID NO: 1297203 - DNA, 22 bp, Artificial Sequence
  chemically synthesized
ttacaaaatgattatatgctcc

SEQ ID NO: 1297204 - DNA, 22 bp, Artificial Sequence
  chemically synthesized
aaatgactaaacaggagcatat

SEQ ID NO: 1297205 - DNA, 22 bp, Artificial Sequence
  chemically synthesized
gaaatgactaaacaggagcata

SEQ ID NO: 1297206 - DNA, 22 bp, Artificial Sequence
  chemically synthesized
caaaatgattatatgctcctgt

SEQ ID NO: 1297207 - DNA, 22 bp, Artificial Sequence
  chemically synthesized
cttgaaatgactaaacaggagc

SEQ ID NO: 1297208 - DNA, 22 bp, Artificial Sequence
  chemically synthesized
tatgctcctgtttagtcatttc

SEQ ID NO: 1297209 - DNA, 22 bp, Artificial Sequence
  chemically synthesized
ctgtttagtcatttcaagcagc

SEQ ID NO: 1297210 - DNA, 22 bp, Artificial Sequence
  chemically synthesized
tttagtcatttcaagcagcaca

SEQ ID NO: 1297211 - DNA, 22 bp, Artificial Sequence
  chemically synthesized
agtcatttcaagcagcacatat

SEQ ID NO: 1297212 - DNA, 22 bp, Artificial Sequence
  chemically synthesized
gtcatttcaagcagcacatatt

SEQ ID NO: 1297213 - DNA, 22 bp, Artificial Sequence
  chemically synthesized
aaggaaatgaaatagaatatgt

SEQ ID NO: 1297214 - DNA, 22 bp, Artificial Sequence
  chemically synthesized
caagcagcacatattctatttc

SEQ ID NO: 1297215 - DNA, 22 bp, Artificial Sequence
  chemically synthesized
aagcagcacatattctatttca

SEQ ID NO: 1297216 - DNA, 22 bp, Artificial Sequence
  chemically synthesized
taaacaaaccctaaaggaaatg

SEQ ID NO: 1297217 - DNA, 22 bp, Artificial Sequence
  chemically synthesized
tatttcatttcctttagggttt

SEQ ID NO: 1297218 - DNA, 22 bp, Artificial Sequence
  chemically synthesized
tttcatttcctttagggtttgt

SEQ ID NO: 1297219 - DNA, 22 bp, Artificial Sequence
  chemically synthesized
catttcctttagggtttgttta

SEQ ID NO: 1297220 - DNA, 22 bp, Artificial Sequence
  chemically synthesized
atttcctttagggtttgtttat

SEQ ID NO: 1297221 - DNA, 22 bp, Artificial Sequence
  chemically synthesized
cctttagggtttgtttataact

SEQ ID NO: 1297222 - DNA, 22 bp, Artificial Sequence
  chemically synthesized
ctttagggtttgtttataactg

SEQ ID NO: 1297223 - DNA, 22 bp, Artificial Sequence
  chemically synthesized
gtaaaataaaatcagttataaa

SEQ ID NO: 1297224 - DNA, 22 bp, Artificial Sequence
  chemically synthesized
tagggtttgtttataactgatt

SEQ ID NO: 1297225 - DNA, 22 bp, Artificial Sequence
  chemically synthesized
ttagtaaaataaaatcagttat

SEQ ID NO: 1297226 - DNA, 22 bp, Artificial Sequence
  chemically synthesized
agggtttgtttataactgattt

SEQ ID NO: 1297227 - DNA, 22 bp, Artificial Sequence
  chemically synthesized
attagtaaaataaaatcagtta

SEQ ID NO: 1297228 - DNA, 22 bp, Artificial Sequence
  chemically synthesized
gggtttgtttataactgatttt

SEQ ID NO: 1297229 - DNA, 22 bp, Artificial Sequence
  chemically synthesized
tattagtaaaataaaatcagtt

SEQ ID NO: 1297230 - DNA, 22 bp, Artificial Sequence
  chemically synthesized
ttattagtaaaataaaatcagt

SEQ ID NO: 1297231 - DNA, 22 bp, Artificial Sequence
  chemically synthesized
gtttataactgattttatttta

SEQ ID NO: 1297232 - DNA, 22 bp, Artificial Sequence
  chemically synthesized
tttataactgattttattttac

SEQ ID NO: 1297233 - DNA, 22 bp, Artificial Sequence
  chemically synthesized
ataactgattttattttactaa

SEQ ID NO: 1297234 - DNA, 22 bp, Artificial Sequence
  chemically synthesized
taactgattttattttactaat

SEQ ID NO: 1297235 - DNA, 22 bp, Artificial Sequence
  chemically synthesized
attttattttactaataaaaac

SEQ ID NO: 1297236 - DNA, 22 bp, Artificial Sequence
  chemically synthesized
atatgcacatgcatgtttttat

SEQ ID NO: 1297237 - DNA, 22 bp, Artificial Sequence
  chemically synthesized
tattttactaataaaaacatgc

SEQ ID NO: 1297238 - DNA, 22 bp, Artificial Sequence
  chemically synthesized
attttactaataaaaacatgca

SEQ ID NO: 1297239 - DNA, 22 bp, Artificial Sequence
  chemically synthesized
ttaatatgcacatgcatgtttt

SEQ ID NO: 1297240 - DNA, 22 bp, Artificial Sequence
  chemically synthesized
ttttactaataaaaacatgcat

SEQ ID NO: 1297241 - DNA, 22 bp, Artificial Sequence
  chemically synthesized
attaatatgcacatgcatgttt

SEQ ID NO: 1297242 - DNA, 22 bp, Artificial Sequence
  chemically synthesized
ttattaatatgcacatgcatgt

SEQ ID NO: 1297243 - DNA, 22 bp, Artificial Sequence
  chemically synthesized
tactaataaaaacatgcatgtg

SEQ ID NO: 1297244 - DNA, 22 bp, Artificial Sequence
  chemically synthesized
actaataaaaacatgcatgtgc

SEQ ID NO: 1297245 - DNA, 22 bp, Artificial Sequence
  chemically synthesized
tcttattaatatgcacatgcat

SEQ ID NO: 1297246 - DNA, 22 bp, Artificial Sequence
  chemically synthesized
ctaataaaaacatgcatgtgca

SEQ ID NO: 1297247 - DNA, 22 bp, Artificial Sequence
  chemically synthesized
ataaaaacatgcatgtgcatat

SEQ ID NO: 1297248 - DNA, 22 bp, Artificial Sequence
  chemically synthesized
cctctcttattaatatgcacat

SEQ ID NO: 1297249 - DNA, 22 bp, Artificial Sequence
  chemically synthesized
gcctctcttattaatatgcaca

SEQ ID NO: 1297250 - DNA, 22 bp, Artificial Sequence
  chemically synthesized
tgcctctcttattaatatgcac

SEQ ID NO: 1297251 - DNA, 22 bp, Artificial Sequence
  chemically synthesized
tttgcctctcttattaatatgc

SEQ ID NO: 1297252 - DNA, 22 bp, Artificial Sequence
  chemically synthesized
ctttgcctctcttattaatatg

SEQ ID NO: 1297253 - DNA, 22 bp, Artificial Sequence
  chemically synthesized
ttctttgcctctcttattaata

SEQ ID NO: 1297254 - DNA, 22 bp, Artificial Sequence
  chemically synthesized
cttctttgcctctcttattaat

SEQ ID NO: 1297255 - DNA, 22 bp, Artificial Sequence
  chemically synthesized
tcttctttgcctctcttattaa

SEQ ID NO: 1297256 - DNA, 22 bp, Artificial Sequence
  chemically synthesized
agagagattttcttctttgcct

SEQ ID NO: 1297257 - DNA, 22 bp, Artificial Sequence
  chemically synthesized
ctaagagagattttcttctttg

SEQ ID NO: 1297258 - DNA, 22 bp, Artificial Sequence
  chemically synthesized
cctaagagagattttcttcttt

SEQ ID NO: 1297259 - DNA, 22 bp, Artificial Sequence
  chemically synthesized
ataagagaggcaaagaagaaaa

SEQ ID NO: 1297260 - DNA, 22 bp, Artificial Sequence
  chemically synthesized
tcctaagagagattttcttctt

SEQ ID NO: 1297261 - DNA, 22 bp, Artificial Sequence
  chemically synthesized
aagtaaattttcctaagagaga

SEQ ID NO: 1297262 - DNA, 22 bp, Artificial Sequence
  chemically synthesized
caagtaaattttcctaagagag

SEQ ID NO: 1297263 - DNA, 22 bp, Artificial Sequence
  chemically synthesized
tcaagtaaattttcctaagaga

SEQ ID NO: 1297264 - DNA, 22 bp, Artificial Sequence
  chemically synthesized
cagggaacagttttcaagtaaa

SEQ ID NO: 1297265 - DNA, 22 bp, Artificial Sequence
  chemically synthesized
tcttaggaaaatttacttgaaa

SEQ ID NO: 1297266 - DNA, 22 bp, Artificial Sequence
  chemically synthesized
ttaggaaaatttacttgaaaac

SEQ ID NO: 1297267 - DNA, 22 bp, Artificial Sequence
  chemically synthesized
aggaaaatttacttgaaaactg

SEQ ID NO: 1297268 - DNA, 22 bp, Artificial Sequence
  chemically synthesized
ggaaaatttacttgaaaactgt

SEQ ID NO: 1297269 - DNA, 22 bp, Artificial Sequence
  chemically synthesized
acatctccagggaacagttttc

SEQ ID NO: 1297270 - DNA, 22 bp, Artificial Sequence
  chemically synthesized
gacatctccagggaacagtttt

SEQ ID NO: 1297271 - DNA, 22 bp, Artificial Sequence
  chemically synthesized
ttgacatctccagggaacagtt

SEQ ID NO: 1297272 - DNA, 22 bp, Artificial Sequence
  chemically synthesized
cttgacatctccagggaacagt

SEQ ID NO: 1297273 - DNA, 22 bp, Artificial Sequence
  chemically synthesized
acttgaaaactgttccctggag

SEQ ID NO: 1297274 - DNA, 22 bp, Artificial Sequence
  chemically synthesized
acttcttgacatctccagggaa

SEQ ID NO: 1297275 - DNA, 22 bp, Artificial Sequence
  chemically synthesized
cttgaaaactgttccctggaga

SEQ ID NO: 1297276 - DNA, 22 bp, Artificial Sequence
  chemically synthesized
cacttcttgacatctccaggga

SEQ ID NO: 1297277 - DNA, 22 bp, Artificial Sequence
  chemically synthesized
ttcacttcttgacatctccagg

SEQ ID NO: 1297278 - DNA, 22 bp, Artificial Sequence
  chemically synthesized
gaaaactgttccctggagatgt

SEQ ID NO: 1297279 - DNA, 22 bp, Artificial Sequence
  chemically synthesized
aaaactgttccctggagatgtc

SEQ ID NO: 1297280 - DNA, 22 bp, Artificial Sequence
  chemically synthesized
ttccctggagatgtcaagaagt

SEQ ID NO: 1297281 - DNA, 22 bp, Artificial Sequence
  chemically synthesized
cctggagatgtcaagaagtgaa

SEQ ID NO: 1297282 - DNA, 22 bp, Artificial Sequence
  chemically synthesized
tgaagtagtggttcttcacttc

SEQ ID NO: 1297283 - DNA, 22 bp, Artificial Sequence
  chemically synthesized
atgaagtagtggttcttcactt

SEQ ID NO: 1297284 - DNA, 22 bp, Artificial Sequence
  chemically synthesized
gagatgtcaagaagtgaagaac

SEQ ID NO: 1297285 - DNA, 22 bp, Artificial Sequence
  chemically synthesized
caatttatgaagtagtggttct

SEQ ID NO: 1297286 - DNA, 22 bp, Artificial Sequence
  chemically synthesized
gcaatttatgaagtagtggttc

SEQ ID NO: 1297287 - DNA, 22 bp, Artificial Sequence
  chemically synthesized
tgcaatttatgaagtagtggtt

SEQ ID NO: 1297288 - DNA, 22 bp, Artificial Sequence
  chemically synthesized
ttgcaatttatgaagtagtggt

SEQ ID NO: 1297289 - DNA, 22 bp, Artificial Sequence
  chemically synthesized
gtcagtttttgcaatttatgaa

SEQ ID NO: 1297290 - DNA, 22 bp, Artificial Sequence
  chemically synthesized
cttcataaattgcaaaaactga

SEQ ID NO: 1297291 - DNA, 22 bp, Artificial Sequence
  chemically synthesized
cataaattgcaaaaactgacca

SEQ ID NO: 1297292 - DNA, 22 bp, Artificial Sequence
  chemically synthesized
ataaattgcaaaaactgaccaa

SEQ ID NO: 1297293 - DNA, 22 bp, Artificial Sequence
  chemically synthesized
caaaaactgaccaacgttttat

SEQ ID NO: 1297294 - DNA, 22 bp, Artificial Sequence
  chemically synthesized
cccgtagagagaataaaataaa

SEQ ID NO: 1297295 - DNA, 22 bp, Artificial Sequence
  chemically synthesized
ccccgtagagagaataaaataa

SEQ ID NO: 1297296 - DNA, 22 bp, Artificial Sequence
  chemically synthesized
accaacgttttattttattctc

SEQ ID NO: 1297297 - DNA, 22 bp, Artificial Sequence
  chemically synthesized
tatgggatttccccgtagagag

SEQ ID NO: 1297298 - DNA, 22 bp, Artificial Sequence
  chemically synthesized
atatgggatttccccgtagaga

SEQ ID NO: 1297299 - DNA, 22 bp, Artificial Sequence
  chemically synthesized
tatatgggatttccccgtagag

SEQ ID NO: 1297300 - DNA, 22 bp, Artificial Sequence
  chemically synthesized
tattttattctctctacgggga

SEQ ID NO: 1297301 - DNA, 22 bp, Artificial Sequence
  chemically synthesized
attttattctctctacggggaa

SEQ ID NO: 1297302 - DNA, 22 bp, Artificial Sequence
  chemically synthesized
ttttattctctctacggggaaa

SEQ ID NO: 1297303 - DNA, 22 bp, Artificial Sequence
  chemically synthesized
attttatatgggatttccccgt

SEQ ID NO: 1297304 - DNA, 22 bp, Artificial Sequence
  chemically synthesized
tattctctctacggggaaatcc

SEQ ID NO: 1297305 - DNA, 22 bp, Artificial Sequence
  chemically synthesized
attctctctacggggaaatccc

SEQ ID NO: 1297306 - DNA, 22 bp, Artificial Sequence
  chemically synthesized
ttctctctacggggaaatccca

SEQ ID NO: 1297307 - DNA, 22 bp, Artificial Sequence
  chemically synthesized
tctctacggggaaatcccatat

SEQ ID NO: 1297308 - DNA, 22 bp, Artificial Sequence
  chemically synthesized
gaaagctaattttatatgggat

SEQ ID NO: 1297309 - DNA, 22 bp, Artificial Sequence
  chemically synthesized
tctacggggaaatcccatataa

SEQ ID NO: 1297310 - DNA, 22 bp, Artificial Sequence
  chemically synthesized
tacggggaaatcccatataaaa

SEQ ID NO: 1297311 - DNA, 22 bp, Artificial Sequence
  chemically synthesized
cggggaaatcccatataaaatt

SEQ ID NO: 1297312 - DNA, 22 bp, Artificial Sequence
  chemically synthesized
tgtcatgttagaaagctaattt

SEQ ID NO: 1297313 - DNA, 22 bp, Artificial Sequence
  chemically synthesized
atgtcatgttagaaagctaatt

SEQ ID NO: 1297314 - DNA, 22 bp, Artificial Sequence
  chemically synthesized
tatgtcatgttagaaagctaat

SEQ ID NO: 1297315 - DNA, 22 bp, Artificial Sequence
  chemically synthesized
ttatgtcatgttagaaagctaa

SEQ ID NO: 1297316 - DNA, 22 bp, Artificial Sequence
  chemically synthesized
gctttctaacatgacataaaaa

SEQ ID NO: 1297317 - DNA, 22 bp, Artificial Sequence
  chemically synthesized
agaggaaatacaatttttatgt

SEQ ID NO: 1297318 - DNA, 22 bp, Artificial Sequence
  chemically synthesized
tctaacatgacataaaaattgt

SEQ ID NO: 1297319 - DNA, 22 bp, Artificial Sequence
  chemically synthesized
ctgagaggaaatacaattttta

SEQ ID NO: 1297320 - DNA, 22 bp, Artificial Sequence
  chemically synthesized
ctaacatgacataaaaattgta

SEQ ID NO: 1297321 - DNA, 22 bp, Artificial Sequence
  chemically synthesized
taacatgacataaaaattgtat

SEQ ID NO: 1297322 - DNA, 22 bp, Artificial Sequence
  chemically synthesized
acatgacataaaaattgtattt

SEQ ID NO: 1297323 - DNA, 22 bp, Artificial Sequence
  chemically synthesized
aagattactgagaggaaataca

SEQ ID NO: 1297324 - DNA, 22 bp, Artificial Sequence
  chemically synthesized
gaaggggttaaagattactgag

SEQ ID NO: 1297325 - DNA, 22 bp, Artificial Sequence
  chemically synthesized
ttagaaggggttaaagattact

SEQ ID NO: 1297326 - DNA, 22 bp, Artificial Sequence
  chemically synthesized
tatttcctctcagtaatcttta

SEQ ID NO: 1297327 - DNA, 22 bp, Artificial Sequence
  chemically synthesized
attagaaggggttaaagattac

SEQ ID NO: 1297328 - DNA, 22 bp, Artificial Sequence
  chemically synthesized
tattagaaggggttaaagatta

SEQ ID NO: 1297329 - DNA, 22 bp, Artificial Sequence
  chemically synthesized
cctctcagtaatctttaacccc

SEQ ID NO: 1297330 - DNA, 22 bp, Artificial Sequence
  chemically synthesized
ctctcagtaatctttaacccct

SEQ ID NO: 1297331 - DNA, 22 bp, Artificial Sequence
  chemically synthesized
tcagtaatctttaaccccttct

SEQ ID NO: 1297332 - DNA, 22 bp, Artificial Sequence
  chemically synthesized
agtaatctttaaccccttctaa

SEQ ID NO: 1297333 - DNA, 22 bp, Artificial Sequence
  chemically synthesized
aataaaaataactttattagaa

SEQ ID NO: 1297334 - DNA, 22 bp, Artificial Sequence
  chemically synthesized
taaccccttctaataaagttat

SEQ ID NO: 1297335 - DNA, 22 bp, Artificial Sequence
  chemically synthesized
aaccccttctaataaagttatt

SEQ ID NO: 1297336 - DNA, 22 bp, Artificial Sequence
  chemically synthesized
accccttctaataaagttattt

SEQ ID NO: 1297337 - DNA, 22 bp, Artificial Sequence
  chemically synthesized
ctaataaagttatttttattca

SEQ ID NO: 1297338 - DNA, 22 bp, Artificial Sequence
  chemically synthesized
taataaagttatttttattcag

SEQ ID NO: 1297339 - DNA, 22 bp, Artificial Sequence
  chemically synthesized
ataaagttatttttattcagta

SEQ ID NO: 1297340 - DNA, 22 bp, Artificial Sequence
  chemically synthesized
tttttattcagtatatgtggcc

SEQ ID NO: 1297341 - DNA, 22 bp, Artificial Sequence
  chemically synthesized
aaaaatatgaaaggccacatat

SEQ ID NO: 1297342 - DNA, 22 bp, Artificial Sequence
  chemically synthesized
aaaaaatatgaaaggccacata

SEQ ID NO: 1297343 - DNA, 22 bp, Artificial Sequence
  chemically synthesized
ttattcagtatatgtggccttt

SEQ ID NO: 1297344 - DNA, 22 bp, Artificial Sequence
  chemically synthesized
tattcagtatatgtggcctttc

SEQ ID NO: 1297345 - DNA, 22 bp, Artificial Sequence
  chemically synthesized
attcagtatatgtggcctttca

SEQ ID NO: 1297346 - DNA, 22 bp, Artificial Sequence
  chemically synthesized
ttcagtatatgtggcctttcat

SEQ ID NO: 1297347 - DNA, 22 bp, Artificial Sequence
  chemically synthesized
atcttaaaaaatatgaaaggcc

SEQ ID NO: 1297348 - DNA, 22 bp, Artificial Sequence
  chemically synthesized
agtatatgtggcctttcatatt

SEQ ID NO: 1297349 - DNA, 22 bp, Artificial Sequence
  chemically synthesized
tactaatcttaaaaaatatgaa

SEQ ID NO: 1297350 - DNA, 22 bp, Artificial Sequence
  chemically synthesized
attgtactaatcttaaaaaata

SEQ ID NO: 1297351 - DNA, 22 bp, Artificial Sequence
  chemically synthesized
tcatattttttaagattagtac

SEQ ID NO: 1297352 - DNA, 22 bp, Artificial Sequence
  chemically synthesized
catattttttaagattagtaca

SEQ ID NO: 1297353 - DNA, 22 bp, Artificial Sequence
  chemically synthesized
atattttttaagattagtacaa

SEQ ID NO: 1297354 - DNA, 22 bp, Artificial Sequence
  chemically synthesized
tttaagattagtacaatgaact

SEQ ID NO: 1297355 - DNA, 22 bp, Artificial Sequence
  chemically synthesized
ttaagattagtacaatgaactt

SEQ ID NO: 1297356 - DNA, 22 bp, Artificial Sequence
  chemically synthesized
ataacagggtaaaagttcattg

SEQ ID NO: 1297357 - DNA, 22 bp, Artificial Sequence
  chemically synthesized
taagattagtacaatgaacttt

SEQ ID NO: 1297358 - DNA, 22 bp, Artificial Sequence
  chemically synthesized
aagattagtacaatgaactttt

SEQ ID NO: 1297359 - DNA, 22 bp, Artificial Sequence
  chemically synthesized
agattagtacaatgaactttta

SEQ ID NO: 1297360 - DNA, 22 bp, Artificial Sequence
  chemically synthesized
gtacaatgaacttttaccctgt

SEQ ID NO: 1297361 - DNA, 22 bp, Artificial Sequence
  chemically synthesized
aggaatataaaagttaataaca

SEQ ID NO: 1297362 - DNA, 22 bp, Artificial Sequence
  chemically synthesized
ttaccctgttattaacttttat

SEQ ID NO: 1297363 - DNA, 22 bp, Artificial Sequence
  chemically synthesized
taccctgttattaacttttata

SEQ ID NO: 1297364 - DNA, 22 bp, Artificial Sequence
  chemically synthesized
accctgttattaacttttatat

SEQ ID NO: 1297365 - DNA, 22 bp, Artificial Sequence
  chemically synthesized
agggactaaggaatataaaagt

SEQ ID NO: 1297366 - DNA, 22 bp, Artificial Sequence
  chemically synthesized
ccctgttattaacttttatatt

SEQ ID NO: 1297367 - DNA, 22 bp, Artificial Sequence
  chemically synthesized
ctgagggactaaggaatataaa

SEQ ID NO: 1297368 - DNA, 22 bp, Artificial Sequence
  chemically synthesized
ttattaacttttatattcctta

SEQ ID NO: 1297369 - DNA, 22 bp, Artificial Sequence
  chemically synthesized
tattcctgagggactaaggaat

SEQ ID NO: 1297370 - DNA, 22 bp, Artificial Sequence
  chemically synthesized
ttaacttttatattccttagtc

SEQ ID NO: 1297371 - DNA, 22 bp, Artificial Sequence
  chemically synthesized
atattcctgagggactaaggaa

SEQ ID NO: 1297372 - DNA, 22 bp, Artificial Sequence
  chemically synthesized
acttttatattccttagtccct

SEQ ID NO: 1297373 - DNA, 22 bp, Artificial Sequence
  chemically synthesized
ttatattccttagtccctcagg

SEQ ID NO: 1297374 - DNA, 22 bp, Artificial Sequence
  chemically synthesized
tatattccttagtccctcagga

SEQ ID NO: 1297375 - DNA, 22 bp, Artificial Sequence
  chemically synthesized
atattccttagtccctcaggaa

SEQ ID NO: 1297376 - DNA, 22 bp, Artificial Sequence
  chemically synthesized
tattccttagtccctcaggaat

SEQ ID NO: 1297377 - DNA, 22 bp, Artificial Sequence
  chemically synthesized
cttagtccctcaggaatataaa

SEQ ID NO: 1297378 - DNA, 22 bp, Artificial Sequence
  chemically synthesized
atatatcccacatttatattcc

SEQ ID NO: 1297379 - DNA, 22 bp, Artificial Sequence
  chemically synthesized
aatatatcccacatttatattc

SEQ ID NO: 1297380 - DNA, 22 bp, Artificial Sequence
  chemically synthesized
agtccctcaggaatataaatgt

SEQ ID NO: 1297381 - DNA, 22 bp, Artificial Sequence
  chemically synthesized
gtccctcaggaatataaatgtg

SEQ ID NO: 1297382 - DNA, 22 bp, Artificial Sequence
  chemically synthesized
caatttaatatatcccacattt

SEQ ID NO: 1297383 - DNA, 22 bp, Artificial Sequence
  chemically synthesized
aggaatataaatgtgggatata

SEQ ID NO: 1297384 - DNA, 22 bp, Artificial Sequence
  chemically synthesized
tgaatcaagaatattgcaattt

SEQ ID NO: 1297385 - DNA, 22 bp, Artificial Sequence
  chemically synthesized
gtgaatcaagaatattgcaatt

SEQ ID NO: 1297386 - DNA, 22 bp, Artificial Sequence
  chemically synthesized
ttgtgaatcaagaatattgcaa

SEQ ID NO: 1297387 - DNA, 22 bp, Artificial Sequence
  chemically synthesized
ctcttgtgaatcaagaatattg

SEQ ID NO: 1297388 - DNA, 22 bp, Artificial Sequence
  chemically synthesized
gctcttgtgaatcaagaatatt

SEQ ID NO: 1297389 - DNA, 22 bp, Artificial Sequence
  chemically synthesized
aattgcaatattcttgattcac

SEQ ID NO: 1297390 - DNA, 22 bp, Artificial Sequence
  chemically synthesized
cagtaacttgctcttgtgaatc

SEQ ID NO: 1297391 - DNA, 22 bp, Artificial Sequence
  chemically synthesized
caatattcttgattcacaagag

SEQ ID NO: 1297392 - DNA, 22 bp, Artificial Sequence
  chemically synthesized
tgcagtaacttgctcttgtgaa

SEQ ID NO: 1297393 - DNA, 22 bp, Artificial Sequence
  chemically synthesized
ctgcagtaacttgctcttgtga

SEQ ID NO: 1297394 - DNA, 22 bp, Artificial Sequence
  chemically synthesized
ttctgcagtaacttgctcttgt

SEQ ID NO: 1297395 - DNA, 22 bp, Artificial Sequence
  chemically synthesized
ttgattcacaagagcaagttac

SEQ ID NO: 1297396 - DNA, 22 bp, Artificial Sequence
  chemically synthesized
gattcacaagagcaagttactg

SEQ ID NO: 1297397 - DNA, 22 bp, Artificial Sequence
  chemically synthesized
attcacaagagcaagttactgc

SEQ ID NO: 1297398 - DNA, 22 bp, Artificial Sequence
  chemically synthesized
acaagagcaagttactgcagaa

SEQ ID NO: 1297399 - DNA, 22 bp, Artificial Sequence
  chemically synthesized
cccagtatcattcttctgcagt

SEQ ID NO: 1297400 - DNA, 22 bp, Artificial Sequence
  chemically synthesized
gcccagtatcattcttctgcag

SEQ ID NO: 1297401 - DNA, 22 bp, Artificial Sequence
  chemically synthesized
agtttgcccagtatcattcttc

SEQ ID NO: 1297402 - DNA, 22 bp, Artificial Sequence
  chemically synthesized
cctcagtttgcccagtatcatt

SEQ ID NO: 1297403 - DNA, 22 bp, Artificial Sequence
  chemically synthesized
ctgcagaagaatgatactgggc

SEQ ID NO: 1297404 - DNA, 22 bp, Artificial Sequence
  chemically synthesized
cagaagaatgatactgggcaaa

SEQ ID NO: 1297405 - DNA, 22 bp, Artificial Sequence
  chemically synthesized
atgttccctcagtttgcccagt

SEQ ID NO: 1297406 - DNA, 22 bp, Artificial Sequence
  chemically synthesized
aatgttccctcagtttgcccag

SEQ ID NO: 1297407 - DNA, 22 bp, Artificial Sequence
  chemically synthesized
cacagatttaatgttccctcag

SEQ ID NO: 1297408 - DNA, 22 bp, Artificial Sequence
  chemically synthesized
ggcaaactgagggaacattaaa

SEQ ID NO: 1297409 - DNA, 22 bp, Artificial Sequence
  chemically synthesized
gaagccagttccacagatttaa

SEQ ID NO: 1297410 - DNA, 22 bp, Artificial Sequence
  chemically synthesized
agggaacattaaatctgtggaa

SEQ ID NO: 1297411 - DNA, 22 bp, Artificial Sequence
  chemically synthesized
caaagccactggaagccagttc

SEQ ID NO: 1297412 - DNA, 22 bp, Artificial Sequence
  chemically synthesized
aatctgtggaactggcttccag

SEQ ID NO: 1297413 - DNA, 22 bp, Artificial Sequence
  chemically synthesized
tggaactggcttccagtggctt

SEQ ID NO: 1297414 - DNA, 22 bp, Artificial Sequence
  chemically synthesized
ataagtcctgcaaagccactgg

SEQ ID NO: 1297415 - DNA, 22 bp, Artificial Sequence
  chemically synthesized
taataagtcctgcaaagccact

SEQ ID NO: 1297416 - DNA, 22 bp, Artificial Sequence
  chemically synthesized
gcttccagtggctttgcaggac

SEQ ID NO: 1297417 - DNA, 22 bp, Artificial Sequence
  chemically synthesized
ccagtggctttgcaggacttat

SEQ ID NO: 1297418 - DNA, 22 bp, Artificial Sequence
  chemically synthesized
cagtggctttgcaggacttatt

SEQ ID NO: 1297419 - DNA, 22 bp, Artificial Sequence
  chemically synthesized
aggccacaattctaataagtcc

SEQ ID NO: 1297420 - DNA, 22 bp, Artificial Sequence
  chemically synthesized
aaggccacaattctaataagtc

SEQ ID NO: 1297421 - DNA, 22 bp, Artificial Sequence
  chemically synthesized
taaggccacaattctaataagt

SEQ ID NO: 1297422 - DNA, 22 bp, Artificial Sequence
  chemically synthesized
tgcaggacttattagaattgtg

SEQ ID NO: 1297423 - DNA, 22 bp, Artificial Sequence
  chemically synthesized
gcaggacttattagaattgtgg

SEQ ID NO: 1297424 - DNA, 22 bp, Artificial Sequence
  chemically synthesized
gcaattttaaggccacaattct

SEQ ID NO: 1297425 - DNA, 22 bp, Artificial Sequence
  chemically synthesized
caggacttattagaattgtggc

SEQ ID NO: 1297426 - DNA, 22 bp, Artificial Sequence
  chemically synthesized
ggcaattttaaggccacaattc

SEQ ID NO: 1297427 - DNA, 22 bp, Artificial Sequence
  chemically synthesized
aggcttggcaattttaaggcca

SEQ ID NO: 1297428 - DNA, 22 bp, Artificial Sequence
  chemically synthesized
attagaattgtggccttaaaat

SEQ ID NO: 1297429 - DNA, 22 bp, Artificial Sequence
  chemically synthesized
ttagaattgtggccttaaaatt

SEQ ID NO: 1297430 - DNA, 22 bp, Artificial Sequence
  chemically synthesized
gaattgtggccttaaaattgcc

SEQ ID NO: 1297431 - DNA, 22 bp, Artificial Sequence
  chemically synthesized
aagacgctaaggcttggcaatt

SEQ ID NO: 1297432 - DNA, 22 bp, Artificial Sequence
  chemically synthesized
tggccttaaaattgccaagcct

SEQ ID NO: 1297433 - DNA, 22 bp, Artificial Sequence
  chemically synthesized
acagttaaagacgctaaggctt

SEQ ID NO: 1297434 - DNA, 22 bp, Artificial Sequence
  chemically synthesized
cacagttaaagacgctaaggct

SEQ ID NO: 1297435 - DNA, 22 bp, Artificial Sequence
  chemically synthesized
aaaattgccaagccttagcgtc

SEQ ID NO: 1297436 - DNA, 22 bp, Artificial Sequence
  chemically synthesized
aaattgccaagccttagcgtct

SEQ ID NO: 1297437 - DNA, 22 bp, Artificial Sequence
  chemically synthesized
atttcacagttaaagacgctaa

SEQ ID NO: 1297438 - DNA, 22 bp, Artificial Sequence
  chemically synthesized
tcatttcacagttaaagacgct

SEQ ID NO: 1297439 - DNA, 22 bp, Artificial Sequence
  chemically synthesized
ccaagccttagcgtctttaact

SEQ ID NO: 1297440 - DNA, 22 bp, Artificial Sequence
  chemically synthesized
atattctcatttcacagttaaa

SEQ ID NO: 1297441 - DNA, 22 bp, Artificial Sequence
  chemically synthesized
agcgtctttaactgtgaaatga

SEQ ID NO: 1297442 - DNA, 22 bp, Artificial Sequence
  chemically synthesized
gcgtctttaactgtgaaatgag

SEQ ID NO: 1297443 - DNA, 22 bp, Artificial Sequence
  chemically synthesized
aagagcaattaatattctcatt

SEQ ID NO: 1297444 - DNA, 22 bp, Artificial Sequence
  chemically synthesized
taactgtgaaatgagaatatta

SEQ ID NO: 1297445 - DNA, 22 bp, Artificial Sequence
  chemically synthesized
aactgtgaaatgagaatattaa

SEQ ID NO: 1297446 - DNA, 22 bp, Artificial Sequence
  chemically synthesized
actgtgaaatgagaatattaat

SEQ ID NO: 1297447 - DNA, 22 bp, Artificial Sequence
  chemically synthesized
tgaaatgagaatattaattgct

SEQ ID NO: 1297448 - DNA, 22 bp, Artificial Sequence
  chemically synthesized
catgagttaaagagcaattaat

SEQ ID NO: 1297449 - DNA, 22 bp, Artificial Sequence
  chemically synthesized
tcaatagctccatgagttaaag

SEQ ID NO: 1297450 - DNA, 22 bp, Artificial Sequence
  chemically synthesized
attgctctttaactcatggagc

SEQ ID NO: 1297451 - DNA, 22 bp, Artificial Sequence
  chemically synthesized
tatcctgtcaatagctccatga

SEQ ID NO: 1297452 - DNA, 22 bp, Artificial Sequence
  chemically synthesized
ctctttaactcatggagctatt

SEQ ID NO: 1297453 - DNA, 22 bp, Artificial Sequence
  chemically synthesized
attatatcctgtcaatagctcc

SEQ ID NO: 1297454 - DNA, 22 bp, Artificial Sequence
  chemically synthesized
tttaactcatggagctattgac

SEQ ID NO: 1297455 - DNA, 22 bp, Artificial Sequence
  chemically synthesized
taactcatggagctattgacag

SEQ ID NO: 1297456 - DNA, 22 bp, Artificial Sequence
  chemically synthesized
aactcatggagctattgacagg

SEQ ID NO: 1297457 - DNA, 22 bp, Artificial Sequence
  chemically synthesized
actcatggagctattgacagga

SEQ ID NO: 1297458 - DNA, 22 bp, Artificial Sequence
  chemically synthesized
atggagctattgacaggatata

SEQ ID NO: 1297459 - DNA, 22 bp, Artificial Sequence
  chemically synthesized
cacgagtaaatgatctcattat

SEQ ID NO: 1297460 - DNA, 22 bp, Artificial Sequence
  chemically synthesized
ttgacaggatataatgagatca

SEQ ID NO: 1297461 - DNA, 22 bp, Artificial Sequence
  chemically synthesized
ttacacgagtaaatgatctcat

SEQ ID NO: 1297462 - DNA, 22 bp, Artificial Sequence
  chemically synthesized
acaggatataatgagatcattt

SEQ ID NO: 1297463 - DNA, 22 bp, Artificial Sequence
  chemically synthesized
taaattattacacgagtaaatg

SEQ ID NO: 1297464 - DNA, 22 bp, Artificial Sequence
  chemically synthesized
ataaattattacacgagtaaat

SEQ ID NO: 1297465 - DNA, 22 bp, Artificial Sequence
  chemically synthesized
tataaattattacacgagtaaa

SEQ ID NO: 1297466 - DNA, 22 bp, Artificial Sequence
  chemically synthesized
ttttataaattattacacgagt

SEQ ID NO: 1297467 - DNA, 22 bp, Artificial Sequence
  chemically synthesized
attttataaattattacacgag

SEQ ID NO: 1297468 - DNA, 22 bp, Artificial Sequence
  chemically synthesized
taaatatttattttataaatta

SEQ ID NO: 1297469 - DNA, 22 bp, Artificial Sequence
  chemically synthesized
actcgtgtaataatttataaaa

SEQ ID NO: 1297470 - DNA, 22 bp, Artificial Sequence
  chemically synthesized
tgtaaatatttattttataaat

SEQ ID NO: 1297471 - DNA, 22 bp, Artificial Sequence
  chemically synthesized
ctcgtgtaataatttataaaat

SEQ ID NO: 1297472 - DNA, 22 bp, Artificial Sequence
  chemically synthesized
gtgtaataatttataaaataaa

SEQ ID NO: 1297473 - DNA, 22 bp, Artificial Sequence
  chemically synthesized
ataaaataaatatttacagaat

SEQ ID NO: 1297474 - DNA, 22 bp, Artificial Sequence
  chemically synthesized
taaaataaatatttacagaatg

SEQ ID NO: 1297475 - DNA, 22 bp, Artificial Sequence
  chemically synthesized
gtgcaatgtccaggtcatagta

SEQ ID NO: 1297476 - DNA, 22 bp, Artificial Sequence
  chemically synthesized
acagaatgcttactatgacctg

SEQ ID NO: 1297477 - DNA, 22 bp, Artificial Sequence
  chemically synthesized
cagaatgcttactatgacctgg

SEQ ID NO: 1297478 - DNA, 22 bp, Artificial Sequence
  chemically synthesized
agtaactagtgcaatgtccagg

SEQ ID NO: 1297479 - DNA, 22 bp, Artificial Sequence
  chemically synthesized
cagtaactagtgcaatgtccag

SEQ ID NO: 1297480 - DNA, 22 bp, Artificial Sequence
  chemically synthesized
tcagtaactagtgcaatgtcca

SEQ ID NO: 1297481 - DNA, 22 bp, Artificial Sequence
  chemically synthesized
actatgacctggacattgcact

SEQ ID NO: 1297482 - DNA, 22 bp, Artificial Sequence
  chemically synthesized
ctatgacctggacattgcacta

SEQ ID NO: 1297483 - DNA, 22 bp, Artificial Sequence
  chemically synthesized
tattttcagtaactagtgcaat

SEQ ID NO: 1297484 - DNA, 22 bp, Artificial Sequence
  chemically synthesized
atattttcagtaactagtgcaa

SEQ ID NO: 1297485 - DNA, 22 bp, Artificial Sequence
  chemically synthesized
tgacctggacattgcactagtt

SEQ ID NO: 1297486 - DNA, 22 bp, Artificial Sequence
  chemically synthesized
tttatattttcagtaactagtg

SEQ ID NO: 1297487 - DNA, 22 bp, Artificial Sequence
  chemically synthesized
gtttatattttcagtaactagt

SEQ ID NO: 1297488 - DNA, 22 bp, Artificial Sequence
  chemically synthesized
gacattgcactagttactgaaa

SEQ ID NO: 1297489 - DNA, 22 bp, Artificial Sequence
  chemically synthesized
aatcttgtttatattttcagta

SEQ ID NO: 1297490 - DNA, 22 bp, Artificial Sequence
  chemically synthesized
cactagttactgaaaatataaa

SEQ ID NO: 1297491 - DNA, 22 bp, Artificial Sequence
  chemically synthesized
ccagactgaatcttgtttatat

SEQ ID NO: 1297492 - DNA, 22 bp, Artificial Sequence
  chemically synthesized
gttactgaaaatataaacaaga

SEQ ID NO: 1297493 - DNA, 22 bp, Artificial Sequence
  chemically synthesized
tcccagactgaatcttgtttat

SEQ ID NO: 1297494 - DNA, 22 bp, Artificial Sequence
  chemically synthesized
ctgaaaatataaacaagattca

SEQ ID NO: 1297495 - DNA, 22 bp, Artificial Sequence
  chemically synthesized
aaaatataaacaagattcagtc

SEQ ID NO: 1297496 - DNA, 22 bp, Artificial Sequence
  chemically synthesized
agagctctcccagactgaatct

SEQ ID NO: 1297497 - DNA, 22 bp, Artificial Sequence
  chemically synthesized
ggctaagagctctcccagactg

SEQ ID NO: 1297498 - DNA, 22 bp, Artificial Sequence
  chemically synthesized
ctaggctaagagctctcccaga

SEQ ID NO: 1297499 - DNA, 22 bp, Artificial Sequence
  chemically synthesized
tctactaggctaagagctctcc

SEQ ID NO: 1297500 - DNA, 22 bp, Artificial Sequence
  chemically synthesized
ttatctactaggctaagagctc

SEQ ID NO: 1297501 - DNA, 22 bp, Artificial Sequence
  chemically synthesized
agtctgggagagctcttagcct

SEQ ID NO: 1297502 - DNA, 22 bp, Artificial Sequence
  chemically synthesized
ggagagctcttagcctagtaga

SEQ ID NO: 1297503 - DNA, 22 bp, Artificial Sequence
  chemically synthesized
tgatgtgtctattatctactag

SEQ ID NO: 1297504 - DNA, 22 bp, Artificial Sequence
  chemically synthesized
tctatgatgtgtctattatcta

SEQ ID NO: 1297505 - DNA, 22 bp, Artificial Sequence
  chemically synthesized
atctatgatgtgtctattatct

SEQ ID NO: 1297506 - DNA, 22 bp, Artificial Sequence
  chemically synthesized
ttagcctagtagataatagaca

SEQ ID NO: 1297507 - DNA, 22 bp, Artificial Sequence
  chemically synthesized
agcctagtagataatagacaca

SEQ ID NO: 1297508 - DNA, 22 bp, Artificial Sequence
  chemically synthesized
gcctagtagataatagacacat

SEQ ID NO: 1297509 - DNA, 22 bp, Artificial Sequence
  chemically synthesized
atatttatctatgatgtgtcta

SEQ ID NO: 1297510 - DNA, 22 bp, Artificial Sequence
  chemically synthesized
catatttatctatgatgtgtct

SEQ ID NO: 1297511 - DNA, 22 bp, Artificial Sequence
  chemically synthesized
gtagataatagacacatcatag

SEQ ID NO: 1297512 - DNA, 22 bp, Artificial Sequence
  chemically synthesized
tgcaaaatgtttcatatttatc

SEQ ID NO: 1297513 - DNA, 22 bp, Artificial Sequence
  chemically synthesized
atgcaaaatgtttcatatttat

SEQ ID NO: 1297514 - DNA, 22 bp, Artificial Sequence
  chemically synthesized
tttatgcaaaatgtttcatatt

SEQ ID NO: 1297515 - DNA, 22 bp, Artificial Sequence
  chemically synthesized
gtttatgcaaaatgtttcatat

SEQ ID NO: 1297516 - DNA, 22 bp, Artificial Sequence
  chemically synthesized
tgtttatgcaaaatgtttcata

SEQ ID NO: 1297517 - DNA, 22 bp, Artificial Sequence
  chemically synthesized
ttgtttatgcaaaatgtttcat

SEQ ID NO: 1297518 - DNA, 22 bp, Artificial Sequence
  chemically synthesized
tatatatttttgtttatgcaaa

SEQ ID NO: 1297519 - DNA, 22 bp, Artificial Sequence
  chemically synthesized
atatatatttttgtttatgcaa

SEQ ID NO: 1297520 - DNA, 22 bp, Artificial Sequence
  chemically synthesized
aatttatatatatttttgttta

SEQ ID NO: 1297521 - DNA, 22 bp, Artificial Sequence
  chemically synthesized
aaatttatatatatttttgttt

SEQ ID NO: 1297522 - DNA, 22 bp, Artificial Sequence
  chemically synthesized
taaatttatatatatttttgtt

SEQ ID NO: 1297523 - DNA, 22 bp, Artificial Sequence
  chemically synthesized
tgcataaacaaaaatatatata

SEQ ID NO: 1297524 - DNA, 22 bp, Artificial Sequence
  chemically synthesized
gcataaacaaaaatatatataa

SEQ ID NO: 1297525 - DNA, 22 bp, Artificial Sequence
  chemically synthesized
cataaacaaaaatatatataaa

SEQ ID NO: 1297526 - DNA, 22 bp, Artificial Sequence
  chemically synthesized
taatacgctttaaatttatata

SEQ ID NO: 1297527 - DNA, 22 bp, Artificial Sequence
  chemically synthesized
ctataatacgctttaaatttat

SEQ ID NO: 1297528 - DNA, 22 bp, Artificial Sequence
  chemically synthesized
catgctcctataatacgcttta

SEQ ID NO: 1297529 - DNA, 22 bp, Artificial Sequence
  chemically synthesized
tccatgctcctataatacgctt

SEQ ID NO: 1297530 - DNA, 22 bp, Artificial Sequence
  chemically synthesized
ctccatgctcctataatacgct

SEQ ID NO: 1297531 - DNA, 22 bp, Artificial Sequence
  chemically synthesized
tctccatgctcctataatacgc

SEQ ID NO: 1297532 - DNA, 22 bp, Artificial Sequence
  chemically synthesized
ctttctccatgctcctataata

SEQ ID NO: 1297533 - DNA, 22 bp, Artificial Sequence
  chemically synthesized
aaagcgtattataggagcatgg

SEQ ID NO: 1297534 - DNA, 22 bp, Artificial Sequence
  chemically synthesized
aagcgtattataggagcatgga

SEQ ID NO: 1297535 - DNA, 22 bp, Artificial Sequence
  chemically synthesized
catattcctttctccatgctcc

SEQ ID NO: 1297536 - DNA, 22 bp, Artificial Sequence
  chemically synthesized
taggagcatggagaaaggaata

SEQ ID NO: 1297537 - DNA, 22 bp, Artificial Sequence
  chemically synthesized
acacccatgtggctacatattc

SEQ ID NO: 1297538 - DNA, 22 bp, Artificial Sequence
  chemically synthesized
taacacccatgtggctacatat

SEQ ID NO: 1297539 - DNA, 22 bp, Artificial Sequence
  chemically synthesized
ctaacacccatgtggctacata

SEQ ID NO: 1297540 - DNA, 22 bp, Artificial Sequence
  chemically synthesized
tctaacacccatgtggctacat

SEQ ID NO: 1297541 - DNA, 22 bp, Artificial Sequence
  chemically synthesized
ttctaacacccatgtggctaca

SEQ ID NO: 1297542 - DNA, 22 bp, Artificial Sequence
  chemically synthesized
caaaatatcttttctaacaccc

SEQ ID NO: 1297543 - DNA, 22 bp, Artificial Sequence
  chemically synthesized
tccaaaatatcttttctaacac

SEQ ID NO: 1297544 - DNA, 22 bp, Artificial Sequence
  chemically synthesized
ctccaaaatatcttttctaaca

SEQ ID NO: 1297545 - DNA, 22 bp, Artificial Sequence
  chemically synthesized
ccttctccaaaatatcttttct

SEQ ID NO: 1297546 - DNA, 22 bp, Artificial Sequence
  chemically synthesized
cccattaccttctccaaaatat

SEQ ID NO: 1297547 - DNA, 22 bp, Artificial Sequence
  chemically synthesized
gaaaagatattttggagaaggt

SEQ ID NO: 1297548 - DNA, 22 bp, Artificial Sequence
  chemically synthesized
aacctacccattaccttctcca

SEQ ID NO: 1297549 - DNA, 22 bp, Artificial Sequence
  chemically synthesized
aactcaacctacccattacctt

SEQ ID NO: 1297550 - DNA, 22 bp, Artificial Sequence
  chemically synthesized
tgaactcaacctacccattacc

SEQ ID NO: 1297551 - DNA, 22 bp, Artificial Sequence
  chemically synthesized
ctgaactcaacctacccattac

SEQ ID NO: 1297552 - DNA, 22 bp, Artificial Sequence
  chemically synthesized
tggagaaggtaatgggtaggtt

SEQ ID NO: 1297553 - DNA, 22 bp, Artificial Sequence
  chemically synthesized
ggagaaggtaatgggtaggttg

SEQ ID NO: 1297554 - DNA, 22 bp, Artificial Sequence
  chemically synthesized
gagaaggtaatgggtaggttga

SEQ ID NO: 1297555 - DNA, 22 bp, Artificial Sequence
  chemically synthesized
atccttctgaactcaacctacc

SEQ ID NO: 1297556 - DNA, 22 bp, Artificial Sequence
  chemically synthesized
tcatccttctgaactcaaccta

SEQ ID NO: 1297557 - DNA, 22 bp, Artificial Sequence
  chemically synthesized
tctcatccttctgaactcaacc

SEQ ID NO: 1297558 - DNA, 22 bp, Artificial Sequence
  chemically synthesized
ctctcatccttctgaactcaac

SEQ ID NO: 1297559 - DNA, 22 bp, Artificial Sequence
  chemically synthesized
tctctcatccttctgaactcaa

SEQ ID NO: 1297560 - DNA, 22 bp, Artificial Sequence
  chemically synthesized
ctttctctcatccttctgaact

SEQ ID NO: 1297561 - DNA, 22 bp, Artificial Sequence
  chemically synthesized
actttctctcatccttctgaac

SEQ ID NO: 1297562 - DNA, 22 bp, Artificial Sequence
  chemically synthesized
tactttctctcatccttctgaa

SEQ ID NO: 1297563 - DNA, 22 bp, Artificial Sequence
  chemically synthesized
tttactttctctcatccttctg

SEQ ID NO: 1297564 - DNA, 22 bp, Artificial Sequence
  chemically synthesized
ctttactttctctcatccttct

SEQ ID NO: 1297565 - DNA, 22 bp, Artificial Sequence
  chemically synthesized
cttctttactttctctcatcct

SEQ ID NO: 1297566 - DNA, 22 bp, Artificial Sequence
  chemically synthesized
ttccttctttactttctctcat

SEQ ID NO: 1297567 - DNA, 22 bp, Artificial Sequence
  chemically synthesized
agttcagaaggatgagagaaag

SEQ ID NO: 1297568 - DNA, 22 bp, Artificial Sequence
  chemically synthesized
attccttctttactttctctca

SEQ ID NO: 1297569 - DNA, 22 bp, Artificial Sequence
  chemically synthesized
tattccttctttactttctctc

SEQ ID NO: 1297570 - DNA, 22 bp, Artificial Sequence
  chemically synthesized
agaaggatgagagaaagtaaag

SEQ ID NO: 1297571 - DNA, 22 bp, Artificial Sequence
  chemically synthesized
cctttattccttctttactttc

SEQ ID NO: 1297572 - DNA, 22 bp, Artificial Sequence
  chemically synthesized
ctacctttattccttctttact

SEQ ID NO: 1297573 - DNA, 22 bp, Artificial Sequence
  chemically synthesized
ctcctacctttattccttcttt

SEQ ID NO: 1297574 - DNA, 22 bp, Artificial Sequence
  chemically synthesized
tcctcctcctacctttattcct

SEQ ID NO: 1297575 - DNA, 22 bp, Artificial Sequence
  chemically synthesized
atcctcctcctacctttattcc

SEQ ID NO: 1297576 - DNA, 22 bp, Artificial Sequence
  chemically synthesized
tatcctcctcctacctttattc

SEQ ID NO: 1297577 - DNA, 22 bp, Artificial Sequence
  chemically synthesized
atctttatcctcctcctacctt

SEQ ID NO: 1297578 - DNA, 22 bp, Artificial Sequence
  chemically synthesized
agtgagattcatctttatcctc

SEQ ID NO: 1297579 - DNA, 22 bp, Artificial Sequence
  chemically synthesized
ctcagtgagattcatctttatc

SEQ ID NO: 1297580 - DNA, 22 bp, Artificial Sequence
  chemically synthesized
tctgctcagtgagattcatctt

SEQ ID NO: 1297581 - DNA, 22 bp, Artificial Sequence
  chemically synthesized
ctgtctgctcagtgagattcat

SEQ ID NO: 1297582 - DNA, 22 bp, Artificial Sequence
  chemically synthesized
actgtctgctcagtgagattca

SEQ ID NO: 1297583 - DNA, 22 bp, Artificial Sequence
  chemically synthesized
tccttactgtctgctcagtgag

SEQ ID NO: 1297584 - DNA, 22 bp, Artificial Sequence
  chemically synthesized
gtccttactgtctgctcagtga

SEQ ID NO: 1297585 - DNA, 22 bp, Artificial Sequence
  chemically synthesized
tccttgtccttactgtctgctc

SEQ ID NO: 1297586 - DNA, 22 bp, Artificial Sequence
  chemically synthesized
tgtccttgtccttactgtctgc

SEQ ID NO: 1297587 - DNA, 22 bp, Artificial Sequence
  chemically synthesized
tcactctgtccttgtccttact

SEQ ID NO: 1297588 - DNA, 22 bp, Artificial Sequence
  chemically synthesized
actgagcagacagtaaggacaa

SEQ ID NO: 1297589 - DNA, 22 bp, Artificial Sequence
  chemically synthesized
atcactctgtccttgtccttac

SEQ ID NO: 1297590 - DNA, 22 bp, Artificial Sequence
  chemically synthesized
ttatcactctgtccttgtcctt

SEQ ID NO: 1297591 - DNA, 22 bp, Artificial Sequence
  chemically synthesized
cttatcactctgtccttgtcct

SEQ ID NO: 1297592 - DNA, 22 bp, Artificial Sequence
  chemically synthesized
agcagacagtaaggacaaggac

SEQ ID NO: 1297593 - DNA, 22 bp, Artificial Sequence
  chemically synthesized
agtttcttatcactctgtcctt

SEQ ID NO: 1297594 - DNA, 22 bp, Artificial Sequence
  chemically synthesized
cagtttcttatcactctgtcct

SEQ ID NO: 1297595 - DNA, 22 bp, Artificial Sequence
  chemically synthesized
tcagtttcttatcactctgtcc

SEQ ID NO: 1297596 - DNA, 22 bp, Artificial Sequence
  chemically synthesized
cataatgaatgagcgtgtactt

SEQ ID NO: 1297597 - DNA, 22 bp, Artificial Sequence
  chemically synthesized
aaagtacacgctcattcattat

SEQ ID NO: 1297598 - DNA, 22 bp, Artificial Sequence
  chemically synthesized
gagtgcaacaaaacagaattgc

SEQ ID NO: 1297599 - DNA, 22 bp, Artificial Sequence
  chemically synthesized
agagtgcaacaaaacagaattg

SEQ ID NO: 1297600 - DNA, 22 bp, Artificial Sequence
  chemically synthesized
tagagtgcaacaaaacagaatt

SEQ ID NO: 1297601 - DNA, 22 bp, Artificial Sequence
  chemically synthesized
attcattatgcaattctgtttt

SEQ ID NO: 1297602 - DNA, 22 bp, Artificial Sequence
  chemically synthesized
attatgcaattctgttttgttg

SEQ ID NO: 1297603 - DNA, 22 bp, Artificial Sequence
  chemically synthesized
acattttagagtgcaacaaaac

SEQ ID NO: 1297604 - DNA, 22 bp, Artificial Sequence
  chemically synthesized
tcacattttagagtgcaacaaa

SEQ ID NO: 1297605 - DNA, 22 bp, Artificial Sequence
  chemically synthesized
tgcaattctgttttgttgcact

SEQ ID NO: 1297606 - DNA, 22 bp, Artificial Sequence
  chemically synthesized
ctcacattttagagtgcaacaa

SEQ ID NO: 1297607 - DNA, 22 bp, Artificial Sequence
  chemically synthesized
tctcacattttagagtgcaaca

SEQ ID NO: 1297608 - DNA, 22 bp, Artificial Sequence
  chemically synthesized
cctttctcacattttagagtgc

SEQ ID NO: 1297609 - DNA, 22 bp, Artificial Sequence
  chemically synthesized
tgttttgttgcactctaaaatg

SEQ ID NO: 1297610 - DNA, 22 bp, Artificial Sequence
  chemically synthesized
ttttgttgcactctaaaatgtg

SEQ ID NO: 1297611 - DNA, 22 bp, Artificial Sequence
  chemically synthesized
tgttgcactctaaaatgtgaga

SEQ ID NO: 1297612 - DNA, 22 bp, Artificial Sequence
  chemically synthesized
gttgcactctaaaatgtgagaa

SEQ ID NO: 1297613 - DNA, 22 bp, Artificial Sequence
  chemically synthesized
ttgcactctaaaatgtgagaaa

SEQ ID NO: 1297614 - DNA, 22 bp, Artificial Sequence
  chemically synthesized
catgccactccctttctcacat

SEQ ID NO: 1297615 - DNA, 22 bp, Artificial Sequence
  chemically synthesized
cactctaaaatgtgagaaaggg

SEQ ID NO: 1297616 - DNA, 22 bp, Artificial Sequence
  chemically synthesized
attccatgccactccctttctc

SEQ ID NO: 1297617 - DNA, 22 bp, Artificial Sequence
  chemically synthesized
cattccatgccactccctttct

SEQ ID NO: 1297618 - DNA, 22 bp, Artificial Sequence
  chemically synthesized
taaaatgtgagaaagggagtgg

SEQ ID NO: 1297619 - DNA, 22 bp, Artificial Sequence
  chemically synthesized
aaatgtgagaaagggagtggca

SEQ ID NO: 1297620 - DNA, 22 bp, Artificial Sequence
  chemically synthesized
caatttcattccatgccactcc

SEQ ID NO: 1297621 - DNA, 22 bp, Artificial Sequence
  chemically synthesized
attgcaatttcattccatgcca

SEQ ID NO: 1297622 - DNA, 22 bp, Artificial Sequence
  chemically synthesized
tcattgcaatttcattccatgc

SEQ ID NO: 1297623 - DNA, 22 bp, Artificial Sequence
  chemically synthesized
actctcattgcaatttcattcc

SEQ ID NO: 1297624 - DNA, 22 bp, Artificial Sequence
  chemically synthesized
ctaactctcattgcaatttcat

SEQ ID NO: 1297625 - DNA, 22 bp, Artificial Sequence
  chemically synthesized
gctcctaactctcattgcaatt

SEQ ID NO: 1297626 - DNA, 22 bp, Artificial Sequence
  chemically synthesized
cagcatctcgctcctaactctc

SEQ ID NO: 1297627 - DNA, 22 bp, Artificial Sequence
  chemically synthesized
tccagcatctcgctcctaactc

SEQ ID NO: 1297628 - DNA, 22 bp, Artificial Sequence
  chemically synthesized
caatgagagttaggagcgagat

SEQ ID NO: 1297629 - DNA, 22 bp, Artificial Sequence
  chemically synthesized
aggaggctctccagcatctcgc

SEQ ID NO: 1297630 - DNA, 22 bp, Artificial Sequence
  chemically synthesized
aaggaggctctccagcatctcg

SEQ ID NO: 1297631 - DNA, 22 bp, Artificial Sequence
  chemically synthesized
ggagcgagatgctggagagcct

SEQ ID NO: 1297632 - DNA, 22 bp, Artificial Sequence
  chemically synthesized
atggcagagaagaggtcttaag

SEQ ID NO: 1297633 - DNA, 22 bp, Artificial Sequence
  chemically synthesized
gagagcctccttaagacctctt

SEQ ID NO: 1297634 - DNA, 22 bp, Artificial Sequence
  chemically synthesized
tctgatggcagagaagaggtct

SEQ ID NO: 1297635 - DNA, 22 bp, Artificial Sequence
  chemically synthesized
atctgatggcagagaagaggtc

SEQ ID NO: 1297636 - DNA, 22 bp, Artificial Sequence
  chemically synthesized
tttatctgatggcagagaagag

SEQ ID NO: 1297637 - DNA, 22 bp, Artificial Sequence
  chemically synthesized
cttaagacctcttctctgccat

SEQ ID NO: 1297638 - DNA, 22 bp, Artificial Sequence
  chemically synthesized
cattgtttatctgatggcagag

SEQ ID NO: 1297639 - DNA, 22 bp, Artificial Sequence
  chemically synthesized
acattgtttatctgatggcaga

SEQ ID NO: 1297640 - DNA, 22 bp, Artificial Sequence
  chemically synthesized
aagacctcttctctgccatcag

SEQ ID NO: 1297641 - DNA, 22 bp, Artificial Sequence
  chemically synthesized
agacctcttctctgccatcaga

SEQ ID NO: 1297642 - DNA, 22 bp, Artificial Sequence
  chemically synthesized
acttacattgtttatctgatgg

SEQ ID NO: 1297643 - DNA, 22 bp, Artificial Sequence
  chemically synthesized
cacttacattgtttatctgatg

SEQ ID NO: 1297644 - DNA, 22 bp, Artificial Sequence
  chemically synthesized
tcacttacattgtttatctgat

SEQ ID NO: 1297645 - DNA, 22 bp, Artificial Sequence
  chemically synthesized
ttctctgccatcagataaacaa

SEQ ID NO: 1297646 - DNA, 22 bp, Artificial Sequence
  chemically synthesized
ctctgccatcagataaacaatg

SEQ ID NO: 1297647 - DNA, 22 bp, Artificial Sequence
  chemically synthesized
tctgccatcagataaacaatgt

SEQ ID NO: 1297648 - DNA, 22 bp, Artificial Sequence
  chemically synthesized
aatgctttcacttacattgttt

SEQ ID NO: 1297649 - DNA, 22 bp, Artificial Sequence
  chemically synthesized
tgccatcagataaacaatgtaa

SEQ ID NO: 1297650 - DNA, 22 bp, Artificial Sequence
  chemically synthesized
aaatgctttcacttacattgtt

SEQ ID NO: 1297651 - DNA, 22 bp, Artificial Sequence
  chemically synthesized
taaatgctttcacttacattgt

SEQ ID NO: 1297652 - DNA, 22 bp, Artificial Sequence
  chemically synthesized
ccatcagataaacaatgtaagt

SEQ ID NO: 1297653 - DNA, 22 bp, Artificial Sequence
  chemically synthesized
ttaaatgctttcacttacattg

SEQ ID NO: 1297654 - DNA, 22 bp, Artificial Sequence
  chemically synthesized
ccccagtttttaaatgctttca

SEQ ID NO: 1297655 - DNA, 22 bp, Artificial Sequence
  chemically synthesized
cccccagtttttaaatgctttc

SEQ ID NO: 1297656 - DNA, 22 bp, Artificial Sequence
  chemically synthesized
tcccccagtttttaaatgcttt

SEQ ID NO: 1297657 - DNA, 22 bp, Artificial Sequence
  chemically synthesized
ttcccccagtttttaaatgctt

SEQ ID NO: 1297658 - DNA, 22 bp, Artificial Sequence
  chemically synthesized
tttcccccagtttttaaatgct

SEQ ID NO: 1297659 - DNA, 22 bp, Artificial Sequence
  chemically synthesized
ttttcccccagtttttaaatgc

SEQ ID NO: 1297660 - DNA, 22 bp, Artificial Sequence
  chemically synthesized
tttttcccccagtttttaaatg

SEQ ID NO: 1297661 - DNA, 22 bp, Artificial Sequence
  chemically synthesized
ttttttcccccagtttttaaat

SEQ ID NO: 1297662 - DNA, 22 bp, Artificial Sequence
  chemically synthesized
tttttttcccccagtttttaaa

SEQ ID NO: 1297663 - DNA, 22 bp, Artificial Sequence
  chemically synthesized
ttttttttcccccagtttttaa

SEQ ID NO: 1297664 - DNA, 22 bp, Artificial Sequence
  chemically synthesized
tttttttttttcccccagtttt

SEQ ID NO: 1297665 - DNA, 22 bp, Artificial Sequence
  chemically synthesized
tgtttttttttttcccccagtt

SEQ ID NO: 1297666 - DNA, 22 bp, Artificial Sequence
  chemically synthesized
ctgtttttttttttcccccagt

SEQ ID NO: 1297667 - DNA, 22 bp, Artificial Sequence
  chemically synthesized
tctgtttttttttttcccccag

SEQ ID NO: 1297668 - DNA, 22 bp, Artificial Sequence
  chemically synthesized
ttctgtttttttttttccccca

SEQ ID NO: 1297669 - DNA, 22 bp, Artificial Sequence
  chemically synthesized
tttttctgtttttttttttccc

SEQ ID NO: 1297670 - DNA, 22 bp, Artificial Sequence
  chemically synthesized
aaaaactgggggaaaaaaaaaa

SEQ ID NO: 1297671 - DNA, 22 bp, Artificial Sequence
  chemically synthesized
aaaactgggggaaaaaaaaaaa

SEQ ID NO: 1297672 - DNA, 22 bp, Artificial Sequence
  chemically synthesized
tagaactgtttttctgtttttt

SEQ ID NO: 1297673 - DNA, 22 bp, Artificial Sequence
  chemically synthesized
atagaactgtttttctgttttt

SEQ ID NO: 1297674 - DNA, 22 bp, Artificial Sequence
  chemically synthesized
ggggaaaaaaaaaaacagaaaa

SEQ ID NO: 1297675 - DNA, 22 bp, Artificial Sequence
  chemically synthesized
gtgtttatagaactgtttttct

SEQ ID NO: 1297676 - DNA, 22 bp, Artificial Sequence
  chemically synthesized
ttagtgtttatagaactgtttt

SEQ ID NO: 1297677 - DNA, 22 bp, Artificial Sequence
  chemically synthesized
tgtaatgggaataattgttagt

SEQ ID NO: 1297678 - DNA, 22 bp, Artificial Sequence
  chemically synthesized
gtgtaatgggaataattgttag

SEQ ID NO: 1297679 - DNA, 22 bp, Artificial Sequence
  chemically synthesized
tgtgtaatgggaataattgtta

SEQ ID NO: 1297680 - DNA, 22 bp, Artificial Sequence
  chemically synthesized
tataaacactaacaattattcc

SEQ ID NO: 1297681 - DNA, 22 bp, Artificial Sequence
  chemically synthesized
ctttgtgtaatgggaataattg

SEQ ID NO: 1297682 - DNA, 22 bp, Artificial Sequence
  chemically synthesized
taaacactaacaattattccca

SEQ ID NO: 1297683 - DNA, 22 bp, Artificial Sequence
  chemically synthesized
attgctttgtgtaatgggaata

SEQ ID NO: 1297684 - DNA, 22 bp, Artificial Sequence
  chemically synthesized
tggttaattgctttgtgtaatg

SEQ ID NO: 1297685 - DNA, 22 bp, Artificial Sequence
  chemically synthesized
acaattattcccattacacaaa

SEQ ID NO: 1297686 - DNA, 22 bp, Artificial Sequence
  chemically synthesized
ttcccattacacaaagcaatta

SEQ ID NO: 1297687 - DNA, 22 bp, Artificial Sequence
  chemically synthesized
tacagattatggttaattgctt

SEQ ID NO: 1297688 - DNA, 22 bp, Artificial Sequence
  chemically synthesized
gtacagattatggttaattgct

SEQ ID NO: 1297689 - DNA, 22 bp, Artificial Sequence
  chemically synthesized
ccattacacaaagcaattaacc

SEQ ID NO: 1297690 - DNA, 22 bp, Artificial Sequence
  chemically synthesized
ttgtacagattatggttaattg

SEQ ID NO: 1297691 - DNA, 22 bp, Artificial Sequence
  chemically synthesized
cttgtacagattatggttaatt

SEQ ID NO: 1297692 - DNA, 22 bp, Artificial Sequence
  chemically synthesized
tcttgtacagattatggttaat

SEQ ID NO: 1297693 - DNA, 22 bp, Artificial Sequence
  chemically synthesized
cacaaagcaattaaccataatc

SEQ ID NO: 1297694 - DNA, 22 bp, Artificial Sequence
  chemically synthesized
ttttcttgtacagattatggtt

SEQ ID NO: 1297695 - DNA, 22 bp, Artificial Sequence
  chemically synthesized
attttcttgtacagattatggt

SEQ ID NO: 1297696 - DNA, 22 bp, Artificial Sequence
  chemically synthesized
tattttcttgtacagattatgg

SEQ ID NO: 1297697 - DNA, 22 bp, Artificial Sequence
  chemically synthesized
accataatctgtacaagaaaat

SEQ ID NO: 1297698 - DNA, 22 bp, Artificial Sequence
  chemically synthesized
tgtcaaaaaaattttattttct

SEQ ID NO: 1297699 - DNA, 22 bp, Artificial Sequence
  chemically synthesized
gtgtcaaaaaaattttattttc

SEQ ID NO: 1297700 - DNA, 22 bp, Artificial Sequence
  chemically synthesized
tacaagaaaataaaattttttt

SEQ ID NO: 1297701 - DNA, 22 bp, Artificial Sequence
  chemically synthesized
gggaacagagcgagaccttgtg

SEQ ID NO: 1297702 - DNA, 22 bp, Artificial Sequence
  chemically synthesized
ttttgacacaaggtctcgctct

SEQ ID NO: 1297703 - DNA, 22 bp, Artificial Sequence
  chemically synthesized
tttgacacaaggtctcgctctg

SEQ ID NO: 1297704 - DNA, 22 bp, Artificial Sequence
  chemically synthesized
cagcctggggaacagagcgaga

SEQ ID NO: 1297705 - DNA, 22 bp, Artificial Sequence
  chemically synthesized
ttgacacaaggtctcgctctgt

SEQ ID NO: 1297706 - DNA, 22 bp, Artificial Sequence
  chemically synthesized
tgacacaaggtctcgctctgtt

SEQ ID NO: 1297707 - DNA, 22 bp, Artificial Sequence
  chemically synthesized
gacacaaggtctcgctctgttc

SEQ ID NO: 1297708 - DNA, 22 bp, Artificial Sequence
  chemically synthesized
acacaaggtctcgctctgttcc

SEQ ID NO: 1297709 - DNA, 22 bp, Artificial Sequence
  chemically synthesized
caatgcactccagcctggggaa

SEQ ID NO: 1297710 - DNA, 22 bp, Artificial Sequence
  chemically synthesized
gctctgttccccaggctggagt

SEQ ID NO: 1297711 - DNA, 22 bp, Artificial Sequence
  chemically synthesized
tgatggttccaatgcactccag

SEQ ID NO: 1297712 - DNA, 22 bp, Artificial Sequence
  chemically synthesized
tgttccccaggctggagtgcat

SEQ ID NO: 1297713 - DNA, 22 bp, Artificial Sequence
  chemically synthesized
ttccccaggctggagtgcattg

SEQ ID NO: 1297714 - DNA, 22 bp, Artificial Sequence
  chemically synthesized
cccaggctggagtgcattggaa

SEQ ID NO: 1297715 - DNA, 22 bp, Artificial Sequence
  chemically synthesized
cagtgagctgtgatggttccaa

SEQ ID NO: 1297716 - DNA, 22 bp, Artificial Sequence
  chemically synthesized
gagtgcattggaaccatcacag

SEQ ID NO: 1297717 - DNA, 22 bp, Artificial Sequence
  chemically synthesized
aagttacagtgagctgtgatgg

SEQ ID NO: 1297718 - DNA, 22 bp, Artificial Sequence
  chemically synthesized
gaaccatcacagctcactgtaa

SEQ ID NO: 1297719 - DNA, 22 bp, Artificial Sequence
  chemically synthesized
agcccaggggtctgaagttaca

SEQ ID NO: 1297720 - DNA, 22 bp, Artificial Sequence
  chemically synthesized
gagcccaggggtctgaagttac

SEQ ID NO: 1297721 - DNA, 22 bp, Artificial Sequence
  chemically synthesized
cttgagcccaggggtctgaagt

SEQ ID NO: 1297722 - DNA, 22 bp, Artificial Sequence
  chemically synthesized
actgtaacttcagacccctggg

SEQ ID NO: 1297723 - DNA, 22 bp, Artificial Sequence
  chemically synthesized
taacttcagacccctgggctca

SEQ ID NO: 1297724 - DNA, 22 bp, Artificial Sequence
  chemically synthesized
cagacccctgggctcaagcaat

SEQ ID NO: 1297725 - DNA, 22 bp, Artificial Sequence
  chemically synthesized
agacccctgggctcaagcaatt

SEQ ID NO: 1297726 - DNA, 22 bp, Artificial Sequence
  chemically synthesized
aggaggcagaggtgagagaatt

SEQ ID NO: 1297727 - DNA, 22 bp, Artificial Sequence
  chemically synthesized
ggctcaagcaattctctcacct

SEQ ID NO: 1297728 - DNA, 22 bp, Artificial Sequence
  chemically synthesized
ctgaggaggcagaggtgagaga

SEQ ID NO: 1297729 - DNA, 22 bp, Artificial Sequence
  chemically synthesized
gctactgaggaggcagaggtga

SEQ ID NO: 1297730 - DNA, 22 bp, Artificial Sequence
  chemically synthesized
aagcaattctctcacctctgcc

SEQ ID NO: 1297731 - DNA, 22 bp, Artificial Sequence
  chemically synthesized
gagtcctagctactgaggaggc

SEQ ID NO: 1297732 - DNA, 22 bp, Artificial Sequence
  chemically synthesized
tctcacctctgcctcctcagta

SEQ ID NO: 1297733 - DNA, 22 bp, Artificial Sequence
  chemically synthesized
tcacctctgcctcctcagtagc

SEQ ID NO: 1297734 - DNA, 22 bp, Artificial Sequence
  chemically synthesized
acctctgcctcctcagtagcta

SEQ ID NO: 1297735 - DNA, 22 bp, Artificial Sequence
  chemically synthesized
tgcctcctcagtagctaggact

SEQ ID NO: 1297736 - DNA, 22 bp, Artificial Sequence
  chemically synthesized
cctcctcagtagctaggactct

SEQ ID NO: 1297737 - DNA, 22 bp, Artificial Sequence
  chemically synthesized
ctcagtagctaggactctaggc

SEQ ID NO: 1297738 - DNA, 22 bp, Artificial Sequence
  chemically synthesized
agtagctaggactctaggcaca

SEQ ID NO: 1297739 - DNA, 22 bp, Artificial Sequence
  chemically synthesized
gacagatgtggtgatgtgtgcc

SEQ ID NO: 1297740 - DNA, 22 bp, Artificial Sequence
  chemically synthesized
ggactctaggcacacatcacca

SEQ ID NO: 1297741 - DNA, 22 bp, Artificial Sequence
  chemically synthesized
aaaattagacagatgtggtgat

SEQ ID NO: 1297742 - DNA, 22 bp, Artificial Sequence
  chemically synthesized
taggcacacatcaccacatctg

SEQ ID NO: 1297743 - DNA, 22 bp, Artificial Sequence
  chemically synthesized
ggcacacatcaccacatctgtc

SEQ ID NO: 1297744 - DNA, 22 bp, Artificial Sequence
  chemically synthesized
caaaagaaaaaaaattaaaaat

SEQ ID NO: 1297745 - DNA, 22 bp, Artificial Sequence
  chemically synthesized
acaaaagaaaaaaaattaaaaa

SEQ ID NO: 1297746 - DNA, 22 bp, Artificial Sequence
  chemically synthesized
tacaaaagaaaaaaaattaaaa

SEQ ID NO: 1297747 - DNA, 22 bp, Artificial Sequence
  chemically synthesized
tctaatttttaattttttttct

SEQ ID NO: 1297748 - DNA, 22 bp, Artificial Sequence
  chemically synthesized
atttttaattttttttcttttg

SEQ ID NO: 1297749 - DNA, 22 bp, Artificial Sequence
  chemically synthesized
ttaattttttttcttttgtaaa

SEQ ID NO: 1297750 - DNA, 22 bp, Artificial Sequence
  chemically synthesized
taattttttttcttttgtaaag

SEQ ID NO: 1297751 - DNA, 22 bp, Artificial Sequence
  chemically synthesized
aattttttttcttttgtaaaga

SEQ ID NO: 1297752 - DNA, 22 bp, Artificial Sequence
  chemically synthesized
attttttttcttttgtaaagat

SEQ ID NO: 1297753 - DNA, 22 bp, Artificial Sequence
  chemically synthesized
tttttcttttgtaaagatgggg

SEQ ID NO: 1297754 - DNA, 22 bp, Artificial Sequence
  chemically synthesized
ttttcttttgtaaagatggggt

SEQ ID NO: 1297755 - DNA, 22 bp, Artificial Sequence
  chemically synthesized
tttcttttgtaaagatggggtc

SEQ ID NO: 1297756 - DNA, 22 bp, Artificial Sequence
  chemically synthesized
ttcttttgtaaagatggggtct

SEQ ID NO: 1297757 - DNA, 22 bp, Artificial Sequence
  chemically synthesized
ggcaacatggggagaccccatc

SEQ ID NO: 1297758 - DNA, 22 bp, Artificial Sequence
  chemically synthesized
tcttttgtaaagatggggtctc

SEQ ID NO: 1297759 - DNA, 22 bp, Artificial Sequence
  chemically synthesized
cttttgtaaagatggggtctcc

SEQ ID NO: 1297760 - DNA, 22 bp, Artificial Sequence
  chemically synthesized
ttttgtaaagatggggtctccc

SEQ ID NO: 1297761 - DNA, 22 bp, Artificial Sequence
  chemically synthesized
ttgtaaagatggggtctcccca

SEQ ID NO: 1297762 - DNA, 22 bp, Artificial Sequence
  chemically synthesized
tgtaaagatggggtctccccat

SEQ ID NO: 1297763 - DNA, 22 bp, Artificial Sequence
  chemically synthesized
gtaaagatggggtctccccatg

SEQ ID NO: 1297764 - DNA, 22 bp, Artificial Sequence
  chemically synthesized
taaagatggggtctccccatgt

SEQ ID NO: 1297765 - DNA, 22 bp, Artificial Sequence
  chemically synthesized
agaccagcctgggcaacatggg

SEQ ID NO: 1297766 - DNA, 22 bp, Artificial Sequence
  chemically synthesized
gagaccagcctgggcaacatgg

SEQ ID NO: 1297767 - DNA, 22 bp, Artificial Sequence
  chemically synthesized
cccatgttgcccaggctggtct

SEQ ID NO: 1297768 - DNA, 22 bp, Artificial Sequence
  chemically synthesized
atggagtccaggagtttgagac

SEQ ID NO: 1297769 - DNA, 22 bp, Artificial Sequence
  chemically synthesized
cccaggctggtctcaaactcct

SEQ ID NO: 1297770 - DNA, 22 bp, Artificial Sequence
  chemically synthesized
gtctcaaactcctggactccat

SEQ ID NO: 1297771 - DNA, 22 bp, Artificial Sequence
  chemically synthesized
agacagaaggattgatggagtc

SEQ ID NO: 1297772 - DNA, 22 bp, Artificial Sequence
  chemically synthesized
aaactcctggactccatcaatc

SEQ ID NO: 1297773 - DNA, 22 bp, Artificial Sequence
  chemically synthesized
ggaggctgagacagaaggattg

SEQ ID NO: 1297774 - DNA, 22 bp, Artificial Sequence
  chemically synthesized
ctggactccatcaatccttctg

SEQ ID NO: 1297775 - DNA, 22 bp, Artificial Sequence
  chemically synthesized
gggaggctgagacagaaggatt

SEQ ID NO: 1297776 - DNA, 22 bp, Artificial Sequence
  chemically synthesized
tgggaggctgagacagaaggat

SEQ ID NO: 1297777 - DNA, 22 bp, Artificial Sequence
  chemically synthesized
gactccatcaatccttctgtct

SEQ ID NO: 1297778 - DNA, 22 bp, Artificial Sequence
  chemically synthesized
gcactttgggaggctgagacag

SEQ ID NO: 1297779 - DNA, 22 bp, Artificial Sequence
  chemically synthesized
catcaatccttctgtctcagcc

SEQ ID NO: 1297780 - DNA, 22 bp, Artificial Sequence
  chemically synthesized
tagtcctagcactttgggaggc

SEQ ID NO: 1297781 - DNA, 22 bp, Artificial Sequence
  chemically synthesized
ctgtctcagcctcccaaagtgc

SEQ ID NO: 1297782 - DNA, 22 bp, Artificial Sequence
  chemically synthesized
tgtctcagcctcccaaagtgct

SEQ ID NO: 1297783 - DNA, 22 bp, Artificial Sequence
  chemically synthesized
tctcagcctcccaaagtgctag

SEQ ID NO: 1297784 - DNA, 22 bp, Artificial Sequence
  chemically synthesized
atgcctgtagtcctagcacttt

SEQ ID NO: 1297785 - DNA, 22 bp, Artificial Sequence
  chemically synthesized
agcctcccaaagtgctaggact

SEQ ID NO: 1297786 - DNA, 22 bp, Artificial Sequence
  chemically synthesized
ccaaagtgctaggactacaggc

SEQ ID NO: 1297787 - DNA, 22 bp, Artificial Sequence
  chemically synthesized
ggccgaatgtggtggctcatgc

SEQ ID NO: 1297788 - DNA, 22 bp, Artificial Sequence
  chemically synthesized
taggccgaatgtggtggctcat

SEQ ID NO: 1297789 - DNA, 22 bp, Artificial Sequence
  chemically synthesized
ggactacaggcatgagccacca

SEQ ID NO: 1297790 - DNA, 22 bp, Artificial Sequence
  chemically synthesized
ctaggccgaatgtggtggctca

SEQ ID NO: 1297791 - DNA, 22 bp, Artificial Sequence
  chemically synthesized
tctaggccgaatgtggtggctc

SEQ ID NO: 1297792 - DNA, 22 bp, Artificial Sequence
  chemically synthesized
ttctaggccgaatgtggtggct

SEQ ID NO: 1297793 - DNA, 22 bp, Artificial Sequence
  chemically synthesized
caggcatgagccaccacattcg

SEQ ID NO: 1297794 - DNA, 22 bp, Artificial Sequence
  chemically synthesized
aaaaatgtttttctaggccgaa

SEQ ID NO: 1297795 - DNA, 22 bp, Artificial Sequence
  chemically synthesized
aaaaaatgtttttctaggccga

SEQ ID NO: 1297796 - DNA, 22 bp, Artificial Sequence
  chemically synthesized
ggcctagaaaaacattttttaa

SEQ ID NO: 1297797 - DNA, 22 bp, Artificial Sequence
  chemically synthesized
gaaaaacattttttaaatgata

SEQ ID NO: 1297798 - DNA, 22 bp, Artificial Sequence
  chemically synthesized
gcccccaaggaaatatcattta

SEQ ID NO: 1297799 - DNA, 22 bp, Artificial Sequence
  chemically synthesized
actagcccccaaggaaatatca

SEQ ID NO: 1297800 - DNA, 22 bp, Artificial Sequence
  chemically synthesized
tttaaatgatatttccttgggg

SEQ ID NO: 1297801 - DNA, 22 bp, Artificial Sequence
  chemically synthesized
ttaaatgatatttccttggggg

SEQ ID NO: 1297802 - DNA, 22 bp, Artificial Sequence
  chemically synthesized
taaatgatatttccttgggggc

SEQ ID NO: 1297803 - DNA, 22 bp, Artificial Sequence
  chemically synthesized
acatattaactagcccccaagg

SEQ ID NO: 1297804 - DNA, 22 bp, Artificial Sequence
  chemically synthesized
aaatgatatttccttgggggct

SEQ ID NO: 1297805 - DNA, 22 bp, Artificial Sequence
  chemically synthesized
aatgatatttccttgggggcta

SEQ ID NO: 1297806 - DNA, 22 bp, Artificial Sequence
  chemically synthesized
aattaacatattaactagcccc

SEQ ID NO: 1297807 - DNA, 22 bp, Artificial Sequence
  chemically synthesized
caattaacatattaactagccc

SEQ ID NO: 1297808 - DNA, 22 bp, Artificial Sequence
  chemically synthesized
ccttgggggctagttaatatgt

SEQ ID NO: 1297809 - DNA, 22 bp, Artificial Sequence
  chemically synthesized
cttgggggctagttaatatgtt

SEQ ID NO: 1297810 - DNA, 22 bp, Artificial Sequence
  chemically synthesized
gggggctagttaatatgttaat

SEQ ID NO: 1297811 - DNA, 22 bp, Artificial Sequence
  chemically synthesized
ggggctagttaatatgttaatt

SEQ ID NO: 1297812 - DNA, 22 bp, Artificial Sequence
  chemically synthesized
gggatgaagatcttcaattaac

SEQ ID NO: 1297813 - DNA, 22 bp, Artificial Sequence
  chemically synthesized
gttaatatgttaattgaagatc

SEQ ID NO: 1297814 - DNA, 22 bp, Artificial Sequence
  chemically synthesized
atatgttaattgaagatcttca

SEQ ID NO: 1297815 - DNA, 22 bp, Artificial Sequence
  chemically synthesized
tgtcacattagggatgaagatc

SEQ ID NO: 1297816 - DNA, 22 bp, Artificial Sequence
  chemically synthesized
tgtgtcacattagggatgaaga

SEQ ID NO: 1297817 - DNA, 22 bp, Artificial Sequence
  chemically synthesized
ctgtgtcacattagggatgaag

SEQ ID NO: 1297818 - DNA, 22 bp, Artificial Sequence
  chemically synthesized
tctgtgtcacattagggatgaa

SEQ ID NO: 1297819 - DNA, 22 bp, Artificial Sequence
  chemically synthesized
attgaagatcttcatccctaat

SEQ ID NO: 1297820 - DNA, 22 bp, Artificial Sequence
  chemically synthesized
aagatcttcatccctaatgtga

SEQ ID NO: 1297821 - DNA, 22 bp, Artificial Sequence
  chemically synthesized
aagatacattttctgtgtcaca

SEQ ID NO: 1297822 - DNA, 22 bp, Artificial Sequence
  chemically synthesized
aaagatacattttctgtgtcac

SEQ ID NO: 1297823 - DNA, 22 bp, Artificial Sequence
  chemically synthesized
taaagatacattttctgtgtca

SEQ ID NO: 1297824 - DNA, 22 bp, Artificial Sequence
  chemically synthesized
catccctaatgtgacacagaaa

SEQ ID NO: 1297825 - DNA, 22 bp, Artificial Sequence
  chemically synthesized
ttaaagatacattttctgtgtc

SEQ ID NO: 1297826 - DNA, 22 bp, Artificial Sequence
  chemically synthesized
atccctaatgtgacacagaaaa

SEQ ID NO: 1297827 - DNA, 22 bp, Artificial Sequence
  chemically synthesized
cccttttaaagatacattttct

SEQ ID NO: 1297828 - DNA, 22 bp, Artificial Sequence
  chemically synthesized
ccccttttaaagatacattttc

SEQ ID NO: 1297829 - DNA, 22 bp, Artificial Sequence
  chemically synthesized
atgtgacacagaaaatgtatct

SEQ ID NO: 1297830 - DNA, 22 bp, Artificial Sequence
  chemically synthesized
ccttccccttttaaagatacat

SEQ ID NO: 1297831 - DNA, 22 bp, Artificial Sequence
  chemically synthesized
atattcccttccccttttaaag

SEQ ID NO: 1297832 - DNA, 22 bp, Artificial Sequence
  chemically synthesized
aatattcccttccccttttaaa

SEQ ID NO: 1297833 - DNA, 22 bp, Artificial Sequence
  chemically synthesized
taatattcccttccccttttaa

SEQ ID NO: 1297834 - DNA, 22 bp, Artificial Sequence
  chemically synthesized
gtatcaactttaatattccctt

SEQ ID NO: 1297835 - DNA, 22 bp, Artificial Sequence
  chemically synthesized
taaaaggggaagggaatattaa

SEQ ID NO: 1297836 - DNA, 22 bp, Artificial Sequence
  chemically synthesized
aaaaggggaagggaatattaaa

SEQ ID NO: 1297837 - DNA, 22 bp, Artificial Sequence
  chemically synthesized
aaaggggaagggaatattaaag

SEQ ID NO: 1297838 - DNA, 22 bp, Artificial Sequence
  chemically synthesized
aactggtatcaactttaatatt

SEQ ID NO: 1297839 - DNA, 22 bp, Artificial Sequence
  chemically synthesized
taaactggtatcaactttaata

SEQ ID NO: 1297840 - DNA, 22 bp, Artificial Sequence
  chemically synthesized
ctaaactggtatcaactttaat

SEQ ID NO: 1297841 - DNA, 22 bp, Artificial Sequence
  chemically synthesized
cgtgagtttctaaactggtatc

SEQ ID NO: 1297842 - DNA, 22 bp, Artificial Sequence
  chemically synthesized
actacgtgagtttctaaactgg

SEQ ID NO: 1297843 - DNA, 22 bp, Artificial Sequence
  chemically synthesized
cactacgtgagtttctaaactg

SEQ ID NO: 1297844 - DNA, 22 bp, Artificial Sequence
  chemically synthesized
aagttgataccagtttagaaac

SEQ ID NO: 1297845 - DNA, 22 bp, Artificial Sequence
  chemically synthesized
ttcactacgtgagtttctaaac

SEQ ID NO: 1297846 - DNA, 22 bp, Artificial Sequence
  chemically synthesized
cttcactacgtgagtttctaaa

SEQ ID NO: 1297847 - DNA, 22 bp, Artificial Sequence
  chemically synthesized
ataccagtttagaaactcacgt

SEQ ID NO: 1297848 - DNA, 22 bp, Artificial Sequence
  chemically synthesized
catttcttcactacgtgagttt

SEQ ID NO: 1297849 - DNA, 22 bp, Artificial Sequence
  chemically synthesized
atcccattgcatttcttcacta

SEQ ID NO: 1297850 - DNA, 22 bp, Artificial Sequence
  chemically synthesized
agaaactcacgtagtgaagaaa

SEQ ID NO: 1297851 - DNA, 22 bp, Artificial Sequence
  chemically synthesized
gaaactcacgtagtgaagaaat

SEQ ID NO: 1297852 - DNA, 22 bp, Artificial Sequence
  chemically synthesized
actcatcccattgcatttcttc

SEQ ID NO: 1297853 - DNA, 22 bp, Artificial Sequence
  chemically synthesized
acgtagtgaagaaatgcaatgg

SEQ ID NO: 1297854 - DNA, 22 bp, Artificial Sequence
  chemically synthesized
agtgaaattaactcatcccatt

SEQ ID NO: 1297855 - DNA, 22 bp, Artificial Sequence
  chemically synthesized
aagtgaaattaactcatcccat

SEQ ID NO: 1297856 - DNA, 22 bp, Artificial Sequence
  chemically synthesized
taagtgaaattaactcatccca

SEQ ID NO: 1297857 - DNA, 22 bp, Artificial Sequence
  chemically synthesized
tttaagtgaaattaactcatcc

SEQ ID NO: 1297858 - DNA, 22 bp, Artificial Sequence
  chemically synthesized
ctttaagtgaaattaactcatc

SEQ ID NO: 1297859 - DNA, 22 bp, Artificial Sequence
  chemically synthesized
tctttaagtgaaattaactcat

SEQ ID NO: 1297860 - DNA, 22 bp, Artificial Sequence
  chemically synthesized
tttctttaagtgaaattaactc

SEQ ID NO: 1297861 - DNA, 22 bp, Artificial Sequence
  chemically synthesized
atagttctttctttaagtgaaa

SEQ ID NO: 1297862 - DNA, 22 bp, Artificial Sequence
  chemically synthesized
catagttctttctttaagtgaa

SEQ ID NO: 1297863 - DNA, 22 bp, Artificial Sequence
  chemically synthesized
atttcacttaaagaaagaacta

SEQ ID NO: 1297864 - DNA, 22 bp, Artificial Sequence
  chemically synthesized
cgcccggcttcatagttctttc

SEQ ID NO: 1297865 - DNA, 22 bp, Artificial Sequence
  chemically synthesized
cacttaaagaaagaactatgaa

SEQ ID NO: 1297866 - DNA, 22 bp, Artificial Sequence
  chemically synthesized
acttaaagaaagaactatgaag

SEQ ID NO: 1297867 - DNA, 22 bp, Artificial Sequence
  chemically synthesized
aaagaaagaactatgaagccgg

SEQ ID NO: 1297868 - DNA, 22 bp, Artificial Sequence
  chemically synthesized
aagaaagaactatgaagccggg

SEQ ID NO: 1297869 - DNA, 22 bp, Artificial Sequence
  chemically synthesized
caggcgtgagccactgcgcccg

SEQ ID NO: 1297870 - DNA, 22 bp, Artificial Sequence
  chemically synthesized
tgaagccgggcgcagtggctca

SEQ ID NO: 1297871 - DNA, 22 bp, Artificial Sequence
  chemically synthesized
ggattacaggcgtgagccactg

SEQ ID NO: 1297872 - DNA, 22 bp, Artificial Sequence
  chemically synthesized
ccaaagtgctgggattacaggc

SEQ ID NO: 1297873 - DNA, 22 bp, Artificial Sequence
  chemically synthesized
ggcctcccaaagtgctgggatt

SEQ ID NO: 1297874 - DNA, 22 bp, Artificial Sequence
  chemically synthesized
acgcctgtaatcccagcacttt

SEQ ID NO: 1297875 - DNA, 22 bp, Artificial Sequence
  chemically synthesized
taatcccagcactttgggaggc

SEQ ID NO: 1297876 - DNA, 22 bp, Artificial Sequence
  chemically synthesized
atgatccgcccacctcggcctc

SEQ ID NO: 1297877 - DNA, 22 bp, Artificial Sequence
  chemically synthesized
acctcatgatccgcccacctcg

SEQ ID NO: 1297878 - DNA, 22 bp, Artificial Sequence
  chemically synthesized
ctgacctcatgatccgcccacc

SEQ ID NO: 1297879 - DNA, 22 bp, Artificial Sequence
  chemically synthesized
tgggaggccgaggtgggcggat

SEQ ID NO: 1297880 - DNA, 22 bp, Artificial Sequence
  chemically synthesized
gggaggccgaggtgggcggatc

SEQ ID NO: 1297881 - DNA, 22 bp, Artificial Sequence
  chemically synthesized
ggaggccgaggtgggcggatca

SEQ ID NO: 1297882 - DNA, 22 bp, Artificial Sequence
  chemically synthesized
atctcctgacctcatgatccgc

SEQ ID NO: 1297883 - DNA, 22 bp, Artificial Sequence
  chemically synthesized
gatctcctgacctcatgatccg

SEQ ID NO: 1297884 - DNA, 22 bp, Artificial Sequence
  chemically synthesized
gccaggatggtcttgatctcct

SEQ ID NO: 1297885 - DNA, 22 bp, Artificial Sequence
  chemically synthesized
accgtgttagccaggatggtct

SEQ ID NO: 1297886 - DNA, 22 bp, Artificial Sequence
  chemically synthesized
caccgtgttagccaggatggtc

SEQ ID NO: 1297887 - DNA, 22 bp, Artificial Sequence
  chemically synthesized
gtagagacggggtttcaccgtg

SEQ ID NO: 1297888 - DNA, 22 bp, Artificial Sequence
  chemically synthesized
agtagagacggggtttcaccgt

SEQ ID NO: 1297889 - DNA, 22 bp, Artificial Sequence
  chemically synthesized
tagtagagacggggtttcaccg

SEQ ID NO: 1297890 - DNA, 22 bp, Artificial Sequence
  chemically synthesized
ttagtagagacggggtttcacc

SEQ ID NO: 1297891 - DNA, 22 bp, Artificial Sequence
  chemically synthesized
gctaacacggtgaaaccccgtc

SEQ ID NO: 1297892 - DNA, 22 bp, Artificial Sequence
  chemically synthesized
tatttttagtagagacggggtt

SEQ ID NO: 1297893 - DNA, 22 bp, Artificial Sequence
  chemically synthesized
gtatttttagtagagacggggt

SEQ ID NO: 1297894 - DNA, 22 bp, Artificial Sequence
  chemically synthesized
tgtatttttagtagagacgggg

SEQ ID NO: 1297895 - DNA, 22 bp, Artificial Sequence
  chemically synthesized
acacggtgaaaccccgtctcta

SEQ ID NO: 1297896 - DNA, 22 bp, Artificial Sequence
  chemically synthesized
ttgtatttttagtagagacggg

SEQ ID NO: 1297897 - DNA, 22 bp, Artificial Sequence
  chemically synthesized
tttgtatttttagtagagacgg

SEQ ID NO: 1297898 - DNA, 22 bp, Artificial Sequence
  chemically synthesized
attttttgtatttttagtagag

SEQ ID NO: 1297899 - DNA, 22 bp, Artificial Sequence
  chemically synthesized
tactaaaaatacaaaaaattag

SEQ ID NO: 1297900 - DNA, 22 bp, Artificial Sequence
  chemically synthesized
ctaaaaatacaaaaaattagcc

SEQ ID NO: 1297901 - DNA, 22 bp, Artificial Sequence
  chemically synthesized
aaaatacaaaaaattagccggg

SEQ ID NO: 1297902 - DNA, 22 bp, Artificial Sequence
  chemically synthesized
caggcgcccgccaccacgcccg

SEQ ID NO: 1297903 - DNA, 22 bp, Artificial Sequence
  chemically synthesized
ggactacaggcgcccgccacca

SEQ ID NO: 1297904 - DNA, 22 bp, Artificial Sequence
  chemically synthesized
gccgggcgtggtggcgggcgcc

SEQ ID NO: 1297905 - DNA, 22 bp, Artificial Sequence
  chemically synthesized
acgccccagtagctgggactac

SEQ ID NO: 1297906 - DNA, 22 bp, Artificial Sequence
  chemically synthesized
ccaggttcacgccccagtagct

SEQ ID NO: 1297907 - DNA, 22 bp, Artificial Sequence
  chemically synthesized
tagtcccagctactggggcgtg

SEQ ID NO: 1297908 - DNA, 22 bp, Artificial Sequence
  chemically synthesized
cgcctcccaggttcacgcccca

SEQ ID NO: 1297909 - DNA, 22 bp, Artificial Sequence
  chemically synthesized
caagttgcgcctcccaggttca

SEQ ID NO: 1297910 - DNA, 22 bp, Artificial Sequence
  chemically synthesized
ctggggcgtgaacctgggaggc

SEQ ID NO: 1297911 - DNA, 22 bp, Artificial Sequence
  chemically synthesized
actgcaagttgcgcctcccagg

SEQ ID NO: 1297912 - DNA, 22 bp, Artificial Sequence
  chemically synthesized
gggcgtgaacctgggaggcgca

SEQ ID NO: 1297913 - DNA, 22 bp, Artificial Sequence
  chemically synthesized
gctcactgcaagttgcgcctcc

SEQ ID NO: 1297914 - DNA, 22 bp, Artificial Sequence
  chemically synthesized
ggctcactgcaagttgcgcctc

SEQ ID NO: 1297915 - DNA, 22 bp, Artificial Sequence
  chemically synthesized
ggaggcgcaacttgcagtgagc

SEQ ID NO: 1297916 - DNA, 22 bp, Artificial Sequence
  chemically synthesized
gcagtgagccaagatcgtgcca

SEQ ID NO: 1297917 - DNA, 22 bp, Artificial Sequence
  chemically synthesized
cagtgagccaagatcgtgccac

SEQ ID NO: 1297918 - DNA, 22 bp, Artificial Sequence
  chemically synthesized
tcccccaggccggagcgcagtg

SEQ ID NO: 1297919 - DNA, 22 bp, Artificial Sequence
  chemically synthesized
tgtcccccaggccggagcgcag

SEQ ID NO: 1297920 - DNA, 22 bp, Artificial Sequence
  chemically synthesized
ctctgtcccccaggccggagcg

SEQ ID NO: 1297921 - DNA, 22 bp, Artificial Sequence
  chemically synthesized
cgctccggcctgggggacagag

SEQ ID NO: 1297922 - DNA, 22 bp, Artificial Sequence
  chemically synthesized
agacggagtctcctctgtcccc

SEQ ID NO: 1297923 - DNA, 22 bp, Artificial Sequence
  chemically synthesized
gagacggagtctcctctgtccc

SEQ ID NO: 1297924 - DNA, 22 bp, Artificial Sequence
  chemically synthesized
tgagacggagtctcctctgtcc

SEQ ID NO: 1297925 - DNA, 22 bp, Artificial Sequence
  chemically synthesized
ttgagacggagtctcctctgtc

SEQ ID NO: 1297926 - DNA, 22 bp, Artificial Sequence
  chemically synthesized
tttgagacggagtctcctctgt

SEQ ID NO: 1297927 - DNA, 22 bp, Artificial Sequence
  chemically synthesized
cggcctgggggacagaggagac

SEQ ID NO: 1297928 - DNA, 22 bp, Artificial Sequence
  chemically synthesized
ttttgagacggagtctcctctg

SEQ ID NO: 1297929 - DNA, 22 bp, Artificial Sequence
  chemically synthesized
tttttgagacggagtctcctct

SEQ ID NO: 1297930 - DNA, 22 bp, Artificial Sequence
  chemically synthesized
ttttttgagacggagtctcctc

SEQ ID NO: 1297931 - DNA, 22 bp, Artificial Sequence
  chemically synthesized
tttttttgagacggagtctcct

SEQ ID NO: 1297932 - DNA, 22 bp, Artificial Sequence
  chemically synthesized
ttttttttgagacggagtctcc

SEQ ID NO: 1297933 - DNA, 22 bp, Artificial Sequence
  chemically synthesized
tttttttttgagacggagtctc

SEQ ID NO: 1297934 - DNA, 22 bp, Artificial Sequence
  chemically synthesized
ttttttttttgagacggagtct

SEQ ID NO: 1297935 - DNA, 22 bp, Artificial Sequence
  chemically synthesized
ggggacagaggagactccgtct

SEQ ID NO: 1297936 - DNA, 22 bp, Artificial Sequence
  chemically synthesized
tttttttttttgagacggagtc

SEQ ID NO: 1297937 - DNA, 22 bp, Artificial Sequence
  chemically synthesized
ttttttttttttgagacggagt

SEQ ID NO: 1297938 - DNA, 22 bp, Artificial Sequence
  chemically synthesized
tttttttttttttgagacggag

SEQ ID NO: 1297939 - DNA, 22 bp, Artificial Sequence
  chemically synthesized
ttttttttttttttgagacgga

SEQ ID NO: 1297940 - DNA, 22 bp, Artificial Sequence
  chemically synthesized
tttttttttttttttgagacgg

SEQ ID NO: 1297941 - DNA, 22 bp, Artificial Sequence
  chemically synthesized
ttttttttttttttttgagacg

SEQ ID NO: 1297942 - DNA, 22 bp, Artificial Sequence
  chemically synthesized
tttttttttttttttttgagac

SEQ ID NO: 1297943 - DNA, 22 bp, Artificial Sequence
  chemically synthesized
ttttttttttttttttttgaga

SEQ ID NO: 1297944 - DNA, 22 bp, Artificial Sequence
  chemically synthesized
tttttttttttttttttttgag

SEQ ID NO: 1297945 - DNA, 22 bp, Artificial Sequence
  chemically synthesized
ttttttttttttttttttttga

SEQ ID NO: 1297946 - DNA, 22 bp, Artificial Sequence
  chemically synthesized
tttttttttttttttttttttg

SEQ ID NO: 1297947 - DNA, 22 bp, Artificial Sequence
  chemically synthesized
tttttttttttttttttttttt

SEQ ID NO: 1297948 - DNA, 22 bp, Artificial Sequence
  chemically synthesized
tttttttttttttttttttttt

SEQ ID NO: 1297949 - DNA, 22 bp, Artificial Sequence
  chemically synthesized
tttttttttttttttttttttt

SEQ ID NO: 1297950 - DNA, 22 bp, Artificial Sequence
  chemically synthesized
tttttttttttttttttttttt

SEQ ID NO: 1297951 - DNA, 22 bp, Artificial Sequence
  chemically synthesized
tttttttttttttttttttttt

SEQ ID NO: 1297952 - DNA, 22 bp, Artificial Sequence
  chemically synthesized
tttttttttttttttttttttt

SEQ ID NO: 1297953 - DNA, 22 bp, Artificial Sequence
  chemically synthesized
cgtctcaaaaaaaaaaaaaaaa

SEQ ID NO: 1297954 - DNA, 22 bp, Artificial Sequence
  chemically synthesized
tttttttttttttttttttttt

SEQ ID NO: 1297955 - DNA, 22 bp, Artificial Sequence
  chemically synthesized
tttttttttttttttttttttt

SEQ ID NO: 1297956 - DNA, 22 bp, Artificial Sequence
  chemically synthesized
tttttttttttttttttttttt

SEQ ID NO: 1297957 - DNA, 22 bp, Artificial Sequence
  chemically synthesized
tttttttttttttttttttttt

SEQ ID NO: 1297958 - DNA, 22 bp, Artificial Sequence
  chemically synthesized
tttttttttttttttttttttt

SEQ ID NO: 1297959 - DNA, 22 bp, Artificial Sequence
  chemically synthesized
aaaaaaaaaaaaaaaaaaaaaa

SEQ ID NO: 1297960 - DNA, 22 bp, Artificial Sequence
  chemically synthesized
tttttttttttttttttttttt

SEQ ID NO: 1297961 - DNA, 22 bp, Artificial Sequence
  chemically synthesized
cttttttttttttttttttttt

SEQ ID NO: 1297962 - DNA, 22 bp, Artificial Sequence
  chemically synthesized
tctttttttttttttttttttt

SEQ ID NO: 1297963 - DNA, 22 bp, Artificial Sequence
  chemically synthesized
tttctttttttttttttttttt

SEQ ID NO: 1297964 - DNA, 22 bp, Artificial Sequence
  chemically synthesized
ctttcttttttttttttttttt

SEQ ID NO: 1297965 - DNA, 22 bp, Artificial Sequence
  chemically synthesized
tctttctttttttttttttttt

SEQ ID NO: 1297966 - DNA, 22 bp, Artificial Sequence
  chemically synthesized
ttctttcttttttttttttttt

SEQ ID NO: 1297967 - DNA, 22 bp, Artificial Sequence
  chemically synthesized
ttttctttcttttttttttttt

SEQ ID NO: 1297968 - DNA, 22 bp, Artificial Sequence
  chemically synthesized
cttttctttctttttttttttt

SEQ ID NO: 1297969 - DNA, 22 bp, Artificial Sequence
  chemically synthesized
tcttttctttcttttttttttt

SEQ ID NO: 1297970 - DNA, 22 bp, Artificial Sequence
  chemically synthesized
ttttcttttctttctttttttt

SEQ ID NO: 1297971 - DNA, 22 bp, Artificial Sequence
  chemically synthesized
attttcttttctttcttttttt

SEQ ID NO: 1297972 - DNA, 22 bp, Artificial Sequence
  chemically synthesized
tattttcttttctttctttttt

SEQ ID NO: 1297973 - DNA, 22 bp, Artificial Sequence
  chemically synthesized
tttattttcttttctttctttt

SEQ ID NO: 1297974 - DNA, 22 bp, Artificial Sequence
  chemically synthesized
atagttctttattttcttttct

SEQ ID NO: 1297975 - DNA, 22 bp, Artificial Sequence
  chemically synthesized
catagttctttattttcttttc

SEQ ID NO: 1297976 - DNA, 22 bp, Artificial Sequence
  chemically synthesized
cttcatagttctttattttctt

SEQ ID NO: 1297977 - DNA, 22 bp, Artificial Sequence
  chemically synthesized
ccatattacttcatagttcttt

SEQ ID NO: 1297978 - DNA, 22 bp, Artificial Sequence
  chemically synthesized
tcccatattacttcatagttct

SEQ ID NO: 1297979 - DNA, 22 bp, Artificial Sequence
  chemically synthesized
ctctcccatattacttcatagt

SEQ ID NO: 1297980 - DNA, 22 bp, Artificial Sequence
  chemically synthesized
attgctctcccatattacttca

SEQ ID NO: 1297981 - DNA, 22 bp, Artificial Sequence
  chemically synthesized
aattgctctcccatattacttc

SEQ ID NO: 1297982 - DNA, 22 bp, Artificial Sequence
  chemically synthesized
aacttaattgctctcccatatt

SEQ ID NO: 1297983 - DNA, 22 bp, Artificial Sequence
  chemically synthesized
tgaagtaatatgggagagcaat

SEQ ID NO: 1297984 - DNA, 22 bp, Artificial Sequence
  chemically synthesized
atggaagcagagaatagactga

SEQ ID NO: 1297985 - DNA, 22 bp, Artificial Sequence
  chemically synthesized
gatggaagcagagaatagactg

SEQ ID NO: 1297986 - DNA, 22 bp, Artificial Sequence
  chemically synthesized
atgtttgatggaagcagagaat

SEQ ID NO: 1297987 - DNA, 22 bp, Artificial Sequence
  chemically synthesized
agttcagtctattctctgcttc

SEQ ID NO: 1297988 - DNA, 22 bp, Artificial Sequence
  chemically synthesized
tcatgtttgatggaagcagaga

SEQ ID NO: 1297989 - DNA, 22 bp, Artificial Sequence
  chemically synthesized
ctcatgtttgatggaagcagag

SEQ ID NO: 1297990 - DNA, 22 bp, Artificial Sequence
  chemically synthesized
tctcatgtttgatggaagcaga

SEQ ID NO: 1297991 - DNA, 22 bp, Artificial Sequence
  chemically synthesized
ttctcatgtttgatggaagcag

SEQ ID NO: 1297992 - DNA, 22 bp, Artificial Sequence
  chemically synthesized
tttctcatgtttgatggaagca

SEQ ID NO: 1297993 - DNA, 22 bp, Artificial Sequence
  chemically synthesized
agtctattctctgcttccatca

SEQ ID NO: 1297994 - DNA, 22 bp, Artificial Sequence
  chemically synthesized
ttttctcatgtttgatggaagc

SEQ ID NO: 1297995 - DNA, 22 bp, Artificial Sequence
  chemically synthesized
atttttttctcatgtttgatgg

SEQ ID NO: 1297996 - DNA, 22 bp, Artificial Sequence
  chemically synthesized
catttttttctcatgtttgatg

SEQ ID NO: 1297997 - DNA, 22 bp, Artificial Sequence
  chemically synthesized
ttctctgcttccatcaaacatg

SEQ ID NO: 1297998 - DNA, 22 bp, Artificial Sequence
  chemically synthesized
tcatttttttctcatgtttgat

SEQ ID NO: 1297999 - DNA, 22 bp, Artificial Sequence
  chemically synthesized
ttcatttttttctcatgtttga

SEQ ID NO: 1298000 - DNA, 22 bp, Artificial Sequence
  chemically synthesized
tctgcttccatcaaacatgaga

SEQ ID NO: 1298001 - DNA, 22 bp, Artificial Sequence
  chemically synthesized
tgcttccatcaaacatgagaaa

SEQ ID NO: 1298002 - DNA, 22 bp, Artificial Sequence
  chemically synthesized
cttccatcaaacatgagaaaaa

SEQ ID NO: 1298003 - DNA, 22 bp, Artificial Sequence
  chemically synthesized
catatttttcatttttttctca

SEQ ID NO: 1298004 - DNA, 22 bp, Artificial Sequence
  chemically synthesized
ccatatttttcatttttttctc

SEQ ID NO: 1298005 - DNA, 22 bp, Artificial Sequence
  chemically synthesized
ccatcaaacatgagaaaaaaat

SEQ ID NO: 1298006 - DNA, 22 bp, Artificial Sequence
  chemically synthesized
catcaaacatgagaaaaaaatg

SEQ ID NO: 1298007 - DNA, 22 bp, Artificial Sequence
  chemically synthesized
atcttccatatttttcattttt

SEQ ID NO: 1298008 - DNA, 22 bp, Artificial Sequence
  chemically synthesized
tcattaatcttccatatttttc

SEQ ID NO: 1298009 - DNA, 22 bp, Artificial Sequence
  chemically synthesized
atcattaatcttccatattttt

SEQ ID NO: 1298010 - DNA, 22 bp, Artificial Sequence
  chemically synthesized
atgtttatcattaatcttccat

SEQ ID NO: 1298011 - DNA, 22 bp, Artificial Sequence
  chemically synthesized
tctaatgtttatcattaatctt

SEQ ID NO: 1298012 - DNA, 22 bp, Artificial Sequence
  chemically synthesized
atctaatgtttatcattaatct

SEQ ID NO: 1298013 - DNA, 22 bp, Artificial Sequence
  chemically synthesized
atgataaacattagataaggtt

SEQ ID NO: 1298014 - DNA, 22 bp, Artificial Sequence
  chemically synthesized
caaaatatcacataaccttatc

SEQ ID NO: 1298015 - DNA, 22 bp, Artificial Sequence
  chemically synthesized
taatgctccaaaatatcacata

SEQ ID NO: 1298016 - DNA, 22 bp, Artificial Sequence
  chemically synthesized
ataatgctccaaaatatcacat

SEQ ID NO: 1298017 - DNA, 22 bp, Artificial Sequence
  chemically synthesized
tataatgctccaaaatatcaca

SEQ ID NO: 1298018 - DNA, 22 bp, Artificial Sequence
  chemically synthesized
gataaggttatgtgatattttg

SEQ ID NO: 1298019 - DNA, 22 bp, Artificial Sequence
  chemically synthesized
ctttataatgctccaaaatatc

SEQ ID NO: 1298020 - DNA, 22 bp, Artificial Sequence
  chemically synthesized
cctttataatgctccaaaatat

SEQ ID NO: 1298021 - DNA, 22 bp, Artificial Sequence
  chemically synthesized
cttcctttataatgctccaaaa

SEQ ID NO: 1298022 - DNA, 22 bp, Artificial Sequence
  chemically synthesized
ccttcctttataatgctccaaa

SEQ ID NO: 1298023 - DNA, 22 bp, Artificial Sequence
  chemically synthesized
tttccttcctttataatgctcc

SEQ ID NO: 1298024 - DNA, 22 bp, Artificial Sequence
  chemically synthesized
tgtgatattttggagcattata

SEQ ID NO: 1298025 - DNA, 22 bp, Artificial Sequence
  chemically synthesized
gtttccttcctttataatgctc

SEQ ID NO: 1298026 - DNA, 22 bp, Artificial Sequence
  chemically synthesized
aatttgtttccttcctttataa

SEQ ID NO: 1298027 - DNA, 22 bp, Artificial Sequence
  chemically synthesized
tggagcattataaaggaaggaa

SEQ ID NO: 1298028 - DNA, 22 bp, Artificial Sequence
  chemically synthesized
ggagcattataaaggaaggaaa

SEQ ID NO: 1298029 - DNA, 22 bp, Artificial Sequence
  chemically synthesized
gagcattataaaggaaggaaac

SEQ ID NO: 1298030 - DNA, 22 bp, Artificial Sequence
  chemically synthesized
aatatgtcctaaatttgtttcc

SEQ ID NO: 1298031 - DNA, 22 bp, Artificial Sequence
  chemically synthesized
taaatatgtcctaaatttgttt

SEQ ID NO: 1298032 - DNA, 22 bp, Artificial Sequence
  chemically synthesized
ctaaatatgtcctaaatttgtt

SEQ ID NO: 1298033 - DNA, 22 bp, Artificial Sequence
  chemically synthesized
taaaggaaggaaacaaatttag

SEQ ID NO: 1298034 - DNA, 22 bp, Artificial Sequence
  chemically synthesized
tctaaatatgtcctaaatttgt

SEQ ID NO: 1298035 - DNA, 22 bp, Artificial Sequence
  chemically synthesized
aggacatatttagaaagtggat

SEQ ID NO: 1298036 - DNA, 22 bp, Artificial Sequence
  chemically synthesized
atggcacagtaaatccactttc

SEQ ID NO: 1298037 - DNA, 22 bp, Artificial Sequence
  chemically synthesized
ggacatatttagaaagtggatt

SEQ ID NO: 1298038 - DNA, 22 bp, Artificial Sequence
  chemically synthesized
taatattaatggcacagtaaat

SEQ ID NO: 1298039 - DNA, 22 bp, Artificial Sequence
  chemically synthesized
gtaatattaatggcacagtaaa

SEQ ID NO: 1298040 - DNA, 22 bp, Artificial Sequence
  chemically synthesized
tgtaatattaatggcacagtaa

SEQ ID NO: 1298041 - DNA, 22 bp, Artificial Sequence
  chemically synthesized
agaaagtggatttactgtgcca

SEQ ID NO: 1298042 - DNA, 22 bp, Artificial Sequence
  chemically synthesized
gaaagtggatttactgtgccat

SEQ ID NO: 1298043 - DNA, 22 bp, Artificial Sequence
  chemically synthesized
ccattttgtaatattaatggca

SEQ ID NO: 1298044 - DNA, 22 bp, Artificial Sequence
  chemically synthesized
cactgccattttgtaatattaa

SEQ ID NO: 1298045 - DNA, 22 bp, Artificial Sequence
  chemically synthesized
tgcactgccattttgtaatatt

SEQ ID NO: 1298046 - DNA, 22 bp, Artificial Sequence
  chemically synthesized
actgtgccattaatattacaaa

SEQ ID NO: 1298047 - DNA, 22 bp, Artificial Sequence
  chemically synthesized
ctgtgccattaatattacaaaa

SEQ ID NO: 1298048 - DNA, 22 bp, Artificial Sequence
  chemically synthesized
tgccattaatattacaaaatgg

SEQ ID NO: 1298049 - DNA, 22 bp, Artificial Sequence
  chemically synthesized
cactctgcactgccattttgta

SEQ ID NO: 1298050 - DNA, 22 bp, Artificial Sequence
  chemically synthesized
ctccactctgcactgccatttt

SEQ ID NO: 1298051 - DNA, 22 bp, Artificial Sequence
  chemically synthesized
atattacaaaatggcagtgcag

SEQ ID NO: 1298052 - DNA, 22 bp, Artificial Sequence
  chemically synthesized
cagcctcctccactctgcactg

SEQ ID NO: 1298053 - DNA, 22 bp, Artificial Sequence
  chemically synthesized
caaaatggcagtgcagagtgga

SEQ ID NO: 1298054 - DNA, 22 bp, Artificial Sequence
  chemically synthesized
cattgcagcctcctccactctg

SEQ ID NO: 1298055 - DNA, 22 bp, Artificial Sequence
  chemically synthesized
ccattgcagcctcctccactct

SEQ ID NO: 1298056 - DNA, 22 bp, Artificial Sequence
  chemically synthesized
tccattgcagcctcctccactc

SEQ ID NO: 1298057 - DNA, 22 bp, Artificial Sequence
  chemically synthesized
ataccattttccattgcagcct

SEQ ID NO: 1298058 - DNA, 22 bp, Artificial Sequence
  chemically synthesized
cataccattttccattgcagcc

SEQ ID NO: 1298059 - DNA, 22 bp, Artificial Sequence
  chemically synthesized
tcataccattttccattgcagc

SEQ ID NO: 1298060 - DNA, 22 bp, Artificial Sequence
  chemically synthesized
ttcataccattttccattgcag

SEQ ID NO: 1298061 - DNA, 22 bp, Artificial Sequence
  chemically synthesized
atagaaagcatttttcatacca

SEQ ID NO: 1298062 - DNA, 22 bp, Artificial Sequence
  chemically synthesized
aatagaaagcatttttcatacc

SEQ ID NO: 1298063 - DNA, 22 bp, Artificial Sequence
  chemically synthesized
caatggaaaatggtatgaaaaa

SEQ ID NO: 1298064 - DNA, 22 bp, Artificial Sequence
  chemically synthesized
agatttaatagaaagcattttt

SEQ ID NO: 1298065 - DNA, 22 bp, Artificial Sequence
  chemically synthesized
ctcagatttaatagaaagcatt

SEQ ID NO: 1298066 - DNA, 22 bp, Artificial Sequence
  chemically synthesized
ttactcagatttaatagaaagc

SEQ ID NO: 1298067 - DNA, 22 bp, Artificial Sequence
  chemically synthesized
tctattaaatctgagtaatagt

SEQ ID NO: 1298068 - DNA, 22 bp, Artificial Sequence
  chemically synthesized
ctattaaatctgagtaatagtc

SEQ ID NO: 1298069 - DNA, 22 bp, Artificial Sequence
  chemically synthesized
tattaaatctgagtaatagtct

SEQ ID NO: 1298070 - DNA, 22 bp, Artificial Sequence
  chemically synthesized
ttaaatctgagtaatagtcttt

SEQ ID NO: 1298071 - DNA, 22 bp, Artificial Sequence
  chemically synthesized
aatctgagtaatagtctttgat

SEQ ID NO: 1298072 - DNA, 22 bp, Artificial Sequence
  chemically synthesized
agtaatagtctttgattatggg

SEQ ID NO: 1298073 - DNA, 22 bp, Artificial Sequence
  chemically synthesized
aggcggtagaaaaatcccataa

SEQ ID NO: 1298074 - DNA, 22 bp, Artificial Sequence
  chemically synthesized
tgattatgggatttttctaccg

SEQ ID NO: 1298075 - DNA, 22 bp, Artificial Sequence
  chemically synthesized
gattatgggatttttctaccgc

SEQ ID NO: 1298076 - DNA, 22 bp, Artificial Sequence
  chemically synthesized
acgtcacctcaggcggtagaaa

SEQ ID NO: 1298077 - DNA, 22 bp, Artificial Sequence
  chemically synthesized
attatgggatttttctaccgcc

SEQ ID NO: 1298078 - DNA, 22 bp, Artificial Sequence
  chemically synthesized
tgggatttttctaccgcctgag

SEQ ID NO: 1298079 - DNA, 22 bp, Artificial Sequence
  chemically synthesized
accactaacgtcacctcaggcg

SEQ ID NO: 1298080 - DNA, 22 bp, Artificial Sequence
  chemically synthesized
ttctaccgcctgaggtgacgtt

SEQ ID NO: 1298081 - DNA, 22 bp, Artificial Sequence
  chemically synthesized
tctaccgcctgaggtgacgtta

SEQ ID NO: 1298082 - DNA, 22 bp, Artificial Sequence
  chemically synthesized
taagctgaccactaacgtcacc

SEQ ID NO: 1298083 - DNA, 22 bp, Artificial Sequence
  chemically synthesized
ctaccgcctgaggtgacgttag

SEQ ID NO: 1298084 - DNA, 22 bp, Artificial Sequence
  chemically synthesized
taccgcctgaggtgacgttagt

SEQ ID NO: 1298085 - DNA, 22 bp, Artificial Sequence
  chemically synthesized
ccgcctgaggtgacgttagtgg

SEQ ID NO: 1298086 - DNA, 22 bp, Artificial Sequence
  chemically synthesized
attgtaagctgaccactaacgt

SEQ ID NO: 1298087 - DNA, 22 bp, Artificial Sequence
  chemically synthesized
ctcattgtaagctgaccactaa

SEQ ID NO: 1298088 - DNA, 22 bp, Artificial Sequence
  chemically synthesized
aggtgacgttagtggtcagctt

SEQ ID NO: 1298089 - DNA, 22 bp, Artificial Sequence
  chemically synthesized
gacctcctcattgtaagctgac

SEQ ID NO: 1298090 - DNA, 22 bp, Artificial Sequence
  chemically synthesized
agacctcctcattgtaagctga

SEQ ID NO: 1298091 - DNA, 22 bp, Artificial Sequence
  chemically synthesized
tagacctcctcattgtaagctg

SEQ ID NO: 1298092 - DNA, 22 bp, Artificial Sequence
  chemically synthesized
ttttagacctcctcattgtaag

SEQ ID NO: 1298093 - DNA, 22 bp, Artificial Sequence
  chemically synthesized
gtggtcagcttacaatgaggag

SEQ ID NO: 1298094 - DNA, 22 bp, Artificial Sequence
  chemically synthesized
attattttagacctcctcattg

SEQ ID NO: 1298095 - DNA, 22 bp, Artificial Sequence
  chemically synthesized
aattattttagacctcctcatt

SEQ ID NO: 1298096 - DNA, 22 bp, Artificial Sequence
  chemically synthesized
acaatgaggaggtctaaaataa

SEQ ID NO: 1298097 - DNA, 22 bp, Artificial Sequence
  chemically synthesized
caatgaggaggtctaaaataat

SEQ ID NO: 1298098 - DNA, 22 bp, Artificial Sequence
  chemically synthesized
gtgcagaagtttaattatttta

SEQ ID NO: 1298099 - DNA, 22 bp, Artificial Sequence
  chemically synthesized
cgtgcagaagtttaattatttt

SEQ ID NO: 1298100 - DNA, 22 bp, Artificial Sequence
  chemically synthesized
ttcgtgcagaagtttaattatt

SEQ ID NO: 1298101 - DNA, 22 bp, Artificial Sequence
  chemically synthesized
ttcttcgtgcagaagtttaatt

SEQ ID NO: 1298102 - DNA, 22 bp, Artificial Sequence
  chemically synthesized
tgttcttcgtgcagaagtttaa

SEQ ID NO: 1298103 - DNA, 22 bp, Artificial Sequence
  chemically synthesized
ctgttcttcgtgcagaagttta

SEQ ID NO: 1298104 - DNA, 22 bp, Artificial Sequence
  chemically synthesized
tctgttcttcgtgcagaagttt

SEQ ID NO: 1298105 - DNA, 22 bp, Artificial Sequence
  chemically synthesized
ttctgttcttcgtgcagaagtt

SEQ ID NO: 1298106 - DNA, 22 bp, Artificial Sequence
  chemically synthesized
aaataattaaacttctgcacga

SEQ ID NO: 1298107 - DNA, 22 bp, Artificial Sequence
  chemically synthesized
aacttctgcacgaagaacagaa

SEQ ID NO: 1298108 - DNA, 22 bp, Artificial Sequence
  chemically synthesized
acatgaacagcttttctgttct

SEQ ID NO: 1298109 - DNA, 22 bp, Artificial Sequence
  chemically synthesized
gacatgaacagcttttctgttc

SEQ ID NO: 1298110 - DNA, 22 bp, Artificial Sequence
  chemically synthesized
tgacatgaacagcttttctgtt

SEQ ID NO: 1298111 - DNA, 22 bp, Artificial Sequence
  chemically synthesized
ctgcacgaagaacagaaaagct

SEQ ID NO: 1298112 - DNA, 22 bp, Artificial Sequence
  chemically synthesized
tgcacgaagaacagaaaagctg

SEQ ID NO: 1298113 - DNA, 22 bp, Artificial Sequence
  chemically synthesized
cacgaagaacagaaaagctgtt

SEQ ID NO: 1298114 - DNA, 22 bp, Artificial Sequence
  chemically synthesized
ttcatgtcaaagatatttcttt

SEQ ID NO: 1298115 - DNA, 22 bp, Artificial Sequence
  chemically synthesized
atgtcaaagatatttctttatt

SEQ ID NO: 1298116 - DNA, 22 bp, Artificial Sequence
  chemically synthesized
taaagcgaatgggaaataaaga

SEQ ID NO: 1298117 - DNA, 22 bp, Artificial Sequence
  chemically synthesized
actgtaaagcgaatgggaaata

SEQ ID NO: 1298118 - DNA, 22 bp, Artificial Sequence
  chemically synthesized
cattgactgtaaagcgaatggg

SEQ ID NO: 1298119 - DNA, 22 bp, Artificial Sequence
  chemically synthesized
ctttatttcccattcgctttac

SEQ ID NO: 1298120 - DNA, 22 bp, Artificial Sequence
  chemically synthesized
tttatttcccattcgctttaca

SEQ ID NO: 1298121 - DNA, 22 bp, Artificial Sequence
  chemically synthesized
cattacattgactgtaaagcga

SEQ ID NO: 1298122 - DNA, 22 bp, Artificial Sequence
  chemically synthesized
tatttcccattcgctttacagt

SEQ ID NO: 1298123 - DNA, 22 bp, Artificial Sequence
  chemically synthesized
atttcccattcgctttacagtc

SEQ ID NO: 1298124 - DNA, 22 bp, Artificial Sequence
  chemically synthesized
tttcccattcgctttacagtca

SEQ ID NO: 1298125 - DNA, 22 bp, Artificial Sequence
  chemically synthesized
cccattcgctttacagtcaatg

SEQ ID NO: 1298126 - DNA, 22 bp, Artificial Sequence
  chemically synthesized
ccattcgctttacagtcaatgt

SEQ ID NO: 1298127 - DNA, 22 bp, Artificial Sequence
  chemically synthesized
gctttacagtcaatgtaatgca

SEQ ID NO: 1298128 - DNA, 22 bp, Artificial Sequence
  chemically synthesized
tacagtcaatgtaatgcagtct

SEQ ID NO: 1298129 - DNA, 22 bp, Artificial Sequence
  chemically synthesized
acagtcaatgtaatgcagtctt

SEQ ID NO: 1298130 - DNA, 22 bp, Artificial Sequence
  chemically synthesized
cagtcaatgtaatgcagtcttc

SEQ ID NO: 1298131 - DNA, 22 bp, Artificial Sequence
  chemically synthesized
taggatgatgagcagtgaagac

SEQ ID NO: 1298132 - DNA, 22 bp, Artificial Sequence
  chemically synthesized
gtaggatgatgagcagtgaaga

SEQ ID NO: 1298133 - DNA, 22 bp, Artificial Sequence
  chemically synthesized
tgtaggatgatgagcagtgaag

SEQ ID NO: 1298134 - DNA, 22 bp, Artificial Sequence
  chemically synthesized
ttgtaggatgatgagcagtgaa

SEQ ID NO: 1298135 - DNA, 22 bp, Artificial Sequence
  chemically synthesized
agaacaacttttgtaggatgat

SEQ ID NO: 1298136 - DNA, 22 bp, Artificial Sequence
  chemically synthesized
ttaagaacaacttttgtaggat

SEQ ID NO: 1298137 - DNA, 22 bp, Artificial Sequence
  chemically synthesized
cactgctcatcatcctacaaaa

SEQ ID NO: 1298138 - DNA, 22 bp, Artificial Sequence
  chemically synthesized
actgctcatcatcctacaaaag

SEQ ID NO: 1298139 - DNA, 22 bp, Artificial Sequence
  chemically synthesized
ctcatcatcctacaaaagttgt

SEQ ID NO: 1298140 - DNA, 22 bp, Artificial Sequence
  chemically synthesized
atcatcctacaaaagttgttct

SEQ ID NO: 1298141 - DNA, 22 bp, Artificial Sequence
  chemically synthesized
caaaagttgttcttaataacat

SEQ ID NO: 1298142 - DNA, 22 bp, Artificial Sequence
  chemically synthesized
ttcttaataacatcacctacat

SEQ ID NO: 1298143 - DNA, 22 bp, Artificial Sequence
  chemically synthesized
gaaatgagaaaggatgtaggtg

SEQ ID NO: 1298144 - DNA, 22 bp, Artificial Sequence
  chemically synthesized
ggaaatgagaaaggatgtaggt

SEQ ID NO: 1298145 - DNA, 22 bp, Artificial Sequence
  chemically synthesized
ttaataacatcacctacatcct

SEQ ID NO: 1298146 - DNA, 22 bp, Artificial Sequence
  chemically synthesized
ttggaaatgagaaaggatgtag

SEQ ID NO: 1298147 - DNA, 22 bp, Artificial Sequence
  chemically synthesized
aataacatcacctacatccttt

SEQ ID NO: 1298148 - DNA, 22 bp, Artificial Sequence
  chemically synthesized
ataacatcacctacatcctttc

SEQ ID NO: 1298149 - DNA, 22 bp, Artificial Sequence
  chemically synthesized
tcttggaaatgagaaaggatgt

SEQ ID NO: 1298150 - DNA, 22 bp, Artificial Sequence
  chemically synthesized
catcctttctcatttccaagag

SEQ ID NO: 1298151 - DNA, 22 bp, Artificial Sequence
  chemically synthesized
atccagacagtcactctcttgg

SEQ ID NO: 1298152 - DNA, 22 bp, Artificial Sequence
  chemically synthesized
tgatccagacagtcactctctt

SEQ ID NO: 1298153 - DNA, 22 bp, Artificial Sequence
  chemically synthesized
tctcatttccaagagagtgact

SEQ ID NO: 1298154 - DNA, 22 bp, Artificial Sequence
  chemically synthesized
ctcatttccaagagagtgactg

SEQ ID NO: 1298155 - DNA, 22 bp, Artificial Sequence
  chemically synthesized
tcatttccaagagagtgactgt

SEQ ID NO: 1298156 - DNA, 22 bp, Artificial Sequence
  chemically synthesized
atttccaagagagtgactgtct

SEQ ID NO: 1298157 - DNA, 22 bp, Artificial Sequence
  chemically synthesized
cagctctgatccagacagtcac

SEQ ID NO: 1298158 - DNA, 22 bp, Artificial Sequence
  chemically synthesized
ccaagagagtgactgtctggat

SEQ ID NO: 1298159 - DNA, 22 bp, Artificial Sequence
  chemically synthesized
caagagagtgactgtctggatc

SEQ ID NO: 1298160 - DNA, 22 bp, Artificial Sequence
  chemically synthesized
ggattacagctctgatccagac

SEQ ID NO: 1298161 - DNA, 22 bp, Artificial Sequence
  chemically synthesized
agtgctgggattacagctctga

SEQ ID NO: 1298162 - DNA, 22 bp, Artificial Sequence
  chemically synthesized
tgctaagtgctgggattacagc

SEQ ID NO: 1298163 - DNA, 22 bp, Artificial Sequence
  chemically synthesized
tctggatcagagctgtaatccc

SEQ ID NO: 1298164 - DNA, 22 bp, Artificial Sequence
  chemically synthesized
tatgctaagtgctgggattaca

SEQ ID NO: 1298165 - DNA, 22 bp, Artificial Sequence
  chemically synthesized
gatcagagctgtaatcccagca

SEQ ID NO: 1298166 - DNA, 22 bp, Artificial Sequence
  chemically synthesized
tgtaacacattctatgctaagt

SEQ ID NO: 1298167 - DNA, 22 bp, Artificial Sequence
  chemically synthesized
taatcccagcacttagcataga

SEQ ID NO: 1298168 - DNA, 22 bp, Artificial Sequence
  chemically synthesized
ctatgtaacacattctatgcta

SEQ ID NO: 1298169 - DNA, 22 bp, Artificial Sequence
  chemically synthesized
agcactactatgtaacacattc

SEQ ID NO: 1298170 - DNA, 22 bp, Artificial Sequence
  chemically synthesized
ttgagcactactatgtaacaca

SEQ ID NO: 1298171 - DNA, 22 bp, Artificial Sequence
  chemically synthesized
attgagcactactatgtaacac

SEQ ID NO: 1298172 - DNA, 22 bp, Artificial Sequence
  chemically synthesized
tattgagcactactatgtaaca

SEQ ID NO: 1298173 - DNA, 22 bp, Artificial Sequence
  chemically synthesized
agcatagaatgtgttacatagt

SEQ ID NO: 1298174 - DNA, 22 bp, Artificial Sequence
  chemically synthesized
gcatagaatgtgttacatagta

SEQ ID NO: 1298175 - DNA, 22 bp, Artificial Sequence
  chemically synthesized
aaacacctttattgagcactac

SEQ ID NO: 1298176 - DNA, 22 bp, Artificial Sequence
  chemically synthesized
aaaacacctttattgagcacta

SEQ ID NO: 1298177 - DNA, 22 bp, Artificial Sequence
  chemically synthesized
acttaaaacacctttattgagc

SEQ ID NO: 1298178 - DNA, 22 bp, Artificial Sequence
  chemically synthesized
catagtagtgctcaataaaggt

SEQ ID NO: 1298179 - DNA, 22 bp, Artificial Sequence
  chemically synthesized
gttaacttaaaacacctttatt

SEQ ID NO: 1298180 - DNA, 22 bp, Artificial Sequence
  chemically synthesized
cgttaacttaaaacacctttat

SEQ ID NO: 1298181 - DNA, 22 bp, Artificial Sequence
  chemically synthesized
gtcttcgttaacttaaaacacc

SEQ ID NO: 1298182 - DNA, 22 bp, Artificial Sequence
  chemically synthesized
aataaaggtgttttaagttaac

SEQ ID NO: 1298183 - DNA, 22 bp, Artificial Sequence
  chemically synthesized
aaaagtaaatctggtcttcgtt

SEQ ID NO: 1298184 - DNA, 22 bp, Artificial Sequence
  chemically synthesized
taagttaacgaagaccagattt

SEQ ID NO: 1298185 - DNA, 22 bp, Artificial Sequence
  chemically synthesized
aagttaacgaagaccagattta

SEQ ID NO: 1298186 - DNA, 22 bp, Artificial Sequence
  chemically synthesized
agttaacgaagaccagatttac

SEQ ID NO: 1298187 - DNA, 22 bp, Artificial Sequence
  chemically synthesized
acgaagaccagatttacttttt

SEQ ID NO: 1298188 - DNA, 22 bp, Artificial Sequence
  chemically synthesized
cagaggagaaaaatgagaagag

SEQ ID NO: 1298189 - DNA, 22 bp, Artificial Sequence
  chemically synthesized
actttttagtcctcttctcatt

SEQ ID NO: 1298190 - DNA, 22 bp, Artificial Sequence
  chemically synthesized
ctttttagtcctcttctcattt

SEQ ID NO: 1298191 - DNA, 22 bp, Artificial Sequence
  chemically synthesized
tttagtcctcttctcatttttc

SEQ ID NO: 1298192 - DNA, 22 bp, Artificial Sequence
  chemically synthesized
ttagtcctcttctcatttttct

SEQ ID NO: 1298193 - DNA, 22 bp, Artificial Sequence
  chemically synthesized
tagtcctcttctcatttttctc

SEQ ID NO: 1298194 - DNA, 22 bp, Artificial Sequence
  chemically synthesized
atatctgcagaggagaaaaatg

SEQ ID NO: 1298195 - DNA, 22 bp, Artificial Sequence
  chemically synthesized
agtcctcttctcatttttctcc

SEQ ID NO: 1298196 - DNA, 22 bp, Artificial Sequence
  chemically synthesized
gtcctcttctcatttttctcct

SEQ ID NO: 1298197 - DNA, 22 bp, Artificial Sequence
  chemically synthesized
ttctcatttttctcctctgcag

SEQ ID NO: 1298198 - DNA, 22 bp, Artificial Sequence
  chemically synthesized
atagaattaatatctgcagagg

SEQ ID NO: 1298199 - DNA, 22 bp, Artificial Sequence
  chemically synthesized
ctcatttttctcctctgcagat

SEQ ID NO: 1298200 - DNA, 22 bp, Artificial Sequence
  chemically synthesized
aatagaattaatatctgcagag

SEQ ID NO: 1298201 - DNA, 22 bp, Artificial Sequence
  chemically synthesized
tcatttttctcctctgcagata

SEQ ID NO: 1298202 - DNA, 22 bp, Artificial Sequence
  chemically synthesized
atttttctcctctgcagatatt

SEQ ID NO: 1298203 - DNA, 22 bp, Artificial Sequence
  chemically synthesized
ttctcctctgcagatattaatt

SEQ ID NO: 1298204 - DNA, 22 bp, Artificial Sequence
  chemically synthesized
tctcctctgcagatattaattc

SEQ ID NO: 1298205 - DNA, 22 bp, Artificial Sequence
  chemically synthesized
ctcctctgcagatattaattct

SEQ ID NO: 1298206 - DNA, 22 bp, Artificial Sequence
  chemically synthesized
ccagagtttaatagaattaata

SEQ ID NO: 1298207 - DNA, 22 bp, Artificial Sequence
  chemically synthesized
tcctctgcagatattaattcta

SEQ ID NO: 1298208 - DNA, 22 bp, Artificial Sequence
  chemically synthesized
ctctgcagatattaattctatt

SEQ ID NO: 1298209 - DNA, 22 bp, Artificial Sequence
  chemically synthesized
cctaccagagtttaatagaatt

SEQ ID NO: 1298210 - DNA, 22 bp, Artificial Sequence
  chemically synthesized
tgcagatattaattctattaaa

SEQ ID NO: 1298211 - DNA, 22 bp, Artificial Sequence
  chemically synthesized
tgcctaccagagtttaatagaa

SEQ ID NO: 1298212 - DNA, 22 bp, Artificial Sequence
  chemically synthesized
cagatattaattctattaaact

SEQ ID NO: 1298213 - DNA, 22 bp, Artificial Sequence
  chemically synthesized
ttctgcctaccagagtttaata

SEQ ID NO: 1298214 - DNA, 22 bp, Artificial Sequence
  chemically synthesized
attctattaaactctggtaggc

SEQ ID NO: 1298215 - DNA, 22 bp, Artificial Sequence
  chemically synthesized
aggaggcattattctgcctacc

SEQ ID NO: 1298216 - DNA, 22 bp, Artificial Sequence
  chemically synthesized
tattaaactctggtaggcagaa

SEQ ID NO: 1298217 - DNA, 22 bp, Artificial Sequence
  chemically synthesized
gaggaggcattattctgcctac

SEQ ID NO: 1298218 - DNA, 22 bp, Artificial Sequence
  chemically synthesized
tgaggaggcattattctgccta

SEQ ID NO: 1298219 - DNA, 22 bp, Artificial Sequence
  chemically synthesized
ttaaactctggtaggcagaata

SEQ ID NO: 1298220 - DNA, 22 bp, Artificial Sequence
  chemically synthesized
ttgaggaggcattattctgcct

SEQ ID NO: 1298221 - DNA, 22 bp, Artificial Sequence
  chemically synthesized
aactctggtaggcagaataatg

SEQ ID NO: 1298222 - DNA, 22 bp, Artificial Sequence
  chemically synthesized
tggtaggcagaataatgcctcc

SEQ ID NO: 1298223 - DNA, 22 bp, Artificial Sequence
  chemically synthesized
gtaggcagaataatgcctcctc

SEQ ID NO: 1298224 - DNA, 22 bp, Artificial Sequence
  chemically synthesized
gcacgtggccatttttgaggag

SEQ ID NO: 1298225 - DNA, 22 bp, Artificial Sequence
  chemically synthesized
ctcaaaaatggccacgtgctaa

SEQ ID NO: 1298226 - DNA, 22 bp, Artificial Sequence
  chemically synthesized
acagatgtcagggattagcacg

SEQ ID NO: 1298227 - DNA, 22 bp, Artificial Sequence
  chemically synthesized
aaaaatggccacgtgctaatcc

SEQ ID NO: 1298228 - DNA, 22 bp, Artificial Sequence
  chemically synthesized
ttcacagatgtcagggattagc

SEQ ID NO: 1298229 - DNA, 22 bp, Artificial Sequence
  chemically synthesized
attcacagatgtcagggattag

SEQ ID NO: 1298230 - DNA, 22 bp, Artificial Sequence
  chemically synthesized
atccctgacatctgtgaataaa

SEQ ID NO: 1298231 - DNA, 22 bp, Artificial Sequence
  chemically synthesized
ccatgtaacataatttattcac

SEQ ID NO: 1298232 - DNA, 22 bp, Artificial Sequence
  chemically synthesized
gccatgtaacataatttattca

SEQ ID NO: 1298233 - DNA, 22 bp, Artificial Sequence
  chemically synthesized
tgccatgtaacataatttattc

SEQ ID NO: 1298234 - DNA, 22 bp, Artificial Sequence
  chemically synthesized
acatctgtgaataaattatgtt

SEQ ID NO: 1298235 - DNA, 22 bp, Artificial Sequence
  chemically synthesized
cactttgccatgtaacataatt

SEQ ID NO: 1298236 - DNA, 22 bp, Artificial Sequence
  chemically synthesized
tgaataaattatgttacatggc

SEQ ID NO: 1298237 - DNA, 22 bp, Artificial Sequence
  chemically synthesized
caataattccactttgccatgt

SEQ ID NO: 1298238 - DNA, 22 bp, Artificial Sequence
  chemically synthesized
tctgcaataattccactttgcc

SEQ ID NO: 1298239 - DNA, 22 bp, Artificial Sequence
  chemically synthesized
tatctgcaataattccactttg

SEQ ID NO: 1298240 - DNA, 22 bp, Artificial Sequence
  chemically synthesized
tgttacatggcaaagtggaatt

SEQ ID NO: 1298241 - DNA, 22 bp, Artificial Sequence
  chemically synthesized
attctatctgcaataattccac

SEQ ID NO: 1298242 - DNA, 22 bp, Artificial Sequence
  chemically synthesized
catggcaaagtggaattattgc

SEQ ID NO: 1298243 - DNA, 22 bp, Artificial Sequence
  chemically synthesized
gaaagtctaattctatctgcaa

SEQ ID NO: 1298244 - DNA, 22 bp, Artificial Sequence
  chemically synthesized
attagaaagtctaattctatct

SEQ ID NO: 1298245 - DNA, 22 bp, Artificial Sequence
  chemically synthesized
gctaattagaaagtctaattct

SEQ ID NO: 1298246 - DNA, 22 bp, Artificial Sequence
  chemically synthesized
ttgcagatagaattagactttc

SEQ ID NO: 1298247 - DNA, 22 bp, Artificial Sequence
  chemically synthesized
cagatagaattagactttctaa

SEQ ID NO: 1298248 - DNA, 22 bp, Artificial Sequence
  chemically synthesized
tcaaaagttagctaattagaaa

SEQ ID NO: 1298249 - DNA, 22 bp, Artificial Sequence
  chemically synthesized
cctatcaaaagttagctaatta

SEQ ID NO: 1298250 - DNA, 22 bp, Artificial Sequence
  chemically synthesized
gactttctaattagctaacttt

SEQ ID NO: 1298251 - DNA, 22 bp, Artificial Sequence
  chemically synthesized
tctaattagctaacttttgata

SEQ ID NO: 1298252 - DNA, 22 bp, Artificial Sequence
  chemically synthesized
ggataatctccctatcaaaagt

SEQ ID NO: 1298253 - DNA, 22 bp, Artificial Sequence
  chemically synthesized
ctaattagctaacttttgatag

SEQ ID NO: 1298254 - DNA, 22 bp, Artificial Sequence
  chemically synthesized
taattagctaacttttgatagg

SEQ ID NO: 1298255 - DNA, 22 bp, Artificial Sequence
  chemically synthesized
attagctaacttttgataggga

SEQ ID NO: 1298256 - DNA, 22 bp, Artificial Sequence
  chemically synthesized
gctaacttttgatagggagatt

SEQ ID NO: 1298257 - DNA, 22 bp, Artificial Sequence
  chemically synthesized
agataatctgggataatctccc

SEQ ID NO: 1298258 - DNA, 22 bp, Artificial Sequence
  chemically synthesized
acttttgatagggagattatcc

SEQ ID NO: 1298259 - DNA, 22 bp, Artificial Sequence
  chemically synthesized
ttgatagggagattatcccaga

SEQ ID NO: 1298260 - DNA, 22 bp, Artificial Sequence
  chemically synthesized
tgatagggagattatcccagat

SEQ ID NO: 1298261 - DNA, 22 bp, Artificial Sequence
  chemically synthesized
cccactcagataatctgggata

SEQ ID NO: 1298262 - DNA, 22 bp, Artificial Sequence
  chemically synthesized
gatagggagattatcccagatt

SEQ ID NO: 1298263 - DNA, 22 bp, Artificial Sequence
  chemically synthesized
atagggagattatcccagatta

SEQ ID NO: 1298264 - DNA, 22 bp, Artificial Sequence
  chemically synthesized
aatcctgcccactcagataatc

SEQ ID NO: 1298265 - DNA, 22 bp, Artificial Sequence
  chemically synthesized
tgattaaatcctgcccactcag

SEQ ID NO: 1298266 - DNA, 22 bp, Artificial Sequence
  chemically synthesized
tcccagattatctgagtgggca

SEQ ID NO: 1298267 - DNA, 22 bp, Artificial Sequence
  chemically synthesized
aggacccctgtgattaaatcct

SEQ ID NO: 1298268 - DNA, 22 bp, Artificial Sequence
  chemically synthesized
tctgagtgggcaggatttaatc

SEQ ID NO: 1298269 - DNA, 22 bp, Artificial Sequence
  chemically synthesized
aaggacccctgtgattaaatcc

SEQ ID NO: 1298270 - DNA, 22 bp, Artificial Sequence
  chemically synthesized
taaggacccctgtgattaaatc

SEQ ID NO: 1298271 - DNA, 22 bp, Artificial Sequence
  chemically synthesized
ttaaggacccctgtgattaaat

SEQ ID NO: 1298272 - DNA, 22 bp, Artificial Sequence
  chemically synthesized
agtgggcaggatttaatcacag

SEQ ID NO: 1298273 - DNA, 22 bp, Artificial Sequence
  chemically synthesized
cccccttttaaggacccctgtg

SEQ ID NO: 1298274 - DNA, 22 bp, Artificial Sequence
  chemically synthesized
ccccccttttaaggacccctgt

SEQ ID NO: 1298275 - DNA, 22 bp, Artificial Sequence
  chemically synthesized
aatcacaggggtccttaaaagg

SEQ ID NO: 1298276 - DNA, 22 bp, Artificial Sequence
  chemically synthesized
atcacaggggtccttaaaaggg

SEQ ID NO: 1298277 - DNA, 22 bp, Artificial Sequence
  chemically synthesized
tgccaacatttcccccctttta

SEQ ID NO: 1298278 - DNA, 22 bp, Artificial Sequence
  chemically synthesized
atgccaacatttcccccctttt

SEQ ID NO: 1298279 - DNA, 22 bp, Artificial Sequence
  chemically synthesized
cccttatgccaacatttccccc

SEQ ID NO: 1298280 - DNA, 22 bp, Artificial Sequence
  chemically synthesized
tccccttatgccaacatttccc

SEQ ID NO: 1298281 - DNA, 22 bp, Artificial Sequence
  chemically synthesized
attctccccttatgccaacatt

SEQ ID NO: 1298282 - DNA, 22 bp, Artificial Sequence
  chemically synthesized
aaaaggggggaaatgttggcat

SEQ ID NO: 1298283 - DNA, 22 bp, Artificial Sequence
  chemically synthesized
aaaggggggaaatgttggcata

SEQ ID NO: 1298284 - DNA, 22 bp, Artificial Sequence
  chemically synthesized
taattctccccttatgccaaca

SEQ ID NO: 1298285 - DNA, 22 bp, Artificial Sequence
  chemically synthesized
ctaattctccccttatgccaac

SEQ ID NO: 1298286 - DNA, 22 bp, Artificial Sequence
  chemically synthesized
tctaattctccccttatgccaa

SEQ ID NO: 1298287 - DNA, 22 bp, Artificial Sequence
  chemically synthesized
atagtgctttctaattctcccc

SEQ ID NO: 1298288 - DNA, 22 bp, Artificial Sequence
  chemically synthesized
tcatagtgctttctaattctcc

SEQ ID NO: 1298289 - DNA, 22 bp, Artificial Sequence
  chemically synthesized
ctcatagtgctttctaattctc

SEQ ID NO: 1298290 - DNA, 22 bp, Artificial Sequence
  chemically synthesized
gcataaggggagaattagaaag

SEQ ID NO: 1298291 - DNA, 22 bp, Artificial Sequence
  chemically synthesized
ggaccaagtccttctcatagtg

SEQ ID NO: 1298292 - DNA, 22 bp, Artificial Sequence
  chemically synthesized
gaaagcactatgagaaggactt

SEQ ID NO: 1298293 - DNA, 22 bp, Artificial Sequence
  chemically synthesized
aaaaccagccacctcggaccaa

SEQ ID NO: 1298294 - DNA, 22 bp, Artificial Sequence
  chemically synthesized
caaaaccagccacctcggacca

SEQ ID NO: 1298295 - DNA, 22 bp, Artificial Sequence
  chemically synthesized
tgagaaggacttggtccgaggt

SEQ ID NO: 1298296 - DNA, 22 bp, Artificial Sequence
  chemically synthesized
gtacatcttcaaaaccagccac

SEQ ID NO: 1298297 - DNA, 22 bp, Artificial Sequence
  chemically synthesized
cgtacatcttcaaaaccagcca

SEQ ID NO: 1298298 - DNA, 22 bp, Artificial Sequence
  chemically synthesized
ttcgtacatcttcaaaaccagc

SEQ ID NO: 1298299 - DNA, 22 bp, Artificial Sequence
  chemically synthesized
ggtccgaggtggctggttttga

SEQ ID NO: 1298300 - DNA, 22 bp, Artificial Sequence
  chemically synthesized
cttcgtacatcttcaaaaccag

SEQ ID NO: 1298301 - DNA, 22 bp, Artificial Sequence
  chemically synthesized
gtccgaggtggctggttttgaa

SEQ ID NO: 1298302 - DNA, 22 bp, Artificial Sequence
  chemically synthesized
acggccttcttcgtacatcttc

SEQ ID NO: 1298303 - DNA, 22 bp, Artificial Sequence
  chemically synthesized
gctcacggccttcttcgtacat

SEQ ID NO: 1298304 - DNA, 22 bp, Artificial Sequence
  chemically synthesized
ggctcacggccttcttcgtaca

SEQ ID NO: 1298305 - DNA, 22 bp, Artificial Sequence
  chemically synthesized
gttttgaagatgtacgaagaag

SEQ ID NO: 1298306 - DNA, 22 bp, Artificial Sequence
  chemically synthesized
tttggctcacggccttcttcgt

SEQ ID NO: 1298307 - DNA, 22 bp, Artificial Sequence
  chemically synthesized
tgaagatgtacgaagaaggccg

SEQ ID NO: 1298308 - DNA, 22 bp, Artificial Sequence
  chemically synthesized
gaagatgtacgaagaaggccgt

SEQ ID NO: 1298309 - DNA, 22 bp, Artificial Sequence
  chemically synthesized
aagatgtacgaagaaggccgtg

SEQ ID NO: 1298310 - DNA, 22 bp, Artificial Sequence
  chemically synthesized
ccacgttatttggctcacggcc

SEQ ID NO: 1298311 - DNA, 22 bp, Artificial Sequence
  chemically synthesized
gagaattcccacgttatttggc

SEQ ID NO: 1298312 - DNA, 22 bp, Artificial Sequence
  chemically synthesized
tagagaattcccacgttatttg

SEQ ID NO: 1298313 - DNA, 22 bp, Artificial Sequence
  chemically synthesized
ctagagaattcccacgttattt

SEQ ID NO: 1298314 - DNA, 22 bp, Artificial Sequence
  chemically synthesized
tctagagaattcccacgttatt

SEQ ID NO: 1298315 - DNA, 22 bp, Artificial Sequence
  chemically synthesized
cattttctagagaattcccacg

SEQ ID NO: 1298316 - DNA, 22 bp, Artificial Sequence
  chemically synthesized
ccattttctagagaattcccac

SEQ ID NO: 1298317 - DNA, 22 bp, Artificial Sequence
  chemically synthesized
tccattttctagagaattccca

SEQ ID NO: 1298318 - DNA, 22 bp, Artificial Sequence
  chemically synthesized
ttccattttctagagaattccc

SEQ ID NO: 1298319 - DNA, 22 bp, Artificial Sequence
  chemically synthesized
ccttttccattttctagagaat

SEQ ID NO: 1298320 - DNA, 22 bp, Artificial Sequence
  chemically synthesized
gccttttccattttctagagaa

SEQ ID NO: 1298321 - DNA, 22 bp, Artificial Sequence
  chemically synthesized
cttgccttttccattttctaga

SEQ ID NO: 1298322 - DNA, 22 bp, Artificial Sequence
  chemically synthesized
tctccttgccttttccattttc

SEQ ID NO: 1298323 - DNA, 22 bp, Artificial Sequence
  chemically synthesized
tctagaaaatggaaaaggcaag

SEQ ID NO: 1298324 - DNA, 22 bp, Artificial Sequence
  chemically synthesized
tagaaaatggaaaaggcaagga

SEQ ID NO: 1298325 - DNA, 22 bp, Artificial Sequence
  chemically synthesized
gaaaatggaaaaggcaaggaga

SEQ ID NO: 1298326 - DNA, 22 bp, Artificial Sequence
  chemically synthesized
caggggagaatctgtctccttg

SEQ ID NO: 1298327 - DNA, 22 bp, Artificial Sequence
  chemically synthesized
gatgctccaggggagaatctgt

SEQ ID NO: 1298328 - DNA, 22 bp, Artificial Sequence
  chemically synthesized
ggatgctccaggggagaatctg

SEQ ID NO: 1298329 - DNA, 22 bp, Artificial Sequence
  chemically synthesized
tggatgctccaggggagaatct

SEQ ID NO: 1298330 - DNA, 22 bp, Artificial Sequence
  chemically synthesized
ttggatgctccaggggagaatc

SEQ ID NO: 1298331 - DNA, 22 bp, Artificial Sequence
  chemically synthesized
tgtacttttggatgctccaggg

SEQ ID NO: 1298332 - DNA, 22 bp, Artificial Sequence
  chemically synthesized
tcccctggagcatccaaaagta

SEQ ID NO: 1298333 - DNA, 22 bp, Artificial Sequence
  chemically synthesized
ccctggagcatccaaaagtaca

SEQ ID NO: 1298334 - DNA, 22 bp, Artificial Sequence
  chemically synthesized
gagcatccaaaagtacacagcc

SEQ ID NO: 1298335 - DNA, 22 bp, Artificial Sequence
  chemically synthesized
aaatcatgatgccagaagggct

SEQ ID NO: 1298336 - DNA, 22 bp, Artificial Sequence
  chemically synthesized
gactcaaatcatgatgccagaa

SEQ ID NO: 1298337 - DNA, 22 bp, Artificial Sequence
  chemically synthesized
ctggactcaaatcatgatgcca

SEQ ID NO: 1298338 - DNA, 22 bp, Artificial Sequence
  chemically synthesized
actggactcaaatcatgatgcc

SEQ ID NO: 1298339 - DNA, 22 bp, Artificial Sequence
  chemically synthesized
gaacttactggactcaaatcat

SEQ ID NO: 1298340 - DNA, 22 bp, Artificial Sequence
  chemically synthesized
ctggcatcatgatttgagtcca

SEQ ID NO: 1298341 - DNA, 22 bp, Artificial Sequence
  chemically synthesized
tggcatcatgatttgagtccag

SEQ ID NO: 1298342 - DNA, 22 bp, Artificial Sequence
  chemically synthesized
gcatcatgatttgagtccagta

SEQ ID NO: 1298343 - DNA, 22 bp, Artificial Sequence
  chemically synthesized
gagtccagtaagttccagtttg

SEQ ID NO: 1298344 - DNA, 22 bp, Artificial Sequence
  chemically synthesized
agtccagtaagttccagtttgg

SEQ ID NO: 1298345 - DNA, 22 bp, Artificial Sequence
  chemically synthesized
caggtcagaaatccaaactgga

SEQ ID NO: 1298346 - DNA, 22 bp, Artificial Sequence
  chemically synthesized
tgcaggtcagaaatccaaactg

SEQ ID NO: 1298347 - DNA, 22 bp, Artificial Sequence
  chemically synthesized
agacagttctgcaggtcagaaa

SEQ ID NO: 1298348 - DNA, 22 bp, Artificial Sequence
  chemically synthesized
tcagacagttctgcaggtcaga

SEQ ID NO: 1298349 - DNA, 22 bp, Artificial Sequence
  chemically synthesized
cagtttggatttctgacctgca

SEQ ID NO: 1298350 - DNA, 22 bp, Artificial Sequence
  chemically synthesized
ttctcagacagttctgcaggtc

SEQ ID NO: 1298351 - DNA, 22 bp, Artificial Sequence
  chemically synthesized
attctcagacagttctgcaggt

SEQ ID NO: 1298352 - DNA, 22 bp, Artificial Sequence
  chemically synthesized
ggatttctgacctgcagaactg

SEQ ID NO: 1298353 - DNA, 22 bp, Artificial Sequence
  chemically synthesized
gatttctgacctgcagaactgt

SEQ ID NO: 1298354 - DNA, 22 bp, Artificial Sequence
  chemically synthesized
ctgacctgcagaactgtctgag

SEQ ID NO: 1298355 - DNA, 22 bp, Artificial Sequence
  chemically synthesized
tatacatttattctcagacagt

SEQ ID NO: 1298356 - DNA, 22 bp, Artificial Sequence
  chemically synthesized
tgacctgcagaactgtctgaga

SEQ ID NO: 1298357 - DNA, 22 bp, Artificial Sequence
  chemically synthesized
acctgcagaactgtctgagaat

SEQ ID NO: 1298358 - DNA, 22 bp, Artificial Sequence
  chemically synthesized
aaattatatacatttattctca

SEQ ID NO: 1298359 - DNA, 22 bp, Artificial Sequence
  chemically synthesized
aaaattatatacatttattctc

SEQ ID NO: 1298360 - DNA, 22 bp, Artificial Sequence
  chemically synthesized
cagaactgtctgagaataaatg

SEQ ID NO: 1298361 - DNA, 22 bp, Artificial Sequence
  chemically synthesized
gtggcttaaaattatatacatt

SEQ ID NO: 1298362 - DNA, 22 bp, Artificial Sequence
  chemically synthesized
agtggcttaaaattatatacat

SEQ ID NO: 1298363 - DNA, 22 bp, Artificial Sequence
  chemically synthesized
tctgagaataaatgtatataat

SEQ ID NO: 1298364 - DNA, 22 bp, Artificial Sequence
  chemically synthesized
agaataaatgtatataatttta

SEQ ID NO: 1298365 - DNA, 22 bp, Artificial Sequence
  chemically synthesized
ccacaaatttagtggcttaaaa

SEQ ID NO: 1298366 - DNA, 22 bp, Artificial Sequence
  chemically synthesized
taaaattaccacaaatttagtg

SEQ ID NO: 1298367 - DNA, 22 bp, Artificial Sequence
  chemically synthesized
ctataaaattaccacaaattta

SEQ ID NO: 1298368 - DNA, 22 bp, Artificial Sequence
  chemically synthesized
ctgctataaaattaccacaaat

SEQ ID NO: 1298369 - DNA, 22 bp, Artificial Sequence
  chemically synthesized
taagccactaaatttgtggtaa

SEQ ID NO: 1298370 - DNA, 22 bp, Artificial Sequence
  chemically synthesized
aagccactaaatttgtggtaat

SEQ ID NO: 1298371 - DNA, 22 bp, Artificial Sequence
  chemically synthesized
agccactaaatttgtggtaatt

SEQ ID NO: 1298372 - DNA, 22 bp, Artificial Sequence
  chemically synthesized
ttgctgctataaaattaccaca

SEQ ID NO: 1298373 - DNA, 22 bp, Artificial Sequence
  chemically synthesized
ctattgctgctataaaattacc

SEQ ID NO: 1298374 - DNA, 22 bp, Artificial Sequence
  chemically synthesized
cctattgctgctataaaattac

SEQ ID NO: 1298375 - DNA, 22 bp, Artificial Sequence
  chemically synthesized
aatttgtggtaattttatagca

SEQ ID NO: 1298376 - DNA, 22 bp, Artificial Sequence
  chemically synthesized
gtttcctattgctgctataaaa

SEQ ID NO: 1298377 - DNA, 22 bp, Artificial Sequence
  chemically synthesized
ttagtttcctattgctgctata

SEQ ID NO: 1298378 - DNA, 22 bp, Artificial Sequence
  chemically synthesized
attagtttcctattgctgctat

SEQ ID NO: 1298379 - DNA, 22 bp, Artificial Sequence
  chemically synthesized
gtggtaattttatagcagcaat

SEQ ID NO: 1298380 - DNA, 22 bp, Artificial Sequence
  chemically synthesized
tggtaattttatagcagcaata

SEQ ID NO: 1298381 - DNA, 22 bp, Artificial Sequence
  chemically synthesized
tatagcagcaataggaaactaa

SEQ ID NO: 1298382 - DNA, 22 bp, Artificial Sequence
  chemically synthesized
atagcagcaataggaaactaat

SEQ ID NO: 1298383 - DNA, 22 bp, Artificial Sequence
  chemically synthesized
tagcagcaataggaaactaata

SEQ ID NO: 1298384 - DNA, 22 bp, Artificial Sequence
  chemically synthesized
aatatgaaatgtaatttattag

SEQ ID NO: 1298385 - DNA, 22 bp, Artificial Sequence
  chemically synthesized
aaatatgaaatgtaatttatta

SEQ ID NO: 1298386 - DNA, 22 bp, Artificial Sequence
  chemically synthesized
atagccttaaatatgaaatgta

SEQ ID NO: 1298387 - DNA, 22 bp, Artificial Sequence
  chemically synthesized
aatagccttaaatatgaaatgt

SEQ ID NO: 1298388 - DNA, 22 bp, Artificial Sequence
  chemically synthesized
ataaattacatttcatatttaa

SEQ ID NO: 1298389 - DNA, 22 bp, Artificial Sequence
  chemically synthesized
tcacttaatagccttaaatatg

SEQ ID NO: 1298390 - DNA, 22 bp, Artificial Sequence
  chemically synthesized
gtcacttaatagccttaaatat

SEQ ID NO: 1298391 - DNA, 22 bp, Artificial Sequence
  chemically synthesized
catttcatatttaaggctatta

SEQ ID NO: 1298392 - DNA, 22 bp, Artificial Sequence
  chemically synthesized
catatttaaggctattaagtga

SEQ ID NO: 1298393 - DNA, 22 bp, Artificial Sequence
  chemically synthesized
atatttaaggctattaagtgac

SEQ ID NO: 1298394 - DNA, 22 bp, Artificial Sequence
  chemically synthesized
aaggctattaagtgacaaatgt

SEQ ID NO: 1298395 - DNA, 22 bp, Artificial Sequence
  chemically synthesized
aggctattaagtgacaaatgtg

SEQ ID NO: 1298396 - DNA, 22 bp, Artificial Sequence
  chemically synthesized
gtaggtgtcagtacacatttgt

SEQ ID NO: 1298397 - DNA, 22 bp, Artificial Sequence
  chemically synthesized
ttaagtgacaaatgtgtactga

SEQ ID NO: 1298398 - DNA, 22 bp, Artificial Sequence
  chemically synthesized
ccacctagtaggtgtcagtaca

SEQ ID NO: 1298399 - DNA, 22 bp, Artificial Sequence
  chemically synthesized
agtgacaaatgtgtactgacac

SEQ ID NO: 1298400 - DNA, 22 bp, Artificial Sequence
  chemically synthesized
taccacctagtaggtgtcagta

SEQ ID NO: 1298401 - DNA, 22 bp, Artificial Sequence
  chemically synthesized
ctaccacctagtaggtgtcagt

SEQ ID NO: 1298402 - DNA, 22 bp, Artificial Sequence
  chemically synthesized
tctaccacctagtaggtgtcag

SEQ ID NO: 1298403 - DNA, 22 bp, Artificial Sequence
  chemically synthesized
ttctaccacctagtaggtgtca

SEQ ID NO: 1298404 - DNA, 22 bp, Artificial Sequence
  chemically synthesized
tttttctaccacctagtaggtg

SEQ ID NO: 1298405 - DNA, 22 bp, Artificial Sequence
  chemically synthesized
acagttgtttttctaccaccta

SEQ ID NO: 1298406 - DNA, 22 bp, Artificial Sequence
  chemically synthesized
tcacagttgtttttctaccacc

SEQ ID NO: 1298407 - DNA, 22 bp, Artificial Sequence
  chemically synthesized
ctcacagttgtttttctaccac

SEQ ID NO: 1298408 - DNA, 22 bp, Artificial Sequence
  chemically synthesized
acacctactaggtggtagaaaa

SEQ ID NO: 1298409 - DNA, 22 bp, Artificial Sequence
  chemically synthesized
tctcacagttgtttttctacca

SEQ ID NO: 1298410 - DNA, 22 bp, Artificial Sequence
  chemically synthesized
cctttctcacagttgtttttct

SEQ ID NO: 1298411 - DNA, 22 bp, Artificial Sequence
  chemically synthesized
ctaggtggtagaaaaacaactg

SEQ ID NO: 1298412 - DNA, 22 bp, Artificial Sequence
  chemically synthesized
ggtggtagaaaaacaactgtga

SEQ ID NO: 1298413 - DNA, 22 bp, Artificial Sequence
  chemically synthesized
gagacactgcctttctcacagt

SEQ ID NO: 1298414 - DNA, 22 bp, Artificial Sequence
  chemically synthesized
gaaggaaaaaagctagagacac

SEQ ID NO: 1298415 - DNA, 22 bp, Artificial Sequence
  chemically synthesized
tgagaaaggcagtgtctctagc

SEQ ID NO: 1298416 - DNA, 22 bp, Artificial Sequence
  chemically synthesized
agctagaaggaaaaaagctaga

SEQ ID NO: 1298417 - DNA, 22 bp, Artificial Sequence
  chemically synthesized
actaagctagaaggaaaaaagc

SEQ ID NO: 1298418 - DNA, 22 bp, Artificial Sequence
  chemically synthesized
tcactaagctagaaggaaaaaa

SEQ ID NO: 1298419 - DNA, 22 bp, Artificial Sequence
  chemically synthesized
tctcactaagctagaaggaaaa

SEQ ID NO: 1298420 - DNA, 22 bp, Artificial Sequence
  chemically synthesized
ctctcactaagctagaaggaaa

SEQ ID NO: 1298421 - DNA, 22 bp, Artificial Sequence
  chemically synthesized
cttctctcactaagctagaagg

SEQ ID NO: 1298422 - DNA, 22 bp, Artificial Sequence
  chemically synthesized
tagcttttttccttctagctta

SEQ ID NO: 1298423 - DNA, 22 bp, Artificial Sequence
  chemically synthesized
gcttttttccttctagcttagt

SEQ ID NO: 1298424 - DNA, 22 bp, Artificial Sequence
  chemically synthesized
tgtctgcttctctcactaagct

SEQ ID NO: 1298425 - DNA, 22 bp, Artificial Sequence
  chemically synthesized
ttttccttctagcttagtgaga

SEQ ID NO: 1298426 - DNA, 22 bp, Artificial Sequence
  chemically synthesized
tttccttctagcttagtgagag

SEQ ID NO: 1298427 - DNA, 22 bp, Artificial Sequence
  chemically synthesized
ttgtgtctgcttctctcactaa

SEQ ID NO: 1298428 - DNA, 22 bp, Artificial Sequence
  chemically synthesized
ttccttctagcttagtgagaga

SEQ ID NO: 1298429 - DNA, 22 bp, Artificial Sequence
  chemically synthesized
gttgtgtctgcttctctcacta

SEQ ID NO: 1298430 - DNA, 22 bp, Artificial Sequence
  chemically synthesized
tccttctagcttagtgagagaa

SEQ ID NO: 1298431 - DNA, 22 bp, Artificial Sequence
  chemically synthesized
tgttgtgtctgcttctctcact

SEQ ID NO: 1298432 - DNA, 22 bp, Artificial Sequence
  chemically synthesized
ccttctagcttagtgagagaag

SEQ ID NO: 1298433 - DNA, 22 bp, Artificial Sequence
  chemically synthesized
ttgttgtgtctgcttctctcac

SEQ ID NO: 1298434 - DNA, 22 bp, Artificial Sequence
  chemically synthesized
cttctagcttagtgagagaagc

SEQ ID NO: 1298435 - DNA, 22 bp, Artificial Sequence
  chemically synthesized
ctagcttagtgagagaagcaga

SEQ ID NO: 1298436 - DNA, 22 bp, Artificial Sequence
  chemically synthesized
tagcttagtgagagaagcagac

SEQ ID NO: 1298437 - DNA, 22 bp, Artificial Sequence
  chemically synthesized
gcttagtgagagaagcagacac

SEQ ID NO: 1298438 - DNA, 22 bp, Artificial Sequence
  chemically synthesized
agtgagagaagcagacacaaca

SEQ ID NO: 1298439 - DNA, 22 bp, Artificial Sequence
  chemically synthesized
gtgagagaagcagacacaacaa

SEQ ID NO: 1298440 - DNA, 22 bp, Artificial Sequence
  chemically synthesized
tatcaacatacccttttgttgt

SEQ ID NO: 1298441 - DNA, 22 bp, Artificial Sequence
  chemically synthesized
gtatcaacatacccttttgttg

SEQ ID NO: 1298442 - DNA, 22 bp, Artificial Sequence
  chemically synthesized
tatatttgtatcaacataccct

SEQ ID NO: 1298443 - DNA, 22 bp, Artificial Sequence
  chemically synthesized
tctgtatatttgtatcaacata

SEQ ID NO: 1298444 - DNA, 22 bp, Artificial Sequence
  chemically synthesized
atctgtatatttgtatcaacat

SEQ ID NO: 1298445 - DNA, 22 bp, Artificial Sequence
  chemically synthesized
atcaggcaacttatctgtatat

SEQ ID NO: 1298446 - DNA, 22 bp, Artificial Sequence
  chemically synthesized
catcaggcaacttatctgtata

SEQ ID NO: 1298447 - DNA, 22 bp, Artificial Sequence
  chemically synthesized
ttcatcaggcaacttatctgta

SEQ ID NO: 1298448 - DNA, 22 bp, Artificial Sequence
  chemically synthesized
cttcatcaggcaacttatctgt

SEQ ID NO: 1298449 - DNA, 22 bp, Artificial Sequence
  chemically synthesized
atacaaatatacagataagttg

SEQ ID NO: 1298450 - DNA, 22 bp, Artificial Sequence
  chemically synthesized
tagtttcttcatcaggcaactt

SEQ ID NO: 1298451 - DNA, 22 bp, Artificial Sequence
  chemically synthesized
tcacatgactgtagtttcttca

SEQ ID NO: 1298452 - DNA, 22 bp, Artificial Sequence
  chemically synthesized
cctgatgaagaaactacagtca

SEQ ID NO: 1298453 - DNA, 22 bp, Artificial Sequence
  chemically synthesized
atgaagaaactacagtcatgtg

SEQ ID NO: 1298454 - DNA, 22 bp, Artificial Sequence
  chemically synthesized
atatatgattgtcacatgactg

SEQ ID NO: 1298455 - DNA, 22 bp, Artificial Sequence
  chemically synthesized
aatatatgattgtcacatgact

SEQ ID NO: 1298456 - DNA, 22 bp, Artificial Sequence
  chemically synthesized
cttaatatatgattgtcacatg

SEQ ID NO: 1298457 - DNA, 22 bp, Artificial Sequence
  chemically synthesized
ccttaatatatgattgtcacat

SEQ ID NO: 1298458 - DNA, 22 bp, Artificial Sequence
  chemically synthesized
cagtcatgtgacaatcatatat

SEQ ID NO: 1298459 - DNA, 22 bp, Artificial Sequence
  chemically synthesized
aaggtagtttccttaatatatg

SEQ ID NO: 1298460 - DNA, 22 bp, Artificial Sequence
  chemically synthesized
caaggtagtttccttaatatat

SEQ ID NO: 1298461 - DNA, 22 bp, Artificial Sequence
  chemically synthesized
tcaaggtagtttccttaatata

SEQ ID NO: 1298462 - DNA, 22 bp, Artificial Sequence
  chemically synthesized
ttcaaggtagtttccttaatat

SEQ ID NO: 1298463 - DNA, 22 bp, Artificial Sequence
  chemically synthesized
gatttttcaaggtagtttcctt

SEQ ID NO: 1298464 - DNA, 22 bp, Artificial Sequence
  chemically synthesized
tggatttttcaaggtagtttcc

SEQ ID NO: 1298465 - DNA, 22 bp, Artificial Sequence
  chemically synthesized
aggaaactaccttgaaaaatcc

SEQ ID NO: 1298466 - DNA, 22 bp, Artificial Sequence
  chemically synthesized
atcaaggaagctctggattttt

SEQ ID NO: 1298467 - DNA, 22 bp, Artificial Sequence
  chemically synthesized
catcaaggaagctctggatttt

SEQ ID NO: 1298468 - DNA, 22 bp, Artificial Sequence
  chemically synthesized
ccttgaaaaatccagagcttcc

SEQ ID NO: 1298469 - DNA, 22 bp, Artificial Sequence
  chemically synthesized
gaaaaatccagagcttccttga

SEQ ID NO: 1298470 - DNA, 22 bp, Artificial Sequence
  chemically synthesized
aaaaatccagagcttccttgat

SEQ ID NO: 1298471 - DNA, 22 bp, Artificial Sequence
  chemically synthesized
agatgtcacttcatcaaggaag

SEQ ID NO: 1298472 - DNA, 22 bp, Artificial Sequence
  chemically synthesized
agctgagatgtcacttcatcaa

SEQ ID NO: 1298473 - DNA, 22 bp, Artificial Sequence
  chemically synthesized
aaaactcagctgagatgtcact

SEQ ID NO: 1298474 - DNA, 22 bp, Artificial Sequence
  chemically synthesized
caaaactcagctgagatgtcac

SEQ ID NO: 1298475 - DNA, 22 bp, Artificial Sequence
  chemically synthesized
tcaaaactcagctgagatgtca

SEQ ID NO: 1298476 - DNA, 22 bp, Artificial Sequence
  chemically synthesized
ccttgatgaagtgacatctcag

SEQ ID NO: 1298477 - DNA, 22 bp, Artificial Sequence
  chemically synthesized
cttgatgaagtgacatctcagc

SEQ ID NO: 1298478 - DNA, 22 bp, Artificial Sequence
  chemically synthesized
actttcaaaactcagctgagat

SEQ ID NO: 1298479 - DNA, 22 bp, Artificial Sequence
  chemically synthesized
gatgaagtgacatctcagctga

SEQ ID NO: 1298480 - DNA, 22 bp, Artificial Sequence
  chemically synthesized
atgaagtgacatctcagctgag

SEQ ID NO: 1298481 - DNA, 22 bp, Artificial Sequence
  chemically synthesized
attaactttcaaaactcagctg

SEQ ID NO: 1298482 - DNA, 22 bp, Artificial Sequence
  chemically synthesized
aattaactttcaaaactcagct

SEQ ID NO: 1298483 - DNA, 22 bp, Artificial Sequence
  chemically synthesized
ttaattaactttcaaaactcag

SEQ ID NO: 1298484 - DNA, 22 bp, Artificial Sequence
  chemically synthesized
ctcttaattaactttcaaaact

SEQ ID NO: 1298485 - DNA, 22 bp, Artificial Sequence
  chemically synthesized
tgctcttaattaactttcaaaa

SEQ ID NO: 1298486 - DNA, 22 bp, Artificial Sequence
  chemically synthesized
tctgctcttaattaactttcaa

SEQ ID NO: 1298487 - DNA, 22 bp, Artificial Sequence
  chemically synthesized
agctgagttttgaaagttaatt

SEQ ID NO: 1298488 - DNA, 22 bp, Artificial Sequence
  chemically synthesized
tctctctgctcttaattaactt

SEQ ID NO: 1298489 - DNA, 22 bp, Artificial Sequence
  chemically synthesized
gtctctctgctcttaattaact

SEQ ID NO: 1298490 - DNA, 22 bp, Artificial Sequence
  chemically synthesized
agttttgaaagttaattaagag

SEQ ID NO: 1298491 - DNA, 22 bp, Artificial Sequence
  chemically synthesized
ccacttgtctctctgctcttaa

SEQ ID NO: 1298492 - DNA, 22 bp, Artificial Sequence
  chemically synthesized
tgaaagttaattaagagcagag

SEQ ID NO: 1298493 - DNA, 22 bp, Artificial Sequence
  chemically synthesized
taccacttgtctctctgctctt

SEQ ID NO: 1298494 - DNA, 22 bp, Artificial Sequence
  chemically synthesized
gaaagttaattaagagcagaga

SEQ ID NO: 1298495 - DNA, 22 bp, Artificial Sequence
  chemically synthesized
ctaccacttgtctctctgctct

SEQ ID NO: 1298496 - DNA, 22 bp, Artificial Sequence
  chemically synthesized
aaagttaattaagagcagagag

SEQ ID NO: 1298497 - DNA, 22 bp, Artificial Sequence
  chemically synthesized
tctaccacttgtctctctgctc

SEQ ID NO: 1298498 - DNA, 22 bp, Artificial Sequence
  chemically synthesized
ttctaccacttgtctctctgct

SEQ ID NO: 1298499 - DNA, 22 bp, Artificial Sequence
  chemically synthesized
ttttctaccacttgtctctctg

SEQ ID NO: 1298500 - DNA, 22 bp, Artificial Sequence
  chemically synthesized
tcttttctaccacttgtctctc

SEQ ID NO: 1298501 - DNA, 22 bp, Artificial Sequence
  chemically synthesized
attaagagcagagagacaagtg

SEQ ID NO: 1298502 - DNA, 22 bp, Artificial Sequence
  chemically synthesized
agagcagagagacaagtggtag

SEQ ID NO: 1298503 - DNA, 22 bp, Artificial Sequence
  chemically synthesized
gagttctcttttctaccacttg

SEQ ID NO: 1298504 - DNA, 22 bp, Artificial Sequence
  chemically synthesized
tggagttctcttttctaccact

SEQ ID NO: 1298505 - DNA, 22 bp, Artificial Sequence
  chemically synthesized
ctggagttctcttttctaccac

SEQ ID NO: 1298506 - DNA, 22 bp, Artificial Sequence
  chemically synthesized
tctggagttctcttttctacca

SEQ ID NO: 1298507 - DNA, 22 bp, Artificial Sequence
  chemically synthesized
attttctggagttctcttttct

SEQ ID NO: 1298508 - DNA, 22 bp, Artificial Sequence
  chemically synthesized
gattttctggagttctcttttc

SEQ ID NO: 1298509 - DNA, 22 bp, Artificial Sequence
  chemically synthesized
tgattttctggagttctctttt

SEQ ID NO: 1298510 - DNA, 22 bp, Artificial Sequence
  chemically synthesized
ttgattttctggagttctcttt

SEQ ID NO: 1298511 - DNA, 22 bp, Artificial Sequence
  chemically synthesized
ttttgattttctggagttctct

SEQ ID NO: 1298512 - DNA, 22 bp, Artificial Sequence
  chemically synthesized
ctcttttgattttctggagttc

SEQ ID NO: 1298513 - DNA, 22 bp, Artificial Sequence
  chemically synthesized
acctgctcttttgattttctgg

SEQ ID NO: 1298514 - DNA, 22 bp, Artificial Sequence
  chemically synthesized
cacctgctcttttgattttctg

SEQ ID NO: 1298515 - DNA, 22 bp, Artificial Sequence
  chemically synthesized
tcacctgctcttttgattttct

SEQ ID NO: 1298516 - DNA, 22 bp, Artificial Sequence
  chemically synthesized
acactttcacctgctcttttga

SEQ ID NO: 1298517 - DNA, 22 bp, Artificial Sequence
  chemically synthesized
cagaaaatcaaaagagcaggtg

SEQ ID NO: 1298518 - DNA, 22 bp, Artificial Sequence
  chemically synthesized
acatcctgacactttcacctgc

SEQ ID NO: 1298519 - DNA, 22 bp, Artificial Sequence
  chemically synthesized
tcacatcctgacactttcacct

SEQ ID NO: 1298520 - DNA, 22 bp, Artificial Sequence
  chemically synthesized
tctcacatcctgacactttcac

SEQ ID NO: 1298521 - DNA, 22 bp, Artificial Sequence
  chemically synthesized
ctctcacatcctgacactttca

SEQ ID NO: 1298522 - DNA, 22 bp, Artificial Sequence
  chemically synthesized
tctctcacatcctgacactttc

SEQ ID NO: 1298523 - DNA, 22 bp, Artificial Sequence
  chemically synthesized
tttctctcacatcctgacactt

SEQ ID NO: 1298524 - DNA, 22 bp, Artificial Sequence
  chemically synthesized
ggaaaggaccatactctttctc

SEQ ID NO: 1298525 - DNA, 22 bp, Artificial Sequence
  chemically synthesized
ggtctgggaaaggaccatactc

SEQ ID NO: 1298526 - DNA, 22 bp, Artificial Sequence
  chemically synthesized
taggtctgggaaaggaccatac

SEQ ID NO: 1298527 - DNA, 22 bp, Artificial Sequence
  chemically synthesized
caccatctctaggtctgggaaa

SEQ ID NO: 1298528 - DNA, 22 bp, Artificial Sequence
  chemically synthesized
ctccaccatctctaggtctggg

SEQ ID NO: 1298529 - DNA, 22 bp, Artificial Sequence
  chemically synthesized
tcctcctccaccatctctaggt

SEQ ID NO: 1298530 - DNA, 22 bp, Artificial Sequence
  chemically synthesized
atcctcctccaccatctctagg

SEQ ID NO: 1298531 - DNA, 22 bp, Artificial Sequence
  chemically synthesized
tatcctcctccaccatctctag

SEQ ID NO: 1298532 - DNA, 22 bp, Artificial Sequence
  chemically synthesized
ttatcctcctccaccatctcta

SEQ ID NO: 1298533 - DNA, 22 bp, Artificial Sequence
  chemically synthesized
tcccagacctagagatggtgga

SEQ ID NO: 1298534 - DNA, 22 bp, Artificial Sequence
  chemically synthesized
cccagacctagagatggtggag

SEQ ID NO: 1298535 - DNA, 22 bp, Artificial Sequence
  chemically synthesized
ccagacctagagatggtggagg

SEQ ID NO: 1298536 - DNA, 22 bp, Artificial Sequence
  chemically synthesized
ccatttttatcctcctccacca

SEQ ID NO: 1298537 - DNA, 22 bp, Artificial Sequence
  chemically synthesized
tgccatttttatcctcctccac

SEQ ID NO: 1298538 - DNA, 22 bp, Artificial Sequence
  chemically synthesized
gagatggtggaggaggataaaa

SEQ ID NO: 1298539 - DNA, 22 bp, Artificial Sequence
  chemically synthesized
gggtcatctctgccatttttat

SEQ ID NO: 1298540 - DNA, 22 bp, Artificial Sequence
  chemically synthesized
tagggtcatctctgccattttt

SEQ ID NO: 1298541 - DNA, 22 bp, Artificial Sequence
  chemically synthesized
ctagggtcatctctgccatttt

SEQ ID NO: 1298542 - DNA, 22 bp, Artificial Sequence
  chemically synthesized
tctagggtcatctctgccattt

SEQ ID NO: 1298543 - DNA, 22 bp, Artificial Sequence
  chemically synthesized
ttctagggtcatctctgccatt

SEQ ID NO: 1298544 - DNA, 22 bp, Artificial Sequence
  chemically synthesized
tttctagggtcatctctgccat

SEQ ID NO: 1298545 - DNA, 22 bp, Artificial Sequence
  chemically synthesized
actttttctagggtcatctctg

SEQ ID NO: 1298546 - DNA, 22 bp, Artificial Sequence
  chemically synthesized
cactttttctagggtcatctct

SEQ ID NO: 1298547 - DNA, 22 bp, Artificial Sequence
  chemically synthesized
atgataatttcactttttctag

SEQ ID NO: 1298548 - DNA, 22 bp, Artificial Sequence
  chemically synthesized
ataaataggttgatgataattt

SEQ ID NO: 1298549 - DNA, 22 bp, Artificial Sequence
  chemically synthesized
cataaataggttgatgataatt

SEQ ID NO: 1298550 - DNA, 22 bp, Artificial Sequence
  chemically synthesized
gaaaaagtgaaattatcatcaa

SEQ ID NO: 1298551 - DNA, 22 bp, Artificial Sequence
  chemically synthesized
ttcataaataggttgatgataa

SEQ ID NO: 1298552 - DNA, 22 bp, Artificial Sequence
  chemically synthesized
aggctcttcataaataggttga

SEQ ID NO: 1298553 - DNA, 22 bp, Artificial Sequence
  chemically synthesized
caggctcttcataaataggttg

SEQ ID NO: 1298554 - DNA, 22 bp, Artificial Sequence
  chemically synthesized
tcaggctcttcataaataggtt

SEQ ID NO: 1298555 - DNA, 22 bp, Artificial Sequence
  chemically synthesized
tattttcaggctcttcataaat

SEQ ID NO: 1298556 - DNA, 22 bp, Artificial Sequence
  chemically synthesized
tcatcaacctatttatgaagag

SEQ ID NO: 1298557 - DNA, 22 bp, Artificial Sequence
  chemically synthesized
gctatattttcaggctcttcat

SEQ ID NO: 1298558 - DNA, 22 bp, Artificial Sequence
  chemically synthesized
tggctatattttcaggctcttc

SEQ ID NO: 1298559 - DNA, 22 bp, Artificial Sequence
  chemically synthesized
ccctctggctatattttcaggc

SEQ ID NO: 1298560 - DNA, 22 bp, Artificial Sequence
  chemically synthesized
tttatgaagagcctgaaaatat

SEQ ID NO: 1298561 - DNA, 22 bp, Artificial Sequence
  chemically synthesized
atgaagagcctgaaaatatagc

SEQ ID NO: 1298562 - DNA, 22 bp, Artificial Sequence
  chemically synthesized
tgaagagcctgaaaatatagcc

SEQ ID NO: 1298563 - DNA, 22 bp, Artificial Sequence
  chemically synthesized
gaactgccctctggctatattt

SEQ ID NO: 1298564 - DNA, 22 bp, Artificial Sequence
  chemically synthesized
cgaactgccctctggctatatt

SEQ ID NO: 1298565 - DNA, 22 bp, Artificial Sequence
  chemically synthesized
atttcgaactgccctctggcta

SEQ ID NO: 1298566 - DNA, 22 bp, Artificial Sequence
  chemically synthesized
gatttcgaactgccctctggct

SEQ ID NO: 1298567 - DNA, 22 bp, Artificial Sequence
  chemically synthesized
tgatttcgaactgccctctggc

SEQ ID NO: 1298568 - DNA, 22 bp, Artificial Sequence
  chemically synthesized
ctttgatttcgaactgccctct

SEQ ID NO: 1298569 - DNA, 22 bp, Artificial Sequence
  chemically synthesized
aaaatatagccagagggcagtt

SEQ ID NO: 1298570 - DNA, 22 bp, Artificial Sequence
  chemically synthesized
tgctttgatttcgaactgccct

SEQ ID NO: 1298571 - DNA, 22 bp, Artificial Sequence
  chemically synthesized
aaattctgctttgatttcgaac

SEQ ID NO: 1298572 - DNA, 22 bp, Artificial Sequence
  chemically synthesized
aaaattctgctttgatttcgaa

SEQ ID NO: 1298573 - DNA, 22 bp, Artificial Sequence
  chemically synthesized
cttaaaattctgctttgatttc

SEQ ID NO: 1298574 - DNA, 22 bp, Artificial Sequence
  chemically synthesized
cctacttaaaattctgctttga

SEQ ID NO: 1298575 - DNA, 22 bp, Artificial Sequence
  chemically synthesized
ccctacttaaaattctgctttg

SEQ ID NO: 1298576 - DNA, 22 bp, Artificial Sequence
  chemically synthesized
tttccctacttaaaattctgct

SEQ ID NO: 1298577 - DNA, 22 bp, Artificial Sequence
  chemically synthesized
ctatttccctacttaaaattct

SEQ ID NO: 1298578 - DNA, 22 bp, Artificial Sequence
  chemically synthesized
gaaatcaaagcagaattttaag

SEQ ID NO: 1298579 - DNA, 22 bp, Artificial Sequence
  chemically synthesized
acattgctatttccctacttaa

SEQ ID NO: 1298580 - DNA, 22 bp, Artificial Sequence
  chemically synthesized
taagtagggaaatagcaatgtc

SEQ ID NO: 1298581 - DNA, 22 bp, Artificial Sequence
  chemically synthesized
aaagccaagcctgacattgcta

SEQ ID NO: 1298582 - DNA, 22 bp, Artificial Sequence
  chemically synthesized
aagtagggaaatagcaatgtca

SEQ ID NO: 1298583 - DNA, 22 bp, Artificial Sequence
  chemically synthesized
agtagggaaatagcaatgtcag

SEQ ID NO: 1298584 - DNA, 22 bp, Artificial Sequence
  chemically synthesized
taaaagccaagcctgacattgc

SEQ ID NO: 1298585 - DNA, 22 bp, Artificial Sequence
  chemically synthesized
ctaaaagccaagcctgacattg

SEQ ID NO: 1298586 - DNA, 22 bp, Artificial Sequence
  chemically synthesized
tttctaaaagccaagcctgaca

SEQ ID NO: 1298587 - DNA, 22 bp, Artificial Sequence
  chemically synthesized
atttctaaaagccaagcctgac

SEQ ID NO: 1298588 - DNA, 22 bp, Artificial Sequence
  chemically synthesized
tgaaatttatttctaaaagcca

SEQ ID NO: 1298589 - DNA, 22 bp, Artificial Sequence
  chemically synthesized
cactgtgaaatttatttctaaa

SEQ ID NO: 1298590 - DNA, 22 bp, Artificial Sequence
  chemically synthesized
tacactgtgaaatttatttcta

SEQ ID NO: 1298591 - DNA, 22 bp, Artificial Sequence
  chemically synthesized
tctacactgtgaaatttatttc

SEQ ID NO: 1298592 - DNA, 22 bp, Artificial Sequence
  chemically synthesized
ggcttttagaaataaatttcac

SEQ ID NO: 1298593 - DNA, 22 bp, Artificial Sequence
  chemically synthesized
gcttttagaaataaatttcaca

SEQ ID NO: 1298594 - DNA, 22 bp, Artificial Sequence
  chemically synthesized
ttagaaataaatttcacagtgt

SEQ ID NO: 1298595 - DNA, 22 bp, Artificial Sequence
  chemically synthesized
tagaaataaatttcacagtgta

SEQ ID NO: 1298596 - DNA, 22 bp, Artificial Sequence
  chemically synthesized
agaaataaatttcacagtgtag

SEQ ID NO: 1298597 - DNA, 22 bp, Artificial Sequence
  chemically synthesized
gaaataaatttcacagtgtaga

SEQ ID NO: 1298598 - DNA, 22 bp, Artificial Sequence
  chemically synthesized
tccccaaatattctctacactg

SEQ ID NO: 1298599 - DNA, 22 bp, Artificial Sequence
  chemically synthesized
atccccaaatattctctacact

SEQ ID NO: 1298600 - DNA, 22 bp, Artificial Sequence
  chemically synthesized
cagtttatccccaaatattctc

SEQ ID NO: 1298601 - DNA, 22 bp, Artificial Sequence
  chemically synthesized
acagtttatccccaaatattct

SEQ ID NO: 1298602 - DNA, 22 bp, Artificial Sequence
  chemically synthesized
cacagtgtagagaatatttggg

SEQ ID NO: 1298603 - DNA, 22 bp, Artificial Sequence
  chemically synthesized
acagtgtagagaatatttgggg

SEQ ID NO: 1298604 - DNA, 22 bp, Artificial Sequence
  chemically synthesized
tttacagtttatccccaaatat

SEQ ID NO: 1298605 - DNA, 22 bp, Artificial Sequence
  chemically synthesized
atttacagtttatccccaaata

SEQ ID NO: 1298606 - DNA, 22 bp, Artificial Sequence
  chemically synthesized
ttatttacagtttatccccaaa

SEQ ID NO: 1298607 - DNA, 22 bp, Artificial Sequence
  chemically synthesized
cttatttacagtttatccccaa

SEQ ID NO: 1298608 - DNA, 22 bp, Artificial Sequence
  chemically synthesized
atgtgtcttcttatttacagtt

SEQ ID NO: 1298609 - DNA, 22 bp, Artificial Sequence
  chemically synthesized
ggggataaactgtaaataagaa

SEQ ID NO: 1298610 - DNA, 22 bp, Artificial Sequence
  chemically synthesized
gggataaactgtaaataagaag

SEQ ID NO: 1298611 - DNA, 22 bp, Artificial Sequence
  chemically synthesized
taggtataatcagctcatgtgt

SEQ ID NO: 1298612 - DNA, 22 bp, Artificial Sequence
  chemically synthesized
taaataagaagacacatgagct

SEQ ID NO: 1298613 - DNA, 22 bp, Artificial Sequence
  chemically synthesized
acgtggattataggtataatca

SEQ ID NO: 1298614 - DNA, 22 bp, Artificial Sequence
  chemically synthesized
tcacgtggattataggtataat

SEQ ID NO: 1298615 - DNA, 22 bp, Artificial Sequence
  chemically synthesized
ctcacgtggattataggtataa

SEQ ID NO: 1298616 - DNA, 22 bp, Artificial Sequence
  chemically synthesized
cttctcacgtggattataggta

SEQ ID NO: 1298617 - DNA, 22 bp, Artificial Sequence
  chemically synthesized
acttctcacgtggattataggt

SEQ ID NO: 1298618 - DNA, 22 bp, Artificial Sequence
  chemically synthesized
attatacctataatccacgtga

SEQ ID NO: 1298619 - DNA, 22 bp, Artificial Sequence
  chemically synthesized
tacctataatccacgtgagaag

SEQ ID NO: 1298620 - DNA, 22 bp, Artificial Sequence
  chemically synthesized
atgcaagtcatgcttacttctc

SEQ ID NO: 1298621 - DNA, 22 bp, Artificial Sequence
  chemically synthesized
taatccacgtgagaagtaagca

SEQ ID NO: 1298622 - DNA, 22 bp, Artificial Sequence
  chemically synthesized
attaatgcaagtcatgcttact

SEQ ID NO: 1298623 - DNA, 22 bp, Artificial Sequence
  chemically synthesized
ccattcattaatgcaagtcatg

SEQ ID NO: 1298624 - DNA, 22 bp, Artificial Sequence
  chemically synthesized
cagccccactgccattcattaa

SEQ ID NO: 1298625 - DNA, 22 bp, Artificial Sequence
  chemically synthesized
ccagccccactgccattcatta

SEQ ID NO: 1298626 - DNA, 22 bp, Artificial Sequence
  chemically synthesized
tccagccccactgccattcatt

SEQ ID NO: 1298627 - DNA, 22 bp, Artificial Sequence
  chemically synthesized
ttccagccccactgccattcat

SEQ ID NO: 1298628 - DNA, 22 bp, Artificial Sequence
  chemically synthesized
cttttccagccccactgccatt

SEQ ID NO: 1298629 - DNA, 22 bp, Artificial Sequence
  chemically synthesized
gcattaatgaatggcagtgggg

SEQ ID NO: 1298630 - DNA, 22 bp, Artificial Sequence
  chemically synthesized
ctccttttccagccccactgcc

SEQ ID NO: 1298631 - DNA, 22 bp, Artificial Sequence
  chemically synthesized
cattaatgaatggcagtggggc

SEQ ID NO: 1298632 - DNA, 22 bp, Artificial Sequence
  chemically synthesized
atgaatggcagtggggctggaa

SEQ ID NO: 1298633 - DNA, 22 bp, Artificial Sequence
  chemically synthesized
aatgcacctactccttttccag

SEQ ID NO: 1298634 - DNA, 22 bp, Artificial Sequence
  chemically synthesized
gaatgcacctactccttttcca

SEQ ID NO: 1298635 - DNA, 22 bp, Artificial Sequence
  chemically synthesized
gaaaaggagtaggtgcattcaa

SEQ ID NO: 1298636 - DNA, 22 bp, Artificial Sequence
  chemically synthesized
ccccgtaaacacatcttgaatg

SEQ ID NO: 1298637 - DNA, 22 bp, Artificial Sequence
  chemically synthesized
ccaatactaccccgtaaacaca

SEQ ID NO: 1298638 - DNA, 22 bp, Artificial Sequence
  chemically synthesized
accaatactaccccgtaaacac

SEQ ID NO: 1298639 - DNA, 22 bp, Artificial Sequence
  chemically synthesized
gtacttaccaatactaccccgt

SEQ ID NO: 1298640 - DNA, 22 bp, Artificial Sequence
  chemically synthesized
aagatgtgtttacggggtagta

SEQ ID NO: 1298641 - DNA, 22 bp, Artificial Sequence
  chemically synthesized
ataattagtacttaccaatact

SEQ ID NO: 1298642 - DNA, 22 bp, Artificial Sequence
  chemically synthesized
acggggtagtattggtaagtac

SEQ ID NO: 1298643 - DNA, 22 bp, Artificial Sequence
  chemically synthesized
cggggtagtattggtaagtact

SEQ ID NO: 1298644 - DNA, 22 bp, Artificial Sequence
  chemically synthesized
cacatataattaataattagta

SEQ ID NO: 1298645 - DNA, 22 bp, Artificial Sequence
  chemically synthesized
actccacatataattaataatt

SEQ ID NO: 1298646 - DNA, 22 bp, Artificial Sequence
  chemically synthesized
gtaagtactaattattaattat

SEQ ID NO: 1298647 - DNA, 22 bp, Artificial Sequence
  chemically synthesized
ccctaactccacatataattaa

SEQ ID NO: 1298648 - DNA, 22 bp, Artificial Sequence
  chemically synthesized
attattaattatatgtggagtt

SEQ ID NO: 1298649 - DNA, 22 bp, Artificial Sequence
  chemically synthesized
ttaattatatgtggagttaggg

SEQ ID NO: 1298650 - DNA, 22 bp, Artificial Sequence
  chemically synthesized
attatatgtggagttaggggag

SEQ ID NO: 1298651 - DNA, 22 bp, Artificial Sequence
  chemically synthesized
tccatgatccaactcccctaac

SEQ ID NO: 1298652 - DNA, 22 bp, Artificial Sequence
  chemically synthesized
tatgtggagttaggggagttgg

SEQ ID NO: 1298653 - DNA, 22 bp, Artificial Sequence
  chemically synthesized
attatccatgatccaactcccc

SEQ ID NO: 1298654 - DNA, 22 bp, Artificial Sequence
  chemically synthesized
tcattgattatccatgatccaa

SEQ ID NO: 1298655 - DNA, 22 bp, Artificial Sequence
  chemically synthesized
atcattgattatccatgatcca

SEQ ID NO: 1298656 - DNA, 22 bp, Artificial Sequence
  chemically synthesized
tatcattgattatccatgatcc

SEQ ID NO: 1298657 - DNA, 22 bp, Artificial Sequence
  chemically synthesized
ggggagttggatcatggataat

SEQ ID NO: 1298658 - DNA, 22 bp, Artificial Sequence
  chemically synthesized
gctttatcattgattatccatg

SEQ ID NO: 1298659 - DNA, 22 bp, Artificial Sequence
  chemically synthesized
agctttatcattgattatccat

SEQ ID NO: 1298660 - DNA, 22 bp, Artificial Sequence
  chemically synthesized
gatcatggataatcaatgataa

SEQ ID NO: 1298661 - DNA, 22 bp, Artificial Sequence
  chemically synthesized
catcagggaatttagctttatc

SEQ ID NO: 1298662 - DNA, 22 bp, Artificial Sequence
  chemically synthesized
tccatcagggaatttagcttta

SEQ ID NO: 1298663 - DNA, 22 bp, Artificial Sequence
  chemically synthesized
ctccatcagggaatttagcttt

SEQ ID NO: 1298664 - DNA, 22 bp, Artificial Sequence
  chemically synthesized
tagtttctccatcagggaattt

SEQ ID NO: 1298665 - DNA, 22 bp, Artificial Sequence
  chemically synthesized
taacagaactgtagtttctcca

SEQ ID NO: 1298666 - DNA, 22 bp, Artificial Sequence
  chemically synthesized
aattccctgatggagaaactac

SEQ ID NO: 1298667 - DNA, 22 bp, Artificial Sequence
  chemically synthesized
cctgatggagaaactacagttc

SEQ ID NO: 1298668 - DNA, 22 bp, Artificial Sequence
  chemically synthesized
atggagaaactacagttctgtt

SEQ ID NO: 1298669 - DNA, 22 bp, Artificial Sequence
  chemically synthesized
atatatgattgtaacagaactg

SEQ ID NO: 1298670 - DNA, 22 bp, Artificial Sequence
  chemically synthesized
aatatatgattgtaacagaact

SEQ ID NO: 1298671 - DNA, 22 bp, Artificial Sequence
  chemically synthesized
ttaatatatgattgtaacagaa

SEQ ID NO: 1298672 - DNA, 22 bp, Artificial Sequence
  chemically synthesized
tcttaatatatgattgtaacag

SEQ ID NO: 1298673 - DNA, 22 bp, Artificial Sequence
  chemically synthesized
gttctcttaatatatgattgta

SEQ ID NO: 1298674 - DNA, 22 bp, Artificial Sequence
  chemically synthesized
cagttctgttacaatcatatat

SEQ ID NO: 1298675 - DNA, 22 bp, Artificial Sequence
  chemically synthesized
aagttagttctcttaatatatg

SEQ ID NO: 1298676 - DNA, 22 bp, Artificial Sequence
  chemically synthesized
caagttagttctcttaatatat

SEQ ID NO: 1298677 - DNA, 22 bp, Artificial Sequence
  chemically synthesized
tcaagttagttctcttaatata

SEQ ID NO: 1298678 - DNA, 22 bp, Artificial Sequence
  chemically synthesized
tgttacaatcatatattaagag

SEQ ID NO: 1298679 - DNA, 22 bp, Artificial Sequence
  chemically synthesized
ttcaagttagttctcttaatat

SEQ ID NO: 1298680 - DNA, 22 bp, Artificial Sequence
  chemically synthesized
ttacaatcatatattaagagaa

SEQ ID NO: 1298681 - DNA, 22 bp, Artificial Sequence
  chemically synthesized
caatcatatattaagagaacta

SEQ ID NO: 1298682 - DNA, 22 bp, Artificial Sequence
  chemically synthesized
gatttttcaagttagttctctt

SEQ ID NO: 1298683 - DNA, 22 bp, Artificial Sequence
  chemically synthesized
tggatttttcaagttagttctc

SEQ ID NO: 1298684 - DNA, 22 bp, Artificial Sequence
  chemically synthesized
agagaactaacttgaaaaatcc

SEQ ID NO: 1298685 - DNA, 22 bp, Artificial Sequence
  chemically synthesized
atcagagaagctctggattttt

SEQ ID NO: 1298686 - DNA, 22 bp, Artificial Sequence
  chemically synthesized
acttgaaaaatccagagcttct

SEQ ID NO: 1298687 - DNA, 22 bp, Artificial Sequence
  chemically synthesized
taacctcatcagagaagctctg

SEQ ID NO: 1298688 - DNA, 22 bp, Artificial Sequence
  chemically synthesized
gaaaaatccagagcttctctga

SEQ ID NO: 1298689 - DNA, 22 bp, Artificial Sequence
  chemically synthesized
aaaaatccagagcttctctgat

SEQ ID NO: 1298690 - DNA, 22 bp, Artificial Sequence
  chemically synthesized
gcctgtaacctcatcagagaag

SEQ ID NO: 1298691 - DNA, 22 bp, Artificial Sequence
  chemically synthesized
aataatctagcctgtaacctca

SEQ ID NO: 1298692 - DNA, 22 bp, Artificial Sequence
  chemically synthesized
tgaataatctagcctgtaacct

SEQ ID NO: 1298693 - DNA, 22 bp, Artificial Sequence
  chemically synthesized
ctctgatgaggttacaggctag

SEQ ID NO: 1298694 - DNA, 22 bp, Artificial Sequence
  chemically synthesized
tctgatgaggttacaggctaga

SEQ ID NO: 1298695 - DNA, 22 bp, Artificial Sequence
  chemically synthesized
tgatgaggttacaggctagatt

SEQ ID NO: 1298696 - DNA, 22 bp, Artificial Sequence
  chemically synthesized
atgaggttacaggctagattat

SEQ ID NO: 1298697 - DNA, 22 bp, Artificial Sequence
  chemically synthesized
tatgccattctgaataatctag

SEQ ID NO: 1298698 - DNA, 22 bp, Artificial Sequence
  chemically synthesized
atatgccattctgaataatcta

SEQ ID NO: 1298699 - DNA, 22 bp, Artificial Sequence
  chemically synthesized
caggctagattattcagaatgg

SEQ ID NO: 1298700 - DNA, 22 bp, Artificial Sequence
  chemically synthesized
tgaaggcccttatatgccattc

SEQ ID NO: 1298701 - DNA, 22 bp, Artificial Sequence
  chemically synthesized
gattattcagaatggcatataa

SEQ ID NO: 1298702 - DNA, 22 bp, Artificial Sequence
  chemically synthesized
ttcagaatggcatataagggcc

SEQ ID NO: 1298703 - DNA, 22 bp, Artificial Sequence
  chemically synthesized
agaatggcatataagggccttc

SEQ ID NO: 1298704 - DNA, 22 bp, Artificial Sequence
  chemically synthesized
gagtcaaattgtgaaggccctt

SEQ ID NO: 1298705 - DNA, 22 bp, Artificial Sequence
  chemically synthesized
gaggagtacactggagtcaaat

SEQ ID NO: 1298706 - DNA, 22 bp, Artificial Sequence
  chemically synthesized
agaggagtacactggagtcaaa

SEQ ID NO: 1298707 - DNA, 22 bp, Artificial Sequence
  chemically synthesized
cacaatttgactccagtgtact

SEQ ID NO: 1298708 - DNA, 22 bp, Artificial Sequence
  chemically synthesized
acaatttgactccagtgtactc

SEQ ID NO: 1298709 - DNA, 22 bp, Artificial Sequence
  chemically synthesized
gactccagtgtactcctctaaa

SEQ ID NO: 1298710 - DNA, 22 bp, Artificial Sequence
  chemically synthesized
atcgataatatgtttagaggag

SEQ ID NO: 1298711 - DNA, 22 bp, Artificial Sequence
  chemically synthesized
actccagtgtactcctctaaac

SEQ ID NO: 1298712 - DNA, 22 bp, Artificial Sequence
  chemically synthesized
cagtgtactcctctaaacatat

SEQ ID NO: 1298713 - DNA, 22 bp, Artificial Sequence
  chemically synthesized
ccaacaggcctaatcgataata

SEQ ID NO: 1298714 - DNA, 22 bp, Artificial Sequence
  chemically synthesized
ctctaaacatattatcgattag

SEQ ID NO: 1298715 - DNA, 22 bp, Artificial Sequence
  chemically synthesized
taaacatattatcgattaggcc

SEQ ID NO: 1298716 - DNA, 22 bp, Artificial Sequence
  chemically synthesized
aacatattatcgattaggcctg

SEQ ID NO: 1298717 - DNA, 22 bp, Artificial Sequence
  chemically synthesized
ggatatgggtgactgccaacag

SEQ ID NO: 1298718 - DNA, 22 bp, Artificial Sequence
  chemically synthesized
gggatatgggtgactgccaaca

SEQ ID NO: 1298719 - DNA, 22 bp, Artificial Sequence
  chemically synthesized
tcgattaggcctgttggcagtc

SEQ ID NO: 1298720 - DNA, 22 bp, Artificial Sequence
  chemically synthesized
ggcctgttggcagtcacccata

SEQ ID NO: 1298721 - DNA, 22 bp, Artificial Sequence
  chemically synthesized
ttggcagtcacccatatcccaa

SEQ ID NO: 1298722 - DNA, 22 bp, Artificial Sequence
  chemically synthesized
gcagtcacccatatcccaaacc

SEQ ID NO: 1298723 - DNA, 22 bp, Artificial Sequence
  chemically synthesized
gtagatgtatataaggtttggg

SEQ ID NO: 1298724 - DNA, 22 bp, Artificial Sequence
  chemically synthesized
aggcagacctggtagatgtata

SEQ ID NO: 1298725 - DNA, 22 bp, Artificial Sequence
  chemically synthesized
tgtgactaaggcagacctggta

SEQ ID NO: 1298726 - DNA, 22 bp, Artificial Sequence
  chemically synthesized
gtgtgactaaggcagacctggt

SEQ ID NO: 1298727 - DNA, 22 bp, Artificial Sequence
  chemically synthesized
atatacatctaccaggtctgcc

SEQ ID NO: 1298728 - DNA, 22 bp, Artificial Sequence
  chemically synthesized
tatacatctaccaggtctgcct

SEQ ID NO: 1298729 - DNA, 22 bp, Artificial Sequence
  chemically synthesized
gcttgtgtgactaaggcagacc

SEQ ID NO: 1298730 - DNA, 22 bp, Artificial Sequence
  chemically synthesized
ggcttgtgtgactaaggcagac

SEQ ID NO: 1298731 - DNA, 22 bp, Artificial Sequence
  chemically synthesized
ccaggtctgccttagtcacaca

SEQ ID NO: 1298732 - DNA, 22 bp, Artificial Sequence
  chemically synthesized
tggagaaatttggcttgtgtga

SEQ ID NO: 1298733 - DNA, 22 bp, Artificial Sequence
  chemically synthesized
atggagaaatttggcttgtgtg

SEQ ID NO: 1298734 - DNA, 22 bp, Artificial Sequence
  chemically synthesized
tttatggagaaatttggcttgt

SEQ ID NO: 1298735 - DNA, 22 bp, Artificial Sequence
  chemically synthesized
atttatggagaaatttggcttg

SEQ ID NO: 1298736 - DNA, 22 bp, Artificial Sequence
  chemically synthesized
ccttagtcacacaagccaaatt

SEQ ID NO: 1298737 - DNA, 22 bp, Artificial Sequence
  chemically synthesized
agtcacacaagccaaatttctc

SEQ ID NO: 1298738 - DNA, 22 bp, Artificial Sequence
  chemically synthesized
gtcacacaagccaaatttctcc

SEQ ID NO: 1298739 - DNA, 22 bp, Artificial Sequence
  chemically synthesized
aagcaagaaagcatatgattta

SEQ ID NO: 1298740 - DNA, 22 bp, Artificial Sequence
  chemically synthesized
ctccataaataaatcatatgct

SEQ ID NO: 1298741 - DNA, 22 bp, Artificial Sequence
  chemically synthesized
tccataaataaatcatatgctt

SEQ ID NO: 1298742 - DNA, 22 bp, Artificial Sequence
  chemically synthesized
cataaataaatcatatgctttc

SEQ ID NO: 1298743 - DNA, 22 bp, Artificial Sequence
  chemically synthesized
gggagtgcatgaacaaaggact

SEQ ID NO: 1298744 - DNA, 22 bp, Artificial Sequence
  chemically synthesized
tagggagtgcatgaacaaagga

SEQ ID NO: 1298745 - DNA, 22 bp, Artificial Sequence
  chemically synthesized
tcttgctttagtcctttgttca

SEQ ID NO: 1298746 - DNA, 22 bp, Artificial Sequence
  chemically synthesized
cttgctttagtcctttgttcat

SEQ ID NO: 1298747 - DNA, 22 bp, Artificial Sequence
  chemically synthesized
ttgctttagtcctttgttcatg

SEQ ID NO: 1298748 - DNA, 22 bp, Artificial Sequence
  chemically synthesized
attctagggagtgcatgaacaa

SEQ ID NO: 1298749 - DNA, 22 bp, Artificial Sequence
  chemically synthesized
gctttagtcctttgttcatgca

SEQ ID NO: 1298750 - DNA, 22 bp, Artificial Sequence
  chemically synthesized
ctttagtcctttgttcatgcac

SEQ ID NO: 1298751 - DNA, 22 bp, Artificial Sequence
  chemically synthesized
tagtcctttgttcatgcactcc

SEQ ID NO: 1298752 - DNA, 22 bp, Artificial Sequence
  chemically synthesized
agtcctttgttcatgcactccc

SEQ ID NO: 1298753 - DNA, 22 bp, Artificial Sequence
  chemically synthesized
gtcctttgttcatgcactccct

SEQ ID NO: 1298754 - DNA, 22 bp, Artificial Sequence
  chemically synthesized
tgttcatgcactccctagaatg

SEQ ID NO: 1298755 - DNA, 22 bp, Artificial Sequence
  chemically synthesized
gttcatgcactccctagaatga

SEQ ID NO: 1298756 - DNA, 22 bp, Artificial Sequence
  chemically synthesized
ttcatgcactccctagaatgag

SEQ ID NO: 1298757 - DNA, 22 bp, Artificial Sequence
  chemically synthesized
atagtgagtgtcctcattctag

SEQ ID NO: 1298758 - DNA, 22 bp, Artificial Sequence
  chemically synthesized
aatagtgagtgtcctcattcta

SEQ ID NO: 1298759 - DNA, 22 bp, Artificial Sequence
  chemically synthesized
atgcactccctagaatgaggac

SEQ ID NO: 1298760 - DNA, 22 bp, Artificial Sequence
  chemically synthesized
gatcttaatagtgagtgtcctc

SEQ ID NO: 1298761 - DNA, 22 bp, Artificial Sequence
  chemically synthesized
cctagaatgaggacactcacta

SEQ ID NO: 1298762 - DNA, 22 bp, Artificial Sequence
  chemically synthesized
gacctagatcttaatagtgagt

SEQ ID NO: 1298763 - DNA, 22 bp, Artificial Sequence
  chemically synthesized
gaatgaggacactcactattaa

SEQ ID NO: 1298764 - DNA, 22 bp, Artificial Sequence
  chemically synthesized
acattcgacctagatcttaata

SEQ ID NO: 1298765 - DNA, 22 bp, Artificial Sequence
  chemically synthesized
actattaagatctaggtcgaat

SEQ ID NO: 1298766 - DNA, 22 bp, Artificial Sequence
  chemically synthesized
tgaaaaccctcacattcgacct

SEQ ID NO: 1298767 - DNA, 22 bp, Artificial Sequence
  chemically synthesized
ttaagatctaggtcgaatgtga

SEQ ID NO: 1298768 - DNA, 22 bp, Artificial Sequence
  chemically synthesized
agatctaggtcgaatgtgaggg

SEQ ID NO: 1298769 - DNA, 22 bp, Artificial Sequence
  chemically synthesized
ggtcgaatgtgagggttttcac

SEQ ID NO: 1298770 - DNA, 22 bp, Artificial Sequence
  chemically synthesized
tgccagggagataagtgtgatt

SEQ ID NO: 1298771 - DNA, 22 bp, Artificial Sequence
  chemically synthesized
tcacaatcacacttatctccct

SEQ ID NO: 1298772 - DNA, 22 bp, Artificial Sequence
  chemically synthesized
ataagttatgccagggagataa

SEQ ID NO: 1298773 - DNA, 22 bp, Artificial Sequence
  chemically synthesized
cacaatcacacttatctccctg

SEQ ID NO: 1298774 - DNA, 22 bp, Artificial Sequence
  chemically synthesized
acaatcacacttatctccctgg

SEQ ID NO: 1298775 - DNA, 22 bp, Artificial Sequence
  chemically synthesized
attgataagttatgccagggag

SEQ ID NO: 1298776 - DNA, 22 bp, Artificial Sequence
  chemically synthesized
atctccctggcataacttatca

SEQ ID NO: 1298777 - DNA, 22 bp, Artificial Sequence
  chemically synthesized
tctccctggcataacttatcaa

SEQ ID NO: 1298778 - DNA, 22 bp, Artificial Sequence
  chemically synthesized
cctggcataacttatcaatcaa

SEQ ID NO: 1298779 - DNA, 22 bp, Artificial Sequence
  chemically synthesized
gcataacttatcaatcaatcct

SEQ ID NO: 1298780 - DNA, 22 bp, Artificial Sequence
  chemically synthesized
cacatatgtatatatcagaagg

SEQ ID NO: 1298781 - DNA, 22 bp, Artificial Sequence
  chemically synthesized
atcaatcaatccttctgatata

SEQ ID NO: 1298782 - DNA, 22 bp, Artificial Sequence
  chemically synthesized
tcaatcaatccttctgatatat

SEQ ID NO: 1298783 - DNA, 22 bp, Artificial Sequence
  chemically synthesized
gaaaaaagcctacacatatgta

SEQ ID NO: 1298784 - DNA, 22 bp, Artificial Sequence
  chemically synthesized
ctgatatatacatatgtgtagg

SEQ ID NO: 1298785 - DNA, 22 bp, Artificial Sequence
  chemically synthesized
tgatatatacatatgtgtaggc

SEQ ID NO: 1298786 - DNA, 22 bp, Artificial Sequence
  chemically synthesized
atatatacatatgtgtaggctt

SEQ ID NO: 1298787 - DNA, 22 bp, Artificial Sequence
  chemically synthesized
tgtgtgtaacacatatgcataa

SEQ ID NO: 1298788 - DNA, 22 bp, Artificial Sequence
  chemically synthesized
atgtgtgtaacacatatgcata

SEQ ID NO: 1298789 - DNA, 22 bp, Artificial Sequence
  chemically synthesized
ttttctaattatgcatatgtgt

SEQ ID NO: 1298790 - DNA, 22 bp, Artificial Sequence
  chemically synthesized
tttctaattatgcatatgtgtt

SEQ ID NO: 1298791 - DNA, 22 bp, Artificial Sequence
  chemically synthesized
ttctaattatgcatatgtgtta

SEQ ID NO: 1298792 - DNA, 22 bp, Artificial Sequence
  chemically synthesized
tctaattatgcatatgtgttac

SEQ ID NO: 1298793 - DNA, 22 bp, Artificial Sequence
  chemically synthesized
ctaattatgcatatgtgttaca

SEQ ID NO: 1298794 - DNA, 22 bp, Artificial Sequence
  chemically synthesized
taattatgcatatgtgttacac

SEQ ID NO: 1298795 - DNA, 22 bp, Artificial Sequence
  chemically synthesized
aagtatttatgtgtgtaacaca

SEQ ID NO: 1298796 - DNA, 22 bp, Artificial Sequence
  chemically synthesized
attatgcatatgtgttacacac

SEQ ID NO: 1298797 - DNA, 22 bp, Artificial Sequence
  chemically synthesized
tgcatatgtgttacacacataa

SEQ ID NO: 1298798 - DNA, 22 bp, Artificial Sequence
  chemically synthesized
cacacataaatactttaactgt

SEQ ID NO: 1298799 - DNA, 22 bp, Artificial Sequence
  chemically synthesized
tgtgtccatacacatacagtta

SEQ ID NO: 1298800 - DNA, 22 bp, Artificial Sequence
  chemically synthesized
aagtatctgtgtgtccatacac

SEQ ID NO: 1298801 - DNA, 22 bp, Artificial Sequence
  chemically synthesized
taactgtatgtgtatggacaca

SEQ ID NO: 1298802 - DNA, 22 bp, Artificial Sequence
  chemically synthesized
aactgtatgtgtatggacacac

SEQ ID NO: 1298803 - DNA, 22 bp, Artificial Sequence
  chemically synthesized
actgtatgtgtatggacacaca

SEQ ID NO: 1298804 - DNA, 22 bp, Artificial Sequence
  chemically synthesized
tatgtgtatggacacacagata

SEQ ID NO: 1298805 - DNA, 22 bp, Artificial Sequence
  chemically synthesized
taatgcacacacaattaaagta

SEQ ID NO: 1298806 - DNA, 22 bp, Artificial Sequence
  chemically synthesized
taaattataatgcacacacaat

SEQ ID NO: 1298807 - DNA, 22 bp, Artificial Sequence
  chemically synthesized
ataaattataatgcacacacaa

SEQ ID NO: 1298808 - DNA, 22 bp, Artificial Sequence
  chemically synthesized
tataaattataatgcacacaca

SEQ ID NO: 1298809 - DNA, 22 bp, Artificial Sequence
  chemically synthesized
taattgtgtgtgcattataatt

SEQ ID NO: 1298810 - DNA, 22 bp, Artificial Sequence
  chemically synthesized
aattgtgtgtgcattataattt

SEQ ID NO: 1298811 - DNA, 22 bp, Artificial Sequence
  chemically synthesized
aaatcactttataaattataat

SEQ ID NO: 1298812 - DNA, 22 bp, Artificial Sequence
  chemically synthesized
attgtgtgtgcattataattta

SEQ ID NO: 1298813 - DNA, 22 bp, Artificial Sequence
  chemically synthesized
gaaatcactttataaattataa

SEQ ID NO: 1298814 - DNA, 22 bp, Artificial Sequence
  chemically synthesized
tgtgtgcattataatttataaa

SEQ ID NO: 1298815 - DNA, 22 bp, Artificial Sequence
  chemically synthesized
taatttataaagtgatttcaaa

SEQ ID NO: 1298816 - DNA, 22 bp, Artificial Sequence
  chemically synthesized
ataaagtgatttcaaatatctc

SEQ ID NO: 1298817 - DNA, 22 bp, Artificial Sequence
  chemically synthesized
taaagtgatttcaaatatctca

SEQ ID NO: 1298818 - DNA, 22 bp, Artificial Sequence
  chemically synthesized
caaatatctcatcttgcttaca

SEQ ID NO: 1298819 - DNA, 22 bp, Artificial Sequence
  chemically synthesized
aaatatctcatcttgcttacac

SEQ ID NO: 1298820 - DNA, 22 bp, Artificial Sequence
  chemically synthesized
atcttgcttacactcacacata

SEQ ID NO: 1298821 - DNA, 22 bp, Artificial Sequence
  chemically synthesized
tgtgtgtgtatgtgtgtatgtg

SEQ ID NO: 1298822 - DNA, 22 bp, Artificial Sequence
  chemically synthesized
gcttacactcacacatacacac

SEQ ID NO: 1298823 - DNA, 22 bp, Artificial Sequence
  chemically synthesized
gtgtgtgtgtatgtgtgtatgt

SEQ ID NO: 1298824 - DNA, 22 bp, Artificial Sequence
  chemically synthesized
cttacactcacacatacacaca

SEQ ID NO: 1298825 - DNA, 22 bp, Artificial Sequence
  chemically synthesized
tttgtgtgtgtgtatgtgtgta

SEQ ID NO: 1298826 - DNA, 22 bp, Artificial Sequence
  chemically synthesized
acactcacacatacacacatac

SEQ ID NO: 1298827 - DNA, 22 bp, Artificial Sequence
  chemically synthesized
cactcacacatacacacataca

SEQ ID NO: 1298828 - DNA, 22 bp, Artificial Sequence
  chemically synthesized
tgtttgtgtgtgtgtatgtgtg

SEQ ID NO: 1298829 - DNA, 22 bp, Artificial Sequence
  chemically synthesized
ctgtttgtgtgtgtgtatgtgt

SEQ ID NO: 1298830 - DNA, 22 bp, Artificial Sequence
  chemically synthesized
tctgtttgtgtgtgtgtatgtg

SEQ ID NO: 1298831 - DNA, 22 bp, Artificial Sequence
  chemically synthesized
acacatacacacatacacacac

SEQ ID NO: 1298832 - DNA, 22 bp, Artificial Sequence
  chemically synthesized
attttctgtttgtgtgtgtgta

SEQ ID NO: 1298833 - DNA, 22 bp, Artificial Sequence
  chemically synthesized
gaagacaacaaactaattttct

SEQ ID NO: 1298834 - DNA, 22 bp, Artificial Sequence
  chemically synthesized
ttggaagacaacaaactaattt

SEQ ID NO: 1298835 - DNA, 22 bp, Artificial Sequence
  chemically synthesized
cattattggaagacaacaaact

SEQ ID NO: 1298836 - DNA, 22 bp, Artificial Sequence
  chemically synthesized
ggctgcattattggaagacaac

SEQ ID NO: 1298837 - DNA, 22 bp, Artificial Sequence
  chemically synthesized
gggctgcattattggaagacaa

SEQ ID NO: 1298838 - DNA, 22 bp, Artificial Sequence
  chemically synthesized
gtttgttgtcttccaataatgc

SEQ ID NO: 1298839 - DNA, 22 bp, Artificial Sequence
  chemically synthesized
gttgtcttccaataatgcagcc

SEQ ID NO: 1298840 - DNA, 22 bp, Artificial Sequence
  chemically synthesized
ttgtcttccaataatgcagccc

SEQ ID NO: 1298841 - DNA, 22 bp, Artificial Sequence
  chemically synthesized
tcttccaataatgcagcccaaa

SEQ ID NO: 1298842 - DNA, 22 bp, Artificial Sequence
  chemically synthesized
ccaataatgcagcccaaatccc

SEQ ID NO: 1298843 - DNA, 22 bp, Artificial Sequence
  chemically synthesized
caataatgcagcccaaatccca

SEQ ID NO: 1298844 - DNA, 22 bp, Artificial Sequence
  chemically synthesized
ggaggtaatgagtgggatttgg

SEQ ID NO: 1298845 - DNA, 22 bp, Artificial Sequence
  chemically synthesized
aggaggtaatgagtgggatttg

SEQ ID NO: 1298846 - DNA, 22 bp, Artificial Sequence
  chemically synthesized
agtgtggtcacatttaggaggt

SEQ ID NO: 1298847 - DNA, 22 bp, Artificial Sequence
  chemically synthesized
ccatctaagtgtggtcacattt

SEQ ID NO: 1298848 - DNA, 22 bp, Artificial Sequence
  chemically synthesized
attacctcctaaatgtgaccac

SEQ ID NO: 1298849 - DNA, 22 bp, Artificial Sequence
  chemically synthesized
tcccatctaagtgtggtcacat

SEQ ID NO: 1298850 - DNA, 22 bp, Artificial Sequence
  chemically synthesized
cctcctaaatgtgaccacactt

SEQ ID NO: 1298851 - DNA, 22 bp, Artificial Sequence
  chemically synthesized
ctaaatgtgaccacacttagat

SEQ ID NO: 1298852 - DNA, 22 bp, Artificial Sequence
  chemically synthesized
aatgtgaccacacttagatggg

SEQ ID NO: 1298853 - DNA, 22 bp, Artificial Sequence
  chemically synthesized
caaagacataataattctccca

SEQ ID NO: 1298854 - DNA, 22 bp, Artificial Sequence
  chemically synthesized
agatgggagaattattatgtct

SEQ ID NO: 1298855 - DNA, 22 bp, Artificial Sequence
  chemically synthesized
gatgggagaattattatgtctt

SEQ ID NO: 1298856 - DNA, 22 bp, Artificial Sequence
  chemically synthesized
gtgccaggagttgcaaagacat

SEQ ID NO: 1298857 - DNA, 22 bp, Artificial Sequence
  chemically synthesized
ggtgccaggagttgcaaagaca

SEQ ID NO: 1298858 - DNA, 22 bp, Artificial Sequence
  chemically synthesized
ttatgtctttgcaactcctggc

SEQ ID NO: 1298859 - DNA, 22 bp, Artificial Sequence
  chemically synthesized
tgtctttgcaactcctggcacc

SEQ ID NO: 1298860 - DNA, 22 bp, Artificial Sequence
  chemically synthesized
agtataccatgtttggtgccag

SEQ ID NO: 1298861 - DNA, 22 bp, Artificial Sequence
  chemically synthesized
cagtataccatgtttggtgcca

SEQ ID NO: 1298862 - DNA, 22 bp, Artificial Sequence
  chemically synthesized
tgcaactcctggcaccaaacat

SEQ ID NO: 1298863 - DNA, 22 bp, Artificial Sequence
  chemically synthesized
cttcagtataccatgtttggtg

SEQ ID NO: 1298864 - DNA, 22 bp, Artificial Sequence
  chemically synthesized
gcaactcctggcaccaaacatg

SEQ ID NO: 1298865 - DNA, 22 bp, Artificial Sequence
  chemically synthesized
caactcctggcaccaaacatgg

SEQ ID NO: 1298866 - DNA, 22 bp, Artificial Sequence
  chemically synthesized
tgcttcagtataccatgtttgg

SEQ ID NO: 1298867 - DNA, 22 bp, Artificial Sequence
  chemically synthesized
ctgcttcagtataccatgtttg

SEQ ID NO: 1298868 - DNA, 22 bp, Artificial Sequence
  chemically synthesized
tttctgcttcagtataccatgt

SEQ ID NO: 1298869 - DNA, 22 bp, Artificial Sequence
  chemically synthesized
ctggcaccaaacatggtatact

SEQ ID NO: 1298870 - DNA, 22 bp, Artificial Sequence
  chemically synthesized
gcaccaaacatggtatactgaa

SEQ ID NO: 1298871 - DNA, 22 bp, Artificial Sequence
  chemically synthesized
agtacctatttctgcttcagta

SEQ ID NO: 1298872 - DNA, 22 bp, Artificial Sequence
  chemically synthesized
ctaagtacctatttctgcttca

SEQ ID NO: 1298873 - DNA, 22 bp, Artificial Sequence
  chemically synthesized
actaagtacctatttctgcttc

SEQ ID NO: 1298874 - DNA, 22 bp, Artificial Sequence
  chemically synthesized
aacaaacccttactaagtacct

SEQ ID NO: 1298875 - DNA, 22 bp, Artificial Sequence
  chemically synthesized
aagcagaaataggtacttagta

SEQ ID NO: 1298876 - DNA, 22 bp, Artificial Sequence
  chemically synthesized
ttcaacaaacccttactaagta

SEQ ID NO: 1298877 - DNA, 22 bp, Artificial Sequence
  chemically synthesized
attcaacaaacccttactaagt

SEQ ID NO: 1298878 - DNA, 22 bp, Artificial Sequence
  chemically synthesized
atttattcaacaaacccttact

SEQ ID NO: 1298879 - DNA, 22 bp, Artificial Sequence
  chemically synthesized
gatttattcaacaaacccttac

SEQ ID NO: 1298880 - DNA, 22 bp, Artificial Sequence
  chemically synthesized
gtcacttgatttattcaacaaa

SEQ ID NO: 1298881 - DNA, 22 bp, Artificial Sequence
  chemically synthesized
agtaagggtttgttgaataaat

SEQ ID NO: 1298882 - DNA, 22 bp, Artificial Sequence
  chemically synthesized
attagtcacttgatttattcaa

SEQ ID NO: 1298883 - DNA, 22 bp, Artificial Sequence
  chemically synthesized
gtaagggtttgttgaataaatc

SEQ ID NO: 1298884 - DNA, 22 bp, Artificial Sequence
  chemically synthesized
cagtattgattagtcacttgat

SEQ ID NO: 1298885 - DNA, 22 bp, Artificial Sequence
  chemically synthesized
gttgaataaatcaagtgactaa

SEQ ID NO: 1298886 - DNA, 22 bp, Artificial Sequence
  chemically synthesized
ttgaataaatcaagtgactaat

SEQ ID NO: 1298887 - DNA, 22 bp, Artificial Sequence
  chemically synthesized
attacagtattgattagtcact

SEQ ID NO: 1298888 - DNA, 22 bp, Artificial Sequence
  chemically synthesized
aattacagtattgattagtcac

SEQ ID NO: 1298889 - DNA, 22 bp, Artificial Sequence
  chemically synthesized
aataaatcaagtgactaatcaa

SEQ ID NO: 1298890 - DNA, 22 bp, Artificial Sequence
  chemically synthesized
agatttaattacagtattgatt

SEQ ID NO: 1298891 - DNA, 22 bp, Artificial Sequence
  chemically synthesized
gtagatctgagatttaattaca

SEQ ID NO: 1298892 - DNA, 22 bp, Artificial Sequence
  chemically synthesized
agtagatctgagatttaattac

SEQ ID NO: 1298893 - DNA, 22 bp, Artificial Sequence
  chemically synthesized
atcaatactgtaattaaatctc

SEQ ID NO: 1298894 - DNA, 22 bp, Artificial Sequence
  chemically synthesized
ggacttagtagatctgagattt

SEQ ID NO: 1298895 - DNA, 22 bp, Artificial Sequence
  chemically synthesized
gtctaggacttagtagatctga

SEQ ID NO: 1298896 - DNA, 22 bp, Artificial Sequence
  chemically synthesized
taattaaatctcagatctacta

SEQ ID NO: 1298897 - DNA, 22 bp, Artificial Sequence
  chemically synthesized
aatctcagatctactaagtcct

SEQ ID NO: 1298898 - DNA, 22 bp, Artificial Sequence
  chemically synthesized
agatctactaagtcctagacca

SEQ ID NO: 1298899 - DNA, 22 bp, Artificial Sequence
  chemically synthesized
ctaagtcctagaccaatgcttt

SEQ ID NO: 1298900 - DNA, 22 bp, Artificial Sequence
  chemically synthesized
agtcctagaccaatgctttccc

SEQ ID NO: 1298901 - DNA, 22 bp, Artificial Sequence
  chemically synthesized
gaccaatgctttccccctgcac

SEQ ID NO: 1298902 - DNA, 22 bp, Artificial Sequence
  chemically synthesized
agcagtatgatgaagtgcaggg

SEQ ID NO: 1298903 - DNA, 22 bp, Artificial Sequence
  chemically synthesized
gagcagtatgatgaagtgcagg

SEQ ID NO: 1298904 - DNA, 22 bp, Artificial Sequence
  chemically synthesized
tccccctgcacttcatcatact

SEQ ID NO: 1298905 - DNA, 22 bp, Artificial Sequence
  chemically synthesized
ccccctgcacttcatcatactg

SEQ ID NO: 1298906 - DNA, 22 bp, Artificial Sequence
  chemically synthesized
cccctgcacttcatcatactgc

SEQ ID NO: 1298907 - DNA, 22 bp, Artificial Sequence
  chemically synthesized
acagagtagtttgagcagtatg

SEQ ID NO: 1298908 - DNA, 22 bp, Artificial Sequence
  chemically synthesized
cacttcatcatactgctcaaac

SEQ ID NO: 1298909 - DNA, 22 bp, Artificial Sequence
  chemically synthesized
taattaacagagtagtttgagc

SEQ ID NO: 1298910 - DNA, 22 bp, Artificial Sequence
  chemically synthesized
catcatactgctcaaactactc

SEQ ID NO: 1298911 - DNA, 22 bp, Artificial Sequence
  chemically synthesized
atcatactgctcaaactactct

SEQ ID NO: 1298912 - DNA, 22 bp, Artificial Sequence
  chemically synthesized
ctcaaactactctgttaattat

SEQ ID NO: 1298913 - DNA, 22 bp, Artificial Sequence
  chemically synthesized
gtgacagaaggtctataattaa

SEQ ID NO: 1298914 - DNA, 22 bp, Artificial Sequence
  chemically synthesized
aaactactctgttaattataga

SEQ ID NO: 1298915 - DNA, 22 bp, Artificial Sequence
  chemically synthesized
ctctgttaattatagaccttct

SEQ ID NO: 1298916 - DNA, 22 bp, Artificial Sequence
  chemically synthesized
tgttaattatagaccttctgtc

SEQ ID NO: 1298917 - DNA, 22 bp, Artificial Sequence
  chemically synthesized
ttaattatagaccttctgtcac

SEQ ID NO: 1298918 - DNA, 22 bp, Artificial Sequence
  chemically synthesized
ggaaatgaattggtgacagaag

SEQ ID NO: 1298919 - DNA, 22 bp, Artificial Sequence
  chemically synthesized
aggaaatgaattggtgacagaa

SEQ ID NO: 1298920 - DNA, 22 bp, Artificial Sequence
  chemically synthesized
attatagaccttctgtcaccaa

SEQ ID NO: 1298921 - DNA, 22 bp, Artificial Sequence
  chemically synthesized
tagaccttctgtcaccaattca

SEQ ID NO: 1298922 - DNA, 22 bp, Artificial Sequence
  chemically synthesized
aatggataatttaggaaatgaa

SEQ ID NO: 1298923 - DNA, 22 bp, Artificial Sequence
  chemically synthesized
ctgtcaccaattcatttcctaa

SEQ ID NO: 1298924 - DNA, 22 bp, Artificial Sequence
  chemically synthesized
tgtcaccaattcatttcctaaa

SEQ ID NO: 1298925 - DNA, 22 bp, Artificial Sequence
  chemically synthesized
tcaccaattcatttcctaaatt

SEQ ID NO: 1298926 - DNA, 22 bp, Artificial Sequence
  chemically synthesized
atgggtgctcaatggataattt

SEQ ID NO: 1298927 - DNA, 22 bp, Artificial Sequence
  chemically synthesized
atttcctaaattatccattgag

SEQ ID NO: 1298928 - DNA, 22 bp, Artificial Sequence
  chemically synthesized
tgtctaatgggtgctcaatgga

SEQ ID NO: 1298929 - DNA, 22 bp, Artificial Sequence
  chemically synthesized
atgtctaatgggtgctcaatgg

SEQ ID NO: 1298930 - DNA, 22 bp, Artificial Sequence
  chemically synthesized
tatgtctaatgggtgctcaatg

SEQ ID NO: 1298931 - DNA, 22 bp, Artificial Sequence
  chemically synthesized
cctaaattatccattgagcacc

SEQ ID NO: 1298932 - DNA, 22 bp, Artificial Sequence
  chemically synthesized
ctaaattatccattgagcaccc

SEQ ID NO: 1298933 - DNA, 22 bp, Artificial Sequence
  chemically synthesized
gttttatgtctaatgggtgctc

SEQ ID NO: 1298934 - DNA, 22 bp, Artificial Sequence
  chemically synthesized
aattatccattgagcacccatt

SEQ ID NO: 1298935 - DNA, 22 bp, Artificial Sequence
  chemically synthesized
tccattgagcacccattagaca

SEQ ID NO: 1298936 - DNA, 22 bp, Artificial Sequence
  chemically synthesized
aaagttagttttatgtctaatg

SEQ ID NO: 1298937 - DNA, 22 bp, Artificial Sequence
  chemically synthesized
agcacccattagacataaaact

SEQ ID NO: 1298938 - DNA, 22 bp, Artificial Sequence
  chemically synthesized
gggagaagtcattgaaagttag

SEQ ID NO: 1298939 - DNA, 22 bp, Artificial Sequence
  chemically synthesized
ggggagaagtcattgaaagtta

SEQ ID NO: 1298940 - DNA, 22 bp, Artificial Sequence
  chemically synthesized
tggggagaagtcattgaaagtt

SEQ ID NO: 1298941 - DNA, 22 bp, Artificial Sequence
  chemically synthesized
gacataaaactaactttcaatg

SEQ ID NO: 1298942 - DNA, 22 bp, Artificial Sequence
  chemically synthesized
aattttggggagaagtcattga

SEQ ID NO: 1298943 - DNA, 22 bp, Artificial Sequence
  chemically synthesized
actttcaatgacttctccccaa

SEQ ID NO: 1298944 - DNA, 22 bp, Artificial Sequence
  chemically synthesized
caaggctaaattttggggagaa

SEQ ID NO: 1298945 - DNA, 22 bp, Artificial Sequence
  chemically synthesized
tcaatgacttctccccaaaatt

SEQ ID NO: 1298946 - DNA, 22 bp, Artificial Sequence
  chemically synthesized
caatgacttctccccaaaattt

SEQ ID NO: 1298947 - DNA, 22 bp, Artificial Sequence
  chemically synthesized
agttccaaggctaaattttggg

SEQ ID NO: 1298948 - DNA, 22 bp, Artificial Sequence
  chemically synthesized
aatgacttctccccaaaattta

SEQ ID NO: 1298949 - DNA, 22 bp, Artificial Sequence
  chemically synthesized
cagttccaaggctaaattttgg

SEQ ID NO: 1298950 - DNA, 22 bp, Artificial Sequence
  chemically synthesized
ctccccaaaatttagccttgga

SEQ ID NO: 1298951 - DNA, 22 bp, Artificial Sequence
  chemically synthesized
tccccaaaatttagccttggaa

SEQ ID NO: 1298952 - DNA, 22 bp, Artificial Sequence
  chemically synthesized
cccaaaatttagccttggaact

SEQ ID NO: 1298953 - DNA, 22 bp, Artificial Sequence
  chemically synthesized
agccttggaactgaaatattgc

SEQ ID NO: 1298954 - DNA, 22 bp, Artificial Sequence
  chemically synthesized
gccttggaactgaaatattgct

SEQ ID NO: 1298955 - DNA, 22 bp, Artificial Sequence
  chemically synthesized
ggaactgaaatattgctactta

SEQ ID NO: 1298956 - DNA, 22 bp, Artificial Sequence
  chemically synthesized
tagtgatgaaaataagtagcaa

SEQ ID NO: 1298957 - DNA, 22 bp, Artificial Sequence
  chemically synthesized
gaactgaaatattgctacttat

SEQ ID NO: 1298958 - DNA, 22 bp, Artificial Sequence
  chemically synthesized
attgtagtgatgaaaataagta

SEQ ID NO: 1298959 - DNA, 22 bp, Artificial Sequence
  chemically synthesized
aaatattgctacttattttcat

SEQ ID NO: 1298960 - DNA, 22 bp, Artificial Sequence
  chemically synthesized
ttcattgtagtgatgaaaataa

SEQ ID NO: 1298961 - DNA, 22 bp, Artificial Sequence
  chemically synthesized
attcattgtagtgatgaaaata

SEQ ID NO: 1298962 - DNA, 22 bp, Artificial Sequence
  chemically synthesized
tattcattgtagtgatgaaaat

SEQ ID NO: 1298963 - DNA, 22 bp, Artificial Sequence
  chemically synthesized
ttattcattgtagtgatgaaaa

SEQ ID NO: 1298964 - DNA, 22 bp, Artificial Sequence
  chemically synthesized
tttattcattgtagtgatgaaa

SEQ ID NO: 1298965 - DNA, 22 bp, Artificial Sequence
  chemically synthesized
ctacttattttcatcactacaa

SEQ ID NO: 1298966 - DNA, 22 bp, Artificial Sequence
  chemically synthesized
attttttattcattgtagtgat

SEQ ID NO: 1298967 - DNA, 22 bp, Artificial Sequence
  chemically synthesized
aattttttattcattgtagtga

SEQ ID NO: 1298968 - DNA, 22 bp, Artificial Sequence
  chemically synthesized
cttattttcatcactacaatga

SEQ ID NO: 1298969 - DNA, 22 bp, Artificial Sequence
  chemically synthesized
ttaattttttattcattgtagt

SEQ ID NO: 1298970 - DNA, 22 bp, Artificial Sequence
  chemically synthesized
tcttaattttttattcattgta

SEQ ID NO: 1298971 - DNA, 22 bp, Artificial Sequence
  chemically synthesized
attttcatcactacaatgaata

SEQ ID NO: 1298972 - DNA, 22 bp, Artificial Sequence
  chemically synthesized
ctcttaattttttattcattgt

SEQ ID NO: 1298973 - DNA, 22 bp, Artificial Sequence
  chemically synthesized
ttttcatcactacaatgaataa

SEQ ID NO: 1298974 - DNA, 22 bp, Artificial Sequence
  chemically synthesized
tctcttaattttttattcattg

SEQ ID NO: 1298975 - DNA, 22 bp, Artificial Sequence
  chemically synthesized
tttctcttaattttttattcat

SEQ ID NO: 1298976 - DNA, 22 bp, Artificial Sequence
  chemically synthesized
tcatcactacaatgaataaaaa

SEQ ID NO: 1298977 - DNA, 22 bp, Artificial Sequence
  chemically synthesized
catcactacaatgaataaaaaa

SEQ ID NO: 1298978 - DNA, 22 bp, Artificial Sequence
  chemically synthesized
atcactacaatgaataaaaaat

SEQ ID NO: 1298979 - DNA, 22 bp, Artificial Sequence
  chemically synthesized
caatgaataaaaaattaagaga

SEQ ID NO: 1298980 - DNA, 22 bp, Artificial Sequence
  chemically synthesized
caagaaatattctttctcttaa

SEQ ID NO: 1298981 - DNA, 22 bp, Artificial Sequence
  chemically synthesized
gcaagaaatattctttctctta

SEQ ID NO: 1298982 - DNA, 22 bp, Artificial Sequence
  chemically synthesized
tttgcaagaaatattctttctc

SEQ ID NO: 1298983 - DNA, 22 bp, Artificial Sequence
  chemically synthesized
agagaaagaatatttcttgcaa

SEQ ID NO: 1298984 - DNA, 22 bp, Artificial Sequence
  chemically synthesized
gagaaataaaggcagattgttt

SEQ ID NO: 1298985 - DNA, 22 bp, Artificial Sequence
  chemically synthesized
acctagagaaataaaggcagat

SEQ ID NO: 1298986 - DNA, 22 bp, Artificial Sequence
  chemically synthesized
cttgcaaacaatctgcctttat

SEQ ID NO: 1298987 - DNA, 22 bp, Artificial Sequence
  chemically synthesized
ttgcaaacaatctgcctttatt

SEQ ID NO: 1298988 - DNA, 22 bp, Artificial Sequence
  chemically synthesized
gcaaacaatctgcctttatttc

SEQ ID NO: 1298989 - DNA, 22 bp, Artificial Sequence
  chemically synthesized
caaacaatctgcctttatttct

SEQ ID NO: 1298990 - DNA, 22 bp, Artificial Sequence
  chemically synthesized
cagagtgaaattcacctagaga

SEQ ID NO: 1298991 - DNA, 22 bp, Artificial Sequence
  chemically synthesized
cctttatttctctaggtgaatt

SEQ ID NO: 1298992 - DNA, 22 bp, Artificial Sequence
  chemically synthesized
tatttctctaggtgaatttcac

SEQ ID NO: 1298993 - DNA, 22 bp, Artificial Sequence
  chemically synthesized
atttctctaggtgaatttcact

SEQ ID NO: 1298994 - DNA, 22 bp, Artificial Sequence
  chemically synthesized
tttctctaggtgaatttcactc

SEQ ID NO: 1298995 - DNA, 22 bp, Artificial Sequence
  chemically synthesized
tatcatattacagagtgaaatt

SEQ ID NO: 1298996 - DNA, 22 bp, Artificial Sequence
  chemically synthesized
ctctaggtgaatttcactctgt

SEQ ID NO: 1298997 - DNA, 22 bp, Artificial Sequence
  chemically synthesized
tctaggtgaatttcactctgta

SEQ ID NO: 1298998 - DNA, 22 bp, Artificial Sequence
  chemically synthesized
taggtgaatttcactctgtaat

SEQ ID NO: 1298999 - DNA, 22 bp, Artificial Sequence
  chemically synthesized
ggtgaatttcactctgtaatat

SEQ ID NO: 1299000 - DNA, 22 bp, Artificial Sequence
  chemically synthesized
cactctgtaatatgatataatt

SEQ ID NO: 1299001 - DNA, 22 bp, Artificial Sequence
  chemically synthesized
actctgtaatatgatataattg

SEQ ID NO: 1299002 - DNA, 22 bp, Artificial Sequence
  chemically synthesized
tgtaatatgatataattgccct

SEQ ID NO: 1299003 - DNA, 22 bp, Artificial Sequence
  chemically synthesized
taatatgatataattgcccttt

SEQ ID NO: 1299004 - DNA, 22 bp, Artificial Sequence
  chemically synthesized
ccctttacttcatctttcatga

SEQ ID NO: 1299005 - DNA, 22 bp, Artificial Sequence
  chemically synthesized
tacttcatctttcatgactgtc

SEQ ID NO: 1299006 - DNA, 22 bp, Artificial Sequence
  chemically synthesized
tgtcagaagcatgacagtcatg

SEQ ID NO: 1299007 - DNA, 22 bp, Artificial Sequence
  chemically synthesized
acttcatctttcatgactgtca

SEQ ID NO: 1299008 - DNA, 22 bp, Artificial Sequence
  chemically synthesized
cttcatctttcatgactgtcat

SEQ ID NO: 1299009 - DNA, 22 bp, Artificial Sequence
  chemically synthesized
catctttcatgactgtcatgct

SEQ ID NO: 1299010 - DNA, 22 bp, Artificial Sequence
  chemically synthesized
cattgtgtcagaagcatgacag

SEQ ID NO: 1299011 - DNA, 22 bp, Artificial Sequence
  chemically synthesized
atctttcatgactgtcatgctt

SEQ ID NO: 1299012 - DNA, 22 bp, Artificial Sequence
  chemically synthesized
acattgtgtcagaagcatgaca

SEQ ID NO: 1299013 - DNA, 22 bp, Artificial Sequence
  chemically synthesized
tacattgtgtcagaagcatgac

SEQ ID NO: 1299014 - DNA, 22 bp, Artificial Sequence
  chemically synthesized
tcatgactgtcatgcttctgac

SEQ ID NO: 1299015 - DNA, 22 bp, Artificial Sequence
  chemically synthesized
catgactgtcatgcttctgaca

SEQ ID NO: 1299016 - DNA, 22 bp, Artificial Sequence
  chemically synthesized
atgactgtcatgcttctgacac

SEQ ID NO: 1299017 - DNA, 22 bp, Artificial Sequence
  chemically synthesized
tcatgcttctgacacaatgtaa

SEQ ID NO: 1299018 - DNA, 22 bp, Artificial Sequence
  chemically synthesized
ctgacacaatgtaaaatgctat

SEQ ID NO: 1299019 - DNA, 22 bp, Artificial Sequence
  chemically synthesized
tgacacaatgtaaaatgctatg

SEQ ID NO: 1299020 - DNA, 22 bp, Artificial Sequence
  chemically synthesized
acacaatgtaaaatgctatgga

SEQ ID NO: 1299021 - DNA, 22 bp, Artificial Sequence
  chemically synthesized
cagtggaggcaaaggaacagac

SEQ ID NO: 1299022 - DNA, 22 bp, Artificial Sequence
  chemically synthesized
gcagtggaggcaaaggaacaga

SEQ ID NO: 1299023 - DNA, 22 bp, Artificial Sequence
  chemically synthesized
tggatgacctgtctgttccttt

SEQ ID NO: 1299024 - DNA, 22 bp, Artificial Sequence
  chemically synthesized
tctgttcctttgcctccactgc

SEQ ID NO: 1299025 - DNA, 22 bp, Artificial Sequence
  chemically synthesized
ttcctttgcctccactgcaaac

SEQ ID NO: 1299026 - DNA, 22 bp, Artificial Sequence
  chemically synthesized
agaaagaagtggcgtttgcagt

SEQ ID NO: 1299027 - DNA, 22 bp, Artificial Sequence
  chemically synthesized
ctttgcctccactgcaaacgcc

SEQ ID NO: 1299028 - DNA, 22 bp, Artificial Sequence
  chemically synthesized
cctgagaaagaagtggcgtttg

SEQ ID NO: 1299029 - DNA, 22 bp, Artificial Sequence
  chemically synthesized
tgcctccactgcaaacgccact

SEQ ID NO: 1299030 - DNA, 22 bp, Artificial Sequence
  chemically synthesized
gcctccactgcaaacgccactt

SEQ ID NO: 1299031 - DNA, 22 bp, Artificial Sequence
  chemically synthesized
cctccactgcaaacgccacttc

SEQ ID NO: 1299032 - DNA, 22 bp, Artificial Sequence
  chemically synthesized
acctacctgagaaagaagtggc

SEQ ID NO: 1299033 - DNA, 22 bp, Artificial Sequence
  chemically synthesized
cactgcaaacgccacttctttc

SEQ ID NO: 1299034 - DNA, 22 bp, Artificial Sequence
  chemically synthesized
caaacgccacttctttctcagg

SEQ ID NO: 1299035 - DNA, 22 bp, Artificial Sequence
  chemically synthesized
caataaaaaagcaattgaccta

SEQ ID NO: 1299036 - DNA, 22 bp, Artificial Sequence
  chemically synthesized
ctttctcaggtaggtcaattgc

SEQ ID NO: 1299037 - DNA, 22 bp, Artificial Sequence
  chemically synthesized
tttctcaggtaggtcaattgct

SEQ ID NO: 1299038 - DNA, 22 bp, Artificial Sequence
  chemically synthesized
cctacaataaaaaagcaattga

SEQ ID NO: 1299039 - DNA, 22 bp, Artificial Sequence
  chemically synthesized
tctcaggtaggtcaattgcttt

SEQ ID NO: 1299040 - DNA, 22 bp, Artificial Sequence
  chemically synthesized
ctcaggtaggtcaattgctttt

SEQ ID NO: 1299041 - DNA, 22 bp, Artificial Sequence
  chemically synthesized
tcaggtaggtcaattgcttttt

SEQ ID NO: 1299042 - DNA, 22 bp, Artificial Sequence
  chemically synthesized
aggtaggtcaattgctttttta

SEQ ID NO: 1299043 - DNA, 22 bp, Artificial Sequence
  chemically synthesized
agtccaacaactccctacaata

SEQ ID NO: 1299044 - DNA, 22 bp, Artificial Sequence
  chemically synthesized
tgagtccaacaactccctacaa

SEQ ID NO: 1299045 - DNA, 22 bp, Artificial Sequence
  chemically synthesized
ctgagtccaacaactccctaca

SEQ ID NO: 1299046 - DNA, 22 bp, Artificial Sequence
  chemically synthesized
cttttttattgtagggagttgt

SEQ ID NO: 1299047 - DNA, 22 bp, Artificial Sequence
  chemically synthesized
gtttctgagtccaacaactccc

SEQ ID NO: 1299048 - DNA, 22 bp, Artificial Sequence
  chemically synthesized
ttttattgtagggagttgttgg

SEQ ID NO: 1299049 - DNA, 22 bp, Artificial Sequence
  chemically synthesized
tttattgtagggagttgttgga

SEQ ID NO: 1299050 - DNA, 22 bp, Artificial Sequence
  chemically synthesized
ttattgtagggagttgttggac

SEQ ID NO: 1299051 - DNA, 22 bp, Artificial Sequence
  chemically synthesized
tattgtagggagttgttggact

SEQ ID NO: 1299052 - DNA, 22 bp, Artificial Sequence
  chemically synthesized
attgtagggagttgttggactc

SEQ ID NO: 1299053 - DNA, 22 bp, Artificial Sequence
  chemically synthesized
ttgtagggagttgttggactca

SEQ ID NO: 1299054 - DNA, 22 bp, Artificial Sequence
  chemically synthesized
caatctggtttctgagtccaac

SEQ ID NO: 1299055 - DNA, 22 bp, Artificial Sequence
  chemically synthesized
ccaatctggtttctgagtccaa

SEQ ID NO: 1299056 - DNA, 22 bp, Artificial Sequence
  chemically synthesized
tccaatctggtttctgagtcca

SEQ ID NO: 1299057 - DNA, 22 bp, Artificial Sequence
  chemically synthesized
tagggagttgttggactcagaa

SEQ ID NO: 1299058 - DNA, 22 bp, Artificial Sequence
  chemically synthesized
acatggctttccaatctggttt

SEQ ID NO: 1299059 - DNA, 22 bp, Artificial Sequence
  chemically synthesized
ttggactcagaaaccagattgg

SEQ ID NO: 1299060 - DNA, 22 bp, Artificial Sequence
  chemically synthesized
gactcagaaaccagattggaaa

SEQ ID NO: 1299061 - DNA, 22 bp, Artificial Sequence
  chemically synthesized
agaaaccagattggaaagccat

SEQ ID NO: 1299062 - DNA, 22 bp, Artificial Sequence
  chemically synthesized
aatatgagctgacatggctttc

SEQ ID NO: 1299063 - DNA, 22 bp, Artificial Sequence
  chemically synthesized
ttcaatatgagctgacatggct

SEQ ID NO: 1299064 - DNA, 22 bp, Artificial Sequence
  chemically synthesized
attcaatatgagctgacatggc

SEQ ID NO: 1299065 - DNA, 22 bp, Artificial Sequence
  chemically synthesized
tattcaatatgagctgacatgg

SEQ ID NO: 1299066 - DNA, 22 bp, Artificial Sequence
  chemically synthesized
ttattcaatatgagctgacatg

SEQ ID NO: 1299067 - DNA, 22 bp, Artificial Sequence
  chemically synthesized
gaaagccatgtcagctcatatt

SEQ ID NO: 1299068 - DNA, 22 bp, Artificial Sequence
  chemically synthesized
atattgaataaaagttctctcc

SEQ ID NO: 1299069 - DNA, 22 bp, Artificial Sequence
  chemically synthesized
agtggcagggaatgggagagaa

SEQ ID NO: 1299070 - DNA, 22 bp, Artificial Sequence
  chemically synthesized
aataaaagttctctcccattcc

SEQ ID NO: 1299071 - DNA, 22 bp, Artificial Sequence
  chemically synthesized
tgattaagtggcagggaatggg

SEQ ID NO: 1299072 - DNA, 22 bp, Artificial Sequence
  chemically synthesized
tgtgattaagtggcagggaatg

SEQ ID NO: 1299073 - DNA, 22 bp, Artificial Sequence
  chemically synthesized
tctcccattccctgccacttaa

SEQ ID NO: 1299074 - DNA, 22 bp, Artificial Sequence
  chemically synthesized
tcccattccctgccacttaatc

SEQ ID NO: 1299075 - DNA, 22 bp, Artificial Sequence
  chemically synthesized
ccattccctgccacttaatcac

SEQ ID NO: 1299076 - DNA, 22 bp, Artificial Sequence
  chemically synthesized
atggagcataaattctgtgatt

SEQ ID NO: 1299077 - DNA, 22 bp, Artificial Sequence
  chemically synthesized
cctgccacttaatcacagaatt

SEQ ID NO: 1299078 - DNA, 22 bp, Artificial Sequence
  chemically synthesized
ctaatggagcataaattctgtg

SEQ ID NO: 1299079 - DNA, 22 bp, Artificial Sequence
  chemically synthesized
gctaatggagcataaattctgt

SEQ ID NO: 1299080 - DNA, 22 bp, Artificial Sequence
  chemically synthesized
ccacttaatcacagaatttatg

SEQ ID NO: 1299081 - DNA, 22 bp, Artificial Sequence
  chemically synthesized
caatttgctaatggagcataaa

SEQ ID NO: 1299082 - DNA, 22 bp, Artificial Sequence
  chemically synthesized
aatcacagaatttatgctccat

SEQ ID NO: 1299083 - DNA, 22 bp, Artificial Sequence
  chemically synthesized
atcacagaatttatgctccatt

SEQ ID NO: 1299084 - DNA, 22 bp, Artificial Sequence
  chemically synthesized
accataactccaatttgctaat

SEQ ID NO: 1299085 - DNA, 22 bp, Artificial Sequence
  chemically synthesized
tcaccataactccaatttgcta

SEQ ID NO: 1299086 - DNA, 22 bp, Artificial Sequence
  chemically synthesized
atgctccattagcaaattggag

SEQ ID NO: 1299087 - DNA, 22 bp, Artificial Sequence
  chemically synthesized
tgctccattagcaaattggagt

SEQ ID NO: 1299088 - DNA, 22 bp, Artificial Sequence
  chemically synthesized
ggttctcaccataactccaatt

SEQ ID NO: 1299089 - DNA, 22 bp, Artificial Sequence
  chemically synthesized
cattagcaaattggagttatgg

SEQ ID NO: 1299090 - DNA, 22 bp, Artificial Sequence
  chemically synthesized
tgttaggttctcaccataactc

SEQ ID NO: 1299091 - DNA, 22 bp, Artificial Sequence
  chemically synthesized
gcaaattggagttatggtgaga

SEQ ID NO: 1299092 - DNA, 22 bp, Artificial Sequence
  chemically synthesized
tgcgattatgttaggttctcac

SEQ ID NO: 1299093 - DNA, 22 bp, Artificial Sequence
  chemically synthesized
gagttatggtgagaacctaaca

SEQ ID NO: 1299094 - DNA, 22 bp, Artificial Sequence
  chemically synthesized
tggtgagaacctaacataatcg

SEQ ID NO: 1299095 - DNA, 22 bp, Artificial Sequence
  chemically synthesized
tgaatatacaactatgcgatta

SEQ ID NO: 1299096 - DNA, 22 bp, Artificial Sequence
  chemically synthesized
atgaatatacaactatgcgatt

SEQ ID NO: 1299097 - DNA, 22 bp, Artificial Sequence
  chemically synthesized
tatgaatatacaactatgcgat

SEQ ID NO: 1299098 - DNA, 22 bp, Artificial Sequence
  chemically synthesized
ttatgaatatacaactatgcga

SEQ ID NO: 1299099 - DNA, 22 bp, Artificial Sequence
  chemically synthesized
acataatcgcatagttgtatat

SEQ ID NO: 1299100 - DNA, 22 bp, Artificial Sequence
  chemically synthesized
caatttttatgaatatacaact

SEQ ID NO: 1299101 - DNA, 22 bp, Artificial Sequence
  chemically synthesized
tatattcataaaaattgcaatg

SEQ ID NO: 1299102 - DNA, 22 bp, Artificial Sequence
  chemically synthesized
caatgtatagagcattgcaatt

SEQ ID NO: 1299103 - DNA, 22 bp, Artificial Sequence
  chemically synthesized
ccaatgtatagagcattgcaat

SEQ ID NO: 1299104 - DNA, 22 bp, Artificial Sequence
  chemically synthesized
tgtttccaatgtatagagcatt

SEQ ID NO: 1299105 - DNA, 22 bp, Artificial Sequence
  chemically synthesized
ataaaaattgcaatgctctata

SEQ ID NO: 1299106 - DNA, 22 bp, Artificial Sequence
  chemically synthesized
tgctatgtttccaatgtataga

SEQ ID NO: 1299107 - DNA, 22 bp, Artificial Sequence
  chemically synthesized
gtgctatgtttccaatgtatag

SEQ ID NO: 1299108 - DNA, 22 bp, Artificial Sequence
  chemically synthesized
caatgctctatacattggaaac

SEQ ID NO: 1299109 - DNA, 22 bp, Artificial Sequence
  chemically synthesized
caatacttgtgctatgtttcca

SEQ ID NO: 1299110 - DNA, 22 bp, Artificial Sequence
  chemically synthesized
tacaatacttgtgctatgtttc

SEQ ID NO: 1299111 - DNA, 22 bp, Artificial Sequence
  chemically synthesized
ctacaatacttgtgctatgttt

SEQ ID NO: 1299112 - DNA, 22 bp, Artificial Sequence
  chemically synthesized
tatacattggaaacatagcaca

SEQ ID NO: 1299113 - DNA, 22 bp, Artificial Sequence
  chemically synthesized
tacattggaaacatagcacaag

SEQ ID NO: 1299114 - DNA, 22 bp, Artificial Sequence
  chemically synthesized
gaaacatagcacaagtattgta

SEQ ID NO: 1299115 - DNA, 22 bp, Artificial Sequence
  chemically synthesized
acaagtatatttctacaatact

SEQ ID NO: 1299116 - DNA, 22 bp, Artificial Sequence
  chemically synthesized
cacaagtatatttctacaatac

SEQ ID NO: 1299117 - DNA, 22 bp, Artificial Sequence
  chemically synthesized
ttcacaagtatatttctacaat

SEQ ID NO: 1299118 - DNA, 22 bp, Artificial Sequence
  chemically synthesized
attcttcacaagtatatttcta

SEQ ID NO: 1299119 - DNA, 22 bp, Artificial Sequence
  chemically synthesized
gattaattcttcacaagtatat

SEQ ID NO: 1299120 - DNA, 22 bp, Artificial Sequence
  chemically synthesized
cgattaattcttcacaagtata

SEQ ID NO: 1299121 - DNA, 22 bp, Artificial Sequence
  chemically synthesized
tagaaatatacttgtgaagaat

SEQ ID NO: 1299122 - DNA, 22 bp, Artificial Sequence
  chemically synthesized
atgcaacttcgattaattcttc

SEQ ID NO: 1299123 - DNA, 22 bp, Artificial Sequence
  chemically synthesized
catgcaacttcgattaattctt

SEQ ID NO: 1299124 - DNA, 22 bp, Artificial Sequence
  chemically synthesized
cttcatgcaacttcgattaatt

SEQ ID NO: 1299125 - DNA, 22 bp, Artificial Sequence
  chemically synthesized
gtgaagaattaatcgaagttgc

SEQ ID NO: 1299126 - DNA, 22 bp, Artificial Sequence
  chemically synthesized
tgaagaattaatcgaagttgca

SEQ ID NO: 1299127 - DNA, 22 bp, Artificial Sequence
  chemically synthesized
tgtcctacttcatgcaacttcg

SEQ ID NO: 1299128 - DNA, 22 bp, Artificial Sequence
  chemically synthesized
tcattatgtcctacttcatgca

SEQ ID NO: 1299129 - DNA, 22 bp, Artificial Sequence
  chemically synthesized
atcgaagttgcatgaagtagga

SEQ ID NO: 1299130 - DNA, 22 bp, Artificial Sequence
  chemically synthesized
attgtcattatgtcctacttca

SEQ ID NO: 1299131 - DNA, 22 bp, Artificial Sequence
  chemically synthesized
aatctcattgtcattatgtcct

SEQ ID NO: 1299132 - DNA, 22 bp, Artificial Sequence
  chemically synthesized
caatctcattgtcattatgtcc

SEQ ID NO: 1299133 - DNA, 22 bp, Artificial Sequence
  chemically synthesized
ttcaatctcattgtcattatgt

SEQ ID NO: 1299134 - DNA, 22 bp, Artificial Sequence
  chemically synthesized
catgaagtaggacataatgaca

SEQ ID NO: 1299135 - DNA, 22 bp, Artificial Sequence
  chemically synthesized
cttcaatctcattgtcattatg

SEQ ID NO: 1299136 - DNA, 22 bp, Artificial Sequence
  chemically synthesized
atacatttcttcaatctcattg

SEQ ID NO: 1299137 - DNA, 22 bp, Artificial Sequence
  chemically synthesized
taatacatttcttcaatctcat

SEQ ID NO: 1299138 - DNA, 22 bp, Artificial Sequence
  chemically synthesized
cactctaatacatttcttcaat

SEQ ID NO: 1299139 - DNA, 22 bp, Artificial Sequence
  chemically synthesized
ccactctaatacatttcttcaa

SEQ ID NO: 1299140 - DNA, 22 bp, Artificial Sequence
  chemically synthesized
ttccactctaatacatttcttc

SEQ ID NO: 1299141 - DNA, 22 bp, Artificial Sequence
  chemically synthesized
atcattcttccactctaataca

SEQ ID NO: 1299142 - DNA, 22 bp, Artificial Sequence
  chemically synthesized
tgatcattcttccactctaata

SEQ ID NO: 1299143 - DNA, 22 bp, Artificial Sequence
  chemically synthesized
aagaaatgtattagagtggaag

SEQ ID NO: 1299144 - DNA, 22 bp, Artificial Sequence
  chemically synthesized
gagttctgatcattcttccact

SEQ ID NO: 1299145 - DNA, 22 bp, Artificial Sequence
  chemically synthesized
ggagttctgatcattcttccac

SEQ ID NO: 1299146 - DNA, 22 bp, Artificial Sequence
  chemically synthesized
ttggagttctgatcattcttcc

SEQ ID NO: 1299147 - DNA, 22 bp, Artificial Sequence
  chemically synthesized
gagtggaagaatgatcagaact

SEQ ID NO: 1299148 - DNA, 22 bp, Artificial Sequence
  chemically synthesized
atatactcttggagttctgatc

SEQ ID NO: 1299149 - DNA, 22 bp, Artificial Sequence
  chemically synthesized
catatactcttggagttctgat

SEQ ID NO: 1299150 - DNA, 22 bp, Artificial Sequence
  chemically synthesized
tcatatactcttggagttctga

SEQ ID NO: 1299151 - DNA, 22 bp, Artificial Sequence
  chemically synthesized
ttcatatactcttggagttctg

SEQ ID NO: 1299152 - DNA, 22 bp, Artificial Sequence
  chemically synthesized
acaccttttcatatactcttgg

SEQ ID NO: 1299153 - DNA, 22 bp, Artificial Sequence
  chemically synthesized
aacaccttttcatatactcttg

SEQ ID NO: 1299154 - DNA, 22 bp, Artificial Sequence
  chemically synthesized
agaccacttaacaccttttcat

SEQ ID NO: 1299155 - DNA, 22 bp, Artificial Sequence
  chemically synthesized
caagagtatatgaaaaggtgtt

SEQ ID NO: 1299156 - DNA, 22 bp, Artificial Sequence
  chemically synthesized
caactgagaccacttaacacct

SEQ ID NO: 1299157 - DNA, 22 bp, Artificial Sequence
  chemically synthesized
ccaactgagaccacttaacacc

SEQ ID NO: 1299158 - DNA, 22 bp, Artificial Sequence
  chemically synthesized
tccaactgagaccacttaacac

SEQ ID NO: 1299159 - DNA, 22 bp, Artificial Sequence
  chemically synthesized
ttccaactgagaccacttaaca

SEQ ID NO: 1299160 - DNA, 22 bp, Artificial Sequence
  chemically synthesized
tttttccaactgagaccactta

SEQ ID NO: 1299161 - DNA, 22 bp, Artificial Sequence
  chemically synthesized
ccagatggcactgtttttccaa

SEQ ID NO: 1299162 - DNA, 22 bp, Artificial Sequence
  chemically synthesized
agtggtctcagttggaaaaaca

SEQ ID NO: 1299163 - DNA, 22 bp, Artificial Sequence
  chemically synthesized
cacaatctaccagatggcactg

SEQ ID NO: 1299164 - DNA, 22 bp, Artificial Sequence
  chemically synthesized
agttggaaaaacagtgccatct

SEQ ID NO: 1299165 - DNA, 22 bp, Artificial Sequence
  chemically synthesized
gcacaatctaccagatggcact

SEQ ID NO: 1299166 - DNA, 22 bp, Artificial Sequence
  chemically synthesized
tttgcacaatctaccagatggc

SEQ ID NO: 1299167 - DNA, 22 bp, Artificial Sequence
  chemically synthesized
gaaaaacagtgccatctggtag

SEQ ID NO: 1299168 - DNA, 22 bp, Artificial Sequence
  chemically synthesized
actgtttgcacaatctaccaga

SEQ ID NO: 1299169 - DNA, 22 bp, Artificial Sequence
  chemically synthesized
agaggataagaattaactgttt

SEQ ID NO: 1299170 - DNA, 22 bp, Artificial Sequence
  chemically synthesized
gtagattgtgcaaacagttaat

SEQ ID NO: 1299171 - DNA, 22 bp, Artificial Sequence
  chemically synthesized
aagaggataagaattaactgtt

SEQ ID NO: 1299172 - DNA, 22 bp, Artificial Sequence
  chemically synthesized
taagaggataagaattaactgt

SEQ ID NO: 1299173 - DNA, 22 bp, Artificial Sequence
  chemically synthesized
tgcaaacagttaattcttatcc

SEQ ID NO: 1299174 - DNA, 22 bp, Artificial Sequence
  chemically synthesized
acacatgcaattttaagaggat

SEQ ID NO: 1299175 - DNA, 22 bp, Artificial Sequence
  chemically synthesized
attcttatcctcttaaaattgc

SEQ ID NO: 1299176 - DNA, 22 bp, Artificial Sequence
  chemically synthesized
tatctaacacatgcaattttaa

SEQ ID NO: 1299177 - DNA, 22 bp, Artificial Sequence
  chemically synthesized
ttatcctcttaaaattgcatgt

SEQ ID NO: 1299178 - DNA, 22 bp, Artificial Sequence
  chemically synthesized
cattgtatctaacacatgcaat

SEQ ID NO: 1299179 - DNA, 22 bp, Artificial Sequence
  chemically synthesized
atcctcttaaaattgcatgtgt

SEQ ID NO: 1299180 - DNA, 22 bp, Artificial Sequence
  chemically synthesized
tcctcttaaaattgcatgtgtt

SEQ ID NO: 1299181 - DNA, 22 bp, Artificial Sequence
  chemically synthesized
ttaaaattgcatgtgttagata

SEQ ID NO: 1299182 - DNA, 22 bp, Artificial Sequence
  chemically synthesized
aaaattgcatgtgttagataca

SEQ ID NO: 1299183 - DNA, 22 bp, Artificial Sequence
  chemically synthesized
aaattgcatgtgttagatacaa

SEQ ID NO: 1299184 - DNA, 22 bp, Artificial Sequence
  chemically synthesized
catgtgttagatacaatgcagg

SEQ ID NO: 1299185 - DNA, 22 bp, Artificial Sequence
  chemically synthesized
gatacaatgcaggccggggtta

SEQ ID NO: 1299186 - DNA, 22 bp, Artificial Sequence
  chemically synthesized
aaatgagtgtatgatgtaaccc

SEQ ID NO: 1299187 - DNA, 22 bp, Artificial Sequence
  chemically synthesized
tgaaatgagtgtatgatgtaac

SEQ ID NO: 1299188 - DNA, 22 bp, Artificial Sequence
  chemically synthesized
actctgaaatgagtgtatgatg

SEQ ID NO: 1299189 - DNA, 22 bp, Artificial Sequence
  chemically synthesized
gactctgaaatgagtgtatgat

SEQ ID NO: 1299190 - DNA, 22 bp, Artificial Sequence
  chemically synthesized
tttgactctgaaatgagtgtat

SEQ ID NO: 1299191 - DNA, 22 bp, Artificial Sequence
  chemically synthesized
aggttatttgactctgaaatga

SEQ ID NO: 1299192 - DNA, 22 bp, Artificial Sequence
  chemically synthesized
catcatacactcatttcagagt

SEQ ID NO: 1299193 - DNA, 22 bp, Artificial Sequence
  chemically synthesized
gaactcaggttatttgactctg

SEQ ID NO: 1299194 - DNA, 22 bp, Artificial Sequence
  chemically synthesized
gagttggaactcaggttatttg

SEQ ID NO: 1299195 - DNA, 22 bp, Artificial Sequence
  chemically synthesized
atttcagagtcaaataacctga

SEQ ID NO: 1299196 - DNA, 22 bp, Artificial Sequence
  chemically synthesized
cagagtcaaataacctgagttc

SEQ ID NO: 1299197 - DNA, 22 bp, Artificial Sequence
  chemically synthesized
agagtcaaataacctgagttcc

SEQ ID NO: 1299198 - DNA, 22 bp, Artificial Sequence
  chemically synthesized
agttccaactccagtttcacat

SEQ ID NO: 1299199 - DNA, 22 bp, Artificial Sequence
  chemically synthesized
caactccagtttcacatctcat

SEQ ID NO: 1299200 - DNA, 22 bp, Artificial Sequence
  chemically synthesized
aaggccacagagataatgagat

SEQ ID NO: 1299201 - DNA, 22 bp, Artificial Sequence
  chemically synthesized
cagtttcacatctcattatctc

SEQ ID NO: 1299202 - DNA, 22 bp, Artificial Sequence
  chemically synthesized
ctcaaggccacagagataatga

SEQ ID NO: 1299203 - DNA, 22 bp, Artificial Sequence
  chemically synthesized
actcaaggccacagagataatg

SEQ ID NO: 1299204 - DNA, 22 bp, Artificial Sequence
  chemically synthesized
cacatctcattatctctgtggc

SEQ ID NO: 1299205 - DNA, 22 bp, Artificial Sequence
  chemically synthesized
acatctcattatctctgtggcc

SEQ ID NO: 1299206 - DNA, 22 bp, Artificial Sequence
  chemically synthesized
agtaacttactcaaggccacag

SEQ ID NO: 1299207 - DNA, 22 bp, Artificial Sequence
  chemically synthesized
attatctctgtggccttgagta

SEQ ID NO: 1299208 - DNA, 22 bp, Artificial Sequence
  chemically synthesized
tctctgtggccttgagtaagtt

SEQ ID NO: 1299209 - DNA, 22 bp, Artificial Sequence
  chemically synthesized
tgtggccttgagtaagttactt

SEQ ID NO: 1299210 - DNA, 22 bp, Artificial Sequence
  chemically synthesized
tggccttgagtaagttacttaa

SEQ ID NO: 1299211 - DNA, 22 bp, Artificial Sequence
  chemically synthesized
gagtaagttacttaacctctct

SEQ ID NO: 1299212 - DNA, 22 bp, Artificial Sequence
  chemically synthesized
agtaagttacttaacctctctg

SEQ ID NO: 1299213 - DNA, 22 bp, Artificial Sequence
  chemically synthesized
cttaacctctctgtgtctcatt

SEQ ID NO: 1299214 - DNA, 22 bp, Artificial Sequence
  chemically synthesized
aacctctctgtgtctcattgcc

SEQ ID NO: 1299215 - DNA, 22 bp, Artificial Sequence
  chemically synthesized
acctctctgtgtctcattgcct

SEQ ID NO: 1299216 - DNA, 22 bp, Artificial Sequence
  chemically synthesized
ccatgaaacaaatagaggcaat

SEQ ID NO: 1299217 - DNA, 22 bp, Artificial Sequence
  chemically synthesized
tctgtgtctcattgcctctatt

SEQ ID NO: 1299218 - DNA, 22 bp, Artificial Sequence
  chemically synthesized
ttaccatgaaacaaatagaggc

SEQ ID NO: 1299219 - DNA, 22 bp, Artificial Sequence
  chemically synthesized
tgtgtctcattgcctctatttg

SEQ ID NO: 1299220 - DNA, 22 bp, Artificial Sequence
  chemically synthesized
tgtctcattgcctctatttgtt

SEQ ID NO: 1299221 - DNA, 22 bp, Artificial Sequence
  chemically synthesized
ctattaccatgaaacaaataga

SEQ ID NO: 1299222 - DNA, 22 bp, Artificial Sequence
  chemically synthesized
ttactattaccatgaaacaaat

SEQ ID NO: 1299223 - DNA, 22 bp, Artificial Sequence
  chemically synthesized
attactattaccatgaaacaaa

SEQ ID NO: 1299224 - DNA, 22 bp, Artificial Sequence
  chemically synthesized
tattactattaccatgaaacaa

SEQ ID NO: 1299225 - DNA, 22 bp, Artificial Sequence
  chemically synthesized
attgcctctatttgtttcatgg

SEQ ID NO: 1299226 - DNA, 22 bp, Artificial Sequence
  chemically synthesized
cctctatttgtttcatggtaat

SEQ ID NO: 1299227 - DNA, 22 bp, Artificial Sequence
  chemically synthesized
agtatctttattactattacca

SEQ ID NO: 1299228 - DNA, 22 bp, Artificial Sequence
  chemically synthesized
tatttgtttcatggtaatagta

SEQ ID NO: 1299229 - DNA, 22 bp, Artificial Sequence
  chemically synthesized
tttgtttcatggtaatagtaat

SEQ ID NO: 1299230 - DNA, 22 bp, Artificial Sequence
  chemically synthesized
gtttcatggtaatagtaataaa

SEQ ID NO: 1299231 - DNA, 22 bp, Artificial Sequence
  chemically synthesized
tttcatggtaatagtaataaag

SEQ ID NO: 1299232 - DNA, 22 bp, Artificial Sequence
  chemically synthesized
acaattcagtatctttattact

SEQ ID NO: 1299233 - DNA, 22 bp, Artificial Sequence
  chemically synthesized
cacaattcagtatctttattac

SEQ ID NO: 1299234 - DNA, 22 bp, Artificial Sequence
  chemically synthesized
catggtaatagtaataaagata

SEQ ID NO: 1299235 - DNA, 22 bp, Artificial Sequence
  chemically synthesized
atggtaatagtaataaagatac

SEQ ID NO: 1299236 - DNA, 22 bp, Artificial Sequence
  chemically synthesized
gtcttcacaattcagtatcttt

SEQ ID NO: 1299237 - DNA, 22 bp, Artificial Sequence
  chemically synthesized
agtcttcacaattcagtatctt

SEQ ID NO: 1299238 - DNA, 22 bp, Artificial Sequence
  chemically synthesized
aattgtgaagactaaatgtgac

SEQ ID NO: 1299239 - DNA, 22 bp, Artificial Sequence
  chemically synthesized
atatgtcatacatgtgtcacat

SEQ ID NO: 1299240 - DNA, 22 bp, Artificial Sequence
  chemically synthesized
tgaagactaaatgtgacacatg

SEQ ID NO: 1299241 - DNA, 22 bp, Artificial Sequence
  chemically synthesized
agcattaatatgtcatacatgt

SEQ ID NO: 1299242 - DNA, 22 bp, Artificial Sequence
  chemically synthesized
tcagcattaatatgtcatacat

SEQ ID NO: 1299243 - DNA, 22 bp, Artificial Sequence
  chemically synthesized
ctcagcattaatatgtcataca

SEQ ID NO: 1299244 - DNA, 22 bp, Artificial Sequence
  chemically synthesized
aatgtgacacatgtatgacata

SEQ ID NO: 1299245 - DNA, 22 bp, Artificial Sequence
  chemically synthesized
tctcagcattaatatgtcatac

SEQ ID NO: 1299246 - DNA, 22 bp, Artificial Sequence
  chemically synthesized
tttctcagcattaatatgtcat

SEQ ID NO: 1299247 - DNA, 22 bp, Artificial Sequence
  chemically synthesized
tctttctcagcattaatatgtc

SEQ ID NO: 1299248 - DNA, 22 bp, Artificial Sequence
  chemically synthesized
ctctttctcagcattaatatgt

SEQ ID NO: 1299249 - DNA, 22 bp, Artificial Sequence
  chemically synthesized
tctctttctcagcattaatatg

SEQ ID NO: 1299250 - DNA, 22 bp, Artificial Sequence
  chemically synthesized
ttctctttctcagcattaatat

SEQ ID NO: 1299251 - DNA, 22 bp, Artificial Sequence
  chemically synthesized
tttctctttctcagcattaata

SEQ ID NO: 1299252 - DNA, 22 bp, Artificial Sequence
  chemically synthesized
ttttctctttctcagcattaat

SEQ ID NO: 1299253 - DNA, 22 bp, Artificial Sequence
  chemically synthesized
tttttttctctttctcagcatt

SEQ ID NO: 1299254 - DNA, 22 bp, Artificial Sequence
  chemically synthesized
tctatttttttctctttctcag

SEQ ID NO: 1299255 - DNA, 22 bp, Artificial Sequence
  chemically synthesized
gtctatttttttctctttctca

SEQ ID NO: 1299256 - DNA, 22 bp, Artificial Sequence
  chemically synthesized
tgtctatttttttctctttctc

SEQ ID NO: 1299257 - DNA, 22 bp, Artificial Sequence
  chemically synthesized
atgctgagaaagagaaaaaaat

SEQ ID NO: 1299258 - DNA, 22 bp, Artificial Sequence
  chemically synthesized
taggttttgtctatttttttct

SEQ ID NO: 1299259 - DNA, 22 bp, Artificial Sequence
  chemically synthesized
ataggttttgtctatttttttc

SEQ ID NO: 1299260 - DNA, 22 bp, Artificial Sequence
  chemically synthesized
agaaagagaaaaaaatagacaa

SEQ ID NO: 1299261 - DNA, 22 bp, Artificial Sequence
  chemically synthesized
gaagtaaagatttataggtttt

SEQ ID NO: 1299262 - DNA, 22 bp, Artificial Sequence
  chemically synthesized
ggaagtaaagatttataggttt

SEQ ID NO: 1299263 - DNA, 22 bp, Artificial Sequence
  chemically synthesized
taatatatttggaagtaaagat

SEQ ID NO: 1299264 - DNA, 22 bp, Artificial Sequence
  chemically synthesized
taaatctttacttccaaatata

SEQ ID NO: 1299265 - DNA, 22 bp, Artificial Sequence
  chemically synthesized
tacttccaaatatattacaact

SEQ ID NO: 1299266 - DNA, 22 bp, Artificial Sequence
  chemically synthesized
acttccaaatatattacaactt

SEQ ID NO: 1299267 - DNA, 22 bp, Artificial Sequence
  chemically synthesized
cttccaaatatattacaacttc

SEQ ID NO: 1299268 - DNA, 22 bp, Artificial Sequence
  chemically synthesized
ccaaatatattacaacttcccg

SEQ ID NO: 1299269 - DNA, 22 bp, Artificial Sequence
  chemically synthesized
caaatatattacaacttcccgt

SEQ ID NO: 1299270 - DNA, 22 bp, Artificial Sequence
  chemically synthesized
tacagaagacccacgggaagtt

SEQ ID NO: 1299271 - DNA, 22 bp, Artificial Sequence
  chemically synthesized
atacagaagacccacgggaagt

SEQ ID NO: 1299272 - DNA, 22 bp, Artificial Sequence
  chemically synthesized
caacttcccgtgggtcttctgt

SEQ ID NO: 1299273 - DNA, 22 bp, Artificial Sequence
  chemically synthesized
cccgtgggtcttctgtataaat

SEQ ID NO: 1299274 - DNA, 22 bp, Artificial Sequence
  chemically synthesized
tgaaataatgtcatttatacag

SEQ ID NO: 1299275 - DNA, 22 bp, Artificial Sequence
  chemically synthesized
ccgtgggtcttctgtataaatg

SEQ ID NO: 1299276 - DNA, 22 bp, Artificial Sequence
  chemically synthesized
atgaaataatgtcatttataca

SEQ ID NO: 1299277 - DNA, 22 bp, Artificial Sequence
  chemically synthesized
tatgaaataatgtcatttatac

SEQ ID NO: 1299278 - DNA, 22 bp, Artificial Sequence
  chemically synthesized
ttttatgaaataatgtcattta

SEQ ID NO: 1299279 - DNA, 22 bp, Artificial Sequence
  chemically synthesized
ctgtataaatgacattatttca

SEQ ID NO: 1299280 - DNA, 22 bp, Artificial Sequence
  chemically synthesized
tgtataaatgacattatttcat

SEQ ID NO: 1299281 - DNA, 22 bp, Artificial Sequence
  chemically synthesized
tataaatgacattatttcataa

SEQ ID NO: 1299282 - DNA, 22 bp, Artificial Sequence
  chemically synthesized
ccacgtagcaatcgtgtctatt

SEQ ID NO: 1299283 - DNA, 22 bp, Artificial Sequence
  chemically synthesized
tttcataaaatagacacgattg

SEQ ID NO: 1299284 - DNA, 22 bp, Artificial Sequence
  chemically synthesized
cataaaatagacacgattgcta

SEQ ID NO: 1299285 - DNA, 22 bp, Artificial Sequence
  chemically synthesized
ataaaatagacacgattgctac

SEQ ID NO: 1299286 - DNA, 22 bp, Artificial Sequence
  chemically synthesized
acatggctgccacgtagcaatc

SEQ ID NO: 1299287 - DNA, 22 bp, Artificial Sequence
  chemically synthesized
ttaacatggctgccacgtagca

SEQ ID NO: 1299288 - DNA, 22 bp, Artificial Sequence
  chemically synthesized
attattaacatggctgccacgt

SEQ ID NO: 1299289 - DNA, 22 bp, Artificial Sequence
  chemically synthesized
ctaattattaacatggctgcca

SEQ ID NO: 1299290 - DNA, 22 bp, Artificial Sequence
  chemically synthesized
ctacgtggcagccatgttaata

SEQ ID NO: 1299291 - DNA, 22 bp, Artificial Sequence
  chemically synthesized
cgtggcagccatgttaataatt

SEQ ID NO: 1299292 - DNA, 22 bp, Artificial Sequence
  chemically synthesized
taaaaatcctactaattattaa

SEQ ID NO: 1299293 - DNA, 22 bp, Artificial Sequence
  chemically synthesized
caaatactataaaaatcctact

SEQ ID NO: 1299294 - DNA, 22 bp, Artificial Sequence
  chemically synthesized
acaaatactataaaaatcctac

SEQ ID NO: 1299295 - DNA, 22 bp, Artificial Sequence
  chemically synthesized
ataattagtaggatttttatag

SEQ ID NO: 1299296 - DNA, 22 bp, Artificial Sequence
  chemically synthesized
catatttacaaatactataaaa

SEQ ID NO: 1299297 - DNA, 22 bp, Artificial Sequence
  chemically synthesized
gcatatttacaaatactataaa

SEQ ID NO: 1299298 - DNA, 22 bp, Artificial Sequence
  chemically synthesized
tgcatatttacaaatactataa

SEQ ID NO: 1299299 - DNA, 22 bp, Artificial Sequence
  chemically synthesized
ttgcatatttacaaatactata

SEQ ID NO: 1299300 - DNA, 22 bp, Artificial Sequence
  chemically synthesized
tttgcatatttacaaatactat

SEQ ID NO: 1299301 - DNA, 22 bp, Artificial Sequence
  chemically synthesized
gtaggatttttatagtatttgt

SEQ ID NO: 1299302 - DNA, 22 bp, Artificial Sequence
  chemically synthesized
aattttttgcatatttacaaat

SEQ ID NO: 1299303 - DNA, 22 bp, Artificial Sequence
  chemically synthesized
gaattttttgcatatttacaaa

SEQ ID NO: 1299304 - DNA, 22 bp, Artificial Sequence
  chemically synthesized
ttatagtatttgtaaatatgca

SEQ ID NO: 1299305 - DNA, 22 bp, Artificial Sequence
  chemically synthesized
tatagtatttgtaaatatgcaa

SEQ ID NO: 1299306 - DNA, 22 bp, Artificial Sequence
  chemically synthesized
atagtatttgtaaatatgcaaa

SEQ ID NO: 1299307 - DNA, 22 bp, Artificial Sequence
  chemically synthesized
tagtatttgtaaatatgcaaaa

SEQ ID NO: 1299308 - DNA, 22 bp, Artificial Sequence
  chemically synthesized
gtaaatatgcaaaaaattcaag

SEQ ID NO: 1299309 - DNA, 22 bp, Artificial Sequence
  chemically synthesized
aaatcgagaagacttgaatttt

SEQ ID NO: 1299310 - DNA, 22 bp, Artificial Sequence
  chemically synthesized
taaatatgcaaaaaattcaagt

SEQ ID NO: 1299311 - DNA, 22 bp, Artificial Sequence
  chemically synthesized
caaatcgagaagacttgaattt

SEQ ID NO: 1299312 - DNA, 22 bp, Artificial Sequence
  chemically synthesized
tcaaatcgagaagacttgaatt

SEQ ID NO: 1299313 - DNA, 22 bp, Artificial Sequence
  chemically synthesized
tctttcaaatcgagaagacttg

SEQ ID NO: 1299314 - DNA, 22 bp, Artificial Sequence
  chemically synthesized
atctttcaaatcgagaagactt

SEQ ID NO: 1299315 - DNA, 22 bp, Artificial Sequence
  chemically synthesized
tatctttcaaatcgagaagact

SEQ ID NO: 1299316 - DNA, 22 bp, Artificial Sequence
  chemically synthesized
ttatctttcaaatcgagaagac

SEQ ID NO: 1299317 - DNA, 22 bp, Artificial Sequence
  chemically synthesized
tttttatctttcaaatcgagaa

SEQ ID NO: 1299318 - DNA, 22 bp, Artificial Sequence
  chemically synthesized
gtttttatctttcaaatcgaga

SEQ ID NO: 1299319 - DNA, 22 bp, Artificial Sequence
  chemically synthesized
tgtttttatctttcaaatcgag

SEQ ID NO: 1299320 - DNA, 22 bp, Artificial Sequence
  chemically synthesized
aagtcttctcgatttgaaagat

SEQ ID NO: 1299321 - DNA, 22 bp, Artificial Sequence
  chemically synthesized
atattttgtttttatctttcaa

SEQ ID NO: 1299322 - DNA, 22 bp, Artificial Sequence
  chemically synthesized
catattttgtttttatctttca

SEQ ID NO: 1299323 - DNA, 22 bp, Artificial Sequence
  chemically synthesized
ctcgatttgaaagataaaaaca

SEQ ID NO: 1299324 - DNA, 22 bp, Artificial Sequence
  chemically synthesized
tcgatttgaaagataaaaacaa

SEQ ID NO: 1299325 - DNA, 22 bp, Artificial Sequence
  chemically synthesized
gatttgaaagataaaaacaaaa

SEQ ID NO: 1299326 - DNA, 22 bp, Artificial Sequence
  chemically synthesized
gaaagataaaaacaaaatatga

SEQ ID NO: 1299327 - DNA, 22 bp, Artificial Sequence
  chemically synthesized
aaagataaaaacaaaatatgaa

SEQ ID NO: 1299328 - DNA, 22 bp, Artificial Sequence
  chemically synthesized
tgtgaatatcatttcatatttt

SEQ ID NO: 1299329 - DNA, 22 bp, Artificial Sequence
  chemically synthesized
atgtgaatatcatttcatattt

SEQ ID NO: 1299330 - DNA, 22 bp, Artificial Sequence
  chemically synthesized
agcatgaggaggtataatttat

SEQ ID NO: 1299331 - DNA, 22 bp, Artificial Sequence
  chemically synthesized
gagcatgaggaggtataattta

SEQ ID NO: 1299332 - DNA, 22 bp, Artificial Sequence
  chemically synthesized
tgagcatgaggaggtataattt

SEQ ID NO: 1299333 - DNA, 22 bp, Artificial Sequence
  chemically synthesized
ttgagcatgaggaggtataatt

SEQ ID NO: 1299334 - DNA, 22 bp, Artificial Sequence
  chemically synthesized
ttttgagcatgaggaggtataa

SEQ ID NO: 1299335 - DNA, 22 bp, Artificial Sequence
  chemically synthesized
attcttttgagcatgaggaggt

SEQ ID NO: 1299336 - DNA, 22 bp, Artificial Sequence
  chemically synthesized
acataaattatacctcctcatg

SEQ ID NO: 1299337 - DNA, 22 bp, Artificial Sequence
  chemically synthesized
cattcttttgagcatgaggagg

SEQ ID NO: 1299338 - DNA, 22 bp, Artificial Sequence
  chemically synthesized
cttcattcttttgagcatgagg

SEQ ID NO: 1299339 - DNA, 22 bp, Artificial Sequence
  chemically synthesized
acttcattcttttgagcatgag

SEQ ID NO: 1299340 - DNA, 22 bp, Artificial Sequence
  chemically synthesized
tacctcctcatgctcaaaagaa

SEQ ID NO: 1299341 - DNA, 22 bp, Artificial Sequence
  chemically synthesized
aaaacttacttcattcttttga

SEQ ID NO: 1299342 - DNA, 22 bp, Artificial Sequence
  chemically synthesized
ctaaaaacttacttcattcttt

SEQ ID NO: 1299343 - DNA, 22 bp, Artificial Sequence
  chemically synthesized
ctcatgctcaaaagaatgaagt

SEQ ID NO: 1299344 - DNA, 22 bp, Artificial Sequence
  chemically synthesized
ttactaaaaacttacttcattc

SEQ ID NO: 1299345 - DNA, 22 bp, Artificial Sequence
  chemically synthesized
atgctcaaaagaatgaagtaag

SEQ ID NO: 1299346 - DNA, 22 bp, Artificial Sequence
  chemically synthesized
cattattactaaaaacttactt

SEQ ID NO: 1299347 - DNA, 22 bp, Artificial Sequence
  chemically synthesized
ccattattactaaaaacttact

SEQ ID NO: 1299348 - DNA, 22 bp, Artificial Sequence
  chemically synthesized
aaaagaatgaagtaagttttta

SEQ ID NO: 1299349 - DNA, 22 bp, Artificial Sequence
  chemically synthesized
tttccattattactaaaaactt

SEQ ID NO: 1299350 - DNA, 22 bp, Artificial Sequence
  chemically synthesized
ttagtaataatggaaataatgg

SEQ ID NO: 1299351 - DNA, 22 bp, Artificial Sequence
  chemically synthesized
tagtaataatggaaataatgga

SEQ ID NO: 1299352 - DNA, 22 bp, Artificial Sequence
  chemically synthesized
agtaataatggaaataatggat

SEQ ID NO: 1299353 - DNA, 22 bp, Artificial Sequence
  chemically synthesized
gtaataatggaaataatggata

SEQ ID NO: 1299354 - DNA, 22 bp, Artificial Sequence
  chemically synthesized
taatgcaccacagaaatatcca

SEQ ID NO: 1299355 - DNA, 22 bp, Artificial Sequence
  chemically synthesized
taaattataatgcaccacagaa

SEQ ID NO: 1299356 - DNA, 22 bp, Artificial Sequence
  chemically synthesized
ataaattataatgcaccacaga

SEQ ID NO: 1299357 - DNA, 22 bp, Artificial Sequence
  chemically synthesized
tataaattataatgcaccacag

SEQ ID NO: 1299358 - DNA, 22 bp, Artificial Sequence
  chemically synthesized
aaatcactttataaattataat

SEQ ID NO: 1299359 - DNA, 22 bp, Artificial Sequence
  chemically synthesized
gaaatcactttataaattataa

SEQ ID NO: 1299360 - DNA, 22 bp, Artificial Sequence
  chemically synthesized
ctgtggtgcattataatttata

SEQ ID NO: 1299361 - DNA, 22 bp, Artificial Sequence
  chemically synthesized
tgtggtgcattataatttataa

SEQ ID NO: 1299362 - DNA, 22 bp, Artificial Sequence
  chemically synthesized
tggtgcattataatttataaag

SEQ ID NO: 1299363 - DNA, 22 bp, Artificial Sequence
  chemically synthesized
taatttataaagtgatttcaaa

SEQ ID NO: 1299364 - DNA, 22 bp, Artificial Sequence
  chemically synthesized
aacaagatgagatatttgaaat

SEQ ID NO: 1299365 - DNA, 22 bp, Artificial Sequence
  chemically synthesized
aaacaagatgagatatttgaaa

SEQ ID NO: 1299366 - DNA, 22 bp, Artificial Sequence
  chemically synthesized
ataaagtgatttcaaatatctc

SEQ ID NO: 1299367 - DNA, 22 bp, Artificial Sequence
  chemically synthesized
taaagtgatttcaaatatctca

SEQ ID NO: 1299368 - DNA, 22 bp, Artificial Sequence
  chemically synthesized
atgtttaaacaagatgagatat

SEQ ID NO: 1299369 - DNA, 22 bp, Artificial Sequence
  chemically synthesized
caaatatctcatcttgtttaaa

SEQ ID NO: 1299370 - DNA, 22 bp, Artificial Sequence
  chemically synthesized
aaatatctcatcttgtttaaac

SEQ ID NO: 1299371 - DNA, 22 bp, Artificial Sequence
  chemically synthesized
cacccacatactcatgtttaaa

SEQ ID NO: 1299372 - DNA, 22 bp, Artificial Sequence
  chemically synthesized
atcttgtttaaacatgagtatg

SEQ ID NO: 1299373 - DNA, 22 bp, Artificial Sequence
  chemically synthesized
acaagtctacacccacatactc

SEQ ID NO: 1299374 - DNA, 22 bp, Artificial Sequence
  chemically synthesized
gtttaaacatgagtatgtgggt

SEQ ID NO: 1299375 - DNA, 22 bp, Artificial Sequence
  chemically synthesized
tttaaacatgagtatgtgggtg

SEQ ID NO: 1299376 - DNA, 22 bp, Artificial Sequence
  chemically synthesized
ctaacaagtctacacccacata

SEQ ID NO: 1299377 - DNA, 22 bp, Artificial Sequence
  chemically synthesized
aaacatgagtatgtgggtgtag

SEQ ID NO: 1299378 - DNA, 22 bp, Artificial Sequence
  chemically synthesized
ctcctaacaagtctacacccac

SEQ ID NO: 1299379 - DNA, 22 bp, Artificial Sequence
  chemically synthesized
aacatgagtatgtgggtgtaga

SEQ ID NO: 1299380 - DNA, 22 bp, Artificial Sequence
  chemically synthesized
actcctaacaagtctacaccca

SEQ ID NO: 1299381 - DNA, 22 bp, Artificial Sequence
  chemically synthesized
tactcctaacaagtctacaccc

SEQ ID NO: 1299382 - DNA, 22 bp, Artificial Sequence
  chemically synthesized
ttactcctaacaagtctacacc

SEQ ID NO: 1299383 - DNA, 22 bp, Artificial Sequence
  chemically synthesized
tttttactcctaacaagtctac

SEQ ID NO: 1299384 - DNA, 22 bp, Artificial Sequence
  chemically synthesized
atttttactcctaacaagtcta

SEQ ID NO: 1299385 - DNA, 22 bp, Artificial Sequence
  chemically synthesized
atagtaacttatttttactcct

SEQ ID NO: 1299386 - DNA, 22 bp, Artificial Sequence
  chemically synthesized
attaatagtaacttatttttac

SEQ ID NO: 1299387 - DNA, 22 bp, Artificial Sequence
  chemically synthesized
gttaggagtaaaaataagttac

SEQ ID NO: 1299388 - DNA, 22 bp, Artificial Sequence
  chemically synthesized
ttaggagtaaaaataagttact

SEQ ID NO: 1299389 - DNA, 22 bp, Artificial Sequence
  chemically synthesized
catactaattaatagtaactta

SEQ ID NO: 1299390 - DNA, 22 bp, Artificial Sequence
  chemically synthesized
ggagtaaaaataagttactatt

SEQ ID NO: 1299391 - DNA, 22 bp, Artificial Sequence
  chemically synthesized
aagtctgcatactaattaatag

SEQ ID NO: 1299392 - DNA, 22 bp, Artificial Sequence
  chemically synthesized
caagtctgcatactaattaata

SEQ ID NO: 1299393 - DNA, 22 bp, Artificial Sequence
  chemically synthesized
ctattaattagtatgcagactt

SEQ ID NO: 1299394 - DNA, 22 bp, Artificial Sequence
  chemically synthesized
ccaaagcacatttcaagtctgc

SEQ ID NO: 1299395 - DNA, 22 bp, Artificial Sequence
  chemically synthesized
ttaattagtatgcagacttgaa

SEQ ID NO: 1299396 - DNA, 22 bp, Artificial Sequence
  chemically synthesized
attagtatgcagacttgaaatg

SEQ ID NO: 1299397 - DNA, 22 bp, Artificial Sequence
  chemically synthesized
gtatgcagacttgaaatgtgct

SEQ ID NO: 1299398 - DNA, 22 bp, Artificial Sequence
  chemically synthesized
atgaacactaccaaagcacatt

SEQ ID NO: 1299399 - DNA, 22 bp, Artificial Sequence
  chemically synthesized
tcatgaacactaccaaagcaca

SEQ ID NO: 1299400 - DNA, 22 bp, Artificial Sequence
  chemically synthesized
ctcatgaacactaccaaagcac

SEQ ID NO: 1299401 - DNA, 22 bp, Artificial Sequence
  chemically synthesized
tctcatgaacactaccaaagca

SEQ ID NO: 1299402 - DNA, 22 bp, Artificial Sequence
  chemically synthesized
gaaatgtgctttggtagtgttc

SEQ ID NO: 1299403 - DNA, 22 bp, Artificial Sequence
  chemically synthesized
aaatgtgctttggtagtgttca

SEQ ID NO: 1299404 - DNA, 22 bp, Artificial Sequence
  chemically synthesized
tggtagtgttcatgagaaagat

SEQ ID NO: 1299405 - DNA, 22 bp, Artificial Sequence
  chemically synthesized
ggtagtgttcatgagaaagatg

SEQ ID NO: 1299406 - DNA, 22 bp, Artificial Sequence
  chemically synthesized
acaaaaataagtcatctttctc

SEQ ID NO: 1299407 - DNA, 22 bp, Artificial Sequence
  chemically synthesized
gtagtgttcatgagaaagatga

SEQ ID NO: 1299408 - DNA, 22 bp, Artificial Sequence
  chemically synthesized
aacaaaaataagtcatctttct

SEQ ID NO: 1299409 - DNA, 22 bp, Artificial Sequence
  chemically synthesized
taacaaaaataagtcatctttc

SEQ ID NO: 1299410 - DNA, 22 bp, Artificial Sequence
  chemically synthesized
ctttaacaaaaataagtcatct

SEQ ID NO: 1299411 - DNA, 22 bp, Artificial Sequence
  chemically synthesized
ttactttaacaaaaataagtca

SEQ ID NO: 1299412 - DNA, 22 bp, Artificial Sequence
  chemically synthesized
atgagaaagatgacttattttt

SEQ ID NO: 1299413 - DNA, 22 bp, Artificial Sequence
  chemically synthesized
tggttattactttaacaaaaat

SEQ ID NO: 1299414 - DNA, 22 bp, Artificial Sequence
  chemically synthesized
gtctatggttattactttaaca

SEQ ID NO: 1299415 - DNA, 22 bp, Artificial Sequence
  chemically synthesized
atttttgttaaagtaataacca

SEQ ID NO: 1299416 - DNA, 22 bp, Artificial Sequence
  chemically synthesized
tttttgttaaagtaataaccat

SEQ ID NO: 1299417 - DNA, 22 bp, Artificial Sequence
  chemically synthesized
tcataattagtctatggttatt

SEQ ID NO: 1299418 - DNA, 22 bp, Artificial Sequence
  chemically synthesized
ttgttaaagtaataaccataga

SEQ ID NO: 1299419 - DNA, 22 bp, Artificial Sequence
  chemically synthesized
tgtcataattagtctatggtta

SEQ ID NO: 1299420 - DNA, 22 bp, Artificial Sequence
  chemically synthesized
tgttaaagtaataaccatagac

SEQ ID NO: 1299421 - DNA, 22 bp, Artificial Sequence
  chemically synthesized
gttaaagtaataaccatagact

SEQ ID NO: 1299422 - DNA, 22 bp, Artificial Sequence
  chemically synthesized
ttaaagtaataaccatagacta

SEQ ID NO: 1299423 - DNA, 22 bp, Artificial Sequence
  chemically synthesized
ttctgtcataattagtctatgg

SEQ ID NO: 1299424 - DNA, 22 bp, Artificial Sequence
  chemically synthesized
attctgtcataattagtctatg

SEQ ID NO: 1299425 - DNA, 22 bp, Artificial Sequence
  chemically synthesized
aagtaataaccatagactaatt

SEQ ID NO: 1299426 - DNA, 22 bp, Artificial Sequence
  chemically synthesized
atttattctgtcataattagtc

SEQ ID NO: 1299427 - DNA, 22 bp, Artificial Sequence
  chemically synthesized
gatttattctgtcataattagt

SEQ ID NO: 1299428 - DNA, 22 bp, Artificial Sequence
  chemically synthesized
tgatttattctgtcataattag

SEQ ID NO: 1299429 - DNA, 22 bp, Artificial Sequence
  chemically synthesized
ttttgatttattctgtcataat

SEQ ID NO: 1299430 - DNA, 22 bp, Artificial Sequence
  chemically synthesized
attttgatttattctgtcataa

SEQ ID NO: 1299431 - DNA, 22 bp, Artificial Sequence
  chemically synthesized
accttattttgatttattctgt

SEQ ID NO: 1299432 - DNA, 22 bp, Artificial Sequence
  chemically synthesized
gaccttattttgatttattctg

SEQ ID NO: 1299433 - DNA, 22 bp, Artificial Sequence
  chemically synthesized
attatgacagaataaatcaaaa

SEQ ID NO: 1299434 - DNA, 22 bp, Artificial Sequence
  chemically synthesized
gagaccttgaccttattttgat

SEQ ID NO: 1299435 - DNA, 22 bp, Artificial Sequence
  chemically synthesized
tgacagaataaatcaaaataag

SEQ ID NO: 1299436 - DNA, 22 bp, Artificial Sequence
  chemically synthesized
cactggagaccttgaccttatt

SEQ ID NO: 1299437 - DNA, 22 bp, Artificial Sequence
  chemically synthesized
aattacactggagaccttgacc

SEQ ID NO: 1299438 - DNA, 22 bp, Artificial Sequence
  chemically synthesized
taaattacactggagaccttga

SEQ ID NO: 1299439 - DNA, 22 bp, Artificial Sequence
  chemically synthesized
acctctaaattacactggagac

SEQ ID NO: 1299440 - DNA, 22 bp, Artificial Sequence
  chemically synthesized
cacctctaaattacactggaga

SEQ ID NO: 1299441 - DNA, 22 bp, Artificial Sequence
  chemically synthesized
atttcacctctaaattacactg

SEQ ID NO: 1299442 - DNA, 22 bp, Artificial Sequence
  chemically synthesized
cagtgtaatttagaggtgaaat

SEQ ID NO: 1299443 - DNA, 22 bp, Artificial Sequence
  chemically synthesized
caatatccaagtagttaatttc

SEQ ID NO: 1299444 - DNA, 22 bp, Artificial Sequence
  chemically synthesized
ctacaatatccaagtagttaat

SEQ ID NO: 1299445 - DNA, 22 bp, Artificial Sequence
  chemically synthesized
tgctacaatatccaagtagtta

SEQ ID NO: 1299446 - DNA, 22 bp, Artificial Sequence
  chemically synthesized
agaggtgaaattaactacttgg

SEQ ID NO: 1299447 - DNA, 22 bp, Artificial Sequence
  chemically synthesized
gaggtgaaattaactacttgga

SEQ ID NO: 1299448 - DNA, 22 bp, Artificial Sequence
  chemically synthesized
gcagttctgctacaatatccaa

SEQ ID NO: 1299449 - DNA, 22 bp, Artificial Sequence
  chemically synthesized
gttagcagttctgctacaatat

SEQ ID NO: 1299450 - DNA, 22 bp, Artificial Sequence
  chemically synthesized
actacttggatattgtagcaga

SEQ ID NO: 1299451 - DNA, 22 bp, Artificial Sequence
  chemically synthesized
cttggatattgtagcagaactg

SEQ ID NO: 1299452 - DNA, 22 bp, Artificial Sequence
  chemically synthesized
ggatattgtagcagaactgcta

SEQ ID NO: 1299453 - DNA, 22 bp, Artificial Sequence
  chemically synthesized
gatattgtagcagaactgctaa

SEQ ID NO: 1299454 - DNA, 22 bp, Artificial Sequence
  chemically synthesized
tagcagaactgctaactagatg

SEQ ID NO: 1299455 - DNA, 22 bp, Artificial Sequence
  chemically synthesized
tatggaaacaggcatctagtta

SEQ ID NO: 1299456 - DNA, 22 bp, Artificial Sequence
  chemically synthesized
ctaactagatgcctgtttccat

SEQ ID NO: 1299457 - DNA, 22 bp, Artificial Sequence
  chemically synthesized
agtaggcagctgtatggaaaca

SEQ ID NO: 1299458 - DNA, 22 bp, Artificial Sequence
  chemically synthesized
actagatgcctgtttccataca

SEQ ID NO: 1299459 - DNA, 22 bp, Artificial Sequence
  chemically synthesized
gatgcctgtttccatacagctg

SEQ ID NO: 1299460 - DNA, 22 bp, Artificial Sequence
  chemically synthesized
aaagtaatattgagtaggcagc

SEQ ID NO: 1299461 - DNA, 22 bp, Artificial Sequence
  chemically synthesized
aaaagtaatattgagtaggcag

SEQ ID NO: 1299462 - DNA, 22 bp, Artificial Sequence
  chemically synthesized
tttccatacagctgcctactca

SEQ ID NO: 1299463 - DNA, 22 bp, Artificial Sequence
  chemically synthesized
taaaagtaatattgagtaggca

SEQ ID NO: 1299464 - DNA, 22 bp, Artificial Sequence
  chemically synthesized
ttaaaagtaatattgagtaggc

SEQ ID NO: 1299465 - DNA, 22 bp, Artificial Sequence
  chemically synthesized
ccatacagctgcctactcaata

SEQ ID NO: 1299466 - DNA, 22 bp, Artificial Sequence
  chemically synthesized
catacagctgcctactcaatat

SEQ ID NO: 1299467 - DNA, 22 bp, Artificial Sequence
  chemically synthesized
aatcttttaaaagtaatattga

SEQ ID NO: 1299468 - DNA, 22 bp, Artificial Sequence
  chemically synthesized
gaatcttttaaaagtaatattg

SEQ ID NO: 1299469 - DNA, 22 bp, Artificial Sequence
  chemically synthesized
cctactcaatattacttttaaa

SEQ ID NO: 1299470 - DNA, 22 bp, Artificial Sequence
  chemically synthesized
ctcaatattacttttaaaagat

SEQ ID NO: 1299471 - DNA, 22 bp, Artificial Sequence
  chemically synthesized
aggggagaatttgaatctttta

SEQ ID NO: 1299472 - DNA, 22 bp, Artificial Sequence
  chemically synthesized
aatattacttttaaaagattca

SEQ ID NO: 1299473 - DNA, 22 bp, Artificial Sequence
  chemically synthesized
caggggagaatttgaatctttt

SEQ ID NO: 1299474 - DNA, 22 bp, Artificial Sequence
  chemically synthesized
tcaggggagaatttgaatcttt

SEQ ID NO: 1299475 - DNA, 22 bp, Artificial Sequence
  chemically synthesized
aattttcaggggagaatttgaa

SEQ ID NO: 1299476 - DNA, 22 bp, Artificial Sequence
  chemically synthesized
cttttaaaagattcaaattctc

SEQ ID NO: 1299477 - DNA, 22 bp, Artificial Sequence
  chemically synthesized
aaattttcaggggagaatttga

SEQ ID NO: 1299478 - DNA, 22 bp, Artificial Sequence
  chemically synthesized
taaattttcaggggagaatttg

SEQ ID NO: 1299479 - DNA, 22 bp, Artificial Sequence
  chemically synthesized
ttaaattttcaggggagaattt

SEQ ID NO: 1299480 - DNA, 22 bp, Artificial Sequence
  chemically synthesized
ttaaaagattcaaattctcccc

SEQ ID NO: 1299481 - DNA, 22 bp, Artificial Sequence
  chemically synthesized
tttaaattttcaggggagaatt

SEQ ID NO: 1299482 - DNA, 22 bp, Artificial Sequence
  chemically synthesized
taaaagattcaaattctcccct

SEQ ID NO: 1299483 - DNA, 22 bp, Artificial Sequence
  chemically synthesized
ttttaaattttcaggggagaat

SEQ ID NO: 1299484 - DNA, 22 bp, Artificial Sequence
  chemically synthesized
aaaagattcaaattctcccctg

SEQ ID NO: 1299485 - DNA, 22 bp, Artificial Sequence
  chemically synthesized
aaagattcaaattctcccctga

SEQ ID NO: 1299486 - DNA, 22 bp, Artificial Sequence
  chemically synthesized
aaattctcccctgaaaatttaa

SEQ ID NO: 1299487 - DNA, 22 bp, Artificial Sequence
  chemically synthesized
tcccctgaaaatttaaaaaaat

SEQ ID NO: 1299488 - DNA, 22 bp, Artificial Sequence
  chemically synthesized
ccctgaaaatttaaaaaaatac

SEQ ID NO: 1299489 - DNA, 22 bp, Artificial Sequence
  chemically synthesized
aaaatttaaaaaaatacattgt

SEQ ID NO: 1299490 - DNA, 22 bp, Artificial Sequence
  chemically synthesized
aaaaaaatacattgttctgtgg

SEQ ID NO: 1299491 - DNA, 22 bp, Artificial Sequence
  chemically synthesized
aaaaaatacattgttctgtggt

SEQ ID NO: 1299492 - DNA, 22 bp, Artificial Sequence
  chemically synthesized
ttctgtggtgtatatttatcta

SEQ ID NO: 1299493 - DNA, 22 bp, Artificial Sequence
  chemically synthesized
caacccataaaaatagataaat

SEQ ID NO: 1299494 - DNA, 22 bp, Artificial Sequence
  chemically synthesized
gcaacccataaaaatagataaa

SEQ ID NO: 1299495 - DNA, 22 bp, Artificial Sequence
  chemically synthesized
tgtggtgtatatttatctattt

SEQ ID NO: 1299496 - DNA, 22 bp, Artificial Sequence
  chemically synthesized
tgcaacccataaaaatagataa

SEQ ID NO: 1299497 - DNA, 22 bp, Artificial Sequence
  chemically synthesized
tggtgtatatttatctattttt

SEQ ID NO: 1299498 - DNA, 22 bp, Artificial Sequence
  chemically synthesized
caaagaagtattttgcaaccca

SEQ ID NO: 1299499 - DNA, 22 bp, Artificial Sequence
  chemically synthesized
atctatttttatgggttgcaaa

SEQ ID NO: 1299500 - DNA, 22 bp, Artificial Sequence
  chemically synthesized
gcaaagaagtattttgcaaccc

SEQ ID NO: 1299501 - DNA, 22 bp, Artificial Sequence
  chemically synthesized
tctatttttatgggttgcaaaa

SEQ ID NO: 1299502 - DNA, 22 bp, Artificial Sequence
  chemically synthesized
gtttgcaaagaagtattttgca

SEQ ID NO: 1299503 - DNA, 22 bp, Artificial Sequence
  chemically synthesized
tttttatgggttgcaaaatact

SEQ ID NO: 1299504 - DNA, 22 bp, Artificial Sequence
  chemically synthesized
ggtttgcaaagaagtattttgc

SEQ ID NO: 1299505 - DNA, 22 bp, Artificial Sequence
  chemically synthesized
tggtttgcaaagaagtattttg

SEQ ID NO: 1299506 - DNA, 22 bp, Artificial Sequence
  chemically synthesized
ttggtttgcaaagaagtatttt

SEQ ID NO: 1299507 - DNA, 22 bp, Artificial Sequence
  chemically synthesized
ttatgggttgcaaaatacttct

SEQ ID NO: 1299508 - DNA, 22 bp, Artificial Sequence
  chemically synthesized
tatgggttgcaaaatacttctt

SEQ ID NO: 1299509 - DNA, 22 bp, Artificial Sequence
  chemically synthesized
atgggttgcaaaatacttcttt

SEQ ID NO: 1299510 - DNA, 22 bp, Artificial Sequence
  chemically synthesized
cttttggtttgcaaagaagtat

SEQ ID NO: 1299511 - DNA, 22 bp, Artificial Sequence
  chemically synthesized
tgggttgcaaaatacttctttg

SEQ ID NO: 1299512 - DNA, 22 bp, Artificial Sequence
  chemically synthesized
ccttttggtttgcaaagaagta

SEQ ID NO: 1299513 - DNA, 22 bp, Artificial Sequence
  chemically synthesized
tccttttggtttgcaaagaagt

SEQ ID NO: 1299514 - DNA, 22 bp, Artificial Sequence
  chemically synthesized
ctttccttttggtttgcaaaga

SEQ ID NO: 1299515 - DNA, 22 bp, Artificial Sequence
  chemically synthesized
gctttccttttggtttgcaaag

SEQ ID NO: 1299516 - DNA, 22 bp, Artificial Sequence
  chemically synthesized
caaaatacttctttgcaaacca

SEQ ID NO: 1299517 - DNA, 22 bp, Artificial Sequence
  chemically synthesized
tttgctttccttttggtttgca

SEQ ID NO: 1299518 - DNA, 22 bp, Artificial Sequence
  chemically synthesized
gctgtttgctttccttttggtt

SEQ ID NO: 1299519 - DNA, 22 bp, Artificial Sequence
  chemically synthesized
ggctgtttgctttccttttggt

SEQ ID NO: 1299520 - DNA, 22 bp, Artificial Sequence
  chemically synthesized
ctttgcaaaccaaaaggaaagc

SEQ ID NO: 1299521 - DNA, 22 bp, Artificial Sequence
  chemically synthesized
tttgcaaaccaaaaggaaagca

SEQ ID NO: 1299522 - DNA, 22 bp, Artificial Sequence
  chemically synthesized
tgcaaaccaaaaggaaagcaaa

SEQ ID NO: 1299523 - DNA, 22 bp, Artificial Sequence
  chemically synthesized
gcaaaccaaaaggaaagcaaac

SEQ ID NO: 1299524 - DNA, 22 bp, Artificial Sequence
  chemically synthesized
caaaccaaaaggaaagcaaaca

SEQ ID NO: 1299525 - DNA, 22 bp, Artificial Sequence
  chemically synthesized
tgtgtcgtgcacatttggctgt

SEQ ID NO: 1299526 - DNA, 22 bp, Artificial Sequence
  chemically synthesized
ttgtgtgtcgtgcacatttggc

SEQ ID NO: 1299527 - DNA, 22 bp, Artificial Sequence
  chemically synthesized
gaaatggctgttgtgtgtcgtg

SEQ ID NO: 1299528 - DNA, 22 bp, Artificial Sequence
  chemically synthesized
ggaaatggctgttgtgtgtcgt

SEQ ID NO: 1299529 - DNA, 22 bp, Artificial Sequence
  chemically synthesized
acagtatgtttggaaatggctg

SEQ ID NO: 1299530 - DNA, 22 bp, Artificial Sequence
  chemically synthesized
attaacagtatgtttggaaatg

SEQ ID NO: 1299531 - DNA, 22 bp, Artificial Sequence
  chemically synthesized
aagcatctcattaacagtatgt

SEQ ID NO: 1299532 - DNA, 22 bp, Artificial Sequence
  chemically synthesized
taaagcatctcattaacagtat

SEQ ID NO: 1299533 - DNA, 22 bp, Artificial Sequence
  chemically synthesized
ctaaagcatctcattaacagta

SEQ ID NO: 1299534 - DNA, 22 bp, Artificial Sequence
  chemically synthesized
tttctaaagcatctcattaaca

SEQ ID NO: 1299535 - DNA, 22 bp, Artificial Sequence
  chemically synthesized
ccaaacatactgttaatgagat

SEQ ID NO: 1299536 - DNA, 22 bp, Artificial Sequence
  chemically synthesized
caaacatactgttaatgagatg

SEQ ID NO: 1299537 - DNA, 22 bp, Artificial Sequence
  chemically synthesized
tctgtttctaaagcatctcatt

SEQ ID NO: 1299538 - DNA, 22 bp, Artificial Sequence
  chemically synthesized
gtctgtttctaaagcatctcat

SEQ ID NO: 1299539 - DNA, 22 bp, Artificial Sequence
  chemically synthesized
accatttgtctgtttctaaagc

SEQ ID NO: 1299540 - DNA, 22 bp, Artificial Sequence
  chemically synthesized
gaccatttgtctgtttctaaag

SEQ ID NO: 1299541 - DNA, 22 bp, Artificial Sequence
  chemically synthesized
ttaatgagatgctttagaaaca

SEQ ID NO: 1299542 - DNA, 22 bp, Artificial Sequence
  chemically synthesized
atgagatgctttagaaacagac

SEQ ID NO: 1299543 - DNA, 22 bp, Artificial Sequence
  chemically synthesized
tgtttgaccatttgtctgtttc

SEQ ID NO: 1299544 - DNA, 22 bp, Artificial Sequence
  chemically synthesized
tagaaacagacaaatggtcaaa

SEQ ID NO: 1299545 - DNA, 22 bp, Artificial Sequence
  chemically synthesized
agaaacagacaaatggtcaaac

SEQ ID NO: 1299546 - DNA, 22 bp, Artificial Sequence
  chemically synthesized
gaaacagacaaatggtcaaaca

SEQ ID NO: 1299547 - DNA, 22 bp, Artificial Sequence
  chemically synthesized
taatccaggccctgtgtttgac

SEQ ID NO: 1299548 - DNA, 22 bp, Artificial Sequence
  chemically synthesized
ataatccaggccctgtgtttga

SEQ ID NO: 1299549 - DNA, 22 bp, Artificial Sequence
  chemically synthesized
aatatccccttataatccaggc

SEQ ID NO: 1299550 - DNA, 22 bp, Artificial Sequence
  chemically synthesized
aaatatccccttataatccagg

SEQ ID NO: 1299551 - DNA, 22 bp, Artificial Sequence
  chemically synthesized
tgatttaaatatccccttataa

SEQ ID NO: 1299552 - DNA, 22 bp, Artificial Sequence
  chemically synthesized
gtgatttaaatatccccttata

SEQ ID NO: 1299553 - DNA, 22 bp, Artificial Sequence
  chemically synthesized
gattataaggggatatttaaat

SEQ ID NO: 1299554 - DNA, 22 bp, Artificial Sequence
  chemically synthesized
taaggggatatttaaatcacaa

SEQ ID NO: 1299555 - DNA, 22 bp, Artificial Sequence
  chemically synthesized
agtaaatacatcttgtgattta

SEQ ID NO: 1299556 - DNA, 22 bp, Artificial Sequence
  chemically synthesized
aaatcacaagatgtatttactc

SEQ ID NO: 1299557 - DNA, 22 bp, Artificial Sequence
  chemically synthesized
aatcacaagatgtatttactca

SEQ ID NO: 1299558 - DNA, 22 bp, Artificial Sequence
  chemically synthesized
catagtgtaagttgagtaaata

SEQ ID NO: 1299559 - DNA, 22 bp, Artificial Sequence
  chemically synthesized
ctccatagtgtaagttgagtaa

SEQ ID NO: 1299560 - DNA, 22 bp, Artificial Sequence
  chemically synthesized
actccatagtgtaagttgagta

SEQ ID NO: 1299561 - DNA, 22 bp, Artificial Sequence
  chemically synthesized
tactccatagtgtaagttgagt

SEQ ID NO: 1299562 - DNA, 22 bp, Artificial Sequence
  chemically synthesized
acctttactccatagtgtaagt

SEQ ID NO: 1299563 - DNA, 22 bp, Artificial Sequence
  chemically synthesized
ttaacctttactccatagtgta

SEQ ID NO: 1299564 - DNA, 22 bp, Artificial Sequence
  chemically synthesized
attaacctttactccatagtgt

SEQ ID NO: 1299565 - DNA, 22 bp, Artificial Sequence
  chemically synthesized
tattaacctttactccatagtg

SEQ ID NO: 1299566 - DNA, 22 bp, Artificial Sequence
  chemically synthesized
actcaacttacactatggagta

SEQ ID NO: 1299567 - DNA, 22 bp, Artificial Sequence
  chemically synthesized
ctcaacttacactatggagtaa

SEQ ID NO: 1299568 - DNA, 22 bp, Artificial Sequence
  chemically synthesized
aacttacactatggagtaaagg

SEQ ID NO: 1299569 - DNA, 22 bp, Artificial Sequence
  chemically synthesized
tgccattttattaacctttact

SEQ ID NO: 1299570 - DNA, 22 bp, Artificial Sequence
  chemically synthesized
acactatggagtaaaggttaat

SEQ ID NO: 1299571 - DNA, 22 bp, Artificial Sequence
  chemically synthesized
ctatgccattttattaaccttt

SEQ ID NO: 1299572 - DNA, 22 bp, Artificial Sequence
  chemically synthesized
cactatggagtaaaggttaata

SEQ ID NO: 1299573 - DNA, 22 bp, Artificial Sequence
  chemically synthesized
atctactatgccattttattaa

SEQ ID NO: 1299574 - DNA, 22 bp, Artificial Sequence
  chemically synthesized
tggagtaaaggttaataaaatg

SEQ ID NO: 1299575 - DNA, 22 bp, Artificial Sequence
  chemically synthesized
tcctcatctactatgccatttt

SEQ ID NO: 1299576 - DNA, 22 bp, Artificial Sequence
  chemically synthesized
ataaaatggcatagtagatgag

SEQ ID NO: 1299577 - DNA, 22 bp, Artificial Sequence
  chemically synthesized
ggtgaaataagggatgaggcat

SEQ ID NO: 1299578 - DNA, 22 bp, Artificial Sequence
  chemically synthesized
agggatggctcggtgaaataag

SEQ ID NO: 1299579 - DNA, 22 bp, Artificial Sequence
  chemically synthesized
atcccttatttcaccgagccat

SEQ ID NO: 1299580 - DNA, 22 bp, Artificial Sequence
  chemically synthesized
taggtgaactcagggatggctc

SEQ ID NO: 1299581 - DNA, 22 bp, Artificial Sequence
  chemically synthesized
atttcaccgagccatccctgag

SEQ ID NO: 1299582 - DNA, 22 bp, Artificial Sequence
  chemically synthesized
tttcaccgagccatccctgagt

SEQ ID NO: 1299583 - DNA, 22 bp, Artificial Sequence
  chemically synthesized
tagttataggtgaactcaggga

SEQ ID NO: 1299584 - DNA, 22 bp, Artificial Sequence
  chemically synthesized
caccgagccatccctgagttca

SEQ ID NO: 1299585 - DNA, 22 bp, Artificial Sequence
  chemically synthesized
accgagccatccctgagttcac

SEQ ID NO: 1299586 - DNA, 22 bp, Artificial Sequence
  chemically synthesized
actatagttataggtgaactca

SEQ ID NO: 1299587 - DNA, 22 bp, Artificial Sequence
  chemically synthesized
agttcacctataactatagtga

SEQ ID NO: 1299588 - DNA, 22 bp, Artificial Sequence
  chemically synthesized
acctataactatagtgaacgga

SEQ ID NO: 1299589 - DNA, 22 bp, Artificial Sequence
  chemically synthesized
agcatccacagaatccgttcac

SEQ ID NO: 1299590 - DNA, 22 bp, Artificial Sequence
  chemically synthesized
cagcatccacagaatccgttca

SEQ ID NO: 1299591 - DNA, 22 bp, Artificial Sequence
  chemically synthesized
taactatagtgaacggattctg

SEQ ID NO: 1299592 - DNA, 22 bp, Artificial Sequence
  chemically synthesized
tagtgaacggattctgtggatg

SEQ ID NO: 1299593 - DNA, 22 bp, Artificial Sequence
  chemically synthesized
tggtgaggaatcttcagcatcc

SEQ ID NO: 1299594 - DNA, 22 bp, Artificial Sequence
  chemically synthesized
gtggtgaggaatcttcagcatc

SEQ ID NO: 1299595 - DNA, 22 bp, Artificial Sequence
  chemically synthesized
tgtggatgctgaagattcctca

SEQ ID NO: 1299596 - DNA, 22 bp, Artificial Sequence
  chemically synthesized
tggatgctgaagattcctcacc

SEQ ID NO: 1299597 - DNA, 22 bp, Artificial Sequence
  chemically synthesized
aagattcctcaccacaagcatc

SEQ ID NO: 1299598 - DNA, 22 bp, Artificial Sequence
  chemically synthesized
ctcaccacaagcatccacatct

SEQ ID NO: 1299599 - DNA, 22 bp, Artificial Sequence
  chemically synthesized
accacaagcatccacatctctc

SEQ ID NO: 1299600 - DNA, 22 bp, Artificial Sequence
  chemically synthesized
acacaaagaaacagagagatgt

SEQ ID NO: 1299601 - DNA, 22 bp, Artificial Sequence
  chemically synthesized
aacacaaagaaacagagagatg

SEQ ID NO: 1299602 - DNA, 22 bp, Artificial Sequence
  chemically synthesized
aagaaagccttaacacaaagaa

SEQ ID NO: 1299603 - DNA, 22 bp, Artificial Sequence
  chemically synthesized
aactgaagaaagccttaacaca

SEQ ID NO: 1299604 - DNA, 22 bp, Artificial Sequence
  chemically synthesized
tctgtttctttgtgttaaggct

SEQ ID NO: 1299605 - DNA, 22 bp, Artificial Sequence
  chemically synthesized
ctaaactgaagaaagccttaac

SEQ ID NO: 1299606 - DNA, 22 bp, Artificial Sequence
  chemically synthesized
tgtttctttgtgttaaggcttt

SEQ ID NO: 1299607 - DNA, 22 bp, Artificial Sequence
  chemically synthesized
tttctttgtgttaaggctttct

SEQ ID NO: 1299608 - DNA, 22 bp, Artificial Sequence
  chemically synthesized
ctttgtgttaaggctttcttca

SEQ ID NO: 1299609 - DNA, 22 bp, Artificial Sequence
  chemically synthesized
tttgtgttaaggctttcttcag

SEQ ID NO: 1299610 - DNA, 22 bp, Artificial Sequence
  chemically synthesized
tgtgttaaggctttcttcagtt

SEQ ID NO: 1299611 - DNA, 22 bp, Artificial Sequence
  chemically synthesized
gtgttaaggctttcttcagttt

SEQ ID NO: 1299612 - DNA, 22 bp, Artificial Sequence
  chemically synthesized
ccaagccctcctaaactgaaga

SEQ ID NO: 1299613 - DNA, 22 bp, Artificial Sequence
  chemically synthesized
tgttaaggctttcttcagttta

SEQ ID NO: 1299614 - DNA, 22 bp, Artificial Sequence
  chemically synthesized
accaagccctcctaaactgaag

SEQ ID NO: 1299615 - DNA, 22 bp, Artificial Sequence
  chemically synthesized
aggctttcttcagtttaggagg

SEQ ID NO: 1299616 - DNA, 22 bp, Artificial Sequence
  chemically synthesized
tcttcagtttaggagggcttgg

SEQ ID NO: 1299617 - DNA, 22 bp, Artificial Sequence
  chemically synthesized
caaatgggcttaccaagccctc

SEQ ID NO: 1299618 - DNA, 22 bp, Artificial Sequence
  chemically synthesized
cttcagtttaggagggcttggt

SEQ ID NO: 1299619 - DNA, 22 bp, Artificial Sequence
  chemically synthesized
ttcagtttaggagggcttggta

SEQ ID NO: 1299620 - DNA, 22 bp, Artificial Sequence
  chemically synthesized
cagtttaggagggcttggtaag

SEQ ID NO: 1299621 - DNA, 22 bp, Artificial Sequence
  chemically synthesized
agtttaggagggcttggtaagc

SEQ ID NO: 1299622 - DNA, 22 bp, Artificial Sequence
  chemically synthesized
ccctgcaaatgggcttaccaag

SEQ ID NO: 1299623 - DNA, 22 bp, Artificial Sequence
  chemically synthesized
aggagggcttggtaagcccatt

SEQ ID NO: 1299624 - DNA, 22 bp, Artificial Sequence
  chemically synthesized
gactgccctgcaaatgggctta

SEQ ID NO: 1299625 - DNA, 22 bp, Artificial Sequence
  chemically synthesized
ggagggcttggtaagcccattt

SEQ ID NO: 1299626 - DNA, 22 bp, Artificial Sequence
  chemically synthesized
tggactgccctgcaaatgggct

SEQ ID NO: 1299627 - DNA, 22 bp, Artificial Sequence
  chemically synthesized
ctggactgccctgcaaatgggc

SEQ ID NO: 1299628 - DNA, 22 bp, Artificial Sequence
  chemically synthesized
tcacttctggactgccctgcaa

SEQ ID NO: 1299629 - DNA, 22 bp, Artificial Sequence
  chemically synthesized
ggtaagcccatttgcagggcag

SEQ ID NO: 1299630 - DNA, 22 bp, Artificial Sequence
  chemically synthesized
gtaagcccatttgcagggcagt

SEQ ID NO: 1299631 - DNA, 22 bp, Artificial Sequence
  chemically synthesized
tatcacttctggactgccctgc

SEQ ID NO: 1299632 - DNA, 22 bp, Artificial Sequence
  chemically synthesized
aatctctatcacttctggactg

SEQ ID NO: 1299633 - DNA, 22 bp, Artificial Sequence
  chemically synthesized
gcagggcagtccagaagtgata

SEQ ID NO: 1299634 - DNA, 22 bp, Artificial Sequence
  chemically synthesized
cagggcagtccagaagtgatag

SEQ ID NO: 1299635 - DNA, 22 bp, Artificial Sequence
  chemically synthesized
ggagaactaaatctctatcact

SEQ ID NO: 1299636 - DNA, 22 bp, Artificial Sequence
  chemically synthesized
cccctgggagaactaaatctct

SEQ ID NO: 1299637 - DNA, 22 bp, Artificial Sequence
  chemically synthesized
agggttgcccctgggagaacta

SEQ ID NO: 1299638 - DNA, 22 bp, Artificial Sequence
  chemically synthesized
ttgagggttgcccctgggagaa

SEQ ID NO: 1299639 - DNA, 22 bp, Artificial Sequence
  chemically synthesized
attgagggttgcccctgggaga

SEQ ID NO: 1299640 - DNA, 22 bp, Artificial Sequence
  chemically synthesized
gtttattgagggttgcccctgg

SEQ ID NO: 1299641 - DNA, 22 bp, Artificial Sequence
  chemically synthesized
agttctcccaggggcaaccctc

SEQ ID NO: 1299642 - DNA, 22 bp, Artificial Sequence
  chemically synthesized
gttctcccaggggcaaccctca

SEQ ID NO: 1299643 - DNA, 22 bp, Artificial Sequence
  chemically synthesized
tccctcgtttattgagggttgc

SEQ ID NO: 1299644 - DNA, 22 bp, Artificial Sequence
  chemically synthesized
tgtccctcgtttattgagggtt

SEQ ID NO: 1299645 - DNA, 22 bp, Artificial Sequence
  chemically synthesized
ctgtccctcgtttattgagggt

SEQ ID NO: 1299646 - DNA, 22 bp, Artificial Sequence
  chemically synthesized
tcccaggggcaaccctcaataa

SEQ ID NO: 1299647 - DNA, 22 bp, Artificial Sequence
  chemically synthesized
ccaggggcaaccctcaataaac

SEQ ID NO: 1299648 - DNA, 22 bp, Artificial Sequence
  chemically synthesized
atacatagacttctgtccctcg

SEQ ID NO: 1299649 - DNA, 22 bp, Artificial Sequence
  chemically synthesized
aatacatagacttctgtccctc

SEQ ID NO: 1299650 - DNA, 22 bp, Artificial Sequence
  chemically synthesized
taatacatagacttctgtccct

SEQ ID NO: 1299651 - DNA, 22 bp, Artificial Sequence
  chemically synthesized
ttaatacatagacttctgtccc

SEQ ID NO: 1299652 - DNA, 22 bp, Artificial Sequence
  chemically synthesized
tttaatacatagacttctgtcc

SEQ ID NO: 1299653 - DNA, 22 bp, Artificial Sequence
  chemically synthesized
aataaacgagggacagaagtct

SEQ ID NO: 1299654 - DNA, 22 bp, Artificial Sequence
  chemically synthesized
tcctttttaatacatagacttc

SEQ ID NO: 1299655 - DNA, 22 bp, Artificial Sequence
  chemically synthesized
gtcctttttaatacatagactt

SEQ ID NO: 1299656 - DNA, 22 bp, Artificial Sequence
  chemically synthesized
tgtcctttttaatacatagact

SEQ ID NO: 1299657 - DNA, 22 bp, Artificial Sequence
  chemically synthesized
ttgtcctttttaatacatagac

SEQ ID NO: 1299658 - DNA, 22 bp, Artificial Sequence
  chemically synthesized
tttgtcctttttaatacataga

SEQ ID NO: 1299659 - DNA, 22 bp, Artificial Sequence
  chemically synthesized
ttttgtcctttttaatacatag

SEQ ID NO: 1299660 - DNA, 22 bp, Artificial Sequence
  chemically synthesized
tttttgtcctttttaatacata

SEQ ID NO: 1299661 - DNA, 22 bp, Artificial Sequence
  chemically synthesized
ttttttgtcctttttaatacat

SEQ ID NO: 1299662 - DNA, 22 bp, Artificial Sequence
  chemically synthesized
tttttttgtcctttttaataca

SEQ ID NO: 1299663 - DNA, 22 bp, Artificial Sequence
  chemically synthesized
ttttttttgtcctttttaatac

SEQ ID NO: 1299664 - DNA, 22 bp, Artificial Sequence
  chemically synthesized
tttttttttgtcctttttaata

SEQ ID NO: 1299665 - DNA, 22 bp, Artificial Sequence
  chemically synthesized
ttttttttttgtcctttttaat

SEQ ID NO: 1299666 - DNA, 22 bp, Artificial Sequence
  chemically synthesized
tttttttttttgtcctttttaa

SEQ ID NO: 1299667 - DNA, 22 bp, Artificial Sequence
  chemically synthesized
ttttttttttttgtccttttta

SEQ ID NO: 1299668 - DNA, 22 bp, Artificial Sequence
  chemically synthesized
tttttttttttttttgtccttt

SEQ ID NO: 1299669 - DNA, 22 bp, Artificial Sequence
  chemically synthesized
tgtattaaaaaggacaaaaaaa

SEQ ID NO: 1299670 - DNA, 22 bp, Artificial Sequence
  chemically synthesized
cattgtttttttttttttttgt

SEQ ID NO: 1299671 - DNA, 22 bp, Artificial Sequence
  chemically synthesized
ttccattgtttttttttttttt

SEQ ID NO: 1299672 - DNA, 22 bp, Artificial Sequence
  chemically synthesized
aaaaggacaaaaaaaaaaaaaa

SEQ ID NO: 1299673 - DNA, 22 bp, Artificial Sequence
  chemically synthesized
gcaattgttccattgttttttt

SEQ ID NO: 1299674 - DNA, 22 bp, Artificial Sequence
  chemically synthesized
agcaattgttccattgtttttt

SEQ ID NO: 1299675 - DNA, 22 bp, Artificial Sequence
  chemically synthesized
cagggcatgcttagcaattgtt

SEQ ID NO: 1299676 - DNA, 22 bp, Artificial Sequence
  chemically synthesized
aggagccctacagggcatgctt

SEQ ID NO: 1299677 - DNA, 22 bp, Artificial Sequence
  chemically synthesized
ctaagcatgccctgtagggctc

SEQ ID NO: 1299678 - DNA, 22 bp, Artificial Sequence
  chemically synthesized
agcatgccctgtagggctcctc

SEQ ID NO: 1299679 - DNA, 22 bp, Artificial Sequence
  chemically synthesized
catatcccatgcaacaattgag

SEQ ID NO: 1299680 - DNA, 22 bp, Artificial Sequence
  chemically synthesized
tagggctcctcaattgttgcat

SEQ ID NO: 1299681 - DNA, 22 bp, Artificial Sequence
  chemically synthesized
gattacatatcccatgcaacaa

SEQ ID NO: 1299682 - DNA, 22 bp, Artificial Sequence
  chemically synthesized
tggattacatatcccatgcaac

SEQ ID NO: 1299683 - DNA, 22 bp, Artificial Sequence
  chemically synthesized
ctcaattgttgcatgggatatg

SEQ ID NO: 1299684 - DNA, 22 bp, Artificial Sequence
  chemically synthesized
aattgttgcatgggatatgtaa

SEQ ID NO: 1299685 - DNA, 22 bp, Artificial Sequence
  chemically synthesized
tgggccattctggattacatat

SEQ ID NO: 1299686 - DNA, 22 bp, Artificial Sequence
  chemically synthesized
ttgcatgggatatgtaatccag

SEQ ID NO: 1299687 - DNA, 22 bp, Artificial Sequence
  chemically synthesized
ctatgggccattctggattaca

SEQ ID NO: 1299688 - DNA, 22 bp, Artificial Sequence
  chemically synthesized
catgggatatgtaatccagaat

SEQ ID NO: 1299689 - DNA, 22 bp, Artificial Sequence
  chemically synthesized
cagagagcagacaataacgatg

SEQ ID NO: 1299690 - DNA, 22 bp, Artificial Sequence
  chemically synthesized
cactacagagagcagacaataa

SEQ ID NO: 1299691 - DNA, 22 bp, Artificial Sequence
  chemically synthesized
ttgtctgctctctgtagtggaa

SEQ ID NO: 1299692 - DNA, 22 bp, Artificial Sequence
  chemically synthesized
tctgctctctgtagtggaattt

SEQ ID NO: 1299693 - DNA, 22 bp, Artificial Sequence
  chemically synthesized
ctctctgtagtggaatttgggc

SEQ ID NO: 1299694 - DNA, 22 bp, Artificial Sequence
  chemically synthesized
tctgtagtggaatttgggccca

SEQ ID NO: 1299695 - DNA, 22 bp, Artificial Sequence
  chemically synthesized
tgtagtggaatttgggcccaca

SEQ ID NO: 1299696 - DNA, 22 bp, Artificial Sequence
  chemically synthesized
tagtggaatttgggcccacatt

SEQ ID NO: 1299697 - DNA, 22 bp, Artificial Sequence
  chemically synthesized
gtgcatgatcaagccaagaaat

SEQ ID NO: 1299698 - DNA, 22 bp, Artificial Sequence
  chemically synthesized
gggcccacatttcttggcttga

SEQ ID NO: 1299699 - DNA, 22 bp, Artificial Sequence
  chemically synthesized
ggcccacatttcttggcttgat

SEQ ID NO: 1299700 - DNA, 22 bp, Artificial Sequence
  chemically synthesized
cataactagtgcatgatcaagc

SEQ ID NO: 1299701 - DNA, 22 bp, Artificial Sequence
  chemically synthesized
acactgcataactagtgcatga

SEQ ID NO: 1299702 - DNA, 22 bp, Artificial Sequence
  chemically synthesized
cttggcttgatcatgcactagt

SEQ ID NO: 1299703 - DNA, 22 bp, Artificial Sequence
  chemically synthesized
taacactgcataactagtgcat

SEQ ID NO: 1299704 - DNA, 22 bp, Artificial Sequence
  chemically synthesized
ttggcttgatcatgcactagtt

SEQ ID NO: 1299705 - DNA, 22 bp, Artificial Sequence
  chemically synthesized
ctaacactgcataactagtgca

SEQ ID NO: 1299706 - DNA, 22 bp, Artificial Sequence
  chemically synthesized
tctaacactgcataactagtgc

SEQ ID NO: 1299707 - DNA, 22 bp, Artificial Sequence
  chemically synthesized
ggcttgatcatgcactagttat

SEQ ID NO: 1299708 - DNA, 22 bp, Artificial Sequence
  chemically synthesized
ttctaacactgcataactagtg

SEQ ID NO: 1299709 - DNA, 22 bp, Artificial Sequence
  chemically synthesized
gcttgatcatgcactagttatg

SEQ ID NO: 1299710 - DNA, 22 bp, Artificial Sequence
  chemically synthesized
gatcatgcactagttatgcagt

SEQ ID NO: 1299711 - DNA, 22 bp, Artificial Sequence
  chemically synthesized
atcatgcactagttatgcagtg

SEQ ID NO: 1299712 - DNA, 22 bp, Artificial Sequence
  chemically synthesized
tgagtcttttctaacactgcat

SEQ ID NO: 1299713 - DNA, 22 bp, Artificial Sequence
  chemically synthesized
gttatgcagtgttagaaaagac

SEQ ID NO: 1299714 - DNA, 22 bp, Artificial Sequence
  chemically synthesized
cacccggcctatgagtcttttc

SEQ ID NO: 1299715 - DNA, 22 bp, Artificial Sequence
  chemically synthesized
tgcagtgttagaaaagactcat

SEQ ID NO: 1299716 - DNA, 22 bp, Artificial Sequence
  chemically synthesized
gaaaagactcataggccgggtg

SEQ ID NO: 1299717 - DNA, 22 bp, Artificial Sequence
  chemically synthesized
cagacatgagagactgcacccg

SEQ ID NO: 1299718 - DNA, 22 bp, Artificial Sequence
  chemically synthesized
ataggccgggtgcagtctctca

SEQ ID NO: 1299719 - DNA, 22 bp, Artificial Sequence
  chemically synthesized
ggattacagacatgagagactg

SEQ ID NO: 1299720 - DNA, 22 bp, Artificial Sequence
  chemically synthesized
ccaaagtgctgggattacagac

SEQ ID NO: 1299721 - DNA, 22 bp, Artificial Sequence
  chemically synthesized
ggcctcccaaagtgctgggatt

SEQ ID NO: 1299722 - DNA, 22 bp, Artificial Sequence
  chemically synthesized
tcatgtctgtaatcccagcact

SEQ ID NO: 1299723 - DNA, 22 bp, Artificial Sequence
  chemically synthesized
atgtctgtaatcccagcacttt

SEQ ID NO: 1299724 - DNA, 22 bp, Artificial Sequence
  chemically synthesized
cgtccacctgggcctcccaaag

SEQ ID NO: 1299725 - DNA, 22 bp, Artificial Sequence
  chemically synthesized
taatcccagcactttgggaggc

SEQ ID NO: 1299726 - DNA, 22 bp, Artificial Sequence
  chemically synthesized
atgctgcgtccacctgggcctc

SEQ ID NO: 1299727 - DNA, 22 bp, Artificial Sequence
  chemically synthesized
acctcatgctgcgtccacctgg

SEQ ID NO: 1299728 - DNA, 22 bp, Artificial Sequence
  chemically synthesized
ctgacctcatgctgcgtccacc

SEQ ID NO: 1299729 - DNA, 22 bp, Artificial Sequence
  chemically synthesized
tgggaggcccaggtggacgcag

SEQ ID NO: 1299730 - DNA, 22 bp, Artificial Sequence
  chemically synthesized
gggaggcccaggtggacgcagc

SEQ ID NO: 1299731 - DNA, 22 bp, Artificial Sequence
  chemically synthesized
ggaggcccaggtggacgcagca

SEQ ID NO: 1299732 - DNA, 22 bp, Artificial Sequence
  chemically synthesized
gaactcctgacctcatgctgcg

SEQ ID NO: 1299733 - DNA, 22 bp, Artificial Sequence
  chemically synthesized
gtctcgaactcctgacctcatg

SEQ ID NO: 1299734 - DNA, 22 bp, Artificial Sequence
  chemically synthesized
atcaggctggtctcgaactcct

SEQ ID NO: 1299735 - DNA, 22 bp, Artificial Sequence
  chemically synthesized
cgttgatcaggctggtctcgaa

SEQ ID NO: 1299736 - DNA, 22 bp, Artificial Sequence
  chemically synthesized
actgcgttgatcaggctggtct

SEQ ID NO: 1299737 - DNA, 22 bp, Artificial Sequence
  chemically synthesized
cactgcgttgatcaggctggtc

SEQ ID NO: 1299738 - DNA, 22 bp, Artificial Sequence
  chemically synthesized
gagaccagcctgatcaacgcag

SEQ ID NO: 1299739 - DNA, 22 bp, Artificial Sequence
  chemically synthesized
gtagagacggggcttcactgcg

SEQ ID NO: 1299740 - DNA, 22 bp, Artificial Sequence
  chemically synthesized
agtagagacggggcttcactgc

SEQ ID NO: 1299741 - DNA, 22 bp, Artificial Sequence
  chemically synthesized
tagtagagacggggcttcactg

SEQ ID NO: 1299742 - DNA, 22 bp, Artificial Sequence
  chemically synthesized
ttagtagagacggggcttcact

SEQ ID NO: 1299743 - DNA, 22 bp, Artificial Sequence
  chemically synthesized
tttttagtagagacggggcttc

SEQ ID NO: 1299744 - DNA, 22 bp, Artificial Sequence
  chemically synthesized
atcaacgcagtgaagccccgtc

SEQ ID NO: 1299745 - DNA, 22 bp, Artificial Sequence
  chemically synthesized
atttttagtagagacggggctt

SEQ ID NO: 1299746 - DNA, 22 bp, Artificial Sequence
  chemically synthesized
tatttttagtagagacggggct

SEQ ID NO: 1299747 - DNA, 22 bp, Artificial Sequence
  chemically synthesized
ttatttttagtagagacggggc

SEQ ID NO: 1299748 - DNA, 22 bp, Artificial Sequence
  chemically synthesized
tttatttttagtagagacgggg

SEQ ID NO: 1299749 - DNA, 22 bp, Artificial Sequence
  chemically synthesized
atctttttatttttagtagaga

SEQ ID NO: 1299750 - DNA, 22 bp, Artificial Sequence
  chemically synthesized
tactaaaaataaaaagattagc

SEQ ID NO: 1299751 - DNA, 22 bp, Artificial Sequence
  chemically synthesized
ctaaaaataaaaagattagccg

SEQ ID NO: 1299752 - DNA, 22 bp, Artificial Sequence
  chemically synthesized
aaaataaaaagattagccgggc

SEQ ID NO: 1299753 - DNA, 22 bp, Artificial Sequence
  chemically synthesized
aggtgtccgccaccacgcccgg

SEQ ID NO: 1299754 - DNA, 22 bp, Artificial Sequence
  chemically synthesized
caggtgtccgccaccacgcccg

SEQ ID NO: 1299755 - DNA, 22 bp, Artificial Sequence
  chemically synthesized
ggatttcaggtgtccgccacca

SEQ ID NO: 1299756 - DNA, 22 bp, Artificial Sequence
  chemically synthesized
gccgggcgtggtggcggacacc

SEQ ID NO: 1299757 - DNA, 22 bp, Artificial Sequence
  chemically synthesized
ccaagtagctgggatttcaggt

SEQ ID NO: 1299758 - DNA, 22 bp, Artificial Sequence
  chemically synthesized
cgtcagcctcccaagtagctgg

SEQ ID NO: 1299759 - DNA, 22 bp, Artificial Sequence
  chemically synthesized
ctgcgtcagcctcccaagtagc

SEQ ID NO: 1299760 - DNA, 22 bp, Artificial Sequence
  chemically synthesized
tcctgcgtcagcctcccaagta

SEQ ID NO: 1299761 - DNA, 22 bp, Artificial Sequence
  chemically synthesized
aaatcccagctacttgggaggc

SEQ ID NO: 1299762 - DNA, 22 bp, Artificial Sequence
  chemically synthesized
aagtgattctcctgcgtcagcc

SEQ ID NO: 1299763 - DNA, 22 bp, Artificial Sequence
  chemically synthesized
cttgggaggctgacgcaggaga

SEQ ID NO: 1299764 - DNA, 22 bp, Artificial Sequence
  chemically synthesized
gggaggctgacgcaggagaatc

SEQ ID NO: 1299765 - DNA, 22 bp, Artificial Sequence
  chemically synthesized
ccaggttcaagtgattctcctg

SEQ ID NO: 1299766 - DNA, 22 bp, Artificial Sequence
  chemically synthesized
ggaggctgacgcaggagaatca

SEQ ID NO: 1299767 - DNA, 22 bp, Artificial Sequence
  chemically synthesized
agcctcccaggttcaagtgatt

SEQ ID NO: 1299768 - DNA, 22 bp, Artificial Sequence
  chemically synthesized
acgcaggagaatcacttgaacc

SEQ ID NO: 1299769 - DNA, 22 bp, Artificial Sequence
  chemically synthesized
caacctcagcctcccaggttca

SEQ ID NO: 1299770 - DNA, 22 bp, Artificial Sequence
  chemically synthesized
actgcaacctcagcctcccagg

SEQ ID NO: 1299771 - DNA, 22 bp, Artificial Sequence
  chemically synthesized
gctcactgcaacctcagcctcc

SEQ ID NO: 1299772 - DNA, 22 bp, Artificial Sequence
  chemically synthesized
ggctcactgcaacctcagcctc

SEQ ID NO: 1299773 - DNA, 22 bp, Artificial Sequence
  chemically synthesized
gaacctgggaggctgaggttgc

SEQ ID NO: 1299774 - DNA, 22 bp, Artificial Sequence
  chemically synthesized
aacctgggaggctgaggttgca

SEQ ID NO: 1299775 - DNA, 22 bp, Artificial Sequence
  chemically synthesized
ggaggctgaggttgcagtgagc

SEQ ID NO: 1299776 - DNA, 22 bp, Artificial Sequence
  chemically synthesized
aggttgcagtgagccaagatca

SEQ ID NO: 1299777 - DNA, 22 bp, Artificial Sequence
  chemically synthesized
gagtgcagtggcatgatcttgg

SEQ ID NO: 1299778 - DNA, 22 bp, Artificial Sequence
  chemically synthesized
cagtgagccaagatcatgccac

SEQ ID NO: 1299779 - DNA, 22 bp, Artificial Sequence
  chemically synthesized
tcggggctggagtgcagtggca

SEQ ID NO: 1299780 - DNA, 22 bp, Artificial Sequence
  chemically synthesized
ctgtcggggctggagtgcagtg

SEQ ID NO: 1299781 - DNA, 22 bp, Artificial Sequence
  chemically synthesized
aactcctgtcggggctggagtg

SEQ ID NO: 1299782 - DNA, 22 bp, Artificial Sequence
  chemically synthesized
gaactcctgtcggggctggagt

SEQ ID NO: 1299783 - DNA, 22 bp, Artificial Sequence
  chemically synthesized
cactccagccccgacaggagtt

SEQ ID NO: 1299784 - DNA, 22 bp, Artificial Sequence
  chemically synthesized
agatggagtcttgaactcctgt

SEQ ID NO: 1299785 - DNA, 22 bp, Artificial Sequence
  chemically synthesized
gagatggagtcttgaactcctg

SEQ ID NO: 1299786 - DNA, 22 bp, Artificial Sequence
  chemically synthesized
tgagatggagtcttgaactcct

SEQ ID NO: 1299787 - DNA, 22 bp, Artificial Sequence
  chemically synthesized
ttgagatggagtcttgaactcc

SEQ ID NO: 1299788 - DNA, 22 bp, Artificial Sequence
  chemically synthesized
cagccccgacaggagttcaaga

SEQ ID NO: 1299789 - DNA, 22 bp, Artificial Sequence
  chemically synthesized
tttttgagatggagtcttgaac

SEQ ID NO: 1299790 - DNA, 22 bp, Artificial Sequence
  chemically synthesized
gtttttgagatggagtcttgaa

SEQ ID NO: 1299791 - DNA, 22 bp, Artificial Sequence
  chemically synthesized
tttgtttttgagatggagtctt

SEQ ID NO: 1299792 - DNA, 22 bp, Artificial Sequence
  chemically synthesized
gtttgtttttgagatggagtct

SEQ ID NO: 1299793 - DNA, 22 bp, Artificial Sequence
  chemically synthesized
tttgtttgtttttgagatggag

SEQ ID NO: 1299794 - DNA, 22 bp, Artificial Sequence
  chemically synthesized
gtttgtttgtttttgagatgga

SEQ ID NO: 1299795 - DNA, 22 bp, Artificial Sequence
  chemically synthesized
tttgtttgtttgtttttgagat

SEQ ID NO: 1299796 - DNA, 22 bp, Artificial Sequence
  chemically synthesized
gtttgtttgtttgtttttgaga

SEQ ID NO: 1299797 - DNA, 22 bp, Artificial Sequence
  chemically synthesized
aagactccatctcaaaaacaaa

SEQ ID NO: 1299798 - DNA, 22 bp, Artificial Sequence
  chemically synthesized
tttgtttgtttgtttgtttttg

SEQ ID NO: 1299799 - DNA, 22 bp, Artificial Sequence
  chemically synthesized
gtttgtttgtttgtttgttttt

SEQ ID NO: 1299800 - DNA, 22 bp, Artificial Sequence
  chemically synthesized
tgtttgtttgtttgtttgtttt

SEQ ID NO: 1299801 - DNA, 22 bp, Artificial Sequence
  chemically synthesized
ttttgtttgtttgtttgtttgt

SEQ ID NO: 1299802 - DNA, 22 bp, Artificial Sequence
  chemically synthesized
gttttgtttgtttgtttgtttg

SEQ ID NO: 1299803 - DNA, 22 bp, Artificial Sequence
  chemically synthesized
catctcaaaaacaaacaaacaa

SEQ ID NO: 1299804 - DNA, 22 bp, Artificial Sequence
  chemically synthesized
tgttttgtttgtttgtttgttt

SEQ ID NO: 1299805 - DNA, 22 bp, Artificial Sequence
  chemically synthesized
tttgttttgtttgtttgtttgt

SEQ ID NO: 1299806 - DNA, 22 bp, Artificial Sequence
  chemically synthesized
ctttgttttgtttgtttgtttg

SEQ ID NO: 1299807 - DNA, 22 bp, Artificial Sequence
  chemically synthesized
tctttgttttgtttgtttgttt

SEQ ID NO: 1299808 - DNA, 22 bp, Artificial Sequence
  chemically synthesized
aaaaacaaacaaacaaacaaac

SEQ ID NO: 1299809 - DNA, 22 bp, Artificial Sequence
  chemically synthesized
tttctttgttttgtttgtttgt

SEQ ID NO: 1299810 - DNA, 22 bp, Artificial Sequence
  chemically synthesized
ctttctttgttttgtttgtttg

SEQ ID NO: 1299811 - DNA, 22 bp, Artificial Sequence
  chemically synthesized
tctttctttgttttgtttgttt

SEQ ID NO: 1299812 - DNA, 22 bp, Artificial Sequence
  chemically synthesized
ttctttctttgttttgtttgtt

SEQ ID NO: 1299813 - DNA, 22 bp, Artificial Sequence
  chemically synthesized
tgagtcttttctttctttgttt

SEQ ID NO: 1299814 - DNA, 22 bp, Artificial Sequence
  chemically synthesized
atgagtcttttctttctttgtt

SEQ ID NO: 1299815 - DNA, 22 bp, Artificial Sequence
  chemically synthesized
gtgtggcttatgagtcttttct

SEQ ID NO: 1299816 - DNA, 22 bp, Artificial Sequence
  chemically synthesized
ggtgtggcttatgagtcttttc

SEQ ID NO: 1299817 - DNA, 22 bp, Artificial Sequence
  chemically synthesized
ggtttggtgtggcttatgagtc

SEQ ID NO: 1299818 - DNA, 22 bp, Artificial Sequence
  chemically synthesized
gggtttggtgtggcttatgagt

SEQ ID NO: 1299819 - DNA, 22 bp, Artificial Sequence
  chemically synthesized
gaaatcttgggtttggtgtggc

SEQ ID NO: 1299820 - DNA, 22 bp, Artificial Sequence
  chemically synthesized
agactggaaatcttgggtttgg

SEQ ID NO: 1299821 - DNA, 22 bp, Artificial Sequence
  chemically synthesized
cagactggaaatcttgggtttg

SEQ ID NO: 1299822 - DNA, 22 bp, Artificial Sequence
  chemically synthesized
ataagccacaccaaacccaaga

SEQ ID NO: 1299823 - DNA, 22 bp, Artificial Sequence
  chemically synthesized
tcagactggaaatcttgggttt

SEQ ID NO: 1299824 - DNA, 22 bp, Artificial Sequence
  chemically synthesized
ttcagactggaaatcttgggtt

SEQ ID NO: 1299825 - DNA, 22 bp, Artificial Sequence
  chemically synthesized
ttttcagactggaaatcttggg

SEQ ID NO: 1299826 - DNA, 22 bp, Artificial Sequence
  chemically synthesized
ctcttttcagactggaaatctt

SEQ ID NO: 1299827 - DNA, 22 bp, Artificial Sequence
  chemically synthesized
cctcttttcagactggaaatct

SEQ ID NO: 1299828 - DNA, 22 bp, Artificial Sequence
  chemically synthesized
tttcctcttttcagactggaaa

SEQ ID NO: 1299829 - DNA, 22 bp, Artificial Sequence
  chemically synthesized
ccacgattatttcctcttttca

SEQ ID NO: 1299830 - DNA, 22 bp, Artificial Sequence
  chemically synthesized
accacgattatttcctcttttc

SEQ ID NO: 1299831 - DNA, 22 bp, Artificial Sequence
  chemically synthesized
taccacgattatttcctctttt

SEQ ID NO: 1299832 - DNA, 22 bp, Artificial Sequence
  chemically synthesized
ttaccacgattatttcctcttt

SEQ ID NO: 1299833 - DNA, 22 bp, Artificial Sequence
  chemically synthesized
tttaccacgattatttcctctt

SEQ ID NO: 1299834 - DNA, 22 bp, Artificial Sequence
  chemically synthesized
ttttaccacgattatttcctct

SEQ ID NO: 1299835 - DNA, 22 bp, Artificial Sequence
  chemically synthesized
ccagtctgaaaagaggaaataa

SEQ ID NO: 1299836 - DNA, 22 bp, Artificial Sequence
  chemically synthesized
cagtctgaaaagaggaaataat

SEQ ID NO: 1299837 - DNA, 22 bp, Artificial Sequence
  chemically synthesized
agagtttttttaccacgattat

SEQ ID NO: 1299838 - DNA, 22 bp, Artificial Sequence
  chemically synthesized
aaaagaggaaataatcgtggta

SEQ ID NO: 1299839 - DNA, 22 bp, Artificial Sequence
  chemically synthesized
atcaaagtgaagctaagagttt

SEQ ID NO: 1299840 - DNA, 22 bp, Artificial Sequence
  chemically synthesized
caggatacctcatcaaagtgaa

SEQ ID NO: 1299841 - DNA, 22 bp, Artificial Sequence
  chemically synthesized
acaggatacctcatcaaagtga

SEQ ID NO: 1299842 - DNA, 22 bp, Artificial Sequence
  chemically synthesized
tacaggatacctcatcaaagtg

SEQ ID NO: 1299843 - DNA, 22 bp, Artificial Sequence
  chemically synthesized
ttagcttcactttgatgaggta

SEQ ID NO: 1299844 - DNA, 22 bp, Artificial Sequence
  chemically synthesized
agcttcactttgatgaggtatc

SEQ ID NO: 1299845 - DNA, 22 bp, Artificial Sequence
  chemically synthesized
gatgctttacaggatacctcat

SEQ ID NO: 1299846 - DNA, 22 bp, Artificial Sequence
  chemically synthesized
gcttcactttgatgaggtatcc

SEQ ID NO: 1299847 - DNA, 22 bp, Artificial Sequence
  chemically synthesized
cgatgctttacaggatacctca

SEQ ID NO: 1299848 - DNA, 22 bp, Artificial Sequence
  chemically synthesized
tcgatgctttacaggatacctc

SEQ ID NO: 1299849 - DNA, 22 bp, Artificial Sequence
  chemically synthesized
cactttgatgaggtatcctgta

SEQ ID NO: 1299850 - DNA, 22 bp, Artificial Sequence
  chemically synthesized
ctttcgatgctttacaggatac

SEQ ID NO: 1299851 - DNA, 22 bp, Artificial Sequence
  chemically synthesized
actttgatgaggtatcctgtaa

SEQ ID NO: 1299852 - DNA, 22 bp, Artificial Sequence
  chemically synthesized
tgatgaggtatcctgtaaagca

SEQ ID NO: 1299853 - DNA, 22 bp, Artificial Sequence
  chemically synthesized
gatgaggtatcctgtaaagcat

SEQ ID NO: 1299854 - DNA, 22 bp, Artificial Sequence
  chemically synthesized
agactactttcgatgctttaca

SEQ ID NO: 1299855 - DNA, 22 bp, Artificial Sequence
  chemically synthesized
atgaggtatcctgtaaagcatc

SEQ ID NO: 1299856 - DNA, 22 bp, Artificial Sequence
  chemically synthesized
aagactactttcgatgctttac

SEQ ID NO: 1299857 - DNA, 22 bp, Artificial Sequence
  chemically synthesized
cttaagactactttcgatgctt

SEQ ID NO: 1299858 - DNA, 22 bp, Artificial Sequence
  chemically synthesized
gcttaagactactttcgatgct

SEQ ID NO: 1299859 - DNA, 22 bp, Artificial Sequence
  chemically synthesized
tgcttaagactactttcgatgc

SEQ ID NO: 1299860 - DNA, 22 bp, Artificial Sequence
  chemically synthesized
agtctttgcttaagactacttt

SEQ ID NO: 1299861 - DNA, 22 bp, Artificial Sequence
  chemically synthesized
taaagcatcgaaagtagtctta

SEQ ID NO: 1299862 - DNA, 22 bp, Artificial Sequence
  chemically synthesized
tactaagtctttgcttaagact

SEQ ID NO: 1299863 - DNA, 22 bp, Artificial Sequence
  chemically synthesized
gtactaagtctttgcttaagac

SEQ ID NO: 1299864 - DNA, 22 bp, Artificial Sequence
  chemically synthesized
tgtactaagtctttgcttaaga

SEQ ID NO: 1299865 - DNA, 22 bp, Artificial Sequence
  chemically synthesized
ctttgtactaagtctttgctta

SEQ ID NO: 1299866 - DNA, 22 bp, Artificial Sequence
  chemically synthesized
actttgtactaagtctttgctt

SEQ ID NO: 1299867 - DNA, 22 bp, Artificial Sequence
  chemically synthesized
gcacttactttgtactaagtct

SEQ ID NO: 1299868 - DNA, 22 bp, Artificial Sequence
  chemically synthesized
ttggcacttactttgtactaag

SEQ ID NO: 1299869 - DNA, 22 bp, Artificial Sequence
  chemically synthesized
tattggcacttactttgtacta

SEQ ID NO: 1299870 - DNA, 22 bp, Artificial Sequence
  chemically synthesized
aagcaaagacttagtacaaagt

SEQ ID NO: 1299871 - DNA, 22 bp, Artificial Sequence
  chemically synthesized
agcaaagacttagtacaaagta

SEQ ID NO: 1299872 - DNA, 22 bp, Artificial Sequence
  chemically synthesized
atctctattggcacttactttg

SEQ ID NO: 1299873 - DNA, 22 bp, Artificial Sequence
  chemically synthesized
agtacaaagtaagtgccaatag

SEQ ID NO: 1299874 - DNA, 22 bp, Artificial Sequence
  chemically synthesized
gtacaaagtaagtgccaataga

SEQ ID NO: 1299875 - DNA, 22 bp, Artificial Sequence
  chemically synthesized
aatatatagtcaggaataataa

SEQ ID NO: 1299876 - DNA, 22 bp, Artificial Sequence
  chemically synthesized
atgcaattaaatatatagtcag

SEQ ID NO: 1299877 - DNA, 22 bp, Artificial Sequence
  chemically synthesized
taatgcaattaaatatatagtc

SEQ ID NO: 1299878 - DNA, 22 bp, Artificial Sequence
  chemically synthesized
ttattcctgactatatatttaa

SEQ ID NO: 1299879 - DNA, 22 bp, Artificial Sequence
  chemically synthesized
ttcctgactatatatttaattg

SEQ ID NO: 1299880 - DNA, 22 bp, Artificial Sequence
  chemically synthesized
aagaagttctaatgcaattaaa

SEQ ID NO: 1299881 - DNA, 22 bp, Artificial Sequence
  chemically synthesized
ctgactatatatttaattgcat

SEQ ID NO: 1299882 - DNA, 22 bp, Artificial Sequence
  chemically synthesized
ttcaagaagttctaatgcaatt

SEQ ID NO: 1299883 - DNA, 22 bp, Artificial Sequence
  chemically synthesized
actatatatttaattgcattag

SEQ ID NO: 1299884 - DNA, 22 bp, Artificial Sequence
  chemically synthesized
gttcaagaagttctaatgcaat

SEQ ID NO: 1299885 - DNA, 22 bp, Artificial Sequence
  chemically synthesized
tatatttaattgcattagaact

SEQ ID NO: 1299886 - DNA, 22 bp, Artificial Sequence
  chemically synthesized
ccaacttgttcaagaagttcta

SEQ ID NO: 1299887 - DNA, 22 bp, Artificial Sequence
  chemically synthesized
aattgcattagaacttcttgaa

SEQ ID NO: 1299888 - DNA, 22 bp, Artificial Sequence
  chemically synthesized
attgcattagaacttcttgaac

SEQ ID NO: 1299889 - DNA, 22 bp, Artificial Sequence
  chemically synthesized
cattagaacttcttgaacaagt

SEQ ID NO: 1299890 - DNA, 22 bp, Artificial Sequence
  chemically synthesized
gaacttcttgaacaagttggta

SEQ ID NO: 1299891 - DNA, 22 bp, Artificial Sequence
  chemically synthesized
cttgaacaagttggtagtttac

SEQ ID NO: 1299892 - DNA, 22 bp, Artificial Sequence
  chemically synthesized
ttgaacaagttggtagtttaca

SEQ ID NO: 1299893 - DNA, 22 bp, Artificial Sequence
  chemically synthesized
gaacaagttggtagtttacatt

SEQ ID NO: 1299894 - DNA, 22 bp, Artificial Sequence
  chemically synthesized
aacaagttggtagtttacatta

SEQ ID NO: 1299895 - DNA, 22 bp, Artificial Sequence
  chemically synthesized
gtagtttacattatttgctcat

SEQ ID NO: 1299896 - DNA, 22 bp, Artificial Sequence
  chemically synthesized
acattatttgctcatcggtttc

SEQ ID NO: 1299897 - DNA, 22 bp, Artificial Sequence
  chemically synthesized
cattatttgctcatcggtttct

SEQ ID NO: 1299898 - DNA, 22 bp, Artificial Sequence
  chemically synthesized
tttgctcatcggtttctttttc

SEQ ID NO: 1299899 - DNA, 22 bp, Artificial Sequence
  chemically synthesized
gctcatcggtttctttttcttc

SEQ ID NO: 1299900 - DNA, 22 bp, Artificial Sequence
  chemically synthesized
ctcatcggtttctttttcttcc

SEQ ID NO: 1299901 - DNA, 22 bp, Artificial Sequence
  chemically synthesized
atcggtttctttttcttcctcc

SEQ ID NO: 1299902 - DNA, 22 bp, Artificial Sequence
  chemically synthesized
ctttttcttcctcctttccact

SEQ ID NO: 1299903 - DNA, 22 bp, Artificial Sequence
  chemically synthesized
tttttcttcctcctttccactt

SEQ ID NO: 1299904 - DNA, 22 bp, Artificial Sequence
  chemically synthesized
tttcttcctcctttccacttgc

SEQ ID NO: 1299905 - DNA, 22 bp, Artificial Sequence
  chemically synthesized
ttcttcctcctttccacttgcc

SEQ ID NO: 1299906 - DNA, 22 bp, Artificial Sequence
  chemically synthesized
tcttcctcctttccacttgcca

SEQ ID NO: 1299907 - DNA, 22 bp, Artificial Sequence
  chemically synthesized
cttcctcctttccacttgccat

SEQ ID NO: 1299908 - DNA, 22 bp, Artificial Sequence
  chemically synthesized
ttcctcctttccacttgccatg

SEQ ID NO: 1299909 - DNA, 22 bp, Artificial Sequence
  chemically synthesized
cctcctttccacttgccatggt

SEQ ID NO: 1299910 - DNA, 22 bp, Artificial Sequence
  chemically synthesized
ctcctttccacttgccatggtt

SEQ ID NO: 1299911 - DNA, 22 bp, Artificial Sequence
  chemically synthesized
ctttccacttgccatggttcac

SEQ ID NO: 1299912 - DNA, 22 bp, Artificial Sequence
  chemically synthesized
tccacttgccatggttcaccat

SEQ ID NO: 1299913 - DNA, 22 bp, Artificial Sequence
  chemically synthesized
ccacttgccatggttcaccatg

SEQ ID NO: 1299914 - DNA, 22 bp, Artificial Sequence
  chemically synthesized
cacttgccatggttcaccatgg

SEQ ID NO: 1299915 - DNA, 22 bp, Artificial Sequence
  chemically synthesized
gccatggttcaccatgggtgga

SEQ ID NO: 1299916 - DNA, 22 bp, Artificial Sequence
  chemically synthesized
ccatggttcaccatgggtggat

SEQ ID NO: 1299917 - DNA, 22 bp, Artificial Sequence
  chemically synthesized
accatgggtggattacacatcc

SEQ ID NO: 1299918 - DNA, 22 bp, Artificial Sequence
  chemically synthesized
cacatcccactcactgatgtgg

SEQ ID NO: 1299919 - DNA, 22 bp, Artificial Sequence
  chemically synthesized
actgatgtggccttggtcatgt

SEQ ID NO: 1299920 - DNA, 22 bp, Artificial Sequence
  chemically synthesized
gtcaaggcaagtcacatgacca

SEQ ID NO: 1299921 - DNA, 22 bp, Artificial Sequence
  chemically synthesized
atgtggccttggtcatgtgact

SEQ ID NO: 1299922 - DNA, 22 bp, Artificial Sequence
  chemically synthesized
cactggtcaaggcaagtcacat

SEQ ID NO: 1299923 - DNA, 22 bp, Artificial Sequence
  chemically synthesized
tgttccactggtcaaggcaagt

SEQ ID NO: 1299924 - DNA, 22 bp, Artificial Sequence
  chemically synthesized
ggtcatgtgacttgccttgacc

SEQ ID NO: 1299925 - DNA, 22 bp, Artificial Sequence
  chemically synthesized
gtcatgtgacttgccttgacca

SEQ ID NO: 1299926 - DNA, 22 bp, Artificial Sequence
  chemically synthesized
actgtgttccactggtcaaggc

SEQ ID NO: 1299927 - DNA, 22 bp, Artificial Sequence
  chemically synthesized
atatctgactgtgttccactgg

SEQ ID NO: 1299928 - DNA, 22 bp, Artificial Sequence
  chemically synthesized
tcatatctgactgtgttccact

SEQ ID NO: 1299929 - DNA, 22 bp, Artificial Sequence
  chemically synthesized
gccttgaccagtggaacacagt

SEQ ID NO: 1299930 - DNA, 22 bp, Artificial Sequence
  chemically synthesized
ccttgaccagtggaacacagtc

SEQ ID NO: 1299931 - DNA, 22 bp, Artificial Sequence
  chemically synthesized
gaccagtggaacacagtcagat

SEQ ID NO: 1299932 - DNA, 22 bp, Artificial Sequence
  chemically synthesized
acacactctcatatctgactgt

SEQ ID NO: 1299933 - DNA, 22 bp, Artificial Sequence
  chemically synthesized
accagtggaacacagtcagata

SEQ ID NO: 1299934 - DNA, 22 bp, Artificial Sequence
  chemically synthesized
agaattgacacactctcatatc

SEQ ID NO: 1299935 - DNA, 22 bp, Artificial Sequence
  chemically synthesized
gctcagaattgacacactctca

SEQ ID NO: 1299936 - DNA, 22 bp, Artificial Sequence
  chemically synthesized
agcccctagctcagaattgaca

SEQ ID NO: 1299937 - DNA, 22 bp, Artificial Sequence
  chemically synthesized
aagcccctagctcagaattgac

SEQ ID NO: 1299938 - DNA, 22 bp, Artificial Sequence
  chemically synthesized
ttaagcccctagctcagaattg

SEQ ID NO: 1299939 - DNA, 22 bp, Artificial Sequence
  chemically synthesized
tgattcttaagcccctagctca

SEQ ID NO: 1299940 - DNA, 22 bp, Artificial Sequence
  chemically synthesized
atgattcttaagcccctagctc

SEQ ID NO: 1299941 - DNA, 22 bp, Artificial Sequence
  chemically synthesized
tatgattcttaagcccctagct

SEQ ID NO: 1299942 - DNA, 22 bp, Artificial Sequence
  chemically synthesized
tgagctaggggcttaagaatca

SEQ ID NO: 1299943 - DNA, 22 bp, Artificial Sequence
  chemically synthesized
agctaggggcttaagaatcata

SEQ ID NO: 1299944 - DNA, 22 bp, Artificial Sequence
  chemically synthesized
ggggcttaagaatcataaagtg

SEQ ID NO: 1299945 - DNA, 22 bp, Artificial Sequence
  chemically synthesized
aagaatcataaagtgttttcac

SEQ ID NO: 1299946 - DNA, 22 bp, Artificial Sequence
  chemically synthesized
agaatcataaagtgttttcact

SEQ ID NO: 1299947 - DNA, 22 bp, Artificial Sequence
  chemically synthesized
acaaagggaggaaggaccaaga

SEQ ID NO: 1299948 - DNA, 22 bp, Artificial Sequence
  chemically synthesized
tcacttttcttggtccttcctc

SEQ ID NO: 1299949 - DNA, 22 bp, Artificial Sequence
  chemically synthesized
ccctgacaaagggaggaaggac

SEQ ID NO: 1299950 - DNA, 22 bp, Artificial Sequence
  chemically synthesized
cacttttcttggtccttcctcc

SEQ ID NO: 1299951 - DNA, 22 bp, Artificial Sequence
  chemically synthesized
cccctgacaaagggaggaagga

SEQ ID NO: 1299952 - DNA, 22 bp, Artificial Sequence
  chemically synthesized
acttttcttggtccttcctccc

SEQ ID NO: 1299953 - DNA, 22 bp, Artificial Sequence
  chemically synthesized
ttcttggtccttcctccctttg

SEQ ID NO: 1299954 - DNA, 22 bp, Artificial Sequence
  chemically synthesized
tcttggtccttcctccctttgt

SEQ ID NO: 1299955 - DNA, 22 bp, Artificial Sequence
  chemically synthesized
cttggtccttcctccctttgtc

SEQ ID NO: 1299956 - DNA, 22 bp, Artificial Sequence
  chemically synthesized
ttggtccttcctccctttgtca

SEQ ID NO: 1299957 - DNA, 22 bp, Artificial Sequence
  chemically synthesized
ggtccttcctccctttgtcagg

SEQ ID NO: 1299958 - DNA, 22 bp, Artificial Sequence
  chemically synthesized
gtccttcctccctttgtcaggg

SEQ ID NO: 1299959 - DNA, 22 bp, Artificial Sequence
  chemically synthesized
aggcgtgtacttcccctgacaa

SEQ ID NO: 1299960 - DNA, 22 bp, Artificial Sequence
  chemically synthesized
cctgaggcgtgtacttcccctg

SEQ ID NO: 1299961 - DNA, 22 bp, Artificial Sequence
  chemically synthesized
cctccctttgtcaggggaagta

SEQ ID NO: 1299962 - DNA, 22 bp, Artificial Sequence
  chemically synthesized
ctccctttgtcaggggaagtac

SEQ ID NO: 1299963 - DNA, 22 bp, Artificial Sequence
  chemically synthesized
cctttgtcaggggaagtacacg

SEQ ID NO: 1299964 - DNA, 22 bp, Artificial Sequence
  chemically synthesized
tgtcaggggaagtacacgcctc

SEQ ID NO: 1299965 - DNA, 22 bp, Artificial Sequence
  chemically synthesized
gtcaggggaagtacacgcctca

SEQ ID NO: 1299966 - DNA, 22 bp, Artificial Sequence
  chemically synthesized
tcaggggaagtacacgcctcag

SEQ ID NO: 1299967 - DNA, 22 bp, Artificial Sequence
  chemically synthesized
ggaacagaggctacctgaggcg

SEQ ID NO: 1299968 - DNA, 22 bp, Artificial Sequence
  chemically synthesized
aggaacagaggctacctgaggc

SEQ ID NO: 1299969 - DNA, 22 bp, Artificial Sequence
  chemically synthesized
taggaacagaggctacctgagg

SEQ ID NO: 1299970 - DNA, 22 bp, Artificial Sequence
  chemically synthesized
ttaggaacagaggctacctgag

SEQ ID NO: 1299971 - DNA, 22 bp, Artificial Sequence
  chemically synthesized
cttttaggaacagaggctacct

SEQ ID NO: 1299972 - DNA, 22 bp, Artificial Sequence
  chemically synthesized
tccttttaggaacagaggctac

SEQ ID NO: 1299973 - DNA, 22 bp, Artificial Sequence
  chemically synthesized
tgcatctctccttttaggaaca

SEQ ID NO: 1299974 - DNA, 22 bp, Artificial Sequence
  chemically synthesized
aggtagcctctgttcctaaaag

SEQ ID NO: 1299975 - DNA, 22 bp, Artificial Sequence
  chemically synthesized
tatgcatctctccttttaggaa

SEQ ID NO: 1299976 - DNA, 22 bp, Artificial Sequence
  chemically synthesized
tgttcctaaaaggagagatgca

SEQ ID NO: 1299977 - DNA, 22 bp, Artificial Sequence
  chemically synthesized
ttcctaaaaggagagatgcata

SEQ ID NO: 1299978 - DNA, 22 bp, Artificial Sequence
  chemically synthesized
ctaaaaggagagatgcatagag

SEQ ID NO: 1299979 - DNA, 22 bp, Artificial Sequence
  chemically synthesized
agtacaggtcagctctatgcat

SEQ ID NO: 1299980 - DNA, 22 bp, Artificial Sequence
  chemically synthesized
aaaggagagatgcatagagctg

SEQ ID NO: 1299981 - DNA, 22 bp, Artificial Sequence
  chemically synthesized
tattgagtacaggtcagctcta

SEQ ID NO: 1299982 - DNA, 22 bp, Artificial Sequence
  chemically synthesized
gtattgagtacaggtcagctct

SEQ ID NO: 1299983 - DNA, 22 bp, Artificial Sequence
  chemically synthesized
tgtattgagtacaggtcagctc

SEQ ID NO: 1299984 - DNA, 22 bp, Artificial Sequence
  chemically synthesized
aattttgtattgagtacaggtc

SEQ ID NO: 1299985 - DNA, 22 bp, Artificial Sequence
  chemically synthesized
acctgtactcaatacaaaattg

SEQ ID NO: 1299986 - DNA, 22 bp, Artificial Sequence
  chemically synthesized
acatgtcaggttcaattttgta

SEQ ID NO: 1299987 - DNA, 22 bp, Artificial Sequence
  chemically synthesized
ttcacatgtcaggttcaatttt

SEQ ID NO: 1299988 - DNA, 22 bp, Artificial Sequence
  chemically synthesized
attcacatgtcaggttcaattt

SEQ ID NO: 1299989 - DNA, 22 bp, Artificial Sequence
  chemically synthesized
tactcaatacaaaattgaacct

SEQ ID NO: 1299990 - DNA, 22 bp, Artificial Sequence
  chemically synthesized
ttattcacatgtcaggttcaat

SEQ ID NO: 1299991 - DNA, 22 bp, Artificial Sequence
  chemically synthesized
cttattcacatgtcaggttcaa

SEQ ID NO: 1299992 - DNA, 22 bp, Artificial Sequence
  chemically synthesized
aatacaaaattgaacctgacat

SEQ ID NO: 1299993 - DNA, 22 bp, Artificial Sequence
  chemically synthesized
tttcttattcacatgtcaggtt

SEQ ID NO: 1299994 - DNA, 22 bp, Artificial Sequence
  chemically synthesized
atttcttattcacatgtcaggt

SEQ ID NO: 1299995 - DNA, 22 bp, Artificial Sequence
  chemically synthesized
aacctgacatgtgaataagaaa

SEQ ID NO: 1299996 - DNA, 22 bp, Artificial Sequence
  chemically synthesized
taagaacaaacatttatttctt

SEQ ID NO: 1299997 - DNA, 22 bp, Artificial Sequence
  chemically synthesized
ataagaacaaacatttatttct

SEQ ID NO: 1299998 - DNA, 22 bp, Artificial Sequence
  chemically synthesized
acatgtgaataagaaataaatg

SEQ ID NO: 1299999 - DNA, 22 bp, Artificial Sequence
  chemically synthesized
aatgacttataagaacaaacat

SEQ ID NO: 1300000 - DNA, 22 bp, Artificial Sequence
  chemically synthesized
gttcttataagtcattgagatt

SEQ ID NO: 1300001 - DNA, 22 bp, Artificial Sequence
  chemically synthesized
ttcttataagtcattgagattt

SEQ ID NO: 1300002 - DNA, 22 bp, Artificial Sequence
  chemically synthesized
taaaaaacaaatccaaatctca

SEQ ID NO: 1300003 - DNA, 22 bp, Artificial Sequence
  chemically synthesized
ttataagtcattgagatttgga

SEQ ID NO: 1300004 - DNA, 22 bp, Artificial Sequence
  chemically synthesized
tgtaaaaaacaaatccaaatct

SEQ ID NO: 1300005 - DNA, 22 bp, Artificial Sequence
  chemically synthesized
ataagtcattgagatttggatt

SEQ ID NO: 1300006 - DNA, 22 bp, Artificial Sequence
  chemically synthesized
taagtcattgagatttggattt

SEQ ID NO: 1300007 - DNA, 22 bp, Artificial Sequence
  chemically synthesized
atgctctgtaaaaaacaaatcc

SEQ ID NO: 1300008 - DNA, 22 bp, Artificial Sequence
  chemically synthesized
agatttggatttgttttttaca

SEQ ID NO: 1300009 - DNA, 22 bp, Artificial Sequence
  chemically synthesized
taggctaatgctctgtaaaaaa

SEQ ID NO: 1300010 - DNA, 22 bp, Artificial Sequence
  chemically synthesized
ttataggctaatgctctgtaaa

SEQ ID NO: 1300011 - DNA, 22 bp, Artificial Sequence
  chemically synthesized
attataggctaatgctctgtaa

SEQ ID NO: 1300012 - DNA, 22 bp, Artificial Sequence
  chemically synthesized
ggatttgttttttacagagcat

SEQ ID NO: 1300013 - DNA, 22 bp, Artificial Sequence
  chemically synthesized
tattataggctaatgctctgta

SEQ ID NO: 1300014 - DNA, 22 bp, Artificial Sequence
  chemically synthesized
gatttgttttttacagagcatt

SEQ ID NO: 1300015 - DNA, 22 bp, Artificial Sequence
  chemically synthesized
gttttttacagagcattagcct

SEQ ID NO: 1300016 - DNA, 22 bp, Artificial Sequence
  chemically synthesized
ttttttacagagcattagccta

SEQ ID NO: 1300017 - DNA, 22 bp, Artificial Sequence
  chemically synthesized
gtcagctttattataggctaat

SEQ ID NO: 1300018 - DNA, 22 bp, Artificial Sequence
  chemically synthesized
tttacagagcattagcctataa

SEQ ID NO: 1300019 - DNA, 22 bp, Artificial Sequence
  chemically synthesized
ttacagagcattagcctataat

SEQ ID NO: 1300020 - DNA, 22 bp, Artificial Sequence
  chemically synthesized
tacagagcattagcctataata

SEQ ID NO: 1300021 - DNA, 22 bp, Artificial Sequence
  chemically synthesized
acagagcattagcctataataa

SEQ ID NO: 1300022 - DNA, 22 bp, Artificial Sequence
  chemically synthesized
tattagtcagctttattatagg

SEQ ID NO: 1300023 - DNA, 22 bp, Artificial Sequence
  chemically synthesized
cagagcattagcctataataaa

SEQ ID NO: 1300024 - DNA, 22 bp, Artificial Sequence
  chemically synthesized
ctatattagtcagctttattat

SEQ ID NO: 1300025 - DNA, 22 bp, Artificial Sequence
  chemically synthesized
cctgctatattagtcagcttta

SEQ ID NO: 1300026 - DNA, 22 bp, Artificial Sequence
  chemically synthesized
acctgctatattagtcagcttt

SEQ ID NO: 1300027 - DNA, 22 bp, Artificial Sequence
  chemically synthesized
gcctataataaagctgactaat

SEQ ID NO: 1300028 - DNA, 22 bp, Artificial Sequence
  chemically synthesized
tttacctgctatattagtcagc

SEQ ID NO: 1300029 - DNA, 22 bp, Artificial Sequence
  chemically synthesized
ctatttacctgctatattagtc

SEQ ID NO: 1300030 - DNA, 22 bp, Artificial Sequence
  chemically synthesized
actatttacctgctatattagt

SEQ ID NO: 1300031 - DNA, 22 bp, Artificial Sequence
  chemically synthesized
taataaagctgactaatatagc

SEQ ID NO: 1300032 - DNA, 22 bp, Artificial Sequence
  chemically synthesized
actaatatagcaggtaaatagt

SEQ ID NO: 1300033 - DNA, 22 bp, Artificial Sequence
  chemically synthesized
tgggccacatttactatttacc

SEQ ID NO: 1300034 - DNA, 22 bp, Artificial Sequence
  chemically synthesized
tatgggccacatttactattta

SEQ ID NO: 1300035 - DNA, 22 bp, Artificial Sequence
  chemically synthesized
atatagcaggtaaatagtaaat

SEQ ID NO: 1300036 - DNA, 22 bp, Artificial Sequence
  chemically synthesized
ttctatgggccacatttactat

SEQ ID NO: 1300037 - DNA, 22 bp, Artificial Sequence
  chemically synthesized
attctatgggccacatttacta

SEQ ID NO: 1300038 - DNA, 22 bp, Artificial Sequence
  chemically synthesized
tattctatgggccacatttact

SEQ ID NO: 1300039 - DNA, 22 bp, Artificial Sequence
  chemically synthesized
aattttattctatgggccacat

SEQ ID NO: 1300040 - DNA, 22 bp, Artificial Sequence
  chemically synthesized
ttgaattttattctatgggcca

SEQ ID NO: 1300041 - DNA, 22 bp, Artificial Sequence
  chemically synthesized
catcattattgaattttattct

SEQ ID NO: 1300042 - DNA, 22 bp, Artificial Sequence
  chemically synthesized
tatacattccatcattattgaa

SEQ ID NO: 1300043 - DNA, 22 bp, Artificial Sequence
  chemically synthesized
aatgaagaggttatatacattc

SEQ ID NO: 1300044 - DNA, 22 bp, Artificial Sequence
  chemically synthesized
aaatgaagaggttatatacatt

SEQ ID NO: 1300045 - DNA, 22 bp, Artificial Sequence
  chemically synthesized
aataatgatggaatgtatataa

SEQ ID NO: 1300046 - DNA, 22 bp, Artificial Sequence
  chemically synthesized
taaatgaagaggttatatacat

SEQ ID NO: 1300047 - DNA, 22 bp, Artificial Sequence
  chemically synthesized
ttaaatgaagaggttatataca

SEQ ID NO: 1300048 - DNA, 22 bp, Artificial Sequence
  chemically synthesized
tttaaatgaagaggttatatac

SEQ ID NO: 1300049 - DNA, 22 bp, Artificial Sequence
  chemically synthesized
ttttaaatgaagaggttatata

SEQ ID NO: 1300050 - DNA, 22 bp, Artificial Sequence
  chemically synthesized
ttttttaaatgaagaggttata

SEQ ID NO: 1300051 - DNA, 22 bp, Artificial Sequence
  chemically synthesized
tcttttttaaatgaagaggtta

SEQ ID NO: 1300052 - DNA, 22 bp, Artificial Sequence
  chemically synthesized
ttcatttaaaaaagagagggtt

SEQ ID NO: 1300053 - DNA, 22 bp, Artificial Sequence
  chemically synthesized
atgatggaatacaaccctctct

SEQ ID NO: 1300054 - DNA, 22 bp, Artificial Sequence
  chemically synthesized
aatgatggaatacaaccctctc

SEQ ID NO: 1300055 - DNA, 22 bp, Artificial Sequence
  chemically synthesized
catttaaaaaagagagggttgt

SEQ ID NO: 1300056 - DNA, 22 bp, Artificial Sequence
  chemically synthesized
atttaaaaaagagagggttgta

SEQ ID NO: 1300057 - DNA, 22 bp, Artificial Sequence
  chemically synthesized
aatttaatgatggaatacaacc

SEQ ID NO: 1300058 - DNA, 22 bp, Artificial Sequence
  chemically synthesized
aaaaaagagagggttgtattcc

SEQ ID NO: 1300059 - DNA, 22 bp, Artificial Sequence
  chemically synthesized
aaatttaatgatggaatacaac

SEQ ID NO: 1300060 - DNA, 22 bp, Artificial Sequence
  chemically synthesized
aaaaagagagggttgtattcca

SEQ ID NO: 1300061 - DNA, 22 bp, Artificial Sequence
  chemically synthesized
taaatttaatgatggaatacaa

SEQ ID NO: 1300062 - DNA, 22 bp, Artificial Sequence
  chemically synthesized
ttttaaatttaatgatggaata

SEQ ID NO: 1300063 - DNA, 22 bp, Artificial Sequence
  chemically synthesized
attttaaatttaatgatggaat

SEQ ID NO: 1300064 - DNA, 22 bp, Artificial Sequence
  chemically synthesized
agcttattttaaatttaatgat

SEQ ID NO: 1300065 - DNA, 22 bp, Artificial Sequence
  chemically synthesized
cagcttattttaaatttaatga

SEQ ID NO: 1300066 - DNA, 22 bp, Artificial Sequence
  chemically synthesized
ttcagcttattttaaatttaat

SEQ ID NO: 1300067 - DNA, 22 bp, Artificial Sequence
  chemically synthesized
tattccatcattaaatttaaaa

SEQ ID NO: 1300068 - DNA, 22 bp, Artificial Sequence
  chemically synthesized
catcattaaatttaaaataagc

SEQ ID NO: 1300069 - DNA, 22 bp, Artificial Sequence
  chemically synthesized
aaacccattcttcagcttattt

SEQ ID NO: 1300070 - DNA, 22 bp, Artificial Sequence
  chemically synthesized
aaaacccattcttcagcttatt

SEQ ID NO: 1300071 - DNA, 22 bp, Artificial Sequence
  chemically synthesized
atttaaaacccattcttcagct

SEQ ID NO: 1300072 - DNA, 22 bp, Artificial Sequence
  chemically synthesized
aatttaaaataagctgaagaat

SEQ ID NO: 1300073 - DNA, 22 bp, Artificial Sequence
  chemically synthesized
catttaaaacccattcttcagc

SEQ ID NO: 1300074 - DNA, 22 bp, Artificial Sequence
  chemically synthesized
aaaataagctgaagaatgggtt

SEQ ID NO: 1300075 - DNA, 22 bp, Artificial Sequence
  chemically synthesized
aaataagctgaagaatgggttt

SEQ ID NO: 1300076 - DNA, 22 bp, Artificial Sequence
  chemically synthesized
atacttcatttaaaacccattc

SEQ ID NO: 1300077 - DNA, 22 bp, Artificial Sequence
  chemically synthesized
aatacttcatttaaaacccatt

SEQ ID NO: 1300078 - DNA, 22 bp, Artificial Sequence
  chemically synthesized
taatacttcatttaaaacccat

SEQ ID NO: 1300079 - DNA, 22 bp, Artificial Sequence
  chemically synthesized
ttaatacttcatttaaaaccca

SEQ ID NO: 1300080 - DNA, 22 bp, Artificial Sequence
  chemically synthesized
aagaatgggttttaaatgaagt

SEQ ID NO: 1300081 - DNA, 22 bp, Artificial Sequence
  chemically synthesized
gaaagcttttaatacttcattt

SEQ ID NO: 1300082 - DNA, 22 bp, Artificial Sequence
  chemically synthesized
ggaaagcttttaatacttcatt

SEQ ID NO: 1300083 - DNA, 22 bp, Artificial Sequence
  chemically synthesized
tggaaagcttttaatacttcat

SEQ ID NO: 1300084 - DNA, 22 bp, Artificial Sequence
  chemically synthesized
ttggaaagcttttaatacttca

SEQ ID NO: 1300085 - DNA, 22 bp, Artificial Sequence
  chemically synthesized
taaatgaagtattaaaagcttt

SEQ ID NO: 1300086 - DNA, 22 bp, Artificial Sequence
  chemically synthesized
aaatgaagtattaaaagctttc

SEQ ID NO: 1300087 - DNA, 22 bp, Artificial Sequence
  chemically synthesized
aatgaagtattaaaagctttcc

SEQ ID NO: 1300088 - DNA, 22 bp, Artificial Sequence
  chemically synthesized
aaagggcaatttttggaaagct

SEQ ID NO: 1300089 - DNA, 22 bp, Artificial Sequence
  chemically synthesized
tgaaagggcaatttttggaaag

SEQ ID NO: 1300090 - DNA, 22 bp, Artificial Sequence
  chemically synthesized
aaagctttccaaaaattgccct

SEQ ID NO: 1300091 - DNA, 22 bp, Artificial Sequence
  chemically synthesized
tccaaaaattgccctttcagaa

SEQ ID NO: 1300092 - DNA, 22 bp, Artificial Sequence
  chemically synthesized
aaagataatatattctgaaagg

SEQ ID NO: 1300093 - DNA, 22 bp, Artificial Sequence
  chemically synthesized
ccaaaaattgccctttcagaat

SEQ ID NO: 1300094 - DNA, 22 bp, Artificial Sequence
  chemically synthesized
aaaagataatatattctgaaag

SEQ ID NO: 1300095 - DNA, 22 bp, Artificial Sequence
  chemically synthesized
caaaaattgccctttcagaata

SEQ ID NO: 1300096 - DNA, 22 bp, Artificial Sequence
  chemically synthesized
ccctttcagaatatattatctt

SEQ ID NO: 1300097 - DNA, 22 bp, Artificial Sequence
  chemically synthesized
tcagaatatattatcttttaaa

SEQ ID NO: 1300098 - DNA, 22 bp, Artificial Sequence
  chemically synthesized
cagaatatattatcttttaaat

SEQ ID NO: 1300099 - DNA, 22 bp, Artificial Sequence
  chemically synthesized
agaatatattatcttttaaatc

SEQ ID NO: 1300100 - DNA, 22 bp, Artificial Sequence
  chemically synthesized
tcttttaaatcttggtctttct

SEQ ID NO: 1300101 - DNA, 22 bp, Artificial Sequence
  chemically synthesized
aatggtatggtaaggagaaaga

SEQ ID NO: 1300102 - DNA, 22 bp, Artificial Sequence
  chemically synthesized
ttaaatcttggtctttctcctt

SEQ ID NO: 1300103 - DNA, 22 bp, Artificial Sequence
  chemically synthesized
gaatggtatggtaaggagaaag

SEQ ID NO: 1300104 - DNA, 22 bp, Artificial Sequence
  chemically synthesized
taaatcttggtctttctcctta

SEQ ID NO: 1300105 - DNA, 22 bp, Artificial Sequence
  chemically synthesized
tgaatggtatggtaaggagaaa

SEQ ID NO: 1300106 - DNA, 22 bp, Artificial Sequence
  chemically synthesized
aaatcttggtctttctccttac

SEQ ID NO: 1300107 - DNA, 22 bp, Artificial Sequence
  chemically synthesized
aatcttggtctttctccttacc

SEQ ID NO: 1300108 - DNA, 22 bp, Artificial Sequence
  chemically synthesized
aattttgaatggtatggtaagg

SEQ ID NO: 1300109 - DNA, 22 bp, Artificial Sequence
  chemically synthesized
aaattttgaatggtatggtaag

SEQ ID NO: 1300110 - DNA, 22 bp, Artificial Sequence
  chemically synthesized
ggtctttctccttaccatacca

SEQ ID NO: 1300111 - DNA, 22 bp, Artificial Sequence
  chemically synthesized
gtctttctccttaccataccat

SEQ ID NO: 1300112 - DNA, 22 bp, Artificial Sequence
  chemically synthesized
atgtttaaattttgaatggtat

SEQ ID NO: 1300113 - DNA, 22 bp, Artificial Sequence
  chemically synthesized
aatgtttaaattttgaatggta

SEQ ID NO: 1300114 - DNA, 22 bp, Artificial Sequence
  chemically synthesized
tctccttaccataccattcaaa

SEQ ID NO: 1300115 - DNA, 22 bp, Artificial Sequence
  chemically synthesized
taatgtttaaattttgaatggt

SEQ ID NO: 1300116 - DNA, 22 bp, Artificial Sequence
  chemically synthesized
ctccttaccataccattcaaaa

SEQ ID NO: 1300117 - DNA, 22 bp, Artificial Sequence
  chemically synthesized
tccttaccataccattcaaaat

SEQ ID NO: 1300118 - DNA, 22 bp, Artificial Sequence
  chemically synthesized
ttttaatgtttaaattttgaat

SEQ ID NO: 1300119 - DNA, 22 bp, Artificial Sequence
  chemically synthesized
cttaccataccattcaaaattt

SEQ ID NO: 1300120 - DNA, 22 bp, Artificial Sequence
  chemically synthesized
gttttaatgtttaaattttgaa

SEQ ID NO: 1300121 - DNA, 22 bp, Artificial Sequence
  chemically synthesized
accataccattcaaaatttaaa

SEQ ID NO: 1300122 - DNA, 22 bp, Artificial Sequence
  chemically synthesized
cttgttttaatgtttaaatttt

SEQ ID NO: 1300123 - DNA, 22 bp, Artificial Sequence
  chemically synthesized
ccataccattcaaaatttaaac

SEQ ID NO: 1300124 - DNA, 22 bp, Artificial Sequence
  chemically synthesized
aaaatttaaacattaaaacaag

SEQ ID NO: 1300125 - DNA, 22 bp, Artificial Sequence
  chemically synthesized
aaacattaaaacaagcaggttg

SEQ ID NO: 1300126 - DNA, 22 bp, Artificial Sequence
  chemically synthesized
aacattaaaacaagcaggttgt

SEQ ID NO: 1300127 - DNA, 22 bp, Artificial Sequence
  chemically synthesized
gccatgtatgagaacaacctgc

SEQ ID NO: 1300128 - DNA, 22 bp, Artificial Sequence
  chemically synthesized
ggccatgtatgagaacaacctg

SEQ ID NO: 1300129 - DNA, 22 bp, Artificial Sequence
  chemically synthesized
aaacaagcaggttgttctcata

SEQ ID NO: 1300130 - DNA, 22 bp, Artificial Sequence
  chemically synthesized
atacttggccatgtatgagaac

SEQ ID NO: 1300131 - DNA, 22 bp, Artificial Sequence
  chemically synthesized
tgctaatacttggccatgtatg

SEQ ID NO: 1300132 - DNA, 22 bp, Artificial Sequence
  chemically synthesized
tctgtgctaatacttggccatg

SEQ ID NO: 1300133 - DNA, 22 bp, Artificial Sequence
  chemically synthesized
tgtctgtgctaatacttggcca

SEQ ID NO: 1300134 - DNA, 22 bp, Artificial Sequence
  chemically synthesized
ctgtctgtgctaatacttggcc

SEQ ID NO: 1300135 - DNA, 22 bp, Artificial Sequence
  chemically synthesized
ttctcatacatggccaagtatt

SEQ ID NO: 1300136 - DNA, 22 bp, Artificial Sequence
  chemically synthesized
tcatacatggccaagtattagc

SEQ ID NO: 1300137 - DNA, 22 bp, Artificial Sequence
  chemically synthesized
atttctgtctgtgctaatactt

SEQ ID NO: 1300138 - DNA, 22 bp, Artificial Sequence
  chemically synthesized
atacatggccaagtattagcac

SEQ ID NO: 1300139 - DNA, 22 bp, Artificial Sequence
  chemically synthesized
cattgatttctgtctgtgctaa

SEQ ID NO: 1300140 - DNA, 22 bp, Artificial Sequence
  chemically synthesized
tacattgatttctgtctgtgct

SEQ ID NO: 1300141 - DNA, 22 bp, Artificial Sequence
  chemically synthesized
ctacattgatttctgtctgtgc

SEQ ID NO: 1300142 - DNA, 22 bp, Artificial Sequence
  chemically synthesized
tctacattgatttctgtctgtg

SEQ ID NO: 1300143 - DNA, 22 bp, Artificial Sequence
  chemically synthesized
ttttctacattgatttctgtct

SEQ ID NO: 1300144 - DNA, 22 bp, Artificial Sequence
  chemically synthesized
aattgttttctacattgatttc

SEQ ID NO: 1300145 - DNA, 22 bp, Artificial Sequence
  chemically synthesized
aaattgttttctacattgattt

SEQ ID NO: 1300146 - DNA, 22 bp, Artificial Sequence
  chemically synthesized
gcacagacagaaatcaatgtag

SEQ ID NO: 1300147 - DNA, 22 bp, Artificial Sequence
  chemically synthesized
cacttaaattgttttctacatt

SEQ ID NO: 1300148 - DNA, 22 bp, Artificial Sequence
  chemically synthesized
ccacttaaattgttttctacat

SEQ ID NO: 1300149 - DNA, 22 bp, Artificial Sequence
  chemically synthesized
tccacttaaattgttttctaca

SEQ ID NO: 1300150 - DNA, 22 bp, Artificial Sequence
  chemically synthesized
ttttccacttaaattgttttct

SEQ ID NO: 1300151 - DNA, 22 bp, Artificial Sequence
  chemically synthesized
attttccacttaaattgttttc

SEQ ID NO: 1300152 - DNA, 22 bp, Artificial Sequence
  chemically synthesized
aaacttattttccacttaaatt

SEQ ID NO: 1300153 - DNA, 22 bp, Artificial Sequence
  chemically synthesized
aaaacttattttccacttaaat

SEQ ID NO: 1300154 - DNA, 22 bp, Artificial Sequence
  chemically synthesized
cttaaaacttattttccactta

SEQ ID NO: 1300155 - DNA, 22 bp, Artificial Sequence
  chemically synthesized
ccttaaaacttattttccactt

SEQ ID NO: 1300156 - DNA, 22 bp, Artificial Sequence
  chemically synthesized
catttccttaaaacttattttc

SEQ ID NO: 1300157 - DNA, 22 bp, Artificial Sequence
  chemically synthesized
actgcatttccttaaaacttat

SEQ ID NO: 1300158 - DNA, 22 bp, Artificial Sequence
  chemically synthesized
aagtggaaaataagttttaagg

SEQ ID NO: 1300159 - DNA, 22 bp, Artificial Sequence
  chemically synthesized
agtggaaaataagttttaagga

SEQ ID NO: 1300160 - DNA, 22 bp, Artificial Sequence
  chemically synthesized
caataactcactgcatttcctt

SEQ ID NO: 1300161 - DNA, 22 bp, Artificial Sequence
  chemically synthesized
ttacaataactcactgcatttc

SEQ ID NO: 1300162 - DNA, 22 bp, Artificial Sequence
  chemically synthesized
ctattacaataactcactgcat

SEQ ID NO: 1300163 - DNA, 22 bp, Artificial Sequence
  chemically synthesized
taaggaaatgcagtgagttatt

SEQ ID NO: 1300164 - DNA, 22 bp, Artificial Sequence
  chemically synthesized
aaggaaatgcagtgagttattg

SEQ ID NO: 1300165 - DNA, 22 bp, Artificial Sequence
  chemically synthesized
aggaaatgcagtgagttattgt

SEQ ID NO: 1300166 - DNA, 22 bp, Artificial Sequence
  chemically synthesized
accattgctattacaataactc

SEQ ID NO: 1300167 - DNA, 22 bp, Artificial Sequence
  chemically synthesized
agtactgaccattgctattaca

SEQ ID NO: 1300168 - DNA, 22 bp, Artificial Sequence
  chemically synthesized
ttgtaatagcaatggtcagtac

SEQ ID NO: 1300169 - DNA, 22 bp, Artificial Sequence
  chemically synthesized
taatagcaatggtcagtactga

SEQ ID NO: 1300170 - DNA, 22 bp, Artificial Sequence
  chemically synthesized
gcacaaggtggaaatgagcagg

SEQ ID NO: 1300171 - DNA, 22 bp, Artificial Sequence
  chemically synthesized
ggcacaaggtggaaatgagcag

SEQ ID NO: 1300172 - DNA, 22 bp, Artificial Sequence
  chemically synthesized
agtatttggcacaaggtggaaa

SEQ ID NO: 1300173 - DNA, 22 bp, Artificial Sequence
  chemically synthesized
cagtatttggcacaaggtggaa

SEQ ID NO: 1300174 - DNA, 22 bp, Artificial Sequence
  chemically synthesized
agcctgctcatttccaccttgt

SEQ ID NO: 1300175 - DNA, 22 bp, Artificial Sequence
  chemically synthesized
tcagtatttggcacaaggtgga

SEQ ID NO: 1300176 - DNA, 22 bp, Artificial Sequence
  chemically synthesized
ctcatttccaccttgtgccaaa

SEQ ID NO: 1300177 - DNA, 22 bp, Artificial Sequence
  chemically synthesized
agtgctttcagtatttggcaca

SEQ ID NO: 1300178 - DNA, 22 bp, Artificial Sequence
  chemically synthesized
aagtgctttcagtatttggcac

SEQ ID NO: 1300179 - DNA, 22 bp, Artificial Sequence
  chemically synthesized
atttccaccttgtgccaaatac

SEQ ID NO: 1300180 - DNA, 22 bp, Artificial Sequence
  chemically synthesized
taagtgctttcagtatttggca

SEQ ID NO: 1300181 - DNA, 22 bp, Artificial Sequence
  chemically synthesized
ttttaagtgctttcagtatttg

SEQ ID NO: 1300182 - DNA, 22 bp, Artificial Sequence
  chemically synthesized
ccaccttgtgccaaatactgaa

SEQ ID NO: 1300183 - DNA, 22 bp, Artificial Sequence
  chemically synthesized
caccttgtgccaaatactgaaa

SEQ ID NO: 1300184 - DNA, 22 bp, Artificial Sequence
  chemically synthesized
tgttttaagtgctttcagtatt

SEQ ID NO: 1300185 - DNA, 22 bp, Artificial Sequence
  chemically synthesized
ctgttttaagtgctttcagtat

SEQ ID NO: 1300186 - DNA, 22 bp, Artificial Sequence
  chemically synthesized
tttctgttttaagtgctttcag

SEQ ID NO: 1300187 - DNA, 22 bp, Artificial Sequence
  chemically synthesized
atttctgttttaagtgctttca

SEQ ID NO: 1300188 - DNA, 22 bp, Artificial Sequence
  chemically synthesized
gtgccaaatactgaaagcactt

SEQ ID NO: 1300189 - DNA, 22 bp, Artificial Sequence
  chemically synthesized
tatttctgttttaagtgctttc

SEQ ID NO: 1300190 - DNA, 22 bp, Artificial Sequence
  chemically synthesized
tgccaaatactgaaagcactta

SEQ ID NO: 1300191 - DNA, 22 bp, Artificial Sequence
  chemically synthesized
cgaaactttatttctgttttaa

SEQ ID NO: 1300192 - DNA, 22 bp, Artificial Sequence
  chemically synthesized
ctccgaaactttatttctgttt

SEQ ID NO: 1300193 - DNA, 22 bp, Artificial Sequence
  chemically synthesized
aaagcacttaaaacagaaataa

SEQ ID NO: 1300194 - DNA, 22 bp, Artificial Sequence
  chemically synthesized
aaaacagaaataaagtttcgga

SEQ ID NO: 1300195 - DNA, 22 bp, Artificial Sequence
  chemically synthesized
aaacagaaataaagtttcggag

SEQ ID NO: 1300196 - DNA, 22 bp, Artificial Sequence
  chemically synthesized
gtgaacagggagtgaatgatta

SEQ ID NO: 1300197 - DNA, 22 bp, Artificial Sequence
  chemically synthesized
ggtgaacagggagtgaatgatt

SEQ ID NO: 1300198 - DNA, 22 bp, Artificial Sequence
  chemically synthesized
cggagtaatcattcactccctg

SEQ ID NO: 1300199 - DNA, 22 bp, Artificial Sequence
  chemically synthesized
ggagtaatcattcactccctgt

SEQ ID NO: 1300200 - DNA, 22 bp, Artificial Sequence
  chemically synthesized
cgtatttggtgaacagggagtg

SEQ ID NO: 1300201 - DNA, 22 bp, Artificial Sequence
  chemically synthesized
ccgtatttggtgaacagggagt

SEQ ID NO: 1300202 - DNA, 22 bp, Artificial Sequence
  chemically synthesized
agacttccgtatttggtgaaca

SEQ ID NO: 1300203 - DNA, 22 bp, Artificial Sequence
  chemically synthesized
aagacttccgtatttggtgaac

SEQ ID NO: 1300204 - DNA, 22 bp, Artificial Sequence
  chemically synthesized
gcttaagacttccgtatttggt

SEQ ID NO: 1300205 - DNA, 22 bp, Artificial Sequence
  chemically synthesized
actccctgttcaccaaatacgg

SEQ ID NO: 1300206 - DNA, 22 bp, Artificial Sequence
  chemically synthesized
cctgttcaccaaatacggaagt

SEQ ID NO: 1300207 - DNA, 22 bp, Artificial Sequence
  chemically synthesized
ttcaccaaatacggaagtctta

SEQ ID NO: 1300208 - DNA, 22 bp, Artificial Sequence
  chemically synthesized
ataaacactggcttaagacttc

SEQ ID NO: 1300209 - DNA, 22 bp, Artificial Sequence
  chemically synthesized
cataaacactggcttaagactt

SEQ ID NO: 1300210 - DNA, 22 bp, Artificial Sequence
  chemically synthesized
accaaatacggaagtcttaagc

SEQ ID NO: 1300211 - DNA, 22 bp, Artificial Sequence
  chemically synthesized
tcataaacactggcttaagact

SEQ ID NO: 1300212 - DNA, 22 bp, Artificial Sequence
  chemically synthesized
atctttcataaacactggctta

SEQ ID NO: 1300213 - DNA, 22 bp, Artificial Sequence
  chemically synthesized
gatctttcataaacactggctt

SEQ ID NO: 1300214 - DNA, 22 bp, Artificial Sequence
  chemically synthesized
gcttgatctttcataaacactg

SEQ ID NO: 1300215 - DNA, 22 bp, Artificial Sequence
  chemically synthesized
ggcttgatctttcataaacact

SEQ ID NO: 1300216 - DNA, 22 bp, Artificial Sequence
  chemically synthesized
tggcttgatctttcataaacac

SEQ ID NO: 1300217 - DNA, 22 bp, Artificial Sequence
  chemically synthesized
ttggcttgatctttcataaaca

SEQ ID NO: 1300218 - DNA, 22 bp, Artificial Sequence
  chemically synthesized
aagccagtgtttatgaaagatc

SEQ ID NO: 1300219 - DNA, 22 bp, Artificial Sequence
  chemically synthesized
agccagtgtttatgaaagatca

SEQ ID NO: 1300220 - DNA, 22 bp, Artificial Sequence
  chemically synthesized
taatttttggcttgatctttca

SEQ ID NO: 1300221 - DNA, 22 bp, Artificial Sequence
  chemically synthesized
ataatttttggcttgatctttc

SEQ ID NO: 1300222 - DNA, 22 bp, Artificial Sequence
  chemically synthesized
tttataatttttggcttgatct

SEQ ID NO: 1300223 - DNA, 22 bp, Artificial Sequence
  chemically synthesized
ctatttataatttttggcttga

SEQ ID NO: 1300224 - DNA, 22 bp, Artificial Sequence
  chemically synthesized
atgaaagatcaagccaaaaatt

SEQ ID NO: 1300225 - DNA, 22 bp, Artificial Sequence
  chemically synthesized
attcctatttataatttttggc

SEQ ID NO: 1300226 - DNA, 22 bp, Artificial Sequence
  chemically synthesized
tgaaagatcaagccaaaaatta

SEQ ID NO: 1300227 - DNA, 22 bp, Artificial Sequence
  chemically synthesized
cattcctatttataatttttgg

SEQ ID NO: 1300228 - DNA, 22 bp, Artificial Sequence
  chemically synthesized
gccttcattcctatttataatt

SEQ ID NO: 1300229 - DNA, 22 bp, Artificial Sequence
  chemically synthesized
ggccttcattcctatttataat

SEQ ID NO: 1300230 - DNA, 22 bp, Artificial Sequence
  chemically synthesized
aaaacatgtttggccttcattc

SEQ ID NO: 1300231 - DNA, 22 bp, Artificial Sequence
  chemically synthesized
taaataggaatgaaggccaaac

SEQ ID NO: 1300232 - DNA, 22 bp, Artificial Sequence
  chemically synthesized
ccgtcagtgctgaaaacatgtt

SEQ ID NO: 1300233 - DNA, 22 bp, Artificial Sequence
  chemically synthesized
cccgtcagtgctgaaaacatgt

SEQ ID NO: 1300234 - DNA, 22 bp, Artificial Sequence
  chemically synthesized
caaagtttcccgtcagtgctga

SEQ ID NO: 1300235 - DNA, 22 bp, Artificial Sequence
  chemically synthesized
actgcaaagtttcccgtcagtg

SEQ ID NO: 1300236 - DNA, 22 bp, Artificial Sequence
  chemically synthesized
ctgactgcaaagtttcccgtca

SEQ ID NO: 1300237 - DNA, 22 bp, Artificial Sequence
  chemically synthesized
actgactgcaaagtttcccgtc

SEQ ID NO: 1300238 - DNA, 22 bp, Artificial Sequence
  chemically synthesized
tactgactgcaaagtttcccgt

SEQ ID NO: 1300239 - DNA, 22 bp, Artificial Sequence
  chemically synthesized
ttactgactgcaaagtttcccg

SEQ ID NO: 1300240 - DNA, 22 bp, Artificial Sequence
  chemically synthesized
tcagcactgacgggaaactttg

SEQ ID NO: 1300241 - DNA, 22 bp, Artificial Sequence
  chemically synthesized
ttttactgactgcaaagtttcc

SEQ ID NO: 1300242 - DNA, 22 bp, Artificial Sequence
  chemically synthesized
cagcactgacgggaaactttgc

SEQ ID NO: 1300243 - DNA, 22 bp, Artificial Sequence
  chemically synthesized
agcactgacgggaaactttgca

SEQ ID NO: 1300244 - DNA, 22 bp, Artificial Sequence
  chemically synthesized
atgttcttttactgactgcaaa

SEQ ID NO: 1300245 - DNA, 22 bp, Artificial Sequence
  chemically synthesized
taatgttcttttactgactgca

SEQ ID NO: 1300246 - DNA, 22 bp, Artificial Sequence
  chemically synthesized
acgggaaactttgcagtcagta

SEQ ID NO: 1300247 - DNA, 22 bp, Artificial Sequence
  chemically synthesized
actctaatgttcttttactgac

SEQ ID NO: 1300248 - DNA, 22 bp, Artificial Sequence
  chemically synthesized
tgcagtcagtaaaagaacatta

SEQ ID NO: 1300249 - DNA, 22 bp, Artificial Sequence
  chemically synthesized
aaagactgactctaatgttctt

SEQ ID NO: 1300250 - DNA, 22 bp, Artificial Sequence
  chemically synthesized
gcagtcagtaaaagaacattag

SEQ ID NO: 1300251 - DNA, 22 bp, Artificial Sequence
  chemically synthesized
cagtcagtaaaagaacattaga

SEQ ID NO: 1300252 - DNA, 22 bp, Artificial Sequence
  chemically synthesized
taaaagactgactctaatgttc

SEQ ID NO: 1300253 - DNA, 22 bp, Artificial Sequence
  chemically synthesized
ctaaaagactgactctaatgtt

SEQ ID NO: 1300254 - DNA, 22 bp, Artificial Sequence
  chemically synthesized
tctaaaagactgactctaatgt

SEQ ID NO: 1300255 - DNA, 22 bp, Artificial Sequence
  chemically synthesized
ttctaaaagactgactctaatg

SEQ ID NO: 1300256 - DNA, 22 bp, Artificial Sequence
  chemically synthesized
caaacccttttctaaaagactg

SEQ ID NO: 1300257 - DNA, 22 bp, Artificial Sequence
  chemically synthesized
ccaaacccttttctaaaagact

SEQ ID NO: 1300258 - DNA, 22 bp, Artificial Sequence
  chemically synthesized
tccaaacccttttctaaaagac

SEQ ID NO: 1300259 - DNA, 22 bp, Artificial Sequence
  chemically synthesized
gagtcagtcttttagaaaaggg

SEQ ID NO: 1300260 - DNA, 22 bp, Artificial Sequence
  chemically synthesized
agtaataattttccaaaccctt

SEQ ID NO: 1300261 - DNA, 22 bp, Artificial Sequence
  chemically synthesized
tcagtaataattttccaaaccc

SEQ ID NO: 1300262 - DNA, 22 bp, Artificial Sequence
  chemically synthesized
ttagaaaagggtttggaaaatt

SEQ ID NO: 1300263 - DNA, 22 bp, Artificial Sequence
  chemically synthesized
tagaaaagggtttggaaaatta

SEQ ID NO: 1300264 - DNA, 22 bp, Artificial Sequence
  chemically synthesized
tattctcagtaataattttcca

SEQ ID NO: 1300265 - DNA, 22 bp, Artificial Sequence
  chemically synthesized
agaaaagggtttggaaaattat

SEQ ID NO: 1300266 - DNA, 22 bp, Artificial Sequence
  chemically synthesized
gtattctcagtaataattttcc

SEQ ID NO: 1300267 - DNA, 22 bp, Artificial Sequence
  chemically synthesized
gaaaagggtttggaaaattatt

SEQ ID NO: 1300268 - DNA, 22 bp, Artificial Sequence
  chemically synthesized
tgtattctcagtaataattttc

SEQ ID NO: 1300269 - DNA, 22 bp, Artificial Sequence
  chemically synthesized
ttgtattctcagtaataatttt

SEQ ID NO: 1300270 - DNA, 22 bp, Artificial Sequence
  chemically synthesized
ttttgtattctcagtaataatt

SEQ ID NO: 1300271 - DNA, 22 bp, Artificial Sequence
  chemically synthesized
cttttgtattctcagtaataat

SEQ ID NO: 1300272 - DNA, 22 bp, Artificial Sequence
  chemically synthesized
ggaaaattattactgagaatac

SEQ ID NO: 1300273 - DNA, 22 bp, Artificial Sequence
  chemically synthesized
gaaaattattactgagaataca

SEQ ID NO: 1300274 - DNA, 22 bp, Artificial Sequence
  chemically synthesized
ccaggatttcttttgtattctc

SEQ ID NO: 1300275 - DNA, 22 bp, Artificial Sequence
  chemically synthesized
gctcccaggatttcttttgtat

SEQ ID NO: 1300276 - DNA, 22 bp, Artificial Sequence
  chemically synthesized
ttactgagaatacaaaagaaat

SEQ ID NO: 1300277 - DNA, 22 bp, Artificial Sequence
  chemically synthesized
attagctcccaggatttctttt

SEQ ID NO: 1300278 - DNA, 22 bp, Artificial Sequence
  chemically synthesized
gattagctcccaggatttcttt

SEQ ID NO: 1300279 - DNA, 22 bp, Artificial Sequence
  chemically synthesized
ctgagaatacaaaagaaatcct

SEQ ID NO: 1300280 - DNA, 22 bp, Artificial Sequence
  chemically synthesized
tgattagctcccaggatttctt

SEQ ID NO: 1300281 - DNA, 22 bp, Artificial Sequence
  chemically synthesized
ttgattagctcccaggatttct

SEQ ID NO: 1300282 - DNA, 22 bp, Artificial Sequence
  chemically synthesized
agaatacaaaagaaatcctggg

SEQ ID NO: 1300283 - DNA, 22 bp, Artificial Sequence
  chemically synthesized
ttttgattagctcccaggattt

SEQ ID NO: 1300284 - DNA, 22 bp, Artificial Sequence
  chemically synthesized
ctcttttgattagctcccagga

SEQ ID NO: 1300285 - DNA, 22 bp, Artificial Sequence
  chemically synthesized
tctcctcttttgattagctccc

SEQ ID NO: 1300286 - DNA, 22 bp, Artificial Sequence
  chemically synthesized
aaaactgtctcctcttttgatt

SEQ ID NO: 1300287 - DNA, 22 bp, Artificial Sequence
  chemically synthesized
tcaaaactgtctcctcttttga

SEQ ID NO: 1300288 - DNA, 22 bp, Artificial Sequence
  chemically synthesized
ggagctaatcaaaagaggagac

SEQ ID NO: 1300289 - DNA, 22 bp, Artificial Sequence
  chemically synthesized
actctcaaaactgtctcctctt

SEQ ID NO: 1300290 - DNA, 22 bp, Artificial Sequence
  chemically synthesized
attaactctcaaaactgtctcc

SEQ ID NO: 1300291 - DNA, 22 bp, Artificial Sequence
  chemically synthesized
atcaaaagaggagacagttttg

SEQ ID NO: 1300292 - DNA, 22 bp, Artificial Sequence
  chemically synthesized
gcacctgattaactctcaaaac

SEQ ID NO: 1300293 - DNA, 22 bp, Artificial Sequence
  chemically synthesized
gcattggcacctgattaactct

SEQ ID NO: 1300294 - DNA, 22 bp, Artificial Sequence
  chemically synthesized
ttagcattggcacctgattaac

SEQ ID NO: 1300295 - DNA, 22 bp, Artificial Sequence
  chemically synthesized
tgagagttaatcaggtgccaat

SEQ ID NO: 1300296 - DNA, 22 bp, Artificial Sequence
  chemically synthesized
gagagttaatcaggtgccaatg

SEQ ID NO: 1300297 - DNA, 22 bp, Artificial Sequence
  chemically synthesized
agagttaatcaggtgccaatgc

SEQ ID NO: 1300298 - DNA, 22 bp, Artificial Sequence
  chemically synthesized
gataatctattagcattggcac

SEQ ID NO: 1300299 - DNA, 22 bp, Artificial Sequence
  chemically synthesized
ggataatctattagcattggca

SEQ ID NO: 1300300 - DNA, 22 bp, Artificial Sequence
  chemically synthesized
atcaggtgccaatgctaataga

SEQ ID NO: 1300301 - DNA, 22 bp, Artificial Sequence
  chemically synthesized
ccacttggataatctattagca

SEQ ID NO: 1300302 - DNA, 22 bp, Artificial Sequence
  chemically synthesized
tgccacttggataatctattag

SEQ ID NO: 1300303 - DNA, 22 bp, Artificial Sequence
  chemically synthesized
ctctgccacttggataatctat

SEQ ID NO: 1300304 - DNA, 22 bp, Artificial Sequence
  chemically synthesized
gctctgccacttggataatcta

SEQ ID NO: 1300305 - DNA, 22 bp, Artificial Sequence
  chemically synthesized
tgctctgccacttggataatct

SEQ ID NO: 1300306 - DNA, 22 bp, Artificial Sequence
  chemically synthesized
tttgctctgccacttggataat

SEQ ID NO: 1300307 - DNA, 22 bp, Artificial Sequence
  chemically synthesized
ctttgctctgccacttggataa

SEQ ID NO: 1300308 - DNA, 22 bp, Artificial Sequence
  chemically synthesized
gaccttctttgctctgccactt

SEQ ID NO: 1300309 - DNA, 22 bp, Artificial Sequence
  chemically synthesized
atagattatccaagtggcagag

SEQ ID NO: 1300310 - DNA, 22 bp, Artificial Sequence
  chemically synthesized
tggaccttctttgctctgccac

SEQ ID NO: 1300311 - DNA, 22 bp, Artificial Sequence
  chemically synthesized
tccaagtggcagagcaaagaag

SEQ ID NO: 1300312 - DNA, 22 bp, Artificial Sequence
  chemically synthesized
tgtgactctggaccttctttgc

SEQ ID NO: 1300313 - DNA, 22 bp, Artificial Sequence
  chemically synthesized
attgtgtgactctggaccttct

SEQ ID NO: 1300314 - DNA, 22 bp, Artificial Sequence
  chemically synthesized
aataaaaattgattgtgtgact

SEQ ID NO: 1300315 - DNA, 22 bp, Artificial Sequence
  chemically synthesized
aagctgaataaaaattgattgt

SEQ ID NO: 1300316 - DNA, 22 bp, Artificial Sequence
  chemically synthesized
gcaactcaagctgaataaaaat

SEQ ID NO: 1300317 - DNA, 22 bp, Artificial Sequence
  chemically synthesized
tcatcagtattagcaactcaag

SEQ ID NO: 1300318 - DNA, 22 bp, Artificial Sequence
  chemically synthesized
gtcatcagtattagcaactcaa

SEQ ID NO: 1300319 - DNA, 22 bp, Artificial Sequence
  chemically synthesized
ttattcagcttgagttgctaat

SEQ ID NO: 1300320 - DNA, 22 bp, Artificial Sequence
  chemically synthesized
tattcagcttgagttgctaata

SEQ ID NO: 1300321 - DNA, 22 bp, Artificial Sequence
  chemically synthesized
attcagcttgagttgctaatac

SEQ ID NO: 1300322 - DNA, 22 bp, Artificial Sequence
  chemically synthesized
ttcagcttgagttgctaatact

SEQ ID NO: 1300323 - DNA, 22 bp, Artificial Sequence
  chemically synthesized
accacttgtcatcagtattagc

SEQ ID NO: 1300324 - DNA, 22 bp, Artificial Sequence
  chemically synthesized
agcttgagttgctaatactgat

SEQ ID NO: 1300325 - DNA, 22 bp, Artificial Sequence
  chemically synthesized
gagttgctaatactgatgacaa

SEQ ID NO: 1300326 - DNA, 22 bp, Artificial Sequence
  chemically synthesized
agttgctaatactgatgacaag

SEQ ID NO: 1300327 - DNA, 22 bp, Artificial Sequence
  chemically synthesized
ctaatactgatgacaagtggtt

SEQ ID NO: 1300328 - DNA, 22 bp, Artificial Sequence
  chemically synthesized
atactgatgacaagtggttaac

SEQ ID NO: 1300329 - DNA, 22 bp, Artificial Sequence
  chemically synthesized
gaagaagcagtcgttaaccact

SEQ ID NO: 1300330 - DNA, 22 bp, Artificial Sequence
  chemically synthesized
ggaagaagcagtcgttaaccac

SEQ ID NO: 1300331 - DNA, 22 bp, Artificial Sequence
  chemically synthesized
atgacaagtggttaacgactgc

SEQ ID NO: 1300332 - DNA, 22 bp, Artificial Sequence
  chemically synthesized
agaatcttggaagaagcagtcg

SEQ ID NO: 1300333 - DNA, 22 bp, Artificial Sequence
  chemically synthesized
attaagaatcttggaagaagca

SEQ ID NO: 1300334 - DNA, 22 bp, Artificial Sequence
  chemically synthesized
cattaagaatcttggaagaagc

SEQ ID NO: 1300335 - DNA, 22 bp, Artificial Sequence
  chemically synthesized
tcattaagaatcttggaagaag

SEQ ID NO: 1300336 - DNA, 22 bp, Artificial Sequence
  chemically synthesized
acgactgcttcttccaagattc

SEQ ID NO: 1300337 - DNA, 22 bp, Artificial Sequence
  chemically synthesized
cttcttccaagattcttaatga

SEQ ID NO: 1300338 - DNA, 22 bp, Artificial Sequence
  chemically synthesized
cttccaagattcttaatgaaag

SEQ ID NO: 1300339 - DNA, 22 bp, Artificial Sequence
  chemically synthesized
ttccaagattcttaatgaaaga

SEQ ID NO: 1300340 - DNA, 22 bp, Artificial Sequence
  chemically synthesized
agaaaagagaagtctttcatta

SEQ ID NO: 1300341 - DNA, 22 bp, Artificial Sequence
  chemically synthesized
ccaagattcttaatgaaagact

SEQ ID NO: 1300342 - DNA, 22 bp, Artificial Sequence
  chemically synthesized
caagattcttaatgaaagactt

SEQ ID NO: 1300343 - DNA, 22 bp, Artificial Sequence
  chemically synthesized
ttaatgaaagacttctcttttc

SEQ ID NO: 1300344 - DNA, 22 bp, Artificial Sequence
  chemically synthesized
aatgaaagacttctcttttctc

SEQ ID NO: 1300345 - DNA, 22 bp, Artificial Sequence
  chemically synthesized
atgaaagacttctcttttctca

SEQ ID NO: 1300346 - DNA, 22 bp, Artificial Sequence
  chemically synthesized
atccagtggcataataaacctg

SEQ ID NO: 1300347 - DNA, 22 bp, Artificial Sequence
  chemically synthesized
aatccagtggcataataaacct

SEQ ID NO: 1300348 - DNA, 22 bp, Artificial Sequence
  chemically synthesized
taatccagtggcataataaacc

SEQ ID NO: 1300349 - DNA, 22 bp, Artificial Sequence
  chemically synthesized
ctcttttctcaggtttattatg

SEQ ID NO: 1300350 - DNA, 22 bp, Artificial Sequence
  chemically synthesized
ttaatccagtggcataataaac

SEQ ID NO: 1300351 - DNA, 22 bp, Artificial Sequence
  chemically synthesized
tcttttctcaggtttattatgc

SEQ ID NO: 1300352 - DNA, 22 bp, Artificial Sequence
  chemically synthesized
tttaatccagtggcataataaa

SEQ ID NO: 1300353 - DNA, 22 bp, Artificial Sequence
  chemically synthesized
ttttaatccagtggcataataa

SEQ ID NO: 1300354 - DNA, 22 bp, Artificial Sequence
  chemically synthesized
ttttctcaggtttattatgcca

SEQ ID NO: 1300355 - DNA, 22 bp, Artificial Sequence
  chemically synthesized
ttctcaggtttattatgccact

SEQ ID NO: 1300356 - DNA, 22 bp, Artificial Sequence
  chemically synthesized
tctcaggtttattatgccactg

SEQ ID NO: 1300357 - DNA, 22 bp, Artificial Sequence
  chemically synthesized
ctcaggtttattatgccactgg

SEQ ID NO: 1300358 - DNA, 22 bp, Artificial Sequence
  chemically synthesized
tcaggtttattatgccactgga

SEQ ID NO: 1300359 - DNA, 22 bp, Artificial Sequence
  chemically synthesized
aggtttattatgccactggatt

SEQ ID NO: 1300360 - DNA, 22 bp, Artificial Sequence
  chemically synthesized
attatgccactggattaaaaaa

SEQ ID NO: 1300361 - DNA, 22 bp, Artificial Sequence
  chemically synthesized
ttatgccactggattaaaaaag

SEQ ID NO: 1300362 - DNA, 22 bp, Artificial Sequence
  chemically synthesized
tgccactggattaaaaaaggta

SEQ ID NO: 1300363 - DNA, 22 bp, Artificial Sequence
  chemically synthesized
gtacagaaataaataccttttt

SEQ ID NO: 1300364 - DNA, 22 bp, Artificial Sequence
  chemically synthesized
agtacagaaataaatacctttt

SEQ ID NO: 1300365 - DNA, 22 bp, Artificial Sequence
  chemically synthesized
gattaaaaaaggtatttatttc

SEQ ID NO: 1300366 - DNA, 22 bp, Artificial Sequence
  chemically synthesized
aaaaaggtatttatttctgtac

SEQ ID NO: 1300367 - DNA, 22 bp, Artificial Sequence
  chemically synthesized
tcaccgatcttagtacagaaat

SEQ ID NO: 1300368 - DNA, 22 bp, Artificial Sequence
  chemically synthesized
atttctgtactaagatcggtga

SEQ ID NO: 1300369 - DNA, 22 bp, Artificial Sequence
  chemically synthesized
ggtgtagtcctgtcaccgatct

SEQ ID NO: 1300370 - DNA, 22 bp, Artificial Sequence
  chemically synthesized
tttctgtactaagatcggtgac

SEQ ID NO: 1300371 - DNA, 22 bp, Artificial Sequence
  chemically synthesized
tcggtgtagtcctgtcaccgat

SEQ ID NO: 1300372 - DNA, 22 bp, Artificial Sequence
  chemically synthesized
ctgtactaagatcggtgacagg

SEQ ID NO: 1300373 - DNA, 22 bp, Artificial Sequence
  chemically synthesized
tgtactaagatcggtgacagga

SEQ ID NO: 1300374 - DNA, 22 bp, Artificial Sequence
  chemically synthesized
tactaagatcggtgacaggact

SEQ ID NO: 1300375 - DNA, 22 bp, Artificial Sequence
  chemically synthesized
agatcggtgacaggactacacc

SEQ ID NO: 1300376 - DNA, 22 bp, Artificial Sequence
  chemically synthesized
agggacgtgttctcggtgtagt

SEQ ID NO: 1300377 - DNA, 22 bp, Artificial Sequence
  chemically synthesized
gcaatgtacactgagggacgtg

SEQ ID NO: 1300378 - DNA, 22 bp, Artificial Sequence
  chemically synthesized
caccgagaacacgtccctcagt

SEQ ID NO: 1300379 - DNA, 22 bp, Artificial Sequence
  chemically synthesized
ttggcaatgtacactgagggac

SEQ ID NO: 1300380 - DNA, 22 bp, Artificial Sequence
  chemically synthesized
atctattggcaatgtacactga

SEQ ID NO: 1300381 - DNA, 22 bp, Artificial Sequence
  chemically synthesized
agtgtacattgccaatagatga

SEQ ID NO: 1300382 - DNA, 22 bp, Artificial Sequence
  chemically synthesized
ccaatagatgagttttgtctat

SEQ ID NO: 1300383 - DNA, 22 bp, Artificial Sequence
  chemically synthesized
gtcaatcaagatatagacaaaa

SEQ ID NO: 1300384 - DNA, 22 bp, Artificial Sequence
  chemically synthesized
aatgattagtcaatcaagatat

SEQ ID NO: 1300385 - DNA, 22 bp, Artificial Sequence
  chemically synthesized
ttaaatgattagtcaatcaaga

SEQ ID NO: 1300386 - DNA, 22 bp, Artificial Sequence
  chemically synthesized
tgtctatatcttgattgactaa

SEQ ID NO: 1300387 - DNA, 22 bp, Artificial Sequence
  chemically synthesized
gtctatatcttgattgactaat

SEQ ID NO: 1300388 - DNA, 22 bp, Artificial Sequence
  chemically synthesized
tctatatcttgattgactaatc

SEQ ID NO: 1300389 - DNA, 22 bp, Artificial Sequence
  chemically synthesized
acatctattaaatgattagtca

SEQ ID NO: 1300390 - DNA, 22 bp, Artificial Sequence
  chemically synthesized
tatcttgattgactaatcattt

SEQ ID NO: 1300391 - DNA, 22 bp, Artificial Sequence
  chemically synthesized
cactcacatctattaaatgatt

SEQ ID NO: 1300392 - DNA, 22 bp, Artificial Sequence
  chemically synthesized
gattgactaatcatttaataga

SEQ ID NO: 1300393 - DNA, 22 bp, Artificial Sequence
  chemically synthesized
attgactaatcatttaatagat

SEQ ID NO: 1300394 - DNA, 22 bp, Artificial Sequence
  chemically synthesized
actaatcatttaatagatgtga

SEQ ID NO: 1300395 - DNA, 22 bp, Artificial Sequence
  chemically synthesized
catgccaacctacactcacatc

SEQ ID NO: 1300396 - DNA, 22 bp, Artificial Sequence
  chemically synthesized
atcatttaatagatgtgagtgt

SEQ ID NO: 1300397 - DNA, 22 bp, Artificial Sequence
  chemically synthesized
gcatgccaacctacactcacat

SEQ ID NO: 1300398 - DNA, 22 bp, Artificial Sequence
  chemically synthesized
atttgcatgccaacctacactc

SEQ ID NO: 1300399 - DNA, 22 bp, Artificial Sequence
  chemically synthesized
aatttgcatgccaacctacact

SEQ ID NO: 1300400 - DNA, 22 bp, Artificial Sequence
  chemically synthesized
aatagatgtgagtgtaggttgg

SEQ ID NO: 1300401 - DNA, 22 bp, Artificial Sequence
  chemically synthesized
atagatgtgagtgtaggttggc

SEQ ID NO: 1300402 - DNA, 22 bp, Artificial Sequence
  chemically synthesized
cttaatttgcatgccaacctac

SEQ ID NO: 1300403 - DNA, 22 bp, Artificial Sequence
  chemically synthesized
gccaaaagttacttaatttgca

SEQ ID NO: 1300404 - DNA, 22 bp, Artificial Sequence
  chemically synthesized
gcatgcaaattaagtaactttt

SEQ ID NO: 1300405 - DNA, 22 bp, Artificial Sequence
  chemically synthesized
agtaacttttggccaggcgcgg

SEQ ID NO: 1300406 - DNA, 22 bp, Artificial Sequence
  chemically synthesized
caggcgtgagccaccgcgcctg

SEQ ID NO: 1300407 - DNA, 22 bp, Artificial Sequence
  chemically synthesized
ttggccaggcgcggtggctcac

SEQ ID NO: 1300408 - DNA, 22 bp, Artificial Sequence
  chemically synthesized
tggccaggcgcggtggctcacg

SEQ ID NO: 1300409 - DNA, 22 bp, Artificial Sequence
  chemically synthesized
ggccaggcgcggtggctcacgc

SEQ ID NO: 1300410 - DNA, 22 bp, Artificial Sequence
  chemically synthesized
gccaggcgcggtggctcacgcc

SEQ ID NO: 1300411 - DNA, 22 bp, Artificial Sequence
  chemically synthesized
ccaaagtgccgggattacaggc

SEQ ID NO: 1300412 - DNA, 22 bp, Artificial Sequence
  chemically synthesized
ggcctcccaaagtgccgggatt

SEQ ID NO: 1300413 - DNA, 22 bp, Artificial Sequence
  chemically synthesized
acgcctgtaatcccggcacttt

SEQ ID NO: 1300414 - DNA, 22 bp, Artificial Sequence
  chemically synthesized
taatcccggcactttgggaggc

SEQ ID NO: 1300415 - DNA, 22 bp, Artificial Sequence
  chemically synthesized
tgatccgcccacctcggcctcc

SEQ ID NO: 1300416 - DNA, 22 bp, Artificial Sequence
  chemically synthesized
gtgatccgcccacctcggcctc

SEQ ID NO: 1300417 - DNA, 22 bp, Artificial Sequence
  chemically synthesized
accttgtgatccgcccacctcg

SEQ ID NO: 1300418 - DNA, 22 bp, Artificial Sequence
  chemically synthesized
ctgaccttgtgatccgcccacc

SEQ ID NO: 1300419 - DNA, 22 bp, Artificial Sequence
  chemically synthesized
tgggaggccgaggtgggcggat

SEQ ID NO: 1300420 - DNA, 22 bp, Artificial Sequence
  chemically synthesized
gggaggccgaggtgggcggatc

SEQ ID NO: 1300421 - DNA, 22 bp, Artificial Sequence
  chemically synthesized
ggaggccgaggtgggcggatca

SEQ ID NO: 1300422 - DNA, 22 bp, Artificial Sequence
  chemically synthesized
gatctcctgaccttgtgatccg

SEQ ID NO: 1300423 - DNA, 22 bp, Artificial Sequence
  chemically synthesized
ccaggagggtctcgatctcctg

SEQ ID NO: 1300424 - DNA, 22 bp, Artificial Sequence
  chemically synthesized
gccaggagggtctcgatctcct

SEQ ID NO: 1300425 - DNA, 22 bp, Artificial Sequence
  chemically synthesized
accgtgtttgccaggagggtct

SEQ ID NO: 1300426 - DNA, 22 bp, Artificial Sequence
  chemically synthesized
caccgtgtttgccaggagggtc

SEQ ID NO: 1300427 - DNA, 22 bp, Artificial Sequence
  chemically synthesized
gtagagacggggtttcaccgtg

SEQ ID NO: 1300428 - DNA, 22 bp, Artificial Sequence
  chemically synthesized
agtagagacggggtttcaccgt

SEQ ID NO: 1300429 - DNA, 22 bp, Artificial Sequence
  chemically synthesized
tagtagagacggggtttcaccg

SEQ ID NO: 1300430 - DNA, 22 bp, Artificial Sequence
  chemically synthesized
ttagtagagacggggtttcacc

SEQ ID NO: 1300431 - DNA, 22 bp, Artificial Sequence
  chemically synthesized
ctggcaaacacggtgaaacccc

SEQ ID NO: 1300432 - DNA, 22 bp, Artificial Sequence
  chemically synthesized
gcaaacacggtgaaaccccgtc

SEQ ID NO: 1300433 - DNA, 22 bp, Artificial Sequence
  chemically synthesized
tatttttagtagagacggggtt

SEQ ID NO: 1300434 - DNA, 22 bp, Artificial Sequence
  chemically synthesized
gtatttttagtagagacggggt

SEQ ID NO: 1300435 - DNA, 22 bp, Artificial Sequence
  chemically synthesized
tgtatttttagtagagacgggg

SEQ ID NO: 1300436 - DNA, 22 bp, Artificial Sequence
  chemically synthesized
ttgtatttttagtagagacggg

SEQ ID NO: 1300437 - DNA, 22 bp, Artificial Sequence
  chemically synthesized
tttgtatttttagtagagacgg

SEQ ID NO: 1300438 - DNA, 22 bp, Artificial Sequence
  chemically synthesized
ttttgtatttttagtagagacg

SEQ ID NO: 1300439 - DNA, 22 bp, Artificial Sequence
  chemically synthesized
tttttgtatttttagtagagac

SEQ ID NO: 1300440 - DNA, 22 bp, Artificial Sequence
  chemically synthesized
ttttttgtatttttagtagaga

SEQ ID NO: 1300441 - DNA, 22 bp, Artificial Sequence
  chemically synthesized
tttttttgtatttttagtagag

SEQ ID NO: 1300442 - DNA, 22 bp, Artificial Sequence
  chemically synthesized
ttttttttgtatttttagtaga

SEQ ID NO: 1300443 - DNA, 22 bp, Artificial Sequence
  chemically synthesized
tttttttttgtatttttagtag

SEQ ID NO: 1300444 - DNA, 22 bp, Artificial Sequence
  chemically synthesized
ttttttttttgtatttttagta

SEQ ID NO: 1300445 - DNA, 22 bp, Artificial Sequence
  chemically synthesized
tttttttttttgtatttttagt

SEQ ID NO: 1300446 - DNA, 22 bp, Artificial Sequence
  chemically synthesized
ttttttttttttgtatttttag

SEQ ID NO: 1300447 - DNA, 22 bp, Artificial Sequence
  chemically synthesized
gtttttttttttttttgtattt

SEQ ID NO: 1300448 - DNA, 22 bp, Artificial Sequence
  chemically synthesized
tactaaaaatacaaaaaaaaaa

SEQ ID NO: 1300449 - DNA, 22 bp, Artificial Sequence
  chemically synthesized
ctaaaaatacaaaaaaaaaaaa

SEQ ID NO: 1300450 - DNA, 22 bp, Artificial Sequence
  chemically synthesized
aaaatacaaaaaaaaaaaaaaa

SEQ ID NO: 1300451 - DNA, 22 bp, Artificial Sequence
  chemically synthesized
caggtgcccgccaccacgcccg

SEQ ID NO: 1300452 - DNA, 22 bp, Artificial Sequence
  chemically synthesized
agactacaggtgcccgccacca

SEQ ID NO: 1300453 - DNA, 22 bp, Artificial Sequence
  chemically synthesized
gccgggcgtggtggcgggcacc

SEQ ID NO: 1300454 - DNA, 22 bp, Artificial Sequence
  chemically synthesized
ccaagtagctgagactacaggt

SEQ ID NO: 1300455 - DNA, 22 bp, Artificial Sequence
  chemically synthesized
agcctcccaagtagctgagact

SEQ ID NO: 1300456 - DNA, 22 bp, Artificial Sequence
  chemically synthesized
tctcagcctcccaagtagctga

SEQ ID NO: 1300457 - DNA, 22 bp, Artificial Sequence
  chemically synthesized
ctgtctcagcctcccaagtagc

SEQ ID NO: 1300458 - DNA, 22 bp, Artificial Sequence
  chemically synthesized
tcctgtctcagcctcccaagta

SEQ ID NO: 1300459 - DNA, 22 bp, Artificial Sequence
  chemically synthesized
tagtctcagctacttgggaggc

SEQ ID NO: 1300460 - DNA, 22 bp, Artificial Sequence
  chemically synthesized
agccattctcctgtctcagcct

SEQ ID NO: 1300461 - DNA, 22 bp, Artificial Sequence
  chemically synthesized
agctacttgggaggctgagaca

SEQ ID NO: 1300462 - DNA, 22 bp, Artificial Sequence
  chemically synthesized
cttgggaggctgagacaggaga

SEQ ID NO: 1300463 - DNA, 22 bp, Artificial Sequence
  chemically synthesized
ccgggttcagccattctcctgt

SEQ ID NO: 1300464 - DNA, 22 bp, Artificial Sequence
  chemically synthesized
gggaggctgagacaggagaatg

SEQ ID NO: 1300465 - DNA, 22 bp, Artificial Sequence
  chemically synthesized
ggaggctgagacaggagaatgg

SEQ ID NO: 1300466 - DNA, 22 bp, Artificial Sequence
  chemically synthesized
cgcctcccgggttcagccattc

SEQ ID NO: 1300467 - DNA, 22 bp, Artificial Sequence
  chemically synthesized
agacaggagaatggctgaaccc

SEQ ID NO: 1300468 - DNA, 22 bp, Artificial Sequence
  chemically synthesized
caagctccgcctcccgggttca

SEQ ID NO: 1300469 - DNA, 22 bp, Artificial Sequence
  chemically synthesized
actgcaagctccgcctcccggg

SEQ ID NO: 1300470 - DNA, 22 bp, Artificial Sequence
  chemically synthesized
ggctcactgcaagctccgcctc

SEQ ID NO: 1300471 - DNA, 22 bp, Artificial Sequence
  chemically synthesized
aacccgggaggcggagcttgca

SEQ ID NO: 1300472 - DNA, 22 bp, Artificial Sequence
  chemically synthesized
gagtgcagtggcgcgatctcgg

SEQ ID NO: 1300473 - DNA, 22 bp, Artificial Sequence
  chemically synthesized
gcagtgagccgagatcgcgcca

SEQ ID NO: 1300474 - DNA, 22 bp, Artificial Sequence
  chemically synthesized
cagtgagccgagatcgcgccac

SEQ ID NO: 1300475 - DNA, 22 bp, Artificial Sequence
  chemically synthesized
tcgcccaggctggagtgcagtg

SEQ ID NO: 1300476 - DNA, 22 bp, Artificial Sequence
  chemically synthesized
tgtcgcccaggctggagtgcag

SEQ ID NO: 1300477 - DNA, 22 bp, Artificial Sequence
  chemically synthesized
gctctgtcgcccaggctggagt

SEQ ID NO: 1300478 - DNA, 22 bp, Artificial Sequence
  chemically synthesized
cactccagcctgggcgacagag

SEQ ID NO: 1300479 - DNA, 22 bp, Artificial Sequence
  chemically synthesized
agacggagtctcgctctgtcgc

SEQ ID NO: 1300480 - DNA, 22 bp, Artificial Sequence
  chemically synthesized
gagacggagtctcgctctgtcg

SEQ ID NO: 1300481 - DNA, 22 bp, Artificial Sequence
  chemically synthesized
tgagacggagtctcgctctgtc

SEQ ID NO: 1300482 - DNA, 22 bp, Artificial Sequence
  chemically synthesized
ttgagacggagtctcgctctgt

SEQ ID NO: 1300483 - DNA, 22 bp, Artificial Sequence
  chemically synthesized
cagcctgggcgacagagcgaga

SEQ ID NO: 1300484 - DNA, 22 bp, Artificial Sequence
  chemically synthesized
tttgagacggagtctcgctctg

SEQ ID NO: 1300485 - DNA, 22 bp, Artificial Sequence
  chemically synthesized
ttttgagacggagtctcgctct

SEQ ID NO: 1300486 - DNA, 22 bp, Artificial Sequence
  chemically synthesized
tttttgagacggagtctcgctc

SEQ ID NO: 1300487 - DNA, 22 bp, Artificial Sequence
  chemically synthesized
ttttttgagacggagtctcgct

SEQ ID NO: 1300488 - DNA, 22 bp, Artificial Sequence
  chemically synthesized
tttttttgagacggagtctcgc

SEQ ID NO: 1300489 - DNA, 22 bp, Artificial Sequence
  chemically synthesized
ttttttttgagacggagtctcg

SEQ ID NO: 1300490 - DNA, 22 bp, Artificial Sequence
  chemically synthesized
tttttttttgagacggagtctc

SEQ ID NO: 1300491 - DNA, 22 bp, Artificial Sequence
  chemically synthesized
ggcgacagagcgagactccgtc

SEQ ID NO: 1300492 - DNA, 22 bp, Artificial Sequence
  chemically synthesized
gtatgagagctttttttttttg

SEQ ID NO: 1300493 - DNA, 22 bp, Artificial Sequence
  chemically synthesized
cgtctcaaaaaaaaaaagctct

SEQ ID NO: 1300494 - DNA, 22 bp, Artificial Sequence
  chemically synthesized
aaaaaaaaaaagctctcatact

SEQ ID NO: 1300495 - DNA, 22 bp, Artificial Sequence
  chemically synthesized
agtgcaaacaataaggctagta

SEQ ID NO: 1300496 - DNA, 22 bp, Artificial Sequence
  chemically synthesized
tcatactagccttattgtttgc

SEQ ID NO: 1300497 - DNA, 22 bp, Artificial Sequence
  chemically synthesized
atactagccttattgtttgcac

SEQ ID NO: 1300498 - DNA, 22 bp, Artificial Sequence
  chemically synthesized
agtgatacctaagtgcaaacaa

SEQ ID NO: 1300499 - DNA, 22 bp, Artificial Sequence
  chemically synthesized
aactcagtgatacctaagtgca

SEQ ID NO: 1300500 - DNA, 22 bp, Artificial Sequence
  chemically synthesized
gccttattgtttgcacttaggt

SEQ ID NO: 1300501 - DNA, 22 bp, Artificial Sequence
  chemically synthesized
attgtttgcacttaggtatcac

SEQ ID NO: 1300502 - DNA, 22 bp, Artificial Sequence
  chemically synthesized
ttgtttgcacttaggtatcact

SEQ ID NO: 1300503 - DNA, 22 bp, Artificial Sequence
  chemically synthesized
caagttcaactcagtgatacct

SEQ ID NO: 1300504 - DNA, 22 bp, Artificial Sequence
  chemically synthesized
tacaagttcaactcagtgatac

SEQ ID NO: 1300505 - DNA, 22 bp, Artificial Sequence
  chemically synthesized
tttgcacttaggtatcactgag

SEQ ID NO: 1300506 - DNA, 22 bp, Artificial Sequence
  chemically synthesized
ctctacaagttcaactcagtga

SEQ ID NO: 1300507 - DNA, 22 bp, Artificial Sequence
  chemically synthesized
gcacttaggtatcactgagttg

SEQ ID NO: 1300508 - DNA, 22 bp, Artificial Sequence
  chemically synthesized
cctctacaagttcaactcagtg

SEQ ID NO: 1300509 - DNA, 22 bp, Artificial Sequence
  chemically synthesized
cacttaggtatcactgagttga

SEQ ID NO: 1300510 - DNA, 22 bp, Artificial Sequence
  chemically synthesized
tcctctacaagttcaactcagt

SEQ ID NO: 1300511 - DNA, 22 bp, Artificial Sequence
  chemically synthesized
aggtatcactgagttgaacttg

SEQ ID NO: 1300512 - DNA, 22 bp, Artificial Sequence
  chemically synthesized
tattttcctctacaagttcaac

SEQ ID NO: 1300513 - DNA, 22 bp, Artificial Sequence
  chemically synthesized
ggtatcactgagttgaacttgt

SEQ ID NO: 1300514 - DNA, 22 bp, Artificial Sequence
  chemically synthesized
ttatattttcctctacaagttc

SEQ ID NO: 1300515 - DNA, 22 bp, Artificial Sequence
  chemically synthesized
tgttatattttcctctacaagt

SEQ ID NO: 1300516 - DNA, 22 bp, Artificial Sequence
  chemically synthesized
agttgaacttgtagaggaaaat

SEQ ID NO: 1300517 - DNA, 22 bp, Artificial Sequence
  chemically synthesized
taattctgttatattttcctct

SEQ ID NO: 1300518 - DNA, 22 bp, Artificial Sequence
  chemically synthesized
gtaattctgttatattttcctc

SEQ ID NO: 1300519 - DNA, 22 bp, Artificial Sequence
  chemically synthesized
tgtaattctgttatattttcct

SEQ ID NO: 1300520 - DNA, 22 bp, Artificial Sequence
  chemically synthesized
ttgtaattctgttatattttcc

SEQ ID NO: 1300521 - DNA, 22 bp, Artificial Sequence
  chemically synthesized
aacttgtagaggaaaatataac

SEQ ID NO: 1300522 - DNA, 22 bp, Artificial Sequence
  chemically synthesized
aatcttttgtaattctgttata

SEQ ID NO: 1300523 - DNA, 22 bp, Artificial Sequence
  chemically synthesized
gtagaggaaaatataacagaat

SEQ ID NO: 1300524 - DNA, 22 bp, Artificial Sequence
  chemically synthesized
tagaggaaaatataacagaatt

SEQ ID NO: 1300525 - DNA, 22 bp, Artificial Sequence
  chemically synthesized
caatgtctaaatcttttgtaat

SEQ ID NO: 1300526 - DNA, 22 bp, Artificial Sequence
  chemically synthesized
tacaatgtctaaatcttttgta

SEQ ID NO: 1300527 - DNA, 22 bp, Artificial Sequence
  chemically synthesized
ctacaatgtctaaatcttttgt

SEQ ID NO: 1300528 - DNA, 22 bp, Artificial Sequence
  chemically synthesized
tctacaatgtctaaatcttttg

SEQ ID NO: 1300529 - DNA, 22 bp, Artificial Sequence
  chemically synthesized
ttctacaatgtctaaatctttt

SEQ ID NO: 1300530 - DNA, 22 bp, Artificial Sequence
  chemically synthesized
tttctacaatgtctaaatcttt

SEQ ID NO: 1300531 - DNA, 22 bp, Artificial Sequence
  chemically synthesized
caaaagatttagacattgtaga

SEQ ID NO: 1300532 - DNA, 22 bp, Artificial Sequence
  chemically synthesized
agacattgtagaaaaaatttgg

SEQ ID NO: 1300533 - DNA, 22 bp, Artificial Sequence
  chemically synthesized
tataataaaaatccaaattttt

SEQ ID NO: 1300534 - DNA, 22 bp, Artificial Sequence
  chemically synthesized
gacattgtagaaaaaatttgga

SEQ ID NO: 1300535 - DNA, 22 bp, Artificial Sequence
  chemically synthesized
atataataaaaatccaaatttt

SEQ ID NO: 1300536 - DNA, 22 bp, Artificial Sequence
  chemically synthesized
tatataataaaaatccaaattt

SEQ ID NO: 1300537 - DNA, 22 bp, Artificial Sequence
  chemically synthesized
ttttatataataaaaatccaaa

SEQ ID NO: 1300538 - DNA, 22 bp, Artificial Sequence
  chemically synthesized
gttttatataataaaaatccaa

SEQ ID NO: 1300539 - DNA, 22 bp, Artificial Sequence
  chemically synthesized
tagaaaaaatttggatttttat

SEQ ID NO: 1300540 - DNA, 22 bp, Artificial Sequence
  chemically synthesized
tttgttttatataataaaaatc

SEQ ID NO: 1300541 - DNA, 22 bp, Artificial Sequence
  chemically synthesized
ttgtttgttttatataataaaa

SEQ ID NO: 1300542 - DNA, 22 bp, Artificial Sequence
  chemically synthesized
ggatttttattatataaaacaa

SEQ ID NO: 1300543 - DNA, 22 bp, Artificial Sequence
  chemically synthesized
aaaatctattgtttgttttata

SEQ ID NO: 1300544 - DNA, 22 bp, Artificial Sequence
  chemically synthesized
gatttttattatataaaacaaa

SEQ ID NO: 1300545 - DNA, 22 bp, Artificial Sequence
  chemically synthesized
ttattatataaaacaaacaata

SEQ ID NO: 1300546 - DNA, 22 bp, Artificial Sequence
  chemically synthesized
tattatataaaacaaacaatag

SEQ ID NO: 1300547 - DNA, 22 bp, Artificial Sequence
  chemically synthesized
aaacctcaaaatctattgtttg

SEQ ID NO: 1300548 - DNA, 22 bp, Artificial Sequence
  chemically synthesized
attatataaaacaaacaataga

SEQ ID NO: 1300549 - DNA, 22 bp, Artificial Sequence
  chemically synthesized
aaaacctcaaaatctattgttt

SEQ ID NO: 1300550 - DNA, 22 bp, Artificial Sequence
  chemically synthesized
ttatataaaacaaacaatagat

SEQ ID NO: 1300551 - DNA, 22 bp, Artificial Sequence
  chemically synthesized
tataaaacaaacaatagatttt

SEQ ID NO: 1300552 - DNA, 22 bp, Artificial Sequence
  chemically synthesized
ccttaaaacctcaaaatctatt

SEQ ID NO: 1300553 - DNA, 22 bp, Artificial Sequence
  chemically synthesized
gaaacagaaaattcccttaaaa

SEQ ID NO: 1300554 - DNA, 22 bp, Artificial Sequence
  chemically synthesized
cgaaacagaaaattcccttaaa

SEQ ID NO: 1300555 - DNA, 22 bp, Artificial Sequence
  chemically synthesized
tcgaaacagaaaattcccttaa

SEQ ID NO: 1300556 - DNA, 22 bp, Artificial Sequence
  chemically synthesized
ttcgaaacagaaaattccctta

SEQ ID NO: 1300557 - DNA, 22 bp, Artificial Sequence
  chemically synthesized
tttttcgaaacagaaaattccc

SEQ ID NO: 1300558 - DNA, 22 bp, Artificial Sequence
  chemically synthesized
tgaggttttaagggaattttct

SEQ ID NO: 1300559 - DNA, 22 bp, Artificial Sequence
  chemically synthesized
gaggttttaagggaattttctg

SEQ ID NO: 1300560 - DNA, 22 bp, Artificial Sequence
  chemically synthesized
aggttttaagggaattttctgt

SEQ ID NO: 1300561 - DNA, 22 bp, Artificial Sequence
  chemically synthesized
aaatgctgtttttcgaaacaga

SEQ ID NO: 1300562 - DNA, 22 bp, Artificial Sequence
  chemically synthesized
taagggaattttctgtttcgaa

SEQ ID NO: 1300563 - DNA, 22 bp, Artificial Sequence
  chemically synthesized
aaaatgctgtttttcgaaacag

SEQ ID NO: 1300564 - DNA, 22 bp, Artificial Sequence
  chemically synthesized
aagggaattttctgtttcgaaa

SEQ ID NO: 1300565 - DNA, 22 bp, Artificial Sequence
  chemically synthesized
agggaattttctgtttcgaaaa

SEQ ID NO: 1300566 - DNA, 22 bp, Artificial Sequence
  chemically synthesized
tacttaaaatgctgtttttcga

SEQ ID NO: 1300567 - DNA, 22 bp, Artificial Sequence
  chemically synthesized
tctgtttcgaaaaacagcattt

SEQ ID NO: 1300568 - DNA, 22 bp, Artificial Sequence
  chemically synthesized
ctgtttcgaaaaacagcatttt

SEQ ID NO: 1300569 - DNA, 22 bp, Artificial Sequence
  chemically synthesized
tgtttcgaaaaacagcatttta

SEQ ID NO: 1300570 - DNA, 22 bp, Artificial Sequence
  chemically synthesized
tttcgaaaaacagcattttaag

SEQ ID NO: 1300571 - DNA, 22 bp, Artificial Sequence
  chemically synthesized
cgaaaaacagcattttaagtat

SEQ ID NO: 1300572 - DNA, 22 bp, Artificial Sequence
  chemically synthesized
gaaaaacagcattttaagtata

SEQ ID NO: 1300573 - DNA, 22 bp, Artificial Sequence
  chemically synthesized
tgaagatgaaataaaactatac

SEQ ID NO: 1300574 - DNA, 22 bp, Artificial Sequence
  chemically synthesized
atgaagatgaaataaaactata

SEQ ID NO: 1300575 - DNA, 22 bp, Artificial Sequence
  chemically synthesized
caatttatgaagatgaaataaa

SEQ ID NO: 1300576 - DNA, 22 bp, Artificial Sequence
  chemically synthesized
acaatttatgaagatgaaataa

SEQ ID NO: 1300577 - DNA, 22 bp, Artificial Sequence
  chemically synthesized
taagtatagttttatttcatct

SEQ ID NO: 1300578 - DNA, 22 bp, Artificial Sequence
  chemically synthesized
aagtatagttttatttcatctt

SEQ ID NO: 1300579 - DNA, 22 bp, Artificial Sequence
  chemically synthesized
agtatagttttatttcatcttc

SEQ ID NO: 1300580 - DNA, 22 bp, Artificial Sequence
  chemically synthesized
aaataaagtttacaatttatga

SEQ ID NO: 1300581 - DNA, 22 bp, Artificial Sequence
  chemically synthesized
aaaataaagtttacaatttatg

SEQ ID NO: 1300582 - DNA, 22 bp, Artificial Sequence
  chemically synthesized
tatttcatcttcataaattgta

SEQ ID NO: 1300583 - DNA, 22 bp, Artificial Sequence
  chemically synthesized
atttcatcttcataaattgtaa

SEQ ID NO: 1300584 - DNA, 22 bp, Artificial Sequence
  chemically synthesized
tttcatcttcataaattgtaaa

SEQ ID NO: 1300585 - DNA, 22 bp, Artificial Sequence
  chemically synthesized
catcttcataaattgtaaactt

SEQ ID NO: 1300586 - DNA, 22 bp, Artificial Sequence
  chemically synthesized
gaatttaaaataaagtttacaa

SEQ ID NO: 1300587 - DNA, 22 bp, Artificial Sequence
  chemically synthesized
atcttcataaattgtaaacttt

SEQ ID NO: 1300588 - DNA, 22 bp, Artificial Sequence
  chemically synthesized
cataaattgtaaactttatttt

SEQ ID NO: 1300589 - DNA, 22 bp, Artificial Sequence
  chemically synthesized
ataaattgtaaactttatttta

SEQ ID NO: 1300590 - DNA, 22 bp, Artificial Sequence
  chemically synthesized
taatgactagaatttaaaataa

SEQ ID NO: 1300591 - DNA, 22 bp, Artificial Sequence
  chemically synthesized
gtaatgactagaatttaaaata

SEQ ID NO: 1300592 - DNA, 22 bp, Artificial Sequence
  chemically synthesized
tgtaatgactagaatttaaaat

SEQ ID NO: 1300593 - DNA, 22 bp, Artificial Sequence
  chemically synthesized
ttgtaatgactagaatttaaaa

SEQ ID NO: 1300594 - DNA, 22 bp, Artificial Sequence
  chemically synthesized
taaactttattttaaattctag

SEQ ID NO: 1300595 - DNA, 22 bp, Artificial Sequence
  chemically synthesized
aagtcttttgtaatgactagaa

SEQ ID NO: 1300596 - DNA, 22 bp, Artificial Sequence
  chemically synthesized
aaagtcttttgtaatgactaga

SEQ ID NO: 1300597 - DNA, 22 bp, Artificial Sequence
  chemically synthesized
tattttaaattctagtcattac

SEQ ID NO: 1300598 - DNA, 22 bp, Artificial Sequence
  chemically synthesized
attttaaattctagtcattaca

SEQ ID NO: 1300599 - DNA, 22 bp, Artificial Sequence
  chemically synthesized
ttttaaattctagtcattacaa

SEQ ID NO: 1300600 - DNA, 22 bp, Artificial Sequence
  chemically synthesized
acttaaagtcttttgtaatgac

SEQ ID NO: 1300601 - DNA, 22 bp, Artificial Sequence
  chemically synthesized
gacttaaagtcttttgtaatga

SEQ ID NO: 1300602 - DNA, 22 bp, Artificial Sequence
  chemically synthesized
taaattctagtcattacaaaag

SEQ ID NO: 1300603 - DNA, 22 bp, Artificial Sequence
  chemically synthesized
aaattctagtcattacaaaaga

SEQ ID NO: 1300604 - DNA, 22 bp, Artificial Sequence
  chemically synthesized
aattctagtcattacaaaagac

SEQ ID NO: 1300605 - DNA, 22 bp, Artificial Sequence
  chemically synthesized
ccatttgacttaaagtcttttg

SEQ ID NO: 1300606 - DNA, 22 bp, Artificial Sequence
  chemically synthesized
gccatttgacttaaagtctttt

SEQ ID NO: 1300607 - DNA, 22 bp, Artificial Sequence
  chemically synthesized
tagtcattacaaaagactttaa

SEQ ID NO: 1300608 - DNA, 22 bp, Artificial Sequence
  chemically synthesized
gtcattacaaaagactttaagt

SEQ ID NO: 1300609 - DNA, 22 bp, Artificial Sequence
  chemically synthesized
caaaagactttaagtcaaatgg

SEQ ID NO: 1300610 - DNA, 22 bp, Artificial Sequence
  chemically synthesized
tagaggaaagcaatttgccatt

SEQ ID NO: 1300611 - DNA, 22 bp, Artificial Sequence
  chemically synthesized
gctatagaggaaagcaatttgc

SEQ ID NO: 1300612 - DNA, 22 bp, Artificial Sequence
  chemically synthesized
taagtcaaatggcaaattgctt

SEQ ID NO: 1300613 - DNA, 22 bp, Artificial Sequence
  chemically synthesized
aagtcaaatggcaaattgcttt

SEQ ID NO: 1300614 - DNA, 22 bp, Artificial Sequence
  chemically synthesized
agtcaaatggcaaattgctttc

SEQ ID NO: 1300615 - DNA, 22 bp, Artificial Sequence
  chemically synthesized
aattggctatagaggaaagcaa

SEQ ID NO: 1300616 - DNA, 22 bp, Artificial Sequence
  chemically synthesized
aaattggctatagaggaaagca

SEQ ID NO: 1300617 - DNA, 22 bp, Artificial Sequence
  chemically synthesized
taaattggctatagaggaaagc

SEQ ID NO: 1300618 - DNA, 22 bp, Artificial Sequence
  chemically synthesized
aaacattttaaattggctatag

SEQ ID NO: 1300619 - DNA, 22 bp, Artificial Sequence
  chemically synthesized
ctttcctctatagccaatttaa

SEQ ID NO: 1300620 - DNA, 22 bp, Artificial Sequence
  chemically synthesized
tcctctatagccaatttaaaat

SEQ ID NO: 1300621 - DNA, 22 bp, Artificial Sequence
  chemically synthesized
cctctatagccaatttaaaatg

SEQ ID NO: 1300622 - DNA, 22 bp, Artificial Sequence
  chemically synthesized
ctctatagccaatttaaaatgt

SEQ ID NO: 1300623 - DNA, 22 bp, Artificial Sequence
  chemically synthesized
tatagccaatttaaaatgtttg

SEQ ID NO: 1300624 - DNA, 22 bp, Artificial Sequence
  chemically synthesized
tagccaatttaaaatgtttgaa

SEQ ID NO: 1300625 - DNA, 22 bp, Artificial Sequence
  chemically synthesized
aaaatgtttgaatggttatcta

SEQ ID NO: 1300626 - DNA, 22 bp, Artificial Sequence
  chemically synthesized
aaatgtttgaatggttatctat

SEQ ID NO: 1300627 - DNA, 22 bp, Artificial Sequence
  chemically synthesized
aatacatatgtatatatagata

SEQ ID NO: 1300628 - DNA, 22 bp, Artificial Sequence
  chemically synthesized
gaatggttatctatatatacat

SEQ ID NO: 1300629 - DNA, 22 bp, Artificial Sequence
  chemically synthesized
aatggttatctatatatacata

SEQ ID NO: 1300630 - DNA, 22 bp, Artificial Sequence
  chemically synthesized
tctatatatacatatgtattca

SEQ ID NO: 1300631 - DNA, 22 bp, Artificial Sequence
  chemically synthesized
tatatacatatgtattcaggtt

SEQ ID NO: 1300632 - DNA, 22 bp, Artificial Sequence
  chemically synthesized
aggttgtgttcatatacatatt

SEQ ID NO: 1300633 - DNA, 22 bp, Artificial Sequence
  chemically synthesized
tgtatgtatataacaatatgta

SEQ ID NO: 1300634 - DNA, 22 bp, Artificial Sequence
  chemically synthesized
atgtatgtatataacaatatgt

SEQ ID NO: 1300635 - DNA, 22 bp, Artificial Sequence
  chemically synthesized
tgttcatatacatattgttata

SEQ ID NO: 1300636 - DNA, 22 bp, Artificial Sequence
  chemically synthesized
atatacatattgttatatacat

SEQ ID NO: 1300637 - DNA, 22 bp, Artificial Sequence
  chemically synthesized
tatatgtatgaagcttatgtat

SEQ ID NO: 1300638 - DNA, 22 bp, Artificial Sequence
  chemically synthesized
ttatatacatacataagcttca

SEQ ID NO: 1300639 - DNA, 22 bp, Artificial Sequence
  chemically synthesized
tatacatacataagcttcatac

SEQ ID NO: 1300640 - DNA, 22 bp, Artificial Sequence
  chemically synthesized
tatgttatatatgtatgaagct

SEQ ID NO: 1300641 - DNA, 22 bp, Artificial Sequence
  chemically synthesized
atatgttatatatgtatgaagc

SEQ ID NO: 1300642 - DNA, 22 bp, Artificial Sequence
  chemically synthesized
tatatgttatatatgtatgaag

SEQ ID NO: 1300643 - DNA, 22 bp, Artificial Sequence
  chemically synthesized
catacatatataacatataaag

SEQ ID NO: 1300644 - DNA, 22 bp, Artificial Sequence
  chemically synthesized
atacatatataacatataaagt

SEQ ID NO: 1300645 - DNA, 22 bp, Artificial Sequence
  chemically synthesized
tacacatgcatatatgaacttt

SEQ ID NO: 1300646 - DNA, 22 bp, Artificial Sequence
  chemically synthesized
atatatgcatgtgtataatttt

SEQ ID NO: 1300647 - DNA, 22 bp, Artificial Sequence
  chemically synthesized
atatcagaatataaaattatac

SEQ ID NO: 1300648 - DNA, 22 bp, Artificial Sequence
  chemically synthesized
tattcatatcagaatataaaat

SEQ ID NO: 1300649 - DNA, 22 bp, Artificial Sequence
  chemically synthesized
atattcatatcagaatataaaa

SEQ ID NO: 1300650 - DNA, 22 bp, Artificial Sequence
  chemically synthesized
tatattcatatcagaatataaa

SEQ ID NO: 1300651 - DNA, 22 bp, Artificial Sequence
  chemically synthesized
atgaattttatattcatatcag

SEQ ID NO: 1300652 - DNA, 22 bp, Artificial Sequence
  chemically synthesized
tatattctgatatgaatataaa

SEQ ID NO: 1300653 - DNA, 22 bp, Artificial Sequence
  chemically synthesized
caattcatgaattttatattca

SEQ ID NO: 1300654 - DNA, 22 bp, Artificial Sequence
  chemically synthesized
atattctgatatgaatataaaa

SEQ ID NO: 1300655 - DNA, 22 bp, Artificial Sequence
  chemically synthesized
tattctgatatgaatataaaat

SEQ ID NO: 1300656 - DNA, 22 bp, Artificial Sequence
  chemically synthesized
tgatatgaatataaaattcatg

SEQ ID NO: 1300657 - DNA, 22 bp, Artificial Sequence
  chemically synthesized
atatgaatataaaattcatgaa

SEQ ID NO: 1300658 - DNA, 22 bp, Artificial Sequence
  chemically synthesized
agtgtgctacaattcatgaatt

SEQ ID NO: 1300659 - DNA, 22 bp, Artificial Sequence
  chemically synthesized
cagtgtgctacaattcatgaat

SEQ ID NO: 1300660 - DNA, 22 bp, Artificial Sequence
  chemically synthesized
tcagtgtgctacaattcatgaa

SEQ ID NO: 1300661 - DNA, 22 bp, Artificial Sequence
  chemically synthesized
atgttttcagtgtgctacaatt

SEQ ID NO: 1300662 - DNA, 22 bp, Artificial Sequence
  chemically synthesized
atgaattgtagcacactgaaaa

SEQ ID NO: 1300663 - DNA, 22 bp, Artificial Sequence
  chemically synthesized
atcaaaaactaatgttttcagt

SEQ ID NO: 1300664 - DNA, 22 bp, Artificial Sequence
  chemically synthesized
taatcaaaaactaatgttttca

SEQ ID NO: 1300665 - DNA, 22 bp, Artificial Sequence
  chemically synthesized
tctaatcaaaaactaatgtttt

SEQ ID NO: 1300666 - DNA, 22 bp, Artificial Sequence
  chemically synthesized
tagcacactgaaaacattagtt

SEQ ID NO: 1300667 - DNA, 22 bp, Artificial Sequence
  chemically synthesized
atgttctctaatcaaaaactaa

SEQ ID NO: 1300668 - DNA, 22 bp, Artificial Sequence
  chemically synthesized
aatgttctctaatcaaaaacta

SEQ ID NO: 1300669 - DNA, 22 bp, Artificial Sequence
  chemically synthesized
taatgttctctaatcaaaaact

SEQ ID NO: 1300670 - DNA, 22 bp, Artificial Sequence
  chemically synthesized
aaaacattagtttttgattaga

SEQ ID NO: 1300671 - DNA, 22 bp, Artificial Sequence
  chemically synthesized
caatcattttaatgttctctaa

SEQ ID NO: 1300672 - DNA, 22 bp, Artificial Sequence
  chemically synthesized
acaatcattttaatgttctcta

SEQ ID NO: 1300673 - DNA, 22 bp, Artificial Sequence
  chemically synthesized
tacaatcattttaatgttctct

SEQ ID NO: 1300674 - DNA, 22 bp, Artificial Sequence
  chemically synthesized
gtttttgattagagaacattaa

SEQ ID NO: 1300675 - DNA, 22 bp, Artificial Sequence
  chemically synthesized
ctttacaatcattttaatgttc

SEQ ID NO: 1300676 - DNA, 22 bp, Artificial Sequence
  chemically synthesized
tactttacaatcattttaatgt

SEQ ID NO: 1300677 - DNA, 22 bp, Artificial Sequence
  chemically synthesized
ttgattagagaacattaaaatg

SEQ ID NO: 1300678 - DNA, 22 bp, Artificial Sequence
  chemically synthesized
tgattagagaacattaaaatga

SEQ ID NO: 1300679 - DNA, 22 bp, Artificial Sequence
  chemically synthesized
gattagagaacattaaaatgat

SEQ ID NO: 1300680 - DNA, 22 bp, Artificial Sequence
  chemically synthesized
attagagaacattaaaatgatt

SEQ ID NO: 1300681 - DNA, 22 bp, Artificial Sequence
  chemically synthesized
gagattctactttacaatcatt

SEQ ID NO: 1300682 - DNA, 22 bp, Artificial Sequence
  chemically synthesized
gagaacattaaaatgattgtaa

SEQ ID NO: 1300683 - DNA, 22 bp, Artificial Sequence
  chemically synthesized
tggagattctactttacaatca

SEQ ID NO: 1300684 - DNA, 22 bp, Artificial Sequence
  chemically synthesized
gaaattctggagattctacttt

SEQ ID NO: 1300685 - DNA, 22 bp, Artificial Sequence
  chemically synthesized
ggaaattctggagattctactt

SEQ ID NO: 1300686 - DNA, 22 bp, Artificial Sequence
  chemically synthesized
aaatgattgtaaagtagaatct

SEQ ID NO: 1300687 - DNA, 22 bp, Artificial Sequence
  chemically synthesized
tggaaattctggagattctact

SEQ ID NO: 1300688 - DNA, 22 bp, Artificial Sequence
  chemically synthesized
caaactttggaaattctggaga

SEQ ID NO: 1300689 - DNA, 22 bp, Artificial Sequence
  chemically synthesized
acaaactttggaaattctggag

SEQ ID NO: 1300690 - DNA, 22 bp, Artificial Sequence
  chemically synthesized
taaagtagaatctccagaattt

SEQ ID NO: 1300691 - DNA, 22 bp, Artificial Sequence
  chemically synthesized
aatttacaaactttggaaattc

SEQ ID NO: 1300692 - DNA, 22 bp, Artificial Sequence
  chemically synthesized
caatttacaaactttggaaatt

SEQ ID NO: 1300693 - DNA, 22 bp, Artificial Sequence
  chemically synthesized
cagaatttccaaagtttgtaaa

SEQ ID NO: 1300694 - DNA, 22 bp, Artificial Sequence
  chemically synthesized
gaatgtcttcaatttacaaact

SEQ ID NO: 1300695 - DNA, 22 bp, Artificial Sequence
  chemically synthesized
ccaaagtttgtaaattgaagac

SEQ ID NO: 1300696 - DNA, 22 bp, Artificial Sequence
  chemically synthesized
gaaaattcgaatgtcttcaatt

SEQ ID NO: 1300697 - DNA, 22 bp, Artificial Sequence
  chemically synthesized
caaagtttgtaaattgaagaca

SEQ ID NO: 1300698 - DNA, 22 bp, Artificial Sequence
  chemically synthesized
aattagaaaattcgaatgtctt

SEQ ID NO: 1300699 - DNA, 22 bp, Artificial Sequence
  chemically synthesized
aaattagaaaattcgaatgtct

SEQ ID NO: 1300700 - DNA, 22 bp, Artificial Sequence
  chemically synthesized
taaattagaaaattcgaatgtc

SEQ ID NO: 1300701 - DNA, 22 bp, Artificial Sequence
  chemically synthesized
gtaaattgaagacattcgaatt

SEQ ID NO: 1300702 - DNA, 22 bp, Artificial Sequence
  chemically synthesized
taaattgaagacattcgaattt

SEQ ID NO: 1300703 - DNA, 22 bp, Artificial Sequence
  chemically synthesized
aagacattcgaattttctaatt

SEQ ID NO: 1300704 - DNA, 22 bp, Artificial Sequence
  chemically synthesized
ggaatgatcaaatctttaaatt

SEQ ID NO: 1300705 - DNA, 22 bp, Artificial Sequence
  chemically synthesized
gaattttctaatttaaagattt

SEQ ID NO: 1300706 - DNA, 22 bp, Artificial Sequence
  chemically synthesized
tctaatttaaagatttgatcat

SEQ ID NO: 1300707 - DNA, 22 bp, Artificial Sequence
  chemically synthesized
ctaatttaaagatttgatcatt

SEQ ID NO: 1300708 - DNA, 22 bp, Artificial Sequence
  chemically synthesized
gtaggcgctcggaatgatcaaa

SEQ ID NO: 1300709 - DNA, 22 bp, Artificial Sequence
  chemically synthesized
taatttaaagatttgatcattc

SEQ ID NO: 1300710 - DNA, 22 bp, Artificial Sequence
  chemically synthesized
agtaggcgctcggaatgatcaa

SEQ ID NO: 1300711 - DNA, 22 bp, Artificial Sequence
  chemically synthesized
atttaaagatttgatcattccg

SEQ ID NO: 1300712 - DNA, 22 bp, Artificial Sequence
  chemically synthesized
gtttagtaggcgctcggaatga

SEQ ID NO: 1300713 - DNA, 22 bp, Artificial Sequence
  chemically synthesized
aaagatttgatcattccgagcg

SEQ ID NO: 1300714 - DNA, 22 bp, Artificial Sequence
  chemically synthesized
aagatttgatcattccgagcgc

SEQ ID NO: 1300715 - DNA, 22 bp, Artificial Sequence
  chemically synthesized
taattcgtttagtaggcgctcg

SEQ ID NO: 1300716 - DNA, 22 bp, Artificial Sequence
  chemically synthesized
ataattcgtttagtaggcgctc

SEQ ID NO: 1300717 - DNA, 22 bp, Artificial Sequence
  chemically synthesized
tataattcgtttagtaggcgct

SEQ ID NO: 1300718 - DNA, 22 bp, Artificial Sequence
  chemically synthesized
gatcattccgagcgcctactaa

SEQ ID NO: 1300719 - DNA, 22 bp, Artificial Sequence
  chemically synthesized
atcattccgagcgcctactaaa

SEQ ID NO: 1300720 - DNA, 22 bp, Artificial Sequence
  chemically synthesized
cctttataattcgtttagtagg

SEQ ID NO: 1300721 - DNA, 22 bp, Artificial Sequence
  chemically synthesized
cgagcgcctactaaacgaatta

SEQ ID NO: 1300722 - DNA, 22 bp, Artificial Sequence
  chemically synthesized
aggaaagccattccctttataa

SEQ ID NO: 1300723 - DNA, 22 bp, Artificial Sequence
  chemically synthesized
ctaaacgaattataaagggaat

SEQ ID NO: 1300724 - DNA, 22 bp, Artificial Sequence
  chemically synthesized
aacgaattataaagggaatggc

SEQ ID NO: 1300725 - DNA, 22 bp, Artificial Sequence
  chemically synthesized
taattcaggaaagccattccct

SEQ ID NO: 1300726 - DNA, 22 bp, Artificial Sequence
  chemically synthesized
ctgtaattcaggaaagccattc

SEQ ID NO: 1300727 - DNA, 22 bp, Artificial Sequence
  chemically synthesized
taaagggaatggctttcctgaa

SEQ ID NO: 1300728 - DNA, 22 bp, Artificial Sequence
  chemically synthesized
ccatattactgtaattcaggaa

SEQ ID NO: 1300729 - DNA, 22 bp, Artificial Sequence
  chemically synthesized
aaactaccatattactgtaatt

SEQ ID NO: 1300730 - DNA, 22 bp, Artificial Sequence
  chemically synthesized
tcctgaattacagtaatatggt

SEQ ID NO: 1300731 - DNA, 22 bp, Artificial Sequence
  chemically synthesized
aaagctaaaactaccatattac

SEQ ID NO: 1300732 - DNA, 22 bp, Artificial Sequence
  chemically synthesized
cctgaattacagtaatatggta

SEQ ID NO: 1300733 - DNA, 22 bp, Artificial Sequence
  chemically synthesized
ctgaattacagtaatatggtag

SEQ ID NO: 1300734 - DNA, 22 bp, Artificial Sequence
  chemically synthesized
aattacagtaatatggtagttt

SEQ ID NO: 1300735 - DNA, 22 bp, Artificial Sequence
  chemically synthesized
cagtaatatggtagttttagct

SEQ ID NO: 1300736 - DNA, 22 bp, Artificial Sequence
  chemically synthesized
gaacccagataggcaggttcaa

SEQ ID NO: 1300737 - DNA, 22 bp, Artificial Sequence
  chemically synthesized
cgaacccagataggcaggttca

SEQ ID NO: 1300738 - DNA, 22 bp, Artificial Sequence
  chemically synthesized
tcgaacccagataggcaggttc

SEQ ID NO: 1300739 - DNA, 22 bp, Artificial Sequence
  chemically synthesized
cctttcgaacccagataggcag

SEQ ID NO: 1300740 - DNA, 22 bp, Artificial Sequence
  chemically synthesized
tagctttgaacctgcctatctg

SEQ ID NO: 1300741 - DNA, 22 bp, Artificial Sequence
  chemically synthesized
agctttgaacctgcctatctgg

SEQ ID NO: 1300742 - DNA, 22 bp, Artificial Sequence
  chemically synthesized
gctttgaacctgcctatctggg

SEQ ID NO: 1300743 - DNA, 22 bp, Artificial Sequence
  chemically synthesized
tgaacctgcctatctgggttcg

SEQ ID NO: 1300744 - DNA, 22 bp, Artificial Sequence
  chemically synthesized
gaacctgcctatctgggttcga

SEQ ID NO: 1300745 - DNA, 22 bp, Artificial Sequence
  chemically synthesized
aacctgcctatctgggttcgaa

SEQ ID NO: 1300746 - DNA, 22 bp, Artificial Sequence
  chemically synthesized
cctatctgggttcgaaaggtag

SEQ ID NO: 1300747 - DNA, 22 bp, Artificial Sequence
  chemically synthesized
ataagtagcagaactacctttc

SEQ ID NO: 1300748 - DNA, 22 bp, Artificial Sequence
  chemically synthesized
tctgggttcgaaaggtagttct

SEQ ID NO: 1300749 - DNA, 22 bp, Artificial Sequence
  chemically synthesized
ttaataagtagcagaactacct

SEQ ID NO: 1300750 - DNA, 22 bp, Artificial Sequence
  chemically synthesized
ggttcgaaaggtagttctgcta

SEQ ID NO: 1300751 - DNA, 22 bp, Artificial Sequence
  chemically synthesized
gaaaggtagttctgctacttat

SEQ ID NO: 1300752 - DNA, 22 bp, Artificial Sequence
  chemically synthesized
tgctacttattaacagtgtgcc

SEQ ID NO: 1300753 - DNA, 22 bp, Artificial Sequence
  chemically synthesized
ctacttattaacagtgtgcctc

SEQ ID NO: 1300754 - DNA, 22 bp, Artificial Sequence
  chemically synthesized
caggtgaggaaacagaggcaca

SEQ ID NO: 1300755 - DNA, 22 bp, Artificial Sequence
  chemically synthesized
cttattaacagtgtgcctctgt

SEQ ID NO: 1300756 - DNA, 22 bp, Artificial Sequence
  chemically synthesized
tacaggtgaggaaacagaggca

SEQ ID NO: 1300757 - DNA, 22 bp, Artificial Sequence
  chemically synthesized
attaacagtgtgcctctgtttc

SEQ ID NO: 1300758 - DNA, 22 bp, Artificial Sequence
  chemically synthesized
ttaacagtgtgcctctgtttcc

SEQ ID NO: 1300759 - DNA, 22 bp, Artificial Sequence
  chemically synthesized
ttctacaggtgaggaaacagag

SEQ ID NO: 1300760 - DNA, 22 bp, Artificial Sequence
  chemically synthesized
acagtgtgcctctgtttcctca

SEQ ID NO: 1300761 - DNA, 22 bp, Artificial Sequence
  chemically synthesized
tcattattctacaggtgaggaa

SEQ ID NO: 1300762 - DNA, 22 bp, Artificial Sequence
  chemically synthesized
ttatcattattctacaggtgag

SEQ ID NO: 1300763 - DNA, 22 bp, Artificial Sequence
  chemically synthesized
tgtttcctcacctgtagaataa

SEQ ID NO: 1300764 - DNA, 22 bp, Artificial Sequence
  chemically synthesized
tttcctcacctgtagaataatg

SEQ ID NO: 1300765 - DNA, 22 bp, Artificial Sequence
  chemically synthesized
cctcacctgtagaataatgata

SEQ ID NO: 1300766 - DNA, 22 bp, Artificial Sequence
  chemically synthesized
caccgatattattatcattatt

SEQ ID NO: 1300767 - DNA, 22 bp, Artificial Sequence
  chemically synthesized
ctcacctgtagaataatgataa

SEQ ID NO: 1300768 - DNA, 22 bp, Artificial Sequence
  chemically synthesized
acctgtagaataatgataataa

SEQ ID NO: 1300769 - DNA, 22 bp, Artificial Sequence
  chemically synthesized
tagaataatgataataatatcg

SEQ ID NO: 1300770 - DNA, 22 bp, Artificial Sequence
  chemically synthesized
atgacaaagctacaccgatatt

SEQ ID NO: 1300771 - DNA, 22 bp, Artificial Sequence
  chemically synthesized
atccaaagctcatgacaaagct

SEQ ID NO: 1300772 - DNA, 22 bp, Artificial Sequence
  chemically synthesized
aagtgggaacattcatccaaag

SEQ ID NO: 1300773 - DNA, 22 bp, Artificial Sequence
  chemically synthesized
tgtcatgagctttggatgaatg

SEQ ID NO: 1300774 - DNA, 22 bp, Artificial Sequence
  chemically synthesized
gtcatgagctttggatgaatgt

SEQ ID NO: 1300775 - DNA, 22 bp, Artificial Sequence
  chemically synthesized
tcatgagctttggatgaatgtt

SEQ ID NO: 1300776 - DNA, 22 bp, Artificial Sequence
  chemically synthesized
gagccagggttcaagtgggaac

SEQ ID NO: 1300777 - DNA, 22 bp, Artificial Sequence
  chemically synthesized
tggatgaatgttcccacttgaa

SEQ ID NO: 1300778 - DNA, 22 bp, Artificial Sequence
  chemically synthesized
ggatgaatgttcccacttgaac

SEQ ID NO: 1300779 - DNA, 22 bp, Artificial Sequence
  chemically synthesized
gatgaatgttcccacttgaacc

SEQ ID NO: 1300780 - DNA, 22 bp, Artificial Sequence
  chemically synthesized
gtgttagagccagggttcaagt

SEQ ID NO: 1300781 - DNA, 22 bp, Artificial Sequence
  chemically synthesized
ccacttgaaccctggctctaac

SEQ ID NO: 1300782 - DNA, 22 bp, Artificial Sequence
  chemically synthesized
gaaccctggctctaacactaac

SEQ ID NO: 1300783 - DNA, 22 bp, Artificial Sequence
  chemically synthesized
aaccctggctctaacactaact

SEQ ID NO: 1300784 - DNA, 22 bp, Artificial Sequence
  chemically synthesized
acagaagcccatagagcaagtt

SEQ ID NO: 1300785 - DNA, 22 bp, Artificial Sequence
  chemically synthesized
gctctaacactaacttgctcta

SEQ ID NO: 1300786 - DNA, 22 bp, Artificial Sequence
  chemically synthesized
taacactaacttgctctatggg

SEQ ID NO: 1300787 - DNA, 22 bp, Artificial Sequence
  chemically synthesized
acactaacttgctctatgggct

SEQ ID NO: 1300788 - DNA, 22 bp, Artificial Sequence
  chemically synthesized
aatgattaacagaagcccatag

SEQ ID NO: 1300789 - DNA, 22 bp, Artificial Sequence
  chemically synthesized
acttgctctatgggcttctgtt

SEQ ID NO: 1300790 - DNA, 22 bp, Artificial Sequence
  chemically synthesized
gctctatgggcttctgttaatc

SEQ ID NO: 1300791 - DNA, 22 bp, Artificial Sequence
  chemically synthesized
ctctatgggcttctgttaatca

SEQ ID NO: 1300792 - DNA, 22 bp, Artificial Sequence
  chemically synthesized
cacataattaaatgattaacag

SEQ ID NO: 1300793 - DNA, 22 bp, Artificial Sequence
  chemically synthesized
tatgggcttctgttaatcattt

SEQ ID NO: 1300794 - DNA, 22 bp, Artificial Sequence
  chemically synthesized
tgggcttctgttaatcatttaa

SEQ ID NO: 1300795 - DNA, 22 bp, Artificial Sequence
  chemically synthesized
tattccacataattaaatgatt

SEQ ID NO: 1300796 - DNA, 22 bp, Artificial Sequence
  chemically synthesized
ctgttaatcatttaattatgtg

SEQ ID NO: 1300797 - DNA, 22 bp, Artificial Sequence
  chemically synthesized
tgttaatcatttaattatgtgg

SEQ ID NO: 1300798 - DNA, 22 bp, Artificial Sequence
  chemically synthesized
aggaaattgtattccacataat

SEQ ID NO: 1300799 - DNA, 22 bp, Artificial Sequence
  chemically synthesized
ttaatcatttaattatgtggaa

SEQ ID NO: 1300800 - DNA, 22 bp, Artificial Sequence
  chemically synthesized
atcatttaattatgtggaatac

SEQ ID NO: 1300801 - DNA, 22 bp, Artificial Sequence
  chemically synthesized
aagttgaggaaattgtattcca

SEQ ID NO: 1300802 - DNA, 22 bp, Artificial Sequence
  chemically synthesized
aaagttgaggaaattgtattcc

SEQ ID NO: 1300803 - DNA, 22 bp, Artificial Sequence
  chemically synthesized
taaagttgaggaaattgtattc

SEQ ID NO: 1300804 - DNA, 22 bp, Artificial Sequence
  chemically synthesized
aattatgtggaatacaatttcc

SEQ ID NO: 1300805 - DNA, 22 bp, Artificial Sequence
  chemically synthesized
attatgtggaatacaatttcct

SEQ ID NO: 1300806 - DNA, 22 bp, Artificial Sequence
  chemically synthesized
tgttttaaagttgaggaaattg

SEQ ID NO: 1300807 - DNA, 22 bp, Artificial Sequence
  chemically synthesized
tatgttttaaagttgaggaaat

SEQ ID NO: 1300808 - DNA, 22 bp, Artificial Sequence
  chemically synthesized
tgtggaatacaatttcctcaac

SEQ ID NO: 1300809 - DNA, 22 bp, Artificial Sequence
  chemically synthesized
caaattctatgttttaaagttg

SEQ ID NO: 1300810 - DNA, 22 bp, Artificial Sequence
  chemically synthesized
ccaaattctatgttttaaagtt

SEQ ID NO: 1300811 - DNA, 22 bp, Artificial Sequence
  chemically synthesized
tccaaattctatgttttaaagt

SEQ ID NO: 1300812 - DNA, 22 bp, Artificial Sequence
  chemically synthesized
ttccaaattctatgttttaaag

SEQ ID NO: 1300813 - DNA, 22 bp, Artificial Sequence
  chemically synthesized
tcttttccaaattctatgtttt

SEQ ID NO: 1300814 - DNA, 22 bp, Artificial Sequence
  chemically synthesized
cctcaactttaaaacatagaat

SEQ ID NO: 1300815 - DNA, 22 bp, Artificial Sequence
  chemically synthesized
ctcaactttaaaacatagaatt

SEQ ID NO: 1300816 - DNA, 22 bp, Artificial Sequence
  chemically synthesized
aactttaaaacatagaatttgg

SEQ ID NO: 1300817 - DNA, 22 bp, Artificial Sequence
  chemically synthesized
taaaacatagaatttggaaaag

SEQ ID NO: 1300818 - DNA, 22 bp, Artificial Sequence
  chemically synthesized
aaaacatagaatttggaaaaga

SEQ ID NO: 1300819 - DNA, 22 bp, Artificial Sequence
  chemically synthesized
aaacatagaatttggaaaagat

SEQ ID NO: 1300820 - DNA, 22 bp, Artificial Sequence
  chemically synthesized
gcggaacacatagaaattatct

SEQ ID NO: 1300821 - DNA, 22 bp, Artificial Sequence
  chemically synthesized
gaactggcggaacacatagaaa

SEQ ID NO: 1300822 - DNA, 22 bp, Artificial Sequence
  chemically synthesized
ggaaaagataatttctatgtgt

SEQ ID NO: 1300823 - DNA, 22 bp, Artificial Sequence
  chemically synthesized
agaactggcggaacacatagaa

SEQ ID NO: 1300824 - DNA, 22 bp, Artificial Sequence
  chemically synthesized
gaaaagataatttctatgtgtt

SEQ ID NO: 1300825 - DNA, 22 bp, Artificial Sequence
  chemically synthesized
tagaactggcggaacacataga

SEQ ID NO: 1300826 - DNA, 22 bp, Artificial Sequence
  chemically synthesized
ctatgtgttccgccagttctaa

SEQ ID NO: 1300827 - DNA, 22 bp, Artificial Sequence
  chemically synthesized
tatgtgttccgccagttctaaa

SEQ ID NO: 1300828 - DNA, 22 bp, Artificial Sequence
  chemically synthesized
tgtgttccgccagttctaaaac

SEQ ID NO: 1300829 - DNA, 22 bp, Artificial Sequence
  chemically synthesized
cgccagttctaaaactctatca

SEQ ID NO: 1300830 - DNA, 22 bp, Artificial Sequence
  chemically synthesized
gaataaagaagcagatgataga

SEQ ID NO: 1300831 - DNA, 22 bp, Artificial Sequence
  chemically synthesized
taaaactctatcatctgcttct

SEQ ID NO: 1300832 - DNA, 22 bp, Artificial Sequence
  chemically synthesized
aaactctatcatctgcttcttt

SEQ ID NO: 1300833 - DNA, 22 bp, Artificial Sequence
  chemically synthesized
tatcatctgcttctttattcta

SEQ ID NO: 1300834 - DNA, 22 bp, Artificial Sequence
  chemically synthesized
tcatctgcttctttattctagg

SEQ ID NO: 1300835 - DNA, 22 bp, Artificial Sequence
  chemically synthesized
cttctttattctaggtttttgt

SEQ ID NO: 1300836 - DNA, 22 bp, Artificial Sequence
  chemically synthesized
ctttattctaggtttttgtttg

SEQ ID NO: 1300837 - DNA, 22 bp, Artificial Sequence
  chemically synthesized
tttattctaggtttttgtttgt

SEQ ID NO: 1300838 - DNA, 22 bp, Artificial Sequence
  chemically synthesized
cagaaacaaataaacaaacaaa

SEQ ID NO: 1300839 - DNA, 22 bp, Artificial Sequence
  chemically synthesized
tattctaggtttttgtttgttt

SEQ ID NO: 1300840 - DNA, 22 bp, Artificial Sequence
  chemically synthesized
attctaggtttttgtttgttta

SEQ ID NO: 1300841 - DNA, 22 bp, Artificial Sequence
  chemically synthesized
ttctaggtttttgtttgtttat

SEQ ID NO: 1300842 - DNA, 22 bp, Artificial Sequence
  chemically synthesized
taggtttttgtttgtttatttg

SEQ ID NO: 1300843 - DNA, 22 bp, Artificial Sequence
  chemically synthesized
catcctgcagaaacaaataaac

SEQ ID NO: 1300844 - DNA, 22 bp, Artificial Sequence
  chemically synthesized
ggtttttgtttgtttatttgtt

SEQ ID NO: 1300845 - DNA, 22 bp, Artificial Sequence
  chemically synthesized
ttgtttgtttatttgtttctgc

SEQ ID NO: 1300846 - DNA, 22 bp, Artificial Sequence
  chemically synthesized
tgtttgtttatttgtttctgca

SEQ ID NO: 1300847 - DNA, 22 bp, Artificial Sequence
  chemically synthesized
taaactgcatcctgcagaaaca

SEQ ID NO: 1300848 - DNA, 22 bp, Artificial Sequence
  chemically synthesized
gtttgtttatttgtttctgcag

SEQ ID NO: 1300849 - DNA, 22 bp, Artificial Sequence
  chemically synthesized
tttgtttatttgtttctgcagg

SEQ ID NO: 1300850 - DNA, 22 bp, Artificial Sequence
  chemically synthesized
gtttatttgtttctgcaggatg

SEQ ID NO: 1300851 - DNA, 22 bp, Artificial Sequence
  chemically synthesized
tttatttgtttctgcaggatgc

SEQ ID NO: 1300852 - DNA, 22 bp, Artificial Sequence
  chemically synthesized
atttgtttctgcaggatgcagt

SEQ ID NO: 1300853 - DNA, 22 bp, Artificial Sequence
  chemically synthesized
tttgtttctgcaggatgcagtt

SEQ ID NO: 1300854 - DNA, 22 bp, Artificial Sequence
  chemically synthesized
caacaaggactgtaaactgcat

SEQ ID NO: 1300855 - DNA, 22 bp, Artificial Sequence
  chemically synthesized
gtttctgcaggatgcagtttac

SEQ ID NO: 1300856 - DNA, 22 bp, Artificial Sequence
  chemically synthesized
tttctgcaggatgcagtttaca

SEQ ID NO: 1300857 - DNA, 22 bp, Artificial Sequence
  chemically synthesized
ctgcaggatgcagtttacagtc

SEQ ID NO: 1300858 - DNA, 22 bp, Artificial Sequence
  chemically synthesized
tgcaggatgcagtttacagtcc

SEQ ID NO: 1300859 - DNA, 22 bp, Artificial Sequence
  chemically synthesized
caggatgcagtttacagtcctt

SEQ ID NO: 1300860 - DNA, 22 bp, Artificial Sequence
  chemically synthesized
cagagcatactccaacaaggac

SEQ ID NO: 1300861 - DNA, 22 bp, Artificial Sequence
  chemically synthesized
acagtccttgttggagtatgct

SEQ ID NO: 1300862 - DNA, 22 bp, Artificial Sequence
  chemically synthesized
cagtccttgttggagtatgctc

SEQ ID NO: 1300863 - DNA, 22 bp, Artificial Sequence
  chemically synthesized
gttggagtatgctctggaatca

SEQ ID NO: 1300864 - DNA, 22 bp, Artificial Sequence
  chemically synthesized
ttggagtatgctctggaatcat

SEQ ID NO: 1300865 - DNA, 22 bp, Artificial Sequence
  chemically synthesized
aatccaggccgtatgattccag

SEQ ID NO: 1300866 - DNA, 22 bp, Artificial Sequence
  chemically synthesized
aaatccaggccgtatgattcca

SEQ ID NO: 1300867 - DNA, 22 bp, Artificial Sequence
  chemically synthesized
taaatccaggccgtatgattcc

SEQ ID NO: 1300868 - DNA, 22 bp, Artificial Sequence
  chemically synthesized
gagtatgctctggaatcatacg

SEQ ID NO: 1300869 - DNA, 22 bp, Artificial Sequence
  chemically synthesized
gactttaaatccaggccgtatg

SEQ ID NO: 1300870 - DNA, 22 bp, Artificial Sequence
  chemically synthesized
tggaatcatacggcctggattt

SEQ ID NO: 1300871 - DNA, 22 bp, Artificial Sequence
  chemically synthesized
gaatcatacggcctggatttaa

SEQ ID NO: 1300872 - DNA, 22 bp, Artificial Sequence
  chemically synthesized
agccagtaagcggcaaaactgg

SEQ ID NO: 1300873 - DNA, 22 bp, Artificial Sequence
  chemically synthesized
gatttaaagtccagttttgccg

SEQ ID NO: 1300874 - DNA, 22 bp, Artificial Sequence
  chemically synthesized
aaagtccagttttgccgcttac

SEQ ID NO: 1300875 - DNA, 22 bp, Artificial Sequence
  chemically synthesized
aagtccagttttgccgcttact

SEQ ID NO: 1300876 - DNA, 22 bp, Artificial Sequence
  chemically synthesized
agaaaactcagccagtaagcgg

SEQ ID NO: 1300877 - DNA, 22 bp, Artificial Sequence
  chemically synthesized
tgccgcttactggctgagtttt

SEQ ID NO: 1300878 - DNA, 22 bp, Artificial Sequence
  chemically synthesized
gccgcttactggctgagttttc

SEQ ID NO: 1300879 - DNA, 22 bp, Artificial Sequence
  chemically synthesized
ccgcttactggctgagttttct

SEQ ID NO: 1300880 - DNA, 22 bp, Artificial Sequence
  chemically synthesized
tgtaaataaattgagaaaactc

SEQ ID NO: 1300881 - DNA, 22 bp, Artificial Sequence
  chemically synthesized
actggctgagttttctcaattt

SEQ ID NO: 1300882 - DNA, 22 bp, Artificial Sequence
  chemically synthesized
ctggctgagttttctcaattta

SEQ ID NO: 1300883 - DNA, 22 bp, Artificial Sequence
  chemically synthesized
gctgagttttctcaatttattt

SEQ ID NO: 1300884 - DNA, 22 bp, Artificial Sequence
  chemically synthesized
agttttctcaatttatttacat

SEQ ID NO: 1300885 - DNA, 22 bp, Artificial Sequence
  chemically synthesized
aaggaaagaaaagttatgtaaa

SEQ ID NO: 1300886 - DNA, 22 bp, Artificial Sequence
  chemically synthesized
tctcaatttatttacataactt

SEQ ID NO: 1300887 - DNA, 22 bp, Artificial Sequence
  chemically synthesized
ctcaatttatttacataacttt

SEQ ID NO: 1300888 - DNA, 22 bp, Artificial Sequence
  chemically synthesized
tcaatttatttacataactttt

SEQ ID NO: 1300889 - DNA, 22 bp, Artificial Sequence
  chemically synthesized
aatttatttacataacttttct

SEQ ID NO: 1300890 - DNA, 22 bp, Artificial Sequence
  chemically synthesized
atttacataacttttctttcct

SEQ ID NO: 1300891 - DNA, 22 bp, Artificial Sequence
  chemically synthesized
tttacataacttttctttcctt

SEQ ID NO: 1300892 - DNA, 22 bp, Artificial Sequence
  chemically synthesized
acataacttttctttcctttag

SEQ ID NO: 1300893 - DNA, 22 bp, Artificial Sequence
  chemically synthesized
cagatgagaaaactaaaggaaa

SEQ ID NO: 1300894 - DNA, 22 bp, Artificial Sequence
  chemically synthesized
cataacttttctttcctttagt

SEQ ID NO: 1300895 - DNA, 22 bp, Artificial Sequence
  chemically synthesized
acagatgagaaaactaaaggaa

SEQ ID NO: 1300896 - DNA, 22 bp, Artificial Sequence
  chemically synthesized
tacagatgagaaaactaaagga

SEQ ID NO: 1300897 - DNA, 22 bp, Artificial Sequence
  chemically synthesized
ttttacagatgagaaaactaaa

SEQ ID NO: 1300898 - DNA, 22 bp, Artificial Sequence
  chemically synthesized
ttctttcctttagttttctcat

SEQ ID NO: 1300899 - DNA, 22 bp, Artificial Sequence
  chemically synthesized
tctttcctttagttttctcatc

SEQ ID NO: 1300900 - DNA, 22 bp, Artificial Sequence
  chemically synthesized
ctttcctttagttttctcatct

SEQ ID NO: 1300901 - DNA, 22 bp, Artificial Sequence
  chemically synthesized
tttcctttagttttctcatctg

SEQ ID NO: 1300902 - DNA, 22 bp, Artificial Sequence
  chemically synthesized
gtacctattttacagatgagaa

SEQ ID NO: 1300903 - DNA, 22 bp, Artificial Sequence
  chemically synthesized
agtacctattttacagatgaga

SEQ ID NO: 1300904 - DNA, 22 bp, Artificial Sequence
  chemically synthesized
tcctttagttttctcatctgta

SEQ ID NO: 1300905 - DNA, 22 bp, Artificial Sequence
  chemically synthesized
tagtacctattttacagatgag

SEQ ID NO: 1300906 - DNA, 22 bp, Artificial Sequence
  chemically synthesized
cctttagttttctcatctgtaa

SEQ ID NO: 1300907 - DNA, 22 bp, Artificial Sequence
  chemically synthesized
ctttagttttctcatctgtaaa

SEQ ID NO: 1300908 - DNA, 22 bp, Artificial Sequence
  chemically synthesized
ttttagtacctattttacagat

SEQ ID NO: 1300909 - DNA, 22 bp, Artificial Sequence
  chemically synthesized
tagttttctcatctgtaaaata

SEQ ID NO: 1300910 - DNA, 22 bp, Artificial Sequence
  chemically synthesized
agttttctcatctgtaaaatag

SEQ ID NO: 1300911 - DNA, 22 bp, Artificial Sequence
  chemically synthesized
ttattttagtacctattttaca

SEQ ID NO: 1300912 - DNA, 22 bp, Artificial Sequence
  chemically synthesized
gttttctcatctgtaaaatagg

SEQ ID NO: 1300913 - DNA, 22 bp, Artificial Sequence
  chemically synthesized
tctcatctgtaaaataggtact

SEQ ID NO: 1300914 - DNA, 22 bp, Artificial Sequence
  chemically synthesized
ctcatctgtaaaataggtacta

SEQ ID NO: 1300915 - DNA, 22 bp, Artificial Sequence
  chemically synthesized
tcatctgtaaaataggtactaa

SEQ ID NO: 1300916 - DNA, 22 bp, Artificial Sequence
  chemically synthesized
atctgtaaaataggtactaaaa

SEQ ID NO: 1300917 - DNA, 22 bp, Artificial Sequence
  chemically synthesized
tgagatagttattattttagta

SEQ ID NO: 1300918 - DNA, 22 bp, Artificial Sequence
  chemically synthesized
taaaataggtactaaaataata

SEQ ID NO: 1300919 - DNA, 22 bp, Artificial Sequence
  chemically synthesized
acaacgacactatgagatagtt

SEQ ID NO: 1300920 - DNA, 22 bp, Artificial Sequence
  chemically synthesized
aaataataactatctcatagtg

SEQ ID NO: 1300921 - DNA, 22 bp, Artificial Sequence
  chemically synthesized
gtcctcacaacgacactatgag

SEQ ID NO: 1300922 - DNA, 22 bp, Artificial Sequence
  chemically synthesized
agtcctcacaacgacactatga

SEQ ID NO: 1300923 - DNA, 22 bp, Artificial Sequence
  chemically synthesized
tttagtcctcacaacgacacta

SEQ ID NO: 1300924 - DNA, 22 bp, Artificial Sequence
  chemically synthesized
atttagtcctcacaacgacact

SEQ ID NO: 1300925 - DNA, 22 bp, Artificial Sequence
  chemically synthesized
tctcatagtgtcgttgtgagga

SEQ ID NO: 1300926 - DNA, 22 bp, Artificial Sequence
  chemically synthesized
atagtgtcgttgtgaggactaa

SEQ ID NO: 1300927 - DNA, 22 bp, Artificial Sequence
  chemically synthesized
tgaggactaaataagccattat

SEQ ID NO: 1300928 - DNA, 22 bp, Artificial Sequence
  chemically synthesized
tgccatataaagataatggctt

SEQ ID NO: 1300929 - DNA, 22 bp, Artificial Sequence
  chemically synthesized
tatgccatataaagataatggc

SEQ ID NO: 1300930 - DNA, 22 bp, Artificial Sequence
  chemically synthesized
ctatgccatataaagataatgg

SEQ ID NO: 1300931 - DNA, 22 bp, Artificial Sequence
  chemically synthesized
tctatgccatataaagataatg

SEQ ID NO: 1300932 - DNA, 22 bp, Artificial Sequence
  chemically synthesized
aataagccattatctttatatg

SEQ ID NO: 1300933 - DNA, 22 bp, Artificial Sequence
  chemically synthesized
gggccagacactttctatgcca

SEQ ID NO: 1300934 - DNA, 22 bp, Artificial Sequence
  chemically synthesized
ggggccagacactttctatgcc

SEQ ID NO: 1300935 - DNA, 22 bp, Artificial Sequence
  chemically synthesized
tctttatatggcatagaaagtg

SEQ ID NO: 1300936 - DNA, 22 bp, Artificial Sequence
  chemically synthesized
atttggggccagacactttcta

SEQ ID NO: 1300937 - DNA, 22 bp, Artificial Sequence
  chemically synthesized
tatatggcatagaaagtgtctg

SEQ ID NO: 1300938 - DNA, 22 bp, Artificial Sequence
  chemically synthesized
ctcatttggggccagacacttt

SEQ ID NO: 1300939 - DNA, 22 bp, Artificial Sequence
  chemically synthesized
atatggcatagaaagtgtctgg

SEQ ID NO: 1300940 - DNA, 22 bp, Artificial Sequence
  chemically synthesized
tatggcatagaaagtgtctggc

SEQ ID NO: 1300941 - DNA, 22 bp, Artificial Sequence
  chemically synthesized
attactcatttggggccagaca

SEQ ID NO: 1300942 - DNA, 22 bp, Artificial Sequence
  chemically synthesized
gccccaaatgagtaatcaacat

SEQ ID NO: 1300943 - DNA, 22 bp, Artificial Sequence
  chemically synthesized
aggataggaataacaatgttga

SEQ ID NO: 1300944 - DNA, 22 bp, Artificial Sequence
  chemically synthesized
caggataggaataacaatgttg

SEQ ID NO: 1300945 - DNA, 22 bp, Artificial Sequence
  chemically synthesized
aaagcccatagatttcaggata

SEQ ID NO: 1300946 - DNA, 22 bp, Artificial Sequence
  chemically synthesized
ttattcctatcctgaaatctat

SEQ ID NO: 1300947 - DNA, 22 bp, Artificial Sequence
  chemically synthesized
ttcctatcctgaaatctatggg

SEQ ID NO: 1300948 - DNA, 22 bp, Artificial Sequence
  chemically synthesized
ctatcctgaaatctatgggctt

SEQ ID NO: 1300949 - DNA, 22 bp, Artificial Sequence
  chemically synthesized
catagtcgtattgaaagcccat

SEQ ID NO: 1300950 - DNA, 22 bp, Artificial Sequence
  chemically synthesized
tcctgaaatctatgggctttca

SEQ ID NO: 1300951 - DNA, 22 bp, Artificial Sequence
  chemically synthesized
ttccatagtcgtattgaaagcc

SEQ ID NO: 1300952 - DNA, 22 bp, Artificial Sequence
  chemically synthesized
attccatagtcgtattgaaagc

SEQ ID NO: 1300953 - DNA, 22 bp, Artificial Sequence
  chemically synthesized
aaatctatgggctttcaatacg

SEQ ID NO: 1300954 - DNA, 22 bp, Artificial Sequence
  chemically synthesized
ggggtttattccatagtcgtat

SEQ ID NO: 1300955 - DNA, 22 bp, Artificial Sequence
  chemically synthesized
aggggtttattccatagtcgta

SEQ ID NO: 1300956 - DNA, 22 bp, Artificial Sequence
  chemically synthesized
tgggctttcaatacgactatgg

SEQ ID NO: 1300957 - DNA, 22 bp, Artificial Sequence
  chemically synthesized
taggggtttattccatagtcgt

SEQ ID NO: 1300958 - DNA, 22 bp, Artificial Sequence
  chemically synthesized
tcaatacgactatggaataaac

SEQ ID NO: 1300959 - DNA, 22 bp, Artificial Sequence
  chemically synthesized
caatacgactatggaataaacc

SEQ ID NO: 1300960 - DNA, 22 bp, Artificial Sequence
  chemically synthesized
aatacgactatggaataaaccc

SEQ ID NO: 1300961 - DNA, 22 bp, Artificial Sequence
  chemically synthesized
cccacaattttaggggtttatt

SEQ ID NO: 1300962 - DNA, 22 bp, Artificial Sequence
  chemically synthesized
gcccacaattttaggggtttat

SEQ ID NO: 1300963 - DNA, 22 bp, Artificial Sequence
  chemically synthesized
tgcccacaattttaggggttta

SEQ ID NO: 1300964 - DNA, 22 bp, Artificial Sequence
  chemically synthesized
tggaataaacccctaaaattgt

SEQ ID NO: 1300965 - DNA, 22 bp, Artificial Sequence
  chemically synthesized
ataaaattttgcccacaatttt

SEQ ID NO: 1300966 - DNA, 22 bp, Artificial Sequence
  chemically synthesized
aaattgtgggcaaaattttatg

SEQ ID NO: 1300967 - DNA, 22 bp, Artificial Sequence
  chemically synthesized
atatatacacactcataaaatt

SEQ ID NO: 1300968 - DNA, 22 bp, Artificial Sequence
  chemically synthesized
tcatatatacacactcataaaa

SEQ ID NO: 1300969 - DNA, 22 bp, Artificial Sequence
  chemically synthesized
tgggcaaaattttatgagtgtg

SEQ ID NO: 1300970 - DNA, 22 bp, Artificial Sequence
  chemically synthesized
tggactctcatatatacacact

SEQ ID NO: 1300971 - DNA, 22 bp, Artificial Sequence
  chemically synthesized
atgactgtggactctcatatat

SEQ ID NO: 1300972 - DNA, 22 bp, Artificial Sequence
  chemically synthesized
tatgagtgtgtatatatgagag

SEQ ID NO: 1300973 - DNA, 22 bp, Artificial Sequence
  chemically synthesized
atgagtgtgtatatatgagagt

SEQ ID NO: 1300974 - DNA, 22 bp, Artificial Sequence
  chemically synthesized
tgagtgtgtatatatgagagtc

SEQ ID NO: 1300975 - DNA, 22 bp, Artificial Sequence
  chemically synthesized
ctgatgactgtggactctcata

SEQ ID NO: 1300976 - DNA, 22 bp, Artificial Sequence
  chemically synthesized
gaatctgctgatgactgtggac

SEQ ID NO: 1300977 - DNA, 22 bp, Artificial Sequence
  chemically synthesized
agaatctgctgatgactgtgga

SEQ ID NO: 1300978 - DNA, 22 bp, Artificial Sequence
  chemically synthesized
tagaatctgctgatgactgtgg

SEQ ID NO: 1300979 - DNA, 22 bp, Artificial Sequence
  chemically synthesized
ttagaatctgctgatgactgtg

SEQ ID NO: 1300980 - DNA, 22 bp, Artificial Sequence
  chemically synthesized
aaaccatggagcccttttagaa

SEQ ID NO: 1300981 - DNA, 22 bp, Artificial Sequence
  chemically synthesized
caaaccatggagcccttttaga

SEQ ID NO: 1300982 - DNA, 22 bp, Artificial Sequence
  chemically synthesized
tcaaaccatggagcccttttag

SEQ ID NO: 1300983 - DNA, 22 bp, Artificial Sequence
  chemically synthesized
ttcaaaccatggagccctttta

SEQ ID NO: 1300984 - DNA, 22 bp, Artificial Sequence
  chemically synthesized
atccaacatttttcaaaccatg

SEQ ID NO: 1300985 - DNA, 22 bp, Artificial Sequence
  chemically synthesized
taaaagggctccatggtttgaa

SEQ ID NO: 1300986 - DNA, 22 bp, Artificial Sequence
  chemically synthesized
catccaacatttttcaaaccat

SEQ ID NO: 1300987 - DNA, 22 bp, Artificial Sequence
  chemically synthesized
tcatccaacatttttcaaacca

SEQ ID NO: 1300988 - DNA, 22 bp, Artificial Sequence
  chemically synthesized
aaagggctccatggtttgaaaa

SEQ ID NO: 1300989 - DNA, 22 bp, Artificial Sequence
  chemically synthesized
ttcatccaacatttttcaaacc

SEQ ID NO: 1300990 - DNA, 22 bp, Artificial Sequence
  chemically synthesized
tatttttcatccaacatttttc

SEQ ID NO: 1300991 - DNA, 22 bp, Artificial Sequence
  chemically synthesized
catggtttgaaaaatgttggat

SEQ ID NO: 1300992 - DNA, 22 bp, Artificial Sequence
  chemically synthesized
gaaaaatgttggatgaaaaata

SEQ ID NO: 1300993 - DNA, 22 bp, Artificial Sequence
  chemically synthesized
aaaaatgttggatgaaaaatat

SEQ ID NO: 1300994 - DNA, 22 bp, Artificial Sequence
  chemically synthesized
gatgaaaaatatagacattatt

SEQ ID NO: 1300995 - DNA, 22 bp, Artificial Sequence
  chemically synthesized
atatccataagagccagaataa

SEQ ID NO: 1300996 - DNA, 22 bp, Artificial Sequence
  chemically synthesized
ttctggctcttatggatattaa

SEQ ID NO: 1300997 - DNA, 22 bp, Artificial Sequence
  chemically synthesized
tggctcttatggatattaatga

SEQ ID NO: 1300998 - DNA, 22 bp, Artificial Sequence
  chemically synthesized
gctcttatggatattaatgatc

SEQ ID NO: 1300999 - DNA, 22 bp, Artificial Sequence
  chemically synthesized
ttatggatattaatgatctctg

SEQ ID NO: 1301000 - DNA, 22 bp, Artificial Sequence
  chemically synthesized
atggatattaatgatctctgtt

SEQ ID NO: 1301001 - DNA, 22 bp, Artificial Sequence
  chemically synthesized
tggatattaatgatctctgttt

SEQ ID NO: 1301002 - DNA, 22 bp, Artificial Sequence
  chemically synthesized
cagaaaaaagtaaaacagagat

SEQ ID NO: 1301003 - DNA, 22 bp, Artificial Sequence
  chemically synthesized
ttccagaaaaaagtaaaacaga

SEQ ID NO: 1301004 - DNA, 22 bp, Artificial Sequence
  chemically synthesized
atgatctctgttttactttttt

SEQ ID NO: 1301005 - DNA, 22 bp, Artificial Sequence
  chemically synthesized
atgccactgttccagaaaaaag

SEQ ID NO: 1301006 - DNA, 22 bp, Artificial Sequence
  chemically synthesized
ttaatgccactgttccagaaaa

SEQ ID NO: 1301007 - DNA, 22 bp, Artificial Sequence
  chemically synthesized
tgttttacttttttctggaaca

SEQ ID NO: 1301008 - DNA, 22 bp, Artificial Sequence
  chemically synthesized
ctgttaatgccactgttccaga

SEQ ID NO: 1301009 - DNA, 22 bp, Artificial Sequence
  chemically synthesized
ttttacttttttctggaacagt

SEQ ID NO: 1301010 - DNA, 22 bp, Artificial Sequence
  chemically synthesized
ttgctgttaatgccactgttcc

SEQ ID NO: 1301011 - DNA, 22 bp, Artificial Sequence
  chemically synthesized
tacttttttctggaacagtggc

SEQ ID NO: 1301012 - DNA, 22 bp, Artificial Sequence
  chemically synthesized
acttttttctggaacagtggca

SEQ ID NO: 1301013 - DNA, 22 bp, Artificial Sequence
  chemically synthesized
cttttttctggaacagtggcat

SEQ ID NO: 1301014 - DNA, 22 bp, Artificial Sequence
  chemically synthesized
ttttctggaacagtggcattaa

SEQ ID NO: 1301015 - DNA, 22 bp, Artificial Sequence
  chemically synthesized
tttctggaacagtggcattaac

SEQ ID NO: 1301016 - DNA, 22 bp, Artificial Sequence
  chemically synthesized
ttctggaacagtggcattaaca

SEQ ID NO: 1301017 - DNA, 22 bp, Artificial Sequence
  chemically synthesized
tctggaacagtggcattaacag

SEQ ID NO: 1301018 - DNA, 22 bp, Artificial Sequence
  chemically synthesized
ctggaacagtggcattaacagc

SEQ ID NO: 1301019 - DNA, 22 bp, Artificial Sequence
  chemically synthesized
tggaacagtggcattaacagca

SEQ ID NO: 1301020 - DNA, 22 bp, Artificial Sequence
  chemically synthesized
gaacagtggcattaacagcaat

SEQ ID NO: 1301021 - DNA, 22 bp, Artificial Sequence
  chemically synthesized
acagcaatagacctgtttttat

SEQ ID NO: 1301022 - DNA, 22 bp, Artificial Sequence
  chemically synthesized
tttttattatttttctttactt

SEQ ID NO: 1301023 - DNA, 22 bp, Artificial Sequence
  chemically synthesized
ttattatttttctttactttgc

SEQ ID NO: 1301024 - DNA, 22 bp, Artificial Sequence
  chemically synthesized
tattatttttctttactttgct

SEQ ID NO: 1301025 - DNA, 22 bp, Artificial Sequence
  chemically synthesized
attatttttctttactttgctt

SEQ ID NO: 1301026 - DNA, 22 bp, Artificial Sequence
  chemically synthesized
ttatttttctttactttgcttt

SEQ ID NO: 1301027 - DNA, 22 bp, Artificial Sequence
  chemically synthesized
tttttctttactttgctttttt

SEQ ID NO: 1301028 - DNA, 22 bp, Artificial Sequence
  chemically synthesized
aataaacatgtaaaaaaaagca

SEQ ID NO: 1301029 - DNA, 22 bp, Artificial Sequence
  chemically synthesized
aaataaacatgtaaaaaaaagc

SEQ ID NO: 1301030 - DNA, 22 bp, Artificial Sequence
  chemically synthesized
ttctttactttgctttttttta

SEQ ID NO: 1301031 - DNA, 22 bp, Artificial Sequence
  chemically synthesized
tctttactttgcttttttttac

SEQ ID NO: 1301032 - DNA, 22 bp, Artificial Sequence
  chemically synthesized
ttaaataaacatgtaaaaaaaa

SEQ ID NO: 1301033 - DNA, 22 bp, Artificial Sequence
  chemically synthesized
ctttactttgcttttttttaca

SEQ ID NO: 1301034 - DNA, 22 bp, Artificial Sequence
  chemically synthesized
tttactttgcttttttttacat

SEQ ID NO: 1301035 - DNA, 22 bp, Artificial Sequence
  chemically synthesized
tactttgcttttttttacatgt

SEQ ID NO: 1301036 - DNA, 22 bp, Artificial Sequence
  chemically synthesized
actttgcttttttttacatgtt

SEQ ID NO: 1301037 - DNA, 22 bp, Artificial Sequence
  chemically synthesized
ctttgcttttttttacatgttt

SEQ ID NO: 1301038 - DNA, 22 bp, Artificial Sequence
  chemically synthesized
tgcttttttttacatgtttatt

SEQ ID NO: 1301039 - DNA, 22 bp, Artificial Sequence
  chemically synthesized
gcttttttttacatgtttattt

SEQ ID NO: 1301040 - DNA, 22 bp, Artificial Sequence
  chemically synthesized
cttttttttacatgtttattta

SEQ ID NO: 1301041 - DNA, 22 bp, Artificial Sequence
  chemically synthesized
ttttttacatgtttatttaaga

SEQ ID NO: 1301042 - DNA, 22 bp, Artificial Sequence
  chemically synthesized
tttttacatgtttatttaagag

SEQ ID NO: 1301043 - DNA, 22 bp, Artificial Sequence
  chemically synthesized
ttttacatgtttatttaagaga

SEQ ID NO: 1301044 - DNA, 22 bp, Artificial Sequence
  chemically synthesized
tttacatgtttatttaagagat

SEQ ID NO: 1301045 - DNA, 22 bp, Artificial Sequence
  chemically synthesized
ttacatgtttatttaagagatc

SEQ ID NO: 1301046 - DNA, 22 bp, Artificial Sequence
  chemically synthesized
tacatgtttatttaagagatct

SEQ ID NO: 1301047 - DNA, 22 bp, Artificial Sequence
  chemically synthesized
acatgtttatttaagagatctg

SEQ ID NO: 1301048 - DNA, 22 bp, Artificial Sequence
  chemically synthesized
catgtttatttaagagatctgc

SEQ ID NO: 1301049 - DNA, 22 bp, Artificial Sequence
  chemically synthesized
atttaagagatctgctcttcat

SEQ ID NO: 1301050 - DNA, 22 bp, Artificial Sequence
  chemically synthesized
tttaagagatctgctcttcatc

SEQ ID NO: 1301051 - DNA, 22 bp, Artificial Sequence
  chemically synthesized
aagagatctgctcttcatctct

SEQ ID NO: 1301052 - DNA, 22 bp, Artificial Sequence
  chemically synthesized
agagatctgctcttcatctctg

SEQ ID NO: 1301053 - DNA, 22 bp, Artificial Sequence
  chemically synthesized
ctcttcatctctgtcaccattg

SEQ ID NO: 1301054 - DNA, 22 bp, Artificial Sequence
  chemically synthesized
ttcatctctgtcaccattgtac

SEQ ID NO: 1301055 - DNA, 22 bp, Artificial Sequence
  chemically synthesized
catctctgtcaccattgtacca

SEQ ID NO: 1301056 - DNA, 22 bp, Artificial Sequence
  chemically synthesized
atctctgtcaccattgtaccat

SEQ ID NO: 1301057 - DNA, 22 bp, Artificial Sequence
  chemically synthesized
tgtcaccattgtaccattcttt

SEQ ID NO: 1301058 - DNA, 22 bp, Artificial Sequence
  chemically synthesized
tcaccattgtaccattcttttt

SEQ ID NO: 1301059 - DNA, 22 bp, Artificial Sequence
  chemically synthesized
tgtgtatatccataaaaagaat

SEQ ID NO: 1301060 - DNA, 22 bp, Artificial Sequence
  chemically synthesized
ctgtgtgtatatccataaaaag

SEQ ID NO: 1301061 - DNA, 22 bp, Artificial Sequence
  chemically synthesized
taccattctttttatggatata

SEQ ID NO: 1301062 - DNA, 22 bp, Artificial Sequence
  chemically synthesized
agtgccaattactgtgtgtata

SEQ ID NO: 1301063 - DNA, 22 bp, Artificial Sequence
  chemically synthesized
cagtgccaattactgtgtgtat

SEQ ID NO: 1301064 - DNA, 22 bp, Artificial Sequence
  chemically synthesized
tttttatggatatacacacagt

SEQ ID NO: 1301065 - DNA, 22 bp, Artificial Sequence
  chemically synthesized
tcagtgccaattactgtgtgta

SEQ ID NO: 1301066 - DNA, 22 bp, Artificial Sequence
  chemically synthesized
tttatggatatacacacagtaa

SEQ ID NO: 1301067 - DNA, 22 bp, Artificial Sequence
  chemically synthesized
tttcagtgccaattactgtgtg

SEQ ID NO: 1301068 - DNA, 22 bp, Artificial Sequence
  chemically synthesized
ttatggatatacacacagtaat

SEQ ID NO: 1301069 - DNA, 22 bp, Artificial Sequence
  chemically synthesized
tatggatatacacacagtaatt

SEQ ID NO: 1301070 - DNA, 22 bp, Artificial Sequence
  chemically synthesized
atggatatacacacagtaattg

SEQ ID NO: 1301071 - DNA, 22 bp, Artificial Sequence
  chemically synthesized
tggatatacacacagtaattgg

SEQ ID NO: 1301072 - DNA, 22 bp, Artificial Sequence
  chemically synthesized
tacctctttcagtgccaattac

SEQ ID NO: 1301073 - DNA, 22 bp, Artificial Sequence
  chemically synthesized
cagtgtatataattatacctct

SEQ ID NO: 1301074 - DNA, 22 bp, Artificial Sequence
  chemically synthesized
gcactgaaagaggtataattat

SEQ ID NO: 1301075 - DNA, 22 bp, Artificial Sequence
  chemically synthesized
gcatagctgcagtgtatataat

SEQ ID NO: 1301076 - DNA, 22 bp, Artificial Sequence
  chemically synthesized
aaagaggtataattatatacac

SEQ ID NO: 1301077 - DNA, 22 bp, Artificial Sequence
  chemically synthesized
tggcatagctgcagtgtatata

SEQ ID NO: 1301078 - DNA, 22 bp, Artificial Sequence
  chemically synthesized
tctggcatagctgcagtgtata

SEQ ID NO: 1301079 - DNA, 22 bp, Artificial Sequence
  chemically synthesized
ctctggcatagctgcagtgtat

SEQ ID NO: 1301080 - DNA, 22 bp, Artificial Sequence
  chemically synthesized
tctctggcatagctgcagtgta

SEQ ID NO: 1301081 - DNA, 22 bp, Artificial Sequence
  chemically synthesized
gctttctctggcatagctgcag

SEQ ID NO: 1301082 - DNA, 22 bp, Artificial Sequence
  chemically synthesized
tatacactgcagctatgccaga

SEQ ID NO: 1301083 - DNA, 22 bp, Artificial Sequence
  chemically synthesized
cagctatgccagagaaagccag

SEQ ID NO: 1301084 - DNA, 22 bp, Artificial Sequence
  chemically synthesized
ggccagataaggagccctggct

SEQ ID NO: 1301085 - DNA, 22 bp, Artificial Sequence
  chemically synthesized
tgccagagaaagccagggctcc

SEQ ID NO: 1301086 - DNA, 22 bp, Artificial Sequence
  chemically synthesized
cctaggccagataaggagccct

SEQ ID NO: 1301087 - DNA, 22 bp, Artificial Sequence
  chemically synthesized
ttccctaggccagataaggagc

SEQ ID NO: 1301088 - DNA, 22 bp, Artificial Sequence
  chemically synthesized
attccctaggccagataaggag

SEQ ID NO: 1301089 - DNA, 22 bp, Artificial Sequence
  chemically synthesized
tttattccctaggccagataag

SEQ ID NO: 1301090 - DNA, 22 bp, Artificial Sequence
  chemically synthesized
cttatctggcctagggaataaa

SEQ ID NO: 1301091 - DNA, 22 bp, Artificial Sequence
  chemically synthesized
atctggcctagggaataaataa

SEQ ID NO: 1301092 - DNA, 22 bp, Artificial Sequence
  chemically synthesized
tctggcctagggaataaataat

SEQ ID NO: 1301093 - DNA, 22 bp, Artificial Sequence
  chemically synthesized
gcctagggaataaataatgggt

SEQ ID NO: 1301094 - DNA, 22 bp, Artificial Sequence
  chemically synthesized
agagaatatgaagaaaacccat

SEQ ID NO: 1301095 - DNA, 22 bp, Artificial Sequence
  chemically synthesized
gggaataaataatgggttttct

SEQ ID NO: 1301096 - DNA, 22 bp, Artificial Sequence
  chemically synthesized
aagagtaatatctaagagaata

SEQ ID NO: 1301097 - DNA, 22 bp, Artificial Sequence
  chemically synthesized
tcttcatattctcttagatatt

SEQ ID NO: 1301098 - DNA, 22 bp, Artificial Sequence
  chemically synthesized
cttcatattctcttagatatta

SEQ ID NO: 1301099 - DNA, 22 bp, Artificial Sequence
  chemically synthesized
ttcatattctcttagatattac

SEQ ID NO: 1301100 - DNA, 22 bp, Artificial Sequence
  chemically synthesized
ggtggctgaagagtaatatcta

SEQ ID NO: 1301101 - DNA, 22 bp, Artificial Sequence
  chemically synthesized
catattctcttagatattactc

SEQ ID NO: 1301102 - DNA, 22 bp, Artificial Sequence
  chemically synthesized
atattctcttagatattactct

SEQ ID NO: 1301103 - DNA, 22 bp, Artificial Sequence
  chemically synthesized
tcttagatattactcttcagcc

SEQ ID NO: 1301104 - DNA, 22 bp, Artificial Sequence
  chemically synthesized
ttagatattactcttcagccac

SEQ ID NO: 1301105 - DNA, 22 bp, Artificial Sequence
  chemically synthesized
agatattactcttcagccacct

SEQ ID NO: 1301106 - DNA, 22 bp, Artificial Sequence
  chemically synthesized
gatattactcttcagccaccta

SEQ ID NO: 1301107 - DNA, 22 bp, Artificial Sequence
  chemically synthesized
ctcttcagccacctaggattgg

SEQ ID NO: 1301108 - DNA, 22 bp, Artificial Sequence
  chemically synthesized
ttcagccacctaggattgggca

SEQ ID NO: 1301109 - DNA, 22 bp, Artificial Sequence
  chemically synthesized
cagccacctaggattgggcact

SEQ ID NO: 1301110 - DNA, 22 bp, Artificial Sequence
  chemically synthesized
agccacctaggattgggcacta

SEQ ID NO: 1301111 - DNA, 22 bp, Artificial Sequence
  chemically synthesized
acaacaacaaaaaaatagtgcc

SEQ ID NO: 1301112 - DNA, 22 bp, Artificial Sequence
  chemically synthesized
ggattgggcactatttttttgt

SEQ ID NO: 1301113 - DNA, 22 bp, Artificial Sequence
  chemically synthesized
ggcactatttttttgttgttgt

SEQ ID NO: 1301114 - DNA, 22 bp, Artificial Sequence
  chemically synthesized
tttttttgttgttgttagtttc

SEQ ID NO: 1301115 - DNA, 22 bp, Artificial Sequence
  chemically synthesized
ttttgttgttgttagtttcttg

SEQ ID NO: 1301116 - DNA, 22 bp, Artificial Sequence
  chemically synthesized
tttgttgttgttagtttcttgt

SEQ ID NO: 1301117 - DNA, 22 bp, Artificial Sequence
  chemically synthesized
ttgttgttgttagtttcttgtg

SEQ ID NO: 1301118 - DNA, 22 bp, Artificial Sequence
  chemically synthesized
tgtatatggaagcacaagaaac

SEQ ID NO: 1301119 - DNA, 22 bp, Artificial Sequence
  chemically synthesized
tgttgttgttagtttcttgtgc

SEQ ID NO: 1301120 - DNA, 22 bp, Artificial Sequence
  chemically synthesized
gttgttgttagtttcttgtgct

SEQ ID NO: 1301121 - DNA, 22 bp, Artificial Sequence
  chemically synthesized
ttgttgttagtttcttgtgctt

SEQ ID NO: 1301122 - DNA, 22 bp, Artificial Sequence
  chemically synthesized
ttgttagtttcttgtgcttcca

SEQ ID NO: 1301123 - DNA, 22 bp, Artificial Sequence
  chemically synthesized
catctgtgtatatggaagcaca

SEQ ID NO: 1301124 - DNA, 22 bp, Artificial Sequence
  chemically synthesized
ttagtttcttgtgcttccatat

SEQ ID NO: 1301125 - DNA, 22 bp, Artificial Sequence
  chemically synthesized
gtttcttgtgcttccatataca

SEQ ID NO: 1301126 - DNA, 22 bp, Artificial Sequence
  chemically synthesized
cttgtgcttccatatacacaga

SEQ ID NO: 1301127 - DNA, 22 bp, Artificial Sequence
  chemically synthesized
ttgtgcttccatatacacagat

SEQ ID NO: 1301128 - DNA, 22 bp, Artificial Sequence
  chemically synthesized
gtgcttccatatacacagatgc

SEQ ID NO: 1301129 - DNA, 22 bp, Artificial Sequence
  chemically synthesized
tgcttccatatacacagatgca

SEQ ID NO: 1301130 - DNA, 22 bp, Artificial Sequence
  chemically synthesized
ccatatacacagatgcagtttc

SEQ ID NO: 1301131 - DNA, 22 bp, Artificial Sequence
  chemically synthesized
catatacacagatgcagtttct

SEQ ID NO: 1301132 - DNA, 22 bp, Artificial Sequence
  chemically synthesized
caatataatgggtgacaagaaa

SEQ ID NO: 1301133 - DNA, 22 bp, Artificial Sequence
  chemically synthesized
agaaagggcattgcaatataat

SEQ ID NO: 1301134 - DNA, 22 bp, Artificial Sequence
  chemically synthesized
cagaaagggcattgcaatataa

SEQ ID NO: 1301135 - DNA, 22 bp, Artificial Sequence
  chemically synthesized
cttgtcacccattatattgcaa

SEQ ID NO: 1301136 - DNA, 22 bp, Artificial Sequence
  chemically synthesized
tcagaaagggcattgcaatata

SEQ ID NO: 1301137 - DNA, 22 bp, Artificial Sequence
  chemically synthesized
ttgtcacccattatattgcaat

SEQ ID NO: 1301138 - DNA, 22 bp, Artificial Sequence
  chemically synthesized
ttcagaaagggcattgcaatat

SEQ ID NO: 1301139 - DNA, 22 bp, Artificial Sequence
  chemically synthesized
gtcacccattatattgcaatgc

SEQ ID NO: 1301140 - DNA, 22 bp, Artificial Sequence
  chemically synthesized
ttttcagaaagggcattgcaat

SEQ ID NO: 1301141 - DNA, 22 bp, Artificial Sequence
  chemically synthesized
tcacccattatattgcaatgcc

SEQ ID NO: 1301142 - DNA, 22 bp, Artificial Sequence
  chemically synthesized
ggctcttttcagaaagggcatt

SEQ ID NO: 1301143 - DNA, 22 bp, Artificial Sequence
  chemically synthesized
tattgcaatgccctttctgaaa

SEQ ID NO: 1301144 - DNA, 22 bp, Artificial Sequence
  chemically synthesized
caatgccctttctgaaaagagc

SEQ ID NO: 1301145 - DNA, 22 bp, Artificial Sequence
  chemically synthesized
cagaaaaaggctgggctctttt

SEQ ID NO: 1301146 - DNA, 22 bp, Artificial Sequence
  chemically synthesized
tctgaaaagagcccagcctttt

SEQ ID NO: 1301147 - DNA, 22 bp, Artificial Sequence
  chemically synthesized
ctgaaaagagcccagccttttt

SEQ ID NO: 1301148 - DNA, 22 bp, Artificial Sequence
  chemically synthesized
tgaaaagagcccagcctttttc

SEQ ID NO: 1301149 - DNA, 22 bp, Artificial Sequence
  chemically synthesized
aaaagagcccagcctttttctg

SEQ ID NO: 1301150 - DNA, 22 bp, Artificial Sequence
  chemically synthesized
tcaaagtacattacagaaaaag

SEQ ID NO: 1301151 - DNA, 22 bp, Artificial Sequence
  chemically synthesized
ctgtcaaagtacattacagaaa

SEQ ID NO: 1301152 - DNA, 22 bp, Artificial Sequence
  chemically synthesized
actgtcaaagtacattacagaa

SEQ ID NO: 1301153 - DNA, 22 bp, Artificial Sequence
  chemically synthesized
tttctgtaatgtactttgacag

SEQ ID NO: 1301154 - DNA, 22 bp, Artificial Sequence
  chemically synthesized
tgtcaatacttactgtcaaagt

SEQ ID NO: 1301155 - DNA, 22 bp, Artificial Sequence
  chemically synthesized
ttctgtaatgtactttgacagt

SEQ ID NO: 1301156 - DNA, 22 bp, Artificial Sequence
  chemically synthesized
tctgtaatgtactttgacagta

SEQ ID NO: 1301157 - DNA, 22 bp, Artificial Sequence
  chemically synthesized
ctgtaatgtactttgacagtaa

SEQ ID NO: 1301158 - DNA, 22 bp, Artificial Sequence
  chemically synthesized
tgtaatgtactttgacagtaag

SEQ ID NO: 1301159 - DNA, 22 bp, Artificial Sequence
  chemically synthesized
cattatgtcaatacttactgtc

SEQ ID NO: 1301160 - DNA, 22 bp, Artificial Sequence
  chemically synthesized
taatgtactttgacagtaagta

SEQ ID NO: 1301161 - DNA, 22 bp, Artificial Sequence
  chemically synthesized
tattacattatgtcaatactta

SEQ ID NO: 1301162 - DNA, 22 bp, Artificial Sequence
  chemically synthesized
ctgtattacattatgtcaatac

SEQ ID NO: 1301163 - DNA, 22 bp, Artificial Sequence
  chemically synthesized
tgacagtaagtattgacataat

SEQ ID NO: 1301164 - DNA, 22 bp, Artificial Sequence
  chemically synthesized
gacagtaagtattgacataatg

SEQ ID NO: 1301165 - DNA, 22 bp, Artificial Sequence
  chemically synthesized
acagtaagtattgacataatgt

SEQ ID NO: 1301166 - DNA, 22 bp, Artificial Sequence
  chemically synthesized
caattactgtattacattatgt

SEQ ID NO: 1301167 - DNA, 22 bp, Artificial Sequence
  chemically synthesized
agttccaattactgtattacat

SEQ ID NO: 1301168 - DNA, 22 bp, Artificial Sequence
  chemically synthesized
tgagttccaattactgtattac

SEQ ID NO: 1301169 - DNA, 22 bp, Artificial Sequence
  chemically synthesized
ctgagttccaattactgtatta

SEQ ID NO: 1301170 - DNA, 22 bp, Artificial Sequence
  chemically synthesized
tctgagttccaattactgtatt

SEQ ID NO: 1301171 - DNA, 22 bp, Artificial Sequence
  chemically synthesized
acataatgtaatacagtaattg

SEQ ID NO: 1301172 - DNA, 22 bp, Artificial Sequence
  chemically synthesized
gaactcagaaagatttgtttgc

SEQ ID NO: 1301173 - DNA, 22 bp, Artificial Sequence
  chemically synthesized
agcagtcaggtagcaaacaaat

SEQ ID NO: 1301174 - DNA, 22 bp, Artificial Sequence
  chemically synthesized
aagcagtcaggtagcaaacaaa

SEQ ID NO: 1301175 - DNA, 22 bp, Artificial Sequence
  chemically synthesized
agaaagatttgtttgctacctg

SEQ ID NO: 1301176 - DNA, 22 bp, Artificial Sequence
  chemically synthesized
aaatatcttaagcagtcaggta

SEQ ID NO: 1301177 - DNA, 22 bp, Artificial Sequence
  chemically synthesized
gtttgctacctgactgcttaag

SEQ ID NO: 1301178 - DNA, 22 bp, Artificial Sequence
  chemically synthesized
tttgctacctgactgcttaaga

SEQ ID NO: 1301179 - DNA, 22 bp, Artificial Sequence
  chemically synthesized
aggcattaaaatatcttaagca

SEQ ID NO: 1301180 - DNA, 22 bp, Artificial Sequence
  chemically synthesized
gctacctgactgcttaagatat

SEQ ID NO: 1301181 - DNA, 22 bp, Artificial Sequence
  chemically synthesized
ctacctgactgcttaagatatt

SEQ ID NO: 1301182 - DNA, 22 bp, Artificial Sequence
  chemically synthesized
cctgactgcttaagatatttta

SEQ ID NO: 1301183 - DNA, 22 bp, Artificial Sequence
  chemically synthesized
actgcttaagatattttaatgc

SEQ ID NO: 1301184 - DNA, 22 bp, Artificial Sequence
  chemically synthesized
cttaagatattttaatgcctta

SEQ ID NO: 1301185 - DNA, 22 bp, Artificial Sequence
  chemically synthesized
aagatattttaatgccttaatc

SEQ ID NO: 1301186 - DNA, 22 bp, Artificial Sequence
  chemically synthesized
agatattttaatgccttaatcg

SEQ ID NO: 1301187 - DNA, 22 bp, Artificial Sequence
  chemically synthesized
aaaatatgtgtccgattaaggc

SEQ ID NO: 1301188 - DNA, 22 bp, Artificial Sequence
  chemically synthesized
taatgccttaatcggacacata

SEQ ID NO: 1301189 - DNA, 22 bp, Artificial Sequence
  chemically synthesized
aatgccttaatcggacacatat

SEQ ID NO: 1301190 - DNA, 22 bp, Artificial Sequence
  chemically synthesized
atgccttaatcggacacatatt

SEQ ID NO: 1301191 - DNA, 22 bp, Artificial Sequence
  chemically synthesized
aatcggacacatatttttaatg

SEQ ID NO: 1301192 - DNA, 22 bp, Artificial Sequence
  chemically synthesized
aagaaaaatgtgcattaaaaat

SEQ ID NO: 1301193 - DNA, 22 bp, Artificial Sequence
  chemically synthesized
atcggacacatatttttaatgc

SEQ ID NO: 1301194 - DNA, 22 bp, Artificial Sequence
  chemically synthesized
actaaagaaaaatgtgcattaa

SEQ ID NO: 1301195 - DNA, 22 bp, Artificial Sequence
  chemically synthesized
taactaaagaaaaatgtgcatt

SEQ ID NO: 1301196 - DNA, 22 bp, Artificial Sequence
  chemically synthesized
ctctaactaaagaaaaatgtgc

SEQ ID NO: 1301197 - DNA, 22 bp, Artificial Sequence
  chemically synthesized
ttaatgcacatttttctttagt

SEQ ID NO: 1301198 - DNA, 22 bp, Artificial Sequence
  chemically synthesized
taatgcacatttttctttagtt

SEQ ID NO: 1301199 - DNA, 22 bp, Artificial Sequence
  chemically synthesized
aatgcacatttttctttagtta

SEQ ID NO: 1301200 - DNA, 22 bp, Artificial Sequence
  chemically synthesized
atgcacatttttctttagttag

SEQ ID NO: 1301201 - DNA, 22 bp, Artificial Sequence
  chemically synthesized
atgacatgggctgctctaacta

SEQ ID NO: 1301202 - DNA, 22 bp, Artificial Sequence
  chemically synthesized
catgacatgggctgctctaact

SEQ ID NO: 1301203 - DNA, 22 bp, Artificial Sequence
  chemically synthesized
cttcatgacatgggctgctcta

SEQ ID NO: 1301204 - DNA, 22 bp, Artificial Sequence
  chemically synthesized
ttctttagttagagcagcccat

SEQ ID NO: 1301205 - DNA, 22 bp, Artificial Sequence
  chemically synthesized
tctttagttagagcagcccatg

SEQ ID NO: 1301206 - DNA, 22 bp, Artificial Sequence
  chemically synthesized
ctttagttagagcagcccatgt

SEQ ID NO: 1301207 - DNA, 22 bp, Artificial Sequence
  chemically synthesized
tttagttagagcagcccatgtc

SEQ ID NO: 1301208 - DNA, 22 bp, Artificial Sequence
  chemically synthesized
tagttagagcagcccatgtcat

SEQ ID NO: 1301209 - DNA, 22 bp, Artificial Sequence
  chemically synthesized
agtggttccttcatgacatggg

SEQ ID NO: 1301210 - DNA, 22 bp, Artificial Sequence
  chemically synthesized
agttagagcagcccatgtcatg

SEQ ID NO: 1301211 - DNA, 22 bp, Artificial Sequence
  chemically synthesized
gagtggttccttcatgacatgg

SEQ ID NO: 1301212 - DNA, 22 bp, Artificial Sequence
  chemically synthesized
gttagagcagcccatgtcatga

SEQ ID NO: 1301213 - DNA, 22 bp, Artificial Sequence
  chemically synthesized
gagcagcccatgtcatgaagga

SEQ ID NO: 1301214 - DNA, 22 bp, Artificial Sequence
  chemically synthesized
cacatttgagtggttccttcat

SEQ ID NO: 1301215 - DNA, 22 bp, Artificial Sequence
  chemically synthesized
tgaaaaccatcaattccacatt

SEQ ID NO: 1301216 - DNA, 22 bp, Artificial Sequence
  chemically synthesized
tatcctgtgaaaaccatcaatt

SEQ ID NO: 1301217 - DNA, 22 bp, Artificial Sequence
  chemically synthesized
atatcctgtgaaaaccatcaat

SEQ ID NO: 1301218 - DNA, 22 bp, Artificial Sequence
  chemically synthesized
tatatcctgtgaaaaccatcaa

SEQ ID NO: 1301219 - DNA, 22 bp, Artificial Sequence
  chemically synthesized
ttatatcctgtgaaaaccatca

SEQ ID NO: 1301220 - DNA, 22 bp, Artificial Sequence
  chemically synthesized
aaatgtggaattgatggttttc

SEQ ID NO: 1301221 - DNA, 22 bp, Artificial Sequence
  chemically synthesized
tttatatcctgtgaaaaccatc

SEQ ID NO: 1301222 - DNA, 22 bp, Artificial Sequence
  chemically synthesized
atggttttcacaggatataaaa

SEQ ID NO: 1301223 - DNA, 22 bp, Artificial Sequence
  chemically synthesized
tatggcatgatgttttttatat

SEQ ID NO: 1301224 - DNA, 22 bp, Artificial Sequence
  chemically synthesized
gtatggcatgatgttttttata

SEQ ID NO: 1301225 - DNA, 22 bp, Artificial Sequence
  chemically synthesized
ttgtatggcatgatgtttttta

SEQ ID NO: 1301226 - DNA, 22 bp, Artificial Sequence
  chemically synthesized
cttgtatggcatgatgtttttt

SEQ ID NO: 1301227 - DNA, 22 bp, Artificial Sequence
  chemically synthesized
tcacaggatataaaaaacatca

SEQ ID NO: 1301228 - DNA, 22 bp, Artificial Sequence
  chemically synthesized
cacaggatataaaaaacatcat

SEQ ID NO: 1301229 - DNA, 22 bp, Artificial Sequence
  chemically synthesized
acaggatataaaaaacatcatg

SEQ ID NO: 1301230 - DNA, 22 bp, Artificial Sequence
  chemically synthesized
tttcttgtatggcatgatgttt

SEQ ID NO: 1301231 - DNA, 22 bp, Artificial Sequence
  chemically synthesized
gtttcttgtatggcatgatgtt

SEQ ID NO: 1301232 - DNA, 22 bp, Artificial Sequence
  chemically synthesized
tgcagaaaggagtgatttgttt

SEQ ID NO: 1301233 - DNA, 22 bp, Artificial Sequence
  chemically synthesized
tatctatgcagaaaggagtgat

SEQ ID NO: 1301234 - DNA, 22 bp, Artificial Sequence
  chemically synthesized
actgtatctatgcagaaaggag

SEQ ID NO: 1301235 - DNA, 22 bp, Artificial Sequence
  chemically synthesized
tgaattcactgtatctatgcag

SEQ ID NO: 1301236 - DNA, 22 bp, Artificial Sequence
  chemically synthesized
caagctgtgaattcactgtatc

SEQ ID NO: 1301237 - DNA, 22 bp, Artificial Sequence
  chemically synthesized
ctttctgcatagatacagtgaa

SEQ ID NO: 1301238 - DNA, 22 bp, Artificial Sequence
  chemically synthesized
ccaagctgtgaattcactgtat

SEQ ID NO: 1301239 - DNA, 22 bp, Artificial Sequence
  chemically synthesized
tctgcatagatacagtgaattc

SEQ ID NO: 1301240 - DNA, 22 bp, Artificial Sequence
  chemically synthesized
ctgcatagatacagtgaattca

SEQ ID NO: 1301241 - DNA, 22 bp, Artificial Sequence
  chemically synthesized
gtttccaagctgtgaattcact

SEQ ID NO: 1301242 - DNA, 22 bp, Artificial Sequence
  chemically synthesized
tgcatagatacagtgaattcac

SEQ ID NO: 1301243 - DNA, 22 bp, Artificial Sequence
  chemically synthesized
catagatacagtgaattcacag

SEQ ID NO: 1301244 - DNA, 22 bp, Artificial Sequence
  chemically synthesized
aaaatactggtttccaagctgt

SEQ ID NO: 1301245 - DNA, 22 bp, Artificial Sequence
  chemically synthesized
gaaaatactggtttccaagctg

SEQ ID NO: 1301246 - DNA, 22 bp, Artificial Sequence
  chemically synthesized
tgaaaatactggtttccaagct

SEQ ID NO: 1301247 - DNA, 22 bp, Artificial Sequence
  chemically synthesized
acagcttggaaaccagtatttt

SEQ ID NO: 1301248 - DNA, 22 bp, Artificial Sequence
  chemically synthesized
ataccacgctttgaaaatactg

SEQ ID NO: 1301249 - DNA, 22 bp, Artificial Sequence
  chemically synthesized
cataccacgctttgaaaatact

SEQ ID NO: 1301250 - DNA, 22 bp, Artificial Sequence
  chemically synthesized
tcataccacgctttgaaaatac

SEQ ID NO: 1301251 - DNA, 22 bp, Artificial Sequence
  chemically synthesized
ggaaaccagtattttcaaagcg

SEQ ID NO: 1301252 - DNA, 22 bp, Artificial Sequence
  chemically synthesized
gaaaccagtattttcaaagcgt

SEQ ID NO: 1301253 - DNA, 22 bp, Artificial Sequence
  chemically synthesized
agacactttcataccacgcttt

SEQ ID NO: 1301254 - DNA, 22 bp, Artificial Sequence
  chemically synthesized
tcagacactttcataccacgct

SEQ ID NO: 1301255 - DNA, 22 bp, Artificial Sequence
  chemically synthesized
ttctcagacactttcataccac

SEQ ID NO: 1301256 - DNA, 22 bp, Artificial Sequence
  chemically synthesized
attctcagacactttcatacca

SEQ ID NO: 1301257 - DNA, 22 bp, Artificial Sequence
  chemically synthesized
tcaaagcgtggtatgaaagtgt

SEQ ID NO: 1301258 - DNA, 22 bp, Artificial Sequence
  chemically synthesized
caaagcgtggtatgaaagtgtc

SEQ ID NO: 1301259 - DNA, 22 bp, Artificial Sequence
  chemically synthesized
aaagcgtggtatgaaagtgtct

SEQ ID NO: 1301260 - DNA, 22 bp, Artificial Sequence
  chemically synthesized
agagtttattctcagacacttt

SEQ ID NO: 1301261 - DNA, 22 bp, Artificial Sequence
  chemically synthesized
ctgagagtttattctcagacac

SEQ ID NO: 1301262 - DNA, 22 bp, Artificial Sequence
  chemically synthesized
tgctgagagtttattctcagac

SEQ ID NO: 1301263 - DNA, 22 bp, Artificial Sequence
  chemically synthesized
atctctgctgagagtttattct

SEQ ID NO: 1301264 - DNA, 22 bp, Artificial Sequence
  chemically synthesized
ctgatctctgctgagagtttat

SEQ ID NO: 1301265 - DNA, 22 bp, Artificial Sequence
  chemically synthesized
tactgatctctgctgagagttt

SEQ ID NO: 1301266 - DNA, 22 bp, Artificial Sequence
  chemically synthesized
ctactgatctctgctgagagtt

SEQ ID NO: 1301267 - DNA, 22 bp, Artificial Sequence
  chemically synthesized
tttctactgatctctgctgaga

SEQ ID NO: 1301268 - DNA, 22 bp, Artificial Sequence
  chemically synthesized
agaataaactctcagcagagat

SEQ ID NO: 1301269 - DNA, 22 bp, Artificial Sequence
  chemically synthesized
gttatttctactgatctctgct

SEQ ID NO: 1301270 - DNA, 22 bp, Artificial Sequence
  chemically synthesized
ctggttatttctactgatctct

SEQ ID NO: 1301271 - DNA, 22 bp, Artificial Sequence
  chemically synthesized
tcagcagagatcagtagaaata

SEQ ID NO: 1301272 - DNA, 22 bp, Artificial Sequence
  chemically synthesized
gcggttactggttatttctact

SEQ ID NO: 1301273 - DNA, 22 bp, Artificial Sequence
  chemically synthesized
agcggttactggttatttctac

SEQ ID NO: 1301274 - DNA, 22 bp, Artificial Sequence
  chemically synthesized
agcagagatcagtagaaataac

SEQ ID NO: 1301275 - DNA, 22 bp, Artificial Sequence
  chemically synthesized
tagcggttactggttatttcta

SEQ ID NO: 1301276 - DNA, 22 bp, Artificial Sequence
  chemically synthesized
ttagcggttactggttatttct

SEQ ID NO: 1301277 - DNA, 22 bp, Artificial Sequence
  chemically synthesized
ttttagcggttactggttattt

SEQ ID NO: 1301278 - DNA, 22 bp, Artificial Sequence
  chemically synthesized
ctcttttagcggttactggtta

SEQ ID NO: 1301279 - DNA, 22 bp, Artificial Sequence
  chemically synthesized
ccaatcaataatgttcctcttt

SEQ ID NO: 1301280 - DNA, 22 bp, Artificial Sequence
  chemically synthesized
gccaatcaataatgttcctctt

SEQ ID NO: 1301281 - DNA, 22 bp, Artificial Sequence
  chemically synthesized
tgccaatcaataatgttcctct

SEQ ID NO: 1301282 - DNA, 22 bp, Artificial Sequence
  chemically synthesized
ctttgccaatcaataatgttcc

SEQ ID NO: 1301283 - DNA, 22 bp, Artificial Sequence
  chemically synthesized
gattactttgccaatcaataat

SEQ ID NO: 1301284 - DNA, 22 bp, Artificial Sequence
  chemically synthesized
ggattactttgccaatcaataa

SEQ ID NO: 1301285 - DNA, 22 bp, Artificial Sequence
  chemically synthesized
aaagaggaacattattgattgg

SEQ ID NO: 1301286 - DNA, 22 bp, Artificial Sequence
  chemically synthesized
tggattactttgccaatcaata

SEQ ID NO: 1301287 - DNA, 22 bp, Artificial Sequence
  chemically synthesized
ttggattactttgccaatcaat

SEQ ID NO: 1301288 - DNA, 22 bp, Artificial Sequence
  chemically synthesized
tttggattactttgccaatcaa

SEQ ID NO: 1301289 - DNA, 22 bp, Artificial Sequence
  chemically synthesized
ttttggattactttgccaatca

SEQ ID NO: 1301290 - DNA, 22 bp, Artificial Sequence
  chemically synthesized
ttttttggattactttgccaat

SEQ ID NO: 1301291 - DNA, 22 bp, Artificial Sequence
  chemically synthesized
tcttttttggattactttgcca

SEQ ID NO: 1301292 - DNA, 22 bp, Artificial Sequence
  chemically synthesized
ctcttttttggattactttgcc

SEQ ID NO: 1301293 - DNA, 22 bp, Artificial Sequence
  chemically synthesized
tctcttttttggattactttgc

SEQ ID NO: 1301294 - DNA, 22 bp, Artificial Sequence
  chemically synthesized
ttctcttttttggattactttg

SEQ ID NO: 1301295 - DNA, 22 bp, Artificial Sequence
  chemically synthesized
ttgattggcaaagtaatccaaa

SEQ ID NO: 1301296 - DNA, 22 bp, Artificial Sequence
  chemically synthesized
attggcaaagtaatccaaaaaa

SEQ ID NO: 1301297 - DNA, 22 bp, Artificial Sequence
  chemically synthesized
gcaaagtaatccaaaaaagaga

SEQ ID NO: 1301298 - DNA, 22 bp, Artificial Sequence
  chemically synthesized
acacacatcttttctctttttt

SEQ ID NO: 1301299 - DNA, 22 bp, Artificial Sequence
  chemically synthesized
agttcacacacatcttttctct

SEQ ID NO: 1301300 - DNA, 22 bp, Artificial Sequence
  chemically synthesized
gtattaagttcacacacatctt

SEQ ID NO: 1301301 - DNA, 22 bp, Artificial Sequence
  chemically synthesized
agtattaagttcacacacatct

SEQ ID NO: 1301302 - DNA, 22 bp, Artificial Sequence
  chemically synthesized
aatttagtattaagttcacaca

SEQ ID NO: 1301303 - DNA, 22 bp, Artificial Sequence
  chemically synthesized
tctaaatttagtattaagttca

SEQ ID NO: 1301304 - DNA, 22 bp, Artificial Sequence
  chemically synthesized
gtctaaatttagtattaagttc

SEQ ID NO: 1301305 - DNA, 22 bp, Artificial Sequence
  chemically synthesized
atcaatgaatacttgtctaaat

SEQ ID NO: 1301306 - DNA, 22 bp, Artificial Sequence
  chemically synthesized
ctaatcaatgaatacttgtcta

SEQ ID NO: 1301307 - DNA, 22 bp, Artificial Sequence
  chemically synthesized
aatactaaatttagacaagtat

SEQ ID NO: 1301308 - DNA, 22 bp, Artificial Sequence
  chemically synthesized
cctaatcaatgaatacttgtct

SEQ ID NO: 1301309 - DNA, 22 bp, Artificial Sequence
  chemically synthesized
atactaaatttagacaagtatt

SEQ ID NO: 1301310 - DNA, 22 bp, Artificial Sequence
  chemically synthesized
atttcctaatcaatgaatactt

SEQ ID NO: 1301311 - DNA, 22 bp, Artificial Sequence
  chemically synthesized
gatttcctaatcaatgaatact

SEQ ID NO: 1301312 - DNA, 22 bp, Artificial Sequence
  chemically synthesized
tgatttcctaatcaatgaatac

SEQ ID NO: 1301313 - DNA, 22 bp, Artificial Sequence
  chemically synthesized
aatttagacaagtattcattga

SEQ ID NO: 1301314 - DNA, 22 bp, Artificial Sequence
  chemically synthesized
aattttgatttcctaatcaatg

SEQ ID NO: 1301315 - DNA, 22 bp, Artificial Sequence
  chemically synthesized
agacaagtattcattgattagg

SEQ ID NO: 1301316 - DNA, 22 bp, Artificial Sequence
  chemically synthesized
gaattttgatttcctaatcaat

SEQ ID NO: 1301317 - DNA, 22 bp, Artificial Sequence
  chemically synthesized
gacaagtattcattgattagga

SEQ ID NO: 1301318 - DNA, 22 bp, Artificial Sequence
  chemically synthesized
tcttgaattttgatttcctaat

SEQ ID NO: 1301319 - DNA, 22 bp, Artificial Sequence
  chemically synthesized
atcttgaattttgatttcctaa

SEQ ID NO: 1301320 - DNA, 22 bp, Artificial Sequence
  chemically synthesized
tatcttgaattttgatttccta

SEQ ID NO: 1301321 - DNA, 22 bp, Artificial Sequence
  chemically synthesized
tttatcttgaattttgatttcc

SEQ ID NO: 1301322 - DNA, 22 bp, Artificial Sequence
  chemically synthesized
ctttatcttgaattttgatttc

SEQ ID NO: 1301323 - DNA, 22 bp, Artificial Sequence
  chemically synthesized
attgattaggaaatcaaaattc

SEQ ID NO: 1301324 - DNA, 22 bp, Artificial Sequence
  chemically synthesized
attaggaaatcaaaattcaaga

SEQ ID NO: 1301325 - DNA, 22 bp, Artificial Sequence
  chemically synthesized
aagatgtttctttatcttgaat

SEQ ID NO: 1301326 - DNA, 22 bp, Artificial Sequence
  chemically synthesized
ggaaatcaaaattcaagataaa

SEQ ID NO: 1301327 - DNA, 22 bp, Artificial Sequence
  chemically synthesized
tgaagatgtttctttatcttga

SEQ ID NO: 1301328 - DNA, 22 bp, Artificial Sequence
  chemically synthesized
atctctgaagatgtttctttat

SEQ ID NO: 1301329 - DNA, 22 bp, Artificial Sequence
  chemically synthesized
aatctctgaagatgtttcttta

SEQ ID NO: 1301330 - DNA, 22 bp, Artificial Sequence
  chemically synthesized
taatctctgaagatgtttcttt

SEQ ID NO: 1301331 - DNA, 22 bp, Artificial Sequence
  chemically synthesized
ttaatctctgaagatgtttctt

SEQ ID NO: 1301332 - DNA, 22 bp, Artificial Sequence
  chemically synthesized
cttttaatctctgaagatgttt

SEQ ID NO: 1301333 - DNA, 22 bp, Artificial Sequence
  chemically synthesized
aagataaagaaacatcttcaga

SEQ ID NO: 1301334 - DNA, 22 bp, Artificial Sequence
  chemically synthesized
aaacaatgaaagactactttta

SEQ ID NO: 1301335 - DNA, 22 bp, Artificial Sequence
  chemically synthesized
ctcaaacaatgaaagactactt

SEQ ID NO: 1301336 - DNA, 22 bp, Artificial Sequence
  chemically synthesized
cagagattaaaagtagtctttc

SEQ ID NO: 1301337 - DNA, 22 bp, Artificial Sequence
  chemically synthesized
agagattaaaagtagtctttca

SEQ ID NO: 1301338 - DNA, 22 bp, Artificial Sequence
  chemically synthesized
ggttactcaaacaatgaaagac

SEQ ID NO: 1301339 - DNA, 22 bp, Artificial Sequence
  chemically synthesized
agctaggttactcaaacaatga

SEQ ID NO: 1301340 - DNA, 22 bp, Artificial Sequence
  chemically synthesized
aaagtagtctttcattgtttga

SEQ ID NO: 1301341 - DNA, 22 bp, Artificial Sequence
  chemically synthesized
ctcagctaggttactcaaacaa

SEQ ID NO: 1301342 - DNA, 22 bp, Artificial Sequence
  chemically synthesized
actcctcagctaggttactcaa

SEQ ID NO: 1301343 - DNA, 22 bp, Artificial Sequence
  chemically synthesized
gactcctcagctaggttactca

SEQ ID NO: 1301344 - DNA, 22 bp, Artificial Sequence
  chemically synthesized
tcattgtttgagtaacctagct

SEQ ID NO: 1301345 - DNA, 22 bp, Artificial Sequence
  chemically synthesized
gtttgactcctcagctaggtta

SEQ ID NO: 1301346 - DNA, 22 bp, Artificial Sequence
  chemically synthesized
cattgtttgagtaacctagctg

SEQ ID NO: 1301347 - DNA, 22 bp, Artificial Sequence
  chemically synthesized
agtttgactcctcagctaggtt

SEQ ID NO: 1301348 - DNA, 22 bp, Artificial Sequence
  chemically synthesized
attgtttgagtaacctagctga

SEQ ID NO: 1301349 - DNA, 22 bp, Artificial Sequence
  chemically synthesized
tagtttgactcctcagctaggt

SEQ ID NO: 1301350 - DNA, 22 bp, Artificial Sequence
  chemically synthesized
tttgagtaacctagctgaggag

SEQ ID NO: 1301351 - DNA, 22 bp, Artificial Sequence
  chemically synthesized
gttttagtttgactcctcagct

SEQ ID NO: 1301352 - DNA, 22 bp, Artificial Sequence
  chemically synthesized
gagtaacctagctgaggagtca

SEQ ID NO: 1301353 - DNA, 22 bp, Artificial Sequence
  chemically synthesized
ttggttttagtttgactcctca

SEQ ID NO: 1301354 - DNA, 22 bp, Artificial Sequence
  chemically synthesized
agtaacctagctgaggagtcaa

SEQ ID NO: 1301355 - DNA, 22 bp, Artificial Sequence
  chemically synthesized
caatctattggttttagtttga

SEQ ID NO: 1301356 - DNA, 22 bp, Artificial Sequence
  chemically synthesized
gctgaggagtcaaactaaaacc

SEQ ID NO: 1301357 - DNA, 22 bp, Artificial Sequence
  chemically synthesized
attacaatctattggttttagt

SEQ ID NO: 1301358 - DNA, 22 bp, Artificial Sequence
  chemically synthesized
aggagtcaaactaaaaccaata

SEQ ID NO: 1301359 - DNA, 22 bp, Artificial Sequence
  chemically synthesized
aagcatcatactaattacaatc

SEQ ID NO: 1301360 - DNA, 22 bp, Artificial Sequence
  chemically synthesized
aaaccaatagattgtaattagt

SEQ ID NO: 1301361 - DNA, 22 bp, Artificial Sequence
  chemically synthesized
tcctaaagcatcatactaatta

SEQ ID NO: 1301362 - DNA, 22 bp, Artificial Sequence
  chemically synthesized
atcctaaagcatcatactaatt

SEQ ID NO: 1301363 - DNA, 22 bp, Artificial Sequence
  chemically synthesized
tatcctaaagcatcatactaat

SEQ ID NO: 1301364 - DNA, 22 bp, Artificial Sequence
  chemically synthesized
aactttatcctaaagcatcata

SEQ ID NO: 1301365 - DNA, 22 bp, Artificial Sequence
  chemically synthesized
ttcaactttatcctaaagcatc

SEQ ID NO: 1301366 - DNA, 22 bp, Artificial Sequence
  chemically synthesized
attcaactttatcctaaagcat

SEQ ID NO: 1301367 - DNA, 22 bp, Artificial Sequence
  chemically synthesized
taattagtatgatgctttagga

SEQ ID NO: 1301368 - DNA, 22 bp, Artificial Sequence
  chemically synthesized
tattcaactttatcctaaagca

SEQ ID NO: 1301369 - DNA, 22 bp, Artificial Sequence
  chemically synthesized
tttattcaactttatcctaaag

SEQ ID NO: 1301370 - DNA, 22 bp, Artificial Sequence
  chemically synthesized
tctttattcaactttatcctaa

SEQ ID NO: 1301371 - DNA, 22 bp, Artificial Sequence
  chemically synthesized
gtatgatgctttaggataaagt

SEQ ID NO: 1301372 - DNA, 22 bp, Artificial Sequence
  chemically synthesized
gctctctttattcaactttatc

SEQ ID NO: 1301373 - DNA, 22 bp, Artificial Sequence
  chemically synthesized
tcgctctctttattcaacttta

SEQ ID NO: 1301374 - DNA, 22 bp, Artificial Sequence
  chemically synthesized
tctcgctctctttattcaactt

SEQ ID NO: 1301375 - DNA, 22 bp, Artificial Sequence
  chemically synthesized
tctctcgctctctttattcaac

SEQ ID NO: 1301376 - DNA, 22 bp, Artificial Sequence
  chemically synthesized
taggataaagttgaataaagag

SEQ ID NO: 1301377 - DNA, 22 bp, Artificial Sequence
  chemically synthesized
aggataaagttgaataaagaga

SEQ ID NO: 1301378 - DNA, 22 bp, Artificial Sequence
  chemically synthesized
tctctctctcgctctctttatt

SEQ ID NO: 1301379 - DNA, 22 bp, Artificial Sequence
  chemically synthesized
ggataaagttgaataaagagag

SEQ ID NO: 1301380 - DNA, 22 bp, Artificial Sequence
  chemically synthesized
tgtctctctctcgctctcttta

SEQ ID NO: 1301381 - DNA, 22 bp, Artificial Sequence
  chemically synthesized
tctgtctctctctcgctctctt

SEQ ID NO: 1301382 - DNA, 22 bp, Artificial Sequence
  chemically synthesized
tctctctgtctctctctcgctc

SEQ ID NO: 1301383 - DNA, 22 bp, Artificial Sequence
  chemically synthesized
aataaagagagcgagagagaga

SEQ ID NO: 1301384 - DNA, 22 bp, Artificial Sequence
  chemically synthesized
tataaacatcagggtaaataat

SEQ ID NO: 1301385 - DNA, 22 bp, Artificial Sequence
  chemically synthesized
gcattgtataaacatcagggta

SEQ ID NO: 1301386 - DNA, 22 bp, Artificial Sequence
  chemically synthesized
ggcattgtataaacatcagggt

SEQ ID NO: 1301387 - DNA, 22 bp, Artificial Sequence
  chemically synthesized
accttggcattgtataaacatc

SEQ ID NO: 1301388 - DNA, 22 bp, Artificial Sequence
  chemically synthesized
tttaccctgatgtttatacaat

SEQ ID NO: 1301389 - DNA, 22 bp, Artificial Sequence
  chemically synthesized
attgaccttggcattgtataaa

SEQ ID NO: 1301390 - DNA, 22 bp, Artificial Sequence
  chemically synthesized
accctgatgtttatacaatgcc

SEQ ID NO: 1301391 - DNA, 22 bp, Artificial Sequence
  chemically synthesized
ccctgatgtttatacaatgcca

SEQ ID NO: 1301392 - DNA, 22 bp, Artificial Sequence
  chemically synthesized
taaattaattgaccttggcatt

SEQ ID NO: 1301393 - DNA, 22 bp, Artificial Sequence
  chemically synthesized
ataaattaattgaccttggcat

SEQ ID NO: 1301394 - DNA, 22 bp, Artificial Sequence
  chemically synthesized
atgtttatacaatgccaaggtc

SEQ ID NO: 1301395 - DNA, 22 bp, Artificial Sequence
  chemically synthesized
atttataaattaattgaccttg

SEQ ID NO: 1301396 - DNA, 22 bp, Artificial Sequence
  chemically synthesized
aatttataaattaattgacctt

SEQ ID NO: 1301397 - DNA, 22 bp, Artificial Sequence
  chemically synthesized
atacaatgccaaggtcaattaa

SEQ ID NO: 1301398 - DNA, 22 bp, Artificial Sequence
  chemically synthesized
tacaatgccaaggtcaattaat

SEQ ID NO: 1301399 - DNA, 22 bp, Artificial Sequence
  chemically synthesized
ataaacataaatttaatttata

SEQ ID NO: 1301400 - DNA, 22 bp, Artificial Sequence
  chemically synthesized
gctaataaacataaatttaatt

SEQ ID NO: 1301401 - DNA, 22 bp, Artificial Sequence
  chemically synthesized
ggctaataaacataaatttaat

SEQ ID NO: 1301402 - DNA, 22 bp, Artificial Sequence
  chemically synthesized
atttataaattaaatttatgtt

SEQ ID NO: 1301403 - DNA, 22 bp, Artificial Sequence
  chemically synthesized
aaatttggctaataaacataaa

SEQ ID NO: 1301404 - DNA, 22 bp, Artificial Sequence
  chemically synthesized
ataaattaaatttatgtttatt

SEQ ID NO: 1301405 - DNA, 22 bp, Artificial Sequence
  chemically synthesized
taaaatttggctaataaacata

SEQ ID NO: 1301406 - DNA, 22 bp, Artificial Sequence
  chemically synthesized
taaattaaatttatgtttatta

SEQ ID NO: 1301407 - DNA, 22 bp, Artificial Sequence
  chemically synthesized
ctaaaatttggctaataaacat

SEQ ID NO: 1301408 - DNA, 22 bp, Artificial Sequence
  chemically synthesized
gtttctaaaatttggctaataa

SEQ ID NO: 1301409 - DNA, 22 bp, Artificial Sequence
  chemically synthesized
tagtttctaaaatttggctaat

SEQ ID NO: 1301410 - DNA, 22 bp, Artificial Sequence
  chemically synthesized
aatttatgtttattagccaaat

SEQ ID NO: 1301411 - DNA, 22 bp, Artificial Sequence
  chemically synthesized
tctagtttctaaaatttggcta

SEQ ID NO: 1301412 - DNA, 22 bp, Artificial Sequence
  chemically synthesized
ctctagtttctaaaatttggct

SEQ ID NO: 1301413 - DNA, 22 bp, Artificial Sequence
  chemically synthesized
tctctagtttctaaaatttggc

SEQ ID NO: 1301414 - DNA, 22 bp, Artificial Sequence
  chemically synthesized
ttctctagtttctaaaatttgg

SEQ ID NO: 1301415 - DNA, 22 bp, Artificial Sequence
  chemically synthesized
atgtttattagccaaattttag

SEQ ID NO: 1301416 - DNA, 22 bp, Artificial Sequence
  chemically synthesized
tttctctagtttctaaaatttg

SEQ ID NO: 1301417 - DNA, 22 bp, Artificial Sequence
  chemically synthesized
tgtttattagccaaattttaga

SEQ ID NO: 1301418 - DNA, 22 bp, Artificial Sequence
  chemically synthesized
actttttctctagtttctaaaa

SEQ ID NO: 1301419 - DNA, 22 bp, Artificial Sequence
  chemically synthesized
attagccaaattttagaaacta

SEQ ID NO: 1301420 - DNA, 22 bp, Artificial Sequence
  chemically synthesized
ttagccaaattttagaaactag

SEQ ID NO: 1301421 - DNA, 22 bp, Artificial Sequence
  chemically synthesized
gccaaattttagaaactagaga

SEQ ID NO: 1301422 - DNA, 22 bp, Artificial Sequence
  chemically synthesized
atactcactttttctctagttt

SEQ ID NO: 1301423 - DNA, 22 bp, Artificial Sequence
  chemically synthesized
aatactcactttttctctagtt

SEQ ID NO: 1301424 - DNA, 22 bp, Artificial Sequence
  chemically synthesized
taatactcactttttctctagt

SEQ ID NO: 1301425 - DNA, 22 bp, Artificial Sequence
  chemically synthesized
ttaatactcactttttctctag

SEQ ID NO: 1301426 - DNA, 22 bp, Artificial Sequence
  chemically synthesized
tagaaactagagaaaaagtgag

SEQ ID NO: 1301427 - DNA, 22 bp, Artificial Sequence
  chemically synthesized
aagcttttaatactcacttttt

SEQ ID NO: 1301428 - DNA, 22 bp, Artificial Sequence
  chemically synthesized
agaaactagagaaaaagtgagt

SEQ ID NO: 1301429 - DNA, 22 bp, Artificial Sequence
  chemically synthesized
gaaactagagaaaaagtgagta

SEQ ID NO: 1301430 - DNA, 22 bp, Artificial Sequence
  chemically synthesized
aatcctaaagcttttaatactc

SEQ ID NO: 1301431 - DNA, 22 bp, Artificial Sequence
  chemically synthesized
aaatcctaaagcttttaatact

SEQ ID NO: 1301432 - DNA, 22 bp, Artificial Sequence
  chemically synthesized
gagaaaaagtgagtattaaaag

SEQ ID NO: 1301433 - DNA, 22 bp, Artificial Sequence
  chemically synthesized
taaatcctaaagcttttaatac

SEQ ID NO: 1301434 - DNA, 22 bp, Artificial Sequence
  chemically synthesized
aaagctttaggatttaaagttt

SEQ ID NO: 1301435 - DNA, 22 bp, Artificial Sequence
  chemically synthesized
taggatttaaagtttgatatat

SEQ ID NO: 1301436 - DNA, 22 bp, Artificial Sequence
  chemically synthesized
aggatttaaagtttgatatatt

SEQ ID NO: 1301437 - DNA, 22 bp, Artificial Sequence
  chemically synthesized
ggatttaaagtttgatatattt

SEQ ID NO: 1301438 - DNA, 22 bp, Artificial Sequence
  chemically synthesized
aaagtttgatatatttcctttg

SEQ ID NO: 1301439 - DNA, 22 bp, Artificial Sequence
  chemically synthesized
aagtttgatatatttcctttgc

SEQ ID NO: 1301440 - DNA, 22 bp, Artificial Sequence
  chemically synthesized
tgcaaggaaaatgcaaaggaaa

SEQ ID NO: 1301441 - DNA, 22 bp, Artificial Sequence
  chemically synthesized
gatatatttcctttgcattttc

SEQ ID NO: 1301442 - DNA, 22 bp, Artificial Sequence
  chemically synthesized
caattatgcaaggaaaatgcaa

SEQ ID NO: 1301443 - DNA, 22 bp, Artificial Sequence
  chemically synthesized
atatatttcctttgcattttcc

SEQ ID NO: 1301444 - DNA, 22 bp, Artificial Sequence
  chemically synthesized
cctttgcattttccttgcataa

SEQ ID NO: 1301445 - DNA, 22 bp, Artificial Sequence
  chemically synthesized
ctttgcattttccttgcataat

SEQ ID NO: 1301446 - DNA, 22 bp, Artificial Sequence
  chemically synthesized
tgcattttccttgcataattgt

SEQ ID NO: 1301447 - DNA, 22 bp, Artificial Sequence
  chemically synthesized
tgcaatgcaattacaattatgc

SEQ ID NO: 1301448 - DNA, 22 bp, Artificial Sequence
  chemically synthesized
gcattttccttgcataattgta

SEQ ID NO: 1301449 - DNA, 22 bp, Artificial Sequence
  chemically synthesized
gtgcaatgcaattacaattatg

SEQ ID NO: 1301450 - DNA, 22 bp, Artificial Sequence
  chemically synthesized
cattttccttgcataattgtaa

SEQ ID NO: 1301451 - DNA, 22 bp, Artificial Sequence
  chemically synthesized
cttgtgcaatgcaattacaatt

SEQ ID NO: 1301452 - DNA, 22 bp, Artificial Sequence
  chemically synthesized
tccttgcataattgtaattgca

SEQ ID NO: 1301453 - DNA, 22 bp, Artificial Sequence
  chemically synthesized
ccttgcataattgtaattgcat

SEQ ID NO: 1301454 - DNA, 22 bp, Artificial Sequence
  chemically synthesized
actacttgtgcaatgcaattac

SEQ ID NO: 1301455 - DNA, 22 bp, Artificial Sequence
  chemically synthesized
cttgcataattgtaattgcatt

SEQ ID NO: 1301456 - DNA, 22 bp, Artificial Sequence
  chemically synthesized
gcataattgtaattgcattgca

SEQ ID NO: 1301457 - DNA, 22 bp, Artificial Sequence
  chemically synthesized
cataattgtaattgcattgcac

SEQ ID NO: 1301458 - DNA, 22 bp, Artificial Sequence
  chemically synthesized
taattgcattgcacaagtagtt

SEQ ID NO: 1301459 - DNA, 22 bp, Artificial Sequence
  chemically synthesized
cattgcacaagtagttagacac

SEQ ID NO: 1301460 - DNA, 22 bp, Artificial Sequence
  chemically synthesized
aatgaagaaagtaaggtgtcta

SEQ ID NO: 1301461 - DNA, 22 bp, Artificial Sequence
  chemically synthesized
aaatgaagaaagtaaggtgtct

SEQ ID NO: 1301462 - DNA, 22 bp, Artificial Sequence
  chemically synthesized
cacaagtagttagacaccttac

SEQ ID NO: 1301463 - DNA, 22 bp, Artificial Sequence
  chemically synthesized
taaatgaagaaagtaaggtgtc

SEQ ID NO: 1301464 - DNA, 22 bp, Artificial Sequence
  chemically synthesized
ttttaaatgaagaaagtaaggt

SEQ ID NO: 1301465 - DNA, 22 bp, Artificial Sequence
  chemically synthesized
ttattttaaatgaagaaagtaa

SEQ ID NO: 1301466 - DNA, 22 bp, Artificial Sequence
  chemically synthesized
gacaccttactttcttcattta

SEQ ID NO: 1301467 - DNA, 22 bp, Artificial Sequence
  chemically synthesized
gaaaacctgttattttaaatga

SEQ ID NO: 1301468 - DNA, 22 bp, Artificial Sequence
  chemically synthesized
actttcttcatttaaaataaca

SEQ ID NO: 1301469 - DNA, 22 bp, Artificial Sequence
  chemically synthesized
ctttcttcatttaaaataacag

SEQ ID NO: 1301470 - DNA, 22 bp, Artificial Sequence
  chemically synthesized
tcttcatttaaaataacaggtt

SEQ ID NO: 1301471 - DNA, 22 bp, Artificial Sequence
  chemically synthesized
cttcatttaaaataacaggttt

SEQ ID NO: 1301472 - DNA, 22 bp, Artificial Sequence
  chemically synthesized
aacaacattggaaaacctgtta

SEQ ID NO: 1301473 - DNA, 22 bp, Artificial Sequence
  chemically synthesized
ttcatttaaaataacaggtttt

SEQ ID NO: 1301474 - DNA, 22 bp, Artificial Sequence
  chemically synthesized
gaacaacattggaaaacctgtt

SEQ ID NO: 1301475 - DNA, 22 bp, Artificial Sequence
  chemically synthesized
catttaaaataacaggttttcc

SEQ ID NO: 1301476 - DNA, 22 bp, Artificial Sequence
  chemically synthesized
atttaaaataacaggttttcca

SEQ ID NO: 1301477 - DNA, 22 bp, Artificial Sequence
  chemically synthesized
tgtttgaacaacattggaaaac

SEQ ID NO: 1301478 - DNA, 22 bp, Artificial Sequence
  chemically synthesized
aaaataacaggttttccaatgt

SEQ ID NO: 1301479 - DNA, 22 bp, Artificial Sequence
  chemically synthesized
aaataacaggttttccaatgtt

SEQ ID NO: 1301480 - DNA, 22 bp, Artificial Sequence
  chemically synthesized
aattgtgtttgaacaacattgg

SEQ ID NO: 1301481 - DNA, 22 bp, Artificial Sequence
  chemically synthesized
aaattgtgtttgaacaacattg

SEQ ID NO: 1301482 - DNA, 22 bp, Artificial Sequence
  chemically synthesized
gatatttaaattgtgtttgaac

SEQ ID NO: 1301483 - DNA, 22 bp, Artificial Sequence
  chemically synthesized
tagatatttaaattgtgtttga

SEQ ID NO: 1301484 - DNA, 22 bp, Artificial Sequence
  chemically synthesized
tccaatgttgttcaaacacaat

SEQ ID NO: 1301485 - DNA, 22 bp, Artificial Sequence
  chemically synthesized
ctagatatttaaattgtgtttg

SEQ ID NO: 1301486 - DNA, 22 bp, Artificial Sequence
  chemically synthesized
ccaatgttgttcaaacacaatt

SEQ ID NO: 1301487 - DNA, 22 bp, Artificial Sequence
  chemically synthesized
caatgttgttcaaacacaattt

SEQ ID NO: 1301488 - DNA, 22 bp, Artificial Sequence
  chemically synthesized
ttcaaacacaatttaaatatct

SEQ ID NO: 1301489 - DNA, 22 bp, Artificial Sequence
  chemically synthesized
aaacacaatttaaatatctaga

SEQ ID NO: 1301490 - DNA, 22 bp, Artificial Sequence
  chemically synthesized
tgggaacaaagaagacaatgct

SEQ ID NO: 1301491 - DNA, 22 bp, Artificial Sequence
  chemically synthesized
aaatatctagaagcattgtctt

SEQ ID NO: 1301492 - DNA, 22 bp, Artificial Sequence
  chemically synthesized
atgggaacaaagaagacaatgc

SEQ ID NO: 1301493 - DNA, 22 bp, Artificial Sequence
  chemically synthesized
aatatctagaagcattgtcttc

SEQ ID NO: 1301494 - DNA, 22 bp, Artificial Sequence
  chemically synthesized
tatgggaacaaagaagacaatg

SEQ ID NO: 1301495 - DNA, 22 bp, Artificial Sequence
  chemically synthesized
ttatgggaacaaagaagacaat

SEQ ID NO: 1301496 - DNA, 22 bp, Artificial Sequence
  chemically synthesized
gaagcattgtcttctttgttcc

SEQ ID NO: 1301497 - DNA, 22 bp, Artificial Sequence
  chemically synthesized
tcttctttgttcccataaaaat

SEQ ID NO: 1301498 - DNA, 22 bp, Artificial Sequence
  chemically synthesized
ctttgttcccataaaaattacc

SEQ ID NO: 1301499 - DNA, 22 bp, Artificial Sequence
  chemically synthesized
tttgttcccataaaaattaccg

SEQ ID NO: 1301500 - DNA, 22 bp, Artificial Sequence
  chemically synthesized
tgttcccataaaaattaccgtt

SEQ ID NO: 1301501 - DNA, 22 bp, Artificial Sequence
  chemically synthesized
gttcccataaaaattaccgttc

SEQ ID NO: 1301502 - DNA, 22 bp, Artificial Sequence
  chemically synthesized
caaaaaaaagcagaacggtaat

SEQ ID NO: 1301503 - DNA, 22 bp, Artificial Sequence
  chemically synthesized
ttcccataaaaattaccgttct

SEQ ID NO: 1301504 - DNA, 22 bp, Artificial Sequence
  chemically synthesized
ccataaaaattaccgttctgct

SEQ ID NO: 1301505 - DNA, 22 bp, Artificial Sequence
  chemically synthesized
aaggttccaaaaaaaagcagaa

SEQ ID NO: 1301506 - DNA, 22 bp, Artificial Sequence
  chemically synthesized
caaggttccaaaaaaaagcaga

SEQ ID NO: 1301507 - DNA, 22 bp, Artificial Sequence
  chemically synthesized
tcaaggttccaaaaaaaagcag

SEQ ID NO: 1301508 - DNA, 22 bp, Artificial Sequence
  chemically synthesized
ttcaaggttccaaaaaaaagca

SEQ ID NO: 1301509 - DNA, 22 bp, Artificial Sequence
  chemically synthesized
ccgttctgcttttttttggaac

SEQ ID NO: 1301510 - DNA, 22 bp, Artificial Sequence
  chemically synthesized
tgagaccatttttcaaggttcc

SEQ ID NO: 1301511 - DNA, 22 bp, Artificial Sequence
  chemically synthesized
tgcttttttttggaaccttgaa

SEQ ID NO: 1301512 - DNA, 22 bp, Artificial Sequence
  chemically synthesized
cttttttttggaaccttgaaaa

SEQ ID NO: 1301513 - DNA, 22 bp, Artificial Sequence
  chemically synthesized
ttttttggaaccttgaaaaatg

SEQ ID NO: 1301514 - DNA, 22 bp, Artificial Sequence
  chemically synthesized
tttttggaaccttgaaaaatgg

SEQ ID NO: 1301515 - DNA, 22 bp, Artificial Sequence
  chemically synthesized
ttttggaaccttgaaaaatggt

SEQ ID NO: 1301516 - DNA, 22 bp, Artificial Sequence
  chemically synthesized
tttggaaccttgaaaaatggtc

SEQ ID NO: 1301517 - DNA, 22 bp, Artificial Sequence
  chemically synthesized
ttggaaccttgaaaaatggtct

SEQ ID NO: 1301518 - DNA, 22 bp, Artificial Sequence
  chemically synthesized
tggaaccttgaaaaatggtctc

SEQ ID NO: 1301519 - DNA, 22 bp, Artificial Sequence
  chemically synthesized
ggaaccttgaaaaatggtctca

SEQ ID NO: 1301520 - DNA, 22 bp, Artificial Sequence
  chemically synthesized
gaaccttgaaaaatggtctcat

SEQ ID NO: 1301521 - DNA, 22 bp, Artificial Sequence
  chemically synthesized
atagcaaaaattatgagaccat

SEQ ID NO: 1301522 - DNA, 22 bp, Artificial Sequence
  chemically synthesized
aatagcaaaaattatgagacca

SEQ ID NO: 1301523 - DNA, 22 bp, Artificial Sequence
  chemically synthesized
taatagcaaaaattatgagacc

SEQ ID NO: 1301524 - DNA, 22 bp, Artificial Sequence
  chemically synthesized
ttttaatagcaaaaattatgag

SEQ ID NO: 1301525 - DNA, 22 bp, Artificial Sequence
  chemically synthesized
gaaaaatggtctcataattttt

SEQ ID NO: 1301526 - DNA, 22 bp, Artificial Sequence
  chemically synthesized
aaaaatggtctcataatttttg

SEQ ID NO: 1301527 - DNA, 22 bp, Artificial Sequence
  chemically synthesized
caagactattttaatagcaaaa

SEQ ID NO: 1301528 - DNA, 22 bp, Artificial Sequence
  chemically synthesized
ataatttttgctattaaaatag

SEQ ID NO: 1301529 - DNA, 22 bp, Artificial Sequence
  chemically synthesized
atagtaattgcaagactatttt

SEQ ID NO: 1301530 - DNA, 22 bp, Artificial Sequence
  chemically synthesized
ttgctattaaaatagtcttgca

SEQ ID NO: 1301531 - DNA, 22 bp, Artificial Sequence
  chemically synthesized
tgctattaaaatagtcttgcaa

SEQ ID NO: 1301532 - DNA, 22 bp, Artificial Sequence
  chemically synthesized
tattgatagtaattgcaagact

SEQ ID NO: 1301533 - DNA, 22 bp, Artificial Sequence
  chemically synthesized
gctattaaaatagtcttgcaat

SEQ ID NO: 1301534 - DNA, 22 bp, Artificial Sequence
  chemically synthesized
ctattaaaatagtcttgcaatt

SEQ ID NO: 1301535 - DNA, 22 bp, Artificial Sequence
  chemically synthesized
tctatattgatagtaattgcaa

SEQ ID NO: 1301536 - DNA, 22 bp, Artificial Sequence
  chemically synthesized
ttaaaatagtcttgcaattact

SEQ ID NO: 1301537 - DNA, 22 bp, Artificial Sequence
  chemically synthesized
atctatattgatagtaattgca

SEQ ID NO: 1301538 - DNA, 22 bp, Artificial Sequence
  chemically synthesized
tatctatattgatagtaattgc

SEQ ID NO: 1301539 - DNA, 22 bp, Artificial Sequence
  chemically synthesized
aaatagtcttgcaattactatc

SEQ ID NO: 1301540 - DNA, 22 bp, Artificial Sequence
  chemically synthesized
ggtggaggctttatctatattg

SEQ ID NO: 1301541 - DNA, 22 bp, Artificial Sequence
  chemically synthesized
gcaattactatcaatatagata

SEQ ID NO: 1301542 - DNA, 22 bp, Artificial Sequence
  chemically synthesized
gggtggaggctttatctatatt

SEQ ID NO: 1301543 - DNA, 22 bp, Artificial Sequence
  chemically synthesized
caattactatcaatatagataa

SEQ ID NO: 1301544 - DNA, 22 bp, Artificial Sequence
  chemically synthesized
ctatcaatatagataaagcctc

SEQ ID NO: 1301545 - DNA, 22 bp, Artificial Sequence
  chemically synthesized
tcaatatagataaagcctccac

SEQ ID NO: 1301546 - DNA, 22 bp, Artificial Sequence
  chemically synthesized
aggtaataatcccacatttggg

SEQ ID NO: 1301547 - DNA, 22 bp, Artificial Sequence
  chemically synthesized
taaggtaataatcccacatttg

SEQ ID NO: 1301548 - DNA, 22 bp, Artificial Sequence
  chemically synthesized
ctaaggtaataatcccacattt

SEQ ID NO: 1301549 - DNA, 22 bp, Artificial Sequence
  chemically synthesized
tctaaggtaataatcccacatt

SEQ ID NO: 1301550 - DNA, 22 bp, Artificial Sequence
  chemically synthesized
ttctaaggtaataatcccacat

SEQ ID NO: 1301551 - DNA, 22 bp, Artificial Sequence
  chemically synthesized
ttttctaaggtaataatcccac

SEQ ID NO: 1301552 - DNA, 22 bp, Artificial Sequence
  chemically synthesized
cacccaaatgtgggattattac

SEQ ID NO: 1301553 - DNA, 22 bp, Artificial Sequence
  chemically synthesized
agactcttttctaaggtaataa

SEQ ID NO: 1301554 - DNA, 22 bp, Artificial Sequence
  chemically synthesized
gagactcttttctaaggtaata

SEQ ID NO: 1301555 - DNA, 22 bp, Artificial Sequence
  chemically synthesized
tgagactcttttctaaggtaat

SEQ ID NO: 1301556 - DNA, 22 bp, Artificial Sequence
  chemically synthesized
ttgagactcttttctaaggtaa

SEQ ID NO: 1301557 - DNA, 22 bp, Artificial Sequence
  chemically synthesized
taatttttgagactcttttcta

SEQ ID NO: 1301558 - DNA, 22 bp, Artificial Sequence
  chemically synthesized
ttaccttagaaaagagtctcaa

SEQ ID NO: 1301559 - DNA, 22 bp, Artificial Sequence
  chemically synthesized
ccttagaaaagagtctcaaaaa

SEQ ID NO: 1301560 - DNA, 22 bp, Artificial Sequence
  chemically synthesized
aatccattataatttttgagac

SEQ ID NO: 1301561 - DNA, 22 bp, Artificial Sequence
  chemically synthesized
agaaaagagtctcaaaaattat

SEQ ID NO: 1301562 - DNA, 22 bp, Artificial Sequence
  chemically synthesized
gaaaagagtctcaaaaattata

SEQ ID NO: 1301563 - DNA, 22 bp, Artificial Sequence
  chemically synthesized
acctaaatccattataattttt

SEQ ID NO: 1301564 - DNA, 22 bp, Artificial Sequence
  chemically synthesized
cacctaaatccattataatttt

SEQ ID NO: 1301565 - DNA, 22 bp, Artificial Sequence
  chemically synthesized
tcacctaaatccattataattt

SEQ ID NO: 1301566 - DNA, 22 bp, Artificial Sequence
  chemically synthesized
ttcacctaaatccattataatt

SEQ ID NO: 1301567 - DNA, 22 bp, Artificial Sequence
  chemically synthesized
aaaaattataatggatttaggt

SEQ ID NO: 1301568 - DNA, 22 bp, Artificial Sequence
  chemically synthesized
cggagatgatttttcacctaaa

SEQ ID NO: 1301569 - DNA, 22 bp, Artificial Sequence
  chemically synthesized
acggagatgatttttcacctaa

SEQ ID NO: 1301570 - DNA, 22 bp, Artificial Sequence
  chemically synthesized
taatggatttaggtgaaaaatc

SEQ ID NO: 1301571 - DNA, 22 bp, Artificial Sequence
  chemically synthesized
aggtgaaaaatcatctccgtaa

SEQ ID NO: 1301572 - DNA, 22 bp, Artificial Sequence
  chemically synthesized
ggtgaaaaatcatctccgtaag

SEQ ID NO: 1301573 - DNA, 22 bp, Artificial Sequence
  chemically synthesized
aaaatatgtaccaaaacttacg

SEQ ID NO: 1301574 - DNA, 22 bp, Artificial Sequence
  chemically synthesized
gaaaatatgtaccaaaacttac

SEQ ID NO: 1301575 - DNA, 22 bp, Artificial Sequence
  chemically synthesized
cgtaagttttggtacatatttt

SEQ ID NO: 1301576 - DNA, 22 bp, Artificial Sequence
  chemically synthesized
agaagtaatttgaaaatatgta

SEQ ID NO: 1301577 - DNA, 22 bp, Artificial Sequence
  chemically synthesized
gagaagtaatttgaaaatatgt

SEQ ID NO: 1301578 - DNA, 22 bp, Artificial Sequence
  chemically synthesized
tgagaagtaatttgaaaatatg

SEQ ID NO: 1301579 - DNA, 22 bp, Artificial Sequence
  chemically synthesized
ttgagaagtaatttgaaaatat

SEQ ID NO: 1301580 - DNA, 22 bp, Artificial Sequence
  chemically synthesized
tggtacatattttcaaattact

SEQ ID NO: 1301581 - DNA, 22 bp, Artificial Sequence
  chemically synthesized
ggtacatattttcaaattactt

SEQ ID NO: 1301582 - DNA, 22 bp, Artificial Sequence
  chemically synthesized
gtacatattttcaaattacttc

SEQ ID NO: 1301583 - DNA, 22 bp, Artificial Sequence
  chemically synthesized
atatggaatttttgagaagtaa

SEQ ID NO: 1301584 - DNA, 22 bp, Artificial Sequence
  chemically synthesized
aatatggaatttttgagaagta

SEQ ID NO: 1301585 - DNA, 22 bp, Artificial Sequence
  chemically synthesized
tcaaattacttctcaaaaattc

SEQ ID NO: 1301586 - DNA, 22 bp, Artificial Sequence
  chemically synthesized
caaattacttctcaaaaattcc

SEQ ID NO: 1301587 - DNA, 22 bp, Artificial Sequence
  chemically synthesized
aaattacttctcaaaaattcca

SEQ ID NO: 1301588 - DNA, 22 bp, Artificial Sequence
  chemically synthesized
cttctcaaaaattccatattaa

SEQ ID NO: 1301589 - DNA, 22 bp, Artificial Sequence
  chemically synthesized
ctcaaaaattccatattaaacc

SEQ ID NO: 1301590 - DNA, 22 bp, Artificial Sequence
  chemically synthesized
tcaaaaattccatattaaacca

SEQ ID NO: 1301591 - DNA, 22 bp, Artificial Sequence
  chemically synthesized
caggtaggaatgtggtttaata

SEQ ID NO: 1301592 - DNA, 22 bp, Artificial Sequence
  chemically synthesized
aaaaattccatattaaaccaca

SEQ ID NO: 1301593 - DNA, 22 bp, Artificial Sequence
  chemically synthesized
atccattacaggtaggaatgtg

SEQ ID NO: 1301594 - DNA, 22 bp, Artificial Sequence
  chemically synthesized
catccattacaggtaggaatgt

SEQ ID NO: 1301595 - DNA, 22 bp, Artificial Sequence
  chemically synthesized
catattaaaccacattcctacc

SEQ ID NO: 1301596 - DNA, 22 bp, Artificial Sequence
  chemically synthesized
tcatccattacaggtaggaatg

SEQ ID NO: 1301597 - DNA, 22 bp, Artificial Sequence
  chemically synthesized
ttcatccattacaggtaggaat

SEQ ID NO: 1301598 - DNA, 22 bp, Artificial Sequence
  chemically synthesized
aaccacattcctacctgtaatg

SEQ ID NO: 1301599 - DNA, 22 bp, Artificial Sequence
  chemically synthesized
tagaccttttcatccattacag

SEQ ID NO: 1301600 - DNA, 22 bp, Artificial Sequence
  chemically synthesized
ctacctgtaatggatgaaaagg

SEQ ID NO: 1301601 - DNA, 22 bp, Artificial Sequence
  chemically synthesized
cctgtaatggatgaaaaggtct

SEQ ID NO: 1301602 - DNA, 22 bp, Artificial Sequence
  chemically synthesized
caatgcaacgttatagaccttt

SEQ ID NO: 1301603 - DNA, 22 bp, Artificial Sequence
  chemically synthesized
taatggatgaaaaggtctataa

SEQ ID NO: 1301604 - DNA, 22 bp, Artificial Sequence
  chemically synthesized
aatgtaggttacaatgcaacgt

SEQ ID NO: 1301605 - DNA, 22 bp, Artificial Sequence
  chemically synthesized
atgtattcaatgtaggttacaa

SEQ ID NO: 1301606 - DNA, 22 bp, Artificial Sequence
  chemically synthesized
aatgtattcaatgtaggttaca

SEQ ID NO: 1301607 - DNA, 22 bp, Artificial Sequence
  chemically synthesized
taacgttgcattgtaacctaca

SEQ ID NO: 1301608 - DNA, 22 bp, Artificial Sequence
  chemically synthesized
tttaatgtattcaatgtaggtt

SEQ ID NO: 1301609 - DNA, 22 bp, Artificial Sequence
  chemically synthesized
tatttaatgtattcaatgtagg

SEQ ID NO: 1301610 - DNA, 22 bp, Artificial Sequence
  chemically synthesized
ctatttaatgtattcaatgtag

SEQ ID NO: 1301611 - DNA, 22 bp, Artificial Sequence
  chemically synthesized
cattgtaacctacattgaatac

SEQ ID NO: 1301612 - DNA, 22 bp, Artificial Sequence
  chemically synthesized
catttctatttaatgtattcaa

SEQ ID NO: 1301613 - DNA, 22 bp, Artificial Sequence
  chemically synthesized
taacctacattgaatacattaa

SEQ ID NO: 1301614 - DNA, 22 bp, Artificial Sequence
  chemically synthesized
cattgaatacattaaatagaaa

SEQ ID NO: 1301615 - DNA, 22 bp, Artificial Sequence
  chemically synthesized
catatgaattacatttctattt

SEQ ID NO: 1301616 - DNA, 22 bp, Artificial Sequence
  chemically synthesized
aatacattaaatagaaatgtaa

SEQ ID NO: 1301617 - DNA, 22 bp, Artificial Sequence
  chemically synthesized
aattacatatgaattacatttc

SEQ ID NO: 1301618 - DNA, 22 bp, Artificial Sequence
  chemically synthesized
cattgaattacatatgaattac

SEQ ID NO: 1301619 - DNA, 22 bp, Artificial Sequence
  chemically synthesized
aatagaaatgtaattcatatgt

SEQ ID NO: 1301620 - DNA, 22 bp, Artificial Sequence
  chemically synthesized
atatgtaattcaatgtaattca

SEQ ID NO: 1301621 - DNA, 22 bp, Artificial Sequence
  chemically synthesized
aatgtaattcacatatatgtct

SEQ ID NO: 1301622 - DNA, 22 bp, Artificial Sequence
  chemically synthesized
gatagacatacacagacatata

SEQ ID NO: 1301623 - DNA, 22 bp, Artificial Sequence
  chemically synthesized
agatagacatacacagacatat

SEQ ID NO: 1301624 - DNA, 22 bp, Artificial Sequence
  chemically synthesized
atgtttagatagacatacacag

SEQ ID NO: 1301625 - DNA, 22 bp, Artificial Sequence
  chemically synthesized
acatatatgtctgtgtatgtct

SEQ ID NO: 1301626 - DNA, 22 bp, Artificial Sequence
  chemically synthesized
tgtatgtctatctaaacatgaa

SEQ ID NO: 1301627 - DNA, 22 bp, Artificial Sequence
  chemically synthesized
tctaaacatgaatgcatgtgtg

SEQ ID NO: 1301628 - DNA, 22 bp, Artificial Sequence
  chemically synthesized
aacatgaatgcatgtgtgtgta

SEQ ID NO: 1301629 - DNA, 22 bp, Artificial Sequence
  chemically synthesized
aatacatacgtatgtatgtgta

SEQ ID NO: 1301630 - DNA, 22 bp, Artificial Sequence
  chemically synthesized
aaatacatacgtatgtatgtgt

SEQ ID NO: 1301631 - DNA, 22 bp, Artificial Sequence
  chemically synthesized
taaatacatacgtatgtatgtg

SEQ ID NO: 1301632 - DNA, 22 bp, Artificial Sequence
  chemically synthesized
tttaaatacatacgtatgtatg

SEQ ID NO: 1301633 - DNA, 22 bp, Artificial Sequence
  chemically synthesized
aattctttaaatacatacgtat

SEQ ID NO: 1301634 - DNA, 22 bp, Artificial Sequence
  chemically synthesized
agacccaagtctaaattcttta

SEQ ID NO: 1301635 - DNA, 22 bp, Artificial Sequence
  chemically synthesized
taagacccaagtctaaattctt

SEQ ID NO: 1301636 - DNA, 22 bp, Artificial Sequence
  chemically synthesized
attctaagacccaagtctaaat

SEQ ID NO: 1301637 - DNA, 22 bp, Artificial Sequence
  chemically synthesized
aaagaatttagacttgggtctt

SEQ ID NO: 1301638 - DNA, 22 bp, Artificial Sequence
  chemically synthesized
aagaatttagacttgggtctta

SEQ ID NO: 1301639 - DNA, 22 bp, Artificial Sequence
  chemically synthesized
agggagagcctgattctaagac

SEQ ID NO: 1301640 - DNA, 22 bp, Artificial Sequence
  chemically synthesized
agacttgggtcttagaatcagg

SEQ ID NO: 1301641 - DNA, 22 bp, Artificial Sequence
  chemically synthesized
gacttgggtcttagaatcaggc

SEQ ID NO: 1301642 - DNA, 22 bp, Artificial Sequence
  chemically synthesized
aaggattcagggagagcctgat

SEQ ID NO: 1301643 - DNA, 22 bp, Artificial Sequence
  chemically synthesized
gggtcttagaatcaggctctcc

SEQ ID NO: 1301644 - DNA, 22 bp, Artificial Sequence
  chemically synthesized
ggtcttagaatcaggctctccc

SEQ ID NO: 1301645 - DNA, 22 bp, Artificial Sequence
  chemically synthesized
gcagttgaaggattcagggaga

SEQ ID NO: 1301646 - DNA, 22 bp, Artificial Sequence
  chemically synthesized
agaatcaggctctccctgaatc

SEQ ID NO: 1301647 - DNA, 22 bp, Artificial Sequence
  chemically synthesized
gaatcaggctctccctgaatcc

SEQ ID NO: 1301648 - DNA, 22 bp, Artificial Sequence
  chemically synthesized
tatctcgcagttgaaggattca

SEQ ID NO: 1301649 - DNA, 22 bp, Artificial Sequence
  chemically synthesized
atatctcgcagttgaaggattc

SEQ ID NO: 1301650 - DNA, 22 bp, Artificial Sequence
  chemically synthesized
tatttatatctcgcagttgaag

SEQ ID NO: 1301651 - DNA, 22 bp, Artificial Sequence
  chemically synthesized
atatttatatctcgcagttgaa

SEQ ID NO: 1301652 - DNA, 22 bp, Artificial Sequence
  chemically synthesized
tccctgaatccttcaactgcga

SEQ ID NO: 1301653 - DNA, 22 bp, Artificial Sequence
  chemically synthesized
cctgaatccttcaactgcgaga

SEQ ID NO: 1301654 - DNA, 22 bp, Artificial Sequence
  chemically synthesized
ccttatatttatatctcgcagt

SEQ ID NO: 1301655 - DNA, 22 bp, Artificial Sequence
  chemically synthesized
aatccttcaactgcgagatata

SEQ ID NO: 1301656 - DNA, 22 bp, Artificial Sequence
  chemically synthesized
ccaacattcccttatatttata

SEQ ID NO: 1301657 - DNA, 22 bp, Artificial Sequence
  chemically synthesized
caactgcgagatataaatataa

SEQ ID NO: 1301658 - DNA, 22 bp, Artificial Sequence
  chemically synthesized
aactgcgagatataaatataag

SEQ ID NO: 1301659 - DNA, 22 bp, Artificial Sequence
  chemically synthesized
cgagatataaatataagggaat

SEQ ID NO: 1301660 - DNA, 22 bp, Artificial Sequence
  chemically synthesized
atgtagcagaccatgattgcca

SEQ ID NO: 1301661 - DNA, 22 bp, Artificial Sequence
  chemically synthesized
ctcatgtagcagaccatgattg

SEQ ID NO: 1301662 - DNA, 22 bp, Artificial Sequence
  chemically synthesized
ttcctcatgtagcagaccatga

SEQ ID NO: 1301663 - DNA, 22 bp, Artificial Sequence
  chemically synthesized
cgctgttcctcatgtagcagac

SEQ ID NO: 1301664 - DNA, 22 bp, Artificial Sequence
  chemically synthesized
ccgctgttcctcatgtagcaga

SEQ ID NO: 1301665 - DNA, 22 bp, Artificial Sequence
  chemically synthesized
gcaatcatggtctgctacatga

SEQ ID NO: 1301666 - DNA, 22 bp, Artificial Sequence
  chemically synthesized
gcttccgctgttcctcatgtag

SEQ ID NO: 1301667 - DNA, 22 bp, Artificial Sequence
  chemically synthesized
cagattggcttccgctgttcct

SEQ ID NO: 1301668 - DNA, 22 bp, Artificial Sequence
  chemically synthesized
ttgcagattggcttccgctgtt

SEQ ID NO: 1301669 - DNA, 22 bp, Artificial Sequence
  chemically synthesized
attgcagattggcttccgctgt

SEQ ID NO: 1301670 - DNA, 22 bp, Artificial Sequence
  chemically synthesized
ctacatgaggaacagcggaagc

SEQ ID NO: 1301671 - DNA, 22 bp, Artificial Sequence
  chemically synthesized
tattgcagattggcttccgctg

SEQ ID NO: 1301672 - DNA, 22 bp, Artificial Sequence
  chemically synthesized
ttattgcagattggcttccgct

SEQ ID NO: 1301673 - DNA, 22 bp, Artificial Sequence
  chemically synthesized
tttattgcagattggcttccgc

SEQ ID NO: 1301674 - DNA, 22 bp, Artificial Sequence
  chemically synthesized
catgaggaacagcggaagccaa

SEQ ID NO: 1301675 - DNA, 22 bp, Artificial Sequence
  chemically synthesized
ttttattgcagattggcttccg

SEQ ID NO: 1301676 - DNA, 22 bp, Artificial Sequence
  chemically synthesized
tcttttttattgcagattggct

SEQ ID NO: 1301677 - DNA, 22 bp, Artificial Sequence
  chemically synthesized
aactatcttttttattgcagat

SEQ ID NO: 1301678 - DNA, 22 bp, Artificial Sequence
  chemically synthesized
taaactatcttttttattgcag

SEQ ID NO: 1301679 - DNA, 22 bp, Artificial Sequence
  chemically synthesized
tctaaactatcttttttattgc

SEQ ID NO: 1301680 - DNA, 22 bp, Artificial Sequence
  chemically synthesized
tctctaaactatcttttttatt

SEQ ID NO: 1301681 - DNA, 22 bp, Artificial Sequence
  chemically synthesized
ctctctaaactatcttttttat

SEQ ID NO: 1301682 - DNA, 22 bp, Artificial Sequence
  chemically synthesized
cttctctctaaactatcttttt

SEQ ID NO: 1301683 - DNA, 22 bp, Artificial Sequence
  chemically synthesized
caataaaaaagatagtttagag

SEQ ID NO: 1301684 - DNA, 22 bp, Artificial Sequence
  chemically synthesized
tcacatctccttctctctaaac

SEQ ID NO: 1301685 - DNA, 22 bp, Artificial Sequence
  chemically synthesized
tgtcacatctccttctctctaa

SEQ ID NO: 1301686 - DNA, 22 bp, Artificial Sequence
  chemically synthesized
tctgtcacatctccttctctct

SEQ ID NO: 1301687 - DNA, 22 bp, Artificial Sequence
  chemically synthesized
caggactctctgtcacatctcc

SEQ ID NO: 1301688 - DNA, 22 bp, Artificial Sequence
  chemically synthesized
ccaggactctctgtcacatctc

SEQ ID NO: 1301689 - DNA, 22 bp, Artificial Sequence
  chemically synthesized
agagagaaggagatgtgacaga

SEQ ID NO: 1301690 - DNA, 22 bp, Artificial Sequence
  chemically synthesized
gagagaaggagatgtgacagag

SEQ ID NO: 1301691 - DNA, 22 bp, Artificial Sequence
  chemically synthesized
agaaaatgcaatcaaaaccttc

SEQ ID NO: 1301692 - DNA, 22 bp, Artificial Sequence
  chemically synthesized
cagtacacctcagaaaatgcaa

SEQ ID NO: 1301693 - DNA, 22 bp, Artificial Sequence
  chemically synthesized
gaaggttttgattgcattttct

SEQ ID NO: 1301694 - DNA, 22 bp, Artificial Sequence
  chemically synthesized
tgattgcattttctgaggtgta

SEQ ID NO: 1301695 - DNA, 22 bp, Artificial Sequence
  chemically synthesized
gattgcattttctgaggtgtac

SEQ ID NO: 1301696 - DNA, 22 bp, Artificial Sequence
  chemically synthesized
gggcaaattgcagtacacctca

SEQ ID NO: 1301697 - DNA, 22 bp, Artificial Sequence
  chemically synthesized
attgcattttctgaggtgtact

SEQ ID NO: 1301698 - DNA, 22 bp, Artificial Sequence
  chemically synthesized
cattttctgaggtgtactgcaa

SEQ ID NO: 1301699 - DNA, 22 bp, Artificial Sequence
  chemically synthesized
tctgaggtgtactgcaatttgc

SEQ ID NO: 1301700 - DNA, 22 bp, Artificial Sequence
  chemically synthesized
ctgaggtgtactgcaatttgcc

SEQ ID NO: 1301701 - DNA, 22 bp, Artificial Sequence
  chemically synthesized
aaggcaggttagggcaaattgc

SEQ ID NO: 1301702 - DNA, 22 bp, Artificial Sequence
  chemically synthesized
tgaggtgtactgcaatttgccc

SEQ ID NO: 1301703 - DNA, 22 bp, Artificial Sequence
  chemically synthesized
tcaaggcaggttagggcaaatt

SEQ ID NO: 1301704 - DNA, 22 bp, Artificial Sequence
  chemically synthesized
aggtgtactgcaatttgcccta

SEQ ID NO: 1301705 - DNA, 22 bp, Artificial Sequence
  chemically synthesized
ctcaaggcaggttagggcaaat

SEQ ID NO: 1301706 - DNA, 22 bp, Artificial Sequence
  chemically synthesized
aaatgtttctcaaggcaggtta

SEQ ID NO: 1301707 - DNA, 22 bp, Artificial Sequence
  chemically synthesized
caatttgccctaacctgccttg

SEQ ID NO: 1301708 - DNA, 22 bp, Artificial Sequence
  chemically synthesized
aggattaaaatgtttctcaagg

SEQ ID NO: 1301709 - DNA, 22 bp, Artificial Sequence
  chemically synthesized
gccctaacctgccttgagaaac

SEQ ID NO: 1301710 - DNA, 22 bp, Artificial Sequence
  chemically synthesized
ccctaacctgccttgagaaaca

SEQ ID NO: 1301711 - DNA, 22 bp, Artificial Sequence
  chemically synthesized
taaggattaaaatgtttctcaa

SEQ ID NO: 1301712 - DNA, 22 bp, Artificial Sequence
  chemically synthesized
ttctaaggattaaaatgtttct

SEQ ID NO: 1301713 - DNA, 22 bp, Artificial Sequence
  chemically synthesized
attctaaggattaaaatgtttc

SEQ ID NO: 1301714 - DNA, 22 bp, Artificial Sequence
  chemically synthesized
acctgccttgagaaacatttta

SEQ ID NO: 1301715 - DNA, 22 bp, Artificial Sequence
  chemically synthesized
ccttgagaaacattttaatcct

SEQ ID NO: 1301716 - DNA, 22 bp, Artificial Sequence
  chemically synthesized
gagaaacattttaatccttaga

SEQ ID NO: 1301717 - DNA, 22 bp, Artificial Sequence
  chemically synthesized
agaaacattttaatccttagaa

SEQ ID NO: 1301718 - DNA, 22 bp, Artificial Sequence
  chemically synthesized
caaaggatacgtttattctaag

SEQ ID NO: 1301719 - DNA, 22 bp, Artificial Sequence
  chemically synthesized
ttccaaaggatacgtttattct

SEQ ID NO: 1301720 - DNA, 22 bp, Artificial Sequence
  chemically synthesized
attccaaaggatacgtttattc

SEQ ID NO: 1301721 - DNA, 22 bp, Artificial Sequence
  chemically synthesized
taatccttagaataaacgtatc

SEQ ID NO: 1301722 - DNA, 22 bp, Artificial Sequence
  chemically synthesized
aatccttagaataaacgtatcc

SEQ ID NO: 1301723 - DNA, 22 bp, Artificial Sequence
  chemically synthesized
atccttagaataaacgtatcct

SEQ ID NO: 1301724 - DNA, 22 bp, Artificial Sequence
  chemically synthesized
agaataaacgtatcctttggaa

SEQ ID NO: 1301725 - DNA, 22 bp, Artificial Sequence
  chemically synthesized
gaataaacgtatcctttggaat

SEQ ID NO: 1301726 - DNA, 22 bp, Artificial Sequence
  chemically synthesized
tcaaatgtggaatttattccaa

SEQ ID NO: 1301727 - DNA, 22 bp, Artificial Sequence
  chemically synthesized
atcaaatgtggaatttattcca

SEQ ID NO: 1301728 - DNA, 22 bp, Artificial Sequence
  chemically synthesized
tatcaaatgtggaatttattcc

SEQ ID NO: 1301729 - DNA, 22 bp, Artificial Sequence
  chemically synthesized
tctttatcaaatgtggaattta

SEQ ID NO: 1301730 - DNA, 22 bp, Artificial Sequence
  chemically synthesized
aactatctttatcaaatgtgga

SEQ ID NO: 1301731 - DNA, 22 bp, Artificial Sequence
  chemically synthesized
gaactatctttatcaaatgtgg

SEQ ID NO: 1301732 - DNA, 22 bp, Artificial Sequence
  chemically synthesized
tggaataaattccacatttgat

SEQ ID NO: 1301733 - DNA, 22 bp, Artificial Sequence
  chemically synthesized
ggaataaattccacatttgata

SEQ ID NO: 1301734 - DNA, 22 bp, Artificial Sequence
  chemically synthesized
gaataaattccacatttgataa

SEQ ID NO: 1301735 - DNA, 22 bp, Artificial Sequence
  chemically synthesized
taccaaatttgaactatcttta

SEQ ID NO: 1301736 - DNA, 22 bp, Artificial Sequence
  chemically synthesized
ataccaaatttgaactatcttt

SEQ ID NO: 1301737 - DNA, 22 bp, Artificial Sequence
  chemically synthesized
cacatttgataaagatagttca

SEQ ID NO: 1301738 - DNA, 22 bp, Artificial Sequence
  chemically synthesized
gataaagatagttcaaatttgg

SEQ ID NO: 1301739 - DNA, 22 bp, Artificial Sequence
  chemically synthesized
ataaagatagttcaaatttggt

SEQ ID NO: 1301740 - DNA, 22 bp, Artificial Sequence
  chemically synthesized
caaataacttataccaaatttg

SEQ ID NO: 1301741 - DNA, 22 bp, Artificial Sequence
  chemically synthesized
gctacaaataacttataccaaa

SEQ ID NO: 1301742 - DNA, 22 bp, Artificial Sequence
  chemically synthesized
ggctacaaataacttataccaa

SEQ ID NO: 1301743 - DNA, 22 bp, Artificial Sequence
  chemically synthesized
aaatttggtataagttatttgt

SEQ ID NO: 1301744 - DNA, 22 bp, Artificial Sequence
  chemically synthesized
ggacacttggctacaaataact

SEQ ID NO: 1301745 - DNA, 22 bp, Artificial Sequence
  chemically synthesized
attaggacacttggctacaaat

SEQ ID NO: 1301746 - DNA, 22 bp, Artificial Sequence
  chemically synthesized
ggtataagttatttgtagccaa

SEQ ID NO: 1301747 - DNA, 22 bp, Artificial Sequence
  chemically synthesized
gtataagttatttgtagccaag

SEQ ID NO: 1301748 - DNA, 22 bp, Artificial Sequence
  chemically synthesized
agtattaattaggacacttggc

SEQ ID NO: 1301749 - DNA, 22 bp, Artificial Sequence
  chemically synthesized
gagtattaattaggacacttgg

SEQ ID NO: 1301750 - DNA, 22 bp, Artificial Sequence
  chemically synthesized
cttgagtattaattaggacact

SEQ ID NO: 1301751 - DNA, 22 bp, Artificial Sequence
  chemically synthesized
tttgtagccaagtgtcctaatt

SEQ ID NO: 1301752 - DNA, 22 bp, Artificial Sequence
  chemically synthesized
ttacttgagtattaattaggac

SEQ ID NO: 1301753 - DNA, 22 bp, Artificial Sequence
  chemically synthesized
attacttgagtattaattagga

SEQ ID NO: 1301754 - DNA, 22 bp, Artificial Sequence
  chemically synthesized
gtagccaagtgtcctaattaat

SEQ ID NO: 1301755 - DNA, 22 bp, Artificial Sequence
  chemically synthesized
tagccaagtgtcctaattaata

SEQ ID NO: 1301756 - DNA, 22 bp, Artificial Sequence
  chemically synthesized
cttattacttgagtattaatta

SEQ ID NO: 1301757 - DNA, 22 bp, Artificial Sequence
  chemically synthesized
agcagtaaactacttattactt

SEQ ID NO: 1301758 - DNA, 22 bp, Artificial Sequence
  chemically synthesized
attaatactcaagtaataagta

SEQ ID NO: 1301759 - DNA, 22 bp, Artificial Sequence
  chemically synthesized
ttaagcagtaaactacttatta

SEQ ID NO: 1301760 - DNA, 22 bp, Artificial Sequence
  chemically synthesized
atactcaagtaataagtagttt

SEQ ID NO: 1301761 - DNA, 22 bp, Artificial Sequence
  chemically synthesized
ctgttaagcagtaaactactta

SEQ ID NO: 1301762 - DNA, 22 bp, Artificial Sequence
  chemically synthesized
tactgttaagcagtaaactact

SEQ ID NO: 1301763 - DNA, 22 bp, Artificial Sequence
  chemically synthesized
aagtaataagtagtttactgct

SEQ ID NO: 1301764 - DNA, 22 bp, Artificial Sequence
  chemically synthesized
attctactgttaagcagtaaac

SEQ ID NO: 1301765 - DNA, 22 bp, Artificial Sequence
  chemically synthesized
tatgaaatagaactaattctac

SEQ ID NO: 1301766 - DNA, 22 bp, Artificial Sequence
  chemically synthesized
actgcttaacagtagaattagt

SEQ ID NO: 1301767 - DNA, 22 bp, Artificial Sequence
  chemically synthesized
ctgcttaacagtagaattagtt

SEQ ID NO: 1301768 - DNA, 22 bp, Artificial Sequence
  chemically synthesized
cttaacagtagaattagttcta

SEQ ID NO: 1301769 - DNA, 22 bp, Artificial Sequence
  chemically synthesized
aacagtagaattagttctattt

SEQ ID NO: 1301770 - DNA, 22 bp, Artificial Sequence
  chemically synthesized
acagtagaattagttctatttc

SEQ ID NO: 1301771 - DNA, 22 bp, Artificial Sequence
  chemically synthesized
aatgagagatggaaaaattata

SEQ ID NO: 1301772 - DNA, 22 bp, Artificial Sequence
  chemically synthesized
gttctatttcatataatttttc

SEQ ID NO: 1301773 - DNA, 22 bp, Artificial Sequence
  chemically synthesized
tatttcatataatttttccatc

SEQ ID NO: 1301774 - DNA, 22 bp, Artificial Sequence
  chemically synthesized
tttcatataatttttccatctc

SEQ ID NO: 1301775 - DNA, 22 bp, Artificial Sequence
  chemically synthesized
ccatctgaatgagagatggaaa

SEQ ID NO: 1301776 - DNA, 22 bp, Artificial Sequence
  chemically synthesized
cccatctgaatgagagatggaa

SEQ ID NO: 1301777 - DNA, 22 bp, Artificial Sequence
  chemically synthesized
catataatttttccatctctca

SEQ ID NO: 1301778 - DNA, 22 bp, Artificial Sequence
  chemically synthesized
atataatttttccatctctcat

SEQ ID NO: 1301779 - DNA, 22 bp, Artificial Sequence
  chemically synthesized
ttccatctctcattcagatggg

SEQ ID NO: 1301780 - DNA, 22 bp, Artificial Sequence
  chemically synthesized
tccatctctcattcagatggga

SEQ ID NO: 1301781 - DNA, 22 bp, Artificial Sequence
  chemically synthesized
ccatctctcattcagatgggaa

SEQ ID NO: 1301782 - DNA, 22 bp, Artificial Sequence
  chemically synthesized
catctctcattcagatgggaag

SEQ ID NO: 1301783 - DNA, 22 bp, Artificial Sequence
  chemically synthesized
tcattcagatgggaagttgctc

SEQ ID NO: 1301784 - DNA, 22 bp, Artificial Sequence
  chemically synthesized
caagaggaaggagagcaacttc

SEQ ID NO: 1301785 - DNA, 22 bp, Artificial Sequence
  chemically synthesized
acaagaggaaggagagcaactt

SEQ ID NO: 1301786 - DNA, 22 bp, Artificial Sequence
  chemically synthesized
attcagatgggaagttgctctc

SEQ ID NO: 1301787 - DNA, 22 bp, Artificial Sequence
  chemically synthesized
agatgggaagttgctctccttc

SEQ ID NO: 1301788 - DNA, 22 bp, Artificial Sequence
  chemically synthesized
ctctccttcctcttgtaaggtc

SEQ ID NO: 1301789 - DNA, 22 bp, Artificial Sequence
  chemically synthesized
tccttcctcttgtaaggtcatg

SEQ ID NO: 1301790 - DNA, 22 bp, Artificial Sequence
  chemically synthesized
cttcctcttgtaaggtcatgat

SEQ ID NO: 1301791 - DNA, 22 bp, Artificial Sequence
  chemically synthesized
cagatatagagcatcatgacct

SEQ ID NO: 1301792 - DNA, 22 bp, Artificial Sequence
  chemically synthesized
gcagatatagagcatcatgacc

SEQ ID NO: 1301793 - DNA, 22 bp, Artificial Sequence
  chemically synthesized
cctcttgtaaggtcatgatgct

SEQ ID NO: 1301794 - DNA, 22 bp, Artificial Sequence
  chemically synthesized
ctcttgtaaggtcatgatgctc

SEQ ID NO: 1301795 - DNA, 22 bp, Artificial Sequence
  chemically synthesized
agtttgcagatatagagcatca

SEQ ID NO: 1301796 - DNA, 22 bp, Artificial Sequence
  chemically synthesized
ttgtaaggtcatgatgctctat

SEQ ID NO: 1301797 - DNA, 22 bp, Artificial Sequence
  chemically synthesized
gagtttgcagatatagagcatc

SEQ ID NO: 1301798 - DNA, 22 bp, Artificial Sequence
  chemically synthesized
gtaaggtcatgatgctctatat

SEQ ID NO: 1301799 - DNA, 22 bp, Artificial Sequence
  chemically synthesized
taaggtcatgatgctctatatc

SEQ ID NO: 1301800 - DNA, 22 bp, Artificial Sequence
  chemically synthesized
ccttgagtttgcagatatagag

SEQ ID NO: 1301801 - DNA, 22 bp, Artificial Sequence
  chemically synthesized
tcccttgagtttgcagatatag

SEQ ID NO: 1301802 - DNA, 22 bp, Artificial Sequence
  chemically synthesized
ctcccttgagtttgcagatata

SEQ ID NO: 1301803 - DNA, 22 bp, Artificial Sequence
  chemically synthesized
tctcccttgagtttgcagatat

SEQ ID NO: 1301804 - DNA, 22 bp, Artificial Sequence
  chemically synthesized
ttctcccttgagtttgcagata

SEQ ID NO: 1301805 - DNA, 22 bp, Artificial Sequence
  chemically synthesized
tttctcccttgagtttgcagat

SEQ ID NO: 1301806 - DNA, 22 bp, Artificial Sequence
  chemically synthesized
agagactttttctcccttgagt

SEQ ID NO: 1301807 - DNA, 22 bp, Artificial Sequence
  chemically synthesized
tatatctgcaaactcaagggag

SEQ ID NO: 1301808 - DNA, 22 bp, Artificial Sequence
  chemically synthesized
tatctgcaaactcaagggagaa

SEQ ID NO: 1301809 - DNA, 22 bp, Artificial Sequence
  chemically synthesized
aagttaagagactttttctccc

SEQ ID NO: 1301810 - DNA, 22 bp, Artificial Sequence
  chemically synthesized
caagttaagagactttttctcc

SEQ ID NO: 1301811 - DNA, 22 bp, Artificial Sequence
  chemically synthesized
caaactcaagggagaaaaagtc

SEQ ID NO: 1301812 - DNA, 22 bp, Artificial Sequence
  chemically synthesized
tatagtttcaagttaagagact

SEQ ID NO: 1301813 - DNA, 22 bp, Artificial Sequence
  chemically synthesized
aagggagaaaaagtctcttaac

SEQ ID NO: 1301814 - DNA, 22 bp, Artificial Sequence
  chemically synthesized
ctgtatagtttcaagttaagag

SEQ ID NO: 1301815 - DNA, 22 bp, Artificial Sequence
  chemically synthesized
cctgtatagtttcaagttaaga

SEQ ID NO: 1301816 - DNA, 22 bp, Artificial Sequence
  chemically synthesized
tcctgtatagtttcaagttaag

SEQ ID NO: 1301817 - DNA, 22 bp, Artificial Sequence
  chemically synthesized
ttcctgtatagtttcaagttaa

SEQ ID NO: 1301818 - DNA, 22 bp, Artificial Sequence
  chemically synthesized
tttcctgtatagtttcaagtta

SEQ ID NO: 1301819 - DNA, 22 bp, Artificial Sequence
  chemically synthesized
ttttcctgtatagtttcaagtt

SEQ ID NO: 1301820 - DNA, 22 bp, Artificial Sequence
  chemically synthesized
tttttcctgtatagtttcaagt

SEQ ID NO: 1301821 - DNA, 22 bp, Artificial Sequence
  chemically synthesized
ttttttcctgtatagtttcaag

SEQ ID NO: 1301822 - DNA, 22 bp, Artificial Sequence
  chemically synthesized
tttttttcctgtatagtttcaa

SEQ ID NO: 1301823 - DNA, 22 bp, Artificial Sequence
  chemically synthesized
ttttttttcctgtatagtttca

SEQ ID NO: 1301824 - DNA, 22 bp, Artificial Sequence
  chemically synthesized
tttttttttcctgtatagtttc

SEQ ID NO: 1301825 - DNA, 22 bp, Artificial Sequence
  chemically synthesized
ttaacttgaaactatacaggaa

SEQ ID NO: 1301826 - DNA, 22 bp, Artificial Sequence
  chemically synthesized
aacttgaaactatacaggaaaa

SEQ ID NO: 1301827 - DNA, 22 bp, Artificial Sequence
  chemically synthesized
acttgaaactatacaggaaaaa

SEQ ID NO: 1301828 - DNA, 22 bp, Artificial Sequence
  chemically synthesized
gaaactatacaggaaaaaaaaa

SEQ ID NO: 1301829 - DNA, 22 bp, Artificial Sequence
  chemically synthesized
aaactatacaggaaaaaaaaaa

SEQ ID NO: 1301830 - DNA, 22 bp, Artificial Sequence
  chemically synthesized
gaaatgacatcagggttttttt

SEQ ID NO: 1301831 - DNA, 22 bp, Artificial Sequence
  chemically synthesized
tacaggaaaaaaaaaaaaccct

SEQ ID NO: 1301832 - DNA, 22 bp, Artificial Sequence
  chemically synthesized
agtactagaaatgacatcaggg

SEQ ID NO: 1301833 - DNA, 22 bp, Artificial Sequence
  chemically synthesized
atgtcatttctagtacttaatt

SEQ ID NO: 1301834 - DNA, 22 bp, Artificial Sequence
  chemically synthesized
tggcagataaataccaattaag

SEQ ID NO: 1301835 - DNA, 22 bp, Artificial Sequence
  chemically synthesized
atggcagataaataccaattaa

SEQ ID NO: 1301836 - DNA, 22 bp, Artificial Sequence
  chemically synthesized
ctagtacttaattggtatttat

SEQ ID NO: 1301837 - DNA, 22 bp, Artificial Sequence
  chemically synthesized
tagtacttaattggtatttatc

SEQ ID NO: 1301838 - DNA, 22 bp, Artificial Sequence
  chemically synthesized
gtacttaattggtatttatctg

SEQ ID NO: 1301839 - DNA, 22 bp, Artificial Sequence
  chemically synthesized
atgtgtttatggcagataaata

SEQ ID NO: 1301840 - DNA, 22 bp, Artificial Sequence
  chemically synthesized
catgtgtttatggcagataaat

SEQ ID NO: 1301841 - DNA, 22 bp, Artificial Sequence
  chemically synthesized
aattggtatttatctgccataa

SEQ ID NO: 1301842 - DNA, 22 bp, Artificial Sequence
  chemically synthesized
attggtatttatctgccataaa

SEQ ID NO: 1301843 - DNA, 22 bp, Artificial Sequence
  chemically synthesized
gtatttatctgccataaacaca

SEQ ID NO: 1301844 - DNA, 22 bp, Artificial Sequence
  chemically synthesized
atctgccataaacacatgaagc

SEQ ID NO: 1301845 - DNA, 22 bp, Artificial Sequence
  chemically synthesized
tctgccataaacacatgaagct

SEQ ID NO: 1301846 - DNA, 22 bp, Artificial Sequence
  chemically synthesized
aacaaaccaaaacagcttcatg

SEQ ID NO: 1301847 - DNA, 22 bp, Artificial Sequence
  chemically synthesized
ccataaacacatgaagctgttt

SEQ ID NO: 1301848 - DNA, 22 bp, Artificial Sequence
  chemically synthesized
tgcagacaagggtaactgaaca

SEQ ID NO: 1301849 - DNA, 22 bp, Artificial Sequence
  chemically synthesized
ttttggtttgttcagttaccct

SEQ ID NO: 1301850 - DNA, 22 bp, Artificial Sequence
  chemically synthesized
tggtttgttcagttacccttgt

SEQ ID NO: 1301851 - DNA, 22 bp, Artificial Sequence
  chemically synthesized
ggtttgttcagttacccttgtc

SEQ ID NO: 1301852 - DNA, 22 bp, Artificial Sequence
  chemically synthesized
gtttgttcagttacccttgtct

SEQ ID NO: 1301853 - DNA, 22 bp, Artificial Sequence
  chemically synthesized
aatggccctatgcagacaaggg

SEQ ID NO: 1301854 - DNA, 22 bp, Artificial Sequence
  chemically synthesized
aaatggccctatgcagacaagg

SEQ ID NO: 1301855 - DNA, 22 bp, Artificial Sequence
  chemically synthesized
gttcagttacccttgtctgcat

SEQ ID NO: 1301856 - DNA, 22 bp, Artificial Sequence
  chemically synthesized
ttcagttacccttgtctgcata

SEQ ID NO: 1301857 - DNA, 22 bp, Artificial Sequence
  chemically synthesized
ggtttaaatggccctatgcaga

SEQ ID NO: 1301858 - DNA, 22 bp, Artificial Sequence
  chemically synthesized
agttacccttgtctgcataggg

SEQ ID NO: 1301859 - DNA, 22 bp, Artificial Sequence
  chemically synthesized
gggtttaaatggccctatgcag

SEQ ID NO: 1301860 - DNA, 22 bp, Artificial Sequence
  chemically synthesized
cccttgtctgcatagggccatt

SEQ ID NO: 1301861 - DNA, 22 bp, Artificial Sequence
  chemically synthesized
caatttgggtttaaatggccct

SEQ ID NO: 1301862 - DNA, 22 bp, Artificial Sequence
  chemically synthesized
gtctgcatagggccatttaaac

SEQ ID NO: 1301863 - DNA, 22 bp, Artificial Sequence
  chemically synthesized
tctgcatagggccatttaaacc

SEQ ID NO: 1301864 - DNA, 22 bp, Artificial Sequence
  chemically synthesized
catagggccatttaaacccaaa

SEQ ID NO: 1301865 - DNA, 22 bp, Artificial Sequence
  chemically synthesized
atagtaacccagagacaattcc

SEQ ID NO: 1301866 - DNA, 22 bp, Artificial Sequence
  chemically synthesized
aaacccaaattggaattgtctc

SEQ ID NO: 1301867 - DNA, 22 bp, Artificial Sequence
  chemically synthesized
aacccaaattggaattgtctct

SEQ ID NO: 1301868 - DNA, 22 bp, Artificial Sequence
  chemically synthesized
tcactgatagtaacccagagac

SEQ ID NO: 1301869 - DNA, 22 bp, Artificial Sequence
  chemically synthesized
ttatcactgatagtaacccaga

SEQ ID NO: 1301870 - DNA, 22 bp, Artificial Sequence
  chemically synthesized
gttatcactgatagtaacccag

SEQ ID NO: 1301871 - DNA, 22 bp, Artificial Sequence
  chemically synthesized
ttgttatcactgatagtaaccc

SEQ ID NO: 1301872 - DNA, 22 bp, Artificial Sequence
  chemically synthesized
gaattgtctctgggttactatc

SEQ ID NO: 1301873 - DNA, 22 bp, Artificial Sequence
  chemically synthesized
tctctgggttactatcagtgat

SEQ ID NO: 1301874 - DNA, 22 bp, Artificial Sequence
  chemically synthesized
aaagttcttgttatcactgata

SEQ ID NO: 1301875 - DNA, 22 bp, Artificial Sequence
  chemically synthesized
tgggttactatcagtgataaca

SEQ ID NO: 1301876 - DNA, 22 bp, Artificial Sequence
  chemically synthesized
ggttactatcagtgataacaag

SEQ ID NO: 1301877 - DNA, 22 bp, Artificial Sequence
  chemically synthesized
gcatgaattgaaagttcttgtt

SEQ ID NO: 1301878 - DNA, 22 bp, Artificial Sequence
  chemically synthesized
ctatcagtgataacaagaactt

SEQ ID NO: 1301879 - DNA, 22 bp, Artificial Sequence
  chemically synthesized
tcagtgataacaagaactttca

SEQ ID NO: 1301880 - DNA, 22 bp, Artificial Sequence
  chemically synthesized
taattggcatgaattgaaagtt

SEQ ID NO: 1301881 - DNA, 22 bp, Artificial Sequence
  chemically synthesized
ctataattggcatgaattgaaa

SEQ ID NO: 1301882 - DNA, 22 bp, Artificial Sequence
  chemically synthesized
tgaattcctataattggcatga

SEQ ID NO: 1301883 - DNA, 22 bp, Artificial Sequence
  chemically synthesized
gtgaattcctataattggcatg

SEQ ID NO: 1301884 - DNA, 22 bp, Artificial Sequence
  chemically synthesized
tgtttgtgaattcctataattg

SEQ ID NO: 1301885 - DNA, 22 bp, Artificial Sequence
  chemically synthesized
tcaattcatgccaattatagga

SEQ ID NO: 1301886 - DNA, 22 bp, Artificial Sequence
  chemically synthesized
caattcatgccaattataggaa

SEQ ID NO: 1301887 - DNA, 22 bp, Artificial Sequence
  chemically synthesized
aattcatgccaattataggaat

SEQ ID NO: 1301888 - DNA, 22 bp, Artificial Sequence
  chemically synthesized
tctgtgtttgtgaattcctata

SEQ ID NO: 1301889 - DNA, 22 bp, Artificial Sequence
  chemically synthesized
atgccaattataggaattcaca

SEQ ID NO: 1301890 - DNA, 22 bp, Artificial Sequence
  chemically synthesized
gtcacccctatctgtgtttgtg

SEQ ID NO: 1301891 - DNA, 22 bp, Artificial Sequence
  chemically synthesized
ggtcacccctatctgtgtttgt

SEQ ID NO: 1301892 - DNA, 22 bp, Artificial Sequence
  chemically synthesized
taggaattcacaaacacagata

SEQ ID NO: 1301893 - DNA, 22 bp, Artificial Sequence
  chemically synthesized
cttggtcacccctatctgtgtt

SEQ ID NO: 1301894 - DNA, 22 bp, Artificial Sequence
  chemically synthesized
gattccttggtcacccctatct

SEQ ID NO: 1301895 - DNA, 22 bp, Artificial Sequence
  chemically synthesized
acaaacacagataggggtgacc

SEQ ID NO: 1301896 - DNA, 22 bp, Artificial Sequence
  chemically synthesized
gttggattccttggtcacccct

SEQ ID NO: 1301897 - DNA, 22 bp, Artificial Sequence
  chemically synthesized
tggttggattccttggtcaccc

SEQ ID NO: 1301898 - DNA, 22 bp, Artificial Sequence
  chemically synthesized
aacagaaagttctggttggatt

SEQ ID NO: 1301899 - DNA, 22 bp, Artificial Sequence
  chemically synthesized
atgaaactaaacagaaagttct

SEQ ID NO: 1301900 - DNA, 22 bp, Artificial Sequence
  chemically synthesized
agtctaatgaaactaaacagaa

SEQ ID NO: 1301901 - DNA, 22 bp, Artificial Sequence
  chemically synthesized
agtctgagtctaatgaaactaa

SEQ ID NO: 1301902 - DNA, 22 bp, Artificial Sequence
  chemically synthesized
attaagtctgagtctaatgaaa

SEQ ID NO: 1301903 - DNA, 22 bp, Artificial Sequence
  chemically synthesized
tcattaagtctgagtctaatga

SEQ ID NO: 1301904 - DNA, 22 bp, Artificial Sequence
  chemically synthesized
tctgtttagtttcattagactc

SEQ ID NO: 1301905 - DNA, 22 bp, Artificial Sequence
  chemically synthesized
ctcattaagtctgagtctaatg

SEQ ID NO: 1301906 - DNA, 22 bp, Artificial Sequence
  chemically synthesized
ctgtttagtttcattagactca

SEQ ID NO: 1301907 - DNA, 22 bp, Artificial Sequence
  chemically synthesized
tctcattaagtctgagtctaat

SEQ ID NO: 1301908 - DNA, 22 bp, Artificial Sequence
  chemically synthesized
tgtttagtttcattagactcag

SEQ ID NO: 1301909 - DNA, 22 bp, Artificial Sequence
  chemically synthesized
ttctcattaagtctgagtctaa

SEQ ID NO: 1301910 - DNA, 22 bp, Artificial Sequence
  chemically synthesized
tttctcattaagtctgagtcta

SEQ ID NO: 1301911 - DNA, 22 bp, Artificial Sequence
  chemically synthesized
tttagtttcattagactcagac

SEQ ID NO: 1301912 - DNA, 22 bp, Artificial Sequence
  chemically synthesized
ttttctcattaagtctgagtct

SEQ ID NO: 1301913 - DNA, 22 bp, Artificial Sequence
  chemically synthesized
tttttctcattaagtctgagtc

SEQ ID NO: 1301914 - DNA, 22 bp, Artificial Sequence
  chemically synthesized
ttttttctcattaagtctgagt

SEQ ID NO: 1301915 - DNA, 22 bp, Artificial Sequence
  chemically synthesized
agtttcattagactcagactta

SEQ ID NO: 1301916 - DNA, 22 bp, Artificial Sequence
  chemically synthesized
gtttcattagactcagacttaa

SEQ ID NO: 1301917 - DNA, 22 bp, Artificial Sequence
  chemically synthesized
cattagactcagacttaatgag

SEQ ID NO: 1301918 - DNA, 22 bp, Artificial Sequence
  chemically synthesized
attagactcagacttaatgaga

SEQ ID NO: 1301919 - DNA, 22 bp, Artificial Sequence
  chemically synthesized
atgatttttttttctcattaag

SEQ ID NO: 1301920 - DNA, 22 bp, Artificial Sequence
  chemically synthesized
gactcagacttaatgagaaaaa

SEQ ID NO: 1301921 - DNA, 22 bp, Artificial Sequence
  chemically synthesized
agtgctaatgatttttttttct

SEQ ID NO: 1301922 - DNA, 22 bp, Artificial Sequence
  chemically synthesized
cagtgctaatgatttttttttc

SEQ ID NO: 1301923 - DNA, 22 bp, Artificial Sequence
  chemically synthesized
agacttaatgagaaaaaaaaat

SEQ ID NO: 1301924 - DNA, 22 bp, Artificial Sequence
  chemically synthesized
tcagtgctaatgattttttttt

SEQ ID NO: 1301925 - DNA, 22 bp, Artificial Sequence
  chemically synthesized
ttcagtgctaatgatttttttt

SEQ ID NO: 1301926 - DNA, 22 bp, Artificial Sequence
  chemically synthesized
aatgagaaaaaaaaatcattag

SEQ ID NO: 1301927 - DNA, 22 bp, Artificial Sequence
  chemically synthesized
atgagaaaaaaaaatcattagc

SEQ ID NO: 1301928 - DNA, 22 bp, Artificial Sequence
  chemically synthesized
caagtttttcagtgctaatgat

SEQ ID NO: 1301929 - DNA, 22 bp, Artificial Sequence
  chemically synthesized
acaagtttttcagtgctaatga

SEQ ID NO: 1301930 - DNA, 22 bp, Artificial Sequence
  chemically synthesized
aacaagacttacaagtttttca

SEQ ID NO: 1301931 - DNA, 22 bp, Artificial Sequence
  chemically synthesized
gcactgaaaaacttgtaagtct

SEQ ID NO: 1301932 - DNA, 22 bp, Artificial Sequence
  chemically synthesized
agcaagaaactaaacaagactt

SEQ ID NO: 1301933 - DNA, 22 bp, Artificial Sequence
  chemically synthesized
cagcaagaaactaaacaagact

SEQ ID NO: 1301934 - DNA, 22 bp, Artificial Sequence
  chemically synthesized
aaaaacttgtaagtcttgttta

SEQ ID NO: 1301935 - DNA, 22 bp, Artificial Sequence
  chemically synthesized
aatttcagcaagaaactaaaca

SEQ ID NO: 1301936 - DNA, 22 bp, Artificial Sequence
  chemically synthesized
aaatttcagcaagaaactaaac

SEQ ID NO: 1301937 - DNA, 22 bp, Artificial Sequence
  chemically synthesized
gtaagtcttgtttagtttcttg

SEQ ID NO: 1301938 - DNA, 22 bp, Artificial Sequence
  chemically synthesized
tttaaatttcagcaagaaacta

SEQ ID NO: 1301939 - DNA, 22 bp, Artificial Sequence
  chemically synthesized
taagtcttgtttagtttcttgc

SEQ ID NO: 1301940 - DNA, 22 bp, Artificial Sequence
  chemically synthesized
gtttagtttcttgctgaaattt

SEQ ID NO: 1301941 - DNA, 22 bp, Artificial Sequence
  chemically synthesized
tttagtttcttgctgaaattta

SEQ ID NO: 1301942 - DNA, 22 bp, Artificial Sequence
  chemically synthesized
agtttcttgctgaaatttaaat

SEQ ID NO: 1301943 - DNA, 22 bp, Artificial Sequence
  chemically synthesized
gtttcttgctgaaatttaaata

SEQ ID NO: 1301944 - DNA, 22 bp, Artificial Sequence
  chemically synthesized
cttgctgaaatttaaataatac

SEQ ID NO: 1301945 - DNA, 22 bp, Artificial Sequence
  chemically synthesized
ttgctgaaatttaaataatact

SEQ ID NO: 1301946 - DNA, 22 bp, Artificial Sequence
  chemically synthesized
gctgaaatttaaataatactga

SEQ ID NO: 1301947 - DNA, 22 bp, Artificial Sequence
  chemically synthesized
ctgaaatttaaataatactgat

SEQ ID NO: 1301948 - DNA, 22 bp, Artificial Sequence
  chemically synthesized
catcacagacacaatcagtatt

SEQ ID NO: 1301949 - DNA, 22 bp, Artificial Sequence
  chemically synthesized
ccatcacagacacaatcagtat

SEQ ID NO: 1301950 - DNA, 22 bp, Artificial Sequence
  chemically synthesized
aaatttaaataatactgattgt

SEQ ID NO: 1301951 - DNA, 22 bp, Artificial Sequence
  chemically synthesized
aaataatactgattgtgtctgt

SEQ ID NO: 1301952 - DNA, 22 bp, Artificial Sequence
  chemically synthesized
ccagtttccatcacagacacaa

SEQ ID NO: 1301953 - DNA, 22 bp, Artificial Sequence
  chemically synthesized
aataatactgattgtgtctgtg

SEQ ID NO: 1301954 - DNA, 22 bp, Artificial Sequence
  chemically synthesized
accagtttccatcacagacaca

SEQ ID NO: 1301955 - DNA, 22 bp, Artificial Sequence
  chemically synthesized
taccagtttccatcacagacac

SEQ ID NO: 1301956 - DNA, 22 bp, Artificial Sequence
  chemically synthesized
tttaccagtttccatcacagac

SEQ ID NO: 1301957 - DNA, 22 bp, Artificial Sequence
  chemically synthesized
ttctttaccagtttccatcaca

SEQ ID NO: 1301958 - DNA, 22 bp, Artificial Sequence
  chemically synthesized
attctttaccagtttccatcac

SEQ ID NO: 1301959 - DNA, 22 bp, Artificial Sequence
  chemically synthesized
tattctttaccagtttccatca

SEQ ID NO: 1301960 - DNA, 22 bp, Artificial Sequence
  chemically synthesized
attgtgtctgtgatggaaactg

SEQ ID NO: 1301961 - DNA, 22 bp, Artificial Sequence
  chemically synthesized
attttattctttaccagtttcc

SEQ ID NO: 1301962 - DNA, 22 bp, Artificial Sequence
  chemically synthesized
tgtctgtgatggaaactggtaa

SEQ ID NO: 1301963 - DNA, 22 bp, Artificial Sequence
  chemically synthesized
aatattcattttattctttacc

SEQ ID NO: 1301964 - DNA, 22 bp, Artificial Sequence
  chemically synthesized
tgatggaaactggtaaagaata

SEQ ID NO: 1301965 - DNA, 22 bp, Artificial Sequence
  chemically synthesized
aattaaatattcattttattct

SEQ ID NO: 1301966 - DNA, 22 bp, Artificial Sequence
  chemically synthesized
ctaaattaaatattcattttat

SEQ ID NO: 1301967 - DNA, 22 bp, Artificial Sequence
  chemically synthesized
actaaattaaatattcatttta

SEQ ID NO: 1301968 - DNA, 22 bp, Artificial Sequence
  chemically synthesized
gtaaagaataaaatgaatattt

SEQ ID NO: 1301969 - DNA, 22 bp, Artificial Sequence
  chemically synthesized
tataccttactaaattaaatat

SEQ ID NO: 1301970 - DNA, 22 bp, Artificial Sequence
  chemically synthesized
gtataccttactaaattaaata

SEQ ID NO: 1301971 - DNA, 22 bp, Artificial Sequence
  chemically synthesized
tgtataccttactaaattaaat

SEQ ID NO: 1301972 - DNA, 22 bp, Artificial Sequence
  chemically synthesized
ttttgtataccttactaaatta

SEQ ID NO: 1301973 - DNA, 22 bp, Artificial Sequence
  chemically synthesized
gttttgtataccttactaaatt

SEQ ID NO: 1301974 - DNA, 22 bp, Artificial Sequence
  chemically synthesized
tgttttgtataccttactaaat

SEQ ID NO: 1301975 - DNA, 22 bp, Artificial Sequence
  chemically synthesized
atgttttgttttgtatacctta

SEQ ID NO: 1301976 - DNA, 22 bp, Artificial Sequence
  chemically synthesized
tcatgttttgttttgtatacct

SEQ ID NO: 1301977 - DNA, 22 bp, Artificial Sequence
  chemically synthesized
aatttagtaaggtatacaaaac

SEQ ID NO: 1301978 - DNA, 22 bp, Artificial Sequence
  chemically synthesized
atttagtaaggtatacaaaaca

SEQ ID NO: 1301979 - DNA, 22 bp, Artificial Sequence
  chemically synthesized
cctctcatgttttgttttgtat

SEQ ID NO: 1301980 - DNA, 22 bp, Artificial Sequence
  chemically synthesized
agtaaggtatacaaaacaaaac

SEQ ID NO: 1301981 - DNA, 22 bp, Artificial Sequence
  chemically synthesized
gtaaggtatacaaaacaaaaca

SEQ ID NO: 1301982 - DNA, 22 bp, Artificial Sequence
  chemically synthesized
tgctccctctcatgttttgttt

SEQ ID NO: 1301983 - DNA, 22 bp, Artificial Sequence
  chemically synthesized
ggaatagctatgctccctctca

SEQ ID NO: 1301984 - DNA, 22 bp, Artificial Sequence
  chemically synthesized
aggaatagctatgctccctctc

SEQ ID NO: 1301985 - DNA, 22 bp, Artificial Sequence
  chemically synthesized
catttaggaatagctatgctcc

SEQ ID NO: 1301986 - DNA, 22 bp, Artificial Sequence
  chemically synthesized
ccatttaggaatagctatgctc

SEQ ID NO: 1301987 - DNA, 22 bp, Artificial Sequence
  chemically synthesized
tccatttaggaatagctatgct

SEQ ID NO: 1301988 - DNA, 22 bp, Artificial Sequence
  chemically synthesized
ttccatttaggaatagctatgc

SEQ ID NO: 1301989 - DNA, 22 bp, Artificial Sequence
  chemically synthesized
tttttccatttaggaatagcta

SEQ ID NO: 1301990 - DNA, 22 bp, Artificial Sequence
  chemically synthesized
atttttccatttaggaatagct

SEQ ID NO: 1301991 - DNA, 22 bp, Artificial Sequence
  chemically synthesized
tagtataccaatttatttttcc

SEQ ID NO: 1301992 - DNA, 22 bp, Artificial Sequence
  chemically synthesized
ttcctaaatggaaaaataaatt

SEQ ID NO: 1301993 - DNA, 22 bp, Artificial Sequence
  chemically synthesized
ttgtagtataccaatttatttt

SEQ ID NO: 1301994 - DNA, 22 bp, Artificial Sequence
  chemically synthesized
ctaaatggaaaaataaattggt

SEQ ID NO: 1301995 - DNA, 22 bp, Artificial Sequence
  chemically synthesized
ctattgtagtataccaatttat

SEQ ID NO: 1301996 - DNA, 22 bp, Artificial Sequence
  chemically synthesized
cctattgtagtataccaattta

SEQ ID NO: 1301997 - DNA, 22 bp, Artificial Sequence
  chemically synthesized
aatggaaaaataaattggtata

SEQ ID NO: 1301998 - DNA, 22 bp, Artificial Sequence
  chemically synthesized
aaaggaaatcatacttcctatt

SEQ ID NO: 1301999 - DNA, 22 bp, Artificial Sequence
  chemically synthesized
gtatactacaataggaagtatg

SEQ ID NO: 1302000 - DNA, 22 bp, Artificial Sequence
  chemically synthesized
caataggaagtatgatttcctt

SEQ ID NO: 1302001 - DNA, 22 bp, Artificial Sequence
  chemically synthesized
taaaacaaacatattaaaagga

SEQ ID NO: 1302002 - DNA, 22 bp, Artificial Sequence
  chemically synthesized
tataaaacaaacatattaaaag

SEQ ID NO: 1302003 - DNA, 22 bp, Artificial Sequence
  chemically synthesized
ctataaaacaaacatattaaaa

SEQ ID NO: 1302004 - DNA, 22 bp, Artificial Sequence
  chemically synthesized
gtaacttctataaaacaaacat

SEQ ID NO: 1302005 - DNA, 22 bp, Artificial Sequence
  chemically synthesized
ccttttaatatgtttgttttat

SEQ ID NO: 1302006 - DNA, 22 bp, Artificial Sequence
  chemically synthesized
cttttaatatgtttgttttata

SEQ ID NO: 1302007 - DNA, 22 bp, Artificial Sequence
  chemically synthesized
caattagtaacttctataaaac

SEQ ID NO: 1302008 - DNA, 22 bp, Artificial Sequence
  chemically synthesized
ttaatatgtttgttttatagaa

SEQ ID NO: 1302009 - DNA, 22 bp, Artificial Sequence
  chemically synthesized
taatatgtttgttttatagaag

SEQ ID NO: 1302010 - DNA, 22 bp, Artificial Sequence
  chemically synthesized
tgcaattagtaacttctataaa

SEQ ID NO: 1302011 - DNA, 22 bp, Artificial Sequence
  chemically synthesized
aatatgtttgttttatagaagt

SEQ ID NO: 1302012 - DNA, 22 bp, Artificial Sequence
  chemically synthesized
ctgcaattagtaacttctataa

SEQ ID NO: 1302013 - DNA, 22 bp, Artificial Sequence
  chemically synthesized
atatgtttgttttatagaagtt

SEQ ID NO: 1302014 - DNA, 22 bp, Artificial Sequence
  chemically synthesized
gttttatagaagttactaattg

SEQ ID NO: 1302015 - DNA, 22 bp, Artificial Sequence
  chemically synthesized
ttttatagaagttactaattgc

SEQ ID NO: 1302016 - DNA, 22 bp, Artificial Sequence
  chemically synthesized
tatagaagttactaattgcaga

SEQ ID NO: 1302017 - DNA, 22 bp, Artificial Sequence
  chemically synthesized
atagaagttactaattgcagaa

SEQ ID NO: 1302018 - DNA, 22 bp, Artificial Sequence
  chemically synthesized
aatcaaaatggtttctgcaatt

SEQ ID NO: 1302019 - DNA, 22 bp, Artificial Sequence
  chemically synthesized
tagaagttactaattgcagaaa

SEQ ID NO: 1302020 - DNA, 22 bp, Artificial Sequence
  chemically synthesized
atgatgttaaatcaaaatggtt

SEQ ID NO: 1302021 - DNA, 22 bp, Artificial Sequence
  chemically synthesized
ctaattgcagaaaccattttga

SEQ ID NO: 1302022 - DNA, 22 bp, Artificial Sequence
  chemically synthesized
ttgatgatgttaaatcaaaatg

SEQ ID NO: 1302023 - DNA, 22 bp, Artificial Sequence
  chemically synthesized
attgcagaaaccattttgattt

SEQ ID NO: 1302024 - DNA, 22 bp, Artificial Sequence
  chemically synthesized
attgatgatgttaaatcaaaat

SEQ ID NO: 1302025 - DNA, 22 bp, Artificial Sequence
  chemically synthesized
tattgatgatgttaaatcaaaa

SEQ ID NO: 1302026 - DNA, 22 bp, Artificial Sequence
  chemically synthesized
cagaaaccattttgatttaaca

SEQ ID NO: 1302027 - DNA, 22 bp, Artificial Sequence
  chemically synthesized
attttattgatgatgttaaatc

SEQ ID NO: 1302028 - DNA, 22 bp, Artificial Sequence
  chemically synthesized
acacattgattttattgatgat

SEQ ID NO: 1302029 - DNA, 22 bp, Artificial Sequence
  chemically synthesized
tgatttaacatcatcaataaaa

SEQ ID NO: 1302030 - DNA, 22 bp, Artificial Sequence
  chemically synthesized
ttcacacattgattttattgat

SEQ ID NO: 1302031 - DNA, 22 bp, Artificial Sequence
  chemically synthesized
gatttaacatcatcaataaaat

SEQ ID NO: 1302032 - DNA, 22 bp, Artificial Sequence
  chemically synthesized
atttaacatcatcaataaaatc

SEQ ID NO: 1302033 - DNA, 22 bp, Artificial Sequence
  chemically synthesized
aacatcatcaataaaatcaatg

SEQ ID NO: 1302034 - DNA, 22 bp, Artificial Sequence
  chemically synthesized
acatcatcaataaaatcaatgt

SEQ ID NO: 1302035 - DNA, 22 bp, Artificial Sequence
  chemically synthesized
gaatgtaatgatattgttcaca

SEQ ID NO: 1302036 - DNA, 22 bp, Artificial Sequence
  chemically synthesized
cgaatgtaatgatattgttcac

SEQ ID NO: 1302037 - DNA, 22 bp, Artificial Sequence
  chemically synthesized
tcgaatgtaatgatattgttca

SEQ ID NO: 1302038 - DNA, 22 bp, Artificial Sequence
  chemically synthesized
gacatgtcatctttcgaatgta

SEQ ID NO: 1302039 - DNA, 22 bp, Artificial Sequence
  chemically synthesized
ttagacatgtcatctttcgaat

SEQ ID NO: 1302040 - DNA, 22 bp, Artificial Sequence
  chemically synthesized
gttagacatgtcatctttcgaa

SEQ ID NO: 1302041 - DNA, 22 bp, Artificial Sequence
  chemically synthesized
tgttagacatgtcatctttcga

SEQ ID NO: 1302042 - DNA, 22 bp, Artificial Sequence
  chemically synthesized
cattcgaaagatgacatgtcta

SEQ ID NO: 1302043 - DNA, 22 bp, Artificial Sequence
  chemically synthesized
atagtgccattttgttagacat

SEQ ID NO: 1302044 - DNA, 22 bp, Artificial Sequence
  chemically synthesized
gaaagatgacatgtctaacaaa

SEQ ID NO: 1302045 - DNA, 22 bp, Artificial Sequence
  chemically synthesized
aatacatatatattgatagtgc

SEQ ID NO: 1302046 - DNA, 22 bp, Artificial Sequence
  chemically synthesized
aaatacatatatattgatagtg

SEQ ID NO: 1302047 - DNA, 22 bp, Artificial Sequence
  chemically synthesized
taaatacatatatattgatagt

SEQ ID NO: 1302048 - DNA, 22 bp, Artificial Sequence
  chemically synthesized
acaaaatggcactatcaatata

SEQ ID NO: 1302049 - DNA, 22 bp, Artificial Sequence
  chemically synthesized
tctttaaatacatatatattga

SEQ ID NO: 1302050 - DNA, 22 bp, Artificial Sequence
  chemically synthesized
aagggagactgtctttaaatac

SEQ ID NO: 1302051 - DNA, 22 bp, Artificial Sequence
  chemically synthesized
tcaatatatatgtatttaaaga

SEQ ID NO: 1302052 - DNA, 22 bp, Artificial Sequence
  chemically synthesized
gcaaagttaaagggagactgtc

SEQ ID NO: 1302053 - DNA, 22 bp, Artificial Sequence
  chemically synthesized
gtgtctagcaaagttaaaggga

SEQ ID NO: 1302054 - DNA, 22 bp, Artificial Sequence
  chemically synthesized
ggtgtctagcaaagttaaaggg

SEQ ID NO: 1302055 - DNA, 22 bp, Artificial Sequence
  chemically synthesized
aaagacagtctccctttaactt

SEQ ID NO: 1302056 - DNA, 22 bp, Artificial Sequence
  chemically synthesized
tggtgtctagcaaagttaaagg

SEQ ID NO: 1302057 - DNA, 22 bp, Artificial Sequence
  chemically synthesized
aagacagtctccctttaacttt

SEQ ID NO: 1302058 - DNA, 22 bp, Artificial Sequence
  chemically synthesized
ttggtgtctagcaaagttaaag

SEQ ID NO: 1302059 - DNA, 22 bp, Artificial Sequence
  chemically synthesized
aacttttggtgtctagcaaagt

SEQ ID NO: 1302060 - DNA, 22 bp, Artificial Sequence
  chemically synthesized
aaacttttggtgtctagcaaag

SEQ ID NO: 1302061 - DNA, 22 bp, Artificial Sequence
  chemically synthesized
cctttaactttgctagacacca

SEQ ID NO: 1302062 - DNA, 22 bp, Artificial Sequence
  chemically synthesized
tgcatttaaacttttggtgtct

SEQ ID NO: 1302063 - DNA, 22 bp, Artificial Sequence
  chemically synthesized
taactttgctagacaccaaaag

SEQ ID NO: 1302064 - DNA, 22 bp, Artificial Sequence
  chemically synthesized
aactttgctagacaccaaaagt

SEQ ID NO: 1302065 - DNA, 22 bp, Artificial Sequence
  chemically synthesized
actttgctagacaccaaaagtt

SEQ ID NO: 1302066 - DNA, 22 bp, Artificial Sequence
  chemically synthesized
gcattgtgcatttaaacttttg

SEQ ID NO: 1302067 - DNA, 22 bp, Artificial Sequence
  chemically synthesized
ggcattgtgcatttaaactttt

SEQ ID NO: 1302068 - DNA, 22 bp, Artificial Sequence
  chemically synthesized
tgctagacaccaaaagtttaaa

SEQ ID NO: 1302069 - DNA, 22 bp, Artificial Sequence
  chemically synthesized
gctagacaccaaaagtttaaat

SEQ ID NO: 1302070 - DNA, 22 bp, Artificial Sequence
  chemically synthesized
ctagacaccaaaagtttaaatg

SEQ ID NO: 1302071 - DNA, 22 bp, Artificial Sequence
  chemically synthesized
cccttggcattgtgcatttaaa

SEQ ID NO: 1302072 - DNA, 22 bp, Artificial Sequence
  chemically synthesized
gacaccaaaagtttaaatgcac

SEQ ID NO: 1302073 - DNA, 22 bp, Artificial Sequence
  chemically synthesized
actgcccttggcattgtgcatt

SEQ ID NO: 1302074 - DNA, 22 bp, Artificial Sequence
  chemically synthesized
aactgcccttggcattgtgcat

SEQ ID NO: 1302075 - DNA, 22 bp, Artificial Sequence
  chemically synthesized
acacttaactgcccttggcatt

SEQ ID NO: 1302076 - DNA, 22 bp, Artificial Sequence
  chemically synthesized
gacacttaactgcccttggcat

SEQ ID NO: 1302077 - DNA, 22 bp, Artificial Sequence
  chemically synthesized
tgacacttaactgcccttggca

SEQ ID NO: 1302078 - DNA, 22 bp, Artificial Sequence
  chemically synthesized
aaatgcacaatgccaagggcag

SEQ ID NO: 1302079 - DNA, 22 bp, Artificial Sequence
  chemically synthesized
aatgcacaatgccaagggcagt

SEQ ID NO: 1302080 - DNA, 22 bp, Artificial Sequence
  chemically synthesized
tattttgacacttaactgccct

SEQ ID NO: 1302081 - DNA, 22 bp, Artificial Sequence
  chemically synthesized
gtattttgacacttaactgccc

SEQ ID NO: 1302082 - DNA, 22 bp, Artificial Sequence
  chemically synthesized
agatacatttgtattttgacac

SEQ ID NO: 1302083 - DNA, 22 bp, Artificial Sequence
  chemically synthesized
agtgtcaaaatacaaatgtatc

SEQ ID NO: 1302084 - DNA, 22 bp, Artificial Sequence
  chemically synthesized
aataaaatattaagatacattt

SEQ ID NO: 1302085 - DNA, 22 bp, Artificial Sequence
  chemically synthesized
aaataaaatattaagatacatt

SEQ ID NO: 1302086 - DNA, 22 bp, Artificial Sequence
  chemically synthesized
acaatagaagccttaaataaaa

SEQ ID NO: 1302087 - DNA, 22 bp, Artificial Sequence
  chemically synthesized
aacaatagaagccttaaataaa

SEQ ID NO: 1302088 - DNA, 22 bp, Artificial Sequence
  chemically synthesized
taacaatagaagccttaaataa

SEQ ID NO: 1302089 - DNA, 22 bp, Artificial Sequence
  chemically synthesized
ttaacaatagaagccttaaata

SEQ ID NO: 1302090 - DNA, 22 bp, Artificial Sequence
  chemically synthesized
tttttaacaatagaagccttaa

SEQ ID NO: 1302091 - DNA, 22 bp, Artificial Sequence
  chemically synthesized
aatattttatttaaggcttcta

SEQ ID NO: 1302092 - DNA, 22 bp, Artificial Sequence
  chemically synthesized
atattttatttaaggcttctat

SEQ ID NO: 1302093 - DNA, 22 bp, Artificial Sequence
  chemically synthesized
tatttaaggcttctattgttaa

SEQ ID NO: 1302094 - DNA, 22 bp, Artificial Sequence
  chemically synthesized
gatgcattatttttaacaatag

SEQ ID NO: 1302095 - DNA, 22 bp, Artificial Sequence
  chemically synthesized
atttaaggcttctattgttaaa

SEQ ID NO: 1302096 - DNA, 22 bp, Artificial Sequence
  chemically synthesized
tttaaggcttctattgttaaaa

SEQ ID NO: 1302097 - DNA, 22 bp, Artificial Sequence
  chemically synthesized
aaggcttctattgttaaaaata

SEQ ID NO: 1302098 - DNA, 22 bp, Artificial Sequence
  chemically synthesized
tgttagatgcattatttttaac

SEQ ID NO: 1302099 - DNA, 22 bp, Artificial Sequence
  chemically synthesized
aggcttctattgttaaaaataa

SEQ ID NO: 1302100 - DNA, 22 bp, Artificial Sequence
  chemically synthesized
ttatgttagatgcattattttt

SEQ ID NO: 1302101 - DNA, 22 bp, Artificial Sequence
  chemically synthesized
attatgttagatgcattatttt

SEQ ID NO: 1302102 - DNA, 22 bp, Artificial Sequence
  chemically synthesized
tattatgttagatgcattattt

SEQ ID NO: 1302103 - DNA, 22 bp, Artificial Sequence
  chemically synthesized
ctattgttaaaaataatgcatc

SEQ ID NO: 1302104 - DNA, 22 bp, Artificial Sequence
  chemically synthesized
tttattatgttagatgcattat

SEQ ID NO: 1302105 - DNA, 22 bp, Artificial Sequence
  chemically synthesized
tattgttaaaaataatgcatct

SEQ ID NO: 1302106 - DNA, 22 bp, Artificial Sequence
  chemically synthesized
ttgttaaaaataatgcatctaa

SEQ ID NO: 1302107 - DNA, 22 bp, Artificial Sequence
  chemically synthesized
ttaaaaataatgcatctaacat

SEQ ID NO: 1302108 - DNA, 22 bp, Artificial Sequence
  chemically synthesized
aaaataatgcatctaacataat

SEQ ID NO: 1302109 - DNA, 22 bp, Artificial Sequence
  chemically synthesized
aaataccctctttattatgtta

SEQ ID NO: 1302110 - DNA, 22 bp, Artificial Sequence
  chemically synthesized
caaataccctctttattatgtt

SEQ ID NO: 1302111 - DNA, 22 bp, Artificial Sequence
  chemically synthesized
acataataaagagggtatttga

SEQ ID NO: 1302112 - DNA, 22 bp, Artificial Sequence
  chemically synthesized
aaatatgaaatttcaaataccc

SEQ ID NO: 1302113 - DNA, 22 bp, Artificial Sequence
  chemically synthesized
gaaatttcatatttcaatatcc

SEQ ID NO: 1302114 - DNA, 22 bp, Artificial Sequence
  chemically synthesized
aaatttcatatttcaatatccc

SEQ ID NO: 1302115 - DNA, 22 bp, Artificial Sequence
  chemically synthesized
tggcaaaccatggggatattga

SEQ ID NO: 1302116 - DNA, 22 bp, Artificial Sequence
  chemically synthesized
tatggcaaaccatggggatatt

SEQ ID NO: 1302117 - DNA, 22 bp, Artificial Sequence
  chemically synthesized
ctatggcaaaccatggggatat

SEQ ID NO: 1302118 - DNA, 22 bp, Artificial Sequence
  chemically synthesized
catatttcaatatccccatggt

SEQ ID NO: 1302119 - DNA, 22 bp, Artificial Sequence
  chemically synthesized
atatttcaatatccccatggtt

SEQ ID NO: 1302120 - DNA, 22 bp, Artificial Sequence
  chemically synthesized
tcttctatggcaaaccatgggg

SEQ ID NO: 1302121 - DNA, 22 bp, Artificial Sequence
  chemically synthesized
gtcttctatggcaaaccatggg

SEQ ID NO: 1302122 - DNA, 22 bp, Artificial Sequence
  chemically synthesized
caatatccccatggtttgccat

SEQ ID NO: 1302123 - DNA, 22 bp, Artificial Sequence
  chemically synthesized
tatttgtcttctatggcaaacc

SEQ ID NO: 1302124 - DNA, 22 bp, Artificial Sequence
  chemically synthesized
aatatccccatggtttgccata

SEQ ID NO: 1302125 - DNA, 22 bp, Artificial Sequence
  chemically synthesized
atatttgtcttctatggcaaac

SEQ ID NO: 1302126 - DNA, 22 bp, Artificial Sequence
  chemically synthesized
atgcatgtatttatatttgtct

SEQ ID NO: 1302127 - DNA, 22 bp, Artificial Sequence
  chemically synthesized
catgcatgtatttatatttgtc

SEQ ID NO: 1302128 - DNA, 22 bp, Artificial Sequence
  chemically synthesized
gccatagaagacaaatataaat

SEQ ID NO: 1302129 - DNA, 22 bp, Artificial Sequence
  chemically synthesized
ccatagaagacaaatataaata

SEQ ID NO: 1302130 - DNA, 22 bp, Artificial Sequence
  chemically synthesized
taaccaaaaagtaaccaagaaa

SEQ ID NO: 1302131 - DNA, 22 bp, Artificial Sequence
  chemically synthesized
tgattttattttcttggttact

SEQ ID NO: 1302132 - DNA, 22 bp, Artificial Sequence
  chemically synthesized
tattttcttggttactttttgg

SEQ ID NO: 1302133 - DNA, 22 bp, Artificial Sequence
  chemically synthesized
attttcttggttactttttggt

SEQ ID NO: 1302134 - DNA, 22 bp, Artificial Sequence
  chemically synthesized
ttttcttggttactttttggtt

SEQ ID NO: 1302135 - DNA, 22 bp, Artificial Sequence
  chemically synthesized
tcttggttactttttggttaca

SEQ ID NO: 1302136 - DNA, 22 bp, Artificial Sequence
  chemically synthesized
cttggttactttttggttacag

SEQ ID NO: 1302137 - DNA, 22 bp, Artificial Sequence
  chemically synthesized
ttggttactttttggttacagc

SEQ ID NO: 1302138 - DNA, 22 bp, Artificial Sequence
  chemically synthesized
ggttactttttggttacagctc

SEQ ID NO: 1302139 - DNA, 22 bp, Artificial Sequence
  chemically synthesized
atgcaaagtgatgagctgtaac

SEQ ID NO: 1302140 - DNA, 22 bp, Artificial Sequence
  chemically synthesized
gttactttttggttacagctca

SEQ ID NO: 1302141 - DNA, 22 bp, Artificial Sequence
  chemically synthesized
ctttttggttacagctcatcac

SEQ ID NO: 1302142 - DNA, 22 bp, Artificial Sequence
  chemically synthesized
tttggttacagctcatcacttt

SEQ ID NO: 1302143 - DNA, 22 bp, Artificial Sequence
  chemically synthesized
ttggttacagctcatcactttg

SEQ ID NO: 1302144 - DNA, 22 bp, Artificial Sequence
  chemically synthesized
tggttacagctcatcactttgc

SEQ ID NO: 1302145 - DNA, 22 bp, Artificial Sequence
  chemically synthesized
ggttacagctcatcactttgca

SEQ ID NO: 1302146 - DNA, 22 bp, Artificial Sequence
  chemically synthesized
gttacagctcatcactttgcat

SEQ ID NO: 1302147 - DNA, 22 bp, Artificial Sequence
  chemically synthesized
gaggtatgcactaatgcaaagt

SEQ ID NO: 1302148 - DNA, 22 bp, Artificial Sequence
  chemically synthesized
ggaggtatgcactaatgcaaag

SEQ ID NO: 1302149 - DNA, 22 bp, Artificial Sequence
  chemically synthesized
cagctcatcactttgcattagt

SEQ ID NO: 1302150 - DNA, 22 bp, Artificial Sequence
  chemically synthesized
gaggtttggaggtatgcactaa

SEQ ID NO: 1302151 - DNA, 22 bp, Artificial Sequence
  chemically synthesized
atcactttgcattagtgcatac

SEQ ID NO: 1302152 - DNA, 22 bp, Artificial Sequence
  chemically synthesized
ttggaggtttggaggtatgcac

SEQ ID NO: 1302153 - DNA, 22 bp, Artificial Sequence
  chemically synthesized
tgcattagtgcatacctccaaa

SEQ ID NO: 1302154 - DNA, 22 bp, Artificial Sequence
  chemically synthesized
gcattagtgcatacctccaaac

SEQ ID NO: 1302155 - DNA, 22 bp, Artificial Sequence
  chemically synthesized
cattagtgcatacctccaaacc

SEQ ID NO: 1302156 - DNA, 22 bp, Artificial Sequence
  chemically synthesized
gtgcatacctccaaacctccaa

SEQ ID NO: 1302157 - DNA, 22 bp, Artificial Sequence
  chemically synthesized
taatgatgcatatgagattatt

SEQ ID NO: 1302158 - DNA, 22 bp, Artificial Sequence
  chemically synthesized
ataatgatgcatatgagattat

SEQ ID NO: 1302159 - DNA, 22 bp, Artificial Sequence
  chemically synthesized
caaacctccaataatctcatat

SEQ ID NO: 1302160 - DNA, 22 bp, Artificial Sequence
  chemically synthesized
cttataatgatgcatatgagat

SEQ ID NO: 1302161 - DNA, 22 bp, Artificial Sequence
  chemically synthesized
atctccttataatgatgcatat

SEQ ID NO: 1302162 - DNA, 22 bp, Artificial Sequence
  chemically synthesized
catctccttataatgatgcata

SEQ ID NO: 1302163 - DNA, 22 bp, Artificial Sequence
  chemically synthesized
caataatctcatatgcatcatt

SEQ ID NO: 1302164 - DNA, 22 bp, Artificial Sequence
  chemically synthesized
tcatctccttataatgatgcat

SEQ ID NO: 1302165 - DNA, 22 bp, Artificial Sequence
  chemically synthesized
atccctttcatctccttataat

SEQ ID NO: 1302166 - DNA, 22 bp, Artificial Sequence
  chemically synthesized
aatccctttcatctccttataa

SEQ ID NO: 1302167 - DNA, 22 bp, Artificial Sequence
  chemically synthesized
atatgcatcattataaggagat

SEQ ID NO: 1302168 - DNA, 22 bp, Artificial Sequence
  chemically synthesized
ttaatccctttcatctccttat

SEQ ID NO: 1302169 - DNA, 22 bp, Artificial Sequence
  chemically synthesized
cttaatccctttcatctcctta

SEQ ID NO: 1302170 - DNA, 22 bp, Artificial Sequence
  chemically synthesized
tttcttaatccctttcatctcc

SEQ ID NO: 1302171 - DNA, 22 bp, Artificial Sequence
  chemically synthesized
atttcttaatccctttcatctc

SEQ ID NO: 1302172 - DNA, 22 bp, Artificial Sequence
  chemically synthesized
aacttatttcttaatccctttc

SEQ ID NO: 1302173 - DNA, 22 bp, Artificial Sequence
  chemically synthesized
aaacttatttcttaatcccttt

SEQ ID NO: 1302174 - DNA, 22 bp, Artificial Sequence
  chemically synthesized
taaggagatgaaagggattaag

SEQ ID NO: 1302175 - DNA, 22 bp, Artificial Sequence
  chemically synthesized
acttaaacttatttcttaatcc

SEQ ID NO: 1302176 - DNA, 22 bp, Artificial Sequence
  chemically synthesized
tgcactgacttaaacttatttc

SEQ ID NO: 1302177 - DNA, 22 bp, Artificial Sequence
  chemically synthesized
tatgcactgacttaaacttatt

SEQ ID NO: 1302178 - DNA, 22 bp, Artificial Sequence
  chemically synthesized
atattctatgcactgacttaaa

SEQ ID NO: 1302179 - DNA, 22 bp, Artificial Sequence
  chemically synthesized
aatattctatgcactgacttaa

SEQ ID NO: 1302180 - DNA, 22 bp, Artificial Sequence
  chemically synthesized
taatattctatgcactgactta

SEQ ID NO: 1302181 - DNA, 22 bp, Artificial Sequence
  chemically synthesized
agaaataagtttaagtcagtgc

SEQ ID NO: 1302182 - DNA, 22 bp, Artificial Sequence
  chemically synthesized
ttaatattctatgcactgactt

SEQ ID NO: 1302183 - DNA, 22 bp, Artificial Sequence
  chemically synthesized
aagtcagtgcatagaatattaa

SEQ ID NO: 1302184 - DNA, 22 bp, Artificial Sequence
  chemically synthesized
agtcagtgcatagaatattaaa

SEQ ID NO: 1302185 - DNA, 22 bp, Artificial Sequence
  chemically synthesized
gatgcaaaggaacttttaatat

SEQ ID NO: 1302186 - DNA, 22 bp, Artificial Sequence
  chemically synthesized
atattagatgcaaaggaacttt

SEQ ID NO: 1302187 - DNA, 22 bp, Artificial Sequence
  chemically synthesized
cattcatattagatgcaaagga

SEQ ID NO: 1302188 - DNA, 22 bp, Artificial Sequence
  chemically synthesized
ccattcatattagatgcaaagg

SEQ ID NO: 1302189 - DNA, 22 bp, Artificial Sequence
  chemically synthesized
aaagttcctttgcatctaatat

SEQ ID NO: 1302190 - DNA, 22 bp, Artificial Sequence
  chemically synthesized
ctttgcatctaatatgaatgga

SEQ ID NO: 1302191 - DNA, 22 bp, Artificial Sequence
  chemically synthesized
atagtaatcacttccattcata

SEQ ID NO: 1302192 - DNA, 22 bp, Artificial Sequence
  chemically synthesized
tgcatctaatatgaatggaagt

SEQ ID NO: 1302193 - DNA, 22 bp, Artificial Sequence
  chemically synthesized
gcatctaatatgaatggaagtg

SEQ ID NO: 1302194 - DNA, 22 bp, Artificial Sequence
  chemically synthesized
catctaatatgaatggaagtga

SEQ ID NO: 1302195 - DNA, 22 bp, Artificial Sequence
  chemically synthesized
tattaatagtaatcacttccat

SEQ ID NO: 1302196 - DNA, 22 bp, Artificial Sequence
  chemically synthesized
atattaatagtaatcacttcca

SEQ ID NO: 1302197 - DNA, 22 bp, Artificial Sequence
  chemically synthesized
atatgaatggaagtgattacta

SEQ ID NO: 1302198 - DNA, 22 bp, Artificial Sequence
  chemically synthesized
agtttatattaatagtaatcac

SEQ ID NO: 1302199 - DNA, 22 bp, Artificial Sequence
  chemically synthesized
ttgagtttatattaatagtaat

SEQ ID NO: 1302200 - DNA, 22 bp, Artificial Sequence
  chemically synthesized
ttattgagtttatattaatagt

SEQ ID NO: 1302201 - DNA, 22 bp, Artificial Sequence
  chemically synthesized
attattgagtttatattaatag

SEQ ID NO: 1302202 - DNA, 22 bp, Artificial Sequence
  chemically synthesized
tattattgagtttatattaata

SEQ ID NO: 1302203 - DNA, 22 bp, Artificial Sequence
  chemically synthesized
ttttattattgagtttatatta

SEQ ID NO: 1302204 - DNA, 22 bp, Artificial Sequence
  chemically synthesized
attttattattgagtttatatt

SEQ ID NO: 1302205 - DNA, 22 bp, Artificial Sequence
  chemically synthesized
cttattttattattgagtttat

SEQ ID NO: 1302206 - DNA, 22 bp, Artificial Sequence
  chemically synthesized
gcttattttattattgagttta

SEQ ID NO: 1302207 - DNA, 22 bp, Artificial Sequence
  chemically synthesized
ctattaatataaactcaataat

SEQ ID NO: 1302208 - DNA, 22 bp, Artificial Sequence
  chemically synthesized
ttaatataaactcaataataaa

SEQ ID NO: 1302209 - DNA, 22 bp, Artificial Sequence
  chemically synthesized
atataaactcaataataaaata

SEQ ID NO: 1302210 - DNA, 22 bp, Artificial Sequence
  chemically synthesized
aataataaaataagcaaatgcc

SEQ ID NO: 1302211 - DNA, 22 bp, Artificial Sequence
  chemically synthesized
ggagaaaataaaagcaggcatt

SEQ ID NO: 1302212 - DNA, 22 bp, Artificial Sequence
  chemically synthesized
attaggagaaaataaaagcagg

SEQ ID NO: 1302213 - DNA, 22 bp, Artificial Sequence
  chemically synthesized
ttaattaggagaaaataaaagc

SEQ ID NO: 1302214 - DNA, 22 bp, Artificial Sequence
  chemically synthesized
gttaattaggagaaaataaaag

SEQ ID NO: 1302215 - DNA, 22 bp, Artificial Sequence
  chemically synthesized
aacttgttaattaggagaaaat

SEQ ID NO: 1302216 - DNA, 22 bp, Artificial Sequence
  chemically synthesized
cttttattttctcctaattaac

SEQ ID NO: 1302217 - DNA, 22 bp, Artificial Sequence
  chemically synthesized
ttattttctcctaattaacaag

SEQ ID NO: 1302218 - DNA, 22 bp, Artificial Sequence
  chemically synthesized
tattttctcctaattaacaagt

SEQ ID NO: 1302219 - DNA, 22 bp, Artificial Sequence
  chemically synthesized
attttctcctaattaacaagtt

SEQ ID NO: 1302220 - DNA, 22 bp, Artificial Sequence
  chemically synthesized
ttttctcctaattaacaagttt

SEQ ID NO: 1302221 - DNA, 22 bp, Artificial Sequence
  chemically synthesized
agtgcaaaggattaaacttgtt

SEQ ID NO: 1302222 - DNA, 22 bp, Artificial Sequence
  chemically synthesized
tctcctaattaacaagtttaat

SEQ ID NO: 1302223 - DNA, 22 bp, Artificial Sequence
  chemically synthesized
ctcctaattaacaagtttaatc

SEQ ID NO: 1302224 - DNA, 22 bp, Artificial Sequence
  chemically synthesized
tcctaattaacaagtttaatcc

SEQ ID NO: 1302225 - DNA, 22 bp, Artificial Sequence
  chemically synthesized
ctaattaacaagtttaatcctt

SEQ ID NO: 1302226 - DNA, 22 bp, Artificial Sequence
  chemically synthesized
acattaagtgcaaaggattaaa

SEQ ID NO: 1302227 - DNA, 22 bp, Artificial Sequence
  chemically synthesized
attaacaagtttaatcctttgc

SEQ ID NO: 1302228 - DNA, 22 bp, Artificial Sequence
  chemically synthesized
acaagtttaatcctttgcactt

SEQ ID NO: 1302229 - DNA, 22 bp, Artificial Sequence
  chemically synthesized
aatcctttgcacttaatgttag

SEQ ID NO: 1302230 - DNA, 22 bp, Artificial Sequence
  chemically synthesized
cggggcaaacaactaacattaa

SEQ ID NO: 1302231 - DNA, 22 bp, Artificial Sequence
  chemically synthesized
atcctttgcacttaatgttagt

SEQ ID NO: 1302232 - DNA, 22 bp, Artificial Sequence
  chemically synthesized
tgcacttaatgttagttgtttg

SEQ ID NO: 1302233 - DNA, 22 bp, Artificial Sequence
  chemically synthesized
gcacttaatgttagttgtttgc

SEQ ID NO: 1302234 - DNA, 22 bp, Artificial Sequence
  chemically synthesized
cacttaatgttagttgtttgcc

SEQ ID NO: 1302235 - DNA, 22 bp, Artificial Sequence
  chemically synthesized
aatgttagttgtttgccccgga

SEQ ID NO: 1302236 - DNA, 22 bp, Artificial Sequence
  chemically synthesized
ccaatgccgggctccggggcaa

SEQ ID NO: 1302237 - DNA, 22 bp, Artificial Sequence
  chemically synthesized
atgttagttgtttgccccggag

SEQ ID NO: 1302238 - DNA, 22 bp, Artificial Sequence
  chemically synthesized
gttgtttgccccggagcccggc

SEQ ID NO: 1302239 - DNA, 22 bp, Artificial Sequence
  chemically synthesized
tttgccccggagcccggcattg

SEQ ID NO: 1302240 - DNA, 22 bp, Artificial Sequence
  chemically synthesized
gccccggagcccggcattggta

SEQ ID NO: 1302241 - DNA, 22 bp, Artificial Sequence
  chemically synthesized
ccccggagcccggcattggtag

SEQ ID NO: 1302242 - DNA, 22 bp, Artificial Sequence
  chemically synthesized
gtagacatctcactgctcatgg

SEQ ID NO: 1302243 - DNA, 22 bp, Artificial Sequence
  chemically synthesized
actgctcatgggccattcttgt

SEQ ID NO: 1302244 - DNA, 22 bp, Artificial Sequence
  chemically synthesized
ggagtcaaggtgacaagaatgg

SEQ ID NO: 1302245 - DNA, 22 bp, Artificial Sequence
  chemically synthesized
ctcatgggccattcttgtcacc

SEQ ID NO: 1302246 - DNA, 22 bp, Artificial Sequence
  chemically synthesized
agctgggagtcaaggtgacaag

SEQ ID NO: 1302247 - DNA, 22 bp, Artificial Sequence
  chemically synthesized
atgggccattcttgtcaccttg

SEQ ID NO: 1302248 - DNA, 22 bp, Artificial Sequence
  chemically synthesized
ttgtcaccttgactcccagctc

SEQ ID NO: 1302249 - DNA, 22 bp, Artificial Sequence
  chemically synthesized
gtcaccttgactcccagctcaa

SEQ ID NO: 1302250 - DNA, 22 bp, Artificial Sequence
  chemically synthesized
tcaccttgactcccagctcaac

SEQ ID NO: 1302251 - DNA, 22 bp, Artificial Sequence
  chemically synthesized
aaacatccatcccaaagttgag

SEQ ID NO: 1302252 - DNA, 22 bp, Artificial Sequence
  chemically synthesized
gaaacatccatcccaaagttga

SEQ ID NO: 1302253 - DNA, 22 bp, Artificial Sequence
  chemically synthesized
gactcccagctcaactttggga

SEQ ID NO: 1302254 - DNA, 22 bp, Artificial Sequence
  chemically synthesized
actcccagctcaactttgggat

SEQ ID NO: 1302255 - DNA, 22 bp, Artificial Sequence
  chemically synthesized
ccagctcaactttgggatggat

SEQ ID NO: 1302256 - DNA, 22 bp, Artificial Sequence
  chemically synthesized
aactttgggatggatgtttcaa

SEQ ID NO: 1302257 - DNA, 22 bp, Artificial Sequence
  chemically synthesized
tgggatggatgtttcaaaccac

SEQ ID NO: 1302258 - DNA, 22 bp, Artificial Sequence
  chemically synthesized
gggatggatgtttcaaaccacc

SEQ ID NO: 1302259 - DNA, 22 bp, Artificial Sequence
  chemically synthesized
ggatggatgtttcaaaccacct

SEQ ID NO: 1302260 - DNA, 22 bp, Artificial Sequence
  chemically synthesized
aacacatcgaggcaggtggttt

SEQ ID NO: 1302261 - DNA, 22 bp, Artificial Sequence
  chemically synthesized
gaacacatcgaggcaggtggtt

SEQ ID NO: 1302262 - DNA, 22 bp, Artificial Sequence
  chemically synthesized
caaaccacctgcctcgatgtgt

SEQ ID NO: 1302263 - DNA, 22 bp, Artificial Sequence
  chemically synthesized
aaaccacctgcctcgatgtgtt

SEQ ID NO: 1302264 - DNA, 22 bp, Artificial Sequence
  chemically synthesized
acacaaagtttgaacacatcga

SEQ ID NO: 1302265 - DNA, 22 bp, Artificial Sequence
  chemically synthesized
tcacacaaagtttgaacacatc

SEQ ID NO: 1302266 - DNA, 22 bp, Artificial Sequence
  chemically synthesized
cctcgatgtgttcaaactttgt

SEQ ID NO: 1302267 - DNA, 22 bp, Artificial Sequence
  chemically synthesized
aaaaatgctctcacacaaagtt

SEQ ID NO: 1302268 - DNA, 22 bp, Artificial Sequence
  chemically synthesized
caaaaatgctctcacacaaagt

SEQ ID NO: 1302269 - DNA, 22 bp, Artificial Sequence
  chemically synthesized
gatgtgttcaaactttgtgtga

SEQ ID NO: 1302270 - DNA, 22 bp, Artificial Sequence
  chemically synthesized
cttcaaaaatgctctcacacaa

SEQ ID NO: 1302271 - DNA, 22 bp, Artificial Sequence
  chemically synthesized
cattccttcaaaaatgctctca

SEQ ID NO: 1302272 - DNA, 22 bp, Artificial Sequence
  chemically synthesized
aaactttgtgtgagagcatttt

SEQ ID NO: 1302273 - DNA, 22 bp, Artificial Sequence
  chemically synthesized
aattacattccttcaaaaatgc

SEQ ID NO: 1302274 - DNA, 22 bp, Artificial Sequence
  chemically synthesized
tgtgtgagagcatttttgaagg

SEQ ID NO: 1302275 - DNA, 22 bp, Artificial Sequence
  chemically synthesized
gtgtgagagcatttttgaagga

SEQ ID NO: 1302276 - DNA, 22 bp, Artificial Sequence
  chemically synthesized
tgtgagagcatttttgaaggaa

SEQ ID NO: 1302277 - DNA, 22 bp, Artificial Sequence
  chemically synthesized
atactcaattacattccttcaa

SEQ ID NO: 1302278 - DNA, 22 bp, Artificial Sequence
  chemically synthesized
tcacataattcatactcaatta

SEQ ID NO: 1302279 - DNA, 22 bp, Artificial Sequence
  chemically synthesized
ttgaaggaatgtaattgagtat

SEQ ID NO: 1302280 - DNA, 22 bp, Artificial Sequence
  chemically synthesized
tgaaggaatgtaattgagtatg

SEQ ID NO: 1302281 - DNA, 22 bp, Artificial Sequence
  chemically synthesized
gaaggaatgtaattgagtatga

SEQ ID NO: 1302282 - DNA, 22 bp, Artificial Sequence
  chemically synthesized
ctgtcacataattcatactcaa

SEQ ID NO: 1302283 - DNA, 22 bp, Artificial Sequence
  chemically synthesized
aaggaatgtaattgagtatgaa

SEQ ID NO: 1302284 - DNA, 22 bp, Artificial Sequence
  chemically synthesized
acatatctactgtcacataatt

SEQ ID NO: 1302285 - DNA, 22 bp, Artificial Sequence
  chemically synthesized
agtatgaattatgtgacagtag

SEQ ID NO: 1302286 - DNA, 22 bp, Artificial Sequence
  chemically synthesized
agtcaaaattcacatatctact

SEQ ID NO: 1302287 - DNA, 22 bp, Artificial Sequence
  chemically synthesized
cagtcaaaattcacatatctac

SEQ ID NO: 1302288 - DNA, 22 bp, Artificial Sequence
  chemically synthesized
tcagtcaaaattcacatatcta

SEQ ID NO: 1302289 - DNA, 22 bp, Artificial Sequence
  chemically synthesized
ttcagtcaaaattcacatatct

SEQ ID NO: 1302290 - DNA, 22 bp, Artificial Sequence
  chemically synthesized
tgtgacagtagatatgtgaatt

SEQ ID NO: 1302291 - DNA, 22 bp, Artificial Sequence
  chemically synthesized
caaaacttttcagtcaaaattc

SEQ ID NO: 1302292 - DNA, 22 bp, Artificial Sequence
  chemically synthesized
acaaaacttttcagtcaaaatt

SEQ ID NO: 1302293 - DNA, 22 bp, Artificial Sequence
  chemically synthesized
tacaaaacttttcagtcaaaat

SEQ ID NO: 1302294 - DNA, 22 bp, Artificial Sequence
  chemically synthesized
aagttttacaaaacttttcagt

SEQ ID NO: 1302295 - DNA, 22 bp, Artificial Sequence
  chemically synthesized
tcaagttttacaaaacttttca

SEQ ID NO: 1302296 - DNA, 22 bp, Artificial Sequence
  chemically synthesized
ctcaagttttacaaaacttttc

SEQ ID NO: 1302297 - DNA, 22 bp, Artificial Sequence
  chemically synthesized
atttctcaagttttacaaaact

SEQ ID NO: 1302298 - DNA, 22 bp, Artificial Sequence
  chemically synthesized
tgactgaaaagttttgtaaaac

SEQ ID NO: 1302299 - DNA, 22 bp, Artificial Sequence
  chemically synthesized
gactgaaaagttttgtaaaact

SEQ ID NO: 1302300 - DNA, 22 bp, Artificial Sequence
  chemically synthesized
actgaaaagttttgtaaaactt

SEQ ID NO: 1302301 - DNA, 22 bp, Artificial Sequence
  chemically synthesized
aaaagttttgtaaaacttgaga

SEQ ID NO: 1302302 - DNA, 22 bp, Artificial Sequence
  chemically synthesized
tgtaaaacttgagaaatgaacc

SEQ ID NO: 1302303 - DNA, 22 bp, Artificial Sequence
  chemically synthesized
gtaaaacttgagaaatgaacct

SEQ ID NO: 1302304 - DNA, 22 bp, Artificial Sequence
  chemically synthesized
taaaacttgagaaatgaacctt

SEQ ID NO: 1302305 - DNA, 22 bp, Artificial Sequence
  chemically synthesized
gagaaatgaaccttttggctgg

SEQ ID NO: 1302306 - DNA, 22 bp, Artificial Sequence
  chemically synthesized
agaaatgaaccttttggctggg

SEQ ID NO: 1302307 - DNA, 22 bp, Artificial Sequence
  chemically synthesized
cagatgtgagtcaccgtgccca

SEQ ID NO: 1302308 - DNA, 22 bp, Artificial Sequence
  chemically synthesized
ggattacagatgtgagtcaccg

SEQ ID NO: 1302309 - DNA, 22 bp, Artificial Sequence
  chemically synthesized
ttggctgggcacggtgactcac

SEQ ID NO: 1302310 - DNA, 22 bp, Artificial Sequence
  chemically synthesized
tggctgggcacggtgactcaca

SEQ ID NO: 1302311 - DNA, 22 bp, Artificial Sequence
  chemically synthesized
ggctgggcacggtgactcacat

SEQ ID NO: 1302312 - DNA, 22 bp, Artificial Sequence
  chemically synthesized
gctgggcacggtgactcacatc

SEQ ID NO: 1302313 - DNA, 22 bp, Artificial Sequence
  chemically synthesized
ggcacggtgactcacatctgta

SEQ ID NO: 1302314 - DNA, 22 bp, Artificial Sequence
  chemically synthesized
gagtgctgggattacagatgtg

SEQ ID NO: 1302315 - DNA, 22 bp, Artificial Sequence
  chemically synthesized
ctagagtgctgggattacagat

SEQ ID NO: 1302316 - DNA, 22 bp, Artificial Sequence
  chemically synthesized
agctcctagagtgctgggatta

SEQ ID NO: 1302317 - DNA, 22 bp, Artificial Sequence
  chemically synthesized
acatctgtaatcccagcactct

SEQ ID NO: 1302318 - DNA, 22 bp, Artificial Sequence
  chemically synthesized
acccacctcagctcctagagtg

SEQ ID NO: 1302319 - DNA, 22 bp, Artificial Sequence
  chemically synthesized
taatcccagcactctaggagct

SEQ ID NO: 1302320 - DNA, 22 bp, Artificial Sequence
  chemically synthesized
aagtgattcacccacctcagct

SEQ ID NO: 1302321 - DNA, 22 bp, Artificial Sequence
  chemically synthesized
acctcaagtgattcacccacct

SEQ ID NO: 1302322 - DNA, 22 bp, Artificial Sequence
  chemically synthesized
taggagctgaggtgggtgaatc

SEQ ID NO: 1302323 - DNA, 22 bp, Artificial Sequence
  chemically synthesized
ctgacctcaagtgattcaccca

SEQ ID NO: 1302324 - DNA, 22 bp, Artificial Sequence
  chemically synthesized
ggagctgaggtgggtgaatcac

SEQ ID NO: 1302325 - DNA, 22 bp, Artificial Sequence
  chemically synthesized
gaactcctgacctcaagtgatt

SEQ ID NO: 1302326 - DNA, 22 bp, Artificial Sequence
  chemically synthesized
aggtgggtgaatcacttgaggt

SEQ ID NO: 1302327 - DNA, 22 bp, Artificial Sequence
  chemically synthesized
gtctcgaactcctgacctcaag

SEQ ID NO: 1302328 - DNA, 22 bp, Artificial Sequence
  chemically synthesized
gccaagctggtctcgaactcct

SEQ ID NO: 1302329 - DNA, 22 bp, Artificial Sequence
  chemically synthesized
gaggtcaggagttcgagaccag

SEQ ID NO: 1302330 - DNA, 22 bp, Artificial Sequence
  chemically synthesized
aggtcaggagttcgagaccagc

SEQ ID NO: 1302331 - DNA, 22 bp, Artificial Sequence
  chemically synthesized
gccatgttggccaagctggtct

SEQ ID NO: 1302332 - DNA, 22 bp, Artificial Sequence
  chemically synthesized
cgccatgttggccaagctggtc

SEQ ID NO: 1302333 - DNA, 22 bp, Artificial Sequence
  chemically synthesized
gagaccagcttggccaacatgg

SEQ ID NO: 1302334 - DNA, 22 bp, Artificial Sequence
  chemically synthesized
gtagagacggggtttcgccatg

SEQ ID NO: 1302335 - DNA, 22 bp, Artificial Sequence
  chemically synthesized
agtagagacggggtttcgccat

SEQ ID NO: 1302336 - DNA, 22 bp, Artificial Sequence
  chemically synthesized
tagtagagacggggtttcgcca

SEQ ID NO: 1302337 - DNA, 22 bp, Artificial Sequence
  chemically synthesized
ttagtagagacggggtttcgcc

SEQ ID NO: 1302338 - DNA, 22 bp, Artificial Sequence
  chemically synthesized
tttagtagagacggggtttcgc

SEQ ID NO: 1302339 - DNA, 22 bp, Artificial Sequence
  chemically synthesized
ggccaacatggcgaaaccccgt

SEQ ID NO: 1302340 - DNA, 22 bp, Artificial Sequence
  chemically synthesized
gccaacatggcgaaaccccgtc

SEQ ID NO: 1302341 - DNA, 22 bp, Artificial Sequence
  chemically synthesized
tgttttttagtagagacggggt

SEQ ID NO: 1302342 - DNA, 22 bp, Artificial Sequence
  chemically synthesized
gtgttttttagtagagacgggg

SEQ ID NO: 1302343 - DNA, 22 bp, Artificial Sequence
  chemically synthesized
tgtgttttttagtagagacggg

SEQ ID NO: 1302344 - DNA, 22 bp, Artificial Sequence
  chemically synthesized
ttgtgttttttagtagagacgg

SEQ ID NO: 1302345 - DNA, 22 bp, Artificial Sequence
  chemically synthesized
atttttgtgttttttagtagag

SEQ ID NO: 1302346 - DNA, 22 bp, Artificial Sequence
  chemically synthesized
tactaaaaaacacaaaaattag

SEQ ID NO: 1302347 - DNA, 22 bp, Artificial Sequence
  chemically synthesized
ctaaaaaacacaaaaattagcc

SEQ ID NO: 1302348 - DNA, 22 bp, Artificial Sequence
  chemically synthesized
aaaaacacaaaaattagccggg

SEQ ID NO: 1302349 - DNA, 22 bp, Artificial Sequence
  chemically synthesized
caggtgcatgccaccatgcccg

SEQ ID NO: 1302350 - DNA, 22 bp, Artificial Sequence
  chemically synthesized
ggattacaggtgcatgccacca

SEQ ID NO: 1302351 - DNA, 22 bp, Artificial Sequence
  chemically synthesized
gccgggcatggtggcatgcacc

SEQ ID NO: 1302352 - DNA, 22 bp, Artificial Sequence
  chemically synthesized
cgagtagctgggattacaggtg

SEQ ID NO: 1302353 - DNA, 22 bp, Artificial Sequence
  chemically synthesized
gcgagtagctgggattacaggt

SEQ ID NO: 1302354 - DNA, 22 bp, Artificial Sequence
  chemically synthesized
agacttgcgagtagctgggatt

SEQ ID NO: 1302355 - DNA, 22 bp, Artificial Sequence
  chemically synthesized
cctgagacttgcgagtagctgg

SEQ ID NO: 1302356 - DNA, 22 bp, Artificial Sequence
  chemically synthesized
ctgcctgagacttgcgagtagc

SEQ ID NO: 1302357 - DNA, 22 bp, Artificial Sequence
  chemically synthesized
tcctgcctgagacttgcgagta

SEQ ID NO: 1302358 - DNA, 22 bp, Artificial Sequence
  chemically synthesized
taatcccagctactcgcaagtc

SEQ ID NO: 1302359 - DNA, 22 bp, Artificial Sequence
  chemically synthesized
atgcgattctcctgcctgagac

SEQ ID NO: 1302360 - DNA, 22 bp, Artificial Sequence
  chemically synthesized
ctcgcaagtctcaggcaggaga

SEQ ID NO: 1302361 - DNA, 22 bp, Artificial Sequence
  chemically synthesized
ggttcatgcgattctcctgcct

SEQ ID NO: 1302362 - DNA, 22 bp, Artificial Sequence
  chemically synthesized
gcaagtctcaggcaggagaatc

SEQ ID NO: 1302363 - DNA, 22 bp, Artificial Sequence
  chemically synthesized
ctgggttcatgcgattctcctg

SEQ ID NO: 1302364 - DNA, 22 bp, Artificial Sequence
  chemically synthesized
cctcctgggttcatgcgattct

SEQ ID NO: 1302365 - DNA, 22 bp, Artificial Sequence
  chemically synthesized
tgcctcctgggttcatgcgatt

SEQ ID NO: 1302366 - DNA, 22 bp, Artificial Sequence
  chemically synthesized
ctgcctcctgggttcatgcgat

SEQ ID NO: 1302367 - DNA, 22 bp, Artificial Sequence
  chemically synthesized
aggcaggagaatcgcatgaacc

SEQ ID NO: 1302368 - DNA, 22 bp, Artificial Sequence
  chemically synthesized
caacttctgcctcctgggttca

SEQ ID NO: 1302369 - DNA, 22 bp, Artificial Sequence
  chemically synthesized
actgcaacttctgcctcctggg

SEQ ID NO: 1302370 - DNA, 22 bp, Artificial Sequence
  chemically synthesized
gctcactgcaacttctgcctcc

SEQ ID NO: 1302371 - DNA, 22 bp, Artificial Sequence
  chemically synthesized
ggctcactgcaacttctgcctc

SEQ ID NO: 1302372 - DNA, 22 bp, Artificial Sequence
  chemically synthesized
gagtgcagtgacgcgatcttgg

SEQ ID NO: 1302373 - DNA, 22 bp, Artificial Sequence
  chemically synthesized
cagtgagccaagatcgcgtcac

SEQ ID NO: 1302374 - DNA, 22 bp, Artificial Sequence
  chemically synthesized
tcacccaggctggagtgcagtg

SEQ ID NO: 1302375 - DNA, 22 bp, Artificial Sequence
  chemically synthesized
tgtcacccaggctggagtgcag

SEQ ID NO: 1302376 - DNA, 22 bp, Artificial Sequence
  chemically synthesized
gctctgtcacccaggctggagt

SEQ ID NO: 1302377 - DNA, 22 bp, Artificial Sequence
  chemically synthesized
cactccagcctgggtgacagag

SEQ ID NO: 1302378 - DNA, 22 bp, Artificial Sequence
  chemically synthesized
agacgaagcctcgctctgtcac

SEQ ID NO: 1302379 - DNA, 22 bp, Artificial Sequence
  chemically synthesized
gagacgaagcctcgctctgtca

SEQ ID NO: 1302380 - DNA, 22 bp, Artificial Sequence
  chemically synthesized
tgagacgaagcctcgctctgtc

SEQ ID NO: 1302381 - DNA, 22 bp, Artificial Sequence
  chemically synthesized
ttgagacgaagcctcgctctgt

SEQ ID NO: 1302382 - DNA, 22 bp, Artificial Sequence
  chemically synthesized
cagcctgggtgacagagcgagg

SEQ ID NO: 1302383 - DNA, 22 bp, Artificial Sequence
  chemically synthesized
tttgagacgaagcctcgctctg

SEQ ID NO: 1302384 - DNA, 22 bp, Artificial Sequence
  chemically synthesized
ttttgagacgaagcctcgctct

SEQ ID NO: 1302385 - DNA, 22 bp, Artificial Sequence
  chemically synthesized
ttttttgagacgaagcctcgct

SEQ ID NO: 1302386 - DNA, 22 bp, Artificial Sequence
  chemically synthesized
cttttttgagacgaagcctcgc

SEQ ID NO: 1302387 - DNA, 22 bp, Artificial Sequence
  chemically synthesized
tcttttttgagacgaagcctcg

SEQ ID NO: 1302388 - DNA, 22 bp, Artificial Sequence
  chemically synthesized
ttcttttttgagacgaagcctc

SEQ ID NO: 1302389 - DNA, 22 bp, Artificial Sequence
  chemically synthesized
ggtgacagagcgaggcttcgtc

SEQ ID NO: 1302390 - DNA, 22 bp, Artificial Sequence
  chemically synthesized
tttcttttttgagacgaagcct

SEQ ID NO: 1302391 - DNA, 22 bp, Artificial Sequence
  chemically synthesized
ttttcttttttgagacgaagcc

SEQ ID NO: 1302392 - DNA, 22 bp, Artificial Sequence
  chemically synthesized
tttttcttttttgagacgaagc

SEQ ID NO: 1302393 - DNA, 22 bp, Artificial Sequence
  chemically synthesized
ttttttcttttttgagacgaag

SEQ ID NO: 1302394 - DNA, 22 bp, Artificial Sequence
  chemically synthesized
ttttttttcttttttgagacga

SEQ ID NO: 1302395 - DNA, 22 bp, Artificial Sequence
  chemically synthesized
cttttttttcttttttgagacg

SEQ ID NO: 1302396 - DNA, 22 bp, Artificial Sequence
  chemically synthesized
tcttttttttcttttttgagac

SEQ ID NO: 1302397 - DNA, 22 bp, Artificial Sequence
  chemically synthesized
ttcttttttttcttttttgaga

SEQ ID NO: 1302398 - DNA, 22 bp, Artificial Sequence
  chemically synthesized
atttttcttttttttctttttt

SEQ ID NO: 1302399 - DNA, 22 bp, Artificial Sequence
  chemically synthesized
catttttcttttttttcttttt

SEQ ID NO: 1302400 - DNA, 22 bp, Artificial Sequence
  chemically synthesized
cgtctcaaaaaagaaaaaaaag

SEQ ID NO: 1302401 - DNA, 22 bp, Artificial Sequence
  chemically synthesized
gtctcaaaaaagaaaaaaaaga

SEQ ID NO: 1302402 - DNA, 22 bp, Artificial Sequence
  chemically synthesized
aaaaaagaaaaaaaagaaaaat

SEQ ID NO: 1302403 - DNA, 22 bp, Artificial Sequence
  chemically synthesized
aagaaaaaatttcatttttctt

SEQ ID NO: 1302404 - DNA, 22 bp, Artificial Sequence
  chemically synthesized
taaaattgaagaaaaaatttca

SEQ ID NO: 1302405 - DNA, 22 bp, Artificial Sequence
  chemically synthesized
ctataaaattgaagaaaaaatt

SEQ ID NO: 1302406 - DNA, 22 bp, Artificial Sequence
  chemically synthesized
actataaaattgaagaaaaaat

SEQ ID NO: 1302407 - DNA, 22 bp, Artificial Sequence
  chemically synthesized
atttactataaaattgaagaaa

SEQ ID NO: 1302408 - DNA, 22 bp, Artificial Sequence
  chemically synthesized
catttactataaaattgaagaa

SEQ ID NO: 1302409 - DNA, 22 bp, Artificial Sequence
  chemically synthesized
ttcatttactataaaattgaag

SEQ ID NO: 1302410 - DNA, 22 bp, Artificial Sequence
  chemically synthesized
cttcatttactataaaattgaa

SEQ ID NO: 1302411 - DNA, 22 bp, Artificial Sequence
  chemically synthesized
tcttcatttactataaaattga

SEQ ID NO: 1302412 - DNA, 22 bp, Artificial Sequence
  chemically synthesized
tttcttcaattttatagtaaat

SEQ ID NO: 1302413 - DNA, 22 bp, Artificial Sequence
  chemically synthesized
ttcttcaattttatagtaaatg

SEQ ID NO: 1302414 - DNA, 22 bp, Artificial Sequence
  chemically synthesized
tcttcaattttatagtaaatga

SEQ ID NO: 1302415 - DNA, 22 bp, Artificial Sequence
  chemically synthesized
cttcaattttatagtaaatgaa

SEQ ID NO: 1302416 - DNA, 22 bp, Artificial Sequence
  chemically synthesized
ttcaattttatagtaaatgaag

SEQ ID NO: 1302417 - DNA, 22 bp, Artificial Sequence
  chemically synthesized
caattttatagtaaatgaagaa

SEQ ID NO: 1302418 - DNA, 22 bp, Artificial Sequence
  chemically synthesized
aattttatagtaaatgaagaaa

SEQ ID NO: 1302419 - DNA, 22 bp, Artificial Sequence
  chemically synthesized
ggagaaatgaaatgttttcttc

SEQ ID NO: 1302420 - DNA, 22 bp, Artificial Sequence
  chemically synthesized
cggagaaatgaaatgttttctt

SEQ ID NO: 1302421 - DNA, 22 bp, Artificial Sequence
  chemically synthesized
tatagtaaatgaagaaaacatt

SEQ ID NO: 1302422 - DNA, 22 bp, Artificial Sequence
  chemically synthesized
atagtaaatgaagaaaacattt

SEQ ID NO: 1302423 - DNA, 22 bp, Artificial Sequence
  chemically synthesized
tagtaaatgaagaaaacatttc

SEQ ID NO: 1302424 - DNA, 22 bp, Artificial Sequence
  chemically synthesized
cgggtgtcaatcaaaatagtct

SEQ ID NO: 1302425 - DNA, 22 bp, Artificial Sequence
  chemically synthesized
catttctccgaagactattttg

SEQ ID NO: 1302426 - DNA, 22 bp, Artificial Sequence
  chemically synthesized
atttctccgaagactattttga

SEQ ID NO: 1302427 - DNA, 22 bp, Artificial Sequence
  chemically synthesized
ctccgaagactattttgattga

SEQ ID NO: 1302428 - DNA, 22 bp, Artificial Sequence
  chemically synthesized
tccgaagactattttgattgac

SEQ ID NO: 1302429 - DNA, 22 bp, Artificial Sequence
  chemically synthesized
cgaagactattttgattgacac

SEQ ID NO: 1302430 - DNA, 22 bp, Artificial Sequence
  chemically synthesized
ttttgattgacacccgtagcct

SEQ ID NO: 1302431 - DNA, 22 bp, Artificial Sequence
  chemically synthesized
tgattgacacccgtagcctatg

SEQ ID NO: 1302432 - DNA, 22 bp, Artificial Sequence
  chemically synthesized
gattgacacccgtagcctatgg

SEQ ID NO: 1302433 - DNA, 22 bp, Artificial Sequence
  chemically synthesized
attgacacccgtagcctatggg

SEQ ID NO: 1302434 - DNA, 22 bp, Artificial Sequence
  chemically synthesized
acacccgtagcctatgggggtt

SEQ ID NO: 1302435 - DNA, 22 bp, Artificial Sequence
  chemically synthesized
caacaacggaaaagagggaata

SEQ ID NO: 1302436 - DNA, 22 bp, Artificial Sequence
  chemically synthesized
tgggggtttcatattccctctt

SEQ ID NO: 1302437 - DNA, 22 bp, Artificial Sequence
  chemically synthesized
catattccctcttttccgttgt

SEQ ID NO: 1302438 - DNA, 22 bp, Artificial Sequence
  chemically synthesized
atattccctcttttccgttgtt

SEQ ID NO: 1302439 - DNA, 22 bp, Artificial Sequence
  chemically synthesized
aaccatgatatctccaacaacg

SEQ ID NO: 1302440 - DNA, 22 bp, Artificial Sequence
  chemically synthesized
aaaccatgatatctccaacaac

SEQ ID NO: 1302441 - DNA, 22 bp, Artificial Sequence
  chemically synthesized
cctcttttccgttgttggagat

SEQ ID NO: 1302442 - DNA, 22 bp, Artificial Sequence
  chemically synthesized
ttttccgttgttggagatatca

SEQ ID NO: 1302443 - DNA, 22 bp, Artificial Sequence
  chemically synthesized
aaaatttaaaccatgatatctc

SEQ ID NO: 1302444 - DNA, 22 bp, Artificial Sequence
  chemically synthesized
ttccgttgttggagatatcatg

SEQ ID NO: 1302445 - DNA, 22 bp, Artificial Sequence
  chemically synthesized
tccgttgttggagatatcatgg

SEQ ID NO: 1302446 - DNA, 22 bp, Artificial Sequence
  chemically synthesized
ccgttgttggagatatcatggt

SEQ ID NO: 1302447 - DNA, 22 bp, Artificial Sequence
  chemically synthesized
ctaaaaatttaaaccatgatat

SEQ ID NO: 1302448 - DNA, 22 bp, Artificial Sequence
  chemically synthesized
cgttgttggagatatcatggtt

SEQ ID NO: 1302449 - DNA, 22 bp, Artificial Sequence
  chemically synthesized
cctaaaaatttaaaccatgata

SEQ ID NO: 1302450 - DNA, 22 bp, Artificial Sequence
  chemically synthesized
ttggagatatcatggtttaaat

SEQ ID NO: 1302451 - DNA, 22 bp, Artificial Sequence
  chemically synthesized
gagatatcatggtttaaatttt

SEQ ID NO: 1302452 - DNA, 22 bp, Artificial Sequence
  chemically synthesized
agatacttcctaaaaatttaaa

SEQ ID NO: 1302453 - DNA, 22 bp, Artificial Sequence
  chemically synthesized
tgaatgattgagatacttccta

SEQ ID NO: 1302454 - DNA, 22 bp, Artificial Sequence
  chemically synthesized
atgaatgattgagatacttcct

SEQ ID NO: 1302455 - DNA, 22 bp, Artificial Sequence
  chemically synthesized
tatgaatgattgagatacttcc

SEQ ID NO: 1302456 - DNA, 22 bp, Artificial Sequence
  chemically synthesized
ttatgaatgattgagatacttc

SEQ ID NO: 1302457 - DNA, 22 bp, Artificial Sequence
  chemically synthesized
aaatttttaggaagtatctcaa

SEQ ID NO: 1302458 - DNA, 22 bp, Artificial Sequence
  chemically synthesized
aatttttaggaagtatctcaat

SEQ ID NO: 1302459 - DNA, 22 bp, Artificial Sequence
  chemically synthesized
acacttttatgaatgattgaga

SEQ ID NO: 1302460 - DNA, 22 bp, Artificial Sequence
  chemically synthesized
ttaggaagtatctcaatcattc

SEQ ID NO: 1302461 - DNA, 22 bp, Artificial Sequence
  chemically synthesized
taggaagtatctcaatcattca

SEQ ID NO: 1302462 - DNA, 22 bp, Artificial Sequence
  chemically synthesized
aggaagtatctcaatcattcat

SEQ ID NO: 1302463 - DNA, 22 bp, Artificial Sequence
  chemically synthesized
ggaagtatctcaatcattcata

SEQ ID NO: 1302464 - DNA, 22 bp, Artificial Sequence
  chemically synthesized
gaatactcacacttttatgaat

SEQ ID NO: 1302465 - DNA, 22 bp, Artificial Sequence
  chemically synthesized
agaatactcacacttttatgaa

SEQ ID NO: 1302466 - DNA, 22 bp, Artificial Sequence
  chemically synthesized
aatcattcataaaagtgtgagt

SEQ ID NO: 1302467 - DNA, 22 bp, Artificial Sequence
  chemically synthesized
aagtaacttagaatactcacac

SEQ ID NO: 1302468 - DNA, 22 bp, Artificial Sequence
  chemically synthesized
attgaagtaacttagaatactc

SEQ ID NO: 1302469 - DNA, 22 bp, Artificial Sequence
  chemically synthesized
ataaaagtgtgagtattctaag

SEQ ID NO: 1302470 - DNA, 22 bp, Artificial Sequence
  chemically synthesized
tatctcattgaagtaacttaga

SEQ ID NO: 1302471 - DNA, 22 bp, Artificial Sequence
  chemically synthesized
gtatctcattgaagtaacttag

SEQ ID NO: 1302472 - DNA, 22 bp, Artificial Sequence
  chemically synthesized
tgtatctcattgaagtaactta

SEQ ID NO: 1302473 - DNA, 22 bp, Artificial Sequence
  chemically synthesized
caaaattttgtatctcattgaa

SEQ ID NO: 1302474 - DNA, 22 bp, Artificial Sequence
  chemically synthesized
taagttacttcaatgagataca

SEQ ID NO: 1302475 - DNA, 22 bp, Artificial Sequence
  chemically synthesized
agttacttcaatgagatacaaa

SEQ ID NO: 1302476 - DNA, 22 bp, Artificial Sequence
  chemically synthesized
cttcaatgagatacaaaatttt

SEQ ID NO: 1302477 - DNA, 22 bp, Artificial Sequence
  chemically synthesized
caatgagatacaaaattttgga

SEQ ID NO: 1302478 - DNA, 22 bp, Artificial Sequence
  chemically synthesized
aatgagatacaaaattttggag

SEQ ID NO: 1302479 - DNA, 22 bp, Artificial Sequence
  chemically synthesized
aaacatggaagcagggctccaa

SEQ ID NO: 1302480 - DNA, 22 bp, Artificial Sequence
  chemically synthesized
aagttgaaacatggaagcaggg

SEQ ID NO: 1302481 - DNA, 22 bp, Artificial Sequence
  chemically synthesized
gaagttgaaacatggaagcagg

SEQ ID NO: 1302482 - DNA, 22 bp, Artificial Sequence
  chemically synthesized
tgaagttgaaacatggaagcag

SEQ ID NO: 1302483 - DNA, 22 bp, Artificial Sequence
  chemically synthesized
ttgaagttgaaacatggaagca

SEQ ID NO: 1302484 - DNA, 22 bp, Artificial Sequence
  chemically synthesized
cttttgaagttgaaacatggaa

SEQ ID NO: 1302485 - DNA, 22 bp, Artificial Sequence
  chemically synthesized
tggagccctgcttccatgtttc

SEQ ID NO: 1302486 - DNA, 22 bp, Artificial Sequence
  chemically synthesized
ggagccctgcttccatgtttca

SEQ ID NO: 1302487 - DNA, 22 bp, Artificial Sequence
  chemically synthesized
tacttttgaagttgaaacatgg

SEQ ID NO: 1302488 - DNA, 22 bp, Artificial Sequence
  chemically synthesized
gagccctgcttccatgtttcaa

SEQ ID NO: 1302489 - DNA, 22 bp, Artificial Sequence
  chemically synthesized
ctacttttgaagttgaaacatg

SEQ ID NO: 1302490 - DNA, 22 bp, Artificial Sequence
  chemically synthesized
acttctacttttgaagttgaaa

SEQ ID NO: 1302491 - DNA, 22 bp, Artificial Sequence
  chemically synthesized
cttccatgtttcaacttcaaaa

SEQ ID NO: 1302492 - DNA, 22 bp, Artificial Sequence
  chemically synthesized
gaactgacttctacttttgaag

SEQ ID NO: 1302493 - DNA, 22 bp, Artificial Sequence
  chemically synthesized
ccatgtttcaacttcaaaagta

SEQ ID NO: 1302494 - DNA, 22 bp, Artificial Sequence
  chemically synthesized
catgtttcaacttcaaaagtag

SEQ ID NO: 1302495 - DNA, 22 bp, Artificial Sequence
  chemically synthesized
caacttcaaaagtagaagtcag

SEQ ID NO: 1302496 - DNA, 22 bp, Artificial Sequence
  chemically synthesized
aacttcaaaagtagaagtcagt

SEQ ID NO: 1302497 - DNA, 22 bp, Artificial Sequence
  chemically synthesized
caaaagtagaagtcagttcgaa

SEQ ID NO: 1302498 - DNA, 22 bp, Artificial Sequence
  chemically synthesized
aaaagtagaagtcagttcgaac

SEQ ID NO: 1302499 - DNA, 22 bp, Artificial Sequence
  chemically synthesized
aagtgcagtcaccagggagttc

SEQ ID NO: 1302500 - DNA, 22 bp, Artificial Sequence
  chemically synthesized
tcaagtgcagtcaccagggagt

SEQ ID NO: 1302501 - DNA, 22 bp, Artificial Sequence
  chemically synthesized
ttctcaagtgcagtcaccaggg

SEQ ID NO: 1302502 - DNA, 22 bp, Artificial Sequence
  chemically synthesized
attctcaagtgcagtcaccagg

SEQ ID NO: 1302503 - DNA, 22 bp, Artificial Sequence
  chemically synthesized
gaactccctggtgactgcactt

SEQ ID NO: 1302504 - DNA, 22 bp, Artificial Sequence
  chemically synthesized
atagtttattctcaagtgcagt

SEQ ID NO: 1302505 - DNA, 22 bp, Artificial Sequence
  chemically synthesized
actgatagtttattctcaagtg

SEQ ID NO: 1302506 - DNA, 22 bp, Artificial Sequence
  chemically synthesized
cctggtgactgcacttgagaat

SEQ ID NO: 1302507 - DNA, 22 bp, Artificial Sequence
  chemically synthesized
gtgactgcacttgagaataaac

SEQ ID NO: 1302508 - DNA, 22 bp, Artificial Sequence
  chemically synthesized
cacttgagaataaactatcagt

SEQ ID NO: 1302509 - DNA, 22 bp, Artificial Sequence
  chemically synthesized
gagaataaactatcagtcaata

SEQ ID NO: 1302510 - DNA, 22 bp, Artificial Sequence
  chemically synthesized
agaataaactatcagtcaatac

SEQ ID NO: 1302511 - DNA, 22 bp, Artificial Sequence
  chemically synthesized
tcagtcaataccacactcctta

SEQ ID NO: 1302512 - DNA, 22 bp, Artificial Sequence
  chemically synthesized
cttatcttttctttttccttcc

SEQ ID NO: 1302513 - DNA, 22 bp, Artificial Sequence
  chemically synthesized
atcttttctttttccttcctac

SEQ ID NO: 1302514 - DNA, 22 bp, Artificial Sequence
  chemically synthesized
tcttttctttttccttcctacg

SEQ ID NO: 1302515 - DNA, 22 bp, Artificial Sequence
  chemically synthesized
ttctttttccttcctacgccca

SEQ ID NO: 1302516 - DNA, 22 bp, Artificial Sequence
  chemically synthesized
tctttttccttcctacgcccac

SEQ ID NO: 1302517 - DNA, 22 bp, Artificial Sequence
  chemically synthesized
ctttttccttcctacgcccacc

SEQ ID NO: 1302518 - DNA, 22 bp, Artificial Sequence
  chemically synthesized
tttttccttcctacgcccaccc

SEQ ID NO: 1302519 - DNA, 22 bp, Artificial Sequence
  chemically synthesized
gtggggtggggtggggtgggcg

SEQ ID NO: 1302520 - DNA, 22 bp, Artificial Sequence
  chemically synthesized
tttccttcctacgcccacccca

SEQ ID NO: 1302521 - DNA, 22 bp, Artificial Sequence
  chemically synthesized
ggtggggtggggtggggtgggc

SEQ ID NO: 1302522 - DNA, 22 bp, Artificial Sequence
  chemically synthesized
ttccttcctacgcccaccccac

SEQ ID NO: 1302523 - DNA, 22 bp, Artificial Sequence
  chemically synthesized
tccttcctacgcccaccccacc

SEQ ID NO: 1302524 - DNA, 22 bp, Artificial Sequence
  chemically synthesized
ccttcctacgcccaccccaccc

SEQ ID NO: 1302525 - DNA, 22 bp, Artificial Sequence
  chemically synthesized
tttggtggggtggggtggggtg

SEQ ID NO: 1302526 - DNA, 22 bp, Artificial Sequence
  chemically synthesized
cttcctacgcccaccccacccc

SEQ ID NO: 1302527 - DNA, 22 bp, Artificial Sequence
  chemically synthesized
gtttggtggggtggggtggggt

SEQ ID NO: 1302528 - DNA, 22 bp, Artificial Sequence
  chemically synthesized
cctacgcccaccccaccccacc

SEQ ID NO: 1302529 - DNA, 22 bp, Artificial Sequence
  chemically synthesized
tttgtttggtggggtggggtgg

SEQ ID NO: 1302530 - DNA, 22 bp, Artificial Sequence
  chemically synthesized
ctacgcccaccccaccccaccc

SEQ ID NO: 1302531 - DNA, 22 bp, Artificial Sequence
  chemically synthesized
gtttgtttggtggggtggggtg

SEQ ID NO: 1302532 - DNA, 22 bp, Artificial Sequence
  chemically synthesized
cgcccaccccaccccaccccac

SEQ ID NO: 1302533 - DNA, 22 bp, Artificial Sequence
  chemically synthesized
tttgtttgtttggtggggtggg

SEQ ID NO: 1302534 - DNA, 22 bp, Artificial Sequence
  chemically synthesized
gtttgtttgtttggtggggtgg

SEQ ID NO: 1302535 - DNA, 22 bp, Artificial Sequence
  chemically synthesized
tgtttgtttgtttggtggggtg

SEQ ID NO: 1302536 - DNA, 22 bp, Artificial Sequence
  chemically synthesized
ttttgtttgtttgtttggtggg

SEQ ID NO: 1302537 - DNA, 22 bp, Artificial Sequence
  chemically synthesized
gttttgtttgtttgtttggtgg

SEQ ID NO: 1302538 - DNA, 22 bp, Artificial Sequence
  chemically synthesized
tgttttgtttgtttgtttggtg

SEQ ID NO: 1302539 - DNA, 22 bp, Artificial Sequence
  chemically synthesized
ttgttttgtttgtttgtttggt

SEQ ID NO: 1302540 - DNA, 22 bp, Artificial Sequence
  chemically synthesized
tttgttttgtttgtttgtttgg

SEQ ID NO: 1302541 - DNA, 22 bp, Artificial Sequence
  chemically synthesized
gcctttttgttttgtttgtttg

SEQ ID NO: 1302542 - DNA, 22 bp, Artificial Sequence
  chemically synthesized
tcctggcctttttgttttgttt

SEQ ID NO: 1302543 - DNA, 22 bp, Artificial Sequence
  chemically synthesized
ctgtcctggcctttttgttttg

SEQ ID NO: 1302544 - DNA, 22 bp, Artificial Sequence
  chemically synthesized
aaaagtgtagaacctgctgtcc

SEQ ID NO: 1302545 - DNA, 22 bp, Artificial Sequence
  chemically synthesized
cattcaaaagtgtagaacctgc

SEQ ID NO: 1302546 - DNA, 22 bp, Artificial Sequence
  chemically synthesized
tccaaaattgcattcaaaagtg

SEQ ID NO: 1302547 - DNA, 22 bp, Artificial Sequence
  chemically synthesized
gcacactgtccaaaattgcatt

SEQ ID NO: 1302548 - DNA, 22 bp, Artificial Sequence
  chemically synthesized
ggcacactgtccaaaattgcat

SEQ ID NO: 1302549 - DNA, 22 bp, Artificial Sequence
  chemically synthesized
tacacttttgaatgcaattttg

SEQ ID NO: 1302550 - DNA, 22 bp, Artificial Sequence
  chemically synthesized
cacttttgaatgcaattttgga

SEQ ID NO: 1302551 - DNA, 22 bp, Artificial Sequence
  chemically synthesized
agatttggcacactgtccaaaa

SEQ ID NO: 1302552 - DNA, 22 bp, Artificial Sequence
  chemically synthesized
ttgaatgcaattttggacagtg

SEQ ID NO: 1302553 - DNA, 22 bp, Artificial Sequence
  chemically synthesized
tgaatgcaattttggacagtgt

SEQ ID NO: 1302554 - DNA, 22 bp, Artificial Sequence
  chemically synthesized
gaatgcaattttggacagtgtg

SEQ ID NO: 1302555 - DNA, 22 bp, Artificial Sequence
  chemically synthesized
aatgcaattttggacagtgtgc

SEQ ID NO: 1302556 - DNA, 22 bp, Artificial Sequence
  chemically synthesized
aaactgagatttggcacactgt

SEQ ID NO: 1302557 - DNA, 22 bp, Artificial Sequence
  chemically synthesized
tgatgttgaaactgagatttgg

SEQ ID NO: 1302558 - DNA, 22 bp, Artificial Sequence
  chemically synthesized
tggacagtgtgccaaatctcag

SEQ ID NO: 1302559 - DNA, 22 bp, Artificial Sequence
  chemically synthesized
gtgatgttgaaactgagatttg

SEQ ID NO: 1302560 - DNA, 22 bp, Artificial Sequence
  chemically synthesized
ggacagtgtgccaaatctcagt

SEQ ID NO: 1302561 - DNA, 22 bp, Artificial Sequence
  chemically synthesized
gacagtgtgccaaatctcagtt

SEQ ID NO: 1302562 - DNA, 22 bp, Artificial Sequence
  chemically synthesized
atttgtgatgttgaaactgaga

SEQ ID NO: 1302563 - DNA, 22 bp, Artificial Sequence
  chemically synthesized
tgaaacctaatttgtgatgttg

SEQ ID NO: 1302564 - DNA, 22 bp, Artificial Sequence
  chemically synthesized
gtgaaacctaatttgtgatgtt

SEQ ID NO: 1302565 - DNA, 22 bp, Artificial Sequence
  chemically synthesized
agtttcaacatcacaaattagg

SEQ ID NO: 1302566 - DNA, 22 bp, Artificial Sequence
  chemically synthesized
caacatcacaaattaggtttca

SEQ ID NO: 1302567 - DNA, 22 bp, Artificial Sequence
  chemically synthesized
agaatccatttgtgaaacctaa

SEQ ID NO: 1302568 - DNA, 22 bp, Artificial Sequence
  chemically synthesized
aacatcacaaattaggtttcac

SEQ ID NO: 1302569 - DNA, 22 bp, Artificial Sequence
  chemically synthesized
tatattcagaatccatttgtga

SEQ ID NO: 1302570 - DNA, 22 bp, Artificial Sequence
  chemically synthesized
gtatattcagaatccatttgtg

SEQ ID NO: 1302571 - DNA, 22 bp, Artificial Sequence
  chemically synthesized
tgtatattcagaatccatttgt

SEQ ID NO: 1302572 - DNA, 22 bp, Artificial Sequence
  chemically synthesized
ggtttcacaaatggattctgaa

SEQ ID NO: 1302573 - DNA, 22 bp, Artificial Sequence
  chemically synthesized
aaaagcattttgtatattcaga

SEQ ID NO: 1302574 - DNA, 22 bp, Artificial Sequence
  chemically synthesized
cacaaatggattctgaatatac

SEQ ID NO: 1302575 - DNA, 22 bp, Artificial Sequence
  chemically synthesized
acaaatggattctgaatataca

SEQ ID NO: 1302576 - DNA, 22 bp, Artificial Sequence
  chemically synthesized
tgaatatacaaaatgcttttga

SEQ ID NO: 1302577 - DNA, 22 bp, Artificial Sequence
  chemically synthesized
aatatacaaaatgcttttgagt

SEQ ID NO: 1302578 - DNA, 22 bp, Artificial Sequence
  chemically synthesized
aaggtgaagaaaaaaggtgact

SEQ ID NO: 1302579 - DNA, 22 bp, Artificial Sequence
  chemically synthesized
aaaggtgaagaaaaaaggtgac

SEQ ID NO: 1302580 - DNA, 22 bp, Artificial Sequence
  chemically synthesized
atttaaaggtgaagaaaaaagg

SEQ ID NO: 1302581 - DNA, 22 bp, Artificial Sequence
  chemically synthesized
aatttaaaggtgaagaaaaaag

SEQ ID NO: 1302582 - DNA, 22 bp, Artificial Sequence
  chemically synthesized
taatttaaaggtgaagaaaaaa

SEQ ID NO: 1302583 - DNA, 22 bp, Artificial Sequence
  chemically synthesized
ttaatttaaaggtgaagaaaaa

SEQ ID NO: 1302584 - DNA, 22 bp, Artificial Sequence
  chemically synthesized
ttgagtcaccttttttcttcac

SEQ ID NO: 1302585 - DNA, 22 bp, Artificial Sequence
  chemically synthesized
tgagtcaccttttttcttcacc

SEQ ID NO: 1302586 - DNA, 22 bp, Artificial Sequence
  chemically synthesized
gagtcaccttttttcttcacct

SEQ ID NO: 1302587 - DNA, 22 bp, Artificial Sequence
  chemically synthesized
agtcaccttttttcttcacctt

SEQ ID NO: 1302588 - DNA, 22 bp, Artificial Sequence
  chemically synthesized
agagcttttaatttaaaggtga

SEQ ID NO: 1302589 - DNA, 22 bp, Artificial Sequence
  chemically synthesized
cagagcttttaatttaaaggtg

SEQ ID NO: 1302590 - DNA, 22 bp, Artificial Sequence
  chemically synthesized
ttttcttcacctttaaattaaa

SEQ ID NO: 1302591 - DNA, 22 bp, Artificial Sequence
  chemically synthesized
tatttcagagcttttaatttaa

SEQ ID NO: 1302592 - DNA, 22 bp, Artificial Sequence
  chemically synthesized
tttcttcacctttaaattaaaa

SEQ ID NO: 1302593 - DNA, 22 bp, Artificial Sequence
  chemically synthesized
ttcttcacctttaaattaaaag

SEQ ID NO: 1302594 - DNA, 22 bp, Artificial Sequence
  chemically synthesized
tcttcacctttaaattaaaagc

SEQ ID NO: 1302595 - DNA, 22 bp, Artificial Sequence
  chemically synthesized
cttcacctttaaattaaaagct

SEQ ID NO: 1302596 - DNA, 22 bp, Artificial Sequence
  chemically synthesized
attgtatttcagagcttttaat

SEQ ID NO: 1302597 - DNA, 22 bp, Artificial Sequence
  chemically synthesized
ttcacctttaaattaaaagctc

SEQ ID NO: 1302598 - DNA, 22 bp, Artificial Sequence
  chemically synthesized
cattgtatttcagagcttttaa

SEQ ID NO: 1302599 - DNA, 22 bp, Artificial Sequence
  chemically synthesized
cacctttaaattaaaagctctg

SEQ ID NO: 1302600 - DNA, 22 bp, Artificial Sequence
  chemically synthesized
acctttaaattaaaagctctga

SEQ ID NO: 1302601 - DNA, 22 bp, Artificial Sequence
  chemically synthesized
taaattaaaagctctgaaatac

SEQ ID NO: 1302602 - DNA, 22 bp, Artificial Sequence
  chemically synthesized
aaattaaaagctctgaaataca

SEQ ID NO: 1302603 - DNA, 22 bp, Artificial Sequence
  chemically synthesized
aattaaaagctctgaaatacaa

SEQ ID NO: 1302604 - DNA, 22 bp, Artificial Sequence
  chemically synthesized
aagaaaacacttcattgtattt

SEQ ID NO: 1302605 - DNA, 22 bp, Artificial Sequence
  chemically synthesized
aaagctctgaaatacaatgaag

SEQ ID NO: 1302606 - DNA, 22 bp, Artificial Sequence
  chemically synthesized
tgaaatacaatgaagtgttttc

SEQ ID NO: 1302607 - DNA, 22 bp, Artificial Sequence
  chemically synthesized
aaatacaatgaagtgttttctt

SEQ ID NO: 1302608 - DNA, 22 bp, Artificial Sequence
  chemically synthesized
tcttcagcttttcatgactttt

SEQ ID NO: 1302609 - DNA, 22 bp, Artificial Sequence
  chemically synthesized
cttcagcttttcatgacttttc

SEQ ID NO: 1302610 - DNA, 22 bp, Artificial Sequence
  chemically synthesized
ttcagcttttcatgacttttcc

SEQ ID NO: 1302611 - DNA, 22 bp, Artificial Sequence
  chemically synthesized
cagcttttcatgacttttccca

SEQ ID NO: 1302612 - DNA, 22 bp, Artificial Sequence
  chemically synthesized
tgaatcacccaatgggaaaagt

SEQ ID NO: 1302613 - DNA, 22 bp, Artificial Sequence
  chemically synthesized
agcttttcatgacttttcccat

SEQ ID NO: 1302614 - DNA, 22 bp, Artificial Sequence
  chemically synthesized
tctgtgaatcacccaatgggaa

SEQ ID NO: 1302615 - DNA, 22 bp, Artificial Sequence
  chemically synthesized
ttcatgacttttcccattgggt

SEQ ID NO: 1302616 - DNA, 22 bp, Artificial Sequence
  chemically synthesized
tcatgacttttcccattgggtg

SEQ ID NO: 1302617 - DNA, 22 bp, Artificial Sequence
  chemically synthesized
ttatctgtgaatcacccaatgg

SEQ ID NO: 1302618 - DNA, 22 bp, Artificial Sequence
  chemically synthesized
catgacttttcccattgggtga

SEQ ID NO: 1302619 - DNA, 22 bp, Artificial Sequence
  chemically synthesized
atgacttttcccattgggtgat

SEQ ID NO: 1302620 - DNA, 22 bp, Artificial Sequence
  chemically synthesized
aggacctgttatctgtgaatca

SEQ ID NO: 1302621 - DNA, 22 bp, Artificial Sequence
  chemically synthesized
ttcccattgggtgattcacaga

SEQ ID NO: 1302622 - DNA, 22 bp, Artificial Sequence
  chemically synthesized
tcccattgggtgattcacagat

SEQ ID NO: 1302623 - DNA, 22 bp, Artificial Sequence
  chemically synthesized
cccattgggtgattcacagata

SEQ ID NO: 1302624 - DNA, 22 bp, Artificial Sequence
  chemically synthesized
ccattgggtgattcacagataa

SEQ ID NO: 1302625 - DNA, 22 bp, Artificial Sequence
  chemically synthesized
ggtgattcacagataacaggtc

SEQ ID NO: 1302626 - DNA, 22 bp, Artificial Sequence
  chemically synthesized
ataaaaatgtattgaggacctg

SEQ ID NO: 1302627 - DNA, 22 bp, Artificial Sequence
  chemically synthesized
aataaaaatgtattgaggacct

SEQ ID NO: 1302628 - DNA, 22 bp, Artificial Sequence
  chemically synthesized
acagataacaggtcctcaatac

SEQ ID NO: 1302629 - DNA, 22 bp, Artificial Sequence
  chemically synthesized
aatttaataaaaatgtattgag

SEQ ID NO: 1302630 - DNA, 22 bp, Artificial Sequence
  chemically synthesized
aaaattgaatttaataaaaatg

SEQ ID NO: 1302631 - DNA, 22 bp, Artificial Sequence
  chemically synthesized
aaaaattgaatttaataaaaat

SEQ ID NO: 1302632 - DNA, 22 bp, Artificial Sequence
  chemically synthesized
taaaaattgaatttaataaaaa

SEQ ID NO: 1302633 - DNA, 22 bp, Artificial Sequence
  chemically synthesized
aatacatttttattaaattcaa

SEQ ID NO: 1302634 - DNA, 22 bp, Artificial Sequence
  chemically synthesized
ttattaaattcaatttttaaaa

SEQ ID NO: 1302635 - DNA, 22 bp, Artificial Sequence
  chemically synthesized
tattaaattcaatttttaaaat

SEQ ID NO: 1302636 - DNA, 22 bp, Artificial Sequence
  chemically synthesized
attaaattcaatttttaaaata

SEQ ID NO: 1302637 - DNA, 22 bp, Artificial Sequence
  chemically synthesized
ttaaattcaatttttaaaatat

SEQ ID NO: 1302638 - DNA, 22 bp, Artificial Sequence
  chemically synthesized
aattcaatttttaaaatatcac

SEQ ID NO: 1302639 - DNA, 22 bp, Artificial Sequence
  chemically synthesized
aatttttaaaatatcacttatc

SEQ ID NO: 1302640 - DNA, 22 bp, Artificial Sequence
  chemically synthesized
gagaaaggccgtagtagataag

SEQ ID NO: 1302641 - DNA, 22 bp, Artificial Sequence
  chemically synthesized
ttaaaatatcacttatctacta

SEQ ID NO: 1302642 - DNA, 22 bp, Artificial Sequence
  chemically synthesized
taaaatatcacttatctactac

SEQ ID NO: 1302643 - DNA, 22 bp, Artificial Sequence
  chemically synthesized
aaaatatcacttatctactacg

SEQ ID NO: 1302644 - DNA, 22 bp, Artificial Sequence
  chemically synthesized
ttagagaaaggccgtagtagat

SEQ ID NO: 1302645 - DNA, 22 bp, Artificial Sequence
  chemically synthesized
aaatatcacttatctactacgg

SEQ ID NO: 1302646 - DNA, 22 bp, Artificial Sequence
  chemically synthesized
attagagaaaggccgtagtaga

SEQ ID NO: 1302647 - DNA, 22 bp, Artificial Sequence
  chemically synthesized
tattagagaaaggccgtagtag

SEQ ID NO: 1302648 - DNA, 22 bp, Artificial Sequence
  chemically synthesized
ttattagagaaaggccgtagta

SEQ ID NO: 1302649 - DNA, 22 bp, Artificial Sequence
  chemically synthesized
tttttattagagaaaggccgta

SEQ ID NO: 1302650 - DNA, 22 bp, Artificial Sequence
  chemically synthesized
atttttattagagaaaggccgt

SEQ ID NO: 1302651 - DNA, 22 bp, Artificial Sequence
  chemically synthesized
atctactacggcctttctctaa

SEQ ID NO: 1302652 - DNA, 22 bp, Artificial Sequence
  chemically synthesized
tctactacggcctttctctaat

SEQ ID NO: 1302653 - DNA, 22 bp, Artificial Sequence
  chemically synthesized
ctacggcctttctctaataaaa

SEQ ID NO: 1302654 - DNA, 22 bp, Artificial Sequence
  chemically synthesized
cggcctttctctaataaaaata

SEQ ID NO: 1302655 - DNA, 22 bp, Artificial Sequence
  chemically synthesized
tctctaataaaaataagtatta

SEQ ID NO: 1302656 - DNA, 22 bp, Artificial Sequence
  chemically synthesized
ctctaataaaaataagtattat

SEQ ID NO: 1302657 - DNA, 22 bp, Artificial Sequence
  chemically synthesized
tctaataaaaataagtattatt

SEQ ID NO: 1302658 - DNA, 22 bp, Artificial Sequence
  chemically synthesized
gatggaaacaatgaataatact

SEQ ID NO: 1302659 - DNA, 22 bp, Artificial Sequence
  chemically synthesized
taataaaaataagtattattca

SEQ ID NO: 1302660 - DNA, 22 bp, Artificial Sequence
  chemically synthesized
agatggaaacaatgaataatac

SEQ ID NO: 1302661 - DNA, 22 bp, Artificial Sequence
  chemically synthesized
tagatggaaacaatgaataata

SEQ ID NO: 1302662 - DNA, 22 bp, Artificial Sequence
  chemically synthesized
ataaaaataagtattattcatt

SEQ ID NO: 1302663 - DNA, 22 bp, Artificial Sequence
  chemically synthesized
ctttagatggaaacaatgaata

SEQ ID NO: 1302664 - DNA, 22 bp, Artificial Sequence
  chemically synthesized
actttagatggaaacaatgaat

SEQ ID NO: 1302665 - DNA, 22 bp, Artificial Sequence
  chemically synthesized
cccttactttagatggaaacaa

SEQ ID NO: 1302666 - DNA, 22 bp, Artificial Sequence
  chemically synthesized
cagttacccttactttagatgg

SEQ ID NO: 1302667 - DNA, 22 bp, Artificial Sequence
  chemically synthesized
ttcattgtttccatctaaagta

SEQ ID NO: 1302668 - DNA, 22 bp, Artificial Sequence
  chemically synthesized
attgtttccatctaaagtaagg

SEQ ID NO: 1302669 - DNA, 22 bp, Artificial Sequence
  chemically synthesized
atcattacagttacccttactt

SEQ ID NO: 1302670 - DNA, 22 bp, Artificial Sequence
  chemically synthesized
tttccatctaaagtaagggtaa

SEQ ID NO: 1302671 - DNA, 22 bp, Artificial Sequence
  chemically synthesized
ccatctaaagtaagggtaactg

SEQ ID NO: 1302672 - DNA, 22 bp, Artificial Sequence
  chemically synthesized
catctaaagtaagggtaactgt

SEQ ID NO: 1302673 - DNA, 22 bp, Artificial Sequence
  chemically synthesized
gacatgttaatcattacagtta

SEQ ID NO: 1302674 - DNA, 22 bp, Artificial Sequence
  chemically synthesized
aagtaagggtaactgtaatgat

SEQ ID NO: 1302675 - DNA, 22 bp, Artificial Sequence
  chemically synthesized
ggatatccacattcgacatgtt

SEQ ID NO: 1302676 - DNA, 22 bp, Artificial Sequence
  chemically synthesized
gggatatccacattcgacatgt

SEQ ID NO: 1302677 - DNA, 22 bp, Artificial Sequence
  chemically synthesized
ttgggatatccacattcgacat

SEQ ID NO: 1302678 - DNA, 22 bp, Artificial Sequence
  chemically synthesized
taatgattaacatgtcgaatgt

SEQ ID NO: 1302679 - DNA, 22 bp, Artificial Sequence
  chemically synthesized
ccctcttgggatatccacattc

SEQ ID NO: 1302680 - DNA, 22 bp, Artificial Sequence
  chemically synthesized
accctcttgggatatccacatt

SEQ ID NO: 1302681 - DNA, 22 bp, Artificial Sequence
  chemically synthesized
taccctcttgggatatccacat

SEQ ID NO: 1302682 - DNA, 22 bp, Artificial Sequence
  chemically synthesized
acatgtcgaatgtggatatccc

SEQ ID NO: 1302683 - DNA, 22 bp, Artificial Sequence
  chemically synthesized
tgatggaaagcgtaagtatttt

SEQ ID NO: 1302684 - DNA, 22 bp, Artificial Sequence
  chemically synthesized
attatgatggaaagcgtaagta

SEQ ID NO: 1302685 - DNA, 22 bp, Artificial Sequence
  chemically synthesized
gattatgatggaaagcgtaagt

SEQ ID NO: 1302686 - DNA, 22 bp, Artificial Sequence
  chemically synthesized
acgctttccatcataatcaagt

SEQ ID NO: 1302687 - DNA, 22 bp, Artificial Sequence
  chemically synthesized
agcagaagaggaacttgattat

SEQ ID NO: 1302688 - DNA, 22 bp, Artificial Sequence
  chemically synthesized
cgctttccatcataatcaagtt

SEQ ID NO: 1302689 - DNA, 22 bp, Artificial Sequence
  chemically synthesized
tccatcataatcaagttcctct

SEQ ID NO: 1302690 - DNA, 22 bp, Artificial Sequence
  chemically synthesized
ccatcataatcaagttcctctt

SEQ ID NO: 1302691 - DNA, 22 bp, Artificial Sequence
  chemically synthesized
catcctaagcagaagaggaact

SEQ ID NO: 1302692 - DNA, 22 bp, Artificial Sequence
  chemically synthesized
catcataatcaagttcctcttc

SEQ ID NO: 1302693 - DNA, 22 bp, Artificial Sequence
  chemically synthesized
acatcctaagcagaagaggaac

SEQ ID NO: 1302694 - DNA, 22 bp, Artificial Sequence
  chemically synthesized
tacatcctaagcagaagaggaa

SEQ ID NO: 1302695 - DNA, 22 bp, Artificial Sequence
  chemically synthesized
ttacatcctaagcagaagagga

SEQ ID NO: 1302696 - DNA, 22 bp, Artificial Sequence
  chemically synthesized
tatagcatttttacatcctaag

SEQ ID NO: 1302697 - DNA, 22 bp, Artificial Sequence
  chemically synthesized
atatagcatttttacatcctaa

SEQ ID NO: 1302698 - DNA, 22 bp, Artificial Sequence
  chemically synthesized
ttatatagcatttttacatcct

SEQ ID NO: 1302699 - DNA, 22 bp, Artificial Sequence
  chemically synthesized
ctcttctgcttaggatgtaaaa

SEQ ID NO: 1302700 - DNA, 22 bp, Artificial Sequence
  chemically synthesized
ttctgcttaggatgtaaaaatg

SEQ ID NO: 1302701 - DNA, 22 bp, Artificial Sequence
  chemically synthesized
ctgcttaggatgtaaaaatgct

SEQ ID NO: 1302702 - DNA, 22 bp, Artificial Sequence
  chemically synthesized
tgcttaggatgtaaaaatgcta

SEQ ID NO: 1302703 - DNA, 22 bp, Artificial Sequence
  chemically synthesized
cttaggatgtaaaaatgctata

SEQ ID NO: 1302704 - DNA, 22 bp, Artificial Sequence
  chemically synthesized
aggatgtaaaaatgctatataa

SEQ ID NO: 1302705 - DNA, 22 bp, Artificial Sequence
  chemically synthesized
ggatgtaaaaatgctatataag

SEQ ID NO: 1302706 - DNA, 22 bp, Artificial Sequence
  chemically synthesized
ggtggagcaacgttcttatata

SEQ ID NO: 1302707 - DNA, 22 bp, Artificial Sequence
  chemically synthesized
attgggtggagcaacgttctta

SEQ ID NO: 1302708 - DNA, 22 bp, Artificial Sequence
  chemically synthesized
tcattgggtggagcaacgttct

SEQ ID NO: 1302709 - DNA, 22 bp, Artificial Sequence
  chemically synthesized
ctcattgggtggagcaacgttc

SEQ ID NO: 1302710 - DNA, 22 bp, Artificial Sequence
  chemically synthesized
tctcattgggtggagcaacgtt

SEQ ID NO: 1302711 - DNA, 22 bp, Artificial Sequence
  chemically synthesized
ttctcattgggtggagcaacgt

SEQ ID NO: 1302712 - DNA, 22 bp, Artificial Sequence
  chemically synthesized
tttctcattgggtggagcaacg

SEQ ID NO: 1302713 - DNA, 22 bp, Artificial Sequence
  chemically synthesized
ctttttctcattgggtggagca

SEQ ID NO: 1302714 - DNA, 22 bp, Artificial Sequence
  chemically synthesized
tataagaacgttgctccaccca

SEQ ID NO: 1302715 - DNA, 22 bp, Artificial Sequence
  chemically synthesized
tagatcaccctgctttttctca

SEQ ID NO: 1302716 - DNA, 22 bp, Artificial Sequence
  chemically synthesized
atagatcaccctgctttttctc

SEQ ID NO: 1302717 - DNA, 22 bp, Artificial Sequence
  chemically synthesized
ctccacccaatgagaaaaagca

SEQ ID NO: 1302718 - DNA, 22 bp, Artificial Sequence
  chemically synthesized
tatagatcaccctgctttttct

SEQ ID NO: 1302719 - DNA, 22 bp, Artificial Sequence
  chemically synthesized
ttatagatcaccctgctttttc

SEQ ID NO: 1302720 - DNA, 22 bp, Artificial Sequence
  chemically synthesized
cacccaatgagaaaaagcaggg

SEQ ID NO: 1302721 - DNA, 22 bp, Artificial Sequence
  chemically synthesized
aaaaaataatacgtttttatag

SEQ ID NO: 1302722 - DNA, 22 bp, Artificial Sequence
  chemically synthesized
tataaatggctcaaaaaataat

SEQ ID NO: 1302723 - DNA, 22 bp, Artificial Sequence
  chemically synthesized
taaaaacgtattattttttgag

SEQ ID NO: 1302724 - DNA, 22 bp, Artificial Sequence
  chemically synthesized
tggccacagctatataaatggc

SEQ ID NO: 1302725 - DNA, 22 bp, Artificial Sequence
  chemically synthesized
gtggccacagctatataaatgg

SEQ ID NO: 1302726 - DNA, 22 bp, Artificial Sequence
  chemically synthesized
ttttttgagccatttatatagc

SEQ ID NO: 1302727 - DNA, 22 bp, Artificial Sequence
  chemically synthesized
ccttgtggccacagctatataa

SEQ ID NO: 1302728 - DNA, 22 bp, Artificial Sequence
  chemically synthesized
tttgagccatttatatagctgt

SEQ ID NO: 1302729 - DNA, 22 bp, Artificial Sequence
  chemically synthesized
ttgagccatttatatagctgtg

SEQ ID NO: 1302730 - DNA, 22 bp, Artificial Sequence
  chemically synthesized
tgagccatttatatagctgtgg

SEQ ID NO: 1302731 - DNA, 22 bp, Artificial Sequence
  chemically synthesized
gttgccttgtggccacagctat

SEQ ID NO: 1302732 - DNA, 22 bp, Artificial Sequence
  chemically synthesized
gagccatttatatagctgtggc

SEQ ID NO: 1302733 - DNA, 22 bp, Artificial Sequence
  chemically synthesized
agccatttatatagctgtggcc

SEQ ID NO: 1302734 - DNA, 22 bp, Artificial Sequence
  chemically synthesized
acctcgttgccttgtggccaca

SEQ ID NO: 1302735 - DNA, 22 bp, Artificial Sequence
  chemically synthesized
gctcacctcgttgccttgtggc

SEQ ID NO: 1302736 - DNA, 22 bp, Artificial Sequence
  chemically synthesized
atatagctgtggccacaaggca

SEQ ID NO: 1302737 - DNA, 22 bp, Artificial Sequence
  chemically synthesized
ggctcacctcgttgccttgtgg

SEQ ID NO: 1302738 - DNA, 22 bp, Artificial Sequence
  chemically synthesized
tatagctgtggccacaaggcaa

SEQ ID NO: 1302739 - DNA, 22 bp, Artificial Sequence
  chemically synthesized
tggctcacctcgttgccttgtg

SEQ ID NO: 1302740 - DNA, 22 bp, Artificial Sequence
  chemically synthesized
tggccacaaggcaacgaggtga

SEQ ID NO: 1302741 - DNA, 22 bp, Artificial Sequence
  chemically synthesized
aagtactttggctcacctcgtt

SEQ ID NO: 1302742 - DNA, 22 bp, Artificial Sequence
  chemically synthesized
gaggagattgaagtactttggc

SEQ ID NO: 1302743 - DNA, 22 bp, Artificial Sequence
  chemically synthesized
ggaggagattgaagtactttgg

SEQ ID NO: 1302744 - DNA, 22 bp, Artificial Sequence
  chemically synthesized
cttggaggagattgaagtactt

SEQ ID NO: 1302745 - DNA, 22 bp, Artificial Sequence
  chemically synthesized
tccttggaggagattgaagtac

SEQ ID NO: 1302746 - DNA, 22 bp, Artificial Sequence
  chemically synthesized
atgtatccagtctctccttgga

SEQ ID NO: 1302747 - DNA, 22 bp, Artificial Sequence
  chemically synthesized
catgtatccagtctctccttgg

SEQ ID NO: 1302748 - DNA, 22 bp, Artificial Sequence
  chemically synthesized
tcatgtatccagtctctccttg

SEQ ID NO: 1302749 - DNA, 22 bp, Artificial Sequence
  chemically synthesized
caatctcctccaaggagagact

SEQ ID NO: 1302750 - DNA, 22 bp, Artificial Sequence
  chemically synthesized
aatctcctccaaggagagactg

SEQ ID NO: 1302751 - DNA, 22 bp, Artificial Sequence
  chemically synthesized
ctccaaggagagactggataca

SEQ ID NO: 1302752 - DNA, 22 bp, Artificial Sequence
  chemically synthesized
caaggagagactggatacatga

SEQ ID NO: 1302753 - DNA, 22 bp, Artificial Sequence
  chemically synthesized
ccaaaggtaaacctttcatgta

SEQ ID NO: 1302754 - DNA, 22 bp, Artificial Sequence
  chemically synthesized
cctgccaaaggtaaacctttca

SEQ ID NO: 1302755 - DNA, 22 bp, Artificial Sequence
  chemically synthesized
gatacatgaaaggtttaccttt

SEQ ID NO: 1302756 - DNA, 22 bp, Artificial Sequence
  chemically synthesized
cagttccctgccaaaggtaaac

SEQ ID NO: 1302757 - DNA, 22 bp, Artificial Sequence
  chemically synthesized
ctccagttccctgccaaaggta

SEQ ID NO: 1302758 - DNA, 22 bp, Artificial Sequence
  chemically synthesized
cctccagttccctgccaaaggt

SEQ ID NO: 1302759 - DNA, 22 bp, Artificial Sequence
  chemically synthesized
ttcctccagttccctgccaaag

SEQ ID NO: 1302760 - DNA, 22 bp, Artificial Sequence
  chemically synthesized
cttcctccagttccctgccaaa

SEQ ID NO: 1302761 - DNA, 22 bp, Artificial Sequence
  chemically synthesized
cttcttcctccagttccctgcc

SEQ ID NO: 1302762 - DNA, 22 bp, Artificial Sequence
  chemically synthesized
acctttggcagggaactggagg

SEQ ID NO: 1302763 - DNA, 22 bp, Artificial Sequence
  chemically synthesized
cctttggcagggaactggagga

SEQ ID NO: 1302764 - DNA, 22 bp, Artificial Sequence
  chemically synthesized
cgatgactacttcttcctccag

SEQ ID NO: 1302765 - DNA, 22 bp, Artificial Sequence
  chemically synthesized
tggcagggaactggaggaagaa

SEQ ID NO: 1302766 - DNA, 22 bp, Artificial Sequence
  chemically synthesized
ggcagggaactggaggaagaag

SEQ ID NO: 1302767 - DNA, 22 bp, Artificial Sequence
  chemically synthesized
ctacgatgactacttcttcctc

SEQ ID NO: 1302768 - DNA, 22 bp, Artificial Sequence
  chemically synthesized
gcagggaactggaggaagaagt

SEQ ID NO: 1302769 - DNA, 22 bp, Artificial Sequence
  chemically synthesized
ctcctacgatgactacttcttc

SEQ ID NO: 1302770 - DNA, 22 bp, Artificial Sequence
  chemically synthesized
ctgctcctacgatgactacttc

SEQ ID NO: 1302771 - DNA, 22 bp, Artificial Sequence
  chemically synthesized
cctgctcctacgatgactactt

SEQ ID NO: 1302772 - DNA, 22 bp, Artificial Sequence
  chemically synthesized
tcctgctcctacgatgactact

SEQ ID NO: 1302773 - DNA, 22 bp, Artificial Sequence
  chemically synthesized
ttcctgctcctacgatgactac

SEQ ID NO: 1302774 - DNA, 22 bp, Artificial Sequence
  chemically synthesized
tttcctgctcctacgatgacta

SEQ ID NO: 1302775 - DNA, 22 bp, Artificial Sequence
  chemically synthesized
gaggaagaagtagtcatcgtag

SEQ ID NO: 1302776 - DNA, 22 bp, Artificial Sequence
  chemically synthesized
tttttcctgctcctacgatgac

SEQ ID NO: 1302777 - DNA, 22 bp, Artificial Sequence
  chemically synthesized
ctttttcctgctcctacgatga

SEQ ID NO: 1302778 - DNA, 22 bp, Artificial Sequence
  chemically synthesized
tctttttcctgctcctacgatg

SEQ ID NO: 1302779 - DNA, 22 bp, Artificial Sequence
  chemically synthesized
ttttctttttcctgctcctacg

SEQ ID NO: 1302780 - DNA, 22 bp, Artificial Sequence
  chemically synthesized
gagctattttctttttcctgct

SEQ ID NO: 1302781 - DNA, 22 bp, Artificial Sequence
  chemically synthesized
caattggagctattttcttttt

SEQ ID NO: 1302782 - DNA, 22 bp, Artificial Sequence
  chemically synthesized
acaattggagctattttctttt

SEQ ID NO: 1302783 - DNA, 22 bp, Artificial Sequence
  chemically synthesized
agaatgccttacaattggagct

SEQ ID NO: 1302784 - DNA, 22 bp, Artificial Sequence
  chemically synthesized
aagaatgccttacaattggagc

SEQ ID NO: 1302785 - DNA, 22 bp, Artificial Sequence
  chemically synthesized
taagaatgccttacaattggag

SEQ ID NO: 1302786 - DNA, 22 bp, Artificial Sequence
  chemically synthesized
ttaagaatgccttacaattgga

SEQ ID NO: 1302787 - DNA, 22 bp, Artificial Sequence
  chemically synthesized
acttttaagaatgccttacaat

SEQ ID NO: 1302788 - DNA, 22 bp, Artificial Sequence
  chemically synthesized
caattgtaaggcattcttaaaa

SEQ ID NO: 1302789 - DNA, 22 bp, Artificial Sequence
  chemically synthesized
taaggcattcttaaaagtcagg

SEQ ID NO: 1302790 - DNA, 22 bp, Artificial Sequence
  chemically synthesized
aaatgtcataccagcccacacc

SEQ ID NO: 1302791 - DNA, 22 bp, Artificial Sequence
  chemically synthesized
ttaaaagtcaggtgtgggctgg

SEQ ID NO: 1302792 - DNA, 22 bp, Artificial Sequence
  chemically synthesized
aaaagtcaggtgtgggctggta

SEQ ID NO: 1302793 - DNA, 22 bp, Artificial Sequence
  chemically synthesized
aaagtcaggtgtgggctggtat

SEQ ID NO: 1302794 - DNA, 22 bp, Artificial Sequence
  chemically synthesized
caaggatgctgaaatgtcatac

SEQ ID NO: 1302795 - DNA, 22 bp, Artificial Sequence
  chemically synthesized
ccaaggatgctgaaatgtcata

SEQ ID NO: 1302796 - DNA, 22 bp, Artificial Sequence
  chemically synthesized
catttccaaggatgctgaaatg

SEQ ID NO: 1302797 - DNA, 22 bp, Artificial Sequence
  chemically synthesized
gtatgacatttcagcatccttg

SEQ ID NO: 1302798 - DNA, 22 bp, Artificial Sequence
  chemically synthesized
ggtctgcatttccaaggatgct

SEQ ID NO: 1302799 - DNA, 22 bp, Artificial Sequence
  chemically synthesized
cggtctgcatttccaaggatgc

SEQ ID NO: 1302800 - DNA, 22 bp, Artificial Sequence
  chemically synthesized
cttcggtctgcatttccaagga

SEQ ID NO: 1302801 - DNA, 22 bp, Artificial Sequence
  chemically synthesized
cagcatccttggaaatgcagac

SEQ ID NO: 1302802 - DNA, 22 bp, Artificial Sequence
  chemically synthesized
agcatccttggaaatgcagacc

SEQ ID NO: 1302803 - DNA, 22 bp, Artificial Sequence
  chemically synthesized
ggaaatgcagaccgaaggagtc

SEQ ID NO: 1302804 - DNA, 22 bp, Artificial Sequence
  chemically synthesized
gaaatgcagaccgaaggagtct

SEQ ID NO: 1302805 - DNA, 22 bp, Artificial Sequence
  chemically synthesized
cagaatgagtgcagactccttc

SEQ ID NO: 1302806 - DNA, 22 bp, Artificial Sequence
  chemically synthesized
tggaaaagaattccagaatgag

SEQ ID NO: 1302807 - DNA, 22 bp, Artificial Sequence
  chemically synthesized
gtggaaaagaattccagaatga

SEQ ID NO: 1302808 - DNA, 22 bp, Artificial Sequence
  chemically synthesized
cactcattctggaattcttttc

SEQ ID NO: 1302809 - DNA, 22 bp, Artificial Sequence
  chemically synthesized
ccaatagaagtttgtggaaaag

SEQ ID NO: 1302810 - DNA, 22 bp, Artificial Sequence
  chemically synthesized
attctggaattcttttccacaa

SEQ ID NO: 1302811 - DNA, 22 bp, Artificial Sequence
  chemically synthesized
tggaattcttttccacaaactt

SEQ ID NO: 1302812 - DNA, 22 bp, Artificial Sequence
  chemically synthesized
gaattcttttccacaaacttct

SEQ ID NO: 1302813 - DNA, 22 bp, Artificial Sequence
  chemically synthesized
caagttcccaatagaagtttgt

SEQ ID NO: 1302814 - DNA, 22 bp, Artificial Sequence
  chemically synthesized
gcaagttcccaatagaagtttg

SEQ ID NO: 1302815 - DNA, 22 bp, Artificial Sequence
  chemically synthesized
tgcaagttcccaatagaagttt

SEQ ID NO: 1302816 - DNA, 22 bp, Artificial Sequence
  chemically synthesized
ttgcaagttcccaatagaagtt

SEQ ID NO: 1302817 - DNA, 22 bp, Artificial Sequence
  chemically synthesized
tttgcaagttcccaatagaagt

SEQ ID NO: 1302818 - DNA, 22 bp, Artificial Sequence
  chemically synthesized
ttttgcaagttcccaatagaag

SEQ ID NO: 1302819 - DNA, 22 bp, Artificial Sequence
  chemically synthesized
ttttccacaaacttctattggg

SEQ ID NO: 1302820 - DNA, 22 bp, Artificial Sequence
  chemically synthesized
ttccacaaacttctattgggaa

SEQ ID NO: 1302821 - DNA, 22 bp, Artificial Sequence
  chemically synthesized
cttttttgcaagttcccaatag

SEQ ID NO: 1302822 - DNA, 22 bp, Artificial Sequence
  chemically synthesized
tccacaaacttctattgggaac

SEQ ID NO: 1302823 - DNA, 22 bp, Artificial Sequence
  chemically synthesized
acttttttgcaagttcccaata

SEQ ID NO: 1302824 - DNA, 22 bp, Artificial Sequence
  chemically synthesized
ccacaaacttctattgggaact

SEQ ID NO: 1302825 - DNA, 22 bp, Artificial Sequence
  chemically synthesized
cacaaacttctattgggaactt

SEQ ID NO: 1302826 - DNA, 22 bp, Artificial Sequence
  chemically synthesized
cgccttacttttttgcaagttc

SEQ ID NO: 1302827 - DNA, 22 bp, Artificial Sequence
  chemically synthesized
ctattgggaacttgcaaaaaag

SEQ ID NO: 1302828 - DNA, 22 bp, Artificial Sequence
  chemically synthesized
tcctacgccttacttttttgca

SEQ ID NO: 1302829 - DNA, 22 bp, Artificial Sequence
  chemically synthesized
tattgggaacttgcaaaaaagt

SEQ ID NO: 1302830 - DNA, 22 bp, Artificial Sequence
  chemically synthesized
gtcctacgccttacttttttgc

SEQ ID NO: 1302831 - DNA, 22 bp, Artificial Sequence
  chemically synthesized
ttgggaacttgcaaaaaagtaa

SEQ ID NO: 1302832 - DNA, 22 bp, Artificial Sequence
  chemically synthesized
ttgtcctacgccttactttttt

SEQ ID NO: 1302833 - DNA, 22 bp, Artificial Sequence
  chemically synthesized
ggaacttgcaaaaaagtaaggc

SEQ ID NO: 1302834 - DNA, 22 bp, Artificial Sequence
  chemically synthesized
tctcttgtcctacgccttactt

SEQ ID NO: 1302835 - DNA, 22 bp, Artificial Sequence
  chemically synthesized
ctatctcttgtcctacgcctta

SEQ ID NO: 1302836 - DNA, 22 bp, Artificial Sequence
  chemically synthesized
cctatctcttgtcctacgcctt

SEQ ID NO: 1302837 - DNA, 22 bp, Artificial Sequence
  chemically synthesized
gcaaaaaagtaaggcgtaggac

SEQ ID NO: 1302838 - DNA, 22 bp, Artificial Sequence
  chemically synthesized
ttcctatctcttgtcctacgcc

SEQ ID NO: 1302839 - DNA, 22 bp, Artificial Sequence
  chemically synthesized
caaaaaagtaaggcgtaggaca

SEQ ID NO: 1302840 - DNA, 22 bp, Artificial Sequence
  chemically synthesized
cttcctatctcttgtcctacgc

SEQ ID NO: 1302841 - DNA, 22 bp, Artificial Sequence
  chemically synthesized
aggggagcttcttcctatctct

SEQ ID NO: 1302842 - DNA, 22 bp, Artificial Sequence
  chemically synthesized
tgtgtcactgaggggagcttct

SEQ ID NO: 1302843 - DNA, 22 bp, Artificial Sequence
  chemically synthesized
gtgtgtcactgaggggagcttc

SEQ ID NO: 1302844 - DNA, 22 bp, Artificial Sequence
  chemically synthesized
atgtttgtgtgtcactgagggg

SEQ ID NO: 1302845 - DNA, 22 bp, Artificial Sequence
  chemically synthesized
catgtttgtgtgtcactgaggg

SEQ ID NO: 1302846 - DNA, 22 bp, Artificial Sequence
  chemically synthesized
acttcatgtttgtgtgtcactg

SEQ ID NO: 1302847 - DNA, 22 bp, Artificial Sequence
  chemically synthesized
gacttcatgtttgtgtgtcact

SEQ ID NO: 1302848 - DNA, 22 bp, Artificial Sequence
  chemically synthesized
ccctcagtgacacacaaacatg

SEQ ID NO: 1302849 - DNA, 22 bp, Artificial Sequence
  chemically synthesized
agtgacacacaaacatgaagtc

SEQ ID NO: 1302850 - DNA, 22 bp, Artificial Sequence
  chemically synthesized
gaaaatgggtttgacttcatgt

SEQ ID NO: 1302851 - DNA, 22 bp, Artificial Sequence
  chemically synthesized
gaagaggagggtctggaaaatg

SEQ ID NO: 1302852 - DNA, 22 bp, Artificial Sequence
  chemically synthesized
agaagaggagggtctggaaaat

SEQ ID NO: 1302853 - DNA, 22 bp, Artificial Sequence
  chemically synthesized
tagaagaggagggtctggaaaa

SEQ ID NO: 1302854 - DNA, 22 bp, Artificial Sequence
  chemically synthesized
ttagaagaggagggtctggaaa

SEQ ID NO: 1302855 - DNA, 22 bp, Artificial Sequence
  chemically synthesized
cgccttttagaagaggagggtc

SEQ ID NO: 1302856 - DNA, 22 bp, Artificial Sequence
  chemically synthesized
acgccttttagaagaggagggt

SEQ ID NO: 1302857 - DNA, 22 bp, Artificial Sequence
  chemically synthesized
aatcttacgccttttagaagag

SEQ ID NO: 1302858 - DNA, 22 bp, Artificial Sequence
  chemically synthesized
tccagaccctcctcttctaaaa

SEQ ID NO: 1302859 - DNA, 22 bp, Artificial Sequence
  chemically synthesized
aaatcttacgccttttagaaga

SEQ ID NO: 1302860 - DNA, 22 bp, Artificial Sequence
  chemically synthesized
ccagaccctcctcttctaaaag

SEQ ID NO: 1302861 - DNA, 22 bp, Artificial Sequence
  chemically synthesized
cagaccctcctcttctaaaagg

SEQ ID NO: 1302862 - DNA, 22 bp, Artificial Sequence
  chemically synthesized
cttaaatcttacgccttttaga

SEQ ID NO: 1302863 - DNA, 22 bp, Artificial Sequence
  chemically synthesized
ccttaaatcttacgccttttag

SEQ ID NO: 1302864 - DNA, 22 bp, Artificial Sequence
  chemically synthesized
tccttaaatcttacgcctttta

SEQ ID NO: 1302865 - DNA, 22 bp, Artificial Sequence
  chemically synthesized
ctcttctaaaaggcgtaagatt

SEQ ID NO: 1302866 - DNA, 22 bp, Artificial Sequence
  chemically synthesized
gtatctttccttaaatcttacg

SEQ ID NO: 1302867 - DNA, 22 bp, Artificial Sequence
  chemically synthesized
agtatctttccttaaatcttac

SEQ ID NO: 1302868 - DNA, 22 bp, Artificial Sequence
  chemically synthesized
ttctaaaaggcgtaagatttaa

SEQ ID NO: 1302869 - DNA, 22 bp, Artificial Sequence
  chemically synthesized
ctaaaaggcgtaagatttaagg

SEQ ID NO: 1302870 - DNA, 22 bp, Artificial Sequence
  chemically synthesized
taaaaggcgtaagatttaagga

SEQ ID NO: 1302871 - DNA, 22 bp, Artificial Sequence
  chemically synthesized
agtttagtatctttccttaaat

SEQ ID NO: 1302872 - DNA, 22 bp, Artificial Sequence
  chemically synthesized
aaaggcgtaagatttaaggaaa

SEQ ID NO: 1302873 - DNA, 22 bp, Artificial Sequence
  chemically synthesized
cagtttagtatctttccttaaa

SEQ ID NO: 1302874 - DNA, 22 bp, Artificial Sequence
  chemically synthesized
cttcagtttagtatctttcctt

SEQ ID NO: 1302875 - DNA, 22 bp, Artificial Sequence
  chemically synthesized
ccttcagtttagtatctttcct

SEQ ID NO: 1302876 - DNA, 22 bp, Artificial Sequence
  chemically synthesized
tccttcagtttagtatctttcc

SEQ ID NO: 1302877 - DNA, 22 bp, Artificial Sequence
  chemically synthesized
gtatctttccttcagtttagta

SEQ ID NO: 1302878 - DNA, 22 bp, Artificial Sequence
  chemically synthesized
agtatctttccttcagtttagt

SEQ ID NO: 1302879 - DNA, 22 bp, Artificial Sequence
  chemically synthesized
aaggaaagatactaaactgaag

SEQ ID NO: 1302880 - DNA, 22 bp, Artificial Sequence
  chemically synthesized
aggaaagatactaaactgaagg

SEQ ID NO: 1302881 - DNA, 22 bp, Artificial Sequence
  chemically synthesized
aactgaaggaaagatactaaac

SEQ ID NO: 1302882 - DNA, 22 bp, Artificial Sequence
  chemically synthesized
aaggaaagatactaaactctac

SEQ ID NO: 1302883 - DNA, 22 bp, Artificial Sequence
  chemically synthesized
aacaggcgggtcccatgggtgg

SEQ ID NO: 1302884 - DNA, 22 bp, Artificial Sequence
  chemically synthesized
tgaacaggcgggtcccatgggt

SEQ ID NO: 1302885 - DNA, 22 bp, Artificial Sequence
  chemically synthesized
aactctaccacccatgggaccc

SEQ ID NO: 1302886 - DNA, 22 bp, Artificial Sequence
  chemically synthesized
taccacccatgggacccgcctg

SEQ ID NO: 1302887 - DNA, 22 bp, Artificial Sequence
  chemically synthesized
ccacccatgggacccgcctgtt

SEQ ID NO: 1302888 - DNA, 22 bp, Artificial Sequence
  chemically synthesized
cccaacccctctgaacaggcgg

SEQ ID NO: 1302889 - DNA, 22 bp, Artificial Sequence
  chemically synthesized
ccccaacccctctgaacaggcg

SEQ ID NO: 1302890 - DNA, 22 bp, Artificial Sequence
  chemically synthesized
ccttccccaacccctctgaaca

SEQ ID NO: 1302891 - DNA, 22 bp, Artificial Sequence
  chemically synthesized
taccttccccaacccctctgaa

SEQ ID NO: 1302892 - DNA, 22 bp, Artificial Sequence
  chemically synthesized
ctaccttccccaacccctctga

SEQ ID NO: 1302893 - DNA, 22 bp, Artificial Sequence
  chemically synthesized
agtggcttctaccttccccaac

SEQ ID NO: 1302894 - DNA, 22 bp, Artificial Sequence
  chemically synthesized
tcagtggcttctaccttcccca

SEQ ID NO: 1302895 - DNA, 22 bp, Artificial Sequence
  chemically synthesized
ttcagaggggttggggaaggta

SEQ ID NO: 1302896 - DNA, 22 bp, Artificial Sequence
  chemically synthesized
tctcagtggcttctaccttccc

SEQ ID NO: 1302897 - DNA, 22 bp, Artificial Sequence
  chemically synthesized
agaggggttggggaaggtagaa

SEQ ID NO: 1302898 - DNA, 22 bp, Artificial Sequence
  chemically synthesized
accctctctcagtggcttctac

SEQ ID NO: 1302899 - DNA, 22 bp, Artificial Sequence
  chemically synthesized
gaccctctctcagtggcttcta

SEQ ID NO: 1302900 - DNA, 22 bp, Artificial Sequence
  chemically synthesized
gggaaggtagaagccactgaga

SEQ ID NO: 1302901 - DNA, 22 bp, Artificial Sequence
  chemically synthesized
caaagagggtatcttgaccctc

SEQ ID NO: 1302902 - DNA, 22 bp, Artificial Sequence
  chemically synthesized
ccaaagagggtatcttgaccct

SEQ ID NO: 1302903 - DNA, 22 bp, Artificial Sequence
  chemically synthesized
ttccaaagagggtatcttgacc

SEQ ID NO: 1302904 - DNA, 22 bp, Artificial Sequence
  chemically synthesized
ctcttccaaagagggtatcttg

SEQ ID NO: 1302905 - DNA, 22 bp, Artificial Sequence
  chemically synthesized
agagagggtcaagataccctct

SEQ ID NO: 1302906 - DNA, 22 bp, Artificial Sequence
  chemically synthesized
tcatactgctcttccaaagagg

SEQ ID NO: 1302907 - DNA, 22 bp, Artificial Sequence
  chemically synthesized
ggccaaagaggttatcatactg

SEQ ID NO: 1302908 - DNA, 22 bp, Artificial Sequence
  chemically synthesized
tttggaagagcagtatgataac

SEQ ID NO: 1302909 - DNA, 22 bp, Artificial Sequence
  chemically synthesized
tggaagagcagtatgataacct

SEQ ID NO: 1302910 - DNA, 22 bp, Artificial Sequence
  chemically synthesized
ggaagagcagtatgataacctc

SEQ ID NO: 1302911 - DNA, 22 bp, Artificial Sequence
  chemically synthesized
gaagagcagtatgataacctct

SEQ ID NO: 1302912 - DNA, 22 bp, Artificial Sequence
  chemically synthesized
gtgcagaatcctgggccaaaga

SEQ ID NO: 1302913 - DNA, 22 bp, Artificial Sequence
  chemically synthesized
ttggtgcagaatcctgggccaa

SEQ ID NO: 1302914 - DNA, 22 bp, Artificial Sequence
  chemically synthesized
attggtgcagaatcctgggcca

SEQ ID NO: 1302915 - DNA, 22 bp, Artificial Sequence
  chemically synthesized
tattggtgcagaatcctgggcc

SEQ ID NO: 1302916 - DNA, 22 bp, Artificial Sequence
  chemically synthesized
ttattggtgcagaatcctgggc

SEQ ID NO: 1302917 - DNA, 22 bp, Artificial Sequence
  chemically synthesized
tttttattggtgcagaatcctg

SEQ ID NO: 1302918 - DNA, 22 bp, Artificial Sequence
  chemically synthesized
tgtttttattggtgcagaatcc

SEQ ID NO: 1302919 - DNA, 22 bp, Artificial Sequence
  chemically synthesized
tttggcccaggattctgcacca

SEQ ID NO: 1302920 - DNA, 22 bp, Artificial Sequence
  chemically synthesized
tggcccaggattctgcaccaat

SEQ ID NO: 1302921 - DNA, 22 bp, Artificial Sequence
  chemically synthesized
ggcccaggattctgcaccaata

SEQ ID NO: 1302922 - DNA, 22 bp, Artificial Sequence
  chemically synthesized
gcccaggattctgcaccaataa

SEQ ID NO: 1302923 - DNA, 22 bp, Artificial Sequence
  chemically synthesized
gtggtaacagatcattctgttt

SEQ ID NO: 1302924 - DNA, 22 bp, Artificial Sequence
  chemically synthesized
tgcaccaataaaaacagaatga

SEQ ID NO: 1302925 - DNA, 22 bp, Artificial Sequence
  chemically synthesized
caccaataaaaacagaatgatc

SEQ ID NO: 1302926 - DNA, 22 bp, Artificial Sequence
  chemically synthesized
ccctagtggtaacagatcattc

SEQ ID NO: 1302927 - DNA, 22 bp, Artificial Sequence
  chemically synthesized
tcccctagtggtaacagatcat

SEQ ID NO: 1302928 - DNA, 22 bp, Artificial Sequence
  chemically synthesized
tctctcccctagtggtaacaga

SEQ ID NO: 1302929 - DNA, 22 bp, Artificial Sequence
  chemically synthesized
tatgcctgtctctcccctagtg

SEQ ID NO: 1302930 - DNA, 22 bp, Artificial Sequence
  chemically synthesized
atatgcctgtctctcccctagt

SEQ ID NO: 1302931 - DNA, 22 bp, Artificial Sequence
  chemically synthesized
ttaccactaggggagagacagg

SEQ ID NO: 1302932 - DNA, 22 bp, Artificial Sequence
  chemically synthesized
ccactaggggagagacaggcat

SEQ ID NO: 1302933 - DNA, 22 bp, Artificial Sequence
  chemically synthesized
agcaagccttatatgcctgtct

SEQ ID NO: 1302934 - DNA, 22 bp, Artificial Sequence
  chemically synthesized
cagcaagccttatatgcctgtc

SEQ ID NO: 1302935 - DNA, 22 bp, Artificial Sequence
  chemically synthesized
tcagcaagccttatatgcctgt

SEQ ID NO: 1302936 - DNA, 22 bp, Artificial Sequence
  chemically synthesized
ggggagagacaggcatataagg

SEQ ID NO: 1302937 - DNA, 22 bp, Artificial Sequence
  chemically synthesized
agttttcagcaagccttatatg

SEQ ID NO: 1302938 - DNA, 22 bp, Artificial Sequence
  chemically synthesized
catcctcagttttcagcaagcc

SEQ ID NO: 1302939 - DNA, 22 bp, Artificial Sequence
  chemically synthesized
ttccatcctcagttttcagcaa

SEQ ID NO: 1302940 - DNA, 22 bp, Artificial Sequence
  chemically synthesized
gttccatcctcagttttcagca

SEQ ID NO: 1302941 - DNA, 22 bp, Artificial Sequence
  chemically synthesized
ttgttccatcctcagttttcag

SEQ ID NO: 1302942 - DNA, 22 bp, Artificial Sequence
  chemically synthesized
cttgttccatcctcagttttca

SEQ ID NO: 1302943 - DNA, 22 bp, Artificial Sequence
  chemically synthesized
tcttcttgttccatcctcagtt

SEQ ID NO: 1302944 - DNA, 22 bp, Artificial Sequence
  chemically synthesized
tatcttcttgttccatcctcag

SEQ ID NO: 1302945 - DNA, 22 bp, Artificial Sequence
  chemically synthesized
ctatcttcttgttccatcctca

SEQ ID NO: 1302946 - DNA, 22 bp, Artificial Sequence
  chemically synthesized
gctgaaaactgaggatggaaca

SEQ ID NO: 1302947 - DNA, 22 bp, Artificial Sequence
  chemically synthesized
ctgaaaactgaggatggaacaa

SEQ ID NO: 1302948 - DNA, 22 bp, Artificial Sequence
  chemically synthesized
aaaactgaggatggaacaagaa

SEQ ID NO: 1302949 - DNA, 22 bp, Artificial Sequence
  chemically synthesized
aagggatttctatcttcttgtt

SEQ ID NO: 1302950 - DNA, 22 bp, Artificial Sequence
  chemically synthesized
aggatggaacaagaagatagaa

SEQ ID NO: 1302951 - DNA, 22 bp, Artificial Sequence
  chemically synthesized
cggtcctaaagggatttctatc

SEQ ID NO: 1302952 - DNA, 22 bp, Artificial Sequence
  chemically synthesized
atgtaatagtgtctgcggtcct

SEQ ID NO: 1302953 - DNA, 22 bp, Artificial Sequence
  chemically synthesized
aatgtaatagtgtctgcggtcc

SEQ ID NO: 1302954 - DNA, 22 bp, Artificial Sequence
  chemically synthesized
taggaccgcagacactattaca

SEQ ID NO: 1302955 - DNA, 22 bp, Artificial Sequence
  chemically synthesized
tcccgtgcttaatgtaatagtg

SEQ ID NO: 1302956 - DNA, 22 bp, Artificial Sequence
  chemically synthesized
aggaccgcagacactattacat

SEQ ID NO: 1302957 - DNA, 22 bp, Artificial Sequence
  chemically synthesized
ggaccgcagacactattacatt

SEQ ID NO: 1302958 - DNA, 22 bp, Artificial Sequence
  chemically synthesized
ctatcccgtgcttaatgtaata

SEQ ID NO: 1302959 - DNA, 22 bp, Artificial Sequence
  chemically synthesized
ctgctatcccgtgcttaatgta

SEQ ID NO: 1302960 - DNA, 22 bp, Artificial Sequence
  chemically synthesized
atgggctgctgctatcccgtgc

SEQ ID NO: 1302961 - DNA, 22 bp, Artificial Sequence
  chemically synthesized
ttacattaagcacgggatagca

SEQ ID NO: 1302962 - DNA, 22 bp, Artificial Sequence
  chemically synthesized
cactgatgggctgctgctatcc

SEQ ID NO: 1302963 - DNA, 22 bp, Artificial Sequence
  chemically synthesized
cattaagcacgggatagcagca

SEQ ID NO: 1302964 - DNA, 22 bp, Artificial Sequence
  chemically synthesized
agcacgggatagcagcagccca

SEQ ID NO: 1302965 - DNA, 22 bp, Artificial Sequence
  chemically synthesized
aaagacctccactgatgggctg

SEQ ID NO: 1302966 - DNA, 22 bp, Artificial Sequence
  chemically synthesized
caaagacctccactgatgggct

SEQ ID NO: 1302967 - DNA, 22 bp, Artificial Sequence
  chemically synthesized
cagtcttcaaagacctccactg

SEQ ID NO: 1302968 - DNA, 22 bp, Artificial Sequence
  chemically synthesized
agaacactacagtcttcaaaga

SEQ ID NO: 1302969 - DNA, 22 bp, Artificial Sequence
  chemically synthesized
cagaacactacagtcttcaaag

SEQ ID NO: 1302970 - DNA, 22 bp, Artificial Sequence
  chemically synthesized
tagcaaccttcagaacactaca

SEQ ID NO: 1302971 - DNA, 22 bp, Artificial Sequence
  chemically synthesized
ctgtagcaaccttcagaacact

SEQ ID NO: 1302972 - DNA, 22 bp, Artificial Sequence
  chemically synthesized
tgaagactgtagtgttctgaag

SEQ ID NO: 1302973 - DNA, 22 bp, Artificial Sequence
  chemically synthesized
gaagactgtagtgttctgaagg

SEQ ID NO: 1302974 - DNA, 22 bp, Artificial Sequence
  chemically synthesized
ttgctgtagcaaccttcagaac

SEQ ID NO: 1302975 - DNA, 22 bp, Artificial Sequence
  chemically synthesized
aagactgtagtgttctgaaggt

SEQ ID NO: 1302976 - DNA, 22 bp, Artificial Sequence
  chemically synthesized
ttgttgctgtagcaaccttcag

SEQ ID NO: 1302977 - DNA, 22 bp, Artificial Sequence
  chemically synthesized
tagtgttctgaaggttgctaca

SEQ ID NO: 1302978 - DNA, 22 bp, Artificial Sequence
  chemically synthesized
tgaaggttgctacagcaacaac

SEQ ID NO: 1302979 - DNA, 22 bp, Artificial Sequence
  chemically synthesized
aaggttgctacagcaacaacaa

SEQ ID NO: 1302980 - DNA, 22 bp, Artificial Sequence
  chemically synthesized
gaggggcgggggttgttgttgc

SEQ ID NO: 1302981 - DNA, 22 bp, Artificial Sequence
  chemically synthesized
ggaggggcgggggttgttgttg

SEQ ID NO: 1302982 - DNA, 22 bp, Artificial Sequence
  chemically synthesized
gtttggaggggcgggggttgtt

SEQ ID NO: 1302983 - DNA, 22 bp, Artificial Sequence
  chemically synthesized
ctacagcaacaacaacccccgc

SEQ ID NO: 1302984 - DNA, 22 bp, Artificial Sequence
  chemically synthesized
cagcaacaacaacccccgcccc

SEQ ID NO: 1302985 - DNA, 22 bp, Artificial Sequence
  chemically synthesized
agctggtttggaggggcggggg

SEQ ID NO: 1302986 - DNA, 22 bp, Artificial Sequence
  chemically synthesized
gtattgagctggtttggagggg

SEQ ID NO: 1302987 - DNA, 22 bp, Artificial Sequence
  chemically synthesized
agtcagtggtgttagtattgag

SEQ ID NO: 1302988 - DNA, 22 bp, Artificial Sequence
  chemically synthesized
gagtcagtggtgttagtattga

SEQ ID NO: 1302989 - DNA, 22 bp, Artificial Sequence
  chemically synthesized
caaaccagctcaatactaacac

SEQ ID NO: 1302990 - DNA, 22 bp, Artificial Sequence
  chemically synthesized
gtatggggtttgagtcagtggt

SEQ ID NO: 1302991 - DNA, 22 bp, Artificial Sequence
  chemically synthesized
aatactaacaccactgactcaa

SEQ ID NO: 1302992 - DNA, 22 bp, Artificial Sequence
  chemically synthesized
ctagtatggggtttgagtcagt

SEQ ID NO: 1302993 - DNA, 22 bp, Artificial Sequence
  chemically synthesized
acaccactgactcaaaccccat

SEQ ID NO: 1302994 - DNA, 22 bp, Artificial Sequence
  chemically synthesized
tcatactgctagtatggggttt

SEQ ID NO: 1302995 - DNA, 22 bp, Artificial Sequence
  chemically synthesized
tgtcatactgctagtatggggt

SEQ ID NO: 1302996 - DNA, 22 bp, Artificial Sequence
  chemically synthesized
ctgtcatactgctagtatgggg

SEQ ID NO: 1302997 - DNA, 22 bp, Artificial Sequence
  chemically synthesized
tctgtcatactgctagtatggg

SEQ ID NO: 1302998 - DNA, 22 bp, Artificial Sequence
  chemically synthesized
ttctgtcatactgctagtatgg

SEQ ID NO: 1302999 - DNA, 22 bp, Artificial Sequence
  chemically synthesized
tttctgtcatactgctagtatg

SEQ ID NO: 1303000 - DNA, 22 bp, Artificial Sequence
  chemically synthesized
ttttctgtcatactgctagtat

SEQ ID NO: 1303001 - DNA, 22 bp, Artificial Sequence
  chemically synthesized
actcaaaccccatactagcagt

SEQ ID NO: 1303002 - DNA, 22 bp, Artificial Sequence
  chemically synthesized
tttttctgtcatactgctagta

SEQ ID NO: 1303003 - DNA, 22 bp, Artificial Sequence
  chemically synthesized
aaaccccatactagcagtatga

SEQ ID NO: 1303004 - DNA, 22 bp, Artificial Sequence
  chemically synthesized
gaaataggtatagctttttttc

SEQ ID NO: 1303005 - DNA, 22 bp, Artificial Sequence
  chemically synthesized
gcagtatgacagaaaaaaagct

SEQ ID NO: 1303006 - DNA, 22 bp, Artificial Sequence
  chemically synthesized
ggaaataggtatagcttttttt

SEQ ID NO: 1303007 - DNA, 22 bp, Artificial Sequence
  chemically synthesized
atcttggaaataggtatagctt

SEQ ID NO: 1303008 - DNA, 22 bp, Artificial Sequence
  chemically synthesized
aatcttggaaataggtatagct

SEQ ID NO: 1303009 - DNA, 22 bp, Artificial Sequence
  chemically synthesized
tacctatttccaagattaaaca

SEQ ID NO: 1303010 - DNA, 22 bp, Artificial Sequence
  chemically synthesized
tttccaagattaaacatattta

SEQ ID NO: 1303011 - DNA, 22 bp, Artificial Sequence
  chemically synthesized
ccaagattaaacatatttacct

SEQ ID NO: 1303012 - DNA, 22 bp, Artificial Sequence
  chemically synthesized
caagattaaacatatttacctc

SEQ ID NO: 1303013 - DNA, 22 bp, Artificial Sequence
  chemically synthesized
aacatatttacctcattctcta

SEQ ID NO: 1303014 - DNA, 22 bp, Artificial Sequence
  chemically synthesized
acctcattctctatttttcttc

SEQ ID NO: 1303015 - DNA, 22 bp, Artificial Sequence
  chemically synthesized
cctcattctctatttttcttct

SEQ ID NO: 1303016 - DNA, 22 bp, Artificial Sequence
  chemically synthesized
gatgtcatgtatagaagaaaaa

SEQ ID NO: 1303017 - DNA, 22 bp, Artificial Sequence
  chemically synthesized
attctctatttttcttctatac

SEQ ID NO: 1303018 - DNA, 22 bp, Artificial Sequence
  chemically synthesized
tctatttttcttctatacatga

SEQ ID NO: 1303019 - DNA, 22 bp, Artificial Sequence
  chemically synthesized
tatttttcttctatacatgaca

SEQ ID NO: 1303020 - DNA, 22 bp, Artificial Sequence
  chemically synthesized
gtgaatgttagatgtcatgtat

SEQ ID NO: 1303021 - DNA, 22 bp, Artificial Sequence
  chemically synthesized
agtgaatgttagatgtcatgta

SEQ ID NO: 1303022 - DNA, 22 bp, Artificial Sequence
  chemically synthesized
tttttcttctatacatgacatc

SEQ ID NO: 1303023 - DNA, 22 bp, Artificial Sequence
  chemically synthesized
tagtgaatgttagatgtcatgt

SEQ ID NO: 1303024 - DNA, 22 bp, Artificial Sequence
  chemically synthesized
ttagtgaatgttagatgtcatg

SEQ ID NO: 1303025 - DNA, 22 bp, Artificial Sequence
  chemically synthesized
tttagtgaatgttagatgtcat

SEQ ID NO: 1303026 - DNA, 22 bp, Artificial Sequence
  chemically synthesized
ttcttctatacatgacatctaa

SEQ ID NO: 1303027 - DNA, 22 bp, Artificial Sequence
  chemically synthesized
tcttctatacatgacatctaac

SEQ ID NO: 1303028 - DNA, 22 bp, Artificial Sequence
  chemically synthesized
tttttagtgaatgttagatgtc

SEQ ID NO: 1303029 - DNA, 22 bp, Artificial Sequence
  chemically synthesized
cttctatacatgacatctaaca

SEQ ID NO: 1303030 - DNA, 22 bp, Artificial Sequence
  chemically synthesized
ctttttagtgaatgttagatgt

SEQ ID NO: 1303031 - DNA, 22 bp, Artificial Sequence
  chemically synthesized
ttctatacatgacatctaacat

SEQ ID NO: 1303032 - DNA, 22 bp, Artificial Sequence
  chemically synthesized
tctttttagtgaatgttagatg

SEQ ID NO: 1303033 - DNA, 22 bp, Artificial Sequence
  chemically synthesized
ctatacatgacatctaacattc

SEQ ID NO: 1303034 - DNA, 22 bp, Artificial Sequence
  chemically synthesized
tatacatgacatctaacattca

SEQ ID NO: 1303035 - DNA, 22 bp, Artificial Sequence
  chemically synthesized
attttctttttagtgaatgtta

SEQ ID NO: 1303036 - DNA, 22 bp, Artificial Sequence
  chemically synthesized
tacatgacatctaacattcact

SEQ ID NO: 1303037 - DNA, 22 bp, Artificial Sequence
  chemically synthesized
caagtctcattttctttttagt

SEQ ID NO: 1303038 - DNA, 22 bp, Artificial Sequence
  chemically synthesized
gcaagtctcattttctttttag

SEQ ID NO: 1303039 - DNA, 22 bp, Artificial Sequence
  chemically synthesized
tgcaagtctcattttcttttta

SEQ ID NO: 1303040 - DNA, 22 bp, Artificial Sequence
  chemically synthesized
ttgcaagtctcattttcttttt

SEQ ID NO: 1303041 - DNA, 22 bp, Artificial Sequence
  chemically synthesized
tttgcaagtctcattttctttt

SEQ ID NO: 1303042 - DNA, 22 bp, Artificial Sequence
  chemically synthesized
acattcactaaaaagaaaatga

SEQ ID NO: 1303043 - DNA, 22 bp, Artificial Sequence
  chemically synthesized
ttttttgcaagtctcattttct

SEQ ID NO: 1303044 - DNA, 22 bp, Artificial Sequence
  chemically synthesized
attttttgcaagtctcattttc

SEQ ID NO: 1303045 - DNA, 22 bp, Artificial Sequence
  chemically synthesized
tttattttttgcaagtctcatt

SEQ ID NO: 1303046 - DNA, 22 bp, Artificial Sequence
  chemically synthesized
actaaaaagaaaatgagacttg

SEQ ID NO: 1303047 - DNA, 22 bp, Artificial Sequence
  chemically synthesized
atttattttttgcaagtctcat

SEQ ID NO: 1303048 - DNA, 22 bp, Artificial Sequence
  chemically synthesized
tatttattttttgcaagtctca

SEQ ID NO: 1303049 - DNA, 22 bp, Artificial Sequence
  chemically synthesized
aaaagaaaatgagacttgcaaa

SEQ ID NO: 1303050 - DNA, 22 bp, Artificial Sequence
  chemically synthesized
gttttatttattttttgcaagt

SEQ ID NO: 1303051 - DNA, 22 bp, Artificial Sequence
  chemically synthesized
agttttatttattttttgcaag

SEQ ID NO: 1303052 - DNA, 22 bp, Artificial Sequence
  chemically synthesized
cttagttttatttattttttgc

SEQ ID NO: 1303053 - DNA, 22 bp, Artificial Sequence
  chemically synthesized
gcttagttttatttattttttg

SEQ ID NO: 1303054 - DNA, 22 bp, Artificial Sequence
  chemically synthesized
tgcttagttttatttatttttt

SEQ ID NO: 1303055 - DNA, 22 bp, Artificial Sequence
  chemically synthesized
gcaaaaaataaataaaactaag

SEQ ID NO: 1303056 - DNA, 22 bp, Artificial Sequence
  chemically synthesized
caaaaaataaataaaactaagc

SEQ ID NO: 1303057 - DNA, 22 bp, Artificial Sequence
  chemically synthesized
ataatgggtgtattttgcttag

SEQ ID NO: 1303058 - DNA, 22 bp, Artificial Sequence
  chemically synthesized
gataatgggtgtattttgctta

SEQ ID NO: 1303059 - DNA, 22 bp, Artificial Sequence
  chemically synthesized
ttgataatgggtgtattttgct

SEQ ID NO: 1303060 - DNA, 22 bp, Artificial Sequence
  chemically synthesized
cttgataatgggtgtattttgc

SEQ ID NO: 1303061 - DNA, 22 bp, Artificial Sequence
  chemically synthesized
cttcttgataatgggtgtattt

SEQ ID NO: 1303062 - DNA, 22 bp, Artificial Sequence
  chemically synthesized
acttcttgataatgggtgtatt

SEQ ID NO: 1303063 - DNA, 22 bp, Artificial Sequence
  chemically synthesized
tacttcttgataatgggtgtat

SEQ ID NO: 1303064 - DNA, 22 bp, Artificial Sequence
  chemically synthesized
agcaaaatacacccattatcaa

SEQ ID NO: 1303065 - DNA, 22 bp, Artificial Sequence
  chemically synthesized
atggctttacttcttgataatg

SEQ ID NO: 1303066 - DNA, 22 bp, Artificial Sequence
  chemically synthesized
tgttgatggctttacttcttga

SEQ ID NO: 1303067 - DNA, 22 bp, Artificial Sequence
  chemically synthesized
gttatgttgatggctttacttc

SEQ ID NO: 1303068 - DNA, 22 bp, Artificial Sequence
  chemically synthesized
gtctggttatgttgatggcttt

SEQ ID NO: 1303069 - DNA, 22 bp, Artificial Sequence
  chemically synthesized
agtctggttatgttgatggctt

SEQ ID NO: 1303070 - DNA, 22 bp, Artificial Sequence
  chemically synthesized
tcaagaagtaaagccatcaaca

SEQ ID NO: 1303071 - DNA, 22 bp, Artificial Sequence
  chemically synthesized
ttagtctggttatgttgatggc

SEQ ID NO: 1303072 - DNA, 22 bp, Artificial Sequence
  chemically synthesized
tctcttagtctggttatgttga

SEQ ID NO: 1303073 - DNA, 22 bp, Artificial Sequence
  chemically synthesized
aagcatataggttatctcttag

SEQ ID NO: 1303074 - DNA, 22 bp, Artificial Sequence
  chemically synthesized
gttcaagcatataggttatctc

SEQ ID NO: 1303075 - DNA, 22 bp, Artificial Sequence
  chemically synthesized
ttagttcaagcatataggttat

SEQ ID NO: 1303076 - DNA, 22 bp, Artificial Sequence
  chemically synthesized
tctgttagttcaagcatatagg

SEQ ID NO: 1303077 - DNA, 22 bp, Artificial Sequence
  chemically synthesized
gtctgttagttcaagcatatag

SEQ ID NO: 1303078 - DNA, 22 bp, Artificial Sequence
  chemically synthesized
agagataacctatatgcttgaa

SEQ ID NO: 1303079 - DNA, 22 bp, Artificial Sequence
  chemically synthesized
aagtccttgtctgttagttcaa

SEQ ID NO: 1303080 - DNA, 22 bp, Artificial Sequence
  chemically synthesized
aaagtccttgtctgttagttca

SEQ ID NO: 1303081 - DNA, 22 bp, Artificial Sequence
  chemically synthesized
taaagtccttgtctgttagttc

SEQ ID NO: 1303082 - DNA, 22 bp, Artificial Sequence
  chemically synthesized
tatgcttgaactaacagacaag

SEQ ID NO: 1303083 - DNA, 22 bp, Artificial Sequence
  chemically synthesized
gaactaacagacaaggacttta

SEQ ID NO: 1303084 - DNA, 22 bp, Artificial Sequence
  chemically synthesized
aactaacagacaaggactttaa

SEQ ID NO: 1303085 - DNA, 22 bp, Artificial Sequence
  chemically synthesized
tcagtcagagatattttaaagt

SEQ ID NO: 1303086 - DNA, 22 bp, Artificial Sequence
  chemically synthesized
atcagtcagagatattttaaag

SEQ ID NO: 1303087 - DNA, 22 bp, Artificial Sequence
  chemically synthesized
acagacaaggactttaaaatat

SEQ ID NO: 1303088 - DNA, 22 bp, Artificial Sequence
  chemically synthesized
tcttatcagtcagagatatttt

SEQ ID NO: 1303089 - DNA, 22 bp, Artificial Sequence
  chemically synthesized
atcttatcagtcagagatattt

SEQ ID NO: 1303090 - DNA, 22 bp, Artificial Sequence
  chemically synthesized
cttatcttatcagtcagagata

SEQ ID NO: 1303091 - DNA, 22 bp, Artificial Sequence
  chemically synthesized
ttccttatcttatcagtcagag

SEQ ID NO: 1303092 - DNA, 22 bp, Artificial Sequence
  chemically synthesized
taaaatatctctgactgataag

SEQ ID NO: 1303093 - DNA, 22 bp, Artificial Sequence
  chemically synthesized
aaaatatctctgactgataaga

SEQ ID NO: 1303094 - DNA, 22 bp, Artificial Sequence
  chemically synthesized
aaatatctctgactgataagat

SEQ ID NO: 1303095 - DNA, 22 bp, Artificial Sequence
  chemically synthesized
gatgaatctattccttatctta

SEQ ID NO: 1303096 - DNA, 22 bp, Artificial Sequence
  chemically synthesized
tgactgataagataaggaatag

SEQ ID NO: 1303097 - DNA, 22 bp, Artificial Sequence
  chemically synthesized
actgataagataaggaatagat

SEQ ID NO: 1303098 - DNA, 22 bp, Artificial Sequence
  chemically synthesized
gtatctagatgaatctattcct

SEQ ID NO: 1303099 - DNA, 22 bp, Artificial Sequence
  chemically synthesized
agtatctagatgaatctattcc

SEQ ID NO: 1303100 - DNA, 22 bp, Artificial Sequence
  chemically synthesized
tagtatctagatgaatctattc

SEQ ID NO: 1303101 - DNA, 22 bp, Artificial Sequence
  chemically synthesized
ataagataaggaatagattcat

SEQ ID NO: 1303102 - DNA, 22 bp, Artificial Sequence
  chemically synthesized
tttagtatctagatgaatctat

SEQ ID NO: 1303103 - DNA, 22 bp, Artificial Sequence
  chemically synthesized
ctttagtatctagatgaatcta

SEQ ID NO: 1303104 - DNA, 22 bp, Artificial Sequence
  chemically synthesized
tctttagtatctagatgaatct

SEQ ID NO: 1303105 - DNA, 22 bp, Artificial Sequence
  chemically synthesized
gatgttttctttagtatctaga

SEQ ID NO: 1303106 - DNA, 22 bp, Artificial Sequence
  chemically synthesized
ggatgttttctttagtatctag

SEQ ID NO: 1303107 - DNA, 22 bp, Artificial Sequence
  chemically synthesized
tggatgttttctttagtatcta

SEQ ID NO: 1303108 - DNA, 22 bp, Artificial Sequence
  chemically synthesized
atctagatactaaagaaaacat

SEQ ID NO: 1303109 - DNA, 22 bp, Artificial Sequence
  chemically synthesized
tgaaagttttggatgttttctt

SEQ ID NO: 1303110 - DNA, 22 bp, Artificial Sequence
  chemically synthesized
gtgaaagttttggatgttttct

SEQ ID NO: 1303111 - DNA, 22 bp, Artificial Sequence
  chemically synthesized
tttgtgaaagttttggatgttt

SEQ ID NO: 1303112 - DNA, 22 bp, Artificial Sequence
  chemically synthesized
gatactaaagaaaacatccaaa

SEQ ID NO: 1303113 - DNA, 22 bp, Artificial Sequence
  chemically synthesized
aagaaaacatccaaaactttca

SEQ ID NO: 1303114 - DNA, 22 bp, Artificial Sequence
  chemically synthesized
aaacatcccatctgtttgtgaa

SEQ ID NO: 1303115 - DNA, 22 bp, Artificial Sequence
  chemically synthesized
tgctgaaacatcccatctgttt

SEQ ID NO: 1303116 - DNA, 22 bp, Artificial Sequence
  chemically synthesized
tcacaaacagatgggatgtttc

SEQ ID NO: 1303117 - DNA, 22 bp, Artificial Sequence
  chemically synthesized
catcactgtgctgaaacatccc

SEQ ID NO: 1303118 - DNA, 22 bp, Artificial Sequence
  chemically synthesized
cacaaacagatgggatgtttca

SEQ ID NO: 1303119 - DNA, 22 bp, Artificial Sequence
  chemically synthesized
acaaacagatgggatgtttcag

SEQ ID NO: 1303120 - DNA, 22 bp, Artificial Sequence
  chemically synthesized
cagattccatcactgtgctgaa

SEQ ID NO: 1303121 - DNA, 22 bp, Artificial Sequence
  chemically synthesized
acagattccatcactgtgctga

SEQ ID NO: 1303122 - DNA, 22 bp, Artificial Sequence
  chemically synthesized
tacagattccatcactgtgctg

SEQ ID NO: 1303123 - DNA, 22 bp, Artificial Sequence
  chemically synthesized
catcattttacagattccatca

SEQ ID NO: 1303124 - DNA, 22 bp, Artificial Sequence
  chemically synthesized
cagcacagtgatggaatctgta

SEQ ID NO: 1303125 - DNA, 22 bp, Artificial Sequence
  chemically synthesized
agcacagtgatggaatctgtaa

SEQ ID NO: 1303126 - DNA, 22 bp, Artificial Sequence
  chemically synthesized
cattgcatcattttacagattc

SEQ ID NO: 1303127 - DNA, 22 bp, Artificial Sequence
  chemically synthesized
gcaattccattgcatcatttta

SEQ ID NO: 1303128 - DNA, 22 bp, Artificial Sequence
  chemically synthesized
ttagcaattccattgcatcatt

SEQ ID NO: 1303129 - DNA, 22 bp, Artificial Sequence
  chemically synthesized
ttgttagcaattccattgcatc

SEQ ID NO: 1303130 - DNA, 22 bp, Artificial Sequence
  chemically synthesized
attgttagcaattccattgcat

SEQ ID NO: 1303131 - DNA, 22 bp, Artificial Sequence
  chemically synthesized
cttattgttagcaattccattg

SEQ ID NO: 1303132 - DNA, 22 bp, Artificial Sequence
  chemically synthesized
taaaatgatgcaatggaattgc

SEQ ID NO: 1303133 - DNA, 22 bp, Artificial Sequence
  chemically synthesized
ttgcttattgttagcaattcca

SEQ ID NO: 1303134 - DNA, 22 bp, Artificial Sequence
  chemically synthesized
attattgcttattgttagcaat

SEQ ID NO: 1303135 - DNA, 22 bp, Artificial Sequence
  chemically synthesized
agttgattattgcttattgtta

SEQ ID NO: 1303136 - DNA, 22 bp, Artificial Sequence
  chemically synthesized
gagttgattattgcttattgtt

SEQ ID NO: 1303137 - DNA, 22 bp, Artificial Sequence
  chemically synthesized
tgagttgattattgcttattgt

SEQ ID NO: 1303138 - DNA, 22 bp, Artificial Sequence
  chemically synthesized
acattttgagttgattattgct

SEQ ID NO: 1303139 - DNA, 22 bp, Artificial Sequence
  chemically synthesized
ctaacaataagcaataatcaac

SEQ ID NO: 1303140 - DNA, 22 bp, Artificial Sequence
  chemically synthesized
cattaacattttgagttgatta

SEQ ID NO: 1303141 - DNA, 22 bp, Artificial Sequence
  chemically synthesized
acaataagcaataatcaactca

SEQ ID NO: 1303142 - DNA, 22 bp, Artificial Sequence
  chemically synthesized
ctacattaacattttgagttga

SEQ ID NO: 1303143 - DNA, 22 bp, Artificial Sequence
  chemically synthesized
caattgctacattaacattttg

SEQ ID NO: 1303144 - DNA, 22 bp, Artificial Sequence
  chemically synthesized
gcaattgctacattaacatttt

SEQ ID NO: 1303145 - DNA, 22 bp, Artificial Sequence
  chemically synthesized
tgcaattgctacattaacattt

SEQ ID NO: 1303146 - DNA, 22 bp, Artificial Sequence
  chemically synthesized
aaaatgttaatgtagcaattgc

SEQ ID NO: 1303147 - DNA, 22 bp, Artificial Sequence
  chemically synthesized
taatagaaataattttgcaatt

SEQ ID NO: 1303148 - DNA, 22 bp, Artificial Sequence
  chemically synthesized
ataatagaaataattttgcaat

SEQ ID NO: 1303149 - DNA, 22 bp, Artificial Sequence
  chemically synthesized
tataatagaaataattttgcaa

SEQ ID NO: 1303150 - DNA, 22 bp, Artificial Sequence
  chemically synthesized
ttataatagaaataattttgca

SEQ ID NO: 1303151 - DNA, 22 bp, Artificial Sequence
  chemically synthesized
tttataatagaaataattttgc

SEQ ID NO: 1303152 - DNA, 22 bp, Artificial Sequence
  chemically synthesized
atgtagcaattgcaaaattatt

SEQ ID NO: 1303153 - DNA, 22 bp, Artificial Sequence
  chemically synthesized
acattttttataatagaaataa

SEQ ID NO: 1303154 - DNA, 22 bp, Artificial Sequence
  chemically synthesized
aacattttttataatagaaata

SEQ ID NO: 1303155 - DNA, 22 bp, Artificial Sequence
  chemically synthesized
caaaattatttctattataaaa

SEQ ID NO: 1303156 - DNA, 22 bp, Artificial Sequence
  chemically synthesized
taatttaacattttttataata

SEQ ID NO: 1303157 - DNA, 22 bp, Artificial Sequence
  chemically synthesized
gtaatttaacattttttataat

SEQ ID NO: 1303158 - DNA, 22 bp, Artificial Sequence
  chemically synthesized
tgtaatttaacattttttataa

SEQ ID NO: 1303159 - DNA, 22 bp, Artificial Sequence
  chemically synthesized
tttgtaatttaacattttttat

SEQ ID NO: 1303160 - DNA, 22 bp, Artificial Sequence
  chemically synthesized
tctttgtaatttaacatttttt

SEQ ID NO: 1303161 - DNA, 22 bp, Artificial Sequence
  chemically synthesized
tttctattataaaaaatgttaa

SEQ ID NO: 1303162 - DNA, 22 bp, Artificial Sequence
  chemically synthesized
ttctctttgtaatttaacattt

SEQ ID NO: 1303163 - DNA, 22 bp, Artificial Sequence
  chemically synthesized
ctattataaaaaatgttaaatt

SEQ ID NO: 1303164 - DNA, 22 bp, Artificial Sequence
  chemically synthesized
tattataaaaaatgttaaatta

SEQ ID NO: 1303165 - DNA, 22 bp, Artificial Sequence
  chemically synthesized
ttattctctttgtaatttaaca

SEQ ID NO: 1303166 - DNA, 22 bp, Artificial Sequence
  chemically synthesized
ttataaaaaatgttaaattaca

SEQ ID NO: 1303167 - DNA, 22 bp, Artificial Sequence
  chemically synthesized
taaaaaatgttaaattacaaag

SEQ ID NO: 1303168 - DNA, 22 bp, Artificial Sequence
  chemically synthesized
aggtactgttattctctttgta

SEQ ID NO: 1303169 - DNA, 22 bp, Artificial Sequence
  chemically synthesized
aaggtactgttattctctttgt

SEQ ID NO: 1303170 - DNA, 22 bp, Artificial Sequence
  chemically synthesized
taaggtactgttattctctttg

SEQ ID NO: 1303171 - DNA, 22 bp, Artificial Sequence
  chemically synthesized
aattacaaagagaataacagta

SEQ ID NO: 1303172 - DNA, 22 bp, Artificial Sequence
  chemically synthesized
tgtgtcattttaaggtactgtt

SEQ ID NO: 1303173 - DNA, 22 bp, Artificial Sequence
  chemically synthesized
caaagagaataacagtacctta

SEQ ID NO: 1303174 - DNA, 22 bp, Artificial Sequence
  chemically synthesized
aattatgtgtcattttaaggta

SEQ ID NO: 1303175 - DNA, 22 bp, Artificial Sequence
  chemically synthesized
aaattatgtgtcattttaaggt

SEQ ID NO: 1303176 - DNA, 22 bp, Artificial Sequence
  chemically synthesized
taaattatgtgtcattttaagg

SEQ ID NO: 1303177 - DNA, 22 bp, Artificial Sequence
  chemically synthesized
tagtattttaaattatgtgtca

SEQ ID NO: 1303178 - DNA, 22 bp, Artificial Sequence
  chemically synthesized
acatctgtagtattttaaatta

SEQ ID NO: 1303179 - DNA, 22 bp, Artificial Sequence
  chemically synthesized
aaaatgacacataatttaaaat

SEQ ID NO: 1303180 - DNA, 22 bp, Artificial Sequence
  chemically synthesized
aaatgacacataatttaaaata

SEQ ID NO: 1303181 - DNA, 22 bp, Artificial Sequence
  chemically synthesized
caatattaacatctgtagtatt

SEQ ID NO: 1303182 - DNA, 22 bp, Artificial Sequence
  chemically synthesized
ccaatattaacatctgtagtat

SEQ ID NO: 1303183 - DNA, 22 bp, Artificial Sequence
  chemically synthesized
tccaatattaacatctgtagta

SEQ ID NO: 1303184 - DNA, 22 bp, Artificial Sequence
  chemically synthesized
ttccaatattaacatctgtagt

SEQ ID NO: 1303185 - DNA, 22 bp, Artificial Sequence
  chemically synthesized
aaaatactacagatgttaatat

SEQ ID NO: 1303186 - DNA, 22 bp, Artificial Sequence
  chemically synthesized
aaatactacagatgttaatatt

SEQ ID NO: 1303187 - DNA, 22 bp, Artificial Sequence
  chemically synthesized
gtaaacaatttttccaatatta

SEQ ID NO: 1303188 - DNA, 22 bp, Artificial Sequence
  chemically synthesized
cagatgttaatattggaaaaat

SEQ ID NO: 1303189 - DNA, 22 bp, Artificial Sequence
  chemically synthesized
atattggaaaaattgtttacca

SEQ ID NO: 1303190 - DNA, 22 bp, Artificial Sequence
  chemically synthesized
aggtgtgaacattggtaaacaa

SEQ ID NO: 1303191 - DNA, 22 bp, Artificial Sequence
  chemically synthesized
gaaaaattgtttaccaatgttc

SEQ ID NO: 1303192 - DNA, 22 bp, Artificial Sequence
  chemically synthesized
agtactcaggtgtgaacattgg

SEQ ID NO: 1303193 - DNA, 22 bp, Artificial Sequence
  chemically synthesized
tttaccaatgttcacacctgag

SEQ ID NO: 1303194 - DNA, 22 bp, Artificial Sequence
  chemically synthesized
accaatgttcacacctgagtac

SEQ ID NO: 1303195 - DNA, 22 bp, Artificial Sequence
  chemically synthesized
ccaatgttcacacctgagtact

SEQ ID NO: 1303196 - DNA, 22 bp, Artificial Sequence
  chemically synthesized
catcaaaggattgagtactcag

SEQ ID NO: 1303197 - DNA, 22 bp, Artificial Sequence
  chemically synthesized
ccatcaaaggattgagtactca

SEQ ID NO: 1303198 - DNA, 22 bp, Artificial Sequence
  chemically synthesized
acacctgagtactcaatccttt

SEQ ID NO: 1303199 - DNA, 22 bp, Artificial Sequence
  chemically synthesized
agtactcaatcctttgatggaa

SEQ ID NO: 1303200 - DNA, 22 bp, Artificial Sequence
  chemically synthesized
tagtgtcataccttccatcaaa

SEQ ID NO: 1303201 - DNA, 22 bp, Artificial Sequence
  chemically synthesized
aatcctttgatggaaggtatga

SEQ ID NO: 1303202 - DNA, 22 bp, Artificial Sequence
  chemically synthesized
taataaatcattatagtgtcat

SEQ ID NO: 1303203 - DNA, 22 bp, Artificial Sequence
  chemically synthesized
tgatggaaggtatgacactata

SEQ ID NO: 1303204 - DNA, 22 bp, Artificial Sequence
  chemically synthesized
ataataaatcattatagtgtca

SEQ ID NO: 1303205 - DNA, 22 bp, Artificial Sequence
  chemically synthesized
gatggaaggtatgacactataa

SEQ ID NO: 1303206 - DNA, 22 bp, Artificial Sequence
  chemically synthesized
tataataaatcattatagtgtc

SEQ ID NO: 1303207 - DNA, 22 bp, Artificial Sequence
  chemically synthesized
atggaaggtatgacactataat

SEQ ID NO: 1303208 - DNA, 22 bp, Artificial Sequence
  chemically synthesized
ttataataaatcattatagtgt

SEQ ID NO: 1303209 - DNA, 22 bp, Artificial Sequence
  chemically synthesized
aggagtttttataataaatcat

SEQ ID NO: 1303210 - DNA, 22 bp, Artificial Sequence
  chemically synthesized
aaggagtttttataataaatca

SEQ ID NO: 1303211 - DNA, 22 bp, Artificial Sequence
  chemically synthesized
taatgatttattataaaaactc

SEQ ID NO: 1303212 - DNA, 22 bp, Artificial Sequence
  chemically synthesized
cgcggccacttaaggagttttt

SEQ ID NO: 1303213 - DNA, 22 bp, Artificial Sequence
  chemically synthesized
attataaaaactccttaagtgg

SEQ ID NO: 1303214 - DNA, 22 bp, Artificial Sequence
  chemically synthesized
ttataaaaactccttaagtggc

SEQ ID NO: 1303215 - DNA, 22 bp, Artificial Sequence
  chemically synthesized
taaaaactccttaagtggccgc

SEQ ID NO: 1303216 - DNA, 22 bp, Artificial Sequence
  chemically synthesized
cttaagtggccgcgcagcctgc

SEQ ID NO: 1303217 - DNA, 22 bp, Artificial Sequence
  chemically synthesized
aagtggccgcgcagcctgcgca

SEQ ID NO: 1303218 - DNA, 22 bp, Artificial Sequence
  chemically synthesized
agtggccgcgcagcctgcgcat

SEQ ID NO: 1303219 - DNA, 22 bp, Artificial Sequence
  chemically synthesized
gtcgccggcgcgcatgcgcagg

SEQ ID NO: 1303220 - DNA, 22 bp, Artificial Sequence
  chemically synthesized
ggtcgccggcgcgcatgcgcag

SEQ ID NO: 1303221 - DNA, 22 bp, Artificial Sequence
  chemically synthesized
ggcttggtcgccggcgcgcatg

SEQ ID NO: 1303222 - DNA, 22 bp, Artificial Sequence
  chemically synthesized
aggcttggtcgccggcgcgcat

SEQ ID NO: 1303223 - DNA, 22 bp, Artificial Sequence
  chemically synthesized
tttaggcttggtcgccggcgcg

SEQ ID NO: 1303224 - DNA, 22 bp, Artificial Sequence
  chemically synthesized
cgcatgcgcgccggcgaccaag

SEQ ID NO: 1303225 - DNA, 22 bp, Artificial Sequence
  chemically synthesized
aatagctaccgcctctgcgcgt

SEQ ID NO: 1303226 - DNA, 22 bp, Artificial Sequence
  chemically synthesized
ccgcctctgcgcgtcgccctcc

SEQ ID NO: 1303227 - DNA, 22 bp, Artificial Sequence
  chemically synthesized
tgcgcgtcgccctccacggtta

SEQ ID NO: 1303228 - DNA, 22 bp, Artificial Sequence
  chemically synthesized
cgcgtcgccctccacggttacc

SEQ ID NO: 1303229 - DNA, 22 bp, Artificial Sequence
  chemically synthesized
cacggttaccccggctttccgc

SEQ ID NO: 1303230 - DNA, 22 bp, Artificial Sequence
  chemically synthesized
ccccggctttccgcccctcctt

SEQ ID NO: 1303231 - DNA, 22 bp, Artificial Sequence
  chemically synthesized
gagccccgcgagaaggaggggc

SEQ ID NO: 1303232 - DNA, 22 bp, Artificial Sequence
  chemically synthesized
tccgcccctccttctcgcgggg

SEQ ID NO: 1303233 - DNA, 22 bp, Artificial Sequence
  chemically synthesized
ccgcccctccttctcgcggggc

SEQ ID NO: 1303234 - DNA, 22 bp, Artificial Sequence
  chemically synthesized
cgcccctccttctcgcggggct

SEQ ID NO: 1303235 - DNA, 22 bp, Artificial Sequence
  chemically synthesized
cttctcgcggggctcgagggac

SEQ ID NO: 1303236 - DNA, 22 bp, Artificial Sequence
  chemically synthesized
ctcgcggggctcgagggaccat

SEQ ID NO: 1303237 - DNA, 22 bp, Artificial Sequence
  chemically synthesized
tcgcggggctcgagggaccatg

SEQ ID NO: 1303238 - DNA, 22 bp, Artificial Sequence
  chemically synthesized
gcggggctcgagggaccatggc

SEQ ID NO: 1303239 - DNA, 22 bp, Artificial Sequence
  chemically synthesized
acgcgaggatcggccatggtcc

SEQ ID NO: 1303240 - DNA, 22 bp, Artificial Sequence
  chemically synthesized
tctcacgcgaggatcggccatg

SEQ ID NO: 1303241 - DNA, 22 bp, Artificial Sequence
  chemically synthesized
gagggaccatggccgatcctcg

SEQ ID NO: 1303242 - DNA, 22 bp, Artificial Sequence
  chemically synthesized
atctgtctcacgcgaggatcgg

SEQ ID NO: 1303243 - DNA, 22 bp, Artificial Sequence
  chemically synthesized
gatctgtctcacgcgaggatcg

SEQ ID NO: 1303244 - DNA, 22 bp, Artificial Sequence
  chemically synthesized
atcttgatctgtctcacgcgag

SEQ ID NO: 1303245 - DNA, 22 bp, Artificial Sequence
  chemically synthesized
gatcttgatctgtctcacgcga

SEQ ID NO: 1303246 - DNA, 22 bp, Artificial Sequence
  chemically synthesized
gcgtgagacagatcaagatcaa

SEQ ID NO: 1303247 - DNA, 22 bp, Artificial Sequence
  chemically synthesized
accacaccggtcttgatcttga

SEQ ID NO: 1303248 - DNA, 22 bp, Artificial Sequence
  chemically synthesized
caccacaccggtcttgatcttg

SEQ ID NO: 1303249 - DNA, 22 bp, Artificial Sequence
  chemically synthesized
accaaccgcttcaccacaccgg

SEQ ID NO: 1303250 - DNA, 22 bp, Artificial Sequence
  chemically synthesized
gaccaaccgcttcaccacaccg

SEQ ID NO: 1303251 - DNA, 22 bp, Artificial Sequence
  chemically synthesized
tttgaccaaccgcttcaccaca

SEQ ID NO: 1303252 - DNA, 22 bp, Artificial Sequence
  chemically synthesized
atttgaccaaccgcttcaccac

SEQ ID NO: 1303253 - DNA, 22 bp, Artificial Sequence
  chemically synthesized
tatttgaccaaccgcttcacca

SEQ ID NO: 1303254 - DNA, 22 bp, Artificial Sequence
  chemically synthesized
ttatttgaccaaccgcttcacc

SEQ ID NO: 1303255 - DNA, 22 bp, Artificial Sequence
  chemically synthesized
tttatttgaccaaccgcttcac

SEQ ID NO: 1303256 - DNA, 22 bp, Artificial Sequence
  chemically synthesized
atacatcactttttatttgacc

SEQ ID NO: 1303257 - DNA, 22 bp, Artificial Sequence
  chemically synthesized
catacatcactttttatttgac

SEQ ID NO: 1303258 - DNA, 22 bp, Artificial Sequence
  chemically synthesized
tcatacatcactttttatttga

SEQ ID NO: 1303259 - DNA, 22 bp, Artificial Sequence
  chemically synthesized
ttcatacatcactttttatttg

SEQ ID NO: 1303260 - DNA, 22 bp, Artificial Sequence
  chemically synthesized
tttcatacatcactttttattt

SEQ ID NO: 1303261 - DNA, 22 bp, Artificial Sequence
  chemically synthesized
tttttcatacatcactttttat

SEQ ID NO: 1303262 - DNA, 22 bp, Artificial Sequence
  chemically synthesized
cctctttttcatacatcacttt

SEQ ID NO: 1303263 - DNA, 22 bp, Artificial Sequence
  chemically synthesized
gcctctttttcatacatcactt

SEQ ID NO: 1303264 - DNA, 22 bp, Artificial Sequence
  chemically synthesized
tgcctctttttcatacatcact

SEQ ID NO: 1303265 - DNA, 22 bp, Artificial Sequence
  chemically synthesized
gtcaaataaaaagtgatgtatg

SEQ ID NO: 1303266 - DNA, 22 bp, Artificial Sequence
  chemically synthesized
ttttgcctctttttcatacatc

SEQ ID NO: 1303267 - DNA, 22 bp, Artificial Sequence
  chemically synthesized
ttgttttgcctctttttcatac

SEQ ID NO: 1303268 - DNA, 22 bp, Artificial Sequence
  chemically synthesized
gttgttttgcctctttttcata

SEQ ID NO: 1303269 - DNA, 22 bp, Artificial Sequence
  chemically synthesized
ttgttgttttgcctctttttca

SEQ ID NO: 1303270 - DNA, 22 bp, Artificial Sequence
  chemically synthesized
cttgttgttttgcctctttttc

SEQ ID NO: 1303271 - DNA, 22 bp, Artificial Sequence
  chemically synthesized
ttcttgttgttttgcctctttt

SEQ ID NO: 1303272 - DNA, 22 bp, Artificial Sequence
  chemically synthesized
cttcttgttgttttgcctcttt

SEQ ID NO: 1303273 - DNA, 22 bp, Artificial Sequence
  chemically synthesized
tcttcttgttgttttgcctctt

SEQ ID NO: 1303274 - DNA, 22 bp, Artificial Sequence
  chemically synthesized
ttcttcttgttgttttgcctct

SEQ ID NO: 1303275 - DNA, 22 bp, Artificial Sequence
  chemically synthesized
aatcttttcttcttgttgtttt

SEQ ID NO: 1303276 - DNA, 22 bp, Artificial Sequence
  chemically synthesized
caatcttttcttcttgttgttt

SEQ ID NO: 1303277 - DNA, 22 bp, Artificial Sequence
  chemically synthesized
tcaatcttttcttcttgttgtt

SEQ ID NO: 1303278 - DNA, 22 bp, Artificial Sequence
  chemically synthesized
ttcaatcttttcttcttgttgt

SEQ ID NO: 1303279 - DNA, 22 bp, Artificial Sequence
  chemically synthesized
tttcaatcttttcttcttgttg

SEQ ID NO: 1303280 - DNA, 22 bp, Artificial Sequence
  chemically synthesized
attttttcaatcttttcttctt

SEQ ID NO: 1303281 - DNA, 22 bp, Artificial Sequence
  chemically synthesized
tcattttttcaatcttttcttc

SEQ ID NO: 1303282 - DNA, 22 bp, Artificial Sequence
  chemically synthesized
agctctcattttttcaatcttt

SEQ ID NO: 1303283 - DNA, 22 bp, Artificial Sequence
  chemically synthesized
cagctctcattttttcaatctt

SEQ ID NO: 1303284 - DNA, 22 bp, Artificial Sequence
  chemically synthesized
accatcttcagctctcattttt

SEQ ID NO: 1303285 - DNA, 22 bp, Artificial Sequence
  chemically synthesized
caccatcttcagctctcatttt

SEQ ID NO: 1303286 - DNA, 22 bp, Artificial Sequence
  chemically synthesized
tcaccatcttcagctctcattt

SEQ ID NO: 1303287 - DNA, 22 bp, Artificial Sequence
  chemically synthesized
aaaaaatgagagctgaagatgg

SEQ ID NO: 1303288 - DNA, 22 bp, Artificial Sequence
  chemically synthesized
atgtcataattttcaccatctt

SEQ ID NO: 1303289 - DNA, 22 bp, Artificial Sequence
  chemically synthesized
gatgtcataattttcaccatct

SEQ ID NO: 1303290 - DNA, 22 bp, Artificial Sequence
  chemically synthesized
tgatgtcataattttcaccatc

SEQ ID NO: 1303291 - DNA, 22 bp, Artificial Sequence
  chemically synthesized
ttgatgtcataattttcaccat

SEQ ID NO: 1303292 - DNA, 22 bp, Artificial Sequence
  chemically synthesized
tttgatgtcataattttcacca

SEQ ID NO: 1303293 - DNA, 22 bp, Artificial Sequence
  chemically synthesized
ctttttgatgtcataattttca

SEQ ID NO: 1303294 - DNA, 22 bp, Artificial Sequence
  chemically synthesized
cctgctttttgatgtcataatt

SEQ ID NO: 1303295 - DNA, 22 bp, Artificial Sequence
  chemically synthesized
aagatggtgaaaattatgacat

SEQ ID NO: 1303296 - DNA, 22 bp, Artificial Sequence
  chemically synthesized
tgcctgctttttgatgtcataa

SEQ ID NO: 1303297 - DNA, 22 bp, Artificial Sequence
  chemically synthesized
taggatctctgcctgctttttg

SEQ ID NO: 1303298 - DNA, 22 bp, Artificial Sequence
  chemically synthesized
gtaggatctctgcctgcttttt

SEQ ID NO: 1303299 - DNA, 22 bp, Artificial Sequence
  chemically synthesized
ttgtaggatctctgcctgcttt

SEQ ID NO: 1303300 - DNA, 22 bp, Artificial Sequence
  chemically synthesized
tgacatcaaaaagcaggcagag

SEQ ID NO: 1303301 - DNA, 22 bp, Artificial Sequence
  chemically synthesized
ggatcatcatccgggattcttg

SEQ ID NO: 1303302 - DNA, 22 bp, Artificial Sequence
  chemically synthesized
gcaatctgggatcatcatccgg

SEQ ID NO: 1303303 - DNA, 22 bp, Artificial Sequence
  chemically synthesized
caagaatcccggatgatgatcc

SEQ ID NO: 1303304 - DNA, 22 bp, Artificial Sequence
  chemically synthesized
cgctggcaatctgggatcatca

SEQ ID NO: 1303305 - DNA, 22 bp, Artificial Sequence
  chemically synthesized
caacctgcgctggcaatctggg

SEQ ID NO: 1303306 - DNA, 22 bp, Artificial Sequence
  chemically synthesized
ccaacctgcgctggcaatctgg

SEQ ID NO: 1303307 - DNA, 22 bp, Artificial Sequence
  chemically synthesized
ccagcgcaggttggaagccgca

SEQ ID NO: 1303308 - DNA, 22 bp, Artificial Sequence
  chemically synthesized
aagatccaaatatgcggcttcc

SEQ ID NO: 1303309 - DNA, 22 bp, Artificial Sequence
  chemically synthesized
ttgaagatccaaatatgcggct

SEQ ID NO: 1303310 - DNA, 22 bp, Artificial Sequence
  chemically synthesized
atatctgttgaagatccaaata

SEQ ID NO: 1303311 - DNA, 22 bp, Artificial Sequence
  chemically synthesized
taatatctgttgaagatccaaa

SEQ ID NO: 1303312 - DNA, 22 bp, Artificial Sequence
  chemically synthesized
gaagccgcatatttggatcttc

SEQ ID NO: 1303313 - DNA, 22 bp, Artificial Sequence
  chemically synthesized
ctaatatctgttgaagatccaa

SEQ ID NO: 1303314 - DNA, 22 bp, Artificial Sequence
  chemically synthesized
tctaatatctgttgaagatcca

SEQ ID NO: 1303315 - DNA, 22 bp, Artificial Sequence
  chemically synthesized
actttctaatatctgttgaaga

SEQ ID NO: 1303316 - DNA, 22 bp, Artificial Sequence
  chemically synthesized
cactttctaatatctgttgaag

SEQ ID NO: 1303317 - DNA, 22 bp, Artificial Sequence
  chemically synthesized
tcactttctaatatctgttgaa

SEQ ID NO: 1303318 - DNA, 22 bp, Artificial Sequence
  chemically synthesized
ttcactttctaatatctgttga

SEQ ID NO: 1303319 - DNA, 22 bp, Artificial Sequence
  chemically synthesized
tttcactttctaatatctgttg

SEQ ID NO: 1303320 - DNA, 22 bp, Artificial Sequence
  chemically synthesized
ggatcttcaacagatattagaa

SEQ ID NO: 1303321 - DNA, 22 bp, Artificial Sequence
  chemically synthesized
gatcttcaacagatattagaaa

SEQ ID NO: 1303322 - DNA, 22 bp, Artificial Sequence
  chemically synthesized
caagtctttttcactttctaat

SEQ ID NO: 1303323 - DNA, 22 bp, Artificial Sequence
  chemically synthesized
ccaagtctttttcactttctaa

SEQ ID NO: 1303324 - DNA, 22 bp, Artificial Sequence
  chemically synthesized
ttccaagtctttttcactttct

SEQ ID NO: 1303325 - DNA, 22 bp, Artificial Sequence
  chemically synthesized
caacagatattagaaagtgaaa

SEQ ID NO: 1303326 - DNA, 22 bp, Artificial Sequence
  chemically synthesized
cttccaagtctttttcactttc

SEQ ID NO: 1303327 - DNA, 22 bp, Artificial Sequence
  chemically synthesized
aacagatattagaaagtgaaaa

SEQ ID NO: 1303328 - DNA, 22 bp, Artificial Sequence
  chemically synthesized
agcttcttccaagtctttttca

SEQ ID NO: 1303329 - DNA, 22 bp, Artificial Sequence
  chemically synthesized
ctcagcttcttccaagtctttt

SEQ ID NO: 1303330 - DNA, 22 bp, Artificial Sequence
  chemically synthesized
gaaagtgaaaaagacttggaag

SEQ ID NO: 1303331 - DNA, 22 bp, Artificial Sequence
  chemically synthesized
tattcctcagcttcttccaagt

SEQ ID NO: 1303332 - DNA, 22 bp, Artificial Sequence
  chemically synthesized
atattcctcagcttcttccaag

SEQ ID NO: 1303333 - DNA, 22 bp, Artificial Sequence
  chemically synthesized
tatattcctcagcttcttccaa

SEQ ID NO: 1303334 - DNA, 22 bp, Artificial Sequence
  chemically synthesized
tttatattcctcagcttcttcc

SEQ ID NO: 1303335 - DNA, 22 bp, Artificial Sequence
  chemically synthesized
ctttatattcctcagcttcttc

SEQ ID NO: 1303336 - DNA, 22 bp, Artificial Sequence
  chemically synthesized
aacgtgcttctttatattcctc

SEQ ID NO: 1303337 - DNA, 22 bp, Artificial Sequence
  chemically synthesized
ggaagaagctgaggaatataaa

SEQ ID NO: 1303338 - DNA, 22 bp, Artificial Sequence
  chemically synthesized
gaagaagctgaggaatataaag

SEQ ID NO: 1303339 - DNA, 22 bp, Artificial Sequence
  chemically synthesized
aatccagtactaaacgtgcttc

SEQ ID NO: 1303340 - DNA, 22 bp, Artificial Sequence
  chemically synthesized
aggaatataaagaagcacgttt

SEQ ID NO: 1303341 - DNA, 22 bp, Artificial Sequence
  chemically synthesized
actgaatccagtactaaacgtg

SEQ ID NO: 1303342 - DNA, 22 bp, Artificial Sequence
  chemically synthesized
cactgaatccagtactaaacgt

SEQ ID NO: 1303343 - DNA, 22 bp, Artificial Sequence
  chemically synthesized
acttcactgaatccagtactaa

SEQ ID NO: 1303344 - DNA, 22 bp, Artificial Sequence
  chemically synthesized
taacttcactgaatccagtact

SEQ ID NO: 1303345 - DNA, 22 bp, Artificial Sequence
  chemically synthesized
ctaacttcactgaatccagtac

SEQ ID NO: 1303346 - DNA, 22 bp, Artificial Sequence
  chemically synthesized
aggcttctaacttcactgaatc

SEQ ID NO: 1303347 - DNA, 22 bp, Artificial Sequence
  chemically synthesized
caggcttctaacttcactgaat

SEQ ID NO: 1303348 - DNA, 22 bp, Artificial Sequence
  chemically synthesized
agtactggattcagtgaagtta

SEQ ID NO: 1303349 - DNA, 22 bp, Artificial Sequence
  chemically synthesized
gtactggattcagtgaagttag

SEQ ID NO: 1303350 - DNA, 22 bp, Artificial Sequence
  chemically synthesized
gattcagtgaagttagaagcct

SEQ ID NO: 1303351 - DNA, 22 bp, Artificial Sequence
  chemically synthesized
agtgaagttagaagcctgaaac

SEQ ID NO: 1303352 - DNA, 22 bp, Artificial Sequence
  chemically synthesized
gaagcctgaaacttttctcgta

SEQ ID NO: 1303353 - DNA, 22 bp, Artificial Sequence
  chemically synthesized
atgcaaaaaccaccccatacga

SEQ ID NO: 1303354 - DNA, 22 bp, Artificial Sequence
  chemically synthesized
aatgcaaaaaccaccccatacg

SEQ ID NO: 1303355 - DNA, 22 bp, Artificial Sequence
  chemically synthesized
aaacttttctcgtatggggtgg

SEQ ID NO: 1303356 - DNA, 22 bp, Artificial Sequence
  chemically synthesized
ttctcgtatggggtggtttttg

SEQ ID NO: 1303357 - DNA, 22 bp, Artificial Sequence
  chemically synthesized
tctcgtatggggtggtttttgc

SEQ ID NO: 1303358 - DNA, 22 bp, Artificial Sequence
  chemically synthesized
ctcgtatggggtggtttttgca

SEQ ID NO: 1303359 - DNA, 22 bp, Artificial Sequence
  chemically synthesized
tcgtatggggtggtttttgcat

SEQ ID NO: 1303360 - DNA, 22 bp, Artificial Sequence
  chemically synthesized
gtatggggtggtttttgcatta

SEQ ID NO: 1303361 - DNA, 22 bp, Artificial Sequence
  chemically synthesized
taaaatggaccccaggatttaa

SEQ ID NO: 1303362 - DNA, 22 bp, Artificial Sequence
  chemically synthesized
ttgcattaaatcctggggtcca

SEQ ID NO: 1303363 - DNA, 22 bp, Artificial Sequence
  chemically synthesized
tgcattaaatcctggggtccat

SEQ ID NO: 1303364 - DNA, 22 bp, Artificial Sequence
  chemically synthesized
gcattaaatcctggggtccatt

SEQ ID NO: 1303365 - DNA, 22 bp, Artificial Sequence
  chemically synthesized
cattaaatcctggggtccattt

SEQ ID NO: 1303366 - DNA, 22 bp, Artificial Sequence
  chemically synthesized
aatcctggggtccattttacaa

SEQ ID NO: 1303367 - DNA, 22 bp, Artificial Sequence
  chemically synthesized
gggtccattttacaatccatta

SEQ ID NO: 1303368 - DNA, 22 bp, Artificial Sequence
  chemically synthesized
tacaatccattatttttgacca

SEQ ID NO: 1303369 - DNA, 22 bp, Artificial Sequence
  chemically synthesized
aacacaccgcagtggtcaaaaa

SEQ ID NO: 1303370 - DNA, 22 bp, Artificial Sequence
  chemically synthesized
acaatccattatttttgaccac

SEQ ID NO: 1303371 - DNA, 22 bp, Artificial Sequence
  chemically synthesized
gaacacaccgcagtggtcaaaa

SEQ ID NO: 1303372 - DNA, 22 bp, Artificial Sequence
  chemically synthesized
caatccattatttttgaccact

SEQ ID NO: 1303373 - DNA, 22 bp, Artificial Sequence
  chemically synthesized
cttgaacacaccgcagtggtca

SEQ ID NO: 1303374 - DNA, 22 bp, Artificial Sequence
  chemically synthesized
atactacttgaacacaccgcag

SEQ ID NO: 1303375 - DNA, 22 bp, Artificial Sequence
  chemically synthesized
tttttgaccactgcggtgtgtt

SEQ ID NO: 1303376 - DNA, 22 bp, Artificial Sequence
  chemically synthesized
tcatactacttgaacacaccgc

SEQ ID NO: 1303377 - DNA, 22 bp, Artificial Sequence
  chemically synthesized
ttgaccactgcggtgtgttcaa

SEQ ID NO: 1303378 - DNA, 22 bp, Artificial Sequence
  chemically synthesized
tgaccactgcggtgtgttcaag

SEQ ID NO: 1303379 - DNA, 22 bp, Artificial Sequence
  chemically synthesized
gaccactgcggtgtgttcaagt

SEQ ID NO: 1303380 - DNA, 22 bp, Artificial Sequence
  chemically synthesized
accactgcggtgtgttcaagta

SEQ ID NO: 1303381 - DNA, 22 bp, Artificial Sequence
  chemically synthesized
cggtgtgttcaagtagtatgag

SEQ ID NO: 1303382 - DNA, 22 bp, Artificial Sequence
  chemically synthesized
aagtagtatgagaatgtgattg

SEQ ID NO: 1303383 - DNA, 22 bp, Artificial Sequence
  chemically synthesized
gacaaagaaatatatatgtaac

SEQ ID NO: 1303384 - DNA, 22 bp, Artificial Sequence
  chemically synthesized
tttttatctggttacatatata

SEQ ID NO: 1303385 - DNA, 22 bp, Artificial Sequence
  chemically synthesized
ttatctggttacatatatattt

SEQ ID NO: 1303386 - DNA, 22 bp, Artificial Sequence
  chemically synthesized
aattagacaaagaaatatatat

SEQ ID NO: 1303387 - DNA, 22 bp, Artificial Sequence
  chemically synthesized
tatctggttacatatatatttc

SEQ ID NO: 1303388 - DNA, 22 bp, Artificial Sequence
  chemically synthesized
atctggttacatatatatttct

SEQ ID NO: 1303389 - DNA, 22 bp, Artificial Sequence
  chemically synthesized
tctggttacatatatatttctt

SEQ ID NO: 1303390 - DNA, 22 bp, Artificial Sequence
  chemically synthesized
gttacatatatatttctttgtc

SEQ ID NO: 1303391 - DNA, 22 bp, Artificial Sequence
  chemically synthesized
acatattaaattagacaaagaa

SEQ ID NO: 1303392 - DNA, 22 bp, Artificial Sequence
  chemically synthesized
gacatattaaattagacaaaga

SEQ ID NO: 1303393 - DNA, 22 bp, Artificial Sequence
  chemically synthesized
catatatatttctttgtctaat

SEQ ID NO: 1303394 - DNA, 22 bp, Artificial Sequence
  chemically synthesized
tttgacatattaaattagacaa

SEQ ID NO: 1303395 - DNA, 22 bp, Artificial Sequence
  chemically synthesized
atttgacatattaaattagaca

SEQ ID NO: 1303396 - DNA, 22 bp, Artificial Sequence
  chemically synthesized
atttatttgacatattaaatta

SEQ ID NO: 1303397 - DNA, 22 bp, Artificial Sequence
  chemically synthesized
ctttgtctaatttaatatgtca

SEQ ID NO: 1303398 - DNA, 22 bp, Artificial Sequence
  chemically synthesized
tttgtctaatttaatatgtcaa

SEQ ID NO: 1303399 - DNA, 22 bp, Artificial Sequence
  chemically synthesized
tgtctaatttaatatgtcaaat

SEQ ID NO: 1303400 - DNA, 22 bp, Artificial Sequence
  chemically synthesized
gtctaatttaatatgtcaaata

SEQ ID NO: 1303401 - DNA, 22 bp, Artificial Sequence
  chemically synthesized
gatgaactcatttatttgacat

SEQ ID NO: 1303402 - DNA, 22 bp, Artificial Sequence
  chemically synthesized
tctaatttaatatgtcaaataa

SEQ ID NO: 1303403 - DNA, 22 bp, Artificial Sequence
  chemically synthesized
agatgaactcatttatttgaca

SEQ ID NO: 1303404 - DNA, 22 bp, Artificial Sequence
  chemically synthesized
tagatgaactcatttatttgac

SEQ ID NO: 1303405 - DNA, 22 bp, Artificial Sequence
  chemically synthesized
ttagatgaactcatttatttga

SEQ ID NO: 1303406 - DNA, 22 bp, Artificial Sequence
  chemically synthesized
tttagatgaactcatttatttg

SEQ ID NO: 1303407 - DNA, 22 bp, Artificial Sequence
  chemically synthesized
atttaatatgtcaaataaatga

SEQ ID NO: 1303408 - DNA, 22 bp, Artificial Sequence
  chemically synthesized
ttttagatgaactcatttattt

SEQ ID NO: 1303409 - DNA, 22 bp, Artificial Sequence
  chemically synthesized
tttttagatgaactcatttatt

SEQ ID NO: 1303410 - DNA, 22 bp, Artificial Sequence
  chemically synthesized
ttttttagatgaactcatttat

SEQ ID NO: 1303411 - DNA, 22 bp, Artificial Sequence
  chemically synthesized
tttttttagatgaactcattta

SEQ ID NO: 1303412 - DNA, 22 bp, Artificial Sequence
  chemically synthesized
aatatgtcaaataaatgagttc

SEQ ID NO: 1303413 - DNA, 22 bp, Artificial Sequence
  chemically synthesized
atatgtcaaataaatgagttca

SEQ ID NO: 1303414 - DNA, 22 bp, Artificial Sequence
  chemically synthesized
atctaaaaaaaaaatccatacg

SEQ ID NO: 1303415 - DNA, 22 bp, Artificial Sequence
  chemically synthesized
aaaaaaaaatccatacgtgatg

SEQ ID NO: 1303416 - DNA, 22 bp, Artificial Sequence
  chemically synthesized
caaatataaaccacacatcacg

SEQ ID NO: 1303417 - DNA, 22 bp, Artificial Sequence
  chemically synthesized
atatttgtaactgcctatatga

SEQ ID NO: 1303418 - DNA, 22 bp, Artificial Sequence
  chemically synthesized
tatttgtaactgcctatatgat

SEQ ID NO: 1303419 - DNA, 22 bp, Artificial Sequence
  chemically synthesized
gggtaagaatatatatcatata

SEQ ID NO: 1303420 - DNA, 22 bp, Artificial Sequence
  chemically synthesized
gtaactgcctatatgatatata

SEQ ID NO: 1303421 - DNA, 22 bp, Artificial Sequence
  chemically synthesized
taactgcctatatgatatatat

SEQ ID NO: 1303422 - DNA, 22 bp, Artificial Sequence
  chemically synthesized
cctatatgatatatattcttac

SEQ ID NO: 1303423 - DNA, 22 bp, Artificial Sequence
  chemically synthesized
tatgatatatattcttacccca

SEQ ID NO: 1303424 - DNA, 22 bp, Artificial Sequence
  chemically synthesized
tatgatgggatggggttggggt

SEQ ID NO: 1303425 - DNA, 22 bp, Artificial Sequence
  chemically synthesized
tctatatgatgggatggggttg

SEQ ID NO: 1303426 - DNA, 22 bp, Artificial Sequence
  chemically synthesized
atctatatgatgggatggggtt

SEQ ID NO: 1303427 - DNA, 22 bp, Artificial Sequence
  chemically synthesized
ttatctatatgatgggatgggg

SEQ ID NO: 1303428 - DNA, 22 bp, Artificial Sequence
  chemically synthesized
cttatctatatgatgggatggg

SEQ ID NO: 1303429 - DNA, 22 bp, Artificial Sequence
  chemically synthesized
tcttatctatatgatgggatgg

SEQ ID NO: 1303430 - DNA, 22 bp, Artificial Sequence
  chemically synthesized
ttaccccaaccccatcccatca

SEQ ID NO: 1303431 - DNA, 22 bp, Artificial Sequence
  chemically synthesized
accccaaccccatcccatcata

SEQ ID NO: 1303432 - DNA, 22 bp, Artificial Sequence
  chemically synthesized
ccccaaccccatcccatcatat

SEQ ID NO: 1303433 - DNA, 22 bp, Artificial Sequence
  chemically synthesized
agcacataagtagcattttctt

SEQ ID NO: 1303434 - DNA, 22 bp, Artificial Sequence
  chemically synthesized
tgtaaacctgagcacataagta

SEQ ID NO: 1303435 - DNA, 22 bp, Artificial Sequence
  chemically synthesized
agagttgtgtaaacctgagcac

SEQ ID NO: 1303436 - DNA, 22 bp, Artificial Sequence
  chemically synthesized
cttatgtgctcaggtttacaca

SEQ ID NO: 1303437 - DNA, 22 bp, Artificial Sequence
  chemically synthesized
atgtgctcaggtttacacaact

SEQ ID NO: 1303438 - DNA, 22 bp, Artificial Sequence
  chemically synthesized
tgtgctcaggtttacacaactc

SEQ ID NO: 1303439 - DNA, 22 bp, Artificial Sequence
  chemically synthesized
tagtcagagacatctaagagtt

SEQ ID NO: 1303440 - DNA, 22 bp, Artificial Sequence
  chemically synthesized
gtagtcagagacatctaagagt

SEQ ID NO: 1303441 - DNA, 22 bp, Artificial Sequence
  chemically synthesized
aggtttacacaactcttagatg

SEQ ID NO: 1303442 - DNA, 22 bp, Artificial Sequence
  chemically synthesized
tgtagtcagagacatctaagag

SEQ ID NO: 1303443 - DNA, 22 bp, Artificial Sequence
  chemically synthesized
acacaactcttagatgtctctg

SEQ ID NO: 1303444 - DNA, 22 bp, Artificial Sequence
  chemically synthesized
cacaactcttagatgtctctga

SEQ ID NO: 1303445 - DNA, 22 bp, Artificial Sequence
  chemically synthesized
ttagatgtctctgactacaaag

SEQ ID NO: 1303446 - DNA, 22 bp, Artificial Sequence
  chemically synthesized
aaaagaacaaagactttgtagt

SEQ ID NO: 1303447 - DNA, 22 bp, Artificial Sequence
  chemically synthesized
agatgtctctgactacaaagtc

SEQ ID NO: 1303448 - DNA, 22 bp, Artificial Sequence
  chemically synthesized
gatgtctctgactacaaagtct

SEQ ID NO: 1303449 - DNA, 22 bp, Artificial Sequence
  chemically synthesized
tgactacaaagtctttgttctt

SEQ ID NO: 1303450 - DNA, 22 bp, Artificial Sequence
  chemically synthesized
actacaaagtctttgttctttt

SEQ ID NO: 1303451 - DNA, 22 bp, Artificial Sequence
  chemically synthesized
caaagtctttgttctttttaat

SEQ ID NO: 1303452 - DNA, 22 bp, Artificial Sequence
  chemically synthesized
tgttctttttaatgtacctcta

SEQ ID NO: 1303453 - DNA, 22 bp, Artificial Sequence
  chemically synthesized
gttctttttaatgtacctctat

SEQ ID NO: 1303454 - DNA, 22 bp, Artificial Sequence
  chemically synthesized
ttctttttaatgtacctctatg

SEQ ID NO: 1303455 - DNA, 22 bp, Artificial Sequence
  chemically synthesized
aagtatgagaggcatagaggta

SEQ ID NO: 1303456 - DNA, 22 bp, Artificial Sequence
  chemically synthesized
aaagtatgagaggcatagaggt

SEQ ID NO: 1303457 - DNA, 22 bp, Artificial Sequence
  chemically synthesized
taaagtatgagaggcatagagg

SEQ ID NO: 1303458 - DNA, 22 bp, Artificial Sequence
  chemically synthesized
tttttaatgtacctctatgcct

SEQ ID NO: 1303459 - DNA, 22 bp, Artificial Sequence
  chemically synthesized
tttaatgtacctctatgcctct

SEQ ID NO: 1303460 - DNA, 22 bp, Artificial Sequence
  chemically synthesized
ttaatgtacctctatgcctctc

SEQ ID NO: 1303461 - DNA, 22 bp, Artificial Sequence
  chemically synthesized
taatgtacctctatgcctctca

SEQ ID NO: 1303462 - DNA, 22 bp, Artificial Sequence
  chemically synthesized
aattttaaagtatgagaggcat

SEQ ID NO: 1303463 - DNA, 22 bp, Artificial Sequence
  chemically synthesized
aatgtacctctatgcctctcat

SEQ ID NO: 1303464 - DNA, 22 bp, Artificial Sequence
  chemically synthesized
caattttaaagtatgagaggca

SEQ ID NO: 1303465 - DNA, 22 bp, Artificial Sequence
  chemically synthesized
atgtacctctatgcctctcata

SEQ ID NO: 1303466 - DNA, 22 bp, Artificial Sequence
  chemically synthesized
tttcaattttaaagtatgagag

SEQ ID NO: 1303467 - DNA, 22 bp, Artificial Sequence
  chemically synthesized
atttcaattttaaagtatgaga

SEQ ID NO: 1303468 - DNA, 22 bp, Artificial Sequence
  chemically synthesized
atttatttcaattttaaagtat

SEQ ID NO: 1303469 - DNA, 22 bp, Artificial Sequence
  chemically synthesized
tatgcctctcatactttaaaat

SEQ ID NO: 1303470 - DNA, 22 bp, Artificial Sequence
  chemically synthesized
tgcctctcatactttaaaattg

SEQ ID NO: 1303471 - DNA, 22 bp, Artificial Sequence
  chemically synthesized
tcatactttaaaattgaaataa

SEQ ID NO: 1303472 - DNA, 22 bp, Artificial Sequence
  chemically synthesized
atactttaaaattgaaataaat

SEQ ID NO: 1303473 - DNA, 22 bp, Artificial Sequence
  chemically synthesized
gagcagtagattaatttatttc

SEQ ID NO: 1303474 - DNA, 22 bp, Artificial Sequence
  chemically synthesized
ggagcagtagattaatttattt

SEQ ID NO: 1303475 - DNA, 22 bp, Artificial Sequence
  chemically synthesized
taaaattgaaataaattaatct

SEQ ID NO: 1303476 - DNA, 22 bp, Artificial Sequence
  chemically synthesized
aaaattgaaataaattaatcta

SEQ ID NO: 1303477 - DNA, 22 bp, Artificial Sequence
  chemically synthesized
aaattgaaataaattaatctac

SEQ ID NO: 1303478 - DNA, 22 bp, Artificial Sequence
  chemically synthesized
atcatttggagcagtagattaa

SEQ ID NO: 1303479 - DNA, 22 bp, Artificial Sequence
  chemically synthesized
aaataaattaatctactgctcc

SEQ ID NO: 1303480 - DNA, 22 bp, Artificial Sequence
  chemically synthesized
catggaaaattgatcatttgga

SEQ ID NO: 1303481 - DNA, 22 bp, Artificial Sequence
  chemically synthesized
ccatggaaaattgatcatttgg

SEQ ID NO: 1303482 - DNA, 22 bp, Artificial Sequence
  chemically synthesized
tccatggaaaattgatcatttg

SEQ ID NO: 1303483 - DNA, 22 bp, Artificial Sequence
  chemically synthesized
atctactgctccaaatgatcaa

SEQ ID NO: 1303484 - DNA, 22 bp, Artificial Sequence
  chemically synthesized
ttccatggaaaattgatcattt

SEQ ID NO: 1303485 - DNA, 22 bp, Artificial Sequence
  chemically synthesized
tttccatggaaaattgatcatt

SEQ ID NO: 1303486 - DNA, 22 bp, Artificial Sequence
  chemically synthesized
ttttccatggaaaattgatcat

SEQ ID NO: 1303487 - DNA, 22 bp, Artificial Sequence
  chemically synthesized
tttttccatggaaaattgatca

SEQ ID NO: 1303488 - DNA, 22 bp, Artificial Sequence
  chemically synthesized
ttttttccatggaaaattgatc

SEQ ID NO: 1303489 - DNA, 22 bp, Artificial Sequence
  chemically synthesized
ctgctccaaatgatcaattttc

SEQ ID NO: 1303490 - DNA, 22 bp, Artificial Sequence
  chemically synthesized
ttttttttccatggaaaattga

SEQ ID NO: 1303491 - DNA, 22 bp, Artificial Sequence
  chemically synthesized
ctccaaatgatcaattttccat

SEQ ID NO: 1303492 - DNA, 22 bp, Artificial Sequence
  chemically synthesized
tcttttttttccatggaaaatt

SEQ ID NO: 1303493 - DNA, 22 bp, Artificial Sequence
  chemically synthesized
caaatgatcaattttccatgga

SEQ ID NO: 1303494 - DNA, 22 bp, Artificial Sequence
  chemically synthesized
caaaagttctcttttttttcca

SEQ ID NO: 1303495 - DNA, 22 bp, Artificial Sequence
  chemically synthesized
caattacaaaagttctcttttt

SEQ ID NO: 1303496 - DNA, 22 bp, Artificial Sequence
  chemically synthesized
tccatggaaaaaaaagagaact

SEQ ID NO: 1303497 - DNA, 22 bp, Artificial Sequence
  chemically synthesized
ccatggaaaaaaaagagaactt

SEQ ID NO: 1303498 - DNA, 22 bp, Artificial Sequence
  chemically synthesized
ttacaattacaaaagttctctt

SEQ ID NO: 1303499 - DNA, 22 bp, Artificial Sequence
  chemically synthesized
catggaaaaaaaagagaacttt

SEQ ID NO: 1303500 - DNA, 22 bp, Artificial Sequence
  chemically synthesized
gtcatatagcagaggttgttac

SEQ ID NO: 1303501 - DNA, 22 bp, Artificial Sequence
  chemically synthesized
agtcatatagcagaggttgtta

SEQ ID NO: 1303502 - DNA, 22 bp, Artificial Sequence
  chemically synthesized
ttgtaattgtaacaacctctgc

SEQ ID NO: 1303503 - DNA, 22 bp, Artificial Sequence
  chemically synthesized
tgtaattgtaacaacctctgct

SEQ ID NO: 1303504 - DNA, 22 bp, Artificial Sequence
  chemically synthesized
gtaattgtaacaacctctgcta

SEQ ID NO: 1303505 - DNA, 22 bp, Artificial Sequence
  chemically synthesized
taattgtaacaacctctgctat

SEQ ID NO: 1303506 - DNA, 22 bp, Artificial Sequence
  chemically synthesized
agtgtttagtcatatagcagag

SEQ ID NO: 1303507 - DNA, 22 bp, Artificial Sequence
  chemically synthesized
taacaacctctgctatatgact

SEQ ID NO: 1303508 - DNA, 22 bp, Artificial Sequence
  chemically synthesized
atggctcagtgtttagtcatat

SEQ ID NO: 1303509 - DNA, 22 bp, Artificial Sequence
  chemically synthesized
tgctatatgactaaacactgag

SEQ ID NO: 1303510 - DNA, 22 bp, Artificial Sequence
  chemically synthesized
ctatatgactaaacactgagcc

SEQ ID NO: 1303511 - DNA, 22 bp, Artificial Sequence
  chemically synthesized
gcagcccacctcatggctcagt

SEQ ID NO: 1303512 - DNA, 22 bp, Artificial Sequence
  chemically synthesized
tatgactaaacactgagccatg

SEQ ID NO: 1303513 - DNA, 22 bp, Artificial Sequence
  chemically synthesized
cctggcagcccacctcatggct

SEQ ID NO: 1303514 - DNA, 22 bp, Artificial Sequence
  chemically synthesized
acctggcagcccacctcatggc

SEQ ID NO: 1303515 - DNA, 22 bp, Artificial Sequence
  chemically synthesized
aacactgagccatgaggtgggc

SEQ ID NO: 1303516 - DNA, 22 bp, Artificial Sequence
  chemically synthesized
caatttacctggcagcccacct

SEQ ID NO: 1303517 - DNA, 22 bp, Artificial Sequence
  chemically synthesized
ccaatttacctggcagcccacc

SEQ ID NO: 1303518 - DNA, 22 bp, Artificial Sequence
  chemically synthesized
agccatgaggtgggctgccagg

SEQ ID NO: 1303519 - DNA, 22 bp, Artificial Sequence
  chemically synthesized
gatgaagccttccaatttacct

SEQ ID NO: 1303520 - DNA, 22 bp, Artificial Sequence
  chemically synthesized
agatgaagccttccaatttacc

SEQ ID NO: 1303521 - DNA, 22 bp, Artificial Sequence
  chemically synthesized
tagatgaagccttccaatttac

SEQ ID NO: 1303522 - DNA, 22 bp, Artificial Sequence
  chemically synthesized
ttagatgaagccttccaattta

SEQ ID NO: 1303523 - DNA, 22 bp, Artificial Sequence
  chemically synthesized
tttagatgaagccttccaattt

SEQ ID NO: 1303524 - DNA, 22 bp, Artificial Sequence
  chemically synthesized
tactttttagatgaagccttcc

SEQ ID NO: 1303525 - DNA, 22 bp, Artificial Sequence
  chemically synthesized
ccaggtaaattggaaggcttca

SEQ ID NO: 1303526 - DNA, 22 bp, Artificial Sequence
  chemically synthesized
gtactttttagatgaagccttc

SEQ ID NO: 1303527 - DNA, 22 bp, Artificial Sequence
  chemically synthesized
acagtcttgtactttttagatg

SEQ ID NO: 1303528 - DNA, 22 bp, Artificial Sequence
  chemically synthesized
gaaggcttcatctaaaaagtac

SEQ ID NO: 1303529 - DNA, 22 bp, Artificial Sequence
  chemically synthesized
catctaaaaagtacaagactgt

SEQ ID NO: 1303530 - DNA, 22 bp, Artificial Sequence
  chemically synthesized
atctaaaaagtacaagactgtg

SEQ ID NO: 1303531 - DNA, 22 bp, Artificial Sequence
  chemically synthesized
agaagggaatatgcctcacagt

SEQ ID NO: 1303532 - DNA, 22 bp, Artificial Sequence
  chemically synthesized
aaaagtacaagactgtgaggca

SEQ ID NO: 1303533 - DNA, 22 bp, Artificial Sequence
  chemically synthesized
ttgagaagggaatatgcctcac

SEQ ID NO: 1303534 - DNA, 22 bp, Artificial Sequence
  chemically synthesized
ggctgttgagaagggaatatgc

SEQ ID NO: 1303535 - DNA, 22 bp, Artificial Sequence
  chemically synthesized
tgaggcatattcccttctcaac

SEQ ID NO: 1303536 - DNA, 22 bp, Artificial Sequence
  chemically synthesized
ccttctcaacagcctaggatga

SEQ ID NO: 1303537 - DNA, 22 bp, Artificial Sequence
  chemically synthesized
ctcaacagcctaggatgattgg

SEQ ID NO: 1303538 - DNA, 22 bp, Artificial Sequence
  chemically synthesized
tcaacagcctaggatgattgga

SEQ ID NO: 1303539 - DNA, 22 bp, Artificial Sequence
  chemically synthesized
aacagcctaggatgattggatc

SEQ ID NO: 1303540 - DNA, 22 bp, Artificial Sequence
  chemically synthesized
aaaatgtgacagaatgggtaga

SEQ ID NO: 1303541 - DNA, 22 bp, Artificial Sequence
  chemically synthesized
ggatgattggatctacccattc

SEQ ID NO: 1303542 - DNA, 22 bp, Artificial Sequence
  chemically synthesized
tatattgaaaatgtgacagaat

SEQ ID NO: 1303543 - DNA, 22 bp, Artificial Sequence
  chemically synthesized
gatctacccattctgtcacatt

SEQ ID NO: 1303544 - DNA, 22 bp, Artificial Sequence
  chemically synthesized
cccattctgtcacattttcaat

SEQ ID NO: 1303545 - DNA, 22 bp, Artificial Sequence
  chemically synthesized
aacaggaattatatattgaaaa

SEQ ID NO: 1303546 - DNA, 22 bp, Artificial Sequence
  chemically synthesized
gaacaggaattatatattgaaa

SEQ ID NO: 1303547 - DNA, 22 bp, Artificial Sequence
  chemically synthesized
tgtcacattttcaatatataat

SEQ ID NO: 1303548 - DNA, 22 bp, Artificial Sequence
  chemically synthesized
tcacattttcaatatataattc

SEQ ID NO: 1303549 - DNA, 22 bp, Artificial Sequence
  chemically synthesized
atagaaagtttgaacaggaatt

SEQ ID NO: 1303550 - DNA, 22 bp, Artificial Sequence
  chemically synthesized
tcaatatataattcctgttcaa

SEQ ID NO: 1303551 - DNA, 22 bp, Artificial Sequence
  chemically synthesized
caatatataattcctgttcaaa

SEQ ID NO: 1303552 - DNA, 22 bp, Artificial Sequence
  chemically synthesized
aatatataattcctgttcaaac

SEQ ID NO: 1303553 - DNA, 22 bp, Artificial Sequence
  chemically synthesized
aaatgatatattaatagaaagt

SEQ ID NO: 1303554 - DNA, 22 bp, Artificial Sequence
  chemically synthesized
gaaatgatatattaatagaaag

SEQ ID NO: 1303555 - DNA, 22 bp, Artificial Sequence
  chemically synthesized
ctgttcaaactttctattaata

SEQ ID NO: 1303556 - DNA, 22 bp, Artificial Sequence
  chemically synthesized
ttcaaactttctattaatatat

SEQ ID NO: 1303557 - DNA, 22 bp, Artificial Sequence
  chemically synthesized
aaactttctattaatatatcat

SEQ ID NO: 1303558 - DNA, 22 bp, Artificial Sequence
  chemically synthesized
tcaatgaaacttgaaatgatat

SEQ ID NO: 1303559 - DNA, 22 bp, Artificial Sequence
  chemically synthesized
tctattaatatatcatttcaag

SEQ ID NO: 1303560 - DNA, 22 bp, Artificial Sequence
  chemically synthesized
ctattaatatatcatttcaagt

SEQ ID NO: 1303561 - DNA, 22 bp, Artificial Sequence
  chemically synthesized
tattaatatatcatttcaagtt

SEQ ID NO: 1303562 - DNA, 22 bp, Artificial Sequence
  chemically synthesized
ggactatcaatgaaacttgaaa

SEQ ID NO: 1303563 - DNA, 22 bp, Artificial Sequence
  chemically synthesized
ttaatatatcatttcaagtttc

SEQ ID NO: 1303564 - DNA, 22 bp, Artificial Sequence
  chemically synthesized
aggactatcaatgaaacttgaa

SEQ ID NO: 1303565 - DNA, 22 bp, Artificial Sequence
  chemically synthesized
taggactatcaatgaaacttga

SEQ ID NO: 1303566 - DNA, 22 bp, Artificial Sequence
  chemically synthesized
atatatcatttcaagtttcatt

SEQ ID NO: 1303567 - DNA, 22 bp, Artificial Sequence
  chemically synthesized
cattttaggactatcaatgaaa

SEQ ID NO: 1303568 - DNA, 22 bp, Artificial Sequence
  chemically synthesized
tgttgcattttaggactatcaa

SEQ ID NO: 1303569 - DNA, 22 bp, Artificial Sequence
  chemically synthesized
gtgttgcattttaggactatca

SEQ ID NO: 1303570 - DNA, 22 bp, Artificial Sequence
  chemically synthesized
tgtgttgcattttaggactatc

SEQ ID NO: 1303571 - DNA, 22 bp, Artificial Sequence
  chemically synthesized
caagtttcattgatagtcctaa

SEQ ID NO: 1303572 - DNA, 22 bp, Artificial Sequence
  chemically synthesized
ttgtgttgcattttaggactat

SEQ ID NO: 1303573 - DNA, 22 bp, Artificial Sequence
  chemically synthesized
aagtttcattgatagtcctaaa

SEQ ID NO: 1303574 - DNA, 22 bp, Artificial Sequence
  chemically synthesized
gtcttttgtgttgcattttagg

SEQ ID NO: 1303575 - DNA, 22 bp, Artificial Sequence
  chemically synthesized
cattgatagtcctaaaatgcaa

SEQ ID NO: 1303576 - DNA, 22 bp, Artificial Sequence
  chemically synthesized
attgatagtcctaaaatgcaac

SEQ ID NO: 1303577 - DNA, 22 bp, Artificial Sequence
  chemically synthesized
ctcgtcttttgtgttgcatttt

SEQ ID NO: 1303578 - DNA, 22 bp, Artificial Sequence
  chemically synthesized
atagtcctaaaatgcaacacaa

SEQ ID NO: 1303579 - DNA, 22 bp, Artificial Sequence
  chemically synthesized
aaatcatctgctcgtcttttgt

SEQ ID NO: 1303580 - DNA, 22 bp, Artificial Sequence
  chemically synthesized
aaatgcaacacaaaagacgagc

SEQ ID NO: 1303581 - DNA, 22 bp, Artificial Sequence
  chemically synthesized
gaatggctgaaatcatctgctc

SEQ ID NO: 1303582 - DNA, 22 bp, Artificial Sequence
  chemically synthesized
caaattggaatggctgaaatca

SEQ ID NO: 1303583 - DNA, 22 bp, Artificial Sequence
  chemically synthesized
caaaaggctgcaaattggaatg

SEQ ID NO: 1303584 - DNA, 22 bp, Artificial Sequence
  chemically synthesized
tacaaaaggctgcaaattggaa

SEQ ID NO: 1303585 - DNA, 22 bp, Artificial Sequence
  chemically synthesized
cagccattccaatttgcagcct

SEQ ID NO: 1303586 - DNA, 22 bp, Artificial Sequence
  chemically synthesized
agccattccaatttgcagcctt

SEQ ID NO: 1303587 - DNA, 22 bp, Artificial Sequence
  chemically synthesized
atgcccctctacaaaaggctgc

SEQ ID NO: 1303588 - DNA, 22 bp, Artificial Sequence
  chemically synthesized
ttgatgcccctctacaaaaggc

SEQ ID NO: 1303589 - DNA, 22 bp, Artificial Sequence
  chemically synthesized
caatttgcagccttttgtagag

SEQ ID NO: 1303590 - DNA, 22 bp, Artificial Sequence
  chemically synthesized
gcagccttttgtagaggggcat

SEQ ID NO: 1303591 - DNA, 22 bp, Artificial Sequence
  chemically synthesized
cagccttttgtagaggggcatc

SEQ ID NO: 1303592 - DNA, 22 bp, Artificial Sequence
  chemically synthesized
ttgtagaggggcatcaatagat

SEQ ID NO: 1303593 - DNA, 22 bp, Artificial Sequence
  chemically synthesized
tgtagaggggcatcaatagatt

SEQ ID NO: 1303594 - DNA, 22 bp, Artificial Sequence
  chemically synthesized
gtagaggggcatcaatagattt

SEQ ID NO: 1303595 - DNA, 22 bp, Artificial Sequence
  chemically synthesized
tagaggggcatcaatagatttt

SEQ ID NO: 1303596 - DNA, 22 bp, Artificial Sequence
  chemically synthesized
tgcaagtacagtaaaatctatt

SEQ ID NO: 1303597 - DNA, 22 bp, Artificial Sequence
  chemically synthesized
atgcaagtacagtaaaatctat

SEQ ID NO: 1303598 - DNA, 22 bp, Artificial Sequence
  chemically synthesized
tatgcaagtacagtaaaatcta

SEQ ID NO: 1303599 - DNA, 22 bp, Artificial Sequence
  chemically synthesized
gggctttatgcaagtacagtaa

SEQ ID NO: 1303600 - DNA, 22 bp, Artificial Sequence
  chemically synthesized
tactgtacttgcataaagccct

SEQ ID NO: 1303601 - DNA, 22 bp, Artificial Sequence
  chemically synthesized
actgtacttgcataaagcccta

SEQ ID NO: 1303602 - DNA, 22 bp, Artificial Sequence
  chemically synthesized
ctgtacttgcataaagccctag

SEQ ID NO: 1303603 - DNA, 22 bp, Artificial Sequence
  chemically synthesized
tacttgcataaagccctagttg

SEQ ID NO: 1303604 - DNA, 22 bp, Artificial Sequence
  chemically synthesized
gcataaagccctagttgttctt

SEQ ID NO: 1303605 - DNA, 22 bp, Artificial Sequence
  chemically synthesized
cataaagccctagttgttcttt

SEQ ID NO: 1303606 - DNA, 22 bp, Artificial Sequence
  chemically synthesized
gttgttcttttcctattctatc

SEQ ID NO: 1303607 - DNA, 22 bp, Artificial Sequence
  chemically synthesized
gccaatccagaaatgatagaat

SEQ ID NO: 1303608 - DNA, 22 bp, Artificial Sequence
  chemically synthesized
ttcttttcctattctatcattt

SEQ ID NO: 1303609 - DNA, 22 bp, Artificial Sequence
  chemically synthesized
ttttcctattctatcatttctg

SEQ ID NO: 1303610 - DNA, 22 bp, Artificial Sequence
  chemically synthesized
ttcctattctatcatttctgga

SEQ ID NO: 1303611 - DNA, 22 bp, Artificial Sequence
  chemically synthesized
tcctattctatcatttctggat

SEQ ID NO: 1303612 - DNA, 22 bp, Artificial Sequence
  chemically synthesized
tcccattcgccaatccagaaat

SEQ ID NO: 1303613 - DNA, 22 bp, Artificial Sequence
  chemically synthesized
cctattctatcatttctggatt

SEQ ID NO: 1303614 - DNA, 22 bp, Artificial Sequence
  chemically synthesized
atcccattcgccaatccagaaa

SEQ ID NO: 1303615 - DNA, 22 bp, Artificial Sequence
  chemically synthesized
ctattctatcatttctggattg

SEQ ID NO: 1303616 - DNA, 22 bp, Artificial Sequence
  chemically synthesized
tatcccattcgccaatccagaa

SEQ ID NO: 1303617 - DNA, 22 bp, Artificial Sequence
  chemically synthesized
ttctatcatttctggattggcg

SEQ ID NO: 1303618 - DNA, 22 bp, Artificial Sequence
  chemically synthesized
tatcatttctggattggcgaat

SEQ ID NO: 1303619 - DNA, 22 bp, Artificial Sequence
  chemically synthesized
aacattttatcccattcgccaa

SEQ ID NO: 1303620 - DNA, 22 bp, Artificial Sequence
  chemically synthesized
tcatttctggattggcgaatgg

SEQ ID NO: 1303621 - DNA, 22 bp, Artificial Sequence
  chemically synthesized
ctgaacattttatcccattcgc

SEQ ID NO: 1303622 - DNA, 22 bp, Artificial Sequence
  chemically synthesized
cctgaacattttatcccattcg

SEQ ID NO: 1303623 - DNA, 22 bp, Artificial Sequence
  chemically synthesized
tcctgaacattttatcccattc

SEQ ID NO: 1303624 - DNA, 22 bp, Artificial Sequence
  chemically synthesized
ctggattggcgaatgggataaa

SEQ ID NO: 1303625 - DNA, 22 bp, Artificial Sequence
  chemically synthesized
tttcctgaacattttatcccat

SEQ ID NO: 1303626 - DNA, 22 bp, Artificial Sequence
  chemically synthesized
tggattggcgaatgggataaaa

SEQ ID NO: 1303627 - DNA, 22 bp, Artificial Sequence
  chemically synthesized
ctttcctgaacattttatccca

SEQ ID NO: 1303628 - DNA, 22 bp, Artificial Sequence
  chemically synthesized
tctttcctgaacattttatccc

SEQ ID NO: 1303629 - DNA, 22 bp, Artificial Sequence
  chemically synthesized
gattggcgaatgggataaaatg

SEQ ID NO: 1303630 - DNA, 22 bp, Artificial Sequence
  chemically synthesized
ttctttcctgaacattttatcc

SEQ ID NO: 1303631 - DNA, 22 bp, Artificial Sequence
  chemically synthesized
tttctttcctgaacattttatc

SEQ ID NO: 1303632 - DNA, 22 bp, Artificial Sequence
  chemically synthesized
ttttttctttcctgaacatttt

SEQ ID NO: 1303633 - DNA, 22 bp, Artificial Sequence
  chemically synthesized
gcgaatgggataaaatgttcag

SEQ ID NO: 1303634 - DNA, 22 bp, Artificial Sequence
  chemically synthesized
gttttttctttcctgaacattt

SEQ ID NO: 1303635 - DNA, 22 bp, Artificial Sequence
  chemically synthesized
agatttgttttttctttcctga

SEQ ID NO: 1303636 - DNA, 22 bp, Artificial Sequence
  chemically synthesized
tgttgagatttgttttttcttt

SEQ ID NO: 1303637 - DNA, 22 bp, Artificial Sequence
  chemically synthesized
gtgttgagatttgttttttctt

SEQ ID NO: 1303638 - DNA, 22 bp, Artificial Sequence
  chemically synthesized
acgtttgtgttgagatttgttt

SEQ ID NO: 1303639 - DNA, 22 bp, Artificial Sequence
  chemically synthesized
aggaaagaaaaaacaaatctca

SEQ ID NO: 1303640 - DNA, 22 bp, Artificial Sequence
  chemically synthesized
aatgacattcacgtttgtgttg

SEQ ID NO: 1303641 - DNA, 22 bp, Artificial Sequence
  chemically synthesized
caatgacattcacgtttgtgtt

SEQ ID NO: 1303642 - DNA, 22 bp, Artificial Sequence
  chemically synthesized
tcaatgacattcacgtttgtgt

SEQ ID NO: 1303643 - DNA, 22 bp, Artificial Sequence
  chemically synthesized
gctttcaatgacattcacgttt

SEQ ID NO: 1303644 - DNA, 22 bp, Artificial Sequence
  chemically synthesized
agctttcaatgacattcacgtt

SEQ ID NO: 1303645 - DNA, 22 bp, Artificial Sequence
  chemically synthesized
tagctttcaatgacattcacgt

SEQ ID NO: 1303646 - DNA, 22 bp, Artificial Sequence
  chemically synthesized
ttagctttcaatgacattcacg

SEQ ID NO: 1303647 - DNA, 22 bp, Artificial Sequence
  chemically synthesized
tttagctttcaatgacattcac

SEQ ID NO: 1303648 - DNA, 22 bp, Artificial Sequence
  chemically synthesized
ttttagctttcaatgacattca

SEQ ID NO: 1303649 - DNA, 22 bp, Artificial Sequence
  chemically synthesized
aacacaaacgtgaatgtcattg

SEQ ID NO: 1303650 - DNA, 22 bp, Artificial Sequence
  chemically synthesized
cttttttagctttcaatgacat

SEQ ID NO: 1303651 - DNA, 22 bp, Artificial Sequence
  chemically synthesized
acttttttagctttcaatgaca

SEQ ID NO: 1303652 - DNA, 22 bp, Artificial Sequence
  chemically synthesized
tttacttttttagctttcaatg

SEQ ID NO: 1303653 - DNA, 22 bp, Artificial Sequence
  chemically synthesized
gtttacttttttagctttcaat

SEQ ID NO: 1303654 - DNA, 22 bp, Artificial Sequence
  chemically synthesized
tgtttacttttttagctttcaa

SEQ ID NO: 1303655 - DNA, 22 bp, Artificial Sequence
  chemically synthesized
actttgtttacttttttagctt

SEQ ID NO: 1303656 - DNA, 22 bp, Artificial Sequence
  chemically synthesized
aaagctaaaaaagtaaacaaag

SEQ ID NO: 1303657 - DNA, 22 bp, Artificial Sequence
  chemically synthesized
cgggtgtgatcattaactttgt

SEQ ID NO: 1303658 - DNA, 22 bp, Artificial Sequence
  chemically synthesized
acgggtgtgatcattaactttg

SEQ ID NO: 1303659 - DNA, 22 bp, Artificial Sequence
  chemically synthesized
aaaaagtaaacaaagttaatga

SEQ ID NO: 1303660 - DNA, 22 bp, Artificial Sequence
  chemically synthesized
atgatcacacccgtaagtgcta

SEQ ID NO: 1303661 - DNA, 22 bp, Artificial Sequence
  chemically synthesized
aatgaaaaatcagtagcactta

SEQ ID NO: 1303662 - DNA, 22 bp, Artificial Sequence
  chemically synthesized
agttcaatgaaaaatcagtagc

SEQ ID NO: 1303663 - DNA, 22 bp, Artificial Sequence
  chemically synthesized
tgagttcaatgaaaaatcagta

SEQ ID NO: 1303664 - DNA, 22 bp, Artificial Sequence
  chemically synthesized
ctctgagttcaatgaaaaatca

SEQ ID NO: 1303665 - DNA, 22 bp, Artificial Sequence
  chemically synthesized
tcctctgagttcaatgaaaaat

SEQ ID NO: 1303666 - DNA, 22 bp, Artificial Sequence
  chemically synthesized
ctcctctgagttcaatgaaaaa

SEQ ID NO: 1303667 - DNA, 22 bp, Artificial Sequence
  chemically synthesized
tctcctctgagttcaatgaaaa

SEQ ID NO: 1303668 - DNA, 22 bp, Artificial Sequence
  chemically synthesized
ctgatttttcattgaactcaga

SEQ ID NO: 1303669 - DNA, 22 bp, Artificial Sequence
  chemically synthesized
atttttcattgaactcagagga

SEQ ID NO: 1303670 - DNA, 22 bp, Artificial Sequence
  chemically synthesized
ttcattgaactcagaggagaaa

SEQ ID NO: 1303671 - DNA, 22 bp, Artificial Sequence
  chemically synthesized
tcattgaactcagaggagaaag

SEQ ID NO: 1303672 - DNA, 22 bp, Artificial Sequence
  chemically synthesized
ggaatccagtaactttctcctc

SEQ ID NO: 1303673 - DNA, 22 bp, Artificial Sequence
  chemically synthesized
cattgaactcagaggagaaagt

SEQ ID NO: 1303674 - DNA, 22 bp, Artificial Sequence
  chemically synthesized
gggaatccagtaactttctcct

SEQ ID NO: 1303675 - DNA, 22 bp, Artificial Sequence
  chemically synthesized
attgaactcagaggagaaagtt

SEQ ID NO: 1303676 - DNA, 22 bp, Artificial Sequence
  chemically synthesized
tgggaatccagtaactttctcc

SEQ ID NO: 1303677 - DNA, 22 bp, Artificial Sequence
  chemically synthesized
ttgggaatccagtaactttctc

SEQ ID NO: 1303678 - DNA, 22 bp, Artificial Sequence
  chemically synthesized
aactcagaggagaaagttactg

SEQ ID NO: 1303679 - DNA, 22 bp, Artificial Sequence
  chemically synthesized
cttttgggaatccagtaacttt

SEQ ID NO: 1303680 - DNA, 22 bp, Artificial Sequence
  chemically synthesized
acttttgggaatccagtaactt

SEQ ID NO: 1303681 - DNA, 22 bp, Artificial Sequence
  chemically synthesized
agaggagaaagttactggattc

SEQ ID NO: 1303682 - DNA, 22 bp, Artificial Sequence
  chemically synthesized
acttacttttgggaatccagta

SEQ ID NO: 1303683 - DNA, 22 bp, Artificial Sequence
  chemically synthesized
cacttacttttgggaatccagt

SEQ ID NO: 1303684 - DNA, 22 bp, Artificial Sequence
  chemically synthesized
ctggattcccaaaagtaagtga

SEQ ID NO: 1303685 - DNA, 22 bp, Artificial Sequence
  chemically synthesized
gattcccaaaagtaagtgaagg

SEQ ID NO: 1303686 - DNA, 22 bp, Artificial Sequence
  chemically synthesized
gcaaacatatacccttcactta

SEQ ID NO: 1303687 - DNA, 22 bp, Artificial Sequence
  chemically synthesized
agcaaacatatacccttcactt

SEQ ID NO: 1303688 - DNA, 22 bp, Artificial Sequence
  chemically synthesized
ccaaaagtaagtgaagggtata

SEQ ID NO: 1303689 - DNA, 22 bp, Artificial Sequence
  chemically synthesized
tgaatgcatttagcaaacatat

SEQ ID NO: 1303690 - DNA, 22 bp, Artificial Sequence
  chemically synthesized
gagcaacaggctgtgaatgcat

SEQ ID NO: 1303691 - DNA, 22 bp, Artificial Sequence
  chemically synthesized
gctaaatgcattcacagcctgt

SEQ ID NO: 1303692 - DNA, 22 bp, Artificial Sequence
  chemically synthesized
ctaaatgcattcacagcctgtt

SEQ ID NO: 1303693 - DNA, 22 bp, Artificial Sequence
  chemically synthesized
aaataattagagcaacaggctg

SEQ ID NO: 1303694 - DNA, 22 bp, Artificial Sequence
  chemically synthesized
aatgcattcacagcctgttgct

SEQ ID NO: 1303695 - DNA, 22 bp, Artificial Sequence
  chemically synthesized
acagcctgttgctctaattatt

SEQ ID NO: 1303696 - DNA, 22 bp, Artificial Sequence
  chemically synthesized
ttgctctaattatttgaggttt

SEQ ID NO: 1303697 - DNA, 22 bp, Artificial Sequence
  chemically synthesized
ctctaattatttgaggtttttt

SEQ ID NO: 1303698 - DNA, 22 bp, Artificial Sequence
  chemically synthesized
aaacaacaacacataaaaaacc

SEQ ID NO: 1303699 - DNA, 22 bp, Artificial Sequence
  chemically synthesized
taattatttgaggttttttatg

SEQ ID NO: 1303700 - DNA, 22 bp, Artificial Sequence
  chemically synthesized
attatttgaggttttttatgtg

SEQ ID NO: 1303701 - DNA, 22 bp, Artificial Sequence
  chemically synthesized
tttgaggttttttatgtgttgt

SEQ ID NO: 1303702 - DNA, 22 bp, Artificial Sequence
  chemically synthesized
gaggttttttatgtgttgttgt

SEQ ID NO: 1303703 - DNA, 22 bp, Artificial Sequence
  chemically synthesized
aggttttttatgtgttgttgtt

SEQ ID NO: 1303704 - DNA, 22 bp, Artificial Sequence
  chemically synthesized
tttatgtgttgttgttttagct

SEQ ID NO: 1303705 - DNA, 22 bp, Artificial Sequence
  chemically synthesized
ttatgtgttgttgttttagctg

SEQ ID NO: 1303706 - DNA, 22 bp, Artificial Sequence
  chemically synthesized
tatgtgttgttgttttagctgt

SEQ ID NO: 1303707 - DNA, 22 bp, Artificial Sequence
  chemically synthesized
atgtgttgttgttttagctgtt

SEQ ID NO: 1303708 - DNA, 22 bp, Artificial Sequence
  chemically synthesized
tgtgttgttgttttagctgttg

SEQ ID NO: 1303709 - DNA, 22 bp, Artificial Sequence
  chemically synthesized
ttgttttagctgttgtttgtgt

SEQ ID NO: 1303710 - DNA, 22 bp, Artificial Sequence
  chemically synthesized
ttttagctgttgtttgtgtttt

SEQ ID NO: 1303711 - DNA, 22 bp, Artificial Sequence
  chemically synthesized
tagctgttgtttgtgtttttta

SEQ ID NO: 1303712 - DNA, 22 bp, Artificial Sequence
  chemically synthesized
agctgttgtttgtgttttttat

SEQ ID NO: 1303713 - DNA, 22 bp, Artificial Sequence
  chemically synthesized
gctgttgtttgtgttttttatt

SEQ ID NO: 1303714 - DNA, 22 bp, Artificial Sequence
  chemically synthesized
ttgtttgtgttttttattcttt

SEQ ID NO: 1303715 - DNA, 22 bp, Artificial Sequence
  chemically synthesized
tttgtgttttttattctttctg

SEQ ID NO: 1303716 - DNA, 22 bp, Artificial Sequence
  chemically synthesized
gtgttttttattctttctgcat

SEQ ID NO: 1303717 - DNA, 22 bp, Artificial Sequence
  chemically synthesized
tgttttttattctttctgcatt

SEQ ID NO: 1303718 - DNA, 22 bp, Artificial Sequence
  chemically synthesized
tacagtagaagaaaaatgcaga

SEQ ID NO: 1303719 - DNA, 22 bp, Artificial Sequence
  chemically synthesized
tttattctttctgcatttttct

SEQ ID NO: 1303720 - DNA, 22 bp, Artificial Sequence
  chemically synthesized
ttattctttctgcatttttctt

SEQ ID NO: 1303721 - DNA, 22 bp, Artificial Sequence
  chemically synthesized
tattctttctgcatttttcttc

SEQ ID NO: 1303722 - DNA, 22 bp, Artificial Sequence
  chemically synthesized
attctttctgcatttttcttct

SEQ ID NO: 1303723 - DNA, 22 bp, Artificial Sequence
  chemically synthesized
ttctttctgcatttttcttcta

SEQ ID NO: 1303724 - DNA, 22 bp, Artificial Sequence
  chemically synthesized
tttctgcatttttcttctactg

SEQ ID NO: 1303725 - DNA, 22 bp, Artificial Sequence
  chemically synthesized
tctgcatttttcttctactgta

SEQ ID NO: 1303726 - DNA, 22 bp, Artificial Sequence
  chemically synthesized
ctgcatttttcttctactgtac

SEQ ID NO: 1303727 - DNA, 22 bp, Artificial Sequence
  chemically synthesized
tgcatttttcttctactgtaca

SEQ ID NO: 1303728 - DNA, 22 bp, Artificial Sequence
  chemically synthesized
catttttcttctactgtacagt

SEQ ID NO: 1303729 - DNA, 22 bp, Artificial Sequence
  chemically synthesized
atagcatgaataacaactgtac

SEQ ID NO: 1303730 - DNA, 22 bp, Artificial Sequence
  chemically synthesized
ttcttctactgtacagttgtta

SEQ ID NO: 1303731 - DNA, 22 bp, Artificial Sequence
  chemically synthesized
tcttctactgtacagttgttat

SEQ ID NO: 1303732 - DNA, 22 bp, Artificial Sequence
  chemically synthesized
cttctactgtacagttgttatt

SEQ ID NO: 1303733 - DNA, 22 bp, Artificial Sequence
  chemically synthesized
ttctactgtacagttgttattc

SEQ ID NO: 1303734 - DNA, 22 bp, Artificial Sequence
  chemically synthesized
ctactgtacagttgttattcat

SEQ ID NO: 1303735 - DNA, 22 bp, Artificial Sequence
  chemically synthesized
tactgtacagttgttattcatg

SEQ ID NO: 1303736 - DNA, 22 bp, Artificial Sequence
  chemically synthesized
gataactcatagcatgaataac

SEQ ID NO: 1303737 - DNA, 22 bp, Artificial Sequence
  chemically synthesized
agataactcatagcatgaataa

SEQ ID NO: 1303738 - DNA, 22 bp, Artificial Sequence
  chemically synthesized
ctgtacagttgttattcatgct

SEQ ID NO: 1303739 - DNA, 22 bp, Artificial Sequence
  chemically synthesized
tagataactcatagcatgaata

SEQ ID NO: 1303740 - DNA, 22 bp, Artificial Sequence
  chemically synthesized
tacagttgttattcatgctatg

SEQ ID NO: 1303741 - DNA, 22 bp, Artificial Sequence
  chemically synthesized
atgtaaactttagataactcat

SEQ ID NO: 1303742 - DNA, 22 bp, Artificial Sequence
  chemically synthesized
ttattcatgctatgagttatct

SEQ ID NO: 1303743 - DNA, 22 bp, Artificial Sequence
  chemically synthesized
ttaatgtaaactttagataact

SEQ ID NO: 1303744 - DNA, 22 bp, Artificial Sequence
  chemically synthesized
ttcatgctatgagttatctaaa

SEQ ID NO: 1303745 - DNA, 22 bp, Artificial Sequence
  chemically synthesized
atgctatgagttatctaaagtt

SEQ ID NO: 1303746 - DNA, 22 bp, Artificial Sequence
  chemically synthesized
attattaatgtaaactttagat

SEQ ID NO: 1303747 - DNA, 22 bp, Artificial Sequence
  chemically synthesized
gattattaatgtaaactttaga

SEQ ID NO: 1303748 - DNA, 22 bp, Artificial Sequence
  chemically synthesized
tgagttatctaaagtttacatt

SEQ ID NO: 1303749 - DNA, 22 bp, Artificial Sequence
  chemically synthesized
tctaaagtttacattaataatc

SEQ ID NO: 1303750 - DNA, 22 bp, Artificial Sequence
  chemically synthesized
aagtttacattaataatcaaat

SEQ ID NO: 1303751 - DNA, 22 bp, Artificial Sequence
  chemically synthesized
ggatggtgcaaggaatttgatt

SEQ ID NO: 1303752 - DNA, 22 bp, Artificial Sequence
  chemically synthesized
acattaataatcaaattccttg

SEQ ID NO: 1303753 - DNA, 22 bp, Artificial Sequence
  chemically synthesized
cattaataatcaaattccttgc

SEQ ID NO: 1303754 - DNA, 22 bp, Artificial Sequence
  chemically synthesized
agagttgggatggtgcaaggaa

SEQ ID NO: 1303755 - DNA, 22 bp, Artificial Sequence
  chemically synthesized
cagagttgggatggtgcaagga

SEQ ID NO: 1303756 - DNA, 22 bp, Artificial Sequence
  chemically synthesized
ataatcaaattccttgcaccat

SEQ ID NO: 1303757 - DNA, 22 bp, Artificial Sequence
  chemically synthesized
tgtgtttcagagttgggatggt

SEQ ID NO: 1303758 - DNA, 22 bp, Artificial Sequence
  chemically synthesized
cttgcaccatcccaactctgaa

SEQ ID NO: 1303759 - DNA, 22 bp, Artificial Sequence
  chemically synthesized
gcaccatcccaactctgaaaca

SEQ ID NO: 1303760 - DNA, 22 bp, Artificial Sequence
  chemically synthesized
caccatcccaactctgaaacac

SEQ ID NO: 1303761 - DNA, 22 bp, Artificial Sequence
  chemically synthesized
catccaagttgtgtgtttcaga

SEQ ID NO: 1303762 - DNA, 22 bp, Artificial Sequence
  chemically synthesized
atctccatccaagttgtgtgtt

SEQ ID NO: 1303763 - DNA, 22 bp, Artificial Sequence
  chemically synthesized
aatctccatccaagttgtgtgt

SEQ ID NO: 1303764 - DNA, 22 bp, Artificial Sequence
  chemically synthesized
tgaaacacacaacttggatgga

SEQ ID NO: 1303765 - DNA, 22 bp, Artificial Sequence
  chemically synthesized
aaacacacaacttggatggaga

SEQ ID NO: 1303766 - DNA, 22 bp, Artificial Sequence
  chemically synthesized
aatgagtcttaatctccatcca

SEQ ID NO: 1303767 - DNA, 22 bp, Artificial Sequence
  chemically synthesized
agtcctgaatgagtcttaatct

SEQ ID NO: 1303768 - DNA, 22 bp, Artificial Sequence
  chemically synthesized
cctgagtcctgaatgagtctta

SEQ ID NO: 1303769 - DNA, 22 bp, Artificial Sequence
  chemically synthesized
ggatggagattaagactcattc

SEQ ID NO: 1303770 - DNA, 22 bp, Artificial Sequence
  chemically synthesized
gatggagattaagactcattca

SEQ ID NO: 1303771 - DNA, 22 bp, Artificial Sequence
  chemically synthesized
aggatgtctgcctgagtcctga

SEQ ID NO: 1303772 - DNA, 22 bp, Artificial Sequence
  chemically synthesized
agactcattcaggactcaggca

SEQ ID NO: 1303773 - DNA, 22 bp, Artificial Sequence
  chemically synthesized
ggtactaaggatgtctgcctga

SEQ ID NO: 1303774 - DNA, 22 bp, Artificial Sequence
  chemically synthesized
tgggtactaaggatgtctgcct

SEQ ID NO: 1303775 - DNA, 22 bp, Artificial Sequence
  chemically synthesized
attcaggactcaggcagacatc

SEQ ID NO: 1303776 - DNA, 22 bp, Artificial Sequence
  chemically synthesized
aggactcaggcagacatcctta

SEQ ID NO: 1303777 - DNA, 22 bp, Artificial Sequence
  chemically synthesized
tggttctgggtactaaggatgt

SEQ ID NO: 1303778 - DNA, 22 bp, Artificial Sequence
  chemically synthesized
tgttgtggttctgggtactaag

SEQ ID NO: 1303779 - DNA, 22 bp, Artificial Sequence
  chemically synthesized
aggcagacatccttagtaccca

SEQ ID NO: 1303780 - DNA, 22 bp, Artificial Sequence
  chemically synthesized
gtgtgtgctgtgttgtggttct

SEQ ID NO: 1303781 - DNA, 22 bp, Artificial Sequence
  chemically synthesized
agtacccagaaccacaacacag

SEQ ID NO: 1303782 - DNA, 22 bp, Artificial Sequence
  chemically synthesized
gtacccagaaccacaacacagc

SEQ ID NO: 1303783 - DNA, 22 bp, Artificial Sequence
  chemically synthesized
tagaaccatgcattcgtgtgtg

SEQ ID NO: 1303784 - DNA, 22 bp, Artificial Sequence
  chemically synthesized
cataaaataattatagaaccat

SEQ ID NO: 1303785 - DNA, 22 bp, Artificial Sequence
  chemically synthesized
atagatgctccataaaataatt

SEQ ID NO: 1303786 - DNA, 22 bp, Artificial Sequence
  chemically synthesized
tataattattttatggagcatc

SEQ ID NO: 1303787 - DNA, 22 bp, Artificial Sequence
  chemically synthesized
taattattttatggagcatcta

SEQ ID NO: 1303788 - DNA, 22 bp, Artificial Sequence
  chemically synthesized
ttttatggagcatctatgaatt

SEQ ID NO: 1303789 - DNA, 22 bp, Artificial Sequence
  chemically synthesized
tatggagcatctatgaatttgc

SEQ ID NO: 1303790 - DNA, 22 bp, Artificial Sequence
  chemically synthesized
atggagcatctatgaatttgct

SEQ ID NO: 1303791 - DNA, 22 bp, Artificial Sequence
  chemically synthesized
tggagcatctatgaatttgcta

SEQ ID NO: 1303792 - DNA, 22 bp, Artificial Sequence
  chemically synthesized
ccagggtccggtgcatagcaaa

SEQ ID NO: 1303793 - DNA, 22 bp, Artificial Sequence
  chemically synthesized
cccagggtccggtgcatagcaa

SEQ ID NO: 1303794 - DNA, 22 bp, Artificial Sequence
  chemically synthesized
acttcccagggtccggtgcata

SEQ ID NO: 1303795 - DNA, 22 bp, Artificial Sequence
  chemically synthesized
tgaatttgctatgcaccggacc

SEQ ID NO: 1303796 - DNA, 22 bp, Artificial Sequence
  chemically synthesized
tacattgacttcccagggtccg

SEQ ID NO: 1303797 - DNA, 22 bp, Artificial Sequence
  chemically synthesized
gctatgcaccggaccctgggaa

SEQ ID NO: 1303798 - DNA, 22 bp, Artificial Sequence
  chemically synthesized
ctatgcaccggaccctgggaag

SEQ ID NO: 1303799 - DNA, 22 bp, Artificial Sequence
  chemically synthesized
tgcaccggaccctgggaagtca

SEQ ID NO: 1303800 - DNA, 22 bp, Artificial Sequence
  chemically synthesized
accactgtacattgacttccca

SEQ ID NO: 1303801 - DNA, 22 bp, Artificial Sequence
  chemically synthesized
ttgaccactgtacattgacttc

SEQ ID NO: 1303802 - DNA, 22 bp, Artificial Sequence
  chemically synthesized
gttgaccactgtacattgactt

SEQ ID NO: 1303803 - DNA, 22 bp, Artificial Sequence
  chemically synthesized
tgttgaccactgtacattgact

SEQ ID NO: 1303804 - DNA, 22 bp, Artificial Sequence
  chemically synthesized
ttgttgaccactgtacattgac

SEQ ID NO: 1303805 - DNA, 22 bp, Artificial Sequence
  chemically synthesized
tttttgttgaccactgtacatt

SEQ ID NO: 1303806 - DNA, 22 bp, Artificial Sequence
  chemically synthesized
ggaagtcaatgtacagtggtca

SEQ ID NO: 1303807 - DNA, 22 bp, Artificial Sequence
  chemically synthesized
aattgtttttgttgaccactgt

SEQ ID NO: 1303808 - DNA, 22 bp, Artificial Sequence
  chemically synthesized
atacaattgaattgtttttgtt

SEQ ID NO: 1303809 - DNA, 22 bp, Artificial Sequence
  chemically synthesized
aatattaatacaattgaattgt

SEQ ID NO: 1303810 - DNA, 22 bp, Artificial Sequence
  chemically synthesized
taaatattaatacaattgaatt

SEQ ID NO: 1303811 - DNA, 22 bp, Artificial Sequence
  chemically synthesized
ctaaatattaatacaattgaat

SEQ ID NO: 1303812 - DNA, 22 bp, Artificial Sequence
  chemically synthesized
tggcttctaaatattaatacaa

SEQ ID NO: 1303813 - DNA, 22 bp, Artificial Sequence
  chemically synthesized
gtggcttctaaatattaataca

SEQ ID NO: 1303814 - DNA, 22 bp, Artificial Sequence
  chemically synthesized
tgtggcttctaaatattaatac

SEQ ID NO: 1303815 - DNA, 22 bp, Artificial Sequence
  chemically synthesized
cattttgtggcttctaaatatt

SEQ ID NO: 1303816 - DNA, 22 bp, Artificial Sequence
  chemically synthesized
gcattttgtggcttctaaatat

SEQ ID NO: 1303817 - DNA, 22 bp, Artificial Sequence
  chemically synthesized
aattgtattaatatttagaagc

SEQ ID NO: 1303818 - DNA, 22 bp, Artificial Sequence
  chemically synthesized
tattaatatttagaagccacaa

SEQ ID NO: 1303819 - DNA, 22 bp, Artificial Sequence
  chemically synthesized
atatttagaagccacaaaatgc

SEQ ID NO: 1303820 - DNA, 22 bp, Artificial Sequence
  chemically synthesized
aaaaagaatatatttgcatttt

SEQ ID NO: 1303821 - DNA, 22 bp, Artificial Sequence
  chemically synthesized
agaagccacaaaatgcaaatat

SEQ ID NO: 1303822 - DNA, 22 bp, Artificial Sequence
  chemically synthesized
gaagccacaaaatgcaaatata

SEQ ID NO: 1303823 - DNA, 22 bp, Artificial Sequence
  chemically synthesized
aaattaaaaaagaatatatttg

SEQ ID NO: 1303824 - DNA, 22 bp, Artificial Sequence
  chemically synthesized
caaattaaaaaagaatatattt

SEQ ID NO: 1303825 - DNA, 22 bp, Artificial Sequence
  chemically synthesized
tgcagaagaataacaagcttca

SEQ ID NO: 1303826 - DNA, 22 bp, Artificial Sequence
  chemically synthesized
ttttttaatttgaagcttgtta

SEQ ID NO: 1303827 - DNA, 22 bp, Artificial Sequence
  chemically synthesized
ttttaatttgaagcttgttatt

SEQ ID NO: 1303828 - DNA, 22 bp, Artificial Sequence
  chemically synthesized
tttaatttgaagcttgttattc

SEQ ID NO: 1303829 - DNA, 22 bp, Artificial Sequence
  chemically synthesized
ttaatttgaagcttgttattct

SEQ ID NO: 1303830 - DNA, 22 bp, Artificial Sequence
  chemically synthesized
taatttgaagcttgttattctt

SEQ ID NO: 1303831 - DNA, 22 bp, Artificial Sequence
  chemically synthesized
tagattgtgcagaagaataaca

SEQ ID NO: 1303832 - DNA, 22 bp, Artificial Sequence
  chemically synthesized
aatttgaagcttgttattcttc

SEQ ID NO: 1303833 - DNA, 22 bp, Artificial Sequence
  chemically synthesized
atttgaagcttgttattcttct

SEQ ID NO: 1303834 - DNA, 22 bp, Artificial Sequence
  chemically synthesized
gaagcttgttattcttctgcac

SEQ ID NO: 1303835 - DNA, 22 bp, Artificial Sequence
  chemically synthesized
aagcttgttattcttctgcaca

SEQ ID NO: 1303836 - DNA, 22 bp, Artificial Sequence
  chemically synthesized
ataggagctatagattgtgcag

SEQ ID NO: 1303837 - DNA, 22 bp, Artificial Sequence
  chemically synthesized
taataggagctatagattgtgc

SEQ ID NO: 1303838 - DNA, 22 bp, Artificial Sequence
  chemically synthesized
gttattcttctgcacaatctat

SEQ ID NO: 1303839 - DNA, 22 bp, Artificial Sequence
  chemically synthesized
ttattcttctgcacaatctata

SEQ ID NO: 1303840 - DNA, 22 bp, Artificial Sequence
  chemically synthesized
ttcttctgcacaatctatagct

SEQ ID NO: 1303841 - DNA, 22 bp, Artificial Sequence
  chemically synthesized
atgattctaataggagctatag

SEQ ID NO: 1303842 - DNA, 22 bp, Artificial Sequence
  chemically synthesized
ttctgcacaatctatagctcct

SEQ ID NO: 1303843 - DNA, 22 bp, Artificial Sequence
  chemically synthesized
aatgattctaataggagctata

SEQ ID NO: 1303844 - DNA, 22 bp, Artificial Sequence
  chemically synthesized
taatgattctaataggagctat

SEQ ID NO: 1303845 - DNA, 22 bp, Artificial Sequence
  chemically synthesized
ctgcacaatctatagctcctat

SEQ ID NO: 1303846 - DNA, 22 bp, Artificial Sequence
  chemically synthesized
tgcacaatctatagctcctatt

SEQ ID NO: 1303847 - DNA, 22 bp, Artificial Sequence
  chemically synthesized
cacaatctatagctcctattag

SEQ ID NO: 1303848 - DNA, 22 bp, Artificial Sequence
  chemically synthesized
aatgtactttaatgattctaat

SEQ ID NO: 1303849 - DNA, 22 bp, Artificial Sequence
  chemically synthesized
ctgaatgtactttaatgattct

SEQ ID NO: 1303850 - DNA, 22 bp, Artificial Sequence
  chemically synthesized
tagctcctattagaatcattaa

SEQ ID NO: 1303851 - DNA, 22 bp, Artificial Sequence
  chemically synthesized
ctgctgaatgtactttaatgat

SEQ ID NO: 1303852 - DNA, 22 bp, Artificial Sequence
  chemically synthesized
ctgctgctgaatgtactttaat

SEQ ID NO: 1303853 - DNA, 22 bp, Artificial Sequence
  chemically synthesized
ctattagaatcattaaagtaca

SEQ ID NO: 1303854 - DNA, 22 bp, Artificial Sequence
  chemically synthesized
ttactgctgctgaatgtacttt

SEQ ID NO: 1303855 - DNA, 22 bp, Artificial Sequence
  chemically synthesized
ttagaatcattaaagtacattc

SEQ ID NO: 1303856 - DNA, 22 bp, Artificial Sequence
  chemically synthesized
gttactgctgctgaatgtactt

SEQ ID NO: 1303857 - DNA, 22 bp, Artificial Sequence
  chemically synthesized
gaatcattaaagtacattcagc

SEQ ID NO: 1303858 - DNA, 22 bp, Artificial Sequence
  chemically synthesized
gtttgttactgctgctgaatgt

SEQ ID NO: 1303859 - DNA, 22 bp, Artificial Sequence
  chemically synthesized
ttcgtttgttactgctgctgaa

SEQ ID NO: 1303860 - DNA, 22 bp, Artificial Sequence
  chemically synthesized
cctgttcgtttgttactgctgc

SEQ ID NO: 1303861 - DNA, 22 bp, Artificial Sequence
  chemically synthesized
aagtacattcagcagcagtaac

SEQ ID NO: 1303862 - DNA, 22 bp, Artificial Sequence
  chemically synthesized
ccctgttcgtttgttactgctg

SEQ ID NO: 1303863 - DNA, 22 bp, Artificial Sequence
  chemically synthesized
tccctgttcgtttgttactgct

SEQ ID NO: 1303864 - DNA, 22 bp, Artificial Sequence
  chemically synthesized
acattttccctgttcgtttgtt

SEQ ID NO: 1303865 - DNA, 22 bp, Artificial Sequence
  chemically synthesized
agcagcagtaacaaacgaacag

SEQ ID NO: 1303866 - DNA, 22 bp, Artificial Sequence
  chemically synthesized
tcatgttcacattttccctgtt

SEQ ID NO: 1303867 - DNA, 22 bp, Artificial Sequence
  chemically synthesized
gtcatgttcacattttccctgt

SEQ ID NO: 1303868 - DNA, 22 bp, Artificial Sequence
  chemically synthesized
tgtcatgttcacattttccctg

SEQ ID NO: 1303869 - DNA, 22 bp, Artificial Sequence
  chemically synthesized
ttgtcatgttcacattttccct

SEQ ID NO: 1303870 - DNA, 22 bp, Artificial Sequence
  chemically synthesized
gcagccttttgtcatgttcaca

SEQ ID NO: 1303871 - DNA, 22 bp, Artificial Sequence
  chemically synthesized
tggcagccttttgtcatgttca

SEQ ID NO: 1303872 - DNA, 22 bp, Artificial Sequence
  chemically synthesized
ctctggcagccttttgtcatgt

SEQ ID NO: 1303873 - DNA, 22 bp, Artificial Sequence
  chemically synthesized
tcacccgtgttactctggcagc

SEQ ID NO: 1303874 - DNA, 22 bp, Artificial Sequence
  chemically synthesized
gtcacccgtgttactctggcag

SEQ ID NO: 1303875 - DNA, 22 bp, Artificial Sequence
  chemically synthesized
ccacatttgtcacccgtgttac

SEQ ID NO: 1303876 - DNA, 22 bp, Artificial Sequence
  chemically synthesized
ccagagtaacacgggtgacaaa

SEQ ID NO: 1303877 - DNA, 22 bp, Artificial Sequence
  chemically synthesized
aaatgttcccacatttgtcacc

SEQ ID NO: 1303878 - DNA, 22 bp, Artificial Sequence
  chemically synthesized
taaaatgttcccacatttgtca

SEQ ID NO: 1303879 - DNA, 22 bp, Artificial Sequence
  chemically synthesized
ggaattctaaaatgttcccaca

SEQ ID NO: 1303880 - DNA, 22 bp, Artificial Sequence
  chemically synthesized
gagtgggaaattgggaattcta

SEQ ID NO: 1303881 - DNA, 22 bp, Artificial Sequence
  chemically synthesized
ttagagtgggaaattgggaatt

SEQ ID NO: 1303882 - DNA, 22 bp, Artificial Sequence
  chemically synthesized
attagagtgggaaattgggaat

SEQ ID NO: 1303883 - DNA, 22 bp, Artificial Sequence
  chemically synthesized
tattagagtgggaaattgggaa

SEQ ID NO: 1303884 - DNA, 22 bp, Artificial Sequence
  chemically synthesized
ttttattagagtgggaaattgg

SEQ ID NO: 1303885 - DNA, 22 bp, Artificial Sequence
  chemically synthesized
tagaattcccaatttcccactc

SEQ ID NO: 1303886 - DNA, 22 bp, Artificial Sequence
  chemically synthesized
agaattcccaatttcccactct

SEQ ID NO: 1303887 - DNA, 22 bp, Artificial Sequence
  chemically synthesized
gaattcccaatttcccactcta

SEQ ID NO: 1303888 - DNA, 22 bp, Artificial Sequence
  chemically synthesized
atattattttattagagtggga

SEQ ID NO: 1303889 - DNA, 22 bp, Artificial Sequence
  chemically synthesized
ttcatattattttattagagtg

SEQ ID NO: 1303890 - DNA, 22 bp, Artificial Sequence
  chemically synthesized
gttcatattattttattagagt

SEQ ID NO: 1303891 - DNA, 22 bp, Artificial Sequence
  chemically synthesized
tgttcatattattttattagag

SEQ ID NO: 1303892 - DNA, 22 bp, Artificial Sequence
  chemically synthesized
ccaatttcccactctaataaaa

SEQ ID NO: 1303893 - DNA, 22 bp, Artificial Sequence
  chemically synthesized
ttgttcatattattttattaga

SEQ ID NO: 1303894 - DNA, 22 bp, Artificial Sequence
  chemically synthesized
tttgttcatattattttattag

SEQ ID NO: 1303895 - DNA, 22 bp, Artificial Sequence
  chemically synthesized
cccactctaataaaataatatg

SEQ ID NO: 1303896 - DNA, 22 bp, Artificial Sequence
  chemically synthesized
ccactctaataaaataatatga

SEQ ID NO: 1303897 - DNA, 22 bp, Artificial Sequence
  chemically synthesized
aaaaaagcctttttgttcatat

SEQ ID NO: 1303898 - DNA, 22 bp, Artificial Sequence
  chemically synthesized
taataaaataatatgaacaaaa

SEQ ID NO: 1303899 - DNA, 22 bp, Artificial Sequence
  chemically synthesized
ctaaaaaaagcctttttgttca

SEQ ID NO: 1303900 - DNA, 22 bp, Artificial Sequence
  chemically synthesized
ataaaataatatgaacaaaaag

SEQ ID NO: 1303901 - DNA, 22 bp, Artificial Sequence
  chemically synthesized
aagctactaaaaaaagcctttt

SEQ ID NO: 1303902 - DNA, 22 bp, Artificial Sequence
  chemically synthesized
agttgaagctactaaaaaaagc

SEQ ID NO: 1303903 - DNA, 22 bp, Artificial Sequence
  chemically synthesized
cagttgaagctactaaaaaaag

SEQ ID NO: 1303904 - DNA, 22 bp, Artificial Sequence
  chemically synthesized
tttttagtagcttcaactgaaa

SEQ ID NO: 1303905 - DNA, 22 bp, Artificial Sequence
  chemically synthesized
ttttagtagcttcaactgaaac

SEQ ID NO: 1303906 - DNA, 22 bp, Artificial Sequence
  chemically synthesized
tttagtagcttcaactgaaact

SEQ ID NO: 1303907 - DNA, 22 bp, Artificial Sequence
  chemically synthesized
ttagtagcttcaactgaaacta

SEQ ID NO: 1303908 - DNA, 22 bp, Artificial Sequence
  chemically synthesized
tagtagcttcaactgaaactat

SEQ ID NO: 1303909 - DNA, 22 bp, Artificial Sequence
  chemically synthesized
agtagcttcaactgaaactatc

SEQ ID NO: 1303910 - DNA, 22 bp, Artificial Sequence
  chemically synthesized
gtagcttcaactgaaactatca

SEQ ID NO: 1303911 - DNA, 22 bp, Artificial Sequence
  chemically synthesized
agaaatagatcaggtgatagtt

SEQ ID NO: 1303912 - DNA, 22 bp, Artificial Sequence
  chemically synthesized
aagaaatagatcaggtgatagt

SEQ ID NO: 1303913 - DNA, 22 bp, Artificial Sequence
  chemically synthesized
taagaaatagatcaggtgatag

SEQ ID NO: 1303914 - DNA, 22 bp, Artificial Sequence
  chemically synthesized
caactgaaactatcacctgatc

SEQ ID NO: 1303915 - DNA, 22 bp, Artificial Sequence
  chemically synthesized
aactgaaactatcacctgatct

SEQ ID NO: 1303916 - DNA, 22 bp, Artificial Sequence
  chemically synthesized
aaactatcacctgatctatttc

SEQ ID NO: 1303917 - DNA, 22 bp, Artificial Sequence
  chemically synthesized
gtgaggattttaagaaatagat

SEQ ID NO: 1303918 - DNA, 22 bp, Artificial Sequence
  chemically synthesized
cgtgaggattttaagaaataga

SEQ ID NO: 1303919 - DNA, 22 bp, Artificial Sequence
  chemically synthesized
tcacctgatctatttcttaaaa

SEQ ID NO: 1303920 - DNA, 22 bp, Artificial Sequence
  chemically synthesized
atctatttcttaaaatcctcac

SEQ ID NO: 1303921 - DNA, 22 bp, Artificial Sequence
  chemically synthesized
agtgaaaccttcgtgaggattt

SEQ ID NO: 1303922 - DNA, 22 bp, Artificial Sequence
  chemically synthesized
tttcttaaaatcctcacgaagg

SEQ ID NO: 1303923 - DNA, 22 bp, Artificial Sequence
  chemically synthesized
atggttcagtgaaaccttcgtg

SEQ ID NO: 1303924 - DNA, 22 bp, Artificial Sequence
  chemically synthesized
cttaaaatcctcacgaaggttt

SEQ ID NO: 1303925 - DNA, 22 bp, Artificial Sequence
  chemically synthesized
ttaaaatcctcacgaaggtttc

SEQ ID NO: 1303926 - DNA, 22 bp, Artificial Sequence
  chemically synthesized
taatggttcagtgaaaccttcg

SEQ ID NO: 1303927 - DNA, 22 bp, Artificial Sequence
  chemically synthesized
aaaatcctcacgaaggtttcac

SEQ ID NO: 1303928 - DNA, 22 bp, Artificial Sequence
  chemically synthesized
aaatcctcacgaaggtttcact

SEQ ID NO: 1303929 - DNA, 22 bp, Artificial Sequence
  chemically synthesized
cccaaacctctaatggttcagt

SEQ ID NO: 1303930 - DNA, 22 bp, Artificial Sequence
  chemically synthesized
acgaaggtttcactgaaccatt

SEQ ID NO: 1303931 - DNA, 22 bp, Artificial Sequence
  chemically synthesized
actgcccaaacctctaatggtt

SEQ ID NO: 1303932 - DNA, 22 bp, Artificial Sequence
  chemically synthesized
gactgcccaaacctctaatggt

SEQ ID NO: 1303933 - DNA, 22 bp, Artificial Sequence
  chemically synthesized
tttgactgcccaaacctctaat

SEQ ID NO: 1303934 - DNA, 22 bp, Artificial Sequence
  chemically synthesized
gtttgactgcccaaacctctaa

SEQ ID NO: 1303935 - DNA, 22 bp, Artificial Sequence
  chemically synthesized
cactgaaccattagaggtttgg

SEQ ID NO: 1303936 - DNA, 22 bp, Artificial Sequence
  chemically synthesized
actgaaccattagaggtttggg

SEQ ID NO: 1303937 - DNA, 22 bp, Artificial Sequence
  chemically synthesized
atttgtttgactgcccaaacct

SEQ ID NO: 1303938 - DNA, 22 bp, Artificial Sequence
  chemically synthesized
aatttgtttgactgcccaaacc

SEQ ID NO: 1303939 - DNA, 22 bp, Artificial Sequence
  chemically synthesized
aaccattagaggtttgggcagt

SEQ ID NO: 1303940 - DNA, 22 bp, Artificial Sequence
  chemically synthesized
atgtttaatttgtttgactgcc

SEQ ID NO: 1303941 - DNA, 22 bp, Artificial Sequence
  chemically synthesized
gaggtttgggcagtcaaacaaa

SEQ ID NO: 1303942 - DNA, 22 bp, Artificial Sequence
  chemically synthesized
gttcatgtttaatttgtttgac

SEQ ID NO: 1303943 - DNA, 22 bp, Artificial Sequence
  chemically synthesized
gggcagtcaaacaaattaaaca

SEQ ID NO: 1303944 - DNA, 22 bp, Artificial Sequence
  chemically synthesized
ggcagtcaaacaaattaaacat

SEQ ID NO: 1303945 - DNA, 22 bp, Artificial Sequence
  chemically synthesized
aaaagattggttcatgtttaat

SEQ ID NO: 1303946 - DNA, 22 bp, Artificial Sequence
  chemically synthesized
taaaaagattggttcatgttta

SEQ ID NO: 1303947 - DNA, 22 bp, Artificial Sequence
  chemically synthesized
agtagtcattctaaaaagattg

SEQ ID NO: 1303948 - DNA, 22 bp, Artificial Sequence
  chemically synthesized
cagtagtcattctaaaaagatt

SEQ ID NO: 1303949 - DNA, 22 bp, Artificial Sequence
  chemically synthesized
aacatgaaccaatctttttaga

SEQ ID NO: 1303950 - DNA, 22 bp, Artificial Sequence
  chemically synthesized
agcacttcagtagtcattctaa

SEQ ID NO: 1303951 - DNA, 22 bp, Artificial Sequence
  chemically synthesized
gaaatactgagcacttcagtag

SEQ ID NO: 1303952 - DNA, 22 bp, Artificial Sequence
  chemically synthesized
tttagaatgactactgaagtgc

SEQ ID NO: 1303953 - DNA, 22 bp, Artificial Sequence
  chemically synthesized
ttagaatgactactgaagtgct

SEQ ID NO: 1303954 - DNA, 22 bp, Artificial Sequence
  chemically synthesized
tagaatgactactgaagtgctc

SEQ ID NO: 1303955 - DNA, 22 bp, Artificial Sequence
  chemically synthesized
agaatgactactgaagtgctca

SEQ ID NO: 1303956 - DNA, 22 bp, Artificial Sequence
  chemically synthesized
gaatgactactgaagtgctcag

SEQ ID NO: 1303957 - DNA, 22 bp, Artificial Sequence
  chemically synthesized
gaaggctggaaatactgagcac

SEQ ID NO: 1303958 - DNA, 22 bp, Artificial Sequence
  chemically synthesized
ctgaagtgctcagtatttccag

SEQ ID NO: 1303959 - DNA, 22 bp, Artificial Sequence
  chemically synthesized
tggtaactggaaggctggaaat

SEQ ID NO: 1303960 - DNA, 22 bp, Artificial Sequence
  chemically synthesized
aagtgctcagtatttccagcct

SEQ ID NO: 1303961 - DNA, 22 bp, Artificial Sequence
  chemically synthesized
actgtggtaactggaaggctgg

SEQ ID NO: 1303962 - DNA, 22 bp, Artificial Sequence
  chemically synthesized
cactgtggtaactggaaggctg

SEQ ID NO: 1303963 - DNA, 22 bp, Artificial Sequence
  chemically synthesized
tcactgtggtaactggaaggct

SEQ ID NO: 1303964 - DNA, 22 bp, Artificial Sequence
  chemically synthesized
tttcactgtggtaactggaagg

SEQ ID NO: 1303965 - DNA, 22 bp, Artificial Sequence
  chemically synthesized
agtatttccagccttccagtta

SEQ ID NO: 1303966 - DNA, 22 bp, Artificial Sequence
  chemically synthesized
ctttcactgtggtaactggaag

SEQ ID NO: 1303967 - DNA, 22 bp, Artificial Sequence
  chemically synthesized
tttctttcactgtggtaactgg

SEQ ID NO: 1303968 - DNA, 22 bp, Artificial Sequence
  chemically synthesized
gtttctttcactgtggtaactg

SEQ ID NO: 1303969 - DNA, 22 bp, Artificial Sequence
  chemically synthesized
ccagccttccagttaccacagt

SEQ ID NO: 1303970 - DNA, 22 bp, Artificial Sequence
  chemically synthesized
tttgtttctttcactgtggtaa

SEQ ID NO: 1303971 - DNA, 22 bp, Artificial Sequence
  chemically synthesized
cagccttccagttaccacagtg

SEQ ID NO: 1303972 - DNA, 22 bp, Artificial Sequence
  chemically synthesized
ccagttaccacagtgaaagaaa

SEQ ID NO: 1303973 - DNA, 22 bp, Artificial Sequence
  chemically synthesized
cagttaccacagtgaaagaaac

SEQ ID NO: 1303974 - DNA, 22 bp, Artificial Sequence
  chemically synthesized
acaagtacctgtttgtttcttt

SEQ ID NO: 1303975 - DNA, 22 bp, Artificial Sequence
  chemically synthesized
ccacagtgaaagaaacaaacag

SEQ ID NO: 1303976 - DNA, 22 bp, Artificial Sequence
  chemically synthesized
taaacctgacaagtacctgttt

SEQ ID NO: 1303977 - DNA, 22 bp, Artificial Sequence
  chemically synthesized
ataaacctgacaagtacctgtt

SEQ ID NO: 1303978 - DNA, 22 bp, Artificial Sequence
  chemically synthesized
ccttataaacctgacaagtacc

SEQ ID NO: 1303979 - DNA, 22 bp, Artificial Sequence
  chemically synthesized
gtcaggtttataagggaatgat

SEQ ID NO: 1303980 - DNA, 22 bp, Artificial Sequence
  chemically synthesized
tcaggtttataagggaatgatc

SEQ ID NO: 1303981 - DNA, 22 bp, Artificial Sequence
  chemically synthesized
ataagggaatgatctattttct

SEQ ID NO: 1303982 - DNA, 22 bp, Artificial Sequence
  chemically synthesized
taagggaatgatctattttctg

SEQ ID NO: 1303983 - DNA, 22 bp, Artificial Sequence
  chemically synthesized
aagagtaggcaaaaaagggcag

SEQ ID NO: 1303984 - DNA, 22 bp, Artificial Sequence
  chemically synthesized
aaagagtaggcaaaaaagggca

SEQ ID NO: 1303985 - DNA, 22 bp, Artificial Sequence
  chemically synthesized
cttaaagagtaggcaaaaaagg

SEQ ID NO: 1303986 - DNA, 22 bp, Artificial Sequence
  chemically synthesized
ccttaaagagtaggcaaaaaag

SEQ ID NO: 1303987 - DNA, 22 bp, Artificial Sequence
  chemically synthesized
tccttaaagagtaggcaaaaaa

SEQ ID NO: 1303988 - DNA, 22 bp, Artificial Sequence
  chemically synthesized
ttttctgcccttttttgcctac

SEQ ID NO: 1303989 - DNA, 22 bp, Artificial Sequence
  chemically synthesized
tctgcccttttttgcctactct

SEQ ID NO: 1303990 - DNA, 22 bp, Artificial Sequence
  chemically synthesized
ctgcccttttttgcctactctt

SEQ ID NO: 1303991 - DNA, 22 bp, Artificial Sequence
  chemically synthesized
tgcccttttttgcctactcttt

SEQ ID NO: 1303992 - DNA, 22 bp, Artificial Sequence
  chemically synthesized
cccttttttgcctactctttaa

SEQ ID NO: 1303993 - DNA, 22 bp, Artificial Sequence
  chemically synthesized
ttttgcctactctttaaggaaa

SEQ ID NO: 1303994 - DNA, 22 bp, Artificial Sequence
  chemically synthesized
tttgcctactctttaaggaaaa

SEQ ID NO: 1303995 - DNA, 22 bp, Artificial Sequence
  chemically synthesized
ttgcctactctttaaggaaaac

SEQ ID NO: 1303996 - DNA, 22 bp, Artificial Sequence
  chemically synthesized
tgcctactctttaaggaaaaca

SEQ ID NO: 1303997 - DNA, 22 bp, Artificial Sequence
  chemically synthesized
gcctactctttaaggaaaacac

SEQ ID NO: 1303998 - DNA, 22 bp, Artificial Sequence
  chemically synthesized
cctactctttaaggaaaacaca

SEQ ID NO: 1303999 - DNA, 22 bp, Artificial Sequence
  chemically synthesized
catgcatatgtgtgtgtgtttt

SEQ ID NO: 1304000 - DNA, 22 bp, Artificial Sequence
  chemically synthesized
gcatgcatatgtgtgtgtgttt

SEQ ID NO: 1304001 - DNA, 22 bp, Artificial Sequence
  chemically synthesized
ctctttaaggaaaacacacaca

SEQ ID NO: 1304002 - DNA, 22 bp, Artificial Sequence
  chemically synthesized
tttaaggaaaacacacacacat

SEQ ID NO: 1304003 - DNA, 22 bp, Artificial Sequence
  chemically synthesized
taaggaaaacacacacacatat

SEQ ID NO: 1304004 - DNA, 22 bp, Artificial Sequence
  chemically synthesized
aaggaaaacacacacacatatg

SEQ ID NO: 1304005 - DNA, 22 bp, Artificial Sequence
  chemically synthesized
aggaaaacacacacacatatgc

SEQ ID NO: 1304006 - DNA, 22 bp, Artificial Sequence
  chemically synthesized
tgcatgcgtgtatgcttgcatg

SEQ ID NO: 1304007 - DNA, 22 bp, Artificial Sequence
  chemically synthesized
gtgcatgcgtgtatgcttgcat

SEQ ID NO: 1304008 - DNA, 22 bp, Artificial Sequence
  chemically synthesized
cttgtgcatgcgtgtatgcttg

SEQ ID NO: 1304009 - DNA, 22 bp, Artificial Sequence
  chemically synthesized
tgcttgtgcatgcgtgtatgct

SEQ ID NO: 1304010 - DNA, 22 bp, Artificial Sequence
  chemically synthesized
tgttctgcttgtgcatgcgtgt

SEQ ID NO: 1304011 - DNA, 22 bp, Artificial Sequence
  chemically synthesized
gtgttctgcttgtgcatgcgtg

SEQ ID NO: 1304012 - DNA, 22 bp, Artificial Sequence
  chemically synthesized
aatttgtgttctgcttgtgcat

SEQ ID NO: 1304013 - DNA, 22 bp, Artificial Sequence
  chemically synthesized
taaatttgtgttctgcttgtgc

SEQ ID NO: 1304014 - DNA, 22 bp, Artificial Sequence
  chemically synthesized
ctaaatttgtgttctgcttgtg

SEQ ID NO: 1304015 - DNA, 22 bp, Artificial Sequence
  chemically synthesized
tagcttctaaatttgtgttctg

SEQ ID NO: 1304016 - DNA, 22 bp, Artificial Sequence
  chemically synthesized
tatagcttctaaatttgtgttc

SEQ ID NO: 1304017 - DNA, 22 bp, Artificial Sequence
  chemically synthesized
tctatagcttctaaatttgtgt

SEQ ID NO: 1304018 - DNA, 22 bp, Artificial Sequence
  chemically synthesized
ctctatagcttctaaatttgtg

SEQ ID NO: 1304019 - DNA, 22 bp, Artificial Sequence
  chemically synthesized
tctctatagcttctaaatttgt

SEQ ID NO: 1304020 - DNA, 22 bp, Artificial Sequence
  chemically synthesized
ttttctctatagcttctaaatt

SEQ ID NO: 1304021 - DNA, 22 bp, Artificial Sequence
  chemically synthesized
attttctctatagcttctaaat

SEQ ID NO: 1304022 - DNA, 22 bp, Artificial Sequence
  chemically synthesized
tttattttctctatagcttcta

SEQ ID NO: 1304023 - DNA, 22 bp, Artificial Sequence
  chemically synthesized
tatttattttctctatagcttc

SEQ ID NO: 1304024 - DNA, 22 bp, Artificial Sequence
  chemically synthesized
ctatttattttctctatagctt

SEQ ID NO: 1304025 - DNA, 22 bp, Artificial Sequence
  chemically synthesized
tctatttattttctctatagct

SEQ ID NO: 1304026 - DNA, 22 bp, Artificial Sequence
  chemically synthesized
ttttctatttattttctctata

SEQ ID NO: 1304027 - DNA, 22 bp, Artificial Sequence
  chemically synthesized
gttttctatttattttctctat

SEQ ID NO: 1304028 - DNA, 22 bp, Artificial Sequence
  chemically synthesized
tgttttctatttattttctcta

SEQ ID NO: 1304029 - DNA, 22 bp, Artificial Sequence
  chemically synthesized
tttgttttctatttattttctc

SEQ ID NO: 1304030 - DNA, 22 bp, Artificial Sequence
  chemically synthesized
ctttgttttctatttattttct

SEQ ID NO: 1304031 - DNA, 22 bp, Artificial Sequence
  chemically synthesized
agaagctatagagaaaataaat

SEQ ID NO: 1304032 - DNA, 22 bp, Artificial Sequence
  chemically synthesized
gaagctatagagaaaataaata

SEQ ID NO: 1304033 - DNA, 22 bp, Artificial Sequence
  chemically synthesized
tagagaaaataaatagaaaaca

SEQ ID NO: 1304034 - DNA, 22 bp, Artificial Sequence
  chemically synthesized
tcaaaacttctttgttttctat

SEQ ID NO: 1304035 - DNA, 22 bp, Artificial Sequence
  chemically synthesized
gtcaaaacttctttgttttcta

SEQ ID NO: 1304036 - DNA, 22 bp, Artificial Sequence
  chemically synthesized
tgtcaaaacttctttgttttct

SEQ ID NO: 1304037 - DNA, 22 bp, Artificial Sequence
  chemically synthesized
gttttgtcaaaacttctttgtt

SEQ ID NO: 1304038 - DNA, 22 bp, Artificial Sequence
  chemically synthesized
ggttttgtcaaaacttctttgt

SEQ ID NO: 1304039 - DNA, 22 bp, Artificial Sequence
  chemically synthesized
aaagtaaagacagtttggtttt

SEQ ID NO: 1304040 - DNA, 22 bp, Artificial Sequence
  chemically synthesized
taatctaaaagtaaagacagtt

SEQ ID NO: 1304041 - DNA, 22 bp, Artificial Sequence
  chemically synthesized
tgacaaaaccaaactgtcttta

SEQ ID NO: 1304042 - DNA, 22 bp, Artificial Sequence
  chemically synthesized
ataatctaaaagtaaagacagt

SEQ ID NO: 1304043 - DNA, 22 bp, Artificial Sequence
  chemically synthesized
gacaaaaccaaactgtctttac

SEQ ID NO: 1304044 - DNA, 22 bp, Artificial Sequence
  chemically synthesized
tataatctaaaagtaaagacag

SEQ ID NO: 1304045 - DNA, 22 bp, Artificial Sequence
  chemically synthesized
acaaaaccaaactgtctttact

SEQ ID NO: 1304046 - DNA, 22 bp, Artificial Sequence
  chemically synthesized
ttataatctaaaagtaaagaca

SEQ ID NO: 1304047 - DNA, 22 bp, Artificial Sequence
  chemically synthesized
tttttataatctaaaagtaaag

SEQ ID NO: 1304048 - DNA, 22 bp, Artificial Sequence
  chemically synthesized
attgtttttataatctaaaagt

SEQ ID NO: 1304049 - DNA, 22 bp, Artificial Sequence
  chemically synthesized
tctttacttttagattataaaa

SEQ ID NO: 1304050 - DNA, 22 bp, Artificial Sequence
  chemically synthesized
tacttttagattataaaaacaa

SEQ ID NO: 1304051 - DNA, 22 bp, Artificial Sequence
  chemically synthesized
acttttagattataaaaacaat

SEQ ID NO: 1304052 - DNA, 22 bp, Artificial Sequence
  chemically synthesized
cttttagattataaaaacaatc

SEQ ID NO: 1304053 - DNA, 22 bp, Artificial Sequence
  chemically synthesized
ttagattataaaaacaatcaac

SEQ ID NO: 1304054 - DNA, 22 bp, Artificial Sequence
  chemically synthesized
tagattataaaaacaatcaact

SEQ ID NO: 1304055 - DNA, 22 bp, Artificial Sequence
  chemically synthesized
agattataaaaacaatcaactc

SEQ ID NO: 1304056 - DNA, 22 bp, Artificial Sequence
  chemically synthesized
gattataaaaacaatcaactct

SEQ ID NO: 1304057 - DNA, 22 bp, Artificial Sequence
  chemically synthesized
taaaaacaatcaactctttttt

SEQ ID NO: 1304058 - DNA, 22 bp, Artificial Sequence
  chemically synthesized
aagtataataataaaaaaaaga

SEQ ID NO: 1304059 - DNA, 22 bp, Artificial Sequence
  chemically synthesized
aaacctaaagtataataataaa

SEQ ID NO: 1304060 - DNA, 22 bp, Artificial Sequence
  chemically synthesized
ttttttttattattatacttta

SEQ ID NO: 1304061 - DNA, 22 bp, Artificial Sequence
  chemically synthesized
ttttttattattatactttagg

SEQ ID NO: 1304062 - DNA, 22 bp, Artificial Sequence
  chemically synthesized
tttttattattatactttaggt

SEQ ID NO: 1304063 - DNA, 22 bp, Artificial Sequence
  chemically synthesized
ttttattattatactttaggtt

SEQ ID NO: 1304064 - DNA, 22 bp, Artificial Sequence
  chemically synthesized
tttattattatactttaggttt

SEQ ID NO: 1304065 - DNA, 22 bp, Artificial Sequence
  chemically synthesized
ttattattatactttaggtttt

SEQ ID NO: 1304066 - DNA, 22 bp, Artificial Sequence
  chemically synthesized
tattattatactttaggtttta

SEQ ID NO: 1304067 - DNA, 22 bp, Artificial Sequence
  chemically synthesized
attattatactttaggttttag

SEQ ID NO: 1304068 - DNA, 22 bp, Artificial Sequence
  chemically synthesized
tgcacatgtaccctaaaaccta

SEQ ID NO: 1304069 - DNA, 22 bp, Artificial Sequence
  chemically synthesized
ttattatactttaggttttagg

SEQ ID NO: 1304070 - DNA, 22 bp, Artificial Sequence
  chemically synthesized
ttatactttaggttttagggta

SEQ ID NO: 1304071 - DNA, 22 bp, Artificial Sequence
  chemically synthesized
tactttaggttttagggtacat

SEQ ID NO: 1304072 - DNA, 22 bp, Artificial Sequence
  chemically synthesized
cacgttgtgcacatgtacccta

SEQ ID NO: 1304073 - DNA, 22 bp, Artificial Sequence
  chemically synthesized
taggttttagggtacatgtgca

SEQ ID NO: 1304074 - DNA, 22 bp, Artificial Sequence
  chemically synthesized
aggttttagggtacatgtgcac

SEQ ID NO: 1304075 - DNA, 22 bp, Artificial Sequence
  chemically synthesized
ggttttagggtacatgtgcaca

SEQ ID NO: 1304076 - DNA, 22 bp, Artificial Sequence
  chemically synthesized
tagggtacatgtgcacaacgtg

SEQ ID NO: 1304077 - DNA, 22 bp, Artificial Sequence
  chemically synthesized
agggtacatgtgcacaacgtgc

SEQ ID NO: 1304078 - DNA, 22 bp, Artificial Sequence
  chemically synthesized
gggtacatgtgcacaacgtgca

SEQ ID NO: 1304079 - DNA, 22 bp, Artificial Sequence
  chemically synthesized
attacatatgtatacatgtgcc

SEQ ID NO: 1304080 - DNA, 22 bp, Artificial Sequence
  chemically synthesized
ttacatatgtatacatgtgcca

SEQ ID NO: 1304081 - DNA, 22 bp, Artificial Sequence
  chemically synthesized
catatgtatacatgtgccatgt

SEQ ID NO: 1304082 - DNA, 22 bp, Artificial Sequence
  chemically synthesized
atgggtgcagcacaccaacatg

SEQ ID NO: 1304083 - DNA, 22 bp, Artificial Sequence
  chemically synthesized
aatgacgagttaatgggtgcag

SEQ ID NO: 1304084 - DNA, 22 bp, Artificial Sequence
  chemically synthesized
atgttaaatgacgagttaatgg

SEQ ID NO: 1304085 - DNA, 22 bp, Artificial Sequence
  chemically synthesized
gtgtgctgcacccattaactcg

SEQ ID NO: 1304086 - DNA, 22 bp, Artificial Sequence
  chemically synthesized
cacccattaactcgtcatttaa

SEQ ID NO: 1304087 - DNA, 22 bp, Artificial Sequence
  chemically synthesized
ggagatatacctaatgttaaat

SEQ ID NO: 1304088 - DNA, 22 bp, Artificial Sequence
  chemically synthesized
actcgtcatttaacattaggta

SEQ ID NO: 1304089 - DNA, 22 bp, Artificial Sequence
  chemically synthesized
gtcatttaacattaggtatatc

SEQ ID NO: 1304090 - DNA, 22 bp, Artificial Sequence
  chemically synthesized
aacattaggtatatctcctaat

SEQ ID NO: 1304091 - DNA, 22 bp, Artificial Sequence
  chemically synthesized
acattaggtatatctcctaatg

SEQ ID NO: 1304092 - DNA, 22 bp, Artificial Sequence
  chemically synthesized
ggtatatctcctaatgctatcc

SEQ ID NO: 1304093 - DNA, 22 bp, Artificial Sequence
  chemically synthesized
tggggtggggggaggggggagg

SEQ ID NO: 1304094 - DNA, 22 bp, Artificial Sequence
  chemically synthesized
ctaatgctatccctcccccctc

SEQ ID NO: 1304095 - DNA, 22 bp, Artificial Sequence
  chemically synthesized
ttgtggggtggggggagggggg

SEQ ID NO: 1304096 - DNA, 22 bp, Artificial Sequence
  chemically synthesized
atgctatccctcccccctcccc

SEQ ID NO: 1304097 - DNA, 22 bp, Artificial Sequence
  chemically synthesized
tccctcccccctccccccaccc

SEQ ID NO: 1304098 - DNA, 22 bp, Artificial Sequence
  chemically synthesized
ccccctccccccaccccacaac

SEQ ID NO: 1304099 - DNA, 22 bp, Artificial Sequence
  chemically synthesized
acacaccggggcctgttgtggg

SEQ ID NO: 1304100 - DNA, 22 bp, Artificial Sequence
  chemically synthesized
cctcacacaccggggcctgttg

SEQ ID NO: 1304101 - DNA, 22 bp, Artificial Sequence
  chemically synthesized
cccccaccccacaacaggcccc

SEQ ID NO: 1304102 - DNA, 22 bp, Artificial Sequence
  chemically synthesized
attccctcacacaccggggcct

SEQ ID NO: 1304103 - DNA, 22 bp, Artificial Sequence
  chemically synthesized
taattccctcacacaccggggc

SEQ ID NO: 1304104 - DNA, 22 bp, Artificial Sequence
  chemically synthesized
caaaattctaattccctcacac

SEQ ID NO: 1304105 - DNA, 22 bp, Artificial Sequence
  chemically synthesized
cccaaatgaattacaaaattct

SEQ ID NO: 1304106 - DNA, 22 bp, Artificial Sequence
  chemically synthesized
tacccaaatgaattacaaaatt

SEQ ID NO: 1304107 - DNA, 22 bp, Artificial Sequence
  chemically synthesized
ctctacccaaatgaattacaaa

SEQ ID NO: 1304108 - DNA, 22 bp, Artificial Sequence
  chemically synthesized
ctcctctacccaaatgaattac

SEQ ID NO: 1304109 - DNA, 22 bp, Artificial Sequence
  chemically synthesized
gctcctctacccaaatgaatta

SEQ ID NO: 1304110 - DNA, 22 bp, Artificial Sequence
  chemically synthesized
tgctcctctacccaaatgaatt

SEQ ID NO: 1304111 - DNA, 22 bp, Artificial Sequence
  chemically synthesized
ttgctcctctacccaaatgaat

SEQ ID NO: 1304112 - DNA, 22 bp, Artificial Sequence
  chemically synthesized
gaattttgtaattcatttgggt

SEQ ID NO: 1304113 - DNA, 22 bp, Artificial Sequence
  chemically synthesized
tgtaattcatttgggtagagga

SEQ ID NO: 1304114 - DNA, 22 bp, Artificial Sequence
  chemically synthesized
gtaattcatttgggtagaggag

SEQ ID NO: 1304115 - DNA, 22 bp, Artificial Sequence
  chemically synthesized
taattcatttgggtagaggagc

SEQ ID NO: 1304116 - DNA, 22 bp, Artificial Sequence
  chemically synthesized
atatataccttttgctcctcta

SEQ ID NO: 1304117 - DNA, 22 bp, Artificial Sequence
  chemically synthesized
atttgggtagaggagcaaaagg

SEQ ID NO: 1304118 - DNA, 22 bp, Artificial Sequence
  chemically synthesized
agcctaatatataccttttgct

SEQ ID NO: 1304119 - DNA, 22 bp, Artificial Sequence
  chemically synthesized
gggtagaggagcaaaaggtata

SEQ ID NO: 1304120 - DNA, 22 bp, Artificial Sequence
  chemically synthesized
ggtagaggagcaaaaggtatat

SEQ ID NO: 1304121 - DNA, 22 bp, Artificial Sequence
  chemically synthesized
aaaagttgagcctaatatatac

SEQ ID NO: 1304122 - DNA, 22 bp, Artificial Sequence
  chemically synthesized
atcaccgactgaaaagttgagc

SEQ ID NO: 1304123 - DNA, 22 bp, Artificial Sequence
  chemically synthesized
tcatcaccgactgaaaagttga

SEQ ID NO: 1304124 - DNA, 22 bp, Artificial Sequence
  chemically synthesized
tctctcatcaccgactgaaaag

SEQ ID NO: 1304125 - DNA, 22 bp, Artificial Sequence
  chemically synthesized
gtctctcatcaccgactgaaaa

SEQ ID NO: 1304126 - DNA, 22 bp, Artificial Sequence
  chemically synthesized
ggctcaacttttcagtcggtga

SEQ ID NO: 1304127 - DNA, 22 bp, Artificial Sequence
  chemically synthesized
aacttttcagtcggtgatgaga

SEQ ID NO: 1304128 - DNA, 22 bp, Artificial Sequence
  chemically synthesized
ttcagtcggtgatgagagacaa

SEQ ID NO: 1304129 - DNA, 22 bp, Artificial Sequence
  chemically synthesized
tcagtcggtgatgagagacaaa

SEQ ID NO: 1304130 - DNA, 22 bp, Artificial Sequence
  chemically synthesized
cagtcggtgatgagagacaaat

SEQ ID NO: 1304131 - DNA, 22 bp, Artificial Sequence
  chemically synthesized
agtcggtgatgagagacaaatg

SEQ ID NO: 1304132 - DNA, 22 bp, Artificial Sequence
  chemically synthesized
gggtaggtgagagagggcaggg

SEQ ID NO: 1304133 - DNA, 22 bp, Artificial Sequence
  chemically synthesized
actggggtaggtgagagagggc

SEQ ID NO: 1304134 - DNA, 22 bp, Artificial Sequence
  chemically synthesized
ccatccctgccctctctcacct

SEQ ID NO: 1304135 - DNA, 22 bp, Artificial Sequence
  chemically synthesized
gattaactggggtaggtgagag

SEQ ID NO: 1304136 - DNA, 22 bp, Artificial Sequence
  chemically synthesized
agattaactggggtaggtgaga

SEQ ID NO: 1304137 - DNA, 22 bp, Artificial Sequence
  chemically synthesized
ccctctctcacctaccccagtt

SEQ ID NO: 1304138 - DNA, 22 bp, Artificial Sequence
  chemically synthesized
cagatttagattaactggggta

SEQ ID NO: 1304139 - DNA, 22 bp, Artificial Sequence
  chemically synthesized
gcagatttagattaactggggt

SEQ ID NO: 1304140 - DNA, 22 bp, Artificial Sequence
  chemically synthesized
tgcagatttagattaactgggg

SEQ ID NO: 1304141 - DNA, 22 bp, Artificial Sequence
  chemically synthesized
tctcacctaccccagttaatct

SEQ ID NO: 1304142 - DNA, 22 bp, Artificial Sequence
  chemically synthesized
gttttgcagatttagattaact

SEQ ID NO: 1304143 - DNA, 22 bp, Artificial Sequence
  chemically synthesized
tcacctaccccagttaatctaa

SEQ ID NO: 1304144 - DNA, 22 bp, Artificial Sequence
  chemically synthesized
cgttttgcagatttagattaac

SEQ ID NO: 1304145 - DNA, 22 bp, Artificial Sequence
  chemically synthesized
tcgttttgcagatttagattaa

SEQ ID NO: 1304146 - DNA, 22 bp, Artificial Sequence
  chemically synthesized
acctaccccagttaatctaaat

SEQ ID NO: 1304147 - DNA, 22 bp, Artificial Sequence
  chemically synthesized
ctttcgttttgcagatttagat

SEQ ID NO: 1304148 - DNA, 22 bp, Artificial Sequence
  chemically synthesized
ccccagttaatctaaatctgca

SEQ ID NO: 1304149 - DNA, 22 bp, Artificial Sequence
  chemically synthesized
gtggaagctcctttcgttttgc

SEQ ID NO: 1304150 - DNA, 22 bp, Artificial Sequence
  chemically synthesized
atctaaatctgcaaaacgaaag

SEQ ID NO: 1304151 - DNA, 22 bp, Artificial Sequence
  chemically synthesized
gcctagtggaagctcctttcgt

SEQ ID NO: 1304152 - DNA, 22 bp, Artificial Sequence
  chemically synthesized
aatctgcaaaacgaaaggagct

SEQ ID NO: 1304153 - DNA, 22 bp, Artificial Sequence
  chemically synthesized
tggcctagtggaagctcctttc

SEQ ID NO: 1304154 - DNA, 22 bp, Artificial Sequence
  chemically synthesized
caaaacgaaaggagcttccact

SEQ ID NO: 1304155 - DNA, 22 bp, Artificial Sequence
  chemically synthesized
cagcccctctggcctagtggaa

SEQ ID NO: 1304156 - DNA, 22 bp, Artificial Sequence
  chemically synthesized
ccatcctgcagcccctctggcc

SEQ ID NO: 1304157 - DNA, 22 bp, Artificial Sequence
  chemically synthesized
cccatcctgcagcccctctggc

SEQ ID NO: 1304158 - DNA, 22 bp, Artificial Sequence
  chemically synthesized
tcccatcctgcagcccctctgg

SEQ ID NO: 1304159 - DNA, 22 bp, Artificial Sequence
  chemically synthesized
ttttcccatcctgcagcccctc

SEQ ID NO: 1304160 - DNA, 22 bp, Artificial Sequence
  chemically synthesized
ccactaggccagaggggctgca

SEQ ID NO: 1304161 - DNA, 22 bp, Artificial Sequence
  chemically synthesized
cactaggccagaggggctgcag

SEQ ID NO: 1304162 - DNA, 22 bp, Artificial Sequence
  chemically synthesized
attgttttcccatcctgcagcc

SEQ ID NO: 1304163 - DNA, 22 bp, Artificial Sequence
  chemically synthesized
tgattgttttcccatcctgcag

SEQ ID NO: 1304164 - DNA, 22 bp, Artificial Sequence
  chemically synthesized
ggccagaggggctgcaggatgg

SEQ ID NO: 1304165 - DNA, 22 bp, Artificial Sequence
  chemically synthesized
cattctgattgttttcccatcc

SEQ ID NO: 1304166 - DNA, 22 bp, Artificial Sequence
  chemically synthesized
caggatgggaaaacaatcagaa

SEQ ID NO: 1304167 - DNA, 22 bp, Artificial Sequence
  chemically synthesized
taggaacgcccatgaaagtgtt

SEQ ID NO: 1304168 - DNA, 22 bp, Artificial Sequence
  chemically synthesized
gtctgtaggaacgcccatgaaa

SEQ ID NO: 1304169 - DNA, 22 bp, Artificial Sequence
  chemically synthesized
gaagcaaattggtctgtaggaa

SEQ ID NO: 1304170 - DNA, 22 bp, Artificial Sequence
  chemically synthesized
tcatgggcgttcctacagacca

SEQ ID NO: 1304171 - DNA, 22 bp, Artificial Sequence
  chemically synthesized
catgggcgttcctacagaccaa

SEQ ID NO: 1304172 - DNA, 22 bp, Artificial Sequence
  chemically synthesized
actggaagcaaattggtctgta

SEQ ID NO: 1304173 - DNA, 22 bp, Artificial Sequence
  chemically synthesized
atgggcgttcctacagaccaat

SEQ ID NO: 1304174 - DNA, 22 bp, Artificial Sequence
  chemically synthesized
aatgggctgactggaagcaaat

SEQ ID NO: 1304175 - DNA, 22 bp, Artificial Sequence
  chemically synthesized
ctacagaccaatttgcttccag

SEQ ID NO: 1304176 - DNA, 22 bp, Artificial Sequence
  chemically synthesized
cagaccaatttgcttccagtca

SEQ ID NO: 1304177 - DNA, 22 bp, Artificial Sequence
  chemically synthesized
gcttccagtcagcccatttaat

SEQ ID NO: 1304178 - DNA, 22 bp, Artificial Sequence
  chemically synthesized
cttccagtcagcccatttaatt

SEQ ID NO: 1304179 - DNA, 22 bp, Artificial Sequence
  chemically synthesized
ccagtcagcccatttaatttca

SEQ ID NO: 1304180 - DNA, 22 bp, Artificial Sequence
  chemically synthesized
cagtcagcccatttaatttcat

SEQ ID NO: 1304181 - DNA, 22 bp, Artificial Sequence
  chemically synthesized
aacaatcataaatatgaaatta

SEQ ID NO: 1304182 - DNA, 22 bp, Artificial Sequence
  chemically synthesized
aaacaatcataaatatgaaatt

SEQ ID NO: 1304183 - DNA, 22 bp, Artificial Sequence
  chemically synthesized
taaacaatcataaatatgaaat

SEQ ID NO: 1304184 - DNA, 22 bp, Artificial Sequence
  chemically synthesized
ttaaacaatcataaatatgaaa

SEQ ID NO: 1304185 - DNA, 22 bp, Artificial Sequence
  chemically synthesized
ttttaaacaatcataaatatga

SEQ ID NO: 1304186 - DNA, 22 bp, Artificial Sequence
  chemically synthesized
tcttttaaacaatcataaatat

SEQ ID NO: 1304187 - DNA, 22 bp, Artificial Sequence
  chemically synthesized
tctcttttaaacaatcataaat

SEQ ID NO: 1304188 - DNA, 22 bp, Artificial Sequence
  chemically synthesized
aatttcatatttatgattgttt

SEQ ID NO: 1304189 - DNA, 22 bp, Artificial Sequence
  chemically synthesized
atttcatatttatgattgttta

SEQ ID NO: 1304190 - DNA, 22 bp, Artificial Sequence
  chemically synthesized
ggctctctcttttaaacaatca

SEQ ID NO: 1304191 - DNA, 22 bp, Artificial Sequence
  chemically synthesized
catatttatgattgtttaaaag

SEQ ID NO: 1304192 - DNA, 22 bp, Artificial Sequence
  chemically synthesized
atatttatgattgtttaaaaga

SEQ ID NO: 1304193 - DNA, 22 bp, Artificial Sequence
  chemically synthesized
cgcctgggctctctcttttaaa

SEQ ID NO: 1304194 - DNA, 22 bp, Artificial Sequence
  chemically synthesized
atgattgtttaaaagagagagc

SEQ ID NO: 1304195 - DNA, 22 bp, Artificial Sequence
  chemically synthesized
tgattgtttaaaagagagagcc

SEQ ID NO: 1304196 - DNA, 22 bp, Artificial Sequence
  chemically synthesized
tttaaaagagagagcccaggcg

SEQ ID NO: 1304197 - DNA, 22 bp, Artificial Sequence
  chemically synthesized
aaaagagagagcccaggcgcag

SEQ ID NO: 1304198 - DNA, 22 bp, Artificial Sequence
  chemically synthesized
aaagagagagcccaggcgcagt

SEQ ID NO: 1304199 - DNA, 22 bp, Artificial Sequence
  chemically synthesized
caggcatgagccactgcgcctg

SEQ ID NO: 1304200 - DNA, 22 bp, Artificial Sequence
  chemically synthesized
ggattacaggcatgagccactg

SEQ ID NO: 1304201 - DNA, 22 bp, Artificial Sequence
  chemically synthesized
ccaaagtactgggattacaggc

SEQ ID NO: 1304202 - DNA, 22 bp, Artificial Sequence
  chemically synthesized
cccaaagtactgggattacagg

SEQ ID NO: 1304203 - DNA, 22 bp, Artificial Sequence
  chemically synthesized
ggcttcccaaagtactgggatt

SEQ ID NO: 1304204 - DNA, 22 bp, Artificial Sequence
  chemically synthesized
atgcctgtaatcccagtacttt

SEQ ID NO: 1304205 - DNA, 22 bp, Artificial Sequence
  chemically synthesized
cctcggcttcccaaagtactgg

SEQ ID NO: 1304206 - DNA, 22 bp, Artificial Sequence
  chemically synthesized
taatcccagtactttgggaagc

SEQ ID NO: 1304207 - DNA, 22 bp, Artificial Sequence
  chemically synthesized
aagtgatccacctgcctcggct

SEQ ID NO: 1304208 - DNA, 22 bp, Artificial Sequence
  chemically synthesized
acctcaagtgatccacctgcct

SEQ ID NO: 1304209 - DNA, 22 bp, Artificial Sequence
  chemically synthesized
tgggaagccgaggcaggtggat

SEQ ID NO: 1304210 - DNA, 22 bp, Artificial Sequence
  chemically synthesized
gggaagccgaggcaggtggatc

SEQ ID NO: 1304211 - DNA, 22 bp, Artificial Sequence
  chemically synthesized
ctgacctcaagtgatccacctg

SEQ ID NO: 1304212 - DNA, 22 bp, Artificial Sequence
  chemically synthesized
ggaagccgaggcaggtggatca

SEQ ID NO: 1304213 - DNA, 22 bp, Artificial Sequence
  chemically synthesized
aactcctgacctcaagtgatcc

SEQ ID NO: 1304214 - DNA, 22 bp, Artificial Sequence
  chemically synthesized
gaactcctgacctcaagtgatc

SEQ ID NO: 1304215 - DNA, 22 bp, Artificial Sequence
  chemically synthesized
gtcttgaactcctgacctcaag

SEQ ID NO: 1304216 - DNA, 22 bp, Artificial Sequence
  chemically synthesized
gccaggctggtcttgaactcct

SEQ ID NO: 1304217 - DNA, 22 bp, Artificial Sequence
  chemically synthesized
gaggtcaggagttcaagaccag

SEQ ID NO: 1304218 - DNA, 22 bp, Artificial Sequence
  chemically synthesized
aggtcaggagttcaagaccagc

SEQ ID NO: 1304219 - DNA, 22 bp, Artificial Sequence
  chemically synthesized
accacgttggccaggctggtct

SEQ ID NO: 1304220 - DNA, 22 bp, Artificial Sequence
  chemically synthesized
caccacgttggccaggctggtc

SEQ ID NO: 1304221 - DNA, 22 bp, Artificial Sequence
  chemically synthesized
aagaccagcctggccaacgtgg

SEQ ID NO: 1304222 - DNA, 22 bp, Artificial Sequence
  chemically synthesized
gtagagacggggtttcaccacg

SEQ ID NO: 1304223 - DNA, 22 bp, Artificial Sequence
  chemically synthesized
agtagagacggggtttcaccac

SEQ ID NO: 1304224 - DNA, 22 bp, Artificial Sequence
  chemically synthesized
tagtagagacggggtttcacca

SEQ ID NO: 1304225 - DNA, 22 bp, Artificial Sequence
  chemically synthesized
ttagtagagacggggtttcacc

SEQ ID NO: 1304226 - DNA, 22 bp, Artificial Sequence
  chemically synthesized
gccaacgtggtgaaaccccgtc

SEQ ID NO: 1304227 - DNA, 22 bp, Artificial Sequence
  chemically synthesized
tatttttagtagagacggggtt

SEQ ID NO: 1304228 - DNA, 22 bp, Artificial Sequence
  chemically synthesized
gtatttttagtagagacggggt

SEQ ID NO: 1304229 - DNA, 22 bp, Artificial Sequence
  chemically synthesized
tgtatttttagtagagacgggg

SEQ ID NO: 1304230 - DNA, 22 bp, Artificial Sequence
  chemically synthesized
ttgtatttttagtagagacggg

SEQ ID NO: 1304231 - DNA, 22 bp, Artificial Sequence
  chemically synthesized
atttttgtatttttagtagaga

SEQ ID NO: 1304232 - DNA, 22 bp, Artificial Sequence
  chemically synthesized
tactaaaaatacaaaaattagc

SEQ ID NO: 1304233 - DNA, 22 bp, Artificial Sequence
  chemically synthesized
ctaaaaatacaaaaattagccg

SEQ ID NO: 1304234 - DNA, 22 bp, Artificial Sequence
  chemically synthesized
aaaatacaaaaattagccgggc

SEQ ID NO: 1304235 - DNA, 22 bp, Artificial Sequence
  chemically synthesized
caggcatgcaccaccacgcccg

SEQ ID NO: 1304236 - DNA, 22 bp, Artificial Sequence
  chemically synthesized
ggattacaggcatgcaccacca

SEQ ID NO: 1304237 - DNA, 22 bp, Artificial Sequence
  chemically synthesized
gccgggcgtggtggtgcatgcc

SEQ ID NO: 1304238 - DNA, 22 bp, Artificial Sequence
  chemically synthesized
gtagctgggattacaggcatgc

SEQ ID NO: 1304239 - DNA, 22 bp, Artificial Sequence
  chemically synthesized
cctagtagctgggattacaggc

SEQ ID NO: 1304240 - DNA, 22 bp, Artificial Sequence
  chemically synthesized
agcctccctagtagctgggatt

SEQ ID NO: 1304241 - DNA, 22 bp, Artificial Sequence
  chemically synthesized
cctaagcctccctagtagctgg

SEQ ID NO: 1304242 - DNA, 22 bp, Artificial Sequence
  chemically synthesized
ctgcctaagcctccctagtagc

SEQ ID NO: 1304243 - DNA, 22 bp, Artificial Sequence
  chemically synthesized
tcctgcctaagcctccctagta

SEQ ID NO: 1304244 - DNA, 22 bp, Artificial Sequence
  chemically synthesized
taatcccagctactagggaggc

SEQ ID NO: 1304245 - DNA, 22 bp, Artificial Sequence
  chemically synthesized
aagtgattctcctgcctaagcc

SEQ ID NO: 1304246 - DNA, 22 bp, Artificial Sequence
  chemically synthesized
ctagggaggcttaggcaggaga

SEQ ID NO: 1304247 - DNA, 22 bp, Artificial Sequence
  chemically synthesized
gggaggcttaggcaggagaatc

SEQ ID NO: 1304248 - DNA, 22 bp, Artificial Sequence
  chemically synthesized
ccgggttcaagtgattctcctg

SEQ ID NO: 1304249 - DNA, 22 bp, Artificial Sequence
  chemically synthesized
ctcccgggttcaagtgattctc

SEQ ID NO: 1304250 - DNA, 22 bp, Artificial Sequence
  chemically synthesized
ctcctcccgggttcaagtgatt

SEQ ID NO: 1304251 - DNA, 22 bp, Artificial Sequence
  chemically synthesized
aggcaggagaatcacttgaacc

SEQ ID NO: 1304252 - DNA, 22 bp, Artificial Sequence
  chemically synthesized
ggcaggagaatcacttgaaccc

SEQ ID NO: 1304253 - DNA, 22 bp, Artificial Sequence
  chemically synthesized
caacctcctcctcccgggttca

SEQ ID NO: 1304254 - DNA, 22 bp, Artificial Sequence
  chemically synthesized
actgcaacctcctcctcccggg

SEQ ID NO: 1304255 - DNA, 22 bp, Artificial Sequence
  chemically synthesized
agctcactgcaacctcctcctc

SEQ ID NO: 1304256 - DNA, 22 bp, Artificial Sequence
  chemically synthesized
gaacccgggaggaggaggttgc

SEQ ID NO: 1304257 - DNA, 22 bp, Artificial Sequence
  chemically synthesized
aacccgggaggaggaggttgca

SEQ ID NO: 1304258 - DNA, 22 bp, Artificial Sequence
  chemically synthesized
gagtacagtggtgcgatctcag

SEQ ID NO: 1304259 - DNA, 22 bp, Artificial Sequence
  chemically synthesized
cagtgagctgagatcgcaccac

SEQ ID NO: 1304260 - DNA, 22 bp, Artificial Sequence
  chemically synthesized
tcacccaggctggagtacagtg

SEQ ID NO: 1304261 - DNA, 22 bp, Artificial Sequence
  chemically synthesized
tgtcacccaggctggagtacag

SEQ ID NO: 1304262 - DNA, 22 bp, Artificial Sequence
  chemically synthesized
agatcgcaccactgtactccag

SEQ ID NO: 1304263 - DNA, 22 bp, Artificial Sequence
  chemically synthesized
ctctgtcacccaggctggagta

SEQ ID NO: 1304264 - DNA, 22 bp, Artificial Sequence
  chemically synthesized
gctctgtcacccaggctggagt

SEQ ID NO: 1304265 - DNA, 22 bp, Artificial Sequence
  chemically synthesized
ttgctctgtcacccaggctgga

SEQ ID NO: 1304266 - DNA, 22 bp, Artificial Sequence
  chemically synthesized
actcttgctctgtcacccaggc

SEQ ID NO: 1304267 - DNA, 22 bp, Artificial Sequence
  chemically synthesized
tactccagcctgggtgacagag

SEQ ID NO: 1304268 - DNA, 22 bp, Artificial Sequence
  chemically synthesized
agactgactcttgctctgtcac

SEQ ID NO: 1304269 - DNA, 22 bp, Artificial Sequence
  chemically synthesized
gagactgactcttgctctgtca

SEQ ID NO: 1304270 - DNA, 22 bp, Artificial Sequence
  chemically synthesized
tgagactgactcttgctctgtc

SEQ ID NO: 1304271 - DNA, 22 bp, Artificial Sequence
  chemically synthesized
ttgagactgactcttgctctgt

SEQ ID NO: 1304272 - DNA, 22 bp, Artificial Sequence
  chemically synthesized
cagcctgggtgacagagcaaga

SEQ ID NO: 1304273 - DNA, 22 bp, Artificial Sequence
  chemically synthesized
tttgagactgactcttgctctg

SEQ ID NO: 1304274 - DNA, 22 bp, Artificial Sequence
  chemically synthesized
tttttgagactgactcttgctc

SEQ ID NO: 1304275 - DNA, 22 bp, Artificial Sequence
  chemically synthesized
ctttttgagactgactcttgct

SEQ ID NO: 1304276 - DNA, 22 bp, Artificial Sequence
  chemically synthesized
tctttttgagactgactcttgc

SEQ ID NO: 1304277 - DNA, 22 bp, Artificial Sequence
  chemically synthesized
ggtgacagagcaagagtcagtc

SEQ ID NO: 1304278 - DNA, 22 bp, Artificial Sequence
  chemically synthesized
ctttctttttgagactgactct

SEQ ID NO: 1304279 - DNA, 22 bp, Artificial Sequence
  chemically synthesized
gctttctttttgagactgactc

SEQ ID NO: 1304280 - DNA, 22 bp, Artificial Sequence
  chemically synthesized
cttgctttctttttgagactga

SEQ ID NO: 1304281 - DNA, 22 bp, Artificial Sequence
  chemically synthesized
cctccttgctttctttttgaga

SEQ ID NO: 1304282 - DNA, 22 bp, Artificial Sequence
  chemically synthesized
tcccattccctccttgctttct

SEQ ID NO: 1304283 - DNA, 22 bp, Artificial Sequence
  chemically synthesized
tgaattgtcccattccctcctt

SEQ ID NO: 1304284 - DNA, 22 bp, Artificial Sequence
  chemically synthesized
aaaaagaaagcaaggagggaat

SEQ ID NO: 1304285 - DNA, 22 bp, Artificial Sequence
  chemically synthesized
atgaattgtcccattccctcct

SEQ ID NO: 1304286 - DNA, 22 bp, Artificial Sequence
  chemically synthesized
tatgaattgtcccattccctcc

SEQ ID NO: 1304287 - DNA, 22 bp, Artificial Sequence
  chemically synthesized
ttatgaattgtcccattccctc

SEQ ID NO: 1304288 - DNA, 22 bp, Artificial Sequence
  chemically synthesized
cttttatgaattgtcccattcc

SEQ ID NO: 1304289 - DNA, 22 bp, Artificial Sequence
  chemically synthesized
gcttttatgaattgtcccattc

SEQ ID NO: 1304290 - DNA, 22 bp, Artificial Sequence
  chemically synthesized
gggcttgcttttatgaattgtc

SEQ ID NO: 1304291 - DNA, 22 bp, Artificial Sequence
  chemically synthesized
ctggggcttgcttttatgaatt

SEQ ID NO: 1304292 - DNA, 22 bp, Artificial Sequence
  chemically synthesized
gaactgctggggcttgctttta

SEQ ID NO: 1304293 - DNA, 22 bp, Artificial Sequence
  chemically synthesized
actagaactgctggggcttgct

SEQ ID NO: 1304294 - DNA, 22 bp, Artificial Sequence
  chemically synthesized
ataaaagcaagccccagcagtt

SEQ ID NO: 1304295 - DNA, 22 bp, Artificial Sequence
  chemically synthesized
acagttaactagaactgctggg

SEQ ID NO: 1304296 - DNA, 22 bp, Artificial Sequence
  chemically synthesized
agttcacagttaactagaactg

SEQ ID NO: 1304297 - DNA, 22 bp, Artificial Sequence
  chemically synthesized
gttcagttcacagttaactaga

SEQ ID NO: 1304298 - DNA, 22 bp, Artificial Sequence
  chemically synthesized
ctggttcagttcacagttaact

SEQ ID NO: 1304299 - DNA, 22 bp, Artificial Sequence
  chemically synthesized
actggttcagttcacagttaac

SEQ ID NO: 1304300 - DNA, 22 bp, Artificial Sequence
  chemically synthesized
tagttaactgtgaactgaacca

SEQ ID NO: 1304301 - DNA, 22 bp, Artificial Sequence
  chemically synthesized
gttaactgtgaactgaaccagt

SEQ ID NO: 1304302 - DNA, 22 bp, Artificial Sequence
  chemically synthesized
actgtgaactgaaccagtaaga

SEQ ID NO: 1304303 - DNA, 22 bp, Artificial Sequence
  chemically synthesized
aatcaatgtgcatcttactggt

SEQ ID NO: 1304304 - DNA, 22 bp, Artificial Sequence
  chemically synthesized
tgaactgaaccagtaagatgca

SEQ ID NO: 1304305 - DNA, 22 bp, Artificial Sequence
  chemically synthesized
cgaagttaaatcaatgtgcatc

SEQ ID NO: 1304306 - DNA, 22 bp, Artificial Sequence
  chemically synthesized
ccgaagttaaatcaatgtgcat

SEQ ID NO: 1304307 - DNA, 22 bp, Artificial Sequence
  chemically synthesized
aaccagtaagatgcacattgat

SEQ ID NO: 1304308 - DNA, 22 bp, Artificial Sequence
  chemically synthesized
tttccgaagttaaatcaatgtg

SEQ ID NO: 1304309 - DNA, 22 bp, Artificial Sequence
  chemically synthesized
atttaacttcggaaataattta

SEQ ID NO: 1304310 - DNA, 22 bp, Artificial Sequence
  chemically synthesized
agaaaccagcacataaattatt

SEQ ID NO: 1304311 - DNA, 22 bp, Artificial Sequence
  chemically synthesized
aagaaaccagcacataaattat

SEQ ID NO: 1304312 - DNA, 22 bp, Artificial Sequence
  chemically synthesized
aacttcggaaataatttatgtg

SEQ ID NO: 1304313 - DNA, 22 bp, Artificial Sequence
  chemically synthesized
acttcggaaataatttatgtgc

SEQ ID NO: 1304314 - DNA, 22 bp, Artificial Sequence
  chemically synthesized
cggaaataatttatgtgctggt

SEQ ID NO: 1304315 - DNA, 22 bp, Artificial Sequence
  chemically synthesized
ggaaataatttatgtgctggtt

SEQ ID NO: 1304316 - DNA, 22 bp, Artificial Sequence
  chemically synthesized
atgtgctggtttcttaaatgac

SEQ ID NO: 1304317 - DNA, 22 bp, Artificial Sequence
  chemically synthesized
tgtgctggtttcttaaatgact

SEQ ID NO: 1304318 - DNA, 22 bp, Artificial Sequence
  chemically synthesized
gtttcttaaatgactgctacat

SEQ ID NO: 1304319 - DNA, 22 bp, Artificial Sequence
  chemically synthesized
cttaaatgactgctacatattg

SEQ ID NO: 1304320 - DNA, 22 bp, Artificial Sequence
  chemically synthesized
ttaaatgactgctacatattgc

SEQ ID NO: 1304321 - DNA, 22 bp, Artificial Sequence
  chemically synthesized
aaatgactgctacatattgcct

SEQ ID NO: 1304322 - DNA, 22 bp, Artificial Sequence
  chemically synthesized
aatgactgctacatattgcctt

SEQ ID NO: 1304323 - DNA, 22 bp, Artificial Sequence
  chemically synthesized
catcgtcaggtaagaaggcaat

SEQ ID NO: 1304324 - DNA, 22 bp, Artificial Sequence
  chemically synthesized
cactccatcgtcaggtaagaag

SEQ ID NO: 1304325 - DNA, 22 bp, Artificial Sequence
  chemically synthesized
ctacatattgccttcttacctg

SEQ ID NO: 1304326 - DNA, 22 bp, Artificial Sequence
  chemically synthesized
tgcactccatcgtcaggtaaga

SEQ ID NO: 1304327 - DNA, 22 bp, Artificial Sequence
  chemically synthesized
catattgccttcttacctgacg

SEQ ID NO: 1304328 - DNA, 22 bp, Artificial Sequence
  chemically synthesized
ccttcttacctgacgatggagt

SEQ ID NO: 1304329 - DNA, 22 bp, Artificial Sequence
  chemically synthesized
tccccatattctgcactccatc

SEQ ID NO: 1304330 - DNA, 22 bp, Artificial Sequence
  chemically synthesized
gtccccatattctgcactccat

SEQ ID NO: 1304331 - DNA, 22 bp, Artificial Sequence
  chemically synthesized
cttacctgacgatggagtgcag

SEQ ID NO: 1304332 - DNA, 22 bp, Artificial Sequence
  chemically synthesized
tgtccccatattctgcactcca

SEQ ID NO: 1304333 - DNA, 22 bp, Artificial Sequence
  chemically synthesized
ttacctgacgatggagtgcaga

SEQ ID NO: 1304334 - DNA, 22 bp, Artificial Sequence
  chemically synthesized
ttgtccccatattctgcactcc

SEQ ID NO: 1304335 - DNA, 22 bp, Artificial Sequence
  chemically synthesized
acctgacgatggagtgcagaat

SEQ ID NO: 1304336 - DNA, 22 bp, Artificial Sequence
  chemically synthesized
cctgacgatggagtgcagaata

SEQ ID NO: 1304337 - DNA, 22 bp, Artificial Sequence
  chemically synthesized
tttttgtccccatattctgcac

SEQ ID NO: 1304338 - DNA, 22 bp, Artificial Sequence
  chemically synthesized
atttttgtccccatattctgca

SEQ ID NO: 1304339 - DNA, 22 bp, Artificial Sequence
  chemically synthesized
ttatttttgtccccatattctg

SEQ ID NO: 1304340 - DNA, 22 bp, Artificial Sequence
  chemically synthesized
acgatggagtgcagaatatggg

SEQ ID NO: 1304341 - DNA, 22 bp, Artificial Sequence
  chemically synthesized
ctcttatttttgtccccatatt

SEQ ID NO: 1304342 - DNA, 22 bp, Artificial Sequence
  chemically synthesized
gaattgctcttatttttgtccc

SEQ ID NO: 1304343 - DNA, 22 bp, Artificial Sequence
  chemically synthesized
ggaattgctcttatttttgtcc

SEQ ID NO: 1304344 - DNA, 22 bp, Artificial Sequence
  chemically synthesized
cttggaattgctcttatttttg

SEQ ID NO: 1304345 - DNA, 22 bp, Artificial Sequence
  chemically synthesized
ccttggaattgctcttattttt

SEQ ID NO: 1304346 - DNA, 22 bp, Artificial Sequence
  chemically synthesized
gggcataaagcatttccttgga

SEQ ID NO: 1304347 - DNA, 22 bp, Artificial Sequence
  chemically synthesized
gcactcgggcataaagcatttc

SEQ ID NO: 1304348 - DNA, 22 bp, Artificial Sequence
  chemically synthesized
aattagcactcgggcataaagc

SEQ ID NO: 1304349 - DNA, 22 bp, Artificial Sequence
  chemically synthesized
tgaattagcactcgggcataaa

SEQ ID NO: 1304350 - DNA, 22 bp, Artificial Sequence
  chemically synthesized
caaggaaatgctttatgcccga

SEQ ID NO: 1304351 - DNA, 22 bp, Artificial Sequence
  chemically synthesized
agtatggttctgaattagcact

SEQ ID NO: 1304352 - DNA, 22 bp, Artificial Sequence
  chemically synthesized
cagtatggttctgaattagcac

SEQ ID NO: 1304353 - DNA, 22 bp, Artificial Sequence
  chemically synthesized
tcagtatggttctgaattagca

SEQ ID NO: 1304354 - DNA, 22 bp, Artificial Sequence
  chemically synthesized
ttcagtatggttctgaattagc

SEQ ID NO: 1304355 - DNA, 22 bp, Artificial Sequence
  chemically synthesized
tatgcccgagtgctaattcaga

SEQ ID NO: 1304356 - DNA, 22 bp, Artificial Sequence
  chemically synthesized
tttcagtatggttctgaattag

SEQ ID NO: 1304357 - DNA, 22 bp, Artificial Sequence
  chemically synthesized
atgcccgagtgctaattcagaa

SEQ ID NO: 1304358 - DNA, 22 bp, Artificial Sequence
  chemically synthesized
tgcccgagtgctaattcagaac

SEQ ID NO: 1304359 - DNA, 22 bp, Artificial Sequence
  chemically synthesized
ctttttcagtatggttctgaat

SEQ ID NO: 1304360 - DNA, 22 bp, Artificial Sequence
  chemically synthesized
catctcctttttcagtatggtt

SEQ ID NO: 1304361 - DNA, 22 bp, Artificial Sequence
  chemically synthesized
gcatctcctttttcagtatggt

SEQ ID NO: 1304362 - DNA, 22 bp, Artificial Sequence
  chemically synthesized
ttgcatctcctttttcagtatg

SEQ ID NO: 1304363 - DNA, 22 bp, Artificial Sequence
  chemically synthesized
tcttgcatctcctttttcagta

SEQ ID NO: 1304364 - DNA, 22 bp, Artificial Sequence
  chemically synthesized
attcagaaccatactgaaaaag

SEQ ID NO: 1304365 - DNA, 22 bp, Artificial Sequence
  chemically synthesized
agaaccatactgaaaaaggaga

SEQ ID NO: 1304366 - DNA, 22 bp, Artificial Sequence
  chemically synthesized
agcattctcttgcatctccttt

SEQ ID NO: 1304367 - DNA, 22 bp, Artificial Sequence
  chemically synthesized
cgctgagcattctcttgcatct

SEQ ID NO: 1304368 - DNA, 22 bp, Artificial Sequence
  chemically synthesized
aaaaaggagatgcaagagaatg

SEQ ID NO: 1304369 - DNA, 22 bp, Artificial Sequence
  chemically synthesized
gaatctacgctgagcattctct

SEQ ID NO: 1304370 - DNA, 22 bp, Artificial Sequence
  chemically synthesized
aggatggcctagaatctacgct

SEQ ID NO: 1304371 - DNA, 22 bp, Artificial Sequence
  chemically synthesized
aaggatggcctagaatctacgc

SEQ ID NO: 1304372 - DNA, 22 bp, Artificial Sequence
  chemically synthesized
tttaaggatggcctagaatcta

SEQ ID NO: 1304373 - DNA, 22 bp, Artificial Sequence
  chemically synthesized
gattgtttaaggatggcctaga

SEQ ID NO: 1304374 - DNA, 22 bp, Artificial Sequence
  chemically synthesized
tggattgtttaaggatggccta

SEQ ID NO: 1304375 - DNA, 22 bp, Artificial Sequence
  chemically synthesized
agcgtagattctaggccatcct

SEQ ID NO: 1304376 - DNA, 22 bp, Artificial Sequence
  chemically synthesized
agctctggattgtttaaggatg

SEQ ID NO: 1304377 - DNA, 22 bp, Artificial Sequence
  chemically synthesized
cagctctggattgtttaaggat

SEQ ID NO: 1304378 - DNA, 22 bp, Artificial Sequence
  chemically synthesized
ttcagctctggattgtttaagg

SEQ ID NO: 1304379 - DNA, 22 bp, Artificial Sequence
  chemically synthesized
taggccatccttaaacaatcca

SEQ ID NO: 1304380 - DNA, 22 bp, Artificial Sequence
  chemically synthesized
ggccatccttaaacaatccaga

SEQ ID NO: 1304381 - DNA, 22 bp, Artificial Sequence
  chemically synthesized
aatacggctcttcagctctgga

SEQ ID NO: 1304382 - DNA, 22 bp, Artificial Sequence
  chemically synthesized
tgaatacggctcttcagctctg

SEQ ID NO: 1304383 - DNA, 22 bp, Artificial Sequence
  chemically synthesized
aaacaatccagagctgaagagc

SEQ ID NO: 1304384 - DNA, 22 bp, Artificial Sequence
  chemically synthesized
tctctgaatacggctcttcagc

SEQ ID NO: 1304385 - DNA, 22 bp, Artificial Sequence
  chemically synthesized
aacaatccagagctgaagagcc

SEQ ID NO: 1304386 - DNA, 22 bp, Artificial Sequence
  chemically synthesized
atctctgaatacggctcttcag

SEQ ID NO: 1304387 - DNA, 22 bp, Artificial Sequence
  chemically synthesized
aagagccgtattcagagataaa

SEQ ID NO: 1304388 - DNA, 22 bp, Artificial Sequence
  chemically synthesized
aacgcagaataaatttatctct

SEQ ID NO: 1304389 - DNA, 22 bp, Artificial Sequence
  chemically synthesized
agagataaatttattctgcgtt

SEQ ID NO: 1304390 - DNA, 22 bp, Artificial Sequence
  chemically synthesized
attctgcgttcaatgtttcttg

SEQ ID NO: 1304391 - DNA, 22 bp, Artificial Sequence
  chemically synthesized
cgagaagtaggtcaagaaacat

SEQ ID NO: 1304392 - DNA, 22 bp, Artificial Sequence
  chemically synthesized
ttctgcgttcaatgtttcttga

SEQ ID NO: 1304393 - DNA, 22 bp, Artificial Sequence
  chemically synthesized
acgagaagtaggtcaagaaaca

SEQ ID NO: 1304394 - DNA, 22 bp, Artificial Sequence
  chemically synthesized
tgcgttcaatgtttcttgacct

SEQ ID NO: 1304395 - DNA, 22 bp, Artificial Sequence
  chemically synthesized
cttacgagaagtaggtcaagaa

SEQ ID NO: 1304396 - DNA, 22 bp, Artificial Sequence
  chemically synthesized
ccttacgagaagtaggtcaaga

SEQ ID NO: 1304397 - DNA, 22 bp, Artificial Sequence
  chemically synthesized
cgttcaatgtttcttgacctac

SEQ ID NO: 1304398 - DNA, 22 bp, Artificial Sequence
  chemically synthesized
tccttacgagaagtaggtcaag

SEQ ID NO: 1304399 - DNA, 22 bp, Artificial Sequence
  chemically synthesized
aatgtttcttgacctacttctc

SEQ ID NO: 1304400 - DNA, 22 bp, Artificial Sequence
  chemically synthesized
aggcagaattttccttacgaga

SEQ ID NO: 1304401 - DNA, 22 bp, Artificial Sequence
  chemically synthesized
cttgacctacttctcgtaagga

SEQ ID NO: 1304402 - DNA, 22 bp, Artificial Sequence
  chemically synthesized
ttgacctacttctcgtaaggaa

SEQ ID NO: 1304403 - DNA, 22 bp, Artificial Sequence
  chemically synthesized
gacctacttctcgtaaggaaaa

SEQ ID NO: 1304404 - DNA, 22 bp, Artificial Sequence
  chemically synthesized
acctacttctcgtaaggaaaat

SEQ ID NO: 1304405 - DNA, 22 bp, Artificial Sequence
  chemically synthesized
gtattcaggcagaattttcctt

SEQ ID NO: 1304406 - DNA, 22 bp, Artificial Sequence
  chemically synthesized
tggtattcaggcagaattttcc

SEQ ID NO: 1304407 - DNA, 22 bp, Artificial Sequence
  chemically synthesized
ctggtattcaggcagaattttc

SEQ ID NO: 1304408 - DNA, 22 bp, Artificial Sequence
  chemically synthesized
cttctcgtaaggaaaattctgc

SEQ ID NO: 1304409 - DNA, 22 bp, Artificial Sequence
  chemically synthesized
cttctggtattcaggcagaatt

SEQ ID NO: 1304410 - DNA, 22 bp, Artificial Sequence
  chemically synthesized
ctcgtaaggaaaattctgcctg

SEQ ID NO: 1304411 - DNA, 22 bp, Artificial Sequence
  chemically synthesized
tcgtaaggaaaattctgcctga

SEQ ID NO: 1304412 - DNA, 22 bp, Artificial Sequence
  chemically synthesized
gtaaggaaaattctgcctgaat

SEQ ID NO: 1304413 - DNA, 22 bp, Artificial Sequence
  chemically synthesized
tgcctgaataccagaaggaatt

SEQ ID NO: 1304414 - DNA, 22 bp, Artificial Sequence
  chemically synthesized
aagtgaaaaatgaattccttct

SEQ ID NO: 1304415 - DNA, 22 bp, Artificial Sequence
  chemically synthesized
cctgaataccagaaggaattca

SEQ ID NO: 1304416 - DNA, 22 bp, Artificial Sequence
  chemically synthesized
aataccagaaggaattcatttt

SEQ ID NO: 1304417 - DNA, 22 bp, Artificial Sequence
  chemically synthesized
aagctaaagtgaaaaatgaatt

SEQ ID NO: 1304418 - DNA, 22 bp, Artificial Sequence
  chemically synthesized
caagctaaagtgaaaaatgaat

SEQ ID NO: 1304419 - DNA, 22 bp, Artificial Sequence
  chemically synthesized
aggtaaatttcaagctaaagtg

SEQ ID NO: 1304420 - DNA, 22 bp, Artificial Sequence
  chemically synthesized
aaggtaaatttcaagctaaagt

SEQ ID NO: 1304421 - DNA, 22 bp, Artificial Sequence
  chemically synthesized
tcttaaggtaaatttcaagcta

SEQ ID NO: 1304422 - DNA, 22 bp, Artificial Sequence
  chemically synthesized
atttttcactttagcttgaaat

SEQ ID NO: 1304423 - DNA, 22 bp, Artificial Sequence
  chemically synthesized
atcttaaggtaaatttcaagct

SEQ ID NO: 1304424 - DNA, 22 bp, Artificial Sequence
  chemically synthesized
tatcttaaggtaaatttcaagc

SEQ ID NO: 1304425 - DNA, 22 bp, Artificial Sequence
  chemically synthesized
ttcactttagcttgaaatttac

SEQ ID NO: 1304426 - DNA, 22 bp, Artificial Sequence
  chemically synthesized
tcactttagcttgaaatttacc

SEQ ID NO: 1304427 - DNA, 22 bp, Artificial Sequence
  chemically synthesized
cactttagcttgaaatttacct

SEQ ID NO: 1304428 - DNA, 22 bp, Artificial Sequence
  chemically synthesized
tgttttatcttaaggtaaattt

SEQ ID NO: 1304429 - DNA, 22 bp, Artificial Sequence
  chemically synthesized
actttagcttgaaatttacctt

SEQ ID NO: 1304430 - DNA, 22 bp, Artificial Sequence
  chemically synthesized
ttgtgttttatcttaaggtaaa

SEQ ID NO: 1304431 - DNA, 22 bp, Artificial Sequence
  chemically synthesized
tagcttgaaatttaccttaaga

SEQ ID NO: 1304432 - DNA, 22 bp, Artificial Sequence
  chemically synthesized
agcttgaaatttaccttaagat

SEQ ID NO: 1304433 - DNA, 22 bp, Artificial Sequence
  chemically synthesized
gcttgaaatttaccttaagata

SEQ ID NO: 1304434 - DNA, 22 bp, Artificial Sequence
  chemically synthesized
gaaatttaccttaagataaaac

SEQ ID NO: 1304435 - DNA, 22 bp, Artificial Sequence
  chemically synthesized
tacaactattgtgttttatctt

SEQ ID NO: 1304436 - DNA, 22 bp, Artificial Sequence
  chemically synthesized
aaatttaccttaagataaaaca

SEQ ID NO: 1304437 - DNA, 22 bp, Artificial Sequence
  chemically synthesized
atacaactattgtgttttatct

SEQ ID NO: 1304438 - DNA, 22 bp, Artificial Sequence
  chemically synthesized
tatacaactattgtgttttatc

SEQ ID NO: 1304439 - DNA, 22 bp, Artificial Sequence
  chemically synthesized
ttatacaactattgtgttttat

SEQ ID NO: 1304440 - DNA, 22 bp, Artificial Sequence
  chemically synthesized
accttaagataaaacacaatag

SEQ ID NO: 1304441 - DNA, 22 bp, Artificial Sequence
  chemically synthesized
ccttaagataaaacacaatagt

SEQ ID NO: 1304442 - DNA, 22 bp, Artificial Sequence
  chemically synthesized
aagataaaacacaatagttgta

SEQ ID NO: 1304443 - DNA, 22 bp, Artificial Sequence
  chemically synthesized
agataaaacacaatagttgtat

SEQ ID NO: 1304444 - DNA, 22 bp, Artificial Sequence
  chemically synthesized
tatgcataaccaaataaggcat

SEQ ID NO: 1304445 - DNA, 22 bp, Artificial Sequence
  chemically synthesized
atatgcataaccaaataaggca

SEQ ID NO: 1304446 - DNA, 22 bp, Artificial Sequence
  chemically synthesized
tatatgcataaccaaataaggc

SEQ ID NO: 1304447 - DNA, 22 bp, Artificial Sequence
  chemically synthesized
tataaaaatatgccttatttgg

SEQ ID NO: 1304448 - DNA, 22 bp, Artificial Sequence
  chemically synthesized
ctttatatgcataaccaaataa

SEQ ID NO: 1304449 - DNA, 22 bp, Artificial Sequence
  chemically synthesized
ggtctgctttatatgcataacc

SEQ ID NO: 1304450 - DNA, 22 bp, Artificial Sequence
  chemically synthesized
gggtctgctttatatgcataac

SEQ ID NO: 1304451 - DNA, 22 bp, Artificial Sequence
  chemically synthesized
ttgggtctgctttatatgcata

SEQ ID NO: 1304452 - DNA, 22 bp, Artificial Sequence
  chemically synthesized
atttggttatgcatataaagca

SEQ ID NO: 1304453 - DNA, 22 bp, Artificial Sequence
  chemically synthesized
tttggttatgcatataaagcag

SEQ ID NO: 1304454 - DNA, 22 bp, Artificial Sequence
  chemically synthesized
ggttatgcatataaagcagacc

SEQ ID NO: 1304455 - DNA, 22 bp, Artificial Sequence
  chemically synthesized
gttatgcatataaagcagaccc

SEQ ID NO: 1304456 - DNA, 22 bp, Artificial Sequence
  chemically synthesized
ccccaaatcctcttgggtctgc

SEQ ID NO: 1304457 - DNA, 22 bp, Artificial Sequence
  chemically synthesized
accccaaatcctcttgggtctg

SEQ ID NO: 1304458 - DNA, 22 bp, Artificial Sequence
  chemically synthesized
tgcatataaagcagacccaaga

SEQ ID NO: 1304459 - DNA, 22 bp, Artificial Sequence
  chemically synthesized
taccccaaatcctcttgggtct

SEQ ID NO: 1304460 - DNA, 22 bp, Artificial Sequence
  chemically synthesized
tgaaatattttaccccaaatcc

SEQ ID NO: 1304461 - DNA, 22 bp, Artificial Sequence
  chemically synthesized
atgaaatattttaccccaaatc

SEQ ID NO: 1304462 - DNA, 22 bp, Artificial Sequence
  chemically synthesized
atgcatagtacaacttatgaaa

SEQ ID NO: 1304463 - DNA, 22 bp, Artificial Sequence
  chemically synthesized
ggggtaaaatatttcataagtt

SEQ ID NO: 1304464 - DNA, 22 bp, Artificial Sequence
  chemically synthesized
gggtaaaatatttcataagttg

SEQ ID NO: 1304465 - DNA, 22 bp, Artificial Sequence
  chemically synthesized
tattcatgcatagtacaactta

SEQ ID NO: 1304466 - DNA, 22 bp, Artificial Sequence
  chemically synthesized
atattcatgcatagtacaactt

SEQ ID NO: 1304467 - DNA, 22 bp, Artificial Sequence
  chemically synthesized
tatattcatgcatagtacaact

SEQ ID NO: 1304468 - DNA, 22 bp, Artificial Sequence
  chemically synthesized
ttatattcatgcatagtacaac

SEQ ID NO: 1304469 - DNA, 22 bp, Artificial Sequence
  chemically synthesized
tttatattcatgcatagtacaa

SEQ ID NO: 1304470 - DNA, 22 bp, Artificial Sequence
  chemically synthesized
attttttatattcatgcatagt

SEQ ID NO: 1304471 - DNA, 22 bp, Artificial Sequence
  chemically synthesized
cataagttgtactatgcatgaa

SEQ ID NO: 1304472 - DNA, 22 bp, Artificial Sequence
  chemically synthesized
tcattttttatattcatgcata

SEQ ID NO: 1304473 - DNA, 22 bp, Artificial Sequence
  chemically synthesized
ataagttgtactatgcatgaat

SEQ ID NO: 1304474 - DNA, 22 bp, Artificial Sequence
  chemically synthesized
ctcattttttatattcatgcat

SEQ ID NO: 1304475 - DNA, 22 bp, Artificial Sequence
  chemically synthesized
tttctcattttttatattcatg

SEQ ID NO: 1304476 - DNA, 22 bp, Artificial Sequence
  chemically synthesized
gtttctcattttttatattcat

SEQ ID NO: 1304477 - DNA, 22 bp, Artificial Sequence
  chemically synthesized
tgtttctcattttttatattca

SEQ ID NO: 1304478 - DNA, 22 bp, Artificial Sequence
  chemically synthesized
ttgtttctcattttttatattc

SEQ ID NO: 1304479 - DNA, 22 bp, Artificial Sequence
  chemically synthesized
tactatgcatgaatataaaaaa

SEQ ID NO: 1304480 - DNA, 22 bp, Artificial Sequence
  chemically synthesized
tccttttgtttctcatttttta

SEQ ID NO: 1304481 - DNA, 22 bp, Artificial Sequence
  chemically synthesized
tgcatgaatataaaaaatgaga

SEQ ID NO: 1304482 - DNA, 22 bp, Artificial Sequence
  chemically synthesized
actatccttttgtttctcattt

SEQ ID NO: 1304483 - DNA, 22 bp, Artificial Sequence
  chemically synthesized
ctaactatccttttgtttctca

SEQ ID NO: 1304484 - DNA, 22 bp, Artificial Sequence
  chemically synthesized
actaactatccttttgtttctc

SEQ ID NO: 1304485 - DNA, 22 bp, Artificial Sequence
  chemically synthesized
tactaactatccttttgtttct

SEQ ID NO: 1304486 - DNA, 22 bp, Artificial Sequence
  chemically synthesized
ttactaactatccttttgtttc

SEQ ID NO: 1304487 - DNA, 22 bp, Artificial Sequence
  chemically synthesized
aacagccttttactaactatcc

SEQ ID NO: 1304488 - DNA, 22 bp, Artificial Sequence
  chemically synthesized
ggactgaacagccttttactaa

SEQ ID NO: 1304489 - DNA, 22 bp, Artificial Sequence
  chemically synthesized
gggactgaacagccttttacta

SEQ ID NO: 1304490 - DNA, 22 bp, Artificial Sequence
  chemically synthesized
tttgggactgaacagcctttta

SEQ ID NO: 1304491 - DNA, 22 bp, Artificial Sequence
  chemically synthesized
atttgggactgaacagcctttt

SEQ ID NO: 1304492 - DNA, 22 bp, Artificial Sequence
  chemically synthesized
tatttgggactgaacagccttt

SEQ ID NO: 1304493 - DNA, 22 bp, Artificial Sequence
  chemically synthesized
ctttatttgggactgaacagcc

SEQ ID NO: 1304494 - DNA, 22 bp, Artificial Sequence
  chemically synthesized
ctcctttatttgggactgaaca

SEQ ID NO: 1304495 - DNA, 22 bp, Artificial Sequence
  chemically synthesized
gtaaaaggctgttcagtcccaa

SEQ ID NO: 1304496 - DNA, 22 bp, Artificial Sequence
  chemically synthesized
ttcagtcccaaataaaggagta

SEQ ID NO: 1304497 - DNA, 22 bp, Artificial Sequence
  chemically synthesized
gcatatcaacaattactccttt

SEQ ID NO: 1304498 - DNA, 22 bp, Artificial Sequence
  chemically synthesized
agcatatcaacaattactcctt

SEQ ID NO: 1304499 - DNA, 22 bp, Artificial Sequence
  chemically synthesized
agtcccaaataaaggagtaatt

SEQ ID NO: 1304500 - DNA, 22 bp, Artificial Sequence
  chemically synthesized
tttagcatatcaacaattactc

SEQ ID NO: 1304501 - DNA, 22 bp, Artificial Sequence
  chemically synthesized
atttagcatatcaacaattact

SEQ ID NO: 1304502 - DNA, 22 bp, Artificial Sequence
  chemically synthesized
tatttagcatatcaacaattac

SEQ ID NO: 1304503 - DNA, 22 bp, Artificial Sequence
  chemically synthesized
ttatttagcatatcaacaatta

SEQ ID NO: 1304504 - DNA, 22 bp, Artificial Sequence
  chemically synthesized
cccaccccccttttatttagca

SEQ ID NO: 1304505 - DNA, 22 bp, Artificial Sequence
  chemically synthesized
ccccaccccccttttatttagc

SEQ ID NO: 1304506 - DNA, 22 bp, Artificial Sequence
  chemically synthesized
tccccaccccccttttatttag

SEQ ID NO: 1304507 - DNA, 22 bp, Artificial Sequence
  chemically synthesized
ttgatatgctaaataaaagggg

SEQ ID NO: 1304508 - DNA, 22 bp, Artificial Sequence
  chemically synthesized
atatgctaaataaaaggggggt

SEQ ID NO: 1304509 - DNA, 22 bp, Artificial Sequence
  chemically synthesized
taaaaaaaggactttccccacc

SEQ ID NO: 1304510 - DNA, 22 bp, Artificial Sequence
  chemically synthesized
aataaaaggggggtggggaaag

SEQ ID NO: 1304511 - DNA, 22 bp, Artificial Sequence
  chemically synthesized
gtaaaaaaaggactttccccac

SEQ ID NO: 1304512 - DNA, 22 bp, Artificial Sequence
  chemically synthesized
ccttgtaaaaaaaggactttcc

SEQ ID NO: 1304513 - DNA, 22 bp, Artificial Sequence
  chemically synthesized
acattcccttgtaaaaaaagga

SEQ ID NO: 1304514 - DNA, 22 bp, Artificial Sequence
  chemically synthesized
ctcacattcccttgtaaaaaaa

SEQ ID NO: 1304515 - DNA, 22 bp, Artificial Sequence
  chemically synthesized
cctcacattcccttgtaaaaaa

SEQ ID NO: 1304516 - DNA, 22 bp, Artificial Sequence
  chemically synthesized
ccttcctcacattcccttgtaa

SEQ ID NO: 1304517 - DNA, 22 bp, Artificial Sequence
  chemically synthesized
tttttacaagggaatgtgagga

SEQ ID NO: 1304518 - DNA, 22 bp, Artificial Sequence
  chemically synthesized
ttttacaagggaatgtgaggaa

SEQ ID NO: 1304519 - DNA, 22 bp, Artificial Sequence
  chemically synthesized
tttacaagggaatgtgaggaag

SEQ ID NO: 1304520 - DNA, 22 bp, Artificial Sequence
  chemically synthesized
ttacaagggaatgtgaggaagg

SEQ ID NO: 1304521 - DNA, 22 bp, Artificial Sequence
  chemically synthesized
tacaagggaatgtgaggaaggg

SEQ ID NO: 1304522 - DNA, 22 bp, Artificial Sequence
  chemically synthesized
acaagggaatgtgaggaaggga

SEQ ID NO: 1304523 - DNA, 22 bp, Artificial Sequence
  chemically synthesized
caagggaatgtgaggaagggaa

SEQ ID NO: 1304524 - DNA, 22 bp, Artificial Sequence
  chemically synthesized
aacaaatgtgagttcccttcct

SEQ ID NO: 1304525 - DNA, 22 bp, Artificial Sequence
  chemically synthesized
aatgcaaaatacagcctcaaca

SEQ ID NO: 1304526 - DNA, 22 bp, Artificial Sequence
  chemically synthesized
acatttgttgaggctgtatttt

SEQ ID NO: 1304527 - DNA, 22 bp, Artificial Sequence
  chemically synthesized
tgaggattaaatgcaaaataca

SEQ ID NO: 1304528 - DNA, 22 bp, Artificial Sequence
  chemically synthesized
gttgaggctgtattttgcattt

SEQ ID NO: 1304529 - DNA, 22 bp, Artificial Sequence
  chemically synthesized
gttgtgaggattaaatgcaaaa

SEQ ID NO: 1304530 - DNA, 22 bp, Artificial Sequence
  chemically synthesized
ttgaggctgtattttgcattta

SEQ ID NO: 1304531 - DNA, 22 bp, Artificial Sequence
  chemically synthesized
aggctgtattttgcatttaatc

SEQ ID NO: 1304532 - DNA, 22 bp, Artificial Sequence
  chemically synthesized
agcctagttgtgaggattaaat

SEQ ID NO: 1304533 - DNA, 22 bp, Artificial Sequence
  chemically synthesized
tcagcctagttgtgaggattaa

SEQ ID NO: 1304534 - DNA, 22 bp, Artificial Sequence
  chemically synthesized
tattttgcatttaatcctcaca

SEQ ID NO: 1304535 - DNA, 22 bp, Artificial Sequence
  chemically synthesized
ttctcagcctagttgtgaggat

SEQ ID NO: 1304536 - DNA, 22 bp, Artificial Sequence
  chemically synthesized
gttctcagcctagttgtgagga

SEQ ID NO: 1304537 - DNA, 22 bp, Artificial Sequence
  chemically synthesized
tgcatttaatcctcacaactag

SEQ ID NO: 1304538 - DNA, 22 bp, Artificial Sequence
  chemically synthesized
gcatttaatcctcacaactagg

SEQ ID NO: 1304539 - DNA, 22 bp, Artificial Sequence
  chemically synthesized
catttaatcctcacaactaggc

SEQ ID NO: 1304540 - DNA, 22 bp, Artificial Sequence
  chemically synthesized
atgtttgttctcagcctagttg

SEQ ID NO: 1304541 - DNA, 22 bp, Artificial Sequence
  chemically synthesized
aatcctcacaactaggctgaga

SEQ ID NO: 1304542 - DNA, 22 bp, Artificial Sequence
  chemically synthesized
atcctcacaactaggctgagaa

SEQ ID NO: 1304543 - DNA, 22 bp, Artificial Sequence
  chemically synthesized
acaactaggctgagaacaaaca

SEQ ID NO: 1304544 - DNA, 22 bp, Artificial Sequence
  chemically synthesized
ggctgagaacaaacattaggca

SEQ ID NO: 1304545 - DNA, 22 bp, Artificial Sequence
  chemically synthesized
taaatgggaaataaaatgccta

SEQ ID NO: 1304546 - DNA, 22 bp, Artificial Sequence
  chemically synthesized
agaacaaacattaggcatttta

SEQ ID NO: 1304547 - DNA, 22 bp, Artificial Sequence
  chemically synthesized
caatctgtaaatgggaaataaa

SEQ ID NO: 1304548 - DNA, 22 bp, Artificial Sequence
  chemically synthesized
acaatctgtaaatgggaaataa

SEQ ID NO: 1304549 - DNA, 22 bp, Artificial Sequence
  chemically synthesized
ggcattttatttcccatttaca

SEQ ID NO: 1304550 - DNA, 22 bp, Artificial Sequence
  chemically synthesized
aggtttacaatctgtaaatggg

SEQ ID NO: 1304551 - DNA, 22 bp, Artificial Sequence
  chemically synthesized
cctcaggtttacaatctgtaaa

SEQ ID NO: 1304552 - DNA, 22 bp, Artificial Sequence
  chemically synthesized
tatttcccatttacagattgta

SEQ ID NO: 1304553 - DNA, 22 bp, Artificial Sequence
  chemically synthesized
ttgcctcaggtttacaatctgt

SEQ ID NO: 1304554 - DNA, 22 bp, Artificial Sequence
  chemically synthesized
atttcccatttacagattgtaa

SEQ ID NO: 1304555 - DNA, 22 bp, Artificial Sequence
  chemically synthesized
tttcccatttacagattgtaaa

SEQ ID NO: 1304556 - DNA, 22 bp, Artificial Sequence
  chemically synthesized
cccatttacagattgtaaacct

SEQ ID NO: 1304557 - DNA, 22 bp, Artificial Sequence
  chemically synthesized
ccatttacagattgtaaacctg

SEQ ID NO: 1304558 - DNA, 22 bp, Artificial Sequence
  chemically synthesized
atcctattgcctcaggtttaca

SEQ ID NO: 1304559 - DNA, 22 bp, Artificial Sequence
  chemically synthesized
acagattgtaaacctgaggcaa

SEQ ID NO: 1304560 - DNA, 22 bp, Artificial Sequence
  chemically synthesized
cagattgtaaacctgaggcaat

SEQ ID NO: 1304561 - DNA, 22 bp, Artificial Sequence
  chemically synthesized
tcacaggcaactaatcctattg

SEQ ID NO: 1304562 - DNA, 22 bp, Artificial Sequence
  chemically synthesized
taaacctgaggcaataggatta

SEQ ID NO: 1304563 - DNA, 22 bp, Artificial Sequence
  chemically synthesized
ttatcacaggcaactaatccta

SEQ ID NO: 1304564 - DNA, 22 bp, Artificial Sequence
  chemically synthesized
aggcaataggattagttgcctg

SEQ ID NO: 1304565 - DNA, 22 bp, Artificial Sequence
  chemically synthesized
aacatgtgaattgttatcacag

SEQ ID NO: 1304566 - DNA, 22 bp, Artificial Sequence
  chemically synthesized
tcaacatgtgaattgttatcac

SEQ ID NO: 1304567 - DNA, 22 bp, Artificial Sequence
  chemically synthesized
gttgcctgtgataacaattcac

SEQ ID NO: 1304568 - DNA, 22 bp, Artificial Sequence
  chemically synthesized
tgattctcaacatgtgaattgt

SEQ ID NO: 1304569 - DNA, 22 bp, Artificial Sequence
  chemically synthesized
cctgtgataacaattcacatgt

SEQ ID NO: 1304570 - DNA, 22 bp, Artificial Sequence
  chemically synthesized
tgataacaattcacatgttgag

SEQ ID NO: 1304571 - DNA, 22 bp, Artificial Sequence
  chemically synthesized
taatattatgattctcaacatg

SEQ ID NO: 1304572 - DNA, 22 bp, Artificial Sequence
  chemically synthesized
acatgttgagaatcataatatt

SEQ ID NO: 1304573 - DNA, 22 bp, Artificial Sequence
  chemically synthesized
ggtggtggaggcctataatatt

SEQ ID NO: 1304574 - DNA, 22 bp, Artificial Sequence
  chemically synthesized
ttaggtggtggaggcctataat

SEQ ID NO: 1304575 - DNA, 22 bp, Artificial Sequence
  chemically synthesized
agaatcataatattataggcct

SEQ ID NO: 1304576 - DNA, 22 bp, Artificial Sequence
  chemically synthesized
aagatggcattgttaggtggtg

SEQ ID NO: 1304577 - DNA, 22 bp, Artificial Sequence
  chemically synthesized
tgaagatggcattgttaggtgg

SEQ ID NO: 1304578 - DNA, 22 bp, Artificial Sequence
  chemically synthesized
taggcctccaccacctaacaat

SEQ ID NO: 1304579 - DNA, 22 bp, Artificial Sequence
  chemically synthesized
caccacctaacaatgccatctt

SEQ ID NO: 1304580 - DNA, 22 bp, Artificial Sequence
  chemically synthesized
tgtgtgtgtagttctgaagatg

SEQ ID NO: 1304581 - DNA, 22 bp, Artificial Sequence
  chemically synthesized
acaatgccatcttcagaactac

SEQ ID NO: 1304582 - DNA, 22 bp, Artificial Sequence
  chemically synthesized
cagaactacacacacacaggtg

SEQ ID NO: 1304583 - DNA, 22 bp, Artificial Sequence
  chemically synthesized
agaactacacacacacaggtgc

SEQ ID NO: 1304584 - DNA, 22 bp, Artificial Sequence
  chemically synthesized
cacacacacaggtgcgtacaca

SEQ ID NO: 1304585 - DNA, 22 bp, Artificial Sequence
  chemically synthesized
tgtgtgtgtgtgtgtgtgtgtg

SEQ ID NO: 1304586 - DNA, 22 bp, Artificial Sequence
  chemically synthesized
gtgtgtgtgtgtgtgtgtgtgt

SEQ ID NO: 1304587 - DNA, 22 bp, Artificial Sequence
  chemically synthesized
acgaaatacttgtgtgtgtgtg

SEQ ID NO: 1304588 - DNA, 22 bp, Artificial Sequence
  chemically synthesized
caatctcacgaaatacttgtgt

SEQ ID NO: 1304589 - DNA, 22 bp, Artificial Sequence
  chemically synthesized
agaatgtggttacaatctcacg

SEQ ID NO: 1304590 - DNA, 22 bp, Artificial Sequence
  chemically synthesized
aagaatgtggttacaatctcac

SEQ ID NO: 1304591 - DNA, 22 bp, Artificial Sequence
  chemically synthesized
cgtgagattgtaaccacattct

SEQ ID NO: 1304592 - DNA, 22 bp, Artificial Sequence
  chemically synthesized
gtgagattgtaaccacattctt

SEQ ID NO: 1304593 - DNA, 22 bp, Artificial Sequence
  chemically synthesized
caaaggatggaacttaagaatg

SEQ ID NO: 1304594 - DNA, 22 bp, Artificial Sequence
  chemically synthesized
gcaaaggatggaacttaagaat

SEQ ID NO: 1304595 - DNA, 22 bp, Artificial Sequence
  chemically synthesized
cttgcaaaggatggaacttaag

SEQ ID NO: 1304596 - DNA, 22 bp, Artificial Sequence
  chemically synthesized
acttgcaaaggatggaacttaa

SEQ ID NO: 1304597 - DNA, 22 bp, Artificial Sequence
  chemically synthesized
taaccacattcttaagttccat

SEQ ID NO: 1304598 - DNA, 22 bp, Artificial Sequence
  chemically synthesized
ccttacttgcaaaggatggaac

SEQ ID NO: 1304599 - DNA, 22 bp, Artificial Sequence
  chemically synthesized
accttacttgcaaaggatggaa

SEQ ID NO: 1304600 - DNA, 22 bp, Artificial Sequence
  chemically synthesized
acttaccttacttgcaaaggat

SEQ ID NO: 1304601 - DNA, 22 bp, Artificial Sequence
  chemically synthesized
ttaagttccatcctttgcaagt

SEQ ID NO: 1304602 - DNA, 22 bp, Artificial Sequence
  chemically synthesized
aagttccatcctttgcaagtaa

SEQ ID NO: 1304603 - DNA, 22 bp, Artificial Sequence
  chemically synthesized
agttccatcctttgcaagtaag

SEQ ID NO: 1304604 - DNA, 22 bp, Artificial Sequence
  chemically synthesized
catcctttgcaagtaaggtaag

SEQ ID NO: 1304605 - DNA, 22 bp, Artificial Sequence
  chemically synthesized
tgcaagtaaggtaagttaggca

SEQ ID NO: 1304606 - DNA, 22 bp, Artificial Sequence
  chemically synthesized
gcaagtaaggtaagttaggcac

SEQ ID NO: 1304607 - DNA, 22 bp, Artificial Sequence
  chemically synthesized
caagtaaggtaagttaggcact

SEQ ID NO: 1304608 - DNA, 22 bp, Artificial Sequence
  chemically synthesized
aggcagtgaggaaacagtgcct

SEQ ID NO: 1304609 - DNA, 22 bp, Artificial Sequence
  chemically synthesized
taaacaaccctaaggcagtgag

SEQ ID NO: 1304610 - DNA, 22 bp, Artificial Sequence
  chemically synthesized
ggcactgtttcctcactgcctt

SEQ ID NO: 1304611 - DNA, 22 bp, Artificial Sequence
  chemically synthesized
ataaacaaccctaaggcagtga

SEQ ID NO: 1304612 - DNA, 22 bp, Artificial Sequence
  chemically synthesized
tatttataaacaaccctaaggc

SEQ ID NO: 1304613 - DNA, 22 bp, Artificial Sequence
  chemically synthesized
tttcctcactgccttagggttg

SEQ ID NO: 1304614 - DNA, 22 bp, Artificial Sequence
  chemically synthesized
tgtatttataaacaaccctaag

SEQ ID NO: 1304615 - DNA, 22 bp, Artificial Sequence
  chemically synthesized
cctcactgccttagggttgttt

SEQ ID NO: 1304616 - DNA, 22 bp, Artificial Sequence
  chemically synthesized
ctcactgccttagggttgttta

SEQ ID NO: 1304617 - DNA, 22 bp, Artificial Sequence
  chemically synthesized
actgccttagggttgtttataa

SEQ ID NO: 1304618 - DNA, 22 bp, Artificial Sequence
  chemically synthesized
aagagctctgtatttataaaca

SEQ ID NO: 1304619 - DNA, 22 bp, Artificial Sequence
  chemically synthesized
ccttagggttgtttataaatac

SEQ ID NO: 1304620 - DNA, 22 bp, Artificial Sequence
  chemically synthesized
taattcaagagctctgtattta

SEQ ID NO: 1304621 - DNA, 22 bp, Artificial Sequence
  chemically synthesized
agggttgtttataaatacagag

SEQ ID NO: 1304622 - DNA, 22 bp, Artificial Sequence
  chemically synthesized
gtaattcaagagctctgtattt

SEQ ID NO: 1304623 - DNA, 22 bp, Artificial Sequence
  chemically synthesized
gggttgtttataaatacagagc

SEQ ID NO: 1304624 - DNA, 22 bp, Artificial Sequence
  chemically synthesized
tgtaattcaagagctctgtatt

SEQ ID NO: 1304625 - DNA, 22 bp, Artificial Sequence
  chemically synthesized
attttgtaattcaagagctctg

SEQ ID NO: 1304626 - DNA, 22 bp, Artificial Sequence
  chemically synthesized
tttataaatacagagctcttga

SEQ ID NO: 1304627 - DNA, 22 bp, Artificial Sequence
  chemically synthesized
ataaatacagagctcttgaatt

SEQ ID NO: 1304628 - DNA, 22 bp, Artificial Sequence
  chemically synthesized
taaatacagagctcttgaatta

SEQ ID NO: 1304629 - DNA, 22 bp, Artificial Sequence
  chemically synthesized
tcagtgaaatcaagagttgatt

SEQ ID NO: 1304630 - DNA, 22 bp, Artificial Sequence
  chemically synthesized
ttgaattacaaaatcaactctt

SEQ ID NO: 1304631 - DNA, 22 bp, Artificial Sequence
  chemically synthesized
tgtcagtgaaatcaagagttga

SEQ ID NO: 1304632 - DNA, 22 bp, Artificial Sequence
  chemically synthesized
gaattacaaaatcaactcttga

SEQ ID NO: 1304633 - DNA, 22 bp, Artificial Sequence
  chemically synthesized
aattacaaaatcaactcttgat

SEQ ID NO: 1304634 - DNA, 22 bp, Artificial Sequence
  chemically synthesized
acctctgtcagtgaaatcaaga

SEQ ID NO: 1304635 - DNA, 22 bp, Artificial Sequence
  chemically synthesized
caaaatcaactcttgatttcac

SEQ ID NO: 1304636 - DNA, 22 bp, Artificial Sequence
  chemically synthesized
aaagcagttgacctctgtcagt

SEQ ID NO: 1304637 - DNA, 22 bp, Artificial Sequence
  chemically synthesized
ttgatttcactgacagaggtca

SEQ ID NO: 1304638 - DNA, 22 bp, Artificial Sequence
  chemically synthesized
cactaaaagcagttgacctctg

SEQ ID NO: 1304639 - DNA, 22 bp, Artificial Sequence
  chemically synthesized
gatttcactgacagaggtcaac

SEQ ID NO: 1304640 - DNA, 22 bp, Artificial Sequence
  chemically synthesized
acactaaaagcagttgacctct

SEQ ID NO: 1304641 - DNA, 22 bp, Artificial Sequence
  chemically synthesized
atttcactgacagaggtcaact

SEQ ID NO: 1304642 - DNA, 22 bp, Artificial Sequence
  chemically synthesized
acttacactaaaagcagttgac

SEQ ID NO: 1304643 - DNA, 22 bp, Artificial Sequence
  chemically synthesized
cactgacagaggtcaactgctt

SEQ ID NO: 1304644 - DNA, 22 bp, Artificial Sequence
  chemically synthesized
actgacagaggtcaactgcttt

SEQ ID NO: 1304645 - DNA, 22 bp, Artificial Sequence
  chemically synthesized
acagaggtcaactgcttttagt

SEQ ID NO: 1304646 - DNA, 22 bp, Artificial Sequence
  chemically synthesized
tgccagaatcatggttcactta

SEQ ID NO: 1304647 - DNA, 22 bp, Artificial Sequence
  chemically synthesized
atgccagaatcatggttcactt

SEQ ID NO: 1304648 - DNA, 22 bp, Artificial Sequence
  chemically synthesized
cttttagtgtaagtgaaccatg

SEQ ID NO: 1304649 - DNA, 22 bp, Artificial Sequence
  chemically synthesized
tttatgccagaatcatggttca

SEQ ID NO: 1304650 - DNA, 22 bp, Artificial Sequence
  chemically synthesized
ttagtgtaagtgaaccatgatt

SEQ ID NO: 1304651 - DNA, 22 bp, Artificial Sequence
  chemically synthesized
tagtgtaagtgaaccatgattc

SEQ ID NO: 1304652 - DNA, 22 bp, Artificial Sequence
  chemically synthesized
agtgtaagtgaaccatgattct

SEQ ID NO: 1304653 - DNA, 22 bp, Artificial Sequence
  chemically synthesized
gtgtaagtgaaccatgattctg

SEQ ID NO: 1304654 - DNA, 22 bp, Artificial Sequence
  chemically synthesized
tatctgtttatgccagaatcat

SEQ ID NO: 1304655 - DNA, 22 bp, Artificial Sequence
  chemically synthesized
tatatctgtttatgccagaatc

SEQ ID NO: 1304656 - DNA, 22 bp, Artificial Sequence
  chemically synthesized
ctatatctgtttatgccagaat

SEQ ID NO: 1304657 - DNA, 22 bp, Artificial Sequence
  chemically synthesized
ttctatatctgtttatgccaga

SEQ ID NO: 1304658 - DNA, 22 bp, Artificial Sequence
  chemically synthesized
aacaggattcttctatatctgt

SEQ ID NO: 1304659 - DNA, 22 bp, Artificial Sequence
  chemically synthesized
aaacaggattcttctatatctg

SEQ ID NO: 1304660 - DNA, 22 bp, Artificial Sequence
  chemically synthesized
taaacaggattcttctatatct

SEQ ID NO: 1304661 - DNA, 22 bp, Artificial Sequence
  chemically synthesized
ttaaacaggattcttctatatc

SEQ ID NO: 1304662 - DNA, 22 bp, Artificial Sequence
  chemically synthesized
tggcataaacagatatagaaga

SEQ ID NO: 1304663 - DNA, 22 bp, Artificial Sequence
  chemically synthesized
gcataaacagatatagaagaat

SEQ ID NO: 1304664 - DNA, 22 bp, Artificial Sequence
  chemically synthesized
gagcaggtaaaaacttttaaac

SEQ ID NO: 1304665 - DNA, 22 bp, Artificial Sequence
  chemically synthesized
gtaggcacctagagcaggtaaa

SEQ ID NO: 1304666 - DNA, 22 bp, Artificial Sequence
  chemically synthesized
ggtaggcacctagagcaggtaa

SEQ ID NO: 1304667 - DNA, 22 bp, Artificial Sequence
  chemically synthesized
tttaaaagtttttacctgctct

SEQ ID NO: 1304668 - DNA, 22 bp, Artificial Sequence
  chemically synthesized
ttggtaggcacctagagcaggt

SEQ ID NO: 1304669 - DNA, 22 bp, Artificial Sequence
  chemically synthesized
aaaagtttttacctgctctagg

SEQ ID NO: 1304670 - DNA, 22 bp, Artificial Sequence
  chemically synthesized
tcttggtaggcacctagagcag

SEQ ID NO: 1304671 - DNA, 22 bp, Artificial Sequence
  chemically synthesized
aaagtttttacctgctctaggt

SEQ ID NO: 1304672 - DNA, 22 bp, Artificial Sequence
  chemically synthesized
ctcttggtaggcacctagagca

SEQ ID NO: 1304673 - DNA, 22 bp, Artificial Sequence
  chemically synthesized
ttctcttggtaggcacctagag

SEQ ID NO: 1304674 - DNA, 22 bp, Artificial Sequence
  chemically synthesized
cttctcttggtaggcacctaga

SEQ ID NO: 1304675 - DNA, 22 bp, Artificial Sequence
  chemically synthesized
ttcttctcttggtaggcaccta

SEQ ID NO: 1304676 - DNA, 22 bp, Artificial Sequence
  chemically synthesized
ttacctgctctaggtgcctacc

SEQ ID NO: 1304677 - DNA, 22 bp, Artificial Sequence
  chemically synthesized
tacctgctctaggtgcctacca

SEQ ID NO: 1304678 - DNA, 22 bp, Artificial Sequence
  chemically synthesized
acctgctctaggtgcctaccaa

SEQ ID NO: 1304679 - DNA, 22 bp, Artificial Sequence
  chemically synthesized
cctgctctaggtgcctaccaag

SEQ ID NO: 1304680 - DNA, 22 bp, Artificial Sequence
  chemically synthesized
cccctcttcttctcttggtagg

SEQ ID NO: 1304681 - DNA, 22 bp, Artificial Sequence
  chemically synthesized
ccccctcttcttctcttggtag

SEQ ID NO: 1304682 - DNA, 22 bp, Artificial Sequence
  chemically synthesized
ctctaggtgcctaccaagagaa

SEQ ID NO: 1304683 - DNA, 22 bp, Artificial Sequence
  chemically synthesized
taggtgcctaccaagagaagaa

SEQ ID NO: 1304684 - DNA, 22 bp, Artificial Sequence
  chemically synthesized
aacttccccctcttcttctctt

SEQ ID NO: 1304685 - DNA, 22 bp, Artificial Sequence
  chemically synthesized
ggtgcctaccaagagaagaaga

SEQ ID NO: 1304686 - DNA, 22 bp, Artificial Sequence
  chemically synthesized
tcaacttccccctcttcttctc

SEQ ID NO: 1304687 - DNA, 22 bp, Artificial Sequence
  chemically synthesized
tctcaacttccccctcttcttc

SEQ ID NO: 1304688 - DNA, 22 bp, Artificial Sequence
  chemically synthesized
ccaagagaagaagagggggaag

SEQ ID NO: 1304689 - DNA, 22 bp, Artificial Sequence
  chemically synthesized
taactctctcaacttccccctc

SEQ ID NO: 1304690 - DNA, 22 bp, Artificial Sequence
  chemically synthesized
tctgtaactctctcaacttccc

SEQ ID NO: 1304691 - DNA, 22 bp, Artificial Sequence
  chemically synthesized
atctgtaactctctcaacttcc

SEQ ID NO: 1304692 - DNA, 22 bp, Artificial Sequence
  chemically synthesized
acttatctgtaactctctcaac

SEQ ID NO: 1304693 - DNA, 22 bp, Artificial Sequence
  chemically synthesized
tcacttatctgtaactctctca

SEQ ID NO: 1304694 - DNA, 22 bp, Artificial Sequence
  chemically synthesized
gctctcacttatctgtaactct

SEQ ID NO: 1304695 - DNA, 22 bp, Artificial Sequence
  chemically synthesized
tagctctcacttatctgtaact

SEQ ID NO: 1304696 - DNA, 22 bp, Artificial Sequence
  chemically synthesized
ctagctctcacttatctgtaac

SEQ ID NO: 1304697 - DNA, 22 bp, Artificial Sequence
  chemically synthesized
agagagttacagataagtgaga

SEQ ID NO: 1304698 - DNA, 22 bp, Artificial Sequence
  chemically synthesized
cagataagtgagagctagaagc

SEQ ID NO: 1304699 - DNA, 22 bp, Artificial Sequence
  chemically synthesized
cccacacccccacacggcttct

SEQ ID NO: 1304700 - DNA, 22 bp, Artificial Sequence
  chemically synthesized
gaagccgtgtgggggtgtgggg

SEQ ID NO: 1304701 - DNA, 22 bp, Artificial Sequence
  chemically synthesized
aaaaggtgtgtgtgtgtgtgtc

SEQ ID NO: 1304702 - DNA, 22 bp, Artificial Sequence
  chemically synthesized
gaaaaggtgtgtgtgtgtgtgt

SEQ ID NO: 1304703 - DNA, 22 bp, Artificial Sequence
  chemically synthesized
tttgaaaaggtgtgtgtgtgtg

SEQ ID NO: 1304704 - DNA, 22 bp, Artificial Sequence
  chemically synthesized
accctctgacacacacacacac

SEQ ID NO: 1304705 - DNA, 22 bp, Artificial Sequence
  chemically synthesized
atttgaaaaggtgtgtgtgtgt

SEQ ID NO: 1304706 - DNA, 22 bp, Artificial Sequence
  chemically synthesized
ttatttgaaaaggtgtgtgtgt

SEQ ID NO: 1304707 - DNA, 22 bp, Artificial Sequence
  chemically synthesized
ctcttatttgaaaaggtgtgtg

SEQ ID NO: 1304708 - DNA, 22 bp, Artificial Sequence
  chemically synthesized
tgacacacacacacacaccttt

SEQ ID NO: 1304709 - DNA, 22 bp, Artificial Sequence
  chemically synthesized
acacacacacacacaccttttc

SEQ ID NO: 1304710 - DNA, 22 bp, Artificial Sequence
  chemically synthesized
taatgttcctcttatttgaaaa

SEQ ID NO: 1304711 - DNA, 22 bp, Artificial Sequence
  chemically synthesized
agaggacattataatgttcctc

SEQ ID NO: 1304712 - DNA, 22 bp, Artificial Sequence
  chemically synthesized
ttcaaataagaggaacattata

SEQ ID NO: 1304713 - DNA, 22 bp, Artificial Sequence
  chemically synthesized
tcaaataagaggaacattataa

SEQ ID NO: 1304714 - DNA, 22 bp, Artificial Sequence
  chemically synthesized
cctaagaggacattataatgtt

SEQ ID NO: 1304715 - DNA, 22 bp, Artificial Sequence
  chemically synthesized
caaataagaggaacattataat

SEQ ID NO: 1304716 - DNA, 22 bp, Artificial Sequence
  chemically synthesized
aaataagaggaacattataatg

SEQ ID NO: 1304717 - DNA, 22 bp, Artificial Sequence
  chemically synthesized
gttccctaagaggacattataa

SEQ ID NO: 1304718 - DNA, 22 bp, Artificial Sequence
  chemically synthesized
ggttccctaagaggacattata

SEQ ID NO: 1304719 - DNA, 22 bp, Artificial Sequence
  chemically synthesized
tggttccctaagaggacattat

SEQ ID NO: 1304720 - DNA, 22 bp, Artificial Sequence
  chemically synthesized
ggactttggttccctaagagga

SEQ ID NO: 1304721 - DNA, 22 bp, Artificial Sequence
  chemically synthesized
aggactttggttccctaagagg

SEQ ID NO: 1304722 - DNA, 22 bp, Artificial Sequence
  chemically synthesized
taggactttggttccctaagag

SEQ ID NO: 1304723 - DNA, 22 bp, Artificial Sequence
  chemically synthesized
tttaggactttggttccctaag

SEQ ID NO: 1304724 - DNA, 22 bp, Artificial Sequence
  chemically synthesized
ctttaggactttggttccctaa

SEQ ID NO: 1304725 - DNA, 22 bp, Artificial Sequence
  chemically synthesized
taatgtcctcttagggaaccaa

SEQ ID NO: 1304726 - DNA, 22 bp, Artificial Sequence
  chemically synthesized
ttctttaggactttggttccct

SEQ ID NO: 1304727 - DNA, 22 bp, Artificial Sequence
  chemically synthesized
tcttctttaggactttggttcc

SEQ ID NO: 1304728 - DNA, 22 bp, Artificial Sequence
  chemically synthesized
ctcttctttaggactttggttc

SEQ ID NO: 1304729 - DNA, 22 bp, Artificial Sequence
  chemically synthesized
cttctcttctttaggactttgg

SEQ ID NO: 1304730 - DNA, 22 bp, Artificial Sequence
  chemically synthesized
ttagggaaccaaagtcctaaag

SEQ ID NO: 1304731 - DNA, 22 bp, Artificial Sequence
  chemically synthesized
agggaaccaaagtcctaaagaa

SEQ ID NO: 1304732 - DNA, 22 bp, Artificial Sequence
  chemically synthesized
gggaaccaaagtcctaaagaag

SEQ ID NO: 1304733 - DNA, 22 bp, Artificial Sequence
  chemically synthesized
cagaacctccttctcttcttta

SEQ ID NO: 1304734 - DNA, 22 bp, Artificial Sequence
  chemically synthesized
agcagctccagaacctccttct

SEQ ID NO: 1304735 - DNA, 22 bp, Artificial Sequence
  chemically synthesized
cagcagctccagaacctccttc

SEQ ID NO: 1304736 - DNA, 22 bp, Artificial Sequence
  chemically synthesized
tcagcagctccagaacctcctt

SEQ ID NO: 1304737 - DNA, 22 bp, Artificial Sequence
  chemically synthesized
ttcagcagctccagaacctcct

SEQ ID NO: 1304738 - DNA, 22 bp, Artificial Sequence
  chemically synthesized
aagaagagaaggaggttctgga

SEQ ID NO: 1304739 - DNA, 22 bp, Artificial Sequence
  chemically synthesized
tttttcagcagctccagaacct

SEQ ID NO: 1304740 - DNA, 22 bp, Artificial Sequence
  chemically synthesized
ggcactatttttcagcagctcc

SEQ ID NO: 1304741 - DNA, 22 bp, Artificial Sequence
  chemically synthesized
gttgggcactatttttcagcag

SEQ ID NO: 1304742 - DNA, 22 bp, Artificial Sequence
  chemically synthesized
tggttgggcactatttttcagc

SEQ ID NO: 1304743 - DNA, 22 bp, Artificial Sequence
  chemically synthesized
ctctggttgggcactatttttc

SEQ ID NO: 1304744 - DNA, 22 bp, Artificial Sequence
  chemically synthesized
gctctggttgggcactattttt

SEQ ID NO: 1304745 - DNA, 22 bp, Artificial Sequence
  chemically synthesized
tggagctgctgaaaaatagtgc

SEQ ID NO: 1304746 - DNA, 22 bp, Artificial Sequence
  chemically synthesized
tgctctggttgggcactatttt

SEQ ID NO: 1304747 - DNA, 22 bp, Artificial Sequence
  chemically synthesized
gagctgctgaaaaatagtgccc

SEQ ID NO: 1304748 - DNA, 22 bp, Artificial Sequence
  chemically synthesized
ctgaaaaatagtgcccaaccag

SEQ ID NO: 1304749 - DNA, 22 bp, Artificial Sequence
  chemically synthesized
aaaaatagtgcccaaccagagc

SEQ ID NO: 1304750 - DNA, 22 bp, Artificial Sequence
  chemically synthesized
catgcccagtccctttgctctg

SEQ ID NO: 1304751 - DNA, 22 bp, Artificial Sequence
  chemically synthesized
atctacatgcccagtccctttg

SEQ ID NO: 1304752 - DNA, 22 bp, Artificial Sequence
  chemically synthesized
tgaggctaatctacatgcccag

SEQ ID NO: 1304753 - DNA, 22 bp, Artificial Sequence
  chemically synthesized
agacccctgtgaggctaatcta

SEQ ID NO: 1304754 - DNA, 22 bp, Artificial Sequence
  chemically synthesized
ggcatgtagattagcctcacag

SEQ ID NO: 1304755 - DNA, 22 bp, Artificial Sequence
  chemically synthesized
atgagatgctcagacccctgtg

SEQ ID NO: 1304756 - DNA, 22 bp, Artificial Sequence
  chemically synthesized
gcctcacaggggtctgagcatc

SEQ ID NO: 1304757 - DNA, 22 bp, Artificial Sequence
  chemically synthesized
tcacaaacctgatgagatgctc

SEQ ID NO: 1304758 - DNA, 22 bp, Artificial Sequence
  chemically synthesized
atcacaaacctgatgagatgct

SEQ ID NO: 1304759 - DNA, 22 bp, Artificial Sequence
  chemically synthesized
acaggggtctgagcatctcatc

SEQ ID NO: 1304760 - DNA, 22 bp, Artificial Sequence
  chemically synthesized
cttatcacaaacctgatgagat

SEQ ID NO: 1304761 - DNA, 22 bp, Artificial Sequence
  chemically synthesized
gctgcttatcacaaacctgatg

SEQ ID NO: 1304762 - DNA, 22 bp, Artificial Sequence
  chemically synthesized
agcatctcatcaggtttgtgat

SEQ ID NO: 1304763 - DNA, 22 bp, Artificial Sequence
  chemically synthesized
atcaggtttgtgataagcagct

SEQ ID NO: 1304764 - DNA, 22 bp, Artificial Sequence
  chemically synthesized
aagcaccgacacatgttagctg

SEQ ID NO: 1304765 - DNA, 22 bp, Artificial Sequence
  chemically synthesized
tcaagcaccgacacatgttagc

SEQ ID NO: 1304766 - DNA, 22 bp, Artificial Sequence
  chemically synthesized
ctcaagcaccgacacatgttag

SEQ ID NO: 1304767 - DNA, 22 bp, Artificial Sequence
  chemically synthesized
gtgataagcagctaacatgtgt

SEQ ID NO: 1304768 - DNA, 22 bp, Artificial Sequence
  chemically synthesized
tgataagcagctaacatgtgtc

SEQ ID NO: 1304769 - DNA, 22 bp, Artificial Sequence
  chemically synthesized
catgaccttctcaagcaccgac

SEQ ID NO: 1304770 - DNA, 22 bp, Artificial Sequence
  chemically synthesized
ccatgaccttctcaagcaccga

SEQ ID NO: 1304771 - DNA, 22 bp, Artificial Sequence
  chemically synthesized
acttccatgaccttctcaagca

SEQ ID NO: 1304772 - DNA, 22 bp, Artificial Sequence
  chemically synthesized
acatgtgtcggtgcttgagaag

SEQ ID NO: 1304773 - DNA, 22 bp, Artificial Sequence
  chemically synthesized
ctaacttccatgaccttctcaa

SEQ ID NO: 1304774 - DNA, 22 bp, Artificial Sequence
  chemically synthesized
ctcctaacttccatgaccttct

SEQ ID NO: 1304775 - DNA, 22 bp, Artificial Sequence
  chemically synthesized
ctcctcctaacttccatgacct

SEQ ID NO: 1304776 - DNA, 22 bp, Artificial Sequence
  chemically synthesized
gctcctcctaacttccatgacc

SEQ ID NO: 1304777 - DNA, 22 bp, Artificial Sequence
  chemically synthesized
gagaaggtcatggaagttagga

SEQ ID NO: 1304778 - DNA, 22 bp, Artificial Sequence
  chemically synthesized
ccagcttgctcctcctaacttc

SEQ ID NO: 1304779 - DNA, 22 bp, Artificial Sequence
  chemically synthesized
agaaggtcatggaagttaggag

SEQ ID NO: 1304780 - DNA, 22 bp, Artificial Sequence
  chemically synthesized
aaagactgccagcttgctcctc

SEQ ID NO: 1304781 - DNA, 22 bp, Artificial Sequence
  chemically synthesized
gaaagactgccagcttgctcct

SEQ ID NO: 1304782 - DNA, 22 bp, Artificial Sequence
  chemically synthesized
ggaggagcaagctggcagtctt

SEQ ID NO: 1304783 - DNA, 22 bp, Artificial Sequence
  chemically synthesized
ccacacccttgaaagactgcca

SEQ ID NO: 1304784 - DNA, 22 bp, Artificial Sequence
  chemically synthesized
attaccacacccttgaaagact

SEQ ID NO: 1304785 - DNA, 22 bp, Artificial Sequence
  chemically synthesized
tgtcctgattaccacacccttg

SEQ ID NO: 1304786 - DNA, 22 bp, Artificial Sequence
  chemically synthesized
gcagtctttcaagggtgtggta

SEQ ID NO: 1304787 - DNA, 22 bp, Artificial Sequence
  chemically synthesized
gggtgtctgtgtcctgattacc

SEQ ID NO: 1304788 - DNA, 22 bp, Artificial Sequence
  chemically synthesized
ggggtgtctgtgtcctgattac

SEQ ID NO: 1304789 - DNA, 22 bp, Artificial Sequence
  chemically synthesized
tcaagggtgtggtaatcaggac

SEQ ID NO: 1304790 - DNA, 22 bp, Artificial Sequence
  chemically synthesized
caagggtgtggtaatcaggaca

SEQ ID NO: 1304791 - DNA, 22 bp, Artificial Sequence
  chemically synthesized
aagggtgtggtaatcaggacac

SEQ ID NO: 1304792 - DNA, 22 bp, Artificial Sequence
  chemically synthesized
caggatttggggtgtctgtgtc

SEQ ID NO: 1304793 - DNA, 22 bp, Artificial Sequence
  chemically synthesized
cctccaggatttggggtgtctg

SEQ ID NO: 1304794 - DNA, 22 bp, Artificial Sequence
  chemically synthesized
tgcctccaggatttggggtgtc

SEQ ID NO: 1304795 - DNA, 22 bp, Artificial Sequence
  chemically synthesized
ttctgcctccaggatttggggt

SEQ ID NO: 1304796 - DNA, 22 bp, Artificial Sequence
  chemically synthesized
cctattctgcctccaggatttg

SEQ ID NO: 1304797 - DNA, 22 bp, Artificial Sequence
  chemically synthesized
aactgcctattctgcctccagg

SEQ ID NO: 1304798 - DNA, 22 bp, Artificial Sequence
  chemically synthesized
gttgaactgcctattctgcctc

SEQ ID NO: 1304799 - DNA, 22 bp, Artificial Sequence
  chemically synthesized
agttgaactgcctattctgcct

SEQ ID NO: 1304800 - DNA, 22 bp, Artificial Sequence
  chemically synthesized
gaggcagaataggcagttcaac

SEQ ID NO: 1304801 - DNA, 22 bp, Artificial Sequence
  chemically synthesized
catcccgcccttagttgaactg

SEQ ID NO: 1304802 - DNA, 22 bp, Artificial Sequence
  chemically synthesized
aagtgaaccagtacctgcatcc

SEQ ID NO: 1304803 - DNA, 22 bp, Artificial Sequence
  chemically synthesized
aactaagggcgggatgcaggta

SEQ ID NO: 1304804 - DNA, 22 bp, Artificial Sequence
  chemically synthesized
gctgaagtgaaccagtacctgc

SEQ ID NO: 1304805 - DNA, 22 bp, Artificial Sequence
  chemically synthesized
agggcgggatgcaggtactggt

SEQ ID NO: 1304806 - DNA, 22 bp, Artificial Sequence
  chemically synthesized
catgcaggcattggctgaagtg

SEQ ID NO: 1304807 - DNA, 22 bp, Artificial Sequence
  chemically synthesized
gcatgcaggcattggctgaagt

SEQ ID NO: 1304808 - DNA, 22 bp, Artificial Sequence
  chemically synthesized
tgcatgcaggcattggctgaag

SEQ ID NO: 1304809 - DNA, 22 bp, Artificial Sequence
  chemically synthesized
gttcacttcagccaatgcctgc

SEQ ID NO: 1304810 - DNA, 22 bp, Artificial Sequence
  chemically synthesized
acttcagccaatgcctgcatgc

SEQ ID NO: 1304811 - DNA, 22 bp, Artificial Sequence
  chemically synthesized
cagccaatgcctgcatgcaaag

SEQ ID NO: 1304812 - DNA, 22 bp, Artificial Sequence
  chemically synthesized
agccaatgcctgcatgcaaaga

SEQ ID NO: 1304813 - DNA, 22 bp, Artificial Sequence
  chemically synthesized
tggggaagaagatctttgcatg

SEQ ID NO: 1304814 - DNA, 22 bp, Artificial Sequence
  chemically synthesized
catgcaaagatcttcttcccca

SEQ ID NO: 1304815 - DNA, 22 bp, Artificial Sequence
  chemically synthesized
cttccccacagaccacattgga

SEQ ID NO: 1304816 - DNA, 22 bp, Artificial Sequence
  chemically synthesized
ttccccacagaccacattggat

SEQ ID NO: 1304817 - DNA, 22 bp, Artificial Sequence
  chemically synthesized
ccccacagaccacattggatgt

SEQ ID NO: 1304818 - DNA, 22 bp, Artificial Sequence
  chemically synthesized
cccacagaccacattggatgtc

SEQ ID NO: 1304819 - DNA, 22 bp, Artificial Sequence
  chemically synthesized
ggtcaaggacacacagagatgt

SEQ ID NO: 1304820 - DNA, 22 bp, Artificial Sequence
  chemically synthesized
taggtcaaggacacacagagat

SEQ ID NO: 1304821 - DNA, 22 bp, Artificial Sequence
  chemically synthesized
gatgtcacatctctgtgtgtcc

SEQ ID NO: 1304822 - DNA, 22 bp, Artificial Sequence
  chemically synthesized
attctaggtcaaggacacacag

SEQ ID NO: 1304823 - DNA, 22 bp, Artificial Sequence
  chemically synthesized
tgattctaggtcaaggacacac

SEQ ID NO: 1304824 - DNA, 22 bp, Artificial Sequence
  chemically synthesized
ctgattctaggtcaaggacaca

SEQ ID NO: 1304825 - DNA, 22 bp, Artificial Sequence
  chemically synthesized
tgtgtgtccttgacctagaatc

SEQ ID NO: 1304826 - DNA, 22 bp, Artificial Sequence
  chemically synthesized
tgtgtccttgacctagaatcag

SEQ ID NO: 1304827 - DNA, 22 bp, Artificial Sequence
  chemically synthesized
atggcatcagggccaacttctg

SEQ ID NO: 1304828 - DNA, 22 bp, Artificial Sequence
  chemically synthesized
catggcatcagggccaacttct

SEQ ID NO: 1304829 - DNA, 22 bp, Artificial Sequence
  chemically synthesized
gacctagaatcagaagttggcc

SEQ ID NO: 1304830 - DNA, 22 bp, Artificial Sequence
  chemically synthesized
acctagaatcagaagttggccc

SEQ ID NO: 1304831 - DNA, 22 bp, Artificial Sequence
  chemically synthesized
gcttcatggcatcagggccaac

SEQ ID NO: 1304832 - DNA, 22 bp, Artificial Sequence
  chemically synthesized
agcttcatggcatcagggccaa

SEQ ID NO: 1304833 - DNA, 22 bp, Artificial Sequence
  chemically synthesized
gaatcagaagttggccctgatg

SEQ ID NO: 1304834 - DNA, 22 bp, Artificial Sequence
  chemically synthesized
cttagcttcatggcatcagggc

SEQ ID NO: 1304835 - DNA, 22 bp, Artificial Sequence
  chemically synthesized
gccctgatgccatgaagctaag

SEQ ID NO: 1304836 - DNA, 22 bp, Artificial Sequence
  chemically synthesized
atgccatgaagctaagtaatac

SEQ ID NO: 1304837 - DNA, 22 bp, Artificial Sequence
  chemically synthesized
gaataacacaggagtattactt

SEQ ID NO: 1304838 - DNA, 22 bp, Artificial Sequence
  chemically synthesized
ggattggaataacacaggagta

SEQ ID NO: 1304839 - DNA, 22 bp, Artificial Sequence
  chemically synthesized
taggattggaataacacaggag

SEQ ID NO: 1304840 - DNA, 22 bp, Artificial Sequence
  chemically synthesized
agtaatactcctgtgttattcc

SEQ ID NO: 1304841 - DNA, 22 bp, Artificial Sequence
  chemically synthesized
cactctaggattggaataacac

SEQ ID NO: 1304842 - DNA, 22 bp, Artificial Sequence
  chemically synthesized
gcctccactctaggattggaat

SEQ ID NO: 1304843 - DNA, 22 bp, Artificial Sequence
  chemically synthesized
tagcctccactctaggattgga

SEQ ID NO: 1304844 - DNA, 22 bp, Artificial Sequence
  chemically synthesized
ctgtgttattccaatcctagag

SEQ ID NO: 1304845 - DNA, 22 bp, Artificial Sequence
  chemically synthesized
tgttattccaatcctagagtgg

SEQ ID NO: 1304846 - DNA, 22 bp, Artificial Sequence
  chemically synthesized
ggactctagcctccactctagg

SEQ ID NO: 1304847 - DNA, 22 bp, Artificial Sequence
  chemically synthesized
ttaggactctagcctccactct

SEQ ID NO: 1304848 - DNA, 22 bp, Artificial Sequence
  chemically synthesized
ttccaatcctagagtggaggct

SEQ ID NO: 1304849 - DNA, 22 bp, Artificial Sequence
  chemically synthesized
caatcctagagtggaggctaga

SEQ ID NO: 1304850 - DNA, 22 bp, Artificial Sequence
  chemically synthesized
aggagttgttaggactctagcc

SEQ ID NO: 1304851 - DNA, 22 bp, Artificial Sequence
  chemically synthesized
gagtggaggctagagtcctaac

SEQ ID NO: 1304852 - DNA, 22 bp, Artificial Sequence
  chemically synthesized
ccggtcacattcaggagttgtt

SEQ ID NO: 1304853 - DNA, 22 bp, Artificial Sequence
  chemically synthesized
gagtcctaacaactcctgaatg

SEQ ID NO: 1304854 - DNA, 22 bp, Artificial Sequence
  chemically synthesized
aggtctaccggtcacattcagg

SEQ ID NO: 1304855 - DNA, 22 bp, Artificial Sequence
  chemically synthesized
caggtctaccggtcacattcag

SEQ ID NO: 1304856 - DNA, 22 bp, Artificial Sequence
  chemically synthesized
tcaggtctaccggtcacattca

SEQ ID NO: 1304857 - DNA, 22 bp, Artificial Sequence
  chemically synthesized
ttcaggtctaccggtcacattc

SEQ ID NO: 1304858 - DNA, 22 bp, Artificial Sequence
  chemically synthesized
acaactcctgaatgtgaccggt

SEQ ID NO: 1304859 - DNA, 22 bp, Artificial Sequence
  chemically synthesized
agtgacttttcaggtctaccgg

SEQ ID NO: 1304860 - DNA, 22 bp, Artificial Sequence
  chemically synthesized
ctgaatgtgaccggtagacctg

SEQ ID NO: 1304861 - DNA, 22 bp, Artificial Sequence
  chemically synthesized
aatgtgaccggtagacctgaaa

SEQ ID NO: 1304862 - DNA, 22 bp, Artificial Sequence
  chemically synthesized
ataaaattcagtgacttttcag

SEQ ID NO: 1304863 - DNA, 22 bp, Artificial Sequence
  chemically synthesized
aataaaattcagtgacttttca

SEQ ID NO: 1304864 - DNA, 22 bp, Artificial Sequence
  chemically synthesized
aggaaatcttaataaaattcag

SEQ ID NO: 1304865 - DNA, 22 bp, Artificial Sequence
  chemically synthesized
tcaggaaatcttaataaaattc

SEQ ID NO: 1304866 - DNA, 22 bp, Artificial Sequence
  chemically synthesized
aaaagtcactgaattttattaa

SEQ ID NO: 1304867 - DNA, 22 bp, Artificial Sequence
  chemically synthesized
atataccattctcaggaaatct

SEQ ID NO: 1304868 - DNA, 22 bp, Artificial Sequence
  chemically synthesized
aatataccattctcaggaaatc

SEQ ID NO: 1304869 - DNA, 22 bp, Artificial Sequence
  chemically synthesized
aattttattaagatttcctgag

SEQ ID NO: 1304870 - DNA, 22 bp, Artificial Sequence
  chemically synthesized
ttaatataccattctcaggaaa

SEQ ID NO: 1304871 - DNA, 22 bp, Artificial Sequence
  chemically synthesized
cttaatataccattctcaggaa

SEQ ID NO: 1304872 - DNA, 22 bp, Artificial Sequence
  chemically synthesized
tattaagatttcctgagaatgg

SEQ ID NO: 1304873 - DNA, 22 bp, Artificial Sequence
  chemically synthesized
attaagatttcctgagaatggt

SEQ ID NO: 1304874 - DNA, 22 bp, Artificial Sequence
  chemically synthesized
ttaagatttcctgagaatggta

SEQ ID NO: 1304875 - DNA, 22 bp, Artificial Sequence
  chemically synthesized
agatttcctgagaatggtatat

SEQ ID NO: 1304876 - DNA, 22 bp, Artificial Sequence
  chemically synthesized
acaggtttcttaatataccatt

SEQ ID NO: 1304877 - DNA, 22 bp, Artificial Sequence
  chemically synthesized
aacaggtttcttaatataccat

SEQ ID NO: 1304878 - DNA, 22 bp, Artificial Sequence
  chemically synthesized
atttaacaggtttcttaatata

SEQ ID NO: 1304879 - DNA, 22 bp, Artificial Sequence
  chemically synthesized
cctgagaatggtatattaagaa

SEQ ID NO: 1304880 - DNA, 22 bp, Artificial Sequence
  chemically synthesized
aatttaacaggtttcttaatat

SEQ ID NO: 1304881 - DNA, 22 bp, Artificial Sequence
  chemically synthesized
ctgagaatggtatattaagaaa

SEQ ID NO: 1304882 - DNA, 22 bp, Artificial Sequence
  chemically synthesized
taatttaacaggtttcttaata

SEQ ID NO: 1304883 - DNA, 22 bp, Artificial Sequence
  chemically synthesized
ttaatttaacaggtttcttaat

SEQ ID NO: 1304884 - DNA, 22 bp, Artificial Sequence
  chemically synthesized
agaatggtatattaagaaacct

SEQ ID NO: 1304885 - DNA, 22 bp, Artificial Sequence
  chemically synthesized
ttttaatttaacaggtttctta

SEQ ID NO: 1304886 - DNA, 22 bp, Artificial Sequence
  chemically synthesized
ctcttttaatttaacaggtttc

SEQ ID NO: 1304887 - DNA, 22 bp, Artificial Sequence
  chemically synthesized
gttcctcttttaatttaacagg

SEQ ID NO: 1304888 - DNA, 22 bp, Artificial Sequence
  chemically synthesized
ggttcctcttttaatttaacag

SEQ ID NO: 1304889 - DNA, 22 bp, Artificial Sequence
  chemically synthesized
tggttcctcttttaatttaaca

SEQ ID NO: 1304890 - DNA, 22 bp, Artificial Sequence
  chemically synthesized
ttttggttcctcttttaattta

SEQ ID NO: 1304891 - DNA, 22 bp, Artificial Sequence
  chemically synthesized
agaaacctgttaaattaaaaga

SEQ ID NO: 1304892 - DNA, 22 bp, Artificial Sequence
  chemically synthesized
tattttggttcctcttttaatt

SEQ ID NO: 1304893 - DNA, 22 bp, Artificial Sequence
  chemically synthesized
ctattttggttcctcttttaat

SEQ ID NO: 1304894 - DNA, 22 bp, Artificial Sequence
  chemically synthesized
aatttctattttggttcctctt

SEQ ID NO: 1304895 - DNA, 22 bp, Artificial Sequence
  chemically synthesized
ttaaattaaaagaggaaccaaa

SEQ ID NO: 1304896 - DNA, 22 bp, Artificial Sequence
  chemically synthesized
aattaaatttctattttggttc

SEQ ID NO: 1304897 - DNA, 22 bp, Artificial Sequence
  chemically synthesized
aattaaaagaggaaccaaaata

SEQ ID NO: 1304898 - DNA, 22 bp, Artificial Sequence
  chemically synthesized
aaagaggaaccaaaatagaaat

SEQ ID NO: 1304899 - DNA, 22 bp, Artificial Sequence
  chemically synthesized
tagctaaattaaatttctattt

SEQ ID NO: 1304900 - DNA, 22 bp, Artificial Sequence
  chemically synthesized
tatagctaaattaaatttctat

SEQ ID NO: 1304901 - DNA, 22 bp, Artificial Sequence
  chemically synthesized
ctatagctaaattaaatttcta

SEQ ID NO: 1304902 - DNA, 22 bp, Artificial Sequence
  chemically synthesized
tctatagctaaattaaatttct

SEQ ID NO: 1304903 - DNA, 22 bp, Artificial Sequence
  chemically synthesized
ttctatagctaaattaaatttc

SEQ ID NO: 1304904 - DNA, 22 bp, Artificial Sequence
  chemically synthesized
atttttctatagctaaattaaa

SEQ ID NO: 1304905 - DNA, 22 bp, Artificial Sequence
  chemically synthesized
ttaatttttctatagctaaatt

SEQ ID NO: 1304906 - DNA, 22 bp, Artificial Sequence
  chemically synthesized
attaatttttctatagctaaat

SEQ ID NO: 1304907 - DNA, 22 bp, Artificial Sequence
  chemically synthesized
tattaatttttctatagctaaa

SEQ ID NO: 1304908 - DNA, 22 bp, Artificial Sequence
  chemically synthesized
aatttagctatagaaaaattaa

SEQ ID NO: 1304909 - DNA, 22 bp, Artificial Sequence
  chemically synthesized
atttagctatagaaaaattaat

SEQ ID NO: 1304910 - DNA, 22 bp, Artificial Sequence
  chemically synthesized
aaaatggtattttattaatttt

SEQ ID NO: 1304911 - DNA, 22 bp, Artificial Sequence
  chemically synthesized
agctatagaaaaattaataaaa

SEQ ID NO: 1304912 - DNA, 22 bp, Artificial Sequence
  chemically synthesized
gctatagaaaaattaataaaat

SEQ ID NO: 1304913 - DNA, 22 bp, Artificial Sequence
  chemically synthesized
tagaaaaattaataaaatacca

SEQ ID NO: 1304914 - DNA, 22 bp, Artificial Sequence
  chemically synthesized
agtgggctaaaaatggtatttt

SEQ ID NO: 1304915 - DNA, 22 bp, Artificial Sequence
  chemically synthesized
aagtgggctaaaaatggtattt

SEQ ID NO: 1304916 - DNA, 22 bp, Artificial Sequence
  chemically synthesized
ataaaataccatttttagccca

SEQ ID NO: 1304917 - DNA, 22 bp, Artificial Sequence
  chemically synthesized
agtatcacacaaatttaagtgg

SEQ ID NO: 1304918 - DNA, 22 bp, Artificial Sequence
  chemically synthesized
cagtatcacacaaatttaagtg

SEQ ID NO: 1304919 - DNA, 22 bp, Artificial Sequence
  chemically synthesized
ttagcccacttaaatttgtgtg

SEQ ID NO: 1304920 - DNA, 22 bp, Artificial Sequence
  chemically synthesized
tagcccacttaaatttgtgtga

SEQ ID NO: 1304921 - DNA, 22 bp, Artificial Sequence
  chemically synthesized
agcccacttaaatttgtgtgat

SEQ ID NO: 1304922 - DNA, 22 bp, Artificial Sequence
  chemically synthesized
gcccacttaaatttgtgtgata

SEQ ID NO: 1304923 - DNA, 22 bp, Artificial Sequence
  chemically synthesized
aaatttgtgtgatactgaaatt

SEQ ID NO: 1304924 - DNA, 22 bp, Artificial Sequence
  chemically synthesized
aatttgtgtgatactgaaattt

SEQ ID NO: 1304925 - DNA, 22 bp, Artificial Sequence
  chemically synthesized
tagcaggaaaaaaaaatttcag

SEQ ID NO: 1304926 - DNA, 22 bp, Artificial Sequence
  chemically synthesized
gtgtgatactgaaatttttttt

SEQ ID NO: 1304927 - DNA, 22 bp, Artificial Sequence
  chemically synthesized
tgtgatactgaaattttttttt

SEQ ID NO: 1304928 - DNA, 22 bp, Artificial Sequence
  chemically synthesized
tacatctgtagcaggaaaaaaa

SEQ ID NO: 1304929 - DNA, 22 bp, Artificial Sequence
  chemically synthesized
aattatacatctgtagcaggaa

SEQ ID NO: 1304930 - DNA, 22 bp, Artificial Sequence
  chemically synthesized
aaatttttttttcctgctacag

SEQ ID NO: 1304931 - DNA, 22 bp, Artificial Sequence
  chemically synthesized
cactaaattatacatctgtagc

SEQ ID NO: 1304932 - DNA, 22 bp, Artificial Sequence
  chemically synthesized
gcactaaattatacatctgtag

SEQ ID NO: 1304933 - DNA, 22 bp, Artificial Sequence
  chemically synthesized
tgcactaaattatacatctgta

SEQ ID NO: 1304934 - DNA, 22 bp, Artificial Sequence
  chemically synthesized
ttttttcctgctacagatgtat

SEQ ID NO: 1304935 - DNA, 22 bp, Artificial Sequence
  chemically synthesized
tttttcctgctacagatgtata

SEQ ID NO: 1304936 - DNA, 22 bp, Artificial Sequence
  chemically synthesized
ttttcctgctacagatgtataa

SEQ ID NO: 1304937 - DNA, 22 bp, Artificial Sequence
  chemically synthesized
tttcctgctacagatgtataat

SEQ ID NO: 1304938 - DNA, 22 bp, Artificial Sequence
  chemically synthesized
ttcctgctacagatgtataatt

SEQ ID NO: 1304939 - DNA, 22 bp, Artificial Sequence
  chemically synthesized
tcctgctacagatgtataattt

SEQ ID NO: 1304940 - DNA, 22 bp, Artificial Sequence
  chemically synthesized
cacctttgcactaaattataca

SEQ ID NO: 1304941 - DNA, 22 bp, Artificial Sequence
  chemically synthesized
cctgctacagatgtataattta

SEQ ID NO: 1304942 - DNA, 22 bp, Artificial Sequence
  chemically synthesized
ctgctacagatgtataatttag

SEQ ID NO: 1304943 - DNA, 22 bp, Artificial Sequence
  chemically synthesized
ctacagatgtataatttagtgc

SEQ ID NO: 1304944 - DNA, 22 bp, Artificial Sequence
  chemically synthesized
ggccctacacctttgcactaaa

SEQ ID NO: 1304945 - DNA, 22 bp, Artificial Sequence
  chemically synthesized
cagatgtataatttagtgcaaa

SEQ ID NO: 1304946 - DNA, 22 bp, Artificial Sequence
  chemically synthesized
gggccctacacctttgcactaa

SEQ ID NO: 1304947 - DNA, 22 bp, Artificial Sequence
  chemically synthesized
acagtgaagccttgggccctac

SEQ ID NO: 1304948 - DNA, 22 bp, Artificial Sequence
  chemically synthesized
agtgcaaaggtgtagggcccaa

SEQ ID NO: 1304949 - DNA, 22 bp, Artificial Sequence
  chemically synthesized
gtgcaaaggtgtagggcccaag

SEQ ID NO: 1304950 - DNA, 22 bp, Artificial Sequence
  chemically synthesized
ctcacagtgaagccttgggccc

SEQ ID NO: 1304951 - DNA, 22 bp, Artificial Sequence
  chemically synthesized
cattcctcacagtgaagccttg

SEQ ID NO: 1304952 - DNA, 22 bp, Artificial Sequence
  chemically synthesized
acattcctcacagtgaagcctt

SEQ ID NO: 1304953 - DNA, 22 bp, Artificial Sequence
  chemically synthesized
gggagcacatttacattcctca

SEQ ID NO: 1304954 - DNA, 22 bp, Artificial Sequence
  chemically synthesized
ggggagcacatttacattcctc

SEQ ID NO: 1304955 - DNA, 22 bp, Artificial Sequence
  chemically synthesized
tggggagcacatttacattcct

SEQ ID NO: 1304956 - DNA, 22 bp, Artificial Sequence
  chemically synthesized
ttttggggagcacatttacatt

SEQ ID NO: 1304957 - DNA, 22 bp, Artificial Sequence
  chemically synthesized
cactgtgaggaatgtaaatgtg

SEQ ID NO: 1304958 - DNA, 22 bp, Artificial Sequence
  chemically synthesized
actgtgaggaatgtaaatgtgc

SEQ ID NO: 1304959 - DNA, 22 bp, Artificial Sequence
  chemically synthesized
tgaggaatgtaaatgtgctccc

SEQ ID NO: 1304960 - DNA, 22 bp, Artificial Sequence
  chemically synthesized
gtcaaaatcataaattattttg

SEQ ID NO: 1304961 - DNA, 22 bp, Artificial Sequence
  chemically synthesized
cccaaaataatttatgattttg

SEQ ID NO: 1304962 - DNA, 22 bp, Artificial Sequence
  chemically synthesized
tgcagacattagtcaaaatcat

SEQ ID NO: 1304963 - DNA, 22 bp, Artificial Sequence
  chemically synthesized
gtgcagacattagtcaaaatca

SEQ ID NO: 1304964 - DNA, 22 bp, Artificial Sequence
  chemically synthesized
tgtgcagacattagtcaaaatc

SEQ ID NO: 1304965 - DNA, 22 bp, Artificial Sequence
  chemically synthesized
tagtattttgtgcagacattag

SEQ ID NO: 1304966 - DNA, 22 bp, Artificial Sequence
  chemically synthesized
atgattttgactaatgtctgca

SEQ ID NO: 1304967 - DNA, 22 bp, Artificial Sequence
  chemically synthesized
tgattttgactaatgtctgcac

SEQ ID NO: 1304968 - DNA, 22 bp, Artificial Sequence
  chemically synthesized
tggactatagtattttgtgcag

SEQ ID NO: 1304969 - DNA, 22 bp, Artificial Sequence
  chemically synthesized
tgactaatgtctgcacaaaata

SEQ ID NO: 1304970 - DNA, 22 bp, Artificial Sequence
  chemically synthesized
gactaatgtctgcacaaaatac

SEQ ID NO: 1304971 - DNA, 22 bp, Artificial Sequence
  chemically synthesized
ttatggactatagtattttgtg

SEQ ID NO: 1304972 - DNA, 22 bp, Artificial Sequence
  chemically synthesized
actaatgtctgcacaaaatact

SEQ ID NO: 1304973 - DNA, 22 bp, Artificial Sequence
  chemically synthesized
atgtctgcacaaaatactatag

SEQ ID NO: 1304974 - DNA, 22 bp, Artificial Sequence
  chemically synthesized
aaacctgttatggactatagta

SEQ ID NO: 1304975 - DNA, 22 bp, Artificial Sequence
  chemically synthesized
gaaacctgttatggactatagt

SEQ ID NO: 1304976 - DNA, 22 bp, Artificial Sequence
  chemically synthesized
cacaaaatactatagtccataa

SEQ ID NO: 1304977 - DNA, 22 bp, Artificial Sequence
  chemically synthesized
taagatttgaaacctgttatgg

SEQ ID NO: 1304978 - DNA, 22 bp, Artificial Sequence
  chemically synthesized
ttataagatttgaaacctgtta

SEQ ID NO: 1304979 - DNA, 22 bp, Artificial Sequence
  chemically synthesized
tagtccataacaggtttcaaat

SEQ ID NO: 1304980 - DNA, 22 bp, Artificial Sequence
  chemically synthesized
atagttgttataagatttgaaa

SEQ ID NO: 1304981 - DNA, 22 bp, Artificial Sequence
  chemically synthesized
atagtattaatagttgttataa

SEQ ID NO: 1304982 - DNA, 22 bp, Artificial Sequence
  chemically synthesized
caaatcttataacaactattaa

SEQ ID NO: 1304983 - DNA, 22 bp, Artificial Sequence
  chemically synthesized
aaatcttataacaactattaat

SEQ ID NO: 1304984 - DNA, 22 bp, Artificial Sequence
  chemically synthesized
catgttgatagtattaatagtt

SEQ ID NO: 1304985 - DNA, 22 bp, Artificial Sequence
  chemically synthesized
tacatgttgatagtattaatag

SEQ ID NO: 1304986 - DNA, 22 bp, Artificial Sequence
  chemically synthesized
ctacatgttgatagtattaata

SEQ ID NO: 1304987 - DNA, 22 bp, Artificial Sequence
  chemically synthesized
tttctacatgttgatagtatta

SEQ ID NO: 1304988 - DNA, 22 bp, Artificial Sequence
  chemically synthesized
ataacaactattaatactatca

SEQ ID NO: 1304989 - DNA, 22 bp, Artificial Sequence
  chemically synthesized
atttctacatgttgatagtatt

SEQ ID NO: 1304990 - DNA, 22 bp, Artificial Sequence
  chemically synthesized
taacaactattaatactatcaa

SEQ ID NO: 1304991 - DNA, 22 bp, Artificial Sequence
  chemically synthesized
ttatttctacatgttgatagta

SEQ ID NO: 1304992 - DNA, 22 bp, Artificial Sequence
  chemically synthesized
cttatttctacatgttgatagt

SEQ ID NO: 1304993 - DNA, 22 bp, Artificial Sequence
  chemically synthesized
tcttatttctacatgttgatag

SEQ ID NO: 1304994 - DNA, 22 bp, Artificial Sequence
  chemically synthesized
agttttcttatttctacatgtt

SEQ ID NO: 1304995 - DNA, 22 bp, Artificial Sequence
  chemically synthesized
ttaatactatcaacatgtagaa

SEQ ID NO: 1304996 - DNA, 22 bp, Artificial Sequence
  chemically synthesized
atactatcaacatgtagaaata

SEQ ID NO: 1304997 - DNA, 22 bp, Artificial Sequence
  chemically synthesized
agcctcagttttcttatttcta

SEQ ID NO: 1304998 - DNA, 22 bp, Artificial Sequence
  chemically synthesized
taagcctcagttttcttatttc

SEQ ID NO: 1304999 - DNA, 22 bp, Artificial Sequence
  chemically synthesized
tcaacatgtagaaataagaaaa

SEQ ID NO: 1305000 - DNA, 22 bp, Artificial Sequence
  chemically synthesized
aggcttagagtggttggactct

SEQ ID NO: 1305001 - DNA, 22 bp, Artificial Sequence
  chemically synthesized
ggcaatcaatggatagagtcca

SEQ ID NO: 1305002 - DNA, 22 bp, Artificial Sequence
  chemically synthesized
agagtggttggactctatccat

SEQ ID NO: 1305003 - DNA, 22 bp, Artificial Sequence
  chemically synthesized
gagtggttggactctatccatt

SEQ ID NO: 1305004 - DNA, 22 bp, Artificial Sequence
  chemically synthesized
tcctgggcaatcaatggataga

SEQ ID NO: 1305005 - DNA, 22 bp, Artificial Sequence
  chemically synthesized
atgttatcctgggcaatcaatg

SEQ ID NO: 1305006 - DNA, 22 bp, Artificial Sequence
  chemically synthesized
gatgttatcctgggcaatcaat

SEQ ID NO: 1305007 - DNA, 22 bp, Artificial Sequence
  chemically synthesized
gactctatccattgattgccca

SEQ ID NO: 1305008 - DNA, 22 bp, Artificial Sequence
  chemically synthesized
tatccattgattgcccaggata

SEQ ID NO: 1305009 - DNA, 22 bp, Artificial Sequence
  chemically synthesized
tccattgattgcccaggataac

SEQ ID NO: 1305010 - DNA, 22 bp, Artificial Sequence
  chemically synthesized
attgcccaggataacatcaagt

SEQ ID NO: 1305011 - DNA, 22 bp, Artificial Sequence
  chemically synthesized
agcccccagtcagtcacttgat

SEQ ID NO: 1305012 - DNA, 22 bp, Artificial Sequence
  chemically synthesized
cccaggataacatcaagtgact

SEQ ID NO: 1305013 - DNA, 22 bp, Artificial Sequence
  chemically synthesized
gagcccccagtcagtcacttga

SEQ ID NO: 1305014 - DNA, 22 bp, Artificial Sequence
  chemically synthesized
tgagcccccagtcagtcacttg

SEQ ID NO: 1305015 - DNA, 22 bp, Artificial Sequence
  chemically synthesized
caatcaggagaacaattttgag

SEQ ID NO: 1305016 - DNA, 22 bp, Artificial Sequence
  chemically synthesized
acaatcaggagaacaattttga

SEQ ID NO: 1305017 - DNA, 22 bp, Artificial Sequence
  chemically synthesized
actgggggctcaaaattgttct

SEQ ID NO: 1305018 - DNA, 22 bp, Artificial Sequence
  chemically synthesized
atatttacaatcaggagaacaa

SEQ ID NO: 1305019 - DNA, 22 bp, Artificial Sequence
  chemically synthesized
ggggctcaaaattgttctcctg

SEQ ID NO: 1305020 - DNA, 22 bp, Artificial Sequence
  chemically synthesized
aaaattgttctcctgattgtaa

SEQ ID NO: 1305021 - DNA, 22 bp, Artificial Sequence
  chemically synthesized
ttctcctgattgtaaatatcaa

SEQ ID NO: 1305022 - DNA, 22 bp, Artificial Sequence
  chemically synthesized
tcctgattgtaaatatcaatcc

SEQ ID NO: 1305023 - DNA, 22 bp, Artificial Sequence
  chemically synthesized
ctgattgtaaatatcaatcctg

SEQ ID NO: 1305024 - DNA, 22 bp, Artificial Sequence
  chemically synthesized
attgtaaatatcaatcctgttt

SEQ ID NO: 1305025 - DNA, 22 bp, Artificial Sequence
  chemically synthesized
taaatatcaatcctgtttccta

SEQ ID NO: 1305026 - DNA, 22 bp, Artificial Sequence
  chemically synthesized
tttcctatacttgtccatatac

SEQ ID NO: 1305027 - DNA, 22 bp, Artificial Sequence
  chemically synthesized
cctatacttgtccatatacttc

SEQ ID NO: 1305028 - DNA, 22 bp, Artificial Sequence
  chemically synthesized
ctatacttgtccatatacttcc

SEQ ID NO: 1305029 - DNA, 22 bp, Artificial Sequence
  chemically synthesized
tacttgtccatatacttcctga

SEQ ID NO: 1305030 - DNA, 22 bp, Artificial Sequence
  chemically synthesized
agcaccaaataggcatcaggaa

SEQ ID NO: 1305031 - DNA, 22 bp, Artificial Sequence
  chemically synthesized
gtccatatacttcctgatgcct

SEQ ID NO: 1305032 - DNA, 22 bp, Artificial Sequence
  chemically synthesized
tccatatacttcctgatgccta

SEQ ID NO: 1305033 - DNA, 22 bp, Artificial Sequence
  chemically synthesized
ttgagcaccaaataggcatcag

SEQ ID NO: 1305034 - DNA, 22 bp, Artificial Sequence
  chemically synthesized
aaagttattgagcaccaaatag

SEQ ID NO: 1305035 - DNA, 22 bp, Artificial Sequence
  chemically synthesized
cctgatgcctatttggtgctca

SEQ ID NO: 1305036 - DNA, 22 bp, Artificial Sequence
  chemically synthesized
ctgatgcctatttggtgctcaa

SEQ ID NO: 1305037 - DNA, 22 bp, Artificial Sequence
  chemically synthesized
aatctaaaagttattgagcacc

SEQ ID NO: 1305038 - DNA, 22 bp, Artificial Sequence
  chemically synthesized
atgcctatttggtgctcaataa

SEQ ID NO: 1305039 - DNA, 22 bp, Artificial Sequence
  chemically synthesized
ctcaatctaaaagttattgagc

SEQ ID NO: 1305040 - DNA, 22 bp, Artificial Sequence
  chemically synthesized
actcaatctaaaagttattgag

SEQ ID NO: 1305041 - DNA, 22 bp, Artificial Sequence
  chemically synthesized
tactcaatctaaaagttattga

SEQ ID NO: 1305042 - DNA, 22 bp, Artificial Sequence
  chemically synthesized
ttactcaatctaaaagttattg

SEQ ID NO: 1305043 - DNA, 22 bp, Artificial Sequence
  chemically synthesized
ttttactcaatctaaaagttat

SEQ ID NO: 1305044 - DNA, 22 bp, Artificial Sequence
  chemically synthesized
tttggtgctcaataacttttag

SEQ ID NO: 1305045 - DNA, 22 bp, Artificial Sequence
  chemically synthesized
ggtgctcaataacttttagatt

SEQ ID NO: 1305046 - DNA, 22 bp, Artificial Sequence
  chemically synthesized
attcttttactcaatctaaaag

SEQ ID NO: 1305047 - DNA, 22 bp, Artificial Sequence
  chemically synthesized
gtgctcaataacttttagattg

SEQ ID NO: 1305048 - DNA, 22 bp, Artificial Sequence
  chemically synthesized
ttcattcttttactcaatctaa

SEQ ID NO: 1305049 - DNA, 22 bp, Artificial Sequence
  chemically synthesized
gttcattcttttactcaatcta

SEQ ID NO: 1305050 - DNA, 22 bp, Artificial Sequence
  chemically synthesized
tgttcattcttttactcaatct

SEQ ID NO: 1305051 - DNA, 22 bp, Artificial Sequence
  chemically synthesized
ttgttcattcttttactcaatc

SEQ ID NO: 1305052 - DNA, 22 bp, Artificial Sequence
  chemically synthesized
aataacttttagattgagtaaa

SEQ ID NO: 1305053 - DNA, 22 bp, Artificial Sequence
  chemically synthesized
ttagattgagtaaaagaatgaa

SEQ ID NO: 1305054 - DNA, 22 bp, Artificial Sequence
  chemically synthesized
tagattgagtaaaagaatgaac

SEQ ID NO: 1305055 - DNA, 22 bp, Artificial Sequence
  chemically synthesized
agattgagtaaaagaatgaaca

SEQ ID NO: 1305056 - DNA, 22 bp, Artificial Sequence
  chemically synthesized
gattgagtaaaagaatgaacaa

SEQ ID NO: 1305057 - DNA, 22 bp, Artificial Sequence
  chemically synthesized
aataaatacatgtttttgttca

SEQ ID NO: 1305058 - DNA, 22 bp, Artificial Sequence
  chemically synthesized
agtaaaagaatgaacaaaaaca

SEQ ID NO: 1305059 - DNA, 22 bp, Artificial Sequence
  chemically synthesized
cgggcactaaataaatacatgt

SEQ ID NO: 1305060 - DNA, 22 bp, Artificial Sequence
  chemically synthesized
ccgggcactaaataaatacatg

SEQ ID NO: 1305061 - DNA, 22 bp, Artificial Sequence
  chemically synthesized
tgccccttccgggcactaaata

SEQ ID NO: 1305062 - DNA, 22 bp, Artificial Sequence
  chemically synthesized
ctatgccccttccgggcactaa

SEQ ID NO: 1305063 - DNA, 22 bp, Artificial Sequence
  chemically synthesized
gctatgccccttccgggcacta

SEQ ID NO: 1305064 - DNA, 22 bp, Artificial Sequence
  chemically synthesized
tttgctatgccccttccgggca

SEQ ID NO: 1305065 - DNA, 22 bp, Artificial Sequence
  chemically synthesized
atttagtgcccggaaggggcat

SEQ ID NO: 1305066 - DNA, 22 bp, Artificial Sequence
  chemically synthesized
tttagtgcccggaaggggcata

SEQ ID NO: 1305067 - DNA, 22 bp, Artificial Sequence
  chemically synthesized
agtgcccggaaggggcatagca

SEQ ID NO: 1305068 - DNA, 22 bp, Artificial Sequence
  chemically synthesized
gtgcccggaaggggcatagcaa

SEQ ID NO: 1305069 - DNA, 22 bp, Artificial Sequence
  chemically synthesized
tgtgagataggaaaggatatca

SEQ ID NO: 1305070 - DNA, 22 bp, Artificial Sequence
  chemically synthesized
aatgctatgtgagataggaaag

SEQ ID NO: 1305071 - DNA, 22 bp, Artificial Sequence
  chemically synthesized
tactgaatgctatgtgagatag

SEQ ID NO: 1305072 - DNA, 22 bp, Artificial Sequence
  chemically synthesized
atatcctttcctatctcacata

SEQ ID NO: 1305073 - DNA, 22 bp, Artificial Sequence
  chemically synthesized
ctgtactgaatgctatgtgaga

SEQ ID NO: 1305074 - DNA, 22 bp, Artificial Sequence
  chemically synthesized
gctgtactgaatgctatgtgag

SEQ ID NO: 1305075 - DNA, 22 bp, Artificial Sequence
  chemically synthesized
tgctgtactgaatgctatgtga

SEQ ID NO: 1305076 - DNA, 22 bp, Artificial Sequence
  chemically synthesized
ctttgctgtactgaatgctatg

SEQ ID NO: 1305077 - DNA, 22 bp, Artificial Sequence
  chemically synthesized
actttgctgtactgaatgctat

SEQ ID NO: 1305078 - DNA, 22 bp, Artificial Sequence
  chemically synthesized
tcctatctcacatagcattcag

SEQ ID NO: 1305079 - DNA, 22 bp, Artificial Sequence
  chemically synthesized
cctatctcacatagcattcagt

SEQ ID NO: 1305080 - DNA, 22 bp, Artificial Sequence
  chemically synthesized
ctatctcacatagcattcagta

SEQ ID NO: 1305081 - DNA, 22 bp, Artificial Sequence
  chemically synthesized
cttactttgctgtactgaatgc

SEQ ID NO: 1305082 - DNA, 22 bp, Artificial Sequence
  chemically synthesized
gcttactttgctgtactgaatg

SEQ ID NO: 1305083 - DNA, 22 bp, Artificial Sequence
  chemically synthesized
tgcttactttgctgtactgaat

SEQ ID NO: 1305084 - DNA, 22 bp, Artificial Sequence
  chemically synthesized
tctcacatagcattcagtacag

SEQ ID NO: 1305085 - DNA, 22 bp, Artificial Sequence
  chemically synthesized
acatagcattcagtacagcaaa

SEQ ID NO: 1305086 - DNA, 22 bp, Artificial Sequence
  chemically synthesized
aattttgcttactttgctgtac

SEQ ID NO: 1305087 - DNA, 22 bp, Artificial Sequence
  chemically synthesized
ctcaattttgcttactttgctg

SEQ ID NO: 1305088 - DNA, 22 bp, Artificial Sequence
  chemically synthesized
cctcctcaattttgcttacttt

SEQ ID NO: 1305089 - DNA, 22 bp, Artificial Sequence
  chemically synthesized
agtacagcaaagtaagcaaaat

SEQ ID NO: 1305090 - DNA, 22 bp, Artificial Sequence
  chemically synthesized
aaattccctcctcaattttgct

SEQ ID NO: 1305091 - DNA, 22 bp, Artificial Sequence
  chemically synthesized
ttaaaattccctcctcaatttt

SEQ ID NO: 1305092 - DNA, 22 bp, Artificial Sequence
  chemically synthesized
aacattattaaaattccctcct

SEQ ID NO: 1305093 - DNA, 22 bp, Artificial Sequence
  chemically synthesized
tagatgttcaacattattaaaa

SEQ ID NO: 1305094 - DNA, 22 bp, Artificial Sequence
  chemically synthesized
gtagatgttcaacattattaaa

SEQ ID NO: 1305095 - DNA, 22 bp, Artificial Sequence
  chemically synthesized
aggagggaattttaataatgtt

SEQ ID NO: 1305096 - DNA, 22 bp, Artificial Sequence
  chemically synthesized
gcaatttgtagatgttcaacat

SEQ ID NO: 1305097 - DNA, 22 bp, Artificial Sequence
  chemically synthesized
taataatgttgaacatctacaa

SEQ ID NO: 1305098 - DNA, 22 bp, Artificial Sequence
  chemically synthesized
aataatgttgaacatctacaaa

SEQ ID NO: 1305099 - DNA, 22 bp, Artificial Sequence
  chemically synthesized
agtgtctagcaatttgtagatg

SEQ ID NO: 1305100 - DNA, 22 bp, Artificial Sequence
  chemically synthesized
ataatgttgaacatctacaaat

SEQ ID NO: 1305101 - DNA, 22 bp, Artificial Sequence
  chemically synthesized
aacatctacaaattgctagaca

SEQ ID NO: 1305102 - DNA, 22 bp, Artificial Sequence
  chemically synthesized
caaattgctagacactgagatt

SEQ ID NO: 1305103 - DNA, 22 bp, Artificial Sequence
  chemically synthesized
aaaagtgcataaaaatctcagt

SEQ ID NO: 1305104 - DNA, 22 bp, Artificial Sequence
  chemically synthesized
aaaaagtgcataaaaatctcag

SEQ ID NO: 1305105 - DNA, 22 bp, Artificial Sequence
  chemically synthesized
ctagacactgagatttttatgc

SEQ ID NO: 1305106 - DNA, 22 bp, Artificial Sequence
  chemically synthesized
aacttaaaaagtgcataaaaat

SEQ ID NO: 1305107 - DNA, 22 bp, Artificial Sequence
  chemically synthesized
gacactgagatttttatgcact

SEQ ID NO: 1305108 - DNA, 22 bp, Artificial Sequence
  chemically synthesized
agatttttatgcactttttaag

SEQ ID NO: 1305109 - DNA, 22 bp, Artificial Sequence
  chemically synthesized
acacgaagattaaacttaaaaa

SEQ ID NO: 1305110 - DNA, 22 bp, Artificial Sequence
  chemically synthesized
ttatgcactttttaagtttaat

SEQ ID NO: 1305111 - DNA, 22 bp, Artificial Sequence
  chemically synthesized
tatgcactttttaagtttaatc

SEQ ID NO: 1305112 - DNA, 22 bp, Artificial Sequence
  chemically synthesized
atgcactttttaagtttaatct

SEQ ID NO: 1305113 - DNA, 22 bp, Artificial Sequence
  chemically synthesized
tgcactttttaagtttaatctt

SEQ ID NO: 1305114 - DNA, 22 bp, Artificial Sequence
  chemically synthesized
tttaagtttaatcttcgtgtta

SEQ ID NO: 1305115 - DNA, 22 bp, Artificial Sequence
  chemically synthesized
ttaagtttaatcttcgtgttaa

SEQ ID NO: 1305116 - DNA, 22 bp, Artificial Sequence
  chemically synthesized
taagtttaatcttcgtgttaat

SEQ ID NO: 1305117 - DNA, 22 bp, Artificial Sequence
  chemically synthesized
aagtttaatcttcgtgttaatc

SEQ ID NO: 1305118 - DNA, 22 bp, Artificial Sequence
  chemically synthesized
atatgtaatgtggattaacacg

SEQ ID NO: 1305119 - DNA, 22 bp, Artificial Sequence
  chemically synthesized
agtttaatcttcgtgttaatcc

SEQ ID NO: 1305120 - DNA, 22 bp, Artificial Sequence
  chemically synthesized
ctcatatgtaatgtggattaac

SEQ ID NO: 1305121 - DNA, 22 bp, Artificial Sequence
  chemically synthesized
cctcatatgtaatgtggattaa

SEQ ID NO: 1305122 - DNA, 22 bp, Artificial Sequence
  chemically synthesized
aatcttcgtgttaatccacatt

SEQ ID NO: 1305123 - DNA, 22 bp, Artificial Sequence
  chemically synthesized
atcttcgtgttaatccacatta

SEQ ID NO: 1305124 - DNA, 22 bp, Artificial Sequence
  chemically synthesized
catttcctcatatgtaatgtgg

SEQ ID NO: 1305125 - DNA, 22 bp, Artificial Sequence
  chemically synthesized
tccatttcctcatatgtaatgt

SEQ ID NO: 1305126 - DNA, 22 bp, Artificial Sequence
  chemically synthesized
cgtgttaatccacattacatat

SEQ ID NO: 1305127 - DNA, 22 bp, Artificial Sequence
  chemically synthesized
gtgttaatccacattacatatg

SEQ ID NO: 1305128 - DNA, 22 bp, Artificial Sequence
  chemically synthesized
tctccatttcctcatatgtaat

SEQ ID NO: 1305129 - DNA, 22 bp, Artificial Sequence
  chemically synthesized
tctctccatttcctcatatgta

SEQ ID NO: 1305130 - DNA, 22 bp, Artificial Sequence
  chemically synthesized
atccacattacatatgaggaaa

SEQ ID NO: 1305131 - DNA, 22 bp, Artificial Sequence
  chemically synthesized
tattctctctccatttcctcat

SEQ ID NO: 1305132 - DNA, 22 bp, Artificial Sequence
  chemically synthesized
acaaactatattctctctccat

SEQ ID NO: 1305133 - DNA, 22 bp, Artificial Sequence
  chemically synthesized
catatgaggaaatggagagaga

SEQ ID NO: 1305134 - DNA, 22 bp, Artificial Sequence
  chemically synthesized
gacaaactatattctctctcca

SEQ ID NO: 1305135 - DNA, 22 bp, Artificial Sequence
  chemically synthesized
ccttgacaaactatattctctc

SEQ ID NO: 1305136 - DNA, 22 bp, Artificial Sequence
  chemically synthesized
tggccattaccttgacaaacta

SEQ ID NO: 1305137 - DNA, 22 bp, Artificial Sequence
  chemically synthesized
tatggactatggccattacctt

SEQ ID NO: 1305138 - DNA, 22 bp, Artificial Sequence
  chemically synthesized
aaattatatggactatggccat

SEQ ID NO: 1305139 - DNA, 22 bp, Artificial Sequence
  chemically synthesized
gtcaaggtaatggccatagtcc

SEQ ID NO: 1305140 - DNA, 22 bp, Artificial Sequence
  chemically synthesized
tcaaggtaatggccatagtcca

SEQ ID NO: 1305141 - DNA, 22 bp, Artificial Sequence
  chemically synthesized
gtaggtggcacatagtaagcac

SEQ ID NO: 1305142 - DNA, 22 bp, Artificial Sequence
  chemically synthesized
agtaggtggcacatagtaagca

SEQ ID NO: 1305143 - DNA, 22 bp, Artificial Sequence
  chemically synthesized
aagtgtttagtaggtggcacat

SEQ ID NO: 1305144 - DNA, 22 bp, Artificial Sequence
  chemically synthesized
gagtgcttactatgtgccacct

SEQ ID NO: 1305145 - DNA, 22 bp, Artificial Sequence
  chemically synthesized
aaagtgtttagtaggtggcaca

SEQ ID NO: 1305146 - DNA, 22 bp, Artificial Sequence
  chemically synthesized
agtgcttactatgtgccaccta

SEQ ID NO: 1305147 - DNA, 22 bp, Artificial Sequence
  chemically synthesized
actatgtgccacctactaaaca

SEQ ID NO: 1305148 - DNA, 22 bp, Artificial Sequence
  chemically synthesized
atgtgtttaaagtgtttagtag

SEQ ID NO: 1305149 - DNA, 22 bp, Artificial Sequence
  chemically synthesized
ctatgtgccacctactaaacac

SEQ ID NO: 1305150 - DNA, 22 bp, Artificial Sequence
  chemically synthesized
tgtgccacctactaaacacttt

SEQ ID NO: 1305151 - DNA, 22 bp, Artificial Sequence
  chemically synthesized
ctaaacactttaaacacatgaa

SEQ ID NO: 1305152 - DNA, 22 bp, Artificial Sequence
  chemically synthesized
aacactttaaacacatgaacat

SEQ ID NO: 1305153 - DNA, 22 bp, Artificial Sequence
  chemically synthesized
tgaaaatgaagtatgttcatgt

SEQ ID NO: 1305154 - DNA, 22 bp, Artificial Sequence
  chemically synthesized
taaacacatgaacatacttcat

SEQ ID NO: 1305155 - DNA, 22 bp, Artificial Sequence
  chemically synthesized
aaacacatgaacatacttcatt

SEQ ID NO: 1305156 - DNA, 22 bp, Artificial Sequence
  chemically synthesized
aacacatgaacatacttcattt

SEQ ID NO: 1305157 - DNA, 22 bp, Artificial Sequence
  chemically synthesized
caaggtctgtgaaaatgaagta

SEQ ID NO: 1305158 - DNA, 22 bp, Artificial Sequence
  chemically synthesized
acaaggtctgtgaaaatgaagt

SEQ ID NO: 1305159 - DNA, 22 bp, Artificial Sequence
  chemically synthesized
ttacaaggtctgtgaaaatgaa

SEQ ID NO: 1305160 - DNA, 22 bp, Artificial Sequence
  chemically synthesized
tcttacaaggtctgtgaaaatg

SEQ ID NO: 1305161 - DNA, 22 bp, Artificial Sequence
  chemically synthesized
cattttcacagaccttgtaaga

SEQ ID NO: 1305162 - DNA, 22 bp, Artificial Sequence
  chemically synthesized
attttcacagaccttgtaagag

SEQ ID NO: 1305163 - DNA, 22 bp, Artificial Sequence
  chemically synthesized
tcacagaccttgtaagagaggt

SEQ ID NO: 1305164 - DNA, 22 bp, Artificial Sequence
  chemically synthesized
cacagaccttgtaagagaggta

SEQ ID NO: 1305165 - DNA, 22 bp, Artificial Sequence
  chemically synthesized
acagaccttgtaagagaggtac

SEQ ID NO: 1305166 - DNA, 22 bp, Artificial Sequence
  chemically synthesized
gtaagagaggtacttctcttga

SEQ ID NO: 1305167 - DNA, 22 bp, Artificial Sequence
  chemically synthesized
taagagaggtacttctcttgac

SEQ ID NO: 1305168 - DNA, 22 bp, Artificial Sequence
  chemically synthesized
tccatacaatagggtcaagaga

SEQ ID NO: 1305169 - DNA, 22 bp, Artificial Sequence
  chemically synthesized
ctatccatacaatagggtcaag

SEQ ID NO: 1305170 - DNA, 22 bp, Artificial Sequence
  chemically synthesized
cctatccatacaatagggtcaa

SEQ ID NO: 1305171 - DNA, 22 bp, Artificial Sequence
  chemically synthesized
tttcctatccatacaatagggt

SEQ ID NO: 1305172 - DNA, 22 bp, Artificial Sequence
  chemically synthesized
gtttcctatccatacaataggg

SEQ ID NO: 1305173 - DNA, 22 bp, Artificial Sequence
  chemically synthesized
tgtttcctatccatacaatagg

SEQ ID NO: 1305174 - DNA, 22 bp, Artificial Sequence
  chemically synthesized
ctcttgaccctattgtatggat

SEQ ID NO: 1305175 - DNA, 22 bp, Artificial Sequence
  chemically synthesized
tcttgaccctattgtatggata

SEQ ID NO: 1305176 - DNA, 22 bp, Artificial Sequence
  chemically synthesized
agctttgtttcctatccataca

SEQ ID NO: 1305177 - DNA, 22 bp, Artificial Sequence
  chemically synthesized
ttgaccctattgtatggatagg

SEQ ID NO: 1305178 - DNA, 22 bp, Artificial Sequence
  chemically synthesized
gaccctattgtatggataggaa

SEQ ID NO: 1305179 - DNA, 22 bp, Artificial Sequence
  chemically synthesized
gctaagctttgtttcctatcca

SEQ ID NO: 1305180 - DNA, 22 bp, Artificial Sequence
  chemically synthesized
accctattgtatggataggaaa

SEQ ID NO: 1305181 - DNA, 22 bp, Artificial Sequence
  chemically synthesized
acctcgctaagctttgtttcct

SEQ ID NO: 1305182 - DNA, 22 bp, Artificial Sequence
  chemically synthesized
aacctcgctaagctttgtttcc

SEQ ID NO: 1305183 - DNA, 22 bp, Artificial Sequence
  chemically synthesized
ttgtatggataggaaacaaagc

SEQ ID NO: 1305184 - DNA, 22 bp, Artificial Sequence
  chemically synthesized
cttaacctcgctaagctttgtt

SEQ ID NO: 1305185 - DNA, 22 bp, Artificial Sequence
  chemically synthesized
tatggataggaaacaaagctta

SEQ ID NO: 1305186 - DNA, 22 bp, Artificial Sequence
  chemically synthesized
ggcagttacttaacctcgctaa

SEQ ID NO: 1305187 - DNA, 22 bp, Artificial Sequence
  chemically synthesized
gggcagttacttaacctcgcta

SEQ ID NO: 1305188 - DNA, 22 bp, Artificial Sequence
  chemically synthesized
tatgaacttgggcagttactta

SEQ ID NO: 1305189 - DNA, 22 bp, Artificial Sequence
  chemically synthesized
agcgaggttaagtaactgccca

SEQ ID NO: 1305190 - DNA, 22 bp, Artificial Sequence
  chemically synthesized
gcgaggttaagtaactgcccaa

SEQ ID NO: 1305191 - DNA, 22 bp, Artificial Sequence
  chemically synthesized
caaagtagctatatgaacttgg

SEQ ID NO: 1305192 - DNA, 22 bp, Artificial Sequence
  chemically synthesized
agtaactgcccaagttcatata

SEQ ID NO: 1305193 - DNA, 22 bp, Artificial Sequence
  chemically synthesized
ctgcaaagtagctatatgaact

SEQ ID NO: 1305194 - DNA, 22 bp, Artificial Sequence
  chemically synthesized
atctactgcaaagtagctatat

SEQ ID NO: 1305195 - DNA, 22 bp, Artificial Sequence
  chemically synthesized
cccaagttcatatagctacttt

SEQ ID NO: 1305196 - DNA, 22 bp, Artificial Sequence
  chemically synthesized
tgctcatctactgcaaagtagc

SEQ ID NO: 1305197 - DNA, 22 bp, Artificial Sequence
  chemically synthesized
gtgctcatctactgcaaagtag

SEQ ID NO: 1305198 - DNA, 22 bp, Artificial Sequence
  chemically synthesized
aatttgtgctcatctactgcaa

SEQ ID NO: 1305199 - DNA, 22 bp, Artificial Sequence
  chemically synthesized
atatagctactttgcagtagat

SEQ ID NO: 1305200 - DNA, 22 bp, Artificial Sequence
  chemically synthesized
caatttgtgctcatctactgca

SEQ ID NO: 1305201 - DNA, 22 bp, Artificial Sequence
  chemically synthesized
ctttgcagtagatgagcacaaa

SEQ ID NO: 1305202 - DNA, 22 bp, Artificial Sequence
  chemically synthesized
tgcagtagatgagcacaaattg

SEQ ID NO: 1305203 - DNA, 22 bp, Artificial Sequence
  chemically synthesized
gcagtagatgagcacaaattga

SEQ ID NO: 1305204 - DNA, 22 bp, Artificial Sequence
  chemically synthesized
cagtagatgagcacaaattgaa

SEQ ID NO: 1305205 - DNA, 22 bp, Artificial Sequence
  chemically synthesized
gagaagcatgagtttcaatttg

SEQ ID NO: 1305206 - DNA, 22 bp, Artificial Sequence
  chemically synthesized
ataatggagttagagaagcatg

SEQ ID NO: 1305207 - DNA, 22 bp, Artificial Sequence
  chemically synthesized
ggttaataatggagttagagaa

SEQ ID NO: 1305208 - DNA, 22 bp, Artificial Sequence
  chemically synthesized
aaactcatgcttctctaactcc

SEQ ID NO: 1305209 - DNA, 22 bp, Artificial Sequence
  chemically synthesized
ttgggttaataatggagttaga

SEQ ID NO: 1305210 - DNA, 22 bp, Artificial Sequence
  chemically synthesized
ctattgggttaataatggagtt

SEQ ID NO: 1305211 - DNA, 22 bp, Artificial Sequence
  chemically synthesized
atgcttctctaactccattatt

SEQ ID NO: 1305212 - DNA, 22 bp, Artificial Sequence
  chemically synthesized
ctctaactccattattaaccca

SEQ ID NO: 1305213 - DNA, 22 bp, Artificial Sequence
  chemically synthesized
agcacctgctattgggttaata

SEQ ID NO: 1305214 - DNA, 22 bp, Artificial Sequence
  chemically synthesized
tctaactccattattaacccaa

SEQ ID NO: 1305215 - DNA, 22 bp, Artificial Sequence
  chemically synthesized
cagcacctgctattgggttaat

SEQ ID NO: 1305216 - DNA, 22 bp, Artificial Sequence
  chemically synthesized
tcagcacctgctattgggttaa

SEQ ID NO: 1305217 - DNA, 22 bp, Artificial Sequence
  chemically synthesized
taactccattattaacccaata

SEQ ID NO: 1305218 - DNA, 22 bp, Artificial Sequence
  chemically synthesized
actccattattaacccaatagc

SEQ ID NO: 1305219 - DNA, 22 bp, Artificial Sequence
  chemically synthesized
cattattaacccaatagcaggt

SEQ ID NO: 1305220 - DNA, 22 bp, Artificial Sequence
  chemically synthesized
ttaacccaatagcaggtgctga

SEQ ID NO: 1305221 - DNA, 22 bp, Artificial Sequence
  chemically synthesized
acccaatagcaggtgctgaaaa

SEQ ID NO: 1305222 - DNA, 22 bp, Artificial Sequence
  chemically synthesized
tcagcaacacgatcagtgattt

SEQ ID NO: 1305223 - DNA, 22 bp, Artificial Sequence
  chemically synthesized
gtcagcaacacgatcagtgatt

SEQ ID NO: 1305224 - DNA, 22 bp, Artificial Sequence
  chemically synthesized
tgtcagcaacacgatcagtgat

SEQ ID NO: 1305225 - DNA, 22 bp, Artificial Sequence
  chemically synthesized
ctttgtcagcaacacgatcagt

SEQ ID NO: 1305226 - DNA, 22 bp, Artificial Sequence
  chemically synthesized
tcctttgtcagcaacacgatca

SEQ ID NO: 1305227 - DNA, 22 bp, Artificial Sequence
  chemically synthesized
ctctcctttgtcagcaacacga

SEQ ID NO: 1305228 - DNA, 22 bp, Artificial Sequence
  chemically synthesized
aaaatcactgatcgtgttgctg

SEQ ID NO: 1305229 - DNA, 22 bp, Artificial Sequence
  chemically synthesized
actctcctttgtcagcaacacg

SEQ ID NO: 1305230 - DNA, 22 bp, Artificial Sequence
  chemically synthesized
tttactctcctttgtcagcaac

SEQ ID NO: 1305231 - DNA, 22 bp, Artificial Sequence
  chemically synthesized
ttgtttactctcctttgtcagc

SEQ ID NO: 1305232 - DNA, 22 bp, Artificial Sequence
  chemically synthesized
atcgtgttgctgacaaaggaga

SEQ ID NO: 1305233 - DNA, 22 bp, Artificial Sequence
  chemically synthesized
tgtggctattgtttactctcct

SEQ ID NO: 1305234 - DNA, 22 bp, Artificial Sequence
  chemically synthesized
ttatgtggctattgtttactct

SEQ ID NO: 1305235 - DNA, 22 bp, Artificial Sequence
  chemically synthesized
ctgacaaaggagagtaaacaat

SEQ ID NO: 1305236 - DNA, 22 bp, Artificial Sequence
  chemically synthesized
acaaaggagagtaaacaatagc

SEQ ID NO: 1305237 - DNA, 22 bp, Artificial Sequence
  chemically synthesized
gatagtattattatgtggctat

SEQ ID NO: 1305238 - DNA, 22 bp, Artificial Sequence
  chemically synthesized
agatagtattattatgtggcta

SEQ ID NO: 1305239 - DNA, 22 bp, Artificial Sequence
  chemically synthesized
ccttagatagtattattatgtg

SEQ ID NO: 1305240 - DNA, 22 bp, Artificial Sequence
  chemically synthesized
ggtacatcagtaatgttccctt

SEQ ID NO: 1305241 - DNA, 22 bp, Artificial Sequence
  chemically synthesized
tctaagggaacattactgatgt

SEQ ID NO: 1305242 - DNA, 22 bp, Artificial Sequence
  chemically synthesized
aaaaatctaggtacatcagtaa

SEQ ID NO: 1305243 - DNA, 22 bp, Artificial Sequence
  chemically synthesized
aaaaaatctaggtacatcagta

SEQ ID NO: 1305244 - DNA, 22 bp, Artificial Sequence
  chemically synthesized
agggaacattactgatgtacct

SEQ ID NO: 1305245 - DNA, 22 bp, Artificial Sequence
  chemically synthesized
ctgatgtacctagattttttaa

SEQ ID NO: 1305246 - DNA, 22 bp, Artificial Sequence
  chemically synthesized
atgtacctagattttttaaact

SEQ ID NO: 1305247 - DNA, 22 bp, Artificial Sequence
  chemically synthesized
ataaataaaagaaagtttaaaa

SEQ ID NO: 1305248 - DNA, 22 bp, Artificial Sequence
  chemically synthesized
cataaataaaagaaagtttaaa

SEQ ID NO: 1305249 - DNA, 22 bp, Artificial Sequence
  chemically synthesized
tcataaataaaagaaagtttaa

SEQ ID NO: 1305250 - DNA, 22 bp, Artificial Sequence
  chemically synthesized
ttttcataaataaaagaaagtt

SEQ ID NO: 1305251 - DNA, 22 bp, Artificial Sequence
  chemically synthesized
attttcataaataaaagaaagt

SEQ ID NO: 1305252 - DNA, 22 bp, Artificial Sequence
  chemically synthesized
tattttcataaataaaagaaag

SEQ ID NO: 1305253 - DNA, 22 bp, Artificial Sequence
  chemically synthesized
gattttttaaactttcttttat

SEQ ID NO: 1305254 - DNA, 22 bp, Artificial Sequence
  chemically synthesized
ttattttcataaataaaagaaa

SEQ ID NO: 1305255 - DNA, 22 bp, Artificial Sequence
  chemically synthesized
atttttattttcataaataaaa

SEQ ID NO: 1305256 - DNA, 22 bp, Artificial Sequence
  chemically synthesized
tttaaactttcttttatttatg

SEQ ID NO: 1305257 - DNA, 22 bp, Artificial Sequence
  chemically synthesized
ttaaactttcttttatttatga

SEQ ID NO: 1305258 - DNA, 22 bp, Artificial Sequence
  chemically synthesized
taaactttcttttatttatgaa

SEQ ID NO: 1305259 - DNA, 22 bp, Artificial Sequence
  chemically synthesized
aaactttcttttatttatgaaa

SEQ ID NO: 1305260 - DNA, 22 bp, Artificial Sequence
  chemically synthesized
aactttcttttatttatgaaaa

SEQ ID NO: 1305261 - DNA, 22 bp, Artificial Sequence
  chemically synthesized
tcttttatttatgaaaataaaa

SEQ ID NO: 1305262 - DNA, 22 bp, Artificial Sequence
  chemically synthesized
cttttatttatgaaaataaaaa

SEQ ID NO: 1305263 - DNA, 22 bp, Artificial Sequence
  chemically synthesized
ttttatttatgaaaataaaaat

SEQ ID NO: 1305264 - DNA, 22 bp, Artificial Sequence
  chemically synthesized
ttatttatgaaaataaaaatga

SEQ ID NO: 1305265 - DNA, 22 bp, Artificial Sequence
  chemically synthesized
tatttatgaaaataaaaatgaa

SEQ ID NO: 1305266 - DNA, 22 bp, Artificial Sequence
  chemically synthesized
atttatgaaaataaaaatgaat

SEQ ID NO: 1305267 - DNA, 22 bp, Artificial Sequence
  chemically synthesized
tttatgaaaataaaaatgaata

SEQ ID NO: 1305268 - DNA, 22 bp, Artificial Sequence
  chemically synthesized
atgaaaataaaaatgaatatat

SEQ ID NO: 1305269 - DNA, 22 bp, Artificial Sequence
  chemically synthesized
tgaaaataaaaatgaatatatt

SEQ ID NO: 1305270 - DNA, 22 bp, Artificial Sequence
  chemically synthesized
gattgtattttcattcttccct

SEQ ID NO: 1305271 - DNA, 22 bp, Artificial Sequence
  chemically synthesized
aagtggcacaaacagagggaag

SEQ ID NO: 1305272 - DNA, 22 bp, Artificial Sequence
  chemically synthesized
aaagtggcacaaacagagggaa

SEQ ID NO: 1305273 - DNA, 22 bp, Artificial Sequence
  chemically synthesized
tattttcattcttccctctgtt

SEQ ID NO: 1305274 - DNA, 22 bp, Artificial Sequence
  chemically synthesized
tcattcttccctctgtttgtgc

SEQ ID NO: 1305275 - DNA, 22 bp, Artificial Sequence
  chemically synthesized
cattcttccctctgtttgtgcc

SEQ ID NO: 1305276 - DNA, 22 bp, Artificial Sequence
  chemically synthesized
attcttccctctgtttgtgcca

SEQ ID NO: 1305277 - DNA, 22 bp, Artificial Sequence
  chemically synthesized
ttccctctgtttgtgccacttt

SEQ ID NO: 1305278 - DNA, 22 bp, Artificial Sequence
  chemically synthesized
ccctctgtttgtgccactttaa

SEQ ID NO: 1305279 - DNA, 22 bp, Artificial Sequence
  chemically synthesized
cctctgtttgtgccactttaaa

SEQ ID NO: 1305280 - DNA, 22 bp, Artificial Sequence
  chemically synthesized
tgtttgtgccactttaaacact

SEQ ID NO: 1305281 - DNA, 22 bp, Artificial Sequence
  chemically synthesized
tttgtgccactttaaacactgg

SEQ ID NO: 1305282 - DNA, 22 bp, Artificial Sequence
  chemically synthesized
gtgccactttaaacactggtgc

SEQ ID NO: 1305283 - DNA, 22 bp, Artificial Sequence
  chemically synthesized
tgccactttaaacactggtgcc

SEQ ID NO: 1305284 - DNA, 22 bp, Artificial Sequence
  chemically synthesized
ggtcaaagagaagggaggcacc

SEQ ID NO: 1305285 - DNA, 22 bp, Artificial Sequence
  chemically synthesized
gggtcaaagagaagggaggcac

SEQ ID NO: 1305286 - DNA, 22 bp, Artificial Sequence
  chemically synthesized
taaacactggtgcctcccttct

SEQ ID NO: 1305287 - DNA, 22 bp, Artificial Sequence
  chemically synthesized
aaacactggtgcctcccttctc

SEQ ID NO: 1305288 - DNA, 22 bp, Artificial Sequence
  chemically synthesized
aacactggtgcctcccttctct

SEQ ID NO: 1305289 - DNA, 22 bp, Artificial Sequence
  chemically synthesized
agtatttgggtcaaagagaagg

SEQ ID NO: 1305290 - DNA, 22 bp, Artificial Sequence
  chemically synthesized
gagtatttgggtcaaagagaag

SEQ ID NO: 1305291 - DNA, 22 bp, Artificial Sequence
  chemically synthesized
tgagtatttgggtcaaagagaa

SEQ ID NO: 1305292 - DNA, 22 bp, Artificial Sequence
  chemically synthesized
gtgcctcccttctctttgaccc

SEQ ID NO: 1305293 - DNA, 22 bp, Artificial Sequence
  chemically synthesized
ttttgagtatttgggtcaaaga

SEQ ID NO: 1305294 - DNA, 22 bp, Artificial Sequence
  chemically synthesized
ccttctctttgacccaaatact

SEQ ID NO: 1305295 - DNA, 22 bp, Artificial Sequence
  chemically synthesized
ctctttgacccaaatactcaaa

SEQ ID NO: 1305296 - DNA, 22 bp, Artificial Sequence
  chemically synthesized
tctttgacccaaatactcaaaa

SEQ ID NO: 1305297 - DNA, 22 bp, Artificial Sequence
  chemically synthesized
aatgtgtgacctgttttgagta

SEQ ID NO: 1305298 - DNA, 22 bp, Artificial Sequence
  chemically synthesized
tttgacccaaatactcaaaaca

SEQ ID NO: 1305299 - DNA, 22 bp, Artificial Sequence
  chemically synthesized
aaatgtgtgacctgttttgagt

SEQ ID NO: 1305300 - DNA, 22 bp, Artificial Sequence
  chemically synthesized
tgacccaaatactcaaaacagg

SEQ ID NO: 1305301 - DNA, 22 bp, Artificial Sequence
  chemically synthesized
gacccaaatactcaaaacaggt

SEQ ID NO: 1305302 - DNA, 22 bp, Artificial Sequence
  chemically synthesized
acccaaatactcaaaacaggtc

SEQ ID NO: 1305303 - DNA, 22 bp, Artificial Sequence
  chemically synthesized
ccatatttaaatgtgtgacctg

SEQ ID NO: 1305304 - DNA, 22 bp, Artificial Sequence
  chemically synthesized
gccatatttaaatgtgtgacct

SEQ ID NO: 1305305 - DNA, 22 bp, Artificial Sequence
  chemically synthesized
aaaacaggtcacacatttaaat

SEQ ID NO: 1305306 - DNA, 22 bp, Artificial Sequence
  chemically synthesized
gagggcttgccatatttaaatg

SEQ ID NO: 1305307 - DNA, 22 bp, Artificial Sequence
  chemically synthesized
cagggctggagggcttgccata

SEQ ID NO: 1305308 - DNA, 22 bp, Artificial Sequence
  chemically synthesized
gcagggctggagggcttgccat

SEQ ID NO: 1305309 - DNA, 22 bp, Artificial Sequence
  chemically synthesized
aaatatggcaagccctccagcc

SEQ ID NO: 1305310 - DNA, 22 bp, Artificial Sequence
  chemically synthesized
aatatggcaagccctccagccc

SEQ ID NO: 1305311 - DNA, 22 bp, Artificial Sequence
  chemically synthesized
tagtccatcatttgcagggctg

SEQ ID NO: 1305312 - DNA, 22 bp, Artificial Sequence
  chemically synthesized
atagtccatcatttgcagggct

SEQ ID NO: 1305313 - DNA, 22 bp, Artificial Sequence
  chemically synthesized
tatagtccatcatttgcagggc

SEQ ID NO: 1305314 - DNA, 22 bp, Artificial Sequence
  chemically synthesized
cagccctgcaaatgatggacta

SEQ ID NO: 1305315 - DNA, 22 bp, Artificial Sequence
  chemically synthesized
caaatgatggactataaaattt

SEQ ID NO: 1305316 - DNA, 22 bp, Artificial Sequence
  chemically synthesized
aaaaaaaatcgccagtagtaca

SEQ ID NO: 1305317 - DNA, 22 bp, Artificial Sequence
  chemically synthesized
taaaatttgtttgtactactgg

SEQ ID NO: 1305318 - DNA, 22 bp, Artificial Sequence
  chemically synthesized
aaaaaaaaatcgccagtagtac

SEQ ID NO: 1305319 - DNA, 22 bp, Artificial Sequence
  chemically synthesized
taaaaaaaaatcgccagtagta

SEQ ID NO: 1305320 - DNA, 22 bp, Artificial Sequence
  chemically synthesized
ttaaaaaaaaatcgccagtagt

SEQ ID NO: 1305321 - DNA, 22 bp, Artificial Sequence
  chemically synthesized
tttaaaaaaaaatcgccagtag

SEQ ID NO: 1305322 - DNA, 22 bp, Artificial Sequence
  chemically synthesized
ttttaaaaaaaaatcgccagta

SEQ ID NO: 1305323 - DNA, 22 bp, Artificial Sequence
  chemically synthesized
gtttgtactactggcgattttt

SEQ ID NO: 1305324 - DNA, 22 bp, Artificial Sequence
  chemically synthesized
tttgtactactggcgatttttt

SEQ ID NO: 1305325 - DNA, 22 bp, Artificial Sequence
  chemically synthesized
gtactactggcgattttttttt

SEQ ID NO: 1305326 - DNA, 22 bp, Artificial Sequence
  chemically synthesized
tactactggcgattttttttta

SEQ ID NO: 1305327 - DNA, 22 bp, Artificial Sequence
  chemically synthesized
ctggcgatttttttttaaaaaa

SEQ ID NO: 1305328 - DNA, 22 bp, Artificial Sequence
  chemically synthesized
gcgatttttttttaaaaaagct

SEQ ID NO: 1305329 - DNA, 22 bp, Artificial Sequence
  chemically synthesized
ttttttaaaaaagcttatgcac

SEQ ID NO: 1305330 - DNA, 22 bp, Artificial Sequence
  chemically synthesized
tttttaaaaaagcttatgcaca

SEQ ID NO: 1305331 - DNA, 22 bp, Artificial Sequence
  chemically synthesized
ttttaaaaaagcttatgcacac

SEQ ID NO: 1305332 - DNA, 22 bp, Artificial Sequence
  chemically synthesized
tttaaaaaagcttatgcacacc

SEQ ID NO: 1305333 - DNA, 22 bp, Artificial Sequence
  chemically synthesized
ttaaaaaagcttatgcacacct

SEQ ID NO: 1305334 - DNA, 22 bp, Artificial Sequence
  chemically synthesized
taaaaaagcttatgcacaccta

SEQ ID NO: 1305335 - DNA, 22 bp, Artificial Sequence
  chemically synthesized
aaaatatgaaagtaggtgtgca

SEQ ID NO: 1305336 - DNA, 22 bp, Artificial Sequence
  chemically synthesized
aaaaaagcttatgcacacctac

SEQ ID NO: 1305337 - DNA, 22 bp, Artificial Sequence
  chemically synthesized
aaaaagcttatgcacacctact

SEQ ID NO: 1305338 - DNA, 22 bp, Artificial Sequence
  chemically synthesized
tccaacctaaaaatatgaaagt

SEQ ID NO: 1305339 - DNA, 22 bp, Artificial Sequence
  chemically synthesized
atgcacacctactttcatattt

SEQ ID NO: 1305340 - DNA, 22 bp, Artificial Sequence
  chemically synthesized
tgcacacctactttcatatttt

SEQ ID NO: 1305341 - DNA, 22 bp, Artificial Sequence
  chemically synthesized
aggtactgtccaacctaaaaat

SEQ ID NO: 1305342 - DNA, 22 bp, Artificial Sequence
  chemically synthesized
taaggtactgtccaacctaaaa

SEQ ID NO: 1305343 - DNA, 22 bp, Artificial Sequence
  chemically synthesized
ctaaggtactgtccaacctaaa

SEQ ID NO: 1305344 - DNA, 22 bp, Artificial Sequence
  chemically synthesized
ctttcatatttttaggttggac

SEQ ID NO: 1305345 - DNA, 22 bp, Artificial Sequence
  chemically synthesized
tttctaaggtactgtccaacct

SEQ ID NO: 1305346 - DNA, 22 bp, Artificial Sequence
  chemically synthesized
atttctaaggtactgtccaacc

SEQ ID NO: 1305347 - DNA, 22 bp, Artificial Sequence
  chemically synthesized
tcatatttttaggttggacagt

SEQ ID NO: 1305348 - DNA, 22 bp, Artificial Sequence
  chemically synthesized
tatttctaaggtactgtccaac

SEQ ID NO: 1305349 - DNA, 22 bp, Artificial Sequence
  chemically synthesized
catatttttaggttggacagta

SEQ ID NO: 1305350 - DNA, 22 bp, Artificial Sequence
  chemically synthesized
ttatttctaaggtactgtccaa

SEQ ID NO: 1305351 - DNA, 22 bp, Artificial Sequence
  chemically synthesized
atatttttaggttggacagtac

SEQ ID NO: 1305352 - DNA, 22 bp, Artificial Sequence
  chemically synthesized
tttttatttctaaggtactgtc

SEQ ID NO: 1305353 - DNA, 22 bp, Artificial Sequence
  chemically synthesized
gtttttatttctaaggtactgt

SEQ ID NO: 1305354 - DNA, 22 bp, Artificial Sequence
  chemically synthesized
tgtttttatttctaaggtactg

SEQ ID NO: 1305355 - DNA, 22 bp, Artificial Sequence
  chemically synthesized
ttgtttttatttctaaggtact

SEQ ID NO: 1305356 - DNA, 22 bp, Artificial Sequence
  chemically synthesized
ttaggttggacagtaccttaga

SEQ ID NO: 1305357 - DNA, 22 bp, Artificial Sequence
  chemically synthesized
taggttggacagtaccttagaa

SEQ ID NO: 1305358 - DNA, 22 bp, Artificial Sequence
  chemically synthesized
aggttggacagtaccttagaaa

SEQ ID NO: 1305359 - DNA, 22 bp, Artificial Sequence
  chemically synthesized
ggttggacagtaccttagaaat

SEQ ID NO: 1305360 - DNA, 22 bp, Artificial Sequence
  chemically synthesized
atttttgtttttatttctaagg

SEQ ID NO: 1305361 - DNA, 22 bp, Artificial Sequence
  chemically synthesized
aatttttgtttttatttctaag

SEQ ID NO: 1305362 - DNA, 22 bp, Artificial Sequence
  chemically synthesized
taatttttgtttttatttctaa

SEQ ID NO: 1305363 - DNA, 22 bp, Artificial Sequence
  chemically synthesized
gacagtaccttagaaataaaaa

SEQ ID NO: 1305364 - DNA, 22 bp, Artificial Sequence
  chemically synthesized
ttttaatttttgtttttatttc

SEQ ID NO: 1305365 - DNA, 22 bp, Artificial Sequence
  chemically synthesized
agaaataaaaacaaaaattaaa

SEQ ID NO: 1305366 - DNA, 22 bp, Artificial Sequence
  chemically synthesized
gaaataaaaacaaaaattaaaa

SEQ ID NO: 1305367 - DNA, 22 bp, Artificial Sequence
  chemically synthesized
aaagataaagatctgttttaat

SEQ ID NO: 1305368 - DNA, 22 bp, Artificial Sequence
  chemically synthesized
aaaagataaagatctgttttaa

SEQ ID NO: 1305369 - DNA, 22 bp, Artificial Sequence
  chemically synthesized
taaaagataaagatctgtttta

SEQ ID NO: 1305370 - DNA, 22 bp, Artificial Sequence
  chemically synthesized
ttaaaagataaagatctgtttt

SEQ ID NO: 1305371 - DNA, 22 bp, Artificial Sequence
  chemically synthesized
tttaaaagataaagatctgttt

SEQ ID NO: 1305372 - DNA, 22 bp, Artificial Sequence
  chemically synthesized
aaacagatctttatcttttaaa

SEQ ID NO: 1305373 - DNA, 22 bp, Artificial Sequence
  chemically synthesized
gaaaatagattttttaaaagat

SEQ ID NO: 1305374 - DNA, 22 bp, Artificial Sequence
  chemically synthesized
ggaaaatagattttttaaaaga

SEQ ID NO: 1305375 - DNA, 22 bp, Artificial Sequence
  chemically synthesized
tggaaaatagattttttaaaag

SEQ ID NO: 1305376 - DNA, 22 bp, Artificial Sequence
  chemically synthesized
ttggaaaatagattttttaaaa

SEQ ID NO: 1305377 - DNA, 22 bp, Artificial Sequence
  chemically synthesized
cttttggaaaatagatttttta

SEQ ID NO: 1305378 - DNA, 22 bp, Artificial Sequence
  chemically synthesized
ccttttggaaaatagatttttt

SEQ ID NO: 1305379 - DNA, 22 bp, Artificial Sequence
  chemically synthesized
tttccttttggaaaatagattt

SEQ ID NO: 1305380 - DNA, 22 bp, Artificial Sequence
  chemically synthesized
tatcttttaaaaaatctatttt

SEQ ID NO: 1305381 - DNA, 22 bp, Artificial Sequence
  chemically synthesized
gtttccttttggaaaatagatt

SEQ ID NO: 1305382 - DNA, 22 bp, Artificial Sequence
  chemically synthesized
atcttttaaaaaatctattttc

SEQ ID NO: 1305383 - DNA, 22 bp, Artificial Sequence
  chemically synthesized
tcttttaaaaaatctattttcc

SEQ ID NO: 1305384 - DNA, 22 bp, Artificial Sequence
  chemically synthesized
atttgtttccttttggaaaata

SEQ ID NO: 1305385 - DNA, 22 bp, Artificial Sequence
  chemically synthesized
ttaaaaaatctattttccaaaa

SEQ ID NO: 1305386 - DNA, 22 bp, Artificial Sequence
  chemically synthesized
taaaaaatctattttccaaaag

SEQ ID NO: 1305387 - DNA, 22 bp, Artificial Sequence
  chemically synthesized
aaaaaatctattttccaaaagg

SEQ ID NO: 1305388 - DNA, 22 bp, Artificial Sequence
  chemically synthesized
aaaaatctattttccaaaagga

SEQ ID NO: 1305389 - DNA, 22 bp, Artificial Sequence
  chemically synthesized
ttttccaaaaggaaacaaatga

SEQ ID NO: 1305390 - DNA, 22 bp, Artificial Sequence
  chemically synthesized
tccaaaaggaaacaaatgaatt

SEQ ID NO: 1305391 - DNA, 22 bp, Artificial Sequence
  chemically synthesized
ccaaaaggaaacaaatgaatta

SEQ ID NO: 1305392 - DNA, 22 bp, Artificial Sequence
  chemically synthesized
caaaaggaaacaaatgaattat

SEQ ID NO: 1305393 - DNA, 22 bp, Artificial Sequence
  chemically synthesized
tatggtaataataagacaaaaa

SEQ ID NO: 1305394 - DNA, 22 bp, Artificial Sequence
  chemically synthesized
agctatatggtaataataagac

SEQ ID NO: 1305395 - DNA, 22 bp, Artificial Sequence
  chemically synthesized
aagctatatggtaataataaga

SEQ ID NO: 1305396 - DNA, 22 bp, Artificial Sequence
  chemically synthesized
taagctatatggtaataataag

SEQ ID NO: 1305397 - DNA, 22 bp, Artificial Sequence
  chemically synthesized
ttaagctatatggtaataataa

SEQ ID NO: 1305398 - DNA, 22 bp, Artificial Sequence
  chemically synthesized
tttttgtcttattattaccata

SEQ ID NO: 1305399 - DNA, 22 bp, Artificial Sequence
  chemically synthesized
atttttaagctatatggtaata

SEQ ID NO: 1305400 - DNA, 22 bp, Artificial Sequence
  chemically synthesized
ttgtcttattattaccatatag

SEQ ID NO: 1305401 - DNA, 22 bp, Artificial Sequence
  chemically synthesized
tgtcttattattaccatatagc

SEQ ID NO: 1305402 - DNA, 22 bp, Artificial Sequence
  chemically synthesized
gtcttattattaccatatagct

SEQ ID NO: 1305403 - DNA, 22 bp, Artificial Sequence
  chemically synthesized
tcttattattaccatatagctt

SEQ ID NO: 1305404 - DNA, 22 bp, Artificial Sequence
  chemically synthesized
aggtaattgatttttaagctat

SEQ ID NO: 1305405 - DNA, 22 bp, Artificial Sequence
  chemically synthesized
attattaccatatagcttaaaa

SEQ ID NO: 1305406 - DNA, 22 bp, Artificial Sequence
  chemically synthesized
caggtaattgatttttaagcta

SEQ ID NO: 1305407 - DNA, 22 bp, Artificial Sequence
  chemically synthesized
ttattaccatatagcttaaaaa

SEQ ID NO: 1305408 - DNA, 22 bp, Artificial Sequence
  chemically synthesized
ttaccatatagcttaaaaatca

SEQ ID NO: 1305409 - DNA, 22 bp, Artificial Sequence
  chemically synthesized
ccatatagcttaaaaatcaatt

SEQ ID NO: 1305410 - DNA, 22 bp, Artificial Sequence
  chemically synthesized
aatgataatgatttcaggtaat

SEQ ID NO: 1305411 - DNA, 22 bp, Artificial Sequence
  chemically synthesized
gaatgataatgatttcaggtaa

SEQ ID NO: 1305412 - DNA, 22 bp, Artificial Sequence
  chemically synthesized
aaaaatcaattacctgaaatca

SEQ ID NO: 1305413 - DNA, 22 bp, Artificial Sequence
  chemically synthesized
aaaatcaattacctgaaatcat

SEQ ID NO: 1305414 - DNA, 22 bp, Artificial Sequence
  chemically synthesized
aagatttgaatgataatgattt

SEQ ID NO: 1305415 - DNA, 22 bp, Artificial Sequence
  chemically synthesized
aaagatttgaatgataatgatt

SEQ ID NO: 1305416 - DNA, 22 bp, Artificial Sequence
  chemically synthesized
taaagatttgaatgataatgat

SEQ ID NO: 1305417 - DNA, 22 bp, Artificial Sequence
  chemically synthesized
ttttaaagatttgaatgataat

SEQ ID NO: 1305418 - DNA, 22 bp, Artificial Sequence
  chemically synthesized
gttttaaagatttgaatgataa

SEQ ID NO: 1305419 - DNA, 22 bp, Artificial Sequence
  chemically synthesized
cctgaaatcattatcattcaaa

SEQ ID NO: 1305420 - DNA, 22 bp, Artificial Sequence
  chemically synthesized
aaatcattatcattcaaatctt

SEQ ID NO: 1305421 - DNA, 22 bp, Artificial Sequence
  chemically synthesized
agtgccttgttttaaagatttg

SEQ ID NO: 1305422 - DNA, 22 bp, Artificial Sequence
  chemically synthesized
aagtgccttgttttaaagattt

SEQ ID NO: 1305423 - DNA, 22 bp, Artificial Sequence
  chemically synthesized
tcattcaaatctttaaaacaag

SEQ ID NO: 1305424 - DNA, 22 bp, Artificial Sequence
  chemically synthesized
aacatttaagtgccttgtttta

SEQ ID NO: 1305425 - DNA, 22 bp, Artificial Sequence
  chemically synthesized
aaatctttaaaacaaggcactt

SEQ ID NO: 1305426 - DNA, 22 bp, Artificial Sequence
  chemically synthesized
aaaaagattaaacatttaagtg

SEQ ID NO: 1305427 - DNA, 22 bp, Artificial Sequence
  chemically synthesized
aaaaaagattaaacatttaagt

SEQ ID NO: 1305428 - DNA, 22 bp, Artificial Sequence
  chemically synthesized
taaaacaaggcacttaaatgtt

SEQ ID NO: 1305429 - DNA, 22 bp, Artificial Sequence
  chemically synthesized
taaaaaagattaaacatttaag

SEQ ID NO: 1305430 - DNA, 22 bp, Artificial Sequence
  chemically synthesized
aaaacaaggcacttaaatgttt

SEQ ID NO: 1305431 - DNA, 22 bp, Artificial Sequence
  chemically synthesized
ttaaaaaagattaaacatttaa

SEQ ID NO: 1305432 - DNA, 22 bp, Artificial Sequence
  chemically synthesized
aaacaaggcacttaaatgttta

SEQ ID NO: 1305433 - DNA, 22 bp, Artificial Sequence
  chemically synthesized
agtttttaaaaaagattaaaca

SEQ ID NO: 1305434 - DNA, 22 bp, Artificial Sequence
  chemically synthesized
gctaagtttttaaaaaagatta

SEQ ID NO: 1305435 - DNA, 22 bp, Artificial Sequence
  chemically synthesized
aaatgtttaatcttttttaaaa

SEQ ID NO: 1305436 - DNA, 22 bp, Artificial Sequence
  chemically synthesized
cattggctaagtttttaaaaaa

SEQ ID NO: 1305437 - DNA, 22 bp, Artificial Sequence
  chemically synthesized
aatgtttaatcttttttaaaaa

SEQ ID NO: 1305438 - DNA, 22 bp, Artificial Sequence
  chemically synthesized
gcattggctaagtttttaaaaa

SEQ ID NO: 1305439 - DNA, 22 bp, Artificial Sequence
  chemically synthesized
tgcattggctaagtttttaaaa

SEQ ID NO: 1305440 - DNA, 22 bp, Artificial Sequence
  chemically synthesized
aatcttttttaaaaacttagcc

SEQ ID NO: 1305441 - DNA, 22 bp, Artificial Sequence
  chemically synthesized
atcttttttaaaaacttagcca

SEQ ID NO: 1305442 - DNA, 22 bp, Artificial Sequence
  chemically synthesized
ttttaaaaacttagccaatgca

SEQ ID NO: 1305443 - DNA, 22 bp, Artificial Sequence
  chemically synthesized
tttaaaaacttagccaatgcaa

SEQ ID NO: 1305444 - DNA, 22 bp, Artificial Sequence
  chemically synthesized
ttaaaaacttagccaatgcaaa

SEQ ID NO: 1305445 - DNA, 22 bp, Artificial Sequence
  chemically synthesized
gaggaaagcagttttgcattgg

SEQ ID NO: 1305446 - DNA, 22 bp, Artificial Sequence
  chemically synthesized
taaaaacttagccaatgcaaaa

SEQ ID NO: 1305447 - DNA, 22 bp, Artificial Sequence
  chemically synthesized
ggaggaaagcagttttgcattg

SEQ ID NO: 1305448 - DNA, 22 bp, Artificial Sequence
  chemically synthesized
aaaaacttagccaatgcaaaac

SEQ ID NO: 1305449 - DNA, 22 bp, Artificial Sequence
  chemically synthesized
tggaggaaagcagttttgcatt

SEQ ID NO: 1305450 - DNA, 22 bp, Artificial Sequence
  chemically synthesized
aaaacttagccaatgcaaaact

SEQ ID NO: 1305451 - DNA, 22 bp, Artificial Sequence
  chemically synthesized
agccaatgcaaaactgctttcc

SEQ ID NO: 1305452 - DNA, 22 bp, Artificial Sequence
  chemically synthesized
gccaatgcaaaactgctttcct

SEQ ID NO: 1305453 - DNA, 22 bp, Artificial Sequence
  chemically synthesized
agggcgttttggaggaaagcag

SEQ ID NO: 1305454 - DNA, 22 bp, Artificial Sequence
  chemically synthesized
tgagggcgttttggaggaaagc

SEQ ID NO: 1305455 - DNA, 22 bp, Artificial Sequence
  chemically synthesized
ctttcctccaaaacgccctcag

SEQ ID NO: 1305456 - DNA, 22 bp, Artificial Sequence
  chemically synthesized
tcctccaaaacgccctcagaat

SEQ ID NO: 1305457 - DNA, 22 bp, Artificial Sequence
  chemically synthesized
cctccaaaacgccctcagaatt

SEQ ID NO: 1305458 - DNA, 22 bp, Artificial Sequence
  chemically synthesized
ctccaaaacgccctcagaatta

SEQ ID NO: 1305459 - DNA, 22 bp, Artificial Sequence
  chemically synthesized
caaaacgccctcagaattacct

SEQ ID NO: 1305460 - DNA, 22 bp, Artificial Sequence
  chemically synthesized
agagtgcaggagaagcaggtaa

SEQ ID NO: 1305461 - DNA, 22 bp, Artificial Sequence
  chemically synthesized
agaattacctgcttctcctgca

SEQ ID NO: 1305462 - DNA, 22 bp, Artificial Sequence
  chemically synthesized
gggatactaagagtgcaggaga

SEQ ID NO: 1305463 - DNA, 22 bp, Artificial Sequence
  chemically synthesized
ggggatactaagagtgcaggag

SEQ ID NO: 1305464 - DNA, 22 bp, Artificial Sequence
  chemically synthesized
cctgcttctcctgcactcttag

SEQ ID NO: 1305465 - DNA, 22 bp, Artificial Sequence
  chemically synthesized
cttctcctgcactcttagtatc

SEQ ID NO: 1305466 - DNA, 22 bp, Artificial Sequence
  chemically synthesized
ccaataacttggggatactaag

SEQ ID NO: 1305467 - DNA, 22 bp, Artificial Sequence
  chemically synthesized
ctcctgcactcttagtatcccc

SEQ ID NO: 1305468 - DNA, 22 bp, Artificial Sequence
  chemically synthesized
tcctgcactcttagtatcccca

SEQ ID NO: 1305469 - DNA, 22 bp, Artificial Sequence
  chemically synthesized
actgccaataacttggggatac

SEQ ID NO: 1305470 - DNA, 22 bp, Artificial Sequence
  chemically synthesized
ctgcactcttagtatccccaag

SEQ ID NO: 1305471 - DNA, 22 bp, Artificial Sequence
  chemically synthesized
ttcactgccaataacttgggga

SEQ ID NO: 1305472 - DNA, 22 bp, Artificial Sequence
  chemically synthesized
cactcttagtatccccaagtta

SEQ ID NO: 1305473 - DNA, 22 bp, Artificial Sequence
  chemically synthesized
attcactgccaataacttgggg

SEQ ID NO: 1305474 - DNA, 22 bp, Artificial Sequence
  chemically synthesized
tattcactgccaataacttggg

SEQ ID NO: 1305475 - DNA, 22 bp, Artificial Sequence
  chemically synthesized
ttattcactgccaataacttgg

SEQ ID NO: 1305476 - DNA, 22 bp, Artificial Sequence
  chemically synthesized
ttagtatccccaagttattggc

SEQ ID NO: 1305477 - DNA, 22 bp, Artificial Sequence
  chemically synthesized
agtatccccaagttattggcag

SEQ ID NO: 1305478 - DNA, 22 bp, Artificial Sequence
  chemically synthesized
cacttttattcactgccaataa

SEQ ID NO: 1305479 - DNA, 22 bp, Artificial Sequence
  chemically synthesized
gtatccccaagttattggcagt

SEQ ID NO: 1305480 - DNA, 22 bp, Artificial Sequence
  chemically synthesized
acacttttattcactgccaata

SEQ ID NO: 1305481 - DNA, 22 bp, Artificial Sequence
  chemically synthesized
tacacttttattcactgccaat

SEQ ID NO: 1305482 - DNA, 22 bp, Artificial Sequence
  chemically synthesized
ctttacacttttattcactgcc

SEQ ID NO: 1305483 - DNA, 22 bp, Artificial Sequence
  chemically synthesized
cctttacacttttattcactgc

SEQ ID NO: 1305484 - DNA, 22 bp, Artificial Sequence
  chemically synthesized
atttcctttacacttttattca

SEQ ID NO: 1305485 - DNA, 22 bp, Artificial Sequence
  chemically synthesized
ttggcagtgaataaaagtgtaa

SEQ ID NO: 1305486 - DNA, 22 bp, Artificial Sequence
  chemically synthesized
gcagtgaataaaagtgtaaagg

SEQ ID NO: 1305487 - DNA, 22 bp, Artificial Sequence
  chemically synthesized
caagattcatttcctttacact

SEQ ID NO: 1305488 - DNA, 22 bp, Artificial Sequence
  chemically synthesized
acagagaattgcaagattcatt

SEQ ID NO: 1305489 - DNA, 22 bp, Artificial Sequence
  chemically synthesized
gaatgaaattcacagagaattg

SEQ ID NO: 1305490 - DNA, 22 bp, Artificial Sequence
  chemically synthesized
ggaatgaaattcacagagaatt

SEQ ID NO: 1305491 - DNA, 22 bp, Artificial Sequence
  chemically synthesized
tggaatgaaattcacagagaat

SEQ ID NO: 1305492 - DNA, 22 bp, Artificial Sequence
  chemically synthesized
ttggaatgaaattcacagagaa

SEQ ID NO: 1305493 - DNA, 22 bp, Artificial Sequence
  chemically synthesized
tttggaatgaaattcacagaga

SEQ ID NO: 1305494 - DNA, 22 bp, Artificial Sequence
  chemically synthesized
ttttggaatgaaattcacagag

SEQ ID NO: 1305495 - DNA, 22 bp, Artificial Sequence
  chemically synthesized
ttttttggaatgaaattcacag

SEQ ID NO: 1305496 - DNA, 22 bp, Artificial Sequence
  chemically synthesized
gcaattctctgtgaatttcatt

SEQ ID NO: 1305497 - DNA, 22 bp, Artificial Sequence
  chemically synthesized
caattctctgtgaatttcattc

SEQ ID NO: 1305498 - DNA, 22 bp, Artificial Sequence
  chemically synthesized
aaattcttttttggaatgaaat

SEQ ID NO: 1305499 - DNA, 22 bp, Artificial Sequence
  chemically synthesized
tctgtgaatttcattccaaaaa

SEQ ID NO: 1305500 - DNA, 22 bp, Artificial Sequence
  chemically synthesized
tgtgaatttcattccaaaaaag

SEQ ID NO: 1305501 - DNA, 22 bp, Artificial Sequence
  chemically synthesized
tgaatttcattccaaaaaagaa

SEQ ID NO: 1305502 - DNA, 22 bp, Artificial Sequence
  chemically synthesized
atcaaaatgcctaaaattcttt

SEQ ID NO: 1305503 - DNA, 22 bp, Artificial Sequence
  chemically synthesized
catcaaaatgcctaaaattctt

SEQ ID NO: 1305504 - DNA, 22 bp, Artificial Sequence
  chemically synthesized
cattccaaaaaagaattttagg

SEQ ID NO: 1305505 - DNA, 22 bp, Artificial Sequence
  chemically synthesized
attccaaaaaagaattttaggc

SEQ ID NO: 1305506 - DNA, 22 bp, Artificial Sequence
  chemically synthesized
caaaaaagaattttaggcattt

SEQ ID NO: 1305507 - DNA, 22 bp, Artificial Sequence
  chemically synthesized
catcgcttcatcaaaatgccta

SEQ ID NO: 1305508 - DNA, 22 bp, Artificial Sequence
  chemically synthesized
atccctacatcgcttcatcaaa

SEQ ID NO: 1305509 - DNA, 22 bp, Artificial Sequence
  chemically synthesized
taggcattttgatgaagcgatg

SEQ ID NO: 1305510 - DNA, 22 bp, Artificial Sequence
  chemically synthesized
aggcattttgatgaagcgatgt

SEQ ID NO: 1305511 - DNA, 22 bp, Artificial Sequence
  chemically synthesized
aaactaatccctacatcgcttc

SEQ ID NO: 1305512 - DNA, 22 bp, Artificial Sequence
  chemically synthesized
ggcattttgatgaagcgatgta

SEQ ID NO: 1305513 - DNA, 22 bp, Artificial Sequence
  chemically synthesized
aaaactaatccctacatcgctt

SEQ ID NO: 1305514 - DNA, 22 bp, Artificial Sequence
  chemically synthesized
tttaaaactaatccctacatcg

SEQ ID NO: 1305515 - DNA, 22 bp, Artificial Sequence
  chemically synthesized
tgatgaagcgatgtagggatta

SEQ ID NO: 1305516 - DNA, 22 bp, Artificial Sequence
  chemically synthesized
gatgaagcgatgtagggattag

SEQ ID NO: 1305517 - DNA, 22 bp, Artificial Sequence
  chemically synthesized
atgaagcgatgtagggattagt

SEQ ID NO: 1305518 - DNA, 22 bp, Artificial Sequence
  chemically synthesized
gttttaaatagggatctctgat

SEQ ID NO: 1305519 - DNA, 22 bp, Artificial Sequence
  chemically synthesized
taaatagggatctctgatttgt

SEQ ID NO: 1305520 - DNA, 22 bp, Artificial Sequence
  chemically synthesized
tgaaaataatacacaaatcaga

SEQ ID NO: 1305521 - DNA, 22 bp, Artificial Sequence
  chemically synthesized
aaatagggatctctgatttgtg

SEQ ID NO: 1305522 - DNA, 22 bp, Artificial Sequence
  chemically synthesized
aatagggatctctgatttgtgt

SEQ ID NO: 1305523 - DNA, 22 bp, Artificial Sequence
  chemically synthesized
caaattgtgaaaataatacaca

SEQ ID NO: 1305524 - DNA, 22 bp, Artificial Sequence
  chemically synthesized
acaaattgtgaaaataatacac

SEQ ID NO: 1305525 - DNA, 22 bp, Artificial Sequence
  chemically synthesized
tgatttgtgtattattttcaca

SEQ ID NO: 1305526 - DNA, 22 bp, Artificial Sequence
  chemically synthesized
atttgtgtattattttcacaat

SEQ ID NO: 1305527 - DNA, 22 bp, Artificial Sequence
  chemically synthesized
gtgtattattttcacaatttgt

SEQ ID NO: 1305528 - DNA, 22 bp, Artificial Sequence
  chemically synthesized
tgtattattttcacaatttgta

SEQ ID NO: 1305529 - DNA, 22 bp, Artificial Sequence
  chemically synthesized
gaagaaagtaagtttacaaatt

SEQ ID NO: 1305530 - DNA, 22 bp, Artificial Sequence
  chemically synthesized
ggaagaaagtaagtttacaaat

SEQ ID NO: 1305531 - DNA, 22 bp, Artificial Sequence
  chemically synthesized
tggaagaaagtaagtttacaaa

SEQ ID NO: 1305532 - DNA, 22 bp, Artificial Sequence
  chemically synthesized
ttggaagaaagtaagtttacaa

SEQ ID NO: 1305533 - DNA, 22 bp, Artificial Sequence
  chemically synthesized
ttttcacaatttgtaaacttac

SEQ ID NO: 1305534 - DNA, 22 bp, Artificial Sequence
  chemically synthesized
tcacaatttgtaaacttacttt

SEQ ID NO: 1305535 - DNA, 22 bp, Artificial Sequence
  chemically synthesized
cacaatttgtaaacttactttc

SEQ ID NO: 1305536 - DNA, 22 bp, Artificial Sequence
  chemically synthesized
acaatttgtaaacttactttct

SEQ ID NO: 1305537 - DNA, 22 bp, Artificial Sequence
  chemically synthesized
aaatcacttttggaagaaagta

SEQ ID NO: 1305538 - DNA, 22 bp, Artificial Sequence
  chemically synthesized
caaatcacttttggaagaaagt

SEQ ID NO: 1305539 - DNA, 22 bp, Artificial Sequence
  chemically synthesized
tttcaaatcacttttggaagaa

SEQ ID NO: 1305540 - DNA, 22 bp, Artificial Sequence
  chemically synthesized
gtaaacttactttcttccaaaa

SEQ ID NO: 1305541 - DNA, 22 bp, Artificial Sequence
  chemically synthesized
atttcaaatcacttttggaaga

SEQ ID NO: 1305542 - DNA, 22 bp, Artificial Sequence
  chemically synthesized
taaacttactttcttccaaaag

SEQ ID NO: 1305543 - DNA, 22 bp, Artificial Sequence
  chemically synthesized
actttcttccaaaagtgatttg

SEQ ID NO: 1305544 - DNA, 22 bp, Artificial Sequence
  chemically synthesized
ctttcttccaaaagtgatttga

SEQ ID NO: 1305545 - DNA, 22 bp, Artificial Sequence
  chemically synthesized
agaatatttatttcaaatcact

SEQ ID NO: 1305546 - DNA, 22 bp, Artificial Sequence
  chemically synthesized
cagaatatttatttcaaatcac

SEQ ID NO: 1305547 - DNA, 22 bp, Artificial Sequence
  chemically synthesized
tcttccaaaagtgatttgaaat

SEQ ID NO: 1305548 - DNA, 22 bp, Artificial Sequence
  chemically synthesized
cttccaaaagtgatttgaaata

SEQ ID NO: 1305549 - DNA, 22 bp, Artificial Sequence
  chemically synthesized
ttccaaaagtgatttgaaataa

SEQ ID NO: 1305550 - DNA, 22 bp, Artificial Sequence
  chemically synthesized
ccaaaagtgatttgaaataaat

SEQ ID NO: 1305551 - DNA, 22 bp, Artificial Sequence
  chemically synthesized
caaaagtgatttgaaataaata

SEQ ID NO: 1305552 - DNA, 22 bp, Artificial Sequence
  chemically synthesized
agtgtttcagaatatttatttc

SEQ ID NO: 1305553 - DNA, 22 bp, Artificial Sequence
  chemically synthesized
cagtgtttcagaatatttattt

SEQ ID NO: 1305554 - DNA, 22 bp, Artificial Sequence
  chemically synthesized
atcttcagtgtttcagaatatt

SEQ ID NO: 1305555 - DNA, 22 bp, Artificial Sequence
  chemically synthesized
cattgatcttcagtgtttcaga

SEQ ID NO: 1305556 - DNA, 22 bp, Artificial Sequence
  chemically synthesized
gaaataaatattctgaaacact

SEQ ID NO: 1305557 - DNA, 22 bp, Artificial Sequence
  chemically synthesized
ccattgatcttcagtgtttcag

SEQ ID NO: 1305558 - DNA, 22 bp, Artificial Sequence
  chemically synthesized
aaataaatattctgaaacactg

SEQ ID NO: 1305559 - DNA, 22 bp, Artificial Sequence
  chemically synthesized
gcttccattgatcttcagtgtt

SEQ ID NO: 1305560 - DNA, 22 bp, Artificial Sequence
  chemically synthesized
agcttccattgatcttcagtgt

SEQ ID NO: 1305561 - DNA, 22 bp, Artificial Sequence
  chemically synthesized
ttagcttccattgatcttcagt

SEQ ID NO: 1305562 - DNA, 22 bp, Artificial Sequence
  chemically synthesized
attcttagcttccattgatctt

SEQ ID NO: 1305563 - DNA, 22 bp, Artificial Sequence
  chemically synthesized
tgaaacactgaagatcaatgga

SEQ ID NO: 1305564 - DNA, 22 bp, Artificial Sequence
  chemically synthesized
taattcttagcttccattgatc

SEQ ID NO: 1305565 - DNA, 22 bp, Artificial Sequence
  chemically synthesized
ctaattcttagcttccattgat

SEQ ID NO: 1305566 - DNA, 22 bp, Artificial Sequence
  chemically synthesized
aaacactgaagatcaatggaag

SEQ ID NO: 1305567 - DNA, 22 bp, Artificial Sequence
  chemically synthesized
aagatcaatggaagctaagaat

SEQ ID NO: 1305568 - DNA, 22 bp, Artificial Sequence
  chemically synthesized
tataagcatttctaattcttag

SEQ ID NO: 1305569 - DNA, 22 bp, Artificial Sequence
  chemically synthesized
gtataagcatttctaattctta

SEQ ID NO: 1305570 - DNA, 22 bp, Artificial Sequence
  chemically synthesized
atagatttgtataagcatttct

SEQ ID NO: 1305571 - DNA, 22 bp, Artificial Sequence
  chemically synthesized
aatagatttgtataagcatttc

SEQ ID NO: 1305572 - DNA, 22 bp, Artificial Sequence
  chemically synthesized
agaattagaaatgcttatacaa

SEQ ID NO: 1305573 - DNA, 22 bp, Artificial Sequence
  chemically synthesized
ggtttaatagatttgtataagc

SEQ ID NO: 1305574 - DNA, 22 bp, Artificial Sequence
  chemically synthesized
gaaatgcttatacaaatctatt

SEQ ID NO: 1305575 - DNA, 22 bp, Artificial Sequence
  chemically synthesized
atacaaatctattaaacctaac

SEQ ID NO: 1305576 - DNA, 22 bp, Artificial Sequence
  chemically synthesized
tacaaatctattaaacctaact

SEQ ID NO: 1305577 - DNA, 22 bp, Artificial Sequence
  chemically synthesized
tatgcatatatacagttaggtt

SEQ ID NO: 1305578 - DNA, 22 bp, Artificial Sequence
  chemically synthesized
ttaaacctaactgtatatatgc

SEQ ID NO: 1305579 - DNA, 22 bp, Artificial Sequence
  chemically synthesized
aacctaactgtatatatgcata

SEQ ID NO: 1305580 - DNA, 22 bp, Artificial Sequence
  chemically synthesized
acaaaaatattatatgcatata

SEQ ID NO: 1305581 - DNA, 22 bp, Artificial Sequence
  chemically synthesized
aacaaaaatattatatgcatat

SEQ ID NO: 1305582 - DNA, 22 bp, Artificial Sequence
  chemically synthesized
ttaacaaaaatattatatgcat

SEQ ID NO: 1305583 - DNA, 22 bp, Artificial Sequence
  chemically synthesized
cttaacaaaaatattatatgca

SEQ ID NO: 1305584 - DNA, 22 bp, Artificial Sequence
  chemically synthesized
actgtatatatgcatataatat

SEQ ID NO: 1305585 - DNA, 22 bp, Artificial Sequence
  chemically synthesized
tgtttcttaacaaaaatattat

SEQ ID NO: 1305586 - DNA, 22 bp, Artificial Sequence
  chemically synthesized
tatatatgcatataatattttt

SEQ ID NO: 1305587 - DNA, 22 bp, Artificial Sequence
  chemically synthesized
tatgtttcttaacaaaaatatt

SEQ ID NO: 1305588 - DNA, 22 bp, Artificial Sequence
  chemically synthesized
aagaattctatgtttcttaaca

SEQ ID NO: 1305589 - DNA, 22 bp, Artificial Sequence
  chemically synthesized
taaagaattctatgtttcttaa

SEQ ID NO: 1305590 - DNA, 22 bp, Artificial Sequence
  chemically synthesized
ttctaaagaattctatgtttct

SEQ ID NO: 1305591 - DNA, 22 bp, Artificial Sequence
  chemically synthesized
aattattctaaagaattctatg

SEQ ID NO: 1305592 - DNA, 22 bp, Artificial Sequence
  chemically synthesized
ttgttaagaaacatagaattct

SEQ ID NO: 1305593 - DNA, 22 bp, Artificial Sequence
  chemically synthesized
tgttaagaaacatagaattctt

SEQ ID NO: 1305594 - DNA, 22 bp, Artificial Sequence
  chemically synthesized
gttaagaaacatagaattcttt

SEQ ID NO: 1305595 - DNA, 22 bp, Artificial Sequence
  chemically synthesized
ttaagaaacatagaattcttta

SEQ ID NO: 1305596 - DNA, 22 bp, Artificial Sequence
  chemically synthesized
agaaacatagaattctttagaa

SEQ ID NO: 1305597 - DNA, 22 bp, Artificial Sequence
  chemically synthesized
tataaaattgaattattctaaa

SEQ ID NO: 1305598 - DNA, 22 bp, Artificial Sequence
  chemically synthesized
tttagaataattcaattttata

SEQ ID NO: 1305599 - DNA, 22 bp, Artificial Sequence
  chemically synthesized
tatccataattatataaaattg

SEQ ID NO: 1305600 - DNA, 22 bp, Artificial Sequence
  chemically synthesized
tagaataattcaattttatata

SEQ ID NO: 1305601 - DNA, 22 bp, Artificial Sequence
  chemically synthesized
agaataattcaattttatataa

SEQ ID NO: 1305602 - DNA, 22 bp, Artificial Sequence
  chemically synthesized
gaataattcaattttatataat

SEQ ID NO: 1305603 - DNA, 22 bp, Artificial Sequence
  chemically synthesized
tgtgtctgtatccataattata

SEQ ID NO: 1305604 - DNA, 22 bp, Artificial Sequence
  chemically synthesized
aattttatataattatggatac

SEQ ID NO: 1305605 - DNA, 22 bp, Artificial Sequence
  chemically synthesized
tatataattatggatacagaca

SEQ ID NO: 1305606 - DNA, 22 bp, Artificial Sequence
  chemically synthesized
atataattatggatacagacac

SEQ ID NO: 1305607 - DNA, 22 bp, Artificial Sequence
  chemically synthesized
tataattatggatacagacaca

SEQ ID NO: 1305608 - DNA, 22 bp, Artificial Sequence
  chemically synthesized
caatgtgaatctatgtgtctgt

SEQ ID NO: 1305609 - DNA, 22 bp, Artificial Sequence
  chemically synthesized
tggatacagacacatagattca

SEQ ID NO: 1305610 - DNA, 22 bp, Artificial Sequence
  chemically synthesized
aataaacattacaatgtgaatc

SEQ ID NO: 1305611 - DNA, 22 bp, Artificial Sequence
  chemically synthesized
acattgtaatgtttattcagat

SEQ ID NO: 1305612 - DNA, 22 bp, Artificial Sequence
  chemically synthesized
taatgtttattcagattttgtg

SEQ ID NO: 1305613 - DNA, 22 bp, Artificial Sequence
  chemically synthesized
aacaatcaacaaataaacacaa

SEQ ID NO: 1305614 - DNA, 22 bp, Artificial Sequence
  chemically synthesized
attcagattttgtgtttatttg

SEQ ID NO: 1305615 - DNA, 22 bp, Artificial Sequence
  chemically synthesized
ttcagattttgtgtttatttgt

SEQ ID NO: 1305616 - DNA, 22 bp, Artificial Sequence
  chemically synthesized
cctgaacaatcaacaaataaac

SEQ ID NO: 1305617 - DNA, 22 bp, Artificial Sequence
  chemically synthesized
gcctgaacaatcaacaaataaa

SEQ ID NO: 1305618 - DNA, 22 bp, Artificial Sequence
  chemically synthesized
agattttgtgtttatttgttga

SEQ ID NO: 1305619 - DNA, 22 bp, Artificial Sequence
  chemically synthesized
cgtttgcctgaacaatcaacaa

SEQ ID NO: 1305620 - DNA, 22 bp, Artificial Sequence
  chemically synthesized
ccgtttgcctgaacaatcaaca

SEQ ID NO: 1305621 - DNA, 22 bp, Artificial Sequence
  chemically synthesized
tgtgtttatttgttgattgttc

SEQ ID NO: 1305622 - DNA, 22 bp, Artificial Sequence
  chemically synthesized
gtgtttatttgttgattgttca

SEQ ID NO: 1305623 - DNA, 22 bp, Artificial Sequence
  chemically synthesized
tgtttatttgttgattgttcag

SEQ ID NO: 1305624 - DNA, 22 bp, Artificial Sequence
  chemically synthesized
atttgttgattgttcaggcaaa

SEQ ID NO: 1305625 - DNA, 22 bp, Artificial Sequence
  chemically synthesized
tttgttgattgttcaggcaaac

SEQ ID NO: 1305626 - DNA, 22 bp, Artificial Sequence
  chemically synthesized
gttgattgttcaggcaaacgga

SEQ ID NO: 1305627 - DNA, 22 bp, Artificial Sequence
  chemically synthesized
ttgattgttcaggcaaacggaa

SEQ ID NO: 1305628 - DNA, 22 bp, Artificial Sequence
  chemically synthesized
acaccaaatgcagtttccgttt

SEQ ID NO: 1305629 - DNA, 22 bp, Artificial Sequence
  chemically synthesized
attgttcaggcaaacggaaact

SEQ ID NO: 1305630 - DNA, 22 bp, Artificial Sequence
  chemically synthesized
ttgacaccaaatgcagtttccg

SEQ ID NO: 1305631 - DNA, 22 bp, Artificial Sequence
  chemically synthesized
ttcaggcaaacggaaactgcat

SEQ ID NO: 1305632 - DNA, 22 bp, Artificial Sequence
  chemically synthesized
aggcaaacggaaactgcatttg

SEQ ID NO: 1305633 - DNA, 22 bp, Artificial Sequence
  chemically synthesized
catttggtgtcaacagttgcat

SEQ ID NO: 1305634 - DNA, 22 bp, Artificial Sequence
  chemically synthesized
atataaatataaagaaatgcaa

SEQ ID NO: 1305635 - DNA, 22 bp, Artificial Sequence
  chemically synthesized
ggtgtcaacagttgcatttctt

SEQ ID NO: 1305636 - DNA, 22 bp, Artificial Sequence
  chemically synthesized
gtgtcaacagttgcatttcttt

SEQ ID NO: 1305637 - DNA, 22 bp, Artificial Sequence
  chemically synthesized
accagctaatataaatataaag

SEQ ID NO: 1305638 - DNA, 22 bp, Artificial Sequence
  chemically synthesized
catttctttatatttatattag

SEQ ID NO: 1305639 - DNA, 22 bp, Artificial Sequence
  chemically synthesized
ctttatatttatattagctggt

SEQ ID NO: 1305640 - DNA, 22 bp, Artificial Sequence
  chemically synthesized
ccagcacagctaaccagctaat

SEQ ID NO: 1305641 - DNA, 22 bp, Artificial Sequence
  chemically synthesized
tttatatttatattagctggtt

SEQ ID NO: 1305642 - DNA, 22 bp, Artificial Sequence
  chemically synthesized
tgccagcacagctaaccagcta

SEQ ID NO: 1305643 - DNA, 22 bp, Artificial Sequence
  chemically synthesized
tatatttatattagctggttag

SEQ ID NO: 1305644 - DNA, 22 bp, Artificial Sequence
  chemically synthesized
atatttatattagctggttagc

SEQ ID NO: 1305645 - DNA, 22 bp, Artificial Sequence
  chemically synthesized
tatttatattagctggttagct

SEQ ID NO: 1305646 - DNA, 22 bp, Artificial Sequence
  chemically synthesized
gttctgccagcacagctaacca

SEQ ID NO: 1305647 - DNA, 22 bp, Artificial Sequence
  chemically synthesized
agttctgccagcacagctaacc

SEQ ID NO: 1305648 - DNA, 22 bp, Artificial Sequence
  chemically synthesized
tagttctgccagcacagctaac

SEQ ID NO: 1305649 - DNA, 22 bp, Artificial Sequence
  chemically synthesized
atattagctggttagctgtgct

SEQ ID NO: 1305650 - DNA, 22 bp, Artificial Sequence
  chemically synthesized
tattagctggttagctgtgctg

SEQ ID NO: 1305651 - DNA, 22 bp, Artificial Sequence
  chemically synthesized
ctttagttctgccagcacagct

SEQ ID NO: 1305652 - DNA, 22 bp, Artificial Sequence
  chemically synthesized
cctttagttctgccagcacagc

SEQ ID NO: 1305653 - DNA, 22 bp, Artificial Sequence
  chemically synthesized
gctggttagctgtgctggcaga

SEQ ID NO: 1305654 - DNA, 22 bp, Artificial Sequence
  chemically synthesized
gttagctgtgctggcagaacta

SEQ ID NO: 1305655 - DNA, 22 bp, Artificial Sequence
  chemically synthesized
tggacaggtttcctttagttct

SEQ ID NO: 1305656 - DNA, 22 bp, Artificial Sequence
  chemically synthesized
gctgtgctggcagaactaaagg

SEQ ID NO: 1305657 - DNA, 22 bp, Artificial Sequence
  chemically synthesized
tatggacaggtttcctttagtt

SEQ ID NO: 1305658 - DNA, 22 bp, Artificial Sequence
  chemically synthesized
tgctggcagaactaaaggaaac

SEQ ID NO: 1305659 - DNA, 22 bp, Artificial Sequence
  chemically synthesized
gcagaactaaaggaaacctgtc

SEQ ID NO: 1305660 - DNA, 22 bp, Artificial Sequence
  chemically synthesized
cgtaaggctctatggacaggtt

SEQ ID NO: 1305661 - DNA, 22 bp, Artificial Sequence
  chemically synthesized
cgactacgtaaggctctatgga

SEQ ID NO: 1305662 - DNA, 22 bp, Artificial Sequence
  chemically synthesized
aaggaaacctgtccatagagcc

SEQ ID NO: 1305663 - DNA, 22 bp, Artificial Sequence
  chemically synthesized
tagttacgactacgtaaggctc

SEQ ID NO: 1305664 - DNA, 22 bp, Artificial Sequence
  chemically synthesized
tgttgtagttacgactacgtaa

SEQ ID NO: 1305665 - DNA, 22 bp, Artificial Sequence
  chemically synthesized
tccatagagccttacgtagtcg

SEQ ID NO: 1305666 - DNA, 22 bp, Artificial Sequence
  chemically synthesized
tgacacatgattgtgttgtagt

SEQ ID NO: 1305667 - DNA, 22 bp, Artificial Sequence
  chemically synthesized
acgtagtcgtaactacaacaca

SEQ ID NO: 1305668 - DNA, 22 bp, Artificial Sequence
  chemically synthesized
gtgacacatgattgtgttgtag

SEQ ID NO: 1305669 - DNA, 22 bp, Artificial Sequence
  chemically synthesized
cgtagtcgtaactacaacacaa

SEQ ID NO: 1305670 - DNA, 22 bp, Artificial Sequence
  chemically synthesized
taaatttgtgacacatgattgt

SEQ ID NO: 1305671 - DNA, 22 bp, Artificial Sequence
  chemically synthesized
tgctataaatttgtgacacatg

SEQ ID NO: 1305672 - DNA, 22 bp, Artificial Sequence
  chemically synthesized
caacacaatcatgtgtcacaaa

SEQ ID NO: 1305673 - DNA, 22 bp, Artificial Sequence
  chemically synthesized
ctgtgctataaatttgtgacac

SEQ ID NO: 1305674 - DNA, 22 bp, Artificial Sequence
  chemically synthesized
agtgtaaaggtctgctgtgcta

SEQ ID NO: 1305675 - DNA, 22 bp, Artificial Sequence
  chemically synthesized
cagtgtaaaggtctgctgtgct

SEQ ID NO: 1305676 - DNA, 22 bp, Artificial Sequence
  chemically synthesized
tcagtgtaaaggtctgctgtgc

SEQ ID NO: 1305677 - DNA, 22 bp, Artificial Sequence
  chemically synthesized
aacaattttcagtgtaaaggtc

SEQ ID NO: 1305678 - DNA, 22 bp, Artificial Sequence
  chemically synthesized
atagcacagcagacctttacac

SEQ ID NO: 1305679 - DNA, 22 bp, Artificial Sequence
  chemically synthesized
tagcacagcagacctttacact

SEQ ID NO: 1305680 - DNA, 22 bp, Artificial Sequence
  chemically synthesized
taaacaattttcagtgtaaagg

SEQ ID NO: 1305681 - DNA, 22 bp, Artificial Sequence
  chemically synthesized
tctaaacaattttcagtgtaaa

SEQ ID NO: 1305682 - DNA, 22 bp, Artificial Sequence
  chemically synthesized
ctctaaacaattttcagtgtaa

SEQ ID NO: 1305683 - DNA, 22 bp, Artificial Sequence
  chemically synthesized
tctctaaacaattttcagtgta

SEQ ID NO: 1305684 - DNA, 22 bp, Artificial Sequence
  chemically synthesized
tttctctaaacaattttcagtg

SEQ ID NO: 1305685 - DNA, 22 bp, Artificial Sequence
  chemically synthesized
ctttctctaaacaattttcagt

SEQ ID NO: 1305686 - DNA, 22 bp, Artificial Sequence
  chemically synthesized
tctttctctaaacaattttcag

SEQ ID NO: 1305687 - DNA, 22 bp, Artificial Sequence
  chemically synthesized
ttctttctctaaacaattttca

SEQ ID NO: 1305688 - DNA, 22 bp, Artificial Sequence
  chemically synthesized
tacactgaaaattgtttagaga

SEQ ID NO: 1305689 - DNA, 22 bp, Artificial Sequence
  chemically synthesized
acactgaaaattgtttagagaa

SEQ ID NO: 1305690 - DNA, 22 bp, Artificial Sequence
  chemically synthesized
cactgaaaattgtttagagaaa

SEQ ID NO: 1305691 - DNA, 22 bp, Artificial Sequence
  chemically synthesized
ccagtcgaatttttctttctct

SEQ ID NO: 1305692 - DNA, 22 bp, Artificial Sequence
  chemically synthesized
aaaattgtttagagaaagaaaa

SEQ ID NO: 1305693 - DNA, 22 bp, Artificial Sequence
  chemically synthesized
tttagagaaagaaaaattcgac

SEQ ID NO: 1305694 - DNA, 22 bp, Artificial Sequence
  chemically synthesized
agagaaagaaaaattcgactgg

SEQ ID NO: 1305695 - DNA, 22 bp, Artificial Sequence
  chemically synthesized
gagaaagaaaaattcgactggg

SEQ ID NO: 1305696 - DNA, 22 bp, Artificial Sequence
  chemically synthesized
caagtgtgagccaccgctccca

SEQ ID NO: 1305697 - DNA, 22 bp, Artificial Sequence
  chemically synthesized
ggattacaagtgtgagccaccg

SEQ ID NO: 1305698 - DNA, 22 bp, Artificial Sequence
  chemically synthesized
gactgggagcggtggctcacac

SEQ ID NO: 1305699 - DNA, 22 bp, Artificial Sequence
  chemically synthesized
ggagcggtggctcacacttgta

SEQ ID NO: 1305700 - DNA, 22 bp, Artificial Sequence
  chemically synthesized
ccaaagtgctgggattacaagt

SEQ ID NO: 1305701 - DNA, 22 bp, Artificial Sequence
  chemically synthesized
ggcctcccaaagtgctgggatt

SEQ ID NO: 1305702 - DNA, 22 bp, Artificial Sequence
  chemically synthesized
acacttgtaatcccagcacttt

SEQ ID NO: 1305703 - DNA, 22 bp, Artificial Sequence
  chemically synthesized
gtaatcccagcactttgggagg

SEQ ID NO: 1305704 - DNA, 22 bp, Artificial Sequence
  chemically synthesized
taatcccagcactttgggaggc

SEQ ID NO: 1305705 - DNA, 22 bp, Artificial Sequence
  chemically synthesized
aggtgatccacccgcctcggcc

SEQ ID NO: 1305706 - DNA, 22 bp, Artificial Sequence
  chemically synthesized
acctcaggtgatccacccgcct

SEQ ID NO: 1305707 - DNA, 22 bp, Artificial Sequence
  chemically synthesized
tgggaggccgaggcgggtggat

SEQ ID NO: 1305708 - DNA, 22 bp, Artificial Sequence
  chemically synthesized
gggaggccgaggcgggtggatc

SEQ ID NO: 1305709 - DNA, 22 bp, Artificial Sequence
  chemically synthesized
ctgacctcaggtgatccacccg

SEQ ID NO: 1305710 - DNA, 22 bp, Artificial Sequence
  chemically synthesized
ggaggccgaggcgggtggatca

SEQ ID NO: 1305711 - DNA, 22 bp, Artificial Sequence
  chemically synthesized
aactcctgacctcaggtgatcc

SEQ ID NO: 1305712 - DNA, 22 bp, Artificial Sequence
  chemically synthesized
gaactcctgacctcaggtgatc

SEQ ID NO: 1305713 - DNA, 22 bp, Artificial Sequence
  chemically synthesized
gtcttgaactcctgacctcagg

SEQ ID NO: 1305714 - DNA, 22 bp, Artificial Sequence
  chemically synthesized
ggcacgctggtcttgaactcct

SEQ ID NO: 1305715 - DNA, 22 bp, Artificial Sequence
  chemically synthesized
aggtcaggagttcaagaccagc

SEQ ID NO: 1305716 - DNA, 22 bp, Artificial Sequence
  chemically synthesized
accatgttgggcacgctggtct

SEQ ID NO: 1305717 - DNA, 22 bp, Artificial Sequence
  chemically synthesized
caccatgttgggcacgctggtc

SEQ ID NO: 1305718 - DNA, 22 bp, Artificial Sequence
  chemically synthesized
aagaccagcgtgcccaacatgg

SEQ ID NO: 1305719 - DNA, 22 bp, Artificial Sequence
  chemically synthesized
gtagagacgggatttcaccatg

SEQ ID NO: 1305720 - DNA, 22 bp, Artificial Sequence
  chemically synthesized
agtagagacgggatttcaccat

SEQ ID NO: 1305721 - DNA, 22 bp, Artificial Sequence
  chemically synthesized
tagtagagacgggatttcacca

SEQ ID NO: 1305722 - DNA, 22 bp, Artificial Sequence
  chemically synthesized
ttagtagagacgggatttcacc

SEQ ID NO: 1305723 - DNA, 22 bp, Artificial Sequence
  chemically synthesized
tatttttagtagagacgggatt

SEQ ID NO: 1305724 - DNA, 22 bp, Artificial Sequence
  chemically synthesized
gtatttttagtagagacgggat

SEQ ID NO: 1305725 - DNA, 22 bp, Artificial Sequence
  chemically synthesized
ttgtatttttagtagagacggg

SEQ ID NO: 1305726 - DNA, 22 bp, Artificial Sequence
  chemically synthesized
cttgtatttttagtagagacgg

SEQ ID NO: 1305727 - DNA, 22 bp, Artificial Sequence
  chemically synthesized
tcttgtatttttagtagagacg

SEQ ID NO: 1305728 - DNA, 22 bp, Artificial Sequence
  chemically synthesized
ttcttgtatttttagtagagac

SEQ ID NO: 1305729 - DNA, 22 bp, Artificial Sequence
  chemically synthesized
atttttcttgtatttttagtag

SEQ ID NO: 1305730 - DNA, 22 bp, Artificial Sequence
  chemically synthesized
tactaaaaatacaagaaaaatt

SEQ ID NO: 1305731 - DNA, 22 bp, Artificial Sequence
  chemically synthesized
ctaaaaatacaagaaaaattag

SEQ ID NO: 1305732 - DNA, 22 bp, Artificial Sequence
  chemically synthesized
aaaatacaagaaaaattagctg

SEQ ID NO: 1305733 - DNA, 22 bp, Artificial Sequence
  chemically synthesized
caggtgcatgccaccatgccca

SEQ ID NO: 1305734 - DNA, 22 bp, Artificial Sequence
  chemically synthesized
ggactacaggtgcatgccacca

SEQ ID NO: 1305735 - DNA, 22 bp, Artificial Sequence
  chemically synthesized
gctgggcatggtggcatgcacc

SEQ ID NO: 1305736 - DNA, 22 bp, Artificial Sequence
  chemically synthesized
ggcatggtggcatgcacctgta

SEQ ID NO: 1305737 - DNA, 22 bp, Artificial Sequence
  chemically synthesized
ccgaatagctaggactacaggt

SEQ ID NO: 1305738 - DNA, 22 bp, Artificial Sequence
  chemically synthesized
agcctcccgaatagctaggact

SEQ ID NO: 1305739 - DNA, 22 bp, Artificial Sequence
  chemically synthesized
ccctcagcctcccgaatagcta

SEQ ID NO: 1305740 - DNA, 22 bp, Artificial Sequence
  chemically synthesized
ctgccctcagcctcccgaatag

SEQ ID NO: 1305741 - DNA, 22 bp, Artificial Sequence
  chemically synthesized
tcctgccctcagcctcccgaat

SEQ ID NO: 1305742 - DNA, 22 bp, Artificial Sequence
  chemically synthesized
tagtcctagctattcgggaggc

SEQ ID NO: 1305743 - DNA, 22 bp, Artificial Sequence
  chemically synthesized
gctattcgggaggctgagggca

SEQ ID NO: 1305744 - DNA, 22 bp, Artificial Sequence
  chemically synthesized
aagcgattctcctgccctcagc

SEQ ID NO: 1305745 - DNA, 22 bp, Artificial Sequence
  chemically synthesized
ttcgggaggctgagggcaggag

SEQ ID NO: 1305746 - DNA, 22 bp, Artificial Sequence
  chemically synthesized
gggaggctgagggcaggagaat

SEQ ID NO: 1305747 - DNA, 22 bp, Artificial Sequence
  chemically synthesized
ccgggttcaagcgattctcctg

SEQ ID NO: 1305748 - DNA, 22 bp, Artificial Sequence
  chemically synthesized
cacctcccgggttcaagcgatt

SEQ ID NO: 1305749 - DNA, 22 bp, Artificial Sequence
  chemically synthesized
agggcaggagaatcgcttgaac

SEQ ID NO: 1305750 - DNA, 22 bp, Artificial Sequence
  chemically synthesized
caacctccacctcccgggttca

SEQ ID NO: 1305751 - DNA, 22 bp, Artificial Sequence
  chemically synthesized
actgcaacctccacctcccggg

SEQ ID NO: 1305752 - DNA, 22 bp, Artificial Sequence
  chemically synthesized
ggctcactgcaacctccacctc

SEQ ID NO: 1305753 - DNA, 22 bp, Artificial Sequence
  chemically synthesized
gaacccgggaggtggaggttgc

SEQ ID NO: 1305754 - DNA, 22 bp, Artificial Sequence
  chemically synthesized
aacccgggaggtggaggttgca

SEQ ID NO: 1305755 - DNA, 22 bp, Artificial Sequence
  chemically synthesized
gagtgcagtagcatgatctcgg

SEQ ID NO: 1305756 - DNA, 22 bp, Artificial Sequence
  chemically synthesized
cagtgagccgagatcatgctac

SEQ ID NO: 1305757 - DNA, 22 bp, Artificial Sequence
  chemically synthesized
tcagccaggctggagtgcagta

SEQ ID NO: 1305758 - DNA, 22 bp, Artificial Sequence
  chemically synthesized
tgtcagccaggctggagtgcag

SEQ ID NO: 1305759 - DNA, 22 bp, Artificial Sequence
  chemically synthesized
gctctgtcagccaggctggagt

SEQ ID NO: 1305760 - DNA, 22 bp, Artificial Sequence
  chemically synthesized
ctgcactccagcctggctgaca

SEQ ID NO: 1305761 - DNA, 22 bp, Artificial Sequence
  chemically synthesized
cactccagcctggctgacagag

SEQ ID NO: 1305762 - DNA, 22 bp, Artificial Sequence
  chemically synthesized
gatggggagtctcgctctgtca

SEQ ID NO: 1305763 - DNA, 22 bp, Artificial Sequence
  chemically synthesized
agatggggagtctcgctctgtc

SEQ ID NO: 1305764 - DNA, 22 bp, Artificial Sequence
  chemically synthesized
tagatggggagtctcgctctgt

SEQ ID NO: 1305765 - DNA, 22 bp, Artificial Sequence
  chemically synthesized
cagcctggctgacagagcgaga

SEQ ID NO: 1305766 - DNA, 22 bp, Artificial Sequence
  chemically synthesized
ttagatggggagtctcgctctg

SEQ ID NO: 1305767 - DNA, 22 bp, Artificial Sequence
  chemically synthesized
tttagatggggagtctcgctct

SEQ ID NO: 1305768 - DNA, 22 bp, Artificial Sequence
  chemically synthesized
ttttagatggggagtctcgctc

SEQ ID NO: 1305769 - DNA, 22 bp, Artificial Sequence
  chemically synthesized
tttttagatggggagtctcgct

SEQ ID NO: 1305770 - DNA, 22 bp, Artificial Sequence
  chemically synthesized
ttttttagatggggagtctcgc

SEQ ID NO: 1305771 - DNA, 22 bp, Artificial Sequence
  chemically synthesized
tttttttagatggggagtctcg

SEQ ID NO: 1305772 - DNA, 22 bp, Artificial Sequence
  chemically synthesized
ttttttttagatggggagtctc

SEQ ID NO: 1305773 - DNA, 22 bp, Artificial Sequence
  chemically synthesized
gctgacagagcgagactcccca

SEQ ID NO: 1305774 - DNA, 22 bp, Artificial Sequence
  chemically synthesized
tttttttttagatggggagtct

SEQ ID NO: 1305775 - DNA, 22 bp, Artificial Sequence
  chemically synthesized
ttttttttttagatggggagtc

SEQ ID NO: 1305776 - DNA, 22 bp, Artificial Sequence
  chemically synthesized
tttttttttttagatggggagt

SEQ ID NO: 1305777 - DNA, 22 bp, Artificial Sequence
  chemically synthesized
ttttttttttttagatggggag

SEQ ID NO: 1305778 - DNA, 22 bp, Artificial Sequence
  chemically synthesized
acagagcgagactccccatcta

SEQ ID NO: 1305779 - DNA, 22 bp, Artificial Sequence
  chemically synthesized
tttttttttttttagatgggga

SEQ ID NO: 1305780 - DNA, 22 bp, Artificial Sequence
  chemically synthesized
ttttttttttttttagatgggg

SEQ ID NO: 1305781 - DNA, 22 bp, Artificial Sequence
  chemically synthesized
tttttttttttttttagatggg

SEQ ID NO: 1305782 - DNA, 22 bp, Artificial Sequence
  chemically synthesized
ttttttttttttttttagatgg

SEQ ID NO: 1305783 - DNA, 22 bp, Artificial Sequence
  chemically synthesized
tttttttttttttttttagatg

SEQ ID NO: 1305784 - DNA, 22 bp, Artificial Sequence
  chemically synthesized
ttttttttttttttttttagat

SEQ ID NO: 1305785 - DNA, 22 bp, Artificial Sequence
  chemically synthesized
tttttttttttttttttttaga

SEQ ID NO: 1305786 - DNA, 22 bp, Artificial Sequence
  chemically synthesized
ttttttttttttttttttttag

SEQ ID NO: 1305787 - DNA, 22 bp, Artificial Sequence
  chemically synthesized
ttttttttttttttttttttta

SEQ ID NO: 1305788 - DNA, 22 bp, Artificial Sequence
  chemically synthesized
tttttttttttttttttttttt

SEQ ID NO: 1305789 - DNA, 22 bp, Artificial Sequence
  chemically synthesized
cttttttttttttttttttttt

SEQ ID NO: 1305790 - DNA, 22 bp, Artificial Sequence
  chemically synthesized
cccatctaaaaaaaaaaaaaaa

SEQ ID NO: 1305791 - DNA, 22 bp, Artificial Sequence
  chemically synthesized
tccttttttttttttttttttt

SEQ ID NO: 1305792 - DNA, 22 bp, Artificial Sequence
  chemically synthesized
tctccttttttttttttttttt

SEQ ID NO: 1305793 - DNA, 22 bp, Artificial Sequence
  chemically synthesized
tctctccttttttttttttttt

SEQ ID NO: 1305794 - DNA, 22 bp, Artificial Sequence
  chemically synthesized
tctctctccttttttttttttt

SEQ ID NO: 1305795 - DNA, 22 bp, Artificial Sequence
  chemically synthesized
aaaaaaaaaaaaaaaaaaaaaa

SEQ ID NO: 1305796 - DNA, 22 bp, Artificial Sequence
  chemically synthesized
tctctctctccttttttttttt

SEQ ID NO: 1305797 - DNA, 22 bp, Artificial Sequence
  chemically synthesized
ctctctctctcctttttttttt

SEQ ID NO: 1305798 - DNA, 22 bp, Artificial Sequence
  chemically synthesized
tctctctctctccttttttttt

SEQ ID NO: 1305799 - DNA, 22 bp, Artificial Sequence
  chemically synthesized
ctttctctctctctcctttttt

SEQ ID NO: 1305800 - DNA, 22 bp, Artificial Sequence
  chemically synthesized
cctttctctctctctccttttt

SEQ ID NO: 1305801 - DNA, 22 bp, Artificial Sequence
  chemically synthesized
tcctttctctctctctcctttt

SEQ ID NO: 1305802 - DNA, 22 bp, Artificial Sequence
  chemically synthesized
aagttttcctttctctctctct

SEQ ID NO: 1305803 - DNA, 22 bp, Artificial Sequence
  chemically synthesized
caagttttcctttctctctctc

SEQ ID NO: 1305804 - DNA, 22 bp, Artificial Sequence
  chemically synthesized
tcaagttttcctttctctctct

SEQ ID NO: 1305805 - DNA, 22 bp, Artificial Sequence
  chemically synthesized
ttcaagttttcctttctctctc

SEQ ID NO: 1305806 - DNA, 22 bp, Artificial Sequence
  chemically synthesized
atttttcaagttttcctttctc

SEQ ID NO: 1305807 - DNA, 22 bp, Artificial Sequence
  chemically synthesized
attcatttttcaagttttcctt

SEQ ID NO: 1305808 - DNA, 22 bp, Artificial Sequence
  chemically synthesized
tcattcatttttcaagttttcc

SEQ ID NO: 1305809 - DNA, 22 bp, Artificial Sequence
  chemically synthesized
ccagttctcattcatttttcaa

SEQ ID NO: 1305810 - DNA, 22 bp, Artificial Sequence
  chemically synthesized
accagttctcattcatttttca

SEQ ID NO: 1305811 - DNA, 22 bp, Artificial Sequence
  chemically synthesized
tttaccagttctcattcatttt

SEQ ID NO: 1305812 - DNA, 22 bp, Artificial Sequence
  chemically synthesized
cagttgtttaccagttctcatt

SEQ ID NO: 1305813 - DNA, 22 bp, Artificial Sequence
  chemically synthesized
gaaaaatgaatgagaactggta

SEQ ID NO: 1305814 - DNA, 22 bp, Artificial Sequence
  chemically synthesized
cctgcagttgtttaccagttct

SEQ ID NO: 1305815 - DNA, 22 bp, Artificial Sequence
  chemically synthesized
aaaaatgaatgagaactggtaa

SEQ ID NO: 1305816 - DNA, 22 bp, Artificial Sequence
  chemically synthesized
ccctgcagttgtttaccagttc

SEQ ID NO: 1305817 - DNA, 22 bp, Artificial Sequence
  chemically synthesized
tccctgcagttgtttaccagtt

SEQ ID NO: 1305818 - DNA, 22 bp, Artificial Sequence
  chemically synthesized
ctttccctgcagttgtttacca

SEQ ID NO: 1305819 - DNA, 22 bp, Artificial Sequence
  chemically synthesized
gtaaacaactgcagggaaagta

SEQ ID NO: 1305820 - DNA, 22 bp, Artificial Sequence
  chemically synthesized
ccatatgaagagtgtggtaatt

SEQ ID NO: 1305821 - DNA, 22 bp, Artificial Sequence
  chemically synthesized
gccatatgaagagtgtggtaat

SEQ ID NO: 1305822 - DNA, 22 bp, Artificial Sequence
  chemically synthesized
cagggaaagtaattaccacact

SEQ ID NO: 1305823 - DNA, 22 bp, Artificial Sequence
  chemically synthesized
gtttgccatatgaagagtgtgg

SEQ ID NO: 1305824 - DNA, 22 bp, Artificial Sequence
  chemically synthesized
agtttgccatatgaagagtgtg

SEQ ID NO: 1305825 - DNA, 22 bp, Artificial Sequence
  chemically synthesized
tagtttgccatatgaagagtgt

SEQ ID NO: 1305826 - DNA, 22 bp, Artificial Sequence
  chemically synthesized
tttagtttgccatatgaagagt

SEQ ID NO: 1305827 - DNA, 22 bp, Artificial Sequence
  chemically synthesized
ctttagtttgccatatgaagag

SEQ ID NO: 1305828 - DNA, 22 bp, Artificial Sequence
  chemically synthesized
tctttagtttgccatatgaaga

SEQ ID NO: 1305829 - DNA, 22 bp, Artificial Sequence
  chemically synthesized
ccacactcttcatatggcaaac

SEQ ID NO: 1305830 - DNA, 22 bp, Artificial Sequence
  chemically synthesized
cggtgccccctttctttagttt

SEQ ID NO: 1305831 - DNA, 22 bp, Artificial Sequence
  chemically synthesized
gcggtgccccctttctttagtt

SEQ ID NO: 1305832 - DNA, 22 bp, Artificial Sequence
  chemically synthesized
ttcatatggcaaactaaagaaa

SEQ ID NO: 1305833 - DNA, 22 bp, Artificial Sequence
  chemically synthesized
ttgcggtgccccctttctttag

SEQ ID NO: 1305834 - DNA, 22 bp, Artificial Sequence
  chemically synthesized
catatggcaaactaaagaaagg

SEQ ID NO: 1305835 - DNA, 22 bp, Artificial Sequence
  chemically synthesized
cttgcggtgccccctttcttta

SEQ ID NO: 1305836 - DNA, 22 bp, Artificial Sequence
  chemically synthesized
atatggcaaactaaagaaaggg

SEQ ID NO: 1305837 - DNA, 22 bp, Artificial Sequence
  chemically synthesized
tcttgcggtgccccctttcttt

SEQ ID NO: 1305838 - DNA, 22 bp, Artificial Sequence
  chemically synthesized
ttcttgcggtgccccctttctt

SEQ ID NO: 1305839 - DNA, 22 bp, Artificial Sequence
  chemically synthesized
gcaatacttttcttgcggtgcc

SEQ ID NO: 1305840 - DNA, 22 bp, Artificial Sequence
  chemically synthesized
tggcaatacttttcttgcggtg

SEQ ID NO: 1305841 - DNA, 22 bp, Artificial Sequence
  chemically synthesized
aagaaagggggcaccgcaagaa

SEQ ID NO: 1305842 - DNA, 22 bp, Artificial Sequence
  chemically synthesized
aagctctggcaatacttttctt

SEQ ID NO: 1305843 - DNA, 22 bp, Artificial Sequence
  chemically synthesized
caagctctggcaatacttttct

SEQ ID NO: 1305844 - DNA, 22 bp, Artificial Sequence
  chemically synthesized
cccttcaagctctggcaatact

SEQ ID NO: 1305845 - DNA, 22 bp, Artificial Sequence
  chemically synthesized
tgcccttcaagctctggcaata

SEQ ID NO: 1305846 - DNA, 22 bp, Artificial Sequence
  chemically synthesized
cacattctgcccttcaagctct

SEQ ID NO: 1305847 - DNA, 22 bp, Artificial Sequence
  chemically synthesized
attacacattctgcccttcaag

SEQ ID NO: 1305848 - DNA, 22 bp, Artificial Sequence
  chemically synthesized
ccagagcttgaagggcagaatg

SEQ ID NO: 1305849 - DNA, 22 bp, Artificial Sequence
  chemically synthesized
gaagggcagaatgtgtaattag

SEQ ID NO: 1305850 - DNA, 22 bp, Artificial Sequence
  chemically synthesized
aagggcagaatgtgtaattagg

SEQ ID NO: 1305851 - DNA, 22 bp, Artificial Sequence
  chemically synthesized
ccagatatcacatcctaattac

SEQ ID NO: 1305852 - DNA, 22 bp, Artificial Sequence
  chemically synthesized
gaatcaccactgccagatatca

SEQ ID NO: 1305853 - DNA, 22 bp, Artificial Sequence
  chemically synthesized
ggatgtgatatctggcagtggt

SEQ ID NO: 1305854 - DNA, 22 bp, Artificial Sequence
  chemically synthesized
atccccaatgattggaatcacc

SEQ ID NO: 1305855 - DNA, 22 bp, Artificial Sequence
  chemically synthesized
aatccccaatgattggaatcac

SEQ ID NO: 1305856 - DNA, 22 bp, Artificial Sequence
  chemically synthesized
taatccccaatgattggaatca

SEQ ID NO: 1305857 - DNA, 22 bp, Artificial Sequence
  chemically synthesized
gcagtggtgattccaatcattg

SEQ ID NO: 1305858 - DNA, 22 bp, Artificial Sequence
  chemically synthesized
agatacagttttaatccccaat

SEQ ID NO: 1305859 - DNA, 22 bp, Artificial Sequence
  chemically synthesized
caatcattggggattaaaactg

SEQ ID NO: 1305860 - DNA, 22 bp, Artificial Sequence
  chemically synthesized
gggattaaaactgtatctcaac

SEQ ID NO: 1305861 - DNA, 22 bp, Artificial Sequence
  chemically synthesized
aaactgtatctcaacttgtgct

SEQ ID NO: 1305862 - DNA, 22 bp, Artificial Sequence
  chemically synthesized
aagcaacagaaagagcacaagt

SEQ ID NO: 1305863 - DNA, 22 bp, Artificial Sequence
  chemically synthesized
tatctcaacttgtgctctttct

SEQ ID NO: 1305864 - DNA, 22 bp, Artificial Sequence
  chemically synthesized
gccctaaagcaacagaaagagc

SEQ ID NO: 1305865 - DNA, 22 bp, Artificial Sequence
  chemically synthesized
aacttgtgctctttctgttgct

SEQ ID NO: 1305866 - DNA, 22 bp, Artificial Sequence
  chemically synthesized
gtgctctttctgttgctttagg

SEQ ID NO: 1305867 - DNA, 22 bp, Artificial Sequence
  chemically synthesized
tgctctttctgttgctttaggg

SEQ ID NO: 1305868 - DNA, 22 bp, Artificial Sequence
  chemically synthesized
agtgaatacactggccctaaag

SEQ ID NO: 1305869 - DNA, 22 bp, Artificial Sequence
  chemically synthesized
tttctgttgctttagggccagt

SEQ ID NO: 1305870 - DNA, 22 bp, Artificial Sequence
  chemically synthesized
tctgttgctttagggccagtgt

SEQ ID NO: 1305871 - DNA, 22 bp, Artificial Sequence
  chemically synthesized
ctgttgctttagggccagtgta

SEQ ID NO: 1305872 - DNA, 22 bp, Artificial Sequence
  chemically synthesized
tgttgctttagggccagtgtat

SEQ ID NO: 1305873 - DNA, 22 bp, Artificial Sequence
  chemically synthesized
ttgctttagggccagtgtattc

SEQ ID NO: 1305874 - DNA, 22 bp, Artificial Sequence
  chemically synthesized
ctttagggccagtgtattcact

SEQ ID NO: 1305875 - DNA, 22 bp, Artificial Sequence
  chemically synthesized
tagggccagtgtattcactcaa

SEQ ID NO: 1305876 - DNA, 22 bp, Artificial Sequence
  chemically synthesized
agggccagtgtattcactcaat

SEQ ID NO: 1305877 - DNA, 22 bp, Artificial Sequence
  chemically synthesized
gggccagtgtattcactcaatc

SEQ ID NO: 1305878 - DNA, 22 bp, Artificial Sequence
  chemically synthesized
actcaatcttccatgatatcta

SEQ ID NO: 1305879 - DNA, 22 bp, Artificial Sequence
  chemically synthesized
agtgagtccatatagatatcat

SEQ ID NO: 1305880 - DNA, 22 bp, Artificial Sequence
  chemically synthesized
aatcttccatgatatctatatg

SEQ ID NO: 1305881 - DNA, 22 bp, Artificial Sequence
  chemically synthesized
aggttcagtgagtccatataga

SEQ ID NO: 1305882 - DNA, 22 bp, Artificial Sequence
  chemically synthesized
ccatgatatctatatggactca

SEQ ID NO: 1305883 - DNA, 22 bp, Artificial Sequence
  chemically synthesized
catgatatctatatggactcac

SEQ ID NO: 1305884 - DNA, 22 bp, Artificial Sequence
  chemically synthesized
agatctgaggttcagtgagtcc

SEQ ID NO: 1305885 - DNA, 22 bp, Artificial Sequence
  chemically synthesized
aagttaagatctgaggttcagt

SEQ ID NO: 1305886 - DNA, 22 bp, Artificial Sequence
  chemically synthesized
tatggactcactgaacctcaga

SEQ ID NO: 1305887 - DNA, 22 bp, Artificial Sequence
  chemically synthesized
aactgaagttaagatctgaggt

SEQ ID NO: 1305888 - DNA, 22 bp, Artificial Sequence
  chemically synthesized
ctcaactgaagttaagatctga

SEQ ID NO: 1305889 - DNA, 22 bp, Artificial Sequence
  chemically synthesized
tgctcaactgaagttaagatct

SEQ ID NO: 1305890 - DNA, 22 bp, Artificial Sequence
  chemically synthesized
actgaacctcagatcttaactt

SEQ ID NO: 1305891 - DNA, 22 bp, Artificial Sequence
  chemically synthesized
gttctgctcaactgaagttaag

SEQ ID NO: 1305892 - DNA, 22 bp, Artificial Sequence
  chemically synthesized
aacctcagatcttaacttcagt

SEQ ID NO: 1305893 - DNA, 22 bp, Artificial Sequence
  chemically synthesized
agatcttaacttcagttgagca

SEQ ID NO: 1305894 - DNA, 22 bp, Artificial Sequence
  chemically synthesized
aacttcagttgagcagaactag

SEQ ID NO: 1305895 - DNA, 22 bp, Artificial Sequence
  chemically synthesized
agagagagaagactagttctgc

SEQ ID NO: 1305896 - DNA, 22 bp, Artificial Sequence
  chemically synthesized
acttcagttgagcagaactagt

SEQ ID NO: 1305897 - DNA, 22 bp, Artificial Sequence
  chemically synthesized
cagttgagcagaactagtcttc

SEQ ID NO: 1305898 - DNA, 22 bp, Artificial Sequence
  chemically synthesized
gtctgagagagagaagactagt

SEQ ID NO: 1305899 - DNA, 22 bp, Artificial Sequence
  chemically synthesized
agttgagcagaactagtcttct

SEQ ID NO: 1305900 - DNA, 22 bp, Artificial Sequence
  chemically synthesized
ggtctgagagagagaagactag

SEQ ID NO: 1305901 - DNA, 22 bp, Artificial Sequence
  chemically synthesized
cttggtctgagagagagaagac

SEQ ID NO: 1305902 - DNA, 22 bp, Artificial Sequence
  chemically synthesized
ccttggtctgagagagagaaga

SEQ ID NO: 1305903 - DNA, 22 bp, Artificial Sequence
  chemically synthesized
agcagaactagtcttctctctc

SEQ ID NO: 1305904 - DNA, 22 bp, Artificial Sequence
  chemically synthesized
tgccttccttggtctgagagag

SEQ ID NO: 1305905 - DNA, 22 bp, Artificial Sequence
  chemically synthesized
gtcttctctctctcagaccaag

SEQ ID NO: 1305906 - DNA, 22 bp, Artificial Sequence
  chemically synthesized
ctctctctcagaccaaggaagg

SEQ ID NO: 1305907 - DNA, 22 bp, Artificial Sequence
  chemically synthesized
tctctctcagaccaaggaaggc

SEQ ID NO: 1305908 - DNA, 22 bp, Artificial Sequence
  chemically synthesized
tctctcagaccaaggaaggcat

SEQ ID NO: 1305909 - DNA, 22 bp, Artificial Sequence
  chemically synthesized
tctcagaccaaggaaggcataa

SEQ ID NO: 1305910 - DNA, 22 bp, Artificial Sequence
  chemically synthesized
atggaacacaagttatgccttc

SEQ ID NO: 1305911 - DNA, 22 bp, Artificial Sequence
  chemically synthesized
catggaacacaagttatgcctt

SEQ ID NO: 1305912 - DNA, 22 bp, Artificial Sequence
  chemically synthesized
tcagaccaaggaaggcataact

SEQ ID NO: 1305913 - DNA, 22 bp, Artificial Sequence
  chemically synthesized
agaccaaggaaggcataacttg

SEQ ID NO: 1305914 - DNA, 22 bp, Artificial Sequence
  chemically synthesized
acacagtaggcttcatggaaca

SEQ ID NO: 1305915 - DNA, 22 bp, Artificial Sequence
  chemically synthesized
gacacagtaggcttcatggaac

SEQ ID NO: 1305916 - DNA, 22 bp, Artificial Sequence
  chemically synthesized
gcagacttgacacagtaggctt

SEQ ID NO: 1305917 - DNA, 22 bp, Artificial Sequence
  chemically synthesized
ggcagacttgacacagtaggct

SEQ ID NO: 1305918 - DNA, 22 bp, Artificial Sequence
  chemically synthesized
gtgttccatgaagcctactgtg

SEQ ID NO: 1305919 - DNA, 22 bp, Artificial Sequence
  chemically synthesized
tgttccatgaagcctactgtgt

SEQ ID NO: 1305920 - DNA, 22 bp, Artificial Sequence
  chemically synthesized
atttggcagacttgacacagta

SEQ ID NO: 1305921 - DNA, 22 bp, Artificial Sequence
  chemically synthesized
catttggcagacttgacacagt

SEQ ID NO: 1305922 - DNA, 22 bp, Artificial Sequence
  chemically synthesized
catgaagcctactgtgtcaagt

SEQ ID NO: 1305923 - DNA, 22 bp, Artificial Sequence
  chemically synthesized
aagtttcatttggcagacttga

SEQ ID NO: 1305924 - DNA, 22 bp, Artificial Sequence
  chemically synthesized
aaagtttcatttggcagacttg

SEQ ID NO: 1305925 - DNA, 22 bp, Artificial Sequence
  chemically synthesized
ctgtgtcaagtctgccaaatga

SEQ ID NO: 1305926 - DNA, 22 bp, Artificial Sequence
  chemically synthesized
catatttaaagtttcatttggc

SEQ ID NO: 1305927 - DNA, 22 bp, Artificial Sequence
  chemically synthesized
tgtcaagtctgccaaatgaaac

SEQ ID NO: 1305928 - DNA, 22 bp, Artificial Sequence
  chemically synthesized
ccaaatgaaactttaaatatgt

SEQ ID NO: 1305929 - DNA, 22 bp, Artificial Sequence
  chemically synthesized
agtagacaatgcctacatattt

SEQ ID NO: 1305930 - DNA, 22 bp, Artificial Sequence
  chemically synthesized
aggctaagtagacaatgcctac

SEQ ID NO: 1305931 - DNA, 22 bp, Artificial Sequence
  chemically synthesized
taaatatgtaggcattgtctac

SEQ ID NO: 1305932 - DNA, 22 bp, Artificial Sequence
  chemically synthesized
aaatatgtaggcattgtctact

SEQ ID NO: 1305933 - DNA, 22 bp, Artificial Sequence
  chemically synthesized
gtgttcaggctaagtagacaat

SEQ ID NO: 1305934 - DNA, 22 bp, Artificial Sequence
  chemically synthesized
aatatgtaggcattgtctactt

SEQ ID NO: 1305935 - DNA, 22 bp, Artificial Sequence
  chemically synthesized
agtgttcaggctaagtagacaa

SEQ ID NO: 1305936 - DNA, 22 bp, Artificial Sequence
  chemically synthesized
tagtgttcaggctaagtagaca

SEQ ID NO: 1305937 - DNA, 22 bp, Artificial Sequence
  chemically synthesized
ttagtgttcaggctaagtagac

SEQ ID NO: 1305938 - DNA, 22 bp, Artificial Sequence
  chemically synthesized
tttagtgttcaggctaagtaga

SEQ ID NO: 1305939 - DNA, 22 bp, Artificial Sequence
  chemically synthesized
tttttagtgttcaggctaagta

SEQ ID NO: 1305940 - DNA, 22 bp, Artificial Sequence
  chemically synthesized
tctacttagcctgaacactaaa

SEQ ID NO: 1305941 - DNA, 22 bp, Artificial Sequence
  chemically synthesized
tagaaaggactctttttagtgt

SEQ ID NO: 1305942 - DNA, 22 bp, Artificial Sequence
  chemically synthesized
cttagcctgaacactaaaaaga

SEQ ID NO: 1305943 - DNA, 22 bp, Artificial Sequence
  chemically synthesized
agcctgaacactaaaaagagtc

SEQ ID NO: 1305944 - DNA, 22 bp, Artificial Sequence
  chemically synthesized
gcctgaacactaaaaagagtcc

SEQ ID NO: 1305945 - DNA, 22 bp, Artificial Sequence
  chemically synthesized
ggaactgtagaaaggactcttt

SEQ ID NO: 1305946 - DNA, 22 bp, Artificial Sequence
  chemically synthesized
gggaactgtagaaaggactctt

SEQ ID NO: 1305947 - DNA, 22 bp, Artificial Sequence
  chemically synthesized
aacactaaaaagagtcctttct

SEQ ID NO: 1305948 - DNA, 22 bp, Artificial Sequence
  chemically synthesized
aaaagagtcctttctacagttc

SEQ ID NO: 1305949 - DNA, 22 bp, Artificial Sequence
  chemically synthesized
caaccaaacaaatccttgggaa

SEQ ID NO: 1305950 - DNA, 22 bp, Artificial Sequence
  chemically synthesized
tctacagttcccaaggatttgt

SEQ ID NO: 1305951 - DNA, 22 bp, Artificial Sequence
  chemically synthesized
ctacagttcccaaggatttgtt

SEQ ID NO: 1305952 - DNA, 22 bp, Artificial Sequence
  chemically synthesized
tacagttcccaaggatttgttt

SEQ ID NO: 1305953 - DNA, 22 bp, Artificial Sequence
  chemically synthesized
cagttcccaaggatttgtttgg

SEQ ID NO: 1305954 - DNA, 22 bp, Artificial Sequence
  chemically synthesized
gaaacattgcaaccaaacaaat

SEQ ID NO: 1305955 - DNA, 22 bp, Artificial Sequence
  chemically synthesized
agaaacattgcaaccaaacaaa

SEQ ID NO: 1305956 - DNA, 22 bp, Artificial Sequence
  chemically synthesized
tagaaacattgcaaccaaacaa

SEQ ID NO: 1305957 - DNA, 22 bp, Artificial Sequence
  chemically synthesized
ccaaggatttgtttggttgcaa

SEQ ID NO: 1305958 - DNA, 22 bp, Artificial Sequence
  chemically synthesized
actttagaaacattgcaaccaa

SEQ ID NO: 1305959 - DNA, 22 bp, Artificial Sequence
  chemically synthesized
tactgactttagaaacattgca

SEQ ID NO: 1305960 - DNA, 22 bp, Artificial Sequence
  chemically synthesized
tgtactgactttagaaacattg

SEQ ID NO: 1305961 - DNA, 22 bp, Artificial Sequence
  chemically synthesized
ctgtactgactttagaaacatt

SEQ ID NO: 1305962 - DNA, 22 bp, Artificial Sequence
  chemically synthesized
gtttggttgcaatgtttctaaa

SEQ ID NO: 1305963 - DNA, 22 bp, Artificial Sequence
  chemically synthesized
tttggttgcaatgtttctaaag

SEQ ID NO: 1305964 - DNA, 22 bp, Artificial Sequence
  chemically synthesized
ggttgcaatgtttctaaagtca

SEQ ID NO: 1305965 - DNA, 22 bp, Artificial Sequence
  chemically synthesized
gttgcaatgtttctaaagtcag

SEQ ID NO: 1305966 - DNA, 22 bp, Artificial Sequence
  chemically synthesized
agggaagtttctgtactgactt

SEQ ID NO: 1305967 - DNA, 22 bp, Artificial Sequence
  chemically synthesized
caatgtttctaaagtcagtaca

SEQ ID NO: 1305968 - DNA, 22 bp, Artificial Sequence
  chemically synthesized
cagggaagtttctgtactgact

SEQ ID NO: 1305969 - DNA, 22 bp, Artificial Sequence
  chemically synthesized
tcagggaagtttctgtactgac

SEQ ID NO: 1305970 - DNA, 22 bp, Artificial Sequence
  chemically synthesized
cattttcagggaagtttctgta

SEQ ID NO: 1305971 - DNA, 22 bp, Artificial Sequence
  chemically synthesized
ctaaagtcagtacagaaacttc

SEQ ID NO: 1305972 - DNA, 22 bp, Artificial Sequence
  chemically synthesized
taaagtcagtacagaaacttcc

SEQ ID NO: 1305973 - DNA, 22 bp, Artificial Sequence
  chemically synthesized
aagtcagtacagaaacttccct

SEQ ID NO: 1305974 - DNA, 22 bp, Artificial Sequence
  chemically synthesized
gagctccattttcagggaagtt

SEQ ID NO: 1305975 - DNA, 22 bp, Artificial Sequence
  chemically synthesized
ggagctccattttcagggaagt

SEQ ID NO: 1305976 - DNA, 22 bp, Artificial Sequence
  chemically synthesized
ccctgaaaatggagctccaaac

SEQ ID NO: 1305977 - DNA, 22 bp, Artificial Sequence
  chemically synthesized
cctgaaaatggagctccaaact

SEQ ID NO: 1305978 - DNA, 22 bp, Artificial Sequence
  chemically synthesized
aaaatggagctccaaacttatc

SEQ ID NO: 1305979 - DNA, 22 bp, Artificial Sequence
  chemically synthesized
caggatgaaaatcgtgataagt

SEQ ID NO: 1305980 - DNA, 22 bp, Artificial Sequence
  chemically synthesized
caaacttatcacgattttcatc

SEQ ID NO: 1305981 - DNA, 22 bp, Artificial Sequence
  chemically synthesized
aatacattccaggatgaaaatc

SEQ ID NO: 1305982 - DNA, 22 bp, Artificial Sequence
  chemically synthesized
atcacgattttcatcctggaat

SEQ ID NO: 1305983 - DNA, 22 bp, Artificial Sequence
  chemically synthesized
tcacgattttcatcctggaatg

SEQ ID NO: 1305984 - DNA, 22 bp, Artificial Sequence
  chemically synthesized
tcatcctggaatgtatttaggt

SEQ ID NO: 1305985 - DNA, 22 bp, Artificial Sequence
  chemically synthesized
catcctggaatgtatttaggtt

SEQ ID NO: 1305986 - DNA, 22 bp, Artificial Sequence
  chemically synthesized
atcctggaatgtatttaggttt

SEQ ID NO: 1305987 - DNA, 22 bp, Artificial Sequence
  chemically synthesized
gaatgtatttaggtttgtatcc

SEQ ID NO: 1305988 - DNA, 22 bp, Artificial Sequence
  chemically synthesized
agtggtgcacgtcgagggatac

SEQ ID NO: 1305989 - DNA, 22 bp, Artificial Sequence
  chemically synthesized
aggtttgtatccctcgacgtgc

SEQ ID NO: 1305990 - DNA, 22 bp, Artificial Sequence
  chemically synthesized
ggtttgtatccctcgacgtgca

SEQ ID NO: 1305991 - DNA, 22 bp, Artificial Sequence
  chemically synthesized
gtatccctcgacgtgcaccact

SEQ ID NO: 1305992 - DNA, 22 bp, Artificial Sequence
  chemically synthesized
tatccctcgacgtgcaccactc

SEQ ID NO: 1305993 - DNA, 22 bp, Artificial Sequence
  chemically synthesized
gacgtgcaccactcaattgacg

SEQ ID NO: 1305994 - DNA, 22 bp, Artificial Sequence
  chemically synthesized
aggtaaaaagtatgtgacgtca

SEQ ID NO: 1305995 - DNA, 22 bp, Artificial Sequence
  chemically synthesized
caggtaaaaagtatgtgacgtc

SEQ ID NO: 1305996 - DNA, 22 bp, Artificial Sequence
  chemically synthesized
aattgacgtcacatacttttta

SEQ ID NO: 1305997 - DNA, 22 bp, Artificial Sequence
  chemically synthesized
aaataaatttcaggtaaaaagt

SEQ ID NO: 1305998 - DNA, 22 bp, Artificial Sequence
  chemically synthesized
acgtcacatactttttacctga

SEQ ID NO: 1305999 - DNA, 22 bp, Artificial Sequence
  chemically synthesized
agaaactgaaataaatttcagg

SEQ ID NO: 1306000 - DNA, 22 bp, Artificial Sequence
  chemically synthesized
tgagaaactgaaataaatttca

SEQ ID NO: 1306001 - DNA, 22 bp, Artificial Sequence
  chemically synthesized
ctgagaaactgaaataaatttc

SEQ ID NO: 1306002 - DNA, 22 bp, Artificial Sequence
  chemically synthesized
tttacctgaaatttatttcagt

SEQ ID NO: 1306003 - DNA, 22 bp, Artificial Sequence
  chemically synthesized
ttacctgaaatttatttcagtt

SEQ ID NO: 1306004 - DNA, 22 bp, Artificial Sequence
  chemically synthesized
tacctgaaatttatttcagttt

SEQ ID NO: 1306005 - DNA, 22 bp, Artificial Sequence
  chemically synthesized
acctgaaatttatttcagtttc

SEQ ID NO: 1306006 - DNA, 22 bp, Artificial Sequence
  chemically synthesized
cctgaaatttatttcagtttct

SEQ ID NO: 1306007 - DNA, 22 bp, Artificial Sequence
  chemically synthesized
aaatttatttcagtttctcaga

SEQ ID NO: 1306008 - DNA, 22 bp, Artificial Sequence
  chemically synthesized
gggaaatatacagtcttctgag

SEQ ID NO: 1306009 - DNA, 22 bp, Artificial Sequence
  chemically synthesized
atttcagtttctcagaagactg

SEQ ID NO: 1306010 - DNA, 22 bp, Artificial Sequence
  chemically synthesized
tttcagtttctcagaagactgt

SEQ ID NO: 1306011 - DNA, 22 bp, Artificial Sequence
  chemically synthesized
cagtttctcagaagactgtata

SEQ ID NO: 1306012 - DNA, 22 bp, Artificial Sequence
  chemically synthesized
taactggggaaatatacagtct

SEQ ID NO: 1306013 - DNA, 22 bp, Artificial Sequence
  chemically synthesized
agtttctcagaagactgtatat

SEQ ID NO: 1306014 - DNA, 22 bp, Artificial Sequence
  chemically synthesized
ctcagaagactgtatatttccc

SEQ ID NO: 1306015 - DNA, 22 bp, Artificial Sequence
  chemically synthesized
tcagaagactgtatatttcccc

SEQ ID NO: 1306016 - DNA, 22 bp, Artificial Sequence
  chemically synthesized
agaagactgtatatttccccag

SEQ ID NO: 1306017 - DNA, 22 bp, Artificial Sequence
  chemically synthesized
aggaatagtaaaatctgtaact

SEQ ID NO: 1306018 - DNA, 22 bp, Artificial Sequence
  chemically synthesized
tatatttccccagttacagatt

SEQ ID NO: 1306019 - DNA, 22 bp, Artificial Sequence
  chemically synthesized
aaggaatagtaaaatctgtaac

SEQ ID NO: 1306020 - DNA, 22 bp, Artificial Sequence
  chemically synthesized
ccccagttacagattttactat

SEQ ID NO: 1306021 - DNA, 22 bp, Artificial Sequence
  chemically synthesized
cccagttacagattttactatt

SEQ ID NO: 1306022 - DNA, 22 bp, Artificial Sequence
  chemically synthesized
cagattttactattccttaaat

SEQ ID NO: 1306023 - DNA, 22 bp, Artificial Sequence
  chemically synthesized
tactattccttaaatatggtgg

SEQ ID NO: 1306024 - DNA, 22 bp, Artificial Sequence
  chemically synthesized
agaaagtggcagccaccatatt

SEQ ID NO: 1306025 - DNA, 22 bp, Artificial Sequence
  chemically synthesized
actattccttaaatatggtggc

SEQ ID NO: 1306026 - DNA, 22 bp, Artificial Sequence
  chemically synthesized
ctattccttaaatatggtggct

SEQ ID NO: 1306027 - DNA, 22 bp, Artificial Sequence
  chemically synthesized
ttccttaaatatggtggctgcc

SEQ ID NO: 1306028 - DNA, 22 bp, Artificial Sequence
  chemically synthesized
taggttaagaaagtggcagcca

SEQ ID NO: 1306029 - DNA, 22 bp, Artificial Sequence
  chemically synthesized
cttaaatatggtggctgccact

SEQ ID NO: 1306030 - DNA, 22 bp, Artificial Sequence
  chemically synthesized
aaatatggtggctgccactttc

SEQ ID NO: 1306031 - DNA, 22 bp, Artificial Sequence
  chemically synthesized
aatatggtggctgccactttct

SEQ ID NO: 1306032 - DNA, 22 bp, Artificial Sequence
  chemically synthesized
atactgtaggttaagaaagtgg

SEQ ID NO: 1306033 - DNA, 22 bp, Artificial Sequence
  chemically synthesized
ccattaatactgtaggttaaga

SEQ ID NO: 1306034 - DNA, 22 bp, Artificial Sequence
  chemically synthesized
tgccattaatactgtaggttaa

SEQ ID NO: 1306035 - DNA, 22 bp, Artificial Sequence
  chemically synthesized
ctgccattaatactgtaggtta

SEQ ID NO: 1306036 - DNA, 22 bp, Artificial Sequence
  chemically synthesized
ccactttcttaacctacagtat

SEQ ID NO: 1306037 - DNA, 22 bp, Artificial Sequence
  chemically synthesized
agcatttctgccattaatactg

SEQ ID NO: 1306038 - DNA, 22 bp, Artificial Sequence
  chemically synthesized
tcttaacctacagtattaatgg

SEQ ID NO: 1306039 - DNA, 22 bp, Artificial Sequence
  chemically synthesized
cttaacctacagtattaatggc

SEQ ID NO: 1306040 - DNA, 22 bp, Artificial Sequence
  chemically synthesized
ttaacctacagtattaatggca

SEQ ID NO: 1306041 - DNA, 22 bp, Artificial Sequence
  chemically synthesized
aacctacagtattaatggcaga

SEQ ID NO: 1306042 - DNA, 22 bp, Artificial Sequence
  chemically synthesized
acctacagtattaatggcagaa

SEQ ID NO: 1306043 - DNA, 22 bp, Artificial Sequence
  chemically synthesized
taaatctaagcatttctgccat

SEQ ID NO: 1306044 - DNA, 22 bp, Artificial Sequence
  chemically synthesized
ataaatctaagcatttctgcca

SEQ ID NO: 1306045 - DNA, 22 bp, Artificial Sequence
  chemically synthesized
tataaatctaagcatttctgcc

SEQ ID NO: 1306046 - DNA, 22 bp, Artificial Sequence
  chemically synthesized
ttataaatctaagcatttctgc

SEQ ID NO: 1306047 - DNA, 22 bp, Artificial Sequence
  chemically synthesized
cagtattaatggcagaaatgct

SEQ ID NO: 1306048 - DNA, 22 bp, Artificial Sequence
  chemically synthesized
ccttttataaatctaagcattt

SEQ ID NO: 1306049 - DNA, 22 bp, Artificial Sequence
  chemically synthesized
gccttttataaatctaagcatt

SEQ ID NO: 1306050 - DNA, 22 bp, Artificial Sequence
  chemically synthesized
atggcagaaatgcttagattta

SEQ ID NO: 1306051 - DNA, 22 bp, Artificial Sequence
  chemically synthesized
cccatgtttgccttttataaat

SEQ ID NO: 1306052 - DNA, 22 bp, Artificial Sequence
  chemically synthesized
ccccatgtttgccttttataaa

SEQ ID NO: 1306053 - DNA, 22 bp, Artificial Sequence
  chemically synthesized
tccccatgtttgccttttataa

SEQ ID NO: 1306054 - DNA, 22 bp, Artificial Sequence
  chemically synthesized
ttccccatgtttgccttttata

SEQ ID NO: 1306055 - DNA, 22 bp, Artificial Sequence
  chemically synthesized
ttttccccatgtttgcctttta

SEQ ID NO: 1306056 - DNA, 22 bp, Artificial Sequence
  chemically synthesized
tcttttccccatgtttgccttt

SEQ ID NO: 1306057 - DNA, 22 bp, Artificial Sequence
  chemically synthesized
agatttataaaaggcaaacatg

SEQ ID NO: 1306058 - DNA, 22 bp, Artificial Sequence
  chemically synthesized
gatttataaaaggcaaacatgg

SEQ ID NO: 1306059 - DNA, 22 bp, Artificial Sequence
  chemically synthesized
tctctcttttccccatgtttgc

SEQ ID NO: 1306060 - DNA, 22 bp, Artificial Sequence
  chemically synthesized
ataaaaggcaaacatggggaaa

SEQ ID NO: 1306061 - DNA, 22 bp, Artificial Sequence
  chemically synthesized
taaaaggcaaacatggggaaaa

SEQ ID NO: 1306062 - DNA, 22 bp, Artificial Sequence
  chemically synthesized
atattgtctctcttttccccat

SEQ ID NO: 1306063 - DNA, 22 bp, Artificial Sequence
  chemically synthesized
aatattgtctctcttttcccca

SEQ ID NO: 1306064 - DNA, 22 bp, Artificial Sequence
  chemically synthesized
aatttaatattgtctctctttt

SEQ ID NO: 1306065 - DNA, 22 bp, Artificial Sequence
  chemically synthesized
gaatttaatattgtctctcttt

SEQ ID NO: 1306066 - DNA, 22 bp, Artificial Sequence
  chemically synthesized
gagagacttgaatttaatattg

SEQ ID NO: 1306067 - DNA, 22 bp, Artificial Sequence
  chemically synthesized
cgagagacttgaatttaatatt

SEQ ID NO: 1306068 - DNA, 22 bp, Artificial Sequence
  chemically synthesized
tcgagagacttgaatttaatat

SEQ ID NO: 1306069 - DNA, 22 bp, Artificial Sequence
  chemically synthesized
ctttcgagagacttgaatttaa

SEQ ID NO: 1306070 - DNA, 22 bp, Artificial Sequence
  chemically synthesized
cctttcgagagacttgaattta

SEQ ID NO: 1306071 - DNA, 22 bp, Artificial Sequence
  chemically synthesized
tcctttcgagagacttgaattt

SEQ ID NO: 1306072 - DNA, 22 bp, Artificial Sequence
  chemically synthesized
ctttcctttcgagagacttgaa

SEQ ID NO: 1306073 - DNA, 22 bp, Artificial Sequence
  chemically synthesized
cctttcctttcgagagacttga

SEQ ID NO: 1306074 - DNA, 22 bp, Artificial Sequence
  chemically synthesized
tcctttcctttcgagagacttg

SEQ ID NO: 1306075 - DNA, 22 bp, Artificial Sequence
  chemically synthesized
ttcctttcctttcgagagactt

SEQ ID NO: 1306076 - DNA, 22 bp, Artificial Sequence
  chemically synthesized
tcttttcctttcctttcgagag

SEQ ID NO: 1306077 - DNA, 22 bp, Artificial Sequence
  chemically synthesized
aattcaagtctctcgaaaggaa

SEQ ID NO: 1306078 - DNA, 22 bp, Artificial Sequence
  chemically synthesized
attatcttttcctttcctttcg

SEQ ID NO: 1306079 - DNA, 22 bp, Artificial Sequence
  chemically synthesized
cattatcttttcctttcctttc

SEQ ID NO: 1306080 - DNA, 22 bp, Artificial Sequence
  chemically synthesized
tcattatcttttcctttccttt

SEQ ID NO: 1306081 - DNA, 22 bp, Artificial Sequence
  chemically synthesized
ttcattatcttttcctttcctt

SEQ ID NO: 1306082 - DNA, 22 bp, Artificial Sequence
  chemically synthesized
aagtctctcgaaaggaaaggaa

SEQ ID NO: 1306083 - DNA, 22 bp, Artificial Sequence
  chemically synthesized
tttcattatcttttcctttcct

SEQ ID NO: 1306084 - DNA, 22 bp, Artificial Sequence
  chemically synthesized
ctttttcattatcttttccttt

SEQ ID NO: 1306085 - DNA, 22 bp, Artificial Sequence
  chemically synthesized
tcgaaaggaaaggaaaagataa

SEQ ID NO: 1306086 - DNA, 22 bp, Artificial Sequence
  chemically synthesized
cattgctttttcattatctttt

SEQ ID NO: 1306087 - DNA, 22 bp, Artificial Sequence
  chemically synthesized
gaaaggaaaggaaaagataatg

SEQ ID NO: 1306088 - DNA, 22 bp, Artificial Sequence
  chemically synthesized
acattgctttttcattatcttt

SEQ ID NO: 1306089 - DNA, 22 bp, Artificial Sequence
  chemically synthesized
tacattgctttttcattatctt

SEQ ID NO: 1306090 - DNA, 22 bp, Artificial Sequence
  chemically synthesized
ttacattgctttttcattatct

SEQ ID NO: 1306091 - DNA, 22 bp, Artificial Sequence
  chemically synthesized
tttacattgctttttcattatc

SEQ ID NO: 1306092 - DNA, 22 bp, Artificial Sequence
  chemically synthesized
attttttacattgctttttcat

SEQ ID NO: 1306093 - DNA, 22 bp, Artificial Sequence
  chemically synthesized
tcattttttacattgctttttc

SEQ ID NO: 1306094 - DNA, 22 bp, Artificial Sequence
  chemically synthesized
tctctcattttttacattgctt

SEQ ID NO: 1306095 - DNA, 22 bp, Artificial Sequence
  chemically synthesized
ccccacctatctctcatttttt

SEQ ID NO: 1306096 - DNA, 22 bp, Artificial Sequence
  chemically synthesized
aacctgccccacctatctctca

SEQ ID NO: 1306097 - DNA, 22 bp, Artificial Sequence
  chemically synthesized
aaacctgccccacctatctctc

SEQ ID NO: 1306098 - DNA, 22 bp, Artificial Sequence
  chemically synthesized
aatggcatcttaaacctgcccc

SEQ ID NO: 1306099 - DNA, 22 bp, Artificial Sequence
  chemically synthesized
tgcagagattcaatggcatctt

SEQ ID NO: 1306100 - DNA, 22 bp, Artificial Sequence
  chemically synthesized
aagatgccattgaatctctgca

SEQ ID NO: 1306101 - DNA, 22 bp, Artificial Sequence
  chemically synthesized
agatgccattgaatctctgcat

SEQ ID NO: 1306102 - DNA, 22 bp, Artificial Sequence
  chemically synthesized
gagcaaaaaaaaaggcagtcta

SEQ ID NO: 1306103 - DNA, 22 bp, Artificial Sequence
  chemically synthesized
agagcaaaaaaaaaggcagtct

SEQ ID NO: 1306104 - DNA, 22 bp, Artificial Sequence
  chemically synthesized
aatctctgcatagactgccttt

SEQ ID NO: 1306105 - DNA, 22 bp, Artificial Sequence
  chemically synthesized
gtatttagagcaaaaaaaaagg

SEQ ID NO: 1306106 - DNA, 22 bp, Artificial Sequence
  chemically synthesized
tgcatagactgccttttttttt

SEQ ID NO: 1306107 - DNA, 22 bp, Artificial Sequence
  chemically synthesized
agtatttagagcaaaaaaaaag

SEQ ID NO: 1306108 - DNA, 22 bp, Artificial Sequence
  chemically synthesized
catagactgcctttttttttgc

SEQ ID NO: 1306109 - DNA, 22 bp, Artificial Sequence
  chemically synthesized
ggcaagtttagtatttagagca

SEQ ID NO: 1306110 - DNA, 22 bp, Artificial Sequence
  chemically synthesized
aggcaagtttagtatttagagc

SEQ ID NO: 1306111 - DNA, 22 bp, Artificial Sequence
  chemically synthesized
cctttttttttgctctaaatac

SEQ ID NO: 1306112 - DNA, 22 bp, Artificial Sequence
  chemically synthesized
atttaggcaagtttagtattta

SEQ ID NO: 1306113 - DNA, 22 bp, Artificial Sequence
  chemically synthesized
tttttttgctctaaatactaaa

SEQ ID NO: 1306114 - DNA, 22 bp, Artificial Sequence
  chemically synthesized
ttttttgctctaaatactaaac

SEQ ID NO: 1306115 - DNA, 22 bp, Artificial Sequence
  chemically synthesized
tttttgctctaaatactaaact

SEQ ID NO: 1306116 - DNA, 22 bp, Artificial Sequence
  chemically synthesized
ttttgctctaaatactaaactt

SEQ ID NO: 1306117 - DNA, 22 bp, Artificial Sequence
  chemically synthesized
tttgctctaaatactaaacttg

SEQ ID NO: 1306118 - DNA, 22 bp, Artificial Sequence
  chemically synthesized
ttgctctaaatactaaacttgc

SEQ ID NO: 1306119 - DNA, 22 bp, Artificial Sequence
  chemically synthesized
tgctctaaatactaaacttgcc

SEQ ID NO: 1306120 - DNA, 22 bp, Artificial Sequence
  chemically synthesized
gctctaaatactaaacttgcct

SEQ ID NO: 1306121 - DNA, 22 bp, Artificial Sequence
  chemically synthesized
ctctaaatactaaacttgccta

SEQ ID NO: 1306122 - DNA, 22 bp, Artificial Sequence
  chemically synthesized
taaatactaaacttgcctaaat

SEQ ID NO: 1306123 - DNA, 22 bp, Artificial Sequence
  chemically synthesized
aatactaaacttgcctaaatta

SEQ ID NO: 1306124 - DNA, 22 bp, Artificial Sequence
  chemically synthesized
gagggaggtggcctaatttagg

SEQ ID NO: 1306125 - DNA, 22 bp, Artificial Sequence
  chemically synthesized
tggagggaggtggcctaattta

SEQ ID NO: 1306126 - DNA, 22 bp, Artificial Sequence
  chemically synthesized
tctggagggaggtggcctaatt

SEQ ID NO: 1306127 - DNA, 22 bp, Artificial Sequence
  chemically synthesized
aacttgcctaaattaggccacc

SEQ ID NO: 1306128 - DNA, 22 bp, Artificial Sequence
  chemically synthesized
ttctctggagggaggtggccta

SEQ ID NO: 1306129 - DNA, 22 bp, Artificial Sequence
  chemically synthesized
gttctctggagggaggtggcct

SEQ ID NO: 1306130 - DNA, 22 bp, Artificial Sequence
  chemically synthesized
tgttctctggagggaggtggcc

SEQ ID NO: 1306131 - DNA, 22 bp, Artificial Sequence
  chemically synthesized
ttgttctctggagggaggtggc

SEQ ID NO: 1306132 - DNA, 22 bp, Artificial Sequence
  chemically synthesized
gcctaaattaggccacctccct

SEQ ID NO: 1306133 - DNA, 22 bp, Artificial Sequence
  chemically synthesized
cctaaattaggccacctccctc

SEQ ID NO: 1306134 - DNA, 22 bp, Artificial Sequence
  chemically synthesized
cttttgttctctggagggaggt

SEQ ID NO: 1306135 - DNA, 22 bp, Artificial Sequence
  chemically synthesized
ccttttgttctctggagggagg

SEQ ID NO: 1306136 - DNA, 22 bp, Artificial Sequence
  chemically synthesized
aattaggccacctccctccaga

SEQ ID NO: 1306137 - DNA, 22 bp, Artificial Sequence
  chemically synthesized
ggccacctccctccagagaaca

SEQ ID NO: 1306138 - DNA, 22 bp, Artificial Sequence
  chemically synthesized
cctccagagaacaaaaggaaac

SEQ ID NO: 1306139 - DNA, 22 bp, Artificial Sequence
  chemically synthesized
catagtggccaagtttcctttt

SEQ ID NO: 1306140 - DNA, 22 bp, Artificial Sequence
  chemically synthesized
ttccatagtggccaagtttcct

SEQ ID NO: 1306141 - DNA, 22 bp, Artificial Sequence
  chemically synthesized
cagagaacaaaaggaaacttgg

SEQ ID NO: 1306142 - DNA, 22 bp, Artificial Sequence
  chemically synthesized
gtactattccatagtggccaag

SEQ ID NO: 1306143 - DNA, 22 bp, Artificial Sequence
  chemically synthesized
ggtactattccatagtggccaa

SEQ ID NO: 1306144 - DNA, 22 bp, Artificial Sequence
  chemically synthesized
tggtactattccatagtggcca

SEQ ID NO: 1306145 - DNA, 22 bp, Artificial Sequence
  chemically synthesized
actttggtactattccatagtg

SEQ ID NO: 1306146 - DNA, 22 bp, Artificial Sequence
  chemically synthesized
aaaattcactttggtactattc

SEQ ID NO: 1306147 - DNA, 22 bp, Artificial Sequence
  chemically synthesized
ggccactatggaatagtaccaa

SEQ ID NO: 1306148 - DNA, 22 bp, Artificial Sequence
  chemically synthesized
taaaaattcactttggtactat

SEQ ID NO: 1306149 - DNA, 22 bp, Artificial Sequence
  chemically synthesized
gccactatggaatagtaccaaa

SEQ ID NO: 1306150 - DNA, 22 bp, Artificial Sequence
  chemically synthesized
ctaaaaattcactttggtacta

SEQ ID NO: 1306151 - DNA, 22 bp, Artificial Sequence
  chemically synthesized
tggaatagtaccaaagtgaatt

SEQ ID NO: 1306152 - DNA, 22 bp, Artificial Sequence
  chemically synthesized
tgagtgggtaataatagcttct

SEQ ID NO: 1306153 - DNA, 22 bp, Artificial Sequence
  chemically synthesized
ttagaagctattattacccact

SEQ ID NO: 1306154 - DNA, 22 bp, Artificial Sequence
  chemically synthesized
tagaagctattattacccactc

SEQ ID NO: 1306155 - DNA, 22 bp, Artificial Sequence
  chemically synthesized
agaagctattattacccactca

SEQ ID NO: 1306156 - DNA, 22 bp, Artificial Sequence
  chemically synthesized
gaagctattattacccactcat

SEQ ID NO: 1306157 - DNA, 22 bp, Artificial Sequence
  chemically synthesized
aaaaatatagattatgagtggg

SEQ ID NO: 1306158 - DNA, 22 bp, Artificial Sequence
  chemically synthesized
caaaaatatagattatgagtgg

SEQ ID NO: 1306159 - DNA, 22 bp, Artificial Sequence
  chemically synthesized
tcaaaaatatagattatgagtg

SEQ ID NO: 1306160 - DNA, 22 bp, Artificial Sequence
  chemically synthesized
ttattacccactcataatctat

SEQ ID NO: 1306161 - DNA, 22 bp, Artificial Sequence
  chemically synthesized
attttcaaaaatatagattatg

SEQ ID NO: 1306162 - DNA, 22 bp, Artificial Sequence
  chemically synthesized
ttacccactcataatctatatt

SEQ ID NO: 1306163 - DNA, 22 bp, Artificial Sequence
  chemically synthesized
cccactcataatctatattttt

SEQ ID NO: 1306164 - DNA, 22 bp, Artificial Sequence
  chemically synthesized
ataatctatatttttgaaaatt

SEQ ID NO: 1306165 - DNA, 22 bp, Artificial Sequence
  chemically synthesized
caaatatacatatatattaatt

SEQ ID NO: 1306166 - DNA, 22 bp, Artificial Sequence
  chemically synthesized
tatttttgaaaattaatatata

SEQ ID NO: 1306167 - DNA, 22 bp, Artificial Sequence
  chemically synthesized
ttgaaaattaatatatatgtat

SEQ ID NO: 1306168 - DNA, 22 bp, Artificial Sequence
  chemically synthesized
ataattacaaatatacatatat

SEQ ID NO: 1306169 - DNA, 22 bp, Artificial Sequence
  chemically synthesized
tgaaaattaatatatatgtata

SEQ ID NO: 1306170 - DNA, 22 bp, Artificial Sequence
  chemically synthesized
gaaaattaatatatatgtatat

SEQ ID NO: 1306171 - DNA, 22 bp, Artificial Sequence
  chemically synthesized
aaaattaatatatatgtatatt

SEQ ID NO: 1306172 - DNA, 22 bp, Artificial Sequence
  chemically synthesized
atattgataattacaaatatac

SEQ ID NO: 1306173 - DNA, 22 bp, Artificial Sequence
  chemically synthesized
atatatatgtatatttgtaatt

SEQ ID NO: 1306174 - DNA, 22 bp, Artificial Sequence
  chemically synthesized
gtattaatattgataattacaa

SEQ ID NO: 1306175 - DNA, 22 bp, Artificial Sequence
  chemically synthesized
cgtattaatattgataattaca

SEQ ID NO: 1306176 - DNA, 22 bp, Artificial Sequence
  chemically synthesized
cttcgtattaatattgataatt

SEQ ID NO: 1306177 - DNA, 22 bp, Artificial Sequence
  chemically synthesized
ttgcttcgtattaatattgata

SEQ ID NO: 1306178 - DNA, 22 bp, Artificial Sequence
  chemically synthesized
accctattgcttcgtattaata

SEQ ID NO: 1306179 - DNA, 22 bp, Artificial Sequence
  chemically synthesized
gtaattatcaatattaatacga

SEQ ID NO: 1306180 - DNA, 22 bp, Artificial Sequence
  chemically synthesized
taattatcaatattaatacgaa

SEQ ID NO: 1306181 - DNA, 22 bp, Artificial Sequence
  chemically synthesized
atgttgaccctattgcttcgta

SEQ ID NO: 1306182 - DNA, 22 bp, Artificial Sequence
  chemically synthesized
tcaatattaatacgaagcaata

SEQ ID NO: 1306183 - DNA, 22 bp, Artificial Sequence
  chemically synthesized
atacgaagcaatagggtcaaca

SEQ ID NO: 1306184 - DNA, 22 bp, Artificial Sequence
  chemically synthesized
acagaagtatccaagttcatgt

SEQ ID NO: 1306185 - DNA, 22 bp, Artificial Sequence
  chemically synthesized
aacagaagtatccaagttcatg

SEQ ID NO: 1306186 - DNA, 22 bp, Artificial Sequence
  chemically synthesized
agtgaacttaacagaagtatcc

SEQ ID NO: 1306187 - DNA, 22 bp, Artificial Sequence
  chemically synthesized
aagtgaacttaacagaagtatc

SEQ ID NO: 1306188 - DNA, 22 bp, Artificial Sequence
  chemically synthesized
aatatttaagtgaacttaacag

SEQ ID NO: 1306189 - DNA, 22 bp, Artificial Sequence
  chemically synthesized
ggatacttctgttaagttcact

SEQ ID NO: 1306190 - DNA, 22 bp, Artificial Sequence
  chemically synthesized
gttcaatatttaagtgaactta

SEQ ID NO: 1306191 - DNA, 22 bp, Artificial Sequence
  chemically synthesized
gatacttctgttaagttcactt

SEQ ID NO: 1306192 - DNA, 22 bp, Artificial Sequence
  chemically synthesized
gattagttcaatatttaagtga

SEQ ID NO: 1306193 - DNA, 22 bp, Artificial Sequence
  chemically synthesized
ctgttaagttcacttaaatatt

SEQ ID NO: 1306194 - DNA, 22 bp, Artificial Sequence
  chemically synthesized
tgttaagttcacttaaatattg

SEQ ID NO: 1306195 - DNA, 22 bp, Artificial Sequence
  chemically synthesized
ttaagttcacttaaatattgaa

SEQ ID NO: 1306196 - DNA, 22 bp, Artificial Sequence
  chemically synthesized
agttcacttaaatattgaacta

SEQ ID NO: 1306197 - DNA, 22 bp, Artificial Sequence
  chemically synthesized
acttaaatattgaactaatcta

SEQ ID NO: 1306198 - DNA, 22 bp, Artificial Sequence
  chemically synthesized
aaatattgaactaatctaatca

SEQ ID NO: 1306199 - DNA, 22 bp, Artificial Sequence
  chemically synthesized
aatattgaactaatctaatcac

SEQ ID NO: 1306200 - DNA, 22 bp, Artificial Sequence
  chemically synthesized
aagaaaaaatgagaagtgatta

SEQ ID NO: 1306201 - DNA, 22 bp, Artificial Sequence
  chemically synthesized
aactaatctaatcacttctcat

SEQ ID NO: 1306202 - DNA, 22 bp, Artificial Sequence
  chemically synthesized
gttaaagaaaaaatgagaagtg

SEQ ID NO: 1306203 - DNA, 22 bp, Artificial Sequence
  chemically synthesized
ggttaaagaaaaaatgagaagt

SEQ ID NO: 1306204 - DNA, 22 bp, Artificial Sequence
  chemically synthesized
atctaatcacttctcatttttt

SEQ ID NO: 1306205 - DNA, 22 bp, Artificial Sequence
  chemically synthesized
catatttggttaaagaaaaaat

SEQ ID NO: 1306206 - DNA, 22 bp, Artificial Sequence
  chemically synthesized
acatatttggttaaagaaaaaa

SEQ ID NO: 1306207 - DNA, 22 bp, Artificial Sequence
  chemically synthesized
atcacttctcattttttcttta

SEQ ID NO: 1306208 - DNA, 22 bp, Artificial Sequence
  chemically synthesized
aatttacatatttggttaaaga

SEQ ID NO: 1306209 - DNA, 22 bp, Artificial Sequence
  chemically synthesized
ctcattttttctttaaccaaat

SEQ ID NO: 1306210 - DNA, 22 bp, Artificial Sequence
  chemically synthesized
tcattttttctttaaccaaata

SEQ ID NO: 1306211 - DNA, 22 bp, Artificial Sequence
  chemically synthesized
tattgaatttacatatttggtt

SEQ ID NO: 1306212 - DNA, 22 bp, Artificial Sequence
  chemically synthesized
attttttctttaaccaaatatg

SEQ ID NO: 1306213 - DNA, 22 bp, Artificial Sequence
  chemically synthesized
tttctttaaccaaatatgtaaa

SEQ ID NO: 1306214 - DNA, 22 bp, Artificial Sequence
  chemically synthesized
ttctttaaccaaatatgtaaat

SEQ ID NO: 1306215 - DNA, 22 bp, Artificial Sequence
  chemically synthesized
tctttaaccaaatatgtaaatt

SEQ ID NO: 1306216 - DNA, 22 bp, Artificial Sequence
  chemically synthesized
ctttaaccaaatatgtaaattc

SEQ ID NO: 1306217 - DNA, 22 bp, Artificial Sequence
  chemically synthesized
tttaaccaaatatgtaaattca

SEQ ID NO: 1306218 - DNA, 22 bp, Artificial Sequence
  chemically synthesized
agtcaattatattgaatttaca

SEQ ID NO: 1306219 - DNA, 22 bp, Artificial Sequence
  chemically synthesized
taaccaaatatgtaaattcaat

SEQ ID NO: 1306220 - DNA, 22 bp, Artificial Sequence
  chemically synthesized
aaccaaatatgtaaattcaata

SEQ ID NO: 1306221 - DNA, 22 bp, Artificial Sequence
  chemically synthesized
accaaatatgtaaattcaatat

SEQ ID NO: 1306222 - DNA, 22 bp, Artificial Sequence
  chemically synthesized
agaactaagtcaattatattga

SEQ ID NO: 1306223 - DNA, 22 bp, Artificial Sequence
  chemically synthesized
gagaactaagtcaattatattg

SEQ ID NO: 1306224 - DNA, 22 bp, Artificial Sequence
  chemically synthesized
aaccaatttgagaactaagtca

SEQ ID NO: 1306225 - DNA, 22 bp, Artificial Sequence
  chemically synthesized
ttgaaccaatttgagaactaag

SEQ ID NO: 1306226 - DNA, 22 bp, Artificial Sequence
  chemically synthesized
aatataattgacttagttctca

SEQ ID NO: 1306227 - DNA, 22 bp, Artificial Sequence
  chemically synthesized
attgaaccaatttgagaactaa

SEQ ID NO: 1306228 - DNA, 22 bp, Artificial Sequence
  chemically synthesized
tattgaaccaatttgagaacta

SEQ ID NO: 1306229 - DNA, 22 bp, Artificial Sequence
  chemically synthesized
acttagttctcaaattggttca

SEQ ID NO: 1306230 - DNA, 22 bp, Artificial Sequence
  chemically synthesized
tgggaacactttattgaaccaa

SEQ ID NO: 1306231 - DNA, 22 bp, Artificial Sequence
  chemically synthesized
agttctcaaattggttcaataa

SEQ ID NO: 1306232 - DNA, 22 bp, Artificial Sequence
  chemically synthesized
gttctcaaattggttcaataaa

SEQ ID NO: 1306233 - DNA, 22 bp, Artificial Sequence
  chemically synthesized
tcaaattggttcaataaagtgt

SEQ ID NO: 1306234 - DNA, 22 bp, Artificial Sequence
  chemically synthesized
aaattggttcaataaagtgttc

SEQ ID NO: 1306235 - DNA, 22 bp, Artificial Sequence
  chemically synthesized
caaatactgtgggaacacttta

SEQ ID NO: 1306236 - DNA, 22 bp, Artificial Sequence
  chemically synthesized
gcaaatactgtgggaacacttt

SEQ ID NO: 1306237 - DNA, 22 bp, Artificial Sequence
  chemically synthesized
gttcaataaagtgttcccacag

SEQ ID NO: 1306238 - DNA, 22 bp, Artificial Sequence
  chemically synthesized
aataaagtgttcccacagtatt

SEQ ID NO: 1306239 - DNA, 22 bp, Artificial Sequence
  chemically synthesized
aagacgaatatatttgcaaata

SEQ ID NO: 1306240 - DNA, 22 bp, Artificial Sequence
  chemically synthesized
taaagacgaatatatttgcaaa

SEQ ID NO: 1306241 - DNA, 22 bp, Artificial Sequence
  chemically synthesized
ccacagtatttgcaaatatatt

SEQ ID NO: 1306242 - DNA, 22 bp, Artificial Sequence
  chemically synthesized
aggaggaatattctaaagacga

SEQ ID NO: 1306243 - DNA, 22 bp, Artificial Sequence
  chemically synthesized
gcaaatatattcgtctttagaa

SEQ ID NO: 1306244 - DNA, 22 bp, Artificial Sequence
  chemically synthesized
caaatatattcgtctttagaat

SEQ ID NO: 1306245 - DNA, 22 bp, Artificial Sequence
  chemically synthesized
aaaaggttaaggaggaatattc

SEQ ID NO: 1306246 - DNA, 22 bp, Artificial Sequence
  chemically synthesized
aaaaaggttaaggaggaatatt

SEQ ID NO: 1306247 - DNA, 22 bp, Artificial Sequence
  chemically synthesized
cttaaaaaggttaaggaggaat

SEQ ID NO: 1306248 - DNA, 22 bp, Artificial Sequence
  chemically synthesized
gtctttagaatattcctcctta

SEQ ID NO: 1306249 - DNA, 22 bp, Artificial Sequence
  chemically synthesized
tacttaaaaaggttaaggagga

SEQ ID NO: 1306250 - DNA, 22 bp, Artificial Sequence
  chemically synthesized
ctacttaaaaaggttaaggagg

SEQ ID NO: 1306251 - DNA, 22 bp, Artificial Sequence
  chemically synthesized
tagaatattcctccttaacctt

SEQ ID NO: 1306252 - DNA, 22 bp, Artificial Sequence
  chemically synthesized
agaatattcctccttaaccttt

SEQ ID NO: 1306253 - DNA, 22 bp, Artificial Sequence
  chemically synthesized
atttctacttaaaaaggttaag

SEQ ID NO: 1306254 - DNA, 22 bp, Artificial Sequence
  chemically synthesized
gaatattcctccttaacctttt

SEQ ID NO: 1306255 - DNA, 22 bp, Artificial Sequence
  chemically synthesized
aatttctacttaaaaaggttaa

SEQ ID NO: 1306256 - DNA, 22 bp, Artificial Sequence
  chemically synthesized
taatttctacttaaaaaggtta

SEQ ID NO: 1306257 - DNA, 22 bp, Artificial Sequence
  chemically synthesized
ttttaatttctacttaaaaagg

SEQ ID NO: 1306258 - DNA, 22 bp, Artificial Sequence
  chemically synthesized
tattttaatttctacttaaaaa

SEQ ID NO: 1306259 - DNA, 22 bp, Artificial Sequence
  chemically synthesized
ctattttaatttctacttaaaa

SEQ ID NO: 1306260 - DNA, 22 bp, Artificial Sequence
  chemically synthesized
ctccttaacctttttaagtaga

SEQ ID NO: 1306261 - DNA, 22 bp, Artificial Sequence
  chemically synthesized
cttaacctttttaagtagaaat

SEQ ID NO: 1306262 - DNA, 22 bp, Artificial Sequence
  chemically synthesized
atatttctattttaatttctac

SEQ ID NO: 1306263 - DNA, 22 bp, Artificial Sequence
  chemically synthesized
aacctttttaagtagaaattaa

SEQ ID NO: 1306264 - DNA, 22 bp, Artificial Sequence
  chemically synthesized
aatatttctattttaatttcta

SEQ ID NO: 1306265 - DNA, 22 bp, Artificial Sequence
  chemically synthesized
acctttttaagtagaaattaaa

SEQ ID NO: 1306266 - DNA, 22 bp, Artificial Sequence
  chemically synthesized
taatatttctattttaatttct

SEQ ID NO: 1306267 - DNA, 22 bp, Artificial Sequence
  chemically synthesized
tttaagtagaaattaaaataga

SEQ ID NO: 1306268 - DNA, 22 bp, Artificial Sequence
  chemically synthesized
ttaagtagaaattaaaatagaa

SEQ ID NO: 1306269 - DNA, 22 bp, Artificial Sequence
  chemically synthesized
taagtagaaattaaaatagaaa

SEQ ID NO: 1306270 - DNA, 22 bp, Artificial Sequence
  chemically synthesized
aagtagaaattaaaatagaaat

SEQ ID NO: 1306271 - DNA, 22 bp, Artificial Sequence
  chemically synthesized
agtagaaattaaaatagaaata

SEQ ID NO: 1306272 - DNA, 22 bp, Artificial Sequence
  chemically synthesized
aatacacgttttaatatttcta

SEQ ID NO: 1306273 - DNA, 22 bp, Artificial Sequence
  chemically synthesized
aaatacacgttttaatatttct

SEQ ID NO: 1306274 - DNA, 22 bp, Artificial Sequence
  chemically synthesized
taaatacacgttttaatatttc

SEQ ID NO: 1306275 - DNA, 22 bp, Artificial Sequence
  chemically synthesized
ttaaatacacgttttaatattt

SEQ ID NO: 1306276 - DNA, 22 bp, Artificial Sequence
  chemically synthesized
aaatagaaatattaaaacgtgt

SEQ ID NO: 1306277 - DNA, 22 bp, Artificial Sequence
  chemically synthesized
agagaaaagaccacttttaaat

SEQ ID NO: 1306278 - DNA, 22 bp, Artificial Sequence
  chemically synthesized
ttaagagaaaagaccactttta

SEQ ID NO: 1306279 - DNA, 22 bp, Artificial Sequence
  chemically synthesized
aaacgtgtatttaaaagtggtc

SEQ ID NO: 1306280 - DNA, 22 bp, Artificial Sequence
  chemically synthesized
aaaagtggtcttttctcttaac

SEQ ID NO: 1306281 - DNA, 22 bp, Artificial Sequence
  chemically synthesized
aaagtggtcttttctcttaaca

SEQ ID NO: 1306282 - DNA, 22 bp, Artificial Sequence
  chemically synthesized
atgtaagaaaaagtaaatgtct

SEQ ID NO: 1306283 - DNA, 22 bp, Artificial Sequence
  chemically synthesized
ttctcttaacagacatttactt

SEQ ID NO: 1306284 - DNA, 22 bp, Artificial Sequence
  chemically synthesized
tctcttaacagacatttacttt

SEQ ID NO: 1306285 - DNA, 22 bp, Artificial Sequence
  chemically synthesized
ctcttaacagacatttactttt

SEQ ID NO: 1306286 - DNA, 22 bp, Artificial Sequence
  chemically synthesized
tcttaacagacatttacttttt

SEQ ID NO: 1306287 - DNA, 22 bp, Artificial Sequence
  chemically synthesized
ttaacagacatttactttttct

SEQ ID NO: 1306288 - DNA, 22 bp, Artificial Sequence
  chemically synthesized
aacagacatttactttttctta

SEQ ID NO: 1306289 - DNA, 22 bp, Artificial Sequence
  chemically synthesized
aaccaattcatgtaagaaaaag

SEQ ID NO: 1306290 - DNA, 22 bp, Artificial Sequence
  chemically synthesized
acagacatttactttttcttac

SEQ ID NO: 1306291 - DNA, 22 bp, Artificial Sequence
  chemically synthesized
actttttcttacatgaattggt

SEQ ID NO: 1306292 - DNA, 22 bp, Artificial Sequence
  chemically synthesized
ctttttcttacatgaattggtt

SEQ ID NO: 1306293 - DNA, 22 bp, Artificial Sequence
  chemically synthesized
gaaaaaaaaactaaaccaattc

SEQ ID NO: 1306294 - DNA, 22 bp, Artificial Sequence
  chemically synthesized
tttcttacatgaattggtttag

SEQ ID NO: 1306295 - DNA, 22 bp, Artificial Sequence
  chemically synthesized
ttcttacatgaattggtttagt

SEQ ID NO: 1306296 - DNA, 22 bp, Artificial Sequence
  chemically synthesized
tcttacatgaattggtttagtt

SEQ ID NO: 1306297 - DNA, 22 bp, Artificial Sequence
  chemically synthesized
cttacatgaattggtttagttt

SEQ ID NO: 1306298 - DNA, 22 bp, Artificial Sequence
  chemically synthesized
ttacatgaattggtttagtttt

SEQ ID NO: 1306299 - DNA, 22 bp, Artificial Sequence
  chemically synthesized
agtgctggaaaaaaaaactaaa

SEQ ID NO: 1306300 - DNA, 22 bp, Artificial Sequence
  chemically synthesized
acatgaattggtttagtttttt

SEQ ID NO: 1306301 - DNA, 22 bp, Artificial Sequence
  chemically synthesized
cagtgctggaaaaaaaaactaa

SEQ ID NO: 1306302 - DNA, 22 bp, Artificial Sequence
  chemically synthesized
catgaattggtttagttttttt

SEQ ID NO: 1306303 - DNA, 22 bp, Artificial Sequence
  chemically synthesized
gaatggtttcagtgctggaaaa

SEQ ID NO: 1306304 - DNA, 22 bp, Artificial Sequence
  chemically synthesized
gtttagtttttttttccagcac

SEQ ID NO: 1306305 - DNA, 22 bp, Artificial Sequence
  chemically synthesized
ggaatggtttcagtgctggaaa

SEQ ID NO: 1306306 - DNA, 22 bp, Artificial Sequence
  chemically synthesized
tggaatggtttcagtgctggaa

SEQ ID NO: 1306307 - DNA, 22 bp, Artificial Sequence
  chemically synthesized
ttggaatggtttcagtgctgga

SEQ ID NO: 1306308 - DNA, 22 bp, Artificial Sequence
  chemically synthesized
tttggaatggtttcagtgctgg

SEQ ID NO: 1306309 - DNA, 22 bp, Artificial Sequence
  chemically synthesized
agtttttttttccagcactgaa

SEQ ID NO: 1306310 - DNA, 22 bp, Artificial Sequence
  chemically synthesized
ttttggaatggtttcagtgctg

SEQ ID NO: 1306311 - DNA, 22 bp, Artificial Sequence
  chemically synthesized
gtttttttttccagcactgaaa

SEQ ID NO: 1306312 - DNA, 22 bp, Artificial Sequence
  chemically synthesized
tttttggaatggtttcagtgct

SEQ ID NO: 1306313 - DNA, 22 bp, Artificial Sequence
  chemically synthesized
ttttttccagcactgaaaccat

SEQ ID NO: 1306314 - DNA, 22 bp, Artificial Sequence
  chemically synthesized
tttttccagcactgaaaccatt

SEQ ID NO: 1306315 - DNA, 22 bp, Artificial Sequence
  chemically synthesized
ttttccagcactgaaaccattc

SEQ ID NO: 1306316 - DNA, 22 bp, Artificial Sequence
  chemically synthesized
cagttttttttggaatggtttc

SEQ ID NO: 1306317 - DNA, 22 bp, Artificial Sequence
  chemically synthesized
tttccagcactgaaaccattcc

SEQ ID NO: 1306318 - DNA, 22 bp, Artificial Sequence
  chemically synthesized
ttccagcactgaaaccattcca

SEQ ID NO: 1306319 - DNA, 22 bp, Artificial Sequence
  chemically synthesized
tacagttttttttggaatggtt

SEQ ID NO: 1306320 - DNA, 22 bp, Artificial Sequence
  chemically synthesized
tccagcactgaaaccattccaa

SEQ ID NO: 1306321 - DNA, 22 bp, Artificial Sequence
  chemically synthesized
ctacagttttttttggaatggt

SEQ ID NO: 1306322 - DNA, 22 bp, Artificial Sequence
  chemically synthesized
ccagcactgaaaccattccaaa

SEQ ID NO: 1306323 - DNA, 22 bp, Artificial Sequence
  chemically synthesized
tctacagttttttttggaatgg

SEQ ID NO: 1306324 - DNA, 22 bp, Artificial Sequence
  chemically synthesized
cagcactgaaaccattccaaaa

SEQ ID NO: 1306325 - DNA, 22 bp, Artificial Sequence
  chemically synthesized
ttctacagttttttttggaatg

SEQ ID NO: 1306326 - DNA, 22 bp, Artificial Sequence
  chemically synthesized
ttttctacagttttttttggaa

SEQ ID NO: 1306327 - DNA, 22 bp, Artificial Sequence
  chemically synthesized
actcttttctacagtttttttt

SEQ ID NO: 1306328 - DNA, 22 bp, Artificial Sequence
  chemically synthesized
aaaccattccaaaaaaaactgt

SEQ ID NO: 1306329 - DNA, 22 bp, Artificial Sequence
  chemically synthesized
caaaaaaaactgtagaaaagag

SEQ ID NO: 1306330 - DNA, 22 bp, Artificial Sequence
  chemically synthesized
tagaaaagagtgaatatttatt

SEQ ID NO: 1306331 - DNA, 22 bp, Artificial Sequence
  chemically synthesized
tgcaaacataacaaacatccaa

SEQ ID NO: 1306332 - DNA, 22 bp, Artificial Sequence
  chemically synthesized
ttatgcaaacataacaaacatc

SEQ ID NO: 1306333 - DNA, 22 bp, Artificial Sequence
  chemically synthesized
attctattggatgtttgttatg

SEQ ID NO: 1306334 - DNA, 22 bp, Artificial Sequence
  chemically synthesized
ttctattggatgtttgttatgt

SEQ ID NO: 1306335 - DNA, 22 bp, Artificial Sequence
  chemically synthesized
gttattatgcaaacataacaaa

SEQ ID NO: 1306336 - DNA, 22 bp, Artificial Sequence
  chemically synthesized
tattggatgtttgttatgtttg

SEQ ID NO: 1306337 - DNA, 22 bp, Artificial Sequence
  chemically synthesized
attagttattatgcaaacataa

SEQ ID NO: 1306338 - DNA, 22 bp, Artificial Sequence
  chemically synthesized
ttggatgtttgttatgtttgca

SEQ ID NO: 1306339 - DNA, 22 bp, Artificial Sequence
  chemically synthesized
gatgtttgttatgtttgcataa

SEQ ID NO: 1306340 - DNA, 22 bp, Artificial Sequence
  chemically synthesized
actaattagttattatgcaaac

SEQ ID NO: 1306341 - DNA, 22 bp, Artificial Sequence
  chemically synthesized
aattcactaattagttattatg

SEQ ID NO: 1306342 - DNA, 22 bp, Artificial Sequence
  chemically synthesized
gttatgtttgcataataactaa

SEQ ID NO: 1306343 - DNA, 22 bp, Artificial Sequence
  chemically synthesized
ttatgtttgcataataactaat

SEQ ID NO: 1306344 - DNA, 22 bp, Artificial Sequence
  chemically synthesized
gcctcaattcactaattagtta

SEQ ID NO: 1306345 - DNA, 22 bp, Artificial Sequence
  chemically synthesized
tgtttgcataataactaattag

SEQ ID NO: 1306346 - DNA, 22 bp, Artificial Sequence
  chemically synthesized
gcataataactaattagtgaat

SEQ ID NO: 1306347 - DNA, 22 bp, Artificial Sequence
  chemically synthesized
cataataactaattagtgaatt

SEQ ID NO: 1306348 - DNA, 22 bp, Artificial Sequence
  chemically synthesized
atcaaagttggcctcaattcac

SEQ ID NO: 1306349 - DNA, 22 bp, Artificial Sequence
  chemically synthesized
gatcaaagttggcctcaattca

SEQ ID NO: 1306350 - DNA, 22 bp, Artificial Sequence
  chemically synthesized
tgatcaaagttggcctcaattc

SEQ ID NO: 1306351 - DNA, 22 bp, Artificial Sequence
  chemically synthesized
attagtgaattgaggccaactt

SEQ ID NO: 1306352 - DNA, 22 bp, Artificial Sequence
  chemically synthesized
gtgaattgaggccaactttgat

SEQ ID NO: 1306353 - DNA, 22 bp, Artificial Sequence
  chemically synthesized
agagcaaacattttgatcaaag

SEQ ID NO: 1306354 - DNA, 22 bp, Artificial Sequence
  chemically synthesized
ttcagagcaaacattttgatca

SEQ ID NO: 1306355 - DNA, 22 bp, Artificial Sequence
  chemically synthesized
aggccaactttgatcaaaatgt

SEQ ID NO: 1306356 - DNA, 22 bp, Artificial Sequence
  chemically synthesized
gcaaatatctattcagagcaaa

SEQ ID NO: 1306357 - DNA, 22 bp, Artificial Sequence
  chemically synthesized
tgatcaaaatgtttgctctgaa

SEQ ID NO: 1306358 - DNA, 22 bp, Artificial Sequence
  chemically synthesized
gatcaaaatgtttgctctgaat

SEQ ID NO: 1306359 - DNA, 22 bp, Artificial Sequence
  chemically synthesized
atcaaaatgtttgctctgaata

SEQ ID NO: 1306360 - DNA, 22 bp, Artificial Sequence
  chemically synthesized
ttagcaaatatctattcagagc

SEQ ID NO: 1306361 - DNA, 22 bp, Artificial Sequence
  chemically synthesized
attagcaaatatctattcagag

SEQ ID NO: 1306362 - DNA, 22 bp, Artificial Sequence
  chemically synthesized
tttattagcaaatatctattca

SEQ ID NO: 1306363 - DNA, 22 bp, Artificial Sequence
  chemically synthesized
gctctgaatagatatttgctaa

SEQ ID NO: 1306364 - DNA, 22 bp, Artificial Sequence
  chemically synthesized
ctctgaatagatatttgctaat

SEQ ID NO: 1306365 - DNA, 22 bp, Artificial Sequence
  chemically synthesized
tgaatagatatttgctaataaa

SEQ ID NO: 1306366 - DNA, 22 bp, Artificial Sequence
  chemically synthesized
aatagatatttgctaataaata

SEQ ID NO: 1306367 - DNA, 22 bp, Artificial Sequence
  chemically synthesized
tcacatgaaaaaattatttatt

SEQ ID NO: 1306368 - DNA, 22 bp, Artificial Sequence
  chemically synthesized
atcacatgaaaaaattatttat

SEQ ID NO: 1306369 - DNA, 22 bp, Artificial Sequence
  chemically synthesized
cacacttatcacatgaaaaaat

SEQ ID NO: 1306370 - DNA, 22 bp, Artificial Sequence
  chemically synthesized
gctaataaataattttttcatg

SEQ ID NO: 1306371 - DNA, 22 bp, Artificial Sequence
  chemically synthesized
ctaataaataattttttcatgt

SEQ ID NO: 1306372 - DNA, 22 bp, Artificial Sequence
  chemically synthesized
ttacacacttatcacatgaaaa

SEQ ID NO: 1306373 - DNA, 22 bp, Artificial Sequence
  chemically synthesized
ataaataattttttcatgtgat

SEQ ID NO: 1306374 - DNA, 22 bp, Artificial Sequence
  chemically synthesized
ttattacacacttatcacatga

SEQ ID NO: 1306375 - DNA, 22 bp, Artificial Sequence
  chemically synthesized
attattacacacttatcacatg

SEQ ID NO: 1306376 - DNA, 22 bp, Artificial Sequence
  chemically synthesized
tttcatgtgataagtgtgtaat

SEQ ID NO: 1306377 - DNA, 22 bp, Artificial Sequence
  chemically synthesized
ttcatgtgataagtgtgtaata

SEQ ID NO: 1306378 - DNA, 22 bp, Artificial Sequence
  chemically synthesized
tcatgtgataagtgtgtaataa

SEQ ID NO: 1306379 - DNA, 22 bp, Artificial Sequence
  chemically synthesized
catgtgataagtgtgtaataat

SEQ ID NO: 1306380 - DNA, 22 bp, Artificial Sequence
  chemically synthesized
atgtgataagtgtgtaataata

SEQ ID NO: 1306381 - DNA, 22 bp, Artificial Sequence
  chemically synthesized
tcaaagcaaggcagcatagaga

SEQ ID NO: 1306382 - DNA, 22 bp, Artificial Sequence
  chemically synthesized
tatcaaagcaaggcagcataga

SEQ ID NO: 1306383 - DNA, 22 bp, Artificial Sequence
  chemically synthesized
aatattctatcaaagcaaggca

SEQ ID NO: 1306384 - DNA, 22 bp, Artificial Sequence
  chemically synthesized
tctgaatattctatcaaagcaa

SEQ ID NO: 1306385 - DNA, 22 bp, Artificial Sequence
  chemically synthesized
tctatgctgccttgctttgata

SEQ ID NO: 1306386 - DNA, 22 bp, Artificial Sequence
  chemically synthesized
tatgctgccttgctttgataga

SEQ ID NO: 1306387 - DNA, 22 bp, Artificial Sequence
  chemically synthesized
tgctgccttgctttgatagaat

SEQ ID NO: 1306388 - DNA, 22 bp, Artificial Sequence
  chemically synthesized
taaatgttgtctgaatattcta

SEQ ID NO: 1306389 - DNA, 22 bp, Artificial Sequence
  chemically synthesized
ccttgctttgatagaatattca

SEQ ID NO: 1306390 - DNA, 22 bp, Artificial Sequence
  chemically synthesized
ataaatgttgtctgaatattct

SEQ ID NO: 1306391 - DNA, 22 bp, Artificial Sequence
  chemically synthesized
gctttgatagaatattcagaca

SEQ ID NO: 1306392 - DNA, 22 bp, Artificial Sequence
  chemically synthesized
ctttgatagaatattcagacaa

SEQ ID NO: 1306393 - DNA, 22 bp, Artificial Sequence
  chemically synthesized
gtcatttataaatgttgtctga

SEQ ID NO: 1306394 - DNA, 22 bp, Artificial Sequence
  chemically synthesized
tgatagaatattcagacaacat

SEQ ID NO: 1306395 - DNA, 22 bp, Artificial Sequence
  chemically synthesized
gatagaatattcagacaacatt

SEQ ID NO: 1306396 - DNA, 22 bp, Artificial Sequence
  chemically synthesized
atagaatattcagacaacattt

SEQ ID NO: 1306397 - DNA, 22 bp, Artificial Sequence
  chemically synthesized
aattagtcatttataaatgttg

SEQ ID NO: 1306398 - DNA, 22 bp, Artificial Sequence
  chemically synthesized
gaattagtcatttataaatgtt

SEQ ID NO: 1306399 - DNA, 22 bp, Artificial Sequence
  chemically synthesized
cttgaattagtcatttataaat

SEQ ID NO: 1306400 - DNA, 22 bp, Artificial Sequence
  chemically synthesized
attccttgaattagtcatttat

SEQ ID NO: 1306401 - DNA, 22 bp, Artificial Sequence
  chemically synthesized
agacaacatttataaatgacta

SEQ ID NO: 1306402 - DNA, 22 bp, Artificial Sequence
  chemically synthesized
aattccttgaattagtcattta

SEQ ID NO: 1306403 - DNA, 22 bp, Artificial Sequence
  chemically synthesized
taattccttgaattagtcattt

SEQ ID NO: 1306404 - DNA, 22 bp, Artificial Sequence
  chemically synthesized
ttaattccttgaattagtcatt

SEQ ID NO: 1306405 - DNA, 22 bp, Artificial Sequence
  chemically synthesized
agaccttttaattccttgaatt

SEQ ID NO: 1306406 - DNA, 22 bp, Artificial Sequence
  chemically synthesized
aagaccttttaattccttgaat

SEQ ID NO: 1306407 - DNA, 22 bp, Artificial Sequence
  chemically synthesized
ataaatgactaattcaaggaat

SEQ ID NO: 1306408 - DNA, 22 bp, Artificial Sequence
  chemically synthesized
taaatgactaattcaaggaatt

SEQ ID NO: 1306409 - DNA, 22 bp, Artificial Sequence
  chemically synthesized
gggcacttaagaccttttaatt

SEQ ID NO: 1306410 - DNA, 22 bp, Artificial Sequence
  chemically synthesized
tggggcacttaagaccttttaa

SEQ ID NO: 1306411 - DNA, 22 bp, Artificial Sequence
  chemically synthesized
attcaaggaattaaaaggtctt

SEQ ID NO: 1306412 - DNA, 22 bp, Artificial Sequence
  chemically synthesized
cattctggggcacttaagacct

SEQ ID NO: 1306413 - DNA, 22 bp, Artificial Sequence
  chemically synthesized
aaggaattaaaaggtcttaagt

SEQ ID NO: 1306414 - DNA, 22 bp, Artificial Sequence
  chemically synthesized
tacattctggggcacttaagac

SEQ ID NO: 1306415 - DNA, 22 bp, Artificial Sequence
  chemically synthesized
ctacattctggggcacttaaga

SEQ ID NO: 1306416 - DNA, 22 bp, Artificial Sequence
  chemically synthesized
catttctacattctggggcact

SEQ ID NO: 1306417 - DNA, 22 bp, Artificial Sequence
  chemically synthesized
aaaggtcttaagtgccccagaa

SEQ ID NO: 1306418 - DNA, 22 bp, Artificial Sequence
  chemically synthesized
ttccatttctacattctggggc

SEQ ID NO: 1306419 - DNA, 22 bp, Artificial Sequence
  chemically synthesized
attccatttctacattctgggg

SEQ ID NO: 1306420 - DNA, 22 bp, Artificial Sequence
  chemically synthesized
aagtgccccagaatgtagaaat

SEQ ID NO: 1306421 - DNA, 22 bp, Artificial Sequence
  chemically synthesized
agtgccccagaatgtagaaatg

SEQ ID NO: 1306422 - DNA, 22 bp, Artificial Sequence
  chemically synthesized
ccacatgtttattccatttcta

SEQ ID NO: 1306423 - DNA, 22 bp, Artificial Sequence
  chemically synthesized
accactaccacatgtttattcc

SEQ ID NO: 1306424 - DNA, 22 bp, Artificial Sequence
  chemically synthesized
gcccaccctcaccactaccaca

SEQ ID NO: 1306425 - DNA, 22 bp, Artificial Sequence
  chemically synthesized
tagcccaccctcaccactacca

SEQ ID NO: 1306426 - DNA, 22 bp, Artificial Sequence
  chemically synthesized
ctagcccaccctcaccactacc

SEQ ID NO: 1306427 - DNA, 22 bp, Artificial Sequence
  chemically synthesized
atcatttctagcccaccctcac

SEQ ID NO: 1306428 - DNA, 22 bp, Artificial Sequence
  chemically synthesized
aatcatttctagcccaccctca

SEQ ID NO: 1306429 - DNA, 22 bp, Artificial Sequence
  chemically synthesized
gtttaatcatttctagcccacc

SEQ ID NO: 1306430 - DNA, 22 bp, Artificial Sequence
  chemically synthesized
aaaaaaatctagtttaatcatt

SEQ ID NO: 1306431 - DNA, 22 bp, Artificial Sequence
  chemically synthesized
aaaaaaaatctagtttaatcat

SEQ ID NO: 1306432 - DNA, 22 bp, Artificial Sequence
  chemically synthesized
taaaaaaaatctagtttaatca

SEQ ID NO: 1306433 - DNA, 22 bp, Artificial Sequence
  chemically synthesized
ttaaaaaaaatctagtttaatc

SEQ ID NO: 1306434 - DNA, 22 bp, Artificial Sequence
  chemically synthesized
tttaaaaaaaatctagtttaat

SEQ ID NO: 1306435 - DNA, 22 bp, Artificial Sequence
  chemically synthesized
ttttaaaaaaaatctagtttaa

SEQ ID NO: 1306436 - DNA, 22 bp, Artificial Sequence
  chemically synthesized
tttttaaaaaaaatctagttta

SEQ ID NO: 1306437 - DNA, 22 bp, Artificial Sequence
  chemically synthesized
tttttttaaaaaaaatctagtt

SEQ ID NO: 1306438 - DNA, 22 bp, Artificial Sequence
  chemically synthesized
ctttttttaaaaaaaatctagt

SEQ ID NO: 1306439 - DNA, 22 bp, Artificial Sequence
  chemically synthesized
gaaatgattaaactagattttt

SEQ ID NO: 1306440 - DNA, 22 bp, Artificial Sequence
  chemically synthesized
cttctttttttaaaaaaaatct

SEQ ID NO: 1306441 - DNA, 22 bp, Artificial Sequence
  chemically synthesized
gcttctttttttaaaaaaaatc

SEQ ID NO: 1306442 - DNA, 22 bp, Artificial Sequence
  chemically synthesized
tgcttctttttttaaaaaaaat

SEQ ID NO: 1306443 - DNA, 22 bp, Artificial Sequence
  chemically synthesized
ttgcttctttttttaaaaaaaa

SEQ ID NO: 1306444 - DNA, 22 bp, Artificial Sequence
  chemically synthesized
aactagattttttttaaaaaaa

SEQ ID NO: 1306445 - DNA, 22 bp, Artificial Sequence
  chemically synthesized
gattttttttaaaaaaagaagc

SEQ ID NO: 1306446 - DNA, 22 bp, Artificial Sequence
  chemically synthesized
cagcggtatttttgcttctttt

SEQ ID NO: 1306447 - DNA, 22 bp, Artificial Sequence
  chemically synthesized
ccagcggtatttttgcttcttt

SEQ ID NO: 1306448 - DNA, 22 bp, Artificial Sequence
  chemically synthesized
tccagcggtatttttgcttctt

SEQ ID NO: 1306449 - DNA, 22 bp, Artificial Sequence
  chemically synthesized
ttccagcggtatttttgcttct

SEQ ID NO: 1306450 - DNA, 22 bp, Artificial Sequence
  chemically synthesized
tttttaaaaaaagaagcaaaaa

SEQ ID NO: 1306451 - DNA, 22 bp, Artificial Sequence
  chemically synthesized
tttccagcggtatttttgcttc

SEQ ID NO: 1306452 - DNA, 22 bp, Artificial Sequence
  chemically synthesized
ttttaaaaaaagaagcaaaaat

SEQ ID NO: 1306453 - DNA, 22 bp, Artificial Sequence
  chemically synthesized
tttaaaaaaagaagcaaaaata

SEQ ID NO: 1306454 - DNA, 22 bp, Artificial Sequence
  chemically synthesized
ttaaaaaaagaagcaaaaatac

SEQ ID NO: 1306455 - DNA, 22 bp, Artificial Sequence
  chemically synthesized
taaaaaaagaagcaaaaatacc

SEQ ID NO: 1306456 - DNA, 22 bp, Artificial Sequence
  chemically synthesized
aaaaaaagaagcaaaaataccg

SEQ ID NO: 1306457 - DNA, 22 bp, Artificial Sequence
  chemically synthesized
aaaaaagaagcaaaaataccgc

SEQ ID NO: 1306458 - DNA, 22 bp, Artificial Sequence
  chemically synthesized
cgtgcattttttccagcggtat

SEQ ID NO: 1306459 - DNA, 22 bp, Artificial Sequence
  chemically synthesized
tgcgtgcattttttccagcggt

SEQ ID NO: 1306460 - DNA, 22 bp, Artificial Sequence
  chemically synthesized
ttctgcgtgcattttttccagc

SEQ ID NO: 1306461 - DNA, 22 bp, Artificial Sequence
  chemically synthesized
attctgcgtgcattttttccag

SEQ ID NO: 1306462 - DNA, 22 bp, Artificial Sequence
  chemically synthesized
ataatgacatttattctgcgtg

SEQ ID NO: 1306463 - DNA, 22 bp, Artificial Sequence
  chemically synthesized
cataatgacatttattctgcgt

SEQ ID NO: 1306464 - DNA, 22 bp, Artificial Sequence
  chemically synthesized
gaaaaaatgcacgcagaataaa

SEQ ID NO: 1306465 - DNA, 22 bp, Artificial Sequence
  chemically synthesized
agaatatttcataatgacattt

SEQ ID NO: 1306466 - DNA, 22 bp, Artificial Sequence
  chemically synthesized
tgaaatattctgaacgtgtgta

SEQ ID NO: 1306467 - DNA, 22 bp, Artificial Sequence
  chemically synthesized
tgaacgtgtgtacttgattttc

SEQ ID NO: 1306468 - DNA, 22 bp, Artificial Sequence
  chemically synthesized
aacgtgtgtacttgattttcct

SEQ ID NO: 1306469 - DNA, 22 bp, Artificial Sequence
  chemically synthesized
aaaatgaagccgtgatgaagga

SEQ ID NO: 1306470 - DNA, 22 bp, Artificial Sequence
  chemically synthesized
gattttccttcatcacggcttc

SEQ ID NO: 1306471 - DNA, 22 bp, Artificial Sequence
  chemically synthesized
attttccttcatcacggcttca

SEQ ID NO: 1306472 - DNA, 22 bp, Artificial Sequence
  chemically synthesized
gacgtctcaaaatgaagccgtg

SEQ ID NO: 1306473 - DNA, 22 bp, Artificial Sequence
  chemically synthesized
tccttcatcacggcttcatttt

SEQ ID NO: 1306474 - DNA, 22 bp, Artificial Sequence
  chemically synthesized
ccttcatcacggcttcattttg

SEQ ID NO: 1306475 - DNA, 22 bp, Artificial Sequence
  chemically synthesized
acctggacgtctcaaaatgaag

SEQ ID NO: 1306476 - DNA, 22 bp, Artificial Sequence
  chemically synthesized
cttcatcacggcttcattttga

SEQ ID NO: 1306477 - DNA, 22 bp, Artificial Sequence
  chemically synthesized
catcacggcttcattttgagac

SEQ ID NO: 1306478 - DNA, 22 bp, Artificial Sequence
  chemically synthesized
atcacggcttcattttgagacg

SEQ ID NO: 1306479 - DNA, 22 bp, Artificial Sequence
  chemically synthesized
acagtggttgacctggacgtct

SEQ ID NO: 1306480 - DNA, 22 bp, Artificial Sequence
  chemically synthesized
gttgacagtggttgacctggac

SEQ ID NO: 1306481 - DNA, 22 bp, Artificial Sequence
  chemically synthesized
cattttgagacgtccaggtcaa

SEQ ID NO: 1306482 - DNA, 22 bp, Artificial Sequence
  chemically synthesized
attttgagacgtccaggtcaac

SEQ ID NO: 1306483 - DNA, 22 bp, Artificial Sequence
  chemically synthesized
attggttgacagtggttgacct

SEQ ID NO: 1306484 - DNA, 22 bp, Artificial Sequence
  chemically synthesized
tgagacgtccaggtcaaccact

SEQ ID NO: 1306485 - DNA, 22 bp, Artificial Sequence
  chemically synthesized
gagacgtccaggtcaaccactg

SEQ ID NO: 1306486 - DNA, 22 bp, Artificial Sequence
  chemically synthesized
agacgtccaggtcaaccactgt

SEQ ID NO: 1306487 - DNA, 22 bp, Artificial Sequence
  chemically synthesized
gagattgattggttgacagtgg

SEQ ID NO: 1306488 - DNA, 22 bp, Artificial Sequence
  chemically synthesized
aaagaggctagagattgattgg

SEQ ID NO: 1306489 - DNA, 22 bp, Artificial Sequence
  chemically synthesized
ctcaaagaggctagagattgat

SEQ ID NO: 1306490 - DNA, 22 bp, Artificial Sequence
  chemically synthesized
tgctcaaagaggctagagattg

SEQ ID NO: 1306491 - DNA, 22 bp, Artificial Sequence
  chemically synthesized
tcaaccaatcaatctctagcct

SEQ ID NO: 1306492 - DNA, 22 bp, Artificial Sequence
  chemically synthesized
atctctgctcaaagaggctaga

SEQ ID NO: 1306493 - DNA, 22 bp, Artificial Sequence
  chemically synthesized
gatctctgctcaaagaggctag

SEQ ID NO: 1306494 - DNA, 22 bp, Artificial Sequence
  chemically synthesized
cccttgatctctgctcaaagag

SEQ ID NO: 1306495 - DNA, 22 bp, Artificial Sequence
  chemically synthesized
ttgcccttgatctctgctcaaa

SEQ ID NO: 1306496 - DNA, 22 bp, Artificial Sequence
  chemically synthesized
ctgttgcccttgatctctgctc

SEQ ID NO: 1306497 - DNA, 22 bp, Artificial Sequence
  chemically synthesized
tagcctctttgagcagagatca

SEQ ID NO: 1306498 - DNA, 22 bp, Artificial Sequence
  chemically synthesized
tgctgttgcccttgatctctgc

SEQ ID NO: 1306499 - DNA, 22 bp, Artificial Sequence
  chemically synthesized
gcctctttgagcagagatcaag

SEQ ID NO: 1306500 - DNA, 22 bp, Artificial Sequence
  chemically synthesized
aggctctgctgttgcccttgat

SEQ ID NO: 1306501 - DNA, 22 bp, Artificial Sequence
  chemically synthesized
tttgagcagagatcaagggcaa

SEQ ID NO: 1306502 - DNA, 22 bp, Artificial Sequence
  chemically synthesized
tgagcagagatcaagggcaaca

SEQ ID NO: 1306503 - DNA, 22 bp, Artificial Sequence
  chemically synthesized
gagcagagatcaagggcaacag

SEQ ID NO: 1306504 - DNA, 22 bp, Artificial Sequence
  chemically synthesized
agcagagatcaagggcaacagc

SEQ ID NO: 1306505 - DNA, 22 bp, Artificial Sequence
  chemically synthesized
aaatcattaaggctctgctgtt

SEQ ID NO: 1306506 - DNA, 22 bp, Artificial Sequence
  chemically synthesized
gaggttgaaatcattaaggctc

SEQ ID NO: 1306507 - DNA, 22 bp, Artificial Sequence
  chemically synthesized
aaggctagaggttgaaatcatt

SEQ ID NO: 1306508 - DNA, 22 bp, Artificial Sequence
  chemically synthesized
gaaggctagaggttgaaatcat

SEQ ID NO: 1306509 - DNA, 22 bp, Artificial Sequence
  chemically synthesized
tgcccttgaaggctagaggttg

SEQ ID NO: 1306510 - DNA, 22 bp, Artificial Sequence
  chemically synthesized
aatgatttcaacctctagcctt

SEQ ID NO: 1306511 - DNA, 22 bp, Artificial Sequence
  chemically synthesized
atgatttcaacctctagccttc

SEQ ID NO: 1306512 - DNA, 22 bp, Artificial Sequence
  chemically synthesized
taatctgtgcccttgaaggcta

SEQ ID NO: 1306513 - DNA, 22 bp, Artificial Sequence
  chemically synthesized
caacctctagccttcaagggca

SEQ ID NO: 1306514 - DNA, 22 bp, Artificial Sequence
  chemically synthesized
aacctctagccttcaagggcac

SEQ ID NO: 1306515 - DNA, 22 bp, Artificial Sequence
  chemically synthesized
agtccctgtaatctgtgccctt

SEQ ID NO: 1306516 - DNA, 22 bp, Artificial Sequence
  chemically synthesized
cagtccctgtaatctgtgccct

SEQ ID NO: 1306517 - DNA, 22 bp, Artificial Sequence
  chemically synthesized
tcagtccctgtaatctgtgccc

SEQ ID NO: 1306518 - DNA, 22 bp, Artificial Sequence
  chemically synthesized
tagccttcaagggcacagatta

SEQ ID NO: 1306519 - DNA, 22 bp, Artificial Sequence
  chemically synthesized
ctttcagtccctgtaatctgtg

SEQ ID NO: 1306520 - DNA, 22 bp, Artificial Sequence
  chemically synthesized
gccttcaagggcacagattaca

SEQ ID NO: 1306521 - DNA, 22 bp, Artificial Sequence
  chemically synthesized
actttcagtccctgtaatctgt

SEQ ID NO: 1306522 - DNA, 22 bp, Artificial Sequence
  chemically synthesized
atttactttcagtccctgtaat

SEQ ID NO: 1306523 - DNA, 22 bp, Artificial Sequence
  chemically synthesized
caagggcacagattacagggac

SEQ ID NO: 1306524 - DNA, 22 bp, Artificial Sequence
  chemically synthesized
aagggcacagattacagggact

SEQ ID NO: 1306525 - DNA, 22 bp, Artificial Sequence
  chemically synthesized
tgatggactgatttactttcag

SEQ ID NO: 1306526 - DNA, 22 bp, Artificial Sequence
  chemically synthesized
gtgatggactgatttactttca

SEQ ID NO: 1306527 - DNA, 22 bp, Artificial Sequence
  chemically synthesized
cagggactgaaagtaaatcagt

SEQ ID NO: 1306528 - DNA, 22 bp, Artificial Sequence
  chemically synthesized
aagtgccttgtgatggactgat

SEQ ID NO: 1306529 - DNA, 22 bp, Artificial Sequence
  chemically synthesized
aaagtaaatcagtccatcacaa

SEQ ID NO: 1306530 - DNA, 22 bp, Artificial Sequence
  chemically synthesized
tgggctgaagtgccttgtgatg

SEQ ID NO: 1306531 - DNA, 22 bp, Artificial Sequence
  chemically synthesized
tcatgggctatgggctgaagtg

SEQ ID NO: 1306532 - DNA, 22 bp, Artificial Sequence
  chemically synthesized
gtcatgggctatgggctgaagt

SEQ ID NO: 1306533 - DNA, 22 bp, Artificial Sequence
  chemically synthesized
tgtcatgggctatgggctgaag

SEQ ID NO: 1306534 - DNA, 22 bp, Artificial Sequence
  chemically synthesized
atcaagctttgtcatgggctat

SEQ ID NO: 1306535 - DNA, 22 bp, Artificial Sequence
  chemically synthesized
taatcaagctttgtcatgggct

SEQ ID NO: 1306536 - DNA, 22 bp, Artificial Sequence
  chemically synthesized
cagcccatagcccatgacaaag

SEQ ID NO: 1306537 - DNA, 22 bp, Artificial Sequence
  chemically synthesized
agcccatagcccatgacaaagc

SEQ ID NO: 1306538 - DNA, 22 bp, Artificial Sequence
  chemically synthesized
cattctaatcaagctttgtcat

SEQ ID NO: 1306539 - DNA, 22 bp, Artificial Sequence
  chemically synthesized
ccattctaatcaagctttgtca

SEQ ID NO: 1306540 - DNA, 22 bp, Artificial Sequence
  chemically synthesized
tccattctaatcaagctttgtc

SEQ ID NO: 1306541 - DNA, 22 bp, Artificial Sequence
  chemically synthesized
ttccattctaatcaagctttgt

SEQ ID NO: 1306542 - DNA, 22 bp, Artificial Sequence
  chemically synthesized
acacttttccattctaatcaag

SEQ ID NO: 1306543 - DNA, 22 bp, Artificial Sequence
  chemically synthesized
aacacttttccattctaatcaa

SEQ ID NO: 1306544 - DNA, 22 bp, Artificial Sequence
  chemically synthesized
atggcttaacacttttccattc

SEQ ID NO: 1306545 - DNA, 22 bp, Artificial Sequence
  chemically synthesized
gatggcttaacacttttccatt

SEQ ID NO: 1306546 - DNA, 22 bp, Artificial Sequence
  chemically synthesized
tgatggcttaacacttttccat

SEQ ID NO: 1306547 - DNA, 22 bp, Artificial Sequence
  chemically synthesized
ttgatggcttaacacttttcca

SEQ ID NO: 1306548 - DNA, 22 bp, Artificial Sequence
  chemically synthesized
tttttgatggcttaacactttt

SEQ ID NO: 1306549 - DNA, 22 bp, Artificial Sequence
  chemically synthesized
gattagaatggaaaagtgttaa

SEQ ID NO: 1306550 - DNA, 22 bp, Artificial Sequence
  chemically synthesized
gtttttgatggcttaacacttt

SEQ ID NO: 1306551 - DNA, 22 bp, Artificial Sequence
  chemically synthesized
attagaatggaaaagtgttaag

SEQ ID NO: 1306552 - DNA, 22 bp, Artificial Sequence
  chemically synthesized
gaatggaaaagtgttaagccat

SEQ ID NO: 1306553 - DNA, 22 bp, Artificial Sequence
  chemically synthesized
tgtcttgtttttgatggcttaa

SEQ ID NO: 1306554 - DNA, 22 bp, Artificial Sequence
  chemically synthesized
tagctgtgtcttgtttttgatg

SEQ ID NO: 1306555 - DNA, 22 bp, Artificial Sequence
  chemically synthesized
atagctgtgtcttgtttttgat

SEQ ID NO: 1306556 - DNA, 22 bp, Artificial Sequence
  chemically synthesized
cttatagctgtgtcttgttttt

SEQ ID NO: 1306557 - DNA, 22 bp, Artificial Sequence
  chemically synthesized
ccttatagctgtgtcttgtttt

SEQ ID NO: 1306558 - DNA, 22 bp, Artificial Sequence
  chemically synthesized
tccttatagctgtgtcttgttt

SEQ ID NO: 1306559 - DNA, 22 bp, Artificial Sequence
  chemically synthesized
tttccttatagctgtgtcttgt

SEQ ID NO: 1306560 - DNA, 22 bp, Artificial Sequence
  chemically synthesized
agccatcaaaaacaagacacag

SEQ ID NO: 1306561 - DNA, 22 bp, Artificial Sequence
  chemically synthesized
ctctttccttatagctgtgtct

SEQ ID NO: 1306562 - DNA, 22 bp, Artificial Sequence
  chemically synthesized
cctctttccttatagctgtgtc

SEQ ID NO: 1306563 - DNA, 22 bp, Artificial Sequence
  chemically synthesized
tatttcctctttccttatagct

SEQ ID NO: 1306564 - DNA, 22 bp, Artificial Sequence
  chemically synthesized
atatttcctctttccttatagc

SEQ ID NO: 1306565 - DNA, 22 bp, Artificial Sequence
  chemically synthesized
gccttatatttcctctttcctt

SEQ ID NO: 1306566 - DNA, 22 bp, Artificial Sequence
  chemically synthesized
attagccttatatttcctcttt

SEQ ID NO: 1306567 - DNA, 22 bp, Artificial Sequence
  chemically synthesized
aaattcattagccttatatttc

SEQ ID NO: 1306568 - DNA, 22 bp, Artificial Sequence
  chemically synthesized
taaggaaagaggaaatataagg

SEQ ID NO: 1306569 - DNA, 22 bp, Artificial Sequence
  chemically synthesized
tgaacactaaaattcattagcc

SEQ ID NO: 1306570 - DNA, 22 bp, Artificial Sequence
  chemically synthesized
ttatgaacactaaaattcatta

SEQ ID NO: 1306571 - DNA, 22 bp, Artificial Sequence
  chemically synthesized
gttatgaacactaaaattcatt

SEQ ID NO: 1306572 - DNA, 22 bp, Artificial Sequence
  chemically synthesized
tcttgttatgaacactaaaatt

SEQ ID NO: 1306573 - DNA, 22 bp, Artificial Sequence
  chemically synthesized
atcttgttatgaacactaaaat

SEQ ID NO: 1306574 - DNA, 22 bp, Artificial Sequence
  chemically synthesized
tatcttgttatgaacactaaaa

SEQ ID NO: 1306575 - DNA, 22 bp, Artificial Sequence
  chemically synthesized
ttatcttgttatgaacactaaa

SEQ ID NO: 1306576 - DNA, 22 bp, Artificial Sequence
  chemically synthesized
atgaattttagtgttcataaca

SEQ ID NO: 1306577 - DNA, 22 bp, Artificial Sequence
  chemically synthesized
agaaacacatttttatcttgtt

SEQ ID NO: 1306578 - DNA, 22 bp, Artificial Sequence
  chemically synthesized
tagtgttcataacaagataaaa

SEQ ID NO: 1306579 - DNA, 22 bp, Artificial Sequence
  chemically synthesized
agtgttcataacaagataaaaa

SEQ ID NO: 1306580 - DNA, 22 bp, Artificial Sequence
  chemically synthesized
gtgttcataacaagataaaaat

SEQ ID NO: 1306581 - DNA, 22 bp, Artificial Sequence
  chemically synthesized
ataacaagataaaaatgtgttt

SEQ ID NO: 1306582 - DNA, 22 bp, Artificial Sequence
  chemically synthesized
cacaggtattgagaaacacatt

SEQ ID NO: 1306583 - DNA, 22 bp, Artificial Sequence
  chemically synthesized
aatggctacacaggtattgaga

SEQ ID NO: 1306584 - DNA, 22 bp, Artificial Sequence
  chemically synthesized
taaatggctacacaggtattga

SEQ ID NO: 1306585 - DNA, 22 bp, Artificial Sequence
  chemically synthesized
ctaaatggctacacaggtattg

SEQ ID NO: 1306586 - DNA, 22 bp, Artificial Sequence
  chemically synthesized
gatttctaaatggctacacagg

SEQ ID NO: 1306587 - DNA, 22 bp, Artificial Sequence
  chemically synthesized
agatttctaaatggctacacag

SEQ ID NO: 1306588 - DNA, 22 bp, Artificial Sequence
  chemically synthesized
tagatttctaaatggctacaca

SEQ ID NO: 1306589 - DNA, 22 bp, Artificial Sequence
  chemically synthesized
tttagatttctaaatggctaca

SEQ ID NO: 1306590 - DNA, 22 bp, Artificial Sequence
  chemically synthesized
ctcaatacctgtgtagccattt

SEQ ID NO: 1306591 - DNA, 22 bp, Artificial Sequence
  chemically synthesized
tcaatacctgtgtagccattta

SEQ ID NO: 1306592 - DNA, 22 bp, Artificial Sequence
  chemically synthesized
ctctttagatttctaaatggct

SEQ ID NO: 1306593 - DNA, 22 bp, Artificial Sequence
  chemically synthesized
aatacctgtgtagccatttaga

SEQ ID NO: 1306594 - DNA, 22 bp, Artificial Sequence
  chemically synthesized
gctctttagatttctaaatggc

SEQ ID NO: 1306595 - DNA, 22 bp, Artificial Sequence
  chemically synthesized
ttgctctttagatttctaaatg

SEQ ID NO: 1306596 - DNA, 22 bp, Artificial Sequence
  chemically synthesized
cttgctctttagatttctaaat

SEQ ID NO: 1306597 - DNA, 22 bp, Artificial Sequence
  chemically synthesized
ttcttgctctttagatttctaa

SEQ ID NO: 1306598 - DNA, 22 bp, Artificial Sequence
  chemically synthesized
cttcttgctctttagatttcta

SEQ ID NO: 1306599 - DNA, 22 bp, Artificial Sequence
  chemically synthesized
tcttcttgctctttagatttct

SEQ ID NO: 1306600 - DNA, 22 bp, Artificial Sequence
  chemically synthesized
tgtagccatttagaaatctaaa

SEQ ID NO: 1306601 - DNA, 22 bp, Artificial Sequence
  chemically synthesized
tcataattttcttcttgctctt

SEQ ID NO: 1306602 - DNA, 22 bp, Artificial Sequence
  chemically synthesized
tatcataattttcttcttgctc

SEQ ID NO: 1306603 - DNA, 22 bp, Artificial Sequence
  chemically synthesized
agaaatctaaagagcaagaaga

SEQ ID NO: 1306604 - DNA, 22 bp, Artificial Sequence
  chemically synthesized
gaaatctaaagagcaagaagaa

SEQ ID NO: 1306605 - DNA, 22 bp, Artificial Sequence
  chemically synthesized
agaatgttctatcataattttc

SEQ ID NO: 1306606 - DNA, 22 bp, Artificial Sequence
  chemically synthesized
aagagcaagaagaaaattatga

SEQ ID NO: 1306607 - DNA, 22 bp, Artificial Sequence
  chemically synthesized
ctcagaatgttctatcataatt

SEQ ID NO: 1306608 - DNA, 22 bp, Artificial Sequence
  chemically synthesized
tgatagaacattctgagcaatt

SEQ ID NO: 1306609 - DNA, 22 bp, Artificial Sequence
  chemically synthesized
agaaaagaggaagaaattgctc

SEQ ID NO: 1306610 - DNA, 22 bp, Artificial Sequence
  chemically synthesized
gagaaaagaggaagaaattgct

SEQ ID NO: 1306611 - DNA, 22 bp, Artificial Sequence
  chemically synthesized
ttgagaaaagaggaagaaattg

SEQ ID NO: 1306612 - DNA, 22 bp, Artificial Sequence
  chemically synthesized
ctcttgagaaaagaggaagaaa

SEQ ID NO: 1306613 - DNA, 22 bp, Artificial Sequence
  chemically synthesized
tgctcttgagaaaagaggaaga

SEQ ID NO: 1306614 - DNA, 22 bp, Artificial Sequence
  chemically synthesized
tgagcaatttcttcctcttttc

SEQ ID NO: 1306615 - DNA, 22 bp, Artificial Sequence
  chemically synthesized
agcaatttcttcctcttttctc

SEQ ID NO: 1306616 - DNA, 22 bp, Artificial Sequence
  chemically synthesized
aattctgctcttgagaaaagag

SEQ ID NO: 1306617 - DNA, 22 bp, Artificial Sequence
  chemically synthesized
tctcaattctgctcttgagaaa

SEQ ID NO: 1306618 - DNA, 22 bp, Artificial Sequence
  chemically synthesized
cttcctcttttctcaagagcag

SEQ ID NO: 1306619 - DNA, 22 bp, Artificial Sequence
  chemically synthesized
ttcctcttttctcaagagcaga

SEQ ID NO: 1306620 - DNA, 22 bp, Artificial Sequence
  chemically synthesized
agtctatctcaattctgctctt

SEQ ID NO: 1306621 - DNA, 22 bp, Artificial Sequence
  chemically synthesized
cctcttttctcaagagcagaat

SEQ ID NO: 1306622 - DNA, 22 bp, Artificial Sequence
  chemically synthesized
ctcttttctcaagagcagaatt

SEQ ID NO: 1306623 - DNA, 22 bp, Artificial Sequence
  chemically synthesized
ttttctcaagagcagaattgag

SEQ ID NO: 1306624 - DNA, 22 bp, Artificial Sequence
  chemically synthesized
ttctcaagagcagaattgagat

SEQ ID NO: 1306625 - DNA, 22 bp, Artificial Sequence
  chemically synthesized
acatctaagtctatctcaattc

SEQ ID NO: 1306626 - DNA, 22 bp, Artificial Sequence
  chemically synthesized
tctcaagagcagaattgagata

SEQ ID NO: 1306627 - DNA, 22 bp, Artificial Sequence
  chemically synthesized
gacatctaagtctatctcaatt

SEQ ID NO: 1306628 - DNA, 22 bp, Artificial Sequence
  chemically synthesized
ctcaagagcagaattgagatag

SEQ ID NO: 1306629 - DNA, 22 bp, Artificial Sequence
  chemically synthesized
tcaagagcagaattgagataga

SEQ ID NO: 1306630 - DNA, 22 bp, Artificial Sequence
  chemically synthesized
aagagcagaattgagatagact

SEQ ID NO: 1306631 - DNA, 22 bp, Artificial Sequence
  chemically synthesized
agatagacttagatgtcaagtc

SEQ ID NO: 1306632 - DNA, 22 bp, Artificial Sequence
  chemically synthesized
gaagaatgggtagacttgacat

SEQ ID NO: 1306633 - DNA, 22 bp, Artificial Sequence
  chemically synthesized
agatgtcaagtctacccattct

SEQ ID NO: 1306634 - DNA, 22 bp, Artificial Sequence
  chemically synthesized
gatgtcaagtctacccattctt

SEQ ID NO: 1306635 - DNA, 22 bp, Artificial Sequence
  chemically synthesized
agaacggcctagaagaatgggt

SEQ ID NO: 1306636 - DNA, 22 bp, Artificial Sequence
  chemically synthesized
aaaatgggtctgagaacggcct

SEQ ID NO: 1306637 - DNA, 22 bp, Artificial Sequence
  chemically synthesized
cccattcttctaggccgttctc

SEQ ID NO: 1306638 - DNA, 22 bp, Artificial Sequence
  chemically synthesized
gaaaatgggtctgagaacggcc

SEQ ID NO: 1306639 - DNA, 22 bp, Artificial Sequence
  chemically synthesized
tgaaaatgggtctgagaacggc

SEQ ID NO: 1306640 - DNA, 22 bp, Artificial Sequence
  chemically synthesized
ttgaaaatgggtctgagaacgg

SEQ ID NO: 1306641 - DNA, 22 bp, Artificial Sequence
  chemically synthesized
tttgaaaatgggtctgagaacg

SEQ ID NO: 1306642 - DNA, 22 bp, Artificial Sequence
  chemically synthesized
ttttgaaaatgggtctgagaac

SEQ ID NO: 1306643 - DNA, 22 bp, Artificial Sequence
  chemically synthesized
ttctaggccgttctcagaccca

SEQ ID NO: 1306644 - DNA, 22 bp, Artificial Sequence
  chemically synthesized
tttttttgaaaatgggtctgag

SEQ ID NO: 1306645 - DNA, 22 bp, Artificial Sequence
  chemically synthesized
ctaggccgttctcagacccatt

SEQ ID NO: 1306646 - DNA, 22 bp, Artificial Sequence
  chemically synthesized
taggccgttctcagacccattt

SEQ ID NO: 1306647 - DNA, 22 bp, Artificial Sequence
  chemically synthesized
ttgtttttttgaaaatgggtct

SEQ ID NO: 1306648 - DNA, 22 bp, Artificial Sequence
  chemically synthesized
attgtttttttgaaaatgggtc

SEQ ID NO: 1306649 - DNA, 22 bp, Artificial Sequence
  chemically synthesized
ggccgttctcagacccattttc

SEQ ID NO: 1306650 - DNA, 22 bp, Artificial Sequence
  chemically synthesized
gatttattgtttttttgaaaat

SEQ ID NO: 1306651 - DNA, 22 bp, Artificial Sequence
  chemically synthesized
ggatttattgtttttttgaaaa

SEQ ID NO: 1306652 - DNA, 22 bp, Artificial Sequence
  chemically synthesized
tggatttattgtttttttgaaa

SEQ ID NO: 1306653 - DNA, 22 bp, Artificial Sequence
  chemically synthesized
ttggatttattgtttttttgaa

SEQ ID NO: 1306654 - DNA, 22 bp, Artificial Sequence
  chemically synthesized
tcagacccattttcaaaaaaac

SEQ ID NO: 1306655 - DNA, 22 bp, Artificial Sequence
  chemically synthesized
agacccattttcaaaaaaacaa

SEQ ID NO: 1306656 - DNA, 22 bp, Artificial Sequence
  chemically synthesized
gcttttggatttattgtttttt

SEQ ID NO: 1306657 - DNA, 22 bp, Artificial Sequence
  chemically synthesized
ggcttttggatttattgttttt

SEQ ID NO: 1306658 - DNA, 22 bp, Artificial Sequence
  chemically synthesized
tggcttttggatttattgtttt

SEQ ID NO: 1306659 - DNA, 22 bp, Artificial Sequence
  chemically synthesized
ttggcttttggatttattgttt

SEQ ID NO: 1306660 - DNA, 22 bp, Artificial Sequence
  chemically synthesized
cttttggcttttggatttattg

SEQ ID NO: 1306661 - DNA, 22 bp, Artificial Sequence
  chemically synthesized
tcaaaaaaacaataaatccaaa

SEQ ID NO: 1306662 - DNA, 22 bp, Artificial Sequence
  chemically synthesized
ttgcttttggcttttggattta

SEQ ID NO: 1306663 - DNA, 22 bp, Artificial Sequence
  chemically synthesized
caaaaaaacaataaatccaaaa

SEQ ID NO: 1306664 - DNA, 22 bp, Artificial Sequence
  chemically synthesized
attgcttttggcttttggattt

SEQ ID NO: 1306665 - DNA, 22 bp, Artificial Sequence
  chemically synthesized
aaaaaaacaataaatccaaaag

SEQ ID NO: 1306666 - DNA, 22 bp, Artificial Sequence
  chemically synthesized
aacaagtttattgcttttggct

SEQ ID NO: 1306667 - DNA, 22 bp, Artificial Sequence
  chemically synthesized
aaacaagtttattgcttttggc

SEQ ID NO: 1306668 - DNA, 22 bp, Artificial Sequence
  chemically synthesized
agtatttaaacaagtttattgc

SEQ ID NO: 1306669 - DNA, 22 bp, Artificial Sequence
  chemically synthesized
cagtatttaaacaagtttattg

SEQ ID NO: 1306670 - DNA, 22 bp, Artificial Sequence
  chemically synthesized
gtttaaatactgaagttcacat

SEQ ID NO: 1306671 - DNA, 22 bp, Artificial Sequence
  chemically synthesized
tttaaatactgaagttcacatg

SEQ ID NO: 1306672 - DNA, 22 bp, Artificial Sequence
  chemically synthesized
aaaacatgagcaccatgtgaac

SEQ ID NO: 1306673 - DNA, 22 bp, Artificial Sequence
  chemically synthesized
aaatactgaagttcacatggtg

SEQ ID NO: 1306674 - DNA, 22 bp, Artificial Sequence
  chemically synthesized
tgaaaacatgagcaccatgtga

SEQ ID NO: 1306675 - DNA, 22 bp, Artificial Sequence
  chemically synthesized
aatactgaagttcacatggtgc

SEQ ID NO: 1306676 - DNA, 22 bp, Artificial Sequence
  chemically synthesized
ctgaaaacatgagcaccatgtg

SEQ ID NO: 1306677 - DNA, 22 bp, Artificial Sequence
  chemically synthesized
aagttcacatggtgctcatgtt

SEQ ID NO: 1306678 - DNA, 22 bp, Artificial Sequence
  chemically synthesized
acatggtgctcatgttttcaga

SEQ ID NO: 1306679 - DNA, 22 bp, Artificial Sequence
  chemically synthesized
atgttttcagaaatccacttac

SEQ ID NO: 1306680 - DNA, 22 bp, Artificial Sequence
  chemically synthesized
tgggtgtaaagtgtaagtggat

SEQ ID NO: 1306681 - DNA, 22 bp, Artificial Sequence
  chemically synthesized
cattatgggtgtaaagtgtaag

SEQ ID NO: 1306682 - DNA, 22 bp, Artificial Sequence
  chemically synthesized
tcagaaatccacttacacttta

SEQ ID NO: 1306683 - DNA, 22 bp, Artificial Sequence
  chemically synthesized
acattatgggtgtaaagtgtaa

SEQ ID NO: 1306684 - DNA, 22 bp, Artificial Sequence
  chemically synthesized
cagaaatccacttacactttac

SEQ ID NO: 1306685 - DNA, 22 bp, Artificial Sequence
  chemically synthesized
agaaatccacttacactttaca

SEQ ID NO: 1306686 - DNA, 22 bp, Artificial Sequence
  chemically synthesized
cttacattatgggtgtaaagtg

SEQ ID NO: 1306687 - DNA, 22 bp, Artificial Sequence
  chemically synthesized
acactttacacccataatgtaa

SEQ ID NO: 1306688 - DNA, 22 bp, Artificial Sequence
  chemically synthesized
cactttacacccataatgtaag

SEQ ID NO: 1306689 - DNA, 22 bp, Artificial Sequence
  chemically synthesized
aagggtacgttacttacattat

SEQ ID NO: 1306690 - DNA, 22 bp, Artificial Sequence
  chemically synthesized
aaagggtacgttacttacatta

SEQ ID NO: 1306691 - DNA, 22 bp, Artificial Sequence
  chemically synthesized
tacacccataatgtaagtaacg

SEQ ID NO: 1306692 - DNA, 22 bp, Artificial Sequence
  chemically synthesized
acacccataatgtaagtaacgt

SEQ ID NO: 1306693 - DNA, 22 bp, Artificial Sequence
  chemically synthesized
cacccataatgtaagtaacgta

SEQ ID NO: 1306694 - DNA, 22 bp, Artificial Sequence
  chemically synthesized
aatatttaaagggtacgttact

SEQ ID NO: 1306695 - DNA, 22 bp, Artificial Sequence
  chemically synthesized
gtgagcagttaaatatttaaag

SEQ ID NO: 1306696 - DNA, 22 bp, Artificial Sequence
  chemically synthesized
taaatatttaactgctcactaa

SEQ ID NO: 1306697 - DNA, 22 bp, Artificial Sequence
  chemically synthesized
aaatatttaactgctcactaat

SEQ ID NO: 1306698 - DNA, 22 bp, Artificial Sequence
  chemically synthesized
aatatttaactgctcactaatg

SEQ ID NO: 1306699 - DNA, 22 bp, Artificial Sequence
  chemically synthesized
aactgctcactaatgtttttat

SEQ ID NO: 1306700 - DNA, 22 bp, Artificial Sequence
  chemically synthesized
actgctcactaatgtttttatt

SEQ ID NO: 1306701 - DNA, 22 bp, Artificial Sequence
  chemically synthesized
ctcactaatgtttttatttgca

SEQ ID NO: 1306702 - DNA, 22 bp, Artificial Sequence
  chemically synthesized
aaaagaaatgatatgcaaataa

SEQ ID NO: 1306703 - DNA, 22 bp, Artificial Sequence
  chemically synthesized
aaaaagaaatgatatgcaaata

SEQ ID NO: 1306704 - DNA, 22 bp, Artificial Sequence
  chemically synthesized
actaatgtttttatttgcatat

SEQ ID NO: 1306705 - DNA, 22 bp, Artificial Sequence
  chemically synthesized
taaaaagaaatgatatgcaaat

SEQ ID NO: 1306706 - DNA, 22 bp, Artificial Sequence
  chemically synthesized
atgtttttatttgcatatcatt

SEQ ID NO: 1306707 - DNA, 22 bp, Artificial Sequence
  chemically synthesized
gttttaaaaagaaatgatatgc

SEQ ID NO: 1306708 - DNA, 22 bp, Artificial Sequence
  chemically synthesized
tctagttttaaaaagaaatgat

SEQ ID NO: 1306709 - DNA, 22 bp, Artificial Sequence
  chemically synthesized
ttatttgcatatcatttctttt

SEQ ID NO: 1306710 - DNA, 22 bp, Artificial Sequence
  chemically synthesized
tatttgcatatcatttcttttt

SEQ ID NO: 1306711 - DNA, 22 bp, Artificial Sequence
  chemically synthesized
atttgcatatcatttcttttta

SEQ ID NO: 1306712 - DNA, 22 bp, Artificial Sequence
  chemically synthesized
tttgcatatcatttctttttaa

SEQ ID NO: 1306713 - DNA, 22 bp, Artificial Sequence
  chemically synthesized
gcatatcatttctttttaaaac

SEQ ID NO: 1306714 - DNA, 22 bp, Artificial Sequence
  chemically synthesized
catatcatttctttttaaaact

SEQ ID NO: 1306715 - DNA, 22 bp, Artificial Sequence
  chemically synthesized
aaaaagtgtgtgttatctagtt

SEQ ID NO: 1306716 - DNA, 22 bp, Artificial Sequence
  chemically synthesized
ctaaaaaagtgtgtgttatcta

SEQ ID NO: 1306717 - DNA, 22 bp, Artificial Sequence
  chemically synthesized
ctttttaaaactagataacaca

SEQ ID NO: 1306718 - DNA, 22 bp, Artificial Sequence
  chemically synthesized
tttttaaaactagataacacac

SEQ ID NO: 1306719 - DNA, 22 bp, Artificial Sequence
  chemically synthesized
tttaaaactagataacacacac

SEQ ID NO: 1306720 - DNA, 22 bp, Artificial Sequence
  chemically synthesized
ttaaaactagataacacacact

SEQ ID NO: 1306721 - DNA, 22 bp, Artificial Sequence
  chemically synthesized
taaaactagataacacacactt

SEQ ID NO: 1306722 - DNA, 22 bp, Artificial Sequence
  chemically synthesized
aaaactagataacacacacttt

SEQ ID NO: 1306723 - DNA, 22 bp, Artificial Sequence
  chemically synthesized
aaactagataacacacactttt

SEQ ID NO: 1306724 - DNA, 22 bp, Artificial Sequence
  chemically synthesized
gataacacacacttttttagca

SEQ ID NO: 1306725 - DNA, 22 bp, Artificial Sequence
  chemically synthesized
agatagtgaagatccaaagata

SEQ ID NO: 1306726 - DNA, 22 bp, Artificial Sequence
  chemically synthesized
ttttagcagatatctttggatc

SEQ ID NO: 1306727 - DNA, 22 bp, Artificial Sequence
  chemically synthesized
tttagcagatatctttggatct

SEQ ID NO: 1306728 - DNA, 22 bp, Artificial Sequence
  chemically synthesized
ttagcagatatctttggatctt

SEQ ID NO: 1306729 - DNA, 22 bp, Artificial Sequence
  chemically synthesized
tagcagatatctttggatcttc

SEQ ID NO: 1306730 - DNA, 22 bp, Artificial Sequence
  chemically synthesized
agcagatatctttggatcttca

SEQ ID NO: 1306731 - DNA, 22 bp, Artificial Sequence
  chemically synthesized
gcagatatctttggatcttcac

SEQ ID NO: 1306732 - DNA, 22 bp, Artificial Sequence
  chemically synthesized
tggatcttcactatctcaactg

SEQ ID NO: 1306733 - DNA, 22 bp, Artificial Sequence
  chemically synthesized
ggatcttcactatctcaactga

SEQ ID NO: 1306734 - DNA, 22 bp, Artificial Sequence
  chemically synthesized
gatcttcactatctcaactgac

SEQ ID NO: 1306735 - DNA, 22 bp, Artificial Sequence
  chemically synthesized
cactatctcaactgacttttct

SEQ ID NO: 1306736 - DNA, 22 bp, Artificial Sequence
  chemically synthesized
actatctcaactgacttttctt

SEQ ID NO: 1306737 - DNA, 22 bp, Artificial Sequence
  chemically synthesized
aaaaaaaaaaaaaaaaagaaaa

SEQ ID NO: 1306738 - DNA, 22 bp, Artificial Sequence
  chemically synthesized
tctcaactgacttttctttttt

SEQ ID NO: 1306739 - DNA, 22 bp, Artificial Sequence
  chemically synthesized
aactgacttttctttttttttt

SEQ ID NO: 1306740 - DNA, 22 bp, Artificial Sequence
  chemically synthesized
agtctcaaaaaaaaaaaaaaaa

SEQ ID NO: 1306741 - DNA, 22 bp, Artificial Sequence
  chemically synthesized
acttttcttttttttttttttt

SEQ ID NO: 1306742 - DNA, 22 bp, Artificial Sequence
  chemically synthesized
ttctttttttttttttttttga

SEQ ID NO: 1306743 - DNA, 22 bp, Artificial Sequence
  chemically synthesized
tctttttttttttttttttgag

SEQ ID NO: 1306744 - DNA, 22 bp, Artificial Sequence
  chemically synthesized
ctttttttttttttttttgaga

SEQ ID NO: 1306745 - DNA, 22 bp, Artificial Sequence
  chemically synthesized
tttttttttttttttttgagac

SEQ ID NO: 1306746 - DNA, 22 bp, Artificial Sequence
  chemically synthesized
tttttttttttttttgagactg

SEQ ID NO: 1306747 - DNA, 22 bp, Artificial Sequence
  chemically synthesized
ttttttttttttttgagactga

SEQ ID NO: 1306748 - DNA, 22 bp, Artificial Sequence
  chemically synthesized
tttttttttttttgagactgaa

SEQ ID NO: 1306749 - DNA, 22 bp, Artificial Sequence
  chemically synthesized
ttttttttttttgagactgaat

SEQ ID NO: 1306750 - DNA, 22 bp, Artificial Sequence
  chemically synthesized
tttttttttttgagactgaatc

SEQ ID NO: 1306751 - DNA, 22 bp, Artificial Sequence
  chemically synthesized
ttttttttttgagactgaatct

SEQ ID NO: 1306752 - DNA, 22 bp, Artificial Sequence
  chemically synthesized
ggcgatagagggagattcagtc

SEQ ID NO: 1306753 - DNA, 22 bp, Artificial Sequence
  chemically synthesized
tttttttttgagactgaatctc

SEQ ID NO: 1306754 - DNA, 22 bp, Artificial Sequence
  chemically synthesized
ttttttttgagactgaatctcc

SEQ ID NO: 1306755 - DNA, 22 bp, Artificial Sequence
  chemically synthesized
tttttttgagactgaatctccc

SEQ ID NO: 1306756 - DNA, 22 bp, Artificial Sequence
  chemically synthesized
ttttttgagactgaatctccct

SEQ ID NO: 1306757 - DNA, 22 bp, Artificial Sequence
  chemically synthesized
tttttgagactgaatctccctc

SEQ ID NO: 1306758 - DNA, 22 bp, Artificial Sequence
  chemically synthesized
ttttgagactgaatctccctct

SEQ ID NO: 1306759 - DNA, 22 bp, Artificial Sequence
  chemically synthesized
tttgagactgaatctccctcta

SEQ ID NO: 1306760 - DNA, 22 bp, Artificial Sequence
  chemically synthesized
cagcctgggcgatagagggaga

SEQ ID NO: 1306761 - DNA, 22 bp, Artificial Sequence
  chemically synthesized
ttgagactgaatctccctctat

SEQ ID NO: 1306762 - DNA, 22 bp, Artificial Sequence
  chemically synthesized
tgagactgaatctccctctatc

SEQ ID NO: 1306763 - DNA, 22 bp, Artificial Sequence
  chemically synthesized
gagactgaatctccctctatcg

SEQ ID NO: 1306764 - DNA, 22 bp, Artificial Sequence
  chemically synthesized
agactgaatctccctctatcgc

SEQ ID NO: 1306765 - DNA, 22 bp, Artificial Sequence
  chemically synthesized
cactccagcctgggcgatagag

SEQ ID NO: 1306766 - DNA, 22 bp, Artificial Sequence
  chemically synthesized
aatctccctctatcgcccaggc

SEQ ID NO: 1306767 - DNA, 22 bp, Artificial Sequence
  chemically synthesized
aaacactgcactccagcctggg

SEQ ID NO: 1306768 - DNA, 22 bp, Artificial Sequence
  chemically synthesized
cctctatcgcccaggctggagt

SEQ ID NO: 1306769 - DNA, 22 bp, Artificial Sequence
  chemically synthesized
tatcgcccaggctggagtgcag

SEQ ID NO: 1306770 - DNA, 22 bp, Artificial Sequence
  chemically synthesized
tcgcccaggctggagtgcagtg

SEQ ID NO: 1306771 - DNA, 22 bp, Artificial Sequence
  chemically synthesized
cagtgagccgagattgaaacac

SEQ ID NO: 1306772 - DNA, 22 bp, Artificial Sequence
  chemically synthesized
gagtgcagtgtttcaatctcgg

SEQ ID NO: 1306773 - DNA, 22 bp, Artificial Sequence
  chemically synthesized
caatctcggctcactgcaacct

SEQ ID NO: 1306774 - DNA, 22 bp, Artificial Sequence
  chemically synthesized
aatctcggctcactgcaacctc

SEQ ID NO: 1306775 - DNA, 22 bp, Artificial Sequence
  chemically synthesized
gacccaggaggaggaggttgca

SEQ ID NO: 1306776 - DNA, 22 bp, Artificial Sequence
  chemically synthesized
ggacccaggaggaggaggttgc

SEQ ID NO: 1306777 - DNA, 22 bp, Artificial Sequence
  chemically synthesized
ggctcactgcaacctcctcctc

SEQ ID NO: 1306778 - DNA, 22 bp, Artificial Sequence
  chemically synthesized
actgcaacctcctcctcctggg

SEQ ID NO: 1306779 - DNA, 22 bp, Artificial Sequence
  chemically synthesized
caacctcctcctcctgggtcca

SEQ ID NO: 1306780 - DNA, 22 bp, Artificial Sequence
  chemically synthesized
aggcagaagaatcgcttggacc

SEQ ID NO: 1306781 - DNA, 22 bp, Artificial Sequence
  chemically synthesized
ctcctcctgggtccaagcgatt

SEQ ID NO: 1306782 - DNA, 22 bp, Artificial Sequence
  chemically synthesized
ctcctgggtccaagcgattctt

SEQ ID NO: 1306783 - DNA, 22 bp, Artificial Sequence
  chemically synthesized
ggaggctgaggcagaagaatcg

SEQ ID NO: 1306784 - DNA, 22 bp, Artificial Sequence
  chemically synthesized
ctgggtccaagcgattcttctg

SEQ ID NO: 1306785 - DNA, 22 bp, Artificial Sequence
  chemically synthesized
aggaggctgaggcagaagaatc

SEQ ID NO: 1306786 - DNA, 22 bp, Artificial Sequence
  chemically synthesized
ggtccaagcgattcttctgcct

SEQ ID NO: 1306787 - DNA, 22 bp, Artificial Sequence
  chemically synthesized
cttaggaggctgaggcagaaga

SEQ ID NO: 1306788 - DNA, 22 bp, Artificial Sequence
  chemically synthesized
atcccagctacttaggaggctg

SEQ ID NO: 1306789 - DNA, 22 bp, Artificial Sequence
  chemically synthesized
taatcccagctacttaggaggc

SEQ ID NO: 1306790 - DNA, 22 bp, Artificial Sequence
  chemically synthesized
ttctgcctcagcctcctaagta

SEQ ID NO: 1306791 - DNA, 22 bp, Artificial Sequence
  chemically synthesized
ctgcctcagcctcctaagtagc

SEQ ID NO: 1306792 - DNA, 22 bp, Artificial Sequence
  chemically synthesized
tgcctcagcctcctaagtagct

SEQ ID NO: 1306793 - DNA, 22 bp, Artificial Sequence
  chemically synthesized
cctcagcctcctaagtagctgg

SEQ ID NO: 1306794 - DNA, 22 bp, Artificial Sequence
  chemically synthesized
agcctcctaagtagctgggatt

SEQ ID NO: 1306795 - DNA, 22 bp, Artificial Sequence
  chemically synthesized
ctaagtagctgggattagaggc

SEQ ID NO: 1306796 - DNA, 22 bp, Artificial Sequence
  chemically synthesized
agtagctgggattagaggcacc

SEQ ID NO: 1306797 - DNA, 22 bp, Artificial Sequence
  chemically synthesized
gccaggcgtggtggtgggtgcc

SEQ ID NO: 1306798 - DNA, 22 bp, Artificial Sequence
  chemically synthesized
ggattagaggcacccaccacca

SEQ ID NO: 1306799 - DNA, 22 bp, Artificial Sequence
  chemically synthesized
gaggcacccaccaccacgcctg

SEQ ID NO: 1306800 - DNA, 22 bp, Artificial Sequence
  chemically synthesized
aaaatacaacaattagccaggc

SEQ ID NO: 1306801 - DNA, 22 bp, Artificial Sequence
  chemically synthesized
ctaaaaatacaacaattagcca

SEQ ID NO: 1306802 - DNA, 22 bp, Artificial Sequence
  chemically synthesized
tactaaaaatacaacaattagc

SEQ ID NO: 1306803 - DNA, 22 bp, Artificial Sequence
  chemically synthesized
tctactaaaaatacaacaatta

SEQ ID NO: 1306804 - DNA, 22 bp, Artificial Sequence
  chemically synthesized
ctctactaaaaatacaacaatt

SEQ ID NO: 1306805 - DNA, 22 bp, Artificial Sequence
  chemically synthesized
gctaattgttgtatttttagta

SEQ ID NO: 1306806 - DNA, 22 bp, Artificial Sequence
  chemically synthesized
attgttgtatttttagtagaga

SEQ ID NO: 1306807 - DNA, 22 bp, Artificial Sequence
  chemically synthesized
ttgtatttttagtagagaaggg

SEQ ID NO: 1306808 - DNA, 22 bp, Artificial Sequence
  chemically synthesized
tatttttagtagagaaggggtt

SEQ ID NO: 1306809 - DNA, 22 bp, Artificial Sequence
  chemically synthesized
gccaacgtgatgaaaccccttc

SEQ ID NO: 1306810 - DNA, 22 bp, Artificial Sequence
  chemically synthesized
ttagtagagaaggggtttcatc

SEQ ID NO: 1306811 - DNA, 22 bp, Artificial Sequence
  chemically synthesized
tagtagagaaggggtttcatca

SEQ ID NO: 1306812 - DNA, 22 bp, Artificial Sequence
  chemically synthesized
agtagagaaggggtttcatcac

SEQ ID NO: 1306813 - DNA, 22 bp, Artificial Sequence
  chemically synthesized
gtagagaaggggtttcatcacg

SEQ ID NO: 1306814 - DNA, 22 bp, Artificial Sequence
  chemically synthesized
agaccagcctagccaacgtgat

SEQ ID NO: 1306815 - DNA, 22 bp, Artificial Sequence
  chemically synthesized
gagaccagcctagccaacgtga

SEQ ID NO: 1306816 - DNA, 22 bp, Artificial Sequence
  chemically synthesized
catcacgttggctaggctggtc

SEQ ID NO: 1306817 - DNA, 22 bp, Artificial Sequence
  chemically synthesized
atcacgttggctaggctggtct

SEQ ID NO: 1306818 - DNA, 22 bp, Artificial Sequence
  chemically synthesized
aagacaggagtttgagaccagc

SEQ ID NO: 1306819 - DNA, 22 bp, Artificial Sequence
  chemically synthesized
gaagacaggagtttgagaccag

SEQ ID NO: 1306820 - DNA, 22 bp, Artificial Sequence
  chemically synthesized
gctaggctggtctcaaactcct

SEQ ID NO: 1306821 - DNA, 22 bp, Artificial Sequence
  chemically synthesized
ggctggtctcaaactcctgtct

SEQ ID NO: 1306822 - DNA, 22 bp, Artificial Sequence
  chemically synthesized
gtctcaaactcctgtcttcaag

SEQ ID NO: 1306823 - DNA, 22 bp, Artificial Sequence
  chemically synthesized
gaggccagtggatcacttgaag

SEQ ID NO: 1306824 - DNA, 22 bp, Artificial Sequence
  chemically synthesized
aaactcctgtcttcaagtgatc

SEQ ID NO: 1306825 - DNA, 22 bp, Artificial Sequence
  chemically synthesized
ctgtcttcaagtgatccactgg

SEQ ID NO: 1306826 - DNA, 22 bp, Artificial Sequence
  chemically synthesized
gggagttagaggccagtggatc

SEQ ID NO: 1306827 - DNA, 22 bp, Artificial Sequence
  chemically synthesized
cgggagttagaggccagtggat

SEQ ID NO: 1306828 - DNA, 22 bp, Artificial Sequence
  chemically synthesized
tcttcaagtgatccactggcct

SEQ ID NO: 1306829 - DNA, 22 bp, Artificial Sequence
  chemically synthesized
caagtgatccactggcctctaa

SEQ ID NO: 1306830 - DNA, 22 bp, Artificial Sequence
  chemically synthesized
aagtgatccactggcctctaac

SEQ ID NO: 1306831 - DNA, 22 bp, Artificial Sequence
  chemically synthesized
taatcccagcacttcgggagtt

SEQ ID NO: 1306832 - DNA, 22 bp, Artificial Sequence
  chemically synthesized
ctgtaatcccagcacttcggga

SEQ ID NO: 1306833 - DNA, 22 bp, Artificial Sequence
  chemically synthesized
gcctctaactcccgaagtgctg

SEQ ID NO: 1306834 - DNA, 22 bp, Artificial Sequence
  chemically synthesized
actcctgtaatcccagcacttc

SEQ ID NO: 1306835 - DNA, 22 bp, Artificial Sequence
  chemically synthesized
taactcccgaagtgctgggatt

SEQ ID NO: 1306836 - DNA, 22 bp, Artificial Sequence
  chemically synthesized
actcccgaagtgctgggattac

SEQ ID NO: 1306837 - DNA, 22 bp, Artificial Sequence
  chemically synthesized
ccgaagtgctgggattacagga

SEQ ID NO: 1306838 - DNA, 22 bp, Artificial Sequence
  chemically synthesized
aggccaggcgcaggggctcact

SEQ ID NO: 1306839 - DNA, 22 bp, Artificial Sequence
  chemically synthesized
ggattacaggagtgagcccctg

SEQ ID NO: 1306840 - DNA, 22 bp, Artificial Sequence
  chemically synthesized
caggagtgagcccctgcgcctg

SEQ ID NO: 1306841 - DNA, 22 bp, Artificial Sequence
  chemically synthesized
aaaaagtcggttgaggccaggc

SEQ ID NO: 1306842 - DNA, 22 bp, Artificial Sequence
  chemically synthesized
tggtctaaaaaagtcggttgag

SEQ ID NO: 1306843 - DNA, 22 bp, Artificial Sequence
  chemically synthesized
cgcctggcctcaaccgactttt

SEQ ID NO: 1306844 - DNA, 22 bp, Artificial Sequence
  chemically synthesized
cctgtggtctaaaaaagtcggt

SEQ ID NO: 1306845 - DNA, 22 bp, Artificial Sequence
  chemically synthesized
acctgtggtctaaaaaagtcgg

SEQ ID NO: 1306846 - DNA, 22 bp, Artificial Sequence
  chemically synthesized
gcctcaaccgacttttttagac

SEQ ID NO: 1306847 - DNA, 22 bp, Artificial Sequence
  chemically synthesized
acatttacctgtggtctaaaaa

SEQ ID NO: 1306848 - DNA, 22 bp, Artificial Sequence
  chemically synthesized
aaccgacttttttagaccacag

SEQ ID NO: 1306849 - DNA, 22 bp, Artificial Sequence
  chemically synthesized
agtaaaactaacatttacctgt

SEQ ID NO: 1306850 - DNA, 22 bp, Artificial Sequence
  chemically synthesized
ttttagaccacaggtaaatgtt

SEQ ID NO: 1306851 - DNA, 22 bp, Artificial Sequence
  chemically synthesized
tttagaccacaggtaaatgtta

SEQ ID NO: 1306852 - DNA, 22 bp, Artificial Sequence
  chemically synthesized
ttagaccacaggtaaatgttag

SEQ ID NO: 1306853 - DNA, 22 bp, Artificial Sequence
  chemically synthesized
tagaccacaggtaaatgttagt

SEQ ID NO: 1306854 - DNA, 22 bp, Artificial Sequence
  chemically synthesized
agaccacaggtaaatgttagtt

SEQ ID NO: 1306855 - DNA, 22 bp, Artificial Sequence
  chemically synthesized
gaccacaggtaaatgttagttt

SEQ ID NO: 1306856 - DNA, 22 bp, Artificial Sequence
  chemically synthesized
caatcattaagtaaaactaaca

SEQ ID NO: 1306857 - DNA, 22 bp, Artificial Sequence
  chemically synthesized
gttttacttaatgattgtaatt

SEQ ID NO: 1306858 - DNA, 22 bp, Artificial Sequence
  chemically synthesized
tacttaatgattgtaattattt

SEQ ID NO: 1306859 - DNA, 22 bp, Artificial Sequence
  chemically synthesized
acttaatgattgtaattatttt

SEQ ID NO: 1306860 - DNA, 22 bp, Artificial Sequence
  chemically synthesized
cttaatgattgtaattattttg

SEQ ID NO: 1306861 - DNA, 22 bp, Artificial Sequence
  chemically synthesized
catatagagtatatcaaaataa

SEQ ID NO: 1306862 - DNA, 22 bp, Artificial Sequence
  chemically synthesized
aatgattgtaattattttgata

SEQ ID NO: 1306863 - DNA, 22 bp, Artificial Sequence
  chemically synthesized
ccatatagagtatatcaaaata

SEQ ID NO: 1306864 - DNA, 22 bp, Artificial Sequence
  chemically synthesized
atgattgtaattattttgatat

SEQ ID NO: 1306865 - DNA, 22 bp, Artificial Sequence
  chemically synthesized
tccatatagagtatatcaaaat

SEQ ID NO: 1306866 - DNA, 22 bp, Artificial Sequence
  chemically synthesized
ttttccatatagagtatatcaa

SEQ ID NO: 1306867 - DNA, 22 bp, Artificial Sequence
  chemically synthesized
attttccatatagagtatatca

SEQ ID NO: 1306868 - DNA, 22 bp, Artificial Sequence
  chemically synthesized
taattattttgatatactctat

SEQ ID NO: 1306869 - DNA, 22 bp, Artificial Sequence
  chemically synthesized
cttattttccatatagagtata

SEQ ID NO: 1306870 - DNA, 22 bp, Artificial Sequence
  chemically synthesized
ccttattttccatatagagtat

SEQ ID NO: 1306871 - DNA, 22 bp, Artificial Sequence
  chemically synthesized
tccttattttccatatagagta

SEQ ID NO: 1306872 - DNA, 22 bp, Artificial Sequence
  chemically synthesized
ttttgatatactctatatggaa

SEQ ID NO: 1306873 - DNA, 22 bp, Artificial Sequence
  chemically synthesized
tgatatactctatatggaaaat

SEQ ID NO: 1306874 - DNA, 22 bp, Artificial Sequence
  chemically synthesized
gatatactctatatggaaaata

SEQ ID NO: 1306875 - DNA, 22 bp, Artificial Sequence
  chemically synthesized
atatactctatatggaaaataa

SEQ ID NO: 1306876 - DNA, 22 bp, Artificial Sequence
  chemically synthesized
tatatggaaaataaggaaagta

SEQ ID NO: 1306877 - DNA, 22 bp, Artificial Sequence
  chemically synthesized
aaagggaaaaaatactttcctt

SEQ ID NO: 1306878 - DNA, 22 bp, Artificial Sequence
  chemically synthesized
aaaagggaaaaaatactttcct

SEQ ID NO: 1306879 - DNA, 22 bp, Artificial Sequence
  chemically synthesized
tatggaaaataaggaaagtatt

SEQ ID NO: 1306880 - DNA, 22 bp, Artificial Sequence
  chemically synthesized
taaaagggaaaaaatactttcc

SEQ ID NO: 1306881 - DNA, 22 bp, Artificial Sequence
  chemically synthesized
ttttaaaagggaaaaaatactt

SEQ ID NO: 1306882 - DNA, 22 bp, Artificial Sequence
  chemically synthesized
attttaaaagggaaaaaatact

SEQ ID NO: 1306883 - DNA, 22 bp, Artificial Sequence
  chemically synthesized
cttattttaaaagggaaaaaat

SEQ ID NO: 1306884 - DNA, 22 bp, Artificial Sequence
  chemically synthesized
ccttattttaaaagggaaaaaa

SEQ ID NO: 1306885 - DNA, 22 bp, Artificial Sequence
  chemically synthesized
tccttattttaaaagggaaaaa

SEQ ID NO: 1306886 - DNA, 22 bp, Artificial Sequence
  chemically synthesized
tatattttccttattttaaaag

SEQ ID NO: 1306887 - DNA, 22 bp, Artificial Sequence
  chemically synthesized
tttcccttttaaaataaggaaa

SEQ ID NO: 1306888 - DNA, 22 bp, Artificial Sequence
  chemically synthesized
ttcccttttaaaataaggaaaa

SEQ ID NO: 1306889 - DNA, 22 bp, Artificial Sequence
  chemically synthesized
tcccttttaaaataaggaaaat

SEQ ID NO: 1306890 - DNA, 22 bp, Artificial Sequence
  chemically synthesized
cccttttaaaataaggaaaata

SEQ ID NO: 1306891 - DNA, 22 bp, Artificial Sequence
  chemically synthesized
ccttttaaaataaggaaaatat

SEQ ID NO: 1306892 - DNA, 22 bp, Artificial Sequence
  chemically synthesized
ttaaaataaggaaaatatataa

SEQ ID NO: 1306893 - DNA, 22 bp, Artificial Sequence
  chemically synthesized
taaaataaggaaaatatataat

SEQ ID NO: 1306894 - DNA, 22 bp, Artificial Sequence
  chemically synthesized
aaaataaggaaaatatataatt

SEQ ID NO: 1306895 - DNA, 22 bp, Artificial Sequence
  chemically synthesized
aaataaggaaaatatataatta

SEQ ID NO: 1306896 - DNA, 22 bp, Artificial Sequence
  chemically synthesized
aaaaaaaaaaaaaaaaaaatag

SEQ ID NO: 1306897 - DNA, 22 bp, Artificial Sequence
  chemically synthesized
cgtctcaaaaaaaaaaaaaaaa

SEQ ID NO: 1306898 - DNA, 22 bp, Artificial Sequence
  chemically synthesized
cgctctattttttttttttttt

SEQ ID NO: 1306899 - DNA, 22 bp, Artificial Sequence
  chemically synthesized
tatttttttttttttttttttg

SEQ ID NO: 1306900 - DNA, 22 bp, Artificial Sequence
  chemically synthesized
tttttttttttttttttttgag

SEQ ID NO: 1306901 - DNA, 22 bp, Artificial Sequence
  chemically synthesized
ttttttttttttttttgagacg

SEQ ID NO: 1306902 - DNA, 22 bp, Artificial Sequence
  chemically synthesized
tttttttttttttttgagacgg

SEQ ID NO: 1306903 - DNA, 22 bp, Artificial Sequence
  chemically synthesized
ttttttttttttttgagacgga

SEQ ID NO: 1306904 - DNA, 22 bp, Artificial Sequence
  chemically synthesized
tttttttttttttgagacggag

SEQ ID NO: 1306905 - DNA, 22 bp, Artificial Sequence
  chemically synthesized
ttttttttttttgagacggaga

SEQ ID NO: 1306906 - DNA, 22 bp, Artificial Sequence
  chemically synthesized
tttttttttttgagacggagac

SEQ ID NO: 1306907 - DNA, 22 bp, Artificial Sequence
  chemically synthesized
ttttttttttgagacggagacc

SEQ ID NO: 1306908 - DNA, 22 bp, Artificial Sequence
  chemically synthesized
gggaacagagccggtctccgtc

SEQ ID NO: 1306909 - DNA, 22 bp, Artificial Sequence
  chemically synthesized
tttttttttgagacggagaccg

SEQ ID NO: 1306910 - DNA, 22 bp, Artificial Sequence
  chemically synthesized
ttttttttgagacggagaccgg

SEQ ID NO: 1306911 - DNA, 22 bp, Artificial Sequence
  chemically synthesized
tttttttgagacggagaccggc

SEQ ID NO: 1306912 - DNA, 22 bp, Artificial Sequence
  chemically synthesized
ttttttgagacggagaccggct

SEQ ID NO: 1306913 - DNA, 22 bp, Artificial Sequence
  chemically synthesized
tttttgagacggagaccggctc

SEQ ID NO: 1306914 - DNA, 22 bp, Artificial Sequence
  chemically synthesized
ttttgagacggagaccggctct

SEQ ID NO: 1306915 - DNA, 22 bp, Artificial Sequence
  chemically synthesized
tttgagacggagaccggctctg

SEQ ID NO: 1306916 - DNA, 22 bp, Artificial Sequence
  chemically synthesized
cagcctggggaacagagccggt

SEQ ID NO: 1306917 - DNA, 22 bp, Artificial Sequence
  chemically synthesized
ttgagacggagaccggctctgt

SEQ ID NO: 1306918 - DNA, 22 bp, Artificial Sequence
  chemically synthesized
ccagcctggggaacagagccgg

SEQ ID NO: 1306919 - DNA, 22 bp, Artificial Sequence
  chemically synthesized
tgagacggagaccggctctgtt

SEQ ID NO: 1306920 - DNA, 22 bp, Artificial Sequence
  chemically synthesized
gagacggagaccggctctgttc

SEQ ID NO: 1306921 - DNA, 22 bp, Artificial Sequence
  chemically synthesized
agacggagaccggctctgttcc

SEQ ID NO: 1306922 - DNA, 22 bp, Artificial Sequence
  chemically synthesized
aacttccagcctggggaacaga

SEQ ID NO: 1306923 - DNA, 22 bp, Artificial Sequence
  chemically synthesized
tgttccccaggctggaagttca

SEQ ID NO: 1306924 - DNA, 22 bp, Artificial Sequence
  chemically synthesized
agatcgtgccactgaacttcca

SEQ ID NO: 1306925 - DNA, 22 bp, Artificial Sequence
  chemically synthesized
ttccccaggctggaagttcagt

SEQ ID NO: 1306926 - DNA, 22 bp, Artificial Sequence
  chemically synthesized
cccaggctggaagttcagtggc

SEQ ID NO: 1306927 - DNA, 22 bp, Artificial Sequence
  chemically synthesized
cagtgagttgagatcgtgccac

SEQ ID NO: 1306928 - DNA, 22 bp, Artificial Sequence
  chemically synthesized
gaagttcagtggcacgatctca

SEQ ID NO: 1306929 - DNA, 22 bp, Artificial Sequence
  chemically synthesized
agtggcacgatctcaactcact

SEQ ID NO: 1306930 - DNA, 22 bp, Artificial Sequence
  chemically synthesized
aacccaggaagcggaggttgca

SEQ ID NO: 1306931 - DNA, 22 bp, Artificial Sequence
  chemically synthesized
gaacccaggaagcggaggttgc

SEQ ID NO: 1306932 - DNA, 22 bp, Artificial Sequence
  chemically synthesized
cttgaacccaggaagcggaggt

SEQ ID NO: 1306933 - DNA, 22 bp, Artificial Sequence
  chemically synthesized
aactcactgcaacctccgcttc

SEQ ID NO: 1306934 - DNA, 22 bp, Artificial Sequence
  chemically synthesized
actgcaacctccgcttcctggg

SEQ ID NO: 1306935 - DNA, 22 bp, Artificial Sequence
  chemically synthesized
caacctccgcttcctgggttca

SEQ ID NO: 1306936 - DNA, 22 bp, Artificial Sequence
  chemically synthesized
aggcaggagagttgcttgaacc

SEQ ID NO: 1306937 - DNA, 22 bp, Artificial Sequence
  chemically synthesized
cgcttcctgggttcaagcaact

SEQ ID NO: 1306938 - DNA, 22 bp, Artificial Sequence
  chemically synthesized
cctgggttcaagcaactctcct

SEQ ID NO: 1306939 - DNA, 22 bp, Artificial Sequence
  chemically synthesized
ggaggctgaggcaggagagttg

SEQ ID NO: 1306940 - DNA, 22 bp, Artificial Sequence
  chemically synthesized
ctgggttcaagcaactctcctg

SEQ ID NO: 1306941 - DNA, 22 bp, Artificial Sequence
  chemically synthesized
gggaggctgaggcaggagagtt

SEQ ID NO: 1306942 - DNA, 22 bp, Artificial Sequence
  chemically synthesized
ttgggaggctgaggcaggagag

SEQ ID NO: 1306943 - DNA, 22 bp, Artificial Sequence
  chemically synthesized
ggttcaagcaactctcctgcct

SEQ ID NO: 1306944 - DNA, 22 bp, Artificial Sequence
  chemically synthesized
cttgggaggctgaggcaggaga

SEQ ID NO: 1306945 - DNA, 22 bp, Artificial Sequence
  chemically synthesized
aagcaactctcctgcctcagcc

SEQ ID NO: 1306946 - DNA, 22 bp, Artificial Sequence
  chemically synthesized
tagtcccaacttcttgggaggc

SEQ ID NO: 1306947 - DNA, 22 bp, Artificial Sequence
  chemically synthesized
tcctgcctcagcctcccaagaa

SEQ ID NO: 1306948 - DNA, 22 bp, Artificial Sequence
  chemically synthesized
ctgcctcagcctcccaagaagt

SEQ ID NO: 1306949 - DNA, 22 bp, Artificial Sequence
  chemically synthesized
cctgtagtcccaacttcttggg

SEQ ID NO: 1306950 - DNA, 22 bp, Artificial Sequence
  chemically synthesized
gcctgtagtcccaacttcttgg

SEQ ID NO: 1306951 - DNA, 22 bp, Artificial Sequence
  chemically synthesized
cctcagcctcccaagaagttgg

SEQ ID NO: 1306952 - DNA, 22 bp, Artificial Sequence
  chemically synthesized
agcctcccaagaagttgggact

SEQ ID NO: 1306953 - DNA, 22 bp, Artificial Sequence
  chemically synthesized
ccaagaagttgggactacaggc

SEQ ID NO: 1306954 - DNA, 22 bp, Artificial Sequence
  chemically synthesized
ggcgtggtggcacttgcctgta

SEQ ID NO: 1306955 - DNA, 22 bp, Artificial Sequence
  chemically synthesized
gctgggcgtggtggcacttgcc

SEQ ID NO: 1306956 - DNA, 22 bp, Artificial Sequence
  chemically synthesized
ggactacaggcaagtgccacca

SEQ ID NO: 1306957 - DNA, 22 bp, Artificial Sequence
  chemically synthesized
caggcaagtgccaccacgccca

SEQ ID NO: 1306958 - DNA, 22 bp, Artificial Sequence
  chemically synthesized
aaaatacaaaaattagctgggc

SEQ ID NO: 1306959 - DNA, 22 bp, Artificial Sequence
  chemically synthesized
ctaaaaatacaaaaattagctg

SEQ ID NO: 1306960 - DNA, 22 bp, Artificial Sequence
  chemically synthesized
tactaaaaatacaaaaattagc

SEQ ID NO: 1306961 - DNA, 22 bp, Artificial Sequence
  chemically synthesized
atttttgtatttttagtagaga

SEQ ID NO: 1306962 - DNA, 22 bp, Artificial Sequence
  chemically synthesized
ttgtatttttagtagagacggg

SEQ ID NO: 1306963 - DNA, 22 bp, Artificial Sequence
  chemically synthesized
tgtatttttagtagagacgggg

SEQ ID NO: 1306964 - DNA, 22 bp, Artificial Sequence
  chemically synthesized
gtatttttagtagagacggggt

SEQ ID NO: 1306965 - DNA, 22 bp, Artificial Sequence
  chemically synthesized
tatttttagtagagacggggtt

SEQ ID NO: 1306966 - DNA, 22 bp, Artificial Sequence
  chemically synthesized
gccaacatggtaaaaccccgtc

SEQ ID NO: 1306967 - DNA, 22 bp, Artificial Sequence
  chemically synthesized
ttagtagagacggggttttacc

SEQ ID NO: 1306968 - DNA, 22 bp, Artificial Sequence
  chemically synthesized
tagtagagacggggttttacca

SEQ ID NO: 1306969 - DNA, 22 bp, Artificial Sequence
  chemically synthesized
gcctggccaacatggtaaaacc

SEQ ID NO: 1306970 - DNA, 22 bp, Artificial Sequence
  chemically synthesized
agtagagacggggttttaccat

SEQ ID NO: 1306971 - DNA, 22 bp, Artificial Sequence
  chemically synthesized
gtagagacggggttttaccatg

SEQ ID NO: 1306972 - DNA, 22 bp, Artificial Sequence
  chemically synthesized
gagactggcctggccaacatgg

SEQ ID NO: 1306973 - DNA, 22 bp, Artificial Sequence
  chemically synthesized
taccatgttggccaggccagtc

SEQ ID NO: 1306974 - DNA, 22 bp, Artificial Sequence
  chemically synthesized
accatgttggccaggccagtct

SEQ ID NO: 1306975 - DNA, 22 bp, Artificial Sequence
  chemically synthesized
ccatgttggccaggccagtctc

SEQ ID NO: 1306976 - DNA, 22 bp, Artificial Sequence
  chemically synthesized
aggtcaggagttcgagactggc

SEQ ID NO: 1306977 - DNA, 22 bp, Artificial Sequence
  chemically synthesized
gccaggccagtctcgaactcct

SEQ ID NO: 1306978 - DNA, 22 bp, Artificial Sequence
  chemically synthesized
gaactcctgacctcaggtgatc

SEQ ID NO: 1306979 - DNA, 22 bp, Artificial Sequence
  chemically synthesized
ggaggccgaggcgggcagatca

SEQ ID NO: 1306980 - DNA, 22 bp, Artificial Sequence
  chemically synthesized
ctgacctcaggtgatctgcccg

SEQ ID NO: 1306981 - DNA, 22 bp, Artificial Sequence
  chemically synthesized
gggaggccgaggcgggcagatc

SEQ ID NO: 1306982 - DNA, 22 bp, Artificial Sequence
  chemically synthesized
tgggaggccgaggcgggcagat

SEQ ID NO: 1306983 - DNA, 22 bp, Artificial Sequence
  chemically synthesized
acctcaggtgatctgcccgcct

SEQ ID NO: 1306984 - DNA, 22 bp, Artificial Sequence
  chemically synthesized
aggtgatctgcccgcctcggcc

SEQ ID NO: 1306985 - DNA, 22 bp, Artificial Sequence
  chemically synthesized
taatcccagcactttgggaggc

SEQ ID NO: 1306986 - DNA, 22 bp, Artificial Sequence
  chemically synthesized
gtaatcccagcactttgggagg

SEQ ID NO: 1306987 - DNA, 22 bp, Artificial Sequence
  chemically synthesized
cccgcctcggcctcccaaagtg

SEQ ID NO: 1306988 - DNA, 22 bp, Artificial Sequence
  chemically synthesized
acacttgtaatcccagcacttt

SEQ ID NO: 1306989 - DNA, 22 bp, Artificial Sequence
  chemically synthesized
ggcctcccaaagtgctgggatt

SEQ ID NO: 1306990 - DNA, 22 bp, Artificial Sequence
  chemically synthesized
ccaaagtgctgggattacaagt

SEQ ID NO: 1306991 - DNA, 22 bp, Artificial Sequence
  chemically synthesized
ggtcgggcgcggtgactcacac

SEQ ID NO: 1306992 - DNA, 22 bp, Artificial Sequence
  chemically synthesized
aggtcgggcgcggtgactcaca

SEQ ID NO: 1306993 - DNA, 22 bp, Artificial Sequence
  chemically synthesized
ggattacaagtgtgagtcaccg

SEQ ID NO: 1306994 - DNA, 22 bp, Artificial Sequence
  chemically synthesized
caagtgtgagtcaccgcgcccg

SEQ ID NO: 1306995 - DNA, 22 bp, Artificial Sequence
  chemically synthesized
aaggatatttaggtcgggcgcg

SEQ ID NO: 1306996 - DNA, 22 bp, Artificial Sequence
  chemically synthesized
aaaggatatttaggtcgggcgc

SEQ ID NO: 1306997 - DNA, 22 bp, Artificial Sequence
  chemically synthesized
gatttaaaggatatttaggtcg

SEQ ID NO: 1306998 - DNA, 22 bp, Artificial Sequence
  chemically synthesized
aatatcctttaaatctagtgta

SEQ ID NO: 1306999 - DNA, 22 bp, Artificial Sequence
  chemically synthesized
tagtcacatagatacactagat

SEQ ID NO: 1307000 - DNA, 22 bp, Artificial Sequence
  chemically synthesized
atcattatagtcacatagatac

SEQ ID NO: 1307001 - DNA, 22 bp, Artificial Sequence
  chemically synthesized
taaatctagtgtatctatgtga

SEQ ID NO: 1307002 - DNA, 22 bp, Artificial Sequence
  chemically synthesized
tcatcattatagtcacatagat

SEQ ID NO: 1307003 - DNA, 22 bp, Artificial Sequence
  chemically synthesized
aaatctagtgtatctatgtgac

SEQ ID NO: 1307004 - DNA, 22 bp, Artificial Sequence
  chemically synthesized
ctcatcattatagtcacataga

SEQ ID NO: 1307005 - DNA, 22 bp, Artificial Sequence
  chemically synthesized
aatctagtgtatctatgtgact

SEQ ID NO: 1307006 - DNA, 22 bp, Artificial Sequence
  chemically synthesized
acttctcatcattatagtcaca

SEQ ID NO: 1307007 - DNA, 22 bp, Artificial Sequence
  chemically synthesized
gtgtatctatgtgactataatg

SEQ ID NO: 1307008 - DNA, 22 bp, Artificial Sequence
  chemically synthesized
tgtgactataatgatgagaagt

SEQ ID NO: 1307009 - DNA, 22 bp, Artificial Sequence
  chemically synthesized
tagggaaggcatcctgacttct

SEQ ID NO: 1307010 - DNA, 22 bp, Artificial Sequence
  chemically synthesized
taatgatgagaagtcaggatgc

SEQ ID NO: 1307011 - DNA, 22 bp, Artificial Sequence
  chemically synthesized
gctgtagggaaggcatcctgac

SEQ ID NO: 1307012 - DNA, 22 bp, Artificial Sequence
  chemically synthesized
agctgtagggaaggcatcctga

SEQ ID NO: 1307013 - DNA, 22 bp, Artificial Sequence
  chemically synthesized
tttagctgtagggaaggcatcc

SEQ ID NO: 1307014 - DNA, 22 bp, Artificial Sequence
  chemically synthesized
gtttagctgtagggaaggcatc

SEQ ID NO: 1307015 - DNA, 22 bp, Artificial Sequence
  chemically synthesized
tgtttagctgtagggaaggcat

SEQ ID NO: 1307016 - DNA, 22 bp, Artificial Sequence
  chemically synthesized
agaaaagtctttgtttagctgt

SEQ ID NO: 1307017 - DNA, 22 bp, Artificial Sequence
  chemically synthesized
cagaaaagtctttgtttagctg

SEQ ID NO: 1307018 - DNA, 22 bp, Artificial Sequence
  chemically synthesized
ccctacagctaaacaaagactt

SEQ ID NO: 1307019 - DNA, 22 bp, Artificial Sequence
  chemically synthesized
cctacagctaaacaaagacttt

SEQ ID NO: 1307020 - DNA, 22 bp, Artificial Sequence
  chemically synthesized
cagctaaacaaagacttttctg

SEQ ID NO: 1307021 - DNA, 22 bp, Artificial Sequence
  chemically synthesized
caaatatacatttcagaaaagt

SEQ ID NO: 1307022 - DNA, 22 bp, Artificial Sequence
  chemically synthesized
aacaaagacttttctgaaatgt

SEQ ID NO: 1307023 - DNA, 22 bp, Artificial Sequence
  chemically synthesized
ggtctccaaatatacatttcag

SEQ ID NO: 1307024 - DNA, 22 bp, Artificial Sequence
  chemically synthesized
tgggtctccaaatatacatttc

SEQ ID NO: 1307025 - DNA, 22 bp, Artificial Sequence
  chemically synthesized
ttctgaaatgtatatttggaga

SEQ ID NO: 1307026 - DNA, 22 bp, Artificial Sequence
  chemically synthesized
tctgaaatgtatatttggagac

SEQ ID NO: 1307027 - DNA, 22 bp, Artificial Sequence
  chemically synthesized
ctgaaatgtatatttggagacc

SEQ ID NO: 1307028 - DNA, 22 bp, Artificial Sequence
  chemically synthesized
tgaaatgtatatttggagaccc

SEQ ID NO: 1307029 - DNA, 22 bp, Artificial Sequence
  chemically synthesized
aaatgtatatttggagacccag

SEQ ID NO: 1307030 - DNA, 22 bp, Artificial Sequence
  chemically synthesized
aaataaggtgaaattctgggtc

SEQ ID NO: 1307031 - DNA, 22 bp, Artificial Sequence
  chemically synthesized
cattcaaataaggtgaaattct

SEQ ID NO: 1307032 - DNA, 22 bp, Artificial Sequence
  chemically synthesized
gcattcaaataaggtgaaattc

SEQ ID NO: 1307033 - DNA, 22 bp, Artificial Sequence
  chemically synthesized
tgcattcaaataaggtgaaatt

SEQ ID NO: 1307034 - DNA, 22 bp, Artificial Sequence
  chemically synthesized
ggagacccagaatttcacctta

SEQ ID NO: 1307035 - DNA, 22 bp, Artificial Sequence
  chemically synthesized
gagacccagaatttcaccttat

SEQ ID NO: 1307036 - DNA, 22 bp, Artificial Sequence
  chemically synthesized
agtgttttgcattcaaataagg

SEQ ID NO: 1307037 - DNA, 22 bp, Artificial Sequence
  chemically synthesized
taagtgttttgcattcaaataa

SEQ ID NO: 1307038 - DNA, 22 bp, Artificial Sequence
  chemically synthesized
ctctaagtgttttgcattcaaa

SEQ ID NO: 1307039 - DNA, 22 bp, Artificial Sequence
  chemically synthesized
cctctaagtgttttgcattcaa

SEQ ID NO: 1307040 - DNA, 22 bp, Artificial Sequence
  chemically synthesized
tttcctctaagtgttttgcatt

SEQ ID NO: 1307041 - DNA, 22 bp, Artificial Sequence
  chemically synthesized
caccttatttgaatgcaaaaca

SEQ ID NO: 1307042 - DNA, 22 bp, Artificial Sequence
  chemically synthesized
atttcctctaagtgttttgcat

SEQ ID NO: 1307043 - DNA, 22 bp, Artificial Sequence
  chemically synthesized
accttatttgaatgcaaaacac

SEQ ID NO: 1307044 - DNA, 22 bp, Artificial Sequence
  chemically synthesized
atttgaatgcaaaacacttaga

SEQ ID NO: 1307045 - DNA, 22 bp, Artificial Sequence
  chemically synthesized
agatttatttcctctaagtgtt

SEQ ID NO: 1307046 - DNA, 22 bp, Artificial Sequence
  chemically synthesized
tttgaatgcaaaacacttagag

SEQ ID NO: 1307047 - DNA, 22 bp, Artificial Sequence
  chemically synthesized
ttaagatttatttcctctaagt

SEQ ID NO: 1307048 - DNA, 22 bp, Artificial Sequence
  chemically synthesized
gaatgcaaaacacttagaggaa

SEQ ID NO: 1307049 - DNA, 22 bp, Artificial Sequence
  chemically synthesized
aatgcaaaacacttagaggaaa

SEQ ID NO: 1307050 - DNA, 22 bp, Artificial Sequence
  chemically synthesized
tattaagatttatttcctctaa

SEQ ID NO: 1307051 - DNA, 22 bp, Artificial Sequence
  chemically synthesized
ctattaagatttatttcctcta

SEQ ID NO: 1307052 - DNA, 22 bp, Artificial Sequence
  chemically synthesized
taaaaatcatttctattaagat

SEQ ID NO: 1307053 - DNA, 22 bp, Artificial Sequence
  chemically synthesized
agaggaaataaatcttaataga

SEQ ID NO: 1307054 - DNA, 22 bp, Artificial Sequence
  chemically synthesized
gaggaaataaatcttaatagaa

SEQ ID NO: 1307055 - DNA, 22 bp, Artificial Sequence
  chemically synthesized
gaaatgctgtaaaaatcatttc

SEQ ID NO: 1307056 - DNA, 22 bp, Artificial Sequence
  chemically synthesized
tgttcgaaatgctgtaaaaatc

SEQ ID NO: 1307057 - DNA, 22 bp, Artificial Sequence
  chemically synthesized
gtgttcgaaatgctgtaaaaat

SEQ ID NO: 1307058 - DNA, 22 bp, Artificial Sequence
  chemically synthesized
aatagaaatgatttttacagca

SEQ ID NO: 1307059 - DNA, 22 bp, Artificial Sequence
  chemically synthesized
ttgtgttcgaaatgctgtaaaa

SEQ ID NO: 1307060 - DNA, 22 bp, Artificial Sequence
  chemically synthesized
atagaaatgatttttacagcat

SEQ ID NO: 1307061 - DNA, 22 bp, Artificial Sequence
  chemically synthesized
caattcttgtgttcgaaatgct

SEQ ID NO: 1307062 - DNA, 22 bp, Artificial Sequence
  chemically synthesized
aactacaattcttgtgttcgaa

SEQ ID NO: 1307063 - DNA, 22 bp, Artificial Sequence
  chemically synthesized
aaactacaattcttgtgttcga

SEQ ID NO: 1307064 - DNA, 22 bp, Artificial Sequence
  chemically synthesized
taaactacaattcttgtgttcg

SEQ ID NO: 1307065 - DNA, 22 bp, Artificial Sequence
  chemically synthesized
ttacagcatttcgaacacaaga

SEQ ID NO: 1307066 - DNA, 22 bp, Artificial Sequence
  chemically synthesized
tacagcatttcgaacacaagaa

SEQ ID NO: 1307067 - DNA, 22 bp, Artificial Sequence
  chemically synthesized
acagcatttcgaacacaagaat

SEQ ID NO: 1307068 - DNA, 22 bp, Artificial Sequence
  chemically synthesized
cagcatttcgaacacaagaatt

SEQ ID NO: 1307069 - DNA, 22 bp, Artificial Sequence
  chemically synthesized
cgaacacaagaattgtagttta

SEQ ID NO: 1307070 - DNA, 22 bp, Artificial Sequence
  chemically synthesized
gaacacaagaattgtagtttaa

SEQ ID NO: 1307071 - DNA, 22 bp, Artificial Sequence
  chemically synthesized
aagaacaatattttaaactaca

SEQ ID NO: 1307072 - DNA, 22 bp, Artificial Sequence
  chemically synthesized
aaagaacaatattttaaactac

SEQ ID NO: 1307073 - DNA, 22 bp, Artificial Sequence
  chemically synthesized
taaagaacaatattttaaacta

SEQ ID NO: 1307074 - DNA, 22 bp, Artificial Sequence
  chemically synthesized
tagctttaaagaacaatatttt

SEQ ID NO: 1307075 - DNA, 22 bp, Artificial Sequence
  chemically synthesized
atagctttaaagaacaatattt

SEQ ID NO: 1307076 - DNA, 22 bp, Artificial Sequence
  chemically synthesized
cttatagctttaaagaacaata

SEQ ID NO: 1307077 - DNA, 22 bp, Artificial Sequence
  chemically synthesized
acttatagctttaaagaacaat

SEQ ID NO: 1307078 - DNA, 22 bp, Artificial Sequence
  chemically synthesized
tagtttaaaatattgttcttta

SEQ ID NO: 1307079 - DNA, 22 bp, Artificial Sequence
  chemically synthesized
gtttacttatagctttaaagaa

SEQ ID NO: 1307080 - DNA, 22 bp, Artificial Sequence
  chemically synthesized
aaaatattgttctttaaagcta

SEQ ID NO: 1307081 - DNA, 22 bp, Artificial Sequence
  chemically synthesized
aaatattgttctttaaagctat

SEQ ID NO: 1307082 - DNA, 22 bp, Artificial Sequence
  chemically synthesized
gaaacattggtttacttatagc

SEQ ID NO: 1307083 - DNA, 22 bp, Artificial Sequence
  chemically synthesized
ggaaacattggtttacttatag

SEQ ID NO: 1307084 - DNA, 22 bp, Artificial Sequence
  chemically synthesized
ttctttaaagctataagtaaac

SEQ ID NO: 1307085 - DNA, 22 bp, Artificial Sequence
  chemically synthesized
tttaaagctataagtaaaccaa

SEQ ID NO: 1307086 - DNA, 22 bp, Artificial Sequence
  chemically synthesized
taaagctataagtaaaccaatg

SEQ ID NO: 1307087 - DNA, 22 bp, Artificial Sequence
  chemically synthesized
aaagctataagtaaaccaatgt

SEQ ID NO: 1307088 - DNA, 22 bp, Artificial Sequence
  chemically synthesized
aagctataagtaaaccaatgtt

SEQ ID NO: 1307089 - DNA, 22 bp, Artificial Sequence
  chemically synthesized
gaaaaaacagtttggaaacatt

SEQ ID NO: 1307090 - DNA, 22 bp, Artificial Sequence
  chemically synthesized
taagtaaaccaatgtttccaaa

SEQ ID NO: 1307091 - DNA, 22 bp, Artificial Sequence
  chemically synthesized
tagaaaaaacagtttggaaaca

SEQ ID NO: 1307092 - DNA, 22 bp, Artificial Sequence
  chemically synthesized
ctctagaaaaaacagtttggaa

SEQ ID NO: 1307093 - DNA, 22 bp, Artificial Sequence
  chemically synthesized
gctctagaaaaaacagtttgga

SEQ ID NO: 1307094 - DNA, 22 bp, Artificial Sequence
  chemically synthesized
tgctctagaaaaaacagtttgg

SEQ ID NO: 1307095 - DNA, 22 bp, Artificial Sequence
  chemically synthesized
ggaaattttgctctagaaaaaa

SEQ ID NO: 1307096 - DNA, 22 bp, Artificial Sequence
  chemically synthesized
taggaaattttgctctagaaaa

SEQ ID NO: 1307097 - DNA, 22 bp, Artificial Sequence
  chemically synthesized
ccaaactgttttttctagagca

SEQ ID NO: 1307098 - DNA, 22 bp, Artificial Sequence
  chemically synthesized
caaactgttttttctagagcaa

SEQ ID NO: 1307099 - DNA, 22 bp, Artificial Sequence
  chemically synthesized
gttctaggaaattttgctctag

SEQ ID NO: 1307100 - DNA, 22 bp, Artificial Sequence
  chemically synthesized
ggttctaggaaattttgctcta

SEQ ID NO: 1307101 - DNA, 22 bp, Artificial Sequence
  chemically synthesized
tggttctaggaaattttgctct

SEQ ID NO: 1307102 - DNA, 22 bp, Artificial Sequence
  chemically synthesized
ttttggttctaggaaattttgc

SEQ ID NO: 1307103 - DNA, 22 bp, Artificial Sequence
  chemically synthesized
ttttttctagagcaaaatttcc

SEQ ID NO: 1307104 - DNA, 22 bp, Artificial Sequence
  chemically synthesized
tttctagagcaaaatttcctag

SEQ ID NO: 1307105 - DNA, 22 bp, Artificial Sequence
  chemically synthesized
ttctagagcaaaatttcctaga

SEQ ID NO: 1307106 - DNA, 22 bp, Artificial Sequence
  chemically synthesized
tctagagcaaaatttcctagaa

SEQ ID NO: 1307107 - DNA, 22 bp, Artificial Sequence
  chemically synthesized
ctagagcaaaatttcctagaac

SEQ ID NO: 1307108 - DNA, 22 bp, Artificial Sequence
  chemically synthesized
aagattattttggttctaggaa

SEQ ID NO: 1307109 - DNA, 22 bp, Artificial Sequence
  chemically synthesized
tagagcaaaatttcctagaacc

SEQ ID NO: 1307110 - DNA, 22 bp, Artificial Sequence
  chemically synthesized
caagattattttggttctagga

SEQ ID NO: 1307111 - DNA, 22 bp, Artificial Sequence
  chemically synthesized
gagcaaaatttcctagaaccaa

SEQ ID NO: 1307112 - DNA, 22 bp, Artificial Sequence
  chemically synthesized
aaatttcaagattattttggtt

SEQ ID NO: 1307113 - DNA, 22 bp, Artificial Sequence
  chemically synthesized
atctaaaatttcaagattattt

SEQ ID NO: 1307114 - DNA, 22 bp, Artificial Sequence
  chemically synthesized
aatctaaaatttcaagattatt

SEQ ID NO: 1307115 - DNA, 22 bp, Artificial Sequence
  chemically synthesized
cctagaaccaaaataatcttga

SEQ ID NO: 1307116 - DNA, 22 bp, Artificial Sequence
  chemically synthesized
ctagaaccaaaataatcttgaa

SEQ ID NO: 1307117 - DNA, 22 bp, Artificial Sequence
  chemically synthesized
tttaatctaaaatttcaagatt

SEQ ID NO: 1307118 - DNA, 22 bp, Artificial Sequence
  chemically synthesized
gtttaatctaaaatttcaagat

SEQ ID NO: 1307119 - DNA, 22 bp, Artificial Sequence
  chemically synthesized
gaaccaaaataatcttgaaatt

SEQ ID NO: 1307120 - DNA, 22 bp, Artificial Sequence
  chemically synthesized
tgtttaatctaaaatttcaaga

SEQ ID NO: 1307121 - DNA, 22 bp, Artificial Sequence
  chemically synthesized
ctttgtttaatctaaaatttca

SEQ ID NO: 1307122 - DNA, 22 bp, Artificial Sequence
  chemically synthesized
gctttgtttaatctaaaatttc

SEQ ID NO: 1307123 - DNA, 22 bp, Artificial Sequence
  chemically synthesized
tgctttgtttaatctaaaattt

SEQ ID NO: 1307124 - DNA, 22 bp, Artificial Sequence
  chemically synthesized
ttttgctttgtttaatctaaaa

SEQ ID NO: 1307125 - DNA, 22 bp, Artificial Sequence
  chemically synthesized
atctgttttgctttgtttaatc

SEQ ID NO: 1307126 - DNA, 22 bp, Artificial Sequence
  chemically synthesized
aatctgttttgctttgtttaat

SEQ ID NO: 1307127 - DNA, 22 bp, Artificial Sequence
  chemically synthesized
gaaattttagattaaacaaagc

SEQ ID NO: 1307128 - DNA, 22 bp, Artificial Sequence
  chemically synthesized
aaattttagattaaacaaagca

SEQ ID NO: 1307129 - DNA, 22 bp, Artificial Sequence
  chemically synthesized
tagattaaacaaagcaaaacag

SEQ ID NO: 1307130 - DNA, 22 bp, Artificial Sequence
  chemically synthesized
agattaaacaaagcaaaacaga

SEQ ID NO: 1307131 - DNA, 22 bp, Artificial Sequence
  chemically synthesized
gaggtgatttaatctgttttgc

SEQ ID NO: 1307132 - DNA, 22 bp, Artificial Sequence
  chemically synthesized
gattaaacaaagcaaaacagat

SEQ ID NO: 1307133 - DNA, 22 bp, Artificial Sequence
  chemically synthesized
ggaggtgatttaatctgttttg

SEQ ID NO: 1307134 - DNA, 22 bp, Artificial Sequence
  chemically synthesized
aacaaagcaaaacagattaaat

SEQ ID NO: 1307135 - DNA, 22 bp, Artificial Sequence
  chemically synthesized
agaaacttggaggtgatttaat

SEQ ID NO: 1307136 - DNA, 22 bp, Artificial Sequence
  chemically synthesized
tgagaaacttggaggtgattta

SEQ ID NO: 1307137 - DNA, 22 bp, Artificial Sequence
  chemically synthesized
aagattctgagaaacttggagg

SEQ ID NO: 1307138 - DNA, 22 bp, Artificial Sequence
  chemically synthesized
aatcacctccaagtttctcaga

SEQ ID NO: 1307139 - DNA, 22 bp, Artificial Sequence
  chemically synthesized
tatgttgaagattctgagaaac

SEQ ID NO: 1307140 - DNA, 22 bp, Artificial Sequence
  chemically synthesized
gtatgttgaagattctgagaaa

SEQ ID NO: 1307141 - DNA, 22 bp, Artificial Sequence
  chemically synthesized
caagtttctcagaatcttcaac

SEQ ID NO: 1307142 - DNA, 22 bp, Artificial Sequence
  chemically synthesized
acagccatttgtatgttgaaga

SEQ ID NO: 1307143 - DNA, 22 bp, Artificial Sequence
  chemically synthesized
ctcagaatcttcaacatacaaa

SEQ ID NO: 1307144 - DNA, 22 bp, Artificial Sequence
  chemically synthesized
tcagaatcttcaacatacaaat

SEQ ID NO: 1307145 - DNA, 22 bp, Artificial Sequence
  chemically synthesized
agaatcttcaacatacaaatgg

SEQ ID NO: 1307146 - DNA, 22 bp, Artificial Sequence
  chemically synthesized
agatattaacagccatttgtat

SEQ ID NO: 1307147 - DNA, 22 bp, Artificial Sequence
  chemically synthesized
gagatattaacagccatttgta

SEQ ID NO: 1307148 - DNA, 22 bp, Artificial Sequence
  chemically synthesized
tgagatattaacagccatttgt

SEQ ID NO: 1307149 - DNA, 22 bp, Artificial Sequence
  chemically synthesized
ttgagatattaacagccatttg

SEQ ID NO: 1307150 - DNA, 22 bp, Artificial Sequence
  chemically synthesized
tttgagatattaacagccattt

SEQ ID NO: 1307151 - DNA, 22 bp, Artificial Sequence
  chemically synthesized
ctttttgagatattaacagcca

SEQ ID NO: 1307152 - DNA, 22 bp, Artificial Sequence
  chemically synthesized
caacatacaaatggctgttaat

SEQ ID NO: 1307153 - DNA, 22 bp, Artificial Sequence
  chemically synthesized
aacatacaaatggctgttaata

SEQ ID NO: 1307154 - DNA, 22 bp, Artificial Sequence
  chemically synthesized
ttcctttttgagatattaacag

SEQ ID NO: 1307155 - DNA, 22 bp, Artificial Sequence
  chemically synthesized
attcctttttgagatattaaca

SEQ ID NO: 1307156 - DNA, 22 bp, Artificial Sequence
  chemically synthesized
tattcctttttgagatattaac

SEQ ID NO: 1307157 - DNA, 22 bp, Artificial Sequence
  chemically synthesized
ttattcctttttgagatattaa

SEQ ID NO: 1307158 - DNA, 22 bp, Artificial Sequence
  chemically synthesized
ttaatatctcaaaaaggaataa

SEQ ID NO: 1307159 - DNA, 22 bp, Artificial Sequence
  chemically synthesized
gaaaaacagtttttattccttt

SEQ ID NO: 1307160 - DNA, 22 bp, Artificial Sequence
  chemically synthesized
ggaaaaacagtttttattcctt

SEQ ID NO: 1307161 - DNA, 22 bp, Artificial Sequence
  chemically synthesized
atatctcaaaaaggaataaaaa

SEQ ID NO: 1307162 - DNA, 22 bp, Artificial Sequence
  chemically synthesized
aaaaaggaataaaaactgtttt

SEQ ID NO: 1307163 - DNA, 22 bp, Artificial Sequence
  chemically synthesized
gtatatatttggaaaaacagtt

SEQ ID NO: 1307164 - DNA, 22 bp, Artificial Sequence
  chemically synthesized
tcgtatatatttggaaaaacag

SEQ ID NO: 1307165 - DNA, 22 bp, Artificial Sequence
  chemically synthesized
tttttccaaatatatacgagaa

SEQ ID NO: 1307166 - DNA, 22 bp, Artificial Sequence
  chemically synthesized
ttccaaatatatacgagaatga

SEQ ID NO: 1307167 - DNA, 22 bp, Artificial Sequence
  chemically synthesized
tccaaatatatacgagaatgac

SEQ ID NO: 1307168 - DNA, 22 bp, Artificial Sequence
  chemically synthesized
ccaaatatatacgagaatgact

SEQ ID NO: 1307169 - DNA, 22 bp, Artificial Sequence
  chemically synthesized
ggggagaaaaaaagtcattctc

SEQ ID NO: 1307170 - DNA, 22 bp, Artificial Sequence
  chemically synthesized
caaatatatacgagaatgactt

SEQ ID NO: 1307171 - DNA, 22 bp, Artificial Sequence
  chemically synthesized
taggggagaaaaaaagtcattc

SEQ ID NO: 1307172 - DNA, 22 bp, Artificial Sequence
  chemically synthesized
attctaggggagaaaaaaagtc

SEQ ID NO: 1307173 - DNA, 22 bp, Artificial Sequence
  chemically synthesized
gcatcaatagctaattctaggg

SEQ ID NO: 1307174 - DNA, 22 bp, Artificial Sequence
  chemically synthesized
ggcatcaatagctaattctagg

SEQ ID NO: 1307175 - DNA, 22 bp, Artificial Sequence
  chemically synthesized
tttttctcccctagaattagct

SEQ ID NO: 1307176 - DNA, 22 bp, Artificial Sequence
  chemically synthesized
ttttctcccctagaattagcta

SEQ ID NO: 1307177 - DNA, 22 bp, Artificial Sequence
  chemically synthesized
tttctcccctagaattagctat

SEQ ID NO: 1307178 - DNA, 22 bp, Artificial Sequence
  chemically synthesized
agcttggcatcaatagctaatt

SEQ ID NO: 1307179 - DNA, 22 bp, Artificial Sequence
  chemically synthesized
ttctcccctagaattagctatt

SEQ ID NO: 1307180 - DNA, 22 bp, Artificial Sequence
  chemically synthesized
tctcccctagaattagctattg

SEQ ID NO: 1307181 - DNA, 22 bp, Artificial Sequence
  chemically synthesized
ctcccctagaattagctattga

SEQ ID NO: 1307182 - DNA, 22 bp, Artificial Sequence
  chemically synthesized
tcccctagaattagctattgat

SEQ ID NO: 1307183 - DNA, 22 bp, Artificial Sequence
  chemically synthesized
ccctagaattagctattgatgc

SEQ ID NO: 1307184 - DNA, 22 bp, Artificial Sequence
  chemically synthesized
gaattagctattgatgccaagc

SEQ ID NO: 1307185 - DNA, 22 bp, Artificial Sequence
  chemically synthesized
tatgagaaacactgagcttggc

SEQ ID NO: 1307186 - DNA, 22 bp, Artificial Sequence
  chemically synthesized
gctattgatgccaagctcagtg

SEQ ID NO: 1307187 - DNA, 22 bp, Artificial Sequence
  chemically synthesized
aactatatgagaaacactgagc

SEQ ID NO: 1307188 - DNA, 22 bp, Artificial Sequence
  chemically synthesized
aaactatatgagaaacactgag

SEQ ID NO: 1307189 - DNA, 22 bp, Artificial Sequence
  chemically synthesized
ttgatgccaagctcagtgtttc

SEQ ID NO: 1307190 - DNA, 22 bp, Artificial Sequence
  chemically synthesized
taaactatatgagaaacactga

SEQ ID NO: 1307191 - DNA, 22 bp, Artificial Sequence
  chemically synthesized
atgccaagctcagtgtttctca

SEQ ID NO: 1307192 - DNA, 22 bp, Artificial Sequence
  chemically synthesized
cgtgtgttttaaactatatgag

SEQ ID NO: 1307193 - DNA, 22 bp, Artificial Sequence
  chemically synthesized
ccgtgtgttttaaactatatga

SEQ ID NO: 1307194 - DNA, 22 bp, Artificial Sequence
  chemically synthesized
cttccgtgtgttttaaactata

SEQ ID NO: 1307195 - DNA, 22 bp, Artificial Sequence
  chemically synthesized
agtgtttctcatatagtttaaa

SEQ ID NO: 1307196 - DNA, 22 bp, Artificial Sequence
  chemically synthesized
acttccgtgtgttttaaactat

SEQ ID NO: 1307197 - DNA, 22 bp, Artificial Sequence
  chemically synthesized
ctcatatagtttaaaacacacg

SEQ ID NO: 1307198 - DNA, 22 bp, Artificial Sequence
  chemically synthesized
tcatatagtttaaaacacacgg

SEQ ID NO: 1307199 - DNA, 22 bp, Artificial Sequence
  chemically synthesized
atatagtttaaaacacacggaa

SEQ ID NO: 1307200 - DNA, 22 bp, Artificial Sequence
  chemically synthesized
taagggaacagcaaatttactt

SEQ ID NO: 1307201 - DNA, 22 bp, Artificial Sequence
  chemically synthesized
aaaacacacggaagtaaatttg

SEQ ID NO: 1307202 - DNA, 22 bp, Artificial Sequence
  chemically synthesized
ataagggaacagcaaatttact

SEQ ID NO: 1307203 - DNA, 22 bp, Artificial Sequence
  chemically synthesized
aaacacacggaagtaaatttgc

SEQ ID NO: 1307204 - DNA, 22 bp, Artificial Sequence
  chemically synthesized
tcaggatatgtttataagggaa

SEQ ID NO: 1307205 - DNA, 22 bp, Artificial Sequence
  chemically synthesized
catattatcaggatatgtttat

SEQ ID NO: 1307206 - DNA, 22 bp, Artificial Sequence
  chemically synthesized
gctgttcccttataaacatatc

SEQ ID NO: 1307207 - DNA, 22 bp, Artificial Sequence
  chemically synthesized
ccatattatcaggatatgttta

SEQ ID NO: 1307208 - DNA, 22 bp, Artificial Sequence
  chemically synthesized
ctgttcccttataaacatatcc

SEQ ID NO: 1307209 - DNA, 22 bp, Artificial Sequence
  chemically synthesized
ttcccttataaacatatcctga

SEQ ID NO: 1307210 - DNA, 22 bp, Artificial Sequence
  chemically synthesized
ccttataaacatatcctgataa

SEQ ID NO: 1307211 - DNA, 22 bp, Artificial Sequence
  chemically synthesized
ataaacatatcctgataatatg

SEQ ID NO: 1307212 - DNA, 22 bp, Artificial Sequence
  chemically synthesized
aataaatgtttccatattatca

SEQ ID NO: 1307213 - DNA, 22 bp, Artificial Sequence
  chemically synthesized
taaacatatcctgataatatgg

SEQ ID NO: 1307214 - DNA, 22 bp, Artificial Sequence
  chemically synthesized
gttgaataaatgtttccatatt

SEQ ID NO: 1307215 - DNA, 22 bp, Artificial Sequence
  chemically synthesized
gttagttgaataaatgtttcca

SEQ ID NO: 1307216 - DNA, 22 bp, Artificial Sequence
  chemically synthesized
ttagttagttgaataaatgttt

SEQ ID NO: 1307217 - DNA, 22 bp, Artificial Sequence
  chemically synthesized
ataatatggaaacatttattca

SEQ ID NO: 1307218 - DNA, 22 bp, Artificial Sequence
  chemically synthesized
ttattagttagttgaataaatg

SEQ ID NO: 1307219 - DNA, 22 bp, Artificial Sequence
  chemically synthesized
gttattagttagttgaataaat

SEQ ID NO: 1307220 - DNA, 22 bp, Artificial Sequence
  chemically synthesized
tgttattagttagttgaataaa

SEQ ID NO: 1307221 - DNA, 22 bp, Artificial Sequence
  chemically synthesized
ttttgttattagttagttgaat

SEQ ID NO: 1307222 - DNA, 22 bp, Artificial Sequence
  chemically synthesized
cctgttttgttattagttagtt

SEQ ID NO: 1307223 - DNA, 22 bp, Artificial Sequence
  chemically synthesized
ttgcctgttttgttattagtta

SEQ ID NO: 1307224 - DNA, 22 bp, Artificial Sequence
  chemically synthesized
gttgcctgttttgttattagtt

SEQ ID NO: 1307225 - DNA, 22 bp, Artificial Sequence
  chemically synthesized
attcaactaactaataacaaaa

SEQ ID NO: 1307226 - DNA, 22 bp, Artificial Sequence
  chemically synthesized
atttgttgcctgttttgttatt

SEQ ID NO: 1307227 - DNA, 22 bp, Artificial Sequence
  chemically synthesized
ttcaactaactaataacaaaac

SEQ ID NO: 1307228 - DNA, 22 bp, Artificial Sequence
  chemically synthesized
aatttgttgcctgttttgttat

SEQ ID NO: 1307229 - DNA, 22 bp, Artificial Sequence
  chemically synthesized
taatttgttgcctgttttgtta

SEQ ID NO: 1307230 - DNA, 22 bp, Artificial Sequence
  chemically synthesized
aactaactaataacaaaacagg

SEQ ID NO: 1307231 - DNA, 22 bp, Artificial Sequence
  chemically synthesized
actaataacaaaacaggcaaca

SEQ ID NO: 1307232 - DNA, 22 bp, Artificial Sequence
  chemically synthesized
aatcagttttaatttgttgcct

SEQ ID NO: 1307233 - DNA, 22 bp, Artificial Sequence
  chemically synthesized
gaatcagttttaatttgttgcc

SEQ ID NO: 1307234 - DNA, 22 bp, Artificial Sequence
  chemically synthesized
ataacaaaacaggcaacaaatt

SEQ ID NO: 1307235 - DNA, 22 bp, Artificial Sequence
  chemically synthesized
tgaatcagttttaatttgttgc

SEQ ID NO: 1307236 - DNA, 22 bp, Artificial Sequence
  chemically synthesized
ccctttgaatcagttttaattt

SEQ ID NO: 1307237 - DNA, 22 bp, Artificial Sequence
  chemically synthesized
aattcccctttgaatcagtttt

SEQ ID NO: 1307238 - DNA, 22 bp, Artificial Sequence
  chemically synthesized
gaattcccctttgaatcagttt

SEQ ID NO: 1307239 - DNA, 22 bp, Artificial Sequence
  chemically synthesized
agtcccttgaattcccctttga

SEQ ID NO: 1307240 - DNA, 22 bp, Artificial Sequence
  chemically synthesized
aaactgattcaaaggggaattc

SEQ ID NO: 1307241 - DNA, 22 bp, Artificial Sequence
  chemically synthesized
tgtgtgttcagtcccttgaatt

SEQ ID NO: 1307242 - DNA, 22 bp, Artificial Sequence
  chemically synthesized
attcaaaggggaattcaaggga

SEQ ID NO: 1307243 - DNA, 22 bp, Artificial Sequence
  chemically synthesized
aaaggggaattcaagggactga

SEQ ID NO: 1307244 - DNA, 22 bp, Artificial Sequence
  chemically synthesized
tgactatgtgtgttcagtccct

SEQ ID NO: 1307245 - DNA, 22 bp, Artificial Sequence
  chemically synthesized
tgtgactatgtgtgttcagtcc

SEQ ID NO: 1307246 - DNA, 22 bp, Artificial Sequence
  chemically synthesized
ctgtgactatgtgtgttcagtc

SEQ ID NO: 1307247 - DNA, 22 bp, Artificial Sequence
  chemically synthesized
tctgtgactatgtgtgttcagt

SEQ ID NO: 1307248 - DNA, 22 bp, Artificial Sequence
  chemically synthesized
tttctgtgactatgtgtgttca

SEQ ID NO: 1307249 - DNA, 22 bp, Artificial Sequence
  chemically synthesized
ctttctgtgactatgtgtgttc

SEQ ID NO: 1307250 - DNA, 22 bp, Artificial Sequence
  chemically synthesized
tctttctgtgactatgtgtgtt

SEQ ID NO: 1307251 - DNA, 22 bp, Artificial Sequence
  chemically synthesized
ttctttctgtgactatgtgtgt

SEQ ID NO: 1307252 - DNA, 22 bp, Artificial Sequence
  chemically synthesized
tttctttctgtgactatgtgtg

SEQ ID NO: 1307253 - DNA, 22 bp, Artificial Sequence
  chemically synthesized
aagggactgaacacacatagtc

SEQ ID NO: 1307254 - DNA, 22 bp, Artificial Sequence
  chemically synthesized
tttttctttctgtgactatgtg

SEQ ID NO: 1307255 - DNA, 22 bp, Artificial Sequence
  chemically synthesized
ctttttctttctgtgactatgt

SEQ ID NO: 1307256 - DNA, 22 bp, Artificial Sequence
  chemically synthesized
gcttctttttctttctgtgact

SEQ ID NO: 1307257 - DNA, 22 bp, Artificial Sequence
  chemically synthesized
tagcttctttttctttctgtga

SEQ ID NO: 1307258 - DNA, 22 bp, Artificial Sequence
  chemically synthesized
aacacacatagtcacagaaaga

SEQ ID NO: 1307259 - DNA, 22 bp, Artificial Sequence
  chemically synthesized
ttctagcttctttttctttctg

SEQ ID NO: 1307260 - DNA, 22 bp, Artificial Sequence
  chemically synthesized
gttctagcttctttttctttct

SEQ ID NO: 1307261 - DNA, 22 bp, Artificial Sequence
  chemically synthesized
gcaatcttgttctagcttcttt

SEQ ID NO: 1307262 - DNA, 22 bp, Artificial Sequence
  chemically synthesized
agcaatcttgttctagcttctt

SEQ ID NO: 1307263 - DNA, 22 bp, Artificial Sequence
  chemically synthesized
acttagcaatcttgttctagct

SEQ ID NO: 1307264 - DNA, 22 bp, Artificial Sequence
  chemically synthesized
taacttagcaatcttgttctag

SEQ ID NO: 1307265 - DNA, 22 bp, Artificial Sequence
  chemically synthesized
ctaacttagcaatcttgttcta

SEQ ID NO: 1307266 - DNA, 22 bp, Artificial Sequence
  chemically synthesized
tttctaacttagcaatcttgtt

SEQ ID NO: 1307267 - DNA, 22 bp, Artificial Sequence
  chemically synthesized
gtttctaacttagcaatcttgt

SEQ ID NO: 1307268 - DNA, 22 bp, Artificial Sequence
  chemically synthesized
tgtttctaacttagcaatcttg

SEQ ID NO: 1307269 - DNA, 22 bp, Artificial Sequence
  chemically synthesized
ttttgtttctaacttagcaatc

SEQ ID NO: 1307270 - DNA, 22 bp, Artificial Sequence
  chemically synthesized
atctgttttgtttctaacttag

SEQ ID NO: 1307271 - DNA, 22 bp, Artificial Sequence
  chemically synthesized
gaacaagattgctaagttagaa

SEQ ID NO: 1307272 - DNA, 22 bp, Artificial Sequence
  chemically synthesized
atgttaatctgttttgtttcta

SEQ ID NO: 1307273 - DNA, 22 bp, Artificial Sequence
  chemically synthesized
gatgttaatctgttttgtttct

SEQ ID NO: 1307274 - DNA, 22 bp, Artificial Sequence
  chemically synthesized
tgatgttaatctgttttgtttc

SEQ ID NO: 1307275 - DNA, 22 bp, Artificial Sequence
  chemically synthesized
ttgatgttaatctgttttgttt

SEQ ID NO: 1307276 - DNA, 22 bp, Artificial Sequence
  chemically synthesized
tttgatgttaatctgttttgtt

SEQ ID NO: 1307277 - DNA, 22 bp, Artificial Sequence
  chemically synthesized
ctaagttagaaacaaaacagat

SEQ ID NO: 1307278 - DNA, 22 bp, Artificial Sequence
  chemically synthesized
agttagaaacaaaacagattaa

SEQ ID NO: 1307279 - DNA, 22 bp, Artificial Sequence
  chemically synthesized
cactttttgatgttaatctgtt

SEQ ID NO: 1307280 - DNA, 22 bp, Artificial Sequence
  chemically synthesized
ttgcactttttgatgttaatct

SEQ ID NO: 1307281 - DNA, 22 bp, Artificial Sequence
  chemically synthesized
attgcactttttgatgttaatc

SEQ ID NO: 1307282 - DNA, 22 bp, Artificial Sequence
  chemically synthesized
gaaacaaaacagattaacatca

SEQ ID NO: 1307283 - DNA, 22 bp, Artificial Sequence
  chemically synthesized
tattgcactttttgatgttaat

SEQ ID NO: 1307284 - DNA, 22 bp, Artificial Sequence
  chemically synthesized
aaaatatataattttattgcac

SEQ ID NO: 1307285 - DNA, 22 bp, Artificial Sequence
  chemically synthesized
acatcaaaaagtgcaataaaat

SEQ ID NO: 1307286 - DNA, 22 bp, Artificial Sequence
  chemically synthesized
gcaccctcaaaatatataattt

SEQ ID NO: 1307287 - DNA, 22 bp, Artificial Sequence
  chemically synthesized
tggcaccctcaaaatatataat

SEQ ID NO: 1307288 - DNA, 22 bp, Artificial Sequence
  chemically synthesized
ctggcaccctcaaaatatataa

SEQ ID NO: 1307289 - DNA, 22 bp, Artificial Sequence
  chemically synthesized
tctggcaccctcaaaatatata

SEQ ID NO: 1307290 - DNA, 22 bp, Artificial Sequence
  chemically synthesized
tatattttgagggtgccagaaa

SEQ ID NO: 1307291 - DNA, 22 bp, Artificial Sequence
  chemically synthesized
tgagggtgccagaaagatatta

SEQ ID NO: 1307292 - DNA, 22 bp, Artificial Sequence
  chemically synthesized
gagggtgccagaaagatattac

SEQ ID NO: 1307293 - DNA, 22 bp, Artificial Sequence
  chemically synthesized
agggtgccagaaagatattact

SEQ ID NO: 1307294 - DNA, 22 bp, Artificial Sequence
  chemically synthesized
agtagagagacaagtaatatct

SEQ ID NO: 1307295 - DNA, 22 bp, Artificial Sequence
  chemically synthesized
ttcagtagagagacaagtaata

SEQ ID NO: 1307296 - DNA, 22 bp, Artificial Sequence
  chemically synthesized
gttcagtagagagacaagtaat

SEQ ID NO: 1307297 - DNA, 22 bp, Artificial Sequence
  chemically synthesized
tgttcagtagagagacaagtaa

SEQ ID NO: 1307298 - DNA, 22 bp, Artificial Sequence
  chemically synthesized
ttgttcagtagagagacaagta

SEQ ID NO: 1307299 - DNA, 22 bp, Artificial Sequence
  chemically synthesized
cttgtctctctactgaacaaaa

SEQ ID NO: 1307300 - DNA, 22 bp, Artificial Sequence
  chemically synthesized
gtctctctactgaacaaaaatg

SEQ ID NO: 1307301 - DNA, 22 bp, Artificial Sequence
  chemically synthesized
cataaatgtacacatttttgtt

SEQ ID NO: 1307302 - DNA, 22 bp, Artificial Sequence
  chemically synthesized
tctctctactgaacaaaaatgt

SEQ ID NO: 1307303 - DNA, 22 bp, Artificial Sequence
  chemically synthesized
acataaatgtacacatttttgt

SEQ ID NO: 1307304 - DNA, 22 bp, Artificial Sequence
  chemically synthesized
tacataaatgtacacatttttg

SEQ ID NO: 1307305 - DNA, 22 bp, Artificial Sequence
  chemically synthesized
tctactgaacaaaaatgtgtac

SEQ ID NO: 1307306 - DNA, 22 bp, Artificial Sequence
  chemically synthesized
tactgaacaaaaatgtgtacat

SEQ ID NO: 1307307 - DNA, 22 bp, Artificial Sequence
  chemically synthesized
ctgaacaaaaatgtgtacattt

SEQ ID NO: 1307308 - DNA, 22 bp, Artificial Sequence
  chemically synthesized
agaaattttacataaatgtaca

SEQ ID NO: 1307309 - DNA, 22 bp, Artificial Sequence
  chemically synthesized
aacaaaaatgtgtacatttatg

SEQ ID NO: 1307310 - DNA, 22 bp, Artificial Sequence
  chemically synthesized
tgagaaattttacataaatgta

SEQ ID NO: 1307311 - DNA, 22 bp, Artificial Sequence
  chemically synthesized
gattctgagaaattttacataa

SEQ ID NO: 1307312 - DNA, 22 bp, Artificial Sequence
  chemically synthesized
agattctgagaaattttacata

SEQ ID NO: 1307313 - DNA, 22 bp, Artificial Sequence
  chemically synthesized
gggcttagattctgagaaattt

SEQ ID NO: 1307314 - DNA, 22 bp, Artificial Sequence
  chemically synthesized
attagggcttagattctgagaa

SEQ ID NO: 1307315 - DNA, 22 bp, Artificial Sequence
  chemically synthesized
atgtaaaatttctcagaatcta

SEQ ID NO: 1307316 - DNA, 22 bp, Artificial Sequence
  chemically synthesized
ttgattagggcttagattctga

SEQ ID NO: 1307317 - DNA, 22 bp, Artificial Sequence
  chemically synthesized
tgtaaaatttctcagaatctaa

SEQ ID NO: 1307318 - DNA, 22 bp, Artificial Sequence
  chemically synthesized
ctattgattagggcttagattc

SEQ ID NO: 1307319 - DNA, 22 bp, Artificial Sequence
  chemically synthesized
actattgattagggcttagatt

SEQ ID NO: 1307320 - DNA, 22 bp, Artificial Sequence
  chemically synthesized
ctcagaatctaagccctaatca

SEQ ID NO: 1307321 - DNA, 22 bp, Artificial Sequence
  chemically synthesized
tcagaatctaagccctaatcaa

SEQ ID NO: 1307322 - DNA, 22 bp, Artificial Sequence
  chemically synthesized
tagtatttactattgattaggg

SEQ ID NO: 1307323 - DNA, 22 bp, Artificial Sequence
  chemically synthesized
agaatctaagccctaatcaata

SEQ ID NO: 1307324 - DNA, 22 bp, Artificial Sequence
  chemically synthesized
agccctaatcaatagtaaatac

SEQ ID NO: 1307325 - DNA, 22 bp, Artificial Sequence
  chemically synthesized
tagtcaccctatagtatttact

SEQ ID NO: 1307326 - DNA, 22 bp, Artificial Sequence
  chemically synthesized
actatagtcaccctatagtatt

SEQ ID NO: 1307327 - DNA, 22 bp, Artificial Sequence
  chemically synthesized
atcaatagtaaatactataggg

SEQ ID NO: 1307328 - DNA, 22 bp, Artificial Sequence
  chemically synthesized
ttgactatagtcaccctatagt

SEQ ID NO: 1307329 - DNA, 22 bp, Artificial Sequence
  chemically synthesized
ttattgactatagtcaccctat

SEQ ID NO: 1307330 - DNA, 22 bp, Artificial Sequence
  chemically synthesized
tagggtgactatagtcaataat

SEQ ID NO: 1307331 - DNA, 22 bp, Artificial Sequence
  chemically synthesized
aaaatgtacaagtaagttatta

SEQ ID NO: 1307332 - DNA, 22 bp, Artificial Sequence
  chemically synthesized
aaaaatgtacaagtaagttatt

SEQ ID NO: 1307333 - DNA, 22 bp, Artificial Sequence
  chemically synthesized
tttaaaaatgtacaagtaagtt

SEQ ID NO: 1307334 - DNA, 22 bp, Artificial Sequence
  chemically synthesized
tagtcaataataacttacttgt

SEQ ID NO: 1307335 - DNA, 22 bp, Artificial Sequence
  chemically synthesized
gttatttaaaaatgtacaagta

SEQ ID NO: 1307336 - DNA, 22 bp, Artificial Sequence
  chemically synthesized
agttatttaaaaatgtacaagt

SEQ ID NO: 1307337 - DNA, 22 bp, Artificial Sequence
  chemically synthesized
ttagttatttaaaaatgtacaa

SEQ ID NO: 1307338 - DNA, 22 bp, Artificial Sequence
  chemically synthesized
tactcttagttatttaaaaatg

SEQ ID NO: 1307339 - DNA, 22 bp, Artificial Sequence
  chemically synthesized
acttgtacatttttaaataact

SEQ ID NO: 1307340 - DNA, 22 bp, Artificial Sequence
  chemically synthesized
cttgtacatttttaaataacta

SEQ ID NO: 1307341 - DNA, 22 bp, Artificial Sequence
  chemically synthesized
gtacatttttaaataactaaga

SEQ ID NO: 1307342 - DNA, 22 bp, Artificial Sequence
  chemically synthesized
tacatttttaaataactaagag

SEQ ID NO: 1307343 - DNA, 22 bp, Artificial Sequence
  chemically synthesized
caaacaatccagttatactctt

SEQ ID NO: 1307344 - DNA, 22 bp, Artificial Sequence
  chemically synthesized
ttaaataactaagagtataact

SEQ ID NO: 1307345 - DNA, 22 bp, Artificial Sequence
  chemically synthesized
taaataactaagagtataactg

SEQ ID NO: 1307346 - DNA, 22 bp, Artificial Sequence
  chemically synthesized
aaataactaagagtataactgg

SEQ ID NO: 1307347 - DNA, 22 bp, Artificial Sequence
  chemically synthesized
aataactaagagtataactgga

SEQ ID NO: 1307348 - DNA, 22 bp, Artificial Sequence
  chemically synthesized
tgttacaaacaatccagttata

SEQ ID NO: 1307349 - DNA, 22 bp, Artificial Sequence
  chemically synthesized
gtgttacaaacaatccagttat

SEQ ID NO: 1307350 - DNA, 22 bp, Artificial Sequence
  chemically synthesized
tgtgttacaaacaatccagtta

SEQ ID NO: 1307351 - DNA, 22 bp, Artificial Sequence
  chemically synthesized
tcctttgtgttacaaacaatcc

SEQ ID NO: 1307352 - DNA, 22 bp, Artificial Sequence
  chemically synthesized
agagtataactggattgtttgt

SEQ ID NO: 1307353 - DNA, 22 bp, Artificial Sequence
  chemically synthesized
atcctttgtgttacaaacaatc

SEQ ID NO: 1307354 - DNA, 22 bp, Artificial Sequence
  chemically synthesized
agcatttatcctttgtgttaca

SEQ ID NO: 1307355 - DNA, 22 bp, Artificial Sequence
  chemically synthesized
aagcatttatcctttgtgttac

SEQ ID NO: 1307356 - DNA, 22 bp, Artificial Sequence
  chemically synthesized
gattgtttgtaacacaaaggat

SEQ ID NO: 1307357 - DNA, 22 bp, Artificial Sequence
  chemically synthesized
ccttaagcatttatcctttgtg

SEQ ID NO: 1307358 - DNA, 22 bp, Artificial Sequence
  chemically synthesized
ttaccttaagcatttatccttt

SEQ ID NO: 1307359 - DNA, 22 bp, Artificial Sequence
  chemically synthesized
tttgtaacacaaaggataaatg

SEQ ID NO: 1307360 - DNA, 22 bp, Artificial Sequence
  chemically synthesized
gtaacacaaaggataaatgctt

SEQ ID NO: 1307361 - DNA, 22 bp, Artificial Sequence
  chemically synthesized
taacacaaaggataaatgctta

SEQ ID NO: 1307362 - DNA, 22 bp, Artificial Sequence
  chemically synthesized
tcacatcagaataaatggggca

SEQ ID NO: 1307363 - DNA, 22 bp, Artificial Sequence
  chemically synthesized
aaggtaatagatgccccattta

SEQ ID NO: 1307364 - DNA, 22 bp, Artificial Sequence
  chemically synthesized
aggtaatagatgccccatttat

SEQ ID NO: 1307365 - DNA, 22 bp, Artificial Sequence
  chemically synthesized
attctgatgtgataactatgca

SEQ ID NO: 1307366 - DNA, 22 bp, Artificial Sequence
  chemically synthesized
ttctgatgtgataactatgcat

SEQ ID NO: 1307367 - DNA, 22 bp, Artificial Sequence
  chemically synthesized
atacagacatacaatgcatagt

SEQ ID NO: 1307368 - DNA, 22 bp, Artificial Sequence
  chemically synthesized
gatacagacatacaatgcatag

SEQ ID NO: 1307369 - DNA, 22 bp, Artificial Sequence
  chemically synthesized
tgatgtgataactatgcattgt

SEQ ID NO: 1307370 - DNA, 22 bp, Artificial Sequence
  chemically synthesized
tgatacagacatacaatgcata

SEQ ID NO: 1307371 - DNA, 22 bp, Artificial Sequence
  chemically synthesized
atgtgataactatgcattgtat

SEQ ID NO: 1307372 - DNA, 22 bp, Artificial Sequence
  chemically synthesized
tgcattgtatgtctgtatcaaa

SEQ ID NO: 1307373 - DNA, 22 bp, Artificial Sequence
  chemically synthesized
gaagcacatgagatattttgat

SEQ ID NO: 1307374 - DNA, 22 bp, Artificial Sequence
  chemically synthesized
ggaagcacatgagatattttga

SEQ ID NO: 1307375 - DNA, 22 bp, Artificial Sequence
  chemically synthesized
tatgtctgtatcaaaatatctc

SEQ ID NO: 1307376 - DNA, 22 bp, Artificial Sequence
  chemically synthesized
tatcaaaatatctcatgtgctt

SEQ ID NO: 1307377 - DNA, 22 bp, Artificial Sequence
  chemically synthesized
atgtgcttccaaattatatgca

SEQ ID NO: 1307378 - DNA, 22 bp, Artificial Sequence
  chemically synthesized
tgggtacatagtaggtgcatat

SEQ ID NO: 1307379 - DNA, 22 bp, Artificial Sequence
  chemically synthesized
gtgggtacatagtaggtgcata

SEQ ID NO: 1307380 - DNA, 22 bp, Artificial Sequence
  chemically synthesized
tgtgggtacatagtaggtgcat

SEQ ID NO: 1307381 - DNA, 22 bp, Artificial Sequence
  chemically synthesized
ttgtgggtacatagtaggtgca

SEQ ID NO: 1307382 - DNA, 22 bp, Artificial Sequence
  chemically synthesized
tttgtgggtacatagtaggtgc

SEQ ID NO: 1307383 - DNA, 22 bp, Artificial Sequence
  chemically synthesized
ccaaattatatgcacctactat

SEQ ID NO: 1307384 - DNA, 22 bp, Artificial Sequence
  chemically synthesized
ttttgtgggtacatagtaggtg

SEQ ID NO: 1307385 - DNA, 22 bp, Artificial Sequence
  chemically synthesized
caaattatatgcacctactatg

SEQ ID NO: 1307386 - DNA, 22 bp, Artificial Sequence
  chemically synthesized
tatgcacctactatgtacccac

SEQ ID NO: 1307387 - DNA, 22 bp, Artificial Sequence
  chemically synthesized
aaagataatttttttgtgggta

SEQ ID NO: 1307388 - DNA, 22 bp, Artificial Sequence
  chemically synthesized
aaaagataatttttttgtgggt

SEQ ID NO: 1307389 - DNA, 22 bp, Artificial Sequence
  chemically synthesized
acttaaaagataatttttttgt

SEQ ID NO: 1307390 - DNA, 22 bp, Artificial Sequence
  chemically synthesized
ctatgtacccacaaaaaaatta

SEQ ID NO: 1307391 - DNA, 22 bp, Artificial Sequence
  chemically synthesized
tgtacccacaaaaaaattatct

SEQ ID NO: 1307392 - DNA, 22 bp, Artificial Sequence
  chemically synthesized
gtactaacttaaaagataattt

SEQ ID NO: 1307393 - DNA, 22 bp, Artificial Sequence
  chemically synthesized
agtactaacttaaaagataatt

SEQ ID NO: 1307394 - DNA, 22 bp, Artificial Sequence
  chemically synthesized
tataacttagtactaacttaaa

SEQ ID NO: 1307395 - DNA, 22 bp, Artificial Sequence
  chemically synthesized
gtataacttagtactaacttaa

SEQ ID NO: 1307396 - DNA, 22 bp, Artificial Sequence
  chemically synthesized
tgtataacttagtactaactta

SEQ ID NO: 1307397 - DNA, 22 bp, Artificial Sequence
  chemically synthesized
tcttttaagttagtactaagtt

SEQ ID NO: 1307398 - DNA, 22 bp, Artificial Sequence
  chemically synthesized
ttaagttagtactaagttatac

SEQ ID NO: 1307399 - DNA, 22 bp, Artificial Sequence
  chemically synthesized
taagttagtactaagttataca

SEQ ID NO: 1307400 - DNA, 22 bp, Artificial Sequence
  chemically synthesized
aagttagtactaagttatacaa

SEQ ID NO: 1307401 - DNA, 22 bp, Artificial Sequence
  chemically synthesized
agttagtactaagttatacaaa

SEQ ID NO: 1307402 - DNA, 22 bp, Artificial Sequence
  chemically synthesized
gggacatgcgtctttgtataac

SEQ ID NO: 1307403 - DNA, 22 bp, Artificial Sequence
  chemically synthesized
ttagggacatgcgtctttgtat

SEQ ID NO: 1307404 - DNA, 22 bp, Artificial Sequence
  chemically synthesized
gttagggacatgcgtctttgta

SEQ ID NO: 1307405 - DNA, 22 bp, Artificial Sequence
  chemically synthesized
gtactaagttatacaaagacgc

SEQ ID NO: 1307406 - DNA, 22 bp, Artificial Sequence
  chemically synthesized
atttgttagggacatgcgtctt

SEQ ID NO: 1307407 - DNA, 22 bp, Artificial Sequence
  chemically synthesized
aatttgttagggacatgcgtct

SEQ ID NO: 1307408 - DNA, 22 bp, Artificial Sequence
  chemically synthesized
agttatacaaagacgcatgtcc

SEQ ID NO: 1307409 - DNA, 22 bp, Artificial Sequence
  chemically synthesized
tacaaagacgcatgtccctaac

SEQ ID NO: 1307410 - DNA, 22 bp, Artificial Sequence
  chemically synthesized
ccgacagatagtttaatttgtt

SEQ ID NO: 1307411 - DNA, 22 bp, Artificial Sequence
  chemically synthesized
aaagatctaccgacagatagtt

SEQ ID NO: 1307412 - DNA, 22 bp, Artificial Sequence
  chemically synthesized
acaaattaaactatctgtcggt

SEQ ID NO: 1307413 - DNA, 22 bp, Artificial Sequence
  chemically synthesized
tctaaaagatctaccgacagat

SEQ ID NO: 1307414 - DNA, 22 bp, Artificial Sequence
  chemically synthesized
aactatctgtcggtagatcttt

SEQ ID NO: 1307415 - DNA, 22 bp, Artificial Sequence
  chemically synthesized
aaaagtattgtctaaaagatct

SEQ ID NO: 1307416 - DNA, 22 bp, Artificial Sequence
  chemically synthesized
tctgtcggtagatcttttagac

SEQ ID NO: 1307417 - DNA, 22 bp, Artificial Sequence
  chemically synthesized
tcggtagatcttttagacaata

SEQ ID NO: 1307418 - DNA, 22 bp, Artificial Sequence
  chemically synthesized
tcatactaaaaagtattgtcta

SEQ ID NO: 1307419 - DNA, 22 bp, Artificial Sequence
  chemically synthesized
ttatcatactaaaaagtattgt

SEQ ID NO: 1307420 - DNA, 22 bp, Artificial Sequence
  chemically synthesized
attatcatactaaaaagtattg

SEQ ID NO: 1307421 - DNA, 22 bp, Artificial Sequence
  chemically synthesized
tattatcatactaaaaagtatt

SEQ ID NO: 1307422 - DNA, 22 bp, Artificial Sequence
  chemically synthesized
ttattatcatactaaaaagtat

SEQ ID NO: 1307423 - DNA, 22 bp, Artificial Sequence
  chemically synthesized
ttttattatcatactaaaaagt

SEQ ID NO: 1307424 - DNA, 22 bp, Artificial Sequence
  chemically synthesized
ttagacaatactttttagtatg

SEQ ID NO: 1307425 - DNA, 22 bp, Artificial Sequence
  chemically synthesized
tagacaatactttttagtatga

SEQ ID NO: 1307426 - DNA, 22 bp, Artificial Sequence
  chemically synthesized
agacaatactttttagtatgat

SEQ ID NO: 1307427 - DNA, 22 bp, Artificial Sequence
  chemically synthesized
gacaatactttttagtatgata

SEQ ID NO: 1307428 - DNA, 22 bp, Artificial Sequence
  chemically synthesized
tttagtatgataataaaagaac

SEQ ID NO: 1307429 - DNA, 22 bp, Artificial Sequence
  chemically synthesized
ttagtatgataataaaagaaca

SEQ ID NO: 1307430 - DNA, 22 bp, Artificial Sequence
  chemically synthesized
tagtatgataataaaagaacat

SEQ ID NO: 1307431 - DNA, 22 bp, Artificial Sequence
  chemically synthesized
agtatgataataaaagaacatc

SEQ ID NO: 1307432 - DNA, 22 bp, Artificial Sequence
  chemically synthesized
gtatgataataaaagaacatct

SEQ ID NO: 1307433 - DNA, 22 bp, Artificial Sequence
  chemically synthesized
gaaataaggcaaaagaacaagt

SEQ ID NO: 1307434 - DNA, 22 bp, Artificial Sequence
  chemically synthesized
ggaaataaggcaaaagaacaag

SEQ ID NO: 1307435 - DNA, 22 bp, Artificial Sequence
  chemically synthesized
aaacttggaaataaggcaaaag

SEQ ID NO: 1307436 - DNA, 22 bp, Artificial Sequence
  chemically synthesized
taaaacttggaaataaggcaaa

SEQ ID NO: 1307437 - DNA, 22 bp, Artificial Sequence
  chemically synthesized
cttgttcttttgccttatttcc

SEQ ID NO: 1307438 - DNA, 22 bp, Artificial Sequence
  chemically synthesized
aactctaaaacttggaaataag

SEQ ID NO: 1307439 - DNA, 22 bp, Artificial Sequence
  chemically synthesized
gttcttttgccttatttccaag

SEQ ID NO: 1307440 - DNA, 22 bp, Artificial Sequence
  chemically synthesized
ttcttttgccttatttccaagt

SEQ ID NO: 1307441 - DNA, 22 bp, Artificial Sequence
  chemically synthesized
ttaaactctaaaacttggaaat

SEQ ID NO: 1307442 - DNA, 22 bp, Artificial Sequence
  chemically synthesized
gttaaactctaaaacttggaaa

SEQ ID NO: 1307443 - DNA, 22 bp, Artificial Sequence
  chemically synthesized
ttttgccttatttccaagtttt

SEQ ID NO: 1307444 - DNA, 22 bp, Artificial Sequence
  chemically synthesized
ttgccttatttccaagttttag

SEQ ID NO: 1307445 - DNA, 22 bp, Artificial Sequence
  chemically synthesized
tgccttatttccaagttttaga

SEQ ID NO: 1307446 - DNA, 22 bp, Artificial Sequence
  chemically synthesized
gccttatttccaagttttagag

SEQ ID NO: 1307447 - DNA, 22 bp, Artificial Sequence
  chemically synthesized
aagcttgttaaactctaaaact

SEQ ID NO: 1307448 - DNA, 22 bp, Artificial Sequence
  chemically synthesized
ccttatttccaagttttagagt

SEQ ID NO: 1307449 - DNA, 22 bp, Artificial Sequence
  chemically synthesized
atttccaagttttagagtttaa

SEQ ID NO: 1307450 - DNA, 22 bp, Artificial Sequence
  chemically synthesized
tttccaagttttagagtttaac

SEQ ID NO: 1307451 - DNA, 22 bp, Artificial Sequence
  chemically synthesized
ccaagttttagagtttaacaag

SEQ ID NO: 1307452 - DNA, 22 bp, Artificial Sequence
  chemically synthesized
caagttttagagtttaacaagc

SEQ ID NO: 1307453 - DNA, 22 bp, Artificial Sequence
  chemically synthesized
tgacacattcaagcttgttaaa

SEQ ID NO: 1307454 - DNA, 22 bp, Artificial Sequence
  chemically synthesized
tagagtttaacaagcttgaatg

SEQ ID NO: 1307455 - DNA, 22 bp, Artificial Sequence
  chemically synthesized
agagtttaacaagcttgaatgt

SEQ ID NO: 1307456 - DNA, 22 bp, Artificial Sequence
  chemically synthesized
gagtttaacaagcttgaatgtg

SEQ ID NO: 1307457 - DNA, 22 bp, Artificial Sequence
  chemically synthesized
aatgagtaattatgacacattc

SEQ ID NO: 1307458 - DNA, 22 bp, Artificial Sequence
  chemically synthesized
aacaagcttgaatgtgtcataa

SEQ ID NO: 1307459 - DNA, 22 bp, Artificial Sequence
  chemically synthesized
acaagcttgaatgtgtcataat

SEQ ID NO: 1307460 - DNA, 22 bp, Artificial Sequence
  chemically synthesized
gaatgtgtcataattactcatt

SEQ ID NO: 1307461 - DNA, 22 bp, Artificial Sequence
  chemically synthesized
cgtgagtaattaaatgagtaat

SEQ ID NO: 1307462 - DNA, 22 bp, Artificial Sequence
  chemically synthesized
aatgtgtcataattactcattt

SEQ ID NO: 1307463 - DNA, 22 bp, Artificial Sequence
  chemically synthesized
agtaattacgtgagtaattaaa

SEQ ID NO: 1307464 - DNA, 22 bp, Artificial Sequence
  chemically synthesized
aagtaattacgtgagtaattaa

SEQ ID NO: 1307465 - DNA, 22 bp, Artificial Sequence
  chemically synthesized
acacttaagtaattacgtgagt

SEQ ID NO: 1307466 - DNA, 22 bp, Artificial Sequence
  chemically synthesized
ctcatttaattactcacgtaat

SEQ ID NO: 1307467 - DNA, 22 bp, Artificial Sequence
  chemically synthesized
atttaattactcacgtaattac

SEQ ID NO: 1307468 - DNA, 22 bp, Artificial Sequence
  chemically synthesized
aattactcacgtaattacttaa

SEQ ID NO: 1307469 - DNA, 22 bp, Artificial Sequence
  chemically synthesized
attactcacgtaattacttaag

SEQ ID NO: 1307470 - DNA, 22 bp, Artificial Sequence
  chemically synthesized
ctcacgtaattacttaagtgtc

SEQ ID NO: 1307471 - DNA, 22 bp, Artificial Sequence
  chemically synthesized
acgtaattacttaagtgtcagg

SEQ ID NO: 1307472 - DNA, 22 bp, Artificial Sequence
  chemically synthesized
gtccccagcacaatgcctgaca

SEQ ID NO: 1307473 - DNA, 22 bp, Artificial Sequence
  chemically synthesized
cctagtccccagcacaatgcct

SEQ ID NO: 1307474 - DNA, 22 bp, Artificial Sequence
  chemically synthesized
cttaagtgtcaggcattgtgct

SEQ ID NO: 1307475 - DNA, 22 bp, Artificial Sequence
  chemically synthesized
aagtgtcaggcattgtgctggg

SEQ ID NO: 1307476 - DNA, 22 bp, Artificial Sequence
  chemically synthesized
agtgtcaggcattgtgctgggg

SEQ ID NO: 1307477 - DNA, 22 bp, Artificial Sequence
  chemically synthesized
tcatctccctagtccccagcac

SEQ ID NO: 1307478 - DNA, 22 bp, Artificial Sequence
  chemically synthesized
cctatcatctccctagtcccca

SEQ ID NO: 1307479 - DNA, 22 bp, Artificial Sequence
  chemically synthesized
tccagttccctatcatctccct

SEQ ID NO: 1307480 - DNA, 22 bp, Artificial Sequence
  chemically synthesized
tgctggggactagggagatgat

SEQ ID NO: 1307481 - DNA, 22 bp, Artificial Sequence
  chemically synthesized
atccagttccctatcatctccc

SEQ ID NO: 1307482 - DNA, 22 bp, Artificial Sequence
  chemically synthesized
gggactagggagatgataggga

SEQ ID NO: 1307483 - DNA, 22 bp, Artificial Sequence
  chemically synthesized
gggagatgatagggaactggat

SEQ ID NO: 1307484 - DNA, 22 bp, Artificial Sequence
  chemically synthesized
aaaagtatgggcatttatccag

SEQ ID NO: 1307485 - DNA, 22 bp, Artificial Sequence
  chemically synthesized
taaaaagtatgggcatttatcc

SEQ ID NO: 1307486 - DNA, 22 bp, Artificial Sequence
  chemically synthesized
ctaaaaagtatgggcatttatc

SEQ ID NO: 1307487 - DNA, 22 bp, Artificial Sequence
  chemically synthesized
gtaagcttctaaaaagtatggg

SEQ ID NO: 1307488 - DNA, 22 bp, Artificial Sequence
  chemically synthesized
gataaatgcccatactttttag

SEQ ID NO: 1307489 - DNA, 22 bp, Artificial Sequence
  chemically synthesized
attagtaagcttctaaaaagta

SEQ ID NO: 1307490 - DNA, 22 bp, Artificial Sequence
  chemically synthesized
tccctcattagtaagcttctaa

SEQ ID NO: 1307491 - DNA, 22 bp, Artificial Sequence
  chemically synthesized
catgtcattatccctcattagt

SEQ ID NO: 1307492 - DNA, 22 bp, Artificial Sequence
  chemically synthesized
tttagaagcttactaatgaggg

SEQ ID NO: 1307493 - DNA, 22 bp, Artificial Sequence
  chemically synthesized
acatgtcattatccctcattag

SEQ ID NO: 1307494 - DNA, 22 bp, Artificial Sequence
  chemically synthesized
ttagaagcttactaatgaggga

SEQ ID NO: 1307495 - DNA, 22 bp, Artificial Sequence
  chemically synthesized
tagaagcttactaatgagggat

SEQ ID NO: 1307496 - DNA, 22 bp, Artificial Sequence
  chemically synthesized
agaagcttactaatgagggata

SEQ ID NO: 1307497 - DNA, 22 bp, Artificial Sequence
  chemically synthesized
tttacatgtcattatccctcat

SEQ ID NO: 1307498 - DNA, 22 bp, Artificial Sequence
  chemically synthesized
gaagcttactaatgagggataa

SEQ ID NO: 1307499 - DNA, 22 bp, Artificial Sequence
  chemically synthesized
ctgtttacatgtcattatccct

SEQ ID NO: 1307500 - DNA, 22 bp, Artificial Sequence
  chemically synthesized
cctgtttacatgtcattatccc

SEQ ID NO: 1307501 - DNA, 22 bp, Artificial Sequence
  chemically synthesized
actaatgagggataatgacatg

SEQ ID NO: 1307502 - DNA, 22 bp, Artificial Sequence
  chemically synthesized
ctaatgagggataatgacatgt

SEQ ID NO: 1307503 - DNA, 22 bp, Artificial Sequence
  chemically synthesized
caatttcctgtttacatgtcat

SEQ ID NO: 1307504 - DNA, 22 bp, Artificial Sequence
  chemically synthesized
gcaatttcctgtttacatgtca

SEQ ID NO: 1307505 - DNA, 22 bp, Artificial Sequence
  chemically synthesized
atgagggataatgacatgtaaa

SEQ ID NO: 1307506 - DNA, 22 bp, Artificial Sequence
  chemically synthesized
tgcaatttcctgtttacatgtc

SEQ ID NO: 1307507 - DNA, 22 bp, Artificial Sequence
  chemically synthesized
acatacatcaaaccactttgca

SEQ ID NO: 1307508 - DNA, 22 bp, Artificial Sequence
  chemically synthesized
aacatacatcaaaccactttgc

SEQ ID NO: 1307509 - DNA, 22 bp, Artificial Sequence
  chemically synthesized
taacatacatcaaaccactttg

SEQ ID NO: 1307510 - DNA, 22 bp, Artificial Sequence
  chemically synthesized
tgttttaacatacatcaaacca

SEQ ID NO: 1307511 - DNA, 22 bp, Artificial Sequence
  chemically synthesized
caaagtggtttgatgtatgtta

SEQ ID NO: 1307512 - DNA, 22 bp, Artificial Sequence
  chemically synthesized
gatgtatgttaaaacatagtta

SEQ ID NO: 1307513 - DNA, 22 bp, Artificial Sequence
  chemically synthesized
atgtatgttaaaacatagttac

SEQ ID NO: 1307514 - DNA, 22 bp, Artificial Sequence
  chemically synthesized
aaacatagttactgtgggccgg

SEQ ID NO: 1307515 - DNA, 22 bp, Artificial Sequence
  chemically synthesized
caggcatgagccaccgcgcccg

SEQ ID NO: 1307516 - DNA, 22 bp, Artificial Sequence
  chemically synthesized
ctgtgggccgggcgcggtggct

SEQ ID NO: 1307517 - DNA, 22 bp, Artificial Sequence
  chemically synthesized
tgggccgggcgcggtggctcat

SEQ ID NO: 1307518 - DNA, 22 bp, Artificial Sequence
  chemically synthesized
tgggattacaggcatgagccac

SEQ ID NO: 1307519 - DNA, 22 bp, Artificial Sequence
  chemically synthesized
ccaaagttatgggattacaggc

SEQ ID NO: 1307520 - DNA, 22 bp, Artificial Sequence
  chemically synthesized
agcctcccaaagttatgggatt

SEQ ID NO: 1307521 - DNA, 22 bp, Artificial Sequence
  chemically synthesized
atgcctgtaatcccataacttt

SEQ ID NO: 1307522 - DNA, 22 bp, Artificial Sequence
  chemically synthesized
taatcccataactttgggaggc

SEQ ID NO: 1307523 - DNA, 22 bp, Artificial Sequence
  chemically synthesized
gtgatccgcccgcctcagcctc

SEQ ID NO: 1307524 - DNA, 22 bp, Artificial Sequence
  chemically synthesized
acctcgtgatccgcccgcctca

SEQ ID NO: 1307525 - DNA, 22 bp, Artificial Sequence
  chemically synthesized
ctgacctcgtgatccgcccgcc

SEQ ID NO: 1307526 - DNA, 22 bp, Artificial Sequence
  chemically synthesized
tgggaggctgaggcgggcggat

SEQ ID NO: 1307527 - DNA, 22 bp, Artificial Sequence
  chemically synthesized
gggaggctgaggcgggcggatc

SEQ ID NO: 1307528 - DNA, 22 bp, Artificial Sequence
  chemically synthesized
ggaggctgaggcgggcggatca

SEQ ID NO: 1307529 - DNA, 22 bp, Artificial Sequence
  chemically synthesized
gaactcctgacctcgtgatccg

SEQ ID NO: 1307530 - DNA, 22 bp, Artificial Sequence
  chemically synthesized
aggcgggcggatcacgaggtca

SEQ ID NO: 1307531 - DNA, 22 bp, Artificial Sequence
  chemically synthesized
gtctcgaactcctgacctcgtg

SEQ ID NO: 1307532 - DNA, 22 bp, Artificial Sequence
  chemically synthesized
gccaggctggtctcgaactcct

SEQ ID NO: 1307533 - DNA, 22 bp, Artificial Sequence
  chemically synthesized
accatattggccaggctggtct

SEQ ID NO: 1307534 - DNA, 22 bp, Artificial Sequence
  chemically synthesized
caccatattggccaggctggtc

SEQ ID NO: 1307535 - DNA, 22 bp, Artificial Sequence
  chemically synthesized
gagaccagcctggccaatatgg

SEQ ID NO: 1307536 - DNA, 22 bp, Artificial Sequence
  chemically synthesized
gtagagacggagtttcaccata

SEQ ID NO: 1307537 - DNA, 22 bp, Artificial Sequence
  chemically synthesized
agtagagacggagtttcaccat

SEQ ID NO: 1307538 - DNA, 22 bp, Artificial Sequence
  chemically synthesized
tagtagagacggagtttcacca

SEQ ID NO: 1307539 - DNA, 22 bp, Artificial Sequence
  chemically synthesized
ttagtagagacggagtttcacc

SEQ ID NO: 1307540 - DNA, 22 bp, Artificial Sequence
  chemically synthesized
tttagtagagacggagtttcac

SEQ ID NO: 1307541 - DNA, 22 bp, Artificial Sequence
  chemically synthesized
ttttagtagagacggagtttca

SEQ ID NO: 1307542 - DNA, 22 bp, Artificial Sequence
  chemically synthesized
gccaatatggtgaaactccgtc

SEQ ID NO: 1307543 - DNA, 22 bp, Artificial Sequence
  chemically synthesized
tatttttttagtagagacggag

SEQ ID NO: 1307544 - DNA, 22 bp, Artificial Sequence
  chemically synthesized
gtatttttttagtagagacgga

SEQ ID NO: 1307545 - DNA, 22 bp, Artificial Sequence
  chemically synthesized
tgtatttttttagtagagacgg

SEQ ID NO: 1307546 - DNA, 22 bp, Artificial Sequence
  chemically synthesized
ttgtatttttttagtagagacg

SEQ ID NO: 1307547 - DNA, 22 bp, Artificial Sequence
  chemically synthesized
atttttgtatttttttagtaga

SEQ ID NO: 1307548 - DNA, 22 bp, Artificial Sequence
  chemically synthesized
cgtctctactaaaaaaatacaa

SEQ ID NO: 1307549 - DNA, 22 bp, Artificial Sequence
  chemically synthesized
tactaaaaaaatacaaaaatta

SEQ ID NO: 1307550 - DNA, 22 bp, Artificial Sequence
  chemically synthesized
ctaaaaaaatacaaaaattagc

SEQ ID NO: 1307551 - DNA, 22 bp, Artificial Sequence
  chemically synthesized
aaaaaatacaaaaattagccgg

SEQ ID NO: 1307552 - DNA, 22 bp, Artificial Sequence
  chemically synthesized
caggtgcgtgccaccatgcccg

SEQ ID NO: 1307553 - DNA, 22 bp, Artificial Sequence
  chemically synthesized
ggactacaggtgcgtgccacca

SEQ ID NO: 1307554 - DNA, 22 bp, Artificial Sequence
  chemically synthesized
gccgggcatggtggcacgcacc

SEQ ID NO: 1307555 - DNA, 22 bp, Artificial Sequence
  chemically synthesized
ccgagtagctgggactacaggt

SEQ ID NO: 1307556 - DNA, 22 bp, Artificial Sequence
  chemically synthesized
agcctcccgagtagctgggact

SEQ ID NO: 1307557 - DNA, 22 bp, Artificial Sequence
  chemically synthesized
tctcagcctcccgagtagctgg

SEQ ID NO: 1307558 - DNA, 22 bp, Artificial Sequence
  chemically synthesized
tgtctcagcctcccgagtagct

SEQ ID NO: 1307559 - DNA, 22 bp, Artificial Sequence
  chemically synthesized
ctgtctcagcctcccgagtagc

SEQ ID NO: 1307560 - DNA, 22 bp, Artificial Sequence
  chemically synthesized
ttctgtctcagcctcccgagta

SEQ ID NO: 1307561 - DNA, 22 bp, Artificial Sequence
  chemically synthesized
tagtcccagctactcgggaggc

SEQ ID NO: 1307562 - DNA, 22 bp, Artificial Sequence
  chemically synthesized
aagcgattcttctgtctcagcc

SEQ ID NO: 1307563 - DNA, 22 bp, Artificial Sequence
  chemically synthesized
ctcgggaggctgagacagaaga

SEQ ID NO: 1307564 - DNA, 22 bp, Artificial Sequence
  chemically synthesized
gggaggctgagacagaagaatc

SEQ ID NO: 1307565 - DNA, 22 bp, Artificial Sequence
  chemically synthesized
ccgagttcaagcgattcttctg

SEQ ID NO: 1307566 - DNA, 22 bp, Artificial Sequence
  chemically synthesized
cgcctcccgagttcaagcgatt

SEQ ID NO: 1307567 - DNA, 22 bp, Artificial Sequence
  chemically synthesized
agacagaagaatcgcttgaact

SEQ ID NO: 1307568 - DNA, 22 bp, Artificial Sequence
  chemically synthesized
caacctccgcctcccgagttca

SEQ ID NO: 1307569 - DNA, 22 bp, Artificial Sequence
  chemically synthesized
actgcaacctccgcctcccgag

SEQ ID NO: 1307570 - DNA, 22 bp, Artificial Sequence
  chemically synthesized
ggctcactgcaacctccgcctc

SEQ ID NO: 1307571 - DNA, 22 bp, Artificial Sequence
  chemically synthesized
gaactcgggaggcggaggttgc

SEQ ID NO: 1307572 - DNA, 22 bp, Artificial Sequence
  chemically synthesized
aactcgggaggcggaggttgca

SEQ ID NO: 1307573 - DNA, 22 bp, Artificial Sequence
  chemically synthesized
gggaggcggaggttgcagtgag

SEQ ID NO: 1307574 - DNA, 22 bp, Artificial Sequence
  chemically synthesized
gagtgcagtggtgtgatctcgg

SEQ ID NO: 1307575 - DNA, 22 bp, Artificial Sequence
  chemically synthesized
cagtgagccgagatcacaccac

SEQ ID NO: 1307576 - DNA, 22 bp, Artificial Sequence
  chemically synthesized
tcacccaggctggagtgcagtg

SEQ ID NO: 1307577 - DNA, 22 bp, Artificial Sequence
  chemically synthesized
tgtcacccaggctggagtgcag

SEQ ID NO: 1307578 - DNA, 22 bp, Artificial Sequence
  chemically synthesized
ctctgtcacccaggctggagtg

SEQ ID NO: 1307579 - DNA, 22 bp, Artificial Sequence
  chemically synthesized
gctctgtcacccaggctggagt

SEQ ID NO: 1307580 - DNA, 22 bp, Artificial Sequence
  chemically synthesized
cactccagcctgggtgacagag

SEQ ID NO: 1307581 - DNA, 22 bp, Artificial Sequence
  chemically synthesized
agatggagtcttgctctgtcac

SEQ ID NO: 1307582 - DNA, 22 bp, Artificial Sequence
  chemically synthesized
gagatggagtcttgctctgtca

SEQ ID NO: 1307583 - DNA, 22 bp, Artificial Sequence
  chemically synthesized
tgagatggagtcttgctctgtc

SEQ ID NO: 1307584 - DNA, 22 bp, Artificial Sequence
  chemically synthesized
ttgagatggagtcttgctctgt

SEQ ID NO: 1307585 - DNA, 22 bp, Artificial Sequence
  chemically synthesized
cagcctgggtgacagagcaaga

SEQ ID NO: 1307586 - DNA, 22 bp, Artificial Sequence
  chemically synthesized
tttgagatggagtcttgctctg

SEQ ID NO: 1307587 - DNA, 22 bp, Artificial Sequence
  chemically synthesized
ttttgagatggagtcttgctct

SEQ ID NO: 1307588 - DNA, 22 bp, Artificial Sequence
  chemically synthesized
tttttgagatggagtcttgctc

SEQ ID NO: 1307589 - DNA, 22 bp, Artificial Sequence
  chemically synthesized
tttttttgagatggagtcttgc

SEQ ID NO: 1307590 - DNA, 22 bp, Artificial Sequence
  chemically synthesized
ctttttttgagatggagtcttg

SEQ ID NO: 1307591 - DNA, 22 bp, Artificial Sequence
  chemically synthesized
tctttttttgagatggagtctt

SEQ ID NO: 1307592 - DNA, 22 bp, Artificial Sequence
  chemically synthesized
ggtgacagagcaagactccatc

SEQ ID NO: 1307593 - DNA, 22 bp, Artificial Sequence
  chemically synthesized
ttctttttttgagatggagtct

SEQ ID NO: 1307594 - DNA, 22 bp, Artificial Sequence
  chemically synthesized
ttttctttttttgagatggagt

SEQ ID NO: 1307595 - DNA, 22 bp, Artificial Sequence
  chemically synthesized
cttttctttttttgagatggag

SEQ ID NO: 1307596 - DNA, 22 bp, Artificial Sequence
  chemically synthesized
tcttttctttttttgagatgga

SEQ ID NO: 1307597 - DNA, 22 bp, Artificial Sequence
  chemically synthesized
tttcttttctttttttgagatg

SEQ ID NO: 1307598 - DNA, 22 bp, Artificial Sequence
  chemically synthesized
ctttcttttctttttttgagat

SEQ ID NO: 1307599 - DNA, 22 bp, Artificial Sequence
  chemically synthesized
tctttcttttctttttttgaga

SEQ ID NO: 1307600 - DNA, 22 bp, Artificial Sequence
  chemically synthesized
tttctttcttttctttttttga

SEQ ID NO: 1307601 - DNA, 22 bp, Artificial Sequence
  chemically synthesized
ctttctttcttttctttttttg

SEQ ID NO: 1307602 - DNA, 22 bp, Artificial Sequence
  chemically synthesized
tctttctttcttttcttttttt

SEQ ID NO: 1307603 - DNA, 22 bp, Artificial Sequence
  chemically synthesized
ttttctttctttcttttctttt

SEQ ID NO: 1307604 - DNA, 22 bp, Artificial Sequence
  chemically synthesized
gttttctttctttcttttcttt

SEQ ID NO: 1307605 - DNA, 22 bp, Artificial Sequence
  chemically synthesized
tgttttctttctttcttttctt

SEQ ID NO: 1307606 - DNA, 22 bp, Artificial Sequence
  chemically synthesized
catctcaaaaaaagaaaagaaa

SEQ ID NO: 1307607 - DNA, 22 bp, Artificial Sequence
  chemically synthesized
ttgttttctttctttcttttct

SEQ ID NO: 1307608 - DNA, 22 bp, Artificial Sequence
  chemically synthesized
tttgttttctttctttcttttc

SEQ ID NO: 1307609 - DNA, 22 bp, Artificial Sequence
  chemically synthesized
tttttgttttctttctttcttt

SEQ ID NO: 1307610 - DNA, 22 bp, Artificial Sequence
  chemically synthesized
ctttttgttttctttctttctt

SEQ ID NO: 1307611 - DNA, 22 bp, Artificial Sequence
  chemically synthesized
tctttttgttttctttctttct

SEQ ID NO: 1307612 - DNA, 22 bp, Artificial Sequence
  chemically synthesized
aaaaaaagaaaagaaagaaaga

SEQ ID NO: 1307613 - DNA, 22 bp, Artificial Sequence
  chemically synthesized
ttctttttgttttctttctttc

SEQ ID NO: 1307614 - DNA, 22 bp, Artificial Sequence
  chemically synthesized
tttctttttgttttctttcttt

SEQ ID NO: 1307615 - DNA, 22 bp, Artificial Sequence
  chemically synthesized
ttttctttttgttttctttctt

SEQ ID NO: 1307616 - DNA, 22 bp, Artificial Sequence
  chemically synthesized
tttttctttttgttttctttct

SEQ ID NO: 1307617 - DNA, 22 bp, Artificial Sequence
  chemically synthesized
ttttttctttttgttttctttc

SEQ ID NO: 1307618 - DNA, 22 bp, Artificial Sequence
  chemically synthesized
tttttttttctttttgttttct

SEQ ID NO: 1307619 - DNA, 22 bp, Artificial Sequence
  chemically synthesized
aacatcccacagtaactatttt

SEQ ID NO: 1307620 - DNA, 22 bp, Artificial Sequence
  chemically synthesized
tgtgtcatctcaacatcccaca

SEQ ID NO: 1307621 - DNA, 22 bp, Artificial Sequence
  chemically synthesized
gtgtgtcatctcaacatcccac

SEQ ID NO: 1307622 - DNA, 22 bp, Artificial Sequence
  chemically synthesized
ttgtgtgtcatctcaacatccc

SEQ ID NO: 1307623 - DNA, 22 bp, Artificial Sequence
  chemically synthesized
ctgtgggatgttgagatgacac

SEQ ID NO: 1307624 - DNA, 22 bp, Artificial Sequence
  chemically synthesized
tgggatgttgagatgacacaca

SEQ ID NO: 1307625 - DNA, 22 bp, Artificial Sequence
  chemically synthesized
caggaggaatatctcttgtgtg

SEQ ID NO: 1307626 - DNA, 22 bp, Artificial Sequence
  chemically synthesized
agatgacacacaagagatattc

SEQ ID NO: 1307627 - DNA, 22 bp, Artificial Sequence
  chemically synthesized
acgttacaggaggaatatctct

SEQ ID NO: 1307628 - DNA, 22 bp, Artificial Sequence
  chemically synthesized
gaattgacgttacaggaggaat

SEQ ID NO: 1307629 - DNA, 22 bp, Artificial Sequence
  chemically synthesized
gaacatacctagaattgacgtt

SEQ ID NO: 1307630 - DNA, 22 bp, Artificial Sequence
  chemically synthesized
ggaacatacctagaattgacgt

SEQ ID NO: 1307631 - DNA, 22 bp, Artificial Sequence
  chemically synthesized
tggaacatacctagaattgacg

SEQ ID NO: 1307632 - DNA, 22 bp, Artificial Sequence
  chemically synthesized
ttggaacatacctagaattgac

SEQ ID NO: 1307633 - DNA, 22 bp, Artificial Sequence
  chemically synthesized
tttggaacatacctagaattga

SEQ ID NO: 1307634 - DNA, 22 bp, Artificial Sequence
  chemically synthesized
ctcctgtaacgtcaattctagg

SEQ ID NO: 1307635 - DNA, 22 bp, Artificial Sequence
  chemically synthesized
ctttttggaacatacctagaat

SEQ ID NO: 1307636 - DNA, 22 bp, Artificial Sequence
  chemically synthesized
ctgtaacgtcaattctaggtat

SEQ ID NO: 1307637 - DNA, 22 bp, Artificial Sequence
  chemically synthesized
taacgtcaattctaggtatgtt

SEQ ID NO: 1307638 - DNA, 22 bp, Artificial Sequence
  chemically synthesized
ggtgatgtctcctttttggaac

SEQ ID NO: 1307639 - DNA, 22 bp, Artificial Sequence
  chemically synthesized
aggtgatgtctcctttttggaa

SEQ ID NO: 1307640 - DNA, 22 bp, Artificial Sequence
  chemically synthesized
taggtatgttccaaaaaggaga

SEQ ID NO: 1307641 - DNA, 22 bp, Artificial Sequence
  chemically synthesized
ggtatgttccaaaaaggagaca

SEQ ID NO: 1307642 - DNA, 22 bp, Artificial Sequence
  chemically synthesized
tcatttaggtgatgtctccttt

SEQ ID NO: 1307643 - DNA, 22 bp, Artificial Sequence
  chemically synthesized
atcatttaggtgatgtctcctt

SEQ ID NO: 1307644 - DNA, 22 bp, Artificial Sequence
  chemically synthesized
cagtttatcatttaggtgatgt

SEQ ID NO: 1307645 - DNA, 22 bp, Artificial Sequence
  chemically synthesized
caaaaaggagacatcacctaaa

SEQ ID NO: 1307646 - DNA, 22 bp, Artificial Sequence
  chemically synthesized
actccagtttatcatttaggtg

SEQ ID NO: 1307647 - DNA, 22 bp, Artificial Sequence
  chemically synthesized
cccagctaactccagtttatca

SEQ ID NO: 1307648 - DNA, 22 bp, Artificial Sequence
  chemically synthesized
acccagctaactccagtttatc

SEQ ID NO: 1307649 - DNA, 22 bp, Artificial Sequence
  chemically synthesized
tacccagctaactccagtttat

SEQ ID NO: 1307650 - DNA, 22 bp, Artificial Sequence
  chemically synthesized
ttacccagctaactccagttta

SEQ ID NO: 1307651 - DNA, 22 bp, Artificial Sequence
  chemically synthesized
tttacccagctaactccagttt

SEQ ID NO: 1307652 - DNA, 22 bp, Artificial Sequence
  chemically synthesized
aactttttacccagctaactcc

SEQ ID NO: 1307653 - DNA, 22 bp, Artificial Sequence
  chemically synthesized
aatgataaactggagttagctg

SEQ ID NO: 1307654 - DNA, 22 bp, Artificial Sequence
  chemically synthesized
ccacctcaactttttacccagc

SEQ ID NO: 1307655 - DNA, 22 bp, Artificial Sequence
  chemically synthesized
gagttagctgggtaaaaagttg

SEQ ID NO: 1307656 - DNA, 22 bp, Artificial Sequence
  chemically synthesized
gctgggtaaaaagttgaggtgg

SEQ ID NO: 1307657 - DNA, 22 bp, Artificial Sequence
  chemically synthesized
gaaatgtcatctcccacctcaa

SEQ ID NO: 1307658 - DNA, 22 bp, Artificial Sequence
  chemically synthesized
tggaaatgtcatctcccacctc

SEQ ID NO: 1307659 - DNA, 22 bp, Artificial Sequence
  chemically synthesized
ggtaaaaagttgaggtgggaga

SEQ ID NO: 1307660 - DNA, 22 bp, Artificial Sequence
  chemically synthesized
ctggaaatgtcatctcccacct

SEQ ID NO: 1307661 - DNA, 22 bp, Artificial Sequence
  chemically synthesized
ttctggaaatgtcatctcccac

SEQ ID NO: 1307662 - DNA, 22 bp, Artificial Sequence
  chemically synthesized
ttcttctggaaatgtcatctcc

SEQ ID NO: 1307663 - DNA, 22 bp, Artificial Sequence
  chemically synthesized
ttattcttctggaaatgtcatc

SEQ ID NO: 1307664 - DNA, 22 bp, Artificial Sequence
  chemically synthesized
tgttattcttctggaaatgtca

SEQ ID NO: 1307665 - DNA, 22 bp, Artificial Sequence
  chemically synthesized
ctgttattcttctggaaatgtc

SEQ ID NO: 1307666 - DNA, 22 bp, Artificial Sequence
  chemically synthesized
aggtgggagatgacatttccag

SEQ ID NO: 1307667 - DNA, 22 bp, Artificial Sequence
  chemically synthesized
gcttctgttattcttctggaaa

SEQ ID NO: 1307668 - DNA, 22 bp, Artificial Sequence
  chemically synthesized
tagcttctgttattcttctgga

SEQ ID NO: 1307669 - DNA, 22 bp, Artificial Sequence
  chemically synthesized
ttctagcttctgttattcttct

SEQ ID NO: 1307670 - DNA, 22 bp, Artificial Sequence
  chemically synthesized
ccagaagaataacagaagctag

SEQ ID NO: 1307671 - DNA, 22 bp, Artificial Sequence
  chemically synthesized
cagaagaataacagaagctaga

SEQ ID NO: 1307672 - DNA, 22 bp, Artificial Sequence
  chemically synthesized
atcatgtcatacaagtcactat

SEQ ID NO: 1307673 - DNA, 22 bp, Artificial Sequence
  chemically synthesized
tacgtactaatcatgtcataca

SEQ ID NO: 1307674 - DNA, 22 bp, Artificial Sequence
  chemically synthesized
gaatagtgacttgtatgacatg

SEQ ID NO: 1307675 - DNA, 22 bp, Artificial Sequence
  chemically synthesized
gtatgacatgattagtacgtac

SEQ ID NO: 1307676 - DNA, 22 bp, Artificial Sequence
  chemically synthesized
aagaacgacattgtacgtacta

SEQ ID NO: 1307677 - DNA, 22 bp, Artificial Sequence
  chemically synthesized
tatgacatgattagtacgtaca

SEQ ID NO: 1307678 - DNA, 22 bp, Artificial Sequence
  chemically synthesized
gtacgtacaatgtcgttcttga

SEQ ID NO: 1307679 - DNA, 22 bp, Artificial Sequence
  chemically synthesized
ccacccaccgaacccacccatc

SEQ ID NO: 1307680 - DNA, 22 bp, Artificial Sequence
  chemically synthesized
cccacccaccgaacccacccat

SEQ ID NO: 1307681 - DNA, 22 bp, Artificial Sequence
  chemically synthesized
ttgagggatgggtgggttcggt

SEQ ID NO: 1307682 - DNA, 22 bp, Artificial Sequence
  chemically synthesized
gagggatgggtgggttcggtgg

SEQ ID NO: 1307683 - DNA, 22 bp, Artificial Sequence
  chemically synthesized
accccttcccacccaccgaacc

SEQ ID NO: 1307684 - DNA, 22 bp, Artificial Sequence
  chemically synthesized
agggatgggtgggttcggtggg

SEQ ID NO: 1307685 - DNA, 22 bp, Artificial Sequence
  chemically synthesized
cattcaccccttcccacccacc

SEQ ID NO: 1307686 - DNA, 22 bp, Artificial Sequence
  chemically synthesized
acattcaccccttcccacccac

SEQ ID NO: 1307687 - DNA, 22 bp, Artificial Sequence
  chemically synthesized
tacattcaccccttcccaccca

SEQ ID NO: 1307688 - DNA, 22 bp, Artificial Sequence
  chemically synthesized
tttacattcaccccttcccacc

SEQ ID NO: 1307689 - DNA, 22 bp, Artificial Sequence
  chemically synthesized
tctctttacattcaccccttcc

SEQ ID NO: 1307690 - DNA, 22 bp, Artificial Sequence
  chemically synthesized
ggtgggtgggaaggggtgaatg

SEQ ID NO: 1307691 - DNA, 22 bp, Artificial Sequence
  chemically synthesized
cactatctctttacattcaccc

SEQ ID NO: 1307692 - DNA, 22 bp, Artificial Sequence
  chemically synthesized
tgcactatctctttacattcac

SEQ ID NO: 1307693 - DNA, 22 bp, Artificial Sequence
  chemically synthesized
gcctctgcactatctctttaca

SEQ ID NO: 1307694 - DNA, 22 bp, Artificial Sequence
  chemically synthesized
attggcctctgcactatctctt

SEQ ID NO: 1307695 - DNA, 22 bp, Artificial Sequence
  chemically synthesized
cattaattggcctctgcactat

SEQ ID NO: 1307696 - DNA, 22 bp, Artificial Sequence
  chemically synthesized
tccattaattggcctctgcact

SEQ ID NO: 1307697 - DNA, 22 bp, Artificial Sequence
  chemically synthesized
ccaatctctccattaattggcc

SEQ ID NO: 1307698 - DNA, 22 bp, Artificial Sequence
  chemically synthesized
taccaatctctccattaattgg

SEQ ID NO: 1307699 - DNA, 22 bp, Artificial Sequence
  chemically synthesized
taagatgctctaccaatctctc

SEQ ID NO: 1307700 - DNA, 22 bp, Artificial Sequence
  chemically synthesized
tataagatgctctaccaatctc

SEQ ID NO: 1307701 - DNA, 22 bp, Artificial Sequence
  chemically synthesized
aattctataagatgctctacca

SEQ ID NO: 1307702 - DNA, 22 bp, Artificial Sequence
  chemically synthesized
atggagagattggtagagcatc

SEQ ID NO: 1307703 - DNA, 22 bp, Artificial Sequence
  chemically synthesized
gtagagcatcttatagaattca

SEQ ID NO: 1307704 - DNA, 22 bp, Artificial Sequence
  chemically synthesized
ccccaaaagtgaaatctgaatt

SEQ ID NO: 1307705 - DNA, 22 bp, Artificial Sequence
  chemically synthesized
attgccccaaaagtgaaatctg

SEQ ID NO: 1307706 - DNA, 22 bp, Artificial Sequence
  chemically synthesized
tcattgccccaaaagtgaaatc

SEQ ID NO: 1307707 - DNA, 22 bp, Artificial Sequence
  chemically synthesized
atagaattcagatttcactttt

SEQ ID NO: 1307708 - DNA, 22 bp, Artificial Sequence
  chemically synthesized
tagaattcagatttcacttttg

SEQ ID NO: 1307709 - DNA, 22 bp, Artificial Sequence
  chemically synthesized
tgccaaattctcattgccccaa

SEQ ID NO: 1307710 - DNA, 22 bp, Artificial Sequence
  chemically synthesized
agatttcacttttggggcaatg

SEQ ID NO: 1307711 - DNA, 22 bp, Artificial Sequence
  chemically synthesized
attatgccaaattctcattgcc

SEQ ID NO: 1307712 - DNA, 22 bp, Artificial Sequence
  chemically synthesized
cacttttggggcaatgagaatt

SEQ ID NO: 1307713 - DNA, 22 bp, Artificial Sequence
  chemically synthesized
ctcattatgccaaattctcatt

SEQ ID NO: 1307714 - DNA, 22 bp, Artificial Sequence
  chemically synthesized
acttttggggcaatgagaattt

SEQ ID NO: 1307715 - DNA, 22 bp, Artificial Sequence
  chemically synthesized
ttggggcaatgagaatttggca

SEQ ID NO: 1307716 - DNA, 22 bp, Artificial Sequence
  chemically synthesized
tggggcaatgagaatttggcat

SEQ ID NO: 1307717 - DNA, 22 bp, Artificial Sequence
  chemically synthesized
ggggcaatgagaatttggcata

SEQ ID NO: 1307718 - DNA, 22 bp, Artificial Sequence
  chemically synthesized
gggcaatgagaatttggcataa

SEQ ID NO: 1307719 - DNA, 22 bp, Artificial Sequence
  chemically synthesized
aaatgtaagtcagataatgcta

SEQ ID NO: 1307720 - DNA, 22 bp, Artificial Sequence
  chemically synthesized
ggcataatgagtagcattatct

SEQ ID NO: 1307721 - DNA, 22 bp, Artificial Sequence
  chemically synthesized
gcataatgagtagcattatctg

SEQ ID NO: 1307722 - DNA, 22 bp, Artificial Sequence
  chemically synthesized
ctaaaatgtaagtcagataatg

SEQ ID NO: 1307723 - DNA, 22 bp, Artificial Sequence
  chemically synthesized
cctaaaatgtaagtcagataat

SEQ ID NO: 1307724 - DNA, 22 bp, Artificial Sequence
  chemically synthesized
tcctaaaatgtaagtcagataa

SEQ ID NO: 1307725 - DNA, 22 bp, Artificial Sequence
  chemically synthesized
tcaaaaagagttttcctaaaat

SEQ ID NO: 1307726 - DNA, 22 bp, Artificial Sequence
  chemically synthesized
tctgacttacattttaggaaaa

SEQ ID NO: 1307727 - DNA, 22 bp, Artificial Sequence
  chemically synthesized
ttatcaaaaagagttttcctaa

SEQ ID NO: 1307728 - DNA, 22 bp, Artificial Sequence
  chemically synthesized
acttacattttaggaaaactct

SEQ ID NO: 1307729 - DNA, 22 bp, Artificial Sequence
  chemically synthesized
acattttaggaaaactcttttt

SEQ ID NO: 1307730 - DNA, 22 bp, Artificial Sequence
  chemically synthesized
ccaattgttatcaaaaagagtt

SEQ ID NO: 1307731 - DNA, 22 bp, Artificial Sequence
  chemically synthesized
cattttaggaaaactctttttg

SEQ ID NO: 1307732 - DNA, 22 bp, Artificial Sequence
  chemically synthesized
cccaattgttatcaaaaagagt

SEQ ID NO: 1307733 - DNA, 22 bp, Artificial Sequence
  chemically synthesized
tcccaattgttatcaaaaagag

SEQ ID NO: 1307734 - DNA, 22 bp, Artificial Sequence
  chemically synthesized
taggaaaactctttttgataac

SEQ ID NO: 1307735 - DNA, 22 bp, Artificial Sequence
  chemically synthesized
aggaaaactctttttgataaca

SEQ ID NO: 1307736 - DNA, 22 bp, Artificial Sequence
  chemically synthesized
ggaaaactctttttgataacaa

SEQ ID NO: 1307737 - DNA, 22 bp, Artificial Sequence
  chemically synthesized
ccaaatccactttcccaattgt

SEQ ID NO: 1307738 - DNA, 22 bp, Artificial Sequence
  chemically synthesized
cccaaatccactttcccaattg

SEQ ID NO: 1307739 - DNA, 22 bp, Artificial Sequence
  chemically synthesized
tttttgataacaattgggaaag

SEQ ID NO: 1307740 - DNA, 22 bp, Artificial Sequence
  chemically synthesized
tttgataacaattgggaaagtg

SEQ ID NO: 1307741 - DNA, 22 bp, Artificial Sequence
  chemically synthesized
ttgataacaattgggaaagtgg

SEQ ID NO: 1307742 - DNA, 22 bp, Artificial Sequence
  chemically synthesized
tgataacaattgggaaagtgga

SEQ ID NO: 1307743 - DNA, 22 bp, Artificial Sequence
  chemically synthesized
aaacttcccaaatccactttcc

SEQ ID NO: 1307744 - DNA, 22 bp, Artificial Sequence
  chemically synthesized
gataacaattgggaaagtggat

SEQ ID NO: 1307745 - DNA, 22 bp, Artificial Sequence
  chemically synthesized
caaacttcccaaatccactttc

SEQ ID NO: 1307746 - DNA, 22 bp, Artificial Sequence
  chemically synthesized
ataacaattgggaaagtggatt

SEQ ID NO: 1307747 - DNA, 22 bp, Artificial Sequence
  chemically synthesized
ttcaaacttcccaaatccactt

SEQ ID NO: 1307748 - DNA, 22 bp, Artificial Sequence
  chemically synthesized
cttcaaacttcccaaatccact

SEQ ID NO: 1307749 - DNA, 22 bp, Artificial Sequence
  chemically synthesized
ccttcttcaaacttcccaaatc

SEQ ID NO: 1307750 - DNA, 22 bp, Artificial Sequence
  chemically synthesized
ggaaagtggatttgggaagttt

SEQ ID NO: 1307751 - DNA, 22 bp, Artificial Sequence
  chemically synthesized
ccacgttcccttcttcaaactt

SEQ ID NO: 1307752 - DNA, 22 bp, Artificial Sequence
  chemically synthesized
gccacgttcccttcttcaaact

SEQ ID NO: 1307753 - DNA, 22 bp, Artificial Sequence
  chemically synthesized
tttgccacgttcccttcttcaa

SEQ ID NO: 1307754 - DNA, 22 bp, Artificial Sequence
  chemically synthesized
atttgccacgttcccttcttca

SEQ ID NO: 1307755 - DNA, 22 bp, Artificial Sequence
  chemically synthesized
tatttgccacgttcccttcttc

SEQ ID NO: 1307756 - DNA, 22 bp, Artificial Sequence
  chemically synthesized
tttatttgccacgttcccttct

SEQ ID NO: 1307757 - DNA, 22 bp, Artificial Sequence
  chemically synthesized
gggaagtttgaagaagggaacg

SEQ ID NO: 1307758 - DNA, 22 bp, Artificial Sequence
  chemically synthesized
ggaagtttgaagaagggaacgt

SEQ ID NO: 1307759 - DNA, 22 bp, Artificial Sequence
  chemically synthesized
tctctttatttgccacgttccc

SEQ ID NO: 1307760 - DNA, 22 bp, Artificial Sequence
  chemically synthesized
gtctctttatttgccacgttcc

SEQ ID NO: 1307761 - DNA, 22 bp, Artificial Sequence
  chemically synthesized
cttgtctctttatttgccacgt

SEQ ID NO: 1307762 - DNA, 22 bp, Artificial Sequence
  chemically synthesized
gaagaagggaacgtggcaaata

SEQ ID NO: 1307763 - DNA, 22 bp, Artificial Sequence
  chemically synthesized
aagaagggaacgtggcaaataa

SEQ ID NO: 1307764 - DNA, 22 bp, Artificial Sequence
  chemically synthesized
attccttgtctctttatttgcc

SEQ ID NO: 1307765 - DNA, 22 bp, Artificial Sequence
  chemically synthesized
ctgattccttgtctctttattt

SEQ ID NO: 1307766 - DNA, 22 bp, Artificial Sequence
  chemically synthesized
caatagcctcctgattccttgt

SEQ ID NO: 1307767 - DNA, 22 bp, Artificial Sequence
  chemically synthesized
agtgattacaatagcctcctga

SEQ ID NO: 1307768 - DNA, 22 bp, Artificial Sequence
  chemically synthesized
acctgagtgattacaatagcct

SEQ ID NO: 1307769 - DNA, 22 bp, Artificial Sequence
  chemically synthesized
cacctgagtgattacaatagcc

SEQ ID NO: 1307770 - DNA, 22 bp, Artificial Sequence
  chemically synthesized
tcacctgagtgattacaatagc

SEQ ID NO: 1307771 - DNA, 22 bp, Artificial Sequence
  chemically synthesized
ttcacctgagtgattacaatag

SEQ ID NO: 1307772 - DNA, 22 bp, Artificial Sequence
  chemically synthesized
taccaccttttcacctgagtga

SEQ ID NO: 1307773 - DNA, 22 bp, Artificial Sequence
  chemically synthesized
ataccaccttttcacctgagtg

SEQ ID NO: 1307774 - DNA, 22 bp, Artificial Sequence
  chemically synthesized
gtttataccaccttttcacctg

SEQ ID NO: 1307775 - DNA, 22 bp, Artificial Sequence
  chemically synthesized
ttgtaatcactcaggtgaaaag

SEQ ID NO: 1307776 - DNA, 22 bp, Artificial Sequence
  chemically synthesized
agtttataccaccttttcacct

SEQ ID NO: 1307777 - DNA, 22 bp, Artificial Sequence
  chemically synthesized
taatcactcaggtgaaaaggtg

SEQ ID NO: 1307778 - DNA, 22 bp, Artificial Sequence
  chemically synthesized
ccttagtttataccaccttttc

SEQ ID NO: 1307779 - DNA, 22 bp, Artificial Sequence
  chemically synthesized
ttaccttagtttataccacctt

SEQ ID NO: 1307780 - DNA, 22 bp, Artificial Sequence
  chemically synthesized
aggtgaaaaggtggtataaact

SEQ ID NO: 1307781 - DNA, 22 bp, Artificial Sequence
  chemically synthesized
catggctgttaccttagtttat

SEQ ID NO: 1307782 - DNA, 22 bp, Artificial Sequence
  chemically synthesized
ccatggctgttaccttagttta

SEQ ID NO: 1307783 - DNA, 22 bp, Artificial Sequence
  chemically synthesized
tttccatggctgttaccttagt

SEQ ID NO: 1307784 - DNA, 22 bp, Artificial Sequence
  chemically synthesized
tgtttccatggctgttacctta

SEQ ID NO: 1307785 - DNA, 22 bp, Artificial Sequence
  chemically synthesized
atgtgatcattctgtttccatg

SEQ ID NO: 1307786 - DNA, 22 bp, Artificial Sequence
  chemically synthesized
aggtaacagccatggaaacaga

SEQ ID NO: 1307787 - DNA, 22 bp, Artificial Sequence
  chemically synthesized
actgatgtgatcattctgtttc

SEQ ID NO: 1307788 - DNA, 22 bp, Artificial Sequence
  chemically synthesized
aacaattaactgatgtgatcat

SEQ ID NO: 1307789 - DNA, 22 bp, Artificial Sequence
  chemically synthesized
tatgtaagttgaacaattaact

SEQ ID NO: 1307790 - DNA, 22 bp, Artificial Sequence
  chemically synthesized
gtatgtaagttgaacaattaac

SEQ ID NO: 1307791 - DNA, 22 bp, Artificial Sequence
  chemically synthesized
tggtttgtatgtaagttgaaca

SEQ ID NO: 1307792 - DNA, 22 bp, Artificial Sequence
  chemically synthesized
gtggtttgtatgtaagttgaac

SEQ ID NO: 1307793 - DNA, 22 bp, Artificial Sequence
  chemically synthesized
gatttgtggtttgtatgtaagt

SEQ ID NO: 1307794 - DNA, 22 bp, Artificial Sequence
  chemically synthesized
attgttcaacttacatacaaac

SEQ ID NO: 1307795 - DNA, 22 bp, Artificial Sequence
  chemically synthesized
attggatttgtggtttgtatgt

SEQ ID NO: 1307796 - DNA, 22 bp, Artificial Sequence
  chemically synthesized
ttcaacttacatacaaaccaca

SEQ ID NO: 1307797 - DNA, 22 bp, Artificial Sequence
  chemically synthesized
gttgattggatttgtggtttgt

SEQ ID NO: 1307798 - DNA, 22 bp, Artificial Sequence
  chemically synthesized
aacttacatacaaaccacaaat

SEQ ID NO: 1307799 - DNA, 22 bp, Artificial Sequence
  chemically synthesized
acatacaaaccacaaatccaat

SEQ ID NO: 1307800 - DNA, 22 bp, Artificial Sequence
  chemically synthesized
aaatattagttgattggatttg

SEQ ID NO: 1307801 - DNA, 22 bp, Artificial Sequence
  chemically synthesized
catacaaaccacaaatccaatc

SEQ ID NO: 1307802 - DNA, 22 bp, Artificial Sequence
  chemically synthesized
gaaatattagttgattggattt

SEQ ID NO: 1307803 - DNA, 22 bp, Artificial Sequence
  chemically synthesized
cacgtttgaaatattagttgat

SEQ ID NO: 1307804 - DNA, 22 bp, Artificial Sequence
  chemically synthesized
gcacgtttgaaatattagttga

SEQ ID NO: 1307805 - DNA, 22 bp, Artificial Sequence
  chemically synthesized
tgcacgtttgaaatattagttg

SEQ ID NO: 1307806 - DNA, 22 bp, Artificial Sequence
  chemically synthesized
ccaaacatattttgcacgtttg

SEQ ID NO: 1307807 - DNA, 22 bp, Artificial Sequence
  chemically synthesized
atatttcaaacgtgcaaaatat

SEQ ID NO: 1307808 - DNA, 22 bp, Artificial Sequence
  chemically synthesized
caaacgtgcaaaatatgtttgg

SEQ ID NO: 1307809 - DNA, 22 bp, Artificial Sequence
  chemically synthesized
aaacgtgcaaaatatgtttggc

SEQ ID NO: 1307810 - DNA, 22 bp, Artificial Sequence
  chemically synthesized
gtaataaacccctgccaaacat

SEQ ID NO: 1307811 - DNA, 22 bp, Artificial Sequence
  chemically synthesized
tagaaacattcgtaataaaccc

SEQ ID NO: 1307812 - DNA, 22 bp, Artificial Sequence
  chemically synthesized
atagaaacattcgtaataaacc

SEQ ID NO: 1307813 - DNA, 22 bp, Artificial Sequence
  chemically synthesized
ggcaggggtttattacgaatgt

SEQ ID NO: 1307814 - DNA, 22 bp, Artificial Sequence
  chemically synthesized
gcaggggtttattacgaatgtt

SEQ ID NO: 1307815 - DNA, 22 bp, Artificial Sequence
  chemically synthesized
attacgaatgtttctataaatt

SEQ ID NO: 1307816 - DNA, 22 bp, Artificial Sequence
  chemically synthesized
ttacgaatgtttctataaatta

SEQ ID NO: 1307817 - DNA, 22 bp, Artificial Sequence
  chemically synthesized
cgaatgtttctataaattatgt

SEQ ID NO: 1307818 - DNA, 22 bp, Artificial Sequence
  chemically synthesized
ctataaattatgtctctataca

SEQ ID NO: 1307819 - DNA, 22 bp, Artificial Sequence
  chemically synthesized
tataaattatgtctctatacac

SEQ ID NO: 1307820 - DNA, 22 bp, Artificial Sequence
  chemically synthesized
taaattatgtctctatacacat

SEQ ID NO: 1307821 - DNA, 22 bp, Artificial Sequence
  chemically synthesized
tgtctctatacacatatctata

SEQ ID NO: 1307822 - DNA, 22 bp, Artificial Sequence
  chemically synthesized
tatacacatatctatacatata

SEQ ID NO: 1307823 - DNA, 22 bp, Artificial Sequence
  chemically synthesized
tacacatatctatacatatata

SEQ ID NO: 1307824 - DNA, 22 bp, Artificial Sequence
  chemically synthesized
tacatatatatacatacacacc

SEQ ID NO: 1307825 - DNA, 22 bp, Artificial Sequence
  chemically synthesized
tggaatatatatataggcatat

SEQ ID NO: 1307826 - DNA, 22 bp, Artificial Sequence
  chemically synthesized
acaaaactatggaatatatata

SEQ ID NO: 1307827 - DNA, 22 bp, Artificial Sequence
  chemically synthesized
cacaaaactatggaatatatat

SEQ ID NO: 1307828 - DNA, 22 bp, Artificial Sequence
  chemically synthesized
tcacaaaactatggaatatata

SEQ ID NO: 1307829 - DNA, 22 bp, Artificial Sequence
  chemically synthesized
tatgcctatatatatattccat

SEQ ID NO: 1307830 - DNA, 22 bp, Artificial Sequence
  chemically synthesized
tatatatattccatagttttgt

SEQ ID NO: 1307831 - DNA, 22 bp, Artificial Sequence
  chemically synthesized
taccatcactttcacaaaacta

SEQ ID NO: 1307832 - DNA, 22 bp, Artificial Sequence
  chemically synthesized
ttataccatcactttcacaaaa

SEQ ID NO: 1307833 - DNA, 22 bp, Artificial Sequence
  chemically synthesized
ttgttataccatcactttcaca

SEQ ID NO: 1307834 - DNA, 22 bp, Artificial Sequence
  chemically synthesized
gttgttataccatcactttcac

SEQ ID NO: 1307835 - DNA, 22 bp, Artificial Sequence
  chemically synthesized
tgttgttataccatcactttca

SEQ ID NO: 1307836 - DNA, 22 bp, Artificial Sequence
  chemically synthesized
ttgttgttataccatcactttc

SEQ ID NO: 1307837 - DNA, 22 bp, Artificial Sequence
  chemically synthesized
catagttttgtgaaagtgatgg

SEQ ID NO: 1307838 - DNA, 22 bp, Artificial Sequence
  chemically synthesized
tttgttgttataccatcacttt

SEQ ID NO: 1307839 - DNA, 22 bp, Artificial Sequence
  chemically synthesized
tgtgaaagtgatggtataacaa

SEQ ID NO: 1307840 - DNA, 22 bp, Artificial Sequence
  chemically synthesized
gtgaaagtgatggtataacaac

SEQ ID NO: 1307841 - DNA, 22 bp, Artificial Sequence
  chemically synthesized
tgaaagtgatggtataacaaca

SEQ ID NO: 1307842 - DNA, 22 bp, Artificial Sequence
  chemically synthesized
tgatcagtggatatgacagaat

SEQ ID NO: 1307843 - DNA, 22 bp, Artificial Sequence
  chemically synthesized
ttgtgatcagtggatatgacag

SEQ ID NO: 1307844 - DNA, 22 bp, Artificial Sequence
  chemically synthesized
tgtcatatccactgatcacaat

SEQ ID NO: 1307845 - DNA, 22 bp, Artificial Sequence
  chemically synthesized
tcatatccactgatcacaatag

SEQ ID NO: 1307846 - DNA, 22 bp, Artificial Sequence
  chemically synthesized
caaaataaccagaggcacaaag

SEQ ID NO: 1307847 - DNA, 22 bp, Artificial Sequence
  chemically synthesized
atcacaatagactttgtgcctc

SEQ ID NO: 1307848 - DNA, 22 bp, Artificial Sequence
  chemically synthesized
gcaaaataaccagaggcacaaa

SEQ ID NO: 1307849 - DNA, 22 bp, Artificial Sequence
  chemically synthesized
aatgatttgcaaaataaccaga

SEQ ID NO: 1307850 - DNA, 22 bp, Artificial Sequence
  chemically synthesized
ttaaatgatttgcaaaataacc

SEQ ID NO: 1307851 - DNA, 22 bp, Artificial Sequence
  chemically synthesized
tgtgcctctggttattttgcaa

SEQ ID NO: 1307852 - DNA, 22 bp, Artificial Sequence
  chemically synthesized
gtgcctctggttattttgcaaa

SEQ ID NO: 1307853 - DNA, 22 bp, Artificial Sequence
  chemically synthesized
attgttaaatgatttgcaaaat

SEQ ID NO: 1307854 - DNA, 22 bp, Artificial Sequence
  chemically synthesized
tgcctctggttattttgcaaat

SEQ ID NO: 1307855 - DNA, 22 bp, Artificial Sequence
  chemically synthesized
tggttattttgcaaatcattta

SEQ ID NO: 1307856 - DNA, 22 bp, Artificial Sequence
  chemically synthesized
gttattttgcaaatcatttaac

SEQ ID NO: 1307857 - DNA, 22 bp, Artificial Sequence
  chemically synthesized
aatgaaaactaattgttaaatg

SEQ ID NO: 1307858 - DNA, 22 bp, Artificial Sequence
  chemically synthesized
aaatgaaaactaattgttaaat

SEQ ID NO: 1307859 - DNA, 22 bp, Artificial Sequence
  chemically synthesized
ttttgcaaatcatttaacaatt

SEQ ID NO: 1307860 - DNA, 22 bp, Artificial Sequence
  chemically synthesized
taaatgaaaactaattgttaaa

SEQ ID NO: 1307861 - DNA, 22 bp, Artificial Sequence
  chemically synthesized
tgcaaatcatttaacaattagt

SEQ ID NO: 1307862 - DNA, 22 bp, Artificial Sequence
  chemically synthesized
ctttaaatgaaaactaattgtt

SEQ ID NO: 1307863 - DNA, 22 bp, Artificial Sequence
  chemically synthesized
gcaaatcatttaacaattagtt

SEQ ID NO: 1307864 - DNA, 22 bp, Artificial Sequence
  chemically synthesized
cctttaaatgaaaactaattgt

SEQ ID NO: 1307865 - DNA, 22 bp, Artificial Sequence
  chemically synthesized
caaatcatttaacaattagttt

SEQ ID NO: 1307866 - DNA, 22 bp, Artificial Sequence
  chemically synthesized
taaacttcctttaaatgaaaac

SEQ ID NO: 1307867 - DNA, 22 bp, Artificial Sequence
  chemically synthesized
ataaacttcctttaaatgaaaa

SEQ ID NO: 1307868 - DNA, 22 bp, Artificial Sequence
  chemically synthesized
aacaattagttttcatttaaag

SEQ ID NO: 1307869 - DNA, 22 bp, Artificial Sequence
  chemically synthesized
acaattagttttcatttaaagg

SEQ ID NO: 1307870 - DNA, 22 bp, Artificial Sequence
  chemically synthesized
acttataaacttcctttaaatg

SEQ ID NO: 1307871 - DNA, 22 bp, Artificial Sequence
  chemically synthesized
aacttataaacttcctttaaat

SEQ ID NO: 1307872 - DNA, 22 bp, Artificial Sequence
  chemically synthesized
taacttataaacttcctttaaa

SEQ ID NO: 1307873 - DNA, 22 bp, Artificial Sequence
  chemically synthesized
ctttaacttataaacttccttt

SEQ ID NO: 1307874 - DNA, 22 bp, Artificial Sequence
  chemically synthesized
actttaacttataaacttcctt

SEQ ID NO: 1307875 - DNA, 22 bp, Artificial Sequence
  chemically synthesized
gttttcatttaaaggaagttta

SEQ ID NO: 1307876 - DNA, 22 bp, Artificial Sequence
  chemically synthesized
tcatttaaaggaagtttataag

SEQ ID NO: 1307877 - DNA, 22 bp, Artificial Sequence
  chemically synthesized
tgtttactttaacttataaact

SEQ ID NO: 1307878 - DNA, 22 bp, Artificial Sequence
  chemically synthesized
catttaaaggaagtttataagt

SEQ ID NO: 1307879 - DNA, 22 bp, Artificial Sequence
  chemically synthesized
atgtttactttaacttataaac

SEQ ID NO: 1307880 - DNA, 22 bp, Artificial Sequence
  chemically synthesized
atttaaaggaagtttataagtt

SEQ ID NO: 1307881 - DNA, 22 bp, Artificial Sequence
  chemically synthesized
tcttatgtttactttaacttat

SEQ ID NO: 1307882 - DNA, 22 bp, Artificial Sequence
  chemically synthesized
aaaggaagtttataagttaaag

SEQ ID NO: 1307883 - DNA, 22 bp, Artificial Sequence
  chemically synthesized
gtcttatgtttactttaactta

SEQ ID NO: 1307884 - DNA, 22 bp, Artificial Sequence
  chemically synthesized
aaggaagtttataagttaaagt

SEQ ID NO: 1307885 - DNA, 22 bp, Artificial Sequence
  chemically synthesized
ataagttaaagtaaacataaga

SEQ ID NO: 1307886 - DNA, 22 bp, Artificial Sequence
  chemically synthesized
taagttaaagtaaacataagac

SEQ ID NO: 1307887 - DNA, 22 bp, Artificial Sequence
  chemically synthesized
aagaataaatttgtcttatgtt

SEQ ID NO: 1307888 - DNA, 22 bp, Artificial Sequence
  chemically synthesized
acattcaagaataaatttgtct

SEQ ID NO: 1307889 - DNA, 22 bp, Artificial Sequence
  chemically synthesized
aagtaaacataagacaaattta

SEQ ID NO: 1307890 - DNA, 22 bp, Artificial Sequence
  chemically synthesized
aacattcaagaataaatttgtc

SEQ ID NO: 1307891 - DNA, 22 bp, Artificial Sequence
  chemically synthesized
agggcttaacattcaagaataa

SEQ ID NO: 1307892 - DNA, 22 bp, Artificial Sequence
  chemically synthesized
gatgctgagggcttaacattca

SEQ ID NO: 1307893 - DNA, 22 bp, Artificial Sequence
  chemically synthesized
attcttgaatgttaagccctca

SEQ ID NO: 1307894 - DNA, 22 bp, Artificial Sequence
  chemically synthesized
ttcttgaatgttaagccctcag

SEQ ID NO: 1307895 - DNA, 22 bp, Artificial Sequence
  chemically synthesized
atggtcctcgatgctgagggct

SEQ ID NO: 1307896 - DNA, 22 bp, Artificial Sequence
  chemically synthesized
catggtcctcgatgctgagggc

SEQ ID NO: 1307897 - DNA, 22 bp, Artificial Sequence
  chemically synthesized
ttgaatgttaagccctcagcat

SEQ ID NO: 1307898 - DNA, 22 bp, Artificial Sequence
  chemically synthesized
tcatggtcctcgatgctgaggg

SEQ ID NO: 1307899 - DNA, 22 bp, Artificial Sequence
  chemically synthesized
gaatgttaagccctcagcatcg

SEQ ID NO: 1307900 - DNA, 22 bp, Artificial Sequence
  chemically synthesized
aatgttaagccctcagcatcga

SEQ ID NO: 1307901 - DNA, 22 bp, Artificial Sequence
  chemically synthesized
agccctcagcatcgaggaccat

SEQ ID NO: 1307902 - DNA, 22 bp, Artificial Sequence
  chemically synthesized
atcagtattttcatggtcctcg

SEQ ID NO: 1307903 - DNA, 22 bp, Artificial Sequence
  chemically synthesized
attaatcagtattttcatggtc

SEQ ID NO: 1307904 - DNA, 22 bp, Artificial Sequence
  chemically synthesized
agcatcgaggaccatgaaaata

SEQ ID NO: 1307905 - DNA, 22 bp, Artificial Sequence
  chemically synthesized
gtcacactaattaatcagtatt

SEQ ID NO: 1307906 - DNA, 22 bp, Artificial Sequence
  chemically synthesized
cgtcacactaattaatcagtat

SEQ ID NO: 1307907 - DNA, 22 bp, Artificial Sequence
  chemically synthesized
cttcgtcacactaattaatcag

SEQ ID NO: 1307908 - DNA, 22 bp, Artificial Sequence
  chemically synthesized
ccttcgtcacactaattaatca

SEQ ID NO: 1307909 - DNA, 22 bp, Artificial Sequence
  chemically synthesized
tccttcgtcacactaattaatc

SEQ ID NO: 1307910 - DNA, 22 bp, Artificial Sequence
  chemically synthesized
aatgttttccttcgtcacacta

SEQ ID NO: 1307911 - DNA, 22 bp, Artificial Sequence
  chemically synthesized
attcaatgttttccttcgtcac

SEQ ID NO: 1307912 - DNA, 22 bp, Artificial Sequence
  chemically synthesized
aattcaatgttttccttcgtca

SEQ ID NO: 1307913 - DNA, 22 bp, Artificial Sequence
  chemically synthesized
attaattagtgtgacgaaggaa

SEQ ID NO: 1307914 - DNA, 22 bp, Artificial Sequence
  chemically synthesized
acttaattcaatgttttccttc

SEQ ID NO: 1307915 - DNA, 22 bp, Artificial Sequence
  chemically synthesized
attagtgtgacgaaggaaaaca

SEQ ID NO: 1307916 - DNA, 22 bp, Artificial Sequence
  chemically synthesized
gttgacttaattcaatgttttc

SEQ ID NO: 1307917 - DNA, 22 bp, Artificial Sequence
  chemically synthesized
gtgtgacgaaggaaaacattga

SEQ ID NO: 1307918 - DNA, 22 bp, Artificial Sequence
  chemically synthesized
aataactagttgacttaattca

SEQ ID NO: 1307919 - DNA, 22 bp, Artificial Sequence
  chemically synthesized
actgaataactagttgacttaa

SEQ ID NO: 1307920 - DNA, 22 bp, Artificial Sequence
  chemically synthesized
aactgaataactagttgactta

SEQ ID NO: 1307921 - DNA, 22 bp, Artificial Sequence
  chemically synthesized
aattaagtcaactagttattca

SEQ ID NO: 1307922 - DNA, 22 bp, Artificial Sequence
  chemically synthesized
aaaataaatttaactgaataac

SEQ ID NO: 1307923 - DNA, 22 bp, Artificial Sequence
  chemically synthesized
caaaataaatttaactgaataa

SEQ ID NO: 1307924 - DNA, 22 bp, Artificial Sequence
  chemically synthesized
agtcaactagttattcagttaa

SEQ ID NO: 1307925 - DNA, 22 bp, Artificial Sequence
  chemically synthesized
ttcaaaataaatttaactgaat

SEQ ID NO: 1307926 - DNA, 22 bp, Artificial Sequence
  chemically synthesized
cttcaaaataaatttaactgaa

SEQ ID NO: 1307927 - DNA, 22 bp, Artificial Sequence
  chemically synthesized
cggtttcttcaaaataaattta

SEQ ID NO: 1307928 - DNA, 22 bp, Artificial Sequence
  chemically synthesized
gttattcagttaaatttatttt

SEQ ID NO: 1307929 - DNA, 22 bp, Artificial Sequence
  chemically synthesized
tgcggtttcttcaaaataaatt

SEQ ID NO: 1307930 - DNA, 22 bp, Artificial Sequence
  chemically synthesized
ctgcggtttcttcaaaataaat

SEQ ID NO: 1307931 - DNA, 22 bp, Artificial Sequence
  chemically synthesized
ttcagttaaatttattttgaag

SEQ ID NO: 1307932 - DNA, 22 bp, Artificial Sequence
  chemically synthesized
agttaaatttattttgaagaaa

SEQ ID NO: 1307933 - DNA, 22 bp, Artificial Sequence
  chemically synthesized
gaaaaccttctgcggtttcttc

SEQ ID NO: 1307934 - DNA, 22 bp, Artificial Sequence
  chemically synthesized
aatttattttgaagaaaccgca

SEQ ID NO: 1307935 - DNA, 22 bp, Artificial Sequence
  chemically synthesized
cccctagaaaaccttctgcggt

SEQ ID NO: 1307936 - DNA, 22 bp, Artificial Sequence
  chemically synthesized
attttgaagaaaccgcagaagg

SEQ ID NO: 1307937 - DNA, 22 bp, Artificial Sequence
  chemically synthesized
ccccctagaaaaccttctgcgg

SEQ ID NO: 1307938 - DNA, 22 bp, Artificial Sequence
  chemically synthesized
ttttgaagaaaccgcagaaggt

SEQ ID NO: 1307939 - DNA, 22 bp, Artificial Sequence
  chemically synthesized
tgaagaaaccgcagaaggtttt

SEQ ID NO: 1307940 - DNA, 22 bp, Artificial Sequence
  chemically synthesized
gaagaaaccgcagaaggttttc

SEQ ID NO: 1307941 - DNA, 22 bp, Artificial Sequence
  chemically synthesized
aagaaaccgcagaaggttttct

SEQ ID NO: 1307942 - DNA, 22 bp, Artificial Sequence
  chemically synthesized
tgtcatcttccccctagaaaac

SEQ ID NO: 1307943 - DNA, 22 bp, Artificial Sequence
  chemically synthesized
gattgtgtcatcttccccctag

SEQ ID NO: 1307944 - DNA, 22 bp, Artificial Sequence
  chemically synthesized
tctagggggaagatgacacaat

SEQ ID NO: 1307945 - DNA, 22 bp, Artificial Sequence
  chemically synthesized
ctagggggaagatgacacaatc

SEQ ID NO: 1307946 - DNA, 22 bp, Artificial Sequence
  chemically synthesized
aaaagcatattcgattgtgtca

SEQ ID NO: 1307947 - DNA, 22 bp, Artificial Sequence
  chemically synthesized
tagggggaagatgacacaatcg

SEQ ID NO: 1307948 - DNA, 22 bp, Artificial Sequence
  chemically synthesized
aaaaagcatattcgattgtgtc

SEQ ID NO: 1307949 - DNA, 22 bp, Artificial Sequence
  chemically synthesized
taaaaagcatattcgattgtgt

SEQ ID NO: 1307950 - DNA, 22 bp, Artificial Sequence
  chemically synthesized
gggggaagatgacacaatcgaa

SEQ ID NO: 1307951 - DNA, 22 bp, Artificial Sequence
  chemically synthesized
cacatgcagccagaatgtttta

SEQ ID NO: 1307952 - DNA, 22 bp, Artificial Sequence
  chemically synthesized
ccacatgcagccagaatgtttt

SEQ ID NO: 1307953 - DNA, 22 bp, Artificial Sequence
  chemically synthesized
tccacatgcagccagaatgttt

SEQ ID NO: 1307954 - DNA, 22 bp, Artificial Sequence
  chemically synthesized
agttttccacatgcagccagaa

SEQ ID NO: 1307955 - DNA, 22 bp, Artificial Sequence
  chemically synthesized
tttaaaacattctggctgcatg

SEQ ID NO: 1307956 - DNA, 22 bp, Artificial Sequence
  chemically synthesized
ttaaaacattctggctgcatgt

SEQ ID NO: 1307957 - DNA, 22 bp, Artificial Sequence
  chemically synthesized
taaaacattctggctgcatgtg

SEQ ID NO: 1307958 - DNA, 22 bp, Artificial Sequence
  chemically synthesized
aaaacattctggctgcatgtgg

SEQ ID NO: 1307959 - DNA, 22 bp, Artificial Sequence
  chemically synthesized
tgattcagttttccacatgcag

SEQ ID NO: 1307960 - DNA, 22 bp, Artificial Sequence
  chemically synthesized
aaacattctggctgcatgtgga

SEQ ID NO: 1307961 - DNA, 22 bp, Artificial Sequence
  chemically synthesized
tggctgcatgtggaaaactgaa

SEQ ID NO: 1307962 - DNA, 22 bp, Artificial Sequence
  chemically synthesized
gctgcatgtggaaaactgaatc

SEQ ID NO: 1307963 - DNA, 22 bp, Artificial Sequence
  chemically synthesized
ccccacccctgtgattcagttt

SEQ ID NO: 1307964 - DNA, 22 bp, Artificial Sequence
  chemically synthesized
cccccacccctgtgattcagtt

SEQ ID NO: 1307965 - DNA, 22 bp, Artificial Sequence
  chemically synthesized
catgtggaaaactgaatcacag

SEQ ID NO: 1307966 - DNA, 22 bp, Artificial Sequence
  chemically synthesized
aatttcccccacccctgtgatt

SEQ ID NO: 1307967 - DNA, 22 bp, Artificial Sequence
  chemically synthesized
aatcacaggggtgggggaaatt

SEQ ID NO: 1307968 - DNA, 22 bp, Artificial Sequence
  chemically synthesized
aaacagatgttcaatttccccc

SEQ ID NO: 1307969 - DNA, 22 bp, Artificial Sequence
  chemically synthesized
ccctaaaacagatgttcaattt

SEQ ID NO: 1307970 - DNA, 22 bp, Artificial Sequence
  chemically synthesized
cagttcccctaaaacagatgtt

SEQ ID NO: 1307971 - DNA, 22 bp, Artificial Sequence
  chemically synthesized
ttgcagttcccctaaaacagat

SEQ ID NO: 1307972 - DNA, 22 bp, Artificial Sequence
  chemically synthesized
aacatctgttttaggggaactg

SEQ ID NO: 1307973 - DNA, 22 bp, Artificial Sequence
  chemically synthesized
ccaggattgttgcagttcccct

SEQ ID NO: 1307974 - DNA, 22 bp, Artificial Sequence
  chemically synthesized
gccaggattgttgcagttcccc

SEQ ID NO: 1307975 - DNA, 22 bp, Artificial Sequence
  chemically synthesized
tgccaggattgttgcagttccc

SEQ ID NO: 1307976 - DNA, 22 bp, Artificial Sequence
  chemically synthesized
ttttaggggaactgcaacaatc

SEQ ID NO: 1307977 - DNA, 22 bp, Artificial Sequence
  chemically synthesized
taggggaactgcaacaatcctg

SEQ ID NO: 1307978 - DNA, 22 bp, Artificial Sequence
  chemically synthesized
aggggaactgcaacaatcctgg

SEQ ID NO: 1307979 - DNA, 22 bp, Artificial Sequence
  chemically synthesized
ggggaactgcaacaatcctggc

SEQ ID NO: 1307980 - DNA, 22 bp, Artificial Sequence
  chemically synthesized
gcatcagccatcatgttttgcc

SEQ ID NO: 1307981 - DNA, 22 bp, Artificial Sequence
  chemically synthesized
ggcatcagccatcatgttttgc

SEQ ID NO: 1307982 - DNA, 22 bp, Artificial Sequence
  chemically synthesized
caacaatcctggcaaaacatga

SEQ ID NO: 1307983 - DNA, 22 bp, Artificial Sequence
  chemically synthesized
ccttggcatcagccatcatgtt

SEQ ID NO: 1307984 - DNA, 22 bp, Artificial Sequence
  chemically synthesized
acattaccttggcatcagccat

SEQ ID NO: 1307985 - DNA, 22 bp, Artificial Sequence
  chemically synthesized
gcaaaacatgatggctgatgcc

SEQ ID NO: 1307986 - DNA, 22 bp, Artificial Sequence
  chemically synthesized
taacattaccttggcatcagcc

SEQ ID NO: 1307987 - DNA, 22 bp, Artificial Sequence
  chemically synthesized
ttctaacattaccttggcatca

SEQ ID NO: 1307988 - DNA, 22 bp, Artificial Sequence
  chemically synthesized
gagatcactgttctaacattac

SEQ ID NO: 1307989 - DNA, 22 bp, Artificial Sequence
  chemically synthesized
atgccaaggtaatgttagaaca

SEQ ID NO: 1307990 - DNA, 22 bp, Artificial Sequence
  chemically synthesized
cctcgagatcactgttctaaca

SEQ ID NO: 1307991 - DNA, 22 bp, Artificial Sequence
  chemically synthesized
tccctcgagatcactgttctaa

SEQ ID NO: 1307992 - DNA, 22 bp, Artificial Sequence
  chemically synthesized
cattctccctcgagatcactgt

SEQ ID NO: 1307993 - DNA, 22 bp, Artificial Sequence
  chemically synthesized
gcattctccctcgagatcactg

SEQ ID NO: 1307994 - DNA, 22 bp, Artificial Sequence
  chemically synthesized
ttgcattctccctcgagatcac

SEQ ID NO: 1307995 - DNA, 22 bp, Artificial Sequence
  chemically synthesized
gaacagtgatctcgagggagaa

SEQ ID NO: 1307996 - DNA, 22 bp, Artificial Sequence
  chemically synthesized
ggggtatcattcttgcattctc

SEQ ID NO: 1307997 - DNA, 22 bp, Artificial Sequence
  chemically synthesized
gggggtatcattcttgcattct

SEQ ID NO: 1307998 - DNA, 22 bp, Artificial Sequence
  chemically synthesized
aggtttgggggtatcattcttg

SEQ ID NO: 1307999 - DNA, 22 bp, Artificial Sequence
  chemically synthesized
gagggagaatgcaagaatgata

SEQ ID NO: 1308000 - DNA, 22 bp, Artificial Sequence
  chemically synthesized
tcaggtttgggggtatcattct

SEQ ID NO: 1308001 - DNA, 22 bp, Artificial Sequence
  chemically synthesized
ctcaggtttgggggtatcattc

SEQ ID NO: 1308002 - DNA, 22 bp, Artificial Sequence
  chemically synthesized
aaagacatcatgtgccaaactt

SEQ ID NO: 1308003 - DNA, 22 bp, Artificial Sequence
  chemically synthesized
attgaaagacatcatgtgccaa

SEQ ID NO: 1308004 - DNA, 22 bp, Artificial Sequence
  chemically synthesized
gctcattgaaagacatcatgtg

SEQ ID NO: 1308005 - DNA, 22 bp, Artificial Sequence
  chemically synthesized
agaagtttggcacatgatgtct

SEQ ID NO: 1308006 - DNA, 22 bp, Artificial Sequence
  chemically synthesized
tagctcattgaaagacatcatg

SEQ ID NO: 1308007 - DNA, 22 bp, Artificial Sequence
  chemically synthesized
tctagctcattgaaagacatca

SEQ ID NO: 1308008 - DNA, 22 bp, Artificial Sequence
  chemically synthesized
ctctagctcattgaaagacatc

SEQ ID NO: 1308009 - DNA, 22 bp, Artificial Sequence
  chemically synthesized
cttctctagctcattgaaagac

SEQ ID NO: 1308010 - DNA, 22 bp, Artificial Sequence
  chemically synthesized
ggcacatgatgtctttcaatga

SEQ ID NO: 1308011 - DNA, 22 bp, Artificial Sequence
  chemically synthesized
gcacatgatgtctttcaatgag

SEQ ID NO: 1308012 - DNA, 22 bp, Artificial Sequence
  chemically synthesized
ctccttctctagctcattgaaa

SEQ ID NO: 1308013 - DNA, 22 bp, Artificial Sequence
  chemically synthesized
cctccttctctagctcattgaa

SEQ ID NO: 1308014 - DNA, 22 bp, Artificial Sequence
  chemically synthesized
ttcctccttctctagctcattg

SEQ ID NO: 1308015 - DNA, 22 bp, Artificial Sequence
  chemically synthesized
agcaattcttcctccttctcta

SEQ ID NO: 1308016 - DNA, 22 bp, Artificial Sequence
  chemically synthesized
taagcaattcttcctccttctc

SEQ ID NO: 1308017 - DNA, 22 bp, Artificial Sequence
  chemically synthesized
tcaatgagctagagaaggagga

SEQ ID NO: 1308018 - DNA, 22 bp, Artificial Sequence
  chemically synthesized
ctaagcaattcttcctccttct

SEQ ID NO: 1308019 - DNA, 22 bp, Artificial Sequence
  chemically synthesized
caatgagctagagaaggaggaa

SEQ ID NO: 1308020 - DNA, 22 bp, Artificial Sequence
  chemically synthesized
aatgagctagagaaggaggaag

SEQ ID NO: 1308021 - DNA, 22 bp, Artificial Sequence
  chemically synthesized
ccttctaagcaattcttcctcc

SEQ ID NO: 1308022 - DNA, 22 bp, Artificial Sequence
  chemically synthesized
gagaaggaggaagaattgctta

SEQ ID NO: 1308023 - DNA, 22 bp, Artificial Sequence
  chemically synthesized
cttagaaggcagtttttgatct

SEQ ID NO: 1308024 - DNA, 22 bp, Artificial Sequence
  chemically synthesized
agaaggcagtttttgatctcat

SEQ ID NO: 1308025 - DNA, 22 bp, Artificial Sequence
  chemically synthesized
gaaggcagtttttgatctcata

SEQ ID NO: 1308026 - DNA, 22 bp, Artificial Sequence
  chemically synthesized
aaaatcagtatatatgagatca

SEQ ID NO: 1308027 - DNA, 22 bp, Artificial Sequence
  chemically synthesized
attcaaaatcagtatatatgag

SEQ ID NO: 1308028 - DNA, 22 bp, Artificial Sequence
  chemically synthesized
ttgatctcatatatactgattt

SEQ ID NO: 1308029 - DNA, 22 bp, Artificial Sequence
  chemically synthesized
tgatctcatatatactgatttt

SEQ ID NO: 1308030 - DNA, 22 bp, Artificial Sequence
  chemically synthesized
gatctcatatatactgattttg

SEQ ID NO: 1308031 - DNA, 22 bp, Artificial Sequence
  chemically synthesized
atctcatatatactgattttga

SEQ ID NO: 1308032 - DNA, 22 bp, Artificial Sequence
  chemically synthesized
atatatactgattttgaattaa

SEQ ID NO: 1308033 - DNA, 22 bp, Artificial Sequence
  chemically synthesized
atgtatgtcacatagttaattc

SEQ ID NO: 1308034 - DNA, 22 bp, Artificial Sequence
  chemically synthesized
tgctcatgtatgtcacatagtt

SEQ ID NO: 1308035 - DNA, 22 bp, Artificial Sequence
  chemically synthesized
attttgaattaactatgtgaca

SEQ ID NO: 1308036 - DNA, 22 bp, Artificial Sequence
  chemically synthesized
tgaattaactatgtgacataca

SEQ ID NO: 1308037 - DNA, 22 bp, Artificial Sequence
  chemically synthesized
gaattaactatgtgacatacat

SEQ ID NO: 1308038 - DNA, 22 bp, Artificial Sequence
  chemically synthesized
aattaactatgtgacatacatg

SEQ ID NO: 1308039 - DNA, 22 bp, Artificial Sequence
  chemically synthesized
cccatcagttatgctcatgtat

SEQ ID NO: 1308040 - DNA, 22 bp, Artificial Sequence
  chemically synthesized
actatgtgacatacatgagcat

SEQ ID NO: 1308041 - DNA, 22 bp, Artificial Sequence
  chemically synthesized
tgtgacatacatgagcataact

SEQ ID NO: 1308042 - DNA, 22 bp, Artificial Sequence
  chemically synthesized
tccccctgcccatcagttatgc

SEQ ID NO: 1308043 - DNA, 22 bp, Artificial Sequence
  chemically synthesized
gagacctatccccctgcccatc

SEQ ID NO: 1308044 - DNA, 22 bp, Artificial Sequence
  chemically synthesized
agctagagacctatccccctgc

SEQ ID NO: 1308045 - DNA, 22 bp, Artificial Sequence
  chemically synthesized
gagctagagacctatccccctg

SEQ ID NO: 1308046 - DNA, 22 bp, Artificial Sequence
  chemically synthesized
tgagctagagacctatccccct

SEQ ID NO: 1308047 - DNA, 22 bp, Artificial Sequence
  chemically synthesized
ttgagctagagacctatccccc

SEQ ID NO: 1308048 - DNA, 22 bp, Artificial Sequence
  chemically synthesized
ttttgagctagagacctatccc

SEQ ID NO: 1308049 - DNA, 22 bp, Artificial Sequence
  chemically synthesized
atgggcagggggataggtctct

SEQ ID NO: 1308050 - DNA, 22 bp, Artificial Sequence
  chemically synthesized
tatccaaccaaaatcattcttt

SEQ ID NO: 1308051 - DNA, 22 bp, Artificial Sequence
  chemically synthesized
atatccaaccaaaatcattctt

SEQ ID NO: 1308052 - DNA, 22 bp, Artificial Sequence
  chemically synthesized
tatatccaaccaaaatcattct

SEQ ID NO: 1308053 - DNA, 22 bp, Artificial Sequence
  chemically synthesized
ttatatccaaccaaaatcattc

SEQ ID NO: 1308054 - DNA, 22 bp, Artificial Sequence
  chemically synthesized
tagctcaaaagaatgattttgg

SEQ ID NO: 1308055 - DNA, 22 bp, Artificial Sequence
  chemically synthesized
gctcaaaagaatgattttggtt

SEQ ID NO: 1308056 - DNA, 22 bp, Artificial Sequence
  chemically synthesized
agatttttatatccaaccaaaa

SEQ ID NO: 1308057 - DNA, 22 bp, Artificial Sequence
  chemically synthesized
aaaagaatgattttggttggat

SEQ ID NO: 1308058 - DNA, 22 bp, Artificial Sequence
  chemically synthesized
accatgaccctcagatttttat

SEQ ID NO: 1308059 - DNA, 22 bp, Artificial Sequence
  chemically synthesized
aaccatgaccctcagattttta

SEQ ID NO: 1308060 - DNA, 22 bp, Artificial Sequence
  chemically synthesized
tggttggatataaaaatctgag

SEQ ID NO: 1308061 - DNA, 22 bp, Artificial Sequence
  chemically synthesized
ttaaccatgaccctcagatttt

SEQ ID NO: 1308062 - DNA, 22 bp, Artificial Sequence
  chemically synthesized
ggttggatataaaaatctgagg

SEQ ID NO: 1308063 - DNA, 22 bp, Artificial Sequence
  chemically synthesized
gttggatataaaaatctgaggg

SEQ ID NO: 1308064 - DNA, 22 bp, Artificial Sequence
  chemically synthesized
gatataaaaatctgagggtcat

SEQ ID NO: 1308065 - DNA, 22 bp, Artificial Sequence
  chemically synthesized
agggtcatggttaagagttgtt

SEQ ID NO: 1308066 - DNA, 22 bp, Artificial Sequence
  chemically synthesized
atcaaaatccatagcaataaca

SEQ ID NO: 1308067 - DNA, 22 bp, Artificial Sequence
  chemically synthesized
atctcatcaaaatccatagcaa

SEQ ID NO: 1308068 - DNA, 22 bp, Artificial Sequence
  chemically synthesized
gatctcatcaaaatccatagca

SEQ ID NO: 1308069 - DNA, 22 bp, Artificial Sequence
  chemically synthesized
agagttgttattgctatggatt

SEQ ID NO: 1308070 - DNA, 22 bp, Artificial Sequence
  chemically synthesized
ttgatctcatcaaaatccatag

SEQ ID NO: 1308071 - DNA, 22 bp, Artificial Sequence
  chemically synthesized
cttgatctcatcaaaatccata

SEQ ID NO: 1308072 - DNA, 22 bp, Artificial Sequence
  chemically synthesized
tcttgatctcatcaaaatccat

SEQ ID NO: 1308073 - DNA, 22 bp, Artificial Sequence
  chemically synthesized
ttcttgatctcatcaaaatcca

SEQ ID NO: 1308074 - DNA, 22 bp, Artificial Sequence
  chemically synthesized
ttattgctatggattttgatga

SEQ ID NO: 1308075 - DNA, 22 bp, Artificial Sequence
  chemically synthesized
ttgctatggattttgatgagat

SEQ ID NO: 1308076 - DNA, 22 bp, Artificial Sequence
  chemically synthesized
ctatggattttgatgagatcaa

SEQ ID NO: 1308077 - DNA, 22 bp, Artificial Sequence
  chemically synthesized
tggattttgatgagatcaagaa

SEQ ID NO: 1308078 - DNA, 22 bp, Artificial Sequence
  chemically synthesized
aatcaacatatttttcttgatc

SEQ ID NO: 1308079 - DNA, 22 bp, Artificial Sequence
  chemically synthesized
tgatgagatcaagaaaaatatg

SEQ ID NO: 1308080 - DNA, 22 bp, Artificial Sequence
  chemically synthesized
atgctcaatcaacatatttttc

SEQ ID NO: 1308081 - DNA, 22 bp, Artificial Sequence
  chemically synthesized
gatgagatcaagaaaaatatgt

SEQ ID NO: 1308082 - DNA, 22 bp, Artificial Sequence
  chemically synthesized
aatgctcaatcaacatattttt

SEQ ID NO: 1308083 - DNA, 22 bp, Artificial Sequence
  chemically synthesized
atgagatcaagaaaaatatgtt

SEQ ID NO: 1308084 - DNA, 22 bp, Artificial Sequence
  chemically synthesized
aatcttaatgctcaatcaacat

SEQ ID NO: 1308085 - DNA, 22 bp, Artificial Sequence
  chemically synthesized
caatcttaatgctcaatcaaca

SEQ ID NO: 1308086 - DNA, 22 bp, Artificial Sequence
  chemically synthesized
agcttcaatcttaatgctcaat

SEQ ID NO: 1308087 - DNA, 22 bp, Artificial Sequence
  chemically synthesized
acgttgagcttcaatcttaatg

SEQ ID NO: 1308088 - DNA, 22 bp, Artificial Sequence
  chemically synthesized
aacgttgagcttcaatcttaat

SEQ ID NO: 1308089 - DNA, 22 bp, Artificial Sequence
  chemically synthesized
taacgttgagcttcaatcttaa

SEQ ID NO: 1308090 - DNA, 22 bp, Artificial Sequence
  chemically synthesized
ttaacgttgagcttcaatctta

SEQ ID NO: 1308091 - DNA, 22 bp, Artificial Sequence
  chemically synthesized
ttttaacgttgagcttcaatct

SEQ ID NO: 1308092 - DNA, 22 bp, Artificial Sequence
  chemically synthesized
attgagcattaagattgaagct

SEQ ID NO: 1308093 - DNA, 22 bp, Artificial Sequence
  chemically synthesized
agcattaagattgaagctcaac

SEQ ID NO: 1308094 - DNA, 22 bp, Artificial Sequence
  chemically synthesized
tcgtaaatctcttttaacgttg

SEQ ID NO: 1308095 - DNA, 22 bp, Artificial Sequence
  chemically synthesized
agattgaagctcaacgttaaaa

SEQ ID NO: 1308096 - DNA, 22 bp, Artificial Sequence
  chemically synthesized
ctatcgtaaatctcttttaacg

SEQ ID NO: 1308097 - DNA, 22 bp, Artificial Sequence
  chemically synthesized
tcctatcgtaaatctcttttaa

SEQ ID NO: 1308098 - DNA, 22 bp, Artificial Sequence
  chemically synthesized
aagctcaacgttaaaagagatt

SEQ ID NO: 1308099 - DNA, 22 bp, Artificial Sequence
  chemically synthesized
ctctcctatcgtaaatctcttt

SEQ ID NO: 1308100 - DNA, 22 bp, Artificial Sequence
  chemically synthesized
aacgttaaaagagatttacgat

SEQ ID NO: 1308101 - DNA, 22 bp, Artificial Sequence
  chemically synthesized
gagggttgctctcctatcgtaa

SEQ ID NO: 1308102 - DNA, 22 bp, Artificial Sequence
  chemically synthesized
ggagggttgctctcctatcgta

SEQ ID NO: 1308103 - DNA, 22 bp, Artificial Sequence
  chemically synthesized
ttggagggttgctctcctatcg

SEQ ID NO: 1308104 - DNA, 22 bp, Artificial Sequence
  chemically synthesized
aaagagatttacgataggagag

SEQ ID NO: 1308105 - DNA, 22 bp, Artificial Sequence
  chemically synthesized
cttggagggttgctctcctatc

SEQ ID NO: 1308106 - DNA, 22 bp, Artificial Sequence
  chemically synthesized
tcttggagggttgctctcctat

SEQ ID NO: 1308107 - DNA, 22 bp, Artificial Sequence
  chemically synthesized
tcattttcttggagggttgctc

SEQ ID NO: 1308108 - DNA, 22 bp, Artificial Sequence
  chemically synthesized
atcattttcttggagggttgct

SEQ ID NO: 1308109 - DNA, 22 bp, Artificial Sequence
  chemically synthesized
tatcattttcttggagggttgc

SEQ ID NO: 1308110 - DNA, 22 bp, Artificial Sequence
  chemically synthesized
acgataggagagcaaccctcca

SEQ ID NO: 1308111 - DNA, 22 bp, Artificial Sequence
  chemically synthesized
cgataggagagcaaccctccaa

SEQ ID NO: 1308112 - DNA, 22 bp, Artificial Sequence
  chemically synthesized
agggcaactttatcattttctt

SEQ ID NO: 1308113 - DNA, 22 bp, Artificial Sequence
  chemically synthesized
tctcagggcaactttatcattt

SEQ ID NO: 1308114 - DNA, 22 bp, Artificial Sequence
  chemically synthesized
ctgtctcagggcaactttatca

SEQ ID NO: 1308115 - DNA, 22 bp, Artificial Sequence
  chemically synthesized
cctgtctcagggcaactttatc

SEQ ID NO: 1308116 - DNA, 22 bp, Artificial Sequence
  chemically synthesized
tcctgtctcagggcaactttat

SEQ ID NO: 1308117 - DNA, 22 bp, Artificial Sequence
  chemically synthesized
caagaaaatgataaagttgccc

SEQ ID NO: 1308118 - DNA, 22 bp, Artificial Sequence
  chemically synthesized
gttttcctgtctcagggcaact

SEQ ID NO: 1308119 - DNA, 22 bp, Artificial Sequence
  chemically synthesized
tagttttcctgtctcagggcaa

SEQ ID NO: 1308120 - DNA, 22 bp, Artificial Sequence
  chemically synthesized
ttctagttttcctgtctcaggg

SEQ ID NO: 1308121 - DNA, 22 bp, Artificial Sequence
  chemically synthesized
cactattctagttttcctgtct

SEQ ID NO: 1308122 - DNA, 22 bp, Artificial Sequence
  chemically synthesized
ccctgagacaggaaaactagaa

SEQ ID NO: 1308123 - DNA, 22 bp, Artificial Sequence
  chemically synthesized
agatattccactattctagttt

SEQ ID NO: 1308124 - DNA, 22 bp, Artificial Sequence
  chemically synthesized
taagatattccactattctagt

SEQ ID NO: 1308125 - DNA, 22 bp, Artificial Sequence
  chemically synthesized
ctaagatattccactattctag

SEQ ID NO: 1308126 - DNA, 22 bp, Artificial Sequence
  chemically synthesized
agacaggaaaactagaatagtg

SEQ ID NO: 1308127 - DNA, 22 bp, Artificial Sequence
  chemically synthesized
gcttctaagatattccactatt

SEQ ID NO: 1308128 - DNA, 22 bp, Artificial Sequence
  chemically synthesized
cctggcttctaagatattccac

SEQ ID NO: 1308129 - DNA, 22 bp, Artificial Sequence
  chemically synthesized
ccctggcttctaagatattcca

SEQ ID NO: 1308130 - DNA, 22 bp, Artificial Sequence
  chemically synthesized
ttccctggcttctaagatattc

SEQ ID NO: 1308131 - DNA, 22 bp, Artificial Sequence
  chemically synthesized
cttccctggcttctaagatatt

SEQ ID NO: 1308132 - DNA, 22 bp, Artificial Sequence
  chemically synthesized
ttcttccctggcttctaagata

SEQ ID NO: 1308133 - DNA, 22 bp, Artificial Sequence
  chemically synthesized
gaatagtggaatatcttagaag

SEQ ID NO: 1308134 - DNA, 22 bp, Artificial Sequence
  chemically synthesized
gaaaaactcttcttccctggct

SEQ ID NO: 1308135 - DNA, 22 bp, Artificial Sequence
  chemically synthesized
ttggaaaaactcttcttccctg

SEQ ID NO: 1308136 - DNA, 22 bp, Artificial Sequence
  chemically synthesized
ctattggaaaaactcttcttcc

SEQ ID NO: 1308137 - DNA, 22 bp, Artificial Sequence
  chemically synthesized
cctattggaaaaactcttcttc

SEQ ID NO: 1308138 - DNA, 22 bp, Artificial Sequence
  chemically synthesized
agaagccagggaagaagagttt

SEQ ID NO: 1308139 - DNA, 22 bp, Artificial Sequence
  chemically synthesized
gaagccagggaagaagagtttt

SEQ ID NO: 1308140 - DNA, 22 bp, Artificial Sequence
  chemically synthesized
atcggtccttcctattggaaaa

SEQ ID NO: 1308141 - DNA, 22 bp, Artificial Sequence
  chemically synthesized
ttgatcggtccttcctattgga

SEQ ID NO: 1308142 - DNA, 22 bp, Artificial Sequence
  chemically synthesized
attgttgatcggtccttcctat

SEQ ID NO: 1308143 - DNA, 22 bp, Artificial Sequence
  chemically synthesized
ttccaataggaaggaccgatca

SEQ ID NO: 1308144 - DNA, 22 bp, Artificial Sequence
  chemically synthesized
tccaataggaaggaccgatcaa

SEQ ID NO: 1308145 - DNA, 22 bp, Artificial Sequence
  chemically synthesized
tagtattgattgttgatcggtc

SEQ ID NO: 1308146 - DNA, 22 bp, Artificial Sequence
  chemically synthesized
ccaataggaaggaccgatcaac

SEQ ID NO: 1308147 - DNA, 22 bp, Artificial Sequence
  chemically synthesized
caataggaaggaccgatcaaca

SEQ ID NO: 1308148 - DNA, 22 bp, Artificial Sequence
  chemically synthesized
tgtagtattgattgttgatcgg

SEQ ID NO: 1308149 - DNA, 22 bp, Artificial Sequence
  chemically synthesized
ccactctgtagtattgattgtt

SEQ ID NO: 1308150 - DNA, 22 bp, Artificial Sequence
  chemically synthesized
accactctgtagtattgattgt

SEQ ID NO: 1308151 - DNA, 22 bp, Artificial Sequence
  chemically synthesized
atcttaccactctgtagtattg

SEQ ID NO: 1308152 - DNA, 22 bp, Artificial Sequence
  chemically synthesized
cagagtggtaagatgaggcctg

SEQ ID NO: 1308153 - DNA, 22 bp, Artificial Sequence
  chemically synthesized
tcacggcccaagtcacatcagg

SEQ ID NO: 1308154 - DNA, 22 bp, Artificial Sequence
  chemically synthesized
gtcacggcccaagtcacatcag

SEQ ID NO: 1308155 - DNA, 22 bp, Artificial Sequence
  chemically synthesized
tgtcacggcccaagtcacatca

SEQ ID NO: 1308156 - DNA, 22 bp, Artificial Sequence
  chemically synthesized
attttgtcacggcccaagtcac

SEQ ID NO: 1308157 - DNA, 22 bp, Artificial Sequence
  chemically synthesized
aaattgattttgtcacggccca

SEQ ID NO: 1308158 - DNA, 22 bp, Artificial Sequence
  chemically synthesized
atgtgacttgggccgtgacaaa

SEQ ID NO: 1308159 - DNA, 22 bp, Artificial Sequence
  chemically synthesized
aactgaaattgattttgtcacg

SEQ ID NO: 1308160 - DNA, 22 bp, Artificial Sequence
  chemically synthesized
caactgaaattgattttgtcac

SEQ ID NO: 1308161 - DNA, 22 bp, Artificial Sequence
  chemically synthesized
gggccgtgacaaaatcaatttc

SEQ ID NO: 1308162 - DNA, 22 bp, Artificial Sequence
  chemically synthesized
ggccgtgacaaaatcaatttca

SEQ ID NO: 1308163 - DNA, 22 bp, Artificial Sequence
  chemically synthesized
cacatccttcaactgaaattga

SEQ ID NO: 1308164 - DNA, 22 bp, Artificial Sequence
  chemically synthesized
ccacatccttcaactgaaattg

SEQ ID NO: 1308165 - DNA, 22 bp, Artificial Sequence
  chemically synthesized
cttccacatccttcaactgaaa

SEQ ID NO: 1308166 - DNA, 22 bp, Artificial Sequence
  chemically synthesized
cagttgaaggatgtggaagcag

SEQ ID NO: 1308167 - DNA, 22 bp, Artificial Sequence
  chemically synthesized
agttgaaggatgtggaagcagc

SEQ ID NO: 1308168 - DNA, 22 bp, Artificial Sequence
  chemically synthesized
aaacaccaataatccggctgct

SEQ ID NO: 1308169 - DNA, 22 bp, Artificial Sequence
  chemically synthesized
aaggatgtggaagcagccggat

SEQ ID NO: 1308170 - DNA, 22 bp, Artificial Sequence
  chemically synthesized
cctcaaacaccaataatccggc

SEQ ID NO: 1308171 - DNA, 22 bp, Artificial Sequence
  chemically synthesized
acgtagctacctcaaacaccaa

SEQ ID NO: 1308172 - DNA, 22 bp, Artificial Sequence
  chemically synthesized
ctcacgtagctacctcaaacac

SEQ ID NO: 1308173 - DNA, 22 bp, Artificial Sequence
  chemically synthesized
actcacgtagctacctcaaaca

SEQ ID NO: 1308174 - DNA, 22 bp, Artificial Sequence
  chemically synthesized
cttactcacgtagctacctcaa

SEQ ID NO: 1308175 - DNA, 22 bp, Artificial Sequence
  chemically synthesized
ccttactcacgtagctacctca

SEQ ID NO: 1308176 - DNA, 22 bp, Artificial Sequence
  chemically synthesized
cttccttactcacgtagctacc

SEQ ID NO: 1308177 - DNA, 22 bp, Artificial Sequence
  chemically synthesized
ttggtgtttgaggtagctacgt

SEQ ID NO: 1308178 - DNA, 22 bp, Artificial Sequence
  chemically synthesized
gtgtttgaggtagctacgtgag

SEQ ID NO: 1308179 - DNA, 22 bp, Artificial Sequence
  chemically synthesized
tatctacttccttactcacgta

SEQ ID NO: 1308180 - DNA, 22 bp, Artificial Sequence
  chemically synthesized
gaggtagctacgtgagtaagga

SEQ ID NO: 1308181 - DNA, 22 bp, Artificial Sequence
  chemically synthesized
attgtatctacttccttactca

SEQ ID NO: 1308182 - DNA, 22 bp, Artificial Sequence
  chemically synthesized
aggtagctacgtgagtaaggaa

SEQ ID NO: 1308183 - DNA, 22 bp, Artificial Sequence
  chemically synthesized
tgctcattgtatctacttcctt

SEQ ID NO: 1308184 - DNA, 22 bp, Artificial Sequence
  chemically synthesized
tatgctcattgtatctacttcc

SEQ ID NO: 1308185 - DNA, 22 bp, Artificial Sequence
  chemically synthesized
ctatgctcattgtatctacttc

SEQ ID NO: 1308186 - DNA, 22 bp, Artificial Sequence
  chemically synthesized
cgtgagtaaggaagtagataca

SEQ ID NO: 1308187 - DNA, 22 bp, Artificial Sequence
  chemically synthesized
acaatttctatgctcattgtat

SEQ ID NO: 1308188 - DNA, 22 bp, Artificial Sequence
  chemically synthesized
aacaatttctatgctcattgta

SEQ ID NO: 1308189 - DNA, 22 bp, Artificial Sequence
  chemically synthesized
taacaatttctatgctcattgt

SEQ ID NO: 1308190 - DNA, 22 bp, Artificial Sequence
  chemically synthesized
tttaacaatttctatgctcatt

SEQ ID NO: 1308191 - DNA, 22 bp, Artificial Sequence
  chemically synthesized
ctttaacaatttctatgctcat

SEQ ID NO: 1308192 - DNA, 22 bp, Artificial Sequence
  chemically synthesized
aacttctttaacaatttctatg

SEQ ID NO: 1308193 - DNA, 22 bp, Artificial Sequence
  chemically synthesized
aagctaaacttctttaacaatt

SEQ ID NO: 1308194 - DNA, 22 bp, Artificial Sequence
  chemically synthesized
ctgaagctaaacttctttaaca

SEQ ID NO: 1308195 - DNA, 22 bp, Artificial Sequence
  chemically synthesized
cactcctgaagctaaacttctt

SEQ ID NO: 1308196 - DNA, 22 bp, Artificial Sequence
  chemically synthesized
ccactcctgaagctaaacttct

SEQ ID NO: 1308197 - DNA, 22 bp, Artificial Sequence
  chemically synthesized
tccactcctgaagctaaacttc

SEQ ID NO: 1308198 - DNA, 22 bp, Artificial Sequence
  chemically synthesized
ttttccactcctgaagctaaac

SEQ ID NO: 1308199 - DNA, 22 bp, Artificial Sequence
  chemically synthesized
ttattttccactcctgaagcta

SEQ ID NO: 1308200 - DNA, 22 bp, Artificial Sequence
  chemically synthesized
ttaaagaagtttagcttcagga

SEQ ID NO: 1308201 - DNA, 22 bp, Artificial Sequence
  chemically synthesized
gttattttccactcctgaagct

SEQ ID NO: 1308202 - DNA, 22 bp, Artificial Sequence
  chemically synthesized
aagaagtttagcttcaggagtg

SEQ ID NO: 1308203 - DNA, 22 bp, Artificial Sequence
  chemically synthesized
ccgacttgttattttccactcc

SEQ ID NO: 1308204 - DNA, 22 bp, Artificial Sequence
  chemically synthesized
ctaccgacttgttattttccac

SEQ ID NO: 1308205 - DNA, 22 bp, Artificial Sequence
  chemically synthesized
agcttcaggagtggaaaataac

SEQ ID NO: 1308206 - DNA, 22 bp, Artificial Sequence
  chemically synthesized
gcttcaggagtggaaaataaca

SEQ ID NO: 1308207 - DNA, 22 bp, Artificial Sequence
  chemically synthesized
atctcctaccgacttgttattt

SEQ ID NO: 1308208 - DNA, 22 bp, Artificial Sequence
  chemically synthesized
aatctcctaccgacttgttatt

SEQ ID NO: 1308209 - DNA, 22 bp, Artificial Sequence
  chemically synthesized
caggagtggaaaataacaagtc

SEQ ID NO: 1308210 - DNA, 22 bp, Artificial Sequence
  chemically synthesized
taatctcctaccgacttgttat

SEQ ID NO: 1308211 - DNA, 22 bp, Artificial Sequence
  chemically synthesized
aggagtggaaaataacaagtcg

SEQ ID NO: 1308212 - DNA, 22 bp, Artificial Sequence
  chemically synthesized
ttaatctcctaccgacttgtta

SEQ ID NO: 1308213 - DNA, 22 bp, Artificial Sequence
  chemically synthesized
gtttttaatctcctaccgactt

SEQ ID NO: 1308214 - DNA, 22 bp, Artificial Sequence
  chemically synthesized
ttagtttttaatctcctaccga

SEQ ID NO: 1308215 - DNA, 22 bp, Artificial Sequence
  chemically synthesized
ctattagtttttaatctcctac

SEQ ID NO: 1308216 - DNA, 22 bp, Artificial Sequence
  chemically synthesized
tgctattagtttttaatctcct

SEQ ID NO: 1308217 - DNA, 22 bp, Artificial Sequence
  chemically synthesized
tagtaacaaataggacattctg

SEQ ID NO: 1308218 - DNA, 22 bp, Artificial Sequence
  chemically synthesized
aaaactaatagcagaatgtcct

SEQ ID NO: 1308219 - DNA, 22 bp, Artificial Sequence
  chemically synthesized
cctgtagtaacaaataggacat

SEQ ID NO: 1308220 - DNA, 22 bp, Artificial Sequence
  chemically synthesized
atagcagaatgtcctatttgtt

SEQ ID NO: 1308221 - DNA, 22 bp, Artificial Sequence
  chemically synthesized
caatacagtgttgcctgtagta

SEQ ID NO: 1308222 - DNA, 22 bp, Artificial Sequence
  chemically synthesized
gcaatacagtgttgcctgtagt

SEQ ID NO: 1308223 - DNA, 22 bp, Artificial Sequence
  chemically synthesized
acttgcaatacagtgttgcctg

SEQ ID NO: 1308224 - DNA, 22 bp, Artificial Sequence
  chemically synthesized
aacttgcaatacagtgttgcct

SEQ ID NO: 1308225 - DNA, 22 bp, Artificial Sequence
  chemically synthesized
tttgttactacaggcaacactg

SEQ ID NO: 1308226 - DNA, 22 bp, Artificial Sequence
  chemically synthesized
taacttgcaatacagtgttgcc

SEQ ID NO: 1308227 - DNA, 22 bp, Artificial Sequence
  chemically synthesized
gttactacaggcaacactgtat

SEQ ID NO: 1308228 - DNA, 22 bp, Artificial Sequence
  chemically synthesized
ttttaacttgcaatacagtgtt

SEQ ID NO: 1308229 - DNA, 22 bp, Artificial Sequence
  chemically synthesized
ttactacaggcaacactgtatt

SEQ ID NO: 1308230 - DNA, 22 bp, Artificial Sequence
  chemically synthesized
attttaacttgcaatacagtgt

SEQ ID NO: 1308231 - DNA, 22 bp, Artificial Sequence
  chemically synthesized
ctacaggcaacactgtattgca

SEQ ID NO: 1308232 - DNA, 22 bp, Artificial Sequence
  chemically synthesized
atttattttaacttgcaataca

SEQ ID NO: 1308233 - DNA, 22 bp, Artificial Sequence
  chemically synthesized
caggcaacactgtattgcaagt

SEQ ID NO: 1308234 - DNA, 22 bp, Artificial Sequence
  chemically synthesized
actaatttattttaacttgcaa

SEQ ID NO: 1308235 - DNA, 22 bp, Artificial Sequence
  chemically synthesized
aactaatttattttaacttgca

SEQ ID NO: 1308236 - DNA, 22 bp, Artificial Sequence
  chemically synthesized
tattgcaagttaaaataaatta

SEQ ID NO: 1308237 - DNA, 22 bp, Artificial Sequence
  chemically synthesized
tgtcaggtttaactaatttatt

SEQ ID NO: 1308238 - DNA, 22 bp, Artificial Sequence
  chemically synthesized
gtgtcaggtttaactaatttat

SEQ ID NO: 1308239 - DNA, 22 bp, Artificial Sequence
  chemically synthesized
caagttaaaataaattagttaa

SEQ ID NO: 1308240 - DNA, 22 bp, Artificial Sequence
  chemically synthesized
aggcatttgtgtcaggtttaac

SEQ ID NO: 1308241 - DNA, 22 bp, Artificial Sequence
  chemically synthesized
aaataaattagttaaacctgac

SEQ ID NO: 1308242 - DNA, 22 bp, Artificial Sequence
  chemically synthesized
cgttcaggcatttgtgtcaggt

SEQ ID NO: 1308243 - DNA, 22 bp, Artificial Sequence
  chemically synthesized
gcgttcaggcatttgtgtcagg

SEQ ID NO: 1308244 - DNA, 22 bp, Artificial Sequence
  chemically synthesized
ttgcgttcaggcatttgtgtca

SEQ ID NO: 1308245 - DNA, 22 bp, Artificial Sequence
  chemically synthesized
cttgcgttcaggcatttgtgtc

SEQ ID NO: 1308246 - DNA, 22 bp, Artificial Sequence
  chemically synthesized
tcttgcgttcaggcatttgtgt

SEQ ID NO: 1308247 - DNA, 22 bp, Artificial Sequence
  chemically synthesized
ttcttgcgttcaggcatttgtg

SEQ ID NO: 1308248 - DNA, 22 bp, Artificial Sequence
  chemically synthesized
gttaaacctgacacaaatgcct

SEQ ID NO: 1308249 - DNA, 22 bp, Artificial Sequence
  chemically synthesized
tttcttgcgttcaggcatttgt

SEQ ID NO: 1308250 - DNA, 22 bp, Artificial Sequence
  chemically synthesized
ttttcttgcgttcaggcatttg

SEQ ID NO: 1308251 - DNA, 22 bp, Artificial Sequence
  chemically synthesized
tttttcttgcgttcaggcattt

SEQ ID NO: 1308252 - DNA, 22 bp, Artificial Sequence
  chemically synthesized
aacctgacacaaatgcctgaac

SEQ ID NO: 1308253 - DNA, 22 bp, Artificial Sequence
  chemically synthesized
attttttttcttgcgttcaggc

SEQ ID NO: 1308254 - DNA, 22 bp, Artificial Sequence
  chemically synthesized
aattttttttcttgcgttcagg

SEQ ID NO: 1308255 - DNA, 22 bp, Artificial Sequence
  chemically synthesized
taattttttttcttgcgttcag

SEQ ID NO: 1308256 - DNA, 22 bp, Artificial Sequence
  chemically synthesized
acacaaatgcctgaacgcaaga

SEQ ID NO: 1308257 - DNA, 22 bp, Artificial Sequence
  chemically synthesized
aagaaaccctttaatttttttt

SEQ ID NO: 1308258 - DNA, 22 bp, Artificial Sequence
  chemically synthesized
aacgcaagaaaaaaaattaaag

SEQ ID NO: 1308259 - DNA, 22 bp, Artificial Sequence
  chemically synthesized
gttgaagaaaccctttaatttt

SEQ ID NO: 1308260 - DNA, 22 bp, Artificial Sequence
  chemically synthesized
aaatacaaatgtctggttgaag

SEQ ID NO: 1308261 - DNA, 22 bp, Artificial Sequence
  chemically synthesized
aaaatacaaatgtctggttgaa

SEQ ID NO: 1308262 - DNA, 22 bp, Artificial Sequence
  chemically synthesized
aagggtttcttcaaccagacat

SEQ ID NO: 1308263 - DNA, 22 bp, Artificial Sequence
  chemically synthesized
cttcaaccagacatttgtattt

SEQ ID NO: 1308264 - DNA, 22 bp, Artificial Sequence
  chemically synthesized
ttcaaccagacatttgtatttt

SEQ ID NO: 1308265 - DNA, 22 bp, Artificial Sequence
  chemically synthesized
caaccagacatttgtattttaa

SEQ ID NO: 1308266 - DNA, 22 bp, Artificial Sequence
  chemically synthesized
aaccagacatttgtattttaag

SEQ ID NO: 1308267 - DNA, 22 bp, Artificial Sequence
  chemically synthesized
ccaaaataaaatgcttaaaata

SEQ ID NO: 1308268 - DNA, 22 bp, Artificial Sequence
  chemically synthesized
attgccaaaataaaatgcttaa

SEQ ID NO: 1308269 - DNA, 22 bp, Artificial Sequence
  chemically synthesized
gtattttaagcattttattttg

SEQ ID NO: 1308270 - DNA, 22 bp, Artificial Sequence
  chemically synthesized
tattttaagcattttattttgg

SEQ ID NO: 1308271 - DNA, 22 bp, Artificial Sequence
  chemically synthesized
cccaattgattgccaaaataaa

SEQ ID NO: 1308272 - DNA, 22 bp, Artificial Sequence
  chemically synthesized
ccccaattgattgccaaaataa

SEQ ID NO: 1308273 - DNA, 22 bp, Artificial Sequence
  chemically synthesized
taagcattttattttggcaatc

SEQ ID NO: 1308274 - DNA, 22 bp, Artificial Sequence
  chemically synthesized
atttccccaattgattgccaaa

SEQ ID NO: 1308275 - DNA, 22 bp, Artificial Sequence
  chemically synthesized
aagcattttattttggcaatca

SEQ ID NO: 1308276 - DNA, 22 bp, Artificial Sequence
  chemically synthesized
agcattttattttggcaatcaa

SEQ ID NO: 1308277 - DNA, 22 bp, Artificial Sequence
  chemically synthesized
tattttggcaatcaattgggga

SEQ ID NO: 1308278 - DNA, 22 bp, Artificial Sequence
  chemically synthesized
attttggcaatcaattggggaa

SEQ ID NO: 1308279 - DNA, 22 bp, Artificial Sequence
  chemically synthesized
ttttggcaatcaattggggaaa

SEQ ID NO: 1308280 - DNA, 22 bp, Artificial Sequence
  chemically synthesized
tggcaatcaattggggaaatga

SEQ ID NO: 1308281 - DNA, 22 bp, Artificial Sequence
  chemically synthesized
ggcaatcaattggggaaatgag

SEQ ID NO: 1308282 - DNA, 22 bp, Artificial Sequence
  chemically synthesized
aggagaaaatatctcatttccc

SEQ ID NO: 1308283 - DNA, 22 bp, Artificial Sequence
  chemically synthesized
gcaatcaattggggaaatgaga

SEQ ID NO: 1308284 - DNA, 22 bp, Artificial Sequence
  chemically synthesized
gaggagaaaatatctcatttcc

SEQ ID NO: 1308285 - DNA, 22 bp, Artificial Sequence
  chemically synthesized
tgaggagaaaatatctcatttc

SEQ ID NO: 1308286 - DNA, 22 bp, Artificial Sequence
  chemically synthesized
cctttgaggagaaaatatctca

SEQ ID NO: 1308287 - DNA, 22 bp, Artificial Sequence
  chemically synthesized
gggaaatgagatattttctcct

SEQ ID NO: 1308288 - DNA, 22 bp, Artificial Sequence
  chemically synthesized
cagcattacctttgaggagaaa

SEQ ID NO: 1308289 - DNA, 22 bp, Artificial Sequence
  chemically synthesized
ctacagcattacctttgaggag

SEQ ID NO: 1308290 - DNA, 22 bp, Artificial Sequence
  chemically synthesized
taactgctacagcattaccttt

SEQ ID NO: 1308291 - DNA, 22 bp, Artificial Sequence
  chemically synthesized
tctcctcaaaggtaatgctgta

SEQ ID NO: 1308292 - DNA, 22 bp, Artificial Sequence
  chemically synthesized
ctcctcaaaggtaatgctgtag

SEQ ID NO: 1308293 - DNA, 22 bp, Artificial Sequence
  chemically synthesized
tcctcaaaggtaatgctgtagc

SEQ ID NO: 1308294 - DNA, 22 bp, Artificial Sequence
  chemically synthesized
ctcaaaggtaatgctgtagcag

SEQ ID NO: 1308295 - DNA, 22 bp, Artificial Sequence
  chemically synthesized
gaatacaattataactgctaca

SEQ ID NO: 1308296 - DNA, 22 bp, Artificial Sequence
  chemically synthesized
aaaggtaatgctgtagcagtta

SEQ ID NO: 1308297 - DNA, 22 bp, Artificial Sequence
  chemically synthesized
tagcagttataattgtattcca

SEQ ID NO: 1308298 - DNA, 22 bp, Artificial Sequence
  chemically synthesized
taatagtagcccgcaagtcctg

SEQ ID NO: 1308299 - DNA, 22 bp, Artificial Sequence
  chemically synthesized
taattgtattccaggacttgcg

SEQ ID NO: 1308300 - DNA, 22 bp, Artificial Sequence
  chemically synthesized
gtaatagtagcccgcaagtcct

SEQ ID NO: 1308301 - DNA, 22 bp, Artificial Sequence
  chemically synthesized
tattccaggacttgcgggctac

SEQ ID NO: 1308302 - DNA, 22 bp, Artificial Sequence
  chemically synthesized
caggacttgcgggctactatta

SEQ ID NO: 1308303 - DNA, 22 bp, Artificial Sequence
  chemically synthesized
catgagtatttgtaatagtagc

SEQ ID NO: 1308304 - DNA, 22 bp, Artificial Sequence
  chemically synthesized
ccatgagtatttgtaatagtag

SEQ ID NO: 1308305 - DNA, 22 bp, Artificial Sequence
  chemically synthesized
atttccatgagtatttgtaata

SEQ ID NO: 1308306 - DNA, 22 bp, Artificial Sequence
  chemically synthesized
gcgggctactattacaaatact

SEQ ID NO: 1308307 - DNA, 22 bp, Artificial Sequence
  chemically synthesized
cgggctactattacaaatactc

SEQ ID NO: 1308308 - DNA, 22 bp, Artificial Sequence
  chemically synthesized
attaatttccatgagtatttgt

SEQ ID NO: 1308309 - DNA, 22 bp, Artificial Sequence
  chemically synthesized
ctattacaaatactcatggaaa

SEQ ID NO: 1308310 - DNA, 22 bp, Artificial Sequence
  chemically synthesized
ttacaaatactcatggaaatta

SEQ ID NO: 1308311 - DNA, 22 bp, Artificial Sequence
  chemically synthesized
caaatactcatggaaattaatg

SEQ ID NO: 1308312 - DNA, 22 bp, Artificial Sequence
  chemically synthesized
atggaaattaatgaatttttat

SEQ ID NO: 1308313 - DNA, 22 bp, Artificial Sequence
  chemically synthesized
cagagccagggggataaaaatt

SEQ ID NO: 1308314 - DNA, 22 bp, Artificial Sequence
  chemically synthesized
ctccagagccagggggataaaa

SEQ ID NO: 1308315 - DNA, 22 bp, Artificial Sequence
  chemically synthesized
atgaatttttatccccctggct

SEQ ID NO: 1308316 - DNA, 22 bp, Artificial Sequence
  chemically synthesized
agccactcctccagagccaggg

SEQ ID NO: 1308317 - DNA, 22 bp, Artificial Sequence
  chemically synthesized
cagccactcctccagagccagg

SEQ ID NO: 1308318 - DNA, 22 bp, Artificial Sequence
  chemically synthesized
tcagccactcctccagagccag

SEQ ID NO: 1308319 - DNA, 22 bp, Artificial Sequence
  chemically synthesized
ttatccccctggctctggagga

SEQ ID NO: 1308320 - DNA, 22 bp, Artificial Sequence
  chemically synthesized
tatccccctggctctggaggag

SEQ ID NO: 1308321 - DNA, 22 bp, Artificial Sequence
  chemically synthesized
atccccctggctctggaggagt

SEQ ID NO: 1308322 - DNA, 22 bp, Artificial Sequence
  chemically synthesized
tccccctggctctggaggagtg

SEQ ID NO: 1308323 - DNA, 22 bp, Artificial Sequence
  chemically synthesized
gctctggaggagtggctgaaag

SEQ ID NO: 1308324 - DNA, 22 bp, Artificial Sequence
  chemically synthesized
taaaacacggtgctttcagcca

SEQ ID NO: 1308325 - DNA, 22 bp, Artificial Sequence
  chemically synthesized
tggaggagtggctgaaagcacc

SEQ ID NO: 1308326 - DNA, 22 bp, Artificial Sequence
  chemically synthesized
gaggagtggctgaaagcaccgt

SEQ ID NO: 1308327 - DNA, 22 bp, Artificial Sequence
  chemically synthesized
tcagactataaaacacggtgct

SEQ ID NO: 1308328 - DNA, 22 bp, Artificial Sequence
  chemically synthesized
gtcagactataaaacacggtgc

SEQ ID NO: 1308329 - DNA, 22 bp, Artificial Sequence
  chemically synthesized
aaagcaccgtgttttatagtct

SEQ ID NO: 1308330 - DNA, 22 bp, Artificial Sequence
  chemically synthesized
ggaatagaacccaaatttgtca

SEQ ID NO: 1308331 - DNA, 22 bp, Artificial Sequence
  chemically synthesized
tatagtctgacaaatttgggtt

SEQ ID NO: 1308332 - DNA, 22 bp, Artificial Sequence
  chemically synthesized
atagtctgacaaatttgggttc

SEQ ID NO: 1308333 - DNA, 22 bp, Artificial Sequence
  chemically synthesized
tagtctgacaaatttgggttct

SEQ ID NO: 1308334 - DNA, 22 bp, Artificial Sequence
  chemically synthesized
acaaatttgggttctattccca

SEQ ID NO: 1308335 - DNA, 22 bp, Artificial Sequence
  chemically synthesized
gtatccagagatactgggaata

SEQ ID NO: 1308336 - DNA, 22 bp, Artificial Sequence
  chemically synthesized
gggttctattcccagtatctct

SEQ ID NO: 1308337 - DNA, 22 bp, Artificial Sequence
  chemically synthesized
ggttctattcccagtatctctg

SEQ ID NO: 1308338 - DNA, 22 bp, Artificial Sequence
  chemically synthesized
tattcccagtatctctggatac

SEQ ID NO: 1308339 - DNA, 22 bp, Artificial Sequence
  chemically synthesized
ttcccagtatctctggatacca

SEQ ID NO: 1308340 - DNA, 22 bp, Artificial Sequence
  chemically synthesized
aaggtcatatagctggtatcca

SEQ ID NO: 1308341 - DNA, 22 bp, Artificial Sequence
  chemically synthesized
ccagtatctctggataccagct

SEQ ID NO: 1308342 - DNA, 22 bp, Artificial Sequence
  chemically synthesized
ttcaaggtcatatagctggtat

SEQ ID NO: 1308343 - DNA, 22 bp, Artificial Sequence
  chemically synthesized
gttcaaggtcatatagctggta

SEQ ID NO: 1308344 - DNA, 22 bp, Artificial Sequence
  chemically synthesized
tgttcaaggtcatatagctggt

SEQ ID NO: 1308345 - DNA, 22 bp, Artificial Sequence
  chemically synthesized
tggataccagctatatgacctt

SEQ ID NO: 1308346 - DNA, 22 bp, Artificial Sequence
  chemically synthesized
agtattttgttcaaggtcatat

SEQ ID NO: 1308347 - DNA, 22 bp, Artificial Sequence
  chemically synthesized
gataccagctatatgaccttga

SEQ ID NO: 1308348 - DNA, 22 bp, Artificial Sequence
  chemically synthesized
aaagaggctcagtattttgttc

SEQ ID NO: 1308349 - DNA, 22 bp, Artificial Sequence
  chemically synthesized
gaaagaggctcagtattttgtt

SEQ ID NO: 1308350 - DNA, 22 bp, Artificial Sequence
  chemically synthesized
tgaaagaggctcagtattttgt

SEQ ID NO: 1308351 - DNA, 22 bp, Artificial Sequence
  chemically synthesized
tatgaccttgaacaaaatactg

SEQ ID NO: 1308352 - DNA, 22 bp, Artificial Sequence
  chemically synthesized
aggctttgaaagaggctcagta

SEQ ID NO: 1308353 - DNA, 22 bp, Artificial Sequence
  chemically synthesized
gaacaaaatactgagcctcttt

SEQ ID NO: 1308354 - DNA, 22 bp, Artificial Sequence
  chemically synthesized
aacaaaatactgagcctctttc

SEQ ID NO: 1308355 - DNA, 22 bp, Artificial Sequence
  chemically synthesized
caaatgagaaaactgaggcttt

SEQ ID NO: 1308356 - DNA, 22 bp, Artificial Sequence
  chemically synthesized
acaaatgagaaaactgaggctt

SEQ ID NO: 1308357 - DNA, 22 bp, Artificial Sequence
  chemically synthesized
agcctctttcaaagcctcagtt

SEQ ID NO: 1308358 - DNA, 22 bp, Artificial Sequence
  chemically synthesized
tttacaaatgagaaaactgagg

SEQ ID NO: 1308359 - DNA, 22 bp, Artificial Sequence
  chemically synthesized
gtttacaaatgagaaaactgag

SEQ ID NO: 1308360 - DNA, 22 bp, Artificial Sequence
  chemically synthesized
tgtttacaaatgagaaaactga

SEQ ID NO: 1308361 - DNA, 22 bp, Artificial Sequence
  chemically synthesized
tttcaaagcctcagttttctca

SEQ ID NO: 1308362 - DNA, 22 bp, Artificial Sequence
  chemically synthesized
ctttgtttacaaatgagaaaac

SEQ ID NO: 1308363 - DNA, 22 bp, Artificial Sequence
  chemically synthesized
tcaaagcctcagttttctcatt

SEQ ID NO: 1308364 - DNA, 22 bp, Artificial Sequence
  chemically synthesized
caaagcctcagttttctcattt

SEQ ID NO: 1308365 - DNA, 22 bp, Artificial Sequence
  chemically synthesized
aaagcctcagttttctcatttg

SEQ ID NO: 1308366 - DNA, 22 bp, Artificial Sequence
  chemically synthesized
ctgctttgtttacaaatgagaa

SEQ ID NO: 1308367 - DNA, 22 bp, Artificial Sequence
  chemically synthesized
ttactgctttgtttacaaatga

SEQ ID NO: 1308368 - DNA, 22 bp, Artificial Sequence
  chemically synthesized
ttgttactgctttgtttacaaa

SEQ ID NO: 1308369 - DNA, 22 bp, Artificial Sequence
  chemically synthesized
agttttctcatttgtaaacaaa

SEQ ID NO: 1308370 - DNA, 22 bp, Artificial Sequence
  chemically synthesized
tctcatttgtaaacaaagcagt

SEQ ID NO: 1308371 - DNA, 22 bp, Artificial Sequence
  chemically synthesized
ctcatttgtaaacaaagcagta

SEQ ID NO: 1308372 - DNA, 22 bp, Artificial Sequence
  chemically synthesized
tcatttgtaaacaaagcagtaa

SEQ ID NO: 1308373 - DNA, 22 bp, Artificial Sequence
  chemically synthesized
atttgtaaacaaagcagtaaca

SEQ ID NO: 1308374 - DNA, 22 bp, Artificial Sequence
  chemically synthesized
taaaagagctattgttactgct

SEQ ID NO: 1308375 - DNA, 22 bp, Artificial Sequence
  chemically synthesized
tataaaagagctattgttactg

SEQ ID NO: 1308376 - DNA, 22 bp, Artificial Sequence
  chemically synthesized
gtaaacaaagcagtaacaatag

SEQ ID NO: 1308377 - DNA, 22 bp, Artificial Sequence
  chemically synthesized
taaacaaagcagtaacaatagc

SEQ ID NO: 1308378 - DNA, 22 bp, Artificial Sequence
  chemically synthesized
catgattctataaaagagctat

SEQ ID NO: 1308379 - DNA, 22 bp, Artificial Sequence
  chemically synthesized
tccatgattctataaaagagct

SEQ ID NO: 1308380 - DNA, 22 bp, Artificial Sequence
  chemically synthesized
ctccatgattctataaaagagc

SEQ ID NO: 1308381 - DNA, 22 bp, Artificial Sequence
  chemically synthesized
ttctccatgattctataaaaga

SEQ ID NO: 1308382 - DNA, 22 bp, Artificial Sequence
  chemically synthesized
ttcttctccatgattctataaa

SEQ ID NO: 1308383 - DNA, 22 bp, Artificial Sequence
  chemically synthesized
attcttctccatgattctataa

SEQ ID NO: 1308384 - DNA, 22 bp, Artificial Sequence
  chemically synthesized
tttattcttctccatgattcta

SEQ ID NO: 1308385 - DNA, 22 bp, Artificial Sequence
  chemically synthesized
atttattcttctccatgattct

SEQ ID NO: 1308386 - DNA, 22 bp, Artificial Sequence
  chemically synthesized
tatttattcttctccatgattc

SEQ ID NO: 1308387 - DNA, 22 bp, Artificial Sequence
  chemically synthesized
ctttatttattcttctccatga

SEQ ID NO: 1308388 - DNA, 22 bp, Artificial Sequence
  chemically synthesized
ttttatagaatcatggagaaga

SEQ ID NO: 1308389 - DNA, 22 bp, Artificial Sequence
  chemically synthesized
ttatagaatcatggagaagaat

SEQ ID NO: 1308390 - DNA, 22 bp, Artificial Sequence
  chemically synthesized
attactttatttattcttctcc

SEQ ID NO: 1308391 - DNA, 22 bp, Artificial Sequence
  chemically synthesized
tatagaatcatggagaagaata

SEQ ID NO: 1308392 - DNA, 22 bp, Artificial Sequence
  chemically synthesized
atagaatcatggagaagaataa

SEQ ID NO: 1308393 - DNA, 22 bp, Artificial Sequence
  chemically synthesized
tagaatcatggagaagaataaa

SEQ ID NO: 1308394 - DNA, 22 bp, Artificial Sequence
  chemically synthesized
agagacagtgtagtagacaata

SEQ ID NO: 1308395 - DNA, 22 bp, Artificial Sequence
  chemically synthesized
ggttgagagacagtgtagtaga

SEQ ID NO: 1308396 - DNA, 22 bp, Artificial Sequence
  chemically synthesized
taggttgagagacagtgtagta

SEQ ID NO: 1308397 - DNA, 22 bp, Artificial Sequence
  chemically synthesized
tctactacactgtctctcaacc

SEQ ID NO: 1308398 - DNA, 22 bp, Artificial Sequence
  chemically synthesized
atatagtctctaggttgagaga

SEQ ID NO: 1308399 - DNA, 22 bp, Artificial Sequence
  chemically synthesized
gatatagtctctaggttgagag

SEQ ID NO: 1308400 - DNA, 22 bp, Artificial Sequence
  chemically synthesized
tgatatagtctctaggttgaga

SEQ ID NO: 1308401 - DNA, 22 bp, Artificial Sequence
  chemically synthesized
ctacactgtctctcaacctaga

SEQ ID NO: 1308402 - DNA, 22 bp, Artificial Sequence
  chemically synthesized
cactgtctctcaacctagagac

SEQ ID NO: 1308403 - DNA, 22 bp, Artificial Sequence
  chemically synthesized
aggggattttgatatagtctct

SEQ ID NO: 1308404 - DNA, 22 bp, Artificial Sequence
  chemically synthesized
tctctcaacctagagactatat

SEQ ID NO: 1308405 - DNA, 22 bp, Artificial Sequence
  chemically synthesized
caggggattttgatatagtctc

SEQ ID NO: 1308406 - DNA, 22 bp, Artificial Sequence
  chemically synthesized
ttcaggggattttgatatagtc

SEQ ID NO: 1308407 - DNA, 22 bp, Artificial Sequence
  chemically synthesized
tcaacctagagactatatcaaa

SEQ ID NO: 1308408 - DNA, 22 bp, Artificial Sequence
  chemically synthesized
aacctagagactatatcaaaat

SEQ ID NO: 1308409 - DNA, 22 bp, Artificial Sequence
  chemically synthesized
gagactatatcaaaatcccctg

SEQ ID NO: 1308410 - DNA, 22 bp, Artificial Sequence
  chemically synthesized
taagaagttcttcaggggattt

SEQ ID NO: 1308411 - DNA, 22 bp, Artificial Sequence
  chemically synthesized
tatcaaaatcccctgaagaact

SEQ ID NO: 1308412 - DNA, 22 bp, Artificial Sequence
  chemically synthesized
ggagaggtattataagaagttc

SEQ ID NO: 1308413 - DNA, 22 bp, Artificial Sequence
  chemically synthesized
tgggagaggtattataagaagt

SEQ ID NO: 1308414 - DNA, 22 bp, Artificial Sequence
  chemically synthesized
aagaacttcttataatacctct

SEQ ID NO: 1308415 - DNA, 22 bp, Artificial Sequence
  chemically synthesized
gataatgaattctgggagaggt

SEQ ID NO: 1308416 - DNA, 22 bp, Artificial Sequence
  chemically synthesized
ctagataatgaattctgggaga

SEQ ID NO: 1308417 - DNA, 22 bp, Artificial Sequence
  chemically synthesized
cttataatacctctcccagaat

SEQ ID NO: 1308418 - DNA, 22 bp, Artificial Sequence
  chemically synthesized
ttataatacctctcccagaatt

SEQ ID NO: 1308419 - DNA, 22 bp, Artificial Sequence
  chemically synthesized
ataatacctctcccagaattca

SEQ ID NO: 1308420 - DNA, 22 bp, Artificial Sequence
  chemically synthesized
taatacctctcccagaattcat

SEQ ID NO: 1308421 - DNA, 22 bp, Artificial Sequence
  chemically synthesized
tgcggagacctactagataatg

SEQ ID NO: 1308422 - DNA, 22 bp, Artificial Sequence
  chemically synthesized
tcccagaattcattatctagta

SEQ ID NO: 1308423 - DNA, 22 bp, Artificial Sequence
  chemically synthesized
ccagaattcattatctagtagg

SEQ ID NO: 1308424 - DNA, 22 bp, Artificial Sequence
  chemically synthesized
gggctgtgcggagacctactag

SEQ ID NO: 1308425 - DNA, 22 bp, Artificial Sequence
  chemically synthesized
tcgggctgtgcggagacctact

SEQ ID NO: 1308426 - DNA, 22 bp, Artificial Sequence
  chemically synthesized
attatctagtaggtctccgcac

SEQ ID NO: 1308427 - DNA, 22 bp, Artificial Sequence
  chemically synthesized
tctagtaggtctccgcacagcc

SEQ ID NO: 1308428 - DNA, 22 bp, Artificial Sequence
  chemically synthesized
gtaggtctccgcacagcccgag

SEQ ID NO: 1308429 - DNA, 22 bp, Artificial Sequence
  chemically synthesized
taagaaatgtaaattctcgggc

SEQ ID NO: 1308430 - DNA, 22 bp, Artificial Sequence
  chemically synthesized
gtaagaaatgtaaattctcggg

SEQ ID NO: 1308431 - DNA, 22 bp, Artificial Sequence
  chemically synthesized
cgcacagcccgagaatttacat

SEQ ID NO: 1308432 - DNA, 22 bp, Artificial Sequence
  chemically synthesized
gaaatttgtaagaaatgtaaat

SEQ ID NO: 1308433 - DNA, 22 bp, Artificial Sequence
  chemically synthesized
acatttcttacaaatttccagg

SEQ ID NO: 1308434 - DNA, 22 bp, Artificial Sequence
  chemically synthesized
catttcttacaaatttccaggt

SEQ ID NO: 1308435 - DNA, 22 bp, Artificial Sequence
  chemically synthesized
agacccgcaatatcacctggaa

SEQ ID NO: 1308436 - DNA, 22 bp, Artificial Sequence
  chemically synthesized
cagacccgcaatatcacctgga

SEQ ID NO: 1308437 - DNA, 22 bp, Artificial Sequence
  chemically synthesized
cttacaaatttccaggtgatat

SEQ ID NO: 1308438 - DNA, 22 bp, Artificial Sequence
  chemically synthesized
ttacaaatttccaggtgatatt

SEQ ID NO: 1308439 - DNA, 22 bp, Artificial Sequence
  chemically synthesized
acaaatttccaggtgatattgc

SEQ ID NO: 1308440 - DNA, 22 bp, Artificial Sequence
  chemically synthesized
caaatttccaggtgatattgcg

SEQ ID NO: 1308441 - DNA, 22 bp, Artificial Sequence
  chemically synthesized
aaagtatgtttcagacccgcaa

SEQ ID NO: 1308442 - DNA, 22 bp, Artificial Sequence
  chemically synthesized
ccaggtgatattgcgggtctga

SEQ ID NO: 1308443 - DNA, 22 bp, Artificial Sequence
  chemically synthesized
tcaaagtatgtttcagacccgc

SEQ ID NO: 1308444 - DNA, 22 bp, Artificial Sequence
  chemically synthesized
caggtgatattgcgggtctgaa

SEQ ID NO: 1308445 - DNA, 22 bp, Artificial Sequence
  chemically synthesized
tggttctcaaagtatgtttcag

SEQ ID NO: 1308446 - DNA, 22 bp, Artificial Sequence
  chemically synthesized
aagctgtggttctcaaagtatg

SEQ ID NO: 1308447 - DNA, 22 bp, Artificial Sequence
  chemically synthesized
cgggtctgaaacatactttgag

SEQ ID NO: 1308448 - DNA, 22 bp, Artificial Sequence
  chemically synthesized
tgtgctaaagctgtggttctca

SEQ ID NO: 1308449 - DNA, 22 bp, Artificial Sequence
  chemically synthesized
aaacatactttgagaaccacag

SEQ ID NO: 1308450 - DNA, 22 bp, Artificial Sequence
  chemically synthesized
tctatgtgctaaagctgtggtt

SEQ ID NO: 1308451 - DNA, 22 bp, Artificial Sequence
  chemically synthesized
tgagaaccacagctttagcaca

SEQ ID NO: 1308452 - DNA, 22 bp, Artificial Sequence
  chemically synthesized
tgtgactgtctatgtgctaaag

SEQ ID NO: 1308453 - DNA, 22 bp, Artificial Sequence
  chemically synthesized
gagaaccacagctttagcacat

SEQ ID NO: 1308454 - DNA, 22 bp, Artificial Sequence
  chemically synthesized
agaaccacagctttagcacata

SEQ ID NO: 1308455 - DNA, 22 bp, Artificial Sequence
  chemically synthesized
ttatgtgactgtctatgtgcta

SEQ ID NO: 1308456 - DNA, 22 bp, Artificial Sequence
  chemically synthesized
gttatgtgactgtctatgtgct

SEQ ID NO: 1308457 - DNA, 22 bp, Artificial Sequence
  chemically synthesized
tgttatgtgactgtctatgtgc

SEQ ID NO: 1308458 - DNA, 22 bp, Artificial Sequence
  chemically synthesized
ttgttatgtgactgtctatgtg

SEQ ID NO: 1308459 - DNA, 22 bp, Artificial Sequence
  chemically synthesized
gtttttgttatgtgactgtcta

SEQ ID NO: 1308460 - DNA, 22 bp, Artificial Sequence
  chemically synthesized
attggtttttgttatgtgactg

SEQ ID NO: 1308461 - DNA, 22 bp, Artificial Sequence
  chemically synthesized
tagcacatagacagtcacataa

SEQ ID NO: 1308462 - DNA, 22 bp, Artificial Sequence
  chemically synthesized
agcacatagacagtcacataac

SEQ ID NO: 1308463 - DNA, 22 bp, Artificial Sequence
  chemically synthesized
gcacatagacagtcacataaca

SEQ ID NO: 1308464 - DNA, 22 bp, Artificial Sequence
  chemically synthesized
cattcattggtttttgttatgt

SEQ ID NO: 1308465 - DNA, 22 bp, Artificial Sequence
  chemically synthesized
acattcattggtttttgttatg

SEQ ID NO: 1308466 - DNA, 22 bp, Artificial Sequence
  chemically synthesized
atatttacattcattggttttt

SEQ ID NO: 1308467 - DNA, 22 bp, Artificial Sequence
  chemically synthesized
catcaaagaaatgctaatattt

SEQ ID NO: 1308468 - DNA, 22 bp, Artificial Sequence
  chemically synthesized
tctccatcaaagaaatgctaat

SEQ ID NO: 1308469 - DNA, 22 bp, Artificial Sequence
  chemically synthesized
gggctgtctccatcaaagaaat

SEQ ID NO: 1308470 - DNA, 22 bp, Artificial Sequence
  chemically synthesized
gcatttctttgatggagacagc

SEQ ID NO: 1308471 - DNA, 22 bp, Artificial Sequence
  chemically synthesized
taggcagcctggggctgtctcc

SEQ ID NO: 1308472 - DNA, 22 bp, Artificial Sequence
  chemically synthesized
ctgtaggcagcctggggctgtc

SEQ ID NO: 1308473 - DNA, 22 bp, Artificial Sequence
  chemically synthesized
gctgtaggcagcctggggctgt

SEQ ID NO: 1308474 - DNA, 22 bp, Artificial Sequence
  chemically synthesized
ctttgatggagacagccccagg

SEQ ID NO: 1308475 - DNA, 22 bp, Artificial Sequence
  chemically synthesized
tttgatggagacagccccaggc

SEQ ID NO: 1308476 - DNA, 22 bp, Artificial Sequence
  chemically synthesized
tgatggagacagccccaggctg

SEQ ID NO: 1308477 - DNA, 22 bp, Artificial Sequence
  chemically synthesized
gatggagacagccccaggctgc

SEQ ID NO: 1308478 - DNA, 22 bp, Artificial Sequence
  chemically synthesized
atggagacagccccaggctgcc

SEQ ID NO: 1308479 - DNA, 22 bp, Artificial Sequence
  chemically synthesized
agggaacatcttgctgtaggca

SEQ ID NO: 1308480 - DNA, 22 bp, Artificial Sequence
  chemically synthesized
aggaacctaagggaacatcttg

SEQ ID NO: 1308481 - DNA, 22 bp, Artificial Sequence
  chemically synthesized
caggaacctaagggaacatctt

SEQ ID NO: 1308482 - DNA, 22 bp, Artificial Sequence
  chemically synthesized
tcaggaacctaagggaacatct

SEQ ID NO: 1308483 - DNA, 22 bp, Artificial Sequence
  chemically synthesized
cctacagcaagatgttccctta

SEQ ID NO: 1308484 - DNA, 22 bp, Artificial Sequence
  chemically synthesized
ttttcaggaacctaagggaaca

SEQ ID NO: 1308485 - DNA, 22 bp, Artificial Sequence
  chemically synthesized
tattttcaggaacctaagggaa

SEQ ID NO: 1308486 - DNA, 22 bp, Artificial Sequence
  chemically synthesized
ctattttcaggaacctaaggga

SEQ ID NO: 1308487 - DNA, 22 bp, Artificial Sequence
  chemically synthesized
cagcaagatgttcccttaggtt

SEQ ID NO: 1308488 - DNA, 22 bp, Artificial Sequence
  chemically synthesized
tctattttcaggaacctaaggg

SEQ ID NO: 1308489 - DNA, 22 bp, Artificial Sequence
  chemically synthesized
ccttaggttcctgaaaatagaa

SEQ ID NO: 1308490 - DNA, 22 bp, Artificial Sequence
  chemically synthesized
aggttcctgaaaatagaaagtc

SEQ ID NO: 1308491 - DNA, 22 bp, Artificial Sequence
  chemically synthesized
ggttcctgaaaatagaaagtcc

SEQ ID NO: 1308492 - DNA, 22 bp, Artificial Sequence
  chemically synthesized
atgaggaccatgcgggactttc

SEQ ID NO: 1308493 - DNA, 22 bp, Artificial Sequence
  chemically synthesized
gatgaggaccatgcgggacttt

SEQ ID NO: 1308494 - DNA, 22 bp, Artificial Sequence
  chemically synthesized
tgatgaggaccatgcgggactt

SEQ ID NO: 1308495 - DNA, 22 bp, Artificial Sequence
  chemically synthesized
ctgaaaatagaaagtcccgcat

SEQ ID NO: 1308496 - DNA, 22 bp, Artificial Sequence
  chemically synthesized
aaaatagaaagtcccgcatggt

SEQ ID NO: 1308497 - DNA, 22 bp, Artificial Sequence
  chemically synthesized
aaggaatccagcggactttgat

SEQ ID NO: 1308498 - DNA, 22 bp, Artificial Sequence
  chemically synthesized
atcaaagtccgctggattcctt

SEQ ID NO: 1308499 - DNA, 22 bp, Artificial Sequence
  chemically synthesized
gattccttcaatacctcttcct

SEQ ID NO: 1308500 - DNA, 22 bp, Artificial Sequence
  chemically synthesized
cttcaatacctcttcctctttt

SEQ ID NO: 1308501 - DNA, 22 bp, Artificial Sequence
  chemically synthesized
atgcccatgtgagaaaagagga

SEQ ID NO: 1308502 - DNA, 22 bp, Artificial Sequence
  chemically synthesized
caatacctcttcctcttttctc

SEQ ID NO: 1308503 - DNA, 22 bp, Artificial Sequence
  chemically synthesized
aatacctcttcctcttttctca

SEQ ID NO: 1308504 - DNA, 22 bp, Artificial Sequence
  chemically synthesized
ttcctcttttctcacatgggca

SEQ ID NO: 1308505 - DNA, 22 bp, Artificial Sequence
  chemically synthesized
cctcttttctcacatgggcatt

SEQ ID NO: 1308506 - DNA, 22 bp, Artificial Sequence
  chemically synthesized
ctcttttctcacatgggcatta

SEQ ID NO: 1308507 - DNA, 22 bp, Artificial Sequence
  chemically synthesized
ttttctcacatgggcattaaca

SEQ ID NO: 1308508 - DNA, 22 bp, Artificial Sequence
  chemically synthesized
ttctcacatgggcattaacatc

SEQ ID NO: 1308509 - DNA, 22 bp, Artificial Sequence
  chemically synthesized
tctcacatgggcattaacatcc

SEQ ID NO: 1308510 - DNA, 22 bp, Artificial Sequence
  chemically synthesized
ctcacatgggcattaacatccc

SEQ ID NO: 1308511 - DNA, 22 bp, Artificial Sequence
  chemically synthesized
tcacatgggcattaacatcccc

SEQ ID NO: 1308512 - DNA, 22 bp, Artificial Sequence
  chemically synthesized
acatgggcattaacatccccac

SEQ ID NO: 1308513 - DNA, 22 bp, Artificial Sequence
  chemically synthesized
gaaggtagaggagtggggatgt

SEQ ID NO: 1308514 - DNA, 22 bp, Artificial Sequence
  chemically synthesized
agttagaaggtagaggagtggg

SEQ ID NO: 1308515 - DNA, 22 bp, Artificial Sequence
  chemically synthesized
acatccccactcctctaccttc

SEQ ID NO: 1308516 - DNA, 22 bp, Artificial Sequence
  chemically synthesized
ctctaccttctaactcaattat

SEQ ID NO: 1308517 - DNA, 22 bp, Artificial Sequence
  chemically synthesized
taccttctaactcaattatctg

SEQ ID NO: 1308518 - DNA, 22 bp, Artificial Sequence
  chemically synthesized
ccttctaactcaattatctgac

SEQ ID NO: 1308519 - DNA, 22 bp, Artificial Sequence
  chemically synthesized
ctaactcaattatctgacccct

SEQ ID NO: 1308520 - DNA, 22 bp, Artificial Sequence
  chemically synthesized
taactcaattatctgacccctg

SEQ ID NO: 1308521 - DNA, 22 bp, Artificial Sequence
  chemically synthesized
actcaattatctgacccctgcg

SEQ ID NO: 1308522 - DNA, 22 bp, Artificial Sequence
  chemically synthesized
aattatctgacccctgcgctct

SEQ ID NO: 1308523 - DNA, 22 bp, Artificial Sequence
  chemically synthesized
tctgacccctgcgctctttttt

SEQ ID NO: 1308524 - DNA, 22 bp, Artificial Sequence
  chemically synthesized
acccctgcgctctttttttttt

SEQ ID NO: 1308525 - DNA, 22 bp, Artificial Sequence
  chemically synthesized
cgctcttttttttttctttttc

SEQ ID NO: 1308526 - DNA, 22 bp, Artificial Sequence
  chemically synthesized
ttttttttttctttttcttttc

SEQ ID NO: 1308527 - DNA, 22 bp, Artificial Sequence
  chemically synthesized
ttttttttctttttcttttctt

SEQ ID NO: 1308528 - DNA, 22 bp, Artificial Sequence
  chemically synthesized
tttttttctttttcttttcttt

SEQ ID NO: 1308529 - DNA, 22 bp, Artificial Sequence
  chemically synthesized
ttttttctttttcttttctttt

SEQ ID NO: 1308530 - DNA, 22 bp, Artificial Sequence
  chemically synthesized
tttttctttttcttttcttttt

SEQ ID NO: 1308531 - DNA, 22 bp, Artificial Sequence
  chemically synthesized
gaaaagaaaagaaaaaagaaaa

SEQ ID NO: 1308532 - DNA, 22 bp, Artificial Sequence
  chemically synthesized
ttttctttttcttttctttttt

SEQ ID NO: 1308533 - DNA, 22 bp, Artificial Sequence
  chemically synthesized
tttctttttcttttcttttttc

SEQ ID NO: 1308534 - DNA, 22 bp, Artificial Sequence
  chemically synthesized
ttctttttcttttcttttttct

SEQ ID NO: 1308535 - DNA, 22 bp, Artificial Sequence
  chemically synthesized
tctttttcttttcttttttctt

SEQ ID NO: 1308536 - DNA, 22 bp, Artificial Sequence
  chemically synthesized
ctttttcttttcttttttcttt

SEQ ID NO: 1308537 - DNA, 22 bp, Artificial Sequence
  chemically synthesized
tttttcttttcttttttctttt

SEQ ID NO: 1308538 - DNA, 22 bp, Artificial Sequence
  chemically synthesized
cgtctcgaaaagaaaagaaaaa

SEQ ID NO: 1308539 - DNA, 22 bp, Artificial Sequence
  chemically synthesized
tttcttttcttttttcttttct

SEQ ID NO: 1308540 - DNA, 22 bp, Artificial Sequence
  chemically synthesized
ttcttttcttttttcttttctt

SEQ ID NO: 1308541 - DNA, 22 bp, Artificial Sequence
  chemically synthesized
tcttttcttttttcttttcttt

SEQ ID NO: 1308542 - DNA, 22 bp, Artificial Sequence
  chemically synthesized
cttttcttttttcttttctttt

SEQ ID NO: 1308543 - DNA, 22 bp, Artificial Sequence
  chemically synthesized
ttttcttttttcttttcttttc

SEQ ID NO: 1308544 - DNA, 22 bp, Artificial Sequence
  chemically synthesized
ttcttttttcttttcttttcga

SEQ ID NO: 1308545 - DNA, 22 bp, Artificial Sequence
  chemically synthesized
tcttttttcttttcttttcgag

SEQ ID NO: 1308546 - DNA, 22 bp, Artificial Sequence
  chemically synthesized
cttttttcttttcttttcgaga

SEQ ID NO: 1308547 - DNA, 22 bp, Artificial Sequence
  chemically synthesized
ttttttcttttcttttcgagac

SEQ ID NO: 1308548 - DNA, 22 bp, Artificial Sequence
  chemically synthesized
ttttcttttcttttcgagacgg

SEQ ID NO: 1308549 - DNA, 22 bp, Artificial Sequence
  chemically synthesized
tttcttttcttttcgagacgga

SEQ ID NO: 1308550 - DNA, 22 bp, Artificial Sequence
  chemically synthesized
ttcttttcttttcgagacggag

SEQ ID NO: 1308551 - DNA, 22 bp, Artificial Sequence
  chemically synthesized
tcttttcttttcgagacggagt

SEQ ID NO: 1308552 - DNA, 22 bp, Artificial Sequence
  chemically synthesized
cttttcttttcgagacggagtt

SEQ ID NO: 1308553 - DNA, 22 bp, Artificial Sequence
  chemically synthesized
ttttcttttcgagacggagttt

SEQ ID NO: 1308554 - DNA, 22 bp, Artificial Sequence
  chemically synthesized
ggcaaagagagcaaaactccgt

SEQ ID NO: 1308555 - DNA, 22 bp, Artificial Sequence
  chemically synthesized
ttcttttcgagacggagttttg

SEQ ID NO: 1308556 - DNA, 22 bp, Artificial Sequence
  chemically synthesized
tcttttcgagacggagttttgc

SEQ ID NO: 1308557 - DNA, 22 bp, Artificial Sequence
  chemically synthesized
cttttcgagacggagttttgct

SEQ ID NO: 1308558 - DNA, 22 bp, Artificial Sequence
  chemically synthesized
ttttcgagacggagttttgctc

SEQ ID NO: 1308559 - DNA, 22 bp, Artificial Sequence
  chemically synthesized
ttcgagacggagttttgctctc

SEQ ID NO: 1308560 - DNA, 22 bp, Artificial Sequence
  chemically synthesized
tcgagacggagttttgctctct

SEQ ID NO: 1308561 - DNA, 22 bp, Artificial Sequence
  chemically synthesized
cagcctgggcaaagagagcaaa

SEQ ID NO: 1308562 - DNA, 22 bp, Artificial Sequence
  chemically synthesized
cgagacggagttttgctctctt

SEQ ID NO: 1308563 - DNA, 22 bp, Artificial Sequence
  chemically synthesized
gagacggagttttgctctcttt

SEQ ID NO: 1308564 - DNA, 22 bp, Artificial Sequence
  chemically synthesized
cactccagcctgggcaaagaga

SEQ ID NO: 1308565 - DNA, 22 bp, Artificial Sequence
  chemically synthesized
tgctctctttgcccaggctgga

SEQ ID NO: 1308566 - DNA, 22 bp, Artificial Sequence
  chemically synthesized
gctctctttgcccaggctggag

SEQ ID NO: 1308567 - DNA, 22 bp, Artificial Sequence
  chemically synthesized
ctctctttgcccaggctggagt

SEQ ID NO: 1308568 - DNA, 22 bp, Artificial Sequence
  chemically synthesized
tctttgcccaggctggagtgta

SEQ ID NO: 1308569 - DNA, 22 bp, Artificial Sequence
  chemically synthesized
tttgcccaggctggagtgtagt

SEQ ID NO: 1308570 - DNA, 22 bp, Artificial Sequence
  chemically synthesized
tgcccaggctggagtgtagtgg

SEQ ID NO: 1308571 - DNA, 22 bp, Artificial Sequence
  chemically synthesized
gcccaggctggagtgtagtggc

SEQ ID NO: 1308572 - DNA, 22 bp, Artificial Sequence
  chemically synthesized
cccaggctggagtgtagtggca

SEQ ID NO: 1308573 - DNA, 22 bp, Artificial Sequence
  chemically synthesized
cagtgagccgagatcgtgccac

SEQ ID NO: 1308574 - DNA, 22 bp, Artificial Sequence
  chemically synthesized
gagtgtagtggcacgatctcgg

SEQ ID NO: 1308575 - DNA, 22 bp, Artificial Sequence
  chemically synthesized
gagacagtggttgcagtgagcc

SEQ ID NO: 1308576 - DNA, 22 bp, Artificial Sequence
  chemically synthesized
aaccctggagacagtggttgca

SEQ ID NO: 1308577 - DNA, 22 bp, Artificial Sequence
  chemically synthesized
gaaccctggagacagtggttgc

SEQ ID NO: 1308578 - DNA, 22 bp, Artificial Sequence
  chemically synthesized
ggctcactgcaaccactgtctc

SEQ ID NO: 1308579 - DNA, 22 bp, Artificial Sequence
  chemically synthesized
actgcaaccactgtctccaggg

SEQ ID NO: 1308580 - DNA, 22 bp, Artificial Sequence
  chemically synthesized
caaccactgtctccagggttca

SEQ ID NO: 1308581 - DNA, 22 bp, Artificial Sequence
  chemically synthesized
aggcaggagaatcgcttgaacc

SEQ ID NO: 1308582 - DNA, 22 bp, Artificial Sequence
  chemically synthesized
tctccagggttcaagcgattct

SEQ ID NO: 1308583 - DNA, 22 bp, Artificial Sequence
  chemically synthesized
ggaggctgaggcaggagaatcg

SEQ ID NO: 1308584 - DNA, 22 bp, Artificial Sequence
  chemically synthesized
cagggttcaagcgattctcctg

SEQ ID NO: 1308585 - DNA, 22 bp, Artificial Sequence
  chemically synthesized
gggaggctgaggcaggagaatc

SEQ ID NO: 1308586 - DNA, 22 bp, Artificial Sequence
  chemically synthesized
cttgggaggctgaggcaggaga

SEQ ID NO: 1308587 - DNA, 22 bp, Artificial Sequence
  chemically synthesized
aagcgattctcctgcctcagcc

SEQ ID NO: 1308588 - DNA, 22 bp, Artificial Sequence
  chemically synthesized
tagtcccagctacttgggaggc

SEQ ID NO: 1308589 - DNA, 22 bp, Artificial Sequence
  chemically synthesized
tcctgcctcagcctcccaagta

SEQ ID NO: 1308590 - DNA, 22 bp, Artificial Sequence
  chemically synthesized
ctgcctcagcctcccaagtagc

SEQ ID NO: 1308591 - DNA, 22 bp, Artificial Sequence
  chemically synthesized
cctcagcctcccaagtagctgg

SEQ ID NO: 1308592 - DNA, 22 bp, Artificial Sequence
  chemically synthesized
agcctcccaagtagctgggact

SEQ ID NO: 1308593 - DNA, 22 bp, Artificial Sequence
  chemically synthesized
ccaagtagctgggactacaggc

SEQ ID NO: 1308594 - DNA, 22 bp, Artificial Sequence
  chemically synthesized
gccgggcatggtggcgcatgcc

SEQ ID NO: 1308595 - DNA, 22 bp, Artificial Sequence
  chemically synthesized
ggactacaggcatgcgccacca

SEQ ID NO: 1308596 - DNA, 22 bp, Artificial Sequence
  chemically synthesized
caggcatgcgccaccatgcccg

SEQ ID NO: 1308597 - DNA, 22 bp, Artificial Sequence
  chemically synthesized
aaaatacaaaaaattagccggg

SEQ ID NO: 1308598 - DNA, 22 bp, Artificial Sequence
  chemically synthesized
ctaaaaatacaaaaaattagcc

SEQ ID NO: 1308599 - DNA, 22 bp, Artificial Sequence
  chemically synthesized
tactaaaaatacaaaaaattag

SEQ ID NO: 1308600 - DNA, 22 bp, Artificial Sequence
  chemically synthesized
attttttgtatttttagtagag

SEQ ID NO: 1308601 - DNA, 22 bp, Artificial Sequence
  chemically synthesized
tttgtatttttagtagagacgg

SEQ ID NO: 1308602 - DNA, 22 bp, Artificial Sequence
  chemically synthesized
ttgtatttttagtagagacggg

SEQ ID NO: 1308603 - DNA, 22 bp, Artificial Sequence
  chemically synthesized
tgtatttttagtagagacgggg

SEQ ID NO: 1308604 - DNA, 22 bp, Artificial Sequence
  chemically synthesized
gtatttttagtagagacggggt

SEQ ID NO: 1308605 - DNA, 22 bp, Artificial Sequence
  chemically synthesized
tatttttagtagagacggggtt

SEQ ID NO: 1308606 - DNA, 22 bp, Artificial Sequence
  chemically synthesized
gcaaacatggtaaaaccccgtc

SEQ ID NO: 1308607 - DNA, 22 bp, Artificial Sequence
  chemically synthesized
ttagtagagacggggttttacc

SEQ ID NO: 1308608 - DNA, 22 bp, Artificial Sequence
  chemically synthesized
tagtagagacggggttttacca

SEQ ID NO: 1308609 - DNA, 22 bp, Artificial Sequence
  chemically synthesized
agtagagacggggttttaccat

SEQ ID NO: 1308610 - DNA, 22 bp, Artificial Sequence
  chemically synthesized
gtagagacggggttttaccatg

SEQ ID NO: 1308611 - DNA, 22 bp, Artificial Sequence
  chemically synthesized
gagaccagcctggcaaacatgg

SEQ ID NO: 1308612 - DNA, 22 bp, Artificial Sequence
  chemically synthesized
taccatgtttgccaggctggtc

SEQ ID NO: 1308613 - DNA, 22 bp, Artificial Sequence
  chemically synthesized
accatgtttgccaggctggtct

SEQ ID NO: 1308614 - DNA, 22 bp, Artificial Sequence
  chemically synthesized
ccatgtttgccaggctggtctc

SEQ ID NO: 1308615 - DNA, 22 bp, Artificial Sequence
  chemically synthesized
aggtcaggagttagagaccagc

SEQ ID NO: 1308616 - DNA, 22 bp, Artificial Sequence
  chemically synthesized
gccaggctggtctctaactcct

SEQ ID NO: 1308617 - DNA, 22 bp, Artificial Sequence
  chemically synthesized
ccaggctggtctctaactcctg

SEQ ID NO: 1308618 - DNA, 22 bp, Artificial Sequence
  chemically synthesized
gtctctaactcctgacctcaga

SEQ ID NO: 1308619 - DNA, 22 bp, Artificial Sequence
  chemically synthesized
aggcagacggatcatctgaggt

SEQ ID NO: 1308620 - DNA, 22 bp, Artificial Sequence
  chemically synthesized
taactcctgacctcagatgatc

SEQ ID NO: 1308621 - DNA, 22 bp, Artificial Sequence
  chemically synthesized
actcctgacctcagatgatccg

SEQ ID NO: 1308622 - DNA, 22 bp, Artificial Sequence
  chemically synthesized
ggaggctgaggcagacggatca

SEQ ID NO: 1308623 - DNA, 22 bp, Artificial Sequence
  chemically synthesized
ctgacctcagatgatccgtctg

SEQ ID NO: 1308624 - DNA, 22 bp, Artificial Sequence
  chemically synthesized
gggaggctgaggcagacggatc

SEQ ID NO: 1308625 - DNA, 22 bp, Artificial Sequence
  chemically synthesized
tgggaggctgaggcagacggat

SEQ ID NO: 1308626 - DNA, 22 bp, Artificial Sequence
  chemically synthesized
acctcagatgatccgtctgcct

SEQ ID NO: 1308627 - DNA, 22 bp, Artificial Sequence
  chemically synthesized
agatgatccgtctgcctcagcc

SEQ ID NO: 1308628 - DNA, 22 bp, Artificial Sequence
  chemically synthesized
taatcccagcactttgggaggc

SEQ ID NO: 1308629 - DNA, 22 bp, Artificial Sequence
  chemically synthesized
cctcagcctcccaaagtgctgg

SEQ ID NO: 1308630 - DNA, 22 bp, Artificial Sequence
  chemically synthesized
acacctgtaatcccagcacttt

SEQ ID NO: 1308631 - DNA, 22 bp, Artificial Sequence
  chemically synthesized
agcctcccaaagtgctgggatt

SEQ ID NO: 1308632 - DNA, 22 bp, Artificial Sequence
  chemically synthesized
ccaaagtgctgggattacaggt

SEQ ID NO: 1308633 - DNA, 22 bp, Artificial Sequence
  chemically synthesized
ggattacaggtgtgagccaccg

SEQ ID NO: 1308634 - DNA, 22 bp, Artificial Sequence
  chemically synthesized
caggtgtgagccaccgcgcccc

SEQ ID NO: 1308635 - DNA, 22 bp, Artificial Sequence
  chemically synthesized
taaaaagcgcaggggggccggg

SEQ ID NO: 1308636 - DNA, 22 bp, Artificial Sequence
  chemically synthesized
ataaaaagcgcaggggggccgg

SEQ ID NO: 1308637 - DNA, 22 bp, Artificial Sequence
  chemically synthesized
cgctttttataaattcattcat

SEQ ID NO: 1308638 - DNA, 22 bp, Artificial Sequence
  chemically synthesized
tttataaattcattcattcatt

SEQ ID NO: 1308639 - DNA, 22 bp, Artificial Sequence
  chemically synthesized
ttataaattcattcattcattc

SEQ ID NO: 1308640 - DNA, 22 bp, Artificial Sequence
  chemically synthesized
tataaattcattcattcattcg

SEQ ID NO: 1308641 - DNA, 22 bp, Artificial Sequence
  chemically synthesized
ataaattcattcattcattcgt

SEQ ID NO: 1308642 - DNA, 22 bp, Artificial Sequence
  chemically synthesized
taaattcattcattcattcgtt

SEQ ID NO: 1308643 - DNA, 22 bp, Artificial Sequence
  chemically synthesized
aatgaatgaacgaacgaatgaa

SEQ ID NO: 1308644 - DNA, 22 bp, Artificial Sequence
  chemically synthesized
ttgaatgaatgaacgaacgaat

SEQ ID NO: 1308645 - DNA, 22 bp, Artificial Sequence
  chemically synthesized
attgaatgaatgaacgaacgaa

SEQ ID NO: 1308646 - DNA, 22 bp, Artificial Sequence
  chemically synthesized
attcattcattcgttcgttcat

SEQ ID NO: 1308647 - DNA, 22 bp, Artificial Sequence
  chemically synthesized
attcattcgttcgttcattcat

SEQ ID NO: 1308648 - DNA, 22 bp, Artificial Sequence
  chemically synthesized
attcgttcgttcattcattcaa

SEQ ID NO: 1308649 - DNA, 22 bp, Artificial Sequence
  chemically synthesized
tagcagagtttattgaatgaat

SEQ ID NO: 1308650 - DNA, 22 bp, Artificial Sequence
  chemically synthesized
gttcgttcattcattcaataaa

SEQ ID NO: 1308651 - DNA, 22 bp, Artificial Sequence
  chemically synthesized
aatactgtagcagagtttattg

SEQ ID NO: 1308652 - DNA, 22 bp, Artificial Sequence
  chemically synthesized
gttcattcattcaataaactct

SEQ ID NO: 1308653 - DNA, 22 bp, Artificial Sequence
  chemically synthesized
tgaatactgtagcagagtttat

SEQ ID NO: 1308654 - DNA, 22 bp, Artificial Sequence
  chemically synthesized
attcattcaataaactctgcta

SEQ ID NO: 1308655 - DNA, 22 bp, Artificial Sequence
  chemically synthesized
attcaataaactctgctacagt

SEQ ID NO: 1308656 - DNA, 22 bp, Artificial Sequence
  chemically synthesized
aataaactctgctacagtattc

SEQ ID NO: 1308657 - DNA, 22 bp, Artificial Sequence
  chemically synthesized
tgctacagtattcagagactct

SEQ ID NO: 1308658 - DNA, 22 bp, Artificial Sequence
  chemically synthesized
ctacagtattcagagactcttt

SEQ ID NO: 1308659 - DNA, 22 bp, Artificial Sequence
  chemically synthesized
cagtattcagagactcttttct

SEQ ID NO: 1308660 - DNA, 22 bp, Artificial Sequence
  chemically synthesized
gatcaaagcaaatatggcagaa

SEQ ID NO: 1308661 - DNA, 22 bp, Artificial Sequence
  chemically synthesized
agagactcttttctgccatatt

SEQ ID NO: 1308662 - DNA, 22 bp, Artificial Sequence
  chemically synthesized
actagatcaaagcaaatatggc

SEQ ID NO: 1308663 - DNA, 22 bp, Artificial Sequence
  chemically synthesized
ttttctgccatatttgctttga

SEQ ID NO: 1308664 - DNA, 22 bp, Artificial Sequence
  chemically synthesized
agtgttaactagatcaaagcaa

SEQ ID NO: 1308665 - DNA, 22 bp, Artificial Sequence
  chemically synthesized
ttctgccatatttgctttgatc

SEQ ID NO: 1308666 - DNA, 22 bp, Artificial Sequence
  chemically synthesized
tctgccatatttgctttgatct

SEQ ID NO: 1308667 - DNA, 22 bp, Artificial Sequence
  chemically synthesized
ctgccatatttgctttgatcta

SEQ ID NO: 1308668 - DNA, 22 bp, Artificial Sequence
  chemically synthesized
tgccatatttgctttgatctag

SEQ ID NO: 1308669 - DNA, 22 bp, Artificial Sequence
  chemically synthesized
attaagtgttaactagatcaaa

SEQ ID NO: 1308670 - DNA, 22 bp, Artificial Sequence
  chemically synthesized
ccatatttgctttgatctagtt

SEQ ID NO: 1308671 - DNA, 22 bp, Artificial Sequence
  chemically synthesized
gctttgatctagttaacactta

SEQ ID NO: 1308672 - DNA, 22 bp, Artificial Sequence
  chemically synthesized
ctttgatctagttaacacttaa

SEQ ID NO: 1308673 - DNA, 22 bp, Artificial Sequence
  chemically synthesized
tgatctagttaacacttaatga

SEQ ID NO: 1308674 - DNA, 22 bp, Artificial Sequence
  chemically synthesized
tggtatataaactcattaagtg

SEQ ID NO: 1308675 - DNA, 22 bp, Artificial Sequence
  chemically synthesized
gatctagttaacacttaatgag

SEQ ID NO: 1308676 - DNA, 22 bp, Artificial Sequence
  chemically synthesized
atctagttaacacttaatgagt

SEQ ID NO: 1308677 - DNA, 22 bp, Artificial Sequence
  chemically synthesized
gttaacacttaatgagtttata

SEQ ID NO: 1308678 - DNA, 22 bp, Artificial Sequence
  chemically synthesized
acacttaatgagtttatatacc

SEQ ID NO: 1308679 - DNA, 22 bp, Artificial Sequence
  chemically synthesized
taaaagggatattatggtatat

SEQ ID NO: 1308680 - DNA, 22 bp, Artificial Sequence
  chemically synthesized
aatgagtttatataccataata

SEQ ID NO: 1308681 - DNA, 22 bp, Artificial Sequence
  chemically synthesized
atgagtttatataccataatat

SEQ ID NO: 1308682 - DNA, 22 bp, Artificial Sequence
  chemically synthesized
caggatactgtaaaagggatat

SEQ ID NO: 1308683 - DNA, 22 bp, Artificial Sequence
  chemically synthesized
atataccataatatccctttta

SEQ ID NO: 1308684 - DNA, 22 bp, Artificial Sequence
  chemically synthesized
tataccataatatcccttttac

SEQ ID NO: 1308685 - DNA, 22 bp, Artificial Sequence
  chemically synthesized
gttacaggatactgtaaaaggg

SEQ ID NO: 1308686 - DNA, 22 bp, Artificial Sequence
  chemically synthesized
ttacagtatcctgtaacgaatc

SEQ ID NO: 1308687 - DNA, 22 bp, Artificial Sequence
  chemically synthesized
tacagtatcctgtaacgaatct

SEQ ID NO: 1308688 - DNA, 22 bp, Artificial Sequence
  chemically synthesized
gaaatgataaagagattcgtta

SEQ ID NO: 1308689 - DNA, 22 bp, Artificial Sequence
  chemically synthesized
acagtatcctgtaacgaatctc

SEQ ID NO: 1308690 - DNA, 22 bp, Artificial Sequence
  chemically synthesized
cagtatcctgtaacgaatctct

SEQ ID NO: 1308691 - DNA, 22 bp, Artificial Sequence
  chemically synthesized
taacgaatctctttatcatttc

SEQ ID NO: 1308692 - DNA, 22 bp, Artificial Sequence
  chemically synthesized
catgatataagctagaaatgat

SEQ ID NO: 1308693 - DNA, 22 bp, Artificial Sequence
  chemically synthesized
tttatcatttctagcttatatc

SEQ ID NO: 1308694 - DNA, 22 bp, Artificial Sequence
  chemically synthesized
tcacagactccatgatataagc

SEQ ID NO: 1308695 - DNA, 22 bp, Artificial Sequence
  chemically synthesized
tatcatttctagcttatatcat

SEQ ID NO: 1308696 - DNA, 22 bp, Artificial Sequence
  chemically synthesized
atcatttctagcttatatcatg

SEQ ID NO: 1308697 - DNA, 22 bp, Artificial Sequence
  chemically synthesized
tcatttctagcttatatcatgg

SEQ ID NO: 1308698 - DNA, 22 bp, Artificial Sequence
  chemically synthesized
tctgtcacagactccatgatat

SEQ ID NO: 1308699 - DNA, 22 bp, Artificial Sequence
  chemically synthesized
ttgtctgtcacagactccatga

SEQ ID NO: 1308700 - DNA, 22 bp, Artificial Sequence
  chemically synthesized
gttgtctgtcacagactccatg

SEQ ID NO: 1308701 - DNA, 22 bp, Artificial Sequence
  chemically synthesized
ctagcttatatcatggagtctg

SEQ ID NO: 1308702 - DNA, 22 bp, Artificial Sequence
  chemically synthesized
tagcttatatcatggagtctgt

SEQ ID NO: 1308703 - DNA, 22 bp, Artificial Sequence
  chemically synthesized
gcttatatcatggagtctgtga

SEQ ID NO: 1308704 - DNA, 22 bp, Artificial Sequence
  chemically synthesized
atatcatggagtctgtgacaga

SEQ ID NO: 1308705 - DNA, 22 bp, Artificial Sequence
  chemically synthesized
tatcatggagtctgtgacagac

SEQ ID NO: 1308706 - DNA, 22 bp, Artificial Sequence
  chemically synthesized
agaggcaatcttgttgtctgtc

SEQ ID NO: 1308707 - DNA, 22 bp, Artificial Sequence
  chemically synthesized
tgacagacaacaagattgcctc

SEQ ID NO: 1308708 - DNA, 22 bp, Artificial Sequence
  chemically synthesized
cctctgaaccatgccctctact

SEQ ID NO: 1308709 - DNA, 22 bp, Artificial Sequence
  chemically synthesized
tgaaccatgccctctactgatg

SEQ ID NO: 1308710 - DNA, 22 bp, Artificial Sequence
  chemically synthesized
aaccatgccctctactgatgtg

SEQ ID NO: 1308711 - DNA, 22 bp, Artificial Sequence
  chemically synthesized
atcagtataataatacccacat

SEQ ID NO: 1308712 - DNA, 22 bp, Artificial Sequence
  chemically synthesized
tactgatgtgggtattattata

SEQ ID NO: 1308713 - DNA, 22 bp, Artificial Sequence
  chemically synthesized
ctgatgtgggtattattatact

SEQ ID NO: 1308714 - DNA, 22 bp, Artificial Sequence
  chemically synthesized
atgtgggtattattatactgat

SEQ ID NO: 1308715 - DNA, 22 bp, Artificial Sequence
  chemically synthesized
ttatactgatgagatttcttct

SEQ ID NO: 1308716 - DNA, 22 bp, Artificial Sequence
  chemically synthesized
tactgatgagatttcttctttc

SEQ ID NO: 1308717 - DNA, 22 bp, Artificial Sequence
  chemically synthesized
ataacagagaacgagaaagaag

SEQ ID NO: 1308718 - DNA, 22 bp, Artificial Sequence
  chemically synthesized
cataacagagaacgagaaagaa

SEQ ID NO: 1308719 - DNA, 22 bp, Artificial Sequence
  chemically synthesized
tcataacagagaacgagaaaga

SEQ ID NO: 1308720 - DNA, 22 bp, Artificial Sequence
  chemically synthesized
atgagatttcttctttctcgtt

SEQ ID NO: 1308721 - DNA, 22 bp, Artificial Sequence
  chemically synthesized
ttcataacagagaacgagaaag

SEQ ID NO: 1308722 - DNA, 22 bp, Artificial Sequence
  chemically synthesized
tttcataacagagaacgagaaa

SEQ ID NO: 1308723 - DNA, 22 bp, Artificial Sequence
  chemically synthesized
ctttttcataacagagaacgag

SEQ ID NO: 1308724 - DNA, 22 bp, Artificial Sequence
  chemically synthesized
gctttttcataacagagaacga

SEQ ID NO: 1308725 - DNA, 22 bp, Artificial Sequence
  chemically synthesized
cttctttctcgttctctgttat

SEQ ID NO: 1308726 - DNA, 22 bp, Artificial Sequence
  chemically synthesized
ttctttctcgttctctgttatg

SEQ ID NO: 1308727 - DNA, 22 bp, Artificial Sequence
  chemically synthesized
ctttctcgttctctgttatgaa

SEQ ID NO: 1308728 - DNA, 22 bp, Artificial Sequence
  chemically synthesized
tttctcgttctctgttatgaaa

SEQ ID NO: 1308729 - DNA, 22 bp, Artificial Sequence
  chemically synthesized
tctcgttctctgttatgaaaaa

SEQ ID NO: 1308730 - DNA, 22 bp, Artificial Sequence
  chemically synthesized
ctcgttctctgttatgaaaaag

SEQ ID NO: 1308731 - DNA, 22 bp, Artificial Sequence
  chemically synthesized
tcgttctctgttatgaaaaagc

SEQ ID NO: 1308732 - DNA, 22 bp, Artificial Sequence
  chemically synthesized
gttctctgttatgaaaaagcaa

SEQ ID NO: 1308733 - DNA, 22 bp, Artificial Sequence
  chemically synthesized
tctgttatgaaaaagcaagctc

SEQ ID NO: 1308734 - DNA, 22 bp, Artificial Sequence
  chemically synthesized
tgttatgaaaaagcaagctcat

SEQ ID NO: 1308735 - DNA, 22 bp, Artificial Sequence
  chemically synthesized
ttatgaaaaagcaagctcatgg

SEQ ID NO: 1308736 - DNA, 22 bp, Artificial Sequence
  chemically synthesized
tgagccccgtgggccatgagct

SEQ ID NO: 1308737 - DNA, 22 bp, Artificial Sequence
  chemically synthesized
atgagccccgtgggccatgagc

SEQ ID NO: 1308738 - DNA, 22 bp, Artificial Sequence
  chemically synthesized
tgaaaaagcaagctcatggccc

SEQ ID NO: 1308739 - DNA, 22 bp, Artificial Sequence
  chemically synthesized
tatgagccccgtgggccatgag

SEQ ID NO: 1308740 - DNA, 22 bp, Artificial Sequence
  chemically synthesized
ttatgagccccgtgggccatga

SEQ ID NO: 1308741 - DNA, 22 bp, Artificial Sequence
  chemically synthesized
tttatgagccccgtgggccatg

SEQ ID NO: 1308742 - DNA, 22 bp, Artificial Sequence
  chemically synthesized
gtacattttttatgagccccgt

SEQ ID NO: 1308743 - DNA, 22 bp, Artificial Sequence
  chemically synthesized
agtacattttttatgagccccg

SEQ ID NO: 1308744 - DNA, 22 bp, Artificial Sequence
  chemically synthesized
tagtacattttttatgagcccc

SEQ ID NO: 1308745 - DNA, 22 bp, Artificial Sequence
  chemically synthesized
atggcccacggggctcataaaa

SEQ ID NO: 1308746 - DNA, 22 bp, Artificial Sequence
  chemically synthesized
agcctttagtacattttttatg

SEQ ID NO: 1308747 - DNA, 22 bp, Artificial Sequence
  chemically synthesized
tcagcctttagtacatttttta

SEQ ID NO: 1308748 - DNA, 22 bp, Artificial Sequence
  chemically synthesized
ctctcagcctttagtacatttt

SEQ ID NO: 1308749 - DNA, 22 bp, Artificial Sequence
  chemically synthesized
ccattgctctcagcctttagta

SEQ ID NO: 1308750 - DNA, 22 bp, Artificial Sequence
  chemically synthesized
ataaaaaatgtactaaaggctg

SEQ ID NO: 1308751 - DNA, 22 bp, Artificial Sequence
  chemically synthesized
gttgccattgctctcagccttt

SEQ ID NO: 1308752 - DNA, 22 bp, Artificial Sequence
  chemically synthesized
aaggctgagagcaatggcaact

SEQ ID NO: 1308753 - DNA, 22 bp, Artificial Sequence
  chemically synthesized
cacgtatatcattagttgccat

SEQ ID NO: 1308754 - DNA, 22 bp, Artificial Sequence
  chemically synthesized
acacgtatatcattagttgcca

SEQ ID NO: 1308755 - DNA, 22 bp, Artificial Sequence
  chemically synthesized
agagcaatggcaactaatgata

SEQ ID NO: 1308756 - DNA, 22 bp, Artificial Sequence
  chemically synthesized
atcaatatgtacttacacgtat

SEQ ID NO: 1308757 - DNA, 22 bp, Artificial Sequence
  chemically synthesized
gatcaatatgtacttacacgta

SEQ ID NO: 1308758 - DNA, 22 bp, Artificial Sequence
  chemically synthesized
atttgatcaatatgtacttaca

SEQ ID NO: 1308759 - DNA, 22 bp, Artificial Sequence
  chemically synthesized
atgatatacgtgtaagtacata

SEQ ID NO: 1308760 - DNA, 22 bp, Artificial Sequence
  chemically synthesized
taatttgatcaatatgtactta

SEQ ID NO: 1308761 - DNA, 22 bp, Artificial Sequence
  chemically synthesized
tgaaaaaaaaaatcatctctaa

SEQ ID NO: 1308762 - DNA, 22 bp, Artificial Sequence
  chemically synthesized
agctgtgaaaaaaaaaatcatc

SEQ ID NO: 1308763 - DNA, 22 bp, Artificial Sequence
  chemically synthesized
atcaaattagagatgatttttt

SEQ ID NO: 1308764 - DNA, 22 bp, Artificial Sequence
  chemically synthesized
gagatgattttttttttcacag

SEQ ID NO: 1308765 - DNA, 22 bp, Artificial Sequence
  chemically synthesized
gacacatcactgagctgtgaaa

SEQ ID NO: 1308766 - DNA, 22 bp, Artificial Sequence
  chemically synthesized
ttagacacatcactgagctgtg

SEQ ID NO: 1308767 - DNA, 22 bp, Artificial Sequence
  chemically synthesized
ttgttagacacatcactgagct

SEQ ID NO: 1308768 - DNA, 22 bp, Artificial Sequence
  chemically synthesized
tttttttcacagctcagtgatg

SEQ ID NO: 1308769 - DNA, 22 bp, Artificial Sequence
  chemically synthesized
ttttttcacagctcagtgatgt

SEQ ID NO: 1308770 - DNA, 22 bp, Artificial Sequence
  chemically synthesized
tttttcacagctcagtgatgtg

SEQ ID NO: 1308771 - DNA, 22 bp, Artificial Sequence
  chemically synthesized
ttttcacagctcagtgatgtgt

SEQ ID NO: 1308772 - DNA, 22 bp, Artificial Sequence
  chemically synthesized
tttcacagctcagtgatgtgtc

SEQ ID NO: 1308773 - DNA, 22 bp, Artificial Sequence
  chemically synthesized
ttcacagctcagtgatgtgtct

SEQ ID NO: 1308774 - DNA, 22 bp, Artificial Sequence
  chemically synthesized
tcacagctcagtgatgtgtcta

SEQ ID NO: 1308775 - DNA, 22 bp, Artificial Sequence
  chemically synthesized
cacagctcagtgatgtgtctaa

SEQ ID NO: 1308776 - DNA, 22 bp, Artificial Sequence
  chemically synthesized
acagctcagtgatgtgtctaac

SEQ ID NO: 1308777 - DNA, 22 bp, Artificial Sequence
  chemically synthesized
ccagaatactattgttagacac

SEQ ID NO: 1308778 - DNA, 22 bp, Artificial Sequence
  chemically synthesized
cccagaatactattgttagaca

SEQ ID NO: 1308779 - DNA, 22 bp, Artificial Sequence
  chemically synthesized
agtgatgtgtctaacaatagta

SEQ ID NO: 1308780 - DNA, 22 bp, Artificial Sequence
  chemically synthesized
tgtatatatggaatttcccaga

SEQ ID NO: 1308781 - DNA, 22 bp, Artificial Sequence
  chemically synthesized
acaatagtattctgggaaattc

SEQ ID NO: 1308782 - DNA, 22 bp, Artificial Sequence
  chemically synthesized
tattatgtatatatggaatttc

SEQ ID NO: 1308783 - DNA, 22 bp, Artificial Sequence
  chemically synthesized
atattatgtatatatggaattt

SEQ ID NO: 1308784 - DNA, 22 bp, Artificial Sequence
  chemically synthesized
tgggaaattccatatatacata

SEQ ID NO: 1308785 - DNA, 22 bp, Artificial Sequence
  chemically synthesized
ggaaattccatatatacataat

SEQ ID NO: 1308786 - DNA, 22 bp, Artificial Sequence
  chemically synthesized
aataaagccatggcttatatta

SEQ ID NO: 1308787 - DNA, 22 bp, Artificial Sequence
  chemically synthesized
catatatacataatataagcca

SEQ ID NO: 1308788 - DNA, 22 bp, Artificial Sequence
  chemically synthesized
tctgaataaagccatggcttat

SEQ ID NO: 1308789 - DNA, 22 bp, Artificial Sequence
  chemically synthesized
tatctgaataaagccatggctt

SEQ ID NO: 1308790 - DNA, 22 bp, Artificial Sequence
  chemically synthesized
ttctatctgaataaagccatgg

SEQ ID NO: 1308791 - DNA, 22 bp, Artificial Sequence
  chemically synthesized
gttctatctgaataaagccatg

SEQ ID NO: 1308792 - DNA, 22 bp, Artificial Sequence
  chemically synthesized
gcatttgttctatctgaataaa

SEQ ID NO: 1308793 - DNA, 22 bp, Artificial Sequence
  chemically synthesized
tctggcatttgttctatctgaa

SEQ ID NO: 1308794 - DNA, 22 bp, Artificial Sequence
  chemically synthesized
acaatattatctggcatttgtt

SEQ ID NO: 1308795 - DNA, 22 bp, Artificial Sequence
  chemically synthesized
tattcagatagaacaaatgcca

SEQ ID NO: 1308796 - DNA, 22 bp, Artificial Sequence
  chemically synthesized
attcagatagaacaaatgccag

SEQ ID NO: 1308797 - DNA, 22 bp, Artificial Sequence
  chemically synthesized
ttcagatagaacaaatgccaga

SEQ ID NO: 1308798 - DNA, 22 bp, Artificial Sequence
  chemically synthesized
ctaacaatattatctggcattt

SEQ ID NO: 1308799 - DNA, 22 bp, Artificial Sequence
  chemically synthesized
agatagaacaaatgccagataa

SEQ ID NO: 1308800 - DNA, 22 bp, Artificial Sequence
  chemically synthesized
tagaagctcctaacaatattat

SEQ ID NO: 1308801 - DNA, 22 bp, Artificial Sequence
  chemically synthesized
ttgtagaagctcctaacaatat

SEQ ID NO: 1308802 - DNA, 22 bp, Artificial Sequence
  chemically synthesized
ctattgtagaagctcctaacaa

SEQ ID NO: 1308803 - DNA, 22 bp, Artificial Sequence
  chemically synthesized
gctattgtagaagctcctaaca

SEQ ID NO: 1308804 - DNA, 22 bp, Artificial Sequence
  chemically synthesized
tgctattgtagaagctcctaac

SEQ ID NO: 1308805 - DNA, 22 bp, Artificial Sequence
  chemically synthesized
aattttgctattgtagaagctc

SEQ ID NO: 1308806 - DNA, 22 bp, Artificial Sequence
  chemically synthesized
gaattttgctattgtagaagct

SEQ ID NO: 1308807 - DNA, 22 bp, Artificial Sequence
  chemically synthesized
tgaattttgctattgtagaagc

SEQ ID NO: 1308808 - DNA, 22 bp, Artificial Sequence
  chemically synthesized
ttaggagcttctacaatagcaa

SEQ ID NO: 1308809 - DNA, 22 bp, Artificial Sequence
  chemically synthesized
ggagcttctacaatagcaaaat

SEQ ID NO: 1308810 - DNA, 22 bp, Artificial Sequence
  chemically synthesized
ctacaatagcaaaattcaaaat

SEQ ID NO: 1308811 - DNA, 22 bp, Artificial Sequence
  chemically synthesized
tacaatagcaaaattcaaaatc

SEQ ID NO: 1308812 - DNA, 22 bp, Artificial Sequence
  chemically synthesized
aaatgataatgtgattttgaat

SEQ ID NO: 1308813 - DNA, 22 bp, Artificial Sequence
  chemically synthesized
aaaatgataatgtgattttgaa

SEQ ID NO: 1308814 - DNA, 22 bp, Artificial Sequence
  chemically synthesized
caatagcaaaattcaaaatcac

SEQ ID NO: 1308815 - DNA, 22 bp, Artificial Sequence
  chemically synthesized
taaaatgataatgtgattttga

SEQ ID NO: 1308816 - DNA, 22 bp, Artificial Sequence
  chemically synthesized
tgtgttttaaaatgataatgtg

SEQ ID NO: 1308817 - DNA, 22 bp, Artificial Sequence
  chemically synthesized
atgtgttttaaaatgataatgt

SEQ ID NO: 1308818 - DNA, 22 bp, Artificial Sequence
  chemically synthesized
tatgtgttttaaaatgataatg

SEQ ID NO: 1308819 - DNA, 22 bp, Artificial Sequence
  chemically synthesized
aaaatcacattatcattttaaa

SEQ ID NO: 1308820 - DNA, 22 bp, Artificial Sequence
  chemically synthesized
tcattttaaaacacataaaatg

SEQ ID NO: 1308821 - DNA, 22 bp, Artificial Sequence
  chemically synthesized
taaaacacataaaatggctcac

SEQ ID NO: 1308822 - DNA, 22 bp, Artificial Sequence
  chemically synthesized
aagaaaaaaaaagtgagccatt

SEQ ID NO: 1308823 - DNA, 22 bp, Artificial Sequence
  chemically synthesized
aaaacacataaaatggctcact

SEQ ID NO: 1308824 - DNA, 22 bp, Artificial Sequence
  chemically synthesized
aaacacataaaatggctcactt

SEQ ID NO: 1308825 - DNA, 22 bp, Artificial Sequence
  chemically synthesized
actttttttttcttcagtgcct

SEQ ID NO: 1308826 - DNA, 22 bp, Artificial Sequence
  chemically synthesized
aacaagatggacaggcactgaa

SEQ ID NO: 1308827 - DNA, 22 bp, Artificial Sequence
  chemically synthesized
taaacaagatggacaggcactg

SEQ ID NO: 1308828 - DNA, 22 bp, Artificial Sequence
  chemically synthesized
ctaaacaagatggacaggcact

SEQ ID NO: 1308829 - DNA, 22 bp, Artificial Sequence
  chemically synthesized
tttttttcttcagtgcctgtcc

SEQ ID NO: 1308830 - DNA, 22 bp, Artificial Sequence
  chemically synthesized
tctaaacaagatggacaggcac

SEQ ID NO: 1308831 - DNA, 22 bp, Artificial Sequence
  chemically synthesized
ttttttcttcagtgcctgtcca

SEQ ID NO: 1308832 - DNA, 22 bp, Artificial Sequence
  chemically synthesized
ttctaaacaagatggacaggca

SEQ ID NO: 1308833 - DNA, 22 bp, Artificial Sequence
  chemically synthesized
tttttcttcagtgcctgtccat

SEQ ID NO: 1308834 - DNA, 22 bp, Artificial Sequence
  chemically synthesized
ttttcttcagtgcctgtccatc

SEQ ID NO: 1308835 - DNA, 22 bp, Artificial Sequence
  chemically synthesized
tttcttcagtgcctgtccatct

SEQ ID NO: 1308836 - DNA, 22 bp, Artificial Sequence
  chemically synthesized
ttcttcagtgcctgtccatctt

SEQ ID NO: 1308837 - DNA, 22 bp, Artificial Sequence
  chemically synthesized
tcttcagtgcctgtccatcttg

SEQ ID NO: 1308838 - DNA, 22 bp, Artificial Sequence
  chemically synthesized
cttcagtgcctgtccatcttgt

SEQ ID NO: 1308839 - DNA, 22 bp, Artificial Sequence
  chemically synthesized
ttcagtgcctgtccatcttgtt

SEQ ID NO: 1308840 - DNA, 22 bp, Artificial Sequence
  chemically synthesized
cagtgcctgtccatcttgttta

SEQ ID NO: 1308841 - DNA, 22 bp, Artificial Sequence
  chemically synthesized
agtgcctgtccatcttgtttag

SEQ ID NO: 1308842 - DNA, 22 bp, Artificial Sequence
  chemically synthesized
atcaagtcttttctaaacaaga

SEQ ID NO: 1308843 - DNA, 22 bp, Artificial Sequence
  chemically synthesized
aatcaagtcttttctaaacaag

SEQ ID NO: 1308844 - DNA, 22 bp, Artificial Sequence
  chemically synthesized
taatcaagtcttttctaaacaa

SEQ ID NO: 1308845 - DNA, 22 bp, Artificial Sequence
  chemically synthesized
tccatcttgtttagaaaagact

SEQ ID NO: 1308846 - DNA, 22 bp, Artificial Sequence
  chemically synthesized
gtttagaaaagacttgattaaa

SEQ ID NO: 1308847 - DNA, 22 bp, Artificial Sequence
  chemically synthesized
tttagaaaagacttgattaaag

SEQ ID NO: 1308848 - DNA, 22 bp, Artificial Sequence
  chemically synthesized
tcagtggatgtggctttaatca

SEQ ID NO: 1308849 - DNA, 22 bp, Artificial Sequence
  chemically synthesized
agaaaagacttgattaaagcca

SEQ ID NO: 1308850 - DNA, 22 bp, Artificial Sequence
  chemically synthesized
gaaaagacttgattaaagccac

SEQ ID NO: 1308851 - DNA, 22 bp, Artificial Sequence
  chemically synthesized
cctatcagtggatgtggcttta

SEQ ID NO: 1308852 - DNA, 22 bp, Artificial Sequence
  chemically synthesized
cattgcctatcagtggatgtgg

SEQ ID NO: 1308853 - DNA, 22 bp, Artificial Sequence
  chemically synthesized
ccattgcctatcagtggatgtg

SEQ ID NO: 1308854 - DNA, 22 bp, Artificial Sequence
  chemically synthesized
gattaaagccacatccactgat

SEQ ID NO: 1308855 - DNA, 22 bp, Artificial Sequence
  chemically synthesized
attaaagccacatccactgata

SEQ ID NO: 1308856 - DNA, 22 bp, Artificial Sequence
  chemically synthesized
acttccattgcctatcagtgga

SEQ ID NO: 1308857 - DNA, 22 bp, Artificial Sequence
  chemically synthesized
aagccacatccactgataggca

SEQ ID NO: 1308858 - DNA, 22 bp, Artificial Sequence
  chemically synthesized
atctaacttccattgcctatca

SEQ ID NO: 1308859 - DNA, 22 bp, Artificial Sequence
  chemically synthesized
ataggcaatggaagttagatta

SEQ ID NO: 1308860 - DNA, 22 bp, Artificial Sequence
  chemically synthesized
aacagtatcggatacacaagta

SEQ ID NO: 1308861 - DNA, 22 bp, Artificial Sequence
  chemically synthesized
aaacagtatcggatacacaagt

SEQ ID NO: 1308862 - DNA, 22 bp, Artificial Sequence
  chemically synthesized
taaacagtatcggatacacaag

SEQ ID NO: 1308863 - DNA, 22 bp, Artificial Sequence
  chemically synthesized
ttaaacagtatcggatacacaa

SEQ ID NO: 1308864 - DNA, 22 bp, Artificial Sequence
  chemically synthesized
gattagatacttgtgtatccga

SEQ ID NO: 1308865 - DNA, 22 bp, Artificial Sequence
  chemically synthesized
gatacttgtgtatccgatactg

SEQ ID NO: 1308866 - DNA, 22 bp, Artificial Sequence
  chemically synthesized
gtgtatccgatactgtttaaaa

SEQ ID NO: 1308867 - DNA, 22 bp, Artificial Sequence
  chemically synthesized
tgtatccgatactgtttaaaag

SEQ ID NO: 1308868 - DNA, 22 bp, Artificial Sequence
  chemically synthesized
taaaacagaaccagtcttttaa

SEQ ID NO: 1308869 - DNA, 22 bp, Artificial Sequence
  chemically synthesized
aaattataaaacagaaccagtc

SEQ ID NO: 1308870 - DNA, 22 bp, Artificial Sequence
  chemically synthesized
attcaaattataaaacagaacc

SEQ ID NO: 1308871 - DNA, 22 bp, Artificial Sequence
  chemically synthesized
tttaaaagactggttctgtttt

SEQ ID NO: 1308872 - DNA, 22 bp, Artificial Sequence
  chemically synthesized
aattcaaattataaaacagaac

SEQ ID NO: 1308873 - DNA, 22 bp, Artificial Sequence
  chemically synthesized
aaaagactggttctgttttata

SEQ ID NO: 1308874 - DNA, 22 bp, Artificial Sequence
  chemically synthesized
aaagactggttctgttttataa

SEQ ID NO: 1308875 - DNA, 22 bp, Artificial Sequence
  chemically synthesized
ccatttaattcaaattataaaa

SEQ ID NO: 1308876 - DNA, 22 bp, Artificial Sequence
  chemically synthesized
gttaccatttaattcaaattat

SEQ ID NO: 1308877 - DNA, 22 bp, Artificial Sequence
  chemically synthesized
gttctgttttataatttgaatt

SEQ ID NO: 1308878 - DNA, 22 bp, Artificial Sequence
  chemically synthesized
tgttttataatttgaattaaat

SEQ ID NO: 1308879 - DNA, 22 bp, Artificial Sequence
  chemically synthesized
ttttataatttgaattaaatgg

SEQ ID NO: 1308880 - DNA, 22 bp, Artificial Sequence
  chemically synthesized
tataatttgaattaaatggtaa

SEQ ID NO: 1308881 - DNA, 22 bp, Artificial Sequence
  chemically synthesized
ataatttgaattaaatggtaac

SEQ ID NO: 1308882 - DNA, 22 bp, Artificial Sequence
  chemically synthesized
taatttgaattaaatggtaact

SEQ ID NO: 1308883 - DNA, 22 bp, Artificial Sequence
  chemically synthesized
caaaaaaaaagattagttacca

SEQ ID NO: 1308884 - DNA, 22 bp, Artificial Sequence
  chemically synthesized
ctacaaaaaaaaagattagtta

SEQ ID NO: 1308885 - DNA, 22 bp, Artificial Sequence
  chemically synthesized
gaattaaatggtaactaatctt

SEQ ID NO: 1308886 - DNA, 22 bp, Artificial Sequence
  chemically synthesized
aattaaatggtaactaatcttt

SEQ ID NO: 1308887 - DNA, 22 bp, Artificial Sequence
  chemically synthesized
aatggtaactaatctttttttt

SEQ ID NO: 1308888 - DNA, 22 bp, Artificial Sequence
  chemically synthesized
gcccaagctcctacaaaaaaaa

SEQ ID NO: 1308889 - DNA, 22 bp, Artificial Sequence
  chemically synthesized
cctagcccaagctcctacaaaa

SEQ ID NO: 1308890 - DNA, 22 bp, Artificial Sequence
  chemically synthesized
gcctagcccaagctcctacaaa

SEQ ID NO: 1308891 - DNA, 22 bp, Artificial Sequence
  chemically synthesized
tgcctagcccaagctcctacaa

SEQ ID NO: 1308892 - DNA, 22 bp, Artificial Sequence
  chemically synthesized
atctttttttttgtaggagctt

SEQ ID NO: 1308893 - DNA, 22 bp, Artificial Sequence
  chemically synthesized
ctttgcctagcccaagctccta

SEQ ID NO: 1308894 - DNA, 22 bp, Artificial Sequence
  chemically synthesized
actttgcctagcccaagctcct

SEQ ID NO: 1308895 - DNA, 22 bp, Artificial Sequence
  chemically synthesized
tttttttgtaggagcttgggct

SEQ ID NO: 1308896 - DNA, 22 bp, Artificial Sequence
  chemically synthesized
cttactttgcctagcccaagct

SEQ ID NO: 1308897 - DNA, 22 bp, Artificial Sequence
  chemically synthesized
ttttttgtaggagcttgggcta

SEQ ID NO: 1308898 - DNA, 22 bp, Artificial Sequence
  chemically synthesized
tttttgtaggagcttgggctag

SEQ ID NO: 1308899 - DNA, 22 bp, Artificial Sequence
  chemically synthesized
ttttgtaggagcttgggctagg

SEQ ID NO: 1308900 - DNA, 22 bp, Artificial Sequence
  chemically synthesized
ttccttactttgcctagcccaa

SEQ ID NO: 1308901 - DNA, 22 bp, Artificial Sequence
  chemically synthesized
tttgtaggagcttgggctaggc

SEQ ID NO: 1308902 - DNA, 22 bp, Artificial Sequence
  chemically synthesized
attccttactttgcctagccca

SEQ ID NO: 1308903 - DNA, 22 bp, Artificial Sequence
  chemically synthesized
ttgtaggagcttgggctaggca

SEQ ID NO: 1308904 - DNA, 22 bp, Artificial Sequence
  chemically synthesized
tattccttactttgcctagccc

SEQ ID NO: 1308905 - DNA, 22 bp, Artificial Sequence
  chemically synthesized
tgtaggagcttgggctaggcaa

SEQ ID NO: 1308906 - DNA, 22 bp, Artificial Sequence
  chemically synthesized
gtaggagcttgggctaggcaaa

SEQ ID NO: 1308907 - DNA, 22 bp, Artificial Sequence
  chemically synthesized
tttattccttactttgcctagc

SEQ ID NO: 1308908 - DNA, 22 bp, Artificial Sequence
  chemically synthesized
taggagcttgggctaggcaaag

SEQ ID NO: 1308909 - DNA, 22 bp, Artificial Sequence
  chemically synthesized
ctttattccttactttgcctag

SEQ ID NO: 1308910 - DNA, 22 bp, Artificial Sequence
  chemically synthesized
tttctttattccttactttgcc

SEQ ID NO: 1308911 - DNA, 22 bp, Artificial Sequence
  chemically synthesized
atttctttattccttactttgc

SEQ ID NO: 1308912 - DNA, 22 bp, Artificial Sequence
  chemically synthesized
tatttctttattccttactttg

SEQ ID NO: 1308913 - DNA, 22 bp, Artificial Sequence
  chemically synthesized
gggctaggcaaagtaaggaata

SEQ ID NO: 1308914 - DNA, 22 bp, Artificial Sequence
  chemically synthesized
ggctaggcaaagtaaggaataa

SEQ ID NO: 1308915 - DNA, 22 bp, Artificial Sequence
  chemically synthesized
ggcaaagtaaggaataaagaaa

SEQ ID NO: 1308916 - DNA, 22 bp, Artificial Sequence
  chemically synthesized
gtcatagaaaatgtaactttat

SEQ ID NO: 1308917 - DNA, 22 bp, Artificial Sequence
  chemically synthesized
tagtcatagaaaatgtaacttt

SEQ ID NO: 1308918 - DNA, 22 bp, Artificial Sequence
  chemically synthesized
aaatacctctagtcatagaaaa

SEQ ID NO: 1308919 - DNA, 22 bp, Artificial Sequence
  chemically synthesized
taaaatacctctagtcatagaa

SEQ ID NO: 1308920 - DNA, 22 bp, Artificial Sequence
  chemically synthesized
ctaaaatacctctagtcataga

SEQ ID NO: 1308921 - DNA, 22 bp, Artificial Sequence
  chemically synthesized
ttctaaaatacctctagtcata

SEQ ID NO: 1308922 - DNA, 22 bp, Artificial Sequence
  chemically synthesized
cttctaaaatacctctagtcat

SEQ ID NO: 1308923 - DNA, 22 bp, Artificial Sequence
  chemically synthesized
cattttctatgactagaggtat

SEQ ID NO: 1308924 - DNA, 22 bp, Artificial Sequence
  chemically synthesized
aacttcttctaaaatacctcta

SEQ ID NO: 1308925 - DNA, 22 bp, Artificial Sequence
  chemically synthesized
tctatgactagaggtattttag

SEQ ID NO: 1308926 - DNA, 22 bp, Artificial Sequence
  chemically synthesized
ctatgactagaggtattttaga

SEQ ID NO: 1308927 - DNA, 22 bp, Artificial Sequence
  chemically synthesized
tatgactagaggtattttagaa

SEQ ID NO: 1308928 - DNA, 22 bp, Artificial Sequence
  chemically synthesized
tgactagaggtattttagaaga

SEQ ID NO: 1308929 - DNA, 22 bp, Artificial Sequence
  chemically synthesized
agtacgcattcaacttcttcta

SEQ ID NO: 1308930 - DNA, 22 bp, Artificial Sequence
  chemically synthesized
gaggtattttagaagaagttga

SEQ ID NO: 1308931 - DNA, 22 bp, Artificial Sequence
  chemically synthesized
ttaagtacgcattcaacttctt

SEQ ID NO: 1308932 - DNA, 22 bp, Artificial Sequence
  chemically synthesized
attaagtacgcattcaacttct

SEQ ID NO: 1308933 - DNA, 22 bp, Artificial Sequence
  chemically synthesized
tattaagtacgcattcaacttc

SEQ ID NO: 1308934 - DNA, 22 bp, Artificial Sequence
  chemically synthesized
tagaagaagttgaatgcgtact

SEQ ID NO: 1308935 - DNA, 22 bp, Artificial Sequence
  chemically synthesized
agaagaagttgaatgcgtactt

SEQ ID NO: 1308936 - DNA, 22 bp, Artificial Sequence
  chemically synthesized
gaagaagttgaatgcgtactta

SEQ ID NO: 1308937 - DNA, 22 bp, Artificial Sequence
  chemically synthesized
catagaacacacattttattaa

SEQ ID NO: 1308938 - DNA, 22 bp, Artificial Sequence
  chemically synthesized
aatgcgtacttaataaaatgtg

SEQ ID NO: 1308939 - DNA, 22 bp, Artificial Sequence
  chemically synthesized
aataaaatgtgtgttctatgga

SEQ ID NO: 1308940 - DNA, 22 bp, Artificial Sequence
  chemically synthesized
ataaaatgtgtgttctatggag

SEQ ID NO: 1308941 - DNA, 22 bp, Artificial Sequence
  chemically synthesized
tgcatgcgtagaatctccatag

SEQ ID NO: 1308942 - DNA, 22 bp, Artificial Sequence
  chemically synthesized
tatgcatgcgtagaatctccat

SEQ ID NO: 1308943 - DNA, 22 bp, Artificial Sequence
  chemically synthesized
ctatgcatgcgtagaatctcca

SEQ ID NO: 1308944 - DNA, 22 bp, Artificial Sequence
  chemically synthesized
tctatgcatgcgtagaatctcc

SEQ ID NO: 1308945 - DNA, 22 bp, Artificial Sequence
  chemically synthesized
gttttctatgcatgcgtagaat

SEQ ID NO: 1308946 - DNA, 22 bp, Artificial Sequence
  chemically synthesized
tatggagattctacgcatgcat

SEQ ID NO: 1308947 - DNA, 22 bp, Artificial Sequence
  chemically synthesized
acctagttttctatgcatgcgt

SEQ ID NO: 1308948 - DNA, 22 bp, Artificial Sequence
  chemically synthesized
cacctagttttctatgcatgcg

SEQ ID NO: 1308949 - DNA, 22 bp, Artificial Sequence
  chemically synthesized
tggagattctacgcatgcatag

SEQ ID NO: 1308950 - DNA, 22 bp, Artificial Sequence
  chemically synthesized
tttcacctagttttctatgcat

SEQ ID NO: 1308951 - DNA, 22 bp, Artificial Sequence
  chemically synthesized
atttcacctagttttctatgca

SEQ ID NO: 1308952 - DNA, 22 bp, Artificial Sequence
  chemically synthesized
tatttcacctagttttctatgc

SEQ ID NO: 1308953 - DNA, 22 bp, Artificial Sequence
  chemically synthesized
ttatttcacctagttttctatg

SEQ ID NO: 1308954 - DNA, 22 bp, Artificial Sequence
  chemically synthesized
tacgcatgcatagaaaactagg

SEQ ID NO: 1308955 - DNA, 22 bp, Artificial Sequence
  chemically synthesized
cgcatgcatagaaaactaggtg

SEQ ID NO: 1308956 - DNA, 22 bp, Artificial Sequence
  chemically synthesized
cagaaatgtgcagaatttttat

SEQ ID NO: 1308957 - DNA, 22 bp, Artificial Sequence
  chemically synthesized
acagaaatgtgcagaattttta

SEQ ID NO: 1308958 - DNA, 22 bp, Artificial Sequence
  chemically synthesized
cttacagaaatgtgcagaattt

SEQ ID NO: 1308959 - DNA, 22 bp, Artificial Sequence
  chemically synthesized
gcttacagaaatgtgcagaatt

SEQ ID NO: 1308960 - DNA, 22 bp, Artificial Sequence
  chemically synthesized
ggtgaaataaaaattctgcaca

SEQ ID NO: 1308961 - DNA, 22 bp, Artificial Sequence
  chemically synthesized
atacttgcttacagaaatgtgc

SEQ ID NO: 1308962 - DNA, 22 bp, Artificial Sequence
  chemically synthesized
gatacttgcttacagaaatgtg

SEQ ID NO: 1308963 - DNA, 22 bp, Artificial Sequence
  chemically synthesized
cttgatacttgcttacagaaat

SEQ ID NO: 1308964 - DNA, 22 bp, Artificial Sequence
  chemically synthesized
ccttgatacttgcttacagaaa

SEQ ID NO: 1308965 - DNA, 22 bp, Artificial Sequence
  chemically synthesized
tccttgatacttgcttacagaa

SEQ ID NO: 1308966 - DNA, 22 bp, Artificial Sequence
  chemically synthesized
ttccttgatacttgcttacaga

SEQ ID NO: 1308967 - DNA, 22 bp, Artificial Sequence
  chemically synthesized
tttccttgatacttgcttacag

SEQ ID NO: 1308968 - DNA, 22 bp, Artificial Sequence
  chemically synthesized
tttttccttgatacttgcttac

SEQ ID NO: 1308969 - DNA, 22 bp, Artificial Sequence
  chemically synthesized
tgcacatttctgtaagcaagta

SEQ ID NO: 1308970 - DNA, 22 bp, Artificial Sequence
  chemically synthesized
cacatttctgtaagcaagtatc

SEQ ID NO: 1308971 - DNA, 22 bp, Artificial Sequence
  chemically synthesized
agaactctttttccttgatact

SEQ ID NO: 1308972 - DNA, 22 bp, Artificial Sequence
  chemically synthesized
ctgtaagcaagtatcaaggaaa

SEQ ID NO: 1308973 - DNA, 22 bp, Artificial Sequence
  chemically synthesized
ttcagaactctttttccttgat

SEQ ID NO: 1308974 - DNA, 22 bp, Artificial Sequence
  chemically synthesized
tgtaagcaagtatcaaggaaaa

SEQ ID NO: 1308975 - DNA, 22 bp, Artificial Sequence
  chemically synthesized
taagcaagtatcaaggaaaaag

SEQ ID NO: 1308976 - DNA, 22 bp, Artificial Sequence
  chemically synthesized
caattgttcagaactctttttc

SEQ ID NO: 1308977 - DNA, 22 bp, Artificial Sequence
  chemically synthesized
cagggtgctgcaattgttcaga

SEQ ID NO: 1308978 - DNA, 22 bp, Artificial Sequence
  chemically synthesized
acagggtgctgcaattgttcag

SEQ ID NO: 1308979 - DNA, 22 bp, Artificial Sequence
  chemically synthesized
tgaacaattgcagcaccctgta

SEQ ID NO: 1308980 - DNA, 22 bp, Artificial Sequence
  chemically synthesized
aacaattgcagcaccctgtaag

SEQ ID NO: 1308981 - DNA, 22 bp, Artificial Sequence
  chemically synthesized
ggaaagagcatgaaggagactt

SEQ ID NO: 1308982 - DNA, 22 bp, Artificial Sequence
  chemically synthesized
cagcaccctgtaagtctccttc

SEQ ID NO: 1308983 - DNA, 22 bp, Artificial Sequence
  chemically synthesized
taagtctccttcatgctctttc

SEQ ID NO: 1308984 - DNA, 22 bp, Artificial Sequence
  chemically synthesized
cttcatgctctttcccaattca

SEQ ID NO: 1308985 - DNA, 22 bp, Artificial Sequence
  chemically synthesized
gtgggaatatagtgtgaattgg

SEQ ID NO: 1308986 - DNA, 22 bp, Artificial Sequence
  chemically synthesized
catgctctttcccaattcacac

SEQ ID NO: 1308987 - DNA, 22 bp, Artificial Sequence
  chemically synthesized
atgctctttcccaattcacact

SEQ ID NO: 1308988 - DNA, 22 bp, Artificial Sequence
  chemically synthesized
tttcccaattcacactatattc

SEQ ID NO: 1308989 - DNA, 22 bp, Artificial Sequence
  chemically synthesized
agaggctggtgggaatatagtg

SEQ ID NO: 1308990 - DNA, 22 bp, Artificial Sequence
  chemically synthesized
tcccaattcacactatattccc

SEQ ID NO: 1308991 - DNA, 22 bp, Artificial Sequence
  chemically synthesized
cccaattcacactatattccca

SEQ ID NO: 1308992 - DNA, 22 bp, Artificial Sequence
  chemically synthesized
ctgagaggctggtgggaatata

SEQ ID NO: 1308993 - DNA, 22 bp, Artificial Sequence
  chemically synthesized
ccaattcacactatattcccac

SEQ ID NO: 1308994 - DNA, 22 bp, Artificial Sequence
  chemically synthesized
cctgagaggctggtgggaatat

SEQ ID NO: 1308995 - DNA, 22 bp, Artificial Sequence
  chemically synthesized
ttcctgagaggctggtgggaat

SEQ ID NO: 1308996 - DNA, 22 bp, Artificial Sequence
  chemically synthesized
cttcctgagaggctggtgggaa

SEQ ID NO: 1308997 - DNA, 22 bp, Artificial Sequence
  chemically synthesized
acactatattcccaccagcctc

SEQ ID NO: 1308998 - DNA, 22 bp, Artificial Sequence
  chemically synthesized
tattcccaccagcctctcagga

SEQ ID NO: 1308999 - DNA, 22 bp, Artificial Sequence
  chemically synthesized
ccaccagcctctcaggaagaaa

SEQ ID NO: 1309000 - DNA, 22 bp, Artificial Sequence
  chemically synthesized
aggtcagcagagcagtttcttc

SEQ ID NO: 1309001 - DNA, 22 bp, Artificial Sequence
  chemically synthesized
tcaggaagaaactgctctgctg

SEQ ID NO: 1309002 - DNA, 22 bp, Artificial Sequence
  chemically synthesized
taatgattcaggtcagcagagc

SEQ ID NO: 1309003 - DNA, 22 bp, Artificial Sequence
  chemically synthesized
aggaagaaactgctctgctgac

SEQ ID NO: 1309004 - DNA, 22 bp, Artificial Sequence
  chemically synthesized
tctataatgattcaggtcagca

SEQ ID NO: 1309005 - DNA, 22 bp, Artificial Sequence
  chemically synthesized
ctctgctgacctgaatcattat

SEQ ID NO: 1309006 - DNA, 22 bp, Artificial Sequence
  chemically synthesized
gccaaagttatctataatgatt

SEQ ID NO: 1309007 - DNA, 22 bp, Artificial Sequence
  chemically synthesized
tgctgacctgaatcattataga

SEQ ID NO: 1309008 - DNA, 22 bp, Artificial Sequence
  chemically synthesized
ctgacctgaatcattatagata

SEQ ID NO: 1309009 - DNA, 22 bp, Artificial Sequence
  chemically synthesized
acctgaatcattatagataact

SEQ ID NO: 1309010 - DNA, 22 bp, Artificial Sequence
  chemically synthesized
agaactggccaaagttatctat

SEQ ID NO: 1309011 - DNA, 22 bp, Artificial Sequence
  chemically synthesized
gagaactggccaaagttatcta

SEQ ID NO: 1309012 - DNA, 22 bp, Artificial Sequence
  chemically synthesized
aatcattatagataactttggc

SEQ ID NO: 1309013 - DNA, 22 bp, Artificial Sequence
  chemically synthesized
tatgaagtttgagaactggcca

SEQ ID NO: 1309014 - DNA, 22 bp, Artificial Sequence
  chemically synthesized
tagataactttggccagttctc

SEQ ID NO: 1309015 - DNA, 22 bp, Artificial Sequence
  chemically synthesized
catctatatgaagtttgagaac

SEQ ID NO: 1309016 - DNA, 22 bp, Artificial Sequence
  chemically synthesized
tggccagttctcaaacttcata

SEQ ID NO: 1309017 - DNA, 22 bp, Artificial Sequence
  chemically synthesized
ggccagttctcaaacttcatat

SEQ ID NO: 1309018 - DNA, 22 bp, Artificial Sequence
  chemically synthesized
gccagttctcaaacttcatata

SEQ ID NO: 1309019 - DNA, 22 bp, Artificial Sequence
  chemically synthesized
tgtgattccatctatatgaagt

SEQ ID NO: 1309020 - DNA, 22 bp, Artificial Sequence
  chemically synthesized
ctgtgtgattccatctatatga

SEQ ID NO: 1309021 - DNA, 22 bp, Artificial Sequence
  chemically synthesized
actgtgtgattccatctatatg

SEQ ID NO: 1309022 - DNA, 22 bp, Artificial Sequence
  chemically synthesized
tcaaacttcatatagatggaat

SEQ ID NO: 1309023 - DNA, 22 bp, Artificial Sequence
  chemically synthesized
aaacttcatatagatggaatca

SEQ ID NO: 1309024 - DNA, 22 bp, Artificial Sequence
  chemically synthesized
catatagatggaatcacacagt

SEQ ID NO: 1309025 - DNA, 22 bp, Artificial Sequence
  chemically synthesized
atatagatggaatcacacagta

SEQ ID NO: 1309026 - DNA, 22 bp, Artificial Sequence
  chemically synthesized
gaagatgaacatttactgtgtg

SEQ ID NO: 1309027 - DNA, 22 bp, Artificial Sequence
  chemically synthesized
actagaagatgaacatttactg

SEQ ID NO: 1309028 - DNA, 22 bp, Artificial Sequence
  chemically synthesized
ataaacacaatgttgactagaa

SEQ ID NO: 1309029 - DNA, 22 bp, Artificial Sequence
  chemically synthesized
cataaacacaatgttgactaga

SEQ ID NO: 1309030 - DNA, 22 bp, Artificial Sequence
  chemically synthesized
atcttctagtcaacattgtgtt

SEQ ID NO: 1309031 - DNA, 22 bp, Artificial Sequence
  chemically synthesized
ctagtcaacattgtgtttatga

SEQ ID NO: 1309032 - DNA, 22 bp, Artificial Sequence
  chemically synthesized
tagtcaacattgtgtttatgaa

SEQ ID NO: 1309033 - DNA, 22 bp, Artificial Sequence
  chemically synthesized
gtcaacattgtgtttatgaagt

SEQ ID NO: 1309034 - DNA, 22 bp, Artificial Sequence
  chemically synthesized
gaagaatatgaacgaacttcat

SEQ ID NO: 1309035 - DNA, 22 bp, Artificial Sequence
  chemically synthesized
ggaagaatatgaacgaacttca

SEQ ID NO: 1309036 - DNA, 22 bp, Artificial Sequence
  chemically synthesized
cttggaagaatatgaacgaact

SEQ ID NO: 1309037 - DNA, 22 bp, Artificial Sequence
  chemically synthesized
tgtttatgaagttcgttcatat

SEQ ID NO: 1309038 - DNA, 22 bp, Artificial Sequence
  chemically synthesized
ctacttggaagaatatgaacga

SEQ ID NO: 1309039 - DNA, 22 bp, Artificial Sequence
  chemically synthesized
atgaagttcgttcatattcttc

SEQ ID NO: 1309040 - DNA, 22 bp, Artificial Sequence
  chemically synthesized
tgaagttcgttcatattcttcc

SEQ ID NO: 1309041 - DNA, 22 bp, Artificial Sequence
  chemically synthesized
gttcatattcttccaagtagca

SEQ ID NO: 1309042 - DNA, 22 bp, Artificial Sequence
  chemically synthesized
atattcttccaagtagcaggtt

SEQ ID NO: 1309043 - DNA, 22 bp, Artificial Sequence
  chemically synthesized
tatagtaataaaaacctgctac

SEQ ID NO: 1309044 - DNA, 22 bp, Artificial Sequence
  chemically synthesized
ttccaagtagcaggtttttatt

SEQ ID NO: 1309045 - DNA, 22 bp, Artificial Sequence
  chemically synthesized
ccaagtagcaggtttttattac

SEQ ID NO: 1309046 - DNA, 22 bp, Artificial Sequence
  chemically synthesized
caagtagcaggtttttattact

SEQ ID NO: 1309047 - DNA, 22 bp, Artificial Sequence
  chemically synthesized
ggtatatccgtggaatattata

SEQ ID NO: 1309048 - DNA, 22 bp, Artificial Sequence
  chemically synthesized
ttattactatataatattccac

SEQ ID NO: 1309049 - DNA, 22 bp, Artificial Sequence
  chemically synthesized
tattactatataatattccacg

SEQ ID NO: 1309050 - DNA, 22 bp, Artificial Sequence
  chemically synthesized
attactatataatattccacgg

SEQ ID NO: 1309051 - DNA, 22 bp, Artificial Sequence
  chemically synthesized
ttactatataatattccacgga

SEQ ID NO: 1309052 - DNA, 22 bp, Artificial Sequence
  chemically synthesized
ctatataatattccacggatat

SEQ ID NO: 1309053 - DNA, 22 bp, Artificial Sequence
  chemically synthesized
tataatattccacggatatacc

SEQ ID NO: 1309054 - DNA, 22 bp, Artificial Sequence
  chemically synthesized
cacggatatacccaatttttgt

SEQ ID NO: 1309055 - DNA, 22 bp, Artificial Sequence
  chemically synthesized
aaaaacaaaaacaaaaaacaaa

SEQ ID NO: 1309056 - DNA, 22 bp, Artificial Sequence
  chemically synthesized
ttgttttttgtttgttttttgt

SEQ ID NO: 1309057 - DNA, 22 bp, Artificial Sequence
  chemically synthesized
tgttttttgtttgttttttgtt

SEQ ID NO: 1309058 - DNA, 22 bp, Artificial Sequence
  chemically synthesized
gttttttgtttgttttttgttt

SEQ ID NO: 1309059 - DNA, 22 bp, Artificial Sequence
  chemically synthesized
tctcaaaaacaaaaacaaaaaa

SEQ ID NO: 1309060 - DNA, 22 bp, Artificial Sequence
  chemically synthesized
ttttttgtttgttttttgtttt

SEQ ID NO: 1309061 - DNA, 22 bp, Artificial Sequence
  chemically synthesized
gtctcaaaaacaaaaacaaaaa

SEQ ID NO: 1309062 - DNA, 22 bp, Artificial Sequence
  chemically synthesized
tgtctcaaaaacaaaaacaaaa

SEQ ID NO: 1309063 - DNA, 22 bp, Artificial Sequence
  chemically synthesized
tttgtttgttttttgtttttgt

SEQ ID NO: 1309064 - DNA, 22 bp, Artificial Sequence
  chemically synthesized
ttgtttgttttttgtttttgtt

SEQ ID NO: 1309065 - DNA, 22 bp, Artificial Sequence
  chemically synthesized
tgtttgttttttgtttttgttt

SEQ ID NO: 1309066 - DNA, 22 bp, Artificial Sequence
  chemically synthesized
gtttgttttttgtttttgtttt

SEQ ID NO: 1309067 - DNA, 22 bp, Artificial Sequence
  chemically synthesized
tttgttttttgtttttgttttt

SEQ ID NO: 1309068 - DNA, 22 bp, Artificial Sequence
  chemically synthesized
gttttttgtttttgtttttgag

SEQ ID NO: 1309069 - DNA, 22 bp, Artificial Sequence
  chemically synthesized
ttttttgtttttgtttttgaga

SEQ ID NO: 1309070 - DNA, 22 bp, Artificial Sequence
  chemically synthesized
tttgtttttgtttttgagacaa

SEQ ID NO: 1309071 - DNA, 22 bp, Artificial Sequence
  chemically synthesized
ttgtttttgtttttgagacaaa

SEQ ID NO: 1309072 - DNA, 22 bp, Artificial Sequence
  chemically synthesized
tgtttttgtttttgagacaaag

SEQ ID NO: 1309073 - DNA, 22 bp, Artificial Sequence
  chemically synthesized
gtttttgtttttgagacaaagt

SEQ ID NO: 1309074 - DNA, 22 bp, Artificial Sequence
  chemically synthesized
tttttgtttttgagacaaagtc

SEQ ID NO: 1309075 - DNA, 22 bp, Artificial Sequence
  chemically synthesized
ggtgacagagcgagactttgtc

SEQ ID NO: 1309076 - DNA, 22 bp, Artificial Sequence
  chemically synthesized
ttgtttttgagacaaagtctcg

SEQ ID NO: 1309077 - DNA, 22 bp, Artificial Sequence
  chemically synthesized
tgtttttgagacaaagtctcgc

SEQ ID NO: 1309078 - DNA, 22 bp, Artificial Sequence
  chemically synthesized
gtttttgagacaaagtctcgct

SEQ ID NO: 1309079 - DNA, 22 bp, Artificial Sequence
  chemically synthesized
tttttgagacaaagtctcgctc

SEQ ID NO: 1309080 - DNA, 22 bp, Artificial Sequence
  chemically synthesized
agcctgggtgacagagcgagac

SEQ ID NO: 1309081 - DNA, 22 bp, Artificial Sequence
  chemically synthesized
cagcctgggtgacagagcgaga

SEQ ID NO: 1309082 - DNA, 22 bp, Artificial Sequence
  chemically synthesized
ttgagacaaagtctcgctctgt

SEQ ID NO: 1309083 - DNA, 22 bp, Artificial Sequence
  chemically synthesized
tgagacaaagtctcgctctgtc

SEQ ID NO: 1309084 - DNA, 22 bp, Artificial Sequence
  chemically synthesized
gagacaaagtctcgctctgtca

SEQ ID NO: 1309085 - DNA, 22 bp, Artificial Sequence
  chemically synthesized
agacaaagtctcgctctgtcac

SEQ ID NO: 1309086 - DNA, 22 bp, Artificial Sequence
  chemically synthesized
cacttcagcctgggtgacagag

SEQ ID NO: 1309087 - DNA, 22 bp, Artificial Sequence
  chemically synthesized
gctctgtcacccaggctgaagt

SEQ ID NO: 1309088 - DNA, 22 bp, Artificial Sequence
  chemically synthesized
agatcatgccactgcacttcag

SEQ ID NO: 1309089 - DNA, 22 bp, Artificial Sequence
  chemically synthesized
tgtcacccaggctgaagtgcag

SEQ ID NO: 1309090 - DNA, 22 bp, Artificial Sequence
  chemically synthesized
tcacccaggctgaagtgcagtg

SEQ ID NO: 1309091 - DNA, 22 bp, Artificial Sequence
  chemically synthesized
tagtgagctgagatcatgccac

SEQ ID NO: 1309092 - DNA, 22 bp, Artificial Sequence
  chemically synthesized
aagtgcagtggcatgatctcag

SEQ ID NO: 1309093 - DNA, 22 bp, Artificial Sequence
  chemically synthesized
aacccaggaggcagaggttgta

SEQ ID NO: 1309094 - DNA, 22 bp, Artificial Sequence
  chemically synthesized
gaacccaggaggcagaggttgt

SEQ ID NO: 1309095 - DNA, 22 bp, Artificial Sequence
  chemically synthesized
agctcactacaacctctgcctc

SEQ ID NO: 1309096 - DNA, 22 bp, Artificial Sequence
  chemically synthesized
actacaacctctgcctcctggg

SEQ ID NO: 1309097 - DNA, 22 bp, Artificial Sequence
  chemically synthesized
caacctctgcctcctgggttca

SEQ ID NO: 1309098 - DNA, 22 bp, Artificial Sequence
  chemically synthesized
aggcaggagaatcgcttgaacc

SEQ ID NO: 1309099 - DNA, 22 bp, Artificial Sequence
  chemically synthesized
tgcctcctgggttcaagcgatt

SEQ ID NO: 1309100 - DNA, 22 bp, Artificial Sequence
  chemically synthesized
cctcctgggttcaagcgattct

SEQ ID NO: 1309101 - DNA, 22 bp, Artificial Sequence
  chemically synthesized
ctgggttcaagcgattctcctg

SEQ ID NO: 1309102 - DNA, 22 bp, Artificial Sequence
  chemically synthesized
aggaggctaaggcaggagaatc

SEQ ID NO: 1309103 - DNA, 22 bp, Artificial Sequence
  chemically synthesized
ggttcaagcgattctcctgcct

SEQ ID NO: 1309104 - DNA, 22 bp, Artificial Sequence
  chemically synthesized
ctcaggaggctaaggcaggaga

SEQ ID NO: 1309105 - DNA, 22 bp, Artificial Sequence
  chemically synthesized
aagcgattctcctgccttagcc

SEQ ID NO: 1309106 - DNA, 22 bp, Artificial Sequence
  chemically synthesized
taatcccagctactcaggaggc

SEQ ID NO: 1309107 - DNA, 22 bp, Artificial Sequence
  chemically synthesized
tcctgccttagcctcctgagta

SEQ ID NO: 1309108 - DNA, 22 bp, Artificial Sequence
  chemically synthesized
ctgccttagcctcctgagtagc

SEQ ID NO: 1309109 - DNA, 22 bp, Artificial Sequence
  chemically synthesized
ccttagcctcctgagtagctgg

SEQ ID NO: 1309110 - DNA, 22 bp, Artificial Sequence
  chemically synthesized
agcctcctgagtagctgggatt

SEQ ID NO: 1309111 - DNA, 22 bp, Artificial Sequence
  chemically synthesized
gcctcctgagtagctgggatta

SEQ ID NO: 1309112 - DNA, 22 bp, Artificial Sequence
  chemically synthesized
ctgagtagctgggattacaggc

SEQ ID NO: 1309113 - DNA, 22 bp, Artificial Sequence
  chemically synthesized
agtagctgggattacaggcgcc

SEQ ID NO: 1309114 - DNA, 22 bp, Artificial Sequence
  chemically synthesized
gccgtgtgtggtggcaggcgcc

SEQ ID NO: 1309115 - DNA, 22 bp, Artificial Sequence
  chemically synthesized
ggattacaggcgcctgccacca

SEQ ID NO: 1309116 - DNA, 22 bp, Artificial Sequence
  chemically synthesized
caggcgcctgccaccacacacg

SEQ ID NO: 1309117 - DNA, 22 bp, Artificial Sequence
  chemically synthesized
aaaatacaaaaaattagccgtg

SEQ ID NO: 1309118 - DNA, 22 bp, Artificial Sequence
  chemically synthesized
ctaaaaatacaaaaaattagcc

SEQ ID NO: 1309119 - DNA, 22 bp, Artificial Sequence
  chemically synthesized
ccaccacacacggctaattttt

SEQ ID NO: 1309120 - DNA, 22 bp, Artificial Sequence
  chemically synthesized
tactaaaaatacaaaaaattag

SEQ ID NO: 1309121 - DNA, 22 bp, Artificial Sequence
  chemically synthesized
tctctactaaaaatacaaaaaa

SEQ ID NO: 1309122 - DNA, 22 bp, Artificial Sequence
  chemically synthesized
attttttgtatttttagtagag

SEQ ID NO: 1309123 - DNA, 22 bp, Artificial Sequence
  chemically synthesized
tttgtatttttagtagagacag

SEQ ID NO: 1309124 - DNA, 22 bp, Artificial Sequence
  chemically synthesized
ttgtatttttagtagagacagg

SEQ ID NO: 1309125 - DNA, 22 bp, Artificial Sequence
  chemically synthesized
tgtatttttagtagagacaggg

SEQ ID NO: 1309126 - DNA, 22 bp, Artificial Sequence
  chemically synthesized
gtatttttagtagagacagggt

SEQ ID NO: 1309127 - DNA, 22 bp, Artificial Sequence
  chemically synthesized
tatttttagtagagacagggtt

SEQ ID NO: 1309128 - DNA, 22 bp, Artificial Sequence
  chemically synthesized
gtcaacatagtgaaaccctgtc

SEQ ID NO: 1309129 - DNA, 22 bp, Artificial Sequence
  chemically synthesized
ttagtagagacagggtttcact

SEQ ID NO: 1309130 - DNA, 22 bp, Artificial Sequence
  chemically synthesized
tagtagagacagggtttcacta

SEQ ID NO: 1309131 - DNA, 22 bp, Artificial Sequence
  chemically synthesized
agtagagacagggtttcactat

SEQ ID NO: 1309132 - DNA, 22 bp, Artificial Sequence
  chemically synthesized
gtagagacagggtttcactatg

SEQ ID NO: 1309133 - DNA, 22 bp, Artificial Sequence
  chemically synthesized
cactatgttgaccaggctggtc

SEQ ID NO: 1309134 - DNA, 22 bp, Artificial Sequence
  chemically synthesized
actatgttgaccaggctggtct

SEQ ID NO: 1309135 - DNA, 22 bp, Artificial Sequence
  chemically synthesized
agatcaggagtcagagaccagc

SEQ ID NO: 1309136 - DNA, 22 bp, Artificial Sequence
  chemically synthesized
gagatcaggagtcagagaccag

SEQ ID NO: 1309137 - DNA, 22 bp, Artificial Sequence
  chemically synthesized
tgttgaccaggctggtctctga

SEQ ID NO: 1309138 - DNA, 22 bp, Artificial Sequence
  chemically synthesized
accaggctggtctctgactcct

SEQ ID NO: 1309139 - DNA, 22 bp, Artificial Sequence
  chemically synthesized
gtctctgactcctgatctcaag

SEQ ID NO: 1309140 - DNA, 22 bp, Artificial Sequence
  chemically synthesized
tgactcctgatctcaagtgatc

SEQ ID NO: 1309141 - DNA, 22 bp, Artificial Sequence
  chemically synthesized
actcctgatctcaagtgatccg

SEQ ID NO: 1309142 - DNA, 22 bp, Artificial Sequence
  chemically synthesized
ggaggcccaggagggcggatca

SEQ ID NO: 1309143 - DNA, 22 bp, Artificial Sequence
  chemically synthesized
ctgatctcaagtgatccgccct

SEQ ID NO: 1309144 - DNA, 22 bp, Artificial Sequence
  chemically synthesized
gggaggcccaggagggcggatc

SEQ ID NO: 1309145 - DNA, 22 bp, Artificial Sequence
  chemically synthesized
tgggaggcccaggagggcggat

SEQ ID NO: 1309146 - DNA, 22 bp, Artificial Sequence
  chemically synthesized
atctcaagtgatccgccctcct

SEQ ID NO: 1309147 - DNA, 22 bp, Artificial Sequence
  chemically synthesized
gcactttgggaggcccaggagg

SEQ ID NO: 1309148 - DNA, 22 bp, Artificial Sequence
  chemically synthesized
aagtgatccgccctcctgggcc

SEQ ID NO: 1309149 - DNA, 22 bp, Artificial Sequence
  chemically synthesized
taatcctagcactttgggaggc

SEQ ID NO: 1309150 - DNA, 22 bp, Artificial Sequence
  chemically synthesized
acgcctgtaatcctagcacttt

SEQ ID NO: 1309151 - DNA, 22 bp, Artificial Sequence
  chemically synthesized
ctgggcctcccaaagtgctagg

SEQ ID NO: 1309152 - DNA, 22 bp, Artificial Sequence
  chemically synthesized
ggcctcccaaagtgctaggatt

SEQ ID NO: 1309153 - DNA, 22 bp, Artificial Sequence
  chemically synthesized
ccaaagtgctaggattacaggc

SEQ ID NO: 1309154 - DNA, 22 bp, Artificial Sequence
  chemically synthesized
ggcgaggtggctcacgcctgta

SEQ ID NO: 1309155 - DNA, 22 bp, Artificial Sequence
  chemically synthesized
ggattacaggcgtgagccacct

SEQ ID NO: 1309156 - DNA, 22 bp, Artificial Sequence
  chemically synthesized
caggcgtgagccacctcgccca

SEQ ID NO: 1309157 - DNA, 22 bp, Artificial Sequence
  chemically synthesized
aaaatgcggtatagactgggcg

SEQ ID NO: 1309158 - DNA, 22 bp, Artificial Sequence
  chemically synthesized
gaattaaaaatgcggtatagac

SEQ ID NO: 1309159 - DNA, 22 bp, Artificial Sequence
  chemically synthesized
gcccagtctataccgcattttt

SEQ ID NO: 1309160 - DNA, 22 bp, Artificial Sequence
  chemically synthesized
agaattagaattaaaaatgcgg

SEQ ID NO: 1309161 - DNA, 22 bp, Artificial Sequence
  chemically synthesized
tgtccctcagaattagaattaa

SEQ ID NO: 1309162 - DNA, 22 bp, Artificial Sequence
  chemically synthesized
gtgtccctcagaattagaatta

SEQ ID NO: 1309163 - DNA, 22 bp, Artificial Sequence
  chemically synthesized
taccgcatttttaattctaatt

SEQ ID NO: 1309164 - DNA, 22 bp, Artificial Sequence
  chemically synthesized
atataacttgtgtccctcagaa

SEQ ID NO: 1309165 - DNA, 22 bp, Artificial Sequence
  chemically synthesized
ttaattctaattctgagggaca

SEQ ID NO: 1309166 - DNA, 22 bp, Artificial Sequence
  chemically synthesized
taattctaattctgagggacac

SEQ ID NO: 1309167 - DNA, 22 bp, Artificial Sequence
  chemically synthesized
aattctaattctgagggacaca

SEQ ID NO: 1309168 - DNA, 22 bp, Artificial Sequence
  chemically synthesized
attctaattctgagggacacaa

SEQ ID NO: 1309169 - DNA, 22 bp, Artificial Sequence
  chemically synthesized
taattctgagggacacaagtta

SEQ ID NO: 1309170 - DNA, 22 bp, Artificial Sequence
  chemically synthesized
attctgagggacacaagttata

SEQ ID NO: 1309171 - DNA, 22 bp, Artificial Sequence
  chemically synthesized
tgagggacacaagttatatcag

SEQ ID NO: 1309172 - DNA, 22 bp, Artificial Sequence
  chemically synthesized
agggacacaagttatatcaggt

SEQ ID NO: 1309173 - DNA, 22 bp, Artificial Sequence
  chemically synthesized
cataatagcagaacctgatata

SEQ ID NO: 1309174 - DNA, 22 bp, Artificial Sequence
  chemically synthesized
gcataatagcagaacctgatat

SEQ ID NO: 1309175 - DNA, 22 bp, Artificial Sequence
  chemically synthesized
tgcataatagcagaacctgata

SEQ ID NO: 1309176 - DNA, 22 bp, Artificial Sequence
  chemically synthesized
tatcaggttctgctattatgca

SEQ ID NO: 1309177 - DNA, 22 bp, Artificial Sequence
  chemically synthesized
atagcaacattttgcataatag

SEQ ID NO: 1309178 - DNA, 22 bp, Artificial Sequence
  chemically synthesized
tgctattatgcaaaatgttgct

SEQ ID NO: 1309179 - DNA, 22 bp, Artificial Sequence
  chemically synthesized
ctattatgcaaaatgttgctat

SEQ ID NO: 1309180 - DNA, 22 bp, Artificial Sequence
  chemically synthesized
ttatgcaaaatgttgctattaa

SEQ ID NO: 1309181 - DNA, 22 bp, Artificial Sequence
  chemically synthesized
tgcaaaatgttgctattaacta

SEQ ID NO: 1309182 - DNA, 22 bp, Artificial Sequence
  chemically synthesized
ctattaactaccttgtgcatgc

SEQ ID NO: 1309183 - DNA, 22 bp, Artificial Sequence
  chemically synthesized
agtccaccaaaatagcatgcac

SEQ ID NO: 1309184 - DNA, 22 bp, Artificial Sequence
  chemically synthesized
ttaactaccttgtgcatgctat

SEQ ID NO: 1309185 - DNA, 22 bp, Artificial Sequence
  chemically synthesized
actaccttgtgcatgctatttt

SEQ ID NO: 1309186 - DNA, 22 bp, Artificial Sequence
  chemically synthesized
ccttgtgcatgctattttggtg

SEQ ID NO: 1309187 - DNA, 22 bp, Artificial Sequence
  chemically synthesized
gtgcatgctattttggtggact

SEQ ID NO: 1309188 - DNA, 22 bp, Artificial Sequence
  chemically synthesized
tgcatgctattttggtggactt

SEQ ID NO: 1309189 - DNA, 22 bp, Artificial Sequence
  chemically synthesized
aaaaaaggggagaaattaagtc

SEQ ID NO: 1309190 - DNA, 22 bp, Artificial Sequence
  chemically synthesized
ttttggtggacttaatttctcc

SEQ ID NO: 1309191 - DNA, 22 bp, Artificial Sequence
  chemically synthesized
tctcaaaaaaggggagaaatta

SEQ ID NO: 1309192 - DNA, 22 bp, Artificial Sequence
  chemically synthesized
tggtggacttaatttctcccct

SEQ ID NO: 1309193 - DNA, 22 bp, Artificial Sequence
  chemically synthesized
ggtggacttaatttctcccctt

SEQ ID NO: 1309194 - DNA, 22 bp, Artificial Sequence
  chemically synthesized
gtggacttaatttctccccttt

SEQ ID NO: 1309195 - DNA, 22 bp, Artificial Sequence
  chemically synthesized
aatttctccccttttttgagac

SEQ ID NO: 1309196 - DNA, 22 bp, Artificial Sequence
  chemically synthesized
atttctccccttttttgagaca

SEQ ID NO: 1309197 - DNA, 22 bp, Artificial Sequence
  chemically synthesized
ctccccttttttgagacagggt

SEQ ID NO: 1309198 - DNA, 22 bp, Artificial Sequence
  chemically synthesized
ggacagagtcagaccctgtctc

SEQ ID NO: 1309199 - DNA, 22 bp, Artificial Sequence
  chemically synthesized
tccccttttttgagacagggtc

SEQ ID NO: 1309200 - DNA, 22 bp, Artificial Sequence
  chemically synthesized
cccttttttgagacagggtctg

SEQ ID NO: 1309201 - DNA, 22 bp, Artificial Sequence
  chemically synthesized
cctgggacagagtcagaccctg

SEQ ID NO: 1309202 - DNA, 22 bp, Artificial Sequence
  chemically synthesized
ctgcctgggacagagtcagacc

SEQ ID NO: 1309203 - DNA, 22 bp, Artificial Sequence
  chemically synthesized
ttttgagacagggtctgactct

SEQ ID NO: 1309204 - DNA, 22 bp, Artificial Sequence
  chemically synthesized
tttgagacagggtctgactctg

SEQ ID NO: 1309205 - DNA, 22 bp, Artificial Sequence
  chemically synthesized
ttgagacagggtctgactctgt

SEQ ID NO: 1309206 - DNA, 22 bp, Artificial Sequence
  chemically synthesized
tgagacagggtctgactctgtc

SEQ ID NO: 1309207 - DNA, 22 bp, Artificial Sequence
  chemically synthesized
gagacagggtctgactctgtcc

SEQ ID NO: 1309208 - DNA, 22 bp, Artificial Sequence
  chemically synthesized
cactcctgcctgggacagagtc

SEQ ID NO: 1309209 - DNA, 22 bp, Artificial Sequence
  chemically synthesized
agacagggtctgactctgtccc

SEQ ID NO: 1309210 - DNA, 22 bp, Artificial Sequence
  chemically synthesized
caccactacactcctgcctggg

SEQ ID NO: 1309211 - DNA, 22 bp, Artificial Sequence
  chemically synthesized
actctgtcccaggcaggagtgt

SEQ ID NO: 1309212 - DNA, 22 bp, Artificial Sequence
  chemically synthesized
tgtcccaggcaggagtgtagtg

SEQ ID NO: 1309213 - DNA, 22 bp, Artificial Sequence
  chemically synthesized
tcccaggcaggagtgtagtggt

SEQ ID NO: 1309214 - DNA, 22 bp, Artificial Sequence
  chemically synthesized
cagggagccgtgattgcaccac

SEQ ID NO: 1309215 - DNA, 22 bp, Artificial Sequence
  chemically synthesized
aggctgcagggagccgtgattg

SEQ ID NO: 1309216 - DNA, 22 bp, Artificial Sequence
  chemically synthesized
agcccaggaagttgaggctgca

SEQ ID NO: 1309217 - DNA, 22 bp, Artificial Sequence
  chemically synthesized
gagcccaggaagttgaggctgc

SEQ ID NO: 1309218 - DNA, 22 bp, Artificial Sequence
  chemically synthesized
cctgcagcctcaacttcctggg

SEQ ID NO: 1309219 - DNA, 22 bp, Artificial Sequence
  chemically synthesized
cagcctcaacttcctgggctca

SEQ ID NO: 1309220 - DNA, 22 bp, Artificial Sequence
  chemically synthesized
agatgagagaatggcttgagcc

SEQ ID NO: 1309221 - DNA, 22 bp, Artificial Sequence
  chemically synthesized
aacttcctgggctcaagccatt

SEQ ID NO: 1309222 - DNA, 22 bp, Artificial Sequence
  chemically synthesized
cctgggctcaagccattctctc

SEQ ID NO: 1309223 - DNA, 22 bp, Artificial Sequence
  chemically synthesized
ctgggctcaagccattctctca

SEQ ID NO: 1309224 - DNA, 22 bp, Artificial Sequence
  chemically synthesized
cagaggctgagatgagagaatg

SEQ ID NO: 1309225 - DNA, 22 bp, Artificial Sequence
  chemically synthesized
ggctcaagccattctctcatct

SEQ ID NO: 1309226 - DNA, 22 bp, Artificial Sequence
  chemically synthesized
ctccagaggctgagatgagaga

SEQ ID NO: 1309227 - DNA, 22 bp, Artificial Sequence
  chemically synthesized
aagccattctctcatctcagcc

SEQ ID NO: 1309228 - DNA, 22 bp, Artificial Sequence
  chemically synthesized
tagtcccagctactccagaggc

SEQ ID NO: 1309229 - DNA, 22 bp, Artificial Sequence
  chemically synthesized
tctcatctcagcctctggagta

SEQ ID NO: 1309230 - DNA, 22 bp, Artificial Sequence
  chemically synthesized
tcatctcagcctctggagtagc

SEQ ID NO: 1309231 - DNA, 22 bp, Artificial Sequence
  chemically synthesized
atctcagcctctggagtagctg

SEQ ID NO: 1309232 - DNA, 22 bp, Artificial Sequence
  chemically synthesized
agcctctggagtagctgggact

SEQ ID NO: 1309233 - DNA, 22 bp, Artificial Sequence
  chemically synthesized
tggagtagctgggactacaggt

SEQ ID NO: 1309234 - DNA, 22 bp, Artificial Sequence
  chemically synthesized
gagtagctgggactacaggtgc

SEQ ID NO: 1309235 - DNA, 22 bp, Artificial Sequence
  chemically synthesized
acatggtggcatgcacctgtag

SEQ ID NO: 1309236 - DNA, 22 bp, Artificial Sequence
  chemically synthesized
gcctgacatggtggcatgcacc

SEQ ID NO: 1309237 - DNA, 22 bp, Artificial Sequence
  chemically synthesized
ggactacaggtgcatgccacca

SEQ ID NO: 1309238 - DNA, 22 bp, Artificial Sequence
  chemically synthesized
caggtgcatgccaccatgtcag

SEQ ID NO: 1309239 - DNA, 22 bp, Artificial Sequence
  chemically synthesized
attttgattattattattttat

SEQ ID NO: 1309240 - DNA, 22 bp, Artificial Sequence
  chemically synthesized
caaaaaaaaaaaataaaataat

SEQ ID NO: 1309241 - DNA, 22 bp, Artificial Sequence
  chemically synthesized
tacaaaaaaaaaaaataaaata

SEQ ID NO: 1309242 - DNA, 22 bp, Artificial Sequence
  chemically synthesized
tgattattattattttattttt

SEQ ID NO: 1309243 - DNA, 22 bp, Artificial Sequence
  chemically synthesized
gattattattattttatttttt

SEQ ID NO: 1309244 - DNA, 22 bp, Artificial Sequence
  chemically synthesized
attattattattttattttttt

SEQ ID NO: 1309245 - DNA, 22 bp, Artificial Sequence
  chemically synthesized
atctctacaaaaaaaaaaaata

SEQ ID NO: 1309246 - DNA, 22 bp, Artificial Sequence
  chemically synthesized
ttattattttattttttttttt

SEQ ID NO: 1309247 - DNA, 22 bp, Artificial Sequence
  chemically synthesized
acctcatctctacaaaaaaaaa

SEQ ID NO: 1309248 - DNA, 22 bp, Artificial Sequence
  chemically synthesized
ttattttattttttttttttgt

SEQ ID NO: 1309249 - DNA, 22 bp, Artificial Sequence
  chemically synthesized
gacctcatctctacaaaaaaaa

SEQ ID NO: 1309250 - DNA, 22 bp, Artificial Sequence
  chemically synthesized
ttttattttttttttttgtaga

SEQ ID NO: 1309251 - DNA, 22 bp, Artificial Sequence
  chemically synthesized
tattttttttttttgtagagat

SEQ ID NO: 1309252 - DNA, 22 bp, Artificial Sequence
  chemically synthesized
attttttttttttgtagagatg

SEQ ID NO: 1309253 - DNA, 22 bp, Artificial Sequence
  chemically synthesized
ttttttttttttgtagagatga

SEQ ID NO: 1309254 - DNA, 22 bp, Artificial Sequence
  chemically synthesized
tttttttttgtagagatgaggt

SEQ ID NO: 1309255 - DNA, 22 bp, Artificial Sequence
  chemically synthesized
ttttttttgtagagatgaggtc

SEQ ID NO: 1309256 - DNA, 22 bp, Artificial Sequence
  chemically synthesized
tttttttgtagagatgaggtca

SEQ ID NO: 1309257 - DNA, 22 bp, Artificial Sequence
  chemically synthesized
ggcaacatagtttgacctcatc

SEQ ID NO: 1309258 - DNA, 22 bp, Artificial Sequence
  chemically synthesized
ttttttgtagagatgaggtcaa

SEQ ID NO: 1309259 - DNA, 22 bp, Artificial Sequence
  chemically synthesized
tttttgtagagatgaggtcaaa

SEQ ID NO: 1309260 - DNA, 22 bp, Artificial Sequence
  chemically synthesized
ttttgtagagatgaggtcaaac

SEQ ID NO: 1309261 - DNA, 22 bp, Artificial Sequence
  chemically synthesized
tttgtagagatgaggtcaaact

SEQ ID NO: 1309262 - DNA, 22 bp, Artificial Sequence
  chemically synthesized
ttgtagagatgaggtcaaacta

SEQ ID NO: 1309263 - DNA, 22 bp, Artificial Sequence
  chemically synthesized
tcctgggcaacatagtttgacc

SEQ ID NO: 1309264 - DNA, 22 bp, Artificial Sequence
  chemically synthesized
tgtagagatgaggtcaaactat

SEQ ID NO: 1309265 - DNA, 22 bp, Artificial Sequence
  chemically synthesized
gtagagatgaggtcaaactatg

SEQ ID NO: 1309266 - DNA, 22 bp, Artificial Sequence
  chemically synthesized
tagagatgaggtcaaactatgt

SEQ ID NO: 1309267 - DNA, 22 bp, Artificial Sequence
  chemically synthesized
gactatcctgggcaacatagtt

SEQ ID NO: 1309268 - DNA, 22 bp, Artificial Sequence
  chemically synthesized
agactatcctgggcaacatagt

SEQ ID NO: 1309269 - DNA, 22 bp, Artificial Sequence
  chemically synthesized
tagactatcctgggcaacatag

SEQ ID NO: 1309270 - DNA, 22 bp, Artificial Sequence
  chemically synthesized
aagccaggagttttagactatc

SEQ ID NO: 1309271 - DNA, 22 bp, Artificial Sequence
  chemically synthesized
gaagccaggagttttagactat

SEQ ID NO: 1309272 - DNA, 22 bp, Artificial Sequence
  chemically synthesized
tgttgcccaggatagtctaaaa

SEQ ID NO: 1309273 - DNA, 22 bp, Artificial Sequence
  chemically synthesized
cccaggatagtctaaaactcct

SEQ ID NO: 1309274 - DNA, 22 bp, Artificial Sequence
  chemically synthesized
aaactcctggcttcaagtgacc

SEQ ID NO: 1309275 - DNA, 22 bp, Artificial Sequence
  chemically synthesized
ggaggccaaagtgggagggtca

SEQ ID NO: 1309276 - DNA, 22 bp, Artificial Sequence
  chemically synthesized
ctggcttcaagtgaccctccca

SEQ ID NO: 1309277 - DNA, 22 bp, Artificial Sequence
  chemically synthesized
gggaggccaaagtgggagggtc

SEQ ID NO: 1309278 - DNA, 22 bp, Artificial Sequence
  chemically synthesized
tgggaggccaaagtgggagggt

SEQ ID NO: 1309279 - DNA, 22 bp, Artificial Sequence
  chemically synthesized
gcttcaagtgaccctcccactt

SEQ ID NO: 1309280 - DNA, 22 bp, Artificial Sequence
  chemically synthesized
caagtgaccctcccactttggc

SEQ ID NO: 1309281 - DNA, 22 bp, Artificial Sequence
  chemically synthesized
aagtgaccctcccactttggcc

SEQ ID NO: 1309282 - DNA, 22 bp, Artificial Sequence
  chemically synthesized
taatcccagcactttgggaggc

SEQ ID NO: 1309283 - DNA, 22 bp, Artificial Sequence
  chemically synthesized
ccactttggcctcccaaagtgc

SEQ ID NO: 1309284 - DNA, 22 bp, Artificial Sequence
  chemically synthesized
tggcctcccaaagtgctgggat

SEQ ID NO: 1309285 - DNA, 22 bp, Artificial Sequence
  chemically synthesized
ggcctcccaaagtgctgggatt

SEQ ID NO: 1309286 - DNA, 22 bp, Artificial Sequence
  chemically synthesized
gcctcccaaagtgctgggatta

SEQ ID NO: 1309287 - DNA, 22 bp, Artificial Sequence
  chemically synthesized
ccaaagtgctgggattacaggc

SEQ ID NO: 1309288 - DNA, 22 bp, Artificial Sequence
  chemically synthesized
ggattacaggcatgatccacta

SEQ ID NO: 1309289 - DNA, 22 bp, Artificial Sequence
  chemically synthesized
gtaggccaggtgtagtggatca

SEQ ID NO: 1309290 - DNA, 22 bp, Artificial Sequence
  chemically synthesized
caggcatgatccactacacctg

SEQ ID NO: 1309291 - DNA, 22 bp, Artificial Sequence
  chemically synthesized
aaaagaaattagtaggccaggt

SEQ ID NO: 1309292 - DNA, 22 bp, Artificial Sequence
  chemically synthesized
cacctggcctactaatttcttt

SEQ ID NO: 1309293 - DNA, 22 bp, Artificial Sequence
  chemically synthesized
atatgtatgtgttcaaaagaaa

SEQ ID NO: 1309294 - DNA, 22 bp, Artificial Sequence
  chemically synthesized
tcatatgtatgtgttcaaaaga

SEQ ID NO: 1309295 - DNA, 22 bp, Artificial Sequence
  chemically synthesized
gcctactaatttcttttgaaca

SEQ ID NO: 1309296 - DNA, 22 bp, Artificial Sequence
  chemically synthesized
ctctcatatgtatgtgttcaaa

SEQ ID NO: 1309297 - DNA, 22 bp, Artificial Sequence
  chemically synthesized
ctaatttcttttgaacacatac

SEQ ID NO: 1309298 - DNA, 22 bp, Artificial Sequence
  chemically synthesized
atttcttttgaacacatacata

SEQ ID NO: 1309299 - DNA, 22 bp, Artificial Sequence
  chemically synthesized
cttttgaacacatacatatgag

SEQ ID NO: 1309300 - DNA, 22 bp, Artificial Sequence
  chemically synthesized
ttttgaacacatacatatgaga

SEQ ID NO: 1309301 - DNA, 22 bp, Artificial Sequence
  chemically synthesized
ttgaacacatacatatgagagg

SEQ ID NO: 1309302 - DNA, 22 bp, Artificial Sequence
  chemically synthesized
tgaacacatacatatgagagga

SEQ ID NO: 1309303 - DNA, 22 bp, Artificial Sequence
  chemically synthesized
tgagccagcaattcctctcata

SEQ ID NO: 1309304 - DNA, 22 bp, Artificial Sequence
  chemically synthesized
gaacacatacatatgagaggaa

SEQ ID NO: 1309305 - DNA, 22 bp, Artificial Sequence
  chemically synthesized
atgagccagcaattcctctcat

SEQ ID NO: 1309306 - DNA, 22 bp, Artificial Sequence
  chemically synthesized
aacacatacatatgagaggaat

SEQ ID NO: 1309307 - DNA, 22 bp, Artificial Sequence
  chemically synthesized
cttatgagccagcaattcctct

SEQ ID NO: 1309308 - DNA, 22 bp, Artificial Sequence
  chemically synthesized
ccttatgagccagcaattcctc

SEQ ID NO: 1309309 - DNA, 22 bp, Artificial Sequence
  chemically synthesized
tgccttccttatgagccagcaa

SEQ ID NO: 1309310 - DNA, 22 bp, Artificial Sequence
  chemically synthesized
atgccttccttatgagccagca

SEQ ID NO: 1309311 - DNA, 22 bp, Artificial Sequence
  chemically synthesized
aatttatgccttccttatgagc

SEQ ID NO: 1309312 - DNA, 22 bp, Artificial Sequence
  chemically synthesized
aatctaaatttatgccttcctt

SEQ ID NO: 1309313 - DNA, 22 bp, Artificial Sequence
  chemically synthesized
ctggctcataaggaaggcataa

SEQ ID NO: 1309314 - DNA, 22 bp, Artificial Sequence
  chemically synthesized
ctaaatctaaatttatgccttc

SEQ ID NO: 1309315 - DNA, 22 bp, Artificial Sequence
  chemically synthesized
gctcataaggaaggcataaatt

SEQ ID NO: 1309316 - DNA, 22 bp, Artificial Sequence
  chemically synthesized
ataaggaaggcataaatttaga

SEQ ID NO: 1309317 - DNA, 22 bp, Artificial Sequence
  chemically synthesized
ccaatatctactaaatctaaat

SEQ ID NO: 1309318 - DNA, 22 bp, Artificial Sequence
  chemically synthesized
gccaatatctactaaatctaaa

SEQ ID NO: 1309319 - DNA, 22 bp, Artificial Sequence
  chemically synthesized
atatttgccaatatctactaaa

SEQ ID NO: 1309320 - DNA, 22 bp, Artificial Sequence
  chemically synthesized
agatttagtagatattggcaaa

SEQ ID NO: 1309321 - DNA, 22 bp, Artificial Sequence
  chemically synthesized
gatttagtagatattggcaaat

SEQ ID NO: 1309322 - DNA, 22 bp, Artificial Sequence
  chemically synthesized
agtgtaaattaatatttgccaa

SEQ ID NO: 1309323 - DNA, 22 bp, Artificial Sequence
  chemically synthesized
aagtgtaaattaatatttgcca

SEQ ID NO: 1309324 - DNA, 22 bp, Artificial Sequence
  chemically synthesized
agtagatattggcaaatattaa

SEQ ID NO: 1309325 - DNA, 22 bp, Artificial Sequence
  chemically synthesized
gtagatattggcaaatattaat

SEQ ID NO: 1309326 - DNA, 22 bp, Artificial Sequence
  chemically synthesized
gtttaagtgtaaattaatattt

SEQ ID NO: 1309327 - DNA, 22 bp, Artificial Sequence
  chemically synthesized
ctggtttaagtgtaaattaata

SEQ ID NO: 1309328 - DNA, 22 bp, Artificial Sequence
  chemically synthesized
gcaaatattaatttacacttaa

SEQ ID NO: 1309329 - DNA, 22 bp, Artificial Sequence
  chemically synthesized
aaatattgctggtttaagtgta

SEQ ID NO: 1309330 - DNA, 22 bp, Artificial Sequence
  chemically synthesized
tcaaatattgctggtttaagtg

SEQ ID NO: 1309331 - DNA, 22 bp, Artificial Sequence
  chemically synthesized
gagctctcaaatattgctggtt

SEQ ID NO: 1309332 - DNA, 22 bp, Artificial Sequence
  chemically synthesized
atttacacttaaaccagcaata

SEQ ID NO: 1309333 - DNA, 22 bp, Artificial Sequence
  chemically synthesized
acacttaaaccagcaatatttg

SEQ ID NO: 1309334 - DNA, 22 bp, Artificial Sequence
  chemically synthesized
agctggagctctcaaatattgc

SEQ ID NO: 1309335 - DNA, 22 bp, Artificial Sequence
  chemically synthesized
cacttaaaccagcaatatttga

SEQ ID NO: 1309336 - DNA, 22 bp, Artificial Sequence
  chemically synthesized
aaaccagcaatatttgagagct

SEQ ID NO: 1309337 - DNA, 22 bp, Artificial Sequence
  chemically synthesized
aaccagcaatatttgagagctc

SEQ ID NO: 1309338 - DNA, 22 bp, Artificial Sequence
  chemically synthesized
gtgcctcagctggagctctcaa

SEQ ID NO: 1309339 - DNA, 22 bp, Artificial Sequence
  chemically synthesized
gggagaattggtgcctcagctg

SEQ ID NO: 1309340 - DNA, 22 bp, Artificial Sequence
  chemically synthesized
gagagctccagctgaggcacca

SEQ ID NO: 1309341 - DNA, 22 bp, Artificial Sequence
  chemically synthesized
agagctccagctgaggcaccaa

SEQ ID NO: 1309342 - DNA, 22 bp, Artificial Sequence
  chemically synthesized
cagctgaggcaccaattctccc

SEQ ID NO: 1309343 - DNA, 22 bp, Artificial Sequence
  chemically synthesized
aggcaccaattctccccaatac

SEQ ID NO: 1309344 - DNA, 22 bp, Artificial Sequence
  chemically synthesized
aaatataataagacaatatcaa

SEQ ID NO: 1309345 - DNA, 22 bp, Artificial Sequence
  chemically synthesized
tccccaatacttgatattgtct

SEQ ID NO: 1309346 - DNA, 22 bp, Artificial Sequence
  chemically synthesized
cccaatacttgatattgtctta

SEQ ID NO: 1309347 - DNA, 22 bp, Artificial Sequence
  chemically synthesized
gatattgtcttattatatttta

SEQ ID NO: 1309348 - DNA, 22 bp, Artificial Sequence
  chemically synthesized
atattgtcttattatattttaa

SEQ ID NO: 1309349 - DNA, 22 bp, Artificial Sequence
  chemically synthesized
tatatgcatccgaatggttaaa

SEQ ID NO: 1309350 - DNA, 22 bp, Artificial Sequence
  chemically synthesized
tcttattatattttaaccattc

SEQ ID NO: 1309351 - DNA, 22 bp, Artificial Sequence
  chemically synthesized
attatattttaaccattcggat

SEQ ID NO: 1309352 - DNA, 22 bp, Artificial Sequence
  chemically synthesized
ttatattttaaccattcggatg

SEQ ID NO: 1309353 - DNA, 22 bp, Artificial Sequence
  chemically synthesized
tattttaaccattcggatgcat

SEQ ID NO: 1309354 - DNA, 22 bp, Artificial Sequence
  chemically synthesized
aatacccctatatatgcatccg

SEQ ID NO: 1309355 - DNA, 22 bp, Artificial Sequence
  chemically synthesized
gaatacccctatatatgcatcc

SEQ ID NO: 1309356 - DNA, 22 bp, Artificial Sequence
  chemically synthesized
tgaatacccctatatatgcatc

SEQ ID NO: 1309357 - DNA, 22 bp, Artificial Sequence
  chemically synthesized
taaccattcggatgcatatata

SEQ ID NO: 1309358 - DNA, 22 bp, Artificial Sequence
  chemically synthesized
aaccattcggatgcatatatag

SEQ ID NO: 1309359 - DNA, 22 bp, Artificial Sequence
  chemically synthesized
accattcggatgcatatatagg

SEQ ID NO: 1309360 - DNA, 22 bp, Artificial Sequence
  chemically synthesized
ggatgcatatataggggtattc

SEQ ID NO: 1309361 - DNA, 22 bp, Artificial Sequence
  chemically synthesized
gtaatcaaagaattttgaatac

SEQ ID NO: 1309362 - DNA, 22 bp, Artificial Sequence
  chemically synthesized
attagtaatcaaagaattttga

SEQ ID NO: 1309363 - DNA, 22 bp, Artificial Sequence
  chemically synthesized
cattagtaatcaaagaattttg

SEQ ID NO: 1309364 - DNA, 22 bp, Artificial Sequence
  chemically synthesized
acttcattagtaatcaaagaat

SEQ ID NO: 1309365 - DNA, 22 bp, Artificial Sequence
  chemically synthesized
aaaattctttgattactaatga

SEQ ID NO: 1309366 - DNA, 22 bp, Artificial Sequence
  chemically synthesized
aataggtgcctaacttcattag

SEQ ID NO: 1309367 - DNA, 22 bp, Artificial Sequence
  chemically synthesized
gaataggtgcctaacttcatta

SEQ ID NO: 1309368 - DNA, 22 bp, Artificial Sequence
  chemically synthesized
tttgattactaatgaagttagg

SEQ ID NO: 1309369 - DNA, 22 bp, Artificial Sequence
  chemically synthesized
tgattactaatgaagttaggca

SEQ ID NO: 1309370 - DNA, 22 bp, Artificial Sequence
  chemically synthesized
gattactaatgaagttaggcac

SEQ ID NO: 1309371 - DNA, 22 bp, Artificial Sequence
  chemically synthesized
attactaatgaagttaggcacc

SEQ ID NO: 1309372 - DNA, 22 bp, Artificial Sequence
  chemically synthesized
ctaatgaagttaggcacctatt

SEQ ID NO: 1309373 - DNA, 22 bp, Artificial Sequence
  chemically synthesized
atgaagttaggcacctattcaa

SEQ ID NO: 1309374 - DNA, 22 bp, Artificial Sequence
  chemically synthesized
ggcacctattcaaatgtttttt

SEQ ID NO: 1309375 - DNA, 22 bp, Artificial Sequence
  chemically synthesized
ttcaaatgttttttaccatctt

SEQ ID NO: 1309376 - DNA, 22 bp, Artificial Sequence
  chemically synthesized
ataaaagaggacaaagatggta

SEQ ID NO: 1309377 - DNA, 22 bp, Artificial Sequence
  chemically synthesized
cataaaagaggacaaagatggt

SEQ ID NO: 1309378 - DNA, 22 bp, Artificial Sequence
  chemically synthesized
aaatgttttttaccatctttgt

SEQ ID NO: 1309379 - DNA, 22 bp, Artificial Sequence
  chemically synthesized
tttaccatctttgtcctctttt

SEQ ID NO: 1309380 - DNA, 22 bp, Artificial Sequence
  chemically synthesized
ttaccatctttgtcctctttta

SEQ ID NO: 1309381 - DNA, 22 bp, Artificial Sequence
  chemically synthesized
taccatctttgtcctcttttat

SEQ ID NO: 1309382 - DNA, 22 bp, Artificial Sequence
  chemically synthesized
aacaggcacttcataaaagagg

SEQ ID NO: 1309383 - DNA, 22 bp, Artificial Sequence
  chemically synthesized
accatctttgtcctcttttatg

SEQ ID NO: 1309384 - DNA, 22 bp, Artificial Sequence
  chemically synthesized
gaacaggcacttcataaaagag

SEQ ID NO: 1309385 - DNA, 22 bp, Artificial Sequence
  chemically synthesized
ccatctttgtcctcttttatga

SEQ ID NO: 1309386 - DNA, 22 bp, Artificial Sequence
  chemically synthesized
tgtcctcttttatgaagtgcct

SEQ ID NO: 1309387 - DNA, 22 bp, Artificial Sequence
  chemically synthesized
gtcctcttttatgaagtgcctg

SEQ ID NO: 1309388 - DNA, 22 bp, Artificial Sequence
  chemically synthesized
tcctcttttatgaagtgcctgt

SEQ ID NO: 1309389 - DNA, 22 bp, Artificial Sequence
  chemically synthesized
gcaaaatatttgaacaggcact

SEQ ID NO: 1309390 - DNA, 22 bp, Artificial Sequence
  chemically synthesized
ttttatgaagtgcctgttcaaa

SEQ ID NO: 1309391 - DNA, 22 bp, Artificial Sequence
  chemically synthesized
ttatgaagtgcctgttcaaata

SEQ ID NO: 1309392 - DNA, 22 bp, Artificial Sequence
  chemically synthesized
tatgaagtgcctgttcaaatat

SEQ ID NO: 1309393 - DNA, 22 bp, Artificial Sequence
  chemically synthesized
aaagttggcaaaatatttgaac

SEQ ID NO: 1309394 - DNA, 22 bp, Artificial Sequence
  chemically synthesized
atgaagtgcctgttcaaatatt

SEQ ID NO: 1309395 - DNA, 22 bp, Artificial Sequence
  chemically synthesized
aaaagttggcaaaatatttgaa

SEQ ID NO: 1309396 - DNA, 22 bp, Artificial Sequence
  chemically synthesized
tgaagtgcctgttcaaatattt

SEQ ID NO: 1309397 - DNA, 22 bp, Artificial Sequence
  chemically synthesized
taaaagttggcaaaatatttga

SEQ ID NO: 1309398 - DNA, 22 bp, Artificial Sequence
  chemically synthesized
ttaaaagttggcaaaatatttg

SEQ ID NO: 1309399 - DNA, 22 bp, Artificial Sequence
  chemically synthesized
tttaaaagttggcaaaatattt

SEQ ID NO: 1309400 - DNA, 22 bp, Artificial Sequence
  chemically synthesized
ttcaaatattttgccaactttt

SEQ ID NO: 1309401 - DNA, 22 bp, Artificial Sequence
  chemically synthesized
aaatattttgccaacttttaaa

SEQ ID NO: 1309402 - DNA, 22 bp, Artificial Sequence
  chemically synthesized
tgccaacttttaaaaaatgggt

SEQ ID NO: 1309403 - DNA, 22 bp, Artificial Sequence
  chemically synthesized
gccaacttttaaaaaatgggtt

SEQ ID NO: 1309404 - DNA, 22 bp, Artificial Sequence
  chemically synthesized
ccaacttttaaaaaatgggttg

SEQ ID NO: 1309405 - DNA, 22 bp, Artificial Sequence
  chemically synthesized
ttaaaaaatgggttgtcttttt

SEQ ID NO: 1309406 - DNA, 22 bp, Artificial Sequence
  chemically synthesized
atacatatcaataaaaagacaa

SEQ ID NO: 1309407 - DNA, 22 bp, Artificial Sequence
  chemically synthesized
taaaaaatgggttgtcttttta

SEQ ID NO: 1309408 - DNA, 22 bp, Artificial Sequence
  chemically synthesized
aaaaaatgggttgtctttttat

SEQ ID NO: 1309409 - DNA, 22 bp, Artificial Sequence
  chemically synthesized
aaaaatgggttgtctttttatt

SEQ ID NO: 1309410 - DNA, 22 bp, Artificial Sequence
  chemically synthesized
tctttttattgatatgtatgag

SEQ ID NO: 1309411 - DNA, 22 bp, Artificial Sequence
  chemically synthesized
tttattgatatgtatgagttta

SEQ ID NO: 1309412 - DNA, 22 bp, Artificial Sequence
  chemically synthesized
ttattgatatgtatgagtttat

SEQ ID NO: 1309413 - DNA, 22 bp, Artificial Sequence
  chemically synthesized
tattgatatgtatgagtttatt

SEQ ID NO: 1309414 - DNA, 22 bp, Artificial Sequence
  chemically synthesized
attgatatgtatgagtttatta

SEQ ID NO: 1309415 - DNA, 22 bp, Artificial Sequence
  chemically synthesized
ttgatatgtatgagtttattat

SEQ ID NO: 1309416 - DNA, 22 bp, Artificial Sequence
  chemically synthesized
tatccataatatataataaact

SEQ ID NO: 1309417 - DNA, 22 bp, Artificial Sequence
  chemically synthesized
gtatccataatatataataaac

SEQ ID NO: 1309418 - DNA, 22 bp, Artificial Sequence
  chemically synthesized
atatgtatgagtttattatata

SEQ ID NO: 1309419 - DNA, 22 bp, Artificial Sequence
  chemically synthesized
gaaaacttgtatccataatata

SEQ ID NO: 1309420 - DNA, 22 bp, Artificial Sequence
  chemically synthesized
attagaaaacttgtatccataa

SEQ ID NO: 1309421 - DNA, 22 bp, Artificial Sequence
  chemically synthesized
attatatattatggatacaagt

SEQ ID NO: 1309422 - DNA, 22 bp, Artificial Sequence
  chemically synthesized
ttatatattatggatacaagtt

SEQ ID NO: 1309423 - DNA, 22 bp, Artificial Sequence
  chemically synthesized
tatattatggatacaagttttc

SEQ ID NO: 1309424 - DNA, 22 bp, Artificial Sequence
  chemically synthesized
tggatacaagttttctaatcag

SEQ ID NO: 1309425 - DNA, 22 bp, Artificial Sequence
  chemically synthesized
acaagacgtatatctgattaga

SEQ ID NO: 1309426 - DNA, 22 bp, Artificial Sequence
  chemically synthesized
tctaatcagatatacgtcttgt

SEQ ID NO: 1309427 - DNA, 22 bp, Artificial Sequence
  chemically synthesized
ctaatcagatatacgtcttgtg

SEQ ID NO: 1309428 - DNA, 22 bp, Artificial Sequence
  chemically synthesized
taatcagatatacgtcttgtga

SEQ ID NO: 1309429 - DNA, 22 bp, Artificial Sequence
  chemically synthesized
ggagaaaaatattcacaagacg

SEQ ID NO: 1309430 - DNA, 22 bp, Artificial Sequence
  chemically synthesized
atcagatatacgtcttgtgaat

SEQ ID NO: 1309431 - DNA, 22 bp, Artificial Sequence
  chemically synthesized
gtgaatatttttctcccagtcc

SEQ ID NO: 1309432 - DNA, 22 bp, Artificial Sequence
  chemically synthesized
tgaatatttttctcccagtcca

SEQ ID NO: 1309433 - DNA, 22 bp, Artificial Sequence
  chemically synthesized
ttctcccagtccatgacttttc

SEQ ID NO: 1309434 - DNA, 22 bp, Artificial Sequence
  chemically synthesized
tctcccagtccatgacttttct

SEQ ID NO: 1309435 - DNA, 22 bp, Artificial Sequence
  chemically synthesized
ataacagtgaaaagaaaagtca

SEQ ID NO: 1309436 - DNA, 22 bp, Artificial Sequence
  chemically synthesized
ctcccagtccatgacttttctt

SEQ ID NO: 1309437 - DNA, 22 bp, Artificial Sequence
  chemically synthesized
tcccagtccatgacttttcttt

SEQ ID NO: 1309438 - DNA, 22 bp, Artificial Sequence
  chemically synthesized
ccagtccatgacttttcttttc

SEQ ID NO: 1309439 - DNA, 22 bp, Artificial Sequence
  chemically synthesized
taatacactaataacagtgaaa

SEQ ID NO: 1309440 - DNA, 22 bp, Artificial Sequence
  chemically synthesized
ttataatacactaataacagtg

SEQ ID NO: 1309441 - DNA, 22 bp, Artificial Sequence
  chemically synthesized
tctattataatacactaataac

SEQ ID NO: 1309442 - DNA, 22 bp, Artificial Sequence
  chemically synthesized
ttcttttcactgttattagtgt

SEQ ID NO: 1309443 - DNA, 22 bp, Artificial Sequence
  chemically synthesized
tcttttcactgttattagtgta

SEQ ID NO: 1309444 - DNA, 22 bp, Artificial Sequence
  chemically synthesized
tatctattataatacactaata

SEQ ID NO: 1309445 - DNA, 22 bp, Artificial Sequence
  chemically synthesized
cttttcactgttattagtgtat

SEQ ID NO: 1309446 - DNA, 22 bp, Artificial Sequence
  chemically synthesized
ttttcactgttattagtgtatt

SEQ ID NO: 1309447 - DNA, 22 bp, Artificial Sequence
  chemically synthesized
ttcactgttattagtgtattat

SEQ ID NO: 1309448 - DNA, 22 bp, Artificial Sequence
  chemically synthesized
tcactgttattagtgtattata

SEQ ID NO: 1309449 - DNA, 22 bp, Artificial Sequence
  chemically synthesized
cactgttattagtgtattataa

SEQ ID NO: 1309450 - DNA, 22 bp, Artificial Sequence
  chemically synthesized
actgttattagtgtattataat

SEQ ID NO: 1309451 - DNA, 22 bp, Artificial Sequence
  chemically synthesized
agaattctatctattataatac

SEQ ID NO: 1309452 - DNA, 22 bp, Artificial Sequence
  chemically synthesized
ttattagtgtattataatagat

SEQ ID NO: 1309453 - DNA, 22 bp, Artificial Sequence
  chemically synthesized
aaactaagaattctatctatta

SEQ ID NO: 1309454 - DNA, 22 bp, Artificial Sequence
  chemically synthesized
ttagtgtattataatagataga

SEQ ID NO: 1309455 - DNA, 22 bp, Artificial Sequence
  chemically synthesized
gtgtattataatagatagaatt

SEQ ID NO: 1309456 - DNA, 22 bp, Artificial Sequence
  chemically synthesized
attaaaactaagaattctatct

SEQ ID NO: 1309457 - DNA, 22 bp, Artificial Sequence
  chemically synthesized
cattaaaactaagaattctatc

SEQ ID NO: 1309458 - DNA, 22 bp, Artificial Sequence
  chemically synthesized
agcttcattaaaactaagaatt

SEQ ID NO: 1309459 - DNA, 22 bp, Artificial Sequence
  chemically synthesized
taatagatagaattcttagttt

SEQ ID NO: 1309460 - DNA, 22 bp, Artificial Sequence
  chemically synthesized
ataaattgagcttcattaaaac

SEQ ID NO: 1309461 - DNA, 22 bp, Artificial Sequence
  chemically synthesized
ttagttttaatgaagctcaatt

SEQ ID NO: 1309462 - DNA, 22 bp, Artificial Sequence
  chemically synthesized
agttttaatgaagctcaattta

SEQ ID NO: 1309463 - DNA, 22 bp, Artificial Sequence
  chemically synthesized
gttttaatgaagctcaatttat

SEQ ID NO: 1309464 - DNA, 22 bp, Artificial Sequence
  chemically synthesized
taatgaagctcaatttatcagt

SEQ ID NO: 1309465 - DNA, 22 bp, Artificial Sequence
  chemically synthesized
aatgaagctcaatttatcagtg

SEQ ID NO: 1309466 - DNA, 22 bp, Artificial Sequence
  chemically synthesized
atgaagctcaatttatcagtgt

SEQ ID NO: 1309467 - DNA, 22 bp, Artificial Sequence
  chemically synthesized
agtacaaagtcaaacactgata

SEQ ID NO: 1309468 - DNA, 22 bp, Artificial Sequence
  chemically synthesized
aatttatcagtgtttgactttg

SEQ ID NO: 1309469 - DNA, 22 bp, Artificial Sequence
  chemically synthesized
atcagtgtttgactttgtactt

SEQ ID NO: 1309470 - DNA, 22 bp, Artificial Sequence
  chemically synthesized
tcagtgtttgactttgtactta

SEQ ID NO: 1309471 - DNA, 22 bp, Artificial Sequence
  chemically synthesized
ggaccgaacaagcactaagtac

SEQ ID NO: 1309472 - DNA, 22 bp, Artificial Sequence
  chemically synthesized
gactttgtacttagtgcttgtt

SEQ ID NO: 1309473 - DNA, 22 bp, Artificial Sequence
  chemically synthesized
actttgtacttagtgcttgttc

SEQ ID NO: 1309474 - DNA, 22 bp, Artificial Sequence
  chemically synthesized
ataattaggaccgaacaagcac

SEQ ID NO: 1309475 - DNA, 22 bp, Artificial Sequence
  chemically synthesized
cataattaggaccgaacaagca

SEQ ID NO: 1309476 - DNA, 22 bp, Artificial Sequence
  chemically synthesized
tgtacttagtgcttgttcggtc

SEQ ID NO: 1309477 - DNA, 22 bp, Artificial Sequence
  chemically synthesized
gtacttagtgcttgttcggtcc

SEQ ID NO: 1309478 - DNA, 22 bp, Artificial Sequence
  chemically synthesized
tacttagtgcttgttcggtcct

SEQ ID NO: 1309479 - DNA, 22 bp, Artificial Sequence
  chemically synthesized
agtgcttgttcggtcctaatta

SEQ ID NO: 1309480 - DNA, 22 bp, Artificial Sequence
  chemically synthesized
gtgcttgttcggtcctaattat

SEQ ID NO: 1309481 - DNA, 22 bp, Artificial Sequence
  chemically synthesized
agcaaagatttcataattagga

SEQ ID NO: 1309482 - DNA, 22 bp, Artificial Sequence
  chemically synthesized
gttcggtcctaattatgaaatc

SEQ ID NO: 1309483 - DNA, 22 bp, Artificial Sequence
  chemically synthesized
ttcggtcctaattatgaaatct

SEQ ID NO: 1309484 - DNA, 22 bp, Artificial Sequence
  chemically synthesized
ggtcctaattatgaaatctttg

SEQ ID NO: 1309485 - DNA, 22 bp, Artificial Sequence
  chemically synthesized
attatgaaatctttgcttagcc

SEQ ID NO: 1309486 - DNA, 22 bp, Artificial Sequence
  chemically synthesized
cgagtgagatacaggctaagca

SEQ ID NO: 1309487 - DNA, 22 bp, Artificial Sequence
  chemically synthesized
tgaaatctttgcttagcctgta

SEQ ID NO: 1309488 - DNA, 22 bp, Artificial Sequence
  chemically synthesized
tgcttagcctgtatctcactcg

SEQ ID NO: 1309489 - DNA, 22 bp, Artificial Sequence
  chemically synthesized
gcttagcctgtatctcactcgt

SEQ ID NO: 1309490 - DNA, 22 bp, Artificial Sequence
  chemically synthesized
cttagcctgtatctcactcgta

SEQ ID NO: 1309491 - DNA, 22 bp, Artificial Sequence
  chemically synthesized
agcctgtatctcactcgtagat

SEQ ID NO: 1309492 - DNA, 22 bp, Artificial Sequence
  chemically synthesized
gcctgtatctcactcgtagatt

SEQ ID NO: 1309493 - DNA, 22 bp, Artificial Sequence
  chemically synthesized
cagtcataagtaaaataatcta

SEQ ID NO: 1309494 - DNA, 22 bp, Artificial Sequence
  chemically synthesized
tatctcactcgtagattatttt

SEQ ID NO: 1309495 - DNA, 22 bp, Artificial Sequence
  chemically synthesized
actcgtagattattttacttat

SEQ ID NO: 1309496 - DNA, 22 bp, Artificial Sequence
  chemically synthesized
gtagattattttacttatgact

SEQ ID NO: 1309497 - DNA, 22 bp, Artificial Sequence
  chemically synthesized
gtgggcaatctccagtcataag

SEQ ID NO: 1309498 - DNA, 22 bp, Artificial Sequence
  chemically synthesized
catctggtgggcaatctccagt

SEQ ID NO: 1309499 - DNA, 22 bp, Artificial Sequence
  chemically synthesized
ttttacttatgactggagattg

SEQ ID NO: 1309500 - DNA, 22 bp, Artificial Sequence
  chemically synthesized
tacttatgactggagattgccc

SEQ ID NO: 1309501 - DNA, 22 bp, Artificial Sequence
  chemically synthesized
acttatgactggagattgccca

SEQ ID NO: 1309502 - DNA, 22 bp, Artificial Sequence
  chemically synthesized
cttatgactggagattgcccac

SEQ ID NO: 1309503 - DNA, 22 bp, Artificial Sequence
  chemically synthesized
atgactggagattgcccaccag

SEQ ID NO: 1309504 - DNA, 22 bp, Artificial Sequence
  chemically synthesized
tgactggagattgcccaccaga

SEQ ID NO: 1309505 - DNA, 22 bp, Artificial Sequence
  chemically synthesized
gtgtgtaagtggttacatctgg

SEQ ID NO: 1309506 - DNA, 22 bp, Artificial Sequence
  chemically synthesized
gagattgcccaccagatgtaac

SEQ ID NO: 1309507 - DNA, 22 bp, Artificial Sequence
  chemically synthesized
cccaccagatgtaaccacttac

SEQ ID NO: 1309508 - DNA, 22 bp, Artificial Sequence
  chemically synthesized
tgaccattagtgtgtaagtggt

SEQ ID NO: 1309509 - DNA, 22 bp, Artificial Sequence
  chemically synthesized
acacactaatggtcacagccat

SEQ ID NO: 1309510 - DNA, 22 bp, Artificial Sequence
  chemically synthesized
cacactaatggtcacagccata

SEQ ID NO: 1309511 - DNA, 22 bp, Artificial Sequence
  chemically synthesized
atggtcacagccatattctcct

SEQ ID NO: 1309512 - DNA, 22 bp, Artificial Sequence
  chemically synthesized
agtaaacatagtcaaggagaat

SEQ ID NO: 1309513 - DNA, 22 bp, Artificial Sequence
  chemically synthesized
ccaatggtgattaagtaaacat

SEQ ID NO: 1309514 - DNA, 22 bp, Artificial Sequence
  chemically synthesized
tgccaatggtgattaagtaaac

SEQ ID NO: 1309515 - DNA, 22 bp, Artificial Sequence
  chemically synthesized
tccttgactatgtttacttaat

SEQ ID NO: 1309516 - DNA, 22 bp, Artificial Sequence
  chemically synthesized
cttgactatgtttacttaatca

SEQ ID NO: 1309517 - DNA, 22 bp, Artificial Sequence
  chemically synthesized
gactatgtttacttaatcacca

SEQ ID NO: 1309518 - DNA, 22 bp, Artificial Sequence
  chemically synthesized
actatgtttacttaatcaccat

SEQ ID NO: 1309519 - DNA, 22 bp, Artificial Sequence
  chemically synthesized
tgtttacttaatcaccattggc

SEQ ID NO: 1309520 - DNA, 22 bp, Artificial Sequence
  chemically synthesized
acttaatcaccattggcagaga

SEQ ID NO: 1309521 - DNA, 22 bp, Artificial Sequence
  chemically synthesized
gacgagacatagtctctgccaa

SEQ ID NO: 1309522 - DNA, 22 bp, Artificial Sequence
  chemically synthesized
cttaatcaccattggcagagac

SEQ ID NO: 1309523 - DNA, 22 bp, Artificial Sequence
  chemically synthesized
aatcaccattggcagagactat

SEQ ID NO: 1309524 - DNA, 22 bp, Artificial Sequence
  chemically synthesized
atcaccattggcagagactatg

SEQ ID NO: 1309525 - DNA, 22 bp, Artificial Sequence
  chemically synthesized
gcagagactatgtctcgtctaa

SEQ ID NO: 1309526 - DNA, 22 bp, Artificial Sequence
  chemically synthesized
aataagggataaaagaatatta

SEQ ID NO: 1309527 - DNA, 22 bp, Artificial Sequence
  chemically synthesized
tgaataagggataaaagaatat

SEQ ID NO: 1309528 - DNA, 22 bp, Artificial Sequence
  chemically synthesized
tgtctcgtctaatattctttta

SEQ ID NO: 1309529 - DNA, 22 bp, Artificial Sequence
  chemically synthesized
gtctaatattcttttatccctt

SEQ ID NO: 1309530 - DNA, 22 bp, Artificial Sequence
  chemically synthesized
atattcttttatcccttattca

SEQ ID NO: 1309531 - DNA, 22 bp, Artificial Sequence
  chemically synthesized
ttttatcccttattcagagact

SEQ ID NO: 1309532 - DNA, 22 bp, Artificial Sequence
  chemically synthesized
ttatcccttattcagagactct

SEQ ID NO: 1309533 - DNA, 22 bp, Artificial Sequence
  chemically synthesized
tatcccttattcagagactctc

SEQ ID NO: 1309534 - DNA, 22 bp, Artificial Sequence
  chemically synthesized
atcccttattcagagactctca

SEQ ID NO: 1309535 - DNA, 22 bp, Artificial Sequence
  chemically synthesized
tcccttattcagagactctcat

SEQ ID NO: 1309536 - DNA, 22 bp, Artificial Sequence
  chemically synthesized
cagtcacaataatatgagagtc

SEQ ID NO: 1309537 - DNA, 22 bp, Artificial Sequence
  chemically synthesized
acagtcacaataatatgagagt

SEQ ID NO: 1309538 - DNA, 22 bp, Artificial Sequence
  chemically synthesized
attcagagactctcatattatt

SEQ ID NO: 1309539 - DNA, 22 bp, Artificial Sequence
  chemically synthesized
ttcagagactctcatattattg

SEQ ID NO: 1309540 - DNA, 22 bp, Artificial Sequence
  chemically synthesized
agagactctcatattattgtga

SEQ ID NO: 1309541 - DNA, 22 bp, Artificial Sequence
  chemically synthesized
agaaaatttacagtcacaataa

SEQ ID NO: 1309542 - DNA, 22 bp, Artificial Sequence
  chemically synthesized
gctaagaaaatttacagtcaca

SEQ ID NO: 1309543 - DNA, 22 bp, Artificial Sequence
  chemically synthesized
agctaagaaaatttacagtcac

SEQ ID NO: 1309544 - DNA, 22 bp, Artificial Sequence
  chemically synthesized
tagctaagaaaatttacagtca

SEQ ID NO: 1309545 - DNA, 22 bp, Artificial Sequence
  chemically synthesized
tcatattattgtgactgtaaat

SEQ ID NO: 1309546 - DNA, 22 bp, Artificial Sequence
  chemically synthesized
atattattgtgactgtaaattt

SEQ ID NO: 1309547 - DNA, 22 bp, Artificial Sequence
  chemically synthesized
ttttagctaagaaaatttacag

SEQ ID NO: 1309548 - DNA, 22 bp, Artificial Sequence
  chemically synthesized
ttgtgactgtaaattttcttag

SEQ ID NO: 1309549 - DNA, 22 bp, Artificial Sequence
  chemically synthesized
tgactgtaaattttcttagcta

SEQ ID NO: 1309550 - DNA, 22 bp, Artificial Sequence
  chemically synthesized
taaattttcttagctaaaataa

SEQ ID NO: 1309551 - DNA, 22 bp, Artificial Sequence
  chemically synthesized
tcttagctaaaataatttccct

SEQ ID NO: 1309552 - DNA, 22 bp, Artificial Sequence
  chemically synthesized
cttagctaaaataatttccctc

SEQ ID NO: 1309553 - DNA, 22 bp, Artificial Sequence
  chemically synthesized
ttagctaaaataatttccctct

SEQ ID NO: 1309554 - DNA, 22 bp, Artificial Sequence
  chemically synthesized
agctaaaataatttccctctat

SEQ ID NO: 1309555 - DNA, 22 bp, Artificial Sequence
  chemically synthesized
gctaaaataatttccctctatc

SEQ ID NO: 1309556 - DNA, 22 bp, Artificial Sequence
  chemically synthesized
aaataatttccctctatctctc

SEQ ID NO: 1309557 - DNA, 22 bp, Artificial Sequence
  chemically synthesized
ccctctatctctctctgtctca

SEQ ID NO: 1309558 - DNA, 22 bp, Artificial Sequence
  chemically synthesized
cctctatctctctctgtctcac

SEQ ID NO: 1309559 - DNA, 22 bp, Artificial Sequence
  chemically synthesized
tatctctctctgtctcactttc

SEQ ID NO: 1309560 - DNA, 22 bp, Artificial Sequence
  chemically synthesized
tctctctctgtctcactttctt

SEQ ID NO: 1309561 - DNA, 22 bp, Artificial Sequence
  chemically synthesized
tctctgtctcactttctttctc

SEQ ID NO: 1309562 - DNA, 22 bp, Artificial Sequence
  chemically synthesized
tctgtctcactttctttctctc

SEQ ID NO: 1309563 - DNA, 22 bp, Artificial Sequence
  chemically synthesized
tgtctcactttctttctctctc

SEQ ID NO: 1309564 - DNA, 22 bp, Artificial Sequence
  chemically synthesized
tctcactttctttctctctctc

SEQ ID NO: 1309565 - DNA, 22 bp, Artificial Sequence
  chemically synthesized
gagagagagagagagagagaga

SEQ ID NO: 1309566 - DNA, 22 bp, Artificial Sequence
  chemically synthesized
actttctttctctctctctctc

SEQ ID NO: 1309567 - DNA, 22 bp, Artificial Sequence
  chemically synthesized
ggagttggagagagagagagag

SEQ ID NO: 1309568 - DNA, 22 bp, Artificial Sequence
  chemically synthesized
tctttctctctctctctctctc

SEQ ID NO: 1309569 - DNA, 22 bp, Artificial Sequence
  chemically synthesized
gggagttggagagagagagaga

SEQ ID NO: 1309570 - DNA, 22 bp, Artificial Sequence
  chemically synthesized
ctttctctctctctctctctct

SEQ ID NO: 1309571 - DNA, 22 bp, Artificial Sequence
  chemically synthesized
tgggagttggagagagagagag

SEQ ID NO: 1309572 - DNA, 22 bp, Artificial Sequence
  chemically synthesized
tttctctctctctctctctctc

SEQ ID NO: 1309573 - DNA, 22 bp, Artificial Sequence
  chemically synthesized
tctctctctctctctctctctc

SEQ ID NO: 1309574 - DNA, 22 bp, Artificial Sequence
  chemically synthesized
ctctctctctctctctctctcc

SEQ ID NO: 1309575 - DNA, 22 bp, Artificial Sequence
  chemically synthesized
tctctctctctctctctctcca

SEQ ID NO: 1309576 - DNA, 22 bp, Artificial Sequence
  chemically synthesized
tctctctctctctctctccaac

SEQ ID NO: 1309577 - DNA, 22 bp, Artificial Sequence
  chemically synthesized
tatatctttgggagttggagag

SEQ ID NO: 1309578 - DNA, 22 bp, Artificial Sequence
  chemically synthesized
tctctctctctctctccaactc

SEQ ID NO: 1309579 - DNA, 22 bp, Artificial Sequence
  chemically synthesized
atatatctttgggagttggaga

SEQ ID NO: 1309580 - DNA, 22 bp, Artificial Sequence
  chemically synthesized
tctctctctctctccaactccc

SEQ ID NO: 1309581 - DNA, 22 bp, Artificial Sequence
  chemically synthesized
tctctctctctccaactcccaa

SEQ ID NO: 1309582 - DNA, 22 bp, Artificial Sequence
  chemically synthesized
tctctctctccaactcccaaag

SEQ ID NO: 1309583 - DNA, 22 bp, Artificial Sequence
  chemically synthesized
tctctctccaactcccaaagat

SEQ ID NO: 1309584 - DNA, 22 bp, Artificial Sequence
  chemically synthesized
tctctccaactcccaaagatat

SEQ ID NO: 1309585 - DNA, 22 bp, Artificial Sequence
  chemically synthesized
tctccaactcccaaagatatat

SEQ ID NO: 1309586 - DNA, 22 bp, Artificial Sequence
  chemically synthesized
tccaactcccaaagatatataa

SEQ ID NO: 1309587 - DNA, 22 bp, Artificial Sequence
  chemically synthesized
caactcccaaagatatataagt

SEQ ID NO: 1309588 - DNA, 22 bp, Artificial Sequence
  chemically synthesized
tgcccaataaatccgacttata

SEQ ID NO: 1309589 - DNA, 22 bp, Artificial Sequence
  chemically synthesized
ccaaagatatataagtcggatt

SEQ ID NO: 1309590 - DNA, 22 bp, Artificial Sequence
  chemically synthesized
gtagctgtgcccaataaatccg

SEQ ID NO: 1309591 - DNA, 22 bp, Artificial Sequence
  chemically synthesized
ctggtagctgtgcccaataaat

SEQ ID NO: 1309592 - DNA, 22 bp, Artificial Sequence
  chemically synthesized
cctggtagctgtgcccaataaa

SEQ ID NO: 1309593 - DNA, 22 bp, Artificial Sequence
  chemically synthesized
tcctggtagctgtgcccaataa

SEQ ID NO: 1309594 - DNA, 22 bp, Artificial Sequence
  chemically synthesized
ttcctggtagctgtgcccaata

SEQ ID NO: 1309595 - DNA, 22 bp, Artificial Sequence
  chemically synthesized
aaccccttttcctggtagctgt

SEQ ID NO: 1309596 - DNA, 22 bp, Artificial Sequence
  chemically synthesized
gaaccccttttcctggtagctg

SEQ ID NO: 1309597 - DNA, 22 bp, Artificial Sequence
  chemically synthesized
ttgaaccccttttcctggtagc

SEQ ID NO: 1309598 - DNA, 22 bp, Artificial Sequence
  chemically synthesized
cttgaaccccttttcctggtag

SEQ ID NO: 1309599 - DNA, 22 bp, Artificial Sequence
  chemically synthesized
attgggcacagctaccaggaaa

SEQ ID NO: 1309600 - DNA, 22 bp, Artificial Sequence
  chemically synthesized
ttgggcacagctaccaggaaaa

SEQ ID NO: 1309601 - DNA, 22 bp, Artificial Sequence
  chemically synthesized
ggcacagctaccaggaaaaggg

SEQ ID NO: 1309602 - DNA, 22 bp, Artificial Sequence
  chemically synthesized
taacccttcttgaacccctttt

SEQ ID NO: 1309603 - DNA, 22 bp, Artificial Sequence
  chemically synthesized
tgtaacccttcttgaacccctt

SEQ ID NO: 1309604 - DNA, 22 bp, Artificial Sequence
  chemically synthesized
ctctgtaacccttcttgaaccc

SEQ ID NO: 1309605 - DNA, 22 bp, Artificial Sequence
  chemically synthesized
gctctgtaacccttcttgaacc

SEQ ID NO: 1309606 - DNA, 22 bp, Artificial Sequence
  chemically synthesized
ccaggaaaaggggttcaagaag

SEQ ID NO: 1309607 - DNA, 22 bp, Artificial Sequence
  chemically synthesized
atttgctctgtaacccttcttg

SEQ ID NO: 1309608 - DNA, 22 bp, Artificial Sequence
  chemically synthesized
ttcatttgctctgtaacccttc

SEQ ID NO: 1309609 - DNA, 22 bp, Artificial Sequence
  chemically synthesized
aagaagggttacagagcaaatg

SEQ ID NO: 1309610 - DNA, 22 bp, Artificial Sequence
  chemically synthesized
gcaaaagattattcatttgctc

SEQ ID NO: 1309611 - DNA, 22 bp, Artificial Sequence
  chemically synthesized
agccctagcaaaagattattca

SEQ ID NO: 1309612 - DNA, 22 bp, Artificial Sequence
  chemically synthesized
cagagcaaatgaataatctttt

SEQ ID NO: 1309613 - DNA, 22 bp, Artificial Sequence
  chemically synthesized
ctcagccctagcaaaagattat

SEQ ID NO: 1309614 - DNA, 22 bp, Artificial Sequence
  chemically synthesized
gactcctcagccctagcaaaag

SEQ ID NO: 1309615 - DNA, 22 bp, Artificial Sequence
  chemically synthesized
ttgctagggctgaggagtccaa

SEQ ID NO: 1309616 - DNA, 22 bp, Artificial Sequence
  chemically synthesized
tgctagggctgaggagtccaac

SEQ ID NO: 1309617 - DNA, 22 bp, Artificial Sequence
  chemically synthesized
gctagggctgaggagtccaact

SEQ ID NO: 1309618 - DNA, 22 bp, Artificial Sequence
  chemically synthesized
ctagggctgaggagtccaactc

SEQ ID NO: 1309619 - DNA, 22 bp, Artificial Sequence
  chemically synthesized
tatcgaggccatgagttggact

SEQ ID NO: 1309620 - DNA, 22 bp, Artificial Sequence
  chemically synthesized
gggctgaggagtccaactcatg

SEQ ID NO: 1309621 - DNA, 22 bp, Artificial Sequence
  chemically synthesized
aaaaattatatcgaggccatga

SEQ ID NO: 1309622 - DNA, 22 bp, Artificial Sequence
  chemically synthesized
aggagtccaactcatggcctcg

SEQ ID NO: 1309623 - DNA, 22 bp, Artificial Sequence
  chemically synthesized
tcaaaaattatatcgaggccat

SEQ ID NO: 1309624 - DNA, 22 bp, Artificial Sequence
  chemically synthesized
cattctcaaaaattatatcgag

SEQ ID NO: 1309625 - DNA, 22 bp, Artificial Sequence
  chemically synthesized
ccattctcaaaaattatatcga

SEQ ID NO: 1309626 - DNA, 22 bp, Artificial Sequence
  chemically synthesized
atggcctcgatataatttttga

SEQ ID NO: 1309627 - DNA, 22 bp, Artificial Sequence
  chemically synthesized
ccagcttccattctcaaaaatt

SEQ ID NO: 1309628 - DNA, 22 bp, Artificial Sequence
  chemically synthesized
ttcccagcttccattctcaaaa

SEQ ID NO: 1309629 - DNA, 22 bp, Artificial Sequence
  chemically synthesized
tattcccagcttccattctcaa

SEQ ID NO: 1309630 - DNA, 22 bp, Artificial Sequence
  chemically synthesized
ctattcccagcttccattctca

SEQ ID NO: 1309631 - DNA, 22 bp, Artificial Sequence
  chemically synthesized
gatataatttttgagaatggaa

SEQ ID NO: 1309632 - DNA, 22 bp, Artificial Sequence
  chemically synthesized
acatcttctattcccagcttcc

SEQ ID NO: 1309633 - DNA, 22 bp, Artificial Sequence
  chemically synthesized
ttgagaatggaagctgggaata

SEQ ID NO: 1309634 - DNA, 22 bp, Artificial Sequence
  chemically synthesized
cctgacatcttctattcccagc

SEQ ID NO: 1309635 - DNA, 22 bp, Artificial Sequence
  chemically synthesized
tgagaatggaagctgggaatag

SEQ ID NO: 1309636 - DNA, 22 bp, Artificial Sequence
  chemically synthesized
gagaatggaagctgggaataga

SEQ ID NO: 1309637 - DNA, 22 bp, Artificial Sequence
  chemically synthesized
agaatggaagctgggaatagaa

SEQ ID NO: 1309638 - DNA, 22 bp, Artificial Sequence
  chemically synthesized
acaaccccagggttccctgaca

SEQ ID NO: 1309639 - DNA, 22 bp, Artificial Sequence
  chemically synthesized
ggaatagaagatgtcagggaac

SEQ ID NO: 1309640 - DNA, 22 bp, Artificial Sequence
  chemically synthesized
ttaacaaccccagggttccctg

SEQ ID NO: 1309641 - DNA, 22 bp, Artificial Sequence
  chemically synthesized
aatactattaacaaccccaggg

SEQ ID NO: 1309642 - DNA, 22 bp, Artificial Sequence
  chemically synthesized
caatactattaacaaccccagg

SEQ ID NO: 1309643 - DNA, 22 bp, Artificial Sequence
  chemically synthesized
tttcaatactattaacaacccc

SEQ ID NO: 1309644 - DNA, 22 bp, Artificial Sequence
  chemically synthesized
caaggtaggttgtttcaatact

SEQ ID NO: 1309645 - DNA, 22 bp, Artificial Sequence
  chemically synthesized
gggttgttaatagtattgaaac

SEQ ID NO: 1309646 - DNA, 22 bp, Artificial Sequence
  chemically synthesized
ttaatagtattgaaacaaccta

SEQ ID NO: 1309647 - DNA, 22 bp, Artificial Sequence
  chemically synthesized
atagtattgaaacaacctacct

SEQ ID NO: 1309648 - DNA, 22 bp, Artificial Sequence
  chemically synthesized
aaaagtactgcaaggtaggttg

SEQ ID NO: 1309649 - DNA, 22 bp, Artificial Sequence
  chemically synthesized
tcaaaagtactgcaaggtaggt

SEQ ID NO: 1309650 - DNA, 22 bp, Artificial Sequence
  chemically synthesized
tctcaaaagtactgcaaggtag

SEQ ID NO: 1309651 - DNA, 22 bp, Artificial Sequence
  chemically synthesized
aaacaacctaccttgcagtact

SEQ ID NO: 1309652 - DNA, 22 bp, Artificial Sequence
  chemically synthesized
tatctctctcaaaagtactgca

SEQ ID NO: 1309653 - DNA, 22 bp, Artificial Sequence
  chemically synthesized
atatctctctcaaaagtactgc

SEQ ID NO: 1309654 - DNA, 22 bp, Artificial Sequence
  chemically synthesized
tatatctctctcaaaagtactg

SEQ ID NO: 1309655 - DNA, 22 bp, Artificial Sequence
  chemically synthesized
ccttgcagtacttttgagagag

SEQ ID NO: 1309656 - DNA, 22 bp, Artificial Sequence
  chemically synthesized
gcagtacttttgagagagatat

SEQ ID NO: 1309657 - DNA, 22 bp, Artificial Sequence
  chemically synthesized
cagtacttttgagagagatata

SEQ ID NO: 1309658 - DNA, 22 bp, Artificial Sequence
  chemically synthesized
agaacagggtgatggttttata

SEQ ID NO: 1309659 - DNA, 22 bp, Artificial Sequence
  chemically synthesized
cagaacagggtgatggttttat

SEQ ID NO: 1309660 - DNA, 22 bp, Artificial Sequence
  chemically synthesized
ttgagagagatataaaaccatc

SEQ ID NO: 1309661 - DNA, 22 bp, Artificial Sequence
  chemically synthesized
tgagagagatataaaaccatca

SEQ ID NO: 1309662 - DNA, 22 bp, Artificial Sequence
  chemically synthesized
gagagagatataaaaccatcac

SEQ ID NO: 1309663 - DNA, 22 bp, Artificial Sequence
  chemically synthesized
agagagatataaaaccatcacc

SEQ ID NO: 1309664 - DNA, 22 bp, Artificial Sequence
  chemically synthesized
gagcttcagaacagggtgatgg

SEQ ID NO: 1309665 - DNA, 22 bp, Artificial Sequence
  chemically synthesized
gggctcgagcttcagaacaggg

SEQ ID NO: 1309666 - DNA, 22 bp, Artificial Sequence
  chemically synthesized
ttctgaagctcgagccctagct

SEQ ID NO: 1309667 - DNA, 22 bp, Artificial Sequence
  chemically synthesized
tgaagctcgagccctagcttat

SEQ ID NO: 1309668 - DNA, 22 bp, Artificial Sequence
  chemically synthesized
aagctcgagccctagcttatta

SEQ ID NO: 1309669 - DNA, 22 bp, Artificial Sequence
  chemically synthesized
ataaagggaaaataataagcta

SEQ ID NO: 1309670 - DNA, 22 bp, Artificial Sequence
  chemically synthesized
gagccctagcttattattttcc

SEQ ID NO: 1309671 - DNA, 22 bp, Artificial Sequence
  chemically synthesized
tgaattgataaagggaaaataa

SEQ ID NO: 1309672 - DNA, 22 bp, Artificial Sequence
  chemically synthesized
gtgaattgataaagggaaaata

SEQ ID NO: 1309673 - DNA, 22 bp, Artificial Sequence
  chemically synthesized
tttgtgaattgataaagggaaa

SEQ ID NO: 1309674 - DNA, 22 bp, Artificial Sequence
  chemically synthesized
atttgtgaattgataaagggaa

SEQ ID NO: 1309675 - DNA, 22 bp, Artificial Sequence
  chemically synthesized
tatttgtgaattgataaaggga

SEQ ID NO: 1309676 - DNA, 22 bp, Artificial Sequence
  chemically synthesized
gcttattattttccctttatca

SEQ ID NO: 1309677 - DNA, 22 bp, Artificial Sequence
  chemically synthesized
ttatttgtgaattgataaaggg

SEQ ID NO: 1309678 - DNA, 22 bp, Artificial Sequence
  chemically synthesized
cttttatttgtgaattgataaa

SEQ ID NO: 1309679 - DNA, 22 bp, Artificial Sequence
  chemically synthesized
attattttccctttatcaattc

SEQ ID NO: 1309680 - DNA, 22 bp, Artificial Sequence
  chemically synthesized
ttattttccctttatcaattca

SEQ ID NO: 1309681 - DNA, 22 bp, Artificial Sequence
  chemically synthesized
attgcttttatttgtgaattga

SEQ ID NO: 1309682 - DNA, 22 bp, Artificial Sequence
  chemically synthesized
ttttccctttatcaattcacaa

SEQ ID NO: 1309683 - DNA, 22 bp, Artificial Sequence
  chemically synthesized
tccctttatcaattcacaaata

SEQ ID NO: 1309684 - DNA, 22 bp, Artificial Sequence
  chemically synthesized
ccctttatcaattcacaaataa

SEQ ID NO: 1309685 - DNA, 22 bp, Artificial Sequence
  chemically synthesized
cctttatcaattcacaaataaa

SEQ ID NO: 1309686 - DNA, 22 bp, Artificial Sequence
  chemically synthesized
tatcaattcacaaataaaagca

SEQ ID NO: 1309687 - DNA, 22 bp, Artificial Sequence
  chemically synthesized
taggaaattcattgcttttatt

SEQ ID NO: 1309688 - DNA, 22 bp, Artificial Sequence
  chemically synthesized
atcaattcacaaataaaagcaa

SEQ ID NO: 1309689 - DNA, 22 bp, Artificial Sequence
  chemically synthesized
gtaggaaattcattgcttttat

SEQ ID NO: 1309690 - DNA, 22 bp, Artificial Sequence
  chemically synthesized
tcaattcacaaataaaagcaat

SEQ ID NO: 1309691 - DNA, 22 bp, Artificial Sequence
  chemically synthesized
acaaataaaagcaatgaatttc

SEQ ID NO: 1309692 - DNA, 22 bp, Artificial Sequence
  chemically synthesized
aaaaccaagaagaagtatttgt

SEQ ID NO: 1309693 - DNA, 22 bp, Artificial Sequence
  chemically synthesized
caaaaccaagaagaagtatttg

SEQ ID NO: 1309694 - DNA, 22 bp, Artificial Sequence
  chemically synthesized
cctacaaatacttcttcttggt

SEQ ID NO: 1309695 - DNA, 22 bp, Artificial Sequence
  chemically synthesized
ctacaaatacttcttcttggtt

SEQ ID NO: 1309696 - DNA, 22 bp, Artificial Sequence
  chemically synthesized
taacataccttcaaaaccaaga

SEQ ID NO: 1309697 - DNA, 22 bp, Artificial Sequence
  chemically synthesized
caaatacttcttcttggttttg

SEQ ID NO: 1309698 - DNA, 22 bp, Artificial Sequence
  chemically synthesized
tataacataccttcaaaaccaa

SEQ ID NO: 1309699 - DNA, 22 bp, Artificial Sequence
  chemically synthesized
ttctataacataccttcaaaac

SEQ ID NO: 1309700 - DNA, 22 bp, Artificial Sequence
  chemically synthesized
tattctataacataccttcaaa

SEQ ID NO: 1309701 - DNA, 22 bp, Artificial Sequence
  chemically synthesized
ctattctataacataccttcaa

SEQ ID NO: 1309702 - DNA, 22 bp, Artificial Sequence
  chemically synthesized
tctattctataacataccttca

SEQ ID NO: 1309703 - DNA, 22 bp, Artificial Sequence
  chemically synthesized
cttcttggttttgaaggtatgt

SEQ ID NO: 1309704 - DNA, 22 bp, Artificial Sequence
  chemically synthesized
ttctattctataacataccttc

SEQ ID NO: 1309705 - DNA, 22 bp, Artificial Sequence
  chemically synthesized
ttcttggttttgaaggtatgtt

SEQ ID NO: 1309706 - DNA, 22 bp, Artificial Sequence
  chemically synthesized
tttctattctataacatacctt

SEQ ID NO: 1309707 - DNA, 22 bp, Artificial Sequence
  chemically synthesized
cttggttttgaaggtatgttat

SEQ ID NO: 1309708 - DNA, 22 bp, Artificial Sequence
  chemically synthesized
ttggttttgaaggtatgttata

SEQ ID NO: 1309709 - DNA, 22 bp, Artificial Sequence
  chemically synthesized
ggttttgaaggtatgttataga

SEQ ID NO: 1309710 - DNA, 22 bp, Artificial Sequence
  chemically synthesized
gttttgaaggtatgttatagaa

SEQ ID NO: 1309711 - DNA, 22 bp, Artificial Sequence
  chemically synthesized
taagactttttctattctataa

SEQ ID NO: 1309712 - DNA, 22 bp, Artificial Sequence
  chemically synthesized
gtaagactttttctattctata

SEQ ID NO: 1309713 - DNA, 22 bp, Artificial Sequence
  chemically synthesized
tgaaggtatgttatagaataga

SEQ ID NO: 1309714 - DNA, 22 bp, Artificial Sequence
  chemically synthesized
tgtaagactttttctattctat

SEQ ID NO: 1309715 - DNA, 22 bp, Artificial Sequence
  chemically synthesized
gaaggtatgttatagaatagaa

SEQ ID NO: 1309716 - DNA, 22 bp, Artificial Sequence
  chemically synthesized
aaggtatgttatagaatagaaa

SEQ ID NO: 1309717 - DNA, 22 bp, Artificial Sequence
  chemically synthesized
tagaatagaaaaagtcttacaa

SEQ ID NO: 1309718 - DNA, 22 bp, Artificial Sequence
  chemically synthesized
tgtgaaaatacacctttgtaag

SEQ ID NO: 1309719 - DNA, 22 bp, Artificial Sequence
  chemically synthesized
acaaaggtgtattttcacatag

SEQ ID NO: 1309720 - DNA, 22 bp, Artificial Sequence
  chemically synthesized
caaaggtgtattttcacatagt

SEQ ID NO: 1309721 - DNA, 22 bp, Artificial Sequence
  chemically synthesized
tccaccatcaccaaccactatg

SEQ ID NO: 1309722 - DNA, 22 bp, Artificial Sequence
  chemically synthesized
tgtccaccatcaccaaccacta

SEQ ID NO: 1309723 - DNA, 22 bp, Artificial Sequence
  chemically synthesized
ctgtccaccatcaccaaccact

SEQ ID NO: 1309724 - DNA, 22 bp, Artificial Sequence
  chemically synthesized
tcacatagtggttggtgatggt

SEQ ID NO: 1309725 - DNA, 22 bp, Artificial Sequence
  chemically synthesized
cacatagtggttggtgatggtg

SEQ ID NO: 1309726 - DNA, 22 bp, Artificial Sequence
  chemically synthesized
aaaatttctgtccaccatcacc

SEQ ID NO: 1309727 - DNA, 22 bp, Artificial Sequence
  chemically synthesized
acatagtggttggtgatggtgg

SEQ ID NO: 1309728 - DNA, 22 bp, Artificial Sequence
  chemically synthesized
aaaaatttctgtccaccatcac

SEQ ID NO: 1309729 - DNA, 22 bp, Artificial Sequence
  chemically synthesized
taaaaatttctgtccaccatca

SEQ ID NO: 1309730 - DNA, 22 bp, Artificial Sequence
  chemically synthesized
ttaaaaatttctgtccaccatc

SEQ ID NO: 1309731 - DNA, 22 bp, Artificial Sequence
  chemically synthesized
gtgatggtggacagaaattttt

SEQ ID NO: 1309732 - DNA, 22 bp, Artificial Sequence
  chemically synthesized
ttaaaaatcatatgtacccttc

SEQ ID NO: 1309733 - DNA, 22 bp, Artificial Sequence
  chemically synthesized
taaaaatcatatgtacccttca

SEQ ID NO: 1309734 - DNA, 22 bp, Artificial Sequence
  chemically synthesized
aaaaatcatatgtacccttcat

SEQ ID NO: 1309735 - DNA, 22 bp, Artificial Sequence
  chemically synthesized
taaaaatatgaaatgaagggta

SEQ ID NO: 1309736 - DNA, 22 bp, Artificial Sequence
  chemically synthesized
aaaatcatatgtacccttcatt

SEQ ID NO: 1309737 - DNA, 22 bp, Artificial Sequence
  chemically synthesized
ttataaaaatatgaaatgaagg

SEQ ID NO: 1309738 - DNA, 22 bp, Artificial Sequence
  chemically synthesized
gttataaaaatatgaaatgaag

SEQ ID NO: 1309739 - DNA, 22 bp, Artificial Sequence
  chemically synthesized
tgttataaaaatatgaaatgaa

SEQ ID NO: 1309740 - DNA, 22 bp, Artificial Sequence
  chemically synthesized
tcattttgttataaaaatatga

SEQ ID NO: 1309741 - DNA, 22 bp, Artificial Sequence
  chemically synthesized
aattgtcattttgttataaaaa

SEQ ID NO: 1309742 - DNA, 22 bp, Artificial Sequence
  chemically synthesized
catttcatatttttataacaaa

SEQ ID NO: 1309743 - DNA, 22 bp, Artificial Sequence
  chemically synthesized
atttcatatttttataacaaaa

SEQ ID NO: 1309744 - DNA, 22 bp, Artificial Sequence
  chemically synthesized
attaaattgtcattttgttata

SEQ ID NO: 1309745 - DNA, 22 bp, Artificial Sequence
  chemically synthesized
catatttttataacaaaatgac

SEQ ID NO: 1309746 - DNA, 22 bp, Artificial Sequence
  chemically synthesized
atatttttataacaaaatgaca

SEQ ID NO: 1309747 - DNA, 22 bp, Artificial Sequence
  chemically synthesized
atacattgattaaattgtcatt

SEQ ID NO: 1309748 - DNA, 22 bp, Artificial Sequence
  chemically synthesized
aatacattgattaaattgtcat

SEQ ID NO: 1309749 - DNA, 22 bp, Artificial Sequence
  chemically synthesized
ttataacaaaatgacaatttaa

SEQ ID NO: 1309750 - DNA, 22 bp, Artificial Sequence
  chemically synthesized
tataacaaaatgacaatttaat

SEQ ID NO: 1309751 - DNA, 22 bp, Artificial Sequence
  chemically synthesized
ataacaaaatgacaatttaatc

SEQ ID NO: 1309752 - DNA, 22 bp, Artificial Sequence
  chemically synthesized
taacaaaatgacaatttaatca

SEQ ID NO: 1309753 - DNA, 22 bp, Artificial Sequence
  chemically synthesized
aaaatttaatacattgattaaa

SEQ ID NO: 1309754 - DNA, 22 bp, Artificial Sequence
  chemically synthesized
gaaaatttaatacattgattaa

SEQ ID NO: 1309755 - DNA, 22 bp, Artificial Sequence
  chemically synthesized
tgaaaatttaatacattgatta

SEQ ID NO: 1309756 - DNA, 22 bp, Artificial Sequence
  chemically synthesized
ttgaaaatttaatacattgatt

SEQ ID NO: 1309757 - DNA, 22 bp, Artificial Sequence
  chemically synthesized
ttttgaaaatttaatacattga

SEQ ID NO: 1309758 - DNA, 22 bp, Artificial Sequence
  chemically synthesized
cttttgaaaatttaatacattg

SEQ ID NO: 1309759 - DNA, 22 bp, Artificial Sequence
  chemically synthesized
tcttttgaaaatttaatacatt

SEQ ID NO: 1309760 - DNA, 22 bp, Artificial Sequence
  chemically synthesized
cattttcttttgaaaatttaat

SEQ ID NO: 1309761 - DNA, 22 bp, Artificial Sequence
  chemically synthesized
gcattttcttttgaaaatttaa

SEQ ID NO: 1309762 - DNA, 22 bp, Artificial Sequence
  chemically synthesized
aatcaatgtattaaattttcaa

SEQ ID NO: 1309763 - DNA, 22 bp, Artificial Sequence
  chemically synthesized
atcaatgtattaaattttcaaa

SEQ ID NO: 1309764 - DNA, 22 bp, Artificial Sequence
  chemically synthesized
aattttcaaaagaaaatgcaaa

SEQ ID NO: 1309765 - DNA, 22 bp, Artificial Sequence
  chemically synthesized
tgtagaacagatatttgcattt

SEQ ID NO: 1309766 - DNA, 22 bp, Artificial Sequence
  chemically synthesized
tcaaaagaaaatgcaaatatct

SEQ ID NO: 1309767 - DNA, 22 bp, Artificial Sequence
  chemically synthesized
caaaagaaaatgcaaatatctg

SEQ ID NO: 1309768 - DNA, 22 bp, Artificial Sequence
  chemically synthesized
aaaagaaaatgcaaatatctgt

SEQ ID NO: 1309769 - DNA, 22 bp, Artificial Sequence
  chemically synthesized
aatctatgtagaacagatattt

SEQ ID NO: 1309770 - DNA, 22 bp, Artificial Sequence
  chemically synthesized
caatctatgtagaacagatatt

SEQ ID NO: 1309771 - DNA, 22 bp, Artificial Sequence
  chemically synthesized
gtcttcaatctatgtagaacag

SEQ ID NO: 1309772 - DNA, 22 bp, Artificial Sequence
  chemically synthesized
ggtcttcaatctatgtagaaca

SEQ ID NO: 1309773 - DNA, 22 bp, Artificial Sequence
  chemically synthesized
ttggtcttcaatctatgtagaa

SEQ ID NO: 1309774 - DNA, 22 bp, Artificial Sequence
  chemically synthesized
gcagaaattcttggtcttcaat

SEQ ID NO: 1309775 - DNA, 22 bp, Artificial Sequence
  chemically synthesized
ttctacatagattgaagaccaa

SEQ ID NO: 1309776 - DNA, 22 bp, Artificial Sequence
  chemically synthesized
tacatagattgaagaccaagaa

SEQ ID NO: 1309777 - DNA, 22 bp, Artificial Sequence
  chemically synthesized
catagattgaagaccaagaatt

SEQ ID NO: 1309778 - DNA, 22 bp, Artificial Sequence
  chemically synthesized
ggtatcactggcagaaattctt

SEQ ID NO: 1309779 - DNA, 22 bp, Artificial Sequence
  chemically synthesized
gctgggtatcactggcagaaat

SEQ ID NO: 1309780 - DNA, 22 bp, Artificial Sequence
  chemically synthesized
ggctgggtatcactggcagaaa

SEQ ID NO: 1309781 - DNA, 22 bp, Artificial Sequence
  chemically synthesized
aagaccaagaatttctgccagt

SEQ ID NO: 1309782 - DNA, 22 bp, Artificial Sequence
  chemically synthesized
atcttggctgggtatcactggc

SEQ ID NO: 1309783 - DNA, 22 bp, Artificial Sequence
  chemically synthesized
aaaactaatcttggctgggtat

SEQ ID NO: 1309784 - DNA, 22 bp, Artificial Sequence
  chemically synthesized
ctgccagtgatacccagccaag

SEQ ID NO: 1309785 - DNA, 22 bp, Artificial Sequence
  chemically synthesized
tgccagtgatacccagccaaga

SEQ ID NO: 1309786 - DNA, 22 bp, Artificial Sequence
  chemically synthesized
actgaaaactaatcttggctgg

SEQ ID NO: 1309787 - DNA, 22 bp, Artificial Sequence
  chemically synthesized
ccagtgatacccagccaagatt

SEQ ID NO: 1309788 - DNA, 22 bp, Artificial Sequence
  chemically synthesized
aaagatggtataaaaagactaa

SEQ ID NO: 1309789 - DNA, 22 bp, Artificial Sequence
  chemically synthesized
gaaagatggtataaaaagacta

SEQ ID NO: 1309790 - DNA, 22 bp, Artificial Sequence
  chemically synthesized
tgaaagatggtataaaaagact

SEQ ID NO: 1309791 - DNA, 22 bp, Artificial Sequence
  chemically synthesized
gttttcagttagtctttttata

SEQ ID NO: 1309792 - DNA, 22 bp, Artificial Sequence
  chemically synthesized
ttttgaaagatggtataaaaag

SEQ ID NO: 1309793 - DNA, 22 bp, Artificial Sequence
  chemically synthesized
gttttgaaagatggtataaaaa

SEQ ID NO: 1309794 - DNA, 22 bp, Artificial Sequence
  chemically synthesized
tcagttagtctttttataccat

SEQ ID NO: 1309795 - DNA, 22 bp, Artificial Sequence
  chemically synthesized
cagttagtctttttataccatc

SEQ ID NO: 1309796 - DNA, 22 bp, Artificial Sequence
  chemically synthesized
agttagtctttttataccatct

SEQ ID NO: 1309797 - DNA, 22 bp, Artificial Sequence
  chemically synthesized
ccatttgttttgaaagatggta

SEQ ID NO: 1309798 - DNA, 22 bp, Artificial Sequence
  chemically synthesized
gtctttttataccatctttcaa

SEQ ID NO: 1309799 - DNA, 22 bp, Artificial Sequence
  chemically synthesized
tttataccatctttcaaaacaa

SEQ ID NO: 1309800 - DNA, 22 bp, Artificial Sequence
  chemically synthesized
ttataccatctttcaaaacaaa

SEQ ID NO: 1309801 - DNA, 22 bp, Artificial Sequence
  chemically synthesized
tataccatctttcaaaacaaat

SEQ ID NO: 1309802 - DNA, 22 bp, Artificial Sequence
  chemically synthesized
ataccatctttcaaaacaaatg

SEQ ID NO: 1309803 - DNA, 22 bp, Artificial Sequence
  chemically synthesized
taccatctttcaaaacaaatgg

SEQ ID NO: 1309804 - DNA, 22 bp, Artificial Sequence
  chemically synthesized
tcaaaacaaatggtaatgtgcg

SEQ ID NO: 1309805 - DNA, 22 bp, Artificial Sequence
  chemically synthesized
caaaacaaatggtaatgtgcga

SEQ ID NO: 1309806 - DNA, 22 bp, Artificial Sequence
  chemically synthesized
acagtataaggatcgcacatta

SEQ ID NO: 1309807 - DNA, 22 bp, Artificial Sequence
  chemically synthesized
aaaacaaatggtaatgtgcgat

SEQ ID NO: 1309808 - DNA, 22 bp, Artificial Sequence
  chemically synthesized
aacagtataaggatcgcacatt

SEQ ID NO: 1309809 - DNA, 22 bp, Artificial Sequence
  chemically synthesized
taacagtataaggatcgcacat

SEQ ID NO: 1309810 - DNA, 22 bp, Artificial Sequence
  chemically synthesized
tttaacagtataaggatcgcac

SEQ ID NO: 1309811 - DNA, 22 bp, Artificial Sequence
  chemically synthesized
ctttaacagtataaggatcgca

SEQ ID NO: 1309812 - DNA, 22 bp, Artificial Sequence
  chemically synthesized
tctttaacagtataaggatcgc

SEQ ID NO: 1309813 - DNA, 22 bp, Artificial Sequence
  chemically synthesized
ttctttaacagtataaggatcg

SEQ ID NO: 1309814 - DNA, 22 bp, Artificial Sequence
  chemically synthesized
tttctttaacagtataaggatc

SEQ ID NO: 1309815 - DNA, 22 bp, Artificial Sequence
  chemically synthesized
aataattttttctttaacagta

SEQ ID NO: 1309816 - DNA, 22 bp, Artificial Sequence
  chemically synthesized
atactgttaaagaaaaaattat

SEQ ID NO: 1309817 - DNA, 22 bp, Artificial Sequence
  chemically synthesized
tactgttaaagaaaaaattatt

SEQ ID NO: 1309818 - DNA, 22 bp, Artificial Sequence
  chemically synthesized
agcaagtgacattgaataattt

SEQ ID NO: 1309819 - DNA, 22 bp, Artificial Sequence
  chemically synthesized
ttaaagaaaaaattattcaatg

SEQ ID NO: 1309820 - DNA, 22 bp, Artificial Sequence
  chemically synthesized
aagaaaaaattattcaatgtca

SEQ ID NO: 1309821 - DNA, 22 bp, Artificial Sequence
  chemically synthesized
ccgtgattcagcaagtgacatt

SEQ ID NO: 1309822 - DNA, 22 bp, Artificial Sequence
  chemically synthesized
accgtgattcagcaagtgacat

SEQ ID NO: 1309823 - DNA, 22 bp, Artificial Sequence
  chemically synthesized
ccttaccgtgattcagcaagtg

SEQ ID NO: 1309824 - DNA, 22 bp, Artificial Sequence
  chemically synthesized
ttcaatgtcacttgctgaatca

SEQ ID NO: 1309825 - DNA, 22 bp, Artificial Sequence
  chemically synthesized
aatgtcacttgctgaatcacgg

SEQ ID NO: 1309826 - DNA, 22 bp, Artificial Sequence
  chemically synthesized
aataaagcctgccttaccgtga

SEQ ID NO: 1309827 - DNA, 22 bp, Artificial Sequence
  chemically synthesized
gaataaagcctgccttaccgtg

SEQ ID NO: 1309828 - DNA, 22 bp, Artificial Sequence
  chemically synthesized
gctgaatcacggtaaggcaggc

SEQ ID NO: 1309829 - DNA, 22 bp, Artificial Sequence
  chemically synthesized
ctgaatcacggtaaggcaggct

SEQ ID NO: 1309830 - DNA, 22 bp, Artificial Sequence
  chemically synthesized
aatcacggtaaggcaggcttta

SEQ ID NO: 1309831 - DNA, 22 bp, Artificial Sequence
  chemically synthesized
agatggtcttgaataaagcctg

SEQ ID NO: 1309832 - DNA, 22 bp, Artificial Sequence
  chemically synthesized
ttgagatggtcttgaataaagc

SEQ ID NO: 1309833 - DNA, 22 bp, Artificial Sequence
  chemically synthesized
tacctattgagatggtcttgaa

SEQ ID NO: 1309834 - DNA, 22 bp, Artificial Sequence
  chemically synthesized
tattcaagaccatctcaatagg

SEQ ID NO: 1309835 - DNA, 22 bp, Artificial Sequence
  chemically synthesized
acggtccctatacctattgaga

SEQ ID NO: 1309836 - DNA, 22 bp, Artificial Sequence
  chemically synthesized
attcaagaccatctcaataggt

SEQ ID NO: 1309837 - DNA, 22 bp, Artificial Sequence
  chemically synthesized
cacggtccctatacctattgag

SEQ ID NO: 1309838 - DNA, 22 bp, Artificial Sequence
  chemically synthesized
ttcaagaccatctcaataggta

SEQ ID NO: 1309839 - DNA, 22 bp, Artificial Sequence
  chemically synthesized
tcacggtccctatacctattga

SEQ ID NO: 1309840 - DNA, 22 bp, Artificial Sequence
  chemically synthesized
aagaccatctcaataggtatag

SEQ ID NO: 1309841 - DNA, 22 bp, Artificial Sequence
  chemically synthesized
ttttcacggtccctatacctat

SEQ ID NO: 1309842 - DNA, 22 bp, Artificial Sequence
  chemically synthesized
caagaccctattttcacggtcc

SEQ ID NO: 1309843 - DNA, 22 bp, Artificial Sequence
  chemically synthesized
aataggtatagggaccgtgaaa

SEQ ID NO: 1309844 - DNA, 22 bp, Artificial Sequence
  chemically synthesized
ctgcaagaccctattttcacgg

SEQ ID NO: 1309845 - DNA, 22 bp, Artificial Sequence
  chemically synthesized
ccctactgcaagaccctatttt

SEQ ID NO: 1309846 - DNA, 22 bp, Artificial Sequence
  chemically synthesized
tcccctactgcaagaccctatt

SEQ ID NO: 1309847 - DNA, 22 bp, Artificial Sequence
  chemically synthesized
tctcccctactgcaagacccta

SEQ ID NO: 1309848 - DNA, 22 bp, Artificial Sequence
  chemically synthesized
aatctctctcccctactgcaag

SEQ ID NO: 1309849 - DNA, 22 bp, Artificial Sequence
  chemically synthesized
agctcaatctctctcccctact

SEQ ID NO: 1309850 - DNA, 22 bp, Artificial Sequence
  chemically synthesized
aaattgagctcaatctctctcc

SEQ ID NO: 1309851 - DNA, 22 bp, Artificial Sequence
  chemically synthesized
gcagtaggggagagagattgag

SEQ ID NO: 1309852 - DNA, 22 bp, Artificial Sequence
  chemically synthesized
cagtaggggagagagattgagc

SEQ ID NO: 1309853 - DNA, 22 bp, Artificial Sequence
  chemically synthesized
tattcaaattgagctcaatctc

SEQ ID NO: 1309854 - DNA, 22 bp, Artificial Sequence
  chemically synthesized
tgctgtattcaaattgagctca

SEQ ID NO: 1309855 - DNA, 22 bp, Artificial Sequence
  chemically synthesized
cctgtgctgtattcaaattgag

SEQ ID NO: 1309856 - DNA, 22 bp, Artificial Sequence
  chemically synthesized
gcctgtgctgtattcaaattga

SEQ ID NO: 1309857 - DNA, 22 bp, Artificial Sequence
  chemically synthesized
ccatttgcctgtgctgtattca

SEQ ID NO: 1309858 - DNA, 22 bp, Artificial Sequence
  chemically synthesized
agctcaatttgaatacagcaca

SEQ ID NO: 1309859 - DNA, 22 bp, Artificial Sequence
  chemically synthesized
aatttgaatacagcacaggcaa

SEQ ID NO: 1309860 - DNA, 22 bp, Artificial Sequence
  chemically synthesized
taaaattcccatttgcctgtgc

SEQ ID NO: 1309861 - DNA, 22 bp, Artificial Sequence
  chemically synthesized
gttataaaattcccatttgcct

SEQ ID NO: 1309862 - DNA, 22 bp, Artificial Sequence
  chemically synthesized
gaatacagcacaggcaaatggg

SEQ ID NO: 1309863 - DNA, 22 bp, Artificial Sequence
  chemically synthesized
ggttataaaattcccatttgcc

SEQ ID NO: 1309864 - DNA, 22 bp, Artificial Sequence
  chemically synthesized
aatacagcacaggcaaatggga

SEQ ID NO: 1309865 - DNA, 22 bp, Artificial Sequence
  chemically synthesized
cttggttataaaattcccattt

SEQ ID NO: 1309866 - DNA, 22 bp, Artificial Sequence
  chemically synthesized
ttccttggttataaaattccca

SEQ ID NO: 1309867 - DNA, 22 bp, Artificial Sequence
  chemically synthesized
ccctgttccttggttataaaat

SEQ ID NO: 1309868 - DNA, 22 bp, Artificial Sequence
  chemically synthesized
acccctaccctgttccttggtt

SEQ ID NO: 1309869 - DNA, 22 bp, Artificial Sequence
  chemically synthesized
tataaccaaggaacagggtagg

SEQ ID NO: 1309870 - DNA, 22 bp, Artificial Sequence
  chemically synthesized
catccactgacccctaccctgt

SEQ ID NO: 1309871 - DNA, 22 bp, Artificial Sequence
  chemically synthesized
ataaccaaggaacagggtaggg

SEQ ID NO: 1309872 - DNA, 22 bp, Artificial Sequence
  chemically synthesized
ccatccactgacccctaccctg

SEQ ID NO: 1309873 - DNA, 22 bp, Artificial Sequence
  chemically synthesized
taaccaaggaacagggtagggg

SEQ ID NO: 1309874 - DNA, 22 bp, Artificial Sequence
  chemically synthesized
tccatccactgacccctaccct

SEQ ID NO: 1309875 - DNA, 22 bp, Artificial Sequence
  chemically synthesized
ataattttccatccactgaccc

SEQ ID NO: 1309876 - DNA, 22 bp, Artificial Sequence
  chemically synthesized
aataattttccatccactgacc

SEQ ID NO: 1309877 - DNA, 22 bp, Artificial Sequence
  chemically synthesized
ttaataattttccatccactga

SEQ ID NO: 1309878 - DNA, 22 bp, Artificial Sequence
  chemically synthesized
ctcttaataattttccatccac

SEQ ID NO: 1309879 - DNA, 22 bp, Artificial Sequence
  chemically synthesized
cctcttaataattttccatcca

SEQ ID NO: 1309880 - DNA, 22 bp, Artificial Sequence
  chemically synthesized
cccatgatgcttcctcttaata

SEQ ID NO: 1309881 - DNA, 22 bp, Artificial Sequence
  chemically synthesized
acccatgatgcttcctcttaat

SEQ ID NO: 1309882 - DNA, 22 bp, Artificial Sequence
  chemically synthesized
ccttacccatgatgcttcctct

SEQ ID NO: 1309883 - DNA, 22 bp, Artificial Sequence
  chemically synthesized
ttaagaggaagcatcatgggta

SEQ ID NO: 1309884 - DNA, 22 bp, Artificial Sequence
  chemically synthesized
agaggaagcatcatgggtaagg

SEQ ID NO: 1309885 - DNA, 22 bp, Artificial Sequence
  chemically synthesized
agcaggagtctcccttacccat

SEQ ID NO: 1309886 - DNA, 22 bp, Artificial Sequence
  chemically synthesized
cagcaggagtctcccttaccca

SEQ ID NO: 1309887 - DNA, 22 bp, Artificial Sequence
  chemically synthesized
tcagcaggagtctcccttaccc

SEQ ID NO: 1309888 - DNA, 22 bp, Artificial Sequence
  chemically synthesized
ttttcagcaggagtctccctta

SEQ ID NO: 1309889 - DNA, 22 bp, Artificial Sequence
  chemically synthesized
gactattttcagcaggagtctc

SEQ ID NO: 1309890 - DNA, 22 bp, Artificial Sequence
  chemically synthesized
caggggatgactggactatttt

SEQ ID NO: 1309891 - DNA, 22 bp, Artificial Sequence
  chemically synthesized
ctgctgaaaatagtccagtcat

SEQ ID NO: 1309892 - DNA, 22 bp, Artificial Sequence
  chemically synthesized
ctgaaaatagtccagtcatccc

SEQ ID NO: 1309893 - DNA, 22 bp, Artificial Sequence
  chemically synthesized
aaaatagtccagtcatcccctg

SEQ ID NO: 1309894 - DNA, 22 bp, Artificial Sequence
  chemically synthesized
atcatccaccatcctccagggg

SEQ ID NO: 1309895 - DNA, 22 bp, Artificial Sequence
  chemically synthesized
ctcatcatccaccatcctccag

SEQ ID NO: 1309896 - DNA, 22 bp, Artificial Sequence
  chemically synthesized
atcatgttcctcatcatccacc

SEQ ID NO: 1309897 - DNA, 22 bp, Artificial Sequence
  chemically synthesized
gaggatggtggatgatgaggaa

SEQ ID NO: 1309898 - DNA, 22 bp, Artificial Sequence
  chemically synthesized
gatatctgatcatgttcctcat

SEQ ID NO: 1309899 - DNA, 22 bp, Artificial Sequence
  chemically synthesized
tcctggatatctgatcatgttc

SEQ ID NO: 1309900 - DNA, 22 bp, Artificial Sequence
  chemically synthesized
attatcctggatatctgatcat

SEQ ID NO: 1309901 - DNA, 22 bp, Artificial Sequence
  chemically synthesized
gattatcctggatatctgatca

SEQ ID NO: 1309902 - DNA, 22 bp, Artificial Sequence
  chemically synthesized
gtatttgattatcctggatatc

SEQ ID NO: 1309903 - DNA, 22 bp, Artificial Sequence
  chemically synthesized
ggtatttgattatcctggatat

SEQ ID NO: 1309904 - DNA, 22 bp, Artificial Sequence
  chemically synthesized
atccttggtatttgattatcct

SEQ ID NO: 1309905 - DNA, 22 bp, Artificial Sequence
  chemically synthesized
gccagaaaacactcatccttgg

SEQ ID NO: 1309906 - DNA, 22 bp, Artificial Sequence
  chemically synthesized
agccagaaaacactcatccttg

SEQ ID NO: 1309907 - DNA, 22 bp, Artificial Sequence
  chemically synthesized
gcaggccagatcagtttagcca

SEQ ID NO: 1309908 - DNA, 22 bp, Artificial Sequence
  chemically synthesized
agcaggccagatcagtttagcc

SEQ ID NO: 1309909 - DNA, 22 bp, Artificial Sequence
  chemically synthesized
tagcaggccagatcagtttagc

SEQ ID NO: 1309910 - DNA, 22 bp, Artificial Sequence
  chemically synthesized
gttttagcaggccagatcagtt

SEQ ID NO: 1309911 - DNA, 22 bp, Artificial Sequence
  chemically synthesized
agttttagcaggccagatcagt

SEQ ID NO: 1309912 - DNA, 22 bp, Artificial Sequence
  chemically synthesized
tctggctaaactgatctggcct

SEQ ID NO: 1309913 - DNA, 22 bp, Artificial Sequence
  chemically synthesized
ctggctaaactgatctggcctg

SEQ ID NO: 1309914 - DNA, 22 bp, Artificial Sequence
  chemically synthesized
tggctaaactgatctggcctgc

SEQ ID NO: 1309915 - DNA, 22 bp, Artificial Sequence
  chemically synthesized
aaatttagttttagcaggccag

SEQ ID NO: 1309916 - DNA, 22 bp, Artificial Sequence
  chemically synthesized
gctaaactgatctggcctgcta

SEQ ID NO: 1309917 - DNA, 22 bp, Artificial Sequence
  chemically synthesized
ctaaaatttagttttagcaggc

SEQ ID NO: 1309918 - DNA, 22 bp, Artificial Sequence
  chemically synthesized
aactgatctggcctgctaaaac

SEQ ID NO: 1309919 - DNA, 22 bp, Artificial Sequence
  chemically synthesized
tcctaaaatttagttttagcag

SEQ ID NO: 1309920 - DNA, 22 bp, Artificial Sequence
  chemically synthesized
atctggcctgctaaaactaaat

SEQ ID NO: 1309921 - DNA, 22 bp, Artificial Sequence
  chemically synthesized
tgcacattctcctaaaatttag

SEQ ID NO: 1309922 - DNA, 22 bp, Artificial Sequence
  chemically synthesized
gcctgctaaaactaaattttag

SEQ ID NO: 1309923 - DNA, 22 bp, Artificial Sequence
  chemically synthesized
ctaaaactaaattttaggagaa

SEQ ID NO: 1309924 - DNA, 22 bp, Artificial Sequence
  chemically synthesized
aaactaaattttaggagaatgt

SEQ ID NO: 1309925 - DNA, 22 bp, Artificial Sequence
  chemically synthesized
atagcccagtctgtgcacattc

SEQ ID NO: 1309926 - DNA, 22 bp, Artificial Sequence
  chemically synthesized
aattttaggagaatgtgcacag

SEQ ID NO: 1309927 - DNA, 22 bp, Artificial Sequence
  chemically synthesized
tcatagcccagtctgtgcacat

SEQ ID NO: 1309928 - DNA, 22 bp, Artificial Sequence
  chemically synthesized
ctcatagcccagtctgtgcaca

SEQ ID NO: 1309929 - DNA, 22 bp, Artificial Sequence
  chemically synthesized
taggagaatgtgcacagactgg

SEQ ID NO: 1309930 - DNA, 22 bp, Artificial Sequence
  chemically synthesized
aggagaatgtgcacagactggg

SEQ ID NO: 1309931 - DNA, 22 bp, Artificial Sequence
  chemically synthesized
ggagaatgtgcacagactgggc

SEQ ID NO: 1309932 - DNA, 22 bp, Artificial Sequence
  chemically synthesized
ccaaccttctcatagcccagtc

SEQ ID NO: 1309933 - DNA, 22 bp, Artificial Sequence
  chemically synthesized
cccaaccttctcatagcccagt

SEQ ID NO: 1309934 - DNA, 22 bp, Artificial Sequence
  chemically synthesized
aggcttcccaaccttctcatag

SEQ ID NO: 1309935 - DNA, 22 bp, Artificial Sequence
  chemically synthesized
ttcaggcttcccaaccttctca

SEQ ID NO: 1309936 - DNA, 22 bp, Artificial Sequence
  chemically synthesized
attcaggcttcccaaccttctc

SEQ ID NO: 1309937 - DNA, 22 bp, Artificial Sequence
  chemically synthesized
ggctatgagaaggttgggaagc

SEQ ID NO: 1309938 - DNA, 22 bp, Artificial Sequence
  chemically synthesized
tgagaaggttgggaagcctgaa

SEQ ID NO: 1309939 - DNA, 22 bp, Artificial Sequence
  chemically synthesized
ggccaaaatttattcaggcttc

SEQ ID NO: 1309940 - DNA, 22 bp, Artificial Sequence
  chemically synthesized
ctcggccaaaatttattcaggc

SEQ ID NO: 1309941 - DNA, 22 bp, Artificial Sequence
  chemically synthesized
gctcggccaaaatttattcagg

SEQ ID NO: 1309942 - DNA, 22 bp, Artificial Sequence
  chemically synthesized
tttgctcggccaaaatttattc

SEQ ID NO: 1309943 - DNA, 22 bp, Artificial Sequence
  chemically synthesized
ggaagcctgaataaattttggc

SEQ ID NO: 1309944 - DNA, 22 bp, Artificial Sequence
  chemically synthesized
acaaagattatttgctcggcca

SEQ ID NO: 1309945 - DNA, 22 bp, Artificial Sequence
  chemically synthesized
aataaattttggccgagcaaat

SEQ ID NO: 1309946 - DNA, 22 bp, Artificial Sequence
  chemically synthesized
gtactgacaaagattatttgct

SEQ ID NO: 1309947 - DNA, 22 bp, Artificial Sequence
  chemically synthesized
tgttagtactgacaaagattat

SEQ ID NO: 1309948 - DNA, 22 bp, Artificial Sequence
  chemically synthesized
tggccgagcaaataatctttgt

SEQ ID NO: 1309949 - DNA, 22 bp, Artificial Sequence
  chemically synthesized
ggccgagcaaataatctttgtc

SEQ ID NO: 1309950 - DNA, 22 bp, Artificial Sequence
  chemically synthesized
gccgagcaaataatctttgtca

SEQ ID NO: 1309951 - DNA, 22 bp, Artificial Sequence
  chemically synthesized
actatgttagtactgacaaaga

SEQ ID NO: 1309952 - DNA, 22 bp, Artificial Sequence
  chemically synthesized
ttaactatgttagtactgacaa

SEQ ID NO: 1309953 - DNA, 22 bp, Artificial Sequence
  chemically synthesized
attaactatgttagtactgaca

SEQ ID NO: 1309954 - DNA, 22 bp, Artificial Sequence
  chemically synthesized
tttattaactatgttagtactg

SEQ ID NO: 1309955 - DNA, 22 bp, Artificial Sequence
  chemically synthesized
tgtttattaactatgttagtac

SEQ ID NO: 1309956 - DNA, 22 bp, Artificial Sequence
  chemically synthesized
tctgtttattaactatgttagt

SEQ ID NO: 1309957 - DNA, 22 bp, Artificial Sequence
  chemically synthesized
tgtcagtactaacatagttaat

SEQ ID NO: 1309958 - DNA, 22 bp, Artificial Sequence
  chemically synthesized
gtcagtactaacatagttaata

SEQ ID NO: 1309959 - DNA, 22 bp, Artificial Sequence
  chemically synthesized
tcagtactaacatagttaataa

SEQ ID NO: 1309960 - DNA, 22 bp, Artificial Sequence
  chemically synthesized
gggtactctctgtttattaact

SEQ ID NO: 1309961 - DNA, 22 bp, Artificial Sequence
  chemically synthesized
ctggggtactctctgtttatta

SEQ ID NO: 1309962 - DNA, 22 bp, Artificial Sequence
  chemically synthesized
acatagttaataaacagagagt

SEQ ID NO: 1309963 - DNA, 22 bp, Artificial Sequence
  chemically synthesized
ataaatgaattactggggtact

SEQ ID NO: 1309964 - DNA, 22 bp, Artificial Sequence
  chemically synthesized
cataaatgaattactggggtac

SEQ ID NO: 1309965 - DNA, 22 bp, Artificial Sequence
  chemically synthesized
ataaacagagagtaccccagta

SEQ ID NO: 1309966 - DNA, 22 bp, Artificial Sequence
  chemically synthesized
tcataaatgaattactggggta

SEQ ID NO: 1309967 - DNA, 22 bp, Artificial Sequence
  chemically synthesized
aaacacattttcataaatgaat

SEQ ID NO: 1309968 - DNA, 22 bp, Artificial Sequence
  chemically synthesized
gaaacacattttcataaatgaa

SEQ ID NO: 1309969 - DNA, 22 bp, Artificial Sequence
  chemically synthesized
tgaaacacattttcataaatga

SEQ ID NO: 1309970 - DNA, 22 bp, Artificial Sequence
  chemically synthesized
ttgaaacacattttcataaatg

SEQ ID NO: 1309971 - DNA, 22 bp, Artificial Sequence
  chemically synthesized
tttgaaacacattttcataaat

SEQ ID NO: 1309972 - DNA, 22 bp, Artificial Sequence
  chemically synthesized
gaattttttgaaacacattttc

SEQ ID NO: 1309973 - DNA, 22 bp, Artificial Sequence
  chemically synthesized
atttatgaaaatgtgtttcaaa

SEQ ID NO: 1309974 - DNA, 22 bp, Artificial Sequence
  chemically synthesized
atgaaaatgtgtttcaaaaaat

SEQ ID NO: 1309975 - DNA, 22 bp, Artificial Sequence
  chemically synthesized
gtcgagactggaattttttgaa

SEQ ID NO: 1309976 - DNA, 22 bp, Artificial Sequence
  chemically synthesized
tgaaaatgtgtttcaaaaaatt

SEQ ID NO: 1309977 - DNA, 22 bp, Artificial Sequence
  chemically synthesized
caaaaaattccagtctcgacca

SEQ ID NO: 1309978 - DNA, 22 bp, Artificial Sequence
  chemically synthesized
aaaaaattccagtctcgaccag

SEQ ID NO: 1309979 - DNA, 22 bp, Artificial Sequence
  chemically synthesized
caggcgtgagccaccacgcctg

SEQ ID NO: 1309980 - DNA, 22 bp, Artificial Sequence
  chemically synthesized
cagtctcgaccaggcgtggtgg

SEQ ID NO: 1309981 - DNA, 22 bp, Artificial Sequence
  chemically synthesized
gaccaggcgtggtggctcacgc

SEQ ID NO: 1309982 - DNA, 22 bp, Artificial Sequence
  chemically synthesized
aagtgcagcgattacaggcgtg

SEQ ID NO: 1309983 - DNA, 22 bp, Artificial Sequence
  chemically synthesized
ctaaagtgcagcgattacaggc

SEQ ID NO: 1309984 - DNA, 22 bp, Artificial Sequence
  chemically synthesized
cctcctaaagtgcagcgattac

SEQ ID NO: 1309985 - DNA, 22 bp, Artificial Sequence
  chemically synthesized
tgcctcctaaagtgcagcgatt

SEQ ID NO: 1309986 - DNA, 22 bp, Artificial Sequence
  chemically synthesized
acgcctgtaatcgctgcacttt

SEQ ID NO: 1309987 - DNA, 22 bp, Artificial Sequence
  chemically synthesized
cctctgcctcctaaagtgcagc

SEQ ID NO: 1309988 - DNA, 22 bp, Artificial Sequence
  chemically synthesized
taatcgctgcactttaggaggc

SEQ ID NO: 1309989 - DNA, 22 bp, Artificial Sequence
  chemically synthesized
aggtgatccacctgcctctgcc

SEQ ID NO: 1309990 - DNA, 22 bp, Artificial Sequence
  chemically synthesized
cactttaggaggcagaggcagg

SEQ ID NO: 1309991 - DNA, 22 bp, Artificial Sequence
  chemically synthesized
gacctcaggtgatccacctgcc

SEQ ID NO: 1309992 - DNA, 22 bp, Artificial Sequence
  chemically synthesized
taggaggcagaggcaggtggat

SEQ ID NO: 1309993 - DNA, 22 bp, Artificial Sequence
  chemically synthesized
aggaggcagaggcaggtggatc

SEQ ID NO: 1309994 - DNA, 22 bp, Artificial Sequence
  chemically synthesized
tagacctcaggtgatccacctg

SEQ ID NO: 1309995 - DNA, 22 bp, Artificial Sequence
  chemically synthesized
ggaggcagaggcaggtggatca

SEQ ID NO: 1309996 - DNA, 22 bp, Artificial Sequence
  chemically synthesized
gaactctagacctcaggtgatc

SEQ ID NO: 1309997 - DNA, 22 bp, Artificial Sequence
  chemically synthesized
gtctcgaactctagacctcagg

SEQ ID NO: 1309998 - DNA, 22 bp, Artificial Sequence
  chemically synthesized
gtcaggctggtctcgaactcta

SEQ ID NO: 1309999 - DNA, 22 bp, Artificial Sequence
  chemically synthesized
tgttggtcaggctggtctcgaa

SEQ ID NO: 1310000 - DNA, 22 bp, Artificial Sequence
  chemically synthesized
aggtctagagttcgagaccagc

SEQ ID NO: 1310001 - DNA, 22 bp, Artificial Sequence
  chemically synthesized
actatgttggtcaggctggtct

SEQ ID NO: 1310002 - DNA, 22 bp, Artificial Sequence
  chemically synthesized
cactatgttggtcaggctggtc

SEQ ID NO: 1310003 - DNA, 22 bp, Artificial Sequence
  chemically synthesized
gagttcgagaccagcctgacca

SEQ ID NO: 1310004 - DNA, 22 bp, Artificial Sequence
  chemically synthesized
gagaccagcctgaccaacatag

SEQ ID NO: 1310005 - DNA, 22 bp, Artificial Sequence
  chemically synthesized
gtagagaaaggggtttcactat

SEQ ID NO: 1310006 - DNA, 22 bp, Artificial Sequence
  chemically synthesized
agtagagaaaggggtttcacta

SEQ ID NO: 1310007 - DNA, 22 bp, Artificial Sequence
  chemically synthesized
tagtagagaaaggggtttcact

SEQ ID NO: 1310008 - DNA, 22 bp, Artificial Sequence
  chemically synthesized
ttagtagagaaaggggtttcac

SEQ ID NO: 1310009 - DNA, 22 bp, Artificial Sequence
  chemically synthesized
accaacatagtgaaaccccttt

SEQ ID NO: 1310010 - DNA, 22 bp, Artificial Sequence
  chemically synthesized
tatttttagtagagaaaggggt

SEQ ID NO: 1310011 - DNA, 22 bp, Artificial Sequence
  chemically synthesized
gtatttttagtagagaaagggg

SEQ ID NO: 1310012 - DNA, 22 bp, Artificial Sequence
  chemically synthesized
tgtatttttagtagagaaaggg

SEQ ID NO: 1310013 - DNA, 22 bp, Artificial Sequence
  chemically synthesized
ttgtatttttagtagagaaagg

SEQ ID NO: 1310014 - DNA, 22 bp, Artificial Sequence
  chemically synthesized
tttgtatttttagtagagaaag

SEQ ID NO: 1310015 - DNA, 22 bp, Artificial Sequence
  chemically synthesized
ttttgtatttttagtagagaaa

SEQ ID NO: 1310016 - DNA, 22 bp, Artificial Sequence
  chemically synthesized
tttttgtatttttagtagagaa

SEQ ID NO: 1310017 - DNA, 22 bp, Artificial Sequence
  chemically synthesized
attttttttgtatttttagtag

SEQ ID NO: 1310018 - DNA, 22 bp, Artificial Sequence
  chemically synthesized
tctctactaaaaatacaaaaaa

SEQ ID NO: 1310019 - DNA, 22 bp, Artificial Sequence
  chemically synthesized
ctctactaaaaatacaaaaaaa

SEQ ID NO: 1310020 - DNA, 22 bp, Artificial Sequence
  chemically synthesized
tctactaaaaatacaaaaaaaa

SEQ ID NO: 1310021 - DNA, 22 bp, Artificial Sequence
  chemically synthesized
tactaaaaatacaaaaaaaatt

SEQ ID NO: 1310022 - DNA, 22 bp, Artificial Sequence
  chemically synthesized
ctaaaaatacaaaaaaaattag

SEQ ID NO: 1310023 - DNA, 22 bp, Artificial Sequence
  chemically synthesized
aaaatacaaaaaaaattagccg

SEQ ID NO: 1310024 - DNA, 22 bp, Artificial Sequence
  chemically synthesized
caagtgcatgccaccacgcccg

SEQ ID NO: 1310025 - DNA, 22 bp, Artificial Sequence
  chemically synthesized
ggattacaagtgcatgccacca

SEQ ID NO: 1310026 - DNA, 22 bp, Artificial Sequence
  chemically synthesized
gccgggcgtggtggcatgcact

SEQ ID NO: 1310027 - DNA, 22 bp, Artificial Sequence
  chemically synthesized
gctgggattacaagtgcatgcc

SEQ ID NO: 1310028 - DNA, 22 bp, Artificial Sequence
  chemically synthesized
ccggttagctgggattacaagt

SEQ ID NO: 1310029 - DNA, 22 bp, Artificial Sequence
  chemically synthesized
agcctcccggttagctgggatt

SEQ ID NO: 1310030 - DNA, 22 bp, Artificial Sequence
  chemically synthesized
cagcctcccggttagctgggat

SEQ ID NO: 1310031 - DNA, 22 bp, Artificial Sequence
  chemically synthesized
cttcagcctcccggttagctgg

SEQ ID NO: 1310032 - DNA, 22 bp, Artificial Sequence
  chemically synthesized
ctgcttcagcctcccggttagc

SEQ ID NO: 1310033 - DNA, 22 bp, Artificial Sequence
  chemically synthesized
tcctgcttcagcctcccggtta

SEQ ID NO: 1310034 - DNA, 22 bp, Artificial Sequence
  chemically synthesized
gtaatcccagctaaccgggagg

SEQ ID NO: 1310035 - DNA, 22 bp, Artificial Sequence
  chemically synthesized
taatcccagctaaccgggaggc

SEQ ID NO: 1310036 - DNA, 22 bp, Artificial Sequence
  chemically synthesized
aagcgattctcctgcttcagcc

SEQ ID NO: 1310037 - DNA, 22 bp, Artificial Sequence
  chemically synthesized
accgggaggctgaagcaggaga

SEQ ID NO: 1310038 - DNA, 22 bp, Artificial Sequence
  chemically synthesized
ccaggttcaagcgattctcctg

SEQ ID NO: 1310039 - DNA, 22 bp, Artificial Sequence
  chemically synthesized
cctcccaggttcaagcgattct

SEQ ID NO: 1310040 - DNA, 22 bp, Artificial Sequence
  chemically synthesized
tgcctcccaggttcaagcgatt

SEQ ID NO: 1310041 - DNA, 22 bp, Artificial Sequence
  chemically synthesized
aagcaggagaatcgcttgaacc

SEQ ID NO: 1310042 - DNA, 22 bp, Artificial Sequence
  chemically synthesized
caacctctgcctcccaggttca

SEQ ID NO: 1310043 - DNA, 22 bp, Artificial Sequence
  chemically synthesized
actgcaacctctgcctcccagg

SEQ ID NO: 1310044 - DNA, 22 bp, Artificial Sequence
  chemically synthesized
gctcactgcaacctctgcctcc

SEQ ID NO: 1310045 - DNA, 22 bp, Artificial Sequence
  chemically synthesized
ggctcactgcaacctctgcctc

SEQ ID NO: 1310046 - DNA, 22 bp, Artificial Sequence
  chemically synthesized
gaacctgggaggcagaggttgc

SEQ ID NO: 1310047 - DNA, 22 bp, Artificial Sequence
  chemically synthesized
aacctgggaggcagaggttgca

SEQ ID NO: 1310048 - DNA, 22 bp, Artificial Sequence
  chemically synthesized
ggaggcagaggttgcagtgagc

SEQ ID NO: 1310049 - DNA, 22 bp, Artificial Sequence
  chemically synthesized
gaatgcagtggcatgatcttgg

SEQ ID NO: 1310050 - DNA, 22 bp, Artificial Sequence
  chemically synthesized
cagtgagccaagatcatgccac

SEQ ID NO: 1310051 - DNA, 22 bp, Artificial Sequence
  chemically synthesized
cccaggctggaatgcagtggca

SEQ ID NO: 1310052 - DNA, 22 bp, Artificial Sequence
  chemically synthesized
ttgcccaggctggaatgcagtg

SEQ ID NO: 1310053 - DNA, 22 bp, Artificial Sequence
  chemically synthesized
attgcccaggctggaatgcagt

SEQ ID NO: 1310054 - DNA, 22 bp, Artificial Sequence
  chemically synthesized
ttattgcccaggctggaatgca

SEQ ID NO: 1310055 - DNA, 22 bp, Artificial Sequence
  chemically synthesized
actcttattgcccaggctggaa

SEQ ID NO: 1310056 - DNA, 22 bp, Artificial Sequence
  chemically synthesized
cactcttattgcccaggctgga

SEQ ID NO: 1310057 - DNA, 22 bp, Artificial Sequence
  chemically synthesized
cattccagcctgggcaataaga

SEQ ID NO: 1310058 - DNA, 22 bp, Artificial Sequence
  chemically synthesized
aaatgaagtttcactcttattg

SEQ ID NO: 1310059 - DNA, 22 bp, Artificial Sequence
  chemically synthesized
gaaatgaagtttcactcttatt

SEQ ID NO: 1310060 - DNA, 22 bp, Artificial Sequence
  chemically synthesized
tgaaatgaagtttcactcttat

SEQ ID NO: 1310061 - DNA, 22 bp, Artificial Sequence
  chemically synthesized
cagcctgggcaataagagtgaa

SEQ ID NO: 1310062 - DNA, 22 bp, Artificial Sequence
  chemically synthesized
ttgaaatgaagtttcactctta

SEQ ID NO: 1310063 - DNA, 22 bp, Artificial Sequence
  chemically synthesized
tttgaaatgaagtttcactctt

SEQ ID NO: 1310064 - DNA, 22 bp, Artificial Sequence
  chemically synthesized
ttttgaaatgaagtttcactct

SEQ ID NO: 1310065 - DNA, 22 bp, Artificial Sequence
  chemically synthesized
tttttgaaatgaagtttcactc

SEQ ID NO: 1310066 - DNA, 22 bp, Artificial Sequence
  chemically synthesized
ttttttgaaatgaagtttcact

SEQ ID NO: 1310067 - DNA, 22 bp, Artificial Sequence
  chemically synthesized
tttttttgaaatgaagtttcac

SEQ ID NO: 1310068 - DNA, 22 bp, Artificial Sequence
  chemically synthesized
ttttttttgaaatgaagtttca

SEQ ID NO: 1310069 - DNA, 22 bp, Artificial Sequence
  chemically synthesized
ggcaataagagtgaaacttcat

SEQ ID NO: 1310070 - DNA, 22 bp, Artificial Sequence
  chemically synthesized
tttttttttgaaatgaagtttc

SEQ ID NO: 1310071 - DNA, 22 bp, Artificial Sequence
  chemically synthesized
ttttttttttgaaatgaagttt

SEQ ID NO: 1310072 - DNA, 22 bp, Artificial Sequence
  chemically synthesized
tttttttttttgaaatgaagtt

SEQ ID NO: 1310073 - DNA, 22 bp, Artificial Sequence
  chemically synthesized
ttttttttttttgaaatgaagt

SEQ ID NO: 1310074 - DNA, 22 bp, Artificial Sequence
  chemically synthesized
tttttttttttttgaaatgaag

SEQ ID NO: 1310075 - DNA, 22 bp, Artificial Sequence
  chemically synthesized
ttttttttttttttgaaatgaa

SEQ ID NO: 1310076 - DNA, 22 bp, Artificial Sequence
  chemically synthesized
tttttttttttttttgaaatga

SEQ ID NO: 1310077 - DNA, 22 bp, Artificial Sequence
  chemically synthesized
ttttttttttttttttgaaatg

SEQ ID NO: 1310078 - DNA, 22 bp, Artificial Sequence
  chemically synthesized
gatttttttttttttttttttg

SEQ ID NO: 1310079 - DNA, 22 bp, Artificial Sequence
  chemically synthesized
catttcaaaaaaaaaaaaaaaa

SEQ ID NO: 1310080 - DNA, 22 bp, Artificial Sequence
  chemically synthesized
atttcaaaaaaaaaaaaaaaaa

SEQ ID NO: 1310081 - DNA, 22 bp, Artificial Sequence
  chemically synthesized
aaagagattggatttttttttt

SEQ ID NO: 1310082 - DNA, 22 bp, Artificial Sequence
  chemically synthesized
caaagagattggattttttttt

SEQ ID NO: 1310083 - DNA, 22 bp, Artificial Sequence
  chemically synthesized
caaaaaaaaaaaaaaaaaaatc

SEQ ID NO: 1310084 - DNA, 22 bp, Artificial Sequence
  chemically synthesized
tcaaagagattggatttttttt

SEQ ID NO: 1310085 - DNA, 22 bp, Artificial Sequence
  chemically synthesized
aaaaaaaaaaaaaaaaaaatcc

SEQ ID NO: 1310086 - DNA, 22 bp, Artificial Sequence
  chemically synthesized
tcaagtgatacataactttcaa

SEQ ID NO: 1310087 - DNA, 22 bp, Artificial Sequence
  chemically synthesized
gtcaagtgatacataactttca

SEQ ID NO: 1310088 - DNA, 22 bp, Artificial Sequence
  chemically synthesized
tgtcaagtgatacataactttc

SEQ ID NO: 1310089 - DNA, 22 bp, Artificial Sequence
  chemically synthesized
ttgtcaagtgatacataacttt

SEQ ID NO: 1310090 - DNA, 22 bp, Artificial Sequence
  chemically synthesized
tttgaaagttatgtatcacttg

SEQ ID NO: 1310091 - DNA, 22 bp, Artificial Sequence
  chemically synthesized
tgaaagttatgtatcacttgac

SEQ ID NO: 1310092 - DNA, 22 bp, Artificial Sequence
  chemically synthesized
gaaagttatgtatcacttgaca

SEQ ID NO: 1310093 - DNA, 22 bp, Artificial Sequence
  chemically synthesized
aaagttatgtatcacttgacaa

SEQ ID NO: 1310094 - DNA, 22 bp, Artificial Sequence
  chemically synthesized
tgtatcacttgacaaaaacatt

SEQ ID NO: 1310095 - DNA, 22 bp, Artificial Sequence
  chemically synthesized
cgtcacaaaggaaatgtttttg

SEQ ID NO: 1310096 - DNA, 22 bp, Artificial Sequence
  chemically synthesized
aacctacgtcacaaaggaaatg

SEQ ID NO: 1310097 - DNA, 22 bp, Artificial Sequence
  chemically synthesized
tgaacctacgtcacaaaggaaa

SEQ ID NO: 1310098 - DNA, 22 bp, Artificial Sequence
  chemically synthesized
ctgaacctacgtcacaaaggaa

SEQ ID NO: 1310099 - DNA, 22 bp, Artificial Sequence
  chemically synthesized
gacaaaaacatttcctttgtga

SEQ ID NO: 1310100 - DNA, 22 bp, Artificial Sequence
  chemically synthesized
acaaaaacatttcctttgtgac

SEQ ID NO: 1310101 - DNA, 22 bp, Artificial Sequence
  chemically synthesized
acccaatgtttctgaacctacg

SEQ ID NO: 1310102 - DNA, 22 bp, Artificial Sequence
  chemically synthesized
aacccaatgtttctgaacctac

SEQ ID NO: 1310103 - DNA, 22 bp, Artificial Sequence
  chemically synthesized
cctttgtgacgtaggttcagaa

SEQ ID NO: 1310104 - DNA, 22 bp, Artificial Sequence
  chemically synthesized
ctttgtgacgtaggttcagaaa

SEQ ID NO: 1310105 - DNA, 22 bp, Artificial Sequence
  chemically synthesized
gtttaacccaatgtttctgaac

SEQ ID NO: 1310106 - DNA, 22 bp, Artificial Sequence
  chemically synthesized
agtttaacccaatgtttctgaa

SEQ ID NO: 1310107 - DNA, 22 bp, Artificial Sequence
  chemically synthesized
tgtgacgtaggttcagaaacat

SEQ ID NO: 1310108 - DNA, 22 bp, Artificial Sequence
  chemically synthesized
gtgacgtaggttcagaaacatt

SEQ ID NO: 1310109 - DNA, 22 bp, Artificial Sequence
  chemically synthesized
tgacgtaggttcagaaacattg

SEQ ID NO: 1310110 - DNA, 22 bp, Artificial Sequence
  chemically synthesized
acttagtttaacccaatgtttc

SEQ ID NO: 1310111 - DNA, 22 bp, Artificial Sequence
  chemically synthesized
aacttagtttaacccaatgttt

SEQ ID NO: 1310112 - DNA, 22 bp, Artificial Sequence
  chemically synthesized
tttaacttagtttaacccaatg

SEQ ID NO: 1310113 - DNA, 22 bp, Artificial Sequence
  chemically synthesized
agaaacattgggttaaactaag

SEQ ID NO: 1310114 - DNA, 22 bp, Artificial Sequence
  chemically synthesized
aaaaaattgtttaacttagttt

SEQ ID NO: 1310115 - DNA, 22 bp, Artificial Sequence
  chemically synthesized
tagttaaaaaaattgtttaact

SEQ ID NO: 1310116 - DNA, 22 bp, Artificial Sequence
  chemically synthesized
gtagttaaaaaaattgtttaac

SEQ ID NO: 1310117 - DNA, 22 bp, Artificial Sequence
  chemically synthesized
ggttaaactaagttaaacaatt

SEQ ID NO: 1310118 - DNA, 22 bp, Artificial Sequence
  chemically synthesized
tgtagttaaaaaaattgtttaa

SEQ ID NO: 1310119 - DNA, 22 bp, Artificial Sequence
  chemically synthesized
aactaagttaaacaattttttt

SEQ ID NO: 1310120 - DNA, 22 bp, Artificial Sequence
  chemically synthesized
aaatgttttgtagttaaaaaaa

SEQ ID NO: 1310121 - DNA, 22 bp, Artificial Sequence
  chemically synthesized
agttaaacaatttttttaacta

SEQ ID NO: 1310122 - DNA, 22 bp, Artificial Sequence
  chemically synthesized
aacaatttttttaactacaaaa

SEQ ID NO: 1310123 - DNA, 22 bp, Artificial Sequence
  chemically synthesized
aaccctgaaatgttttgtagtt

SEQ ID NO: 1310124 - DNA, 22 bp, Artificial Sequence
  chemically synthesized
ttttaactacaaaacatttcag

SEQ ID NO: 1310125 - DNA, 22 bp, Artificial Sequence
  chemically synthesized
tttaactacaaaacatttcagg

SEQ ID NO: 1310126 - DNA, 22 bp, Artificial Sequence
  chemically synthesized
ttaactacaaaacatttcaggg

SEQ ID NO: 1310127 - DNA, 22 bp, Artificial Sequence
  chemically synthesized
taactacaaaacatttcagggt

SEQ ID NO: 1310128 - DNA, 22 bp, Artificial Sequence
  chemically synthesized
aactacaaaacatttcagggtt

SEQ ID NO: 1310129 - DNA, 22 bp, Artificial Sequence
  chemically synthesized
actacaaaacatttcagggttg

SEQ ID NO: 1310130 - DNA, 22 bp, Artificial Sequence
  chemically synthesized
gcgagtcacaactcaaccctga

SEQ ID NO: 1310131 - DNA, 22 bp, Artificial Sequence
  chemically synthesized
agcgagtcacaactcaaccctg

SEQ ID NO: 1310132 - DNA, 22 bp, Artificial Sequence
  chemically synthesized
tagcgagtcacaactcaaccct

SEQ ID NO: 1310133 - DNA, 22 bp, Artificial Sequence
  chemically synthesized
caaaacatttcagggttgagtt

SEQ ID NO: 1310134 - DNA, 22 bp, Artificial Sequence
  chemically synthesized
tttagcgagtcacaactcaacc

SEQ ID NO: 1310135 - DNA, 22 bp, Artificial Sequence
  chemically synthesized
ctttagcgagtcacaactcaac

SEQ ID NO: 1310136 - DNA, 22 bp, Artificial Sequence
  chemically synthesized
cttctttagcgagtcacaactc

SEQ ID NO: 1310137 - DNA, 22 bp, Artificial Sequence
  chemically synthesized
ccttctttagcgagtcacaact

SEQ ID NO: 1310138 - DNA, 22 bp, Artificial Sequence
  chemically synthesized
cagggttgagttgtgactcgct

SEQ ID NO: 1310139 - DNA, 22 bp, Artificial Sequence
  chemically synthesized
atttccttctttagcgagtcac

SEQ ID NO: 1310140 - DNA, 22 bp, Artificial Sequence
  chemically synthesized
agggttgagttgtgactcgcta

SEQ ID NO: 1310141 - DNA, 22 bp, Artificial Sequence
  chemically synthesized
catttccttctttagcgagtca

SEQ ID NO: 1310142 - DNA, 22 bp, Artificial Sequence
  chemically synthesized
agttgtgactcgctaaagaagg

SEQ ID NO: 1310143 - DNA, 22 bp, Artificial Sequence
  chemically synthesized
tgactcgctaaagaaggaaatg

SEQ ID NO: 1310144 - DNA, 22 bp, Artificial Sequence
  chemically synthesized
aaatgtgataatttcatttcct

SEQ ID NO: 1310145 - DNA, 22 bp, Artificial Sequence
  chemically synthesized
ttaaaatgtgataatttcattt

SEQ ID NO: 1310146 - DNA, 22 bp, Artificial Sequence
  chemically synthesized
gctaaagaaggaaatgaaatta

SEQ ID NO: 1310147 - DNA, 22 bp, Artificial Sequence
  chemically synthesized
aagaaggaaatgaaattatcac

SEQ ID NO: 1310148 - DNA, 22 bp, Artificial Sequence
  chemically synthesized
aatgaaaaacaaattgttaaaa

SEQ ID NO: 1310149 - DNA, 22 bp, Artificial Sequence
  chemically synthesized
tcacattttaacaatttgtttt

SEQ ID NO: 1310150 - DNA, 22 bp, Artificial Sequence
  chemically synthesized
taacaatttgtttttcattcaa

SEQ ID NO: 1310151 - DNA, 22 bp, Artificial Sequence
  chemically synthesized
aacaatttgtttttcattcaac

SEQ ID NO: 1310152 - DNA, 22 bp, Artificial Sequence
  chemically synthesized
atcccgtaagatgttgaatgaa

SEQ ID NO: 1310153 - DNA, 22 bp, Artificial Sequence
  chemically synthesized
acaatttgtttttcattcaaca

SEQ ID NO: 1310154 - DNA, 22 bp, Artificial Sequence
  chemically synthesized
gtttttcattcaacatcttacg

SEQ ID NO: 1310155 - DNA, 22 bp, Artificial Sequence
  chemically synthesized
tttttcattcaacatcttacgg

SEQ ID NO: 1310156 - DNA, 22 bp, Artificial Sequence
  chemically synthesized
ttcattcaacatcttacgggat

SEQ ID NO: 1310157 - DNA, 22 bp, Artificial Sequence
  chemically synthesized
taaagaacattgatcccgtaag

SEQ ID NO: 1310158 - DNA, 22 bp, Artificial Sequence
  chemically synthesized
tcattcaacatcttacgggatc

SEQ ID NO: 1310159 - DNA, 22 bp, Artificial Sequence
  chemically synthesized
cattcaacatcttacgggatca

SEQ ID NO: 1310160 - DNA, 22 bp, Artificial Sequence
  chemically synthesized
attcaacatcttacgggatcaa

SEQ ID NO: 1310161 - DNA, 22 bp, Artificial Sequence
  chemically synthesized
aacatcttacgggatcaatgtt

SEQ ID NO: 1310162 - DNA, 22 bp, Artificial Sequence
  chemically synthesized
caaatggaaattgtaaagaaca

SEQ ID NO: 1310163 - DNA, 22 bp, Artificial Sequence
  chemically synthesized
ccaaatggaaattgtaaagaac

SEQ ID NO: 1310164 - DNA, 22 bp, Artificial Sequence
  chemically synthesized
acgggatcaatgttctttacaa

SEQ ID NO: 1310165 - DNA, 22 bp, Artificial Sequence
  chemically synthesized
cgggatcaatgttctttacaat

SEQ ID NO: 1310166 - DNA, 22 bp, Artificial Sequence
  chemically synthesized
gaacagcatttccaaatggaaa

SEQ ID NO: 1310167 - DNA, 22 bp, Artificial Sequence
  chemically synthesized
tttacaatttccatttggaaat

SEQ ID NO: 1310168 - DNA, 22 bp, Artificial Sequence
  chemically synthesized
tacaatttccatttggaaatgc

SEQ ID NO: 1310169 - DNA, 22 bp, Artificial Sequence
  chemically synthesized
acaatttccatttggaaatgct

SEQ ID NO: 1310170 - DNA, 22 bp, Artificial Sequence
  chemically synthesized
caatttccatttggaaatgctg

SEQ ID NO: 1310171 - DNA, 22 bp, Artificial Sequence
  chemically synthesized
ccatttggaaatgctgttctag

SEQ ID NO: 1310172 - DNA, 22 bp, Artificial Sequence
  chemically synthesized
catttggaaatgctgttctaga

SEQ ID NO: 1310173 - DNA, 22 bp, Artificial Sequence
  chemically synthesized
tataacggatgagtctagaaca

SEQ ID NO: 1310174 - DNA, 22 bp, Artificial Sequence
  chemically synthesized
atataacggatgagtctagaac

SEQ ID NO: 1310175 - DNA, 22 bp, Artificial Sequence
  chemically synthesized
ggaaatgctgttctagactcat

SEQ ID NO: 1310176 - DNA, 22 bp, Artificial Sequence
  chemically synthesized
gaaatgctgttctagactcatc

SEQ ID NO: 1310177 - DNA, 22 bp, Artificial Sequence
  chemically synthesized
aatgtataatttatataacgga

SEQ ID NO: 1310178 - DNA, 22 bp, Artificial Sequence
  chemically synthesized
ttctagactcatccgttatata

SEQ ID NO: 1310179 - DNA, 22 bp, Artificial Sequence
  chemically synthesized
aaatgtataatttatataacgg

SEQ ID NO: 1310180 - DNA, 22 bp, Artificial Sequence
  chemically synthesized
ttaaatgtataatttatataac

SEQ ID NO: 1310181 - DNA, 22 bp, Artificial Sequence
  chemically synthesized
tagactcatccgttatataaat

SEQ ID NO: 1310182 - DNA, 22 bp, Artificial Sequence
  chemically synthesized
gactcatccgttatataaatta

SEQ ID NO: 1310183 - DNA, 22 bp, Artificial Sequence
  chemically synthesized
atccgttatataaattatacat

SEQ ID NO: 1310184 - DNA, 22 bp, Artificial Sequence
  chemically synthesized
gaaccaacatcctcttaaatgt

SEQ ID NO: 1310185 - DNA, 22 bp, Artificial Sequence
  chemically synthesized
agaaccaacatcctcttaaatg

SEQ ID NO: 1310186 - DNA, 22 bp, Artificial Sequence
  chemically synthesized
tataaattatacatttaagagg

SEQ ID NO: 1310187 - DNA, 22 bp, Artificial Sequence
  chemically synthesized
aagtatttagaaccaacatcct

SEQ ID NO: 1310188 - DNA, 22 bp, Artificial Sequence
  chemically synthesized
tacatttaagaggatgttggtt

SEQ ID NO: 1310189 - DNA, 22 bp, Artificial Sequence
  chemically synthesized
aagaggatgttggttctaaata

SEQ ID NO: 1310190 - DNA, 22 bp, Artificial Sequence
  chemically synthesized
agaggatgttggttctaaatac

SEQ ID NO: 1310191 - DNA, 22 bp, Artificial Sequence
  chemically synthesized
atagcaagttaaagtatttaga

SEQ ID NO: 1310192 - DNA, 22 bp, Artificial Sequence
  chemically synthesized
gatagcaagttaaagtatttag

SEQ ID NO: 1310193 - DNA, 22 bp, Artificial Sequence
  chemically synthesized
ccttgatagcaagttaaagtat

SEQ ID NO: 1310194 - DNA, 22 bp, Artificial Sequence
  chemically synthesized
tgccttgatagcaagttaaagt

SEQ ID NO: 1310195 - DNA, 22 bp, Artificial Sequence
  chemically synthesized
ctgccttgatagcaagttaaag

SEQ ID NO: 1310196 - DNA, 22 bp, Artificial Sequence
  chemically synthesized
gttctaaatactttaacttgct

SEQ ID NO: 1310197 - DNA, 22 bp, Artificial Sequence
  chemically synthesized
aatttctgccttgatagcaagt

SEQ ID NO: 1310198 - DNA, 22 bp, Artificial Sequence
  chemically synthesized
taaatactttaacttgctatca

SEQ ID NO: 1310199 - DNA, 22 bp, Artificial Sequence
  chemically synthesized
aaatttctgccttgatagcaag

SEQ ID NO: 1310200 - DNA, 22 bp, Artificial Sequence
  chemically synthesized
taaatttctgccttgatagcaa

SEQ ID NO: 1310201 - DNA, 22 bp, Artificial Sequence
  chemically synthesized
aatactttaacttgctatcaag

SEQ ID NO: 1310202 - DNA, 22 bp, Artificial Sequence
  chemically synthesized
ttaaatttctgccttgatagca

SEQ ID NO: 1310203 - DNA, 22 bp, Artificial Sequence
  chemically synthesized
cttttaaatttctgccttgata

SEQ ID NO: 1310204 - DNA, 22 bp, Artificial Sequence
  chemically synthesized
gcttttaaatttctgccttgat

SEQ ID NO: 1310205 - DNA, 22 bp, Artificial Sequence
  chemically synthesized
taacttgctatcaaggcagaaa

SEQ ID NO: 1310206 - DNA, 22 bp, Artificial Sequence
  chemically synthesized
aacttgctatcaaggcagaaat

SEQ ID NO: 1310207 - DNA, 22 bp, Artificial Sequence
  chemically synthesized
acttgctatcaaggcagaaatt

SEQ ID NO: 1310208 - DNA, 22 bp, Artificial Sequence
  chemically synthesized
gctatcaaggcagaaatttaaa

SEQ ID NO: 1310209 - DNA, 22 bp, Artificial Sequence
  chemically synthesized
ctatcaaggcagaaatttaaaa

SEQ ID NO: 1310210 - DNA, 22 bp, Artificial Sequence
  chemically synthesized
tcaaggcagaaatttaaaagca

SEQ ID NO: 1310211 - DNA, 22 bp, Artificial Sequence
  chemically synthesized
aaaagcaaatttgctcttgtta

SEQ ID NO: 1310212 - DNA, 22 bp, Artificial Sequence
  chemically synthesized
aaagcaaatttgctcttgttac

SEQ ID NO: 1310213 - DNA, 22 bp, Artificial Sequence
  chemically synthesized
gatataaaagagaataacgtaa

SEQ ID NO: 1310214 - DNA, 22 bp, Artificial Sequence
  chemically synthesized
ggatataaaagagaataacgta

SEQ ID NO: 1310215 - DNA, 22 bp, Artificial Sequence
  chemically synthesized
ttggatataaaagagaataacg

SEQ ID NO: 1310216 - DNA, 22 bp, Artificial Sequence
  chemically synthesized
gctcttgttacgttattctctt

SEQ ID NO: 1310217 - DNA, 22 bp, Artificial Sequence
  chemically synthesized
tcttggatataaaagagaataa

SEQ ID NO: 1310218 - DNA, 22 bp, Artificial Sequence
  chemically synthesized
ctcttgttacgttattctcttt

SEQ ID NO: 1310219 - DNA, 22 bp, Artificial Sequence
  chemically synthesized
ctcttggatataaaagagaata

SEQ ID NO: 1310220 - DNA, 22 bp, Artificial Sequence
  chemically synthesized
tctcttggatataaaagagaat

SEQ ID NO: 1310221 - DNA, 22 bp, Artificial Sequence
  chemically synthesized
ttctcttggatataaaagagaa

SEQ ID NO: 1310222 - DNA, 22 bp, Artificial Sequence
  chemically synthesized
ttgttacgttattctcttttat

SEQ ID NO: 1310223 - DNA, 22 bp, Artificial Sequence
  chemically synthesized
tttctcttggatataaaagaga

SEQ ID NO: 1310224 - DNA, 22 bp, Artificial Sequence
  chemically synthesized
gttacgttattctcttttatat

SEQ ID NO: 1310225 - DNA, 22 bp, Artificial Sequence
  chemically synthesized
tttttctcttggatataaaaga

SEQ ID NO: 1310226 - DNA, 22 bp, Artificial Sequence
  chemically synthesized
ttacgttattctcttttatatc

SEQ ID NO: 1310227 - DNA, 22 bp, Artificial Sequence
  chemically synthesized
cgttattctcttttatatccaa

SEQ ID NO: 1310228 - DNA, 22 bp, Artificial Sequence
  chemically synthesized
acattctttttctcttggatat

SEQ ID NO: 1310229 - DNA, 22 bp, Artificial Sequence
  chemically synthesized
aacattctttttctcttggata

SEQ ID NO: 1310230 - DNA, 22 bp, Artificial Sequence
  chemically synthesized
ttctcttttatatccaagagaa

SEQ ID NO: 1310231 - DNA, 22 bp, Artificial Sequence
  chemically synthesized
tcttttatatccaagagaaaaa

SEQ ID NO: 1310232 - DNA, 22 bp, Artificial Sequence
  chemically synthesized
aacttaacattctttttctctt

SEQ ID NO: 1310233 - DNA, 22 bp, Artificial Sequence
  chemically synthesized
caacttaacattctttttctct

SEQ ID NO: 1310234 - DNA, 22 bp, Artificial Sequence
  chemically synthesized
ttttatatccaagagaaaaaga

SEQ ID NO: 1310235 - DNA, 22 bp, Artificial Sequence
  chemically synthesized
tcaacttaacattctttttctc

SEQ ID NO: 1310236 - DNA, 22 bp, Artificial Sequence
  chemically synthesized
ttatatccaagagaaaaagaat

SEQ ID NO: 1310237 - DNA, 22 bp, Artificial Sequence
  chemically synthesized
tatatccaagagaaaaagaatg

SEQ ID NO: 1310238 - DNA, 22 bp, Artificial Sequence
  chemically synthesized
atatccaagagaaaaagaatgt

SEQ ID NO: 1310239 - DNA, 22 bp, Artificial Sequence
  chemically synthesized
tatccaagagaaaaagaatgtt

SEQ ID NO: 1310240 - DNA, 22 bp, Artificial Sequence
  chemically synthesized
agcaaaataactttcaacttaa

SEQ ID NO: 1310241 - DNA, 22 bp, Artificial Sequence
  chemically synthesized
taagtgtccctgagcaaaataa

SEQ ID NO: 1310242 - DNA, 22 bp, Artificial Sequence
  chemically synthesized
gtaagtgtccctgagcaaaata

SEQ ID NO: 1310243 - DNA, 22 bp, Artificial Sequence
  chemically synthesized
tgtaagtgtccctgagcaaaat

SEQ ID NO: 1310244 - DNA, 22 bp, Artificial Sequence
  chemically synthesized
agttgaaagttattttgctcag

SEQ ID NO: 1310245 - DNA, 22 bp, Artificial Sequence
  chemically synthesized
aaagttattttgctcagggaca

SEQ ID NO: 1310246 - DNA, 22 bp, Artificial Sequence
  chemically synthesized
ttttgctcagggacacttacaa

SEQ ID NO: 1310247 - DNA, 22 bp, Artificial Sequence
  chemically synthesized
tgctcagggacacttacaaaga

SEQ ID NO: 1310248 - DNA, 22 bp, Artificial Sequence
  chemically synthesized
aatgtgtatatatctttgtaag

SEQ ID NO: 1310249 - DNA, 22 bp, Artificial Sequence
  chemically synthesized
gctcagggacacttacaaagat

SEQ ID NO: 1310250 - DNA, 22 bp, Artificial Sequence
  chemically synthesized
ctcagggacacttacaaagata

SEQ ID NO: 1310251 - DNA, 22 bp, Artificial Sequence
  chemically synthesized
ctgaatgtgtatatatctttgt

SEQ ID NO: 1310252 - DNA, 22 bp, Artificial Sequence
  chemically synthesized
agggacacttacaaagatatat

SEQ ID NO: 1310253 - DNA, 22 bp, Artificial Sequence
  chemically synthesized
acaaagatatatacacattcag

SEQ ID NO: 1310254 - DNA, 22 bp, Artificial Sequence
  chemically synthesized
caaagatatatacacattcagt

SEQ ID NO: 1310255 - DNA, 22 bp, Artificial Sequence
  chemically synthesized
aaatgtaatgtcatgcaagtgt

SEQ ID NO: 1310256 - DNA, 22 bp, Artificial Sequence
  chemically synthesized
caaatgtaatgtcatgcaagtg

SEQ ID NO: 1310257 - DNA, 22 bp, Artificial Sequence
  chemically synthesized
agtagacacttgcatgacatta

SEQ ID NO: 1310258 - DNA, 22 bp, Artificial Sequence
  chemically synthesized
gcatgacattacatttgaaatt

SEQ ID NO: 1310259 - DNA, 22 bp, Artificial Sequence
  chemically synthesized
aaagatatatccaatttcaaat

SEQ ID NO: 1310260 - DNA, 22 bp, Artificial Sequence
  chemically synthesized
catgacattacatttgaaattg

SEQ ID NO: 1310261 - DNA, 22 bp, Artificial Sequence
  chemically synthesized
catttgaaattggatatatctt

SEQ ID NO: 1310262 - DNA, 22 bp, Artificial Sequence
  chemically synthesized
tgtataaaaagctaaaagatat

SEQ ID NO: 1310263 - DNA, 22 bp, Artificial Sequence
  chemically synthesized
gaaattggatatatcttttagc

SEQ ID NO: 1310264 - DNA, 22 bp, Artificial Sequence
  chemically synthesized
aaattggatatatcttttagct

SEQ ID NO: 1310265 - DNA, 22 bp, Artificial Sequence
  chemically synthesized
tgatctgtgtataaaaagctaa

SEQ ID NO: 1310266 - DNA, 22 bp, Artificial Sequence
  chemically synthesized
gatatatcttttagctttttat

SEQ ID NO: 1310267 - DNA, 22 bp, Artificial Sequence
  chemically synthesized
catactatgatctgtgtataaa

SEQ ID NO: 1310268 - DNA, 22 bp, Artificial Sequence
  chemically synthesized
ttagctttttatacacagatca

SEQ ID NO: 1310269 - DNA, 22 bp, Artificial Sequence
  chemically synthesized
tagctttttatacacagatcat

SEQ ID NO: 1310270 - DNA, 22 bp, Artificial Sequence
  chemically synthesized
agctttttatacacagatcata

SEQ ID NO: 1310271 - DNA, 22 bp, Artificial Sequence
  chemically synthesized
aaatctgcatactatgatctgt

SEQ ID NO: 1310272 - DNA, 22 bp, Artificial Sequence
  chemically synthesized
gctttttatacacagatcatag

SEQ ID NO: 1310273 - DNA, 22 bp, Artificial Sequence
  chemically synthesized
aaaatctgcatactatgatctg

SEQ ID NO: 1310274 - DNA, 22 bp, Artificial Sequence
  chemically synthesized
tttatacacagatcatagtatg

SEQ ID NO: 1310275 - DNA, 22 bp, Artificial Sequence
  chemically synthesized
ttatacacagatcatagtatgc

SEQ ID NO: 1310276 - DNA, 22 bp, Artificial Sequence
  chemically synthesized
tatacacagatcatagtatgca

SEQ ID NO: 1310277 - DNA, 22 bp, Artificial Sequence
  chemically synthesized
atacacagatcatagtatgcag

SEQ ID NO: 1310278 - DNA, 22 bp, Artificial Sequence
  chemically synthesized
tacacagatcatagtatgcaga

SEQ ID NO: 1310279 - DNA, 22 bp, Artificial Sequence
  chemically synthesized
caccacttaaaatctgcatact

SEQ ID NO: 1310280 - DNA, 22 bp, Artificial Sequence
  chemically synthesized
ccaccacttaaaatctgcatac

SEQ ID NO: 1310281 - DNA, 22 bp, Artificial Sequence
  chemically synthesized
tccaccacttaaaatctgcata

SEQ ID NO: 1310282 - DNA, 22 bp, Artificial Sequence
  chemically synthesized
attttccaccacttaaaatctg

SEQ ID NO: 1310283 - DNA, 22 bp, Artificial Sequence
  chemically synthesized
aaagattcattttccaccactt

SEQ ID NO: 1310284 - DNA, 22 bp, Artificial Sequence
  chemically synthesized
aatgttaaaagattcattttcc

SEQ ID NO: 1310285 - DNA, 22 bp, Artificial Sequence
  chemically synthesized
gaatgttaaaagattcattttc

SEQ ID NO: 1310286 - DNA, 22 bp, Artificial Sequence
  chemically synthesized
tgaatgttaaaagattcatttt

SEQ ID NO: 1310287 - DNA, 22 bp, Artificial Sequence
  chemically synthesized
taagtggtggaaaatgaatctt

SEQ ID NO: 1310288 - DNA, 22 bp, Artificial Sequence
  chemically synthesized
aagtggtggaaaatgaatcttt

SEQ ID NO: 1310289 - DNA, 22 bp, Artificial Sequence
  chemically synthesized
agtggtggaaaatgaatctttt

SEQ ID NO: 1310290 - DNA, 22 bp, Artificial Sequence
  chemically synthesized
atcactttgaatgttaaaagat

SEQ ID NO: 1310291 - DNA, 22 bp, Artificial Sequence
  chemically synthesized
caaagctcatcactttgaatgt

SEQ ID NO: 1310292 - DNA, 22 bp, Artificial Sequence
  chemically synthesized
tccaaagctcatcactttgaat

SEQ ID NO: 1310293 - DNA, 22 bp, Artificial Sequence
  chemically synthesized
ctccaaagctcatcactttgaa

SEQ ID NO: 1310294 - DNA, 22 bp, Artificial Sequence
  chemically synthesized
ttaacattcaaagtgatgagct

SEQ ID NO: 1310295 - DNA, 22 bp, Artificial Sequence
  chemically synthesized
taacattcaaagtgatgagctt

SEQ ID NO: 1310296 - DNA, 22 bp, Artificial Sequence
  chemically synthesized
aacattcaaagtgatgagcttt

SEQ ID NO: 1310297 - DNA, 22 bp, Artificial Sequence
  chemically synthesized
acattcaaagtgatgagctttg

SEQ ID NO: 1310298 - DNA, 22 bp, Artificial Sequence
  chemically synthesized
aaacagccttctccaaagctca

SEQ ID NO: 1310299 - DNA, 22 bp, Artificial Sequence
  chemically synthesized
aaagtgatgagctttggagaag

SEQ ID NO: 1310300 - DNA, 22 bp, Artificial Sequence
  chemically synthesized
cagtataacagattaaaacagc

SEQ ID NO: 1310301 - DNA, 22 bp, Artificial Sequence
  chemically synthesized
tggagaaggctgttttaatctg

SEQ ID NO: 1310302 - DNA, 22 bp, Artificial Sequence
  chemically synthesized
ggagaaggctgttttaatctgt

SEQ ID NO: 1310303 - DNA, 22 bp, Artificial Sequence
  chemically synthesized
gagaaggctgttttaatctgtt

SEQ ID NO: 1310304 - DNA, 22 bp, Artificial Sequence
  chemically synthesized
cacctgcagtataacagattaa

SEQ ID NO: 1310305 - DNA, 22 bp, Artificial Sequence
  chemically synthesized
ttttaatctgttatactgcagg

SEQ ID NO: 1310306 - DNA, 22 bp, Artificial Sequence
  chemically synthesized
taatctgttatactgcaggtgt

SEQ ID NO: 1310307 - DNA, 22 bp, Artificial Sequence
  chemically synthesized
aatctgttatactgcaggtgta

SEQ ID NO: 1310308 - DNA, 22 bp, Artificial Sequence
  chemically synthesized
atctgttatactgcaggtgtaa

SEQ ID NO: 1310309 - DNA, 22 bp, Artificial Sequence
  chemically synthesized
caagtgtaccaggagttacacc

SEQ ID NO: 1310310 - DNA, 22 bp, Artificial Sequence
  chemically synthesized
ttatactgcaggtgtaactcct

SEQ ID NO: 1310311 - DNA, 22 bp, Artificial Sequence
  chemically synthesized
tactgcaggtgtaactcctggt

SEQ ID NO: 1310312 - DNA, 22 bp, Artificial Sequence
  chemically synthesized
acctacaagtgtaccaggagtt

SEQ ID NO: 1310313 - DNA, 22 bp, Artificial Sequence
  chemically synthesized
ctaacctacaagtgtaccagga

SEQ ID NO: 1310314 - DNA, 22 bp, Artificial Sequence
  chemically synthesized
caggtgtaactcctggtacact

SEQ ID NO: 1310315 - DNA, 22 bp, Artificial Sequence
  chemically synthesized
caatatcactactaacctacaa

SEQ ID NO: 1310316 - DNA, 22 bp, Artificial Sequence
  chemically synthesized
ctggtacacttgtaggttagta

SEQ ID NO: 1310317 - DNA, 22 bp, Artificial Sequence
  chemically synthesized
gtacacttgtaggttagtagtg

SEQ ID NO: 1310318 - DNA, 22 bp, Artificial Sequence
  chemically synthesized
gtaggttagtagtgatattgta

SEQ ID NO: 1310319 - DNA, 22 bp, Artificial Sequence
  chemically synthesized
taggttagtagtgatattgtag

SEQ ID NO: 1310320 - DNA, 22 bp, Artificial Sequence
  chemically synthesized
atccatcgaatatgcctacaat

SEQ ID NO: 1310321 - DNA, 22 bp, Artificial Sequence
  chemically synthesized
gtagtgatattgtaggcatatt

SEQ ID NO: 1310322 - DNA, 22 bp, Artificial Sequence
  chemically synthesized
catatatattgatccatcgaat

SEQ ID NO: 1310323 - DNA, 22 bp, Artificial Sequence
  chemically synthesized
taggcatattcgatggatcaat

SEQ ID NO: 1310324 - DNA, 22 bp, Artificial Sequence
  chemically synthesized
aatatcaagtactccatatata

SEQ ID NO: 1310325 - DNA, 22 bp, Artificial Sequence
  chemically synthesized
gatggatcaatatatatggagt

SEQ ID NO: 1310326 - DNA, 22 bp, Artificial Sequence
  chemically synthesized
aatatctgaatatcaagtactc

SEQ ID NO: 1310327 - DNA, 22 bp, Artificial Sequence
  chemically synthesized
aggcatcggggagaactgaata

SEQ ID NO: 1310328 - DNA, 22 bp, Artificial Sequence
  chemically synthesized
gatattcagatattcagttctc

SEQ ID NO: 1310329 - DNA, 22 bp, Artificial Sequence
  chemically synthesized
atattcagatattcagttctcc

SEQ ID NO: 1310330 - DNA, 22 bp, Artificial Sequence
  chemically synthesized
agatattcagttctccccgatg

SEQ ID NO: 1310331 - DNA, 22 bp, Artificial Sequence
  chemically synthesized
agttctccccgatgccttaatc

SEQ ID NO: 1310332 - DNA, 22 bp, Artificial Sequence
  chemically synthesized
caaaaacaacacccagattaag

SEQ ID NO: 1310333 - DNA, 22 bp, Artificial Sequence
  chemically synthesized
tccccgatgccttaatctgggt

SEQ ID NO: 1310334 - DNA, 22 bp, Artificial Sequence
  chemically synthesized
cccgatgccttaatctgggtgt

SEQ ID NO: 1310335 - DNA, 22 bp, Artificial Sequence
  chemically synthesized
accactgcaaaaacaacaccca

SEQ ID NO: 1310336 - DNA, 22 bp, Artificial Sequence
  chemically synthesized
ctaaccactgcaaaaacaacac

SEQ ID NO: 1310337 - DNA, 22 bp, Artificial Sequence
  chemically synthesized
ctcctaaccactgcaaaaacaa

SEQ ID NO: 1310338 - DNA, 22 bp, Artificial Sequence
  chemically synthesized
cctcctaaccactgcaaaaaca

SEQ ID NO: 1310339 - DNA, 22 bp, Artificial Sequence
  chemically synthesized
aatctgggtgttgtttttgcag

SEQ ID NO: 1310340 - DNA, 22 bp, Artificial Sequence
  chemically synthesized
atctgggtgttgtttttgcagt

SEQ ID NO: 1310341 - DNA, 22 bp, Artificial Sequence
  chemically synthesized
cttcctcctaaccactgcaaaa

SEQ ID NO: 1310342 - DNA, 22 bp, Artificial Sequence
  chemically synthesized
tccttcctcctaaccactgcaa

SEQ ID NO: 1310343 - DNA, 22 bp, Artificial Sequence
  chemically synthesized
ggtgttgtttttgcagtggtta

SEQ ID NO: 1310344 - DNA, 22 bp, Artificial Sequence
  chemically synthesized
ctctccttcctcctaaccactg

SEQ ID NO: 1310345 - DNA, 22 bp, Artificial Sequence
  chemically synthesized
tttttgcagtggttaggaggaa

SEQ ID NO: 1310346 - DNA, 22 bp, Artificial Sequence
  chemically synthesized
gcacctcctctccttcctccta

SEQ ID NO: 1310347 - DNA, 22 bp, Artificial Sequence
  chemically synthesized
ggcacctcctctccttcctcct

SEQ ID NO: 1310348 - DNA, 22 bp, Artificial Sequence
  chemically synthesized
ttgcagtggttaggaggaagga

SEQ ID NO: 1310349 - DNA, 22 bp, Artificial Sequence
  chemically synthesized
tgcagtggttaggaggaaggag

SEQ ID NO: 1310350 - DNA, 22 bp, Artificial Sequence
  chemically synthesized
gcagtggttaggaggaaggaga

SEQ ID NO: 1310351 - DNA, 22 bp, Artificial Sequence
  chemically synthesized
cagtggttaggaggaaggagag

SEQ ID NO: 1310352 - DNA, 22 bp, Artificial Sequence
  chemically synthesized
aatcttggcacctcctctcctt

SEQ ID NO: 1310353 - DNA, 22 bp, Artificial Sequence
  chemically synthesized
ggaggaaggagaggaggtgcca

SEQ ID NO: 1310354 - DNA, 22 bp, Artificial Sequence
  chemically synthesized
cagtgtctgaatcttggcacct

SEQ ID NO: 1310355 - DNA, 22 bp, Artificial Sequence
  chemically synthesized
tgcagtgtctgaatcttggcac

SEQ ID NO: 1310356 - DNA, 22 bp, Artificial Sequence
  chemically synthesized
ctgcagtgtctgaatcttggca

SEQ ID NO: 1310357 - DNA, 22 bp, Artificial Sequence
  chemically synthesized
ttctgcagtgtctgaatcttgg

SEQ ID NO: 1310358 - DNA, 22 bp, Artificial Sequence
  chemically synthesized
tataatcctcttctgcagtgtc

SEQ ID NO: 1310359 - DNA, 22 bp, Artificial Sequence
  chemically synthesized
atataatcctcttctgcagtgt

SEQ ID NO: 1310360 - DNA, 22 bp, Artificial Sequence
  chemically synthesized
cttatataatcctcttctgcag

SEQ ID NO: 1310361 - DNA, 22 bp, Artificial Sequence
  chemically synthesized
tgcttatataatcctcttctgc

SEQ ID NO: 1310362 - DNA, 22 bp, Artificial Sequence
  chemically synthesized
ctgcttatataatcctcttctg

SEQ ID NO: 1310363 - DNA, 22 bp, Artificial Sequence
  chemically synthesized
tttctgcttatataatcctctt

SEQ ID NO: 1310364 - DNA, 22 bp, Artificial Sequence
  chemically synthesized
agacactgcagaagaggattat

SEQ ID NO: 1310365 - DNA, 22 bp, Artificial Sequence
  chemically synthesized
cagaagaggattatataagcag

SEQ ID NO: 1310366 - DNA, 22 bp, Artificial Sequence
  chemically synthesized
tataagcagaaataattccatg

SEQ ID NO: 1310367 - DNA, 22 bp, Artificial Sequence
  chemically synthesized
tagtaaacaggtacaaaaccgc

SEQ ID NO: 1310368 - DNA, 22 bp, Artificial Sequence
  chemically synthesized
gtagtaaacaggtacaaaaccg

SEQ ID NO: 1310369 - DNA, 22 bp, Artificial Sequence
  chemically synthesized
atttgtagtaaacaggtacaaa

SEQ ID NO: 1310370 - DNA, 22 bp, Artificial Sequence
  chemically synthesized
catgatgcggttttgtacctgt

SEQ ID NO: 1310371 - DNA, 22 bp, Artificial Sequence
  chemically synthesized
gatttgtagtaaacaggtacaa

SEQ ID NO: 1310372 - DNA, 22 bp, Artificial Sequence
  chemically synthesized
tgatttgtagtaaacaggtaca

SEQ ID NO: 1310373 - DNA, 22 bp, Artificial Sequence
  chemically synthesized
tgtacctgtttactacaaatca

SEQ ID NO: 1310374 - DNA, 22 bp, Artificial Sequence
  chemically synthesized
gtacctgtttactacaaatcaa

SEQ ID NO: 1310375 - DNA, 22 bp, Artificial Sequence
  chemically synthesized
tgtcagccacctttgatttgta

SEQ ID NO: 1310376 - DNA, 22 bp, Artificial Sequence
  chemically synthesized
tacctgtttactacaaatcaaa

SEQ ID NO: 1310377 - DNA, 22 bp, Artificial Sequence
  chemically synthesized
tttactacaaatcaaaggtggc

SEQ ID NO: 1310378 - DNA, 22 bp, Artificial Sequence
  chemically synthesized
actacaaatcaaaggtggctga

SEQ ID NO: 1310379 - DNA, 22 bp, Artificial Sequence
  chemically synthesized
ctacaaatcaaaggtggctgac

SEQ ID NO: 1310380 - DNA, 22 bp, Artificial Sequence
  chemically synthesized
gggacaaagttgtgtcagccac

SEQ ID NO: 1310381 - DNA, 22 bp, Artificial Sequence
  chemically synthesized
caaatcaaaggtggctgacaca

SEQ ID NO: 1310382 - DNA, 22 bp, Artificial Sequence
  chemically synthesized
ctggggacaaagttgtgtcagc

SEQ ID NO: 1310383 - DNA, 22 bp, Artificial Sequence
  chemically synthesized
tagaattcctggggacaaagtt

SEQ ID NO: 1310384 - DNA, 22 bp, Artificial Sequence
  chemically synthesized
accattatagaattcctgggga

SEQ ID NO: 1310385 - DNA, 22 bp, Artificial Sequence
  chemically synthesized
acacaactttgtccccaggaat

SEQ ID NO: 1310386 - DNA, 22 bp, Artificial Sequence
  chemically synthesized
tcgtctaaccattatagaattc

SEQ ID NO: 1310387 - DNA, 22 bp, Artificial Sequence
  chemically synthesized
tgtccccaggaattctataatg

SEQ ID NO: 1310388 - DNA, 22 bp, Artificial Sequence
  chemically synthesized
gtccccaggaattctataatgg

SEQ ID NO: 1310389 - DNA, 22 bp, Artificial Sequence
  chemically synthesized
tccccaggaattctataatggt

SEQ ID NO: 1310390 - DNA, 22 bp, Artificial Sequence
  chemically synthesized
cagctatcgtctaaccattata

SEQ ID NO: 1310391 - DNA, 22 bp, Artificial Sequence
  chemically synthesized
acagctatcgtctaaccattat

SEQ ID NO: 1310392 - DNA, 22 bp, Artificial Sequence
  chemically synthesized
tataatggttagacgatagctg

SEQ ID NO: 1310393 - DNA, 22 bp, Artificial Sequence
  chemically synthesized
taatggttagacgatagctgta

SEQ ID NO: 1310394 - DNA, 22 bp, Artificial Sequence
  chemically synthesized
gacgatagctgtaaatacgctc

SEQ ID NO: 1310395 - DNA, 22 bp, Artificial Sequence
  chemically synthesized
gaaggaacacaggagcgtattt

SEQ ID NO: 1310396 - DNA, 22 bp, Artificial Sequence
  chemically synthesized
tggaaggaacacaggagcgtat

SEQ ID NO: 1310397 - DNA, 22 bp, Artificial Sequence
  chemically synthesized
taaatacgctcctgtgttcctt

SEQ ID NO: 1310398 - DNA, 22 bp, Artificial Sequence
  chemically synthesized
ccacacacctctggaaggaaca

SEQ ID NO: 1310399 - DNA, 22 bp, Artificial Sequence
  chemically synthesized
cccacacacctctggaaggaac

SEQ ID NO: 1310400 - DNA, 22 bp, Artificial Sequence
  chemically synthesized
agggtttcccacacacctctgg

SEQ ID NO: 1310401 - DNA, 22 bp, Artificial Sequence
  chemically synthesized
ctgtgttccttccagaggtgtg

SEQ ID NO: 1310402 - DNA, 22 bp, Artificial Sequence
  chemically synthesized
tcagggtttcccacacacctct

SEQ ID NO: 1310403 - DNA, 22 bp, Artificial Sequence
  chemically synthesized
tgttccttccagaggtgtgtgg

SEQ ID NO: 1310404 - DNA, 22 bp, Artificial Sequence
  chemically synthesized
cttccagaggtgtgtgggaaac

SEQ ID NO: 1310405 - DNA, 22 bp, Artificial Sequence
  chemically synthesized
ccagaggtgtgtgggaaaccct

SEQ ID NO: 1310406 - DNA, 22 bp, Artificial Sequence
  chemically synthesized
cagaggtgtgtgggaaaccctg

SEQ ID NO: 1310407 - DNA, 22 bp, Artificial Sequence
  chemically synthesized
ggggcaaatgcacaccccattc

SEQ ID NO: 1310408 - DNA, 22 bp, Artificial Sequence
  chemically synthesized
actaggggcaaatgcacacccc

SEQ ID NO: 1310409 - DNA, 22 bp, Artificial Sequence
  chemically synthesized
aactaggggcaaatgcacaccc

SEQ ID NO: 1310410 - DNA, 22 bp, Artificial Sequence
  chemically synthesized
agaatggggtgtgcatttgccc

SEQ ID NO: 1310411 - DNA, 22 bp, Artificial Sequence
  chemically synthesized
acccttaactaggggcaaatgc

SEQ ID NO: 1310412 - DNA, 22 bp, Artificial Sequence
  chemically synthesized
gttgacccttaactaggggcaa

SEQ ID NO: 1310413 - DNA, 22 bp, Artificial Sequence
  chemically synthesized
cgttgacccttaactaggggca

SEQ ID NO: 1310414 - DNA, 22 bp, Artificial Sequence
  chemically synthesized
gatttcgttgacccttaactag

SEQ ID NO: 1310415 - DNA, 22 bp, Artificial Sequence
  chemically synthesized
agatttcgttgacccttaacta

SEQ ID NO: 1310416 - DNA, 22 bp, Artificial Sequence
  chemically synthesized
ccttagatttcgttgaccctta

SEQ ID NO: 1310417 - DNA, 22 bp, Artificial Sequence
  chemically synthesized
tgccttagatttcgttgaccct

SEQ ID NO: 1310418 - DNA, 22 bp, Artificial Sequence
  chemically synthesized
gcccctagttaagggtcaacga

SEQ ID NO: 1310419 - DNA, 22 bp, Artificial Sequence
  chemically synthesized
cccctagttaagggtcaacgaa

SEQ ID NO: 1310420 - DNA, 22 bp, Artificial Sequence
  chemically synthesized
aattctgccttagatttcgttg

SEQ ID NO: 1310421 - DNA, 22 bp, Artificial Sequence
  chemically synthesized
gttaagggtcaacgaaatctaa

SEQ ID NO: 1310422 - DNA, 22 bp, Artificial Sequence
  chemically synthesized
tagctgaattctgccttagatt

SEQ ID NO: 1310423 - DNA, 22 bp, Artificial Sequence
  chemically synthesized
agggtcaacgaaatctaaggca

SEQ ID NO: 1310424 - DNA, 22 bp, Artificial Sequence
  chemically synthesized
aacctgtagctgaattctgcct

SEQ ID NO: 1310425 - DNA, 22 bp, Artificial Sequence
  chemically synthesized
taaacctgtagctgaattctgc

SEQ ID NO: 1310426 - DNA, 22 bp, Artificial Sequence
  chemically synthesized
tagctctaaacctgtagctgaa

SEQ ID NO: 1310427 - DNA, 22 bp, Artificial Sequence
  chemically synthesized
aggcagaattcagctacaggtt

SEQ ID NO: 1310428 - DNA, 22 bp, Artificial Sequence
  chemically synthesized
aagagactatagctctaaacct

SEQ ID NO: 1310429 - DNA, 22 bp, Artificial Sequence
  chemically synthesized
taaagagactatagctctaaac

SEQ ID NO: 1310430 - DNA, 22 bp, Artificial Sequence
  chemically synthesized
agctacaggtttagagctatag

SEQ ID NO: 1310431 - DNA, 22 bp, Artificial Sequence
  chemically synthesized
gaactctaaagagactatagct

SEQ ID NO: 1310432 - DNA, 22 bp, Artificial Sequence
  chemically synthesized
caggtttagagctatagtctct

SEQ ID NO: 1310433 - DNA, 22 bp, Artificial Sequence
  chemically synthesized
agagctatagtctctttagagt

SEQ ID NO: 1310434 - DNA, 22 bp, Artificial Sequence
  chemically synthesized
gagctatagtctctttagagtt

SEQ ID NO: 1310435 - DNA, 22 bp, Artificial Sequence
  chemically synthesized
tagtctctttagagttccaggt

SEQ ID NO: 1310436 - DNA, 22 bp, Artificial Sequence
  chemically synthesized
agtaaaagggacacctggaact

SEQ ID NO: 1310437 - DNA, 22 bp, Artificial Sequence
  chemically synthesized
aagtaaaagggacacctggaac

SEQ ID NO: 1310438 - DNA, 22 bp, Artificial Sequence
  chemically synthesized
taagtaaaagggacacctggaa

SEQ ID NO: 1310439 - DNA, 22 bp, Artificial Sequence
  chemically synthesized
tttagagttccaggtgtccctt

SEQ ID NO: 1310440 - DNA, 22 bp, Artificial Sequence
  chemically synthesized
tagagttccaggtgtccctttt

SEQ ID NO: 1310441 - DNA, 22 bp, Artificial Sequence
  chemically synthesized
agagttccaggtgtccctttta

SEQ ID NO: 1310442 - DNA, 22 bp, Artificial Sequence
  chemically synthesized
gagttccaggtgtcccttttac

SEQ ID NO: 1310443 - DNA, 22 bp, Artificial Sequence
  chemically synthesized
caggtgtcccttttacttaaaa

SEQ ID NO: 1310444 - DNA, 22 bp, Artificial Sequence
  chemically synthesized
aaatgtcagggaaaaaaagagt

SEQ ID NO: 1310445 - DNA, 22 bp, Artificial Sequence
  chemically synthesized
aaaatgtcagggaaaaaaagag

SEQ ID NO: 1310446 - DNA, 22 bp, Artificial Sequence
  chemically synthesized
ttacttaaaactctttttttcc

SEQ ID NO: 1310447 - DNA, 22 bp, Artificial Sequence
  chemically synthesized
tacttaaaactctttttttccc

SEQ ID NO: 1310448 - DNA, 22 bp, Artificial Sequence
  chemically synthesized
acttaaaactctttttttccct

SEQ ID NO: 1310449 - DNA, 22 bp, Artificial Sequence
  chemically synthesized
cttaaaactctttttttccctg

SEQ ID NO: 1310450 - DNA, 22 bp, Artificial Sequence
  chemically synthesized
tatttaaaatgtcagggaaaaa

SEQ ID NO: 1310451 - DNA, 22 bp, Artificial Sequence
  chemically synthesized
atatttaaaatgtcagggaaaa

SEQ ID NO: 1310452 - DNA, 22 bp, Artificial Sequence
  chemically synthesized
aaaactctttttttccctgaca

SEQ ID NO: 1310453 - DNA, 22 bp, Artificial Sequence
  chemically synthesized
aaactctttttttccctgacat

SEQ ID NO: 1310454 - DNA, 22 bp, Artificial Sequence
  chemically synthesized
tttttttccctgacattttaaa

SEQ ID NO: 1310455 - DNA, 22 bp, Artificial Sequence
  chemically synthesized
tttttccctgacattttaaata

SEQ ID NO: 1310456 - DNA, 22 bp, Artificial Sequence
  chemically synthesized
ttttccctgacattttaaatat

SEQ ID NO: 1310457 - DNA, 22 bp, Artificial Sequence
  chemically synthesized
tttccctgacattttaaatata

SEQ ID NO: 1310458 - DNA, 22 bp, Artificial Sequence
  chemically synthesized
ttccctgacattttaaatataa

SEQ ID NO: 1310459 - DNA, 22 bp, Artificial Sequence
  chemically synthesized
tccctgacattttaaatataag

SEQ ID NO: 1310460 - DNA, 22 bp, Artificial Sequence
  chemically synthesized
ccctgacattttaaatataagt

SEQ ID NO: 1310461 - DNA, 22 bp, Artificial Sequence
  chemically synthesized
cctgacattttaaatataagtt

SEQ ID NO: 1310462 - DNA, 22 bp, Artificial Sequence
  chemically synthesized
caaagtgaatagggaaacttat

SEQ ID NO: 1310463 - DNA, 22 bp, Artificial Sequence
  chemically synthesized
acattttaaatataagtttccc

SEQ ID NO: 1310464 - DNA, 22 bp, Artificial Sequence
  chemically synthesized
gcaaagtgaatagggaaactta

SEQ ID NO: 1310465 - DNA, 22 bp, Artificial Sequence
  chemically synthesized
tgcaaagtgaatagggaaactt

SEQ ID NO: 1310466 - DNA, 22 bp, Artificial Sequence
  chemically synthesized
taaatataagtttccctattca

SEQ ID NO: 1310467 - DNA, 22 bp, Artificial Sequence
  chemically synthesized
agctttgcaaagtgaataggga

SEQ ID NO: 1310468 - DNA, 22 bp, Artificial Sequence
  chemically synthesized
aaatataagtttccctattcac

SEQ ID NO: 1310469 - DNA, 22 bp, Artificial Sequence
  chemically synthesized
aatataagtttccctattcact

SEQ ID NO: 1310470 - DNA, 22 bp, Artificial Sequence
  chemically synthesized
actaagctttgcaaagtgaata

SEQ ID NO: 1310471 - DNA, 22 bp, Artificial Sequence
  chemically synthesized
ccctattcactttgcaaagctt

SEQ ID NO: 1310472 - DNA, 22 bp, Artificial Sequence
  chemically synthesized
cctattcactttgcaaagctta

SEQ ID NO: 1310473 - DNA, 22 bp, Artificial Sequence
  chemically synthesized
catatcagtattaactaagctt

SEQ ID NO: 1310474 - DNA, 22 bp, Artificial Sequence
  chemically synthesized
ttcactttgcaaagcttagtta

SEQ ID NO: 1310475 - DNA, 22 bp, Artificial Sequence
  chemically synthesized
ttacatatcagtattaactaag

SEQ ID NO: 1310476 - DNA, 22 bp, Artificial Sequence
  chemically synthesized
actttgcaaagcttagttaata

SEQ ID NO: 1310477 - DNA, 22 bp, Artificial Sequence
  chemically synthesized
gttacatatcagtattaactaa

SEQ ID NO: 1310478 - DNA, 22 bp, Artificial Sequence
  chemically synthesized
tgttacatatcagtattaacta

SEQ ID NO: 1310479 - DNA, 22 bp, Artificial Sequence
  chemically synthesized
ttgttacatatcagtattaact

SEQ ID NO: 1310480 - DNA, 22 bp, Artificial Sequence
  chemically synthesized
tgcaaagcttagttaatactga

SEQ ID NO: 1310481 - DNA, 22 bp, Artificial Sequence
  chemically synthesized
gcaaagcttagttaatactgat

SEQ ID NO: 1310482 - DNA, 22 bp, Artificial Sequence
  chemically synthesized
caaagcttagttaatactgata

SEQ ID NO: 1310483 - DNA, 22 bp, Artificial Sequence
  chemically synthesized
agttaatactgatatgtaacaa

SEQ ID NO: 1310484 - DNA, 22 bp, Artificial Sequence
  chemically synthesized
gttaatactgatatgtaacaaa

SEQ ID NO: 1310485 - DNA, 22 bp, Artificial Sequence
  chemically synthesized
atactgatatgtaacaaaaatt

SEQ ID NO: 1310486 - DNA, 22 bp, Artificial Sequence
  chemically synthesized
aagtgtagcgaataatttttgt

SEQ ID NO: 1310487 - DNA, 22 bp, Artificial Sequence
  chemically synthesized
atatgtaacaaaaattattcgc

SEQ ID NO: 1310488 - DNA, 22 bp, Artificial Sequence
  chemically synthesized
tggagaagagacatgctcaagt

SEQ ID NO: 1310489 - DNA, 22 bp, Artificial Sequence
  chemically synthesized
atggagaagagacatgctcaag

SEQ ID NO: 1310490 - DNA, 22 bp, Artificial Sequence
  chemically synthesized
tatggagaagagacatgctcaa

SEQ ID NO: 1310491 - DNA, 22 bp, Artificial Sequence
  chemically synthesized
ttcgctacacttgagcatgtct

SEQ ID NO: 1310492 - DNA, 22 bp, Artificial Sequence
  chemically synthesized
gctacacttgagcatgtctctt

SEQ ID NO: 1310493 - DNA, 22 bp, Artificial Sequence
  chemically synthesized
gatctttatggagaagagacat

SEQ ID NO: 1310494 - DNA, 22 bp, Artificial Sequence
  chemically synthesized
cacttgagcatgtctcttctcc

SEQ ID NO: 1310495 - DNA, 22 bp, Artificial Sequence
  chemically synthesized
aagctggatctttatggagaag

SEQ ID NO: 1310496 - DNA, 22 bp, Artificial Sequence
  chemically synthesized
gagcatgtctcttctccataaa

SEQ ID NO: 1310497 - DNA, 22 bp, Artificial Sequence
  chemically synthesized
agcatgtctcttctccataaag

SEQ ID NO: 1310498 - DNA, 22 bp, Artificial Sequence
  chemically synthesized
tctaaagctggatctttatgga

SEQ ID NO: 1310499 - DNA, 22 bp, Artificial Sequence
  chemically synthesized
ctatctaaagctggatctttat

SEQ ID NO: 1310500 - DNA, 22 bp, Artificial Sequence
  chemically synthesized
ttctccataaagatccagcttt

SEQ ID NO: 1310501 - DNA, 22 bp, Artificial Sequence
  chemically synthesized
ctccataaagatccagctttag

SEQ ID NO: 1310502 - DNA, 22 bp, Artificial Sequence
  chemically synthesized
tccataaagatccagctttaga

SEQ ID NO: 1310503 - DNA, 22 bp, Artificial Sequence
  chemically synthesized
cataaagatccagctttagata

SEQ ID NO: 1310504 - DNA, 22 bp, Artificial Sequence
  chemically synthesized
tgagaagagttgctatctaaag

SEQ ID NO: 1310505 - DNA, 22 bp, Artificial Sequence
  chemically synthesized
cagatctatgagaagagttgct

SEQ ID NO: 1310506 - DNA, 22 bp, Artificial Sequence
  chemically synthesized
acagatctatgagaagagttgc

SEQ ID NO: 1310507 - DNA, 22 bp, Artificial Sequence
  chemically synthesized
tagatagcaactcttctcatag

SEQ ID NO: 1310508 - DNA, 22 bp, Artificial Sequence
  chemically synthesized
agatagcaactcttctcataga

SEQ ID NO: 1310509 - DNA, 22 bp, Artificial Sequence
  chemically synthesized
gatagcaactcttctcatagat

SEQ ID NO: 1310510 - DNA, 22 bp, Artificial Sequence
  chemically synthesized
acaatacttacagatctatgag

SEQ ID NO: 1310511 - DNA, 22 bp, Artificial Sequence
  chemically synthesized
tcacaatacttacagatctatg

SEQ ID NO: 1310512 - DNA, 22 bp, Artificial Sequence
  chemically synthesized
ctcacaatacttacagatctat

SEQ ID NO: 1310513 - DNA, 22 bp, Artificial Sequence
  chemically synthesized
tcttctcacaatacttacagat

SEQ ID NO: 1310514 - DNA, 22 bp, Artificial Sequence
  chemically synthesized
ttctcatagatctgtaagtatt

SEQ ID NO: 1310515 - DNA, 22 bp, Artificial Sequence
  chemically synthesized
attatcttctcacaatacttac

SEQ ID NO: 1310516 - DNA, 22 bp, Artificial Sequence
  chemically synthesized
ctcatagatctgtaagtattgt

SEQ ID NO: 1310517 - DNA, 22 bp, Artificial Sequence
  chemically synthesized
aattatcttctcacaatactta

SEQ ID NO: 1310518 - DNA, 22 bp, Artificial Sequence
  chemically synthesized
tcatagatctgtaagtattgtg

SEQ ID NO: 1310519 - DNA, 22 bp, Artificial Sequence
  chemically synthesized
taattatcttctcacaatactt

SEQ ID NO: 1310520 - DNA, 22 bp, Artificial Sequence
  chemically synthesized
ttaattatcttctcacaatact

SEQ ID NO: 1310521 - DNA, 22 bp, Artificial Sequence
  chemically synthesized
atagatctgtaagtattgtgag

SEQ ID NO: 1310522 - DNA, 22 bp, Artificial Sequence
  chemically synthesized
taagtattgtgagaagataatt

SEQ ID NO: 1310523 - DNA, 22 bp, Artificial Sequence
  chemically synthesized
tgagaagataattaaaagtttg

SEQ ID NO: 1310524 - DNA, 22 bp, Artificial Sequence
  chemically synthesized
tatggacaataatcaaactttt

SEQ ID NO: 1310525 - DNA, 22 bp, Artificial Sequence
  chemically synthesized
atatggacaataatcaaacttt

SEQ ID NO: 1310526 - DNA, 22 bp, Artificial Sequence
  chemically synthesized
tttatatggacaataatcaaac

SEQ ID NO: 1310527 - DNA, 22 bp, Artificial Sequence
  chemically synthesized
ccgtctatttatatggacaata

SEQ ID NO: 1310528 - DNA, 22 bp, Artificial Sequence
  chemically synthesized
accgtctatttatatggacaat

SEQ ID NO: 1310529 - DNA, 22 bp, Artificial Sequence
  chemically synthesized
aaagtttgattattgtccatat

SEQ ID NO: 1310530 - DNA, 22 bp, Artificial Sequence
  chemically synthesized
ttaccgtctatttatatggaca

SEQ ID NO: 1310531 - DNA, 22 bp, Artificial Sequence
  chemically synthesized
cttaccgtctatttatatggac

SEQ ID NO: 1310532 - DNA, 22 bp, Artificial Sequence
  chemically synthesized
tcttaccgtctatttatatgga

SEQ ID NO: 1310533 - DNA, 22 bp, Artificial Sequence
  chemically synthesized
gattattgtccatataaataga

SEQ ID NO: 1310534 - DNA, 22 bp, Artificial Sequence
  chemically synthesized
attattgtccatataaatagac

SEQ ID NO: 1310535 - DNA, 22 bp, Artificial Sequence
  chemically synthesized
ttgtccatataaatagacggta

SEQ ID NO: 1310536 - DNA, 22 bp, Artificial Sequence
  chemically synthesized
tccatataaatagacggtaaga

SEQ ID NO: 1310537 - DNA, 22 bp, Artificial Sequence
  chemically synthesized
aaaatgtgtattttcttaccgt

SEQ ID NO: 1310538 - DNA, 22 bp, Artificial Sequence
  chemically synthesized
aatactgaaaatgtgtattttc

SEQ ID NO: 1310539 - DNA, 22 bp, Artificial Sequence
  chemically synthesized
ttcaatactgaaaatgtgtatt

SEQ ID NO: 1310540 - DNA, 22 bp, Artificial Sequence
  chemically synthesized
attcaatactgaaaatgtgtat

SEQ ID NO: 1310541 - DNA, 22 bp, Artificial Sequence
  chemically synthesized
tattcaatactgaaaatgtgta

SEQ ID NO: 1310542 - DNA, 22 bp, Artificial Sequence
  chemically synthesized
agaagaaggaaagtctttattc

SEQ ID NO: 1310543 - DNA, 22 bp, Artificial Sequence
  chemically synthesized
ctgagaagaaggaaagtcttta

SEQ ID NO: 1310544 - DNA, 22 bp, Artificial Sequence
  chemically synthesized
tcagtattgaataaagactttc

SEQ ID NO: 1310545 - DNA, 22 bp, Artificial Sequence
  chemically synthesized
cagtattgaataaagactttcc

SEQ ID NO: 1310546 - DNA, 22 bp, Artificial Sequence
  chemically synthesized
tgctgagaagaaggaaagtctt

SEQ ID NO: 1310547 - DNA, 22 bp, Artificial Sequence
  chemically synthesized
agtattgaataaagactttcct

SEQ ID NO: 1310548 - DNA, 22 bp, Artificial Sequence
  chemically synthesized
ctgctgagaagaaggaaagtct

SEQ ID NO: 1310549 - DNA, 22 bp, Artificial Sequence
  chemically synthesized
aataaagactttccttcttctc

SEQ ID NO: 1310550 - DNA, 22 bp, Artificial Sequence
  chemically synthesized
gaatacaatcaacttctgctga

SEQ ID NO: 1310551 - DNA, 22 bp, Artificial Sequence
  chemically synthesized
tggaatacaatcaacttctgct

SEQ ID NO: 1310552 - DNA, 22 bp, Artificial Sequence
  chemically synthesized
tccttcttctcagcagaagttg

SEQ ID NO: 1310553 - DNA, 22 bp, Artificial Sequence
  chemically synthesized
ctggaatacaatcaacttctgc

SEQ ID NO: 1310554 - DNA, 22 bp, Artificial Sequence
  chemically synthesized
ccttcttctcagcagaagttga

SEQ ID NO: 1310555 - DNA, 22 bp, Artificial Sequence
  chemically synthesized
tctggaatacaatcaacttctg

SEQ ID NO: 1310556 - DNA, 22 bp, Artificial Sequence
  chemically synthesized
cttcttctcagcagaagttgat

SEQ ID NO: 1310557 - DNA, 22 bp, Artificial Sequence
  chemically synthesized
ttctggaatacaatcaacttct

SEQ ID NO: 1310558 - DNA, 22 bp, Artificial Sequence
  chemically synthesized
cttctcagcagaagttgattgt

SEQ ID NO: 1310559 - DNA, 22 bp, Artificial Sequence
  chemically synthesized
cttttctggaatacaatcaact

SEQ ID NO: 1310560 - DNA, 22 bp, Artificial Sequence
  chemically synthesized
ttctcagcagaagttgattgta

SEQ ID NO: 1310561 - DNA, 22 bp, Artificial Sequence
  chemically synthesized
ccttttctggaatacaatcaac

SEQ ID NO: 1310562 - DNA, 22 bp, Artificial Sequence
  chemically synthesized
tccttttctggaatacaatcaa

SEQ ID NO: 1310563 - DNA, 22 bp, Artificial Sequence
  chemically synthesized
ctcagcagaagttgattgtatt

SEQ ID NO: 1310564 - DNA, 22 bp, Artificial Sequence
  chemically synthesized
tcagcagaagttgattgtattc

SEQ ID NO: 1310565 - DNA, 22 bp, Artificial Sequence
  chemically synthesized
tttccttttctggaatacaatc

SEQ ID NO: 1310566 - DNA, 22 bp, Artificial Sequence
  chemically synthesized
agcagaagttgattgtattcca

SEQ ID NO: 1310567 - DNA, 22 bp, Artificial Sequence
  chemically synthesized
attgtattccagaaaaggaaag

SEQ ID NO: 1310568 - DNA, 22 bp, Artificial Sequence
  chemically synthesized
tgaaaggaaggattctttcctt

SEQ ID NO: 1310569 - DNA, 22 bp, Artificial Sequence
  chemically synthesized
atgaaaggaaggattctttcct

SEQ ID NO: 1310570 - DNA, 22 bp, Artificial Sequence
  chemically synthesized
tattccagaaaaggaaagaatc

SEQ ID NO: 1310571 - DNA, 22 bp, Artificial Sequence
  chemically synthesized
cccttatgaaaggaaggattct

SEQ ID NO: 1310572 - DNA, 22 bp, Artificial Sequence
  chemically synthesized
cagaaaaggaaagaatccttcc

SEQ ID NO: 1310573 - DNA, 22 bp, Artificial Sequence
  chemically synthesized
gcccttatgaaaggaaggattc

SEQ ID NO: 1310574 - DNA, 22 bp, Artificial Sequence
  chemically synthesized
atttgcccttatgaaaggaagg

SEQ ID NO: 1310575 - DNA, 22 bp, Artificial Sequence
  chemically synthesized
aatttgcccttatgaaaggaag

SEQ ID NO: 1310576 - DNA, 22 bp, Artificial Sequence
  chemically synthesized
taatttgcccttatgaaaggaa

SEQ ID NO: 1310577 - DNA, 22 bp, Artificial Sequence
  chemically synthesized
cattttaatttgcccttatgaa

SEQ ID NO: 1310578 - DNA, 22 bp, Artificial Sequence
  chemically synthesized
ctgcattttaatttgcccttat

SEQ ID NO: 1310579 - DNA, 22 bp, Artificial Sequence
  chemically synthesized
cctttcataagggcaaattaaa

SEQ ID NO: 1310580 - DNA, 22 bp, Artificial Sequence
  chemically synthesized
ctttcataagggcaaattaaaa

SEQ ID NO: 1310581 - DNA, 22 bp, Artificial Sequence
  chemically synthesized
agagttcctgcattttaatttg

SEQ ID NO: 1310582 - DNA, 22 bp, Artificial Sequence
  chemically synthesized
tcataagggcaaattaaaatgc

SEQ ID NO: 1310583 - DNA, 22 bp, Artificial Sequence
  chemically synthesized
cataagggcaaattaaaatgca

SEQ ID NO: 1310584 - DNA, 22 bp, Artificial Sequence
  chemically synthesized
ataagggcaaattaaaatgcag

SEQ ID NO: 1310585 - DNA, 22 bp, Artificial Sequence
  chemically synthesized
ccaaattcagagttcctgcatt

SEQ ID NO: 1310586 - DNA, 22 bp, Artificial Sequence
  chemically synthesized
aaatgcaggaactctgaatttg

SEQ ID NO: 1310587 - DNA, 22 bp, Artificial Sequence
  chemically synthesized
aaaaacagactcccaaattcag

SEQ ID NO: 1310588 - DNA, 22 bp, Artificial Sequence
  chemically synthesized
gaaaaacagactcccaaattca

SEQ ID NO: 1310589 - DNA, 22 bp, Artificial Sequence
  chemically synthesized
atcttgaaaaacagactcccaa

SEQ ID NO: 1310590 - DNA, 22 bp, Artificial Sequence
  chemically synthesized
ttcatcttgaaaaacagactcc

SEQ ID NO: 1310591 - DNA, 22 bp, Artificial Sequence
  chemically synthesized
tgaatttgggagtctgtttttc

SEQ ID NO: 1310592 - DNA, 22 bp, Artificial Sequence
  chemically synthesized
aatttgggagtctgtttttcaa

SEQ ID NO: 1310593 - DNA, 22 bp, Artificial Sequence
  chemically synthesized
gggagtctgtttttcaagatga

SEQ ID NO: 1310594 - DNA, 22 bp, Artificial Sequence
  chemically synthesized
ggagtctgtttttcaagatgaa

SEQ ID NO: 1310595 - DNA, 22 bp, Artificial Sequence
  chemically synthesized
ccaaagatgattattcatcttg

SEQ ID NO: 1310596 - DNA, 22 bp, Artificial Sequence
  chemically synthesized
ttgccaaagatgattattcatc

SEQ ID NO: 1310597 - DNA, 22 bp, Artificial Sequence
  chemically synthesized
tttttcaagatgaataatcatc

SEQ ID NO: 1310598 - DNA, 22 bp, Artificial Sequence
  chemically synthesized
ttcaagatgaataatcatcttt

SEQ ID NO: 1310599 - DNA, 22 bp, Artificial Sequence
  chemically synthesized
aatcctattgccaaagatgatt

SEQ ID NO: 1310600 - DNA, 22 bp, Artificial Sequence
  chemically synthesized
tcaagatgaataatcatctttg

SEQ ID NO: 1310601 - DNA, 22 bp, Artificial Sequence
  chemically synthesized
gaatcctattgccaaagatgat

SEQ ID NO: 1310602 - DNA, 22 bp, Artificial Sequence
  chemically synthesized
caagatgaataatcatctttgg

SEQ ID NO: 1310603 - DNA, 22 bp, Artificial Sequence
  chemically synthesized
aagatgaataatcatctttggc

SEQ ID NO: 1310604 - DNA, 22 bp, Artificial Sequence
  chemically synthesized
tgccatttgaatcctattgcca

SEQ ID NO: 1310605 - DNA, 22 bp, Artificial Sequence
  chemically synthesized
ttgtgccatttgaatcctattg

SEQ ID NO: 1310606 - DNA, 22 bp, Artificial Sequence
  chemically synthesized
tgttgtgccatttgaatcctat

SEQ ID NO: 1310607 - DNA, 22 bp, Artificial Sequence
  chemically synthesized
ctgttgtgccatttgaatccta

SEQ ID NO: 1310608 - DNA, 22 bp, Artificial Sequence
  chemically synthesized
cttctgttgtgccatttgaatc

SEQ ID NO: 1310609 - DNA, 22 bp, Artificial Sequence
  chemically synthesized
tggcaataggattcaaatggca

SEQ ID NO: 1310610 - DNA, 22 bp, Artificial Sequence
  chemically synthesized
ggcaataggattcaaatggcac

SEQ ID NO: 1310611 - DNA, 22 bp, Artificial Sequence
  chemically synthesized
gcaataggattcaaatggcaca

SEQ ID NO: 1310612 - DNA, 22 bp, Artificial Sequence
  chemically synthesized
aattccttctgttgtgccattt

SEQ ID NO: 1310613 - DNA, 22 bp, Artificial Sequence
  chemically synthesized
aatatcaattcaattccttctg

SEQ ID NO: 1310614 - DNA, 22 bp, Artificial Sequence
  chemically synthesized
aaatggcacaacagaaggaatt

SEQ ID NO: 1310615 - DNA, 22 bp, Artificial Sequence
  chemically synthesized
ttcaatatcaattcaattcctt

SEQ ID NO: 1310616 - DNA, 22 bp, Artificial Sequence
  chemically synthesized
agattattcaatatcaattcaa

SEQ ID NO: 1310617 - DNA, 22 bp, Artificial Sequence
  chemically synthesized
gatcaagaattcagattattca

SEQ ID NO: 1310618 - DNA, 22 bp, Artificial Sequence
  chemically synthesized
aattgatattgaataatctgaa

SEQ ID NO: 1310619 - DNA, 22 bp, Artificial Sequence
  chemically synthesized
atattgaataatctgaattctt

SEQ ID NO: 1310620 - DNA, 22 bp, Artificial Sequence
  chemically synthesized
aataatctgaattcttgatcca

SEQ ID NO: 1310621 - DNA, 22 bp, Artificial Sequence
  chemically synthesized
aaaaatagaggttggatcaaga

SEQ ID NO: 1310622 - DNA, 22 bp, Artificial Sequence
  chemically synthesized
aattcttgatccaacctctatt

SEQ ID NO: 1310623 - DNA, 22 bp, Artificial Sequence
  chemically synthesized
aatgtacatattcaaaaataga

SEQ ID NO: 1310624 - DNA, 22 bp, Artificial Sequence
  chemically synthesized
ttgatccaacctctatttttga

SEQ ID NO: 1310625 - DNA, 22 bp, Artificial Sequence
  chemically synthesized
aaatgtacatattcaaaaatag

SEQ ID NO: 1310626 - DNA, 22 bp, Artificial Sequence
  chemically synthesized
gatccaacctctatttttgaat

SEQ ID NO: 1310627 - DNA, 22 bp, Artificial Sequence
  chemically synthesized
atccaacctctatttttgaata

SEQ ID NO: 1310628 - DNA, 22 bp, Artificial Sequence
  chemically synthesized
tatttttgaatatgtacattta

SEQ ID NO: 1310629 - DNA, 22 bp, Artificial Sequence
  chemically synthesized
tttttgaatatgtacatttaag

SEQ ID NO: 1310630 - DNA, 22 bp, Artificial Sequence
  chemically synthesized
ttgaatatgtacatttaagatc

SEQ ID NO: 1310631 - DNA, 22 bp, Artificial Sequence
  chemically synthesized
aatgcacaaagtgatcttaaat

SEQ ID NO: 1310632 - DNA, 22 bp, Artificial Sequence
  chemically synthesized
tgaatatgtacatttaagatca

SEQ ID NO: 1310633 - DNA, 22 bp, Artificial Sequence
  chemically synthesized
gaatatgtacatttaagatcac

SEQ ID NO: 1310634 - DNA, 22 bp, Artificial Sequence
  chemically synthesized
aatatgtacatttaagatcact

SEQ ID NO: 1310635 - DNA, 22 bp, Artificial Sequence
  chemically synthesized
aagatcactttgtgcatttaac

SEQ ID NO: 1310636 - DNA, 22 bp, Artificial Sequence
  chemically synthesized
tgcataatgagagttaaatgca

SEQ ID NO: 1310637 - DNA, 22 bp, Artificial Sequence
  chemically synthesized
agatcactttgtgcatttaact

SEQ ID NO: 1310638 - DNA, 22 bp, Artificial Sequence
  chemically synthesized
tgcaattatgcataatgagagt

SEQ ID NO: 1310639 - DNA, 22 bp, Artificial Sequence
  chemically synthesized
tgtgcatttaactctcattatg

SEQ ID NO: 1310640 - DNA, 22 bp, Artificial Sequence
  chemically synthesized
gtgcatttaactctcattatgc

SEQ ID NO: 1310641 - DNA, 22 bp, Artificial Sequence
  chemically synthesized
tgcatttaactctcattatgca

SEQ ID NO: 1310642 - DNA, 22 bp, Artificial Sequence
  chemically synthesized
tccagttatgcaattatgcata

SEQ ID NO: 1310643 - DNA, 22 bp, Artificial Sequence
  chemically synthesized
aactctcattatgcataattgc

SEQ ID NO: 1310644 - DNA, 22 bp, Artificial Sequence
  chemically synthesized
ttgtccagttatgcaattatgc

SEQ ID NO: 1310645 - DNA, 22 bp, Artificial Sequence
  chemically synthesized
actctcattatgcataattgca

SEQ ID NO: 1310646 - DNA, 22 bp, Artificial Sequence
  chemically synthesized
tcattatgcataattgcataac

SEQ ID NO: 1310647 - DNA, 22 bp, Artificial Sequence
  chemically synthesized
attatgcataattgcataactg

SEQ ID NO: 1310648 - DNA, 22 bp, Artificial Sequence
  chemically synthesized
tgcataattgcataactggaca

SEQ ID NO: 1310649 - DNA, 22 bp, Artificial Sequence
  chemically synthesized
caggaagaaacaaatattgttg

SEQ ID NO: 1310650 - DNA, 22 bp, Artificial Sequence
  chemically synthesized
cataactggacaacaatatttg

SEQ ID NO: 1310651 - DNA, 22 bp, Artificial Sequence
  chemically synthesized
aattccaggaagaaacaaatat

SEQ ID NO: 1310652 - DNA, 22 bp, Artificial Sequence
  chemically synthesized
gaattccaggaagaaacaaata

SEQ ID NO: 1310653 - DNA, 22 bp, Artificial Sequence
  chemically synthesized
cttgaattccaggaagaaacaa

SEQ ID NO: 1310654 - DNA, 22 bp, Artificial Sequence
  chemically synthesized
gacaacaatatttgtttcttcc

SEQ ID NO: 1310655 - DNA, 22 bp, Artificial Sequence
  chemically synthesized
tagaataaactccttgaattcc

SEQ ID NO: 1310656 - DNA, 22 bp, Artificial Sequence
  chemically synthesized
gtttcttcctggaattcaagga

SEQ ID NO: 1310657 - DNA, 22 bp, Artificial Sequence
  chemically synthesized
tttcttcctggaattcaaggag

SEQ ID NO: 1310658 - DNA, 22 bp, Artificial Sequence
  chemically synthesized
cttcctggaattcaaggagttt

SEQ ID NO: 1310659 - DNA, 22 bp, Artificial Sequence
  chemically synthesized
ttcctggaattcaaggagttta

SEQ ID NO: 1310660 - DNA, 22 bp, Artificial Sequence
  chemically synthesized
cctggaattcaaggagtttatt

SEQ ID NO: 1310661 - DNA, 22 bp, Artificial Sequence
  chemically synthesized
ctggaattcaaggagtttattc

SEQ ID NO: 1310662 - DNA, 22 bp, Artificial Sequence
  chemically synthesized
gaattcaaggagtttattctac

SEQ ID NO: 1310663 - DNA, 22 bp, Artificial Sequence
  chemically synthesized
aaggagtttattctacaatttt

SEQ ID NO: 1310664 - DNA, 22 bp, Artificial Sequence
  chemically synthesized
attctacaatttttgtttttat

SEQ ID NO: 1310665 - DNA, 22 bp, Artificial Sequence
  chemically synthesized
ttctacaatttttgtttttatt

SEQ ID NO: 1310666 - DNA, 22 bp, Artificial Sequence
  chemically synthesized
tacaatttttgtttttatttat

SEQ ID NO: 1310667 - DNA, 22 bp, Artificial Sequence
  chemically synthesized
caatttttgtttttatttattt

SEQ ID NO: 1310668 - DNA, 22 bp, Artificial Sequence
  chemically synthesized
aaaaataaatagataaataaat

SEQ ID NO: 1310669 - DNA, 22 bp, Artificial Sequence
  chemically synthesized
caaaaataaatagataaataaa

SEQ ID NO: 1310670 - DNA, 22 bp, Artificial Sequence
  chemically synthesized
tcaaaaataaatagataaataa

SEQ ID NO: 1310671 - DNA, 22 bp, Artificial Sequence
  chemically synthesized
ttgtttttatttatttatctat

SEQ ID NO: 1310672 - DNA, 22 bp, Artificial Sequence
  chemically synthesized
tgtttttatttatttatctatt

SEQ ID NO: 1310673 - DNA, 22 bp, Artificial Sequence
  chemically synthesized
gtttttatttatttatctattt

SEQ ID NO: 1310674 - DNA, 22 bp, Artificial Sequence
  chemically synthesized
tttttatttatttatctattta

SEQ ID NO: 1310675 - DNA, 22 bp, Artificial Sequence
  chemically synthesized
catctttcaaaaataaatagat

SEQ ID NO: 1310676 - DNA, 22 bp, Artificial Sequence
  chemically synthesized
ttatttatttatctatttattt

SEQ ID NO: 1310677 - DNA, 22 bp, Artificial Sequence
  chemically synthesized
tatttatttatctatttatttt

SEQ ID NO: 1310678 - DNA, 22 bp, Artificial Sequence
  chemically synthesized
atttatttatctatttattttt

SEQ ID NO: 1310679 - DNA, 22 bp, Artificial Sequence
  chemically synthesized
tttatttatctatttatttttg

SEQ ID NO: 1310680 - DNA, 22 bp, Artificial Sequence
  chemically synthesized
atttatctatttatttttgaaa

SEQ ID NO: 1310681 - DNA, 22 bp, Artificial Sequence
  chemically synthesized
tttatctatttatttttgaaag

SEQ ID NO: 1310682 - DNA, 22 bp, Artificial Sequence
  chemically synthesized
atctatttatttttgaaagatg

SEQ ID NO: 1310683 - DNA, 22 bp, Artificial Sequence
  chemically synthesized
tctatttatttttgaaagatgg

SEQ ID NO: 1310684 - DNA, 22 bp, Artificial Sequence
  chemically synthesized
tttatttttgaaagatggagtc

SEQ ID NO: 1310685 - DNA, 22 bp, Artificial Sequence
  chemically synthesized
ggcaacagaacgagactccatc

SEQ ID NO: 1310686 - DNA, 22 bp, Artificial Sequence
  chemically synthesized
atttttgaaagatggagtctcg

SEQ ID NO: 1310687 - DNA, 22 bp, Artificial Sequence
  chemically synthesized
tttttgaaagatggagtctcgt

SEQ ID NO: 1310688 - DNA, 22 bp, Artificial Sequence
  chemically synthesized
ttgaaagatggagtctcgttct

SEQ ID NO: 1310689 - DNA, 22 bp, Artificial Sequence
  chemically synthesized
tgaaagatggagtctcgttctg

SEQ ID NO: 1310690 - DNA, 22 bp, Artificial Sequence
  chemically synthesized
cagcctgggcaacagaacgaga

SEQ ID NO: 1310691 - DNA, 22 bp, Artificial Sequence
  chemically synthesized
gaaagatggagtctcgttctgt

SEQ ID NO: 1310692 - DNA, 22 bp, Artificial Sequence
  chemically synthesized
aaagatggagtctcgttctgtt

SEQ ID NO: 1310693 - DNA, 22 bp, Artificial Sequence
  chemically synthesized
cactccagcctgggcaacagaa

SEQ ID NO: 1310694 - DNA, 22 bp, Artificial Sequence
  chemically synthesized
gttctgttgcccaggctggagt

SEQ ID NO: 1310695 - DNA, 22 bp, Artificial Sequence
  chemically synthesized
tgttgcccaggctggagtgcag

SEQ ID NO: 1310696 - DNA, 22 bp, Artificial Sequence
  chemically synthesized
ttgcccaggctggagtgcagtg

SEQ ID NO: 1310697 - DNA, 22 bp, Artificial Sequence
  chemically synthesized
cccaggctggagtgcagtggtg

SEQ ID NO: 1310698 - DNA, 22 bp, Artificial Sequence
  chemically synthesized
cagtgagccaagatcacaccac

SEQ ID NO: 1310699 - DNA, 22 bp, Artificial Sequence
  chemically synthesized
gagtgcagtggtgtgatcttgg

SEQ ID NO: 1310700 - DNA, 22 bp, Artificial Sequence
  chemically synthesized
gggaggtggaggttgcagtgag

SEQ ID NO: 1310701 - DNA, 22 bp, Artificial Sequence
  chemically synthesized
aactcgggaggtggaggttgca

SEQ ID NO: 1310702 - DNA, 22 bp, Artificial Sequence
  chemically synthesized
gaactcgggaggtggaggttgc

SEQ ID NO: 1310703 - DNA, 22 bp, Artificial Sequence
  chemically synthesized
cttgaactcgggaggtggaggt

SEQ ID NO: 1310704 - DNA, 22 bp, Artificial Sequence
  chemically synthesized
ggctcactgcaacctccacctc

SEQ ID NO: 1310705 - DNA, 22 bp, Artificial Sequence
  chemically synthesized
gctcactgcaacctccacctcc

SEQ ID NO: 1310706 - DNA, 22 bp, Artificial Sequence
  chemically synthesized
actgcaacctccacctcccgag

SEQ ID NO: 1310707 - DNA, 22 bp, Artificial Sequence
  chemically synthesized
caacctccacctcccgagttca

SEQ ID NO: 1310708 - DNA, 22 bp, Artificial Sequence
  chemically synthesized
aggcaggagaattgcttgaact

SEQ ID NO: 1310709 - DNA, 22 bp, Artificial Sequence
  chemically synthesized
cacctcccgagttcaagcaatt

SEQ ID NO: 1310710 - DNA, 22 bp, Artificial Sequence
  chemically synthesized
ccgagttcaagcaattctcctg

SEQ ID NO: 1310711 - DNA, 22 bp, Artificial Sequence
  chemically synthesized
gggaggctgaggcaggagaatt

SEQ ID NO: 1310712 - DNA, 22 bp, Artificial Sequence
  chemically synthesized
ctcgggaggctgaggcaggaga

SEQ ID NO: 1310713 - DNA, 22 bp, Artificial Sequence
  chemically synthesized
aagcaattctcctgcctcagcc

SEQ ID NO: 1310714 - DNA, 22 bp, Artificial Sequence
  chemically synthesized
tgatcccagctactcgggaggc

SEQ ID NO: 1310715 - DNA, 22 bp, Artificial Sequence
  chemically synthesized
tcctgcctcagcctcccgagta

SEQ ID NO: 1310716 - DNA, 22 bp, Artificial Sequence
  chemically synthesized
ctgcctcagcctcccgagtagc

SEQ ID NO: 1310717 - DNA, 22 bp, Artificial Sequence
  chemically synthesized
cctcagcctcccgagtagctgg

SEQ ID NO: 1310718 - DNA, 22 bp, Artificial Sequence
  chemically synthesized
agcctcccgagtagctgggatc

SEQ ID NO: 1310719 - DNA, 22 bp, Artificial Sequence
  chemically synthesized
ccgagtagctgggatcacaggc

SEQ ID NO: 1310720 - DNA, 22 bp, Artificial Sequence
  chemically synthesized
ggatcacaggcgtgcgccacta

SEQ ID NO: 1310721 - DNA, 22 bp, Artificial Sequence
  chemically synthesized
aaaatacaaaaaccagccaggc

SEQ ID NO: 1310722 - DNA, 22 bp, Artificial Sequence
  chemically synthesized
ctaaaaatacaaaaaccagcca

SEQ ID NO: 1310723 - DNA, 22 bp, Artificial Sequence
  chemically synthesized
tactaaaaatacaaaaaccagc

SEQ ID NO: 1310724 - DNA, 22 bp, Artificial Sequence
  chemically synthesized
cgcctggctggtttttgtattt

SEQ ID NO: 1310725 - DNA, 22 bp, Artificial Sequence
  chemically synthesized
gctggtttttgtatttttagta

SEQ ID NO: 1310726 - DNA, 22 bp, Artificial Sequence
  chemically synthesized
gtttttgtatttttagtagaga

SEQ ID NO: 1310727 - DNA, 22 bp, Artificial Sequence
  chemically synthesized
ttgtatttttagtagagatggg

SEQ ID NO: 1310728 - DNA, 22 bp, Artificial Sequence
  chemically synthesized
tgtatttttagtagagatgggg

SEQ ID NO: 1310729 - DNA, 22 bp, Artificial Sequence
  chemically synthesized
gtatttttagtagagatggggt

SEQ ID NO: 1310730 - DNA, 22 bp, Artificial Sequence
  chemically synthesized
tatttttagtagagatggggtt

SEQ ID NO: 1310731 - DNA, 22 bp, Artificial Sequence
  chemically synthesized
gccaacgtggtgaaaccccatc

SEQ ID NO: 1310732 - DNA, 22 bp, Artificial Sequence
  chemically synthesized
ttagtagagatggggtttcacc

SEQ ID NO: 1310733 - DNA, 22 bp, Artificial Sequence
  chemically synthesized
tagtagagatggggtttcacca

SEQ ID NO: 1310734 - DNA, 22 bp, Artificial Sequence
  chemically synthesized
agtagagatggggtttcaccac

SEQ ID NO: 1310735 - DNA, 22 bp, Artificial Sequence
  chemically synthesized
gtagagatggggtttcaccacg

SEQ ID NO: 1310736 - DNA, 22 bp, Artificial Sequence
  chemically synthesized
aagaccagcctggccaacgtgg

SEQ ID NO: 1310737 - DNA, 22 bp, Artificial Sequence
  chemically synthesized
caccacgttggccaggctggtc

SEQ ID NO: 1310738 - DNA, 22 bp, Artificial Sequence
  chemically synthesized
accacgttggccaggctggtct

SEQ ID NO: 1310739 - DNA, 22 bp, Artificial Sequence
  chemically synthesized
gccaggctggtcttgaactcct

SEQ ID NO: 1310740 - DNA, 22 bp, Artificial Sequence
  chemically synthesized
gtcttgaactcctggcctccgg

SEQ ID NO: 1310741 - DNA, 22 bp, Artificial Sequence
  chemically synthesized
gaactcctggcctccggtgatc

SEQ ID NO: 1310742 - DNA, 22 bp, Artificial Sequence
  chemically synthesized
aactcctggcctccggtgatcc

SEQ ID NO: 1310743 - DNA, 22 bp, Artificial Sequence
  chemically synthesized
ggaggccgaggcgggtggatca

SEQ ID NO: 1310744 - DNA, 22 bp, Artificial Sequence
  chemically synthesized
ctggcctccggtgatccacccg

SEQ ID NO: 1310745 - DNA, 22 bp, Artificial Sequence
  chemically synthesized
gggaggccgaggcgggtggatc

SEQ ID NO: 1310746 - DNA, 22 bp, Artificial Sequence
  chemically synthesized
tgggaggccgaggcgggtggat

SEQ ID NO: 1310747 - DNA, 22 bp, Artificial Sequence
  chemically synthesized
gcctccggtgatccacccgcct

SEQ ID NO: 1310748 - DNA, 22 bp, Artificial Sequence
  chemically synthesized
cggtgatccacccgcctcggcc

SEQ ID NO: 1310749 - DNA, 22 bp, Artificial Sequence
  chemically synthesized
tcccagcactttgggaggccga

SEQ ID NO: 1310750 - DNA, 22 bp, Artificial Sequence
  chemically synthesized
ttatcccagcactttgggaggc

SEQ ID NO: 1310751 - DNA, 22 bp, Artificial Sequence
  chemically synthesized
ggcctcccaaagtgctgggata

SEQ ID NO: 1310752 - DNA, 22 bp, Artificial Sequence
  chemically synthesized
aatggcgcacgcctgttatccc

SEQ ID NO: 1310753 - DNA, 22 bp, Artificial Sequence
  chemically synthesized
ccaaagtgctgggataacaggc

SEQ ID NO: 1310754 - DNA, 22 bp, Artificial Sequence
  chemically synthesized
ggataacaggcgtgcgccattg

SEQ ID NO: 1310755 - DNA, 22 bp, Artificial Sequence
  chemically synthesized
tagaatagccaggctcaatggc

SEQ ID NO: 1310756 - DNA, 22 bp, Artificial Sequence
  chemically synthesized
aaaattgtagaatagccaggct

SEQ ID NO: 1310757 - DNA, 22 bp, Artificial Sequence
  chemically synthesized
taaaaattgtagaatagccagg

SEQ ID NO: 1310758 - DNA, 22 bp, Artificial Sequence
  chemically synthesized
ctaaaaattgtagaatagccag

SEQ ID NO: 1310759 - DNA, 22 bp, Artificial Sequence
  chemically synthesized
tctaaaaattgtagaatagcca

SEQ ID NO: 1310760 - DNA, 22 bp, Artificial Sequence
  chemically synthesized
cctttctaaaaattgtagaata

SEQ ID NO: 1310761 - DNA, 22 bp, Artificial Sequence
  chemically synthesized
ctacctttctaaaaattgtaga

SEQ ID NO: 1310762 - DNA, 22 bp, Artificial Sequence
  chemically synthesized
agcctggctattctacaatttt

SEQ ID NO: 1310763 - DNA, 22 bp, Artificial Sequence
  chemically synthesized
gctattctacaatttttagaaa

SEQ ID NO: 1310764 - DNA, 22 bp, Artificial Sequence
  chemically synthesized
ttctacaatttttagaaaggta

SEQ ID NO: 1310765 - DNA, 22 bp, Artificial Sequence
  chemically synthesized
tacaatttttagaaaggtagca

SEQ ID NO: 1310766 - DNA, 22 bp, Artificial Sequence
  chemically synthesized
caatttttagaaaggtagcaac

SEQ ID NO: 1310767 - DNA, 22 bp, Artificial Sequence
  chemically synthesized
ttagaaaggtagcaacttcttt

SEQ ID NO: 1310768 - DNA, 22 bp, Artificial Sequence
  chemically synthesized
tagaaaggtagcaacttctttc

SEQ ID NO: 1310769 - DNA, 22 bp, Artificial Sequence
  chemically synthesized
atgtcatgtggggaaagaagtt

SEQ ID NO: 1310770 - DNA, 22 bp, Artificial Sequence
  chemically synthesized
agaaaggtagcaacttctttcc

SEQ ID NO: 1310771 - DNA, 22 bp, Artificial Sequence
  chemically synthesized
aatgtcatgtggggaaagaagt

SEQ ID NO: 1310772 - DNA, 22 bp, Artificial Sequence
  chemically synthesized
gaaaggtagcaacttctttccc

SEQ ID NO: 1310773 - DNA, 22 bp, Artificial Sequence
  chemically synthesized
taaaaaacttaatgtcatgtgg

SEQ ID NO: 1310774 - DNA, 22 bp, Artificial Sequence
  chemically synthesized
ctttccccacatgacattaagt

SEQ ID NO: 1310775 - DNA, 22 bp, Artificial Sequence
  chemically synthesized
gtattataaaaaacttaatgtc

SEQ ID NO: 1310776 - DNA, 22 bp, Artificial Sequence
  chemically synthesized
tttccccacatgacattaagtt

SEQ ID NO: 1310777 - DNA, 22 bp, Artificial Sequence
  chemically synthesized
agtattataaaaaacttaatgt

SEQ ID NO: 1310778 - DNA, 22 bp, Artificial Sequence
  chemically synthesized
tccccacatgacattaagtttt

SEQ ID NO: 1310779 - DNA, 22 bp, Artificial Sequence
  chemically synthesized
ccccacatgacattaagttttt

SEQ ID NO: 1310780 - DNA, 22 bp, Artificial Sequence
  chemically synthesized
cccacatgacattaagtttttt

SEQ ID NO: 1310781 - DNA, 22 bp, Artificial Sequence
  chemically synthesized
atatttagtattataaaaaact

SEQ ID NO: 1310782 - DNA, 22 bp, Artificial Sequence
  chemically synthesized
catatttagtattataaaaaac

SEQ ID NO: 1310783 - DNA, 22 bp, Artificial Sequence
  chemically synthesized
aagcttcatatttagtattata

SEQ ID NO: 1310784 - DNA, 22 bp, Artificial Sequence
  chemically synthesized
agttttttataatactaaatat

SEQ ID NO: 1310785 - DNA, 22 bp, Artificial Sequence
  chemically synthesized
gtgcattaaagcttcatattta

SEQ ID NO: 1310786 - DNA, 22 bp, Artificial Sequence
  chemically synthesized
ggtgcattaaagcttcatattt

SEQ ID NO: 1310787 - DNA, 22 bp, Artificial Sequence
  chemically synthesized
tttataatactaaatatgaagc

SEQ ID NO: 1310788 - DNA, 22 bp, Artificial Sequence
  chemically synthesized
ttataatactaaatatgaagct

SEQ ID NO: 1310789 - DNA, 22 bp, Artificial Sequence
  chemically synthesized
tataatactaaatatgaagctt

SEQ ID NO: 1310790 - DNA, 22 bp, Artificial Sequence
  chemically synthesized
ataatactaaatatgaagcttt

SEQ ID NO: 1310791 - DNA, 22 bp, Artificial Sequence
  chemically synthesized
taatactaaatatgaagcttta

SEQ ID NO: 1310792 - DNA, 22 bp, Artificial Sequence
  chemically synthesized
caagtatgtttggtgcattaaa

SEQ ID NO: 1310793 - DNA, 22 bp, Artificial Sequence
  chemically synthesized
aatatgaagctttaatgcacca

SEQ ID NO: 1310794 - DNA, 22 bp, Artificial Sequence
  chemically synthesized
atgattgcaagtatgtttggtg

SEQ ID NO: 1310795 - DNA, 22 bp, Artificial Sequence
  chemically synthesized
ttgatgattgcaagtatgtttg

SEQ ID NO: 1310796 - DNA, 22 bp, Artificial Sequence
  chemically synthesized
attgatgattgcaagtatgttt

SEQ ID NO: 1310797 - DNA, 22 bp, Artificial Sequence
  chemically synthesized
taatgcaccaaacatacttgca

SEQ ID NO: 1310798 - DNA, 22 bp, Artificial Sequence
  chemically synthesized
aatgcaccaaacatacttgcaa

SEQ ID NO: 1310799 - DNA, 22 bp, Artificial Sequence
  chemically synthesized
atgcaccaaacatacttgcaat

SEQ ID NO: 1310800 - DNA, 22 bp, Artificial Sequence
  chemically synthesized
gtagagatatgtcatatgttta

SEQ ID NO: 1310801 - DNA, 22 bp, Artificial Sequence
  chemically synthesized
gcaatcatcaataaacatatga

SEQ ID NO: 1310802 - DNA, 22 bp, Artificial Sequence
  chemically synthesized
caatcatcaataaacatatgac

SEQ ID NO: 1310803 - DNA, 22 bp, Artificial Sequence
  chemically synthesized
ttagtagagatatgtcatatgt

SEQ ID NO: 1310804 - DNA, 22 bp, Artificial Sequence
  chemically synthesized
gttagtagagatatgtcatatg

SEQ ID NO: 1310805 - DNA, 22 bp, Artificial Sequence
  chemically synthesized
cttgttagtagagatatgtcat

SEQ ID NO: 1310806 - DNA, 22 bp, Artificial Sequence
  chemically synthesized
caatctgcttgttagtagagat

SEQ ID NO: 1310807 - DNA, 22 bp, Artificial Sequence
  chemically synthesized
ccaatctgcttgttagtagaga

SEQ ID NO: 1310808 - DNA, 22 bp, Artificial Sequence
  chemically synthesized
atgccataatttccaatctgct

SEQ ID NO: 1310809 - DNA, 22 bp, Artificial Sequence
  chemically synthesized
tactaacaagcagattggaaat

SEQ ID NO: 1310810 - DNA, 22 bp, Artificial Sequence
  chemically synthesized
ctaacaagcagattggaaatta

SEQ ID NO: 1310811 - DNA, 22 bp, Artificial Sequence
  chemically synthesized
acaagcagattggaaattatgg

SEQ ID NO: 1310812 - DNA, 22 bp, Artificial Sequence
  chemically synthesized
gaaattatggcatcaattcacc

SEQ ID NO: 1310813 - DNA, 22 bp, Artificial Sequence
  chemically synthesized
tgtggcacagatggtgaattga

SEQ ID NO: 1310814 - DNA, 22 bp, Artificial Sequence
  chemically synthesized
tggcatcaattcaccatctgtg

SEQ ID NO: 1310815 - DNA, 22 bp, Artificial Sequence
  chemically synthesized
gagtctgtgtggcacagatggt

SEQ ID NO: 1310816 - DNA, 22 bp, Artificial Sequence
  chemically synthesized
aaaactagagtctgtgtggcac

SEQ ID NO: 1310817 - DNA, 22 bp, Artificial Sequence
  chemically synthesized
caaaactagagtctgtgtggca

SEQ ID NO: 1310818 - DNA, 22 bp, Artificial Sequence
  chemically synthesized
accatctgtgccacacagactc

SEQ ID NO: 1310819 - DNA, 22 bp, Artificial Sequence
  chemically synthesized
tgccacacagactctagttttg

SEQ ID NO: 1310820 - DNA, 22 bp, Artificial Sequence
  chemically synthesized
aaataagagtttcaaaactaga

SEQ ID NO: 1310821 - DNA, 22 bp, Artificial Sequence
  chemically synthesized
caaataagagtttcaaaactag

SEQ ID NO: 1310822 - DNA, 22 bp, Artificial Sequence
  chemically synthesized
tttcaaataagagtttcaaaac

SEQ ID NO: 1310823 - DNA, 22 bp, Artificial Sequence
  chemically synthesized
tgtttcaaataagagtttcaaa

SEQ ID NO: 1310824 - DNA, 22 bp, Artificial Sequence
  chemically synthesized
ctgtttcaaataagagtttcaa

SEQ ID NO: 1310825 - DNA, 22 bp, Artificial Sequence
  chemically synthesized
tctgtttcaaataagagtttca

SEQ ID NO: 1310826 - DNA, 22 bp, Artificial Sequence
  chemically synthesized
tagttttgaaactcttatttga

SEQ ID NO: 1310827 - DNA, 22 bp, Artificial Sequence
  chemically synthesized
gttttgaaactcttatttgaaa

SEQ ID NO: 1310828 - DNA, 22 bp, Artificial Sequence
  chemically synthesized
atatataactttctgtttcaaa

SEQ ID NO: 1310829 - DNA, 22 bp, Artificial Sequence
  chemically synthesized
tgaaactcttatttgaaacaga

SEQ ID NO: 1310830 - DNA, 22 bp, Artificial Sequence
  chemically synthesized
gaaactcttatttgaaacagaa

SEQ ID NO: 1310831 - DNA, 22 bp, Artificial Sequence
  chemically synthesized
aaactcttatttgaaacagaaa

SEQ ID NO: 1310832 - DNA, 22 bp, Artificial Sequence
  chemically synthesized
tgctcatatataactttctgtt

SEQ ID NO: 1310833 - DNA, 22 bp, Artificial Sequence
  chemically synthesized
atgctcatatataactttctgt

SEQ ID NO: 1310834 - DNA, 22 bp, Artificial Sequence
  chemically synthesized
ttatgctcatatataactttct

SEQ ID NO: 1310835 - DNA, 22 bp, Artificial Sequence
  chemically synthesized
ttatttgaaacagaaagttata

SEQ ID NO: 1310836 - DNA, 22 bp, Artificial Sequence
  chemically synthesized
atttgaaacagaaagttatata

SEQ ID NO: 1310837 - DNA, 22 bp, Artificial Sequence
  chemically synthesized
tttgaaacagaaagttatatat

SEQ ID NO: 1310838 - DNA, 22 bp, Artificial Sequence
  chemically synthesized
gaaacagaaagttatatatgag

SEQ ID NO: 1310839 - DNA, 22 bp, Artificial Sequence
  chemically synthesized
aaacagaaagttatatatgagc

SEQ ID NO: 1310840 - DNA, 22 bp, Artificial Sequence
  chemically synthesized
catgtgcagtgtcctcttatgc

SEQ ID NO: 1310841 - DNA, 22 bp, Artificial Sequence
  chemically synthesized
tatatgagcataagaggacact

SEQ ID NO: 1310842 - DNA, 22 bp, Artificial Sequence
  chemically synthesized
gaagaactccatgtgcagtgtc

SEQ ID NO: 1310843 - DNA, 22 bp, Artificial Sequence
  chemically synthesized
cacataaagttagaagaactcc

SEQ ID NO: 1310844 - DNA, 22 bp, Artificial Sequence
  chemically synthesized
acacataaagttagaagaactc

SEQ ID NO: 1310845 - DNA, 22 bp, Artificial Sequence
  chemically synthesized
cacatggagttcttctaacttt

SEQ ID NO: 1310846 - DNA, 22 bp, Artificial Sequence
  chemically synthesized
agtagaaatttacacataaagt

SEQ ID NO: 1310847 - DNA, 22 bp, Artificial Sequence
  chemically synthesized
ttaagtagaaatttacacataa

SEQ ID NO: 1310848 - DNA, 22 bp, Artificial Sequence
  chemically synthesized
tattaagtagaaatttacacat

SEQ ID NO: 1310849 - DNA, 22 bp, Artificial Sequence
  chemically synthesized
ttctaactttatgtgtaaattt

SEQ ID NO: 1310850 - DNA, 22 bp, Artificial Sequence
  chemically synthesized
ctaactttatgtgtaaatttct

SEQ ID NO: 1310851 - DNA, 22 bp, Artificial Sequence
  chemically synthesized
taactttatgtgtaaatttcta

SEQ ID NO: 1310852 - DNA, 22 bp, Artificial Sequence
  chemically synthesized
actttatgtgtaaatttctact

SEQ ID NO: 1310853 - DNA, 22 bp, Artificial Sequence
  chemically synthesized
tatgtgtaaatttctacttaat

SEQ ID NO: 1310854 - DNA, 22 bp, Artificial Sequence
  chemically synthesized
atgtgtaaatttctacttaata

SEQ ID NO: 1310855 - DNA, 22 bp, Artificial Sequence
  chemically synthesized
tgtgtaaatttctacttaatag

SEQ ID NO: 1310856 - DNA, 22 bp, Artificial Sequence
  chemically synthesized
taacagtatatattctattaag

SEQ ID NO: 1310857 - DNA, 22 bp, Artificial Sequence
  chemically synthesized
ataacagtatatattctattaa

SEQ ID NO: 1310858 - DNA, 22 bp, Artificial Sequence
  chemically synthesized
ctacttaatagaatatatactg

SEQ ID NO: 1310859 - DNA, 22 bp, Artificial Sequence
  chemically synthesized
tacttaatagaatatatactgt

SEQ ID NO: 1310860 - DNA, 22 bp, Artificial Sequence
  chemically synthesized
cttaatagaatatatactgtta

SEQ ID NO: 1310861 - DNA, 22 bp, Artificial Sequence
  chemically synthesized
aatagaatatatactgttataa

SEQ ID NO: 1310862 - DNA, 22 bp, Artificial Sequence
  chemically synthesized
atagaatatatactgttataag

SEQ ID NO: 1310863 - DNA, 22 bp, Artificial Sequence
  chemically synthesized
acaataagtgaagcagcttata

SEQ ID NO: 1310864 - DNA, 22 bp, Artificial Sequence
  chemically synthesized
aacaataagtgaagcagcttat

SEQ ID NO: 1310865 - DNA, 22 bp, Artificial Sequence
  chemically synthesized
ttataagctgcttcacttattg

SEQ ID NO: 1310866 - DNA, 22 bp, Artificial Sequence
  chemically synthesized
taagctgcttcacttattgtta

SEQ ID NO: 1310867 - DNA, 22 bp, Artificial Sequence
  chemically synthesized
cttcacttattgttaaacctat

SEQ ID NO: 1310868 - DNA, 22 bp, Artificial Sequence
  chemically synthesized
atgtatatgtatataggtttaa

SEQ ID NO: 1310869 - DNA, 22 bp, Artificial Sequence
  chemically synthesized
cacttattgttaaacctatata

SEQ ID NO: 1310870 - DNA, 22 bp, Artificial Sequence
  chemically synthesized
ttaatgtatatgtatataggtt

SEQ ID NO: 1310871 - DNA, 22 bp, Artificial Sequence
  chemically synthesized
acttattgttaaacctatatac

SEQ ID NO: 1310872 - DNA, 22 bp, Artificial Sequence
  chemically synthesized
attaatgtatatgtatataggt

SEQ ID NO: 1310873 - DNA, 22 bp, Artificial Sequence
  chemically synthesized
tattaatgtatatgtatatagg

SEQ ID NO: 1310874 - DNA, 22 bp, Artificial Sequence
  chemically synthesized
ttattaatgtatatgtatatag

SEQ ID NO: 1310875 - DNA, 22 bp, Artificial Sequence
  chemically synthesized
tttattaatgtatatgtatata

SEQ ID NO: 1310876 - DNA, 22 bp, Artificial Sequence
  chemically synthesized
attgttaaacctatatacatat

SEQ ID NO: 1310877 - DNA, 22 bp, Artificial Sequence
  chemically synthesized
ttgttaaacctatatacatata

SEQ ID NO: 1310878 - DNA, 22 bp, Artificial Sequence
  chemically synthesized
ttaaacctatatacatatacat

SEQ ID NO: 1310879 - DNA, 22 bp, Artificial Sequence
  chemically synthesized
atgactttttattaatgtatat

SEQ ID NO: 1310880 - DNA, 22 bp, Artificial Sequence
  chemically synthesized
aacctatatacatatacattaa

SEQ ID NO: 1310881 - DNA, 22 bp, Artificial Sequence
  chemically synthesized
tatacatatacattaataaaaa

SEQ ID NO: 1310882 - DNA, 22 bp, Artificial Sequence
  chemically synthesized
taggtcaatattaatgactttt

SEQ ID NO: 1310883 - DNA, 22 bp, Artificial Sequence
  chemically synthesized
gtaggtcaatattaatgacttt

SEQ ID NO: 1310884 - DNA, 22 bp, Artificial Sequence
  chemically synthesized
tttgtaggtcaatattaatgac

SEQ ID NO: 1310885 - DNA, 22 bp, Artificial Sequence
  chemically synthesized
ataaaaagtcattaatattgac

SEQ ID NO: 1310886 - DNA, 22 bp, Artificial Sequence
  chemically synthesized
aaattatttgtaggtcaatatt

SEQ ID NO: 1310887 - DNA, 22 bp, Artificial Sequence
  chemically synthesized
aaactcaaattatttgtaggtc

SEQ ID NO: 1310888 - DNA, 22 bp, Artificial Sequence
  chemically synthesized
aaaactcaaattatttgtaggt

SEQ ID NO: 1310889 - DNA, 22 bp, Artificial Sequence
  chemically synthesized
taaaactcaaattatttgtagg

SEQ ID NO: 1310890 - DNA, 22 bp, Artificial Sequence
  chemically synthesized
ttaaaactcaaattatttgtag

SEQ ID NO: 1310891 - DNA, 22 bp, Artificial Sequence
  chemically synthesized
tttaaaactcaaattatttgta

SEQ ID NO: 1310892 - DNA, 22 bp, Artificial Sequence
  chemically synthesized
atattgacctacaaataatttg

SEQ ID NO: 1310893 - DNA, 22 bp, Artificial Sequence
  chemically synthesized
acctacaaataatttgagtttt

SEQ ID NO: 1310894 - DNA, 22 bp, Artificial Sequence
  chemically synthesized
caaataatttgagttttaaaaa

SEQ ID NO: 1310895 - DNA, 22 bp, Artificial Sequence
  chemically synthesized
gagttttaaaaaattattatta

SEQ ID NO: 1310896 - DNA, 22 bp, Artificial Sequence
  chemically synthesized
agttttaaaaaattattattac

SEQ ID NO: 1310897 - DNA, 22 bp, Artificial Sequence
  chemically synthesized
caaaaatgaagtacagtaataa

SEQ ID NO: 1310898 - DNA, 22 bp, Artificial Sequence
  chemically synthesized
taaaaaattattattactgtac

SEQ ID NO: 1310899 - DNA, 22 bp, Artificial Sequence
  chemically synthesized
aaaaaattattattactgtact

SEQ ID NO: 1310900 - DNA, 22 bp, Artificial Sequence
  chemically synthesized
ttccaaaaatgaagtacagtaa

SEQ ID NO: 1310901 - DNA, 22 bp, Artificial Sequence
  chemically synthesized
aaaaattattattactgtactt

SEQ ID NO: 1310902 - DNA, 22 bp, Artificial Sequence
  chemically synthesized
ctgttccaaaaatgaagtacag

SEQ ID NO: 1310903 - DNA, 22 bp, Artificial Sequence
  chemically synthesized
attcctgttccaaaaatgaagt

SEQ ID NO: 1310904 - DNA, 22 bp, Artificial Sequence
  chemically synthesized
gattcctgttccaaaaatgaag

SEQ ID NO: 1310905 - DNA, 22 bp, Artificial Sequence
  chemically synthesized
ttattactgtacttcatttttg

SEQ ID NO: 1310906 - DNA, 22 bp, Artificial Sequence
  chemically synthesized
ttactgtacttcatttttggaa

SEQ ID NO: 1310907 - DNA, 22 bp, Artificial Sequence
  chemically synthesized
taatttgattcctgttccaaaa

SEQ ID NO: 1310908 - DNA, 22 bp, Artificial Sequence
  chemically synthesized
ctgtacttcatttttggaacag

SEQ ID NO: 1310909 - DNA, 22 bp, Artificial Sequence
  chemically synthesized
ttataatttgattcctgttcca

SEQ ID NO: 1310910 - DNA, 22 bp, Artificial Sequence
  chemically synthesized
tacttcatttttggaacaggaa

SEQ ID NO: 1310911 - DNA, 22 bp, Artificial Sequence
  chemically synthesized
attataatttgattcctgttcc

SEQ ID NO: 1310912 - DNA, 22 bp, Artificial Sequence
  chemically synthesized
tattataatttgattcctgttc

SEQ ID NO: 1310913 - DNA, 22 bp, Artificial Sequence
  chemically synthesized
catttttggaacaggaatcaaa

SEQ ID NO: 1310914 - DNA, 22 bp, Artificial Sequence
  chemically synthesized
gttttattataatttgattcct

SEQ ID NO: 1310915 - DNA, 22 bp, Artificial Sequence
  chemically synthesized
atttttggaacaggaatcaaat

SEQ ID NO: 1310916 - DNA, 22 bp, Artificial Sequence
  chemically synthesized
ctagttttattataatttgatt

SEQ ID NO: 1310917 - DNA, 22 bp, Artificial Sequence
  chemically synthesized
ttggaacaggaatcaaattata

SEQ ID NO: 1310918 - DNA, 22 bp, Artificial Sequence
  chemically synthesized
tggaacaggaatcaaattataa

SEQ ID NO: 1310919 - DNA, 22 bp, Artificial Sequence
  chemically synthesized
ggaacaggaatcaaattataat

SEQ ID NO: 1310920 - DNA, 22 bp, Artificial Sequence
  chemically synthesized
gaacaggaatcaaattataata

SEQ ID NO: 1310921 - DNA, 22 bp, Artificial Sequence
  chemically synthesized
tgctactagttttattataatt

SEQ ID NO: 1310922 - DNA, 22 bp, Artificial Sequence
  chemically synthesized
tgtgctactagttttattataa

SEQ ID NO: 1310923 - DNA, 22 bp, Artificial Sequence
  chemically synthesized
ctgtgctactagttttattata

SEQ ID NO: 1310924 - DNA, 22 bp, Artificial Sequence
  chemically synthesized
tttctgtgctactagttttatt

SEQ ID NO: 1310925 - DNA, 22 bp, Artificial Sequence
  chemically synthesized
tctgtttctgtgctactagttt

SEQ ID NO: 1310926 - DNA, 22 bp, Artificial Sequence
  chemically synthesized
gtctgtttctgtgctactagtt

SEQ ID NO: 1310927 - DNA, 22 bp, Artificial Sequence
  chemically synthesized
taataaaactagtagcacagaa

SEQ ID NO: 1310928 - DNA, 22 bp, Artificial Sequence
  chemically synthesized
gtagcacagaaacagacaagat

SEQ ID NO: 1310929 - DNA, 22 bp, Artificial Sequence
  chemically synthesized
gtaaccaaagtaatcttgtctg

SEQ ID NO: 1310930 - DNA, 22 bp, Artificial Sequence
  chemically synthesized
tggtaaccaaagtaatcttgtc

SEQ ID NO: 1310931 - DNA, 22 bp, Artificial Sequence
  chemically synthesized
gcagagtctctggtaaccaaag

SEQ ID NO: 1310932 - DNA, 22 bp, Artificial Sequence
  chemically synthesized
ggcagagtctctggtaaccaaa

SEQ ID NO: 1310933 - DNA, 22 bp, Artificial Sequence
  chemically synthesized
aaaatttggcagagtctctggt

SEQ ID NO: 1310934 - DNA, 22 bp, Artificial Sequence
  chemically synthesized
ctttggttaccagagactctgc

SEQ ID NO: 1310935 - DNA, 22 bp, Artificial Sequence
  chemically synthesized
tcattgaaaatttggcagagtc

SEQ ID NO: 1310936 - DNA, 22 bp, Artificial Sequence
  chemically synthesized
tggttaccagagactctgccaa

SEQ ID NO: 1310937 - DNA, 22 bp, Artificial Sequence
  chemically synthesized
ggttaccagagactctgccaaa

SEQ ID NO: 1310938 - DNA, 22 bp, Artificial Sequence
  chemically synthesized
gttaccagagactctgccaaat

SEQ ID NO: 1310939 - DNA, 22 bp, Artificial Sequence
  chemically synthesized
ccagagactctgccaaattttc

SEQ ID NO: 1310940 - DNA, 22 bp, Artificial Sequence
  chemically synthesized
atatgtaaattatcattgaaaa

SEQ ID NO: 1310941 - DNA, 22 bp, Artificial Sequence
  chemically synthesized
catatgtaaattatcattgaaa

SEQ ID NO: 1310942 - DNA, 22 bp, Artificial Sequence
  chemically synthesized
tcatatgtaaattatcattgaa

SEQ ID NO: 1310943 - DNA, 22 bp, Artificial Sequence
  chemically synthesized
ttcatatgtaaattatcattga

SEQ ID NO: 1310944 - DNA, 22 bp, Artificial Sequence
  chemically synthesized
tttcatatgtaaattatcattg

SEQ ID NO: 1310945 - DNA, 22 bp, Artificial Sequence
  chemically synthesized
tgccaaattttcaatgataatt

SEQ ID NO: 1310946 - DNA, 22 bp, Artificial Sequence
  chemically synthesized
ttttcatatgtaaattatcatt

SEQ ID NO: 1310947 - DNA, 22 bp, Artificial Sequence
  chemically synthesized
ccaaattttcaatgataattta

SEQ ID NO: 1310948 - DNA, 22 bp, Artificial Sequence
  chemically synthesized
tttttttcatatgtaaattatc

SEQ ID NO: 1310949 - DNA, 22 bp, Artificial Sequence
  chemically synthesized
tatttttttcatatgtaaatta

SEQ ID NO: 1310950 - DNA, 22 bp, Artificial Sequence
  chemically synthesized
ctatttttttcatatgtaaatt

SEQ ID NO: 1310951 - DNA, 22 bp, Artificial Sequence
  chemically synthesized
ttctatttttttcatatgtaaa

SEQ ID NO: 1310952 - DNA, 22 bp, Artificial Sequence
  chemically synthesized
cttctatttttttcatatgtaa

SEQ ID NO: 1310953 - DNA, 22 bp, Artificial Sequence
  chemically synthesized
tcaatgataatttacatatgaa

SEQ ID NO: 1310954 - DNA, 22 bp, Artificial Sequence
  chemically synthesized
tcttctatttttttcatatgta

SEQ ID NO: 1310955 - DNA, 22 bp, Artificial Sequence
  chemically synthesized
caatgataatttacatatgaaa

SEQ ID NO: 1310956 - DNA, 22 bp, Artificial Sequence
  chemically synthesized
ttcttctatttttttcatatgt

SEQ ID NO: 1310957 - DNA, 22 bp, Artificial Sequence
  chemically synthesized
aatgataatttacatatgaaaa

SEQ ID NO: 1310958 - DNA, 22 bp, Artificial Sequence
  chemically synthesized
tttcttctatttttttcatatg

SEQ ID NO: 1310959 - DNA, 22 bp, Artificial Sequence
  chemically synthesized
ctttttcttctatttttttcat

SEQ ID NO: 1310960 - DNA, 22 bp, Artificial Sequence
  chemically synthesized
tactttttcttctatttttttc

SEQ ID NO: 1310961 - DNA, 22 bp, Artificial Sequence
  chemically synthesized
ctactttttcttctattttttt

SEQ ID NO: 1310962 - DNA, 22 bp, Artificial Sequence
  chemically synthesized
tctactttttcttctatttttt

SEQ ID NO: 1310963 - DNA, 22 bp, Artificial Sequence
  chemically synthesized
acatatgaaaaaaatagaagaa

SEQ ID NO: 1310964 - DNA, 22 bp, Artificial Sequence
  chemically synthesized
catatgaaaaaaatagaagaaa

SEQ ID NO: 1310965 - DNA, 22 bp, Artificial Sequence
  chemically synthesized
ccatggtaacattttctacttt

SEQ ID NO: 1310966 - DNA, 22 bp, Artificial Sequence
  chemically synthesized
ctgccatggtaacattttctac

SEQ ID NO: 1310967 - DNA, 22 bp, Artificial Sequence
  chemically synthesized
actgccatggtaacattttcta

SEQ ID NO: 1310968 - DNA, 22 bp, Artificial Sequence
  chemically synthesized
tactgccatggtaacattttct

SEQ ID NO: 1310969 - DNA, 22 bp, Artificial Sequence
  chemically synthesized
aaatacatgcatattttactgc

SEQ ID NO: 1310970 - DNA, 22 bp, Artificial Sequence
  chemically synthesized
ccatggcagtaaaatatgcatg

SEQ ID NO: 1310971 - DNA, 22 bp, Artificial Sequence
  chemically synthesized
aatatcatcctcaaatacatgc

SEQ ID NO: 1310972 - DNA, 22 bp, Artificial Sequence
  chemically synthesized
ttgaatatcatcctcaaataca

SEQ ID NO: 1310973 - DNA, 22 bp, Artificial Sequence
  chemically synthesized
caggtaagtcctgttgaatatc

SEQ ID NO: 1310974 - DNA, 22 bp, Artificial Sequence
  chemically synthesized
ttgcaggtaagtcctgttgaat

SEQ ID NO: 1310975 - DNA, 22 bp, Artificial Sequence
  chemically synthesized
gttgcaggtaagtcctgttgaa

SEQ ID NO: 1310976 - DNA, 22 bp, Artificial Sequence
  chemically synthesized
gaggatgatattcaacaggact

SEQ ID NO: 1310977 - DNA, 22 bp, Artificial Sequence
  chemically synthesized
aggatgatattcaacaggactt

SEQ ID NO: 1310978 - DNA, 22 bp, Artificial Sequence
  chemically synthesized
tatttgttgcaggtaagtcctg

SEQ ID NO: 1310979 - DNA, 22 bp, Artificial Sequence
  chemically synthesized
atatttgttgcaggtaagtcct

SEQ ID NO: 1310980 - DNA, 22 bp, Artificial Sequence
  chemically synthesized
tatatttgttgcaggtaagtcc

SEQ ID NO: 1310981 - DNA, 22 bp, Artificial Sequence
  chemically synthesized
ttatatttgttgcaggtaagtc

SEQ ID NO: 1310982 - DNA, 22 bp, Artificial Sequence
  chemically synthesized
tttatatttgttgcaggtaagt

SEQ ID NO: 1310983 - DNA, 22 bp, Artificial Sequence
  chemically synthesized
cctttttatatttgttgcaggt

SEQ ID NO: 1310984 - DNA, 22 bp, Artificial Sequence
  chemically synthesized
ccctttttatatttgttgcagg

SEQ ID NO: 1310985 - DNA, 22 bp, Artificial Sequence
  chemically synthesized
aacaggacttacctgcaacaaa

SEQ ID NO: 1310986 - DNA, 22 bp, Artificial Sequence
  chemically synthesized
cacttccctttttatatttgtt

SEQ ID NO: 1310987 - DNA, 22 bp, Artificial Sequence
  chemically synthesized
ccacttccctttttatatttgt

SEQ ID NO: 1310988 - DNA, 22 bp, Artificial Sequence
  chemically synthesized
tccacttccctttttatatttg

SEQ ID NO: 1310989 - DNA, 22 bp, Artificial Sequence
  chemically synthesized
ttccacttccctttttatattt

SEQ ID NO: 1310990 - DNA, 22 bp, Artificial Sequence
  chemically synthesized
acctgcaacaaatataaaaagg

SEQ ID NO: 1310991 - DNA, 22 bp, Artificial Sequence
  chemically synthesized
cctgcaacaaatataaaaaggg

SEQ ID NO: 1310992 - DNA, 22 bp, Artificial Sequence
  chemically synthesized
caacaaatataaaaagggaagt

SEQ ID NO: 1310993 - DNA, 22 bp, Artificial Sequence
  chemically synthesized
gtgaatttttccacttcccttt

SEQ ID NO: 1310994 - DNA, 22 bp, Artificial Sequence
  chemically synthesized
agtgaatttttccacttccctt

SEQ ID NO: 1310995 - DNA, 22 bp, Artificial Sequence
  chemically synthesized
agggatttagtgaatttttcca

SEQ ID NO: 1310996 - DNA, 22 bp, Artificial Sequence
  chemically synthesized
aagggatttagtgaatttttcc

SEQ ID NO: 1310997 - DNA, 22 bp, Artificial Sequence
  chemically synthesized
taagggatttagtgaatttttc

SEQ ID NO: 1310998 - DNA, 22 bp, Artificial Sequence
  chemically synthesized
acattttaagggatttagtgaa

SEQ ID NO: 1310999 - DNA, 22 bp, Artificial Sequence
  chemically synthesized
aacattttaagggatttagtga

SEQ ID NO: 1311000 - DNA, 22 bp, Artificial Sequence
  chemically synthesized
agtacttaacattttaagggat

SEQ ID NO: 1311001 - DNA, 22 bp, Artificial Sequence
  chemically synthesized
actaaatcccttaaaatgttaa

SEQ ID NO: 1311002 - DNA, 22 bp, Artificial Sequence
  chemically synthesized
caccctcagtacttaacatttt

SEQ ID NO: 1311003 - DNA, 22 bp, Artificial Sequence
  chemically synthesized
ccaccctcagtacttaacattt

SEQ ID NO: 1311004 - DNA, 22 bp, Artificial Sequence
  chemically synthesized
tccaccctcagtacttaacatt

SEQ ID NO: 1311005 - DNA, 22 bp, Artificial Sequence
  chemically synthesized
aatcccttaaaatgttaagtac

SEQ ID NO: 1311006 - DNA, 22 bp, Artificial Sequence
  chemically synthesized
ctttccaccctcagtacttaac

SEQ ID NO: 1311007 - DNA, 22 bp, Artificial Sequence
  chemically synthesized
actttccaccctcagtacttaa

SEQ ID NO: 1311008 - DNA, 22 bp, Artificial Sequence
  chemically synthesized
tcttactttccaccctcagtac

SEQ ID NO: 1311009 - DNA, 22 bp, Artificial Sequence
  chemically synthesized
aaaatgttaagtactgagggtg

SEQ ID NO: 1311010 - DNA, 22 bp, Artificial Sequence
  chemically synthesized
aaatgttaagtactgagggtgg

SEQ ID NO: 1311011 - DNA, 22 bp, Artificial Sequence
  chemically synthesized
tctatcttactttccaccctca

SEQ ID NO: 1311012 - DNA, 22 bp, Artificial Sequence
  chemically synthesized
ttatctatcttactttccaccc

SEQ ID NO: 1311013 - DNA, 22 bp, Artificial Sequence
  chemically synthesized
agtactgagggtggaaagtaag

SEQ ID NO: 1311014 - DNA, 22 bp, Artificial Sequence
  chemically synthesized
taattattatctatcttacttt

SEQ ID NO: 1311015 - DNA, 22 bp, Artificial Sequence
  chemically synthesized
agggtggaaagtaagatagata

SEQ ID NO: 1311016 - DNA, 22 bp, Artificial Sequence
  chemically synthesized
ggaaaaattataattattatct

SEQ ID NO: 1311017 - DNA, 22 bp, Artificial Sequence
  chemically synthesized
taggaaaaattataattattat

SEQ ID NO: 1311018 - DNA, 22 bp, Artificial Sequence
  chemically synthesized
attctaggaaaaattataatta

SEQ ID NO: 1311019 - DNA, 22 bp, Artificial Sequence
  chemically synthesized
ccctcattctaggaaaaattat

SEQ ID NO: 1311020 - DNA, 22 bp, Artificial Sequence
  chemically synthesized
accctcattctaggaaaaatta

SEQ ID NO: 1311021 - DNA, 22 bp, Artificial Sequence
  chemically synthesized
gagccttaccctcattctagga

SEQ ID NO: 1311022 - DNA, 22 bp, Artificial Sequence
  chemically synthesized
taatttttcctagaatgagggt

SEQ ID NO: 1311023 - DNA, 22 bp, Artificial Sequence
  chemically synthesized
ataactcgagccttaccctcat

SEQ ID NO: 1311024 - DNA, 22 bp, Artificial Sequence
  chemically synthesized
cataactcgagccttaccctca

SEQ ID NO: 1311025 - DNA, 22 bp, Artificial Sequence
  chemically synthesized
tcataactcgagccttaccctc

SEQ ID NO: 1311026 - DNA, 22 bp, Artificial Sequence
  chemically synthesized
ttcctagaatgagggtaaggct

SEQ ID NO: 1311027 - DNA, 22 bp, Artificial Sequence
  chemically synthesized
tcctagaatgagggtaaggctc

SEQ ID NO: 1311028 - DNA, 22 bp, Artificial Sequence
  chemically synthesized
cctagaatgagggtaaggctcg

SEQ ID NO: 1311029 - DNA, 22 bp, Artificial Sequence
  chemically synthesized
ctagaatgagggtaaggctcga

SEQ ID NO: 1311030 - DNA, 22 bp, Artificial Sequence
  chemically synthesized
gtgttttcataactcgagcctt

SEQ ID NO: 1311031 - DNA, 22 bp, Artificial Sequence
  chemically synthesized
gaatgagggtaaggctcgagtt

SEQ ID NO: 1311032 - DNA, 22 bp, Artificial Sequence
  chemically synthesized
acggtgttagtgttttcataac

SEQ ID NO: 1311033 - DNA, 22 bp, Artificial Sequence
  chemically synthesized
tgacggtgttagtgttttcata

SEQ ID NO: 1311034 - DNA, 22 bp, Artificial Sequence
  chemically synthesized
ctctgacggtgttagtgttttc

SEQ ID NO: 1311035 - DNA, 22 bp, Artificial Sequence
  chemically synthesized
actctgacggtgttagtgtttt

SEQ ID NO: 1311036 - DNA, 22 bp, Artificial Sequence
  chemically synthesized
gagttatgaaaacactaacacc

SEQ ID NO: 1311037 - DNA, 22 bp, Artificial Sequence
  chemically synthesized
agacttactctgacggtgttag

SEQ ID NO: 1311038 - DNA, 22 bp, Artificial Sequence
  chemically synthesized
aagacttactctgacggtgtta

SEQ ID NO: 1311039 - DNA, 22 bp, Artificial Sequence
  chemically synthesized
tgaaaacactaacaccgtcaga

SEQ ID NO: 1311040 - DNA, 22 bp, Artificial Sequence
  chemically synthesized
ccttaagacttactctgacggt

SEQ ID NO: 1311041 - DNA, 22 bp, Artificial Sequence
  chemically synthesized
tcccttaagacttactctgacg

SEQ ID NO: 1311042 - DNA, 22 bp, Artificial Sequence
  chemically synthesized
acaccgtcagagtaagtcttaa

SEQ ID NO: 1311043 - DNA, 22 bp, Artificial Sequence
  chemically synthesized
cagaagtggttctcccttaaga

SEQ ID NO: 1311044 - DNA, 22 bp, Artificial Sequence
  chemically synthesized
aagggagaaccacttctggaat

SEQ ID NO: 1311045 - DNA, 22 bp, Artificial Sequence
  chemically synthesized
agggagaaccacttctggaatt

SEQ ID NO: 1311046 - DNA, 22 bp, Artificial Sequence
  chemically synthesized
ctggaattccctggttttgctc

SEQ ID NO: 1311047 - DNA, 22 bp, Artificial Sequence
  chemically synthesized
tggaattccctggttttgctcc

SEQ ID NO: 1311048 - DNA, 22 bp, Artificial Sequence
  chemically synthesized
tacatcagccggggagcaaaac

SEQ ID NO: 1311049 - DNA, 22 bp, Artificial Sequence
  chemically synthesized
gaattccctggttttgctcccc

SEQ ID NO: 1311050 - DNA, 22 bp, Artificial Sequence
  chemically synthesized
tgtacatcagccggggagcaaa

SEQ ID NO: 1311051 - DNA, 22 bp, Artificial Sequence
  chemically synthesized
cctggttttgctccccggctga

SEQ ID NO: 1311052 - DNA, 22 bp, Artificial Sequence
  chemically synthesized
gttttgctccccggctgatgta

SEQ ID NO: 1311053 - DNA, 22 bp, Artificial Sequence
  chemically synthesized
gagacatatgttctgtacatca

SEQ ID NO: 1311054 - DNA, 22 bp, Artificial Sequence
  chemically synthesized
tgctccccggctgatgtacaga

SEQ ID NO: 1311055 - DNA, 22 bp, Artificial Sequence
  chemically synthesized
gctccccggctgatgtacagaa

SEQ ID NO: 1311056 - DNA, 22 bp, Artificial Sequence
  chemically synthesized
tagagacatatgttctgtacat

SEQ ID NO: 1311057 - DNA, 22 bp, Artificial Sequence
  chemically synthesized
ctccccggctgatgtacagaac

SEQ ID NO: 1311058 - DNA, 22 bp, Artificial Sequence
  chemically synthesized
ctagagacatatgttctgtaca

SEQ ID NO: 1311059 - DNA, 22 bp, Artificial Sequence
  chemically synthesized
ttctagagacatatgttctgta

SEQ ID NO: 1311060 - DNA, 22 bp, Artificial Sequence
  chemically synthesized
cccggctgatgtacagaacata

SEQ ID NO: 1311061 - DNA, 22 bp, Artificial Sequence
  chemically synthesized
ttcttctagagacatatgttct

SEQ ID NO: 1311062 - DNA, 22 bp, Artificial Sequence
  chemically synthesized
attattcttctagagacatatg

SEQ ID NO: 1311063 - DNA, 22 bp, Artificial Sequence
  chemically synthesized
gattattcttctagagacatat

SEQ ID NO: 1311064 - DNA, 22 bp, Artificial Sequence
  chemically synthesized
atgtacagaacatatgtctcta

SEQ ID NO: 1311065 - DNA, 22 bp, Artificial Sequence
  chemically synthesized
tgattattcttctagagacata

SEQ ID NO: 1311066 - DNA, 22 bp, Artificial Sequence
  chemically synthesized
taatgcctttgattattcttct

SEQ ID NO: 1311067 - DNA, 22 bp, Artificial Sequence
  chemically synthesized
gtaatgcctttgattattcttc

SEQ ID NO: 1311068 - DNA, 22 bp, Artificial Sequence
  chemically synthesized
tgtaatgcctttgattattctt

SEQ ID NO: 1311069 - DNA, 22 bp, Artificial Sequence
  chemically synthesized
tttgtaatgcctttgattattc

SEQ ID NO: 1311070 - DNA, 22 bp, Artificial Sequence
  chemically synthesized
tagaagaataatcaaaggcatt

SEQ ID NO: 1311071 - DNA, 22 bp, Artificial Sequence
  chemically synthesized
gaagaataatcaaaggcattac

SEQ ID NO: 1311072 - DNA, 22 bp, Artificial Sequence
  chemically synthesized
gtgagagggttctttgtaatgc

SEQ ID NO: 1311073 - DNA, 22 bp, Artificial Sequence
  chemically synthesized
tcagcaattagtgagagggttc

SEQ ID NO: 1311074 - DNA, 22 bp, Artificial Sequence
  chemically synthesized
taactatcagcaattagtgaga

SEQ ID NO: 1311075 - DNA, 22 bp, Artificial Sequence
  chemically synthesized
caaagaaccctctcactaattg

SEQ ID NO: 1311076 - DNA, 22 bp, Artificial Sequence
  chemically synthesized
tactgtaactatcagcaattag

SEQ ID NO: 1311077 - DNA, 22 bp, Artificial Sequence
  chemically synthesized
ggactgtactgtaactatcagc

SEQ ID NO: 1311078 - DNA, 22 bp, Artificial Sequence
  chemically synthesized
tcactaattgctgatagttaca

SEQ ID NO: 1311079 - DNA, 22 bp, Artificial Sequence
  chemically synthesized
actaattgctgatagttacagt

SEQ ID NO: 1311080 - DNA, 22 bp, Artificial Sequence
  chemically synthesized
attgctgatagttacagtacag

SEQ ID NO: 1311081 - DNA, 22 bp, Artificial Sequence
  chemically synthesized
tgggtgtctaggactgtactgt

SEQ ID NO: 1311082 - DNA, 22 bp, Artificial Sequence
  chemically synthesized
tatgggtgtctaggactgtact

SEQ ID NO: 1311083 - DNA, 22 bp, Artificial Sequence
  chemically synthesized
ctgatagttacagtacagtcct

SEQ ID NO: 1311084 - DNA, 22 bp, Artificial Sequence
  chemically synthesized
atagttacagtacagtcctaga

SEQ ID NO: 1311085 - DNA, 22 bp, Artificial Sequence
  chemically synthesized
cctctatgggtgtctaggactg

SEQ ID NO: 1311086 - DNA, 22 bp, Artificial Sequence
  chemically synthesized
cagtacagtcctagacacccat

SEQ ID NO: 1311087 - DNA, 22 bp, Artificial Sequence
  chemically synthesized
gacacccatagaggcagttctt

SEQ ID NO: 1311088 - DNA, 22 bp, Artificial Sequence
  chemically synthesized
atgtgtagtaggggcaaagaac

SEQ ID NO: 1311089 - DNA, 22 bp, Artificial Sequence
  chemically synthesized
tgatgtgtagtaggggcaaaga

SEQ ID NO: 1311090 - DNA, 22 bp, Artificial Sequence
  chemically synthesized
ggtggttctgatgtgtagtagg

SEQ ID NO: 1311091 - DNA, 22 bp, Artificial Sequence
  chemically synthesized
taggtggttctgatgtgtagta

SEQ ID NO: 1311092 - DNA, 22 bp, Artificial Sequence
  chemically synthesized
tctaggtggttctgatgtgtag

SEQ ID NO: 1311093 - DNA, 22 bp, Artificial Sequence
  chemically synthesized
tttgcccctactacacatcaga

SEQ ID NO: 1311094 - DNA, 22 bp, Artificial Sequence
  chemically synthesized
tgcccctactacacatcagaac

SEQ ID NO: 1311095 - DNA, 22 bp, Artificial Sequence
  chemically synthesized
gcccctactacacatcagaacc

SEQ ID NO: 1311096 - DNA, 22 bp, Artificial Sequence
  chemically synthesized
cccctactacacatcagaacca

SEQ ID NO: 1311097 - DNA, 22 bp, Artificial Sequence
  chemically synthesized
tggctctctaggtggttctgat

SEQ ID NO: 1311098 - DNA, 22 bp, Artificial Sequence
  chemically synthesized
atggctctctaggtggttctga

SEQ ID NO: 1311099 - DNA, 22 bp, Artificial Sequence
  chemically synthesized
tatggctctctaggtggttctg

SEQ ID NO: 1311100 - DNA, 22 bp, Artificial Sequence
  chemically synthesized
ctacacatcagaaccacctaga

SEQ ID NO: 1311101 - DNA, 22 bp, Artificial Sequence
  chemically synthesized
cacatcagaaccacctagagag

SEQ ID NO: 1311102 - DNA, 22 bp, Artificial Sequence
  chemically synthesized
ggtaatattttatggctctcta

SEQ ID NO: 1311103 - DNA, 22 bp, Artificial Sequence
  chemically synthesized
aggtaatattttatggctctct

SEQ ID NO: 1311104 - DNA, 22 bp, Artificial Sequence
  chemically synthesized
gagagccataaaatattaccta

SEQ ID NO: 1311105 - DNA, 22 bp, Artificial Sequence
  chemically synthesized
gggtggggtatgggcttaggta

SEQ ID NO: 1311106 - DNA, 22 bp, Artificial Sequence
  chemically synthesized
gtctggggtggggtatgggctt

SEQ ID NO: 1311107 - DNA, 22 bp, Artificial Sequence
  chemically synthesized
agttggtctggggtggggtatg

SEQ ID NO: 1311108 - DNA, 22 bp, Artificial Sequence
  chemically synthesized
cctaagcccataccccacccca

SEQ ID NO: 1311109 - DNA, 22 bp, Artificial Sequence
  chemically synthesized
agcccataccccaccccagacc

SEQ ID NO: 1311110 - DNA, 22 bp, Artificial Sequence
  chemically synthesized
aatcactatctctatgccgggg

SEQ ID NO: 1311111 - DNA, 22 bp, Artificial Sequence
  chemically synthesized
aaccatatgcccaagccccggc

SEQ ID NO: 1311112 - DNA, 22 bp, Artificial Sequence
  chemically synthesized
caaccatatgcccaagccccgg

SEQ ID NO: 1311113 - DNA, 22 bp, Artificial Sequence
  chemically synthesized
tcaaccatatgcccaagccccg

SEQ ID NO: 1311114 - DNA, 22 bp, Artificial Sequence
  chemically synthesized
tctctatgccggggcttgggca

SEQ ID NO: 1311115 - DNA, 22 bp, Artificial Sequence
  chemically synthesized
caattttcaaccatatgcccaa

SEQ ID NO: 1311116 - DNA, 22 bp, Artificial Sequence
  chemically synthesized
tatgccggggcttgggcatatg

SEQ ID NO: 1311117 - DNA, 22 bp, Artificial Sequence
  chemically synthesized
tgccggggcttgggcatatggt

SEQ ID NO: 1311118 - DNA, 22 bp, Artificial Sequence
  chemically synthesized
ggactgcaattttcaaccatat

SEQ ID NO: 1311119 - DNA, 22 bp, Artificial Sequence
  chemically synthesized
gggcatatggttgaaaattgca

SEQ ID NO: 1311120 - DNA, 22 bp, Artificial Sequence
  chemically synthesized
ggcatatggttgaaaattgcag

SEQ ID NO: 1311121 - DNA, 22 bp, Artificial Sequence
  chemically synthesized
tagcaggtcatctaggactgca

SEQ ID NO: 1311122 - DNA, 22 bp, Artificial Sequence
  chemically synthesized
aaaattgcagtcctagatgacc

SEQ ID NO: 1311123 - DNA, 22 bp, Artificial Sequence
  chemically synthesized
cagtcctagatgacctgctaca

SEQ ID NO: 1311124 - DNA, 22 bp, Artificial Sequence
  chemically synthesized
tgtgtgtgtgtattgtagcagg

SEQ ID NO: 1311125 - DNA, 22 bp, Artificial Sequence
  chemically synthesized
gtgtgtgtgtgtattgtagcag

SEQ ID NO: 1311126 - DNA, 22 bp, Artificial Sequence
  chemically synthesized
gatgacctgctacaatacacac

SEQ ID NO: 1311127 - DNA, 22 bp, Artificial Sequence
  chemically synthesized
aaaatgtgtttgtgtgtgtgtg

SEQ ID NO: 1311128 - DNA, 22 bp, Artificial Sequence
  chemically synthesized
ctacaatacacacacacacaaa

SEQ ID NO: 1311129 - DNA, 22 bp, Artificial Sequence
  chemically synthesized
caatacacacacacacaaacac

SEQ ID NO: 1311130 - DNA, 22 bp, Artificial Sequence
  chemically synthesized
tcaacttcatgtactctcatac

SEQ ID NO: 1311131 - DNA, 22 bp, Artificial Sequence
  chemically synthesized
caacttcatgtactctcatact

SEQ ID NO: 1311132 - DNA, 22 bp, Artificial Sequence
  chemically synthesized
aacttcatgtactctcatactt

SEQ ID NO: 1311133 - DNA, 22 bp, Artificial Sequence
  chemically synthesized
gtgcgtgaagtggaaagtatga

SEQ ID NO: 1311134 - DNA, 22 bp, Artificial Sequence
  chemically synthesized
catgtactctcatactttccac

SEQ ID NO: 1311135 - DNA, 22 bp, Artificial Sequence
  chemically synthesized
atgtactctcatactttccact

SEQ ID NO: 1311136 - DNA, 22 bp, Artificial Sequence
  chemically synthesized
tcatactttccacttcacgcac

SEQ ID NO: 1311137 - DNA, 22 bp, Artificial Sequence
  chemically synthesized
atactttccacttcacgcacta

SEQ ID NO: 1311138 - DNA, 22 bp, Artificial Sequence
  chemically synthesized
tccacttcacgcactagcactt

SEQ ID NO: 1311139 - DNA, 22 bp, Artificial Sequence
  chemically synthesized
ccacttcacgcactagcacttg

SEQ ID NO: 1311140 - DNA, 22 bp, Artificial Sequence
  chemically synthesized
cacttcacgcactagcacttgt

SEQ ID NO: 1311141 - DNA, 22 bp, Artificial Sequence
  chemically synthesized
ggaaggtacagggaacaagtgc

SEQ ID NO: 1311142 - DNA, 22 bp, Artificial Sequence
  chemically synthesized
aggaaggtacagggaacaagtg

SEQ ID NO: 1311143 - DNA, 22 bp, Artificial Sequence
  chemically synthesized
cacgcactagcacttgttccct

SEQ ID NO: 1311144 - DNA, 22 bp, Artificial Sequence
  chemically synthesized
acgcactagcacttgttccctg

SEQ ID NO: 1311145 - DNA, 22 bp, Artificial Sequence
  chemically synthesized
agtggacttaggaaggtacagg

SEQ ID NO: 1311146 - DNA, 22 bp, Artificial Sequence
  chemically synthesized
gcacttgttccctgtaccttcc

SEQ ID NO: 1311147 - DNA, 22 bp, Artificial Sequence
  chemically synthesized
taagtggacttaggaaggtaca

SEQ ID NO: 1311148 - DNA, 22 bp, Artificial Sequence
  chemically synthesized
ctaagtggacttaggaaggtac

SEQ ID NO: 1311149 - DNA, 22 bp, Artificial Sequence
  chemically synthesized
tctaagtggacttaggaaggta

SEQ ID NO: 1311150 - DNA, 22 bp, Artificial Sequence
  chemically synthesized
gttccctgtaccttcctaagtc

SEQ ID NO: 1311151 - DNA, 22 bp, Artificial Sequence
  chemically synthesized
attttctaagtggacttaggaa

SEQ ID NO: 1311152 - DNA, 22 bp, Artificial Sequence
  chemically synthesized
ttccctgtaccttcctaagtcc

SEQ ID NO: 1311153 - DNA, 22 bp, Artificial Sequence
  chemically synthesized
cctgtaccttcctaagtccact

SEQ ID NO: 1311154 - DNA, 22 bp, Artificial Sequence
  chemically synthesized
taccttcctaagtccacttaga

SEQ ID NO: 1311155 - DNA, 22 bp, Artificial Sequence
  chemically synthesized
cctaagtccacttagaaaatca

SEQ ID NO: 1311156 - DNA, 22 bp, Artificial Sequence
  chemically synthesized
ctaagtccacttagaaaatcag

SEQ ID NO: 1311157 - DNA, 22 bp, Artificial Sequence
  chemically synthesized
aaaatgtaaaatctgattttct

SEQ ID NO: 1311158 - DNA, 22 bp, Artificial Sequence
  chemically synthesized
agtccacttagaaaatcagatt

SEQ ID NO: 1311159 - DNA, 22 bp, Artificial Sequence
  chemically synthesized
agaaaatcagattttacatttt

SEQ ID NO: 1311160 - DNA, 22 bp, Artificial Sequence
  chemically synthesized
gaaaatcagattttacattttt

SEQ ID NO: 1311161 - DNA, 22 bp, Artificial Sequence
  chemically synthesized
aaatgcacacacgaaaaaatta

SEQ ID NO: 1311162 - DNA, 22 bp, Artificial Sequence
  chemically synthesized
tacatttttaattttttcgtgt

SEQ ID NO: 1311163 - DNA, 22 bp, Artificial Sequence
  chemically synthesized
attaaaatgcacacacgaaaaa

SEQ ID NO: 1311164 - DNA, 22 bp, Artificial Sequence
  chemically synthesized
acatttttaattttttcgtgtg

SEQ ID NO: 1311165 - DNA, 22 bp, Artificial Sequence
  chemically synthesized
cattaaaatgcacacacgaaaa

SEQ ID NO: 1311166 - DNA, 22 bp, Artificial Sequence
  chemically synthesized
catttttaattttttcgtgtgt

SEQ ID NO: 1311167 - DNA, 22 bp, Artificial Sequence
  chemically synthesized
tcattaaaatgcacacacgaaa

SEQ ID NO: 1311168 - DNA, 22 bp, Artificial Sequence
  chemically synthesized
tttcattaaaatgcacacacga

SEQ ID NO: 1311169 - DNA, 22 bp, Artificial Sequence
  chemically synthesized
ttaattttttcgtgtgtgcatt

SEQ ID NO: 1311170 - DNA, 22 bp, Artificial Sequence
  chemically synthesized
taattttttcgtgtgtgcattt

SEQ ID NO: 1311171 - DNA, 22 bp, Artificial Sequence
  chemically synthesized
aattttttcgtgtgtgcatttt

SEQ ID NO: 1311172 - DNA, 22 bp, Artificial Sequence
  chemically synthesized
attttttcgtgtgtgcatttta

SEQ ID NO: 1311173 - DNA, 22 bp, Artificial Sequence
  chemically synthesized
gtgatactctttcattaaaatg

SEQ ID NO: 1311174 - DNA, 22 bp, Artificial Sequence
  chemically synthesized
tttcgtgtgtgcattttaatga

SEQ ID NO: 1311175 - DNA, 22 bp, Artificial Sequence
  chemically synthesized
agtgatactctttcattaaaat

SEQ ID NO: 1311176 - DNA, 22 bp, Artificial Sequence
  chemically synthesized
ttcgtgtgtgcattttaatgaa

SEQ ID NO: 1311177 - DNA, 22 bp, Artificial Sequence
  chemically synthesized
tcgtgtgtgcattttaatgaaa

SEQ ID NO: 1311178 - DNA, 22 bp, Artificial Sequence
  chemically synthesized
cgtgtgtgcattttaatgaaag

SEQ ID NO: 1311179 - DNA, 22 bp, Artificial Sequence
  chemically synthesized
gtgtgtgcattttaatgaaaga

SEQ ID NO: 1311180 - DNA, 22 bp, Artificial Sequence
  chemically synthesized
tcttagtgatactctttcatta

SEQ ID NO: 1311181 - DNA, 22 bp, Artificial Sequence
  chemically synthesized
atcttagtgatactctttcatt

SEQ ID NO: 1311182 - DNA, 22 bp, Artificial Sequence
  chemically synthesized
tatcttagtgatactctttcat

SEQ ID NO: 1311183 - DNA, 22 bp, Artificial Sequence
  chemically synthesized
tcacattttatcttagtgatac

SEQ ID NO: 1311184 - DNA, 22 bp, Artificial Sequence
  chemically synthesized
taatgaaagagtatcactaaga

SEQ ID NO: 1311185 - DNA, 22 bp, Artificial Sequence
  chemically synthesized
aatgaaagagtatcactaagat

SEQ ID NO: 1311186 - DNA, 22 bp, Artificial Sequence
  chemically synthesized
ctgtcacattttatcttagtga

SEQ ID NO: 1311187 - DNA, 22 bp, Artificial Sequence
  chemically synthesized
atgaaagagtatcactaagata

SEQ ID NO: 1311188 - DNA, 22 bp, Artificial Sequence
  chemically synthesized
cctactgtcacattttatctta

SEQ ID NO: 1311189 - DNA, 22 bp, Artificial Sequence
  chemically synthesized
gttgcctactgtcacattttat

SEQ ID NO: 1311190 - DNA, 22 bp, Artificial Sequence
  chemically synthesized
agataaaatgtgacagtaggca

SEQ ID NO: 1311191 - DNA, 22 bp, Artificial Sequence
  chemically synthesized
tgaagaaagaaattggttgcct

SEQ ID NO: 1311192 - DNA, 22 bp, Artificial Sequence
  chemically synthesized
tgtgaagaaagaaattggttgc

SEQ ID NO: 1311193 - DNA, 22 bp, Artificial Sequence
  chemically synthesized
aatgctctgtgaagaaagaaat

SEQ ID NO: 1311194 - DNA, 22 bp, Artificial Sequence
  chemically synthesized
caatgctctgtgaagaaagaaa

SEQ ID NO: 1311195 - DNA, 22 bp, Artificial Sequence
  chemically synthesized
tcaatgctctgtgaagaaagaa

SEQ ID NO: 1311196 - DNA, 22 bp, Artificial Sequence
  chemically synthesized
ttttcaatgctctgtgaagaaa

SEQ ID NO: 1311197 - DNA, 22 bp, Artificial Sequence
  chemically synthesized
tgtctattttcaatgctctgtg

SEQ ID NO: 1311198 - DNA, 22 bp, Artificial Sequence
  chemically synthesized
ctttcttcacagagcattgaaa

SEQ ID NO: 1311199 - DNA, 22 bp, Artificial Sequence
  chemically synthesized
tttcttcacagagcattgaaaa

SEQ ID NO: 1311200 - DNA, 22 bp, Artificial Sequence
  chemically synthesized
tcttcacagagcattgaaaata

SEQ ID NO: 1311201 - DNA, 22 bp, Artificial Sequence
  chemically synthesized
cttcacagagcattgaaaatag

SEQ ID NO: 1311202 - DNA, 22 bp, Artificial Sequence
  chemically synthesized
ttcacagagcattgaaaataga

SEQ ID NO: 1311203 - DNA, 22 bp, Artificial Sequence
  chemically synthesized
cacagagcattgaaaatagaca

SEQ ID NO: 1311204 - DNA, 22 bp, Artificial Sequence
  chemically synthesized
acagagcattgaaaatagacat

SEQ ID NO: 1311205 - DNA, 22 bp, Artificial Sequence
  chemically synthesized
aggcaatcaattatgtctattt

SEQ ID NO: 1311206 - DNA, 22 bp, Artificial Sequence
  chemically synthesized
aaaatagacataattgattgcc

SEQ ID NO: 1311207 - DNA, 22 bp, Artificial Sequence
  chemically synthesized
attgccttagattcatgcccat

SEQ ID NO: 1311208 - DNA, 22 bp, Artificial Sequence
  chemically synthesized
ccttagattcatgcccatatat

SEQ ID NO: 1311209 - DNA, 22 bp, Artificial Sequence
  chemically synthesized
agattcatgcccatatatacat

SEQ ID NO: 1311210 - DNA, 22 bp, Artificial Sequence
  chemically synthesized
gattcatgcccatatatacata

SEQ ID NO: 1311211 - DNA, 22 bp, Artificial Sequence
  chemically synthesized
atgcccatatatacatatatat

SEQ ID NO: 1311212 - DNA, 22 bp, Artificial Sequence
  chemically synthesized
aagtatatatgtgcatatatat

SEQ ID NO: 1311213 - DNA, 22 bp, Artificial Sequence
  chemically synthesized
gaagtatatatgtgcatatata

SEQ ID NO: 1311214 - DNA, 22 bp, Artificial Sequence
  chemically synthesized
tcaaaatgagtttgaagtatat

SEQ ID NO: 1311215 - DNA, 22 bp, Artificial Sequence
  chemically synthesized
tgccctatcaaaatgagtttga

SEQ ID NO: 1311216 - DNA, 22 bp, Artificial Sequence
  chemically synthesized
ctgtgccctatcaaaatgagtt

SEQ ID NO: 1311217 - DNA, 22 bp, Artificial Sequence
  chemically synthesized
caaactcattttgatagggcac

SEQ ID NO: 1311218 - DNA, 22 bp, Artificial Sequence
  chemically synthesized
aaactcattttgatagggcaca

SEQ ID NO: 1311219 - DNA, 22 bp, Artificial Sequence
  chemically synthesized
caccaggaaatcactactgtgc

SEQ ID NO: 1311220 - DNA, 22 bp, Artificial Sequence
  chemically synthesized
attttgatagggcacagtagtg

SEQ ID NO: 1311221 - DNA, 22 bp, Artificial Sequence
  chemically synthesized
ttacaccaggaaatcactactg

SEQ ID NO: 1311222 - DNA, 22 bp, Artificial Sequence
  chemically synthesized
tgatagggcacagtagtgattt

SEQ ID NO: 1311223 - DNA, 22 bp, Artificial Sequence
  chemically synthesized
gatagggcacagtagtgatttc

SEQ ID NO: 1311224 - DNA, 22 bp, Artificial Sequence
  chemically synthesized
ttattacaccaggaaatcacta

SEQ ID NO: 1311225 - DNA, 22 bp, Artificial Sequence
  chemically synthesized
atagggcacagtagtgatttcc

SEQ ID NO: 1311226 - DNA, 22 bp, Artificial Sequence
  chemically synthesized
catgaaaaatgaacggattgtt

SEQ ID NO: 1311227 - DNA, 22 bp, Artificial Sequence
  chemically synthesized
cctggtgtaataacaatccgtt

SEQ ID NO: 1311228 - DNA, 22 bp, Artificial Sequence
  chemically synthesized
ctggtgtaataacaatccgttc

SEQ ID NO: 1311229 - DNA, 22 bp, Artificial Sequence
  chemically synthesized
gtgtaataacaatccgttcatt

SEQ ID NO: 1311230 - DNA, 22 bp, Artificial Sequence
  chemically synthesized
atttttcatgtaacattgtcta

SEQ ID NO: 1311231 - DNA, 22 bp, Artificial Sequence
  chemically synthesized
ttcatgtaacattgtctatatg

SEQ ID NO: 1311232 - DNA, 22 bp, Artificial Sequence
  chemically synthesized
tcatgtaacattgtctatatga

SEQ ID NO: 1311233 - DNA, 22 bp, Artificial Sequence
  chemically synthesized
catgtaacattgtctatatgat

SEQ ID NO: 1311234 - DNA, 22 bp, Artificial Sequence
  chemically synthesized
atgtaacattgtctatatgatt

SEQ ID NO: 1311235 - DNA, 22 bp, Artificial Sequence
  chemically synthesized
tgtataaaaagtataataaaat

SEQ ID NO: 1311236 - DNA, 22 bp, Artificial Sequence
  chemically synthesized
tatgtataaaaagtataataaa

SEQ ID NO: 1311237 - DNA, 22 bp, Artificial Sequence
  chemically synthesized
tctatatgattttattatactt

SEQ ID NO: 1311238 - DNA, 22 bp, Artificial Sequence
  chemically synthesized
attctatgtataaaaagtataa

SEQ ID NO: 1311239 - DNA, 22 bp, Artificial Sequence
  chemically synthesized
cattctatgtataaaaagtata

SEQ ID NO: 1311240 - DNA, 22 bp, Artificial Sequence
  chemically synthesized
tatgattttattatacttttta

SEQ ID NO: 1311241 - DNA, 22 bp, Artificial Sequence
  chemically synthesized
tattatactttttatacataga

SEQ ID NO: 1311242 - DNA, 22 bp, Artificial Sequence
  chemically synthesized
attatactttttatacatagaa

SEQ ID NO: 1311243 - DNA, 22 bp, Artificial Sequence
  chemically synthesized
acaaatatttcattctatgtat

SEQ ID NO: 1311244 - DNA, 22 bp, Artificial Sequence
  chemically synthesized
ttatactttttatacatagaat

SEQ ID NO: 1311245 - DNA, 22 bp, Artificial Sequence
  chemically synthesized
ttaacaaatatttcattctatg

SEQ ID NO: 1311246 - DNA, 22 bp, Artificial Sequence
  chemically synthesized
tactttttatacatagaatgaa

SEQ ID NO: 1311247 - DNA, 22 bp, Artificial Sequence
  chemically synthesized
attaacaaatatttcattctat

SEQ ID NO: 1311248 - DNA, 22 bp, Artificial Sequence
  chemically synthesized
atttattaacaaatatttcatt

SEQ ID NO: 1311249 - DNA, 22 bp, Artificial Sequence
  chemically synthesized
tttatacatagaatgaaatatt

SEQ ID NO: 1311250 - DNA, 22 bp, Artificial Sequence
  chemically synthesized
catttattaacaaatatttcat

SEQ ID NO: 1311251 - DNA, 22 bp, Artificial Sequence
  chemically synthesized
ttatacatagaatgaaatattt

SEQ ID NO: 1311252 - DNA, 22 bp, Artificial Sequence
  chemically synthesized
tatacatagaatgaaatatttg

SEQ ID NO: 1311253 - DNA, 22 bp, Artificial Sequence
  chemically synthesized
ttcatttattaacaaatatttc

SEQ ID NO: 1311254 - DNA, 22 bp, Artificial Sequence
  chemically synthesized
atacatagaatgaaatatttgt

SEQ ID NO: 1311255 - DNA, 22 bp, Artificial Sequence
  chemically synthesized
tacatagaatgaaatatttgtt

SEQ ID NO: 1311256 - DNA, 22 bp, Artificial Sequence
  chemically synthesized
gttcttcatttattaacaaata

SEQ ID NO: 1311257 - DNA, 22 bp, Artificial Sequence
  chemically synthesized
agttcttcatttattaacaaat

SEQ ID NO: 1311258 - DNA, 22 bp, Artificial Sequence
  chemically synthesized
gttaataaatgaagaactaagg

SEQ ID NO: 1311259 - DNA, 22 bp, Artificial Sequence
  chemically synthesized
tagagtgagtgcccttagttct

SEQ ID NO: 1311260 - DNA, 22 bp, Artificial Sequence
  chemically synthesized
ttaataaatgaagaactaaggg

SEQ ID NO: 1311261 - DNA, 22 bp, Artificial Sequence
  chemically synthesized
ctatagagtgagtgcccttagt

SEQ ID NO: 1311262 - DNA, 22 bp, Artificial Sequence
  chemically synthesized
ataaatgaagaactaagggcac

SEQ ID NO: 1311263 - DNA, 22 bp, Artificial Sequence
  chemically synthesized
gctatagagtgagtgcccttag

SEQ ID NO: 1311264 - DNA, 22 bp, Artificial Sequence
  chemically synthesized
tgctatagagtgagtgccctta

SEQ ID NO: 1311265 - DNA, 22 bp, Artificial Sequence
  chemically synthesized
ttgctatagagtgagtgccctt

SEQ ID NO: 1311266 - DNA, 22 bp, Artificial Sequence
  chemically synthesized
agggcactcactctatagcaaa

SEQ ID NO: 1311267 - DNA, 22 bp, Artificial Sequence
  chemically synthesized
gtagaggtggcatttttgctat

SEQ ID NO: 1311268 - DNA, 22 bp, Artificial Sequence
  chemically synthesized
ctagtagaggtggcatttttgc

SEQ ID NO: 1311269 - DNA, 22 bp, Artificial Sequence
  chemically synthesized
actagtagaggtggcatttttg

SEQ ID NO: 1311270 - DNA, 22 bp, Artificial Sequence
  chemically synthesized
ttactagtagaggtggcatttt

SEQ ID NO: 1311271 - DNA, 22 bp, Artificial Sequence
  chemically synthesized
actctatagcaaaaatgccacc

SEQ ID NO: 1311272 - DNA, 22 bp, Artificial Sequence
  chemically synthesized
cttactagtagaggtggcattt

SEQ ID NO: 1311273 - DNA, 22 bp, Artificial Sequence
  chemically synthesized
tcttactagtagaggtggcatt

SEQ ID NO: 1311274 - DNA, 22 bp, Artificial Sequence
  chemically synthesized
ttcttactagtagaggtggcat

SEQ ID NO: 1311275 - DNA, 22 bp, Artificial Sequence
  chemically synthesized
tttcttactagtagaggtggca

SEQ ID NO: 1311276 - DNA, 22 bp, Artificial Sequence
  chemically synthesized
tatagcaaaaatgccacctcta

SEQ ID NO: 1311277 - DNA, 22 bp, Artificial Sequence
  chemically synthesized
tttttcttactagtagaggtgg

SEQ ID NO: 1311278 - DNA, 22 bp, Artificial Sequence
  chemically synthesized
tagcaaaaatgccacctctact

SEQ ID NO: 1311279 - DNA, 22 bp, Artificial Sequence
  chemically synthesized
ctttttcttactagtagaggtg

SEQ ID NO: 1311280 - DNA, 22 bp, Artificial Sequence
  chemically synthesized
tttctttttcttactagtagag

SEQ ID NO: 1311281 - DNA, 22 bp, Artificial Sequence
  chemically synthesized
atttctttttcttactagtaga

SEQ ID NO: 1311282 - DNA, 22 bp, Artificial Sequence
  chemically synthesized
tactagtaagaaaaagaaataa

SEQ ID NO: 1311283 - DNA, 22 bp, Artificial Sequence
  chemically synthesized
ctagtaagaaaaagaaataaac

SEQ ID NO: 1311284 - DNA, 22 bp, Artificial Sequence
  chemically synthesized
gtaagaaaaagaaataaacatt

SEQ ID NO: 1311285 - DNA, 22 bp, Artificial Sequence
  chemically synthesized
ccgcaataatagaaaatgttta

SEQ ID NO: 1311286 - DNA, 22 bp, Artificial Sequence
  chemically synthesized
gaaagttgccgcaataatagaa

SEQ ID NO: 1311287 - DNA, 22 bp, Artificial Sequence
  chemically synthesized
agaaagttgccgcaataataga

SEQ ID NO: 1311288 - DNA, 22 bp, Artificial Sequence
  chemically synthesized
tagaaagttgccgcaataatag

SEQ ID NO: 1311289 - DNA, 22 bp, Artificial Sequence
  chemically synthesized
ttagaaagttgccgcaataata

SEQ ID NO: 1311290 - DNA, 22 bp, Artificial Sequence
  chemically synthesized
cttttagaaagttgccgcaata

SEQ ID NO: 1311291 - DNA, 22 bp, Artificial Sequence
  chemically synthesized
ccttttagaaagttgccgcaat

SEQ ID NO: 1311292 - DNA, 22 bp, Artificial Sequence
  chemically synthesized
tccttttagaaagttgccgcaa

SEQ ID NO: 1311293 - DNA, 22 bp, Artificial Sequence
  chemically synthesized
ttccttttagaaagttgccgca

SEQ ID NO: 1311294 - DNA, 22 bp, Artificial Sequence
  chemically synthesized
tttccttttagaaagttgccgc

SEQ ID NO: 1311295 - DNA, 22 bp, Artificial Sequence
  chemically synthesized
ttttccttttagaaagttgccg

SEQ ID NO: 1311296 - DNA, 22 bp, Artificial Sequence
  chemically synthesized
tttttccttttagaaagttgcc

SEQ ID NO: 1311297 - DNA, 22 bp, Artificial Sequence
  chemically synthesized
tctattattgcggcaactttct

SEQ ID NO: 1311298 - DNA, 22 bp, Artificial Sequence
  chemically synthesized
ttttttccttttagaaagttgc

SEQ ID NO: 1311299 - DNA, 22 bp, Artificial Sequence
  chemically synthesized
ctattattgcggcaactttcta

SEQ ID NO: 1311300 - DNA, 22 bp, Artificial Sequence
  chemically synthesized
tattattgcggcaactttctaa

SEQ ID NO: 1311301 - DNA, 22 bp, Artificial Sequence
  chemically synthesized
ttattgcggcaactttctaaaa

SEQ ID NO: 1311302 - DNA, 22 bp, Artificial Sequence
  chemically synthesized
tgtttttttttccttttagaaa

SEQ ID NO: 1311303 - DNA, 22 bp, Artificial Sequence
  chemically synthesized
ttgcggcaactttctaaaagga

SEQ ID NO: 1311304 - DNA, 22 bp, Artificial Sequence
  chemically synthesized
ctgtgtttttttttccttttag

SEQ ID NO: 1311305 - DNA, 22 bp, Artificial Sequence
  chemically synthesized
cctgtgtttttttttcctttta

SEQ ID NO: 1311306 - DNA, 22 bp, Artificial Sequence
  chemically synthesized
cggcaactttctaaaaggaaaa

SEQ ID NO: 1311307 - DNA, 22 bp, Artificial Sequence
  chemically synthesized
tctaaaaggaaaaaaaaacaca

SEQ ID NO: 1311308 - DNA, 22 bp, Artificial Sequence
  chemically synthesized
ctaaaaggaaaaaaaaacacag

SEQ ID NO: 1311309 - DNA, 22 bp, Artificial Sequence
  chemically synthesized
taaaaggaaaaaaaaacacagg

SEQ ID NO: 1311310 - DNA, 22 bp, Artificial Sequence
  chemically synthesized
tgtgatagtcttcctgtgtttt

SEQ ID NO: 1311311 - DNA, 22 bp, Artificial Sequence
  chemically synthesized
aaaggaaaaaaaaacacaggaa

SEQ ID NO: 1311312 - DNA, 22 bp, Artificial Sequence
  chemically synthesized
attatgtgatagtcttcctgtg

SEQ ID NO: 1311313 - DNA, 22 bp, Artificial Sequence
  chemically synthesized
cattatgtgatagtcttcctgt

SEQ ID NO: 1311314 - DNA, 22 bp, Artificial Sequence
  chemically synthesized
aaggatttcattatgtgatagt

SEQ ID NO: 1311315 - DNA, 22 bp, Artificial Sequence
  chemically synthesized
tcacataatgaaatcctttaat

SEQ ID NO: 1311316 - DNA, 22 bp, Artificial Sequence
  chemically synthesized
taattgttacttctttctctat

SEQ ID NO: 1311317 - DNA, 22 bp, Artificial Sequence
  chemically synthesized
aattgttacttctttctctatc

SEQ ID NO: 1311318 - DNA, 22 bp, Artificial Sequence
  chemically synthesized
attgttacttctttctctatct

SEQ ID NO: 1311319 - DNA, 22 bp, Artificial Sequence
  chemically synthesized
ttacttctttctctatctcact

SEQ ID NO: 1311320 - DNA, 22 bp, Artificial Sequence
  chemically synthesized
cttctttctctatctcactctc

SEQ ID NO: 1311321 - DNA, 22 bp, Artificial Sequence
  chemically synthesized
gatgaaacaaaagagagtgaga

SEQ ID NO: 1311322 - DNA, 22 bp, Artificial Sequence
  chemically synthesized
ggatgaaacaaaagagagtgag

SEQ ID NO: 1311323 - DNA, 22 bp, Artificial Sequence
  chemically synthesized
ctttctctatctcactctcttt

SEQ ID NO: 1311324 - DNA, 22 bp, Artificial Sequence
  chemically synthesized
ttggatgaaacaaaagagagtg

SEQ ID NO: 1311325 - DNA, 22 bp, Artificial Sequence
  chemically synthesized
tttctctatctcactctctttt

SEQ ID NO: 1311326 - DNA, 22 bp, Artificial Sequence
  chemically synthesized
cttggatgaaacaaaagagagt

SEQ ID NO: 1311327 - DNA, 22 bp, Artificial Sequence
  chemically synthesized
tcttggatgaaacaaaagagag

SEQ ID NO: 1311328 - DNA, 22 bp, Artificial Sequence
  chemically synthesized
tctctatctcactctcttttgt

SEQ ID NO: 1311329 - DNA, 22 bp, Artificial Sequence
  chemically synthesized
ctctatctcactctcttttgtt

SEQ ID NO: 1311330 - DNA, 22 bp, Artificial Sequence
  chemically synthesized
tctatctcactctcttttgttt

SEQ ID NO: 1311331 - DNA, 22 bp, Artificial Sequence
  chemically synthesized
tatctcactctcttttgtttca

SEQ ID NO: 1311332 - DNA, 22 bp, Artificial Sequence
  chemically synthesized
tctcactctcttttgtttcatc

SEQ ID NO: 1311333 - DNA, 22 bp, Artificial Sequence
  chemically synthesized
aatagttttcttggatgaaaca

SEQ ID NO: 1311334 - DNA, 22 bp, Artificial Sequence
  chemically synthesized
actctcttttgtttcatccaag

SEQ ID NO: 1311335 - DNA, 22 bp, Artificial Sequence
  chemically synthesized
tcttttgtttcatccaagaaaa

SEQ ID NO: 1311336 - DNA, 22 bp, Artificial Sequence
  chemically synthesized
ttttgtttcatccaagaaaact

SEQ ID NO: 1311337 - DNA, 22 bp, Artificial Sequence
  chemically synthesized
ttgtttcatccaagaaaactat

SEQ ID NO: 1311338 - DNA, 22 bp, Artificial Sequence
  chemically synthesized
tataatagttaaatagttttct

SEQ ID NO: 1311339 - DNA, 22 bp, Artificial Sequence
  chemically synthesized
tgtttcatccaagaaaactatt

SEQ ID NO: 1311340 - DNA, 22 bp, Artificial Sequence
  chemically synthesized
gtttcatccaagaaaactattt

SEQ ID NO: 1311341 - DNA, 22 bp, Artificial Sequence
  chemically synthesized
tttcatccaagaaaactattta

SEQ ID NO: 1311342 - DNA, 22 bp, Artificial Sequence
  chemically synthesized
catccaagaaaactatttaact

SEQ ID NO: 1311343 - DNA, 22 bp, Artificial Sequence
  chemically synthesized
atccaagaaaactatttaacta

SEQ ID NO: 1311344 - DNA, 22 bp, Artificial Sequence
  chemically synthesized
catatcactatataatagttaa

SEQ ID NO: 1311345 - DNA, 22 bp, Artificial Sequence
  chemically synthesized
attacatatcactatataatag

SEQ ID NO: 1311346 - DNA, 22 bp, Artificial Sequence
  chemically synthesized
taattacatatcactatataat

SEQ ID NO: 1311347 - DNA, 22 bp, Artificial Sequence
  chemically synthesized
tttaactattatatagtgatat

SEQ ID NO: 1311348 - DNA, 22 bp, Artificial Sequence
  chemically synthesized
aactattatatagtgatatgta

SEQ ID NO: 1311349 - DNA, 22 bp, Artificial Sequence
  chemically synthesized
aaagactctaattacatatcac

SEQ ID NO: 1311350 - DNA, 22 bp, Artificial Sequence
  chemically synthesized
actattatatagtgatatgtaa

SEQ ID NO: 1311351 - DNA, 22 bp, Artificial Sequence
  chemically synthesized
attgaaagactctaattacata

SEQ ID NO: 1311352 - DNA, 22 bp, Artificial Sequence
  chemically synthesized
ttatatagtgatatgtaattag

SEQ ID NO: 1311353 - DNA, 22 bp, Artificial Sequence
  chemically synthesized
aattgaaagactctaattacat

SEQ ID NO: 1311354 - DNA, 22 bp, Artificial Sequence
  chemically synthesized
taattgaaagactctaattaca

SEQ ID NO: 1311355 - DNA, 22 bp, Artificial Sequence
  chemically synthesized
tatagtgatatgtaattagagt

SEQ ID NO: 1311356 - DNA, 22 bp, Artificial Sequence
  chemically synthesized
acaattttaattgaaagactct

SEQ ID NO: 1311357 - DNA, 22 bp, Artificial Sequence
  chemically synthesized
aacaattttaattgaaagactc

SEQ ID NO: 1311358 - DNA, 22 bp, Artificial Sequence
  chemically synthesized
tagcttaacaattttaattgaa

SEQ ID NO: 1311359 - DNA, 22 bp, Artificial Sequence
  chemically synthesized
gagtctttcaattaaaattgtt

SEQ ID NO: 1311360 - DNA, 22 bp, Artificial Sequence
  chemically synthesized
tcaattaaaattgttaagctac

SEQ ID NO: 1311361 - DNA, 22 bp, Artificial Sequence
  chemically synthesized
caattaaaattgttaagctaca

SEQ ID NO: 1311362 - DNA, 22 bp, Artificial Sequence
  chemically synthesized
aattaaaattgttaagctacag

SEQ ID NO: 1311363 - DNA, 22 bp, Artificial Sequence
  chemically synthesized
ggtggtgtcaacaatctgtagc

SEQ ID NO: 1311364 - DNA, 22 bp, Artificial Sequence
  chemically synthesized
aaattgttaagctacagattgt

SEQ ID NO: 1311365 - DNA, 22 bp, Artificial Sequence
  chemically synthesized
ttaagctacagattgttgacac

SEQ ID NO: 1311366 - DNA, 22 bp, Artificial Sequence
  chemically synthesized
agctacagattgttgacaccac

SEQ ID NO: 1311367 - DNA, 22 bp, Artificial Sequence
  chemically synthesized
atcaagtatattcggtggtgtc

SEQ ID NO: 1311368 - DNA, 22 bp, Artificial Sequence
  chemically synthesized
aatcaagtatattcggtggtgt

SEQ ID NO: 1311369 - DNA, 22 bp, Artificial Sequence
  chemically synthesized
taatcaagtatattcggtggtg

SEQ ID NO: 1311370 - DNA, 22 bp, Artificial Sequence
  chemically synthesized
cagattgttgacaccaccgaat

SEQ ID NO: 1311371 - DNA, 22 bp, Artificial Sequence
  chemically synthesized
ttttaatcaagtatattcggtg

SEQ ID NO: 1311372 - DNA, 22 bp, Artificial Sequence
  chemically synthesized
attttaatcaagtatattcggt

SEQ ID NO: 1311373 - DNA, 22 bp, Artificial Sequence
  chemically synthesized
ttgacaccaccgaatatacttg

SEQ ID NO: 1311374 - DNA, 22 bp, Artificial Sequence
  chemically synthesized
tacttattttaatcaagtatat

SEQ ID NO: 1311375 - DNA, 22 bp, Artificial Sequence
  chemically synthesized
acaccaccgaatatacttgatt

SEQ ID NO: 1311376 - DNA, 22 bp, Artificial Sequence
  chemically synthesized
catctatacttattttaatcaa

SEQ ID NO: 1311377 - DNA, 22 bp, Artificial Sequence
  chemically synthesized
acatctatacttattttaatca

SEQ ID NO: 1311378 - DNA, 22 bp, Artificial Sequence
  chemically synthesized
tttacatctatacttattttaa

SEQ ID NO: 1311379 - DNA, 22 bp, Artificial Sequence
  chemically synthesized
gtttacatctatacttatttta

SEQ ID NO: 1311380 - DNA, 22 bp, Artificial Sequence
  chemically synthesized
catttgtttacatctatactta

SEQ ID NO: 1311381 - DNA, 22 bp, Artificial Sequence
  chemically synthesized
acatttgtttacatctatactt

SEQ ID NO: 1311382 - DNA, 22 bp, Artificial Sequence
  chemically synthesized
gattaaaataagtatagatgta

SEQ ID NO: 1311383 - DNA, 22 bp, Artificial Sequence
  chemically synthesized
tttacatttgtttacatctata

SEQ ID NO: 1311384 - DNA, 22 bp, Artificial Sequence
  chemically synthesized
attaaaataagtatagatgtaa

SEQ ID NO: 1311385 - DNA, 22 bp, Artificial Sequence
  chemically synthesized
tgtttacatttgtttacatcta

SEQ ID NO: 1311386 - DNA, 22 bp, Artificial Sequence
  chemically synthesized
aaataagtatagatgtaaacaa

SEQ ID NO: 1311387 - DNA, 22 bp, Artificial Sequence
  chemically synthesized
agtgcaattctgtttacatttg

SEQ ID NO: 1311388 - DNA, 22 bp, Artificial Sequence
  chemically synthesized
aagtgcaattctgtttacattt

SEQ ID NO: 1311389 - DNA, 22 bp, Artificial Sequence
  chemically synthesized
aataatgaatatcatttaagtg

SEQ ID NO: 1311390 - DNA, 22 bp, Artificial Sequence
  chemically synthesized
cacttaaatgatattcattatt

SEQ ID NO: 1311391 - DNA, 22 bp, Artificial Sequence
  chemically synthesized
aataaatgaactaaataatgaa

SEQ ID NO: 1311392 - DNA, 22 bp, Artificial Sequence
  chemically synthesized
aaataaatgaactaaataatga

SEQ ID NO: 1311393 - DNA, 22 bp, Artificial Sequence
  chemically synthesized
taaataaatgaactaaataatg

SEQ ID NO: 1311394 - DNA, 22 bp, Artificial Sequence
  chemically synthesized
aaatgatattcattatttagtt

SEQ ID NO: 1311395 - DNA, 22 bp, Artificial Sequence
  chemically synthesized
aatgatattcattatttagttc

SEQ ID NO: 1311396 - DNA, 22 bp, Artificial Sequence
  chemically synthesized
attatttagttcatttatttaa

SEQ ID NO: 1311397 - DNA, 22 bp, Artificial Sequence
  chemically synthesized
gccatcaatgcattttaaataa

SEQ ID NO: 1311398 - DNA, 22 bp, Artificial Sequence
  chemically synthesized
tttagttcatttatttaaaatg

SEQ ID NO: 1311399 - DNA, 22 bp, Artificial Sequence
  chemically synthesized
agttcatttatttaaaatgcat

SEQ ID NO: 1311400 - DNA, 22 bp, Artificial Sequence
  chemically synthesized
gttcatttatttaaaatgcatt

SEQ ID NO: 1311401 - DNA, 22 bp, Artificial Sequence
  chemically synthesized
atttatttaaaatgcattgatg

SEQ ID NO: 1311402 - DNA, 22 bp, Artificial Sequence
  chemically synthesized
atttaaaatgcattgatggcca

SEQ ID NO: 1311403 - DNA, 22 bp, Artificial Sequence
  chemically synthesized
tttaaaatgcattgatggccag

SEQ ID NO: 1311404 - DNA, 22 bp, Artificial Sequence
  chemically synthesized
aaaatgcattgatggccagacg

SEQ ID NO: 1311405 - DNA, 22 bp, Artificial Sequence
  chemically synthesized
aaatgcattgatggccagacgc

SEQ ID NO: 1311406 - DNA, 22 bp, Artificial Sequence
  chemically synthesized
caggcatgagccaccgcgtctg

SEQ ID NO: 1311407 - DNA, 22 bp, Artificial Sequence
  chemically synthesized
ggattacaggcatgagccaccg

SEQ ID NO: 1311408 - DNA, 22 bp, Artificial Sequence
  chemically synthesized
atggccagacgcggtggctcat

SEQ ID NO: 1311409 - DNA, 22 bp, Artificial Sequence
  chemically synthesized
ccaaagtgttgggattacaggc

SEQ ID NO: 1311410 - DNA, 22 bp, Artificial Sequence
  chemically synthesized
agcctcccaaagtgttgggatt

SEQ ID NO: 1311411 - DNA, 22 bp, Artificial Sequence
  chemically synthesized
atgcctgtaatcccaacacttt

SEQ ID NO: 1311412 - DNA, 22 bp, Artificial Sequence
  chemically synthesized
taatcccaacactttgggaggc

SEQ ID NO: 1311413 - DNA, 22 bp, Artificial Sequence
  chemically synthesized
aggtgatccacccacctcagcc

SEQ ID NO: 1311414 - DNA, 22 bp, Artificial Sequence
  chemically synthesized
caggtgatccacccacctcagc

SEQ ID NO: 1311415 - DNA, 22 bp, Artificial Sequence
  chemically synthesized
acttcaggtgatccacccacct

SEQ ID NO: 1311416 - DNA, 22 bp, Artificial Sequence
  chemically synthesized
tgggaggctgaggtgggtggat

SEQ ID NO: 1311417 - DNA, 22 bp, Artificial Sequence
  chemically synthesized
gggaggctgaggtgggtggatc

SEQ ID NO: 1311418 - DNA, 22 bp, Artificial Sequence
  chemically synthesized
ctgacttcaggtgatccaccca

SEQ ID NO: 1311419 - DNA, 22 bp, Artificial Sequence
  chemically synthesized
ggaggctgaggtgggtggatca

SEQ ID NO: 1311420 - DNA, 22 bp, Artificial Sequence
  chemically synthesized
aactcctgacttcaggtgatcc

SEQ ID NO: 1311421 - DNA, 22 bp, Artificial Sequence
  chemically synthesized
gaactcctgacttcaggtgatc

SEQ ID NO: 1311422 - DNA, 22 bp, Artificial Sequence
  chemically synthesized
aggtgggtggatcacctgaagt

SEQ ID NO: 1311423 - DNA, 22 bp, Artificial Sequence
  chemically synthesized
gtcttgaactcctgacttcagg

SEQ ID NO: 1311424 - DNA, 22 bp, Artificial Sequence
  chemically synthesized
gccagactggtcttgaactcct

SEQ ID NO: 1311425 - DNA, 22 bp, Artificial Sequence
  chemically synthesized
aagtcaggagttcaagaccagt

SEQ ID NO: 1311426 - DNA, 22 bp, Artificial Sequence
  chemically synthesized
ccatgttggccagactggtctt

SEQ ID NO: 1311427 - DNA, 22 bp, Artificial Sequence
  chemically synthesized
gccatgttggccagactggtct

SEQ ID NO: 1311428 - DNA, 22 bp, Artificial Sequence
  chemically synthesized
tgccatgttggccagactggtc

SEQ ID NO: 1311429 - DNA, 22 bp, Artificial Sequence
  chemically synthesized
aagaccagtctggccaacatgg

SEQ ID NO: 1311430 - DNA, 22 bp, Artificial Sequence
  chemically synthesized
gtagagatggggttttgccatg

SEQ ID NO: 1311431 - DNA, 22 bp, Artificial Sequence
  chemically synthesized
agtagagatggggttttgccat

SEQ ID NO: 1311432 - DNA, 22 bp, Artificial Sequence
  chemically synthesized
tagtagagatggggttttgcca

SEQ ID NO: 1311433 - DNA, 22 bp, Artificial Sequence
  chemically synthesized
ttagtagagatggggttttgcc

SEQ ID NO: 1311434 - DNA, 22 bp, Artificial Sequence
  chemically synthesized
gccaacatggcaaaaccccatc

SEQ ID NO: 1311435 - DNA, 22 bp, Artificial Sequence
  chemically synthesized
tgtttttagtagagatggggtt

SEQ ID NO: 1311436 - DNA, 22 bp, Artificial Sequence
  chemically synthesized
gtgtttttagtagagatggggt

SEQ ID NO: 1311437 - DNA, 22 bp, Artificial Sequence
  chemically synthesized
tgtgtttttagtagagatgggg

SEQ ID NO: 1311438 - DNA, 22 bp, Artificial Sequence
  chemically synthesized
ttgtgtttttagtagagatggg

SEQ ID NO: 1311439 - DNA, 22 bp, Artificial Sequence
  chemically synthesized
atttttgtgtttttagtagaga

SEQ ID NO: 1311440 - DNA, 22 bp, Artificial Sequence
  chemically synthesized
tactaaaaacacaaaaattagc

SEQ ID NO: 1311441 - DNA, 22 bp, Artificial Sequence
  chemically synthesized
ccaccatgcccggctaattttt

SEQ ID NO: 1311442 - DNA, 22 bp, Artificial Sequence
  chemically synthesized
gccaccatgcccggctaatttt

SEQ ID NO: 1311443 - DNA, 22 bp, Artificial Sequence
  chemically synthesized
ctaaaaacacaaaaattagccg

SEQ ID NO: 1311444 - DNA, 22 bp, Artificial Sequence
  chemically synthesized
aaaacacaaaaattagccgggc

SEQ ID NO: 1311445 - DNA, 22 bp, Artificial Sequence
  chemically synthesized
caggcacttgccaccatgcccg

SEQ ID NO: 1311446 - DNA, 22 bp, Artificial Sequence
  chemically synthesized
ggactacaggcacttgccacca

SEQ ID NO: 1311447 - DNA, 22 bp, Artificial Sequence
  chemically synthesized
gccgggcatggtggcaagtgcc

SEQ ID NO: 1311448 - DNA, 22 bp, Artificial Sequence
  chemically synthesized
ccaagtagctgggactacaggc

SEQ ID NO: 1311449 - DNA, 22 bp, Artificial Sequence
  chemically synthesized
agtctcccaagtagctgggact

SEQ ID NO: 1311450 - DNA, 22 bp, Artificial Sequence
  chemically synthesized
ccacctcagtctcccaagtagc

SEQ ID NO: 1311451 - DNA, 22 bp, Artificial Sequence
  chemically synthesized
tcccacctcagtctcccaagta

SEQ ID NO: 1311452 - DNA, 22 bp, Artificial Sequence
  chemically synthesized
tagtcccagctacttgggagac

SEQ ID NO: 1311453 - DNA, 22 bp, Artificial Sequence
  chemically synthesized
aagcaattctcccacctcagtc

SEQ ID NO: 1311454 - DNA, 22 bp, Artificial Sequence
  chemically synthesized
cttgggagactgaggtgggaga

SEQ ID NO: 1311455 - DNA, 22 bp, Artificial Sequence
  chemically synthesized
aagttcaagcaattctcccacc

SEQ ID NO: 1311456 - DNA, 22 bp, Artificial Sequence
  chemically synthesized
gggagactgaggtgggagaatt

SEQ ID NO: 1311457 - DNA, 22 bp, Artificial Sequence
  chemically synthesized
tgaagttcaagcaattctccca

SEQ ID NO: 1311458 - DNA, 22 bp, Artificial Sequence
  chemically synthesized
ggagactgaggtgggagaattg

SEQ ID NO: 1311459 - DNA, 22 bp, Artificial Sequence
  chemically synthesized
cgcctctgaagttcaagcaatt

SEQ ID NO: 1311460 - DNA, 22 bp, Artificial Sequence
  chemically synthesized
aggtgggagaattgcttgaact

SEQ ID NO: 1311461 - DNA, 22 bp, Artificial Sequence
  chemically synthesized
caacctccgcctctgaagttca

SEQ ID NO: 1311462 - DNA, 22 bp, Artificial Sequence
  chemically synthesized
actgcaacctccgcctctgaag

SEQ ID NO: 1311463 - DNA, 22 bp, Artificial Sequence
  chemically synthesized
gctcactgcaacctccgcctct

SEQ ID NO: 1311464 - DNA, 22 bp, Artificial Sequence
  chemically synthesized
ggctcactgcaacctccgcctc

SEQ ID NO: 1311465 - DNA, 22 bp, Artificial Sequence
  chemically synthesized
cttgaacttcagaggcggaggt

SEQ ID NO: 1311466 - DNA, 22 bp, Artificial Sequence
  chemically synthesized
gaacttcagaggcggaggttgc

SEQ ID NO: 1311467 - DNA, 22 bp, Artificial Sequence
  chemically synthesized
aacttcagaggcggaggttgca

SEQ ID NO: 1311468 - DNA, 22 bp, Artificial Sequence
  chemically synthesized
cagaggcggaggttgcagtgag

SEQ ID NO: 1311469 - DNA, 22 bp, Artificial Sequence
  chemically synthesized
agaggcggaggttgcagtgagc

SEQ ID NO: 1311470 - DNA, 22 bp, Artificial Sequence
  chemically synthesized
aagtgcagtggcgcgatcttgg

SEQ ID NO: 1311471 - DNA, 22 bp, Artificial Sequence
  chemically synthesized
cagtgagccaagatcgcgccac

SEQ ID NO: 1311472 - DNA, 22 bp, Artificial Sequence
  chemically synthesized
accccgaggctgaagtgcagtg

SEQ ID NO: 1311473 - DNA, 22 bp, Artificial Sequence
  chemically synthesized
tgaccccgaggctgaagtgcag

SEQ ID NO: 1311474 - DNA, 22 bp, Artificial Sequence
  chemically synthesized
tctgaccccgaggctgaagtgc

SEQ ID NO: 1311475 - DNA, 22 bp, Artificial Sequence
  chemically synthesized
tctctgaccccgaggctgaagt

SEQ ID NO: 1311476 - DNA, 22 bp, Artificial Sequence
  chemically synthesized
cacttcagcctcggggtcagag

SEQ ID NO: 1311477 - DNA, 22 bp, Artificial Sequence
  chemically synthesized
agatgaagtctctctctgaccc

SEQ ID NO: 1311478 - DNA, 22 bp, Artificial Sequence
  chemically synthesized
tgagatgaagtctctctctgac

SEQ ID NO: 1311479 - DNA, 22 bp, Artificial Sequence
  chemically synthesized
ctgagatgaagtctctctctga

SEQ ID NO: 1311480 - DNA, 22 bp, Artificial Sequence
  chemically synthesized
cagcctcggggtcagagagaga

SEQ ID NO: 1311481 - DNA, 22 bp, Artificial Sequence
  chemically synthesized
tctgagatgaagtctctctctg

SEQ ID NO: 1311482 - DNA, 22 bp, Artificial Sequence
  chemically synthesized
agcctcggggtcagagagagac

SEQ ID NO: 1311483 - DNA, 22 bp, Artificial Sequence
  chemically synthesized
ttctgagatgaagtctctctct

SEQ ID NO: 1311484 - DNA, 22 bp, Artificial Sequence
  chemically synthesized
tttctgagatgaagtctctctc

SEQ ID NO: 1311485 - DNA, 22 bp, Artificial Sequence
  chemically synthesized
ttttctgagatgaagtctctct

SEQ ID NO: 1311486 - DNA, 22 bp, Artificial Sequence
  chemically synthesized
tttttttctgagatgaagtctc

SEQ ID NO: 1311487 - DNA, 22 bp, Artificial Sequence
  chemically synthesized
ggggtcagagagagacttcatc

SEQ ID NO: 1311488 - DNA, 22 bp, Artificial Sequence
  chemically synthesized
ttatttttttctgagatgaagt

SEQ ID NO: 1311489 - DNA, 22 bp, Artificial Sequence
  chemically synthesized
ttattatttttttctgagatga

SEQ ID NO: 1311490 - DNA, 22 bp, Artificial Sequence
  chemically synthesized
attattatttttttctgagatg

SEQ ID NO: 1311491 - DNA, 22 bp, Artificial Sequence
  chemically synthesized
tattattatttttttctgagat

SEQ ID NO: 1311492 - DNA, 22 bp, Artificial Sequence
  chemically synthesized
ttttattattatttttttctga

SEQ ID NO: 1311493 - DNA, 22 bp, Artificial Sequence
  chemically synthesized
attttattattatttttttctg

SEQ ID NO: 1311494 - DNA, 22 bp, Artificial Sequence
  chemically synthesized
tattttattattatttttttct

SEQ ID NO: 1311495 - DNA, 22 bp, Artificial Sequence
  chemically synthesized
ttttattttattattatttttt

SEQ ID NO: 1311496 - DNA, 22 bp, Artificial Sequence
  chemically synthesized
attttattttattattattttt

SEQ ID NO: 1311497 - DNA, 22 bp, Artificial Sequence
  chemically synthesized
tattttattttattattatttt

SEQ ID NO: 1311498 - DNA, 22 bp, Artificial Sequence
  chemically synthesized
catctcagaaaaaaataataat

SEQ ID NO: 1311499 - DNA, 22 bp, Artificial Sequence
  chemically synthesized
atctcagaaaaaaataataata

SEQ ID NO: 1311500 - DNA, 22 bp, Artificial Sequence
  chemically synthesized
ttttattttattttattattat

SEQ ID NO: 1311501 - DNA, 22 bp, Artificial Sequence
  chemically synthesized
attttattttattttattatta

SEQ ID NO: 1311502 - DNA, 22 bp, Artificial Sequence
  chemically synthesized
tattttattttattttattatt

SEQ ID NO: 1311503 - DNA, 22 bp, Artificial Sequence
  chemically synthesized
agaaaaaaataataataaaata

SEQ ID NO: 1311504 - DNA, 22 bp, Artificial Sequence
  chemically synthesized
catacattttattttattttat

SEQ ID NO: 1311505 - DNA, 22 bp, Artificial Sequence
  chemically synthesized
gccattccatacattttatttt

SEQ ID NO: 1311506 - DNA, 22 bp, Artificial Sequence
  chemically synthesized
gtagaatggtggttggccattc

SEQ ID NO: 1311507 - DNA, 22 bp, Artificial Sequence
  chemically synthesized
cgtagaatggtggttggccatt

SEQ ID NO: 1311508 - DNA, 22 bp, Artificial Sequence
  chemically synthesized
cttcgtagaatggtggttggcc

SEQ ID NO: 1311509 - DNA, 22 bp, Artificial Sequence
  chemically synthesized
acttcgtagaatggtggttggc

SEQ ID NO: 1311510 - DNA, 22 bp, Artificial Sequence
  chemically synthesized
ttacttcgtagaatggtggttg

SEQ ID NO: 1311511 - DNA, 22 bp, Artificial Sequence
  chemically synthesized
agttcttacttcgtagaatggt

SEQ ID NO: 1311512 - DNA, 22 bp, Artificial Sequence
  chemically synthesized
cagttcttacttcgtagaatgg

SEQ ID NO: 1311513 - DNA, 22 bp, Artificial Sequence
  chemically synthesized
tcagttcttacttcgtagaatg

SEQ ID NO: 1311514 - DNA, 22 bp, Artificial Sequence
  chemically synthesized
gactttcagttcttacttcgta

SEQ ID NO: 1311515 - DNA, 22 bp, Artificial Sequence
  chemically synthesized
ttagactttcagttcttacttc

SEQ ID NO: 1311516 - DNA, 22 bp, Artificial Sequence
  chemically synthesized
attagactttcagttcttactt

SEQ ID NO: 1311517 - DNA, 22 bp, Artificial Sequence
  chemically synthesized
cttattagactttcagttctta

SEQ ID NO: 1311518 - DNA, 22 bp, Artificial Sequence
  chemically synthesized
gcttattagactttcagttctt

SEQ ID NO: 1311519 - DNA, 22 bp, Artificial Sequence
  chemically synthesized
tgcttattagactttcagttct

SEQ ID NO: 1311520 - DNA, 22 bp, Artificial Sequence
  chemically synthesized
tacgaagtaagaactgaaagtc

SEQ ID NO: 1311521 - DNA, 22 bp, Artificial Sequence
  chemically synthesized
cgaagtaagaactgaaagtcta

SEQ ID NO: 1311522 - DNA, 22 bp, Artificial Sequence
  chemically synthesized
agaagtagagacctttgcttat

SEQ ID NO: 1311523 - DNA, 22 bp, Artificial Sequence
  chemically synthesized
tgagaagtagagacctttgctt

SEQ ID NO: 1311524 - DNA, 22 bp, Artificial Sequence
  chemically synthesized
ctgagaagtagagacctttgct

SEQ ID NO: 1311525 - DNA, 22 bp, Artificial Sequence
  chemically synthesized
aaagtctaataagcaaaggtct

SEQ ID NO: 1311526 - DNA, 22 bp, Artificial Sequence
  chemically synthesized
ataagcaaaggtctctacttct

SEQ ID NO: 1311527 - DNA, 22 bp, Artificial Sequence
  chemically synthesized
tatcatccaacagagcttctga

SEQ ID NO: 1311528 - DNA, 22 bp, Artificial Sequence
  chemically synthesized
tacttctcagaagctctgttgg

SEQ ID NO: 1311529 - DNA, 22 bp, Artificial Sequence
  chemically synthesized
cttctcagaagctctgttggat

SEQ ID NO: 1311530 - DNA, 22 bp, Artificial Sequence
  chemically synthesized
ctcagaagctctgttggatgat

SEQ ID NO: 1311531 - DNA, 22 bp, Artificial Sequence
  chemically synthesized
tcagaagctctgttggatgata

SEQ ID NO: 1311532 - DNA, 22 bp, Artificial Sequence
  chemically synthesized
tacacaaacctgtatcatccaa

SEQ ID NO: 1311533 - DNA, 22 bp, Artificial Sequence
  chemically synthesized
gtacacaaacctgtatcatcca

SEQ ID NO: 1311534 - DNA, 22 bp, Artificial Sequence
  chemically synthesized
agaagctctgttggatgataca

SEQ ID NO: 1311535 - DNA, 22 bp, Artificial Sequence
  chemically synthesized
tgttggatgatacaggtttgtg

SEQ ID NO: 1311536 - DNA, 22 bp, Artificial Sequence
  chemically synthesized
ttggatgatacaggtttgtgta

SEQ ID NO: 1311537 - DNA, 22 bp, Artificial Sequence
  chemically synthesized
atgtaatatttgtacacaaacc

SEQ ID NO: 1311538 - DNA, 22 bp, Artificial Sequence
  chemically synthesized
gatgatacaggtttgtgtacaa

SEQ ID NO: 1311539 - DNA, 22 bp, Artificial Sequence
  chemically synthesized
catgttaatgtaatatttgtac

SEQ ID NO: 1311540 - DNA, 22 bp, Artificial Sequence
  chemically synthesized
ccatgttaatgtaatatttgta

SEQ ID NO: 1311541 - DNA, 22 bp, Artificial Sequence
  chemically synthesized
tccatgttaatgtaatatttgt

SEQ ID NO: 1311542 - DNA, 22 bp, Artificial Sequence
  chemically synthesized
ttccatgttaatgtaatatttg

SEQ ID NO: 1311543 - DNA, 22 bp, Artificial Sequence
  chemically synthesized
tttccatgttaatgtaatattt

SEQ ID NO: 1311544 - DNA, 22 bp, Artificial Sequence
  chemically synthesized
gtgtacaaatattacattaaca

SEQ ID NO: 1311545 - DNA, 22 bp, Artificial Sequence
  chemically synthesized
gcactttttccatgttaatgta

SEQ ID NO: 1311546 - DNA, 22 bp, Artificial Sequence
  chemically synthesized
tgtacaaatattacattaacat

SEQ ID NO: 1311547 - DNA, 22 bp, Artificial Sequence
  chemically synthesized
catgttagcactttttccatgt

SEQ ID NO: 1311548 - DNA, 22 bp, Artificial Sequence
  chemically synthesized
ctgcatgttagcactttttcca

SEQ ID NO: 1311549 - DNA, 22 bp, Artificial Sequence
  chemically synthesized
tactgcatgttagcactttttc

SEQ ID NO: 1311550 - DNA, 22 bp, Artificial Sequence
  chemically synthesized
cattaacatggaaaaagtgcta

SEQ ID NO: 1311551 - DNA, 22 bp, Artificial Sequence
  chemically synthesized
ctctactgcatgttagcacttt

SEQ ID NO: 1311552 - DNA, 22 bp, Artificial Sequence
  chemically synthesized
acatggaaaaagtgctaacatg

SEQ ID NO: 1311553 - DNA, 22 bp, Artificial Sequence
  chemically synthesized
tgcctcctctactgcatgttag

SEQ ID NO: 1311554 - DNA, 22 bp, Artificial Sequence
  chemically synthesized
atgcctcctctactgcatgtta

SEQ ID NO: 1311555 - DNA, 22 bp, Artificial Sequence
  chemically synthesized
atcgagcaagtttatgcctcct

SEQ ID NO: 1311556 - DNA, 22 bp, Artificial Sequence
  chemically synthesized
acatgcagtagaggaggcataa

SEQ ID NO: 1311557 - DNA, 22 bp, Artificial Sequence
  chemically synthesized
caaccaccaaacctaatcgagc

SEQ ID NO: 1311558 - DNA, 22 bp, Artificial Sequence
  chemically synthesized
taaaacctccaaccaccaaacc

SEQ ID NO: 1311559 - DNA, 22 bp, Artificial Sequence
  chemically synthesized
gtaaaacctccaaccaccaaac

SEQ ID NO: 1311560 - DNA, 22 bp, Artificial Sequence
  chemically synthesized
tgtaaaacctccaaccaccaaa

SEQ ID NO: 1311561 - DNA, 22 bp, Artificial Sequence
  chemically synthesized
gctcgattaggtttggtggttg

SEQ ID NO: 1311562 - DNA, 22 bp, Artificial Sequence
  chemically synthesized
ttgtaaaacctccaaccaccaa

SEQ ID NO: 1311563 - DNA, 22 bp, Artificial Sequence
  chemically synthesized
ctcgattaggtttggtggttgg

SEQ ID NO: 1311564 - DNA, 22 bp, Artificial Sequence
  chemically synthesized
ttttgtaaaacctccaaccacc

SEQ ID NO: 1311565 - DNA, 22 bp, Artificial Sequence
  chemically synthesized
gattaggtttggtggttggagg

SEQ ID NO: 1311566 - DNA, 22 bp, Artificial Sequence
  chemically synthesized
ggtttggtggttggaggtttta

SEQ ID NO: 1311567 - DNA, 22 bp, Artificial Sequence
  chemically synthesized
atcatctcttttgtaaaacctc

SEQ ID NO: 1311568 - DNA, 22 bp, Artificial Sequence
  chemically synthesized
ggtggttggaggttttacaaaa

SEQ ID NO: 1311569 - DNA, 22 bp, Artificial Sequence
  chemically synthesized
cctcatcatctcttttgtaaaa

SEQ ID NO: 1311570 - DNA, 22 bp, Artificial Sequence
  chemically synthesized
gtggttggaggttttacaaaag

SEQ ID NO: 1311571 - DNA, 22 bp, Artificial Sequence
  chemically synthesized
gcctcatcatctcttttgtaaa

SEQ ID NO: 1311572 - DNA, 22 bp, Artificial Sequence
  chemically synthesized
gaggttttacaaaagagatgat

SEQ ID NO: 1311573 - DNA, 22 bp, Artificial Sequence
  chemically synthesized
tacaaaagagatgatgaggcaa

SEQ ID NO: 1311574 - DNA, 22 bp, Artificial Sequence
  chemically synthesized
acaaaagagatgatgaggcaaa

SEQ ID NO: 1311575 - DNA, 22 bp, Artificial Sequence
  chemically synthesized
caaaagagatgatgaggcaaat

SEQ ID NO: 1311576 - DNA, 22 bp, Artificial Sequence
  chemically synthesized
tcaagtgtaggtaaacaccaat

SEQ ID NO: 1311577 - DNA, 22 bp, Artificial Sequence
  chemically synthesized
tgggtgggggctgtcaagtgta

SEQ ID NO: 1311578 - DNA, 22 bp, Artificial Sequence
  chemically synthesized
gtgtttacctacacttgacagc

SEQ ID NO: 1311579 - DNA, 22 bp, Artificial Sequence
  chemically synthesized
actatgggtgggggctgtcaag

SEQ ID NO: 1311580 - DNA, 22 bp, Artificial Sequence
  chemically synthesized
acctacacttgacagcccccac

SEQ ID NO: 1311581 - DNA, 22 bp, Artificial Sequence
  chemically synthesized
tactaactatgggtgggggctg

SEQ ID NO: 1311582 - DNA, 22 bp, Artificial Sequence
  chemically synthesized
cctacacttgacagcccccacc

SEQ ID NO: 1311583 - DNA, 22 bp, Artificial Sequence
  chemically synthesized
atactaactatgggtgggggct

SEQ ID NO: 1311584 - DNA, 22 bp, Artificial Sequence
  chemically synthesized
tatactaactatgggtgggggc

SEQ ID NO: 1311585 - DNA, 22 bp, Artificial Sequence
  chemically synthesized
cacttgacagcccccacccata

SEQ ID NO: 1311586 - DNA, 22 bp, Artificial Sequence
  chemically synthesized
cattttatactaactatgggtg

SEQ ID NO: 1311587 - DNA, 22 bp, Artificial Sequence
  chemically synthesized
gacagcccccacccatagttag

SEQ ID NO: 1311588 - DNA, 22 bp, Artificial Sequence
  chemically synthesized
acagcccccacccatagttagt

SEQ ID NO: 1311589 - DNA, 22 bp, Artificial Sequence
  chemically synthesized
taattacattttatactaacta

SEQ ID NO: 1311590 - DNA, 22 bp, Artificial Sequence
  chemically synthesized
tatacacaaaattataattaca

SEQ ID NO: 1311591 - DNA, 22 bp, Artificial Sequence
  chemically synthesized
gtataaaatgtaattataattt

SEQ ID NO: 1311592 - DNA, 22 bp, Artificial Sequence
  chemically synthesized
aagtactgtatacacaaaatta

SEQ ID NO: 1311593 - DNA, 22 bp, Artificial Sequence
  chemically synthesized
caagtactgtatacacaaaatt

SEQ ID NO: 1311594 - DNA, 22 bp, Artificial Sequence
  chemically synthesized
tcaagtactgtatacacaaaat

SEQ ID NO: 1311595 - DNA, 22 bp, Artificial Sequence
  chemically synthesized
ttcaagtactgtatacacaaaa

SEQ ID NO: 1311596 - DNA, 22 bp, Artificial Sequence
  chemically synthesized
taattttgtgtatacagtactt

SEQ ID NO: 1311597 - DNA, 22 bp, Artificial Sequence
  chemically synthesized
taataatttttcaagtactgta

SEQ ID NO: 1311598 - DNA, 22 bp, Artificial Sequence
  chemically synthesized
gctgtaataatttttcaagtac

SEQ ID NO: 1311599 - DNA, 22 bp, Artificial Sequence
  chemically synthesized
tgtgtatacagtacttgaaaaa

SEQ ID NO: 1311600 - DNA, 22 bp, Artificial Sequence
  chemically synthesized
gtgtatacagtacttgaaaaat

SEQ ID NO: 1311601 - DNA, 22 bp, Artificial Sequence
  chemically synthesized
tgtatacagtacttgaaaaatt

SEQ ID NO: 1311602 - DNA, 22 bp, Artificial Sequence
  chemically synthesized
tgattggctgtaataatttttc

SEQ ID NO: 1311603 - DNA, 22 bp, Artificial Sequence
  chemically synthesized
ttgtgattggctgtaataattt

SEQ ID NO: 1311604 - DNA, 22 bp, Artificial Sequence
  chemically synthesized
gaaaaattattacagccaatca

SEQ ID NO: 1311605 - DNA, 22 bp, Artificial Sequence
  chemically synthesized
tatccactattgtgattggctg

SEQ ID NO: 1311606 - DNA, 22 bp, Artificial Sequence
  chemically synthesized
aaaaattattacagccaatcac

SEQ ID NO: 1311607 - DNA, 22 bp, Artificial Sequence
  chemically synthesized
atatccactattgtgattggct

SEQ ID NO: 1311608 - DNA, 22 bp, Artificial Sequence
  chemically synthesized
tatatccactattgtgattggc

SEQ ID NO: 1311609 - DNA, 22 bp, Artificial Sequence
  chemically synthesized
ttatatccactattgtgattgg

SEQ ID NO: 1311610 - DNA, 22 bp, Artificial Sequence
  chemically synthesized
ttacagccaatcacaatagtgg

SEQ ID NO: 1311611 - DNA, 22 bp, Artificial Sequence
  chemically synthesized
gaatttttatatccactattgt

SEQ ID NO: 1311612 - DNA, 22 bp, Artificial Sequence
  chemically synthesized
ggaatttttatatccactattg

SEQ ID NO: 1311613 - DNA, 22 bp, Artificial Sequence
  chemically synthesized
cagccaatcacaatagtggata

SEQ ID NO: 1311614 - DNA, 22 bp, Artificial Sequence
  chemically synthesized
taaatagacttggaatttttat

SEQ ID NO: 1311615 - DNA, 22 bp, Artificial Sequence
  chemically synthesized
gtaaatagacttggaattttta

SEQ ID NO: 1311616 - DNA, 22 bp, Artificial Sequence
  chemically synthesized
cttgtaaatagacttggaattt

SEQ ID NO: 1311617 - DNA, 22 bp, Artificial Sequence
  chemically synthesized
ccttgtaaatagacttggaatt

SEQ ID NO: 1311618 - DNA, 22 bp, Artificial Sequence
  chemically synthesized
tccttgtaaatagacttggaat

SEQ ID NO: 1311619 - DNA, 22 bp, Artificial Sequence
  chemically synthesized
gccagaatgttttccttgtaaa

SEQ ID NO: 1311620 - DNA, 22 bp, Artificial Sequence
  chemically synthesized
ggccagaatgttttccttgtaa

SEQ ID NO: 1311621 - DNA, 22 bp, Artificial Sequence
  chemically synthesized
caagtctatttacaaggaaaac

SEQ ID NO: 1311622 - DNA, 22 bp, Artificial Sequence
  chemically synthesized
tttacaaggaaaacattctggc

SEQ ID NO: 1311623 - DNA, 22 bp, Artificial Sequence
  chemically synthesized
tggtcatatttggccagaatgt

SEQ ID NO: 1311624 - DNA, 22 bp, Artificial Sequence
  chemically synthesized
atggtcatatttggccagaatg

SEQ ID NO: 1311625 - DNA, 22 bp, Artificial Sequence
  chemically synthesized
acaaggaaaacattctggccaa

SEQ ID NO: 1311626 - DNA, 22 bp, Artificial Sequence
  chemically synthesized
caaggaaaacattctggccaaa

SEQ ID NO: 1311627 - DNA, 22 bp, Artificial Sequence
  chemically synthesized
taagcacaaatatttatggtca

SEQ ID NO: 1311628 - DNA, 22 bp, Artificial Sequence
  chemically synthesized
tggccaaatatgaccataaata

SEQ ID NO: 1311629 - DNA, 22 bp, Artificial Sequence
  chemically synthesized
gccaaatatgaccataaatatt

SEQ ID NO: 1311630 - DNA, 22 bp, Artificial Sequence
  chemically synthesized
ggtattgtaagcacaaatattt

SEQ ID NO: 1311631 - DNA, 22 bp, Artificial Sequence
  chemically synthesized
taggtattgtaagcacaaatat

SEQ ID NO: 1311632 - DNA, 22 bp, Artificial Sequence
  chemically synthesized
ctaggtattgtaagcacaaata

SEQ ID NO: 1311633 - DNA, 22 bp, Artificial Sequence
  chemically synthesized
aaatttctaggtattgtaagca

SEQ ID NO: 1311634 - DNA, 22 bp, Artificial Sequence
  chemically synthesized
gaaatttctaggtattgtaagc

SEQ ID NO: 1311635 - DNA, 22 bp, Artificial Sequence
  chemically synthesized
gtgcttacaatacctagaaatt

SEQ ID NO: 1311636 - DNA, 22 bp, Artificial Sequence
  chemically synthesized
tgcttacaatacctagaaattt

SEQ ID NO: 1311637 - DNA, 22 bp, Artificial Sequence
  chemically synthesized
acatatcaaacatttgaaattt

SEQ ID NO: 1311638 - DNA, 22 bp, Artificial Sequence
  chemically synthesized
acaatacctagaaatttcaaat

SEQ ID NO: 1311639 - DNA, 22 bp, Artificial Sequence
  chemically synthesized
aacatatcaaacatttgaaatt

SEQ ID NO: 1311640 - DNA, 22 bp, Artificial Sequence
  chemically synthesized
caatacctagaaatttcaaatg

SEQ ID NO: 1311641 - DNA, 22 bp, Artificial Sequence
  chemically synthesized
gaaatttcaaatgtttgatatg

SEQ ID NO: 1311642 - DNA, 22 bp, Artificial Sequence
  chemically synthesized
caaataaaaatatttaacatat

SEQ ID NO: 1311643 - DNA, 22 bp, Artificial Sequence
  chemically synthesized
caaatgtttgatatgttaaata

SEQ ID NO: 1311644 - DNA, 22 bp, Artificial Sequence
  chemically synthesized
tacaaataaaaatatttaacat

SEQ ID NO: 1311645 - DNA, 22 bp, Artificial Sequence
  chemically synthesized
aaatgtttgatatgttaaatat

SEQ ID NO: 1311646 - DNA, 22 bp, Artificial Sequence
  chemically synthesized
gatatgttaaatatttttattt

SEQ ID NO: 1311647 - DNA, 22 bp, Artificial Sequence
  chemically synthesized
atatgttaaatatttttatttg

SEQ ID NO: 1311648 - DNA, 22 bp, Artificial Sequence
  chemically synthesized
aaagtgaagaactctacaaata

SEQ ID NO: 1311649 - DNA, 22 bp, Artificial Sequence
  chemically synthesized
gaaagtgaagaactctacaaat

SEQ ID NO: 1311650 - DNA, 22 bp, Artificial Sequence
  chemically synthesized
aatatttttatttgtagagttc

SEQ ID NO: 1311651 - DNA, 22 bp, Artificial Sequence
  chemically synthesized
tatttgaaagtgaagaactcta

SEQ ID NO: 1311652 - DNA, 22 bp, Artificial Sequence
  chemically synthesized
ttatttgtagagttcttcactt

SEQ ID NO: 1311653 - DNA, 22 bp, Artificial Sequence
  chemically synthesized
tatttgtagagttcttcacttt

SEQ ID NO: 1311654 - DNA, 22 bp, Artificial Sequence
  chemically synthesized
atttgtagagttcttcactttc

SEQ ID NO: 1311655 - DNA, 22 bp, Artificial Sequence
  chemically synthesized
tttgtagagttcttcactttca

SEQ ID NO: 1311656 - DNA, 22 bp, Artificial Sequence
  chemically synthesized
gtagagttcttcactttcaaat

SEQ ID NO: 1311657 - DNA, 22 bp, Artificial Sequence
  chemically synthesized
aaagtaatctatatttgaaagt

SEQ ID NO: 1311658 - DNA, 22 bp, Artificial Sequence
  chemically synthesized
tagagttcttcactttcaaata

SEQ ID NO: 1311659 - DNA, 22 bp, Artificial Sequence
  chemically synthesized
attaaaagtaatctatatttga

SEQ ID NO: 1311660 - DNA, 22 bp, Artificial Sequence
  chemically synthesized
tctcattaaaagtaatctatat

SEQ ID NO: 1311661 - DNA, 22 bp, Artificial Sequence
  chemically synthesized
ttcactttcaaatatagattac

SEQ ID NO: 1311662 - DNA, 22 bp, Artificial Sequence
  chemically synthesized
tatctcattaaaagtaatctat

SEQ ID NO: 1311663 - DNA, 22 bp, Artificial Sequence
  chemically synthesized
cactttcaaatatagattactt

SEQ ID NO: 1311664 - DNA, 22 bp, Artificial Sequence
  chemically synthesized
ctatctcattaaaagtaatcta

SEQ ID NO: 1311665 - DNA, 22 bp, Artificial Sequence
  chemically synthesized
actttcaaatatagattacttt

SEQ ID NO: 1311666 - DNA, 22 bp, Artificial Sequence
  chemically synthesized
tttctatctcattaaaagtaat

SEQ ID NO: 1311667 - DNA, 22 bp, Artificial Sequence
  chemically synthesized
tcaaatatagattacttttaat

SEQ ID NO: 1311668 - DNA, 22 bp, Artificial Sequence
  chemically synthesized
caaatatagattacttttaatg

SEQ ID NO: 1311669 - DNA, 22 bp, Artificial Sequence
  chemically synthesized
aaatatagattacttttaatga

SEQ ID NO: 1311670 - DNA, 22 bp, Artificial Sequence
  chemically synthesized
ataattgtttctatctcattaa

SEQ ID NO: 1311671 - DNA, 22 bp, Artificial Sequence
  chemically synthesized
cttttaatgagatagaaacaat

SEQ ID NO: 1311672 - DNA, 22 bp, Artificial Sequence
  chemically synthesized
ttaatgagatagaaacaattat

SEQ ID NO: 1311673 - DNA, 22 bp, Artificial Sequence
  chemically synthesized
taatgagatagaaacaattatc

SEQ ID NO: 1311674 - DNA, 22 bp, Artificial Sequence
  chemically synthesized
atgaatcaaactgataattgtt

SEQ ID NO: 1311675 - DNA, 22 bp, Artificial Sequence
  chemically synthesized
aatgagatagaaacaattatca

SEQ ID NO: 1311676 - DNA, 22 bp, Artificial Sequence
  chemically synthesized
aatgaatcaaactgataattgt

SEQ ID NO: 1311677 - DNA, 22 bp, Artificial Sequence
  chemically synthesized
atgagatagaaacaattatcag

SEQ ID NO: 1311678 - DNA, 22 bp, Artificial Sequence
  chemically synthesized
tcccttaatgaatcaaactgat

SEQ ID NO: 1311679 - DNA, 22 bp, Artificial Sequence
  chemically synthesized
tcagtttgattcattaagggac

SEQ ID NO: 1311680 - DNA, 22 bp, Artificial Sequence
  chemically synthesized
taaagtgatattgtcccttaat

SEQ ID NO: 1311681 - DNA, 22 bp, Artificial Sequence
  chemically synthesized
tgtaaagtgatattgtccctta

SEQ ID NO: 1311682 - DNA, 22 bp, Artificial Sequence
  chemically synthesized
ctgtaaagtgatattgtccctt

SEQ ID NO: 1311683 - DNA, 22 bp, Artificial Sequence
  chemically synthesized
gattcattaagggacaatatca

SEQ ID NO: 1311684 - DNA, 22 bp, Artificial Sequence
  chemically synthesized
attcattaagggacaatatcac

SEQ ID NO: 1311685 - DNA, 22 bp, Artificial Sequence
  chemically synthesized
attaagggacaatatcacttta

SEQ ID NO: 1311686 - DNA, 22 bp, Artificial Sequence
  chemically synthesized
agggacaatatcactttacaga

SEQ ID NO: 1311687 - DNA, 22 bp, Artificial Sequence
  chemically synthesized
ataaatacatgtaaatttctgt

SEQ ID NO: 1311688 - DNA, 22 bp, Artificial Sequence
  chemically synthesized
acatgttaataaatacatgtaa

SEQ ID NO: 1311689 - DNA, 22 bp, Artificial Sequence
  chemically synthesized
cacatgttaataaatacatgta

SEQ ID NO: 1311690 - DNA, 22 bp, Artificial Sequence
  chemically synthesized
tacagaaatttacatgtattta

SEQ ID NO: 1311691 - DNA, 22 bp, Artificial Sequence
  chemically synthesized
acagaaatttacatgtatttat

SEQ ID NO: 1311692 - DNA, 22 bp, Artificial Sequence
  chemically synthesized
cagaaatttacatgtatttatt

SEQ ID NO: 1311693 - DNA, 22 bp, Artificial Sequence
  chemically synthesized
aagtgcttcacatgttaataaa

SEQ ID NO: 1311694 - DNA, 22 bp, Artificial Sequence
  chemically synthesized
ctaaagtgcttcacatgttaat

SEQ ID NO: 1311695 - DNA, 22 bp, Artificial Sequence
  chemically synthesized
acatgtatttattaacatgtga

SEQ ID NO: 1311696 - DNA, 22 bp, Artificial Sequence
  chemically synthesized
catgtatttattaacatgtgaa

SEQ ID NO: 1311697 - DNA, 22 bp, Artificial Sequence
  chemically synthesized
tctactaaagtgcttcacatgt

SEQ ID NO: 1311698 - DNA, 22 bp, Artificial Sequence
  chemically synthesized
atctactaaagtgcttcacatg

SEQ ID NO: 1311699 - DNA, 22 bp, Artificial Sequence
  chemically synthesized
tatctactaaagtgcttcacat

SEQ ID NO: 1311700 - DNA, 22 bp, Artificial Sequence
  chemically synthesized
ttatctactaaagtgcttcaca

SEQ ID NO: 1311701 - DNA, 22 bp, Artificial Sequence
  chemically synthesized
tttatctactaaagtgcttcac

SEQ ID NO: 1311702 - DNA, 22 bp, Artificial Sequence
  chemically synthesized
attaacatgtgaagcactttag

SEQ ID NO: 1311703 - DNA, 22 bp, Artificial Sequence
  chemically synthesized
ttaacatgtgaagcactttagt

SEQ ID NO: 1311704 - DNA, 22 bp, Artificial Sequence
  chemically synthesized
acatgtgaagcactttagtaga

SEQ ID NO: 1311705 - DNA, 22 bp, Artificial Sequence
  chemically synthesized
agtgatacaaaaatgtcctttt

SEQ ID NO: 1311706 - DNA, 22 bp, Artificial Sequence
  chemically synthesized
aagtgatacaaaaatgtccttt

SEQ ID NO: 1311707 - DNA, 22 bp, Artificial Sequence
  chemically synthesized
taagtgatacaaaaatgtcctt

SEQ ID NO: 1311708 - DNA, 22 bp, Artificial Sequence
  chemically synthesized
tagtagataaaaaggacatttt

SEQ ID NO: 1311709 - DNA, 22 bp, Artificial Sequence
  chemically synthesized
agtagataaaaaggacattttt

SEQ ID NO: 1311710 - DNA, 22 bp, Artificial Sequence
  chemically synthesized
gtagataaaaaggacatttttg

SEQ ID NO: 1311711 - DNA, 22 bp, Artificial Sequence
  chemically synthesized
atgttttaagtgatacaaaaat

SEQ ID NO: 1311712 - DNA, 22 bp, Artificial Sequence
  chemically synthesized
atcctaatgttttaagtgatac

SEQ ID NO: 1311713 - DNA, 22 bp, Artificial Sequence
  chemically synthesized
catcctaatgttttaagtgata

SEQ ID NO: 1311714 - DNA, 22 bp, Artificial Sequence
  chemically synthesized
ataatttcatcctaatgtttta

SEQ ID NO: 1311715 - DNA, 22 bp, Artificial Sequence
  chemically synthesized
cataatttcatcctaatgtttt

SEQ ID NO: 1311716 - DNA, 22 bp, Artificial Sequence
  chemically synthesized
ttgtatcacttaaaacattagg

SEQ ID NO: 1311717 - DNA, 22 bp, Artificial Sequence
  chemically synthesized
tgtatcacttaaaacattagga

SEQ ID NO: 1311718 - DNA, 22 bp, Artificial Sequence
  chemically synthesized
gtatcacttaaaacattaggat

SEQ ID NO: 1311719 - DNA, 22 bp, Artificial Sequence
  chemically synthesized
tatcacttaaaacattaggatg

SEQ ID NO: 1311720 - DNA, 22 bp, Artificial Sequence
  chemically synthesized
aaaacattaggatgaaattatg

SEQ ID NO: 1311721 - DNA, 22 bp, Artificial Sequence
  chemically synthesized
aaacattaggatgaaattatga

SEQ ID NO: 1311722 - DNA, 22 bp, Artificial Sequence
  chemically synthesized
ggatgaaattatgaaatgtaca

SEQ ID NO: 1311723 - DNA, 22 bp, Artificial Sequence
  chemically synthesized
gtgccagtaggcagcatgtaca

SEQ ID NO: 1311724 - DNA, 22 bp, Artificial Sequence
  chemically synthesized
ggtgccagtaggcagcatgtac

SEQ ID NO: 1311725 - DNA, 22 bp, Artificial Sequence
  chemically synthesized
tggtgccagtaggcagcatgta

SEQ ID NO: 1311726 - DNA, 22 bp, Artificial Sequence
  chemically synthesized
tgaaatgtacatgctgcctact

SEQ ID NO: 1311727 - DNA, 22 bp, Artificial Sequence
  chemically synthesized
taatctttggtgccagtaggca

SEQ ID NO: 1311728 - DNA, 22 bp, Artificial Sequence
  chemically synthesized
ataatctttggtgccagtaggc

SEQ ID NO: 1311729 - DNA, 22 bp, Artificial Sequence
  chemically synthesized
tgagaccggcttataatctttg

SEQ ID NO: 1311730 - DNA, 22 bp, Artificial Sequence
  chemically synthesized
cctactggcaccaaagattata

SEQ ID NO: 1311731 - DNA, 22 bp, Artificial Sequence
  chemically synthesized
ctggcaccaaagattataagcc

SEQ ID NO: 1311732 - DNA, 22 bp, Artificial Sequence
  chemically synthesized
gcaccaaagattataagccggt

SEQ ID NO: 1311733 - DNA, 22 bp, Artificial Sequence
  chemically synthesized
tataatgaaaagccaattgtga

SEQ ID NO: 1311734 - DNA, 22 bp, Artificial Sequence
  chemically synthesized
atataatgaaaagccaattgtg

SEQ ID NO: 1311735 - DNA, 22 bp, Artificial Sequence
  chemically synthesized
taagccggtctcacaattggct

SEQ ID NO: 1311736 - DNA, 22 bp, Artificial Sequence
  chemically synthesized
tatataatgaaaagccaattgt

SEQ ID NO: 1311737 - DNA, 22 bp, Artificial Sequence
  chemically synthesized
tttatataatgaaaagccaatt

SEQ ID NO: 1311738 - DNA, 22 bp, Artificial Sequence
  chemically synthesized
acaattggcttttcattatata

SEQ ID NO: 1311739 - DNA, 22 bp, Artificial Sequence
  chemically synthesized
gcttttcattatataaagaaca

SEQ ID NO: 1311740 - DNA, 22 bp, Artificial Sequence
  chemically synthesized
caagcatataatgggtgttctt

SEQ ID NO: 1311741 - DNA, 22 bp, Artificial Sequence
  chemically synthesized
ttcattatataaagaacaccca

SEQ ID NO: 1311742 - DNA, 22 bp, Artificial Sequence
  chemically synthesized
tcattatataaagaacacccat

SEQ ID NO: 1311743 - DNA, 22 bp, Artificial Sequence
  chemically synthesized
cattatataaagaacacccatt

SEQ ID NO: 1311744 - DNA, 22 bp, Artificial Sequence
  chemically synthesized
attatataaagaacacccatta

SEQ ID NO: 1311745 - DNA, 22 bp, Artificial Sequence
  chemically synthesized
tataaagaacacccattatatg

SEQ ID NO: 1311746 - DNA, 22 bp, Artificial Sequence
  chemically synthesized
gcataggaattccaagcatata

SEQ ID NO: 1311747 - DNA, 22 bp, Artificial Sequence
  chemically synthesized
ctggcataggaattccaagcat

SEQ ID NO: 1311748 - DNA, 22 bp, Artificial Sequence
  chemically synthesized
tatgcctgctggcataggaatt

SEQ ID NO: 1311749 - DNA, 22 bp, Artificial Sequence
  chemically synthesized
tatgcttggaattcctatgcca

SEQ ID NO: 1311750 - DNA, 22 bp, Artificial Sequence
  chemically synthesized
ctgtatgcctgctggcatagga

SEQ ID NO: 1311751 - DNA, 22 bp, Artificial Sequence
  chemically synthesized
gctgtatgcctgctggcatagg

SEQ ID NO: 1311752 - DNA, 22 bp, Artificial Sequence
  chemically synthesized
ggaattcctatgccagcaggca

SEQ ID NO: 1311753 - DNA, 22 bp, Artificial Sequence
  chemically synthesized
gaattcctatgccagcaggcat

SEQ ID NO: 1311754 - DNA, 22 bp, Artificial Sequence
  chemically synthesized
cagcatttgctgtatgcctgct

SEQ ID NO: 1311755 - DNA, 22 bp, Artificial Sequence
  chemically synthesized
ccagcatttgctgtatgcctgc

SEQ ID NO: 1311756 - DNA, 22 bp, Artificial Sequence
  chemically synthesized
ctatgccagcaggcatacagca

SEQ ID NO: 1311757 - DNA, 22 bp, Artificial Sequence
  chemically synthesized
tgccagcaggcatacagcaaat

SEQ ID NO: 1311758 - DNA, 22 bp, Artificial Sequence
  chemically synthesized
tgaacaatgggcttccagcatt

SEQ ID NO: 1311759 - DNA, 22 bp, Artificial Sequence
  chemically synthesized
gcaagaagtaaagttatgaaca

SEQ ID NO: 1311760 - DNA, 22 bp, Artificial Sequence
  chemically synthesized
ggcaagaagtaaagttatgaac

SEQ ID NO: 1311761 - DNA, 22 bp, Artificial Sequence
  chemically synthesized
gaagcccattgttcataacttt

SEQ ID NO: 1311762 - DNA, 22 bp, Artificial Sequence
  chemically synthesized
aaatgcttggcaagaagtaaag

SEQ ID NO: 1311763 - DNA, 22 bp, Artificial Sequence
  chemically synthesized
ttcataactttacttcttgcca

SEQ ID NO: 1311764 - DNA, 22 bp, Artificial Sequence
  chemically synthesized
ataactttacttcttgccaagc

SEQ ID NO: 1311765 - DNA, 22 bp, Artificial Sequence
  chemically synthesized
tacttcttgccaagcatttcag

SEQ ID NO: 1311766 - DNA, 22 bp, Artificial Sequence
  chemically synthesized
acttcttgccaagcatttcagt

SEQ ID NO: 1311767 - DNA, 22 bp, Artificial Sequence
  chemically synthesized
cttcttgccaagcatttcagtt

SEQ ID NO: 1311768 - DNA, 22 bp, Artificial Sequence
  chemically synthesized
cttgccaagcatttcagttata

SEQ ID NO: 1311769 - DNA, 22 bp, Artificial Sequence
  chemically synthesized
ttgccaagcatttcagttatat

SEQ ID NO: 1311770 - DNA, 22 bp, Artificial Sequence
  chemically synthesized
gccaagcatttcagttatattt

SEQ ID NO: 1311771 - DNA, 22 bp, Artificial Sequence
  chemically synthesized
tataaccaaagaaaatataact

SEQ ID NO: 1311772 - DNA, 22 bp, Artificial Sequence
  chemically synthesized
ccaagcatttcagttatatttt

SEQ ID NO: 1311773 - DNA, 22 bp, Artificial Sequence
  chemically synthesized
atataaccaaagaaaatataac

SEQ ID NO: 1311774 - DNA, 22 bp, Artificial Sequence
  chemically synthesized
tatataaccaaagaaaatataa

SEQ ID NO: 1311775 - DNA, 22 bp, Artificial Sequence
  chemically synthesized
gccctttatataaccaaagaaa

SEQ ID NO: 1311776 - DNA, 22 bp, Artificial Sequence
  chemically synthesized
tggccctttatataaccaaaga

SEQ ID NO: 1311777 - DNA, 22 bp, Artificial Sequence
  chemically synthesized
cagttatattttctttggttat

SEQ ID NO: 1311778 - DNA, 22 bp, Artificial Sequence
  chemically synthesized
agttatattttctttggttata

SEQ ID NO: 1311779 - DNA, 22 bp, Artificial Sequence
  chemically synthesized
tattttctttggttatataaag

SEQ ID NO: 1311780 - DNA, 22 bp, Artificial Sequence
  chemically synthesized
aaatagctctggccctttatat

SEQ ID NO: 1311781 - DNA, 22 bp, Artificial Sequence
  chemically synthesized
aaaatagctctggccctttata

SEQ ID NO: 1311782 - DNA, 22 bp, Artificial Sequence
  chemically synthesized
tctttggttatataaagggcca

SEQ ID NO: 1311783 - DNA, 22 bp, Artificial Sequence
  chemically synthesized
ctttggttatataaagggccag

SEQ ID NO: 1311784 - DNA, 22 bp, Artificial Sequence
  chemically synthesized
tttggttatataaagggccaga

SEQ ID NO: 1311785 - DNA, 22 bp, Artificial Sequence
  chemically synthesized
acttaaaatagctctggccctt

SEQ ID NO: 1311786 - DNA, 22 bp, Artificial Sequence
  chemically synthesized
cacttaaaatagctctggccct

SEQ ID NO: 1311787 - DNA, 22 bp, Artificial Sequence
  chemically synthesized
tggttatataaagggccagagc

SEQ ID NO: 1311788 - DNA, 22 bp, Artificial Sequence
  chemically synthesized
tcacttaaaatagctctggccc

SEQ ID NO: 1311789 - DNA, 22 bp, Artificial Sequence
  chemically synthesized
ggttatataaagggccagagct

SEQ ID NO: 1311790 - DNA, 22 bp, Artificial Sequence
  chemically synthesized
gttatataaagggccagagcta

SEQ ID NO: 1311791 - DNA, 22 bp, Artificial Sequence
  chemically synthesized
tttcacttaaaatagctctggc

SEQ ID NO: 1311792 - DNA, 22 bp, Artificial Sequence
  chemically synthesized
tataaagggccagagctatttt

SEQ ID NO: 1311793 - DNA, 22 bp, Artificial Sequence
  chemically synthesized
cctctttcacttaaaatagctc

SEQ ID NO: 1311794 - DNA, 22 bp, Artificial Sequence
  chemically synthesized
ttttaagtgaaagaggtagcca

SEQ ID NO: 1311795 - DNA, 22 bp, Artificial Sequence
  chemically synthesized
taagtgaaagaggtagccatcc

SEQ ID NO: 1311796 - DNA, 22 bp, Artificial Sequence
  chemically synthesized
aagtgaaagaggtagccatcct

SEQ ID NO: 1311797 - DNA, 22 bp, Artificial Sequence
  chemically synthesized
agtgaaagaggtagccatcctc

SEQ ID NO: 1311798 - DNA, 22 bp, Artificial Sequence
  chemically synthesized
tcatatagtgagatgaggatgg

SEQ ID NO: 1311799 - DNA, 22 bp, Artificial Sequence
  chemically synthesized
taatatgacatctgtcatatag

SEQ ID NO: 1311800 - DNA, 22 bp, Artificial Sequence
  chemically synthesized
atctcactatatgacagatgtc

SEQ ID NO: 1311801 - DNA, 22 bp, Artificial Sequence
  chemically synthesized
actatatgacagatgtcatatt

SEQ ID NO: 1311802 - DNA, 22 bp, Artificial Sequence
  chemically synthesized
tgtagggcattgtaatatgaca

SEQ ID NO: 1311803 - DNA, 22 bp, Artificial Sequence
  chemically synthesized
tatgacagatgtcatattacaa

SEQ ID NO: 1311804 - DNA, 22 bp, Artificial Sequence
  chemically synthesized
ttatgtagggcattgtaatatg

SEQ ID NO: 1311805 - DNA, 22 bp, Artificial Sequence
  chemically synthesized
catactattatgtagggcattg

SEQ ID NO: 1311806 - DNA, 22 bp, Artificial Sequence
  chemically synthesized
gcatactattatgtagggcatt

SEQ ID NO: 1311807 - DNA, 22 bp, Artificial Sequence
  chemically synthesized
cccttgcatactattatgtagg

SEQ ID NO: 1311808 - DNA, 22 bp, Artificial Sequence
  chemically synthesized
caatgccctacataatagtatg

SEQ ID NO: 1311809 - DNA, 22 bp, Artificial Sequence
  chemically synthesized
cataatagtatgcaagggcaat

SEQ ID NO: 1311810 - DNA, 22 bp, Artificial Sequence
  chemically synthesized
caccaggtcgaaggaggtagca

SEQ ID NO: 1311811 - DNA, 22 bp, Artificial Sequence
  chemically synthesized
acaccaggtcgaaggaggtagc

SEQ ID NO: 1311812 - DNA, 22 bp, Artificial Sequence
  chemically synthesized
tacaccaggtcgaaggaggtag

SEQ ID NO: 1311813 - DNA, 22 bp, Artificial Sequence
  chemically synthesized
aggaattttacaccaggtcgaa

SEQ ID NO: 1311814 - DNA, 22 bp, Artificial Sequence
  chemically synthesized
taaggaattttacaccaggtcg

SEQ ID NO: 1311815 - DNA, 22 bp, Artificial Sequence
  chemically synthesized
cctccttcgacctggtgtaaaa

SEQ ID NO: 1311816 - DNA, 22 bp, Artificial Sequence
  chemically synthesized
taattctaaggaattttacacc

SEQ ID NO: 1311817 - DNA, 22 bp, Artificial Sequence
  chemically synthesized
cttcgacctggtgtaaaattcc

SEQ ID NO: 1311818 - DNA, 22 bp, Artificial Sequence
  chemically synthesized
cgacctggtgtaaaattcctta

SEQ ID NO: 1311819 - DNA, 22 bp, Artificial Sequence
  chemically synthesized
gacctggtgtaaaattccttag

SEQ ID NO: 1311820 - DNA, 22 bp, Artificial Sequence
  chemically synthesized
aacacacagttgtaattctaag

SEQ ID NO: 1311821 - DNA, 22 bp, Artificial Sequence
  chemically synthesized
gtgtaaaattccttagaattac

SEQ ID NO: 1311822 - DNA, 22 bp, Artificial Sequence
  chemically synthesized
tctaaacacacagttgtaattc

SEQ ID NO: 1311823 - DNA, 22 bp, Artificial Sequence
  chemically synthesized
ttgtctaaacacacagttgtaa

SEQ ID NO: 1311824 - DNA, 22 bp, Artificial Sequence
  chemically synthesized
attgtctaaacacacagttgta

SEQ ID NO: 1311825 - DNA, 22 bp, Artificial Sequence
  chemically synthesized
tattgtctaaacacacagttgt

SEQ ID NO: 1311826 - DNA, 22 bp, Artificial Sequence
  chemically synthesized
cttagaattacaactgtgtgtt

SEQ ID NO: 1311827 - DNA, 22 bp, Artificial Sequence
  chemically synthesized
ggttttattgtctaaacacaca

SEQ ID NO: 1311828 - DNA, 22 bp, Artificial Sequence
  chemically synthesized
agaattacaactgtgtgtttag

SEQ ID NO: 1311829 - DNA, 22 bp, Artificial Sequence
  chemically synthesized
cggttttattgtctaaacacac

SEQ ID NO: 1311830 - DNA, 22 bp, Artificial Sequence
  chemically synthesized
gaattacaactgtgtgtttaga

SEQ ID NO: 1311831 - DNA, 22 bp, Artificial Sequence
  chemically synthesized
caactgtgtgtttagacaataa

SEQ ID NO: 1311832 - DNA, 22 bp, Artificial Sequence
  chemically synthesized
aggcaaatccttcggttttatt

SEQ ID NO: 1311833 - DNA, 22 bp, Artificial Sequence
  chemically synthesized
tgtgtttagacaataaaaccga

SEQ ID NO: 1311834 - DNA, 22 bp, Artificial Sequence
  chemically synthesized
gaggcaaatccttcggttttat

SEQ ID NO: 1311835 - DNA, 22 bp, Artificial Sequence
  chemically synthesized
atatttgaggcaaatccttcgg

SEQ ID NO: 1311836 - DNA, 22 bp, Artificial Sequence
  chemically synthesized
agacaataaaaccgaaggattt

SEQ ID NO: 1311837 - DNA, 22 bp, Artificial Sequence
  chemically synthesized
gatatttgaggcaaatccttcg

SEQ ID NO: 1311838 - DNA, 22 bp, Artificial Sequence
  chemically synthesized
gacaataaaaccgaaggatttg

SEQ ID NO: 1311839 - DNA, 22 bp, Artificial Sequence
  chemically synthesized
tgatatttgaggcaaatccttc

SEQ ID NO: 1311840 - DNA, 22 bp, Artificial Sequence
  chemically synthesized
gttttgatatttgaggcaaatc

SEQ ID NO: 1311841 - DNA, 22 bp, Artificial Sequence
  chemically synthesized
agttttgatatttgaggcaaat

SEQ ID NO: 1311842 - DNA, 22 bp, Artificial Sequence
  chemically synthesized
cacttagttttgatatttgagg

SEQ ID NO: 1311843 - DNA, 22 bp, Artificial Sequence
  chemically synthesized
gcacttagttttgatatttgag

SEQ ID NO: 1311844 - DNA, 22 bp, Artificial Sequence
  chemically synthesized
cccatttgcacttagttttgat

SEQ ID NO: 1311845 - DNA, 22 bp, Artificial Sequence
  chemically synthesized
gcctcaaatatcaaaactaagt

SEQ ID NO: 1311846 - DNA, 22 bp, Artificial Sequence
  chemically synthesized
cctcaaatatcaaaactaagtg

SEQ ID NO: 1311847 - DNA, 22 bp, Artificial Sequence
  chemically synthesized
aaatatcaaaactaagtgcaaa

SEQ ID NO: 1311848 - DNA, 22 bp, Artificial Sequence
  chemically synthesized
tatagcattgcccatttgcact

SEQ ID NO: 1311849 - DNA, 22 bp, Artificial Sequence
  chemically synthesized
atctatatagcattgcccattt

SEQ ID NO: 1311850 - DNA, 22 bp, Artificial Sequence
  chemically synthesized
ctcatctatatagcattgccca

SEQ ID NO: 1311851 - DNA, 22 bp, Artificial Sequence
  chemically synthesized
ctgctcatctatatagcattgc

SEQ ID NO: 1311852 - DNA, 22 bp, Artificial Sequence
  chemically synthesized
agtgcaaatgggcaatgctata

SEQ ID NO: 1311853 - DNA, 22 bp, Artificial Sequence
  chemically synthesized
cctgctcatctatatagcattg

SEQ ID NO: 1311854 - DNA, 22 bp, Artificial Sequence
  chemically synthesized
tatagatgagcaggaaacattt

SEQ ID NO: 1311855 - DNA, 22 bp, Artificial Sequence
  chemically synthesized
gaggagagtgagaaatgtttcc

SEQ ID NO: 1311856 - DNA, 22 bp, Artificial Sequence
  chemically synthesized
agaggagagtgagaaatgtttc

SEQ ID NO: 1311857 - DNA, 22 bp, Artificial Sequence
  chemically synthesized
acttagaggagagtgagaaatg

SEQ ID NO: 1311858 - DNA, 22 bp, Artificial Sequence
  chemically synthesized
gcattcacttagaggagagtga

SEQ ID NO: 1311859 - DNA, 22 bp, Artificial Sequence
  chemically synthesized
ctcactctcctctaagtgaatg

SEQ ID NO: 1311860 - DNA, 22 bp, Artificial Sequence
  chemically synthesized
tcactctcctctaagtgaatgc

SEQ ID NO: 1311861 - DNA, 22 bp, Artificial Sequence
  chemically synthesized
actctcctctaagtgaatgcta

SEQ ID NO: 1311862 - DNA, 22 bp, Artificial Sequence
  chemically synthesized
atgaaatcatattagcattcac

SEQ ID NO: 1311863 - DNA, 22 bp, Artificial Sequence
  chemically synthesized
tcctctaagtgaatgctaatat

SEQ ID NO: 1311864 - DNA, 22 bp, Artificial Sequence
  chemically synthesized
ctctaagtgaatgctaatatga

SEQ ID NO: 1311865 - DNA, 22 bp, Artificial Sequence
  chemically synthesized
taagtgaatgctaatatgattt

SEQ ID NO: 1311866 - DNA, 22 bp, Artificial Sequence
  chemically synthesized
tgtcaattcatgaaatcatatt

SEQ ID NO: 1311867 - DNA, 22 bp, Artificial Sequence
  chemically synthesized
agtgaatgctaatatgatttca

SEQ ID NO: 1311868 - DNA, 22 bp, Artificial Sequence
  chemically synthesized
gttgtgtcaattcatgaaatca

SEQ ID NO: 1311869 - DNA, 22 bp, Artificial Sequence
  chemically synthesized
agttgtgtcaattcatgaaatc

SEQ ID NO: 1311870 - DNA, 22 bp, Artificial Sequence
  chemically synthesized
atatgatttcatgaattgacac

SEQ ID NO: 1311871 - DNA, 22 bp, Artificial Sequence
  chemically synthesized
taaagcaaaatttagttgtgtc

SEQ ID NO: 1311872 - DNA, 22 bp, Artificial Sequence
  chemically synthesized
ataaagcaaaatttagttgtgt

SEQ ID NO: 1311873 - DNA, 22 bp, Artificial Sequence
  chemically synthesized
ttataaagcaaaatttagttgt

SEQ ID NO: 1311874 - DNA, 22 bp, Artificial Sequence
  chemically synthesized
catgaattgacacaactaaatt

SEQ ID NO: 1311875 - DNA, 22 bp, Artificial Sequence
  chemically synthesized
atgaattgacacaactaaattt

SEQ ID NO: 1311876 - DNA, 22 bp, Artificial Sequence
  chemically synthesized
tgtatgttcttataaagcaaaa

SEQ ID NO: 1311877 - DNA, 22 bp, Artificial Sequence
  chemically synthesized
acacaactaaattttgctttat

SEQ ID NO: 1311878 - DNA, 22 bp, Artificial Sequence
  chemically synthesized
gctatgtatgttcttataaagc

SEQ ID NO: 1311879 - DNA, 22 bp, Artificial Sequence
  chemically synthesized
ggctatgtatgttcttataaag

SEQ ID NO: 1311880 - DNA, 22 bp, Artificial Sequence
  chemically synthesized
tggctatgtatgttcttataaa

SEQ ID NO: 1311881 - DNA, 22 bp, Artificial Sequence
  chemically synthesized
aattttgctttataagaacata

SEQ ID NO: 1311882 - DNA, 22 bp, Artificial Sequence
  chemically synthesized
aatcctttggctatgtatgttc

SEQ ID NO: 1311883 - DNA, 22 bp, Artificial Sequence
  chemically synthesized
aaatcctttggctatgtatgtt

SEQ ID NO: 1311884 - DNA, 22 bp, Artificial Sequence
  chemically synthesized
tgctttataagaacatacatag

SEQ ID NO: 1311885 - DNA, 22 bp, Artificial Sequence
  chemically synthesized
taaatcctttggctatgtatgt

SEQ ID NO: 1311886 - DNA, 22 bp, Artificial Sequence
  chemically synthesized
gctttataagaacatacatagc

SEQ ID NO: 1311887 - DNA, 22 bp, Artificial Sequence
  chemically synthesized
ttaaatcctttggctatgtatg

SEQ ID NO: 1311888 - DNA, 22 bp, Artificial Sequence
  chemically synthesized
ctttataagaacatacatagcc

SEQ ID NO: 1311889 - DNA, 22 bp, Artificial Sequence
  chemically synthesized
tttaaatcctttggctatgtat

SEQ ID NO: 1311890 - DNA, 22 bp, Artificial Sequence
  chemically synthesized
ttttaaatcctttggctatgta

SEQ ID NO: 1311891 - DNA, 22 bp, Artificial Sequence
  chemically synthesized
tttttaaatcctttggctatgt

SEQ ID NO: 1311892 - DNA, 22 bp, Artificial Sequence
  chemically synthesized
tataagaacatacatagccaaa

SEQ ID NO: 1311893 - DNA, 22 bp, Artificial Sequence
  chemically synthesized
ttttttaaatcctttggctatg

SEQ ID NO: 1311894 - DNA, 22 bp, Artificial Sequence
  chemically synthesized
ataagaacatacatagccaaag

SEQ ID NO: 1311895 - DNA, 22 bp, Artificial Sequence
  chemically synthesized
tttttttaaatcctttggctat

SEQ ID NO: 1311896 - DNA, 22 bp, Artificial Sequence
  chemically synthesized
taagaacatacatagccaaagg

SEQ ID NO: 1311897 - DNA, 22 bp, Artificial Sequence
  chemically synthesized
ttttttttaaatcctttggcta

SEQ ID NO: 1311898 - DNA, 22 bp, Artificial Sequence
  chemically synthesized
tttttttttaaatcctttggct

SEQ ID NO: 1311899 - DNA, 22 bp, Artificial Sequence
  chemically synthesized
ttttttttttaaatcctttggc

SEQ ID NO: 1311900 - DNA, 22 bp, Artificial Sequence
  chemically synthesized
tttttttttttaaatcctttgg

SEQ ID NO: 1311901 - DNA, 22 bp, Artificial Sequence
  chemically synthesized
aggtggttttttttttttttaa

SEQ ID NO: 1311902 - DNA, 22 bp, Artificial Sequence
  chemically synthesized
aaggtggtttttttttttttta

SEQ ID NO: 1311903 - DNA, 22 bp, Artificial Sequence
  chemically synthesized
taaggtggtttttttttttttt

SEQ ID NO: 1311904 - DNA, 22 bp, Artificial Sequence
  chemically synthesized
ttttaaggtggttttttttttt

SEQ ID NO: 1311905 - DNA, 22 bp, Artificial Sequence
  chemically synthesized
gttttaaggtggtttttttttt

SEQ ID NO: 1311906 - DNA, 22 bp, Artificial Sequence
  chemically synthesized
taacttgttttaaggtggtttt

SEQ ID NO: 1311907 - DNA, 22 bp, Artificial Sequence
  chemically synthesized
aaaaaaaaaaaaaaccacctta

SEQ ID NO: 1311908 - DNA, 22 bp, Artificial Sequence
  chemically synthesized
tgtaacttgttttaaggtggtt

SEQ ID NO: 1311909 - DNA, 22 bp, Artificial Sequence
  chemically synthesized
aaaaaaaaaaaaaccaccttaa

SEQ ID NO: 1311910 - DNA, 22 bp, Artificial Sequence
  chemically synthesized
accctctgtaacttgttttaag

SEQ ID NO: 1311911 - DNA, 22 bp, Artificial Sequence
  chemically synthesized
aaccctctgtaacttgttttaa

SEQ ID NO: 1311912 - DNA, 22 bp, Artificial Sequence
  chemically synthesized
cgtttaaccctctgtaacttgt

SEQ ID NO: 1311913 - DNA, 22 bp, Artificial Sequence
  chemically synthesized
ccgtttaaccctctgtaacttg

SEQ ID NO: 1311914 - DNA, 22 bp, Artificial Sequence
  chemically synthesized
cttccgtttaaccctctgtaac

SEQ ID NO: 1311915 - DNA, 22 bp, Artificial Sequence
  chemically synthesized
gcttccgtttaaccctctgtaa

SEQ ID NO: 1311916 - DNA, 22 bp, Artificial Sequence
  chemically synthesized
tgcttccgtttaaccctctgta

SEQ ID NO: 1311917 - DNA, 22 bp, Artificial Sequence
  chemically synthesized
ttgcttccgtttaaccctctgt

SEQ ID NO: 1311918 - DNA, 22 bp, Artificial Sequence
  chemically synthesized
aaaacaagttacagagggttaa

SEQ ID NO: 1311919 - DNA, 22 bp, Artificial Sequence
  chemically synthesized
aaacaagttacagagggttaaa

SEQ ID NO: 1311920 - DNA, 22 bp, Artificial Sequence
  chemically synthesized
cttttgcttccgtttaaccctc

SEQ ID NO: 1311921 - DNA, 22 bp, Artificial Sequence
  chemically synthesized
cctacttttgcttccgtttaac

SEQ ID NO: 1311922 - DNA, 22 bp, Artificial Sequence
  chemically synthesized
gctacctacttttgcttccgtt

SEQ ID NO: 1311923 - DNA, 22 bp, Artificial Sequence
  chemically synthesized
agctacctacttttgcttccgt

SEQ ID NO: 1311924 - DNA, 22 bp, Artificial Sequence
  chemically synthesized
cagagggttaaacggaagcaaa

SEQ ID NO: 1311925 - DNA, 22 bp, Artificial Sequence
  chemically synthesized
atacttagctacctacttttgc

SEQ ID NO: 1311926 - DNA, 22 bp, Artificial Sequence
  chemically synthesized
ctaatacttagctacctacttt

SEQ ID NO: 1311927 - DNA, 22 bp, Artificial Sequence
  chemically synthesized
cctaatacttagctacctactt

SEQ ID NO: 1311928 - DNA, 22 bp, Artificial Sequence
  chemically synthesized
aacggaagcaaaagtaggtagc

SEQ ID NO: 1311929 - DNA, 22 bp, Artificial Sequence
  chemically synthesized
cacccttcctaatacttagcta

SEQ ID NO: 1311930 - DNA, 22 bp, Artificial Sequence
  chemically synthesized
ttccacccttcctaatacttag

SEQ ID NO: 1311931 - DNA, 22 bp, Artificial Sequence
  chemically synthesized
gacattattccacccttcctaa

SEQ ID NO: 1311932 - DNA, 22 bp, Artificial Sequence
  chemically synthesized
ctagacattattccacccttcc

SEQ ID NO: 1311933 - DNA, 22 bp, Artificial Sequence
  chemically synthesized
cctagacattattccacccttc

SEQ ID NO: 1311934 - DNA, 22 bp, Artificial Sequence
  chemically synthesized
agtattaggaagggtggaataa

SEQ ID NO: 1311935 - DNA, 22 bp, Artificial Sequence
  chemically synthesized
gtttcctagacattattccacc

SEQ ID NO: 1311936 - DNA, 22 bp, Artificial Sequence
  chemically synthesized
tcgtttcctagacattattcca

SEQ ID NO: 1311937 - DNA, 22 bp, Artificial Sequence
  chemically synthesized
ctctcgtttcctagacattatt

SEQ ID NO: 1311938 - DNA, 22 bp, Artificial Sequence
  chemically synthesized
ggaagggtggaataatgtctag

SEQ ID NO: 1311939 - DNA, 22 bp, Artificial Sequence
  chemically synthesized
ttactctcgtttcctagacatt

SEQ ID NO: 1311940 - DNA, 22 bp, Artificial Sequence
  chemically synthesized
attactctcgtttcctagacat

SEQ ID NO: 1311941 - DNA, 22 bp, Artificial Sequence
  chemically synthesized
gccttattactctcgtttccta

SEQ ID NO: 1311942 - DNA, 22 bp, Artificial Sequence
  chemically synthesized
cacctggccttattactctcgt

SEQ ID NO: 1311943 - DNA, 22 bp, Artificial Sequence
  chemically synthesized
ggaaacgagagtaataaggcca

SEQ ID NO: 1311944 - DNA, 22 bp, Artificial Sequence
  chemically synthesized
taggcatgagccactgcacctg

SEQ ID NO: 1311945 - DNA, 22 bp, Artificial Sequence
  chemically synthesized
ggattataggcatgagccactg

SEQ ID NO: 1311946 - DNA, 22 bp, Artificial Sequence
  chemically synthesized
ccaaagtgctaggattataggc

SEQ ID NO: 1311947 - DNA, 22 bp, Artificial Sequence
  chemically synthesized
ggcctcccaaagtgctaggatt

SEQ ID NO: 1311948 - DNA, 22 bp, Artificial Sequence
  chemically synthesized
atgcctataatcctagcacttt

SEQ ID NO: 1311949 - DNA, 22 bp, Artificial Sequence
  chemically synthesized
cccgcctcggcctcccaaagtg

SEQ ID NO: 1311950 - DNA, 22 bp, Artificial Sequence
  chemically synthesized
taatcctagcactttgggaggc

SEQ ID NO: 1311951 - DNA, 22 bp, Artificial Sequence
  chemically synthesized
aagtgatctgcccgcctcggcc

SEQ ID NO: 1311952 - DNA, 22 bp, Artificial Sequence
  chemically synthesized
gcactttgggaggccgaggcgg

SEQ ID NO: 1311953 - DNA, 22 bp, Artificial Sequence
  chemically synthesized
acctcaagtgatctgcccgcct

SEQ ID NO: 1311954 - DNA, 22 bp, Artificial Sequence
  chemically synthesized
tgggaggccgaggcgggcagat

SEQ ID NO: 1311955 - DNA, 22 bp, Artificial Sequence
  chemically synthesized
gggaggccgaggcgggcagatc

SEQ ID NO: 1311956 - DNA, 22 bp, Artificial Sequence
  chemically synthesized
ctgacctcaagtgatctgcccg

SEQ ID NO: 1311957 - DNA, 22 bp, Artificial Sequence
  chemically synthesized
ggaggccgaggcgggcagatca

SEQ ID NO: 1311958 - DNA, 22 bp, Artificial Sequence
  chemically synthesized
aactcctgacctcaagtgatct

SEQ ID NO: 1311959 - DNA, 22 bp, Artificial Sequence
  chemically synthesized
gaactcctgacctcaagtgatc

SEQ ID NO: 1311960 - DNA, 22 bp, Artificial Sequence
  chemically synthesized
tgaactcctgacctcaagtgat

SEQ ID NO: 1311961 - DNA, 22 bp, Artificial Sequence
  chemically synthesized
gttttgaactcctgacctcaag

SEQ ID NO: 1311962 - DNA, 22 bp, Artificial Sequence
  chemically synthesized
gccaggttggttttgaactcct

SEQ ID NO: 1311963 - DNA, 22 bp, Artificial Sequence
  chemically synthesized
gaggtcaggagttcaaaaccaa

SEQ ID NO: 1311964 - DNA, 22 bp, Artificial Sequence
  chemically synthesized
aggtcaggagttcaaaaccaac

SEQ ID NO: 1311965 - DNA, 22 bp, Artificial Sequence
  chemically synthesized
atcacattggccaggttggttt

SEQ ID NO: 1311966 - DNA, 22 bp, Artificial Sequence
  chemically synthesized
catcacattggccaggttggtt

SEQ ID NO: 1311967 - DNA, 22 bp, Artificial Sequence
  chemically synthesized
aaaaccaacctggccaatgtga

SEQ ID NO: 1311968 - DNA, 22 bp, Artificial Sequence
  chemically synthesized
gtagagacgcggtttcatcaca

SEQ ID NO: 1311969 - DNA, 22 bp, Artificial Sequence
  chemically synthesized
agtagagacgcggtttcatcac

SEQ ID NO: 1311970 - DNA, 22 bp, Artificial Sequence
  chemically synthesized
tagtagagacgcggtttcatca

SEQ ID NO: 1311971 - DNA, 22 bp, Artificial Sequence
  chemically synthesized
ttttagtagagacgcggtttca

SEQ ID NO: 1311972 - DNA, 22 bp, Artificial Sequence
  chemically synthesized
attttagtagagacgcggtttc

SEQ ID NO: 1311973 - DNA, 22 bp, Artificial Sequence
  chemically synthesized
gccaatgtgatgaaaccgcgtc

SEQ ID NO: 1311974 - DNA, 22 bp, Artificial Sequence
  chemically synthesized
tattttagtagagacgcggttt

SEQ ID NO: 1311975 - DNA, 22 bp, Artificial Sequence
  chemically synthesized
ttattttagtagagacgcggtt

SEQ ID NO: 1311976 - DNA, 22 bp, Artificial Sequence
  chemically synthesized
atttttattttagtagagacgc

SEQ ID NO: 1311977 - DNA, 22 bp, Artificial Sequence
  chemically synthesized
gctaatttttattttagtagag

SEQ ID NO: 1311978 - DNA, 22 bp, Artificial Sequence
  chemically synthesized
tactaaaataaaaattagccag

SEQ ID NO: 1311979 - DNA, 22 bp, Artificial Sequence
  chemically synthesized
ctaaaataaaaattagccaggc

SEQ ID NO: 1311980 - DNA, 22 bp, Artificial Sequence
  chemically synthesized
aaataaaaattagccaggcctg

SEQ ID NO: 1311981 - DNA, 22 bp, Artificial Sequence
  chemically synthesized
caggcgcgcaccaccaggcctg

SEQ ID NO: 1311982 - DNA, 22 bp, Artificial Sequence
  chemically synthesized
ggattacaggcgcgcaccacca

SEQ ID NO: 1311983 - DNA, 22 bp, Artificial Sequence
  chemically synthesized
gccaggcctggtggtgcgcgcc

SEQ ID NO: 1311984 - DNA, 22 bp, Artificial Sequence
  chemically synthesized
agtagctgggattacaggcgcg

SEQ ID NO: 1311985 - DNA, 22 bp, Artificial Sequence
  chemically synthesized
ctgagtagctgggattacaggc

SEQ ID NO: 1311986 - DNA, 22 bp, Artificial Sequence
  chemically synthesized
gtggtgcgcgcctgtaatccca

SEQ ID NO: 1311987 - DNA, 22 bp, Artificial Sequence
  chemically synthesized
accctcctgagtagctgggatt

SEQ ID NO: 1311988 - DNA, 22 bp, Artificial Sequence
  chemically synthesized
atgcctcaccctcctgagtagc

SEQ ID NO: 1311989 - DNA, 22 bp, Artificial Sequence
  chemically synthesized
tcatgcctcaccctcctgagta

SEQ ID NO: 1311990 - DNA, 22 bp, Artificial Sequence
  chemically synthesized
taatcccagctactcaggaggg

SEQ ID NO: 1311991 - DNA, 22 bp, Artificial Sequence
  chemically synthesized
aagcgattctcatgcctcaccc

SEQ ID NO: 1311992 - DNA, 22 bp, Artificial Sequence
  chemically synthesized
ctcaggagggtgaggcatgaga

SEQ ID NO: 1311993 - DNA, 22 bp, Artificial Sequence
  chemically synthesized
aggagggtgaggcatgagaatc

SEQ ID NO: 1311994 - DNA, 22 bp, Artificial Sequence
  chemically synthesized
ccaggttcaagcgattctcatg

SEQ ID NO: 1311995 - DNA, 22 bp, Artificial Sequence
  chemically synthesized
cctcccaggttcaagcgattct

SEQ ID NO: 1311996 - DNA, 22 bp, Artificial Sequence
  chemically synthesized
tgcctcccaggttcaagcgatt

SEQ ID NO: 1311997 - DNA, 22 bp, Artificial Sequence
  chemically synthesized
caacctctgcctcccaggttca

SEQ ID NO: 1311998 - DNA, 22 bp, Artificial Sequence
  chemically synthesized
actgcaacctctgcctcccagg

SEQ ID NO: 1311999 - DNA, 22 bp, Artificial Sequence
  chemically synthesized
gtctcactgcaacctctgcctc

SEQ ID NO: 1312000 - DNA, 22 bp, Artificial Sequence
  chemically synthesized
gaacctgggaggcagaggttgc

SEQ ID NO: 1312001 - DNA, 22 bp, Artificial Sequence
  chemically synthesized
aacctgggaggcagaggttgca

SEQ ID NO: 1312002 - DNA, 22 bp, Artificial Sequence
  chemically synthesized
ggaggcagaggttgcagtgaga

SEQ ID NO: 1312003 - DNA, 22 bp, Artificial Sequence
  chemically synthesized
gagtgcagtggtgtgatctcgt

SEQ ID NO: 1312004 - DNA, 22 bp, Artificial Sequence
  chemically synthesized
cagtgagacgagatcacaccac

SEQ ID NO: 1312005 - DNA, 22 bp, Artificial Sequence
  chemically synthesized
tccaggctggagtgcagtggtg

SEQ ID NO: 1312006 - DNA, 22 bp, Artificial Sequence
  chemically synthesized
gtccaggctggagtgcagtggt

SEQ ID NO: 1312007 - DNA, 22 bp, Artificial Sequence
  chemically synthesized
tgtccaggctggagtgcagtgg

SEQ ID NO: 1312008 - DNA, 22 bp, Artificial Sequence
  chemically synthesized
ttttgtccaggctggagtgcag

SEQ ID NO: 1312009 - DNA, 22 bp, Artificial Sequence
  chemically synthesized
actgttttgtccaggctggagt

SEQ ID NO: 1312010 - DNA, 22 bp, Artificial Sequence
  chemically synthesized
acagagtctcactgttttgtcc

SEQ ID NO: 1312011 - DNA, 22 bp, Artificial Sequence
  chemically synthesized
cactccagcctggacaaaacag

SEQ ID NO: 1312012 - DNA, 22 bp, Artificial Sequence
  chemically synthesized
gacagagtctcactgttttgtc

SEQ ID NO: 1312013 - DNA, 22 bp, Artificial Sequence
  chemically synthesized
tgacagagtctcactgttttgt

SEQ ID NO: 1312014 - DNA, 22 bp, Artificial Sequence
  chemically synthesized
ttgacagagtctcactgttttg

SEQ ID NO: 1312015 - DNA, 22 bp, Artificial Sequence
  chemically synthesized
tttgacagagtctcactgtttt

SEQ ID NO: 1312016 - DNA, 22 bp, Artificial Sequence
  chemically synthesized
ttttgacagagtctcactgttt

SEQ ID NO: 1312017 - DNA, 22 bp, Artificial Sequence
  chemically synthesized
cagcctggacaaaacagtgaga

SEQ ID NO: 1312018 - DNA, 22 bp, Artificial Sequence
  chemically synthesized
tttttgacagagtctcactgtt

SEQ ID NO: 1312019 - DNA, 22 bp, Artificial Sequence
  chemically synthesized
ttttttgacagagtctcactgt

SEQ ID NO: 1312020 - DNA, 22 bp, Artificial Sequence
  chemically synthesized
tttttttgacagagtctcactg

SEQ ID NO: 1312021 - DNA, 22 bp, Artificial Sequence
  chemically synthesized
ttttttttgacagagtctcact

SEQ ID NO: 1312022 - DNA, 22 bp, Artificial Sequence
  chemically synthesized
tttttttttgacagagtctcac

SEQ ID NO: 1312023 - DNA, 22 bp, Artificial Sequence
  chemically synthesized
ttttttttttgacagagtctca

SEQ ID NO: 1312024 - DNA, 22 bp, Artificial Sequence
  chemically synthesized
tttttttttttgacagagtctc

SEQ ID NO: 1312025 - DNA, 22 bp, Artificial Sequence
  chemically synthesized
gacaaaacagtgagactctgtc

SEQ ID NO: 1312026 - DNA, 22 bp, Artificial Sequence
  chemically synthesized
ttttttttttttgacagagtct

SEQ ID NO: 1312027 - DNA, 22 bp, Artificial Sequence
  chemically synthesized
tttttttttttttgacagagtc

SEQ ID NO: 1312028 - DNA, 22 bp, Artificial Sequence
  chemically synthesized
ttttttttttttttgacagagt

SEQ ID NO: 1312029 - DNA, 22 bp, Artificial Sequence
  chemically synthesized
tttttttttttttttgacagag

SEQ ID NO: 1312030 - DNA, 22 bp, Artificial Sequence
  chemically synthesized
ctttttttttttttttttgaca

SEQ ID NO: 1312031 - DNA, 22 bp, Artificial Sequence
  chemically synthesized
cctttttttttttttttttgac

SEQ ID NO: 1312032 - DNA, 22 bp, Artificial Sequence
  chemically synthesized
cttccttttttttttttttttt

SEQ ID NO: 1312033 - DNA, 22 bp, Artificial Sequence
  chemically synthesized
ccttcctttttttttttttttt

SEQ ID NO: 1312034 - DNA, 22 bp, Artificial Sequence
  chemically synthesized
cttccttccttttttttttttt

SEQ ID NO: 1312035 - DNA, 22 bp, Artificial Sequence
  chemically synthesized
ccttccttcctttttttttttt

SEQ ID NO: 1312036 - DNA, 22 bp, Artificial Sequence
  chemically synthesized
tgtcaaaaaaaaaaaaaaaaag

SEQ ID NO: 1312037 - DNA, 22 bp, Artificial Sequence
  chemically synthesized
cttccttccttccttttttttt

SEQ ID NO: 1312038 - DNA, 22 bp, Artificial Sequence
  chemically synthesized
ccttccttccttcctttttttt

SEQ ID NO: 1312039 - DNA, 22 bp, Artificial Sequence
  chemically synthesized
tcaaaaaaaaaaaaaaaaagga

SEQ ID NO: 1312040 - DNA, 22 bp, Artificial Sequence
  chemically synthesized
tccttccttccttccttttttt

SEQ ID NO: 1312041 - DNA, 22 bp, Artificial Sequence
  chemically synthesized
ttccttccttccttcctttttt

SEQ ID NO: 1312042 - DNA, 22 bp, Artificial Sequence
  chemically synthesized
tttccttccttccttccttttt

SEQ ID NO: 1312043 - DNA, 22 bp, Artificial Sequence
  chemically synthesized
tttttccttccttccttccttt

SEQ ID NO: 1312044 - DNA, 22 bp, Artificial Sequence
  chemically synthesized
ctttttccttccttccttcctt

SEQ ID NO: 1312045 - DNA, 22 bp, Artificial Sequence
  chemically synthesized
tctttttccttccttccttcct

SEQ ID NO: 1312046 - DNA, 22 bp, Artificial Sequence
  chemically synthesized
ttctttttccttccttccttcc

SEQ ID NO: 1312047 - DNA, 22 bp, Artificial Sequence
  chemically synthesized
ttttctttttccttccttcctt

SEQ ID NO: 1312048 - DNA, 22 bp, Artificial Sequence
  chemically synthesized
cttttctttttccttccttcct

SEQ ID NO: 1312049 - DNA, 22 bp, Artificial Sequence
  chemically synthesized
tcttttctttttccttccttcc

SEQ ID NO: 1312050 - DNA, 22 bp, Artificial Sequence
  chemically synthesized
ttcttttctttttccttccttc

SEQ ID NO: 1312051 - DNA, 22 bp, Artificial Sequence
  chemically synthesized
tttcttttctttttccttcctt

SEQ ID NO: 1312052 - DNA, 22 bp, Artificial Sequence
  chemically synthesized
ttttcttttctttttccttcct

SEQ ID NO: 1312053 - DNA, 22 bp, Artificial Sequence
  chemically synthesized
tttttcttttctttttccttcc

SEQ ID NO: 1312054 - DNA, 22 bp, Artificial Sequence
  chemically synthesized
ctttttttcttttctttttcct

SEQ ID NO: 1312055 - DNA, 22 bp, Artificial Sequence
  chemically synthesized
cctttttttcttttctttttcc

SEQ ID NO: 1312056 - DNA, 22 bp, Artificial Sequence
  chemically synthesized
tttcctttttttcttttctttt

SEQ ID NO: 1312057 - DNA, 22 bp, Artificial Sequence
  chemically synthesized
gtttcctttttttcttttcttt

SEQ ID NO: 1312058 - DNA, 22 bp, Artificial Sequence
  chemically synthesized
tgtttcctttttttcttttctt

SEQ ID NO: 1312059 - DNA, 22 bp, Artificial Sequence
  chemically synthesized
ttgtttcctttttttcttttct

SEQ ID NO: 1312060 - DNA, 22 bp, Artificial Sequence
  chemically synthesized
cttttgtttcctttttttcttt

SEQ ID NO: 1312061 - DNA, 22 bp, Artificial Sequence
  chemically synthesized
ttacttttgtttcctttttttc

SEQ ID NO: 1312062 - DNA, 22 bp, Artificial Sequence
  chemically synthesized
gtctattacttttgtttccttt

SEQ ID NO: 1312063 - DNA, 22 bp, Artificial Sequence
  chemically synthesized
agattagtctattacttttgtt

SEQ ID NO: 1312064 - DNA, 22 bp, Artificial Sequence
  chemically synthesized
ctaagattagtctattactttt

SEQ ID NO: 1312065 - DNA, 22 bp, Artificial Sequence
  chemically synthesized
cctaagattagtctattacttt

SEQ ID NO: 1312066 - DNA, 22 bp, Artificial Sequence
  chemically synthesized
cagccagcttcctaagattagt

SEQ ID NO: 1312067 - DNA, 22 bp, Artificial Sequence
  chemically synthesized
ctccagccagcttcctaagatt

SEQ ID NO: 1312068 - DNA, 22 bp, Artificial Sequence
  chemically synthesized
tactccagccagcttcctaaga

SEQ ID NO: 1312069 - DNA, 22 bp, Artificial Sequence
  chemically synthesized
tgccattctactccagccagct

SEQ ID NO: 1312070 - DNA, 22 bp, Artificial Sequence
  chemically synthesized
tatgccattctactccagccag

SEQ ID NO: 1312071 - DNA, 22 bp, Artificial Sequence
  chemically synthesized
atcttaggaagctggctggagt

SEQ ID NO: 1312072 - DNA, 22 bp, Artificial Sequence
  chemically synthesized
aggaagctggctggagtagaat

SEQ ID NO: 1312073 - DNA, 22 bp, Artificial Sequence
  chemically synthesized
ggaagctggctggagtagaatg

SEQ ID NO: 1312074 - DNA, 22 bp, Artificial Sequence
  chemically synthesized
ggggctctatgccattctactc

SEQ ID NO: 1312075 - DNA, 22 bp, Artificial Sequence
  chemically synthesized
gctggagtagaatggcatagag

SEQ ID NO: 1312076 - DNA, 22 bp, Artificial Sequence
  chemically synthesized
gtaccgttgggggctctatgcc

SEQ ID NO: 1312077 - DNA, 22 bp, Artificial Sequence
  chemically synthesized
gagtagaatggcatagagcccc

SEQ ID NO: 1312078 - DNA, 22 bp, Artificial Sequence
  chemically synthesized
ctggtaccgttgggggctctat

SEQ ID NO: 1312079 - DNA, 22 bp, Artificial Sequence
  chemically synthesized
ccccacattgctggtaccgttg

SEQ ID NO: 1312080 - DNA, 22 bp, Artificial Sequence
  chemically synthesized
cctaccccacattgctggtacc

SEQ ID NO: 1312081 - DNA, 22 bp, Artificial Sequence
  chemically synthesized
agtcctacctaccccacattgc

SEQ ID NO: 1312082 - DNA, 22 bp, Artificial Sequence
  chemically synthesized
ggagctgagtcctacctacccc

SEQ ID NO: 1312083 - DNA, 22 bp, Artificial Sequence
  chemically synthesized
aggaccataagaagatctagga

SEQ ID NO: 1312084 - DNA, 22 bp, Artificial Sequence
  chemically synthesized
tgtcctgaggaccataagaaga

SEQ ID NO: 1312085 - DNA, 22 bp, Artificial Sequence
  chemically synthesized
atgtcctgaggaccataagaag

SEQ ID NO: 1312086 - DNA, 22 bp, Artificial Sequence
  chemically synthesized
agctcctagatcttcttatggt

SEQ ID NO: 1312087 - DNA, 22 bp, Artificial Sequence
  chemically synthesized
ttatgtcctgaggaccataaga

SEQ ID NO: 1312088 - DNA, 22 bp, Artificial Sequence
  chemically synthesized
cttatgtcctgaggaccataag

SEQ ID NO: 1312089 - DNA, 22 bp, Artificial Sequence
  chemically synthesized
ctagatcttcttatggtcctca

SEQ ID NO: 1312090 - DNA, 22 bp, Artificial Sequence
  chemically synthesized
gatcttcttatggtcctcagga

SEQ ID NO: 1312091 - DNA, 22 bp, Artificial Sequence
  chemically synthesized
gtgtgcttcttatgtcctgagg

SEQ ID NO: 1312092 - DNA, 22 bp, Artificial Sequence
  chemically synthesized
agtgtgcttcttatgtcctgag

SEQ ID NO: 1312093 - DNA, 22 bp, Artificial Sequence
  chemically synthesized
tagtgtgcttcttatgtcctga

SEQ ID NO: 1312094 - DNA, 22 bp, Artificial Sequence
  chemically synthesized
ttagtgtgcttcttatgtcctg

SEQ ID NO: 1312095 - DNA, 22 bp, Artificial Sequence
  chemically synthesized
cttatggtcctcaggacataag

SEQ ID NO: 1312096 - DNA, 22 bp, Artificial Sequence
  chemically synthesized
ttatggtcctcaggacataaga

SEQ ID NO: 1312097 - DNA, 22 bp, Artificial Sequence
  chemically synthesized
atggtcctcaggacataagaag

SEQ ID NO: 1312098 - DNA, 22 bp, Artificial Sequence
  chemically synthesized
tggtcctcaggacataagaagc

SEQ ID NO: 1312099 - DNA, 22 bp, Artificial Sequence
  chemically synthesized
taggccttttagtgtgcttctt

SEQ ID NO: 1312100 - DNA, 22 bp, Artificial Sequence
  chemically synthesized
tataggccttttagtgtgcttc

SEQ ID NO: 1312101 - DNA, 22 bp, Artificial Sequence
  chemically synthesized
aggacataagaagcacactaaa

SEQ ID NO: 1312102 - DNA, 22 bp, Artificial Sequence
  chemically synthesized
tcctctataggccttttagtgt

SEQ ID NO: 1312103 - DNA, 22 bp, Artificial Sequence
  chemically synthesized
aatgggcatcatctatcctcta

SEQ ID NO: 1312104 - DNA, 22 bp, Artificial Sequence
  chemically synthesized
aaatgggcatcatctatcctct

SEQ ID NO: 1312105 - DNA, 22 bp, Artificial Sequence
  chemically synthesized
aaaggcctatagaggatagatg

SEQ ID NO: 1312106 - DNA, 22 bp, Artificial Sequence
  chemically synthesized
aaggtttaaatgggcatcatct

SEQ ID NO: 1312107 - DNA, 22 bp, Artificial Sequence
  chemically synthesized
tagaggatagatgatgcccatt

SEQ ID NO: 1312108 - DNA, 22 bp, Artificial Sequence
  chemically synthesized
ggcagaattaaaggtttaaatg

SEQ ID NO: 1312109 - DNA, 22 bp, Artificial Sequence
  chemically synthesized
aggcagaattaaaggtttaaat

SEQ ID NO: 1312110 - DNA, 22 bp, Artificial Sequence
  chemically synthesized
taggcagaattaaaggtttaaa

SEQ ID NO: 1312111 - DNA, 22 bp, Artificial Sequence
  chemically synthesized
gcagaactttaggcagaattaa

SEQ ID NO: 1312112 - DNA, 22 bp, Artificial Sequence
  chemically synthesized
aaacctttaattctgcctaaag

SEQ ID NO: 1312113 - DNA, 22 bp, Artificial Sequence
  chemically synthesized
aacctttaattctgcctaaagt

SEQ ID NO: 1312114 - DNA, 22 bp, Artificial Sequence
  chemically synthesized
taattctgcctaaagttctgcc

SEQ ID NO: 1312115 - DNA, 22 bp, Artificial Sequence
  chemically synthesized
aattctgcctaaagttctgcca

SEQ ID NO: 1312116 - DNA, 22 bp, Artificial Sequence
  chemically synthesized
attctgcctaaagttctgccag

SEQ ID NO: 1312117 - DNA, 22 bp, Artificial Sequence
  chemically synthesized
tgcccgtacataaacctggcag

SEQ ID NO: 1312118 - DNA, 22 bp, Artificial Sequence
  chemically synthesized
tgcctaaagttctgccaggttt

SEQ ID NO: 1312119 - DNA, 22 bp, Artificial Sequence
  chemically synthesized
cctaaagttctgccaggtttat

SEQ ID NO: 1312120 - DNA, 22 bp, Artificial Sequence
  chemically synthesized
aagttctgccaggtttatgtac

SEQ ID NO: 1312121 - DNA, 22 bp, Artificial Sequence
  chemically synthesized
tgtgcactatgcccgtacataa

SEQ ID NO: 1312122 - DNA, 22 bp, Artificial Sequence
  chemically synthesized
atgtgcactatgcccgtacata

SEQ ID NO: 1312123 - DNA, 22 bp, Artificial Sequence
  chemically synthesized
tatgtgcactatgcccgtacat

SEQ ID NO: 1312124 - DNA, 22 bp, Artificial Sequence
  chemically synthesized
tgccaggtttatgtacgggcat

SEQ ID NO: 1312125 - DNA, 22 bp, Artificial Sequence
  chemically synthesized
ccaggtttatgtacgggcatag

SEQ ID NO: 1312126 - DNA, 22 bp, Artificial Sequence
  chemically synthesized
tgcatgctttatgtgcactatg

SEQ ID NO: 1312127 - DNA, 22 bp, Artificial Sequence
  chemically synthesized
atgcatgctttatgtgcactat

SEQ ID NO: 1312128 - DNA, 22 bp, Artificial Sequence
  chemically synthesized
atgtacgggcatagtgcacata

SEQ ID NO: 1312129 - DNA, 22 bp, Artificial Sequence
  chemically synthesized
ttatgcatgctttatgtgcact

SEQ ID NO: 1312130 - DNA, 22 bp, Artificial Sequence
  chemically synthesized
tgtacgggcatagtgcacataa

SEQ ID NO: 1312131 - DNA, 22 bp, Artificial Sequence
  chemically synthesized
aaggcaaggcaaaaaatatgca

SEQ ID NO: 1312132 - DNA, 22 bp, Artificial Sequence
  chemically synthesized
gaaaaactaaaggcaaggcaaa

SEQ ID NO: 1312133 - DNA, 22 bp, Artificial Sequence
  chemically synthesized
tttgccttgcctttagtttttc

SEQ ID NO: 1312134 - DNA, 22 bp, Artificial Sequence
  chemically synthesized
ttgccttgcctttagtttttcc

SEQ ID NO: 1312135 - DNA, 22 bp, Artificial Sequence
  chemically synthesized
tgccttgcctttagtttttcca

SEQ ID NO: 1312136 - DNA, 22 bp, Artificial Sequence
  chemically synthesized
gccttgcctttagtttttccag

SEQ ID NO: 1312137 - DNA, 22 bp, Artificial Sequence
  chemically synthesized
ccttgcctttagtttttccagg

SEQ ID NO: 1312138 - DNA, 22 bp, Artificial Sequence
  chemically synthesized
atatcatgaaaacctggaaaaa

SEQ ID NO: 1312139 - DNA, 22 bp, Artificial Sequence
  chemically synthesized
gcctttagtttttccaggtttt

SEQ ID NO: 1312140 - DNA, 22 bp, Artificial Sequence
  chemically synthesized
cctttagtttttccaggttttc

SEQ ID NO: 1312141 - DNA, 22 bp, Artificial Sequence
  chemically synthesized
gtgttaatatcatgaaaacctg

SEQ ID NO: 1312142 - DNA, 22 bp, Artificial Sequence
  chemically synthesized
tagtttttccaggttttcatga

SEQ ID NO: 1312143 - DNA, 22 bp, Artificial Sequence
  chemically synthesized
agtttttccaggttttcatgat

SEQ ID NO: 1312144 - DNA, 22 bp, Artificial Sequence
  chemically synthesized
gtttttccaggttttcatgata

SEQ ID NO: 1312145 - DNA, 22 bp, Artificial Sequence
  chemically synthesized
ttccaggttttcatgatattaa

SEQ ID NO: 1312146 - DNA, 22 bp, Artificial Sequence
  chemically synthesized
tccaggttttcatgatattaac

SEQ ID NO: 1312147 - DNA, 22 bp, Artificial Sequence
  chemically synthesized
ccaggttttcatgatattaaca

SEQ ID NO: 1312148 - DNA, 22 bp, Artificial Sequence
  chemically synthesized
caggttttcatgatattaacac

SEQ ID NO: 1312149 - DNA, 22 bp, Artificial Sequence
  chemically synthesized
acataatcgttggtgttaatat

SEQ ID NO: 1312150 - DNA, 22 bp, Artificial Sequence
  chemically synthesized
tgacataatcgttggtgttaat

SEQ ID NO: 1312151 - DNA, 22 bp, Artificial Sequence
  chemically synthesized
tcatgatattaacaccaacgat

SEQ ID NO: 1312152 - DNA, 22 bp, Artificial Sequence
  chemically synthesized
catgatattaacaccaacgatt

SEQ ID NO: 1312153 - DNA, 22 bp, Artificial Sequence
  chemically synthesized
atgatattaacaccaacgatta

SEQ ID NO: 1312154 - DNA, 22 bp, Artificial Sequence
  chemically synthesized
acaccaacgattatgtcagagt

SEQ ID NO: 1312155 - DNA, 22 bp, Artificial Sequence
  chemically synthesized
agaaaaaacaaagcataactct

SEQ ID NO: 1312156 - DNA, 22 bp, Artificial Sequence
  chemically synthesized
ccattgagaaaaaacaaagcat

SEQ ID NO: 1312157 - DNA, 22 bp, Artificial Sequence
  chemically synthesized
tgtcagagttatgctttgtttt

SEQ ID NO: 1312158 - DNA, 22 bp, Artificial Sequence
  chemically synthesized
tcccattgagaaaaaacaaagc

SEQ ID NO: 1312159 - DNA, 22 bp, Artificial Sequence
  chemically synthesized
ctcccattgagaaaaaacaaag

SEQ ID NO: 1312160 - DNA, 22 bp, Artificial Sequence
  chemically synthesized
gatttctcccattgagaaaaaa

SEQ ID NO: 1312161 - DNA, 22 bp, Artificial Sequence
  chemically synthesized
ggatttctcccattgagaaaaa

SEQ ID NO: 1312162 - DNA, 22 bp, Artificial Sequence
  chemically synthesized
tgctttgttttttctcaatggg

SEQ ID NO: 1312163 - DNA, 22 bp, Artificial Sequence
  chemically synthesized
tgcttggatttctcccattgag

SEQ ID NO: 1312164 - DNA, 22 bp, Artificial Sequence
  chemically synthesized
tgttttttctcaatgggagaaa

SEQ ID NO: 1312165 - DNA, 22 bp, Artificial Sequence
  chemically synthesized
gttttttctcaatgggagaaat

SEQ ID NO: 1312166 - DNA, 22 bp, Artificial Sequence
  chemically synthesized
ttttttctcaatgggagaaatc

SEQ ID NO: 1312167 - DNA, 22 bp, Artificial Sequence
  chemically synthesized
tttctcaatgggagaaatccaa

SEQ ID NO: 1312168 - DNA, 22 bp, Artificial Sequence
  chemically synthesized
gggggcctatgcttggatttct

SEQ ID NO: 1312169 - DNA, 22 bp, Artificial Sequence
  chemically synthesized
ttctcaatgggagaaatccaag

SEQ ID NO: 1312170 - DNA, 22 bp, Artificial Sequence
  chemically synthesized
agggggcctatgcttggatttc

SEQ ID NO: 1312171 - DNA, 22 bp, Artificial Sequence
  chemically synthesized
tctcaatgggagaaatccaagc

SEQ ID NO: 1312172 - DNA, 22 bp, Artificial Sequence
  chemically synthesized
tagggggcctatgcttggattt

SEQ ID NO: 1312173 - DNA, 22 bp, Artificial Sequence
  chemically synthesized
ctcaatgggagaaatccaagca

SEQ ID NO: 1312174 - DNA, 22 bp, Artificial Sequence
  chemically synthesized
tcaatgggagaaatccaagcat

SEQ ID NO: 1312175 - DNA, 22 bp, Artificial Sequence
  chemically synthesized
tttagggggcctatgcttggat

SEQ ID NO: 1312176 - DNA, 22 bp, Artificial Sequence
  chemically synthesized
aatgggagaaatccaagcatag

SEQ ID NO: 1312177 - DNA, 22 bp, Artificial Sequence
  chemically synthesized
attctttagggggcctatgctt

SEQ ID NO: 1312178 - DNA, 22 bp, Artificial Sequence
  chemically synthesized
cattctttagggggcctatgct

SEQ ID NO: 1312179 - DNA, 22 bp, Artificial Sequence
  chemically synthesized
catttcattctttagggggcct

SEQ ID NO: 1312180 - DNA, 22 bp, Artificial Sequence
  chemically synthesized
acatttcattctttagggggcc

SEQ ID NO: 1312181 - DNA, 22 bp, Artificial Sequence
  chemically synthesized
tacatttcattctttagggggc

SEQ ID NO: 1312182 - DNA, 22 bp, Artificial Sequence
  chemically synthesized
ttttacatttcattctttaggg

SEQ ID NO: 1312183 - DNA, 22 bp, Artificial Sequence
  chemically synthesized
aagaatgaaatgtaaaacaatg

SEQ ID NO: 1312184 - DNA, 22 bp, Artificial Sequence
  chemically synthesized
tatcaggcaggagtcattgttt

SEQ ID NO: 1312185 - DNA, 22 bp, Artificial Sequence
  chemically synthesized
gttgtatcaggcaggagtcatt

SEQ ID NO: 1312186 - DNA, 22 bp, Artificial Sequence
  chemically synthesized
tggttgtatcaggcaggagtca

SEQ ID NO: 1312187 - DNA, 22 bp, Artificial Sequence
  chemically synthesized
ctggttgtatcaggcaggagtc

SEQ ID NO: 1312188 - DNA, 22 bp, Artificial Sequence
  chemically synthesized
cttctggttgtatcaggcagga

SEQ ID NO: 1312189 - DNA, 22 bp, Artificial Sequence
  chemically synthesized
ccttctggttgtatcaggcagg

SEQ ID NO: 1312190 - DNA, 22 bp, Artificial Sequence
  chemically synthesized
tcaatcttccttctggttgtat

SEQ ID NO: 1312191 - DNA, 22 bp, Artificial Sequence
  chemically synthesized
ctgcctgatacaaccagaagga

SEQ ID NO: 1312192 - DNA, 22 bp, Artificial Sequence
  chemically synthesized
tattgtcaatcttccttctggt

SEQ ID NO: 1312193 - DNA, 22 bp, Artificial Sequence
  chemically synthesized
cctgatacaaccagaaggaaga

SEQ ID NO: 1312194 - DNA, 22 bp, Artificial Sequence
  chemically synthesized
atgttgtattgtcaatcttcct

SEQ ID NO: 1312195 - DNA, 22 bp, Artificial Sequence
  chemically synthesized
atacaaccagaaggaagattga

SEQ ID NO: 1312196 - DNA, 22 bp, Artificial Sequence
  chemically synthesized
catgttgtattgtcaatcttcc

SEQ ID NO: 1312197 - DNA, 22 bp, Artificial Sequence
  chemically synthesized
tcatgttgtattgtcaatcttc

SEQ ID NO: 1312198 - DNA, 22 bp, Artificial Sequence
  chemically synthesized
ttcatgttgtattgtcaatctt

SEQ ID NO: 1312199 - DNA, 22 bp, Artificial Sequence
  chemically synthesized
cgtgacttttcatgttgtattg

SEQ ID NO: 1312200 - DNA, 22 bp, Artificial Sequence
  chemically synthesized
ctccgtgacttttcatgttgta

SEQ ID NO: 1312201 - DNA, 22 bp, Artificial Sequence
  chemically synthesized
actccgtgacttttcatgttgt

SEQ ID NO: 1312202 - DNA, 22 bp, Artificial Sequence
  chemically synthesized
acaatacaacatgaaaagtcac

SEQ ID NO: 1312203 - DNA, 22 bp, Artificial Sequence
  chemically synthesized
tatgaaaataatttactccgtg

SEQ ID NO: 1312204 - DNA, 22 bp, Artificial Sequence
  chemically synthesized
gtatgaaaataatttactccgt

SEQ ID NO: 1312205 - DNA, 22 bp, Artificial Sequence
  chemically synthesized
cacttgtatgaaaataatttac

SEQ ID NO: 1312206 - DNA, 22 bp, Artificial Sequence
  chemically synthesized
tccacttgtatgaaaataattt

SEQ ID NO: 1312207 - DNA, 22 bp, Artificial Sequence
  chemically synthesized
ctccacttgtatgaaaataatt

SEQ ID NO: 1312208 - DNA, 22 bp, Artificial Sequence
  chemically synthesized
aaaataatttctccacttgtat

SEQ ID NO: 1312209 - DNA, 22 bp, Artificial Sequence
  chemically synthesized
cctgaaaataatttctccactt

SEQ ID NO: 1312210 - DNA, 22 bp, Artificial Sequence
  chemically synthesized
ttttcatacaagtggagaaatt

SEQ ID NO: 1312211 - DNA, 22 bp, Artificial Sequence
  chemically synthesized
tcatacaagtggagaaattatt

SEQ ID NO: 1312212 - DNA, 22 bp, Artificial Sequence
  chemically synthesized
catacaagtggagaaattattt

SEQ ID NO: 1312213 - DNA, 22 bp, Artificial Sequence
  chemically synthesized
cgaattccctgaaaataatttc

SEQ ID NO: 1312214 - DNA, 22 bp, Artificial Sequence
  chemically synthesized
atacaagtggagaaattatttt

SEQ ID NO: 1312215 - DNA, 22 bp, Artificial Sequence
  chemically synthesized
tcggtctacgaattccctgaaa

SEQ ID NO: 1312216 - DNA, 22 bp, Artificial Sequence
  chemically synthesized
tgaatagctgtcggtctacgaa

SEQ ID NO: 1312217 - DNA, 22 bp, Artificial Sequence
  chemically synthesized
ttttcagggaattcgtagaccg

SEQ ID NO: 1312218 - DNA, 22 bp, Artificial Sequence
  chemically synthesized
tcagggaattcgtagaccgaca

SEQ ID NO: 1312219 - DNA, 22 bp, Artificial Sequence
  chemically synthesized
cagggaattcgtagaccgacag

SEQ ID NO: 1312220 - DNA, 22 bp, Artificial Sequence
  chemically synthesized
agggaattcgtagaccgacagc

SEQ ID NO: 1312221 - DNA, 22 bp, Artificial Sequence
  chemically synthesized
atggcctgtgaatagctgtcgg

SEQ ID NO: 1312222 - DNA, 22 bp, Artificial Sequence
  chemically synthesized
gatggcctgtgaatagctgtcg

SEQ ID NO: 1312223 - DNA, 22 bp, Artificial Sequence
  chemically synthesized
gtagaccgacagctattcacag

SEQ ID NO: 1312224 - DNA, 22 bp, Artificial Sequence
  chemically synthesized
tgggtgtttgatggcctgtgaa

SEQ ID NO: 1312225 - DNA, 22 bp, Artificial Sequence
  chemically synthesized
atgggtgtttgatggcctgtga

SEQ ID NO: 1312226 - DNA, 22 bp, Artificial Sequence
  chemically synthesized
ttcacaggccatcaaacaccca

SEQ ID NO: 1312227 - DNA, 22 bp, Artificial Sequence
  chemically synthesized
acaggccatcaaacacccataa

SEQ ID NO: 1312228 - DNA, 22 bp, Artificial Sequence
  chemically synthesized
aaggatgacaaaggtccttatg

SEQ ID NO: 1312229 - DNA, 22 bp, Artificial Sequence
  chemically synthesized
aagtgattgaaggatgacaaag

SEQ ID NO: 1312230 - DNA, 22 bp, Artificial Sequence
  chemically synthesized
ctgaagtgattgaaggatgaca

SEQ ID NO: 1312231 - DNA, 22 bp, Artificial Sequence
  chemically synthesized
tactgaagtgattgaaggatga

SEQ ID NO: 1312232 - DNA, 22 bp, Artificial Sequence
  chemically synthesized
tctactgaagtgattgaaggat

SEQ ID NO: 1312233 - DNA, 22 bp, Artificial Sequence
  chemically synthesized
tctctactgaagtgattgaagg

SEQ ID NO: 1312234 - DNA, 22 bp, Artificial Sequence
  chemically synthesized
tctctctactgaagtgattgaa

SEQ ID NO: 1312235 - DNA, 22 bp, Artificial Sequence
  chemically synthesized
tgtcatccttcaatcacttcag

SEQ ID NO: 1312236 - DNA, 22 bp, Artificial Sequence
  chemically synthesized
gtcatccttcaatcacttcagt

SEQ ID NO: 1312237 - DNA, 22 bp, Artificial Sequence
  chemically synthesized
tcatccttcaatcacttcagta

SEQ ID NO: 1312238 - DNA, 22 bp, Artificial Sequence
  chemically synthesized
atacatgttctctctctactga

SEQ ID NO: 1312239 - DNA, 22 bp, Artificial Sequence
  chemically synthesized
catacatgttctctctctactg

SEQ ID NO: 1312240 - DNA, 22 bp, Artificial Sequence
  chemically synthesized
tcatacatgttctctctctact

SEQ ID NO: 1312241 - DNA, 22 bp, Artificial Sequence
  chemically synthesized
caatcacttcagtagagagaga

SEQ ID NO: 1312242 - DNA, 22 bp, Artificial Sequence
  chemically synthesized
tttcatacatgttctctctcta

SEQ ID NO: 1312243 - DNA, 22 bp, Artificial Sequence
  chemically synthesized
aatcacttcagtagagagagaa

SEQ ID NO: 1312244 - DNA, 22 bp, Artificial Sequence
  chemically synthesized
tctctttcatacatgttctctc

SEQ ID NO: 1312245 - DNA, 22 bp, Artificial Sequence
  chemically synthesized
tgtctctttcatacatgttctc

SEQ ID NO: 1312246 - DNA, 22 bp, Artificial Sequence
  chemically synthesized
ctgtctctttcatacatgttct

SEQ ID NO: 1312247 - DNA, 22 bp, Artificial Sequence
  chemically synthesized
tctgtctctttcatacatgttc

SEQ ID NO: 1312248 - DNA, 22 bp, Artificial Sequence
  chemically synthesized
cagtagagagagaacatgtatg

SEQ ID NO: 1312249 - DNA, 22 bp, Artificial Sequence
  chemically synthesized
agtagagagagaacatgtatga

SEQ ID NO: 1312250 - DNA, 22 bp, Artificial Sequence
  chemically synthesized
tgttttctgtctctttcataca

SEQ ID NO: 1312251 - DNA, 22 bp, Artificial Sequence
  chemically synthesized
actgtgttttctgtctctttca

SEQ ID NO: 1312252 - DNA, 22 bp, Artificial Sequence
  chemically synthesized
aactgtgttttctgtctctttc

SEQ ID NO: 1312253 - DNA, 22 bp, Artificial Sequence
  chemically synthesized
tttaactgtgttttctgtctct

SEQ ID NO: 1312254 - DNA, 22 bp, Artificial Sequence
  chemically synthesized
atttaactgtgttttctgtctc

SEQ ID NO: 1312255 - DNA, 22 bp, Artificial Sequence
  chemically synthesized
cttatttaactgtgttttctgt

SEQ ID NO: 1312256 - DNA, 22 bp, Artificial Sequence
  chemically synthesized
aacaggaattgcttatttaact

SEQ ID NO: 1312257 - DNA, 22 bp, Artificial Sequence
  chemically synthesized
ctgaacaggaattgcttattta

SEQ ID NO: 1312258 - DNA, 22 bp, Artificial Sequence
  chemically synthesized
actgaacaggaattgcttattt

SEQ ID NO: 1312259 - DNA, 22 bp, Artificial Sequence
  chemically synthesized
cagacacttactgaacaggaat

SEQ ID NO: 1312260 - DNA, 22 bp, Artificial Sequence
  chemically synthesized
aataagcaattcctgttcagta

SEQ ID NO: 1312261 - DNA, 22 bp, Artificial Sequence
  chemically synthesized
cctgcagacacttactgaacag

SEQ ID NO: 1312262 - DNA, 22 bp, Artificial Sequence
  chemically synthesized
aaaaactccctgcagacactta

SEQ ID NO: 1312263 - DNA, 22 bp, Artificial Sequence
  chemically synthesized
tgaaaaactccctgcagacact

SEQ ID NO: 1312264 - DNA, 22 bp, Artificial Sequence
  chemically synthesized
ctgttcagtaagtgtctgcagg

SEQ ID NO: 1312265 - DNA, 22 bp, Artificial Sequence
  chemically synthesized
ttcagtaagtgtctgcagggag

SEQ ID NO: 1312266 - DNA, 22 bp, Artificial Sequence
  chemically synthesized
agtaagtgtctgcagggagttt

SEQ ID NO: 1312267 - DNA, 22 bp, Artificial Sequence
  chemically synthesized
tccgtacacactctgaaaaact

SEQ ID NO: 1312268 - DNA, 22 bp, Artificial Sequence
  chemically synthesized
cagggagtttttcagagtgtgt

SEQ ID NO: 1312269 - DNA, 22 bp, Artificial Sequence
  chemically synthesized
ttcagagtgtgtacggataaca

SEQ ID NO: 1312270 - DNA, 22 bp, Artificial Sequence
  chemically synthesized
tcagagtgtgtacggataacac

SEQ ID NO: 1312271 - DNA, 22 bp, Artificial Sequence
  chemically synthesized
cagagtgtgtacggataacacg

SEQ ID NO: 1312272 - DNA, 22 bp, Artificial Sequence
  chemically synthesized
agagtgtgtacggataacacgt

SEQ ID NO: 1312273 - DNA, 22 bp, Artificial Sequence
  chemically synthesized
taggatcgagtaggtatacgtg

SEQ ID NO: 1312274 - DNA, 22 bp, Artificial Sequence
  chemically synthesized
gtaggatcgagtaggtatacgt

SEQ ID NO: 1312275 - DNA, 22 bp, Artificial Sequence
  chemically synthesized
agaaccacgcacttgtaggatc

SEQ ID NO: 1312276 - DNA, 22 bp, Artificial Sequence
  chemically synthesized
ttcagaaccacgcacttgtagg

SEQ ID NO: 1312277 - DNA, 22 bp, Artificial Sequence
  chemically synthesized
tgttcagaaccacgcacttgta

SEQ ID NO: 1312278 - DNA, 22 bp, Artificial Sequence
  chemically synthesized
ctgttcagaaccacgcacttgt

SEQ ID NO: 1312279 - DNA, 22 bp, Artificial Sequence
  chemically synthesized
ctcgatcctacaagtgcgtggt

SEQ ID NO: 1312280 - DNA, 22 bp, Artificial Sequence
  chemically synthesized
cttctgttcagaaccacgcact

SEQ ID NO: 1312281 - DNA, 22 bp, Artificial Sequence
  chemically synthesized
gcttctgttcagaaccacgcac

SEQ ID NO: 1312282 - DNA, 22 bp, Artificial Sequence
  chemically synthesized
gatcctacaagtgcgtggttct

SEQ ID NO: 1312283 - DNA, 22 bp, Artificial Sequence
  chemically synthesized
aaatttgcttctgttcagaacc

SEQ ID NO: 1312284 - DNA, 22 bp, Artificial Sequence
  chemically synthesized
caaatttgcttctgttcagaac

SEQ ID NO: 1312285 - DNA, 22 bp, Artificial Sequence
  chemically synthesized
caagtgcgtggttctgaacaga

SEQ ID NO: 1312286 - DNA, 22 bp, Artificial Sequence
  chemically synthesized
atacttcaaatttgcttctgtt

SEQ ID NO: 1312287 - DNA, 22 bp, Artificial Sequence
  chemically synthesized
ttaatacttcaaatttgcttct

SEQ ID NO: 1312288 - DNA, 22 bp, Artificial Sequence
  chemically synthesized
ttattaatacttcaaatttgct

SEQ ID NO: 1312289 - DNA, 22 bp, Artificial Sequence
  chemically synthesized
tgaacagaagcaaatttgaagt

SEQ ID NO: 1312290 - DNA, 22 bp, Artificial Sequence
  chemically synthesized
attgttattaatacttcaaatt

SEQ ID NO: 1312291 - DNA, 22 bp, Artificial Sequence
  chemically synthesized
cattgttattaatacttcaaat

SEQ ID NO: 1312292 - DNA, 22 bp, Artificial Sequence
  chemically synthesized
aacagaagcaaatttgaagtat

SEQ ID NO: 1312293 - DNA, 22 bp, Artificial Sequence
  chemically synthesized
catcttcattgttattaatact

SEQ ID NO: 1312294 - DNA, 22 bp, Artificial Sequence
  chemically synthesized
ccatcttcattgttattaatac

SEQ ID NO: 1312295 - DNA, 22 bp, Artificial Sequence
  chemically synthesized
tttccatcttcattgttattaa

SEQ ID NO: 1312296 - DNA, 22 bp, Artificial Sequence
  chemically synthesized
gaagtattaataacaatgaaga

SEQ ID NO: 1312297 - DNA, 22 bp, Artificial Sequence
  chemically synthesized
aagtattaataacaatgaagat

SEQ ID NO: 1312298 - DNA, 22 bp, Artificial Sequence
  chemically synthesized
aacaaccctatttccatcttca

SEQ ID NO: 1312299 - DNA, 22 bp, Artificial Sequence
  chemically synthesized
caacaaccctatttccatcttc

SEQ ID NO: 1312300 - DNA, 22 bp, Artificial Sequence
  chemically synthesized
tcaacaaccctatttccatctt

SEQ ID NO: 1312301 - DNA, 22 bp, Artificial Sequence
  chemically synthesized
ataacaatgaagatggaaatag

SEQ ID NO: 1312302 - DNA, 22 bp, Artificial Sequence
  chemically synthesized
aatacagaattttcaacaaccc

SEQ ID NO: 1312303 - DNA, 22 bp, Artificial Sequence
  chemically synthesized
attaaatacagaattttcaaca

SEQ ID NO: 1312304 - DNA, 22 bp, Artificial Sequence
  chemically synthesized
actcattaaatacagaattttc

SEQ ID NO: 1312305 - DNA, 22 bp, Artificial Sequence
  chemically synthesized
agttcactcattaaatacagaa

SEQ ID NO: 1312306 - DNA, 22 bp, Artificial Sequence
  chemically synthesized
ttgaaaattctgtatttaatga

SEQ ID NO: 1312307 - DNA, 22 bp, Artificial Sequence
  chemically synthesized
aaaattctgtatttaatgagtg

SEQ ID NO: 1312308 - DNA, 22 bp, Artificial Sequence
  chemically synthesized
cagtcgctgagttcactcatta

SEQ ID NO: 1312309 - DNA, 22 bp, Artificial Sequence
  chemically synthesized
tgtatttaatgagtgaactcag

SEQ ID NO: 1312310 - DNA, 22 bp, Artificial Sequence
  chemically synthesized
tgtctgcagtcgctgagttcac

SEQ ID NO: 1312311 - DNA, 22 bp, Artificial Sequence
  chemically synthesized
gtgtctgcagtcgctgagttca

SEQ ID NO: 1312312 - DNA, 22 bp, Artificial Sequence
  chemically synthesized
tatttaatgagtgaactcagcg

SEQ ID NO: 1312313 - DNA, 22 bp, Artificial Sequence
  chemically synthesized
tgtgtctgcagtcgctgagttc

SEQ ID NO: 1312314 - DNA, 22 bp, Artificial Sequence
  chemically synthesized
tttgtgtctgcagtcgctgagt

SEQ ID NO: 1312315 - DNA, 22 bp, Artificial Sequence
  chemically synthesized
aatgagtgaactcagcgactgc

SEQ ID NO: 1312316 - DNA, 22 bp, Artificial Sequence
  chemically synthesized
atgagtgaactcagcgactgca

SEQ ID NO: 1312317 - DNA, 22 bp, Artificial Sequence
  chemically synthesized
ggagaatccacactctttgtgt

SEQ ID NO: 1312318 - DNA, 22 bp, Artificial Sequence
  chemically synthesized
agcgactgcagacacaaagagt

SEQ ID NO: 1312319 - DNA, 22 bp, Artificial Sequence
  chemically synthesized
cagacacaaagagtgtggattc

SEQ ID NO: 1312320 - DNA, 22 bp, Artificial Sequence
  chemically synthesized
taatcattcggagaatccacac

SEQ ID NO: 1312321 - DNA, 22 bp, Artificial Sequence
  chemically synthesized
ataatcattcggagaatccaca

SEQ ID NO: 1312322 - DNA, 22 bp, Artificial Sequence
  chemically synthesized
tataatcattcggagaatccac

SEQ ID NO: 1312323 - DNA, 22 bp, Artificial Sequence
  chemically synthesized
ttataatcattcggagaatcca

SEQ ID NO: 1312324 - DNA, 22 bp, Artificial Sequence
  chemically synthesized
aggcttttataatcattcggag

SEQ ID NO: 1312325 - DNA, 22 bp, Artificial Sequence
  chemically synthesized
ttaaggcttttataatcattcg

SEQ ID NO: 1312326 - DNA, 22 bp, Artificial Sequence
  chemically synthesized
tattaaggcttttataatcatt

SEQ ID NO: 1312327 - DNA, 22 bp, Artificial Sequence
  chemically synthesized
ctattaaggcttttataatcat

SEQ ID NO: 1312328 - DNA, 22 bp, Artificial Sequence
  chemically synthesized
tttctattaaggcttttataat

SEQ ID NO: 1312329 - DNA, 22 bp, Artificial Sequence
  chemically synthesized
atttctattaaggcttttataa

SEQ ID NO: 1312330 - DNA, 22 bp, Artificial Sequence
  chemically synthesized
tccgaatgattataaaagcctt

SEQ ID NO: 1312331 - DNA, 22 bp, Artificial Sequence
  chemically synthesized
cgaatgattataaaagccttaa

SEQ ID NO: 1312332 - DNA, 22 bp, Artificial Sequence
  chemically synthesized
gtaatcatttatttctattaag

SEQ ID NO: 1312333 - DNA, 22 bp, Artificial Sequence
  chemically synthesized
taaaagccttaatagaaataaa

SEQ ID NO: 1312334 - DNA, 22 bp, Artificial Sequence
  chemically synthesized
caattagtaatcatttatttct

SEQ ID NO: 1312335 - DNA, 22 bp, Artificial Sequence
  chemically synthesized
aatagaaataaatgattactaa

SEQ ID NO: 1312336 - DNA, 22 bp, Artificial Sequence
  chemically synthesized
atagaaataaatgattactaat

SEQ ID NO: 1312337 - DNA, 22 bp, Artificial Sequence
  chemically synthesized
atgtcccattccaattagtaat

SEQ ID NO: 1312338 - DNA, 22 bp, Artificial Sequence
  chemically synthesized
catgtcccattccaattagtaa

SEQ ID NO: 1312339 - DNA, 22 bp, Artificial Sequence
  chemically synthesized
tcatgtcccattccaattagta

SEQ ID NO: 1312340 - DNA, 22 bp, Artificial Sequence
  chemically synthesized
tttcatgtcccattccaattag

SEQ ID NO: 1312341 - DNA, 22 bp, Artificial Sequence
  chemically synthesized
ctttcatgtcccattccaatta

SEQ ID NO: 1312342 - DNA, 22 bp, Artificial Sequence
  chemically synthesized
tcttctttcatgtcccattcca

SEQ ID NO: 1312343 - DNA, 22 bp, Artificial Sequence
  chemically synthesized
ctaattggaatgggacatgaaa

SEQ ID NO: 1312344 - DNA, 22 bp, Artificial Sequence
  chemically synthesized
attggaatgggacatgaaagaa

SEQ ID NO: 1312345 - DNA, 22 bp, Artificial Sequence
  chemically synthesized
taacaaggttatcttctttcat

SEQ ID NO: 1312346 - DNA, 22 bp, Artificial Sequence
  chemically synthesized
gtaacaaggttatcttctttca

SEQ ID NO: 1312347 - DNA, 22 bp, Artificial Sequence
  chemically synthesized
tgtaacaaggttatcttctttc

SEQ ID NO: 1312348 - DNA, 22 bp, Artificial Sequence
  chemically synthesized
gaatgggacatgaaagaagata

SEQ ID NO: 1312349 - DNA, 22 bp, Artificial Sequence
  chemically synthesized
gaatctttgtaacaaggttatc

SEQ ID NO: 1312350 - DNA, 22 bp, Artificial Sequence
  chemically synthesized
cctggaatctttgtaacaaggt

SEQ ID NO: 1312351 - DNA, 22 bp, Artificial Sequence
  chemically synthesized
gcctggaatctttgtaacaagg

SEQ ID NO: 1312352 - DNA, 22 bp, Artificial Sequence
  chemically synthesized
tgcctggaatctttgtaacaag

SEQ ID NO: 1312353 - DNA, 22 bp, Artificial Sequence
  chemically synthesized
tttgcctggaatctttgtaaca

SEQ ID NO: 1312354 - DNA, 22 bp, Artificial Sequence
  chemically synthesized
ctttgcctggaatctttgtaac

SEQ ID NO: 1312355 - DNA, 22 bp, Artificial Sequence
  chemically synthesized
tctttgcctggaatctttgtaa

SEQ ID NO: 1312356 - DNA, 22 bp, Artificial Sequence
  chemically synthesized
tttctttgcctggaatctttgt

SEQ ID NO: 1312357 - DNA, 22 bp, Artificial Sequence
  chemically synthesized
ctttctttgcctggaatctttg

SEQ ID NO: 1312358 - DNA, 22 bp, Artificial Sequence
  chemically synthesized
ttctttctttgcctggaatctt

SEQ ID NO: 1312359 - DNA, 22 bp, Artificial Sequence
  chemically synthesized
gttacaaagattccaggcaaag

SEQ ID NO: 1312360 - DNA, 22 bp, Artificial Sequence
  chemically synthesized
ttacaaagattccaggcaaaga

SEQ ID NO: 1312361 - DNA, 22 bp, Artificial Sequence
  chemically synthesized
caaagattccaggcaaagaaag

SEQ ID NO: 1312362 - DNA, 22 bp, Artificial Sequence
  chemically synthesized
gaaccatctcttctttctttgc

SEQ ID NO: 1312363 - DNA, 22 bp, Artificial Sequence
  chemically synthesized
taattggaaccatctcttcttt

SEQ ID NO: 1312364 - DNA, 22 bp, Artificial Sequence
  chemically synthesized
caggcaaagaaagaagagatgg

SEQ ID NO: 1312365 - DNA, 22 bp, Artificial Sequence
  chemically synthesized
ttgtaattggaaccatctcttc

SEQ ID NO: 1312366 - DNA, 22 bp, Artificial Sequence
  chemically synthesized
attattgtaattggaaccatct

SEQ ID NO: 1312367 - DNA, 22 bp, Artificial Sequence
  chemically synthesized
gattattgtaattggaaccatc

SEQ ID NO: 1312368 - DNA, 22 bp, Artificial Sequence
  chemically synthesized
tgattattgtaattggaaccat

SEQ ID NO: 1312369 - DNA, 22 bp, Artificial Sequence
  chemically synthesized
tttgattattgtaattggaacc

SEQ ID NO: 1312370 - DNA, 22 bp, Artificial Sequence
  chemically synthesized
agaaaatcacctctttgattat

SEQ ID NO: 1312371 - DNA, 22 bp, Artificial Sequence
  chemically synthesized
taagaaaatcacctctttgatt

SEQ ID NO: 1312372 - DNA, 22 bp, Artificial Sequence
  chemically synthesized
caattacaataatcaaagaggt

SEQ ID NO: 1312373 - DNA, 22 bp, Artificial Sequence
  chemically synthesized
caataatcaaagaggtgatttt

SEQ ID NO: 1312374 - DNA, 22 bp, Artificial Sequence
  chemically synthesized
gccatattctaagaaaatcacc

SEQ ID NO: 1312375 - DNA, 22 bp, Artificial Sequence
  chemically synthesized
agccatattctaagaaaatcac

SEQ ID NO: 1312376 - DNA, 22 bp, Artificial Sequence
  chemically synthesized
cttagccatattctaagaaaat

SEQ ID NO: 1312377 - DNA, 22 bp, Artificial Sequence
  chemically synthesized
ccttagccatattctaagaaaa

SEQ ID NO: 1312378 - DNA, 22 bp, Artificial Sequence
  chemically synthesized
tcttagaatatggctaaggaaa

SEQ ID NO: 1312379 - DNA, 22 bp, Artificial Sequence
  chemically synthesized
cttagaatatggctaaggaaac

SEQ ID NO: 1312380 - DNA, 22 bp, Artificial Sequence
  chemically synthesized
ttagaatatggctaaggaaaca

SEQ ID NO: 1312381 - DNA, 22 bp, Artificial Sequence
  chemically synthesized
agaatatggctaaggaaacaca

SEQ ID NO: 1312382 - DNA, 22 bp, Artificial Sequence
  chemically synthesized
gaatatggctaaggaaacacat

SEQ ID NO: 1312383 - DNA, 22 bp, Artificial Sequence
  chemically synthesized
aggaaacacattttcattcatt

SEQ ID NO: 1312384 - DNA, 22 bp, Artificial Sequence
  chemically synthesized
aaaaaatgaatgaaacaaatga

SEQ ID NO: 1312385 - DNA, 22 bp, Artificial Sequence
  chemically synthesized
cactaaaaaaatgaatgaaaca

SEQ ID NO: 1312386 - DNA, 22 bp, Artificial Sequence
  chemically synthesized
tcattcatttgtttcattcatt

SEQ ID NO: 1312387 - DNA, 22 bp, Artificial Sequence
  chemically synthesized
cattcatttgtttcattcattt

SEQ ID NO: 1312388 - DNA, 22 bp, Artificial Sequence
  chemically synthesized
attcatttgtttcattcatttt

SEQ ID NO: 1312389 - DNA, 22 bp, Artificial Sequence
  chemically synthesized
atttgtttcattcattttttta

SEQ ID NO: 1312390 - DNA, 22 bp, Artificial Sequence
  chemically synthesized
ccaaacactgcactaaaaaaat

SEQ ID NO: 1312391 - DNA, 22 bp, Artificial Sequence
  chemically synthesized
gtttcattcatttttttagtgc

SEQ ID NO: 1312392 - DNA, 22 bp, Artificial Sequence
  chemically synthesized
tttcattcatttttttagtgca

SEQ ID NO: 1312393 - DNA, 22 bp, Artificial Sequence
  chemically synthesized
gttcccaaacactgcactaaaa

SEQ ID NO: 1312394 - DNA, 22 bp, Artificial Sequence
  chemically synthesized
cattcatttttttagtgcagtg

SEQ ID NO: 1312395 - DNA, 22 bp, Artificial Sequence
  chemically synthesized
attcatttttttagtgcagtgt

SEQ ID NO: 1312396 - DNA, 22 bp, Artificial Sequence
  chemically synthesized
aggttagttcccaaacactgca

SEQ ID NO: 1312397 - DNA, 22 bp, Artificial Sequence
  chemically synthesized
atttttttagtgcagtgtttgg

SEQ ID NO: 1312398 - DNA, 22 bp, Artificial Sequence
  chemically synthesized
ttttagtgcagtgtttgggaac

SEQ ID NO: 1312399 - DNA, 22 bp, Artificial Sequence
  chemically synthesized
gtactgaggttagttcccaaac

SEQ ID NO: 1312400 - DNA, 22 bp, Artificial Sequence
  chemically synthesized
tttagtgcagtgtttgggaact

SEQ ID NO: 1312401 - DNA, 22 bp, Artificial Sequence
  chemically synthesized
ttagtgcagtgtttgggaacta

SEQ ID NO: 1312402 - DNA, 22 bp, Artificial Sequence
  chemically synthesized
tagtgcagtgtttgggaactaa

SEQ ID NO: 1312403 - DNA, 22 bp, Artificial Sequence
  chemically synthesized
agtgcagtgtttgggaactaac

SEQ ID NO: 1312404 - DNA, 22 bp, Artificial Sequence
  chemically synthesized
actagtactgaggttagttccc

SEQ ID NO: 1312405 - DNA, 22 bp, Artificial Sequence
  chemically synthesized
gtgcagtgtttgggaactaacc

SEQ ID NO: 1312406 - DNA, 22 bp, Artificial Sequence
  chemically synthesized
gggaactaacctcagtactagt

SEQ ID NO: 1312407 - DNA, 22 bp, Artificial Sequence
  chemically synthesized
ggaactaacctcagtactagtg

SEQ ID NO: 1312408 - DNA, 22 bp, Artificial Sequence
  chemically synthesized
acatcatatgttcactagtact

SEQ ID NO: 1312409 - DNA, 22 bp, Artificial Sequence
  chemically synthesized
acctcagtactagtgaacatat

SEQ ID NO: 1312410 - DNA, 22 bp, Artificial Sequence
  chemically synthesized
aagaattaacatcatatgttca

SEQ ID NO: 1312411 - DNA, 22 bp, Artificial Sequence
  chemically synthesized
agtactagtgaacatatgatgt

SEQ ID NO: 1312412 - DNA, 22 bp, Artificial Sequence
  chemically synthesized
gctaaagaattaacatcatatg

SEQ ID NO: 1312413 - DNA, 22 bp, Artificial Sequence
  chemically synthesized
gcctcgctaaagaattaacatc

SEQ ID NO: 1312414 - DNA, 22 bp, Artificial Sequence
  chemically synthesized
gtgaacatatgatgttaattct

SEQ ID NO: 1312415 - DNA, 22 bp, Artificial Sequence
  chemically synthesized
ctggcctcgctaaagaattaac

SEQ ID NO: 1312416 - DNA, 22 bp, Artificial Sequence
  chemically synthesized
attctttagcgaggccaggagc

SEQ ID NO: 1312417 - DNA, 22 bp, Artificial Sequence
  chemically synthesized
caggcgtgagccaccgctcctg

SEQ ID NO: 1312418 - DNA, 22 bp, Artificial Sequence
  chemically synthesized
tttagcgaggccaggagcggtg

SEQ ID NO: 1312419 - DNA, 22 bp, Artificial Sequence
  chemically synthesized
tagcgaggccaggagcggtggc

SEQ ID NO: 1312420 - DNA, 22 bp, Artificial Sequence
  chemically synthesized
agcgaggccaggagcggtggct

SEQ ID NO: 1312421 - DNA, 22 bp, Artificial Sequence
  chemically synthesized
gcgaggccaggagcggtggctc

SEQ ID NO: 1312422 - DNA, 22 bp, Artificial Sequence
  chemically synthesized
ggattacaggcgtgagccaccg

SEQ ID NO: 1312423 - DNA, 22 bp, Artificial Sequence
  chemically synthesized
ccaaagtgctgggattacaggc

SEQ ID NO: 1312424 - DNA, 22 bp, Artificial Sequence
  chemically synthesized
gcctcccaaagtgctgggatta

SEQ ID NO: 1312425 - DNA, 22 bp, Artificial Sequence
  chemically synthesized
ggcctcccaaagtgctgggatt

SEQ ID NO: 1312426 - DNA, 22 bp, Artificial Sequence
  chemically synthesized
acgcctgtaatcccagcacttt

SEQ ID NO: 1312427 - DNA, 22 bp, Artificial Sequence
  chemically synthesized
taatcccagcactttgggaggc

SEQ ID NO: 1312428 - DNA, 22 bp, Artificial Sequence
  chemically synthesized
aggtgatccacccgccttggcc

SEQ ID NO: 1312429 - DNA, 22 bp, Artificial Sequence
  chemically synthesized
atctcaggtgatccacccgcct

SEQ ID NO: 1312430 - DNA, 22 bp, Artificial Sequence
  chemically synthesized
tgggaggccaaggcgggtggat

SEQ ID NO: 1312431 - DNA, 22 bp, Artificial Sequence
  chemically synthesized
gggaggccaaggcgggtggatc

SEQ ID NO: 1312432 - DNA, 22 bp, Artificial Sequence
  chemically synthesized
ctgatctcaggtgatccacccg

SEQ ID NO: 1312433 - DNA, 22 bp, Artificial Sequence
  chemically synthesized
ggaggccaaggcgggtggatca

SEQ ID NO: 1312434 - DNA, 22 bp, Artificial Sequence
  chemically synthesized
gaactcctgatctcaggtgatc

SEQ ID NO: 1312435 - DNA, 22 bp, Artificial Sequence
  chemically synthesized
gtctggaactcctgatctcagg

SEQ ID NO: 1312436 - DNA, 22 bp, Artificial Sequence
  chemically synthesized
gccaggctagtctggaactcct

SEQ ID NO: 1312437 - DNA, 22 bp, Artificial Sequence
  chemically synthesized
agatcaggagttccagactagc

SEQ ID NO: 1312438 - DNA, 22 bp, Artificial Sequence
  chemically synthesized
accatgttggccaggctagtct

SEQ ID NO: 1312439 - DNA, 22 bp, Artificial Sequence
  chemically synthesized
caccatgttggccaggctagtc

SEQ ID NO: 1312440 - DNA, 22 bp, Artificial Sequence
  chemically synthesized
cagactagcctggccaacatgg

SEQ ID NO: 1312441 - DNA, 22 bp, Artificial Sequence
  chemically synthesized
gtagagatgggatttcaccatg

SEQ ID NO: 1312442 - DNA, 22 bp, Artificial Sequence
  chemically synthesized
agtagagatgggatttcaccat

SEQ ID NO: 1312443 - DNA, 22 bp, Artificial Sequence
  chemically synthesized
gcctggccaacatggtgaaatc

SEQ ID NO: 1312444 - DNA, 22 bp, Artificial Sequence
  chemically synthesized
tagtagagatgggatttcacca

SEQ ID NO: 1312445 - DNA, 22 bp, Artificial Sequence
  chemically synthesized
ttagtagagatgggatttcacc

SEQ ID NO: 1312446 - DNA, 22 bp, Artificial Sequence
  chemically synthesized
gccaacatggtgaaatcccatc

SEQ ID NO: 1312447 - DNA, 22 bp, Artificial Sequence
  chemically synthesized
tatttttagtagagatgggatt

SEQ ID NO: 1312448 - DNA, 22 bp, Artificial Sequence
  chemically synthesized
gtatttttagtagagatgggat

SEQ ID NO: 1312449 - DNA, 22 bp, Artificial Sequence
  chemically synthesized
tgtatttttagtagagatggga

SEQ ID NO: 1312450 - DNA, 22 bp, Artificial Sequence
  chemically synthesized
ttgtatttttagtagagatggg

SEQ ID NO: 1312451 - DNA, 22 bp, Artificial Sequence
  chemically synthesized
tttgtatttttagtagagatgg

SEQ ID NO: 1312452 - DNA, 22 bp, Artificial Sequence
  chemically synthesized
ttttgtatttttagtagagatg

SEQ ID NO: 1312453 - DNA, 22 bp, Artificial Sequence
  chemically synthesized
tttttgtatttttagtagagat

SEQ ID NO: 1312454 - DNA, 22 bp, Artificial Sequence
  chemically synthesized
ttttttgtatttttagtagaga

SEQ ID NO: 1312455 - DNA, 22 bp, Artificial Sequence
  chemically synthesized
tactaaaaatacaaaaaaaaat

SEQ ID NO: 1312456 - DNA, 22 bp, Artificial Sequence
  chemically synthesized
ctaaaaatacaaaaaaaaatta

SEQ ID NO: 1312457 - DNA, 22 bp, Artificial Sequence
  chemically synthesized
aaaatacaaaaaaaaattatcc

SEQ ID NO: 1312458 - DNA, 22 bp, Artificial Sequence
  chemically synthesized
cccgtcaccacacccggataat

SEQ ID NO: 1312459 - DNA, 22 bp, Artificial Sequence
  chemically synthesized
cagctgcccgtcaccacacccg

SEQ ID NO: 1312460 - DNA, 22 bp, Artificial Sequence
  chemically synthesized
ggattacagctgcccgtcacca

SEQ ID NO: 1312461 - DNA, 22 bp, Artificial Sequence
  chemically synthesized
tccgggtgtggtgacgggcagc

SEQ ID NO: 1312462 - DNA, 22 bp, Artificial Sequence
  chemically synthesized
ccaagtagctgggattacagct

SEQ ID NO: 1312463 - DNA, 22 bp, Artificial Sequence
  chemically synthesized
cccaagtagctgggattacagc

SEQ ID NO: 1312464 - DNA, 22 bp, Artificial Sequence
  chemically synthesized
agcttcccaagtagctgggatt

SEQ ID NO: 1312465 - DNA, 22 bp, Artificial Sequence
  chemically synthesized
cctcagcttcccaagtagctgg

SEQ ID NO: 1312466 - DNA, 22 bp, Artificial Sequence
  chemically synthesized
gcctcagcttcccaagtagctg

SEQ ID NO: 1312467 - DNA, 22 bp, Artificial Sequence
  chemically synthesized
ttgcctcagcttcccaagtagc

SEQ ID NO: 1312468 - DNA, 22 bp, Artificial Sequence
  chemically synthesized
tcttgcctcagcttcccaagta

SEQ ID NO: 1312469 - DNA, 22 bp, Artificial Sequence
  chemically synthesized
taatcccagctacttgggaagc

SEQ ID NO: 1312470 - DNA, 22 bp, Artificial Sequence
  chemically synthesized
aagcgattctcttgcctcagct

SEQ ID NO: 1312471 - DNA, 22 bp, Artificial Sequence
  chemically synthesized
cttgggaagctgaggcaagaga

SEQ ID NO: 1312472 - DNA, 22 bp, Artificial Sequence
  chemically synthesized
gggttcaagcgattctcttgcc

SEQ ID NO: 1312473 - DNA, 22 bp, Artificial Sequence
  chemically synthesized
gggaagctgaggcaagagaatc

SEQ ID NO: 1312474 - DNA, 22 bp, Artificial Sequence
  chemically synthesized
tcgggttcaagcgattctcttg

SEQ ID NO: 1312475 - DNA, 22 bp, Artificial Sequence
  chemically synthesized
ggaagctgaggcaagagaatcg

SEQ ID NO: 1312476 - DNA, 22 bp, Artificial Sequence
  chemically synthesized
cacctctcgggttcaagcgatt

SEQ ID NO: 1312477 - DNA, 22 bp, Artificial Sequence
  chemically synthesized
aggcaagagaatcgcttgaacc

SEQ ID NO: 1312478 - DNA, 22 bp, Artificial Sequence
  chemically synthesized
caacctccacctctcgggttca

SEQ ID NO: 1312479 - DNA, 22 bp, Artificial Sequence
  chemically synthesized
actgcaacctccacctctcggg

SEQ ID NO: 1312480 - DNA, 22 bp, Artificial Sequence
  chemically synthesized
ggctcactgcaacctccacctc

SEQ ID NO: 1312481 - DNA, 22 bp, Artificial Sequence
  chemically synthesized
gaacccgagaggtggaggttgc

SEQ ID NO: 1312482 - DNA, 22 bp, Artificial Sequence
  chemically synthesized
aacccgagaggtggaggttgca

SEQ ID NO: 1312483 - DNA, 22 bp, Artificial Sequence
  chemically synthesized
gagtgcagtggtgtgatctcgg

SEQ ID NO: 1312484 - DNA, 22 bp, Artificial Sequence
  chemically synthesized
cagtgagccgagatcacaccac

SEQ ID NO: 1312485 - DNA, 22 bp, Artificial Sequence
  chemically synthesized
tcgcccaggctggagtgcagtg

SEQ ID NO: 1312486 - DNA, 22 bp, Artificial Sequence
  chemically synthesized
tgtcgcccaggctggagtgcag

SEQ ID NO: 1312487 - DNA, 22 bp, Artificial Sequence
  chemically synthesized
gctctgtcgcccaggctggagt

SEQ ID NO: 1312488 - DNA, 22 bp, Artificial Sequence
  chemically synthesized
cactccagcctgggcgacagag

SEQ ID NO: 1312489 - DNA, 22 bp, Artificial Sequence
  chemically synthesized
agacagagtctggctctgtcgc

SEQ ID NO: 1312490 - DNA, 22 bp, Artificial Sequence
  chemically synthesized
gagacagagtctggctctgtcg

SEQ ID NO: 1312491 - DNA, 22 bp, Artificial Sequence
  chemically synthesized
tgagacagagtctggctctgtc

SEQ ID NO: 1312492 - DNA, 22 bp, Artificial Sequence
  chemically synthesized
ttgagacagagtctggctctgt

SEQ ID NO: 1312493 - DNA, 22 bp, Artificial Sequence
  chemically synthesized
cagcctgggcgacagagccaga

SEQ ID NO: 1312494 - DNA, 22 bp, Artificial Sequence
  chemically synthesized
tttttgagacagagtctggctc

SEQ ID NO: 1312495 - DNA, 22 bp, Artificial Sequence
  chemically synthesized
atttttgagacagagtctggct

SEQ ID NO: 1312496 - DNA, 22 bp, Artificial Sequence
  chemically synthesized
cttatttttgagacagagtctg

SEQ ID NO: 1312497 - DNA, 22 bp, Artificial Sequence
  chemically synthesized
ggcgacagagccagactctgtc

SEQ ID NO: 1312498 - DNA, 22 bp, Artificial Sequence
  chemically synthesized
acttatttttgagacagagtct

SEQ ID NO: 1312499 - DNA, 22 bp, Artificial Sequence
  chemically synthesized
cttacttatttttgagacagag

SEQ ID NO: 1312500 - DNA, 22 bp, Artificial Sequence
  chemically synthesized
acttacttatttttgagacaga

SEQ ID NO: 1312501 - DNA, 22 bp, Artificial Sequence
  chemically synthesized
tttacttacttatttttgagac

SEQ ID NO: 1312502 - DNA, 22 bp, Artificial Sequence
  chemically synthesized
atttacttacttatttttgaga

SEQ ID NO: 1312503 - DNA, 22 bp, Artificial Sequence
  chemically synthesized
tttatttacttacttatttttg

SEQ ID NO: 1312504 - DNA, 22 bp, Artificial Sequence
  chemically synthesized
atttatttacttacttattttt

SEQ ID NO: 1312505 - DNA, 22 bp, Artificial Sequence
  chemically synthesized
tttatttatttacttacttatt

SEQ ID NO: 1312506 - DNA, 22 bp, Artificial Sequence
  chemically synthesized
tgtctcaaaaataagtaagtaa

SEQ ID NO: 1312507 - DNA, 22 bp, Artificial Sequence
  chemically synthesized
ttatttatttatttacttactt

SEQ ID NO: 1312508 - DNA, 22 bp, Artificial Sequence
  chemically synthesized
attatttatttatttacttact

SEQ ID NO: 1312509 - DNA, 22 bp, Artificial Sequence
  chemically synthesized
tctcaaaaataagtaagtaaat

SEQ ID NO: 1312510 - DNA, 22 bp, Artificial Sequence
  chemically synthesized
tattatttatttatttacttac

SEQ ID NO: 1312511 - DNA, 22 bp, Artificial Sequence
  chemically synthesized
ttattatttatttatttactta

SEQ ID NO: 1312512 - DNA, 22 bp, Artificial Sequence
  chemically synthesized
aaaaataagtaagtaaataaat

SEQ ID NO: 1312513 - DNA, 22 bp, Artificial Sequence
  chemically synthesized
tttttattatttatttatttac

SEQ ID NO: 1312514 - DNA, 22 bp, Artificial Sequence
  chemically synthesized
atttttattatttatttattta

SEQ ID NO: 1312515 - DNA, 22 bp, Artificial Sequence
  chemically synthesized
tatttttattatttatttattt

SEQ ID NO: 1312516 - DNA, 22 bp, Artificial Sequence
  chemically synthesized
ttatttttattatttatttatt

SEQ ID NO: 1312517 - DNA, 22 bp, Artificial Sequence
  chemically synthesized
aagaatttttatttttattatt

SEQ ID NO: 1312518 - DNA, 22 bp, Artificial Sequence
  chemically synthesized
actaaagaatttttatttttat

SEQ ID NO: 1312519 - DNA, 22 bp, Artificial Sequence
  chemically synthesized
atctcactaaagaatttttatt

SEQ ID NO: 1312520 - DNA, 22 bp, Artificial Sequence
  chemically synthesized
acagttcatctcactaaagaat

SEQ ID NO: 1312521 - DNA, 22 bp, Artificial Sequence
  chemically synthesized
tggaatcaaccattaacagttc

SEQ ID NO: 1312522 - DNA, 22 bp, Artificial Sequence
  chemically synthesized
tttagtgagatgaactgttaat

SEQ ID NO: 1312523 - DNA, 22 bp, Artificial Sequence
  chemically synthesized
tagtgagatgaactgttaatgg

SEQ ID NO: 1312524 - DNA, 22 bp, Artificial Sequence
  chemically synthesized
agtgagatgaactgttaatggt

SEQ ID NO: 1312525 - DNA, 22 bp, Artificial Sequence
  chemically synthesized
gtgagatgaactgttaatggtt

SEQ ID NO: 1312526 - DNA, 22 bp, Artificial Sequence
  chemically synthesized
ttaatggttgattccataatac

SEQ ID NO: 1312527 - DNA, 22 bp, Artificial Sequence
  chemically synthesized
taatgagaatcagtattatgga

SEQ ID NO: 1312528 - DNA, 22 bp, Artificial Sequence
  chemically synthesized
ataatgagaatcagtattatgg

SEQ ID NO: 1312529 - DNA, 22 bp, Artificial Sequence
  chemically synthesized
atggttgattccataatactga

SEQ ID NO: 1312530 - DNA, 22 bp, Artificial Sequence
  chemically synthesized
attccataatactgattctcat

SEQ ID NO: 1312531 - DNA, 22 bp, Artificial Sequence
  chemically synthesized
cagtaatttataatgagaatca

SEQ ID NO: 1312532 - DNA, 22 bp, Artificial Sequence
  chemically synthesized
cataatactgattctcattata

SEQ ID NO: 1312533 - DNA, 22 bp, Artificial Sequence
  chemically synthesized
aaagttacagtaatttataatg

SEQ ID NO: 1312534 - DNA, 22 bp, Artificial Sequence
  chemically synthesized
attctcattataaattactgta

SEQ ID NO: 1312535 - DNA, 22 bp, Artificial Sequence
  chemically synthesized
agacaactaaaagttacagtaa

SEQ ID NO: 1312536 - DNA, 22 bp, Artificial Sequence
  chemically synthesized
aagacaactaaaagttacagta

SEQ ID NO: 1312537 - DNA, 22 bp, Artificial Sequence
  chemically synthesized
tcattataaattactgtaactt

SEQ ID NO: 1312538 - DNA, 22 bp, Artificial Sequence
  chemically synthesized
attataaattactgtaactttt

SEQ ID NO: 1312539 - DNA, 22 bp, Artificial Sequence
  chemically synthesized
atatttaagacaactaaaagtt

SEQ ID NO: 1312540 - DNA, 22 bp, Artificial Sequence
  chemically synthesized
taaattactgtaacttttagtt

SEQ ID NO: 1312541 - DNA, 22 bp, Artificial Sequence
  chemically synthesized
aatatttaagacaactaaaagt

SEQ ID NO: 1312542 - DNA, 22 bp, Artificial Sequence
  chemically synthesized
tttaatatttaagacaactaaa

SEQ ID NO: 1312543 - DNA, 22 bp, Artificial Sequence
  chemically synthesized
gtttaatatttaagacaactaa

SEQ ID NO: 1312544 - DNA, 22 bp, Artificial Sequence
  chemically synthesized
tgtttaatatttaagacaacta

SEQ ID NO: 1312545 - DNA, 22 bp, Artificial Sequence
  chemically synthesized
ctgtaacttttagttgtcttaa

SEQ ID NO: 1312546 - DNA, 22 bp, Artificial Sequence
  chemically synthesized
ttttgtttaatatttaagacaa

SEQ ID NO: 1312547 - DNA, 22 bp, Artificial Sequence
  chemically synthesized
taacttttagttgtcttaaata

SEQ ID NO: 1312548 - DNA, 22 bp, Artificial Sequence
  chemically synthesized
ttattttgtttaatatttaaga

SEQ ID NO: 1312549 - DNA, 22 bp, Artificial Sequence
  chemically synthesized
ttgttattttgtttaatattta

SEQ ID NO: 1312550 - DNA, 22 bp, Artificial Sequence
  chemically synthesized
ttagttgtcttaaatattaaac

SEQ ID NO: 1312551 - DNA, 22 bp, Artificial Sequence
  chemically synthesized
tagttgtcttaaatattaaaca

SEQ ID NO: 1312552 - DNA, 22 bp, Artificial Sequence
  chemically synthesized
ttgttgttattttgtttaatat

SEQ ID NO: 1312553 - DNA, 22 bp, Artificial Sequence
  chemically synthesized
agttgtcttaaatattaaacaa

SEQ ID NO: 1312554 - DNA, 22 bp, Artificial Sequence
  chemically synthesized
gttgtcttaaatattaaacaaa

SEQ ID NO: 1312555 - DNA, 22 bp, Artificial Sequence
  chemically synthesized
tcttaaatattaaacaaaataa

SEQ ID NO: 1312556 - DNA, 22 bp, Artificial Sequence
  chemically synthesized
gcactattgttgttattttgtt

SEQ ID NO: 1312557 - DNA, 22 bp, Artificial Sequence
  chemically synthesized
ttggcactattgttgttatttt

SEQ ID NO: 1312558 - DNA, 22 bp, Artificial Sequence
  chemically synthesized
aaatattaaacaaaataacaac

SEQ ID NO: 1312559 - DNA, 22 bp, Artificial Sequence
  chemically synthesized
gttggcactattgttgttattt

SEQ ID NO: 1312560 - DNA, 22 bp, Artificial Sequence
  chemically synthesized
aatattaaacaaaataacaaca

SEQ ID NO: 1312561 - DNA, 22 bp, Artificial Sequence
  chemically synthesized
aacaaaataacaacaatagtgc

SEQ ID NO: 1312562 - DNA, 22 bp, Artificial Sequence
  chemically synthesized
gcagcacttgttggcactattg

SEQ ID NO: 1312563 - DNA, 22 bp, Artificial Sequence
  chemically synthesized
agcactagcagcacttgttggc

SEQ ID NO: 1312564 - DNA, 22 bp, Artificial Sequence
  chemically synthesized
cagcactagcagcacttgttgg

SEQ ID NO: 1312565 - DNA, 22 bp, Artificial Sequence
  chemically synthesized
tcagcactagcagcacttgttg

SEQ ID NO: 1312566 - DNA, 22 bp, Artificial Sequence
  chemically synthesized
aagaaattttcagcactagcag

SEQ ID NO: 1312567 - DNA, 22 bp, Artificial Sequence
  chemically synthesized
acaatctgaagaaattttcagc

SEQ ID NO: 1312568 - DNA, 22 bp, Artificial Sequence
  chemically synthesized
taacaatctgaagaaattttca

SEQ ID NO: 1312569 - DNA, 22 bp, Artificial Sequence
  chemically synthesized
ctctaacaatctgaagaaattt

SEQ ID NO: 1312570 - DNA, 22 bp, Artificial Sequence
  chemically synthesized
ctagtgctgaaaatttcttcag

SEQ ID NO: 1312571 - DNA, 22 bp, Artificial Sequence
  chemically synthesized
ttcctctaacaatctgaagaaa

SEQ ID NO: 1312572 - DNA, 22 bp, Artificial Sequence
  chemically synthesized
gtgctgaaaatttcttcagatt

SEQ ID NO: 1312573 - DNA, 22 bp, Artificial Sequence
  chemically synthesized
aaaatttcttcagattgttaga

SEQ ID NO: 1312574 - DNA, 22 bp, Artificial Sequence
  chemically synthesized
aaatactgttcctctaacaatc

SEQ ID NO: 1312575 - DNA, 22 bp, Artificial Sequence
  chemically synthesized
cttcagattgttagaggaacag

SEQ ID NO: 1312576 - DNA, 22 bp, Artificial Sequence
  chemically synthesized
ttcagattgttagaggaacagt

SEQ ID NO: 1312577 - DNA, 22 bp, Artificial Sequence
  chemically synthesized
cagattgttagaggaacagtat

SEQ ID NO: 1312578 - DNA, 22 bp, Artificial Sequence
  chemically synthesized
agattgttagaggaacagtatt

SEQ ID NO: 1312579 - DNA, 22 bp, Artificial Sequence
  chemically synthesized
ttagaggaacagtatttcagta

SEQ ID NO: 1312580 - DNA, 22 bp, Artificial Sequence
  chemically synthesized
taacaaaatatatgtactgaaa

SEQ ID NO: 1312581 - DNA, 22 bp, Artificial Sequence
  chemically synthesized
gaggaacagtatttcagtacat

SEQ ID NO: 1312582 - DNA, 22 bp, Artificial Sequence
  chemically synthesized
gaaattgtaacaaaatatatgt

SEQ ID NO: 1312583 - DNA, 22 bp, Artificial Sequence
  chemically synthesized
tcgaaattgtaacaaaatatat

SEQ ID NO: 1312584 - DNA, 22 bp, Artificial Sequence
  chemically synthesized
ctcgaaattgtaacaaaatata

SEQ ID NO: 1312585 - DNA, 22 bp, Artificial Sequence
  chemically synthesized
tctcgaaattgtaacaaaatat

SEQ ID NO: 1312586 - DNA, 22 bp, Artificial Sequence
  chemically synthesized
tttctcgaaattgtaacaaaat

SEQ ID NO: 1312587 - DNA, 22 bp, Artificial Sequence
  chemically synthesized
cagtacatatattttgttacaa

SEQ ID NO: 1312588 - DNA, 22 bp, Artificial Sequence
  chemically synthesized
agtacatatattttgttacaat

SEQ ID NO: 1312589 - DNA, 22 bp, Artificial Sequence
  chemically synthesized
aattctttctcgaaattgtaac

SEQ ID NO: 1312590 - DNA, 22 bp, Artificial Sequence
  chemically synthesized
gaattctttctcgaaattgtaa

SEQ ID NO: 1312591 - DNA, 22 bp, Artificial Sequence
  chemically synthesized
tgaattctttctcgaaattgta

SEQ ID NO: 1312592 - DNA, 22 bp, Artificial Sequence
  chemically synthesized
ggttttgaattctttctcgaaa

SEQ ID NO: 1312593 - DNA, 22 bp, Artificial Sequence
  chemically synthesized
tgggttttgaattctttctcga

SEQ ID NO: 1312594 - DNA, 22 bp, Artificial Sequence
  chemically synthesized
tgttacaatttcgagaaagaat

SEQ ID NO: 1312595 - DNA, 22 bp, Artificial Sequence
  chemically synthesized
gttacaatttcgagaaagaatt

SEQ ID NO: 1312596 - DNA, 22 bp, Artificial Sequence
  chemically synthesized
ttacaatttcgagaaagaattc

SEQ ID NO: 1312597 - DNA, 22 bp, Artificial Sequence
  chemically synthesized
ccattctgggttttgaattctt

SEQ ID NO: 1312598 - DNA, 22 bp, Artificial Sequence
  chemically synthesized
caatttcgagaaagaattcaaa

SEQ ID NO: 1312599 - DNA, 22 bp, Artificial Sequence
  chemically synthesized
ttcccattctgggttttgaatt

SEQ ID NO: 1312600 - DNA, 22 bp, Artificial Sequence
  chemically synthesized
ttattcccattctgggttttga

SEQ ID NO: 1312601 - DNA, 22 bp, Artificial Sequence
  chemically synthesized
cgagaaagaattcaaaacccag

SEQ ID NO: 1312602 - DNA, 22 bp, Artificial Sequence
  chemically synthesized
gttattcccattctgggttttg

SEQ ID NO: 1312603 - DNA, 22 bp, Artificial Sequence
  chemically synthesized
gagaaagaattcaaaacccaga

SEQ ID NO: 1312604 - DNA, 22 bp, Artificial Sequence
  chemically synthesized
tgttattcccattctgggtttt

SEQ ID NO: 1312605 - DNA, 22 bp, Artificial Sequence
  chemically synthesized
aaaggtctttgttattcccatt

SEQ ID NO: 1312606 - DNA, 22 bp, Artificial Sequence
  chemically synthesized
taaaaggtctttgttattccca

SEQ ID NO: 1312607 - DNA, 22 bp, Artificial Sequence
  chemically synthesized
aaaacccagaatgggaataaca

SEQ ID NO: 1312608 - DNA, 22 bp, Artificial Sequence
  chemically synthesized
agaaacacaactctaaaaggtc

SEQ ID NO: 1312609 - DNA, 22 bp, Artificial Sequence
  chemically synthesized
gagaaacacaactctaaaaggt

SEQ ID NO: 1312610 - DNA, 22 bp, Artificial Sequence
  chemically synthesized
tgagaaacacaactctaaaagg

SEQ ID NO: 1312611 - DNA, 22 bp, Artificial Sequence
  chemically synthesized
tttgagaaacacaactctaaaa

SEQ ID NO: 1312612 - DNA, 22 bp, Artificial Sequence
  chemically synthesized
ctttgagaaacacaactctaaa

SEQ ID NO: 1312613 - DNA, 22 bp, Artificial Sequence
  chemically synthesized
tctttgagaaacacaactctaa

SEQ ID NO: 1312614 - DNA, 22 bp, Artificial Sequence
  chemically synthesized
gggtctttctttgagaaacaca

SEQ ID NO: 1312615 - DNA, 22 bp, Artificial Sequence
  chemically synthesized
ctggggtctttctttgagaaac

SEQ ID NO: 1312616 - DNA, 22 bp, Artificial Sequence
  chemically synthesized
ttagagttgtgtttctcaaaga

SEQ ID NO: 1312617 - DNA, 22 bp, Artificial Sequence
  chemically synthesized
tagagttgtgtttctcaaagaa

SEQ ID NO: 1312618 - DNA, 22 bp, Artificial Sequence
  chemically synthesized
agagttgtgtttctcaaagaaa

SEQ ID NO: 1312619 - DNA, 22 bp, Artificial Sequence
  chemically synthesized
gagttgtgtttctcaaagaaag

SEQ ID NO: 1312620 - DNA, 22 bp, Artificial Sequence
  chemically synthesized
tgtttctcaaagaaagacccca

SEQ ID NO: 1312621 - DNA, 22 bp, Artificial Sequence
  chemically synthesized
caagtcatgtattcctggggtc

SEQ ID NO: 1312622 - DNA, 22 bp, Artificial Sequence
  chemically synthesized
acaagtcatgtattcctggggt

SEQ ID NO: 1312623 - DNA, 22 bp, Artificial Sequence
  chemically synthesized
ctcaaagaaagaccccaggaat

SEQ ID NO: 1312624 - DNA, 22 bp, Artificial Sequence
  chemically synthesized
tacaagtcatgtattcctgggg

SEQ ID NO: 1312625 - DNA, 22 bp, Artificial Sequence
  chemically synthesized
tcaaagaaagaccccaggaata

SEQ ID NO: 1312626 - DNA, 22 bp, Artificial Sequence
  chemically synthesized
aaagaaagaccccaggaataca

SEQ ID NO: 1312627 - DNA, 22 bp, Artificial Sequence
  chemically synthesized
gtaggtctttacaagtcatgta

SEQ ID NO: 1312628 - DNA, 22 bp, Artificial Sequence
  chemically synthesized
tggtaggtctttacaagtcatg

SEQ ID NO: 1312629 - DNA, 22 bp, Artificial Sequence
  chemically synthesized
ctggtaggtctttacaagtcat

SEQ ID NO: 1312630 - DNA, 22 bp, Artificial Sequence
  chemically synthesized
ttctggtaggtctttacaagtc

SEQ ID NO: 1312631 - DNA, 22 bp, Artificial Sequence
  chemically synthesized
aatgatattcttctggtaggtc

SEQ ID NO: 1312632 - DNA, 22 bp, Artificial Sequence
  chemically synthesized
taaatgatattcttctggtagg

SEQ ID NO: 1312633 - DNA, 22 bp, Artificial Sequence
  chemically synthesized
gtaaagacctaccagaagaata

SEQ ID NO: 1312634 - DNA, 22 bp, Artificial Sequence
  chemically synthesized
taaagacctaccagaagaatat

SEQ ID NO: 1312635 - DNA, 22 bp, Artificial Sequence
  chemically synthesized
aagccccattctaaatgatatt

SEQ ID NO: 1312636 - DNA, 22 bp, Artificial Sequence
  chemically synthesized
taaagccccattctaaatgata

SEQ ID NO: 1312637 - DNA, 22 bp, Artificial Sequence
  chemically synthesized
ccagaagaatatcatttagaat

SEQ ID NO: 1312638 - DNA, 22 bp, Artificial Sequence
  chemically synthesized
aaaatgcagattctaaagcccc

SEQ ID NO: 1312639 - DNA, 22 bp, Artificial Sequence
  chemically synthesized
ttaaaaatgcagattctaaagc

SEQ ID NO: 1312640 - DNA, 22 bp, Artificial Sequence
  chemically synthesized
attaaaaatgcagattctaaag

SEQ ID NO: 1312641 - DNA, 22 bp, Artificial Sequence
  chemically synthesized
agaatggggctttagaatctgc

SEQ ID NO: 1312642 - DNA, 22 bp, Artificial Sequence
  chemically synthesized
gaatggggctttagaatctgca

SEQ ID NO: 1312643 - DNA, 22 bp, Artificial Sequence
  chemically synthesized
gaatgcttattaaaaatgcaga

SEQ ID NO: 1312644 - DNA, 22 bp, Artificial Sequence
  chemically synthesized
tagaatctgcatttttaataag

SEQ ID NO: 1312645 - DNA, 22 bp, Artificial Sequence
  chemically synthesized
agaatctgcatttttaataagc

SEQ ID NO: 1312646 - DNA, 22 bp, Artificial Sequence
  chemically synthesized
gaatctgcatttttaataagca

SEQ ID NO: 1312647 - DNA, 22 bp, Artificial Sequence
  chemically synthesized
catttttaataagcattctagg

SEQ ID NO: 1312648 - DNA, 22 bp, Artificial Sequence
  chemically synthesized
gaatacagcagaatcccctaga

SEQ ID NO: 1312649 - DNA, 22 bp, Artificial Sequence
  chemically synthesized
ttaataagcattctaggggatt

SEQ ID NO: 1312650 - DNA, 22 bp, Artificial Sequence
  chemically synthesized
taataagcattctaggggattc

SEQ ID NO: 1312651 - DNA, 22 bp, Artificial Sequence
  chemically synthesized
tagaatacagcagaatccccta

SEQ ID NO: 1312652 - DNA, 22 bp, Artificial Sequence
  chemically synthesized
aataagcattctaggggattct

SEQ ID NO: 1312653 - DNA, 22 bp, Artificial Sequence
  chemically synthesized
ataagcattctaggggattctg

SEQ ID NO: 1312654 - DNA, 22 bp, Artificial Sequence
  chemically synthesized
ccaaactctagaatacagcaga

SEQ ID NO: 1312655 - DNA, 22 bp, Artificial Sequence
  chemically synthesized
cccaaactctagaatacagcag

SEQ ID NO: 1312656 - DNA, 22 bp, Artificial Sequence
  chemically synthesized
taggggattctgctgtattcta

SEQ ID NO: 1312657 - DNA, 22 bp, Artificial Sequence
  chemically synthesized
ggggattctgctgtattctaga

SEQ ID NO: 1312658 - DNA, 22 bp, Artificial Sequence
  chemically synthesized
ggcagtccttcccaaactctag

SEQ ID NO: 1312659 - DNA, 22 bp, Artificial Sequence
  chemically synthesized
tgctgtattctagagtttggga

SEQ ID NO: 1312660 - DNA, 22 bp, Artificial Sequence
  chemically synthesized
ctaggcagtccttcccaaactc

SEQ ID NO: 1312661 - DNA, 22 bp, Artificial Sequence
  chemically synthesized
ctgtattctagagtttgggaag

SEQ ID NO: 1312662 - DNA, 22 bp, Artificial Sequence
  chemically synthesized
tattctagagtttgggaaggac

SEQ ID NO: 1312663 - DNA, 22 bp, Artificial Sequence
  chemically synthesized
caatctactaggcagtccttcc

SEQ ID NO: 1312664 - DNA, 22 bp, Artificial Sequence
  chemically synthesized
acaatctactaggcagtccttc

SEQ ID NO: 1312665 - DNA, 22 bp, Artificial Sequence
  chemically synthesized
tagagtttgggaaggactgcct

SEQ ID NO: 1312666 - DNA, 22 bp, Artificial Sequence
  chemically synthesized
gagtttgggaaggactgcctag

SEQ ID NO: 1312667 - DNA, 22 bp, Artificial Sequence
  chemically synthesized
gccttacaatctactaggcagt

SEQ ID NO: 1312668 - DNA, 22 bp, Artificial Sequence
  chemically synthesized
ggccttacaatctactaggcag

SEQ ID NO: 1312669 - DNA, 22 bp, Artificial Sequence
  chemically synthesized
gggaaggactgcctagtagatt

SEQ ID NO: 1312670 - DNA, 22 bp, Artificial Sequence
  chemically synthesized
ccttggccttacaatctactag

SEQ ID NO: 1312671 - DNA, 22 bp, Artificial Sequence
  chemically synthesized
ggaaggactgcctagtagattg

SEQ ID NO: 1312672 - DNA, 22 bp, Artificial Sequence
  chemically synthesized
atcactaccttggccttacaat

SEQ ID NO: 1312673 - DNA, 22 bp, Artificial Sequence
  chemically synthesized
cctagtagattgtaaggccaag

SEQ ID NO: 1312674 - DNA, 22 bp, Artificial Sequence
  chemically synthesized
gtagattgtaaggccaaggtag

SEQ ID NO: 1312675 - DNA, 22 bp, Artificial Sequence
  chemically synthesized
gatcaattaatcactaccttgg

SEQ ID NO: 1312676 - DNA, 22 bp, Artificial Sequence
  chemically synthesized
gcctagatcaattaatcactac

SEQ ID NO: 1312677 - DNA, 22 bp, Artificial Sequence
  chemically synthesized
taaggccaaggtagtgattaat

SEQ ID NO: 1312678 - DNA, 22 bp, Artificial Sequence
  chemically synthesized
tagcctagatcaattaatcact

SEQ ID NO: 1312679 - DNA, 22 bp, Artificial Sequence
  chemically synthesized
ctctagcctagatcaattaatc

SEQ ID NO: 1312680 - DNA, 22 bp, Artificial Sequence
  chemically synthesized
actctagcctagatcaattaat

SEQ ID NO: 1312681 - DNA, 22 bp, Artificial Sequence
  chemically synthesized
tactctagcctagatcaattaa

SEQ ID NO: 1312682 - DNA, 22 bp, Artificial Sequence
  chemically synthesized
agccacagctttactctagcct

SEQ ID NO: 1312683 - DNA, 22 bp, Artificial Sequence
  chemically synthesized
cagccacagctttactctagcc

SEQ ID NO: 1312684 - DNA, 22 bp, Artificial Sequence
  chemically synthesized
attgatctaggctagagtaaag

SEQ ID NO: 1312685 - DNA, 22 bp, Artificial Sequence
  chemically synthesized
atctaggctagagtaaagctgt

SEQ ID NO: 1312686 - DNA, 22 bp, Artificial Sequence
  chemically synthesized
gaaaaatatttcagccacagct

SEQ ID NO: 1312687 - DNA, 22 bp, Artificial Sequence
  chemically synthesized
ggctagagtaaagctgtggctg

SEQ ID NO: 1312688 - DNA, 22 bp, Artificial Sequence
  chemically synthesized
agaaaaatatttcagccacagc

SEQ ID NO: 1312689 - DNA, 22 bp, Artificial Sequence
  chemically synthesized
gagtaaagctgtggctgaaata

SEQ ID NO: 1312690 - DNA, 22 bp, Artificial Sequence
  chemically synthesized
ggagaacttagaaaaatatttc

SEQ ID NO: 1312691 - DNA, 22 bp, Artificial Sequence
  chemically synthesized
actgggagaacttagaaaaata

SEQ ID NO: 1312692 - DNA, 22 bp, Artificial Sequence
  chemically synthesized
tggctgaaatatttttctaagt

SEQ ID NO: 1312693 - DNA, 22 bp, Artificial Sequence
  chemically synthesized
gactcactgggagaacttagaa

SEQ ID NO: 1312694 - DNA, 22 bp, Artificial Sequence
  chemically synthesized
ttagactcactgggagaactta

SEQ ID NO: 1312695 - DNA, 22 bp, Artificial Sequence
  chemically synthesized
aaatatttttctaagttctccc

SEQ ID NO: 1312696 - DNA, 22 bp, Artificial Sequence
  chemically synthesized
gctgttagactcactgggagaa

SEQ ID NO: 1312697 - DNA, 22 bp, Artificial Sequence
  chemically synthesized
ctggctgttagactcactggga

SEQ ID NO: 1312698 - DNA, 22 bp, Artificial Sequence
  chemically synthesized
ttctaagttctcccagtgagtc

SEQ ID NO: 1312699 - DNA, 22 bp, Artificial Sequence
  chemically synthesized
tcctggctgttagactcactgg

SEQ ID NO: 1312700 - DNA, 22 bp, Artificial Sequence
  chemically synthesized
tctaagttctcccagtgagtct

SEQ ID NO: 1312701 - DNA, 22 bp, Artificial Sequence
  chemically synthesized
ctcctggctgttagactcactg

SEQ ID NO: 1312702 - DNA, 22 bp, Artificial Sequence
  chemically synthesized
ctaagttctcccagtgagtcta

SEQ ID NO: 1312703 - DNA, 22 bp, Artificial Sequence
  chemically synthesized
tctcctggctgttagactcact

SEQ ID NO: 1312704 - DNA, 22 bp, Artificial Sequence
  chemically synthesized
taagttctcccagtgagtctaa

SEQ ID NO: 1312705 - DNA, 22 bp, Artificial Sequence
  chemically synthesized
tttctcctggctgttagactca

SEQ ID NO: 1312706 - DNA, 22 bp, Artificial Sequence
  chemically synthesized
agttctcccagtgagtctaaca

SEQ ID NO: 1312707 - DNA, 22 bp, Artificial Sequence
  chemically synthesized
tcccagtgagtctaacagccag

SEQ ID NO: 1312708 - DNA, 22 bp, Artificial Sequence
  chemically synthesized
ccagtgagtctaacagccagga

SEQ ID NO: 1312709 - DNA, 22 bp, Artificial Sequence
  chemically synthesized
ccaatgcacaggtgttctttct

SEQ ID NO: 1312710 - DNA, 22 bp, Artificial Sequence
  chemically synthesized
acagccaggagaaagaacacct

SEQ ID NO: 1312711 - DNA, 22 bp, Artificial Sequence
  chemically synthesized
tcactgccaatgcacaggtgtt

SEQ ID NO: 1312712 - DNA, 22 bp, Artificial Sequence
  chemically synthesized
cgctgtcactgccaatgcacag

SEQ ID NO: 1312713 - DNA, 22 bp, Artificial Sequence
  chemically synthesized
ctccgctgtcactgccaatgca

SEQ ID NO: 1312714 - DNA, 22 bp, Artificial Sequence
  chemically synthesized
tgcattggcagtgacagcggag

SEQ ID NO: 1312715 - DNA, 22 bp, Artificial Sequence
  chemically synthesized
gcaaagtacaatacctcctccg

SEQ ID NO: 1312716 - DNA, 22 bp, Artificial Sequence
  chemically synthesized
ggcaaagtacaatacctcctcc

SEQ ID NO: 1312717 - DNA, 22 bp, Artificial Sequence
  chemically synthesized
gcagtgacagcggaggaggtat

SEQ ID NO: 1312718 - DNA, 22 bp, Artificial Sequence
  chemically synthesized
cttggcaaagtacaatacctcc

SEQ ID NO: 1312719 - DNA, 22 bp, Artificial Sequence
  chemically synthesized
ccttggcaaagtacaatacctc

SEQ ID NO: 1312720 - DNA, 22 bp, Artificial Sequence
  chemically synthesized
tgcatacttccttggcaaagta

SEQ ID NO: 1312721 - DNA, 22 bp, Artificial Sequence
  chemically synthesized
tgtgcatacttccttggcaaag

SEQ ID NO: 1312722 - DNA, 22 bp, Artificial Sequence
  chemically synthesized
tactttgccaaggaagtatgca

SEQ ID NO: 1312723 - DNA, 22 bp, Artificial Sequence
  chemically synthesized
tataaaaatgattctgtgcata

SEQ ID NO: 1312724 - DNA, 22 bp, Artificial Sequence
  chemically synthesized
tgccaaggaagtatgcacagaa

SEQ ID NO: 1312725 - DNA, 22 bp, Artificial Sequence
  chemically synthesized
gccaaggaagtatgcacagaat

SEQ ID NO: 1312726 - DNA, 22 bp, Artificial Sequence
  chemically synthesized
ccaaggaagtatgcacagaatc

SEQ ID NO: 1312727 - DNA, 22 bp, Artificial Sequence
  chemically synthesized
cctatataaaaatgattctgtg

SEQ ID NO: 1312728 - DNA, 22 bp, Artificial Sequence
  chemically synthesized
ttacctatataaaaatgattct

SEQ ID NO: 1312729 - DNA, 22 bp, Artificial Sequence
  chemically synthesized
gatatacagttattacctatat

SEQ ID NO: 1312730 - DNA, 22 bp, Artificial Sequence
  chemically synthesized
ttagatatacagttattaccta

SEQ ID NO: 1312731 - DNA, 22 bp, Artificial Sequence
  chemically synthesized
gttagatatacagttattacct

SEQ ID NO: 1312732 - DNA, 22 bp, Artificial Sequence
  chemically synthesized
tgttagatatacagttattacc

SEQ ID NO: 1312733 - DNA, 22 bp, Artificial Sequence
  chemically synthesized
ttatataggtaataactgtata

SEQ ID NO: 1312734 - DNA, 22 bp, Artificial Sequence
  chemically synthesized
tatataggtaataactgtatat

SEQ ID NO: 1312735 - DNA, 22 bp, Artificial Sequence
  chemically synthesized
atataggtaataactgtatatc

SEQ ID NO: 1312736 - DNA, 22 bp, Artificial Sequence
  chemically synthesized
tataggtaataactgtatatct

SEQ ID NO: 1312737 - DNA, 22 bp, Artificial Sequence
  chemically synthesized
agagtgaaatgaaatagagttt

SEQ ID NO: 1312738 - DNA, 22 bp, Artificial Sequence
  chemically synthesized
tatatctaacaaaactctattt

SEQ ID NO: 1312739 - DNA, 22 bp, Artificial Sequence
  chemically synthesized
aagagtgaaatgaaatagagtt

SEQ ID NO: 1312740 - DNA, 22 bp, Artificial Sequence
  chemically synthesized
aatttaagagtgaaatgaaata

SEQ ID NO: 1312741 - DNA, 22 bp, Artificial Sequence
  chemically synthesized
tgaatttaagagtgaaatgaaa

SEQ ID NO: 1312742 - DNA, 22 bp, Artificial Sequence
  chemically synthesized
acaaaactctatttcatttcac

SEQ ID NO: 1312743 - DNA, 22 bp, Artificial Sequence
  chemically synthesized
ctgaatttaagagtgaaatgaa

SEQ ID NO: 1312744 - DNA, 22 bp, Artificial Sequence
  chemically synthesized
tctgaatttaagagtgaaatga

SEQ ID NO: 1312745 - DNA, 22 bp, Artificial Sequence
  chemically synthesized
ttctgaatttaagagtgaaatg

SEQ ID NO: 1312746 - DNA, 22 bp, Artificial Sequence
  chemically synthesized
tttctgaatttaagagtgaaat

SEQ ID NO: 1312747 - DNA, 22 bp, Artificial Sequence
  chemically synthesized
ttttctgaatttaagagtgaaa

SEQ ID NO: 1312748 - DNA, 22 bp, Artificial Sequence
  chemically synthesized
tttttctgaatttaagagtgaa

SEQ ID NO: 1312749 - DNA, 22 bp, Artificial Sequence
  chemically synthesized
tatttcatttcactcttaaatt

SEQ ID NO: 1312750 - DNA, 22 bp, Artificial Sequence
  chemically synthesized
tttcatttcactcttaaattca

SEQ ID NO: 1312751 - DNA, 22 bp, Artificial Sequence
  chemically synthesized
catttcactcttaaattcagaa

SEQ ID NO: 1312752 - DNA, 22 bp, Artificial Sequence
  chemically synthesized
catgtattttttttctgaattt

SEQ ID NO: 1312753 - DNA, 22 bp, Artificial Sequence
  chemically synthesized
atttcactcttaaattcagaaa

SEQ ID NO: 1312754 - DNA, 22 bp, Artificial Sequence
  chemically synthesized
cactcttaaattcagaaaaaaa

SEQ ID NO: 1312755 - DNA, 22 bp, Artificial Sequence
  chemically synthesized
aattacatgtattttttttctg

SEQ ID NO: 1312756 - DNA, 22 bp, Artificial Sequence
  chemically synthesized
actcttaaattcagaaaaaaaa

SEQ ID NO: 1312757 - DNA, 22 bp, Artificial Sequence
  chemically synthesized
gaattacatgtattttttttct

SEQ ID NO: 1312758 - DNA, 22 bp, Artificial Sequence
  chemically synthesized
tgaattacatgtattttttttc

SEQ ID NO: 1312759 - DNA, 22 bp, Artificial Sequence
  chemically synthesized
ttaaattcagaaaaaaaataca

SEQ ID NO: 1312760 - DNA, 22 bp, Artificial Sequence
  chemically synthesized
ttttgaattacatgtatttttt

SEQ ID NO: 1312761 - DNA, 22 bp, Artificial Sequence
  chemically synthesized
attttgaattacatgtattttt

SEQ ID NO: 1312762 - DNA, 22 bp, Artificial Sequence
  chemically synthesized
aaattcagaaaaaaaatacatg

SEQ ID NO: 1312763 - DNA, 22 bp, Artificial Sequence
  chemically synthesized
aattcagaaaaaaaatacatgt

SEQ ID NO: 1312764 - DNA, 22 bp, Artificial Sequence
  chemically synthesized
agaaaaaaaatacatgtaattc

SEQ ID NO: 1312765 - DNA, 22 bp, Artificial Sequence
  chemically synthesized
ccatatccagtgataacgttta

SEQ ID NO: 1312766 - DNA, 22 bp, Artificial Sequence
  chemically synthesized
ctaccatatccagtgataacgt

SEQ ID NO: 1312767 - DNA, 22 bp, Artificial Sequence
  chemically synthesized
gctaccatatccagtgataacg

SEQ ID NO: 1312768 - DNA, 22 bp, Artificial Sequence
  chemically synthesized
tgctaccatatccagtgataac

SEQ ID NO: 1312769 - DNA, 22 bp, Artificial Sequence
  chemically synthesized
aaaataaacgttatcactggat

SEQ ID NO: 1312770 - DNA, 22 bp, Artificial Sequence
  chemically synthesized
ttttgctaccatatccagtgat

SEQ ID NO: 1312771 - DNA, 22 bp, Artificial Sequence
  chemically synthesized
ttgttttgctaccatatccagt

SEQ ID NO: 1312772 - DNA, 22 bp, Artificial Sequence
  chemically synthesized
cgcactgttgttttgctaccat

SEQ ID NO: 1312773 - DNA, 22 bp, Artificial Sequence
  chemically synthesized
tcactggatatggtagcaaaac

SEQ ID NO: 1312774 - DNA, 22 bp, Artificial Sequence
  chemically synthesized
gatatggtagcaaaacaacagt

SEQ ID NO: 1312775 - DNA, 22 bp, Artificial Sequence
  chemically synthesized
acacggaaacataagcacatat

SEQ ID NO: 1312776 - DNA, 22 bp, Artificial Sequence
  chemically synthesized
atgtttccgtgtgagttctatc

SEQ ID NO: 1312777 - DNA, 22 bp, Artificial Sequence
  chemically synthesized
tgtttccgtgtgagttctatct

SEQ ID NO: 1312778 - DNA, 22 bp, Artificial Sequence
  chemically synthesized
ccgtgtgagttctatctatgtg

SEQ ID NO: 1312779 - DNA, 22 bp, Artificial Sequence
  chemically synthesized
cgtgtgagttctatctatgtgt

SEQ ID NO: 1312780 - DNA, 22 bp, Artificial Sequence
  chemically synthesized
tatctatgtgtgtgcttatata

SEQ ID NO: 1312781 - DNA, 22 bp, Artificial Sequence
  chemically synthesized
tctatgtgtgtgcttatatatg

SEQ ID NO: 1312782 - DNA, 22 bp, Artificial Sequence
  chemically synthesized
tgtgtgtgcttatatatgtgta

SEQ ID NO: 1312783 - DNA, 22 bp, Artificial Sequence
  chemically synthesized
tgtatatgtgtgtgtacacata

SEQ ID NO: 1312784 - DNA, 22 bp, Artificial Sequence
  chemically synthesized
atatatgtgtacacacacatat

SEQ ID NO: 1312785 - DNA, 22 bp, Artificial Sequence
  chemically synthesized
tatgtgttgtgtatatgtgtgt

SEQ ID NO: 1312786 - DNA, 22 bp, Artificial Sequence
  chemically synthesized
tatatgtgtacacacacatata

SEQ ID NO: 1312787 - DNA, 22 bp, Artificial Sequence
  chemically synthesized
actgtatgtgttgtgtatatgt

SEQ ID NO: 1312788 - DNA, 22 bp, Artificial Sequence
  chemically synthesized
tcactgtatgtgttgtgtatat

SEQ ID NO: 1312789 - DNA, 22 bp, Artificial Sequence
  chemically synthesized
tctcactgtatgtgttgtgtat

SEQ ID NO: 1312790 - DNA, 22 bp, Artificial Sequence
  chemically synthesized
ctctcactgtatgtgttgtgta

SEQ ID NO: 1312791 - DNA, 22 bp, Artificial Sequence
  chemically synthesized
tctctcactgtatgtgttgtgt

SEQ ID NO: 1312792 - DNA, 22 bp, Artificial Sequence
  chemically synthesized
tttctctcactgtatgtgttgt

SEQ ID NO: 1312793 - DNA, 22 bp, Artificial Sequence
  chemically synthesized
tctttctctcactgtatgtgtt

SEQ ID NO: 1312794 - DNA, 22 bp, Artificial Sequence
  chemically synthesized
cctctctttctctcactgtatg

SEQ ID NO: 1312795 - DNA, 22 bp, Artificial Sequence
  chemically synthesized
taaactgcctctctttctctca

SEQ ID NO: 1312796 - DNA, 22 bp, Artificial Sequence
  chemically synthesized
gaagattataaactgcctctct

SEQ ID NO: 1312797 - DNA, 22 bp, Artificial Sequence
  chemically synthesized
acataagccaaaaatgttggaa

SEQ ID NO: 1312798 - DNA, 22 bp, Artificial Sequence
  chemically synthesized
ataatcttccaacatttttggc

SEQ ID NO: 1312799 - DNA, 22 bp, Artificial Sequence
  chemically synthesized
taatcttccaacatttttggct

SEQ ID NO: 1312800 - DNA, 22 bp, Artificial Sequence
  chemically synthesized
caggttgacataagccaaaaat

SEQ ID NO: 1312801 - DNA, 22 bp, Artificial Sequence
  chemically synthesized
acctacaggttgacataagcca

SEQ ID NO: 1312802 - DNA, 22 bp, Artificial Sequence
  chemically synthesized
aacctacaggttgacataagcc

SEQ ID NO: 1312803 - DNA, 22 bp, Artificial Sequence
  chemically synthesized
ccaacatttttggcttatgtca

SEQ ID NO: 1312804 - DNA, 22 bp, Artificial Sequence
  chemically synthesized
taacctacaggttgacataagc

SEQ ID NO: 1312805 - DNA, 22 bp, Artificial Sequence
  chemically synthesized
caacatttttggcttatgtcaa

SEQ ID NO: 1312806 - DNA, 22 bp, Artificial Sequence
  chemically synthesized
ttaacctacaggttgacataag

SEQ ID NO: 1312807 - DNA, 22 bp, Artificial Sequence
  chemically synthesized
ttggcttatgtcaacctgtagg

SEQ ID NO: 1312808 - DNA, 22 bp, Artificial Sequence
  chemically synthesized
tggcttatgtcaacctgtaggt

SEQ ID NO: 1312809 - DNA, 22 bp, Artificial Sequence
  chemically synthesized
ggcttatgtcaacctgtaggtt

SEQ ID NO: 1312810 - DNA, 22 bp, Artificial Sequence
  chemically synthesized
gcttatgtcaacctgtaggtta

SEQ ID NO: 1312811 - DNA, 22 bp, Artificial Sequence
  chemically synthesized
atgtcaacctgtaggttaaaaa

SEQ ID NO: 1312812 - DNA, 22 bp, Artificial Sequence
  chemically synthesized
tgtcaacctgtaggttaaaaat

SEQ ID NO: 1312813 - DNA, 22 bp, Artificial Sequence
  chemically synthesized
gcatcacaaagtcagattttta

SEQ ID NO: 1312814 - DNA, 22 bp, Artificial Sequence
  chemically synthesized
ggcatcacaaagtcagattttt

SEQ ID NO: 1312815 - DNA, 22 bp, Artificial Sequence
  chemically synthesized
tggcatcacaaagtcagatttt

SEQ ID NO: 1312816 - DNA, 22 bp, Artificial Sequence
  chemically synthesized
tttggcatcacaaagtcagatt

SEQ ID NO: 1312817 - DNA, 22 bp, Artificial Sequence
  chemically synthesized
taggttaaaaatctgactttgt

SEQ ID NO: 1312818 - DNA, 22 bp, Artificial Sequence
  chemically synthesized
ctctttggcatcacaaagtcag

SEQ ID NO: 1312819 - DNA, 22 bp, Artificial Sequence
  chemically synthesized
cctctttggcatcacaaagtca

SEQ ID NO: 1312820 - DNA, 22 bp, Artificial Sequence
  chemically synthesized
tcctctttggcatcacaaagtc

SEQ ID NO: 1312821 - DNA, 22 bp, Artificial Sequence
  chemically synthesized
aaaatctgactttgtgatgcca

SEQ ID NO: 1312822 - DNA, 22 bp, Artificial Sequence
  chemically synthesized
tacctttcctctttggcatcac

SEQ ID NO: 1312823 - DNA, 22 bp, Artificial Sequence
  chemically synthesized
ctatacctttcctctttggcat

SEQ ID NO: 1312824 - DNA, 22 bp, Artificial Sequence
  chemically synthesized
cctatacctttcctctttggca

SEQ ID NO: 1312825 - DNA, 22 bp, Artificial Sequence
  chemically synthesized
actttgtgatgccaaagaggaa

SEQ ID NO: 1312826 - DNA, 22 bp, Artificial Sequence
  chemically synthesized
cttcctatacctttcctctttg

SEQ ID NO: 1312827 - DNA, 22 bp, Artificial Sequence
  chemically synthesized
ctccttcctatacctttcctct

SEQ ID NO: 1312828 - DNA, 22 bp, Artificial Sequence
  chemically synthesized
tgtgatgccaaagaggaaaggt

SEQ ID NO: 1312829 - DNA, 22 bp, Artificial Sequence
  chemically synthesized
gtgatgccaaagaggaaaggta

SEQ ID NO: 1312830 - DNA, 22 bp, Artificial Sequence
  chemically synthesized
tgctccttcctatacctttcct

SEQ ID NO: 1312831 - DNA, 22 bp, Artificial Sequence
  chemically synthesized
tgatgccaaagaggaaaggtat

SEQ ID NO: 1312832 - DNA, 22 bp, Artificial Sequence
  chemically synthesized
tctgctccttcctatacctttc

SEQ ID NO: 1312833 - DNA, 22 bp, Artificial Sequence
  chemically synthesized
ctctgctccttcctataccttt

SEQ ID NO: 1312834 - DNA, 22 bp, Artificial Sequence
  chemically synthesized
tctctgctccttcctatacctt

SEQ ID NO: 1312835 - DNA, 22 bp, Artificial Sequence
  chemically synthesized
ttttctctgctccttcctatac

SEQ ID NO: 1312836 - DNA, 22 bp, Artificial Sequence
  chemically synthesized
agttattttctctgctccttcc

SEQ ID NO: 1312837 - DNA, 22 bp, Artificial Sequence
  chemically synthesized
gagttattttctctgctccttc

SEQ ID NO: 1312838 - DNA, 22 bp, Artificial Sequence
  chemically synthesized
agtaaaccatatttgagttatt

SEQ ID NO: 1312839 - DNA, 22 bp, Artificial Sequence
  chemically synthesized
ccatacctaagtaaaccatatt

SEQ ID NO: 1312840 - DNA, 22 bp, Artificial Sequence
  chemically synthesized
acctcccatacctaagtaaacc

SEQ ID NO: 1312841 - DNA, 22 bp, Artificial Sequence
  chemically synthesized
cacctcccatacctaagtaaac

SEQ ID NO: 1312842 - DNA, 22 bp, Artificial Sequence
  chemically synthesized
tcacctcccatacctaagtaaa

SEQ ID NO: 1312843 - DNA, 22 bp, Artificial Sequence
  chemically synthesized
aaatatggtttacttaggtatg

SEQ ID NO: 1312844 - DNA, 22 bp, Artificial Sequence
  chemically synthesized
acttaggtatgggaggtgaaag

SEQ ID NO: 1312845 - DNA, 22 bp, Artificial Sequence
  chemically synthesized
cttaggtatgggaggtgaaaga

SEQ ID NO: 1312846 - DNA, 22 bp, Artificial Sequence
  chemically synthesized
aggtatgggaggtgaaagatta

SEQ ID NO: 1312847 - DNA, 22 bp, Artificial Sequence
  chemically synthesized
ggtatgggaggtgaaagattat

SEQ ID NO: 1312848 - DNA, 22 bp, Artificial Sequence
  chemically synthesized
taatgatgccacaaataatctt

SEQ ID NO: 1312849 - DNA, 22 bp, Artificial Sequence
  chemically synthesized
acaaagctgtaatgatgccaca

SEQ ID NO: 1312850 - DNA, 22 bp, Artificial Sequence
  chemically synthesized
cacaaagctgtaatgatgccac

SEQ ID NO: 1312851 - DNA, 22 bp, Artificial Sequence
  chemically synthesized
tttcacaaagctgtaatgatgc

SEQ ID NO: 1312852 - DNA, 22 bp, Artificial Sequence
  chemically synthesized
tttgtggcatcattacagcttt

SEQ ID NO: 1312853 - DNA, 22 bp, Artificial Sequence
  chemically synthesized
ccaattgtttcacaaagctgta

SEQ ID NO: 1312854 - DNA, 22 bp, Artificial Sequence
  chemically synthesized
gccaattgtttcacaaagctgt

SEQ ID NO: 1312855 - DNA, 22 bp, Artificial Sequence
  chemically synthesized
gtggcatcattacagctttgtg

SEQ ID NO: 1312856 - DNA, 22 bp, Artificial Sequence
  chemically synthesized
tggcatcattacagctttgtga

SEQ ID NO: 1312857 - DNA, 22 bp, Artificial Sequence
  chemically synthesized
cacaaccttgccaattgtttca

SEQ ID NO: 1312858 - DNA, 22 bp, Artificial Sequence
  chemically synthesized
gcacaaccttgccaattgtttc

SEQ ID NO: 1312859 - DNA, 22 bp, Artificial Sequence
  chemically synthesized
tgcacaaccttgccaattgttt

SEQ ID NO: 1312860 - DNA, 22 bp, Artificial Sequence
  chemically synthesized
cagctttgtgaaacaattggca

SEQ ID NO: 1312861 - DNA, 22 bp, Artificial Sequence
  chemically synthesized
tgtgaaacaattggcaaggttg

SEQ ID NO: 1312862 - DNA, 22 bp, Artificial Sequence
  chemically synthesized
gtgaaacaattggcaaggttgt

SEQ ID NO: 1312863 - DNA, 22 bp, Artificial Sequence
  chemically synthesized
tgaaacaattggcaaggttgtg

SEQ ID NO: 1312864 - DNA, 22 bp, Artificial Sequence
  chemically synthesized
atcaagatggtactttgcacaa

SEQ ID NO: 1312865 - DNA, 22 bp, Artificial Sequence
  chemically synthesized
actgatcaagatggtactttgc

SEQ ID NO: 1312866 - DNA, 22 bp, Artificial Sequence
  chemically synthesized
cactgatcaagatggtactttg

SEQ ID NO: 1312867 - DNA, 22 bp, Artificial Sequence
  chemically synthesized
gcaaggttgtgcaaagtaccat

SEQ ID NO: 1312868 - DNA, 22 bp, Artificial Sequence
  chemically synthesized
tgcaaagtaccatcttgatcag

SEQ ID NO: 1312869 - DNA, 22 bp, Artificial Sequence
  chemically synthesized
agggaaaaagcttcactgatca

SEQ ID NO: 1312870 - DNA, 22 bp, Artificial Sequence
  chemically synthesized
aagggaaaaagcttcactgatc

SEQ ID NO: 1312871 - DNA, 22 bp, Artificial Sequence
  chemically synthesized
gatcagtgaagctttttccctt

SEQ ID NO: 1312872 - DNA, 22 bp, Artificial Sequence
  chemically synthesized
taatccatccttaagggaaaaa

SEQ ID NO: 1312873 - DNA, 22 bp, Artificial Sequence
  chemically synthesized
atcagtgaagctttttccctta

SEQ ID NO: 1312874 - DNA, 22 bp, Artificial Sequence
  chemically synthesized
gtaatccatccttaagggaaaa

SEQ ID NO: 1312875 - DNA, 22 bp, Artificial Sequence
  chemically synthesized
cacacttgtaatccatccttaa

SEQ ID NO: 1312876 - DNA, 22 bp, Artificial Sequence
  chemically synthesized
aattacacacttgtaatccatc

SEQ ID NO: 1312877 - DNA, 22 bp, Artificial Sequence
  chemically synthesized
tttcccttaaggatggattaca

SEQ ID NO: 1312878 - DNA, 22 bp, Artificial Sequence
  chemically synthesized
ttcccttaaggatggattacaa

SEQ ID NO: 1312879 - DNA, 22 bp, Artificial Sequence
  chemically synthesized
tcccttaaggatggattacaag

SEQ ID NO: 1312880 - DNA, 22 bp, Artificial Sequence
  chemically synthesized
cccttaaggatggattacaagt

SEQ ID NO: 1312881 - DNA, 22 bp, Artificial Sequence
  chemically synthesized
ccttaaggatggattacaagtg

SEQ ID NO: 1312882 - DNA, 22 bp, Artificial Sequence
  chemically synthesized
aaggatggattacaagtgtgta

SEQ ID NO: 1312883 - DNA, 22 bp, Artificial Sequence
  chemically synthesized
aggatggattacaagtgtgtaa

SEQ ID NO: 1312884 - DNA, 22 bp, Artificial Sequence
  chemically synthesized
caagtcaaggttgaattacaca

SEQ ID NO: 1312885 - DNA, 22 bp, Artificial Sequence
  chemically synthesized
caagtgtgtaattcaaccttga

SEQ ID NO: 1312886 - DNA, 22 bp, Artificial Sequence
  chemically synthesized
gagaggaaatggaggtctacaa

SEQ ID NO: 1312887 - DNA, 22 bp, Artificial Sequence
  chemically synthesized
aaccttgacttgtagacctcca

SEQ ID NO: 1312888 - DNA, 22 bp, Artificial Sequence
  chemically synthesized
gacttgtagacctccatttcct

SEQ ID NO: 1312889 - DNA, 22 bp, Artificial Sequence
  chemically synthesized
acataactagagaggaaatgga

SEQ ID NO: 1312890 - DNA, 22 bp, Artificial Sequence
  chemically synthesized
acttgtagacctccatttcctc

SEQ ID NO: 1312891 - DNA, 22 bp, Artificial Sequence
  chemically synthesized
gtagacctccatttcctctcta

SEQ ID NO: 1312892 - DNA, 22 bp, Artificial Sequence
  chemically synthesized
tagacctccatttcctctctag

SEQ ID NO: 1312893 - DNA, 22 bp, Artificial Sequence
  chemically synthesized
catttcctctctagttatgtga

SEQ ID NO: 1312894 - DNA, 22 bp, Artificial Sequence
  chemically synthesized
tatggtgcacattcacataact

SEQ ID NO: 1312895 - DNA, 22 bp, Artificial Sequence
  chemically synthesized
cctctctagttatgtgaatgtg

SEQ ID NO: 1312896 - DNA, 22 bp, Artificial Sequence
  chemically synthesized
tattgtatggtgcacattcaca

SEQ ID NO: 1312897 - DNA, 22 bp, Artificial Sequence
  chemically synthesized
ctctctagttatgtgaatgtgc

SEQ ID NO: 1312898 - DNA, 22 bp, Artificial Sequence
  chemically synthesized
gtattgtatggtgcacattcac

SEQ ID NO: 1312899 - DNA, 22 bp, Artificial Sequence
  chemically synthesized
tgtattgtatggtgcacattca

SEQ ID NO: 1312900 - DNA, 22 bp, Artificial Sequence
  chemically synthesized
tctagttatgtgaatgtgcacc

SEQ ID NO: 1312901 - DNA, 22 bp, Artificial Sequence
  chemically synthesized
tagttatgtgaatgtgcaccat

SEQ ID NO: 1312902 - DNA, 22 bp, Artificial Sequence
  chemically synthesized
gttatgtgaatgtgcaccatac

SEQ ID NO: 1312903 - DNA, 22 bp, Artificial Sequence
  chemically synthesized
tgtgaatgtgcaccatacaata

SEQ ID NO: 1312904 - DNA, 22 bp, Artificial Sequence
  chemically synthesized
aagtaataggtatagaactttg

SEQ ID NO: 1312905 - DNA, 22 bp, Artificial Sequence
  chemically synthesized
aaagtaataggtatagaacttt

SEQ ID NO: 1312906 - DNA, 22 bp, Artificial Sequence
  chemically synthesized
gtttaaagtaataggtatagaa

SEQ ID NO: 1312907 - DNA, 22 bp, Artificial Sequence
  chemically synthesized
ctggtttaaagtaataggtata

SEQ ID NO: 1312908 - DNA, 22 bp, Artificial Sequence
  chemically synthesized
tatacctattactttaaaccag

SEQ ID NO: 1312909 - DNA, 22 bp, Artificial Sequence
  chemically synthesized
tacctattactttaaaccagta

SEQ ID NO: 1312910 - DNA, 22 bp, Artificial Sequence
  chemically synthesized
agtacaataaaacgttactggt

SEQ ID NO: 1312911 - DNA, 22 bp, Artificial Sequence
  chemically synthesized
ttactttaaaccagtaacgttt

SEQ ID NO: 1312912 - DNA, 22 bp, Artificial Sequence
  chemically synthesized
ttaagtacaataaaacgttact

SEQ ID NO: 1312913 - DNA, 22 bp, Artificial Sequence
  chemically synthesized
ctttaaaccagtaacgttttat

SEQ ID NO: 1312914 - DNA, 22 bp, Artificial Sequence
  chemically synthesized
ttattaagtacaataaaacgtt

SEQ ID NO: 1312915 - DNA, 22 bp, Artificial Sequence
  chemically synthesized
taaaccagtaacgttttattgt

SEQ ID NO: 1312916 - DNA, 22 bp, Artificial Sequence
  chemically synthesized
aaaccagtaacgttttattgta

SEQ ID NO: 1312917 - DNA, 22 bp, Artificial Sequence
  chemically synthesized
aaccagtaacgttttattgtac

SEQ ID NO: 1312918 - DNA, 22 bp, Artificial Sequence
  chemically synthesized
agactattattaagtacaataa

SEQ ID NO: 1312919 - DNA, 22 bp, Artificial Sequence
  chemically synthesized
gatagcctaagactattattaa

SEQ ID NO: 1312920 - DNA, 22 bp, Artificial Sequence
  chemically synthesized
tattgtacttaataatagtctt

SEQ ID NO: 1312921 - DNA, 22 bp, Artificial Sequence
  chemically synthesized
cctagatagcctaagactatta

SEQ ID NO: 1312922 - DNA, 22 bp, Artificial Sequence
  chemically synthesized
attgtacttaataatagtctta

SEQ ID NO: 1312923 - DNA, 22 bp, Artificial Sequence
  chemically synthesized
ttgtacttaataatagtcttag

SEQ ID NO: 1312924 - DNA, 22 bp, Artificial Sequence
  chemically synthesized
tacttaataatagtcttaggct

SEQ ID NO: 1312925 - DNA, 22 bp, Artificial Sequence
  chemically synthesized
aataatagtcttaggctatcta

SEQ ID NO: 1312926 - DNA, 22 bp, Artificial Sequence
  chemically synthesized
ataatagtcttaggctatctag

SEQ ID NO: 1312927 - DNA, 22 bp, Artificial Sequence
  chemically synthesized
taaacagagattacctagatag

SEQ ID NO: 1312928 - DNA, 22 bp, Artificial Sequence
  chemically synthesized
aggctatctaggtaatctctgt

SEQ ID NO: 1312929 - DNA, 22 bp, Artificial Sequence
  chemically synthesized
ggctatctaggtaatctctgtt

SEQ ID NO: 1312930 - DNA, 22 bp, Artificial Sequence
  chemically synthesized
taaacacctataaacagagatt

SEQ ID NO: 1312931 - DNA, 22 bp, Artificial Sequence
  chemically synthesized
gtaaacacctataaacagagat

SEQ ID NO: 1312932 - DNA, 22 bp, Artificial Sequence
  chemically synthesized
tgtaaacacctataaacagaga

SEQ ID NO: 1312933 - DNA, 22 bp, Artificial Sequence
  chemically synthesized
tctaggtaatctctgtttatag

SEQ ID NO: 1312934 - DNA, 22 bp, Artificial Sequence
  chemically synthesized
ctttgtaaacacctataaacag

SEQ ID NO: 1312935 - DNA, 22 bp, Artificial Sequence
  chemically synthesized
ggtaatctctgtttataggtgt

SEQ ID NO: 1312936 - DNA, 22 bp, Artificial Sequence
  chemically synthesized
tgtttataggtgtttacaaagt

SEQ ID NO: 1312937 - DNA, 22 bp, Artificial Sequence
  chemically synthesized
tttataggtgtttacaaagtaa

SEQ ID NO: 1312938 - DNA, 22 bp, Artificial Sequence
  chemically synthesized
cataaaataatattactttgta

SEQ ID NO: 1312939 - DNA, 22 bp, Artificial Sequence
  chemically synthesized
acataaaataatattactttgt

SEQ ID NO: 1312940 - DNA, 22 bp, Artificial Sequence
  chemically synthesized
ataggtgtttacaaagtaatat

SEQ ID NO: 1312941 - DNA, 22 bp, Artificial Sequence
  chemically synthesized
taggtgtttacaaagtaatatt

SEQ ID NO: 1312942 - DNA, 22 bp, Artificial Sequence
  chemically synthesized
gtttacataaaataatattact

SEQ ID NO: 1312943 - DNA, 22 bp, Artificial Sequence
  chemically synthesized
ttagtttacataaaataatatt

SEQ ID NO: 1312944 - DNA, 22 bp, Artificial Sequence
  chemically synthesized
attagtttacataaaataatat

SEQ ID NO: 1312945 - DNA, 22 bp, Artificial Sequence
  chemically synthesized
tattagtttacataaaataata

SEQ ID NO: 1312946 - DNA, 22 bp, Artificial Sequence
  chemically synthesized
ttattagtttacataaaataat

SEQ ID NO: 1312947 - DNA, 22 bp, Artificial Sequence
  chemically synthesized
acaaagtaatattattttatgt

SEQ ID NO: 1312948 - DNA, 22 bp, Artificial Sequence
  chemically synthesized
caaagtaatattattttatgta

SEQ ID NO: 1312949 - DNA, 22 bp, Artificial Sequence
  chemically synthesized
gcaccaacgtttttattagttt

SEQ ID NO: 1312950 - DNA, 22 bp, Artificial Sequence
  chemically synthesized
ttttatgtaaactaataaaaac

SEQ ID NO: 1312951 - DNA, 22 bp, Artificial Sequence
  chemically synthesized
tatgtaaactaataaaaacgtt

SEQ ID NO: 1312952 - DNA, 22 bp, Artificial Sequence
  chemically synthesized
atgtaaactaataaaaacgttg

SEQ ID NO: 1312953 - DNA, 22 bp, Artificial Sequence
  chemically synthesized
tgtaaactaataaaaacgttgg

SEQ ID NO: 1312954 - DNA, 22 bp, Artificial Sequence
  chemically synthesized
ataaaaacgttggtgctaattg

SEQ ID NO: 1312955 - DNA, 22 bp, Artificial Sequence
  chemically synthesized
caagcaatgtgtaaagcaatta

SEQ ID NO: 1312956 - DNA, 22 bp, Artificial Sequence
  chemically synthesized
ccaagcaatgtgtaaagcaatt

SEQ ID NO: 1312957 - DNA, 22 bp, Artificial Sequence
  chemically synthesized
tccaagcaatgtgtaaagcaat

SEQ ID NO: 1312958 - DNA, 22 bp, Artificial Sequence
  chemically synthesized
ttccaagcaatgtgtaaagcaa

SEQ ID NO: 1312959 - DNA, 22 bp, Artificial Sequence
  chemically synthesized
cttttccaagcaatgtgtaaag

SEQ ID NO: 1312960 - DNA, 22 bp, Artificial Sequence
  chemically synthesized
gcttttccaagcaatgtgtaaa

SEQ ID NO: 1312961 - DNA, 22 bp, Artificial Sequence
  chemically synthesized
gtgctaattgctttacacattg

SEQ ID NO: 1312962 - DNA, 22 bp, Artificial Sequence
  chemically synthesized
attgctttacacattgcttgga

SEQ ID NO: 1312963 - DNA, 22 bp, Artificial Sequence
  chemically synthesized
ctttacacattgcttggaaaag

SEQ ID NO: 1312964 - DNA, 22 bp, Artificial Sequence
  chemically synthesized
caaaaatggcttgcttttccaa

SEQ ID NO: 1312965 - DNA, 22 bp, Artificial Sequence
  chemically synthesized
tacacattgcttggaaaagcaa

SEQ ID NO: 1312966 - DNA, 22 bp, Artificial Sequence
  chemically synthesized
acacattgcttggaaaagcaag

SEQ ID NO: 1312967 - DNA, 22 bp, Artificial Sequence
  chemically synthesized
cacattgcttggaaaagcaagc

SEQ ID NO: 1312968 - DNA, 22 bp, Artificial Sequence
  chemically synthesized
aactgcaaaaatggcttgcttt

SEQ ID NO: 1312969 - DNA, 22 bp, Artificial Sequence
  chemically synthesized
ctcaactgcaaaaatggcttgc

SEQ ID NO: 1312970 - DNA, 22 bp, Artificial Sequence
  chemically synthesized
cttggaaaagcaagccattttt

SEQ ID NO: 1312971 - DNA, 22 bp, Artificial Sequence
  chemically synthesized
ggaaaagcaagccatttttgca

SEQ ID NO: 1312972 - DNA, 22 bp, Artificial Sequence
  chemically synthesized
gaaaagcaagccatttttgcag

SEQ ID NO: 1312973 - DNA, 22 bp, Artificial Sequence
  chemically synthesized
agcaactactcaactgcaaaaa

SEQ ID NO: 1312974 - DNA, 22 bp, Artificial Sequence
  chemically synthesized
gccaatagtgctgagcaactac

SEQ ID NO: 1312975 - DNA, 22 bp, Artificial Sequence
  chemically synthesized
ttgcagttgagtagttgctcag

SEQ ID NO: 1312976 - DNA, 22 bp, Artificial Sequence
  chemically synthesized
tgcagttgagtagttgctcagc

SEQ ID NO: 1312977 - DNA, 22 bp, Artificial Sequence
  chemically synthesized
gcagttgagtagttgctcagca

SEQ ID NO: 1312978 - DNA, 22 bp, Artificial Sequence
  chemically synthesized
cagttgagtagttgctcagcac

SEQ ID NO: 1312979 - DNA, 22 bp, Artificial Sequence
  chemically synthesized
agtagttgctcagcactattgg

SEQ ID NO: 1312980 - DNA, 22 bp, Artificial Sequence
  chemically synthesized
tagaaatagattggccaatagt

SEQ ID NO: 1312981 - DNA, 22 bp, Artificial Sequence
  chemically synthesized
ctcagcactattggccaatcta

SEQ ID NO: 1312982 - DNA, 22 bp, Artificial Sequence
  chemically synthesized
agcactattggccaatctattt

SEQ ID NO: 1312983 - DNA, 22 bp, Artificial Sequence
  chemically synthesized
ttggccaatctatttctatagc

SEQ ID NO: 1312984 - DNA, 22 bp, Artificial Sequence
  chemically synthesized
gccaatctatttctatagcttc

SEQ ID NO: 1312985 - DNA, 22 bp, Artificial Sequence
  chemically synthesized
aaggagatgaaaaacaagaagc

SEQ ID NO: 1312986 - DNA, 22 bp, Artificial Sequence
  chemically synthesized
ttgaaggagatgaaaaacaaga

SEQ ID NO: 1312987 - DNA, 22 bp, Artificial Sequence
  chemically synthesized
tttctatagcttcttgtttttc

SEQ ID NO: 1312988 - DNA, 22 bp, Artificial Sequence
  chemically synthesized
gttgaaggagatgaaaaacaag

SEQ ID NO: 1312989 - DNA, 22 bp, Artificial Sequence
  chemically synthesized
ctatagcttcttgtttttcatc

SEQ ID NO: 1312990 - DNA, 22 bp, Artificial Sequence
  chemically synthesized
tatagcttcttgtttttcatct

SEQ ID NO: 1312991 - DNA, 22 bp, Artificial Sequence
  chemically synthesized
tagcttcttgtttttcatctcc

SEQ ID NO: 1312992 - DNA, 22 bp, Artificial Sequence
  chemically synthesized
cttgtttttcatctccttcaac

SEQ ID NO: 1312993 - DNA, 22 bp, Artificial Sequence
  chemically synthesized
gcagatgaacttgttgaaggag

SEQ ID NO: 1312994 - DNA, 22 bp, Artificial Sequence
  chemically synthesized
ttgtttttcatctccttcaaca

SEQ ID NO: 1312995 - DNA, 22 bp, Artificial Sequence
  chemically synthesized
gtttttcatctccttcaacaag

SEQ ID NO: 1312996 - DNA, 22 bp, Artificial Sequence
  chemically synthesized
tttttcatctccttcaacaagt

SEQ ID NO: 1312997 - DNA, 22 bp, Artificial Sequence
  chemically synthesized
ttcatctccttcaacaagttca

SEQ ID NO: 1312998 - DNA, 22 bp, Artificial Sequence
  chemically synthesized
tcatctccttcaacaagttcat

SEQ ID NO: 1312999 - DNA, 22 bp, Artificial Sequence
  chemically synthesized
catctccttcaacaagttcatc

SEQ ID NO: 1313000 - DNA, 22 bp, Artificial Sequence
  chemically synthesized
atctccttcaacaagttcatct

SEQ ID NO: 1313001 - DNA, 22 bp, Artificial Sequence
  chemically synthesized
cttcaacaagttcatctgccaa

SEQ ID NO: 1313002 - DNA, 22 bp, Artificial Sequence
  chemically synthesized
caacaagttcatctgccaatat

SEQ ID NO: 1313003 - DNA, 22 bp, Artificial Sequence
  chemically synthesized
aacaagttcatctgccaatatt

SEQ ID NO: 1313004 - DNA, 22 bp, Artificial Sequence
  chemically synthesized
gagcaacacggggagcaaaata

SEQ ID NO: 1313005 - DNA, 22 bp, Artificial Sequence
  chemically synthesized
atctgccaatattttgctcccc

SEQ ID NO: 1313006 - DNA, 22 bp, Artificial Sequence
  chemically synthesized
agattagagcaacacggggagc

SEQ ID NO: 1313007 - DNA, 22 bp, Artificial Sequence
  chemically synthesized
ccaatattttgctccccgtgtt

SEQ ID NO: 1313008 - DNA, 22 bp, Artificial Sequence
  chemically synthesized
tgctccccgtgttgctctaatc

SEQ ID NO: 1313009 - DNA, 22 bp, Artificial Sequence
  chemically synthesized
gctccccgtgttgctctaatct

SEQ ID NO: 1313010 - DNA, 22 bp, Artificial Sequence
  chemically synthesized
agatagaaattgagattagagc

SEQ ID NO: 1313011 - DNA, 22 bp, Artificial Sequence
  chemically synthesized
ctccccgtgttgctctaatctc

SEQ ID NO: 1313012 - DNA, 22 bp, Artificial Sequence
  chemically synthesized
aagatagaaattgagattagag

SEQ ID NO: 1313013 - DNA, 22 bp, Artificial Sequence
  chemically synthesized
taagatagaaattgagattaga

SEQ ID NO: 1313014 - DNA, 22 bp, Artificial Sequence
  chemically synthesized
ttaagatagaaattgagattag

SEQ ID NO: 1313015 - DNA, 22 bp, Artificial Sequence
  chemically synthesized
cccgtgttgctctaatctcaat

SEQ ID NO: 1313016 - DNA, 22 bp, Artificial Sequence
  chemically synthesized
tttaagatagaaattgagatta

SEQ ID NO: 1313017 - DNA, 22 bp, Artificial Sequence
  chemically synthesized
ttttaagatagaaattgagatt

SEQ ID NO: 1313018 - DNA, 22 bp, Artificial Sequence
  chemically synthesized
tatttttttaagatagaaattg

SEQ ID NO: 1313019 - DNA, 22 bp, Artificial Sequence
  chemically synthesized
ctctaatctcaatttctatctt

SEQ ID NO: 1313020 - DNA, 22 bp, Artificial Sequence
  chemically synthesized
taatctcaatttctatcttaaa

SEQ ID NO: 1313021 - DNA, 22 bp, Artificial Sequence
  chemically synthesized
ccattgtatttttttaagatag

SEQ ID NO: 1313022 - DNA, 22 bp, Artificial Sequence
  chemically synthesized
accattgtatttttttaagata

SEQ ID NO: 1313023 - DNA, 22 bp, Artificial Sequence
  chemically synthesized
atctcaatttctatcttaaaaa

SEQ ID NO: 1313024 - DNA, 22 bp, Artificial Sequence
  chemically synthesized
aatttctatcttaaaaaaatac

SEQ ID NO: 1313025 - DNA, 22 bp, Artificial Sequence
  chemically synthesized
ctatcttaaaaaaatacaatgg

SEQ ID NO: 1313026 - DNA, 22 bp, Artificial Sequence
  chemically synthesized
tatcttaaaaaaatacaatggt

SEQ ID NO: 1313027 - DNA, 22 bp, Artificial Sequence
  chemically synthesized
tcttaaaaaaatacaatggtaa

SEQ ID NO: 1313028 - DNA, 22 bp, Artificial Sequence
  chemically synthesized
caaagtacccccttaccattgt

SEQ ID NO: 1313029 - DNA, 22 bp, Artificial Sequence
  chemically synthesized
gcaaagtacccccttaccattg

SEQ ID NO: 1313030 - DNA, 22 bp, Artificial Sequence
  chemically synthesized
aaaaaaatacaatggtaagggg

SEQ ID NO: 1313031 - DNA, 22 bp, Artificial Sequence
  chemically synthesized
aaaaaatacaatggtaaggggg

SEQ ID NO: 1313032 - DNA, 22 bp, Artificial Sequence
  chemically synthesized
acttgcaaagtacccccttacc

SEQ ID NO: 1313033 - DNA, 22 bp, Artificial Sequence
  chemically synthesized
ggcctaacttgcaaagtacccc

SEQ ID NO: 1313034 - DNA, 22 bp, Artificial Sequence
  chemically synthesized
aggcctaacttgcaaagtaccc

SEQ ID NO: 1313035 - DNA, 22 bp, Artificial Sequence
  chemically synthesized
ttaggcctaacttgcaaagtac

SEQ ID NO: 1313036 - DNA, 22 bp, Artificial Sequence
  chemically synthesized
cttaggcctaacttgcaaagta

SEQ ID NO: 1313037 - DNA, 22 bp, Artificial Sequence
  chemically synthesized
cttcttaggcctaacttgcaaa

SEQ ID NO: 1313038 - DNA, 22 bp, Artificial Sequence
  chemically synthesized
ggaaatcagtctccttcttagg

SEQ ID NO: 1313039 - DNA, 22 bp, Artificial Sequence
  chemically synthesized
tgcaagttaggcctaagaagga

SEQ ID NO: 1313040 - DNA, 22 bp, Artificial Sequence
  chemically synthesized
gggaaatcagtctccttcttag

SEQ ID NO: 1313041 - DNA, 22 bp, Artificial Sequence
  chemically synthesized
gcaagttaggcctaagaaggag

SEQ ID NO: 1313042 - DNA, 22 bp, Artificial Sequence
  chemically synthesized
caagttaggcctaagaaggaga

SEQ ID NO: 1313043 - DNA, 22 bp, Artificial Sequence
  chemically synthesized
ggcctaagaaggagactgattt

SEQ ID NO: 1313044 - DNA, 22 bp, Artificial Sequence
  chemically synthesized
agaaggagactgatttcccaag

SEQ ID NO: 1313045 - DNA, 22 bp, Artificial Sequence
  chemically synthesized
atttcccaaggatgttcacgtt

SEQ ID NO: 1313046 - DNA, 22 bp, Artificial Sequence
  chemically synthesized
aaaggcaataaatcaacgtgaa

SEQ ID NO: 1313047 - DNA, 22 bp, Artificial Sequence
  chemically synthesized
aaaaggcaataaatcaacgtga

SEQ ID NO: 1313048 - DNA, 22 bp, Artificial Sequence
  chemically synthesized
cccaaggatgttcacgttgatt

SEQ ID NO: 1313049 - DNA, 22 bp, Artificial Sequence
  chemically synthesized
taaaaggcaataaatcaacgtg

SEQ ID NO: 1313050 - DNA, 22 bp, Artificial Sequence
  chemically synthesized
ccaaggatgttcacgttgattt

SEQ ID NO: 1313051 - DNA, 22 bp, Artificial Sequence
  chemically synthesized
gtattttaaaaggcaataaatc

SEQ ID NO: 1313052 - DNA, 22 bp, Artificial Sequence
  chemically synthesized
acgttgatttattgccttttaa

SEQ ID NO: 1313053 - DNA, 22 bp, Artificial Sequence
  chemically synthesized
tgcaactagtattttaaaaggc

SEQ ID NO: 1313054 - DNA, 22 bp, Artificial Sequence
  chemically synthesized
attgtgcaactagtattttaaa

SEQ ID NO: 1313055 - DNA, 22 bp, Artificial Sequence
  chemically synthesized
atttattgccttttaaaatact

SEQ ID NO: 1313056 - DNA, 22 bp, Artificial Sequence
  chemically synthesized
cattgtgcaactagtattttaa

SEQ ID NO: 1313057 - DNA, 22 bp, Artificial Sequence
  chemically synthesized
attgccttttaaaatactagtt

SEQ ID NO: 1313058 - DNA, 22 bp, Artificial Sequence
  chemically synthesized
ttgccttttaaaatactagttg

SEQ ID NO: 1313059 - DNA, 22 bp, Artificial Sequence
  chemically synthesized
tcatttcattgtgcaactagta

SEQ ID NO: 1313060 - DNA, 22 bp, Artificial Sequence
  chemically synthesized
gtcatttcattgtgcaactagt

SEQ ID NO: 1313061 - DNA, 22 bp, Artificial Sequence
  chemically synthesized
ccttttaaaatactagttgcac

SEQ ID NO: 1313062 - DNA, 22 bp, Artificial Sequence
  chemically synthesized
ttaaaatactagttgcacaatg

SEQ ID NO: 1313063 - DNA, 22 bp, Artificial Sequence
  chemically synthesized
taaaatactagttgcacaatga

SEQ ID NO: 1313064 - DNA, 22 bp, Artificial Sequence
  chemically synthesized
aaaatactagttgcacaatgaa

SEQ ID NO: 1313065 - DNA, 22 bp, Artificial Sequence
  chemically synthesized
aaatactagttgcacaatgaaa

SEQ ID NO: 1313066 - DNA, 22 bp, Artificial Sequence
  chemically synthesized
gcagaatttgtcatttcattgt

SEQ ID NO: 1313067 - DNA, 22 bp, Artificial Sequence
  chemically synthesized
gttgcacaatgaaatgacaaat

SEQ ID NO: 1313068 - DNA, 22 bp, Artificial Sequence
  chemically synthesized
cacaatgaaatgacaaattctg

SEQ ID NO: 1313069 - DNA, 22 bp, Artificial Sequence
  chemically synthesized
ggaatagtatgtaaattggcag

SEQ ID NO: 1313070 - DNA, 22 bp, Artificial Sequence
  chemically synthesized
tgccaatttacatactattcct

SEQ ID NO: 1313071 - DNA, 22 bp, Artificial Sequence
  chemically synthesized
aaagaatgacactaggaatagt

SEQ ID NO: 1313072 - DNA, 22 bp, Artificial Sequence
  chemically synthesized
ccaatttacatactattcctag

SEQ ID NO: 1313073 - DNA, 22 bp, Artificial Sequence
  chemically synthesized
acatactattcctagtgtcatt

SEQ ID NO: 1313074 - DNA, 22 bp, Artificial Sequence
  chemically synthesized
aaaaattgaaagaatgacacta

SEQ ID NO: 1313075 - DNA, 22 bp, Artificial Sequence
  chemically synthesized
catactattcctagtgtcattc

SEQ ID NO: 1313076 - DNA, 22 bp, Artificial Sequence
  chemically synthesized
gttgaaaaattgaaagaatgac

SEQ ID NO: 1313077 - DNA, 22 bp, Artificial Sequence
  chemically synthesized
tggttgaaaaattgaaagaatg

SEQ ID NO: 1313078 - DNA, 22 bp, Artificial Sequence
  chemically synthesized
ttcctagtgtcattctttcaat

SEQ ID NO: 1313079 - DNA, 22 bp, Artificial Sequence
  chemically synthesized
ctagtgtcattctttcaatttt

SEQ ID NO: 1313080 - DNA, 22 bp, Artificial Sequence
  chemically synthesized
gtgtcattctttcaatttttca

SEQ ID NO: 1313081 - DNA, 22 bp, Artificial Sequence
  chemically synthesized
tgtatatgaattctggttgaaa

SEQ ID NO: 1313082 - DNA, 22 bp, Artificial Sequence
  chemically synthesized
tgtgtatatgaattctggttga

SEQ ID NO: 1313083 - DNA, 22 bp, Artificial Sequence
  chemically synthesized
ctgtgtatatgaattctggttg

SEQ ID NO: 1313084 - DNA, 22 bp, Artificial Sequence
  chemically synthesized
tttcaatttttcaaccagaatt

SEQ ID NO: 1313085 - DNA, 22 bp, Artificial Sequence
  chemically synthesized
tctgtgtatatgaattctggtt

SEQ ID NO: 1313086 - DNA, 22 bp, Artificial Sequence
  chemically synthesized
tcaatttttcaaccagaattca

SEQ ID NO: 1313087 - DNA, 22 bp, Artificial Sequence
  chemically synthesized
caatttttcaaccagaattcat

SEQ ID NO: 1313088 - DNA, 22 bp, Artificial Sequence
  chemically synthesized
aatttttcaaccagaattcata

SEQ ID NO: 1313089 - DNA, 22 bp, Artificial Sequence
  chemically synthesized
ttcaaccagaattcatatacac

SEQ ID NO: 1313090 - DNA, 22 bp, Artificial Sequence
  chemically synthesized
tcaaccagaattcatatacaca

SEQ ID NO: 1313091 - DNA, 22 bp, Artificial Sequence
  chemically synthesized
caaccagaattcatatacacag

SEQ ID NO: 1313092 - DNA, 22 bp, Artificial Sequence
  chemically synthesized
aaccagaattcatatacacaga

SEQ ID NO: 1313093 - DNA, 22 bp, Artificial Sequence
  chemically synthesized
aggaaacaagaaaagcatgttt

SEQ ID NO: 1313094 - DNA, 22 bp, Artificial Sequence
  chemically synthesized
atatacacagaaaacatgcttt

SEQ ID NO: 1313095 - DNA, 22 bp, Artificial Sequence
  chemically synthesized
aaggaactcaggaaacaagaaa

SEQ ID NO: 1313096 - DNA, 22 bp, Artificial Sequence
  chemically synthesized
gaaggaactcaggaaacaagaa

SEQ ID NO: 1313097 - DNA, 22 bp, Artificial Sequence
  chemically synthesized
cttgaaggaactcaggaaacaa

SEQ ID NO: 1313098 - DNA, 22 bp, Artificial Sequence
  chemically synthesized
gcttgaaggaactcaggaaaca

SEQ ID NO: 1313099 - DNA, 22 bp, Artificial Sequence
  chemically synthesized
tgcttgaaggaactcaggaaac

SEQ ID NO: 1313100 - DNA, 22 bp, Artificial Sequence
  chemically synthesized
tgttttgcttgaaggaactcag

SEQ ID NO: 1313101 - DNA, 22 bp, Artificial Sequence
  chemically synthesized
ttcttgtttcctgagttccttc

SEQ ID NO: 1313102 - DNA, 22 bp, Artificial Sequence
  chemically synthesized
tcttgtttcctgagttccttca

SEQ ID NO: 1313103 - DNA, 22 bp, Artificial Sequence
  chemically synthesized
cttgtttcctgagttccttcaa

SEQ ID NO: 1313104 - DNA, 22 bp, Artificial Sequence
  chemically synthesized
ttgtttcctgagttccttcaag

SEQ ID NO: 1313105 - DNA, 22 bp, Artificial Sequence
  chemically synthesized
gtttcctgagttccttcaagca

SEQ ID NO: 1313106 - DNA, 22 bp, Artificial Sequence
  chemically synthesized
tttcctgagttccttcaagcaa

SEQ ID NO: 1313107 - DNA, 22 bp, Artificial Sequence
  chemically synthesized
tagaattatgttttgcttgaag

SEQ ID NO: 1313108 - DNA, 22 bp, Artificial Sequence
  chemically synthesized
cctgagttccttcaagcaaaac

SEQ ID NO: 1313109 - DNA, 22 bp, Artificial Sequence
  chemically synthesized
ctgagttccttcaagcaaaaca

SEQ ID NO: 1313110 - DNA, 22 bp, Artificial Sequence
  chemically synthesized
attatagaattatgttttgctt

SEQ ID NO: 1313111 - DNA, 22 bp, Artificial Sequence
  chemically synthesized
agttccttcaagcaaaacataa

SEQ ID NO: 1313112 - DNA, 22 bp, Artificial Sequence
  chemically synthesized
ctcattatagaattatgttttg

SEQ ID NO: 1313113 - DNA, 22 bp, Artificial Sequence
  chemically synthesized
cttcaagcaaaacataattcta

SEQ ID NO: 1313114 - DNA, 22 bp, Artificial Sequence
  chemically synthesized
taattgctcattatagaattat

SEQ ID NO: 1313115 - DNA, 22 bp, Artificial Sequence
  chemically synthesized
caagcaaaacataattctataa

SEQ ID NO: 1313116 - DNA, 22 bp, Artificial Sequence
  chemically synthesized
aagcaaaacataattctataat

SEQ ID NO: 1313117 - DNA, 22 bp, Artificial Sequence
  chemically synthesized
ggctataattgctcattataga

SEQ ID NO: 1313118 - DNA, 22 bp, Artificial Sequence
  chemically synthesized
tataatgagcaattatagccta

SEQ ID NO: 1313119 - DNA, 22 bp, Artificial Sequence
  chemically synthesized
taatgagcaattatagcctaac

SEQ ID NO: 1313120 - DNA, 22 bp, Artificial Sequence
  chemically synthesized
atagcagcaggtgttaggctat

SEQ ID NO: 1313121 - DNA, 22 bp, Artificial Sequence
  chemically synthesized
catagcagcaggtgttaggcta

SEQ ID NO: 1313122 - DNA, 22 bp, Artificial Sequence
  chemically synthesized
ttcatagcagcaggtgttaggc

SEQ ID NO: 1313123 - DNA, 22 bp, Artificial Sequence
  chemically synthesized
tagcctaacacctgctgctatg

SEQ ID NO: 1313124 - DNA, 22 bp, Artificial Sequence
  chemically synthesized
acaaggtcctcttcatagcagc

SEQ ID NO: 1313125 - DNA, 22 bp, Artificial Sequence
  chemically synthesized
acacctgctgctatgaagagga

SEQ ID NO: 1313126 - DNA, 22 bp, Artificial Sequence
  chemically synthesized
gatagatgttgacaaggtcctc

SEQ ID NO: 1313127 - DNA, 22 bp, Artificial Sequence
  chemically synthesized
agatagatgttgacaaggtcct

SEQ ID NO: 1313128 - DNA, 22 bp, Artificial Sequence
  chemically synthesized
ctgctatgaagaggaccttgtc

SEQ ID NO: 1313129 - DNA, 22 bp, Artificial Sequence
  chemically synthesized
ctatgaagaggaccttgtcaac

SEQ ID NO: 1313130 - DNA, 22 bp, Artificial Sequence
  chemically synthesized
aatttagatagatgttgacaag

SEQ ID NO: 1313131 - DNA, 22 bp, Artificial Sequence
  chemically synthesized
caatttagatagatgttgacaa

SEQ ID NO: 1313132 - DNA, 22 bp, Artificial Sequence
  chemically synthesized
tgaagaggaccttgtcaacatc

SEQ ID NO: 1313133 - DNA, 22 bp, Artificial Sequence
  chemically synthesized
ttcaatttagatagatgttgac

SEQ ID NO: 1313134 - DNA, 22 bp, Artificial Sequence
  chemically synthesized
ttcttcaatttagatagatgtt

SEQ ID NO: 1313135 - DNA, 22 bp, Artificial Sequence
  chemically synthesized
ttgttcttcaatttagatagat

SEQ ID NO: 1313136 - DNA, 22 bp, Artificial Sequence
  chemically synthesized
gtcaacatctatctaaattgaa

SEQ ID NO: 1313137 - DNA, 22 bp, Artificial Sequence
  chemically synthesized
tcaacatctatctaaattgaag

SEQ ID NO: 1313138 - DNA, 22 bp, Artificial Sequence
  chemically synthesized
tctaaattgaagaacaacagca

SEQ ID NO: 1313139 - DNA, 22 bp, Artificial Sequence
  chemically synthesized
ccaaaatcaaggaatgctgttg

SEQ ID NO: 1313140 - DNA, 22 bp, Artificial Sequence
  chemically synthesized
cccaaaatcaaggaatgctgtt

SEQ ID NO: 1313141 - DNA, 22 bp, Artificial Sequence
  chemically synthesized
aattgaagaacaacagcattcc

SEQ ID NO: 1313142 - DNA, 22 bp, Artificial Sequence
  chemically synthesized
tcccaaaatcaaggaatgctgt

SEQ ID NO: 1313143 - DNA, 22 bp, Artificial Sequence
  chemically synthesized
attttcccaaaatcaaggaatg

SEQ ID NO: 1313144 - DNA, 22 bp, Artificial Sequence
  chemically synthesized
aagaacaacagcattccttgat

SEQ ID NO: 1313145 - DNA, 22 bp, Artificial Sequence
  chemically synthesized
ctcattttcccaaaatcaagga

SEQ ID NO: 1313146 - DNA, 22 bp, Artificial Sequence
  chemically synthesized
ttgctcattttcccaaaatcaa

SEQ ID NO: 1313147 - DNA, 22 bp, Artificial Sequence
  chemically synthesized
attgctcattttcccaaaatca

SEQ ID NO: 1313148 - DNA, 22 bp, Artificial Sequence
  chemically synthesized
gtttattgctcattttcccaaa

SEQ ID NO: 1313149 - DNA, 22 bp, Artificial Sequence
  chemically synthesized
cgtttattgctcattttcccaa

SEQ ID NO: 1313150 - DNA, 22 bp, Artificial Sequence
  chemically synthesized
cttgattttgggaaaatgagca

SEQ ID NO: 1313151 - DNA, 22 bp, Artificial Sequence
  chemically synthesized
gattttgggaaaatgagcaata

SEQ ID NO: 1313152 - DNA, 22 bp, Artificial Sequence
  chemically synthesized
attttgggaaaatgagcaataa

SEQ ID NO: 1313153 - DNA, 22 bp, Artificial Sequence
  chemically synthesized
agaaatggacttcgtttattgc

SEQ ID NO: 1313154 - DNA, 22 bp, Artificial Sequence
  chemically synthesized
tgggaaaatgagcaataaacga

SEQ ID NO: 1313155 - DNA, 22 bp, Artificial Sequence
  chemically synthesized
gggaaaatgagcaataaacgaa

SEQ ID NO: 1313156 - DNA, 22 bp, Artificial Sequence
  chemically synthesized
ggaaaatgagcaataaacgaag

SEQ ID NO: 1313157 - DNA, 22 bp, Artificial Sequence
  chemically synthesized
ctaagaaatggacttcgtttat

SEQ ID NO: 1313158 - DNA, 22 bp, Artificial Sequence
  chemically synthesized
tgctaagaaatggacttcgttt

SEQ ID NO: 1313159 - DNA, 22 bp, Artificial Sequence
  chemically synthesized
ctgctaagaaatggacttcgtt

SEQ ID NO: 1313160 - DNA, 22 bp, Artificial Sequence
  chemically synthesized
tctgctaagaaatggacttcgt

SEQ ID NO: 1313161 - DNA, 22 bp, Artificial Sequence
  chemically synthesized
ttctgctaagaaatggacttcg

SEQ ID NO: 1313162 - DNA, 22 bp, Artificial Sequence
  chemically synthesized
tgagtttttctgctaagaaatg

SEQ ID NO: 1313163 - DNA, 22 bp, Artificial Sequence
  chemically synthesized
cctatgagtttttctgctaaga

SEQ ID NO: 1313164 - DNA, 22 bp, Artificial Sequence
  chemically synthesized
gaatacattgcctatgagtttt

SEQ ID NO: 1313165 - DNA, 22 bp, Artificial Sequence
  chemically synthesized
ggaatacattgcctatgagttt

SEQ ID NO: 1313166 - DNA, 22 bp, Artificial Sequence
  chemically synthesized
cttagcagaaaaactcataggc

SEQ ID NO: 1313167 - DNA, 22 bp, Artificial Sequence
  chemically synthesized
ttagcagaaaaactcataggca

SEQ ID NO: 1313168 - DNA, 22 bp, Artificial Sequence
  chemically synthesized
ccttggaatacattgcctatga

SEQ ID NO: 1313169 - DNA, 22 bp, Artificial Sequence
  chemically synthesized
agcagaaaaactcataggcaat

SEQ ID NO: 1313170 - DNA, 22 bp, Artificial Sequence
  chemically synthesized
gcagaaaaactcataggcaatg

SEQ ID NO: 1313171 - DNA, 22 bp, Artificial Sequence
  chemically synthesized
tgagctaccttggaatacattg

SEQ ID NO: 1313172 - DNA, 22 bp, Artificial Sequence
  chemically synthesized
tgtgagctaccttggaatacat

SEQ ID NO: 1313173 - DNA, 22 bp, Artificial Sequence
  chemically synthesized
ttctgtgagctaccttggaata

SEQ ID NO: 1313174 - DNA, 22 bp, Artificial Sequence
  chemically synthesized
ataggcaatgtattccaaggta

SEQ ID NO: 1313175 - DNA, 22 bp, Artificial Sequence
  chemically synthesized
attattctgtgagctaccttgg

SEQ ID NO: 1313176 - DNA, 22 bp, Artificial Sequence
  chemically synthesized
aatcctgattattctgtgagct

SEQ ID NO: 1313177 - DNA, 22 bp, Artificial Sequence
  chemically synthesized
ttaaatcctgattattctgtga

SEQ ID NO: 1313178 - DNA, 22 bp, Artificial Sequence
  chemically synthesized
tattaaatcctgattattctgt

SEQ ID NO: 1313179 - DNA, 22 bp, Artificial Sequence
  chemically synthesized
caaggtagctcacagaataatc

SEQ ID NO: 1313180 - DNA, 22 bp, Artificial Sequence
  chemically synthesized
attctattaaatcctgattatt

SEQ ID NO: 1313181 - DNA, 22 bp, Artificial Sequence
  chemically synthesized
acagaataatcaggatttaata

SEQ ID NO: 1313182 - DNA, 22 bp, Artificial Sequence
  chemically synthesized
aaatgatggtaaaaaatctaat

SEQ ID NO: 1313183 - DNA, 22 bp, Artificial Sequence
  chemically synthesized
tcaaatgatggtaaaaaatcta

SEQ ID NO: 1313184 - DNA, 22 bp, Artificial Sequence
  chemically synthesized
tctcaaatgatggtaaaaaatc

SEQ ID NO: 1313185 - DNA, 22 bp, Artificial Sequence
  chemically synthesized
ctctcaaatgatggtaaaaaat

SEQ ID NO: 1313186 - DNA, 22 bp, Artificial Sequence
  chemically synthesized
aatagaattagattttttacca

SEQ ID NO: 1313187 - DNA, 22 bp, Artificial Sequence
  chemically synthesized
tctctcaaatgatggtaaaaaa

SEQ ID NO: 1313188 - DNA, 22 bp, Artificial Sequence
  chemically synthesized
atagaattagattttttaccat

SEQ ID NO: 1313189 - DNA, 22 bp, Artificial Sequence
  chemically synthesized
gattttttaccatcatttgaga

SEQ ID NO: 1313190 - DNA, 22 bp, Artificial Sequence
  chemically synthesized
tttaccatcatttgagagaaag

SEQ ID NO: 1313191 - DNA, 22 bp, Artificial Sequence
  chemically synthesized
ttaccatcatttgagagaaagt

SEQ ID NO: 1313192 - DNA, 22 bp, Artificial Sequence
  chemically synthesized
gcccagagcaaaactttctctc

SEQ ID NO: 1313193 - DNA, 22 bp, Artificial Sequence
  chemically synthesized
taccatcatttgagagaaagtt

SEQ ID NO: 1313194 - DNA, 22 bp, Artificial Sequence
  chemically synthesized
agcccagagcaaaactttctct

SEQ ID NO: 1313195 - DNA, 22 bp, Artificial Sequence
  chemically synthesized
accatcatttgagagaaagttt

SEQ ID NO: 1313196 - DNA, 22 bp, Artificial Sequence
  chemically synthesized
ccatcatttgagagaaagtttt

SEQ ID NO: 1313197 - DNA, 22 bp, Artificial Sequence
  chemically synthesized
gagagaaagttttgctctgggc

SEQ ID NO: 1313198 - DNA, 22 bp, Artificial Sequence
  chemically synthesized
agagaaagttttgctctgggct

SEQ ID NO: 1313199 - DNA, 22 bp, Artificial Sequence
  chemically synthesized
accataatacttagcccagagc

SEQ ID NO: 1313200 - DNA, 22 bp, Artificial Sequence
  chemically synthesized
aaccataatacttagcccagag

SEQ ID NO: 1313201 - DNA, 22 bp, Artificial Sequence
  chemically synthesized
cttaaccataatacttagccca

SEQ ID NO: 1313202 - DNA, 22 bp, Artificial Sequence
  chemically synthesized
gattccttaaccataatactta

SEQ ID NO: 1313203 - DNA, 22 bp, Artificial Sequence
  chemically synthesized
ggattccttaaccataatactt

SEQ ID NO: 1313204 - DNA, 22 bp, Artificial Sequence
  chemically synthesized
tgctctgggctaagtattatgg

SEQ ID NO: 1313205 - DNA, 22 bp, Artificial Sequence
  chemically synthesized
gctctgggctaagtattatggt

SEQ ID NO: 1313206 - DNA, 22 bp, Artificial Sequence
  chemically synthesized
ttggattccttaaccataatac

SEQ ID NO: 1313207 - DNA, 22 bp, Artificial Sequence
  chemically synthesized
ctctgggctaagtattatggtt

SEQ ID NO: 1313208 - DNA, 22 bp, Artificial Sequence
  chemically synthesized
cttggattccttaaccataata

SEQ ID NO: 1313209 - DNA, 22 bp, Artificial Sequence
  chemically synthesized
tcttggattccttaaccataat

SEQ ID NO: 1313210 - DNA, 22 bp, Artificial Sequence
  chemically synthesized
ttcttggattccttaaccataa

SEQ ID NO: 1313211 - DNA, 22 bp, Artificial Sequence
  chemically synthesized
tgggctaagtattatggttaag

SEQ ID NO: 1313212 - DNA, 22 bp, Artificial Sequence
  chemically synthesized
ggctaagtattatggttaagga

SEQ ID NO: 1313213 - DNA, 22 bp, Artificial Sequence
  chemically synthesized
gtgtttttcttggattccttaa

SEQ ID NO: 1313214 - DNA, 22 bp, Artificial Sequence
  chemically synthesized
agtgtttttcttggattcctta

SEQ ID NO: 1313215 - DNA, 22 bp, Artificial Sequence
  chemically synthesized
agtattatggttaaggaatcca

SEQ ID NO: 1313216 - DNA, 22 bp, Artificial Sequence
  chemically synthesized
tagtgtttttcttggattcctt

SEQ ID NO: 1313217 - DNA, 22 bp, Artificial Sequence
  chemically synthesized
tggttaaggaatccaagaaaaa

SEQ ID NO: 1313218 - DNA, 22 bp, Artificial Sequence
  chemically synthesized
aggaatccaagaaaaacactaa

SEQ ID NO: 1313219 - DNA, 22 bp, Artificial Sequence
  chemically synthesized
taagggatccaggaattttagt

SEQ ID NO: 1313220 - DNA, 22 bp, Artificial Sequence
  chemically synthesized
cctgtaagggatccaggaattt

SEQ ID NO: 1313221 - DNA, 22 bp, Artificial Sequence
  chemically synthesized
agtaaatattgcctgtaaggga

SEQ ID NO: 1313222 - DNA, 22 bp, Artificial Sequence
  chemically synthesized
aaattcctggatcccttacagg

SEQ ID NO: 1313223 - DNA, 22 bp, Artificial Sequence
  chemically synthesized
aagtaaatattgcctgtaaggg

SEQ ID NO: 1313224 - DNA, 22 bp, Artificial Sequence
  chemically synthesized
taagtaaatattgcctgtaagg

SEQ ID NO: 1313225 - DNA, 22 bp, Artificial Sequence
  chemically synthesized
ttttaagtaaatattgcctgta

SEQ ID NO: 1313226 - DNA, 22 bp, Artificial Sequence
  chemically synthesized
attttaagtaaatattgcctgt

SEQ ID NO: 1313227 - DNA, 22 bp, Artificial Sequence
  chemically synthesized
ctggatcccttacaggcaatat

SEQ ID NO: 1313228 - DNA, 22 bp, Artificial Sequence
  chemically synthesized
tattttaagtaaatattgcctg

SEQ ID NO: 1313229 - DNA, 22 bp, Artificial Sequence
  chemically synthesized
gatcccttacaggcaatattta

SEQ ID NO: 1313230 - DNA, 22 bp, Artificial Sequence
  chemically synthesized
tggatggttttattttaagtaa

SEQ ID NO: 1313231 - DNA, 22 bp, Artificial Sequence
  chemically synthesized
acaggcaatatttacttaaaat

SEQ ID NO: 1313232 - DNA, 22 bp, Artificial Sequence
  chemically synthesized
atggatggttttattttaagta

SEQ ID NO: 1313233 - DNA, 22 bp, Artificial Sequence
  chemically synthesized
caggcaatatttacttaaaata

SEQ ID NO: 1313234 - DNA, 22 bp, Artificial Sequence
  chemically synthesized
tatggatggttttattttaagt

SEQ ID NO: 1313235 - DNA, 22 bp, Artificial Sequence
  chemically synthesized
ttatggatggttttattttaag

SEQ ID NO: 1313236 - DNA, 22 bp, Artificial Sequence
  chemically synthesized
acttaaaataaaaccatccata

SEQ ID NO: 1313237 - DNA, 22 bp, Artificial Sequence
  chemically synthesized
cttaaaataaaaccatccataa

SEQ ID NO: 1313238 - DNA, 22 bp, Artificial Sequence
  chemically synthesized
aaaataaaaccatccataaaag

SEQ ID NO: 1313239 - DNA, 22 bp, Artificial Sequence
  chemically synthesized
aaataaaaccatccataaaagt

SEQ ID NO: 1313240 - DNA, 22 bp, Artificial Sequence
  chemically synthesized
tagtagagaaggacttttatgg

SEQ ID NO: 1313241 - DNA, 22 bp, Artificial Sequence
  chemically synthesized
ataagaaaaacaggaagagata

SEQ ID NO: 1313242 - DNA, 22 bp, Artificial Sequence
  chemically synthesized
ctctactatagtatctcttcct

SEQ ID NO: 1313243 - DNA, 22 bp, Artificial Sequence
  chemically synthesized
cataagaaaaacaggaagagat

SEQ ID NO: 1313244 - DNA, 22 bp, Artificial Sequence
  chemically synthesized
tctactatagtatctcttcctg

SEQ ID NO: 1313245 - DNA, 22 bp, Artificial Sequence
  chemically synthesized
tactatagtatctcttcctgtt

SEQ ID NO: 1313246 - DNA, 22 bp, Artificial Sequence
  chemically synthesized
tttcataagaaaaacaggaaga

SEQ ID NO: 1313247 - DNA, 22 bp, Artificial Sequence
  chemically synthesized
gtttcataagaaaaacaggaag

SEQ ID NO: 1313248 - DNA, 22 bp, Artificial Sequence
  chemically synthesized
ctatagtatctcttcctgtttt

SEQ ID NO: 1313249 - DNA, 22 bp, Artificial Sequence
  chemically synthesized
ttgtttcataagaaaaacagga

SEQ ID NO: 1313250 - DNA, 22 bp, Artificial Sequence
  chemically synthesized
tagtatctcttcctgtttttct

SEQ ID NO: 1313251 - DNA, 22 bp, Artificial Sequence
  chemically synthesized
agcagagttcttgtttcataag

SEQ ID NO: 1313252 - DNA, 22 bp, Artificial Sequence
  chemically synthesized
ttcctgtttttcttatgaaaca

SEQ ID NO: 1313253 - DNA, 22 bp, Artificial Sequence
  chemically synthesized
gagcagagttcttgtttcataa

SEQ ID NO: 1313254 - DNA, 22 bp, Artificial Sequence
  chemically synthesized
cctgtttttcttatgaaacaag

SEQ ID NO: 1313255 - DNA, 22 bp, Artificial Sequence
  chemically synthesized
ctgtttttcttatgaaacaaga

SEQ ID NO: 1313256 - DNA, 22 bp, Artificial Sequence
  chemically synthesized
agcttgagcagagttcttgttt

SEQ ID NO: 1313257 - DNA, 22 bp, Artificial Sequence
  chemically synthesized
tttttcttatgaaacaagaact

SEQ ID NO: 1313258 - DNA, 22 bp, Artificial Sequence
  chemically synthesized
cagcttgagcagagttcttgtt

SEQ ID NO: 1313259 - DNA, 22 bp, Artificial Sequence
  chemically synthesized
tcagcttgagcagagttcttgt

SEQ ID NO: 1313260 - DNA, 22 bp, Artificial Sequence
  chemically synthesized
ttcttatgaaacaagaactctg

SEQ ID NO: 1313261 - DNA, 22 bp, Artificial Sequence
  chemically synthesized
tcttatgaaacaagaactctgc

SEQ ID NO: 1313262 - DNA, 22 bp, Artificial Sequence
  chemically synthesized
cttatgaaacaagaactctgct

SEQ ID NO: 1313263 - DNA, 22 bp, Artificial Sequence
  chemically synthesized
cctttcagcttgagcagagttc

SEQ ID NO: 1313264 - DNA, 22 bp, Artificial Sequence
  chemically synthesized
ttatgaaacaagaactctgctc

SEQ ID NO: 1313265 - DNA, 22 bp, Artificial Sequence
  chemically synthesized
acctttcagcttgagcagagtt

SEQ ID NO: 1313266 - DNA, 22 bp, Artificial Sequence
  chemically synthesized
atgaaacaagaactctgctcaa

SEQ ID NO: 1313267 - DNA, 22 bp, Artificial Sequence
  chemically synthesized
tgaaacaagaactctgctcaag

SEQ ID NO: 1313268 - DNA, 22 bp, Artificial Sequence
  chemically synthesized
tttacctttcagcttgagcaga

SEQ ID NO: 1313269 - DNA, 22 bp, Artificial Sequence
  chemically synthesized
gtttacctttcagcttgagcag

SEQ ID NO: 1313270 - DNA, 22 bp, Artificial Sequence
  chemically synthesized
tccgatttgtttacctttcagc

SEQ ID NO: 1313271 - DNA, 22 bp, Artificial Sequence
  chemically synthesized
tatccgatttgtttacctttca

SEQ ID NO: 1313272 - DNA, 22 bp, Artificial Sequence
  chemically synthesized
ctatccgatttgtttacctttc

SEQ ID NO: 1313273 - DNA, 22 bp, Artificial Sequence
  chemically synthesized
tgctcaagctgaaaggtaaaca

SEQ ID NO: 1313274 - DNA, 22 bp, Artificial Sequence
  chemically synthesized
ctcaagctgaaaggtaaacaaa

SEQ ID NO: 1313275 - DNA, 22 bp, Artificial Sequence
  chemically synthesized
aagctgaaaggtaaacaaatcg

SEQ ID NO: 1313276 - DNA, 22 bp, Artificial Sequence
  chemically synthesized
aaatgatgcttctatccgattt

SEQ ID NO: 1313277 - DNA, 22 bp, Artificial Sequence
  chemically synthesized
aaaggtaaacaaatcggataga

SEQ ID NO: 1313278 - DNA, 22 bp, Artificial Sequence
  chemically synthesized
agctcaaatgatgcttctatcc

SEQ ID NO: 1313279 - DNA, 22 bp, Artificial Sequence
  chemically synthesized
gagctcaaatgatgcttctatc

SEQ ID NO: 1313280 - DNA, 22 bp, Artificial Sequence
  chemically synthesized
atatggcttgagctcaaatgat

SEQ ID NO: 1313281 - DNA, 22 bp, Artificial Sequence
  chemically synthesized
ttgatatggcttgagctcaaat

SEQ ID NO: 1313282 - DNA, 22 bp, Artificial Sequence
  chemically synthesized
gagctcaagccatatcaacaat

SEQ ID NO: 1313283 - DNA, 22 bp, Artificial Sequence
  chemically synthesized
agctcaagccatatcaacaatc

SEQ ID NO: 1313284 - DNA, 22 bp, Artificial Sequence
  chemically synthesized
aagccatatcaacaatcttgtg

SEQ ID NO: 1313285 - DNA, 22 bp, Artificial Sequence
  chemically synthesized
gcaatgtaaatccacaagattg

SEQ ID NO: 1313286 - DNA, 22 bp, Artificial Sequence
  chemically synthesized
ctggcaatgtaaatccacaaga

SEQ ID NO: 1313287 - DNA, 22 bp, Artificial Sequence
  chemically synthesized
cctggcaatgtaaatccacaag

SEQ ID NO: 1313288 - DNA, 22 bp, Artificial Sequence
  chemically synthesized
aaaaaagatttcctggcaatgt

SEQ ID NO: 1313289 - DNA, 22 bp, Artificial Sequence
  chemically synthesized
gaaaaaagatttcctggcaatg

SEQ ID NO: 1313290 - DNA, 22 bp, Artificial Sequence
  chemically synthesized
tgaaaaaagatttcctggcaat

SEQ ID NO: 1313291 - DNA, 22 bp, Artificial Sequence
  chemically synthesized
gtggatttacattgccaggaaa

SEQ ID NO: 1313292 - DNA, 22 bp, Artificial Sequence
  chemically synthesized
tggatttacattgccaggaaat

SEQ ID NO: 1313293 - DNA, 22 bp, Artificial Sequence
  chemically synthesized
acattgccaggaaatctttttt

SEQ ID NO: 1313294 - DNA, 22 bp, Artificial Sequence
  chemically synthesized
cattgccaggaaatcttttttc

SEQ ID NO: 1313295 - DNA, 22 bp, Artificial Sequence
  chemically synthesized
tcccggcataattttgaaaaaa

SEQ ID NO: 1313296 - DNA, 22 bp, Artificial Sequence
  chemically synthesized
ccaggaaatcttttttcaaaat

SEQ ID NO: 1313297 - DNA, 22 bp, Artificial Sequence
  chemically synthesized
atgtaattatcccggcataatt

SEQ ID NO: 1313298 - DNA, 22 bp, Artificial Sequence
  chemically synthesized
ttgatgtaattatcccggcata

SEQ ID NO: 1313299 - DNA, 22 bp, Artificial Sequence
  chemically synthesized
gttgatgtaattatcccggcat

SEQ ID NO: 1313300 - DNA, 22 bp, Artificial Sequence
  chemically synthesized
ttttcaaaattatgccgggata

SEQ ID NO: 1313301 - DNA, 22 bp, Artificial Sequence
  chemically synthesized
tgttgatgtaattatcccggca

SEQ ID NO: 1313302 - DNA, 22 bp, Artificial Sequence
  chemically synthesized
tttcaaaattatgccgggataa

SEQ ID NO: 1313303 - DNA, 22 bp, Artificial Sequence
  chemically synthesized
ttgttgatgtaattatcccggc

SEQ ID NO: 1313304 - DNA, 22 bp, Artificial Sequence
  chemically synthesized
ttcaaaattatgccgggataat

SEQ ID NO: 1313305 - DNA, 22 bp, Artificial Sequence
  chemically synthesized
tcaaaattatgccgggataatt

SEQ ID NO: 1313306 - DNA, 22 bp, Artificial Sequence
  chemically synthesized
caaaattatgccgggataatta

SEQ ID NO: 1313307 - DNA, 22 bp, Artificial Sequence
  chemically synthesized
aaaattatgccgggataattac

SEQ ID NO: 1313308 - DNA, 22 bp, Artificial Sequence
  chemically synthesized
catttttgttgatgtaattatc

SEQ ID NO: 1313309 - DNA, 22 bp, Artificial Sequence
  chemically synthesized
cctccatttttgttgatgtaat

SEQ ID NO: 1313310 - DNA, 22 bp, Artificial Sequence
  chemically synthesized
tgccgggataattacatcaaca

SEQ ID NO: 1313311 - DNA, 22 bp, Artificial Sequence
  chemically synthesized
tgcctccatttttgttgatgta

SEQ ID NO: 1313312 - DNA, 22 bp, Artificial Sequence
  chemically synthesized
ctgcctccatttttgttgatgt

SEQ ID NO: 1313313 - DNA, 22 bp, Artificial Sequence
  chemically synthesized
taccaagatttctgcctccatt

SEQ ID NO: 1313314 - DNA, 22 bp, Artificial Sequence
  chemically synthesized
catcaacaaaaatggaggcaga

SEQ ID NO: 1313315 - DNA, 22 bp, Artificial Sequence
  chemically synthesized
atattataccaagatttctgcc

SEQ ID NO: 1313316 - DNA, 22 bp, Artificial Sequence
  chemically synthesized
gatattataccaagatttctgc

SEQ ID NO: 1313317 - DNA, 22 bp, Artificial Sequence
  chemically synthesized
tgatattataccaagatttctg

SEQ ID NO: 1313318 - DNA, 22 bp, Artificial Sequence
  chemically synthesized
ttgatattataccaagatttct

SEQ ID NO: 1313319 - DNA, 22 bp, Artificial Sequence
  chemically synthesized
tttgatattataccaagatttc

SEQ ID NO: 1313320 - DNA, 22 bp, Artificial Sequence
  chemically synthesized
ccccatctttttgatattatac

SEQ ID NO: 1313321 - DNA, 22 bp, Artificial Sequence
  chemically synthesized
cccccatctttttgatattata

SEQ ID NO: 1313322 - DNA, 22 bp, Artificial Sequence
  chemically synthesized
ttcccccatctttttgatatta

SEQ ID NO: 1313323 - DNA, 22 bp, Artificial Sequence
  chemically synthesized
ttcttcccccatctttttgata

SEQ ID NO: 1313324 - DNA, 22 bp, Artificial Sequence
  chemically synthesized
ggtataatatcaaaaagatggg

SEQ ID NO: 1313325 - DNA, 22 bp, Artificial Sequence
  chemically synthesized
gtataatatcaaaaagatgggg

SEQ ID NO: 1313326 - DNA, 22 bp, Artificial Sequence
  chemically synthesized
cagcaacctattcttcccccat

SEQ ID NO: 1313327 - DNA, 22 bp, Artificial Sequence
  chemically synthesized
ccagcaacctattcttccccca

SEQ ID NO: 1313328 - DNA, 22 bp, Artificial Sequence
  chemically synthesized
tccagcaacctattcttccccc

SEQ ID NO: 1313329 - DNA, 22 bp, Artificial Sequence
  chemically synthesized
ttccagcaacctattcttcccc

SEQ ID NO: 1313330 - DNA, 22 bp, Artificial Sequence
  chemically synthesized
tttccagcaacctattcttccc

SEQ ID NO: 1313331 - DNA, 22 bp, Artificial Sequence
  chemically synthesized
gcaggctttttccagcaaccta

SEQ ID NO: 1313332 - DNA, 22 bp, Artificial Sequence
  chemically synthesized
ctagcaggctttttccagcaac

SEQ ID NO: 1313333 - DNA, 22 bp, Artificial Sequence
  chemically synthesized
ggcaatctgctagcaggctttt

SEQ ID NO: 1313334 - DNA, 22 bp, Artificial Sequence
  chemically synthesized
taggcaatctgctagcaggctt

SEQ ID NO: 1313335 - DNA, 22 bp, Artificial Sequence
  chemically synthesized
ctaggcaatctgctagcaggct

SEQ ID NO: 1313336 - DNA, 22 bp, Artificial Sequence
  chemically synthesized
tctaggcaatctgctagcaggc

SEQ ID NO: 1313337 - DNA, 22 bp, Artificial Sequence
  chemically synthesized
tttctaggcaatctgctagcag

SEQ ID NO: 1313338 - DNA, 22 bp, Artificial Sequence
  chemically synthesized
ctggaaaaagcctgctagcaga

SEQ ID NO: 1313339 - DNA, 22 bp, Artificial Sequence
  chemically synthesized
ctttctaggcaatctgctagca

SEQ ID NO: 1313340 - DNA, 22 bp, Artificial Sequence
  chemically synthesized
tctttctaggcaatctgctagc

SEQ ID NO: 1313341 - DNA, 22 bp, Artificial Sequence
  chemically synthesized
ttctttctaggcaatctgctag

SEQ ID NO: 1313342 - DNA, 22 bp, Artificial Sequence
  chemically synthesized
gaaaaagcctgctagcagattg

SEQ ID NO: 1313343 - DNA, 22 bp, Artificial Sequence
  chemically synthesized
atttttctttctaggcaatctg

SEQ ID NO: 1313344 - DNA, 22 bp, Artificial Sequence
  chemically synthesized
catttttctttctaggcaatct

SEQ ID NO: 1313345 - DNA, 22 bp, Artificial Sequence
  chemically synthesized
ctagcagattgcctagaaagaa

SEQ ID NO: 1313346 - DNA, 22 bp, Artificial Sequence
  chemically synthesized
gaatggcttcatttttctttct

SEQ ID NO: 1313347 - DNA, 22 bp, Artificial Sequence
  chemically synthesized
gcagattgcctagaaagaaaaa

SEQ ID NO: 1313348 - DNA, 22 bp, Artificial Sequence
  chemically synthesized
acatattagaatggcttcattt

SEQ ID NO: 1313349 - DNA, 22 bp, Artificial Sequence
  chemically synthesized
cctagaaagaaaaatgaagcca

SEQ ID NO: 1313350 - DNA, 22 bp, Artificial Sequence
  chemically synthesized
aacatattagaatggcttcatt

SEQ ID NO: 1313351 - DNA, 22 bp, Artificial Sequence
  chemically synthesized
taacatattagaatggcttcat

SEQ ID NO: 1313352 - DNA, 22 bp, Artificial Sequence
  chemically synthesized
gaaagaaaaatgaagccattct

SEQ ID NO: 1313353 - DNA, 22 bp, Artificial Sequence
  chemically synthesized
gatgagattttaacatattaga

SEQ ID NO: 1313354 - DNA, 22 bp, Artificial Sequence
  chemically synthesized
agatgagattttaacatattag

SEQ ID NO: 1313355 - DNA, 22 bp, Artificial Sequence
  chemically synthesized
aatgtttagatgagattttaac

SEQ ID NO: 1313356 - DNA, 22 bp, Artificial Sequence
  chemically synthesized
caatgtttagatgagattttaa

SEQ ID NO: 1313357 - DNA, 22 bp, Artificial Sequence
  chemically synthesized
tttcaatgtttagatgagattt

SEQ ID NO: 1313358 - DNA, 22 bp, Artificial Sequence
  chemically synthesized
atttcaatgtttagatgagatt

SEQ ID NO: 1313359 - DNA, 22 bp, Artificial Sequence
  chemically synthesized
taatatgttaaaatctcatcta

SEQ ID NO: 1313360 - DNA, 22 bp, Artificial Sequence
  chemically synthesized
atatgttaaaatctcatctaaa

SEQ ID NO: 1313361 - DNA, 22 bp, Artificial Sequence
  chemically synthesized
aaatctcatctaaacattgaaa

SEQ ID NO: 1313362 - DNA, 22 bp, Artificial Sequence
  chemically synthesized
taagtgaataatcatttatttc

SEQ ID NO: 1313363 - DNA, 22 bp, Artificial Sequence
  chemically synthesized
atctaaacattgaaataaatga

SEQ ID NO: 1313364 - DNA, 22 bp, Artificial Sequence
  chemically synthesized
tgtaagtgaataatcatttatt

SEQ ID NO: 1313365 - DNA, 22 bp, Artificial Sequence
  chemically synthesized
ctctgtaagtgaataatcattt

SEQ ID NO: 1313366 - DNA, 22 bp, Artificial Sequence
  chemically synthesized
aacattgaaataaatgattatt

SEQ ID NO: 1313367 - DNA, 22 bp, Artificial Sequence
  chemically synthesized
actctgtaagtgaataatcatt

SEQ ID NO: 1313368 - DNA, 22 bp, Artificial Sequence
  chemically synthesized
tttactctgtaagtgaataatc

SEQ ID NO: 1313369 - DNA, 22 bp, Artificial Sequence
  chemically synthesized
aaataaatgattattcacttac

SEQ ID NO: 1313370 - DNA, 22 bp, Artificial Sequence
  chemically synthesized
aacatatctgtttactctgtaa

SEQ ID NO: 1313371 - DNA, 22 bp, Artificial Sequence
  chemically synthesized
aaacatatctgtttactctgta

SEQ ID NO: 1313372 - DNA, 22 bp, Artificial Sequence
  chemically synthesized
ttcacttacagagtaaacagat

SEQ ID NO: 1313373 - DNA, 22 bp, Artificial Sequence
  chemically synthesized
acttacagagtaaacagatatg

SEQ ID NO: 1313374 - DNA, 22 bp, Artificial Sequence
  chemically synthesized
acagagtaaacagatatgttta

SEQ ID NO: 1313375 - DNA, 22 bp, Artificial Sequence
  chemically synthesized
cagagtaaacagatatgtttaa

SEQ ID NO: 1313376 - DNA, 22 bp, Artificial Sequence
  chemically synthesized
cgtaaaaaaatacacttaaaca

SEQ ID NO: 1313377 - DNA, 22 bp, Artificial Sequence
  chemically synthesized
aagtgtatttttttacgtagtc

SEQ ID NO: 1313378 - DNA, 22 bp, Artificial Sequence
  chemically synthesized
agtgtatttttttacgtagtca

SEQ ID NO: 1313379 - DNA, 22 bp, Artificial Sequence
  chemically synthesized
ttttacgtagtcacatgtatat

SEQ ID NO: 1313380 - DNA, 22 bp, Artificial Sequence
  chemically synthesized
tttacgtagtcacatgtatata

SEQ ID NO: 1313381 - DNA, 22 bp, Artificial Sequence
  chemically synthesized
ttacgtagtcacatgtatatat

SEQ ID NO: 1313382 - DNA, 22 bp, Artificial Sequence
  chemically synthesized
tacgtagtcacatgtatatatg

SEQ ID NO: 1313383 - DNA, 22 bp, Artificial Sequence
  chemically synthesized
acgtagtcacatgtatatatga

SEQ ID NO: 1313384 - DNA, 22 bp, Artificial Sequence
  chemically synthesized
cgtagtcacatgtatatatgat

SEQ ID NO: 1313385 - DNA, 22 bp, Artificial Sequence
  chemically synthesized
ctgtgtgcctatgtacacgcac

SEQ ID NO: 1313386 - DNA, 22 bp, Artificial Sequence
  chemically synthesized
tgtgtgcctatgtacacgcaca

SEQ ID NO: 1313387 - DNA, 22 bp, Artificial Sequence
  chemically synthesized
tgtgcctatgtacacgcacaca

SEQ ID NO: 1313388 - DNA, 22 bp, Artificial Sequence
  chemically synthesized
aagtgtgtgtatgtatgtgtgc

SEQ ID NO: 1313389 - DNA, 22 bp, Artificial Sequence
  chemically synthesized
tgtacacgcacacatacataca

SEQ ID NO: 1313390 - DNA, 22 bp, Artificial Sequence
  chemically synthesized
acgttcaagtgtgtgtatgtat

SEQ ID NO: 1313391 - DNA, 22 bp, Artificial Sequence
  chemically synthesized
atacgtacaagttgacgttcaa

SEQ ID NO: 1313392 - DNA, 22 bp, Artificial Sequence
  chemically synthesized
ttaatacgtacaagttgacgtt

SEQ ID NO: 1313393 - DNA, 22 bp, Artificial Sequence
  chemically synthesized
cactattaatacgtacaagttg

SEQ ID NO: 1313394 - DNA, 22 bp, Artificial Sequence
  chemically synthesized
ttgcactattaatacgtacaag

SEQ ID NO: 1313395 - DNA, 22 bp, Artificial Sequence
  chemically synthesized
attgcactattaatacgtacaa

SEQ ID NO: 1313396 - DNA, 22 bp, Artificial Sequence
  chemically synthesized
tattgcactattaatacgtaca

SEQ ID NO: 1313397 - DNA, 22 bp, Artificial Sequence
  chemically synthesized
gaacgtcaacttgtacgtatta

SEQ ID NO: 1313398 - DNA, 22 bp, Artificial Sequence
  chemically synthesized
ttattgcactattaatacgtac

SEQ ID NO: 1313399 - DNA, 22 bp, Artificial Sequence
  chemically synthesized
aacgtcaacttgtacgtattaa

SEQ ID NO: 1313400 - DNA, 22 bp, Artificial Sequence
  chemically synthesized
tttattgcactattaatacgta

SEQ ID NO: 1313401 - DNA, 22 bp, Artificial Sequence
  chemically synthesized
acaacattttttattgcactat

SEQ ID NO: 1313402 - DNA, 22 bp, Artificial Sequence
  chemically synthesized
gtacgtattaatagtgcaataa

SEQ ID NO: 1313403 - DNA, 22 bp, Artificial Sequence
  chemically synthesized
tacgtattaatagtgcaataaa

SEQ ID NO: 1313404 - DNA, 22 bp, Artificial Sequence
  chemically synthesized
atagtgcaataaaaaatgttgt

SEQ ID NO: 1313405 - DNA, 22 bp, Artificial Sequence
  chemically synthesized
ggaatgccagaggggaagtcat

SEQ ID NO: 1313406 - DNA, 22 bp, Artificial Sequence
  chemically synthesized
tcagggatgacttcccctctgg

SEQ ID NO: 1313407 - DNA, 22 bp, Artificial Sequence
  chemically synthesized
tcagtcatagtgctgggaatgc

SEQ ID NO: 1313408 - DNA, 22 bp, Artificial Sequence
  chemically synthesized
cccctctggcattcccagcact

SEQ ID NO: 1313409 - DNA, 22 bp, Artificial Sequence
  chemically synthesized
ccctctggcattcccagcacta

SEQ ID NO: 1313410 - DNA, 22 bp, Artificial Sequence
  chemically synthesized
tggcattcccagcactatgact

SEQ ID NO: 1313411 - DNA, 22 bp, Artificial Sequence
  chemically synthesized
gcattcccagcactatgactga

SEQ ID NO: 1313412 - DNA, 22 bp, Artificial Sequence
  chemically synthesized
atgcagtaagagctgtcagtca

SEQ ID NO: 1313413 - DNA, 22 bp, Artificial Sequence
  chemically synthesized
ccagcactatgactgacagctc

SEQ ID NO: 1313414 - DNA, 22 bp, Artificial Sequence
  chemically synthesized
ttgatgcagtaagagctgtcag

SEQ ID NO: 1313415 - DNA, 22 bp, Artificial Sequence
  chemically synthesized
tattgatgcagtaagagctgtc

SEQ ID NO: 1313416 - DNA, 22 bp, Artificial Sequence
  chemically synthesized
ctattgatgcagtaagagctgt

SEQ ID NO: 1313417 - DNA, 22 bp, Artificial Sequence
  chemically synthesized
ttctattgatgcagtaagagct

SEQ ID NO: 1313418 - DNA, 22 bp, Artificial Sequence
  chemically synthesized
tgactgacagctcttactgcat

SEQ ID NO: 1313419 - DNA, 22 bp, Artificial Sequence
  chemically synthesized
acagctcttactgcatcaatag

SEQ ID NO: 1313420 - DNA, 22 bp, Artificial Sequence
  chemically synthesized
aatacaattcttctattgatgc

SEQ ID NO: 1313421 - DNA, 22 bp, Artificial Sequence
  chemically synthesized
aaatacaattcttctattgatg

SEQ ID NO: 1313422 - DNA, 22 bp, Artificial Sequence
  chemically synthesized
tttaaatacaattcttctattg

SEQ ID NO: 1313423 - DNA, 22 bp, Artificial Sequence
  chemically synthesized
gtttaaatacaattcttctatt

SEQ ID NO: 1313424 - DNA, 22 bp, Artificial Sequence
  chemically synthesized
tgtttaaatacaattcttctat

SEQ ID NO: 1313425 - DNA, 22 bp, Artificial Sequence
  chemically synthesized
ttactgcatcaatagaagaatt

SEQ ID NO: 1313426 - DNA, 22 bp, Artificial Sequence
  chemically synthesized
ttgtttaaatacaattcttcta

SEQ ID NO: 1313427 - DNA, 22 bp, Artificial Sequence
  chemically synthesized
actgcatcaatagaagaattgt

SEQ ID NO: 1313428 - DNA, 22 bp, Artificial Sequence
  chemically synthesized
ctgcatcaatagaagaattgta

SEQ ID NO: 1313429 - DNA, 22 bp, Artificial Sequence
  chemically synthesized
catcaatagaagaattgtattt

SEQ ID NO: 1313430 - DNA, 22 bp, Artificial Sequence
  chemically synthesized
taccataacttttgtttaaata

SEQ ID NO: 1313431 - DNA, 22 bp, Artificial Sequence
  chemically synthesized
ggaattgtaccataacttttgt

SEQ ID NO: 1313432 - DNA, 22 bp, Artificial Sequence
  chemically synthesized
tatttaaacaaaagttatggta

SEQ ID NO: 1313433 - DNA, 22 bp, Artificial Sequence
  chemically synthesized
aaacaaaagttatggtacaatt

SEQ ID NO: 1313434 - DNA, 22 bp, Artificial Sequence
  chemically synthesized
aacaaaagttatggtacaattc

SEQ ID NO: 1313435 - DNA, 22 bp, Artificial Sequence
  chemically synthesized
agcatcaacctaggaattgtac

SEQ ID NO: 1313436 - DNA, 22 bp, Artificial Sequence
  chemically synthesized
ttaagcatcaacctaggaattg

SEQ ID NO: 1313437 - DNA, 22 bp, Artificial Sequence
  chemically synthesized
tctattaagcatcaacctagga

SEQ ID NO: 1313438 - DNA, 22 bp, Artificial Sequence
  chemically synthesized
tggtacaattcctaggttgatg

SEQ ID NO: 1313439 - DNA, 22 bp, Artificial Sequence
  chemically synthesized
ctgtctattaagcatcaaccta

SEQ ID NO: 1313440 - DNA, 22 bp, Artificial Sequence
  chemically synthesized
actgtctattaagcatcaacct

SEQ ID NO: 1313441 - DNA, 22 bp, Artificial Sequence
  chemically synthesized
tagtatttactgtctattaagc

SEQ ID NO: 1313442 - DNA, 22 bp, Artificial Sequence
  chemically synthesized
ctaggttgatgcttaatagaca

SEQ ID NO: 1313443 - DNA, 22 bp, Artificial Sequence
  chemically synthesized
ctgtagtatttactgtctatta

SEQ ID NO: 1313444 - DNA, 22 bp, Artificial Sequence
  chemically synthesized
ggttgatgcttaatagacagta

SEQ ID NO: 1313445 - DNA, 22 bp, Artificial Sequence
  chemically synthesized
atgcttaatagacagtaaatac

SEQ ID NO: 1313446 - DNA, 22 bp, Artificial Sequence
  chemically synthesized
gtagttcctgtagtatttactg

SEQ ID NO: 1313447 - DNA, 22 bp, Artificial Sequence
  chemically synthesized
ttggtagttcctgtagtattta

SEQ ID NO: 1313448 - DNA, 22 bp, Artificial Sequence
  chemically synthesized
attggtagttcctgtagtattt

SEQ ID NO: 1313449 - DNA, 22 bp, Artificial Sequence
  chemically synthesized
aatagacagtaaatactacagg

SEQ ID NO: 1313450 - DNA, 22 bp, Artificial Sequence
  chemically synthesized
atagacagtaaatactacagga

SEQ ID NO: 1313451 - DNA, 22 bp, Artificial Sequence
  chemically synthesized
ataaggaagcttattggtagtt

SEQ ID NO: 1313452 - DNA, 22 bp, Artificial Sequence
  chemically synthesized
aataaggaagcttattggtagt

SEQ ID NO: 1313453 - DNA, 22 bp, Artificial Sequence
  chemically synthesized
tttaataaggaagcttattggt

SEQ ID NO: 1313454 - DNA, 22 bp, Artificial Sequence
  chemically synthesized
atttaataaggaagcttattgg

SEQ ID NO: 1313455 - DNA, 22 bp, Artificial Sequence
  chemically synthesized
caggaactaccaataagcttcc

SEQ ID NO: 1313456 - DNA, 22 bp, Artificial Sequence
  chemically synthesized
ccaataagcttccttattaaat

SEQ ID NO: 1313457 - DNA, 22 bp, Artificial Sequence
  chemically synthesized
ccttattaaataaatgtattta

SEQ ID NO: 1313458 - DNA, 22 bp, Artificial Sequence
  chemically synthesized
cttattaaataaatgtatttat

SEQ ID NO: 1313459 - DNA, 22 bp, Artificial Sequence
  chemically synthesized
attaaataaatgtatttattca

SEQ ID NO: 1313460 - DNA, 22 bp, Artificial Sequence
  chemically synthesized
cataagatcaaatgaataaata

SEQ ID NO: 1313461 - DNA, 22 bp, Artificial Sequence
  chemically synthesized
ttaaataaatgtatttattcat

SEQ ID NO: 1313462 - DNA, 22 bp, Artificial Sequence
  chemically synthesized
acataagatcaaatgaataaat

SEQ ID NO: 1313463 - DNA, 22 bp, Artificial Sequence
  chemically synthesized
tacataagatcaaatgaataaa

SEQ ID NO: 1313464 - DNA, 22 bp, Artificial Sequence
  chemically synthesized
aataaatgtatttattcatttg

SEQ ID NO: 1313465 - DNA, 22 bp, Artificial Sequence
  chemically synthesized
tttacataagatcaaatgaata

SEQ ID NO: 1313466 - DNA, 22 bp, Artificial Sequence
  chemically synthesized
tgttctttacataagatcaaat

SEQ ID NO: 1313467 - DNA, 22 bp, Artificial Sequence
  chemically synthesized
gtgttctttacataagatcaaa

SEQ ID NO: 1313468 - DNA, 22 bp, Artificial Sequence
  chemically synthesized
tgtgttctttacataagatcaa

SEQ ID NO: 1313469 - DNA, 22 bp, Artificial Sequence
  chemically synthesized
ttgtgttctttacataagatca

SEQ ID NO: 1313470 - DNA, 22 bp, Artificial Sequence
  chemically synthesized
ccttttgtgttctttacataag

SEQ ID NO: 1313471 - DNA, 22 bp, Artificial Sequence
  chemically synthesized
attcatttgatcttatgtaaag

SEQ ID NO: 1313472 - DNA, 22 bp, Artificial Sequence
  chemically synthesized
accttttgtgttctttacataa

SEQ ID NO: 1313473 - DNA, 22 bp, Artificial Sequence
  chemically synthesized
ttcatttgatcttatgtaaaga

SEQ ID NO: 1313474 - DNA, 22 bp, Artificial Sequence
  chemically synthesized
taccttttgtgttctttacata

SEQ ID NO: 1313475 - DNA, 22 bp, Artificial Sequence
  chemically synthesized
ttaccttttgtgttctttacat

SEQ ID NO: 1313476 - DNA, 22 bp, Artificial Sequence
  chemically synthesized
atttgatcttatgtaaagaaca

SEQ ID NO: 1313477 - DNA, 22 bp, Artificial Sequence
  chemically synthesized
ttttaccttttgtgttctttac

SEQ ID NO: 1313478 - DNA, 22 bp, Artificial Sequence
  chemically synthesized
cttttaccttttgtgttcttta

SEQ ID NO: 1313479 - DNA, 22 bp, Artificial Sequence
  chemically synthesized
tcttttaccttttgtgttcttt

SEQ ID NO: 1313480 - DNA, 22 bp, Artificial Sequence
  chemically synthesized
ttcttttaccttttgtgttctt

SEQ ID NO: 1313481 - DNA, 22 bp, Artificial Sequence
  chemically synthesized
gatcttatgtaaagaacacaaa

SEQ ID NO: 1313482 - DNA, 22 bp, Artificial Sequence
  chemically synthesized
tttcttttaccttttgtgttct

SEQ ID NO: 1313483 - DNA, 22 bp, Artificial Sequence
  chemically synthesized
atcttatgtaaagaacacaaaa

SEQ ID NO: 1313484 - DNA, 22 bp, Artificial Sequence
  chemically synthesized
ttttcttttaccttttgtgttc

SEQ ID NO: 1313485 - DNA, 22 bp, Artificial Sequence
  chemically synthesized
atttttttcttttaccttttgt

SEQ ID NO: 1313486 - DNA, 22 bp, Artificial Sequence
  chemically synthesized
atgtaaagaacacaaaaggtaa

SEQ ID NO: 1313487 - DNA, 22 bp, Artificial Sequence
  chemically synthesized
aatttttttcttttaccttttg

SEQ ID NO: 1313488 - DNA, 22 bp, Artificial Sequence
  chemically synthesized
tgtaaagaacacaaaaggtaaa

SEQ ID NO: 1313489 - DNA, 22 bp, Artificial Sequence
  chemically synthesized
taatttttttcttttacctttt

SEQ ID NO: 1313490 - DNA, 22 bp, Artificial Sequence
  chemically synthesized
ttaatttttttcttttaccttt

SEQ ID NO: 1313491 - DNA, 22 bp, Artificial Sequence
  chemically synthesized
tttaatttttttcttttacctt

SEQ ID NO: 1313492 - DNA, 22 bp, Artificial Sequence
  chemically synthesized
ttttaatttttttcttttacct

SEQ ID NO: 1313493 - DNA, 22 bp, Artificial Sequence
  chemically synthesized
ttttttaatttttttcttttac

SEQ ID NO: 1313494 - DNA, 22 bp, Artificial Sequence
  chemically synthesized
tacaaaaataaaatactctttt

SEQ ID NO: 1313495 - DNA, 22 bp, Artificial Sequence
  chemically synthesized
attatacaaaaataaaatactc

SEQ ID NO: 1313496 - DNA, 22 bp, Artificial Sequence
  chemically synthesized
aattatacaaaaataaaatact

SEQ ID NO: 1313497 - DNA, 22 bp, Artificial Sequence
  chemically synthesized
taattatacaaaaataaaatac

SEQ ID NO: 1313498 - DNA, 22 bp, Artificial Sequence
  chemically synthesized
ttaattatacaaaaataaaata

SEQ ID NO: 1313499 - DNA, 22 bp, Artificial Sequence
  chemically synthesized
tttaattatacaaaaataaaat

SEQ ID NO: 1313500 - DNA, 22 bp, Artificial Sequence
  chemically synthesized
aaaaagagtattttatttttgt

SEQ ID NO: 1313501 - DNA, 22 bp, Artificial Sequence
  chemically synthesized
gattttttaattatacaaaaat

SEQ ID NO: 1313502 - DNA, 22 bp, Artificial Sequence
  chemically synthesized
tatttttgtataattaaaaaat

SEQ ID NO: 1313503 - DNA, 22 bp, Artificial Sequence
  chemically synthesized
atttttgtataattaaaaaatc

SEQ ID NO: 1313504 - DNA, 22 bp, Artificial Sequence
  chemically synthesized
tttttgtataattaaaaaatct

SEQ ID NO: 1313505 - DNA, 22 bp, Artificial Sequence
  chemically synthesized
ttgtataattaaaaaatctagt

SEQ ID NO: 1313506 - DNA, 22 bp, Artificial Sequence
  chemically synthesized
tgtataattaaaaaatctagtt

SEQ ID NO: 1313507 - DNA, 22 bp, Artificial Sequence
  chemically synthesized
gtataattaaaaaatctagttc

SEQ ID NO: 1313508 - DNA, 22 bp, Artificial Sequence
  chemically synthesized
tataattaaaaaatctagttcc

SEQ ID NO: 1313509 - DNA, 22 bp, Artificial Sequence
  chemically synthesized
aaatccaggaagaaggaactag

SEQ ID NO: 1313510 - DNA, 22 bp, Artificial Sequence
  chemically synthesized
aaaaatctagttccttcttcct

SEQ ID NO: 1313511 - DNA, 22 bp, Artificial Sequence
  chemically synthesized
gttccttcttcctggatttgag

SEQ ID NO: 1313512 - DNA, 22 bp, Artificial Sequence
  chemically synthesized
cttcttcctggatttgaggtat

SEQ ID NO: 1313513 - DNA, 22 bp, Artificial Sequence
  chemically synthesized
cttcctggatttgaggtatcta

SEQ ID NO: 1313514 - DNA, 22 bp, Artificial Sequence
  chemically synthesized
ttcctggatttgaggtatctat

SEQ ID NO: 1313515 - DNA, 22 bp, Artificial Sequence
  chemically synthesized
cctggatttgaggtatctatat

SEQ ID NO: 1313516 - DNA, 22 bp, Artificial Sequence
  chemically synthesized
ctggatttgaggtatctatatc

SEQ ID NO: 1313517 - DNA, 22 bp, Artificial Sequence
  chemically synthesized
gatttgaggtatctatatctgt

SEQ ID NO: 1313518 - DNA, 22 bp, Artificial Sequence
  chemically synthesized
gaggtatctatatctgtatcta

SEQ ID NO: 1313519 - DNA, 22 bp, Artificial Sequence
  chemically synthesized
aggtatctatatctgtatctat

SEQ ID NO: 1313520 - DNA, 22 bp, Artificial Sequence
  chemically synthesized
tatctgtatctatccatctctc

SEQ ID NO: 1313521 - DNA, 22 bp, Artificial Sequence
  chemically synthesized
tatctatccatctctctctctc

SEQ ID NO: 1313522 - DNA, 22 bp, Artificial Sequence
  chemically synthesized
tccatctctctctctctctctc

SEQ ID NO: 1313523 - DNA, 22 bp, Artificial Sequence
  chemically synthesized
tctctctctctctctctctctc

SEQ ID NO: 1313524 - DNA, 22 bp, Artificial Sequence
  chemically synthesized
tctctctctctctctctctctc

SEQ ID NO: 1313525 - DNA, 22 bp, Artificial Sequence
  chemically synthesized
tctctctctctctctctctctc

SEQ ID NO: 1313526 - DNA, 22 bp, Artificial Sequence
  chemically synthesized
tctctctctctctctctctctc

SEQ ID NO: 1313527 - DNA, 22 bp, Artificial Sequence
  chemically synthesized
tctctctctctctctctctctc

SEQ ID NO: 1313528 - DNA, 22 bp, Artificial Sequence
  chemically synthesized
tctctctctctctctctctcta

SEQ ID NO: 1313529 - DNA, 22 bp, Artificial Sequence
  chemically synthesized
tctctctctctctctctctata

SEQ ID NO: 1313530 - DNA, 22 bp, Artificial Sequence
  chemically synthesized
tctctctctctctctctatata

SEQ ID NO: 1313531 - DNA, 22 bp, Artificial Sequence
  chemically synthesized
tctctctctctctctatatata

SEQ ID NO: 1313532 - DNA, 22 bp, Artificial Sequence
  chemically synthesized
tctctctctctctatatatata

SEQ ID NO: 1313533 - DNA, 22 bp, Artificial Sequence
  chemically synthesized
tctctctctctatatatatata

SEQ ID NO: 1313534 - DNA, 22 bp, Artificial Sequence
  chemically synthesized
tctctctctatatatatatata

SEQ ID NO: 1313535 - DNA, 22 bp, Artificial Sequence
  chemically synthesized
tctctctatatatatatatata

SEQ ID NO: 1313536 - DNA, 22 bp, Artificial Sequence
  chemically synthesized
tctctatatatatatatatata

SEQ ID NO: 1313537 - DNA, 22 bp, Artificial Sequence
  chemically synthesized
tctatatatatatatatatata

SEQ ID NO: 1313538 - DNA, 22 bp, Artificial Sequence
  chemically synthesized
tatatatatatatatatatata

SEQ ID NO: 1313539 - DNA, 22 bp, Artificial Sequence
  chemically synthesized
tatatatatatatatatatata

SEQ ID NO: 1313540 - DNA, 22 bp, Artificial Sequence
  chemically synthesized
atatagatatgaacatatatat

SEQ ID NO: 1313541 - DNA, 22 bp, Artificial Sequence
  chemically synthesized
tcaatattgatatagatatgaa

SEQ ID NO: 1313542 - DNA, 22 bp, Artificial Sequence
  chemically synthesized
atatctatatcaatattgataa

SEQ ID NO: 1313543 - DNA, 22 bp, Artificial Sequence
  chemically synthesized
agaagtaaagaaacattatcaa

SEQ ID NO: 1313544 - DNA, 22 bp, Artificial Sequence
  chemically synthesized
aagaagtaaagaaacattatca

SEQ ID NO: 1313545 - DNA, 22 bp, Artificial Sequence
  chemically synthesized
tatcaatattgataatgtttct

SEQ ID NO: 1313546 - DNA, 22 bp, Artificial Sequence
  chemically synthesized
tttaagaagtaaagaaacatta

SEQ ID NO: 1313547 - DNA, 22 bp, Artificial Sequence
  chemically synthesized
atttaagaagtaaagaaacatt

SEQ ID NO: 1313548 - DNA, 22 bp, Artificial Sequence
  chemically synthesized
tatttaagaagtaaagaaacat

SEQ ID NO: 1313549 - DNA, 22 bp, Artificial Sequence
  chemically synthesized
tttatttaagaagtaaagaaac

SEQ ID NO: 1313550 - DNA, 22 bp, Artificial Sequence
  chemically synthesized
ataatgtttctttacttcttaa

SEQ ID NO: 1313551 - DNA, 22 bp, Artificial Sequence
  chemically synthesized
ggtaattctttatttaagaagt

SEQ ID NO: 1313552 - DNA, 22 bp, Artificial Sequence
  chemically synthesized
aggtaattctttatttaagaag

SEQ ID NO: 1313553 - DNA, 22 bp, Artificial Sequence
  chemically synthesized
ctttacttcttaaataaagaat

SEQ ID NO: 1313554 - DNA, 22 bp, Artificial Sequence
  chemically synthesized
tttacttcttaaataaagaatt

SEQ ID NO: 1313555 - DNA, 22 bp, Artificial Sequence
  chemically synthesized
tacttcttaaataaagaattac

SEQ ID NO: 1313556 - DNA, 22 bp, Artificial Sequence
  chemically synthesized
acttcttaaataaagaattacc

SEQ ID NO: 1313557 - DNA, 22 bp, Artificial Sequence
  chemically synthesized
cttcttaaataaagaattacct

SEQ ID NO: 1313558 - DNA, 22 bp, Artificial Sequence
  chemically synthesized
aaaaaagatgcttaggtaattc

SEQ ID NO: 1313559 - DNA, 22 bp, Artificial Sequence
  chemically synthesized
gaaaaaagatgcttaggtaatt

SEQ ID NO: 1313560 - DNA, 22 bp, Artificial Sequence
  chemically synthesized
cttaaataaagaattacctaag

SEQ ID NO: 1313561 - DNA, 22 bp, Artificial Sequence
  chemically synthesized
ttaaataaagaattacctaagc

SEQ ID NO: 1313562 - DNA, 22 bp, Artificial Sequence
  chemically synthesized
aaataaagaattacctaagcat

SEQ ID NO: 1313563 - DNA, 22 bp, Artificial Sequence
  chemically synthesized
aataaagaattacctaagcatc

SEQ ID NO: 1313564 - DNA, 22 bp, Artificial Sequence
  chemically synthesized
ccgcttgaaaaaagatgcttag

SEQ ID NO: 1313565 - DNA, 22 bp, Artificial Sequence
  chemically synthesized
tcccgcttgaaaaaagatgctt

SEQ ID NO: 1313566 - DNA, 22 bp, Artificial Sequence
  chemically synthesized
attctcccgcttgaaaaaagat

SEQ ID NO: 1313567 - DNA, 22 bp, Artificial Sequence
  chemically synthesized
cattctcccgcttgaaaaaaga

SEQ ID NO: 1313568 - DNA, 22 bp, Artificial Sequence
  chemically synthesized
tcattctcccgcttgaaaaaag

SEQ ID NO: 1313569 - DNA, 22 bp, Artificial Sequence
  chemically synthesized
cctaagcatcttttttcaagcg

SEQ ID NO: 1313570 - DNA, 22 bp, Artificial Sequence
  chemically synthesized
tgttttcattctcccgcttgaa

SEQ ID NO: 1313571 - DNA, 22 bp, Artificial Sequence
  chemically synthesized
agcatcttttttcaagcgggag

SEQ ID NO: 1313572 - DNA, 22 bp, Artificial Sequence
  chemically synthesized
gaataattgtgttttcattctc

SEQ ID NO: 1313573 - DNA, 22 bp, Artificial Sequence
  chemically synthesized
ttttcaagcgggagaatgaaaa

SEQ ID NO: 1313574 - DNA, 22 bp, Artificial Sequence
  chemically synthesized
agaataattgtgttttcattct

SEQ ID NO: 1313575 - DNA, 22 bp, Artificial Sequence
  chemically synthesized
tttcaagcgggagaatgaaaac

SEQ ID NO: 1313576 - DNA, 22 bp, Artificial Sequence
  chemically synthesized
ttcaagcgggagaatgaaaaca

SEQ ID NO: 1313577 - DNA, 22 bp, Artificial Sequence
  chemically synthesized
tcaagcgggagaatgaaaacac

SEQ ID NO: 1313578 - DNA, 22 bp, Artificial Sequence
  chemically synthesized
caagcgggagaatgaaaacaca

SEQ ID NO: 1313579 - DNA, 22 bp, Artificial Sequence
  chemically synthesized
aagcgggagaatgaaaacacaa

SEQ ID NO: 1313580 - DNA, 22 bp, Artificial Sequence
  chemically synthesized
gccatcttagaataattgtgtt

SEQ ID NO: 1313581 - DNA, 22 bp, Artificial Sequence
  chemically synthesized
tcaatattcgccatcttagaat

SEQ ID NO: 1313582 - DNA, 22 bp, Artificial Sequence
  chemically synthesized
gtcaatattcgccatcttagaa

SEQ ID NO: 1313583 - DNA, 22 bp, Artificial Sequence
  chemically synthesized
ccttgtcaatattcgccatctt

SEQ ID NO: 1313584 - DNA, 22 bp, Artificial Sequence
  chemically synthesized
attcccttgtcaatattcgcca

SEQ ID NO: 1313585 - DNA, 22 bp, Artificial Sequence
  chemically synthesized
cattcccttgtcaatattcgcc

SEQ ID NO: 1313586 - DNA, 22 bp, Artificial Sequence
  chemically synthesized
ttctaagatggcgaatattgac

SEQ ID NO: 1313587 - DNA, 22 bp, Artificial Sequence
  chemically synthesized
taagatggcgaatattgacaag

SEQ ID NO: 1313588 - DNA, 22 bp, Artificial Sequence
  chemically synthesized
accatttcattcccttgtcaat

SEQ ID NO: 1313589 - DNA, 22 bp, Artificial Sequence
  chemically synthesized
agatggcgaatattgacaaggg

SEQ ID NO: 1313590 - DNA, 22 bp, Artificial Sequence
  chemically synthesized
caccatttcattcccttgtcaa

SEQ ID NO: 1313591 - DNA, 22 bp, Artificial Sequence
  chemically synthesized
tcaccatttcattcccttgtca

SEQ ID NO: 1313592 - DNA, 22 bp, Artificial Sequence
  chemically synthesized
ctttcaccatttcattcccttg

SEQ ID NO: 1313593 - DNA, 22 bp, Artificial Sequence
  chemically synthesized
gctttcaccatttcattccctt

SEQ ID NO: 1313594 - DNA, 22 bp, Artificial Sequence
  chemically synthesized
gatagatttgctttcaccattt

SEQ ID NO: 1313595 - DNA, 22 bp, Artificial Sequence
  chemically synthesized
acaagggaatgaaatggtgaaa

SEQ ID NO: 1313596 - DNA, 22 bp, Artificial Sequence
  chemically synthesized
tagatagatttgctttcaccat

SEQ ID NO: 1313597 - DNA, 22 bp, Artificial Sequence
  chemically synthesized
ctagatagatttgctttcacca

SEQ ID NO: 1313598 - DNA, 22 bp, Artificial Sequence
  chemically synthesized
tctagatagatttgctttcacc

SEQ ID NO: 1313599 - DNA, 22 bp, Artificial Sequence
  chemically synthesized
ttctagatagatttgctttcac

SEQ ID NO: 1313600 - DNA, 22 bp, Artificial Sequence
  chemically synthesized
tttctagatagatttgctttca

SEQ ID NO: 1313601 - DNA, 22 bp, Artificial Sequence
  chemically synthesized
ttttctagatagatttgctttc

SEQ ID NO: 1313602 - DNA, 22 bp, Artificial Sequence
  chemically synthesized
agggggcccttttttctagata

SEQ ID NO: 1313603 - DNA, 22 bp, Artificial Sequence
  chemically synthesized
aggctaagggggcccttttttc

SEQ ID NO: 1313604 - DNA, 22 bp, Artificial Sequence
  chemically synthesized
attcaggctaagggggcccttt

SEQ ID NO: 1313605 - DNA, 22 bp, Artificial Sequence
  chemically synthesized
ttcattcaggctaagggggccc

SEQ ID NO: 1313606 - DNA, 22 bp, Artificial Sequence
  chemically synthesized
tctagaaaaaagggccccctta

SEQ ID NO: 1313607 - DNA, 22 bp, Artificial Sequence
  chemically synthesized
gaaaaaagggcccccttagcct

SEQ ID NO: 1313608 - DNA, 22 bp, Artificial Sequence
  chemically synthesized
gtctattcattcaggctaaggg

SEQ ID NO: 1313609 - DNA, 22 bp, Artificial Sequence
  chemically synthesized
actggtctattcattcaggcta

SEQ ID NO: 1313610 - DNA, 22 bp, Artificial Sequence
  chemically synthesized
attcactggtctattcattcag

SEQ ID NO: 1313611 - DNA, 22 bp, Artificial Sequence
  chemically synthesized
ctcattcactggtctattcatt

SEQ ID NO: 1313612 - DNA, 22 bp, Artificial Sequence
  chemically synthesized
cctcattcactggtctattcat

SEQ ID NO: 1313613 - DNA, 22 bp, Artificial Sequence
  chemically synthesized
tttcctcattcactggtctatt

SEQ ID NO: 1313614 - DNA, 22 bp, Artificial Sequence
  chemically synthesized
gtttcctcattcactggtctat

SEQ ID NO: 1313615 - DNA, 22 bp, Artificial Sequence
  chemically synthesized
agcctgaatgaatagaccagtg

SEQ ID NO: 1313616 - DNA, 22 bp, Artificial Sequence
  chemically synthesized
tgtttcctcattcactggtcta

SEQ ID NO: 1313617 - DNA, 22 bp, Artificial Sequence
  chemically synthesized
gcctgaatgaatagaccagtga

SEQ ID NO: 1313618 - DNA, 22 bp, Artificial Sequence
  chemically synthesized
aatgaatagaccagtgaatgag

SEQ ID NO: 1313619 - DNA, 22 bp, Artificial Sequence
  chemically synthesized
atcattttgtttcctcattcac

SEQ ID NO: 1313620 - DNA, 22 bp, Artificial Sequence
  chemically synthesized
aatcattttgtttcctcattca

SEQ ID NO: 1313621 - DNA, 22 bp, Artificial Sequence
  chemically synthesized
atttaatcattttgtttcctca

SEQ ID NO: 1313622 - DNA, 22 bp, Artificial Sequence
  chemically synthesized
gatttaatcattttgtttcctc

SEQ ID NO: 1313623 - DNA, 22 bp, Artificial Sequence
  chemically synthesized
aaaagacttgatttaatcattt

SEQ ID NO: 1313624 - DNA, 22 bp, Artificial Sequence
  chemically synthesized
caaaagacttgatttaatcatt

SEQ ID NO: 1313625 - DNA, 22 bp, Artificial Sequence
  chemically synthesized
tcaaaagacttgatttaatcat

SEQ ID NO: 1313626 - DNA, 22 bp, Artificial Sequence
  chemically synthesized
tgctttcaaaagacttgattta

SEQ ID NO: 1313627 - DNA, 22 bp, Artificial Sequence
  chemically synthesized
acaataatgctgtgctttcaaa

SEQ ID NO: 1313628 - DNA, 22 bp, Artificial Sequence
  chemically synthesized
aatcaagtcttttgaaagcaca

SEQ ID NO: 1313629 - DNA, 22 bp, Artificial Sequence
  chemically synthesized
caatatgtctcacaataatgct

SEQ ID NO: 1313630 - DNA, 22 bp, Artificial Sequence
  chemically synthesized
acaatatgtctcacaataatgc

SEQ ID NO: 1313631 - DNA, 22 bp, Artificial Sequence
  chemically synthesized
ttgaaagcacagcattattgtg

SEQ ID NO: 1313632 - DNA, 22 bp, Artificial Sequence
  chemically synthesized
tacaatatgtctcacaataatg

SEQ ID NO: 1313633 - DNA, 22 bp, Artificial Sequence
  chemically synthesized
tgaaagcacagcattattgtga

SEQ ID NO: 1313634 - DNA, 22 bp, Artificial Sequence
  chemically synthesized
gaaagcacagcattattgtgag

SEQ ID NO: 1313635 - DNA, 22 bp, Artificial Sequence
  chemically synthesized
aaagcacagcattattgtgaga

SEQ ID NO: 1313636 - DNA, 22 bp, Artificial Sequence
  chemically synthesized
cacagatctttacaatatgtct

SEQ ID NO: 1313637 - DNA, 22 bp, Artificial Sequence
  chemically synthesized
ttgtgagacatattgtaaagat

SEQ ID NO: 1313638 - DNA, 22 bp, Artificial Sequence
  chemically synthesized
tgagacatattgtaaagatctg

SEQ ID NO: 1313639 - DNA, 22 bp, Artificial Sequence
  chemically synthesized
taaagatctgtgcagctattct

SEQ ID NO: 1313640 - DNA, 22 bp, Artificial Sequence
  chemically synthesized
tgcagctattctgcccttccta

SEQ ID NO: 1313641 - DNA, 22 bp, Artificial Sequence
  chemically synthesized
ttctgcccttcctacatactca

SEQ ID NO: 1313642 - DNA, 22 bp, Artificial Sequence
  chemically synthesized
tgcccttcctacatactcattg

SEQ ID NO: 1313643 - DNA, 22 bp, Artificial Sequence
  chemically synthesized
tataatagagagcaatgagtat

SEQ ID NO: 1313644 - DNA, 22 bp, Artificial Sequence
  chemically synthesized
gtataatagagagcaatgagta

SEQ ID NO: 1313645 - DNA, 22 bp, Artificial Sequence
  chemically synthesized
cccttcctacatactcattgct

SEQ ID NO: 1313646 - DNA, 22 bp, Artificial Sequence
  chemically synthesized
tgtataatagagagcaatgagt

SEQ ID NO: 1313647 - DNA, 22 bp, Artificial Sequence
  chemically synthesized
tttgtataatagagagcaatga

SEQ ID NO: 1313648 - DNA, 22 bp, Artificial Sequence
  chemically synthesized
ctttgtataatagagagcaatg

SEQ ID NO: 1313649 - DNA, 22 bp, Artificial Sequence
  chemically synthesized
cctacatactcattgctctcta

SEQ ID NO: 1313650 - DNA, 22 bp, Artificial Sequence
  chemically synthesized
ctacatactcattgctctctat

SEQ ID NO: 1313651 - DNA, 22 bp, Artificial Sequence
  chemically synthesized
cttctttgtataatagagagca

SEQ ID NO: 1313652 - DNA, 22 bp, Artificial Sequence
  chemically synthesized
catactcattgctctctattat

SEQ ID NO: 1313653 - DNA, 22 bp, Artificial Sequence
  chemically synthesized
tgttccttctttgtataataga

SEQ ID NO: 1313654 - DNA, 22 bp, Artificial Sequence
  chemically synthesized
tgtgttccttctttgtataata

SEQ ID NO: 1313655 - DNA, 22 bp, Artificial Sequence
  chemically synthesized
tctgtgttccttctttgtataa

SEQ ID NO: 1313656 - DNA, 22 bp, Artificial Sequence
  chemically synthesized
attgctctctattatacaaaga

SEQ ID NO: 1313657 - DNA, 22 bp, Artificial Sequence
  chemically synthesized
ctctgtgttccttctttgtata

SEQ ID NO: 1313658 - DNA, 22 bp, Artificial Sequence
  chemically synthesized
tctctgtgttccttctttgtat

SEQ ID NO: 1313659 - DNA, 22 bp, Artificial Sequence
  chemically synthesized
ttctctgtgttccttctttgta

SEQ ID NO: 1313660 - DNA, 22 bp, Artificial Sequence
  chemically synthesized
ctctctattatacaaagaagga

SEQ ID NO: 1313661 - DNA, 22 bp, Artificial Sequence
  chemically synthesized
ttttctctgtgttccttctttg

SEQ ID NO: 1313662 - DNA, 22 bp, Artificial Sequence
  chemically synthesized
tctattatacaaagaaggaaca

SEQ ID NO: 1313663 - DNA, 22 bp, Artificial Sequence
  chemically synthesized
tattatacaaagaaggaacaca

SEQ ID NO: 1313664 - DNA, 22 bp, Artificial Sequence
  chemically synthesized
ttatacaaagaaggaacacaga

SEQ ID NO: 1313665 - DNA, 22 bp, Artificial Sequence
  chemically synthesized
tacaaagaaggaacacagagaa

SEQ ID NO: 1313666 - DNA, 22 bp, Artificial Sequence
  chemically synthesized
aagtataatgttcttttctctg

SEQ ID NO: 1313667 - DNA, 22 bp, Artificial Sequence
  chemically synthesized
caagtataatgttcttttctct

SEQ ID NO: 1313668 - DNA, 22 bp, Artificial Sequence
  chemically synthesized
acttcaagtataatgttctttt

SEQ ID NO: 1313669 - DNA, 22 bp, Artificial Sequence
  chemically synthesized
taacttcaagtataatgttctt

SEQ ID NO: 1313670 - DNA, 22 bp, Artificial Sequence
  chemically synthesized
aaacccaggtattctaacttca

SEQ ID NO: 1313671 - DNA, 22 bp, Artificial Sequence
  chemically synthesized
tacttgaagttagaatacctgg

SEQ ID NO: 1313672 - DNA, 22 bp, Artificial Sequence
  chemically synthesized
gaagttagaatacctgggtttg

SEQ ID NO: 1313673 - DNA, 22 bp, Artificial Sequence
  chemically synthesized
aagttagaatacctgggtttga

SEQ ID NO: 1313674 - DNA, 22 bp, Artificial Sequence
  chemically synthesized
gaatacctgggtttgagtgtga

SEQ ID NO: 1313675 - DNA, 22 bp, Artificial Sequence
  chemically synthesized
gtaagtgataaagtcacactca

SEQ ID NO: 1313676 - DNA, 22 bp, Artificial Sequence
  chemically synthesized
ggtttgagtgtgactttatcac

SEQ ID NO: 1313677 - DNA, 22 bp, Artificial Sequence
  chemically synthesized
gagtgtgactttatcacttact

SEQ ID NO: 1313678 - DNA, 22 bp, Artificial Sequence
  chemically synthesized
agtgtgactttatcacttacta

SEQ ID NO: 1313679 - DNA, 22 bp, Artificial Sequence
  chemically synthesized
aagatcacataattagtaagtg

SEQ ID NO: 1313680 - DNA, 22 bp, Artificial Sequence
  chemically synthesized
ttcaagatcacataattagtaa

SEQ ID NO: 1313681 - DNA, 22 bp, Artificial Sequence
  chemically synthesized
gttcaagatcacataattagta

SEQ ID NO: 1313682 - DNA, 22 bp, Artificial Sequence
  chemically synthesized
tatcacttactaattatgtgat

SEQ ID NO: 1313683 - DNA, 22 bp, Artificial Sequence
  chemically synthesized
atcacttactaattatgtgatc

SEQ ID NO: 1313684 - DNA, 22 bp, Artificial Sequence
  chemically synthesized
tcacttactaattatgtgatct

SEQ ID NO: 1313685 - DNA, 22 bp, Artificial Sequence
  chemically synthesized
agtaacttgttcaagatcacat

SEQ ID NO: 1313686 - DNA, 22 bp, Artificial Sequence
  chemically synthesized
actaattatgtgatcttgaaca

SEQ ID NO: 1313687 - DNA, 22 bp, Artificial Sequence
  chemically synthesized
ctaattatgtgatcttgaacaa

SEQ ID NO: 1313688 - DNA, 22 bp, Artificial Sequence
  chemically synthesized
attatgtgatcttgaacaagtt

SEQ ID NO: 1313689 - DNA, 22 bp, Artificial Sequence
  chemically synthesized
tgtgatcttgaacaagttactc

SEQ ID NO: 1313690 - DNA, 22 bp, Artificial Sequence
  chemically synthesized
agcacaaagaggttgagtaact

SEQ ID NO: 1313691 - DNA, 22 bp, Artificial Sequence
  chemically synthesized
gaacaagttactcaacctcttt

SEQ ID NO: 1313692 - DNA, 22 bp, Artificial Sequence
  chemically synthesized
aacaagttactcaacctctttg

SEQ ID NO: 1313693 - DNA, 22 bp, Artificial Sequence
  chemically synthesized
gaaaaggaaactgagcacaaag

SEQ ID NO: 1313694 - DNA, 22 bp, Artificial Sequence
  chemically synthesized
agaaaaggaaactgagcacaaa

SEQ ID NO: 1313695 - DNA, 22 bp, Artificial Sequence
  chemically synthesized
tagaaaaggaaactgagcacaa

SEQ ID NO: 1313696 - DNA, 22 bp, Artificial Sequence
  chemically synthesized
ttagaaaaggaaactgagcaca

SEQ ID NO: 1313697 - DNA, 22 bp, Artificial Sequence
  chemically synthesized
ctcaacctctttgtgctcagtt

SEQ ID NO: 1313698 - DNA, 22 bp, Artificial Sequence
  chemically synthesized
tttagaaaaggaaactgagcac

SEQ ID NO: 1313699 - DNA, 22 bp, Artificial Sequence
  chemically synthesized
aacctctttgtgctcagtttcc

SEQ ID NO: 1313700 - DNA, 22 bp, Artificial Sequence
  chemically synthesized
tttgtgctcagtttccttttct

SEQ ID NO: 1313701 - DNA, 22 bp, Artificial Sequence
  chemically synthesized
tgtgctcagtttccttttctaa

SEQ ID NO: 1313702 - DNA, 22 bp, Artificial Sequence
  chemically synthesized
tatgtccattttttagaaaagg

SEQ ID NO: 1313703 - DNA, 22 bp, Artificial Sequence
  chemically synthesized
gtgctcagtttccttttctaaa

SEQ ID NO: 1313704 - DNA, 22 bp, Artificial Sequence
  chemically synthesized
tgctcagtttccttttctaaaa

SEQ ID NO: 1313705 - DNA, 22 bp, Artificial Sequence
  chemically synthesized
agtttccttttctaaaaaatgg

SEQ ID NO: 1313706 - DNA, 22 bp, Artificial Sequence
  chemically synthesized
ccttttctaaaaaatggacata

SEQ ID NO: 1313707 - DNA, 22 bp, Artificial Sequence
  chemically synthesized
cttttctaaaaaatggacatac

SEQ ID NO: 1313708 - DNA, 22 bp, Artificial Sequence
  chemically synthesized
ttctaaaaaatggacatacagg

SEQ ID NO: 1313709 - DNA, 22 bp, Artificial Sequence
  chemically synthesized
tctaaaaaatggacatacaggc

SEQ ID NO: 1313710 - DNA, 22 bp, Artificial Sequence
  chemically synthesized
ctaaaaaatggacatacaggcc

SEQ ID NO: 1313711 - DNA, 22 bp, Artificial Sequence
  chemically synthesized
taaaaaatggacatacaggccg

SEQ ID NO: 1313712 - DNA, 22 bp, Artificial Sequence
  chemically synthesized
aaaaatggacatacaggccgga

SEQ ID NO: 1313713 - DNA, 22 bp, Artificial Sequence
  chemically synthesized
caggtgtgagccaccaagtccg

SEQ ID NO: 1313714 - DNA, 22 bp, Artificial Sequence
  chemically synthesized
ggattacaggtgtgagccacca

SEQ ID NO: 1313715 - DNA, 22 bp, Artificial Sequence
  chemically synthesized
ccaaagtgctgggattacaggt

SEQ ID NO: 1313716 - DNA, 22 bp, Artificial Sequence
  chemically synthesized
ggtggctcacacctgtaatccc

SEQ ID NO: 1313717 - DNA, 22 bp, Artificial Sequence
  chemically synthesized
gtggctcacacctgtaatccca

SEQ ID NO: 1313718 - DNA, 22 bp, Artificial Sequence
  chemically synthesized
ggcctcccaaagtgctgggatt

SEQ ID NO: 1313719 - DNA, 22 bp, Artificial Sequence
  chemically synthesized
acacctgtaatcccagcacttt

SEQ ID NO: 1313720 - DNA, 22 bp, Artificial Sequence
  chemically synthesized
ccacctcggcctcccaaagtgc

SEQ ID NO: 1313721 - DNA, 22 bp, Artificial Sequence
  chemically synthesized
taatcccagcactttgggaggc

SEQ ID NO: 1313722 - DNA, 22 bp, Artificial Sequence
  chemically synthesized
aagtcatctgccacctcggcct

SEQ ID NO: 1313723 - DNA, 22 bp, Artificial Sequence
  chemically synthesized
gcctcaagtcatctgccacctc

SEQ ID NO: 1313724 - DNA, 22 bp, Artificial Sequence
  chemically synthesized
tgggaggccgaggtggcagatg

SEQ ID NO: 1313725 - DNA, 22 bp, Artificial Sequence
  chemically synthesized
ctggcctcaagtcatctgccac

SEQ ID NO: 1313726 - DNA, 22 bp, Artificial Sequence
  chemically synthesized
gggaggccgaggtggcagatga

SEQ ID NO: 1313727 - DNA, 22 bp, Artificial Sequence
  chemically synthesized
ggaggccgaggtggcagatgac

SEQ ID NO: 1313728 - DNA, 22 bp, Artificial Sequence
  chemically synthesized
aactcctggcctcaagtcatct

SEQ ID NO: 1313729 - DNA, 22 bp, Artificial Sequence
  chemically synthesized
gaactcctggcctcaagtcatc

SEQ ID NO: 1313730 - DNA, 22 bp, Artificial Sequence
  chemically synthesized
tgaactcctggcctcaagtcat

SEQ ID NO: 1313731 - DNA, 22 bp, Artificial Sequence
  chemically synthesized
ttttgaactcctggcctcaagt

SEQ ID NO: 1313732 - DNA, 22 bp, Artificial Sequence
  chemically synthesized
gttttgaactcctggcctcaag

SEQ ID NO: 1313733 - DNA, 22 bp, Artificial Sequence
  chemically synthesized
gccaggcttgttttgaactcct

SEQ ID NO: 1313734 - DNA, 22 bp, Artificial Sequence
  chemically synthesized
gaggccaggagttcaaaacaag

SEQ ID NO: 1313735 - DNA, 22 bp, Artificial Sequence
  chemically synthesized
aggccaggagttcaaaacaagc

SEQ ID NO: 1313736 - DNA, 22 bp, Artificial Sequence
  chemically synthesized
accatgttggccaggcttgttt

SEQ ID NO: 1313737 - DNA, 22 bp, Artificial Sequence
  chemically synthesized
caccatgttggccaggcttgtt

SEQ ID NO: 1313738 - DNA, 22 bp, Artificial Sequence
  chemically synthesized
aaaacaagcctggccaacatgg

SEQ ID NO: 1313739 - DNA, 22 bp, Artificial Sequence
  chemically synthesized
gtggaaacggggtttcaccatg

SEQ ID NO: 1313740 - DNA, 22 bp, Artificial Sequence
  chemically synthesized
agtggaaacggggtttcaccat

SEQ ID NO: 1313741 - DNA, 22 bp, Artificial Sequence
  chemically synthesized
tagtggaaacggggtttcacca

SEQ ID NO: 1313742 - DNA, 22 bp, Artificial Sequence
  chemically synthesized
ttagtggaaacggggtttcacc

SEQ ID NO: 1313743 - DNA, 22 bp, Artificial Sequence
  chemically synthesized
gccaacatggtgaaaccccgtt

SEQ ID NO: 1313744 - DNA, 22 bp, Artificial Sequence
  chemically synthesized
tatttttagtggaaacggggtt

SEQ ID NO: 1313745 - DNA, 22 bp, Artificial Sequence
  chemically synthesized
gtatttttagtggaaacggggt

SEQ ID NO: 1313746 - DNA, 22 bp, Artificial Sequence
  chemically synthesized
tgtatttttagtggaaacgggg

SEQ ID NO: 1313747 - DNA, 22 bp, Artificial Sequence
  chemically synthesized
ttgtatttttagtggaaacggg

SEQ ID NO: 1313748 - DNA, 22 bp, Artificial Sequence
  chemically synthesized
atttttgtatttttagtggaaa

SEQ ID NO: 1313749 - DNA, 22 bp, Artificial Sequence
  chemically synthesized
gctaatttttgtatttttagtg

SEQ ID NO: 1313750 - DNA, 22 bp, Artificial Sequence
  chemically synthesized
ggctaatttttgtatttttagt

SEQ ID NO: 1313751 - DNA, 22 bp, Artificial Sequence
  chemically synthesized
ccactaaaaatacaaaaattag

SEQ ID NO: 1313752 - DNA, 22 bp, Artificial Sequence
  chemically synthesized
cactaaaaatacaaaaattagc

SEQ ID NO: 1313753 - DNA, 22 bp, Artificial Sequence
  chemically synthesized
aaaatacaaaaattagccaagt

SEQ ID NO: 1313754 - DNA, 22 bp, Artificial Sequence
  chemically synthesized
caggcatgtgccaccacacttg

SEQ ID NO: 1313755 - DNA, 22 bp, Artificial Sequence
  chemically synthesized
ggactacaggcatgtgccacca

SEQ ID NO: 1313756 - DNA, 22 bp, Artificial Sequence
  chemically synthesized
gccaagtgtggtggcacatgcc

SEQ ID NO: 1313757 - DNA, 22 bp, Artificial Sequence
  chemically synthesized
ccagatagctgggactacaggc

SEQ ID NO: 1313758 - DNA, 22 bp, Artificial Sequence
  chemically synthesized
cctcccagatagctgggactac

SEQ ID NO: 1313759 - DNA, 22 bp, Artificial Sequence
  chemically synthesized
caaccactgcctcccagatagc

SEQ ID NO: 1313760 - DNA, 22 bp, Artificial Sequence
  chemically synthesized
tagtcccagctatctgggaggc

SEQ ID NO: 1313761 - DNA, 22 bp, Artificial Sequence
  chemically synthesized
actgcaaccactgcctcccaga

SEQ ID NO: 1313762 - DNA, 22 bp, Artificial Sequence
  chemically synthesized
agctcactgcaaccactgcctc

SEQ ID NO: 1313763 - DNA, 22 bp, Artificial Sequence
  chemically synthesized
tctgggaggcagtggttgcagt

SEQ ID NO: 1313764 - DNA, 22 bp, Artificial Sequence
  chemically synthesized
ggaggcagtggttgcagtgagc

SEQ ID NO: 1313765 - DNA, 22 bp, Artificial Sequence
  chemically synthesized
gagtgaagtggcgtgatctcag

SEQ ID NO: 1313766 - DNA, 22 bp, Artificial Sequence
  chemically synthesized
cagtgagctgagatcacgccac

SEQ ID NO: 1313767 - DNA, 22 bp, Artificial Sequence
  chemically synthesized
cccaggctggagtgaagtggcg

SEQ ID NO: 1313768 - DNA, 22 bp, Artificial Sequence
  chemically synthesized
ttgcccaggctggagtgaagtg

SEQ ID NO: 1313769 - DNA, 22 bp, Artificial Sequence
  chemically synthesized
tgttgcccaggctggagtgaag

SEQ ID NO: 1313770 - DNA, 22 bp, Artificial Sequence
  chemically synthesized
agatcacgccacttcactccag

SEQ ID NO: 1313771 - DNA, 22 bp, Artificial Sequence
  chemically synthesized
actctgttgcccaggctggagt

SEQ ID NO: 1313772 - DNA, 22 bp, Artificial Sequence
  chemically synthesized
cactccagcctgggcaacagag

SEQ ID NO: 1313773 - DNA, 22 bp, Artificial Sequence
  chemically synthesized
actccagcctgggcaacagagt

SEQ ID NO: 1313774 - DNA, 22 bp, Artificial Sequence
  chemically synthesized
cagcctgggcaacagagtgaga

SEQ ID NO: 1313775 - DNA, 22 bp, Artificial Sequence
  chemically synthesized
atcaggacagagtctcactctg

SEQ ID NO: 1313776 - DNA, 22 bp, Artificial Sequence
  chemically synthesized
aatcaggacagagtctcactct

SEQ ID NO: 1313777 - DNA, 22 bp, Artificial Sequence
  chemically synthesized
taatcaggacagagtctcactc

SEQ ID NO: 1313778 - DNA, 22 bp, Artificial Sequence
  chemically synthesized
ttaatcaggacagagtctcact

SEQ ID NO: 1313779 - DNA, 22 bp, Artificial Sequence
  chemically synthesized
tttaatcaggacagagtctcac

SEQ ID NO: 1313780 - DNA, 22 bp, Artificial Sequence
  chemically synthesized
ttttaatcaggacagagtctca

SEQ ID NO: 1313781 - DNA, 22 bp, Artificial Sequence
  chemically synthesized
tttttaatcaggacagagtctc

SEQ ID NO: 1313782 - DNA, 22 bp, Artificial Sequence
  chemically synthesized
ggcaacagagtgagactctgtc

SEQ ID NO: 1313783 - DNA, 22 bp, Artificial Sequence
  chemically synthesized
ttttttaatcaggacagagtct

SEQ ID NO: 1313784 - DNA, 22 bp, Artificial Sequence
  chemically synthesized
tttttttaatcaggacagagtc

SEQ ID NO: 1313785 - DNA, 22 bp, Artificial Sequence
  chemically synthesized
ttttttttaatcaggacagagt

SEQ ID NO: 1313786 - DNA, 22 bp, Artificial Sequence
  chemically synthesized
tttttttttaatcaggacagag

SEQ ID NO: 1313787 - DNA, 22 bp, Artificial Sequence
  chemically synthesized
ttttttttttaatcaggacaga

SEQ ID NO: 1313788 - DNA, 22 bp, Artificial Sequence
  chemically synthesized
tttttttttttaatcaggacag

SEQ ID NO: 1313789 - DNA, 22 bp, Artificial Sequence
  chemically synthesized
ttttttttttttaatcaggaca

SEQ ID NO: 1313790 - DNA, 22 bp, Artificial Sequence
  chemically synthesized
tttttttttttttaatcaggac

SEQ ID NO: 1313791 - DNA, 22 bp, Artificial Sequence
  chemically synthesized
ttttttttttttttaatcagga

SEQ ID NO: 1313792 - DNA, 22 bp, Artificial Sequence
  chemically synthesized
tttttttttttttttaatcagg

SEQ ID NO: 1313793 - DNA, 22 bp, Artificial Sequence
  chemically synthesized
ttttttttttttttttaatcag

SEQ ID NO: 1313794 - DNA, 22 bp, Artificial Sequence
  chemically synthesized
tttttttttttttttttaatca

SEQ ID NO: 1313795 - DNA, 22 bp, Artificial Sequence
  chemically synthesized
ttttttttttttttttttaatc

SEQ ID NO: 1313796 - DNA, 22 bp, Artificial Sequence
  chemically synthesized
tgtcctgattaaaaaaaaaaaa

SEQ ID NO: 1313797 - DNA, 22 bp, Artificial Sequence
  chemically synthesized
tcctgattaaaaaaaaaaaaaa

SEQ ID NO: 1313798 - DNA, 22 bp, Artificial Sequence
  chemically synthesized
tatatccttttttttttttttt

SEQ ID NO: 1313799 - DNA, 22 bp, Artificial Sequence
  chemically synthesized
gtatatcctttttttttttttt

SEQ ID NO: 1313800 - DNA, 22 bp, Artificial Sequence
  chemically synthesized
attaaaaaaaaaaaaaaaaaaa

SEQ ID NO: 1313801 - DNA, 22 bp, Artificial Sequence
  chemically synthesized
aaaaaaaaaaaaaaaaaaagga

SEQ ID NO: 1313802 - DNA, 22 bp, Artificial Sequence
  chemically synthesized
gatatttgtatatccttttttt

SEQ ID NO: 1313803 - DNA, 22 bp, Artificial Sequence
  chemically synthesized
gccctggatatttgtatatcct

SEQ ID NO: 1313804 - DNA, 22 bp, Artificial Sequence
  chemically synthesized
caattagccctggatatttgta

SEQ ID NO: 1313805 - DNA, 22 bp, Artificial Sequence
  chemically synthesized
aatctccaattagccctggata

SEQ ID NO: 1313806 - DNA, 22 bp, Artificial Sequence
  chemically synthesized
tcaaatctgaatctccaattag

SEQ ID NO: 1313807 - DNA, 22 bp, Artificial Sequence
  chemically synthesized
tgcattatcaaatctgaatctc

SEQ ID NO: 1313808 - DNA, 22 bp, Artificial Sequence
  chemically synthesized
ctatgcattatcaaatctgaat

SEQ ID NO: 1313809 - DNA, 22 bp, Artificial Sequence
  chemically synthesized
cctatgcattatcaaatctgaa

SEQ ID NO: 1313810 - DNA, 22 bp, Artificial Sequence
  chemically synthesized
tcctatgcattatcaaatctga

SEQ ID NO: 1313811 - DNA, 22 bp, Artificial Sequence
  chemically synthesized
attggagattcagatttgataa

SEQ ID NO: 1313812 - DNA, 22 bp, Artificial Sequence
  chemically synthesized
gagattcagatttgataatgca

SEQ ID NO: 1313813 - DNA, 22 bp, Artificial Sequence
  chemically synthesized
ggatctttcctatgcattatca

SEQ ID NO: 1313814 - DNA, 22 bp, Artificial Sequence
  chemically synthesized
agatttgataatgcataggaaa

SEQ ID NO: 1313815 - DNA, 22 bp, Artificial Sequence
  chemically synthesized
tagtgtactaggatctttccta

SEQ ID NO: 1313816 - DNA, 22 bp, Artificial Sequence
  chemically synthesized
atagtgtactaggatctttcct

SEQ ID NO: 1313817 - DNA, 22 bp, Artificial Sequence
  chemically synthesized
gataatgcataggaaagatcct

SEQ ID NO: 1313818 - DNA, 22 bp, Artificial Sequence
  chemically synthesized
ataatgcataggaaagatccta

SEQ ID NO: 1313819 - DNA, 22 bp, Artificial Sequence
  chemically synthesized
taaatgtaaggtgtcttatagt

SEQ ID NO: 1313820 - DNA, 22 bp, Artificial Sequence
  chemically synthesized
ataaatgtaaggtgtcttatag

SEQ ID NO: 1313821 - DNA, 22 bp, Artificial Sequence
  chemically synthesized
tataaatgtaaggtgtcttata

SEQ ID NO: 1313822 - DNA, 22 bp, Artificial Sequence
  chemically synthesized
ctttataaatgtaaggtgtctt

SEQ ID NO: 1313823 - DNA, 22 bp, Artificial Sequence
  chemically synthesized
gtacactataagacaccttaca

SEQ ID NO: 1313824 - DNA, 22 bp, Artificial Sequence
  chemically synthesized
tactactttataaatgtaaggt

SEQ ID NO: 1313825 - DNA, 22 bp, Artificial Sequence
  chemically synthesized
taagacaccttacatttataaa

SEQ ID NO: 1313826 - DNA, 22 bp, Artificial Sequence
  chemically synthesized
acatttataaagtagtataatt

SEQ ID NO: 1313827 - DNA, 22 bp, Artificial Sequence
  chemically synthesized
catttataaagtagtataattg

SEQ ID NO: 1313828 - DNA, 22 bp, Artificial Sequence
  chemically synthesized
ataaagtagtataattgtcatc

SEQ ID NO: 1313829 - DNA, 22 bp, Artificial Sequence
  chemically synthesized
taaagtagtataattgtcatcc

SEQ ID NO: 1313830 - DNA, 22 bp, Artificial Sequence
  chemically synthesized
tgatgtaataataatggtatgt

SEQ ID NO: 1313831 - DNA, 22 bp, Artificial Sequence
  chemically synthesized
actatgatgtaataataatggt

SEQ ID NO: 1313832 - DNA, 22 bp, Artificial Sequence
  chemically synthesized
cactatgatgtaataataatgg

SEQ ID NO: 1313833 - DNA, 22 bp, Artificial Sequence
  chemically synthesized
tcatccacataccattattatt

SEQ ID NO: 1313834 - DNA, 22 bp, Artificial Sequence
  chemically synthesized
tcactatgatgtaataataatg

SEQ ID NO: 1313835 - DNA, 22 bp, Artificial Sequence
  chemically synthesized
ttcactatgatgtaataataat

SEQ ID NO: 1313836 - DNA, 22 bp, Artificial Sequence
  chemically synthesized
tttcactatgatgtaataataa

SEQ ID NO: 1313837 - DNA, 22 bp, Artificial Sequence
  chemically synthesized
tattttttcactatgatgtaat

SEQ ID NO: 1313838 - DNA, 22 bp, Artificial Sequence
  chemically synthesized
taagttgtattttttcactatg

SEQ ID NO: 1313839 - DNA, 22 bp, Artificial Sequence
  chemically synthesized
gtaagttgtattttttcactat

SEQ ID NO: 1313840 - DNA, 22 bp, Artificial Sequence
  chemically synthesized
ttattacatcatagtgaaaaaa

SEQ ID NO: 1313841 - DNA, 22 bp, Artificial Sequence
  chemically synthesized
ttgtaagttgtattttttcact

SEQ ID NO: 1313842 - DNA, 22 bp, Artificial Sequence
  chemically synthesized
ttacatcatagtgaaaaaatac

SEQ ID NO: 1313843 - DNA, 22 bp, Artificial Sequence
  chemically synthesized
aactcttgtaagttgtattttt

SEQ ID NO: 1313844 - DNA, 22 bp, Artificial Sequence
  chemically synthesized
catcatagtgaaaaaatacaac

SEQ ID NO: 1313845 - DNA, 22 bp, Artificial Sequence
  chemically synthesized
agctgaactcttgtaagttgta

SEQ ID NO: 1313846 - DNA, 22 bp, Artificial Sequence
  chemically synthesized
agctcagctgaactcttgtaag

SEQ ID NO: 1313847 - DNA, 22 bp, Artificial Sequence
  chemically synthesized
aagctcagctgaactcttgtaa

SEQ ID NO: 1313848 - DNA, 22 bp, Artificial Sequence
  chemically synthesized
taagctcagctgaactcttgta

SEQ ID NO: 1313849 - DNA, 22 bp, Artificial Sequence
  chemically synthesized
tttaagctcagctgaactcttg

SEQ ID NO: 1313850 - DNA, 22 bp, Artificial Sequence
  chemically synthesized
acaagagttcagctgagcttaa

SEQ ID NO: 1313851 - DNA, 22 bp, Artificial Sequence
  chemically synthesized
caagagttcagctgagcttaaa

SEQ ID NO: 1313852 - DNA, 22 bp, Artificial Sequence
  chemically synthesized
aaatgaatatattctttaagct

SEQ ID NO: 1313853 - DNA, 22 bp, Artificial Sequence
  chemically synthesized
caaatgaatatattctttaagc

SEQ ID NO: 1313854 - DNA, 22 bp, Artificial Sequence
  chemically synthesized
ggcttcaaatgaatatattctt

SEQ ID NO: 1313855 - DNA, 22 bp, Artificial Sequence
  chemically synthesized
agctgagcttaaagaatatatt

SEQ ID NO: 1313856 - DNA, 22 bp, Artificial Sequence
  chemically synthesized
agcttaaagaatatattcattt

SEQ ID NO: 1313857 - DNA, 22 bp, Artificial Sequence
  chemically synthesized
aaagaatatattcatttgaagc

SEQ ID NO: 1313858 - DNA, 22 bp, Artificial Sequence
  chemically synthesized
aagaatatattcatttgaagcc

SEQ ID NO: 1313859 - DNA, 22 bp, Artificial Sequence
  chemically synthesized
acacaacaatgattgggcttca

SEQ ID NO: 1313860 - DNA, 22 bp, Artificial Sequence
  chemically synthesized
atttgaagcccaatcattgttg

SEQ ID NO: 1313861 - DNA, 22 bp, Artificial Sequence
  chemically synthesized
gaagcccaatcattgttgtgtg

SEQ ID NO: 1313862 - DNA, 22 bp, Artificial Sequence
  chemically synthesized
aagcccaatcattgttgtgtga

SEQ ID NO: 1313863 - DNA, 22 bp, Artificial Sequence
  chemically synthesized
aaataagataatatgaagaagc

SEQ ID NO: 1313864 - DNA, 22 bp, Artificial Sequence
  chemically synthesized
ttgtgtgagcttcttcatatta

SEQ ID NO: 1313865 - DNA, 22 bp, Artificial Sequence
  chemically synthesized
tgtgagcttcttcatattatct

SEQ ID NO: 1313866 - DNA, 22 bp, Artificial Sequence
  chemically synthesized
cttcatattatcttatttcaat

SEQ ID NO: 1313867 - DNA, 22 bp, Artificial Sequence
  chemically synthesized
ttcatattatcttatttcaatt

SEQ ID NO: 1313868 - DNA, 22 bp, Artificial Sequence
  chemically synthesized
catattatcttatttcaattat

SEQ ID NO: 1313869 - DNA, 22 bp, Artificial Sequence
  chemically synthesized
atattatcttatttcaattatt

SEQ ID NO: 1313870 - DNA, 22 bp, Artificial Sequence
  chemically synthesized
agataaaagcataataattgaa

SEQ ID NO: 1313871 - DNA, 22 bp, Artificial Sequence
  chemically synthesized
tcttatttcaattattatgctt

SEQ ID NO: 1313872 - DNA, 22 bp, Artificial Sequence
  chemically synthesized
gagtctaagataaaagcataat

SEQ ID NO: 1313873 - DNA, 22 bp, Artificial Sequence
  chemically synthesized
atttcaattattatgcttttat

SEQ ID NO: 1313874 - DNA, 22 bp, Artificial Sequence
  chemically synthesized
tttcaattattatgcttttatc

SEQ ID NO: 1313875 - DNA, 22 bp, Artificial Sequence
  chemically synthesized
caattattatgcttttatctta

SEQ ID NO: 1313876 - DNA, 22 bp, Artificial Sequence
  chemically synthesized
aattattatgcttttatcttag

SEQ ID NO: 1313877 - DNA, 22 bp, Artificial Sequence
  chemically synthesized
gatatataattagagtctaaga

SEQ ID NO: 1313878 - DNA, 22 bp, Artificial Sequence
  chemically synthesized
ttatgcttttatcttagactct

SEQ ID NO: 1313879 - DNA, 22 bp, Artificial Sequence
  chemically synthesized
tgcttttatcttagactctaat

SEQ ID NO: 1313880 - DNA, 22 bp, Artificial Sequence
  chemically synthesized
ttatcttagactctaattatat

SEQ ID NO: 1313881 - DNA, 22 bp, Artificial Sequence
  chemically synthesized
tatcttagactctaattatata

SEQ ID NO: 1313882 - DNA, 22 bp, Artificial Sequence
  chemically synthesized
atcttagactctaattatatat

SEQ ID NO: 1313883 - DNA, 22 bp, Artificial Sequence
  chemically synthesized
tcttagactctaattatatatc

SEQ ID NO: 1313884 - DNA, 22 bp, Artificial Sequence
  chemically synthesized
agactctaattatatatccagt

SEQ ID NO: 1313885 - DNA, 22 bp, Artificial Sequence
  chemically synthesized
gactctaattatatatccagtt

SEQ ID NO: 1313886 - DNA, 22 bp, Artificial Sequence
  chemically synthesized
atggcgtaagtaaaactggata

SEQ ID NO: 1313887 - DNA, 22 bp, Artificial Sequence
  chemically synthesized
aatggcgtaagtaaaactggat

SEQ ID NO: 1313888 - DNA, 22 bp, Artificial Sequence
  chemically synthesized
taattatatatccagttttact

SEQ ID NO: 1313889 - DNA, 22 bp, Artificial Sequence
  chemically synthesized
atttaatggcgtaagtaaaact

SEQ ID NO: 1313890 - DNA, 22 bp, Artificial Sequence
  chemically synthesized
attatatatccagttttactta

SEQ ID NO: 1313891 - DNA, 22 bp, Artificial Sequence
  chemically synthesized
tatatccagttttacttacgcc

SEQ ID NO: 1313892 - DNA, 22 bp, Artificial Sequence
  chemically synthesized
aaattcatttaatggcgtaagt

SEQ ID NO: 1313893 - DNA, 22 bp, Artificial Sequence
  chemically synthesized
aaaattcatttaatggcgtaag

SEQ ID NO: 1313894 - DNA, 22 bp, Artificial Sequence
  chemically synthesized
taaaattcatttaatggcgtaa

SEQ ID NO: 1313895 - DNA, 22 bp, Artificial Sequence
  chemically synthesized
ttaaaattcatttaatggcgta

SEQ ID NO: 1313896 - DNA, 22 bp, Artificial Sequence
  chemically synthesized
cttttaaaattcatttaatggc

SEQ ID NO: 1313897 - DNA, 22 bp, Artificial Sequence
  chemically synthesized
tacttacgccattaaatgaatt

SEQ ID NO: 1313898 - DNA, 22 bp, Artificial Sequence
  chemically synthesized
acttacgccattaaatgaattt

SEQ ID NO: 1313899 - DNA, 22 bp, Artificial Sequence
  chemically synthesized
cttacgccattaaatgaatttt

SEQ ID NO: 1313900 - DNA, 22 bp, Artificial Sequence
  chemically synthesized
atgtgactccttttaaaattca

SEQ ID NO: 1313901 - DNA, 22 bp, Artificial Sequence
  chemically synthesized
acgccattaaatgaattttaaa

SEQ ID NO: 1313902 - DNA, 22 bp, Artificial Sequence
  chemically synthesized
aatgtgactccttttaaaattc

SEQ ID NO: 1313903 - DNA, 22 bp, Artificial Sequence
  chemically synthesized
cgccattaaatgaattttaaaa

SEQ ID NO: 1313904 - DNA, 22 bp, Artificial Sequence
  chemically synthesized
tttaatgtgactccttttaaaa

SEQ ID NO: 1313905 - DNA, 22 bp, Artificial Sequence
  chemically synthesized
atttaatgtgactccttttaaa

SEQ ID NO: 1313906 - DNA, 22 bp, Artificial Sequence
  chemically synthesized
tatttaatgtgactccttttaa

SEQ ID NO: 1313907 - DNA, 22 bp, Artificial Sequence
  chemically synthesized
aatgaattttaaaaggagtcac

SEQ ID NO: 1313908 - DNA, 22 bp, Artificial Sequence
  chemically synthesized
aagggcctttatttaatgtgac

SEQ ID NO: 1313909 - DNA, 22 bp, Artificial Sequence
  chemically synthesized
aaagggcctttatttaatgtga

SEQ ID NO: 1313910 - DNA, 22 bp, Artificial Sequence
  chemically synthesized
taaaaggagtcacattaaataa

SEQ ID NO: 1313911 - DNA, 22 bp, Artificial Sequence
  chemically synthesized
aaaaggagtcacattaaataaa

SEQ ID NO: 1313912 - DNA, 22 bp, Artificial Sequence
  chemically synthesized
aaaggagtcacattaaataaag

SEQ ID NO: 1313913 - DNA, 22 bp, Artificial Sequence
  chemically synthesized
ataaaaaatttaaagggccttt

SEQ ID NO: 1313914 - DNA, 22 bp, Artificial Sequence
  chemically synthesized
tctcataaaaaatttaaagggc

SEQ ID NO: 1313915 - DNA, 22 bp, Artificial Sequence
  chemically synthesized
atctcataaaaaatttaaaggg

SEQ ID NO: 1313916 - DNA, 22 bp, Artificial Sequence
  chemically synthesized
tatctcataaaaaatttaaagg

SEQ ID NO: 1313917 - DNA, 22 bp, Artificial Sequence
  chemically synthesized
tttatctcataaaaaatttaaa

SEQ ID NO: 1313918 - DNA, 22 bp, Artificial Sequence
  chemically synthesized
aataaaggccctttaaattttt

SEQ ID NO: 1313919 - DNA, 22 bp, Artificial Sequence
  chemically synthesized
tggcaactctttatctcataaa

SEQ ID NO: 1313920 - DNA, 22 bp, Artificial Sequence
  chemically synthesized
taaattttttatgagataaaga

SEQ ID NO: 1313921 - DNA, 22 bp, Artificial Sequence
  chemically synthesized
aaattttttatgagataaagag

SEQ ID NO: 1313922 - DNA, 22 bp, Artificial Sequence
  chemically synthesized
aattttttatgagataaagagt

SEQ ID NO: 1313923 - DNA, 22 bp, Artificial Sequence
  chemically synthesized
tttatgagataaagagttgcca

SEQ ID NO: 1313924 - DNA, 22 bp, Artificial Sequence
  chemically synthesized
ttatgagataaagagttgccat

SEQ ID NO: 1313925 - DNA, 22 bp, Artificial Sequence
  chemically synthesized
tatgagataaagagttgccata

SEQ ID NO: 1313926 - DNA, 22 bp, Artificial Sequence
  chemically synthesized
atgagataaagagttgccatag

SEQ ID NO: 1313927 - DNA, 22 bp, Artificial Sequence
  chemically synthesized
tgagataaagagttgccataga

SEQ ID NO: 1313928 - DNA, 22 bp, Artificial Sequence
  chemically synthesized
taccgggtaagatgcaaaagag

SEQ ID NO: 1313929 - DNA, 22 bp, Artificial Sequence
  chemically synthesized
ccatagacacactcttttgcat

SEQ ID NO: 1313930 - DNA, 22 bp, Artificial Sequence
  chemically synthesized
actgtaccgggtaagatgcaaa

SEQ ID NO: 1313931 - DNA, 22 bp, Artificial Sequence
  chemically synthesized
gactgtaccgggtaagatgcaa

SEQ ID NO: 1313932 - DNA, 22 bp, Artificial Sequence
  chemically synthesized
agtttgactgtaccgggtaaga

SEQ ID NO: 1313933 - DNA, 22 bp, Artificial Sequence
  chemically synthesized
attgagtttgactgtaccgggt

SEQ ID NO: 1313934 - DNA, 22 bp, Artificial Sequence
  chemically synthesized
ttttgcatcttacccggtacag

SEQ ID NO: 1313935 - DNA, 22 bp, Artificial Sequence
  chemically synthesized
ttgcatcttacccggtacagtc

SEQ ID NO: 1313936 - DNA, 22 bp, Artificial Sequence
  chemically synthesized
tgcatcttacccggtacagtca

SEQ ID NO: 1313937 - DNA, 22 bp, Artificial Sequence
  chemically synthesized
gcatcttacccggtacagtcaa

SEQ ID NO: 1313938 - DNA, 22 bp, Artificial Sequence
  chemically synthesized
catcttacccggtacagtcaaa

SEQ ID NO: 1313939 - DNA, 22 bp, Artificial Sequence
  chemically synthesized
aatagttaattgagtttgactg

SEQ ID NO: 1313940 - DNA, 22 bp, Artificial Sequence
  chemically synthesized
acccggtacagtcaaactcaat

SEQ ID NO: 1313941 - DNA, 22 bp, Artificial Sequence
  chemically synthesized
cccggtacagtcaaactcaatt

SEQ ID NO: 1313942 - DNA, 22 bp, Artificial Sequence
  chemically synthesized
ccagtctgaatagttaattgag

SEQ ID NO: 1313943 - DNA, 22 bp, Artificial Sequence
  chemically synthesized
gccagtctgaatagttaattga

SEQ ID NO: 1313944 - DNA, 22 bp, Artificial Sequence
  chemically synthesized
tgccagtctgaatagttaattg

SEQ ID NO: 1313945 - DNA, 22 bp, Artificial Sequence
  chemically synthesized
aattaactattcagactggcaa

SEQ ID NO: 1313946 - DNA, 22 bp, Artificial Sequence
  chemically synthesized
actattcagactggcaaagcat

SEQ ID NO: 1313947 - DNA, 22 bp, Artificial Sequence
  chemically synthesized
cgaaaaatgtaaaagatgcttt

SEQ ID NO: 1313948 - DNA, 22 bp, Artificial Sequence
  chemically synthesized
ttcagactggcaaagcatcttt

SEQ ID NO: 1313949 - DNA, 22 bp, Artificial Sequence
  chemically synthesized
acgaaaaatgtaaaagatgctt

SEQ ID NO: 1313950 - DNA, 22 bp, Artificial Sequence
  chemically synthesized
tacgaaaaatgtaaaagatgct

SEQ ID NO: 1313951 - DNA, 22 bp, Artificial Sequence
  chemically synthesized
agactggcaaagcatcttttac

SEQ ID NO: 1313952 - DNA, 22 bp, Artificial Sequence
  chemically synthesized
gaatctttacgaaaaatgtaaa

SEQ ID NO: 1313953 - DNA, 22 bp, Artificial Sequence
  chemically synthesized
gcaaagcatcttttacattttt

SEQ ID NO: 1313954 - DNA, 22 bp, Artificial Sequence
  chemically synthesized
agaatctttacgaaaaatgtaa

SEQ ID NO: 1313955 - DNA, 22 bp, Artificial Sequence
  chemically synthesized
acttagaatctttacgaaaaat

SEQ ID NO: 1313956 - DNA, 22 bp, Artificial Sequence
  chemically synthesized
cacttagaatctttacgaaaaa

SEQ ID NO: 1313957 - DNA, 22 bp, Artificial Sequence
  chemically synthesized
tcacttagaatctttacgaaaa

SEQ ID NO: 1313958 - DNA, 22 bp, Artificial Sequence
  chemically synthesized
ttcacttagaatctttacgaaa

SEQ ID NO: 1313959 - DNA, 22 bp, Artificial Sequence
  chemically synthesized
ttacatttttcgtaaagattct

SEQ ID NO: 1313960 - DNA, 22 bp, Artificial Sequence
  chemically synthesized
tacatttttcgtaaagattcta

SEQ ID NO: 1313961 - DNA, 22 bp, Artificial Sequence
  chemically synthesized
acatttttcgtaaagattctaa

SEQ ID NO: 1313962 - DNA, 22 bp, Artificial Sequence
  chemically synthesized
catttttcgtaaagattctaag

SEQ ID NO: 1313963 - DNA, 22 bp, Artificial Sequence
  chemically synthesized
ttcgtaaagattctaagtgaaa

SEQ ID NO: 1313964 - DNA, 22 bp, Artificial Sequence
  chemically synthesized
tcgtaaagattctaagtgaaaa

SEQ ID NO: 1313965 - DNA, 22 bp, Artificial Sequence
  chemically synthesized
cgtaaagattctaagtgaaaag

SEQ ID NO: 1313966 - DNA, 22 bp, Artificial Sequence
  chemically synthesized
gtaaagattctaagtgaaaaga

SEQ ID NO: 1313967 - DNA, 22 bp, Artificial Sequence
  chemically synthesized
aaaaatagtacaatcttttcac

SEQ ID NO: 1313968 - DNA, 22 bp, Artificial Sequence
  chemically synthesized
attgaaaaatagtacaatcttt

SEQ ID NO: 1313969 - DNA, 22 bp, Artificial Sequence
  chemically synthesized
aattgaaaaatagtacaatctt

SEQ ID NO: 1313970 - DNA, 22 bp, Artificial Sequence
  chemically synthesized
taagtgaaaagattgtactatt

SEQ ID NO: 1313971 - DNA, 22 bp, Artificial Sequence
  chemically synthesized
agtgaaaagattgtactatttt

SEQ ID NO: 1313972 - DNA, 22 bp, Artificial Sequence
  chemically synthesized
aaagatatataacttaattgaa

SEQ ID NO: 1313973 - DNA, 22 bp, Artificial Sequence
  chemically synthesized
gaaagatatataacttaattga

SEQ ID NO: 1313974 - DNA, 22 bp, Artificial Sequence
  chemically synthesized
tgaaagatatataacttaattg

SEQ ID NO: 1313975 - DNA, 22 bp, Artificial Sequence
  chemically synthesized
ttgaaagatatataacttaatt

SEQ ID NO: 1313976 - DNA, 22 bp, Artificial Sequence
  chemically synthesized
tactatttttcaattaagttat

SEQ ID NO: 1313977 - DNA, 22 bp, Artificial Sequence
  chemically synthesized
tttttgaaagatatataactta

SEQ ID NO: 1313978 - DNA, 22 bp, Artificial Sequence
  chemically synthesized
tttttcaattaagttatatatc

SEQ ID NO: 1313979 - DNA, 22 bp, Artificial Sequence
  chemically synthesized
ttcaattaagttatatatcttt

SEQ ID NO: 1313980 - DNA, 22 bp, Artificial Sequence
  chemically synthesized
tcaattaagttatatatctttc

SEQ ID NO: 1313981 - DNA, 22 bp, Artificial Sequence
  chemically synthesized
ccagctatttttgaaagatata

SEQ ID NO: 1313982 - DNA, 22 bp, Artificial Sequence
  chemically synthesized
caattaagttatatatctttca

SEQ ID NO: 1313983 - DNA, 22 bp, Artificial Sequence
  chemically synthesized
aattaagttatatatctttcaa

SEQ ID NO: 1313984 - DNA, 22 bp, Artificial Sequence
  chemically synthesized
atctaccagctatttttgaaag

SEQ ID NO: 1313985 - DNA, 22 bp, Artificial Sequence
  chemically synthesized
aatctaccagctatttttgaaa

SEQ ID NO: 1313986 - DNA, 22 bp, Artificial Sequence
  chemically synthesized
agttatatatctttcaaaaata

SEQ ID NO: 1313987 - DNA, 22 bp, Artificial Sequence
  chemically synthesized
taatctaccagctatttttgaa

SEQ ID NO: 1313988 - DNA, 22 bp, Artificial Sequence
  chemically synthesized
ctttaatctaccagctattttt

SEQ ID NO: 1313989 - DNA, 22 bp, Artificial Sequence
  chemically synthesized
gctttaatctaccagctatttt

SEQ ID NO: 1313990 - DNA, 22 bp, Artificial Sequence
  chemically synthesized
tatatctttcaaaaatagctgg

SEQ ID NO: 1313991 - DNA, 22 bp, Artificial Sequence
  chemically synthesized
tgctttaatctaccagctattt

SEQ ID NO: 1313992 - DNA, 22 bp, Artificial Sequence
  chemically synthesized
tcaaaaatagctggtagattaa

SEQ ID NO: 1313993 - DNA, 22 bp, Artificial Sequence
  chemically synthesized
caaaaatagctggtagattaaa

SEQ ID NO: 1313994 - DNA, 22 bp, Artificial Sequence
  chemically synthesized
aaaaatagctggtagattaaag

SEQ ID NO: 1313995 - DNA, 22 bp, Artificial Sequence
  chemically synthesized
tgacagtgcctttgctttaatc

SEQ ID NO: 1313996 - DNA, 22 bp, Artificial Sequence
  chemically synthesized
tgattgtgacagtgcctttgct

SEQ ID NO: 1313997 - DNA, 22 bp, Artificial Sequence
  chemically synthesized
gtagattaaagcaaaggcactg

SEQ ID NO: 1313998 - DNA, 22 bp, Artificial Sequence
  chemically synthesized
aagcaaaggcactgtcacaatc

SEQ ID NO: 1313999 - DNA, 22 bp, Artificial Sequence
  chemically synthesized
aatagaatctgtgattgtgaca

SEQ ID NO: 1314000 - DNA, 22 bp, Artificial Sequence
  chemically synthesized
aatggcactaaatagaatctgt

SEQ ID NO: 1314001 - DNA, 22 bp, Artificial Sequence
  chemically synthesized
taaatggcactaaatagaatct

SEQ ID NO: 1314002 - DNA, 22 bp, Artificial Sequence
  chemically synthesized
tcacaatcacagattctattta

SEQ ID NO: 1314003 - DNA, 22 bp, Artificial Sequence
  chemically synthesized
tcctctaaatggcactaaatag

SEQ ID NO: 1314004 - DNA, 22 bp, Artificial Sequence
  chemically synthesized
gtcctctaaatggcactaaata

SEQ ID NO: 1314005 - DNA, 22 bp, Artificial Sequence
  chemically synthesized
tgtcctctaaatggcactaaat

SEQ ID NO: 1314006 - DNA, 22 bp, Artificial Sequence
  chemically synthesized
ttgtcctctaaatggcactaaa

SEQ ID NO: 1314007 - DNA, 22 bp, Artificial Sequence
  chemically synthesized
atttttgtcctctaaatggcac

SEQ ID NO: 1314008 - DNA, 22 bp, Artificial Sequence
  chemically synthesized
catttttgtcctctaaatggca

SEQ ID NO: 1314009 - DNA, 22 bp, Artificial Sequence
  chemically synthesized
gcttcatttttgtcctctaaat

SEQ ID NO: 1314010 - DNA, 22 bp, Artificial Sequence
  chemically synthesized
tatttagtgccatttagaggac

SEQ ID NO: 1314011 - DNA, 22 bp, Artificial Sequence
  chemically synthesized
tttagtgccatttagaggacaa

SEQ ID NO: 1314012 - DNA, 22 bp, Artificial Sequence
  chemically synthesized
gctggcttcatttttgtcctct

SEQ ID NO: 1314013 - DNA, 22 bp, Artificial Sequence
  chemically synthesized
agtgccatttagaggacaaaaa

SEQ ID NO: 1314014 - DNA, 22 bp, Artificial Sequence
  chemically synthesized
gtgccatttagaggacaaaaat

SEQ ID NO: 1314015 - DNA, 22 bp, Artificial Sequence
  chemically synthesized
aagtctagctggcttcattttt

SEQ ID NO: 1314016 - DNA, 22 bp, Artificial Sequence
  chemically synthesized
caagtctagctggcttcatttt

SEQ ID NO: 1314017 - DNA, 22 bp, Artificial Sequence
  chemically synthesized
tcaagtctagctggcttcattt

SEQ ID NO: 1314018 - DNA, 22 bp, Artificial Sequence
  chemically synthesized
agaggacaaaaatgaagccagc

SEQ ID NO: 1314019 - DNA, 22 bp, Artificial Sequence
  chemically synthesized
gaggacaaaaatgaagccagct

SEQ ID NO: 1314020 - DNA, 22 bp, Artificial Sequence
  chemically synthesized
tgaacacattttcaagtctagc

SEQ ID NO: 1314021 - DNA, 22 bp, Artificial Sequence
  chemically synthesized
aaaaatcactatgaacacattt

SEQ ID NO: 1314022 - DNA, 22 bp, Artificial Sequence
  chemically synthesized
gacttgaaaatgtgttcatagt

SEQ ID NO: 1314023 - DNA, 22 bp, Artificial Sequence
  chemically synthesized
atacattgaaaaatcactatga

SEQ ID NO: 1314024 - DNA, 22 bp, Artificial Sequence
  chemically synthesized
gatacattgaaaaatcactatg

SEQ ID NO: 1314025 - DNA, 22 bp, Artificial Sequence
  chemically synthesized
gaaaatgtgttcatagtgattt

SEQ ID NO: 1314026 - DNA, 22 bp, Artificial Sequence
  chemically synthesized
tgatacattgaaaaatcactat

SEQ ID NO: 1314027 - DNA, 22 bp, Artificial Sequence
  chemically synthesized
aaaatgtgttcatagtgatttt

SEQ ID NO: 1314028 - DNA, 22 bp, Artificial Sequence
  chemically synthesized
gtagattttgatacattgaaaa

SEQ ID NO: 1314029 - DNA, 22 bp, Artificial Sequence
  chemically synthesized
agtagattttgatacattgaaa

SEQ ID NO: 1314030 - DNA, 22 bp, Artificial Sequence
  chemically synthesized
atagtgatttttcaatgtatca

SEQ ID NO: 1314031 - DNA, 22 bp, Artificial Sequence
  chemically synthesized
catttagtagattttgatacat

SEQ ID NO: 1314032 - DNA, 22 bp, Artificial Sequence
  chemically synthesized
aatgttccatttagtagatttt

SEQ ID NO: 1314033 - DNA, 22 bp, Artificial Sequence
  chemically synthesized
ttcaatgtatcaaaatctacta

SEQ ID NO: 1314034 - DNA, 22 bp, Artificial Sequence
  chemically synthesized
tcaatgtatcaaaatctactaa

SEQ ID NO: 1314035 - DNA, 22 bp, Artificial Sequence
  chemically synthesized
caatgtatcaaaatctactaaa

SEQ ID NO: 1314036 - DNA, 22 bp, Artificial Sequence
  chemically synthesized
aatgtatcaaaatctactaaat

SEQ ID NO: 1314037 - DNA, 22 bp, Artificial Sequence
  chemically synthesized
ccattcaatgttccatttagta

SEQ ID NO: 1314038 - DNA, 22 bp, Artificial Sequence
  chemically synthesized
gccattcaatgttccatttagt

SEQ ID NO: 1314039 - DNA, 22 bp, Artificial Sequence
  chemically synthesized
gacttgccattcaatgttccat

SEQ ID NO: 1314040 - DNA, 22 bp, Artificial Sequence
  chemically synthesized
ggacttgccattcaatgttcca

SEQ ID NO: 1314041 - DNA, 22 bp, Artificial Sequence
  chemically synthesized
tggacttgccattcaatgttcc

SEQ ID NO: 1314042 - DNA, 22 bp, Artificial Sequence
  chemically synthesized
ctaaatggaacattgaatggca

SEQ ID NO: 1314043 - DNA, 22 bp, Artificial Sequence
  chemically synthesized
aatggaacattgaatggcaagt

SEQ ID NO: 1314044 - DNA, 22 bp, Artificial Sequence
  chemically synthesized
accatcacatgcctttggactt

SEQ ID NO: 1314045 - DNA, 22 bp, Artificial Sequence
  chemically synthesized
aaccatcacatgcctttggact

SEQ ID NO: 1314046 - DNA, 22 bp, Artificial Sequence
  chemically synthesized
ttaaccatcacatgcctttgga

SEQ ID NO: 1314047 - DNA, 22 bp, Artificial Sequence
  chemically synthesized
cttaaccatcacatgcctttgg

SEQ ID NO: 1314048 - DNA, 22 bp, Artificial Sequence
  chemically synthesized
aatggcaagtccaaaggcatgt

SEQ ID NO: 1314049 - DNA, 22 bp, Artificial Sequence
  chemically synthesized
tgaccagatttcttaaccatca

SEQ ID NO: 1314050 - DNA, 22 bp, Artificial Sequence
  chemically synthesized
ggcctgtgaccagatttcttaa

SEQ ID NO: 1314051 - DNA, 22 bp, Artificial Sequence
  chemically synthesized
agaaatctggtcacaggcccag

SEQ ID NO: 1314052 - DNA, 22 bp, Artificial Sequence
  chemically synthesized
caggcgtgagccaccgcgctgg

SEQ ID NO: 1314053 - DNA, 22 bp, Artificial Sequence
  chemically synthesized
gtcacaggcccagcgcggtggc

SEQ ID NO: 1314054 - DNA, 22 bp, Artificial Sequence
  chemically synthesized
ggattacaggcgtgagccaccg

SEQ ID NO: 1314055 - DNA, 22 bp, Artificial Sequence
  chemically synthesized
ccaaagtgctgggattacaggc

SEQ ID NO: 1314056 - DNA, 22 bp, Artificial Sequence
  chemically synthesized
gcctcccaaagtgctgggatta

SEQ ID NO: 1314057 - DNA, 22 bp, Artificial Sequence
  chemically synthesized
ggcctcccaaagtgctgggatt

SEQ ID NO: 1314058 - DNA, 22 bp, Artificial Sequence
  chemically synthesized
acgcctgtaatcccagcacttt

SEQ ID NO: 1314059 - DNA, 22 bp, Artificial Sequence
  chemically synthesized
ccttggcctcccaaagtgctgg

SEQ ID NO: 1314060 - DNA, 22 bp, Artificial Sequence
  chemically synthesized
taatcccagcactttgggaggc

SEQ ID NO: 1314061 - DNA, 22 bp, Artificial Sequence
  chemically synthesized
aggtgatccgcctgccttggcc

SEQ ID NO: 1314062 - DNA, 22 bp, Artificial Sequence
  chemically synthesized
acctcaggtgatccgcctgcct

SEQ ID NO: 1314063 - DNA, 22 bp, Artificial Sequence
  chemically synthesized
tgggaggccaaggcaggcggat

SEQ ID NO: 1314064 - DNA, 22 bp, Artificial Sequence
  chemically synthesized
gggaggccaaggcaggcggatc

SEQ ID NO: 1314065 - DNA, 22 bp, Artificial Sequence
  chemically synthesized
ctgacctcaggtgatccgcctg

SEQ ID NO: 1314066 - DNA, 22 bp, Artificial Sequence
  chemically synthesized
ggaggccaaggcaggcggatca

SEQ ID NO: 1314067 - DNA, 22 bp, Artificial Sequence
  chemically synthesized
aactcctgacctcaggtgatcc

SEQ ID NO: 1314068 - DNA, 22 bp, Artificial Sequence
  chemically synthesized
aaactcctgacctcaggtgatc

SEQ ID NO: 1314069 - DNA, 22 bp, Artificial Sequence
  chemically synthesized
gtcttaaactcctgacctcagg

SEQ ID NO: 1314070 - DNA, 22 bp, Artificial Sequence
  chemically synthesized
accaggctagtcttaaactcct

SEQ ID NO: 1314071 - DNA, 22 bp, Artificial Sequence
  chemically synthesized
tgctgaccaggctagtcttaaa

SEQ ID NO: 1314072 - DNA, 22 bp, Artificial Sequence
  chemically synthesized
aggtcaggagtttaagactagc

SEQ ID NO: 1314073 - DNA, 22 bp, Artificial Sequence
  chemically synthesized
actatgctgaccaggctagtct

SEQ ID NO: 1314074 - DNA, 22 bp, Artificial Sequence
  chemically synthesized
cactatgctgaccaggctagtc

SEQ ID NO: 1314075 - DNA, 22 bp, Artificial Sequence
  chemically synthesized
aagactagcctggtcagcatag

SEQ ID NO: 1314076 - DNA, 22 bp, Artificial Sequence
  chemically synthesized
agactagcctggtcagcatagt

SEQ ID NO: 1314077 - DNA, 22 bp, Artificial Sequence
  chemically synthesized
gtagagaaggggtttcactatg

SEQ ID NO: 1314078 - DNA, 22 bp, Artificial Sequence
  chemically synthesized
agtagagaaggggtttcactat

SEQ ID NO: 1314079 - DNA, 22 bp, Artificial Sequence
  chemically synthesized
gcctggtcagcatagtgaaacc

SEQ ID NO: 1314080 - DNA, 22 bp, Artificial Sequence
  chemically synthesized
tagtagagaaggggtttcacta

SEQ ID NO: 1314081 - DNA, 22 bp, Artificial Sequence
  chemically synthesized
ttagtagagaaggggtttcact

SEQ ID NO: 1314082 - DNA, 22 bp, Artificial Sequence
  chemically synthesized
gtcagcatagtgaaaccccttc

SEQ ID NO: 1314083 - DNA, 22 bp, Artificial Sequence
  chemically synthesized
tatttttagtagagaaggggtt

SEQ ID NO: 1314084 - DNA, 22 bp, Artificial Sequence
  chemically synthesized
gtatttttagtagagaaggggt

SEQ ID NO: 1314085 - DNA, 22 bp, Artificial Sequence
  chemically synthesized
tgtatttttagtagagaagggg

SEQ ID NO: 1314086 - DNA, 22 bp, Artificial Sequence
  chemically synthesized
ttgtatttttagtagagaaggg

SEQ ID NO: 1314087 - DNA, 22 bp, Artificial Sequence
  chemically synthesized
atttttgtatttttagtagaga

SEQ ID NO: 1314088 - DNA, 22 bp, Artificial Sequence
  chemically synthesized
gctaatttttgtatttttagta

SEQ ID NO: 1314089 - DNA, 22 bp, Artificial Sequence
  chemically synthesized
ctctactaaaaatacaaaaatt

SEQ ID NO: 1314090 - DNA, 22 bp, Artificial Sequence
  chemically synthesized
tctactaaaaatacaaaaatta

SEQ ID NO: 1314091 - DNA, 22 bp, Artificial Sequence
  chemically synthesized
tactaaaaatacaaaaattagc

SEQ ID NO: 1314092 - DNA, 22 bp, Artificial Sequence
  chemically synthesized
cgaccacacctggctaattttt

SEQ ID NO: 1314093 - DNA, 22 bp, Artificial Sequence
  chemically synthesized
ctaaaaatacaaaaattagcca

SEQ ID NO: 1314094 - DNA, 22 bp, Artificial Sequence
  chemically synthesized
aaaatacaaaaattagccaggt

SEQ ID NO: 1314095 - DNA, 22 bp, Artificial Sequence
  chemically synthesized
caggtgcctgcgaccacacctg

SEQ ID NO: 1314096 - DNA, 22 bp, Artificial Sequence
  chemically synthesized
ggattacaggtgcctgcgacca

SEQ ID NO: 1314097 - DNA, 22 bp, Artificial Sequence
  chemically synthesized
gccaggtgtggtcgcaggcacc

SEQ ID NO: 1314098 - DNA, 22 bp, Artificial Sequence
  chemically synthesized
ccgagtagctaggattacaggt

SEQ ID NO: 1314099 - DNA, 22 bp, Artificial Sequence
  chemically synthesized
agcctcccgagtagctaggatt

SEQ ID NO: 1314100 - DNA, 22 bp, Artificial Sequence
  chemically synthesized
cctcagcctcccgagtagctag

SEQ ID NO: 1314101 - DNA, 22 bp, Artificial Sequence
  chemically synthesized
ctacctcagcctcccgagtagc

SEQ ID NO: 1314102 - DNA, 22 bp, Artificial Sequence
  chemically synthesized
tcctacctcagcctcccgagta

SEQ ID NO: 1314103 - DNA, 22 bp, Artificial Sequence
  chemically synthesized
taatcctagctactcgggaggc

SEQ ID NO: 1314104 - DNA, 22 bp, Artificial Sequence
  chemically synthesized
aaatgattctcctacctcagcc

SEQ ID NO: 1314105 - DNA, 22 bp, Artificial Sequence
  chemically synthesized
gctactcgggaggctgaggtag

SEQ ID NO: 1314106 - DNA, 22 bp, Artificial Sequence
  chemically synthesized
ctcgggaggctgaggtaggaga

SEQ ID NO: 1314107 - DNA, 22 bp, Artificial Sequence
  chemically synthesized
gggaggctgaggtaggagaatc

SEQ ID NO: 1314108 - DNA, 22 bp, Artificial Sequence
  chemically synthesized
ccaggttcaaatgattctccta

SEQ ID NO: 1314109 - DNA, 22 bp, Artificial Sequence
  chemically synthesized
catctcccaggttcaaatgatt

SEQ ID NO: 1314110 - DNA, 22 bp, Artificial Sequence
  chemically synthesized
aggtaggagaatcatttgaacc

SEQ ID NO: 1314111 - DNA, 22 bp, Artificial Sequence
  chemically synthesized
caacctccatctcccaggttca

SEQ ID NO: 1314112 - DNA, 22 bp, Artificial Sequence
  chemically synthesized
actgcaacctccatctcccagg

SEQ ID NO: 1314113 - DNA, 22 bp, Artificial Sequence
  chemically synthesized
gaacctgggagatggaggttgc

SEQ ID NO: 1314114 - DNA, 22 bp, Artificial Sequence
  chemically synthesized
aacctgggagatggaggttgca

SEQ ID NO: 1314115 - DNA, 22 bp, Artificial Sequence
  chemically synthesized
ggagatggaggttgcagtgagc

SEQ ID NO: 1314116 - DNA, 22 bp, Artificial Sequence
  chemically synthesized
gagtgcagtggtgcgatcgtgg

SEQ ID NO: 1314117 - DNA, 22 bp, Artificial Sequence
  chemically synthesized
cagtgagccacgatcgcaccac

SEQ ID NO: 1314118 - DNA, 22 bp, Artificial Sequence
  chemically synthesized
tcgcccaggctggagtgcagtg

SEQ ID NO: 1314119 - DNA, 22 bp, Artificial Sequence
  chemically synthesized
atcgcccaggctggagtgcagt

SEQ ID NO: 1314120 - DNA, 22 bp, Artificial Sequence
  chemically synthesized
ttatcgcccaggctggagtgca

SEQ ID NO: 1314121 - DNA, 22 bp, Artificial Sequence
  chemically synthesized
actcttatcgcccaggctggag

SEQ ID NO: 1314122 - DNA, 22 bp, Artificial Sequence
  chemically synthesized
cactcttatcgcccaggctgga

SEQ ID NO: 1314123 - DNA, 22 bp, Artificial Sequence
  chemically synthesized
cactccagcctgggcgataaga

SEQ ID NO: 1314124 - DNA, 22 bp, Artificial Sequence
  chemically synthesized
aaacagagtttcactcttatcg

SEQ ID NO: 1314125 - DNA, 22 bp, Artificial Sequence
  chemically synthesized
gaaacagagtttcactcttatc

SEQ ID NO: 1314126 - DNA, 22 bp, Artificial Sequence
  chemically synthesized
tgaaacagagtttcactcttat

SEQ ID NO: 1314127 - DNA, 22 bp, Artificial Sequence
  chemically synthesized
cagcctgggcgataagagtgaa

SEQ ID NO: 1314128 - DNA, 22 bp, Artificial Sequence
  chemically synthesized
ttgaaacagagtttcactctta

SEQ ID NO: 1314129 - DNA, 22 bp, Artificial Sequence
  chemically synthesized
gtttttgaaacagagtttcact

SEQ ID NO: 1314130 - DNA, 22 bp, Artificial Sequence
  chemically synthesized
ggtttttgaaacagagtttcac

SEQ ID NO: 1314131 - DNA, 22 bp, Artificial Sequence
  chemically synthesized
tggtttttgaaacagagtttca

SEQ ID NO: 1314132 - DNA, 22 bp, Artificial Sequence
  chemically synthesized
ggcgataagagtgaaactctgt

SEQ ID NO: 1314133 - DNA, 22 bp, Artificial Sequence
  chemically synthesized
ttggtttttgaaacagagtttc

SEQ ID NO: 1314134 - DNA, 22 bp, Artificial Sequence
  chemically synthesized
tttttggtttttgaaacagagt

SEQ ID NO: 1314135 - DNA, 22 bp, Artificial Sequence
  chemically synthesized
gtttttggtttttgaaacagag

SEQ ID NO: 1314136 - DNA, 22 bp, Artificial Sequence
  chemically synthesized
tttgtttttggtttttgaaaca

SEQ ID NO: 1314137 - DNA, 22 bp, Artificial Sequence
  chemically synthesized
tcgttgtttgtttttggttttt

SEQ ID NO: 1314138 - DNA, 22 bp, Artificial Sequence
  chemically synthesized
gtcgttgtttgtttttggtttt

SEQ ID NO: 1314139 - DNA, 22 bp, Artificial Sequence
  chemically synthesized
tgtcgttgtttgtttttggttt

SEQ ID NO: 1314140 - DNA, 22 bp, Artificial Sequence
  chemically synthesized
ttgtcgttgtttgtttttggtt

SEQ ID NO: 1314141 - DNA, 22 bp, Artificial Sequence
  chemically synthesized
tttgtcgttgtttgtttttggt

SEQ ID NO: 1314142 - DNA, 22 bp, Artificial Sequence
  chemically synthesized
ttttgtcgttgtttgtttttgg

SEQ ID NO: 1314143 - DNA, 22 bp, Artificial Sequence
  chemically synthesized
tgtttcaaaaaccaaaaacaaa

SEQ ID NO: 1314144 - DNA, 22 bp, Artificial Sequence
  chemically synthesized
tttcaaaaaccaaaaacaaaca

SEQ ID NO: 1314145 - DNA, 22 bp, Artificial Sequence
  chemically synthesized
caaaaaccaaaaacaaacaacg

SEQ ID NO: 1314146 - DNA, 22 bp, Artificial Sequence
  chemically synthesized
aaaaaccaaaaacaaacaacga

SEQ ID NO: 1314147 - DNA, 22 bp, Artificial Sequence
  chemically synthesized
tgcccagatttttttgtcgttg

SEQ ID NO: 1314148 - DNA, 22 bp, Artificial Sequence
  chemically synthesized
tctgtgcccagatttttttgtc

SEQ ID NO: 1314149 - DNA, 22 bp, Artificial Sequence
  chemically synthesized
tgtaattatctgtgcccagatt

SEQ ID NO: 1314150 - DNA, 22 bp, Artificial Sequence
  chemically synthesized
gtgtaattatctgtgcccagat

SEQ ID NO: 1314151 - DNA, 22 bp, Artificial Sequence
  chemically synthesized
tgtgaaatccttgtgtaattat

SEQ ID NO: 1314152 - DNA, 22 bp, Artificial Sequence
  chemically synthesized
ggcacagataattacacaagga

SEQ ID NO: 1314153 - DNA, 22 bp, Artificial Sequence
  chemically synthesized
cacaaggatttcacataacctc

SEQ ID NO: 1314154 - DNA, 22 bp, Artificial Sequence
  chemically synthesized
aatgaataacagagaggttatg

SEQ ID NO: 1314155 - DNA, 22 bp, Artificial Sequence
  chemically synthesized
taaatgaataacagagaggtta

SEQ ID NO: 1314156 - DNA, 22 bp, Artificial Sequence
  chemically synthesized
cacataacctctctgttattca

SEQ ID NO: 1314157 - DNA, 22 bp, Artificial Sequence
  chemically synthesized
gacatctctaaatgaataacag

SEQ ID NO: 1314158 - DNA, 22 bp, Artificial Sequence
  chemically synthesized
acataacctctctgttattcat

SEQ ID NO: 1314159 - DNA, 22 bp, Artificial Sequence
  chemically synthesized
agacatctctaaatgaataaca

SEQ ID NO: 1314160 - DNA, 22 bp, Artificial Sequence
  chemically synthesized
tagacatctctaaatgaataac

SEQ ID NO: 1314161 - DNA, 22 bp, Artificial Sequence
  chemically synthesized
ttagacatctctaaatgaataa

SEQ ID NO: 1314162 - DNA, 22 bp, Artificial Sequence
  chemically synthesized
cttttagacatctctaaatgaa

SEQ ID NO: 1314163 - DNA, 22 bp, Artificial Sequence
  chemically synthesized
tctgttattcatttagagatgt

SEQ ID NO: 1314164 - DNA, 22 bp, Artificial Sequence
  chemically synthesized
tgttattcatttagagatgtct

SEQ ID NO: 1314165 - DNA, 22 bp, Artificial Sequence
  chemically synthesized
aggaattacttttagacatctc

SEQ ID NO: 1314166 - DNA, 22 bp, Artificial Sequence
  chemically synthesized
ttattcatttagagatgtctaa

SEQ ID NO: 1314167 - DNA, 22 bp, Artificial Sequence
  chemically synthesized
tcaggaattacttttagacatc

SEQ ID NO: 1314168 - DNA, 22 bp, Artificial Sequence
  chemically synthesized
ctcaggaattacttttagacat

SEQ ID NO: 1314169 - DNA, 22 bp, Artificial Sequence
  chemically synthesized
ttcatttagagatgtctaaaag

SEQ ID NO: 1314170 - DNA, 22 bp, Artificial Sequence
  chemically synthesized
atttagagatgtctaaaagtaa

SEQ ID NO: 1314171 - DNA, 22 bp, Artificial Sequence
  chemically synthesized
caaatttctcaggaattacttt

SEQ ID NO: 1314172 - DNA, 22 bp, Artificial Sequence
  chemically synthesized
agagatgtctaaaagtaattcc

SEQ ID NO: 1314173 - DNA, 22 bp, Artificial Sequence
  chemically synthesized
gagatgtctaaaagtaattcct

SEQ ID NO: 1314174 - DNA, 22 bp, Artificial Sequence
  chemically synthesized
aataaaaattccaaatttctca

SEQ ID NO: 1314175 - DNA, 22 bp, Artificial Sequence
  chemically synthesized
aaagtaattcctgagaaatttg

SEQ ID NO: 1314176 - DNA, 22 bp, Artificial Sequence
  chemically synthesized
acatgttcaataaaaattccaa

SEQ ID NO: 1314177 - DNA, 22 bp, Artificial Sequence
  chemically synthesized
tgacatgttcaataaaaattcc

SEQ ID NO: 1314178 - DNA, 22 bp, Artificial Sequence
  chemically synthesized
ctgagaaatttggaatttttat

SEQ ID NO: 1314179 - DNA, 22 bp, Artificial Sequence
  chemically synthesized
agaaatttggaatttttattga

SEQ ID NO: 1314180 - DNA, 22 bp, Artificial Sequence
  chemically synthesized
gagaagattctgacatgttcaa

SEQ ID NO: 1314181 - DNA, 22 bp, Artificial Sequence
  chemically synthesized
agagaagattctgacatgttca

SEQ ID NO: 1314182 - DNA, 22 bp, Artificial Sequence
  chemically synthesized
ggaatttttattgaacatgtca

SEQ ID NO: 1314183 - DNA, 22 bp, Artificial Sequence
  chemically synthesized
gaatttttattgaacatgtcag

SEQ ID NO: 1314184 - DNA, 22 bp, Artificial Sequence
  chemically synthesized
tttagagaagattctgacatgt

SEQ ID NO: 1314185 - DNA, 22 bp, Artificial Sequence
  chemically synthesized
ttattgaacatgtcagaatctt

SEQ ID NO: 1314186 - DNA, 22 bp, Artificial Sequence
  chemically synthesized
tattgaacatgtcagaatcttc

SEQ ID NO: 1314187 - DNA, 22 bp, Artificial Sequence
  chemically synthesized
attgaacatgtcagaatcttct

SEQ ID NO: 1314188 - DNA, 22 bp, Artificial Sequence
  chemically synthesized
ttgaacatgtcagaatcttctc

SEQ ID NO: 1314189 - DNA, 22 bp, Artificial Sequence
  chemically synthesized
agaagttatttagagaagattc

SEQ ID NO: 1314190 - DNA, 22 bp, Artificial Sequence
  chemically synthesized
aacatgtcagaatcttctctaa

SEQ ID NO: 1314191 - DNA, 22 bp, Artificial Sequence
  chemically synthesized
caggtgattcagaagttattta

SEQ ID NO: 1314192 - DNA, 22 bp, Artificial Sequence
  chemically synthesized
acaggtgattcagaagttattt

SEQ ID NO: 1314193 - DNA, 22 bp, Artificial Sequence
  chemically synthesized
ctctaaataacttctgaatcac

SEQ ID NO: 1314194 - DNA, 22 bp, Artificial Sequence
  chemically synthesized
tctaaataacttctgaatcacc

SEQ ID NO: 1314195 - DNA, 22 bp, Artificial Sequence
  chemically synthesized
taaataacttctgaatcacctg

SEQ ID NO: 1314196 - DNA, 22 bp, Artificial Sequence
  chemically synthesized
aataacttctgaatcacctgta

SEQ ID NO: 1314197 - DNA, 22 bp, Artificial Sequence
  chemically synthesized
tccaaatcaatggtgcatttac

SEQ ID NO: 1314198 - DNA, 22 bp, Artificial Sequence
  chemically synthesized
ctgaatcacctgtaaatgcacc

SEQ ID NO: 1314199 - DNA, 22 bp, Artificial Sequence
  chemically synthesized
tgaatcacctgtaaatgcacca

SEQ ID NO: 1314200 - DNA, 22 bp, Artificial Sequence
  chemically synthesized
aatcacctgtaaatgcaccatt

SEQ ID NO: 1314201 - DNA, 22 bp, Artificial Sequence
  chemically synthesized
caccattatccaaatcaatggt

SEQ ID NO: 1314202 - DNA, 22 bp, Artificial Sequence
  chemically synthesized
taaatgcaccattgatttggat

SEQ ID NO: 1314203 - DNA, 22 bp, Artificial Sequence
  chemically synthesized
gattccaccattatccaaatca

SEQ ID NO: 1314204 - DNA, 22 bp, Artificial Sequence
  chemically synthesized
cacagctagattccaccattat

SEQ ID NO: 1314205 - DNA, 22 bp, Artificial Sequence
  chemically synthesized
ttccacagctagattccaccat

SEQ ID NO: 1314206 - DNA, 22 bp, Artificial Sequence
  chemically synthesized
attccacagctagattccacca

SEQ ID NO: 1314207 - DNA, 22 bp, Artificial Sequence
  chemically synthesized
atttggataatggtggaatcta

SEQ ID NO: 1314208 - DNA, 22 bp, Artificial Sequence
  chemically synthesized
acttattccacagctagattcc

SEQ ID NO: 1314209 - DNA, 22 bp, Artificial Sequence
  chemically synthesized
aacttattccacagctagattc

SEQ ID NO: 1314210 - DNA, 22 bp, Artificial Sequence
  chemically synthesized
ggataatggtggaatctagctg

SEQ ID NO: 1314211 - DNA, 22 bp, Artificial Sequence
  chemically synthesized
taacttattccacagctagatt

SEQ ID NO: 1314212 - DNA, 22 bp, Artificial Sequence
  chemically synthesized
gataatggtggaatctagctgt

SEQ ID NO: 1314213 - DNA, 22 bp, Artificial Sequence
  chemically synthesized
ttaacttattccacagctagat

SEQ ID NO: 1314214 - DNA, 22 bp, Artificial Sequence
  chemically synthesized
tgaccttttaacttattccaca

SEQ ID NO: 1314215 - DNA, 22 bp, Artificial Sequence
  chemically synthesized
atgaccttttaacttattccac

SEQ ID NO: 1314216 - DNA, 22 bp, Artificial Sequence
  chemically synthesized
gaggccttatgaccttttaact

SEQ ID NO: 1314217 - DNA, 22 bp, Artificial Sequence
  chemically synthesized
gctgtggaataagttaaaaggt

SEQ ID NO: 1314218 - DNA, 22 bp, Artificial Sequence
  chemically synthesized
ggaggccttatgaccttttaac

SEQ ID NO: 1314219 - DNA, 22 bp, Artificial Sequence
  chemically synthesized
tggaataagttaaaaggtcata

SEQ ID NO: 1314220 - DNA, 22 bp, Artificial Sequence
  chemically synthesized
acccttggaggccttatgacct

SEQ ID NO: 1314221 - DNA, 22 bp, Artificial Sequence
  chemically synthesized
cacccttggaggccttatgacc

SEQ ID NO: 1314222 - DNA, 22 bp, Artificial Sequence
  chemically synthesized
aaatttcacccttggaggcctt

SEQ ID NO: 1314223 - DNA, 22 bp, Artificial Sequence
  chemically synthesized
aaaggtcataaggcctccaagg

SEQ ID NO: 1314224 - DNA, 22 bp, Artificial Sequence
  chemically synthesized
actgaaatttcacccttggagg

SEQ ID NO: 1314225 - DNA, 22 bp, Artificial Sequence
  chemically synthesized
cctcactgaaatttcacccttg

SEQ ID NO: 1314226 - DNA, 22 bp, Artificial Sequence
  chemically synthesized
gttacctcactgaaatttcacc

SEQ ID NO: 1314227 - DNA, 22 bp, Artificial Sequence
  chemically synthesized
gctggttacctcactgaaattt

SEQ ID NO: 1314228 - DNA, 22 bp, Artificial Sequence
  chemically synthesized
caagggtgaaatttcagtgagg

SEQ ID NO: 1314229 - DNA, 22 bp, Artificial Sequence
  chemically synthesized
cgtagcctggctggttacctca

SEQ ID NO: 1314230 - DNA, 22 bp, Artificial Sequence
  chemically synthesized
ctccgtagcctggctggttacc

SEQ ID NO: 1314231 - DNA, 22 bp, Artificial Sequence
  chemically synthesized
cagtgaggtaaccagccaggct

SEQ ID NO: 1314232 - DNA, 22 bp, Artificial Sequence
  chemically synthesized
agtgaggtaaccagccaggcta

SEQ ID NO: 1314233 - DNA, 22 bp, Artificial Sequence
  chemically synthesized
accgagctgctccgtagcctgg

SEQ ID NO: 1314234 - DNA, 22 bp, Artificial Sequence
  chemically synthesized
atgaaatgctcaccgagctgct

SEQ ID NO: 1314235 - DNA, 22 bp, Artificial Sequence
  chemically synthesized
caaactgatgaaatgctcaccg

SEQ ID NO: 1314236 - DNA, 22 bp, Artificial Sequence
  chemically synthesized
cggagcagctcggtgagcattt

SEQ ID NO: 1314237 - DNA, 22 bp, Artificial Sequence
  chemically synthesized
ctccaaactgatgaaatgctca

SEQ ID NO: 1314238 - DNA, 22 bp, Artificial Sequence
  chemically synthesized
tactccaaactgatgaaatgct

SEQ ID NO: 1314239 - DNA, 22 bp, Artificial Sequence
  chemically synthesized
ggtgagcatttcatcagtttgg

SEQ ID NO: 1314240 - DNA, 22 bp, Artificial Sequence
  chemically synthesized
cccatattctactccaaactga

SEQ ID NO: 1314241 - DNA, 22 bp, Artificial Sequence
  chemically synthesized
catcagtttggagtagaatatg

SEQ ID NO: 1314242 - DNA, 22 bp, Artificial Sequence
  chemically synthesized
atcagtttggagtagaatatgg

SEQ ID NO: 1314243 - DNA, 22 bp, Artificial Sequence
  chemically synthesized
agaaaaggtatcatctccccat

SEQ ID NO: 1314244 - DNA, 22 bp, Artificial Sequence
  chemically synthesized
ggagtagaatatggggagatga

SEQ ID NO: 1314245 - DNA, 22 bp, Artificial Sequence
  chemically synthesized
gagtagaatatggggagatgat

SEQ ID NO: 1314246 - DNA, 22 bp, Artificial Sequence
  chemically synthesized
agttgagaaaaggtatcatctc

SEQ ID NO: 1314247 - DNA, 22 bp, Artificial Sequence
  chemically synthesized
cctgagttgagaaaaggtatca

SEQ ID NO: 1314248 - DNA, 22 bp, Artificial Sequence
  chemically synthesized
acctgagttgagaaaaggtatc

SEQ ID NO: 1314249 - DNA, 22 bp, Artificial Sequence
  chemically synthesized
tacctgagttgagaaaaggtat

SEQ ID NO: 1314250 - DNA, 22 bp, Artificial Sequence
  chemically synthesized
ttacctgagttgagaaaaggta

SEQ ID NO: 1314251 - DNA, 22 bp, Artificial Sequence
  chemically synthesized
tttacctgagttgagaaaaggt

SEQ ID NO: 1314252 - DNA, 22 bp, Artificial Sequence
  chemically synthesized
tttttacctgagttgagaaaag

SEQ ID NO: 1314253 - DNA, 22 bp, Artificial Sequence
  chemically synthesized
gtcaaattctttttacctgagt

SEQ ID NO: 1314254 - DNA, 22 bp, Artificial Sequence
  chemically synthesized
ggtcaaattctttttacctgag

SEQ ID NO: 1314255 - DNA, 22 bp, Artificial Sequence
  chemically synthesized
ttctcaactcaggtaaaaagaa

SEQ ID NO: 1314256 - DNA, 22 bp, Artificial Sequence
  chemically synthesized
tctcaactcaggtaaaaagaat

SEQ ID NO: 1314257 - DNA, 22 bp, Artificial Sequence
  chemically synthesized
ctcaactcaggtaaaaagaatt

SEQ ID NO: 1314258 - DNA, 22 bp, Artificial Sequence
  chemically synthesized
tcaactcaggtaaaaagaattt

SEQ ID NO: 1314259 - DNA, 22 bp, Artificial Sequence
  chemically synthesized
aactcaggtaaaaagaatttga

SEQ ID NO: 1314260 - DNA, 22 bp, Artificial Sequence
  chemically synthesized
gtatgagaacttggtcaaattc

SEQ ID NO: 1314261 - DNA, 22 bp, Artificial Sequence
  chemically synthesized
aggtaaaaagaatttgaccaag

SEQ ID NO: 1314262 - DNA, 22 bp, Artificial Sequence
  chemically synthesized
tgtaacataaaagctggtatga

SEQ ID NO: 1314263 - DNA, 22 bp, Artificial Sequence
  chemically synthesized
gaccaagttctcataccagctt

SEQ ID NO: 1314264 - DNA, 22 bp, Artificial Sequence
  chemically synthesized
accaagttctcataccagcttt

SEQ ID NO: 1314265 - DNA, 22 bp, Artificial Sequence
  chemically synthesized
tcataccagcttttatgttaca

SEQ ID NO: 1314266 - DNA, 22 bp, Artificial Sequence
  chemically synthesized
ataccagcttttatgttacaca

SEQ ID NO: 1314267 - DNA, 22 bp, Artificial Sequence
  chemically synthesized
atggtaataaacagctgtgtaa

SEQ ID NO: 1314268 - DNA, 22 bp, Artificial Sequence
  chemically synthesized
ttatgttacacagctgtttatt

SEQ ID NO: 1314269 - DNA, 22 bp, Artificial Sequence
  chemically synthesized
tatgttacacagctgtttatta

SEQ ID NO: 1314270 - DNA, 22 bp, Artificial Sequence
  chemically synthesized
atgttacacagctgtttattac

SEQ ID NO: 1314271 - DNA, 22 bp, Artificial Sequence
  chemically synthesized
tgttacacagctgtttattacc

SEQ ID NO: 1314272 - DNA, 22 bp, Artificial Sequence
  chemically synthesized
aaaaacattgatggtaataaac

SEQ ID NO: 1314273 - DNA, 22 bp, Artificial Sequence
  chemically synthesized
caaaaacattgatggtaataaa

SEQ ID NO: 1314274 - DNA, 22 bp, Artificial Sequence
  chemically synthesized
tcaaaaacattgatggtaataa

SEQ ID NO: 1314275 - DNA, 22 bp, Artificial Sequence
  chemically synthesized
cacagctgtttattaccatcaa

SEQ ID NO: 1314276 - DNA, 22 bp, Artificial Sequence
  chemically synthesized
cccagttttcaaaaacattgat

SEQ ID NO: 1314277 - DNA, 22 bp, Artificial Sequence
  chemically synthesized
tttattaccatcaatgtttttg

SEQ ID NO: 1314278 - DNA, 22 bp, Artificial Sequence
  chemically synthesized
tgctgcccagttttcaaaaaca

SEQ ID NO: 1314279 - DNA, 22 bp, Artificial Sequence
  chemically synthesized
attaccatcaatgtttttgaaa

SEQ ID NO: 1314280 - DNA, 22 bp, Artificial Sequence
  chemically synthesized
ttaccatcaatgtttttgaaaa

SEQ ID NO: 1314281 - DNA, 22 bp, Artificial Sequence
  chemically synthesized
ccatcaatgtttttgaaaactg

SEQ ID NO: 1314282 - DNA, 22 bp, Artificial Sequence
  chemically synthesized
ttgaaaactgggcagcataatt

SEQ ID NO: 1314283 - DNA, 22 bp, Artificial Sequence
  chemically synthesized
tgaaaactgggcagcataattt

SEQ ID NO: 1314284 - DNA, 22 bp, Artificial Sequence
  chemically synthesized
gaaaactgggcagcataatttc

SEQ ID NO: 1314285 - DNA, 22 bp, Artificial Sequence
  chemically synthesized
aaaactgggcagcataatttcc

SEQ ID NO: 1314286 - DNA, 22 bp, Artificial Sequence
  chemically synthesized
ggcagcataatttccatcatgc

SEQ ID NO: 1314287 - DNA, 22 bp, Artificial Sequence
  chemically synthesized
ccatcatgctatgtccctggtt

SEQ ID NO: 1314288 - DNA, 22 bp, Artificial Sequence
  chemically synthesized
catcatgctatgtccctggttc

SEQ ID NO: 1314289 - DNA, 22 bp, Artificial Sequence
  chemically synthesized
tgtccctggttctacttattat

SEQ ID NO: 1314290 - DNA, 22 bp, Artificial Sequence
  chemically synthesized
gttctacttattatttggacct

SEQ ID NO: 1314291 - DNA, 22 bp, Artificial Sequence
  chemically synthesized
gtcagtaaatcaggaggtccaa

SEQ ID NO: 1314292 - DNA, 22 bp, Artificial Sequence
  chemically synthesized
agtcagtaaatcaggaggtcca

SEQ ID NO: 1314293 - DNA, 22 bp, Artificial Sequence
  chemically synthesized
tacttattatttggacctcctg

SEQ ID NO: 1314294 - DNA, 22 bp, Artificial Sequence
  chemically synthesized
tagtcagtaaatcaggaggtcc

SEQ ID NO: 1314295 - DNA, 22 bp, Artificial Sequence
  chemically synthesized
cttattatttggacctcctgat

SEQ ID NO: 1314296 - DNA, 22 bp, Artificial Sequence
  chemically synthesized
attatttggacctcctgattta

SEQ ID NO: 1314297 - DNA, 22 bp, Artificial Sequence
  chemically synthesized
ttatttggacctcctgatttac

SEQ ID NO: 1314298 - DNA, 22 bp, Artificial Sequence
  chemically synthesized
tttggacctcctgatttactga

SEQ ID NO: 1314299 - DNA, 22 bp, Artificial Sequence
  chemically synthesized
aatagtagttttagtcagtaaa

SEQ ID NO: 1314300 - DNA, 22 bp, Artificial Sequence
  chemically synthesized
ggacctcctgatttactgacta

SEQ ID NO: 1314301 - DNA, 22 bp, Artificial Sequence
  chemically synthesized
gacctcctgatttactgactaa

SEQ ID NO: 1314302 - DNA, 22 bp, Artificial Sequence
  chemically synthesized
ctgatttactgactaaaactac

SEQ ID NO: 1314303 - DNA, 22 bp, Artificial Sequence
  chemically synthesized
atttactgactaaaactactat

SEQ ID NO: 1314304 - DNA, 22 bp, Artificial Sequence
  chemically synthesized
tatacagataattaaatagtag

SEQ ID NO: 1314305 - DNA, 22 bp, Artificial Sequence
  chemically synthesized
actgactaaaactactatttaa

SEQ ID NO: 1314306 - DNA, 22 bp, Artificial Sequence
  chemically synthesized
gtatacagataattaaatagta

SEQ ID NO: 1314307 - DNA, 22 bp, Artificial Sequence
  chemically synthesized
ctgactaaaactactatttaat

SEQ ID NO: 1314308 - DNA, 22 bp, Artificial Sequence
  chemically synthesized
actaaaactactatttaattat

SEQ ID NO: 1314309 - DNA, 22 bp, Artificial Sequence
  chemically synthesized
aaactactatttaattatctgt

SEQ ID NO: 1314310 - DNA, 22 bp, Artificial Sequence
  chemically synthesized
ctatttaattatctgtatacaa

SEQ ID NO: 1314311 - DNA, 22 bp, Artificial Sequence
  chemically synthesized
tttaattatctgtatacaaatt

SEQ ID NO: 1314312 - DNA, 22 bp, Artificial Sequence
  chemically synthesized
aattatctgtatacaaattcac

SEQ ID NO: 1314313 - DNA, 22 bp, Artificial Sequence
  chemically synthesized
attatctgtatacaaattcacc

SEQ ID NO: 1314314 - DNA, 22 bp, Artificial Sequence
  chemically synthesized
aaaggaaaatggccggtgaatt

SEQ ID NO: 1314315 - DNA, 22 bp, Artificial Sequence
  chemically synthesized
tctgtatacaaattcaccggcc

SEQ ID NO: 1314316 - DNA, 22 bp, Artificial Sequence
  chemically synthesized
tatacaaattcaccggccattt

SEQ ID NO: 1314317 - DNA, 22 bp, Artificial Sequence
  chemically synthesized
accggccattttcctttgaggt

SEQ ID NO: 1314318 - DNA, 22 bp, Artificial Sequence
  chemically synthesized
gccaaatagggatacctcaaag

SEQ ID NO: 1314319 - DNA, 22 bp, Artificial Sequence
  chemically synthesized
tggccaaatagggatacctcaa

SEQ ID NO: 1314320 - DNA, 22 bp, Artificial Sequence
  chemically synthesized
ctggccaaatagggatacctca

SEQ ID NO: 1314321 - DNA, 22 bp, Artificial Sequence
  chemically synthesized
tctggccaaatagggatacctc

SEQ ID NO: 1314322 - DNA, 22 bp, Artificial Sequence
  chemically synthesized
aattttctggccaaatagggat

SEQ ID NO: 1314323 - DNA, 22 bp, Artificial Sequence
  chemically synthesized
tcctttgaggtatccctatttg

SEQ ID NO: 1314324 - DNA, 22 bp, Artificial Sequence
  chemically synthesized
cctttgaggtatccctatttgg

SEQ ID NO: 1314325 - DNA, 22 bp, Artificial Sequence
  chemically synthesized
taaattttctggccaaataggg

SEQ ID NO: 1314326 - DNA, 22 bp, Artificial Sequence
  chemically synthesized
ctttgaggtatccctatttggc

SEQ ID NO: 1314327 - DNA, 22 bp, Artificial Sequence
  chemically synthesized
ctctaaattttctggccaaata

SEQ ID NO: 1314328 - DNA, 22 bp, Artificial Sequence
  chemically synthesized
tgaggtatccctatttggccag

SEQ ID NO: 1314329 - DNA, 22 bp, Artificial Sequence
  chemically synthesized
gctctaaattttctggccaaat

SEQ ID NO: 1314330 - DNA, 22 bp, Artificial Sequence
  chemically synthesized
gaggtatccctatttggccaga

SEQ ID NO: 1314331 - DNA, 22 bp, Artificial Sequence
  chemically synthesized
tgctctaaattttctggccaaa

SEQ ID NO: 1314332 - DNA, 22 bp, Artificial Sequence
  chemically synthesized
aggtatccctatttggccagaa

SEQ ID NO: 1314333 - DNA, 22 bp, Artificial Sequence
  chemically synthesized
ttgctctaaattttctggccaa

SEQ ID NO: 1314334 - DNA, 22 bp, Artificial Sequence
  chemically synthesized
aacatcttttgctctaaatttt

SEQ ID NO: 1314335 - DNA, 22 bp, Artificial Sequence
  chemically synthesized
tttggccagaaaatttagagca

SEQ ID NO: 1314336 - DNA, 22 bp, Artificial Sequence
  chemically synthesized
aattgaacatcttttgctctaa

SEQ ID NO: 1314337 - DNA, 22 bp, Artificial Sequence
  chemically synthesized
ggccagaaaatttagagcaaaa

SEQ ID NO: 1314338 - DNA, 22 bp, Artificial Sequence
  chemically synthesized
gccagaaaatttagagcaaaag

SEQ ID NO: 1314339 - DNA, 22 bp, Artificial Sequence
  chemically synthesized
tgaattgaacatcttttgctct

SEQ ID NO: 1314340 - DNA, 22 bp, Artificial Sequence
  chemically synthesized
ctgaattgaacatcttttgctc

SEQ ID NO: 1314341 - DNA, 22 bp, Artificial Sequence
  chemically synthesized
agagcaaaagatgttcaattca

SEQ ID NO: 1314342 - DNA, 22 bp, Artificial Sequence
  chemically synthesized
aaaagaaatttctgaattgaac

SEQ ID NO: 1314343 - DNA, 22 bp, Artificial Sequence
  chemically synthesized
gagcaaaagatgttcaattcag

SEQ ID NO: 1314344 - DNA, 22 bp, Artificial Sequence
  chemically synthesized
ataaataacattaaaaagaaat

SEQ ID NO: 1314345 - DNA, 22 bp, Artificial Sequence
  chemically synthesized
aattcagaaatttctttttaat

SEQ ID NO: 1314346 - DNA, 22 bp, Artificial Sequence
  chemically synthesized
aaactgataaataacattaaaa

SEQ ID NO: 1314347 - DNA, 22 bp, Artificial Sequence
  chemically synthesized
agaaatttctttttaatgttat

SEQ ID NO: 1314348 - DNA, 22 bp, Artificial Sequence
  chemically synthesized
ctttttaatgttatttatcagt

SEQ ID NO: 1314349 - DNA, 22 bp, Artificial Sequence
  chemically synthesized
tttttaatgttatttatcagtt

SEQ ID NO: 1314350 - DNA, 22 bp, Artificial Sequence
  chemically synthesized
tttaatgttatttatcagtttt

SEQ ID NO: 1314351 - DNA, 22 bp, Artificial Sequence
  chemically synthesized
tgtatatcagttaaaactgata

SEQ ID NO: 1314352 - DNA, 22 bp, Artificial Sequence
  chemically synthesized
ttaatgttatttatcagtttta

SEQ ID NO: 1314353 - DNA, 22 bp, Artificial Sequence
  chemically synthesized
taatgttatttatcagttttaa

SEQ ID NO: 1314354 - DNA, 22 bp, Artificial Sequence
  chemically synthesized
aatgttatttatcagttttaac

SEQ ID NO: 1314355 - DNA, 22 bp, Artificial Sequence
  chemically synthesized
atgttatttatcagttttaact

SEQ ID NO: 1314356 - DNA, 22 bp, Artificial Sequence
  chemically synthesized
tttatcagttttaactgatata

SEQ ID NO: 1314357 - DNA, 22 bp, Artificial Sequence
  chemically synthesized
atcagttttaactgatatacat

SEQ ID NO: 1314358 - DNA, 22 bp, Artificial Sequence
  chemically synthesized
tcagttttaactgatatacata

SEQ ID NO: 1314359 - DNA, 22 bp, Artificial Sequence
  chemically synthesized
acagtaaagtgaaagattatgt

SEQ ID NO: 1314360 - DNA, 22 bp, Artificial Sequence
  chemically synthesized
taactgatatacataatctttc

SEQ ID NO: 1314361 - DNA, 22 bp, Artificial Sequence
  chemically synthesized
tgacagtaaagtgaaagattat

SEQ ID NO: 1314362 - DNA, 22 bp, Artificial Sequence
  chemically synthesized
aactgatatacataatctttca

SEQ ID NO: 1314363 - DNA, 22 bp, Artificial Sequence
  chemically synthesized
actgatatacataatctttcac

SEQ ID NO: 1314364 - DNA, 22 bp, Artificial Sequence
  chemically synthesized
atatacataatctttcacttta

SEQ ID NO: 1314365 - DNA, 22 bp, Artificial Sequence
  chemically synthesized
taaatctctgacagtaaagtga

SEQ ID NO: 1314366 - DNA, 22 bp, Artificial Sequence
  chemically synthesized
ttataaatctctgacagtaaag

SEQ ID NO: 1314367 - DNA, 22 bp, Artificial Sequence
  chemically synthesized
gttataaatctctgacagtaaa

SEQ ID NO: 1314368 - DNA, 22 bp, Artificial Sequence
  chemically synthesized
tgttataaatctctgacagtaa

SEQ ID NO: 1314369 - DNA, 22 bp, Artificial Sequence
  chemically synthesized
tcactttactgtcagagattta

SEQ ID NO: 1314370 - DNA, 22 bp, Artificial Sequence
  chemically synthesized
cactttactgtcagagatttat

SEQ ID NO: 1314371 - DNA, 22 bp, Artificial Sequence
  chemically synthesized
gataattttgttataaatctct

SEQ ID NO: 1314372 - DNA, 22 bp, Artificial Sequence
  chemically synthesized
actttactgtcagagatttata

SEQ ID NO: 1314373 - DNA, 22 bp, Artificial Sequence
  chemically synthesized
tactgtcagagatttataacaa

SEQ ID NO: 1314374 - DNA, 22 bp, Artificial Sequence
  chemically synthesized
actgtcagagatttataacaaa

SEQ ID NO: 1314375 - DNA, 22 bp, Artificial Sequence
  chemically synthesized
ctgtcagagatttataacaaaa

SEQ ID NO: 1314376 - DNA, 22 bp, Artificial Sequence
  chemically synthesized
tcagagatttataacaaaatta

SEQ ID NO: 1314377 - DNA, 22 bp, Artificial Sequence
  chemically synthesized
agtagatatcactggataattt

SEQ ID NO: 1314378 - DNA, 22 bp, Artificial Sequence
  chemically synthesized
ttcagtagatatcactggataa

SEQ ID NO: 1314379 - DNA, 22 bp, Artificial Sequence
  chemically synthesized
attcagtagatatcactggata

SEQ ID NO: 1314380 - DNA, 22 bp, Artificial Sequence
  chemically synthesized
tattcagtagatatcactggat

SEQ ID NO: 1314381 - DNA, 22 bp, Artificial Sequence
  chemically synthesized
ataacaaaattatccagtgata

SEQ ID NO: 1314382 - DNA, 22 bp, Artificial Sequence
  chemically synthesized
ttattcagtagatatcactgga

SEQ ID NO: 1314383 - DNA, 22 bp, Artificial Sequence
  chemically synthesized
taacaaaattatccagtgatat

SEQ ID NO: 1314384 - DNA, 22 bp, Artificial Sequence
  chemically synthesized
tttattcagtagatatcactgg

SEQ ID NO: 1314385 - DNA, 22 bp, Artificial Sequence
  chemically synthesized
ttttattcagtagatatcactg

SEQ ID NO: 1314386 - DNA, 22 bp, Artificial Sequence
  chemically synthesized
cttttttattcagtagatatca

SEQ ID NO: 1314387 - DNA, 22 bp, Artificial Sequence
  chemically synthesized
tccagtgatatctactgaataa

SEQ ID NO: 1314388 - DNA, 22 bp, Artificial Sequence
  chemically synthesized
aggataaacattacttttttat

SEQ ID NO: 1314389 - DNA, 22 bp, Artificial Sequence
  chemically synthesized
ctgaataaaaaagtaatgttta

SEQ ID NO: 1314390 - DNA, 22 bp, Artificial Sequence
  chemically synthesized
gtatactgaggataaacattac

SEQ ID NO: 1314391 - DNA, 22 bp, Artificial Sequence
  chemically synthesized
aataaaaaagtaatgtttatcc

SEQ ID NO: 1314392 - DNA, 22 bp, Artificial Sequence
  chemically synthesized
aacaattggtatactgaggata

SEQ ID NO: 1314393 - DNA, 22 bp, Artificial Sequence
  chemically synthesized
caccaaaactgaacaattggta

SEQ ID NO: 1314394 - DNA, 22 bp, Artificial Sequence
  chemically synthesized
gcaccaaaactgaacaattggt

SEQ ID NO: 1314395 - DNA, 22 bp, Artificial Sequence
  chemically synthesized
atcctcagtataccaattgttc

SEQ ID NO: 1314396 - DNA, 22 bp, Artificial Sequence
  chemically synthesized
tcctcagtataccaattgttca

SEQ ID NO: 1314397 - DNA, 22 bp, Artificial Sequence
  chemically synthesized
agtataccaattgttcagtttt

SEQ ID NO: 1314398 - DNA, 22 bp, Artificial Sequence
  chemically synthesized
aaccaccttgcaccaaaactga

SEQ ID NO: 1314399 - DNA, 22 bp, Artificial Sequence
  chemically synthesized
tgacatattaaaccaccttgca

SEQ ID NO: 1314400 - DNA, 22 bp, Artificial Sequence
  chemically synthesized
ttcagttttggtgcaaggtggt

SEQ ID NO: 1314401 - DNA, 22 bp, Artificial Sequence
  chemically synthesized
agttttggtgcaaggtggttta

SEQ ID NO: 1314402 - DNA, 22 bp, Artificial Sequence
  chemically synthesized
gagctgtgacatattaaaccac

SEQ ID NO: 1314403 - DNA, 22 bp, Artificial Sequence
  chemically synthesized
tggtgcaaggtggtttaatatg

SEQ ID NO: 1314404 - DNA, 22 bp, Artificial Sequence
  chemically synthesized
ggtgcaaggtggtttaatatgt

SEQ ID NO: 1314405 - DNA, 22 bp, Artificial Sequence
  chemically synthesized
cctagagctgtgacatattaaa

SEQ ID NO: 1314406 - DNA, 22 bp, Artificial Sequence
  chemically synthesized
gtgcaaggtggtttaatatgtc

SEQ ID NO: 1314407 - DNA, 22 bp, Artificial Sequence
  chemically synthesized
acctagagctgtgacatattaa

SEQ ID NO: 1314408 - DNA, 22 bp, Artificial Sequence
  chemically synthesized
ttacctagagctgtgacatatt

SEQ ID NO: 1314409 - DNA, 22 bp, Artificial Sequence
  chemically synthesized
tattcttacctagagctgtgac

SEQ ID NO: 1314410 - DNA, 22 bp, Artificial Sequence
  chemically synthesized
ctatattcttacctagagctgt

SEQ ID NO: 1314411 - DNA, 22 bp, Artificial Sequence
  chemically synthesized
actatattcttacctagagctg

SEQ ID NO: 1314412 - DNA, 22 bp, Artificial Sequence
  chemically synthesized
ttactatattcttacctagagc

SEQ ID NO: 1314413 - DNA, 22 bp, Artificial Sequence
  chemically synthesized
aatatgtcacagctctaggtaa

SEQ ID NO: 1314414 - DNA, 22 bp, Artificial Sequence
  chemically synthesized
cttactatattcttacctagag

SEQ ID NO: 1314415 - DNA, 22 bp, Artificial Sequence
  chemically synthesized
atatgtcacagctctaggtaag

SEQ ID NO: 1314416 - DNA, 22 bp, Artificial Sequence
  chemically synthesized
agggtttcttactatattctta

SEQ ID NO: 1314417 - DNA, 22 bp, Artificial Sequence
  chemically synthesized
tcagggtttcttactatattct

SEQ ID NO: 1314418 - DNA, 22 bp, Artificial Sequence
  chemically synthesized
taggtaagaatatagtaagaaa

SEQ ID NO: 1314419 - DNA, 22 bp, Artificial Sequence
  chemically synthesized
ggtaagaatatagtaagaaacc

SEQ ID NO: 1314420 - DNA, 22 bp, Artificial Sequence
  chemically synthesized
aacatgtccctctcagggtttc

SEQ ID NO: 1314421 - DNA, 22 bp, Artificial Sequence
  chemically synthesized
caattaaacatgtccctctcag

SEQ ID NO: 1314422 - DNA, 22 bp, Artificial Sequence
  chemically synthesized
acaattaaacatgtccctctca

SEQ ID NO: 1314423 - DNA, 22 bp, Artificial Sequence
  chemically synthesized
tacaattaaacatgtccctctc

SEQ ID NO: 1314424 - DNA, 22 bp, Artificial Sequence
  chemically synthesized
acagttttacaattaaacatgt

SEQ ID NO: 1314425 - DNA, 22 bp, Artificial Sequence
  chemically synthesized
cacagttttacaattaaacatg

SEQ ID NO: 1314426 - DNA, 22 bp, Artificial Sequence
  chemically synthesized
agagggacatgtttaattgtaa

SEQ ID NO: 1314427 - DNA, 22 bp, Artificial Sequence
  chemically synthesized
tgtgcttcacagttttacaatt

SEQ ID NO: 1314428 - DNA, 22 bp, Artificial Sequence
  chemically synthesized
atgtgcttcacagttttacaat

SEQ ID NO: 1314429 - DNA, 22 bp, Artificial Sequence
  chemically synthesized
aattgtaaaactgtgaagcaca

SEQ ID NO: 1314430 - DNA, 22 bp, Artificial Sequence
  chemically synthesized
attgtaaaactgtgaagcacat

SEQ ID NO: 1314431 - DNA, 22 bp, Artificial Sequence
  chemically synthesized
taaaactgtgaagcacataaat

SEQ ID NO: 1314432 - DNA, 22 bp, Artificial Sequence
  chemically synthesized
ataatagtaagtatgtatttat

SEQ ID NO: 1314433 - DNA, 22 bp, Artificial Sequence
  chemically synthesized
ttgataatagtaagtatgtatt

SEQ ID NO: 1314434 - DNA, 22 bp, Artificial Sequence
  chemically synthesized
tgaagcacataaatacatactt

SEQ ID NO: 1314435 - DNA, 22 bp, Artificial Sequence
  chemically synthesized
ttattgataatagtaagtatgt

SEQ ID NO: 1314436 - DNA, 22 bp, Artificial Sequence
  chemically synthesized
ttattattgataatagtaagta

SEQ ID NO: 1314437 - DNA, 22 bp, Artificial Sequence
  chemically synthesized
aatggtaactattattattgat

SEQ ID NO: 1314438 - DNA, 22 bp, Artificial Sequence
  chemically synthesized
aaatggtaactattattattga

SEQ ID NO: 1314439 - DNA, 22 bp, Artificial Sequence
  chemically synthesized
actattatcaataataatagtt

SEQ ID NO: 1314440 - DNA, 22 bp, Artificial Sequence
  chemically synthesized
ctattatcaataataatagtta

SEQ ID NO: 1314441 - DNA, 22 bp, Artificial Sequence
  chemically synthesized
ttatcaataataatagttacca

SEQ ID NO: 1314442 - DNA, 22 bp, Artificial Sequence
  chemically synthesized
tcaataataatagttaccattt

SEQ ID NO: 1314443 - DNA, 22 bp, Artificial Sequence
  chemically synthesized
tgatatatagcaggcaatattt

SEQ ID NO: 1314444 - DNA, 22 bp, Artificial Sequence
  chemically synthesized
gtgatatatagcaggcaatatt

SEQ ID NO: 1314445 - DNA, 22 bp, Artificial Sequence
  chemically synthesized
tgtgatatatagcaggcaatat

SEQ ID NO: 1314446 - DNA, 22 bp, Artificial Sequence
  chemically synthesized
ccatttaaatattgcctgctat

SEQ ID NO: 1314447 - DNA, 22 bp, Artificial Sequence
  chemically synthesized
gtgctttgtgatatatagcagg

SEQ ID NO: 1314448 - DNA, 22 bp, Artificial Sequence
  chemically synthesized
agtgctttgtgatatatagcag

SEQ ID NO: 1314449 - DNA, 22 bp, Artificial Sequence
  chemically synthesized
ttagtgctttgtgatatatagc

SEQ ID NO: 1314450 - DNA, 22 bp, Artificial Sequence
  chemically synthesized
aaatattgcctgctatatatca

SEQ ID NO: 1314451 - DNA, 22 bp, Artificial Sequence
  chemically synthesized
aatattgcctgctatatatcac

SEQ ID NO: 1314452 - DNA, 22 bp, Artificial Sequence
  chemically synthesized
agcctcttagtgctttgtgata

SEQ ID NO: 1314453 - DNA, 22 bp, Artificial Sequence
  chemically synthesized
aagcctcttagtgctttgtgat

SEQ ID NO: 1314454 - DNA, 22 bp, Artificial Sequence
  chemically synthesized
taagcctcttagtgctttgtga

SEQ ID NO: 1314455 - DNA, 22 bp, Artificial Sequence
  chemically synthesized
cctgctatatatcacaaagcac

SEQ ID NO: 1314456 - DNA, 22 bp, Artificial Sequence
  chemically synthesized
ctatatatcacaaagcactaag

SEQ ID NO: 1314457 - DNA, 22 bp, Artificial Sequence
  chemically synthesized
tatatcacaaagcactaagagg

SEQ ID NO: 1314458 - DNA, 22 bp, Artificial Sequence
  chemically synthesized
tacaggacagagaaaaatgtat

SEQ ID NO: 1314459 - DNA, 22 bp, Artificial Sequence
  chemically synthesized
agaggcttaaaatacatttttc

SEQ ID NO: 1314460 - DNA, 22 bp, Artificial Sequence
  chemically synthesized
aaaatacatttttctctgtcct

SEQ ID NO: 1314461 - DNA, 22 bp, Artificial Sequence
  chemically synthesized
aaatacatttttctctgtcctg

SEQ ID NO: 1314462 - DNA, 22 bp, Artificial Sequence
  chemically synthesized
aatagaattgtacaggacagag

SEQ ID NO: 1314463 - DNA, 22 bp, Artificial Sequence
  chemically synthesized
aaatagaattgtacaggacaga

SEQ ID NO: 1314464 - DNA, 22 bp, Artificial Sequence
  chemically synthesized
taaatagaattgtacaggacag

SEQ ID NO: 1314465 - DNA, 22 bp, Artificial Sequence
  chemically synthesized
ttaaatagaattgtacaggaca

SEQ ID NO: 1314466 - DNA, 22 bp, Artificial Sequence
  chemically synthesized
tttttaaatagaattgtacagg

SEQ ID NO: 1314467 - DNA, 22 bp, Artificial Sequence
  chemically synthesized
ttctctgtcctgtacaattcta

SEQ ID NO: 1314468 - DNA, 22 bp, Artificial Sequence
  chemically synthesized
cctatttttaaatagaattgta

SEQ ID NO: 1314469 - DNA, 22 bp, Artificial Sequence
  chemically synthesized
tctctgtcctgtacaattctat

SEQ ID NO: 1314470 - DNA, 22 bp, Artificial Sequence
  chemically synthesized
gcctatttttaaatagaattgt

SEQ ID NO: 1314471 - DNA, 22 bp, Artificial Sequence
  chemically synthesized
ctctgtcctgtacaattctatt

SEQ ID NO: 1314472 - DNA, 22 bp, Artificial Sequence
  chemically synthesized
tgcctatttttaaatagaattg

SEQ ID NO: 1314473 - DNA, 22 bp, Artificial Sequence
  chemically synthesized
tctgtcctgtacaattctattt

SEQ ID NO: 1314474 - DNA, 22 bp, Artificial Sequence
  chemically synthesized
tgtcctgtacaattctatttaa

SEQ ID NO: 1314475 - DNA, 22 bp, Artificial Sequence
  chemically synthesized
tcctgtacaattctatttaaaa

SEQ ID NO: 1314476 - DNA, 22 bp, Artificial Sequence
  chemically synthesized
tacaattctatttaaaaatagg

SEQ ID NO: 1314477 - DNA, 22 bp, Artificial Sequence
  chemically synthesized
tatttaaaaataggcaaaattt

SEQ ID NO: 1314478 - DNA, 22 bp, Artificial Sequence
  chemically synthesized
tttaaaaataggcaaaatttct

SEQ ID NO: 1314479 - DNA, 22 bp, Artificial Sequence
  chemically synthesized
catacaaagtggagaaattttg

SEQ ID NO: 1314480 - DNA, 22 bp, Artificial Sequence
  chemically synthesized
acatacaaagtggagaaatttt

SEQ ID NO: 1314481 - DNA, 22 bp, Artificial Sequence
  chemically synthesized
aaaaataggcaaaatttctcca

SEQ ID NO: 1314482 - DNA, 22 bp, Artificial Sequence
  chemically synthesized
aaaataggcaaaatttctccac

SEQ ID NO: 1314483 - DNA, 22 bp, Artificial Sequence
  chemically synthesized
cttacatacaaagtggagaaat

SEQ ID NO: 1314484 - DNA, 22 bp, Artificial Sequence
  chemically synthesized
tccttacatacaaagtggagaa

SEQ ID NO: 1314485 - DNA, 22 bp, Artificial Sequence
  chemically synthesized
attctccttacatacaaagtgg

SEQ ID NO: 1314486 - DNA, 22 bp, Artificial Sequence
  chemically synthesized
tgactcattctccttacataca

SEQ ID NO: 1314487 - DNA, 22 bp, Artificial Sequence
  chemically synthesized
gtgactcattctccttacatac

SEQ ID NO: 1314488 - DNA, 22 bp, Artificial Sequence
  chemically synthesized
tgtgactcattctccttacata

SEQ ID NO: 1314489 - DNA, 22 bp, Artificial Sequence
  chemically synthesized
ttgtgactcattctccttacat

SEQ ID NO: 1314490 - DNA, 22 bp, Artificial Sequence
  chemically synthesized
ctccactttgtatgtaaggaga

SEQ ID NO: 1314491 - DNA, 22 bp, Artificial Sequence
  chemically synthesized
tccactttgtatgtaaggagaa

SEQ ID NO: 1314492 - DNA, 22 bp, Artificial Sequence
  chemically synthesized
cactttgtatgtaaggagaatg

SEQ ID NO: 1314493 - DNA, 22 bp, Artificial Sequence
  chemically synthesized
acatttttgtgactcattctcc

SEQ ID NO: 1314494 - DNA, 22 bp, Artificial Sequence
  chemically synthesized
aacatttttgtgactcattctc

SEQ ID NO: 1314495 - DNA, 22 bp, Artificial Sequence
  chemically synthesized
tgtatgtaaggagaatgagtca

SEQ ID NO: 1314496 - DNA, 22 bp, Artificial Sequence
  chemically synthesized
gtatgtaaggagaatgagtcac

SEQ ID NO: 1314497 - DNA, 22 bp, Artificial Sequence
  chemically synthesized
cttaacatttttgtgactcatt

SEQ ID NO: 1314498 - DNA, 22 bp, Artificial Sequence
  chemically synthesized
tatgtaaggagaatgagtcaca

SEQ ID NO: 1314499 - DNA, 22 bp, Artificial Sequence
  chemically synthesized
atcaagttgcttaacatttttg

SEQ ID NO: 1314500 - DNA, 22 bp, Artificial Sequence
  chemically synthesized
ggcctgatcaagttgcttaaca

SEQ ID NO: 1314501 - DNA, 22 bp, Artificial Sequence
  chemically synthesized
gcagttgggcctgatcaagttg

SEQ ID NO: 1314502 - DNA, 22 bp, Artificial Sequence
  chemically synthesized
ttggcagttgggcctgatcaag

SEQ ID NO: 1314503 - DNA, 22 bp, Artificial Sequence
  chemically synthesized
attggcagttgggcctgatcaa

SEQ ID NO: 1314504 - DNA, 22 bp, Artificial Sequence
  chemically synthesized
agcaacttgatcaggcccaact

SEQ ID NO: 1314505 - DNA, 22 bp, Artificial Sequence
  chemically synthesized
aaacttattggcagttgggcct

SEQ ID NO: 1314506 - DNA, 22 bp, Artificial Sequence
  chemically synthesized
caaacttattggcagttgggcc

SEQ ID NO: 1314507 - DNA, 22 bp, Artificial Sequence
  chemically synthesized
tcttcaaacttattggcagttg

SEQ ID NO: 1314508 - DNA, 22 bp, Artificial Sequence
  chemically synthesized
gatcaggcccaactgccaataa

SEQ ID NO: 1314509 - DNA, 22 bp, Artificial Sequence
  chemically synthesized
atcaggcccaactgccaataag

SEQ ID NO: 1314510 - DNA, 22 bp, Artificial Sequence
  chemically synthesized
aatcctgtcttcaaacttattg

SEQ ID NO: 1314511 - DNA, 22 bp, Artificial Sequence
  chemically synthesized
gaatcctgtcttcaaacttatt

SEQ ID NO: 1314512 - DNA, 22 bp, Artificial Sequence
  chemically synthesized
aggtttgaatcctgtcttcaaa

SEQ ID NO: 1314513 - DNA, 22 bp, Artificial Sequence
  chemically synthesized
ccaataagtttgaagacaggat

SEQ ID NO: 1314514 - DNA, 22 bp, Artificial Sequence
  chemically synthesized
gagaggcaaactgaggtttgaa

SEQ ID NO: 1314515 - DNA, 22 bp, Artificial Sequence
  chemically synthesized
ggagaggcaaactgaggtttga

SEQ ID NO: 1314516 - DNA, 22 bp, Artificial Sequence
  chemically synthesized
gaagacaggattcaaacctcag

SEQ ID NO: 1314517 - DNA, 22 bp, Artificial Sequence
  chemically synthesized
aagacaggattcaaacctcagt

SEQ ID NO: 1314518 - DNA, 22 bp, Artificial Sequence
  chemically synthesized
agatttggagaggcaaactgag

SEQ ID NO: 1314519 - DNA, 22 bp, Artificial Sequence
  chemically synthesized
ctgagatttggagaggcaaact

SEQ ID NO: 1314520 - DNA, 22 bp, Artificial Sequence
  chemically synthesized
aaacctcagtttgcctctccaa

SEQ ID NO: 1314521 - DNA, 22 bp, Artificial Sequence
  chemically synthesized
gtatagttcctgagatttggag

SEQ ID NO: 1314522 - DNA, 22 bp, Artificial Sequence
  chemically synthesized
ggtatagttcctgagatttgga

SEQ ID NO: 1314523 - DNA, 22 bp, Artificial Sequence
  chemically synthesized
agtttgcctctccaaatctcag

SEQ ID NO: 1314524 - DNA, 22 bp, Artificial Sequence
  chemically synthesized
gcctctccaaatctcaggaact

SEQ ID NO: 1314525 - DNA, 22 bp, Artificial Sequence
  chemically synthesized
atggcttggtatagttcctgag

SEQ ID NO: 1314526 - DNA, 22 bp, Artificial Sequence
  chemically synthesized
cctctccaaatctcaggaacta

SEQ ID NO: 1314527 - DNA, 22 bp, Artificial Sequence
  chemically synthesized
tccaaatctcaggaactatacc

SEQ ID NO: 1314528 - DNA, 22 bp, Artificial Sequence
  chemically synthesized
caaatctcaggaactataccaa

SEQ ID NO: 1314529 - DNA, 22 bp, Artificial Sequence
  chemically synthesized
atatgtaactcatggcttggta

SEQ ID NO: 1314530 - DNA, 22 bp, Artificial Sequence
  chemically synthesized
aatatgtaactcatggcttggt

SEQ ID NO: 1314531 - DNA, 22 bp, Artificial Sequence
  chemically synthesized
aggaactataccaagccatgag

SEQ ID NO: 1314532 - DNA, 22 bp, Artificial Sequence
  chemically synthesized
tttaatatgtaactcatggctt

SEQ ID NO: 1314533 - DNA, 22 bp, Artificial Sequence
  chemically synthesized
gctgtttaatatgtaactcatg

SEQ ID NO: 1314534 - DNA, 22 bp, Artificial Sequence
  chemically synthesized
agctgtttaatatgtaactcat

SEQ ID NO: 1314535 - DNA, 22 bp, Artificial Sequence
  chemically synthesized
taccaagccatgagttacatat

SEQ ID NO: 1314536 - DNA, 22 bp, Artificial Sequence
  chemically synthesized
ccttagctgtttaatatgtaac

SEQ ID NO: 1314537 - DNA, 22 bp, Artificial Sequence
  chemically synthesized
catattaaacagctaaggcagg

SEQ ID NO: 1314538 - DNA, 22 bp, Artificial Sequence
  chemically synthesized
aacagctaaggcaggtgggcgt

SEQ ID NO: 1314539 - DNA, 22 bp, Artificial Sequence
  chemically synthesized
caggcatgagccaccacgccca

SEQ ID NO: 1314540 - DNA, 22 bp, Artificial Sequence
  chemically synthesized
aggcaggtgggcgtggtggctc

SEQ ID NO: 1314541 - DNA, 22 bp, Artificial Sequence
  chemically synthesized
ggattacaggcatgagccacca

SEQ ID NO: 1314542 - DNA, 22 bp, Artificial Sequence
  chemically synthesized
ccaaagtgctgggattacaggc

SEQ ID NO: 1314543 - DNA, 22 bp, Artificial Sequence
  chemically synthesized
agcctcccaaagtgctgggatt

SEQ ID NO: 1314544 - DNA, 22 bp, Artificial Sequence
  chemically synthesized
atgcctgtaatcccagcacttt

SEQ ID NO: 1314545 - DNA, 22 bp, Artificial Sequence
  chemically synthesized
taatcccagcactttgggaggc

SEQ ID NO: 1314546 - DNA, 22 bp, Artificial Sequence
  chemically synthesized
aggtgacccacccacctcagcc

SEQ ID NO: 1314547 - DNA, 22 bp, Artificial Sequence
  chemically synthesized
acctcaggtgacccacccacct

SEQ ID NO: 1314548 - DNA, 22 bp, Artificial Sequence
  chemically synthesized
tgggaggctgaggtgggtgggt

SEQ ID NO: 1314549 - DNA, 22 bp, Artificial Sequence
  chemically synthesized
gggaggctgaggtgggtgggtc

SEQ ID NO: 1314550 - DNA, 22 bp, Artificial Sequence
  chemically synthesized
ctgacctcaggtgacccaccca

SEQ ID NO: 1314551 - DNA, 22 bp, Artificial Sequence
  chemically synthesized
ggaggctgaggtgggtgggtca

SEQ ID NO: 1314552 - DNA, 22 bp, Artificial Sequence
  chemically synthesized
gaactcctgacctcaggtgacc

SEQ ID NO: 1314553 - DNA, 22 bp, Artificial Sequence
  chemically synthesized
aggtgggtgggtcacctgaggt

SEQ ID NO: 1314554 - DNA, 22 bp, Artificial Sequence
  chemically synthesized
gtctcgaactcctgacctcagg

SEQ ID NO: 1314555 - DNA, 22 bp, Artificial Sequence
  chemically synthesized
gccaggctggtctcgaactcct

SEQ ID NO: 1314556 - DNA, 22 bp, Artificial Sequence
  chemically synthesized
aggtcaggagttcgagaccagc

SEQ ID NO: 1314557 - DNA, 22 bp, Artificial Sequence
  chemically synthesized
accacattggccaggctggtct

SEQ ID NO: 1314558 - DNA, 22 bp, Artificial Sequence
  chemically synthesized
caccacattggccaggctggtc

SEQ ID NO: 1314559 - DNA, 22 bp, Artificial Sequence
  chemically synthesized
gagaccagcctggccaatgtgg

SEQ ID NO: 1314560 - DNA, 22 bp, Artificial Sequence
  chemically synthesized
gtagagacggggtttcaccaca

SEQ ID NO: 1314561 - DNA, 22 bp, Artificial Sequence
  chemically synthesized
agtagagacggggtttcaccac

SEQ ID NO: 1314562 - DNA, 22 bp, Artificial Sequence
  chemically synthesized
tagtagagacggggtttcacca

SEQ ID NO: 1314563 - DNA, 22 bp, Artificial Sequence
  chemically synthesized
ttagtagagacggggtttcacc

SEQ ID NO: 1314564 - DNA, 22 bp, Artificial Sequence
  chemically synthesized
gccaatgtggtgaaaccccgtc

SEQ ID NO: 1314565 - DNA, 22 bp, Artificial Sequence
  chemically synthesized
tgtttttagtagagacggggtt

SEQ ID NO: 1314566 - DNA, 22 bp, Artificial Sequence
  chemically synthesized
gtgtttttagtagagacggggt

SEQ ID NO: 1314567 - DNA, 22 bp, Artificial Sequence
  chemically synthesized
tgtgtttttagtagagacgggg

SEQ ID NO: 1314568 - DNA, 22 bp, Artificial Sequence
  chemically synthesized
ttgtgtttttagtagagacggg

SEQ ID NO: 1314569 - DNA, 22 bp, Artificial Sequence
  chemically synthesized
tttgtgtttttagtagagacgg

SEQ ID NO: 1314570 - DNA, 22 bp, Artificial Sequence
  chemically synthesized
attttttgtgtttttagtagag

SEQ ID NO: 1314571 - DNA, 22 bp, Artificial Sequence
  chemically synthesized
tactaaaaacacaaaaaattag

SEQ ID NO: 1314572 - DNA, 22 bp, Artificial Sequence
  chemically synthesized
ctaaaaacacaaaaaattagcc

SEQ ID NO: 1314573 - DNA, 22 bp, Artificial Sequence
  chemically synthesized
aaaacacaaaaaattagccggg

SEQ ID NO: 1314574 - DNA, 22 bp, Artificial Sequence
  chemically synthesized
cgggcacccgccaccaagcccg

SEQ ID NO: 1314575 - DNA, 22 bp, Artificial Sequence
  chemically synthesized
ggattacgggcacccgccacca

SEQ ID NO: 1314576 - DNA, 22 bp, Artificial Sequence
  chemically synthesized
gccgggcttggtggcgggtgcc

SEQ ID NO: 1314577 - DNA, 22 bp, Artificial Sequence
  chemically synthesized
gagtagctaggattacgggcac

SEQ ID NO: 1314578 - DNA, 22 bp, Artificial Sequence
  chemically synthesized
tcgagtagctaggattacgggc

SEQ ID NO: 1314579 - DNA, 22 bp, Artificial Sequence
  chemically synthesized
ggtggcgggtgcccgtaatcct

SEQ ID NO: 1314580 - DNA, 22 bp, Artificial Sequence
  chemically synthesized
gtggcgggtgcccgtaatccta

SEQ ID NO: 1314581 - DNA, 22 bp, Artificial Sequence
  chemically synthesized
agcctctcgagtagctaggatt

SEQ ID NO: 1314582 - DNA, 22 bp, Artificial Sequence
  chemically synthesized
cctcagcctctcgagtagctag

SEQ ID NO: 1314583 - DNA, 22 bp, Artificial Sequence
  chemically synthesized
ctgcctcagcctctcgagtagc

SEQ ID NO: 1314584 - DNA, 22 bp, Artificial Sequence
  chemically synthesized
tcctgcctcagcctctcgagta

SEQ ID NO: 1314585 - DNA, 22 bp, Artificial Sequence
  chemically synthesized
aagtgattctcctgcctcagcc

SEQ ID NO: 1314586 - DNA, 22 bp, Artificial Sequence
  chemically synthesized
gctactcgagaggctgaggcag

SEQ ID NO: 1314587 - DNA, 22 bp, Artificial Sequence
  chemically synthesized
ctcgagaggctgaggcaggaga

SEQ ID NO: 1314588 - DNA, 22 bp, Artificial Sequence
  chemically synthesized
gagaggctgaggcaggagaatc

SEQ ID NO: 1314589 - DNA, 22 bp, Artificial Sequence
  chemically synthesized
ccaggttcaagtgattctcctg

SEQ ID NO: 1314590 - DNA, 22 bp, Artificial Sequence
  chemically synthesized
cgcctgccaggttcaagtgatt

SEQ ID NO: 1314591 - DNA, 22 bp, Artificial Sequence
  chemically synthesized
aggcaggagaatcacttgaacc

SEQ ID NO: 1314592 - DNA, 22 bp, Artificial Sequence
  chemically synthesized
caacctccgcctgccaggttca

SEQ ID NO: 1314593 - DNA, 22 bp, Artificial Sequence
  chemically synthesized
actgcaacctccgcctgccagg

SEQ ID NO: 1314594 - DNA, 22 bp, Artificial Sequence
  chemically synthesized
ggctcactgcaacctccgcctg

SEQ ID NO: 1314595 - DNA, 22 bp, Artificial Sequence
  chemically synthesized
gaacctggcaggcggaggttgc

SEQ ID NO: 1314596 - DNA, 22 bp, Artificial Sequence
  chemically synthesized
aacctggcaggcggaggttgca

SEQ ID NO: 1314597 - DNA, 22 bp, Artificial Sequence
  chemically synthesized
gcaggcggaggttgcagtgagc

SEQ ID NO: 1314598 - DNA, 22 bp, Artificial Sequence
  chemically synthesized
cagtgagccgagatcgcatcac

SEQ ID NO: 1314599 - DNA, 22 bp, Artificial Sequence
  chemically synthesized
tccaggatggagtgcggtgatg

SEQ ID NO: 1314600 - DNA, 22 bp, Artificial Sequence
  chemically synthesized
gttgtccaggatggagtgcggt

SEQ ID NO: 1314601 - DNA, 22 bp, Artificial Sequence
  chemically synthesized
tcgttgtccaggatggagtgcg

SEQ ID NO: 1314602 - DNA, 22 bp, Artificial Sequence
  chemically synthesized
ctctcgttgtccaggatggagt

SEQ ID NO: 1314603 - DNA, 22 bp, Artificial Sequence
  chemically synthesized
gctctcgttgtccaggatggag

SEQ ID NO: 1314604 - DNA, 22 bp, Artificial Sequence
  chemically synthesized
tgctctcgttgtccaggatgga

SEQ ID NO: 1314605 - DNA, 22 bp, Artificial Sequence
  chemically synthesized
agacagagttttgctctcgttg

SEQ ID NO: 1314606 - DNA, 22 bp, Artificial Sequence
  chemically synthesized
gagacagagttttgctctcgtt

SEQ ID NO: 1314607 - DNA, 22 bp, Artificial Sequence
  chemically synthesized
catcctggacaacgagagcaaa

SEQ ID NO: 1314608 - DNA, 22 bp, Artificial Sequence
  chemically synthesized
tttgagacagagttttgctctc

SEQ ID NO: 1314609 - DNA, 22 bp, Artificial Sequence
  chemically synthesized
atttgagacagagttttgctct

SEQ ID NO: 1314610 - DNA, 22 bp, Artificial Sequence
  chemically synthesized
tttatttgagacagagttttgc

SEQ ID NO: 1314611 - DNA, 22 bp, Artificial Sequence
  chemically synthesized
atttatttgagacagagttttg

SEQ ID NO: 1314612 - DNA, 22 bp, Artificial Sequence
  chemically synthesized
gacaacgagagcaaaactctgt

SEQ ID NO: 1314613 - DNA, 22 bp, Artificial Sequence
  chemically synthesized
tttatttatttgagacagagtt

SEQ ID NO: 1314614 - DNA, 22 bp, Artificial Sequence
  chemically synthesized
atttatttatttgagacagagt

SEQ ID NO: 1314615 - DNA, 22 bp, Artificial Sequence
  chemically synthesized
tttatttatttatttgagacag

SEQ ID NO: 1314616 - DNA, 22 bp, Artificial Sequence
  chemically synthesized
atttatttatttatttgagaca

SEQ ID NO: 1314617 - DNA, 22 bp, Artificial Sequence
  chemically synthesized
tttatttatttatttatttgag

SEQ ID NO: 1314618 - DNA, 22 bp, Artificial Sequence
  chemically synthesized
atttatttatttatttatttga

SEQ ID NO: 1314619 - DNA, 22 bp, Artificial Sequence
  chemically synthesized
tttatttatttatttatttatt

SEQ ID NO: 1314620 - DNA, 22 bp, Artificial Sequence
  chemically synthesized
atttatttatttatttatttat

SEQ ID NO: 1314621 - DNA, 22 bp, Artificial Sequence
  chemically synthesized
tttatttatttatttatttatt

SEQ ID NO: 1314622 - DNA, 22 bp, Artificial Sequence
  chemically synthesized
tgtctcaaataaataaataaat

SEQ ID NO: 1314623 - DNA, 22 bp, Artificial Sequence
  chemically synthesized
atttatttatttatttatttat

SEQ ID NO: 1314624 - DNA, 22 bp, Artificial Sequence
  chemically synthesized
tctcaaataaataaataaataa

SEQ ID NO: 1314625 - DNA, 22 bp, Artificial Sequence
  chemically synthesized
tttatttatttatttatttatt

SEQ ID NO: 1314626 - DNA, 22 bp, Artificial Sequence
  chemically synthesized
atttatttatttatttatttat

SEQ ID NO: 1314627 - DNA, 22 bp, Artificial Sequence
  chemically synthesized
aaataaataaataaataaataa

SEQ ID NO: 1314628 - DNA, 22 bp, Artificial Sequence
  chemically synthesized
tttatttatttatttatttatt

SEQ ID NO: 1314629 - DNA, 22 bp, Artificial Sequence
  chemically synthesized
atttatttatttatttatttat

SEQ ID NO: 1314630 - DNA, 22 bp, Artificial Sequence
  chemically synthesized
tttatttatttatttatttatt

SEQ ID NO: 1314631 - DNA, 22 bp, Artificial Sequence
  chemically synthesized
atttatttatttatttatttat

SEQ ID NO: 1314632 - DNA, 22 bp, Artificial Sequence
  chemically synthesized
tttatttatttatttatttatt

SEQ ID NO: 1314633 - DNA, 22 bp, Artificial Sequence
  chemically synthesized
gctgtttatttatttatttatt

SEQ ID NO: 1314634 - DNA, 22 bp, Artificial Sequence
  chemically synthesized
agctgtttatttatttatttat

SEQ ID NO: 1314635 - DNA, 22 bp, Artificial Sequence
  chemically synthesized
gccttagctgtttatttattta

SEQ ID NO: 1314636 - DNA, 22 bp, Artificial Sequence
  chemically synthesized
ttagccttagctgtttatttat

SEQ ID NO: 1314637 - DNA, 22 bp, Artificial Sequence
  chemically synthesized
actgttagccttagctgtttat

SEQ ID NO: 1314638 - DNA, 22 bp, Artificial Sequence
  chemically synthesized
atattgactgttagccttagct

SEQ ID NO: 1314639 - DNA, 22 bp, Artificial Sequence
  chemically synthesized
aatattgactgttagccttagc

SEQ ID NO: 1314640 - DNA, 22 bp, Artificial Sequence
  chemically synthesized
taatattgactgttagccttag

SEQ ID NO: 1314641 - DNA, 22 bp, Artificial Sequence
  chemically synthesized
ttaatattgactgttagcctta

SEQ ID NO: 1314642 - DNA, 22 bp, Artificial Sequence
  chemically synthesized
taatttttaatattgactgtta

SEQ ID NO: 1314643 - DNA, 22 bp, Artificial Sequence
  chemically synthesized
ataatttttaatattgactgtt

SEQ ID NO: 1314644 - DNA, 22 bp, Artificial Sequence
  chemically synthesized
gtgtttataatttttaatattg

SEQ ID NO: 1314645 - DNA, 22 bp, Artificial Sequence
  chemically synthesized
aggctaacagtcaatattaaaa

SEQ ID NO: 1314646 - DNA, 22 bp, Artificial Sequence
  chemically synthesized
agtgtttataatttttaatatt

SEQ ID NO: 1314647 - DNA, 22 bp, Artificial Sequence
  chemically synthesized
tagtgtttataatttttaatat

SEQ ID NO: 1314648 - DNA, 22 bp, Artificial Sequence
  chemically synthesized
acagtcaatattaaaaattata

SEQ ID NO: 1314649 - DNA, 22 bp, Artificial Sequence
  chemically synthesized
gagaaacactttagtgtttata

SEQ ID NO: 1314650 - DNA, 22 bp, Artificial Sequence
  chemically synthesized
aaaattataaacactaaagtgt

SEQ ID NO: 1314651 - DNA, 22 bp, Artificial Sequence
  chemically synthesized
taaacactaaagtgtttctcta

SEQ ID NO: 1314652 - DNA, 22 bp, Artificial Sequence
  chemically synthesized
aatgcaaaataataagttagag

SEQ ID NO: 1314653 - DNA, 22 bp, Artificial Sequence
  chemically synthesized
ttaaatgcaaaataataagtta

SEQ ID NO: 1314654 - DNA, 22 bp, Artificial Sequence
  chemically synthesized
aagtgtttctctaacttattat

SEQ ID NO: 1314655 - DNA, 22 bp, Artificial Sequence
  chemically synthesized
gttaaatgcaaaataataagtt

SEQ ID NO: 1314656 - DNA, 22 bp, Artificial Sequence
  chemically synthesized
tgttaaatgcaaaataataagt

SEQ ID NO: 1314657 - DNA, 22 bp, Artificial Sequence
  chemically synthesized
ctctaacttattattttgcatt

SEQ ID NO: 1314658 - DNA, 22 bp, Artificial Sequence
  chemically synthesized
tctaacttattattttgcattt

SEQ ID NO: 1314659 - DNA, 22 bp, Artificial Sequence
  chemically synthesized
taacttattattttgcatttaa

SEQ ID NO: 1314660 - DNA, 22 bp, Artificial Sequence
  chemically synthesized
acttattattttgcatttaaca

SEQ ID NO: 1314661 - DNA, 22 bp, Artificial Sequence
  chemically synthesized
attattttgcatttaacaaaat

SEQ ID NO: 1314662 - DNA, 22 bp, Artificial Sequence
  chemically synthesized
tgggaaaatggtattttgttaa

SEQ ID NO: 1314663 - DNA, 22 bp, Artificial Sequence
  chemically synthesized
ttattttgcatttaacaaaata

SEQ ID NO: 1314664 - DNA, 22 bp, Artificial Sequence
  chemically synthesized
atgggaaaatggtattttgtta

SEQ ID NO: 1314665 - DNA, 22 bp, Artificial Sequence
  chemically synthesized
tatgggaaaatggtattttgtt

SEQ ID NO: 1314666 - DNA, 22 bp, Artificial Sequence
  chemically synthesized
ttttgcatttaacaaaatacca

SEQ ID NO: 1314667 - DNA, 22 bp, Artificial Sequence
  chemically synthesized
tgcatttaacaaaataccattt

SEQ ID NO: 1314668 - DNA, 22 bp, Artificial Sequence
  chemically synthesized
gcatttaacaaaataccatttt

SEQ ID NO: 1314669 - DNA, 22 bp, Artificial Sequence
  chemically synthesized
catttaacaaaataccattttc

SEQ ID NO: 1314670 - DNA, 22 bp, Artificial Sequence
  chemically synthesized
acaatagactttatgggaaaat

SEQ ID NO: 1314671 - DNA, 22 bp, Artificial Sequence
  chemically synthesized
aacaaaataccattttcccata

SEQ ID NO: 1314672 - DNA, 22 bp, Artificial Sequence
  chemically synthesized
aacaatagactttatgggaaaa

SEQ ID NO: 1314673 - DNA, 22 bp, Artificial Sequence
  chemically synthesized
acaaaataccattttcccataa

SEQ ID NO: 1314674 - DNA, 22 bp, Artificial Sequence
  chemically synthesized
taacaatagactttatgggaaa

SEQ ID NO: 1314675 - DNA, 22 bp, Artificial Sequence
  chemically synthesized
ctttaacaatagactttatggg

SEQ ID NO: 1314676 - DNA, 22 bp, Artificial Sequence
  chemically synthesized
gctttaacaatagactttatgg

SEQ ID NO: 1314677 - DNA, 22 bp, Artificial Sequence
  chemically synthesized
gtttgctttaacaatagacttt

SEQ ID NO: 1314678 - DNA, 22 bp, Artificial Sequence
  chemically synthesized
agtttgctttaacaatagactt

SEQ ID NO: 1314679 - DNA, 22 bp, Artificial Sequence
  chemically synthesized
tcccataaagtctattgttaaa

SEQ ID NO: 1314680 - DNA, 22 bp, Artificial Sequence
  chemically synthesized
cccataaagtctattgttaaag

SEQ ID NO: 1314681 - DNA, 22 bp, Artificial Sequence
  chemically synthesized
ccataaagtctattgttaaagc

SEQ ID NO: 1314682 - DNA, 22 bp, Artificial Sequence
  chemically synthesized
aggccgtatttagtttgcttta

SEQ ID NO: 1314683 - DNA, 22 bp, Artificial Sequence
  chemically synthesized
tcaggccgtatttagtttgctt

SEQ ID NO: 1314684 - DNA, 22 bp, Artificial Sequence
  chemically synthesized
ctcaggccgtatttagtttgct

SEQ ID NO: 1314685 - DNA, 22 bp, Artificial Sequence
  chemically synthesized
ttgttaaagcaaactaaatacg

SEQ ID NO: 1314686 - DNA, 22 bp, Artificial Sequence
  chemically synthesized
ttaaagcaaactaaatacggcc

SEQ ID NO: 1314687 - DNA, 22 bp, Artificial Sequence
  chemically synthesized
aagcaaactaaatacggcctga

SEQ ID NO: 1314688 - DNA, 22 bp, Artificial Sequence
  chemically synthesized
aatacggcctgagaaggactcc

SEQ ID NO: 1314689 - DNA, 22 bp, Artificial Sequence
  chemically synthesized
aaatatagaagtacggagtcct

SEQ ID NO: 1314690 - DNA, 22 bp, Artificial Sequence
  chemically synthesized
agaaggactccgtacttctata

SEQ ID NO: 1314691 - DNA, 22 bp, Artificial Sequence
  chemically synthesized
atccacagggactcaaatatag

SEQ ID NO: 1314692 - DNA, 22 bp, Artificial Sequence
  chemically synthesized
cgtacttctatatttgagtccc

SEQ ID NO: 1314693 - DNA, 22 bp, Artificial Sequence
  chemically synthesized
tagttcatccacagggactcaa

SEQ ID NO: 1314694 - DNA, 22 bp, Artificial Sequence
  chemically synthesized
ctatatttgagtccctgtggat

SEQ ID NO: 1314695 - DNA, 22 bp, Artificial Sequence
  chemically synthesized
tatatttgagtccctgtggatg

SEQ ID NO: 1314696 - DNA, 22 bp, Artificial Sequence
  chemically synthesized
tatttgagtccctgtggatgaa

SEQ ID NO: 1314697 - DNA, 22 bp, Artificial Sequence
  chemically synthesized
agataggttgtagttcatccac

SEQ ID NO: 1314698 - DNA, 22 bp, Artificial Sequence
  chemically synthesized
ttgagataggttgtagttcatc

SEQ ID NO: 1314699 - DNA, 22 bp, Artificial Sequence
  chemically synthesized
gagtccctgtggatgaactaca

SEQ ID NO: 1314700 - DNA, 22 bp, Artificial Sequence
  chemically synthesized
agtccctgtggatgaactacaa

SEQ ID NO: 1314701 - DNA, 22 bp, Artificial Sequence
  chemically synthesized
cctattgagataggttgtagtt

SEQ ID NO: 1314702 - DNA, 22 bp, Artificial Sequence
  chemically synthesized
tctacctattgagataggttgt

SEQ ID NO: 1314703 - DNA, 22 bp, Artificial Sequence
  chemically synthesized
gtctacctattgagataggttg

SEQ ID NO: 1314704 - DNA, 22 bp, Artificial Sequence
  chemically synthesized
tggatgaactacaacctatctc

SEQ ID NO: 1314705 - DNA, 22 bp, Artificial Sequence
  chemically synthesized
aatcttgtctacctattgagat

SEQ ID NO: 1314706 - DNA, 22 bp, Artificial Sequence
  chemically synthesized
caatcttgtctacctattgaga

SEQ ID NO: 1314707 - DNA, 22 bp, Artificial Sequence
  chemically synthesized
tcaatcttgtctacctattgag

SEQ ID NO: 1314708 - DNA, 22 bp, Artificial Sequence
  chemically synthesized
ttcaatcttgtctacctattga

SEQ ID NO: 1314709 - DNA, 22 bp, Artificial Sequence
  chemically synthesized
caacctatctcaataggtagac

SEQ ID NO: 1314710 - DNA, 22 bp, Artificial Sequence
  chemically synthesized
gtttttcaatcttgtctaccta

SEQ ID NO: 1314711 - DNA, 22 bp, Artificial Sequence
  chemically synthesized
agttagtttttcaatcttgtct

SEQ ID NO: 1314712 - DNA, 22 bp, Artificial Sequence
  chemically synthesized
tctcaataggtagacaagattg

SEQ ID NO: 1314713 - DNA, 22 bp, Artificial Sequence
  chemically synthesized
ctaagttagtttttcaatcttg

SEQ ID NO: 1314714 - DNA, 22 bp, Artificial Sequence
  chemically synthesized
aataggtagacaagattgaaaa

SEQ ID NO: 1314715 - DNA, 22 bp, Artificial Sequence
  chemically synthesized
tcacaggcccatactcctaagt

SEQ ID NO: 1314716 - DNA, 22 bp, Artificial Sequence
  chemically synthesized
aaaaactaacttaggagtatgg

SEQ ID NO: 1314717 - DNA, 22 bp, Artificial Sequence
  chemically synthesized
agtgattgtcacaggcccatac

SEQ ID NO: 1314718 - DNA, 22 bp, Artificial Sequence
  chemically synthesized
acttaggagtatgggcctgtga

SEQ ID NO: 1314719 - DNA, 22 bp, Artificial Sequence
  chemically synthesized
aggagtatgggcctgtgacaat

SEQ ID NO: 1314720 - DNA, 22 bp, Artificial Sequence
  chemically synthesized
ggagtatgggcctgtgacaatc

SEQ ID NO: 1314721 - DNA, 22 bp, Artificial Sequence
  chemically synthesized
gccaagactgagtgattgtcac

SEQ ID NO: 1314722 - DNA, 22 bp, Artificial Sequence
  chemically synthesized
ggattggccaagactgagtgat

SEQ ID NO: 1314723 - DNA, 22 bp, Artificial Sequence
  chemically synthesized
tgacaatcactcagtcttggcc

SEQ ID NO: 1314724 - DNA, 22 bp, Artificial Sequence
  chemically synthesized
aagaatggcggctgggattggc

SEQ ID NO: 1314725 - DNA, 22 bp, Artificial Sequence
  chemically synthesized
gctgaagaatggcggctgggat

SEQ ID NO: 1314726 - DNA, 22 bp, Artificial Sequence
  chemically synthesized
agtcttggccaatcccagccgc

SEQ ID NO: 1314727 - DNA, 22 bp, Artificial Sequence
  chemically synthesized
ggccaatcccagccgccattct

SEQ ID NO: 1314728 - DNA, 22 bp, Artificial Sequence
  chemically synthesized
gccaatcccagccgccattctt

SEQ ID NO: 1314729 - DNA, 22 bp, Artificial Sequence
  chemically synthesized
aacaatcagcagtgtataactg

SEQ ID NO: 1314730 - DNA, 22 bp, Artificial Sequence
  chemically synthesized
gaacaatcagcagtgtataact

SEQ ID NO: 1314731 - DNA, 22 bp, Artificial Sequence
  chemically synthesized
ttcagccagttatacactgctg

SEQ ID NO: 1314732 - DNA, 22 bp, Artificial Sequence
  chemically synthesized
cagccagttatacactgctgat

SEQ ID NO: 1314733 - DNA, 22 bp, Artificial Sequence
  chemically synthesized
agccagttatacactgctgatt

SEQ ID NO: 1314734 - DNA, 22 bp, Artificial Sequence
  chemically synthesized
aacacagtttgaacaatcagca

SEQ ID NO: 1314735 - DNA, 22 bp, Artificial Sequence
  chemically synthesized
gaacacagtttgaacaatcagc

SEQ ID NO: 1314736 - DNA, 22 bp, Artificial Sequence
  chemically synthesized
tttgaacacagtttgaacaatc

SEQ ID NO: 1314737 - DNA, 22 bp, Artificial Sequence
  chemically synthesized
atttgaacacagtttgaacaat

SEQ ID NO: 1314738 - DNA, 22 bp, Artificial Sequence
  chemically synthesized
tacactgctgattgttcaaact

SEQ ID NO: 1314739 - DNA, 22 bp, Artificial Sequence
  chemically synthesized
ccttatttgaacacagtttgaa

SEQ ID NO: 1314740 - DNA, 22 bp, Artificial Sequence
  chemically synthesized
gccttatttgaacacagtttga

SEQ ID NO: 1314741 - DNA, 22 bp, Artificial Sequence
  chemically synthesized
tttgccttatttgaacacagtt

SEQ ID NO: 1314742 - DNA, 22 bp, Artificial Sequence
  chemically synthesized
ctgattgttcaaactgtgttca

SEQ ID NO: 1314743 - DNA, 22 bp, Artificial Sequence
  chemically synthesized
attgttcaaactgtgttcaaat

SEQ ID NO: 1314744 - DNA, 22 bp, Artificial Sequence
  chemically synthesized
gctgtttgccttatttgaacac

SEQ ID NO: 1314745 - DNA, 22 bp, Artificial Sequence
  chemically synthesized
ttcaaactgtgttcaaataagg

SEQ ID NO: 1314746 - DNA, 22 bp, Artificial Sequence
  chemically synthesized
cagctcgctgtttgccttattt

SEQ ID NO: 1314747 - DNA, 22 bp, Artificial Sequence
  chemically synthesized
aaactgtgttcaaataaggcaa

SEQ ID NO: 1314748 - DNA, 22 bp, Artificial Sequence
  chemically synthesized
gttacagctcgctgtttgcctt

SEQ ID NO: 1314749 - DNA, 22 bp, Artificial Sequence
  chemically synthesized
tgttcaaataaggcaaacagcg

SEQ ID NO: 1314750 - DNA, 22 bp, Artificial Sequence
  chemically synthesized
gattggttacagctcgctgttt

SEQ ID NO: 1314751 - DNA, 22 bp, Artificial Sequence
  chemically synthesized
aaataaggcaaacagcgagctg

SEQ ID NO: 1314752 - DNA, 22 bp, Artificial Sequence
  chemically synthesized
taaccaatccagctgtttctgc

SEQ ID NO: 1314753 - DNA, 22 bp, Artificial Sequence
  chemically synthesized
tttctgcatctcacttccgatt

SEQ ID NO: 1314754 - DNA, 22 bp, Artificial Sequence
  chemically synthesized
ctgcatctcacttccgatttct

SEQ ID NO: 1314755 - DNA, 22 bp, Artificial Sequence
  chemically synthesized
tgcatctcacttccgatttcta

SEQ ID NO: 1314756 - DNA, 22 bp, Artificial Sequence
  chemically synthesized
catctcacttccgatttctaca

SEQ ID NO: 1314757 - DNA, 22 bp, Artificial Sequence
  chemically synthesized
acttccgatttctacatgtcac

SEQ ID NO: 1314758 - DNA, 22 bp, Artificial Sequence
  chemically synthesized
ccgatttctacatgtcacttta

SEQ ID NO: 1314759 - DNA, 22 bp, Artificial Sequence
  chemically synthesized
cgatttctacatgtcactttac

SEQ ID NO: 1314760 - DNA, 22 bp, Artificial Sequence
  chemically synthesized
tagacaaaaaaaagtaaagtga

SEQ ID NO: 1314761 - DNA, 22 bp, Artificial Sequence
  chemically synthesized
atagacaaaaaaaagtaaagtg

SEQ ID NO: 1314762 - DNA, 22 bp, Artificial Sequence
  chemically synthesized
ctacatgtcactttactttttt

SEQ ID NO: 1314763 - DNA, 22 bp, Artificial Sequence
  chemically synthesized
tacatgtcactttacttttttt

SEQ ID NO: 1314764 - DNA, 22 bp, Artificial Sequence
  chemically synthesized
catgtcactttacttttttttg

SEQ ID NO: 1314765 - DNA, 22 bp, Artificial Sequence
  chemically synthesized
tggtcagaataaatttatagac

SEQ ID NO: 1314766 - DNA, 22 bp, Artificial Sequence
  chemically synthesized
tacttttttttgtctataaatt

SEQ ID NO: 1314767 - DNA, 22 bp, Artificial Sequence
  chemically synthesized
gtggtcagaataaatttataga

SEQ ID NO: 1314768 - DNA, 22 bp, Artificial Sequence
  chemically synthesized
acttttttttgtctataaattt

SEQ ID NO: 1314769 - DNA, 22 bp, Artificial Sequence
  chemically synthesized
cttttttttgtctataaattta

SEQ ID NO: 1314770 - DNA, 22 bp, Artificial Sequence
  chemically synthesized
ttttttgtctataaatttattc

SEQ ID NO: 1314771 - DNA, 22 bp, Artificial Sequence
  chemically synthesized
tttttgtctataaatttattct

SEQ ID NO: 1314772 - DNA, 22 bp, Artificial Sequence
  chemically synthesized
ttttgtctataaatttattctg

SEQ ID NO: 1314773 - DNA, 22 bp, Artificial Sequence
  chemically synthesized
tttgtctataaatttattctga

SEQ ID NO: 1314774 - DNA, 22 bp, Artificial Sequence
  chemically synthesized
ttgtctataaatttattctgac

SEQ ID NO: 1314775 - DNA, 22 bp, Artificial Sequence
  chemically synthesized
tgtctataaatttattctgacc

SEQ ID NO: 1314776 - DNA, 22 bp, Artificial Sequence
  chemically synthesized
gtctataaatttattctgacca

SEQ ID NO: 1314777 - DNA, 22 bp, Artificial Sequence
  chemically synthesized
tctataaatttattctgaccac

SEQ ID NO: 1314778 - DNA, 22 bp, Artificial Sequence
  chemically synthesized
caggggtgccttgtggtcagaa

SEQ ID NO: 1314779 - DNA, 22 bp, Artificial Sequence
  chemically synthesized
taaatttattctgaccacaagg

SEQ ID NO: 1314780 - DNA, 22 bp, Artificial Sequence
  chemically synthesized
agagagactccaggggtgcctt

SEQ ID NO: 1314781 - DNA, 22 bp, Artificial Sequence
  chemically synthesized
attctgaccacaaggcacccct

SEQ ID NO: 1314782 - DNA, 22 bp, Artificial Sequence
  chemically synthesized
ttctgaccacaaggcacccctg

SEQ ID NO: 1314783 - DNA, 22 bp, Artificial Sequence
  chemically synthesized
tgaccacaaggcacccctggag

SEQ ID NO: 1314784 - DNA, 22 bp, Artificial Sequence
  chemically synthesized
accacaaggcacccctggagtc

SEQ ID NO: 1314785 - DNA, 22 bp, Artificial Sequence
  chemically synthesized
cagcagattcagagagactcca

SEQ ID NO: 1314786 - DNA, 22 bp, Artificial Sequence
  chemically synthesized
agaattacagcagattcagaga

SEQ ID NO: 1314787 - DNA, 22 bp, Artificial Sequence
  chemically synthesized
gagtctctctgaatctgctgta

SEQ ID NO: 1314788 - DNA, 22 bp, Artificial Sequence
  chemically synthesized
tctgaatctgctgtaattctga

SEQ ID NO: 1314789 - DNA, 22 bp, Artificial Sequence
  chemically synthesized
tgaatctgctgtaattctgagg

SEQ ID NO: 1314790 - DNA, 22 bp, Artificial Sequence
  chemically synthesized
cgaatcaggcagccctcagaat

SEQ ID NO: 1314791 - DNA, 22 bp, Artificial Sequence
  chemically synthesized
aatctgctgtaattctgagggc

SEQ ID NO: 1314792 - DNA, 22 bp, Artificial Sequence
  chemically synthesized
gcgaatcaggcagccctcagaa

SEQ ID NO: 1314793 - DNA, 22 bp, Artificial Sequence
  chemically synthesized
ctgtaattctgagggctgcctg

SEQ ID NO: 1314794 - DNA, 22 bp, Artificial Sequence
  chemically synthesized
taattctgagggctgcctgatt

SEQ ID NO: 1314795 - DNA, 22 bp, Artificial Sequence
  chemically synthesized
tgagggctgcctgattcgcaaa

SEQ ID NO: 1314796 - DNA, 22 bp, Artificial Sequence
  chemically synthesized
agcaatgaacgatttgcgaatc

SEQ ID NO: 1314797 - DNA, 22 bp, Artificial Sequence
  chemically synthesized
agggctgcctgattcgcaaatc

SEQ ID NO: 1314798 - DNA, 22 bp, Artificial Sequence
  chemically synthesized
attgagcaatgaacgatttgcg

SEQ ID NO: 1314799 - DNA, 22 bp, Artificial Sequence
  chemically synthesized
aattgagcaatgaacgatttgc

SEQ ID NO: 1314800 - DNA, 22 bp, Artificial Sequence
  chemically synthesized
cctgattcgcaaatcgttcatt

SEQ ID NO: 1314801 - DNA, 22 bp, Artificial Sequence
  chemically synthesized
attcgcaaatcgttcattgctc

SEQ ID NO: 1314802 - DNA, 22 bp, Artificial Sequence
  chemically synthesized
aaggagtttaattgagcaatga

SEQ ID NO: 1314803 - DNA, 22 bp, Artificial Sequence
  chemically synthesized
gcaaatcgttcattgctcaatt

SEQ ID NO: 1314804 - DNA, 22 bp, Artificial Sequence
  chemically synthesized
aagttaaaggagtttaattgag

SEQ ID NO: 1314805 - DNA, 22 bp, Artificial Sequence
  chemically synthesized
attgctcaattaaactccttta

SEQ ID NO: 1314806 - DNA, 22 bp, Artificial Sequence
  chemically synthesized
agccaaattaaagttaaaggag

SEQ ID NO: 1314807 - DNA, 22 bp, Artificial Sequence
  chemically synthesized
gagccaaattaaagttaaagga

SEQ ID NO: 1314808 - DNA, 22 bp, Artificial Sequence
  chemically synthesized
ctcaattaaactcctttaactt

SEQ ID NO: 1314809 - DNA, 22 bp, Artificial Sequence
  chemically synthesized
aattaaactcctttaactttaa

SEQ ID NO: 1314810 - DNA, 22 bp, Artificial Sequence
  chemically synthesized
aactcctttaactttaatttgg

SEQ ID NO: 1314811 - DNA, 22 bp, Artificial Sequence
  chemically synthesized
aaagaaaaacttgagccaaatt

SEQ ID NO: 1314812 - DNA, 22 bp, Artificial Sequence
  chemically synthesized
ctttaactttaatttggctcaa

SEQ ID NO: 1314813 - DNA, 22 bp, Artificial Sequence
  chemically synthesized
taactttaatttggctcaagtt

SEQ ID NO: 1314814 - DNA, 22 bp, Artificial Sequence
  chemically synthesized
aactttaatttggctcaagttt

SEQ ID NO: 1314815 - DNA, 22 bp, Artificial Sequence
  chemically synthesized
actttaatttggctcaagtttt

SEQ ID NO: 1314816 - DNA, 22 bp, Artificial Sequence
  chemically synthesized
taatttggctcaagtttttctt

SEQ ID NO: 1314817 - DNA, 22 bp, Artificial Sequence
  chemically synthesized
aatttggctcaagtttttcttt

SEQ ID NO: 1314818 - DNA, 22 bp, Artificial Sequence
  chemically synthesized
atttggctcaagtttttctttt

SEQ ID NO: 1314819 - DNA, 22 bp, Artificial Sequence
  chemically synthesized
ggctcaagtttttcttttaaca

SEQ ID NO: 1314820 - DNA, 22 bp, Artificial Sequence
  chemically synthesized
gctcaagtttttcttttaacac

SEQ ID NO: 1314821 - DNA, 22 bp, Artificial Sequence
  chemically synthesized
aagtttttcttttaacactata

SEQ ID NO: 1314822 - DNA, 22 bp, Artificial Sequence
  chemically synthesized
ttcttttaacactatatttttt

SEQ ID NO: 1314823 - DNA, 22 bp, Artificial Sequence
  chemically synthesized
aaagacaaaaaaaaaaaatata

SEQ ID NO: 1314824 - DNA, 22 bp, Artificial Sequence
  chemically synthesized
tcttttaacactatattttttt

SEQ ID NO: 1314825 - DNA, 22 bp, Artificial Sequence
  chemically synthesized
cttttaacactatatttttttt

SEQ ID NO: 1314826 - DNA, 22 bp, Artificial Sequence
  chemically synthesized
ttttaacactatattttttttt

SEQ ID NO: 1314827 - DNA, 22 bp, Artificial Sequence
  chemically synthesized
ttaacactatattttttttttt

SEQ ID NO: 1314828 - DNA, 22 bp, Artificial Sequence
  chemically synthesized
taacactatatttttttttttt

SEQ ID NO: 1314829 - DNA, 22 bp, Artificial Sequence
  chemically synthesized
aacactatattttttttttttg

SEQ ID NO: 1314830 - DNA, 22 bp, Artificial Sequence
  chemically synthesized
acactatattttttttttttgt

SEQ ID NO: 1314831 - DNA, 22 bp, Artificial Sequence
  chemically synthesized
aaaatgatgctaaaagacaaaa

SEQ ID NO: 1314832 - DNA, 22 bp, Artificial Sequence
  chemically synthesized
aaaaatgatgctaaaagacaaa

SEQ ID NO: 1314833 - DNA, 22 bp, Artificial Sequence
  chemically synthesized
tattttttttttttgtctttta

SEQ ID NO: 1314834 - DNA, 22 bp, Artificial Sequence
  chemically synthesized
taaaaatgatgctaaaagacaa

SEQ ID NO: 1314835 - DNA, 22 bp, Artificial Sequence
  chemically synthesized
ttaaaaatgatgctaaaagaca

SEQ ID NO: 1314836 - DNA, 22 bp, Artificial Sequence
  chemically synthesized
tttttaaaaatgatgctaaaag

SEQ ID NO: 1314837 - DNA, 22 bp, Artificial Sequence
  chemically synthesized
tttttttttgtcttttagcatc

SEQ ID NO: 1314838 - DNA, 22 bp, Artificial Sequence
  chemically synthesized
ttttttttgtcttttagcatca

SEQ ID NO: 1314839 - DNA, 22 bp, Artificial Sequence
  chemically synthesized
tttttttgtcttttagcatcat

SEQ ID NO: 1314840 - DNA, 22 bp, Artificial Sequence
  chemically synthesized
ttttttgtcttttagcatcatt

SEQ ID NO: 1314841 - DNA, 22 bp, Artificial Sequence
  chemically synthesized
tttttgtcttttagcatcattt

SEQ ID NO: 1314842 - DNA, 22 bp, Artificial Sequence
  chemically synthesized
ttttgtcttttagcatcatttt

SEQ ID NO: 1314843 - DNA, 22 bp, Artificial Sequence
  chemically synthesized
tttgtcttttagcatcattttt

SEQ ID NO: 1314844 - DNA, 22 bp, Artificial Sequence
  chemically synthesized
aatgctatttttaaaaatgatg

SEQ ID NO: 1314845 - DNA, 22 bp, Artificial Sequence
  chemically synthesized
ttgtcttttagcatcattttta

SEQ ID NO: 1314846 - DNA, 22 bp, Artificial Sequence
  chemically synthesized
tgtcttttagcatcatttttaa

SEQ ID NO: 1314847 - DNA, 22 bp, Artificial Sequence
  chemically synthesized
gtcttttagcatcatttttaaa

SEQ ID NO: 1314848 - DNA, 22 bp, Artificial Sequence
  chemically synthesized
tcttttagcatcatttttaaaa

SEQ ID NO: 1314849 - DNA, 22 bp, Artificial Sequence
  chemically synthesized
ttagcatcatttttaaaaatag

SEQ ID NO: 1314850 - DNA, 22 bp, Artificial Sequence
  chemically synthesized
tagcatcatttttaaaaatagc

SEQ ID NO: 1314851 - DNA, 22 bp, Artificial Sequence
  chemically synthesized
agcatcatttttaaaaatagca

SEQ ID NO: 1314852 - DNA, 22 bp, Artificial Sequence
  chemically synthesized
gcatcatttttaaaaatagcat

SEQ ID NO: 1314853 - DNA, 22 bp, Artificial Sequence
  chemically synthesized
aatcaaaggagttaaatgctat

SEQ ID NO: 1314854 - DNA, 22 bp, Artificial Sequence
  chemically synthesized
ttaaaaatagcatttaactcct

SEQ ID NO: 1314855 - DNA, 22 bp, Artificial Sequence
  chemically synthesized
taaaaatagcatttaactcctt

SEQ ID NO: 1314856 - DNA, 22 bp, Artificial Sequence
  chemically synthesized
aaaaatagcatttaactccttt

SEQ ID NO: 1314857 - DNA, 22 bp, Artificial Sequence
  chemically synthesized
aaaatagcatttaactcctttg

SEQ ID NO: 1314858 - DNA, 22 bp, Artificial Sequence
  chemically synthesized
aactcctttgattcagtggttg

SEQ ID NO: 1314859 - DNA, 22 bp, Artificial Sequence
  chemically synthesized
actcctttgattcagtggttgc

SEQ ID NO: 1314860 - DNA, 22 bp, Artificial Sequence
  chemically synthesized
ctttgattcagtggttgctatg

SEQ ID NO: 1314861 - DNA, 22 bp, Artificial Sequence
  chemically synthesized
tgattcagtggttgctatggtt

SEQ ID NO: 1314862 - DNA, 22 bp, Artificial Sequence
  chemically synthesized
gattcagtggttgctatggttt

SEQ ID NO: 1314863 - DNA, 22 bp, Artificial Sequence
  chemically synthesized
attcagtggttgctatggtttc

SEQ ID NO: 1314864 - DNA, 22 bp, Artificial Sequence
  chemically synthesized
gaggggataaatagtgaaacca

SEQ ID NO: 1314865 - DNA, 22 bp, Artificial Sequence
  chemically synthesized
agtggttgctatggtttcacta

SEQ ID NO: 1314866 - DNA, 22 bp, Artificial Sequence
  chemically synthesized
ggaggggataaatagtgaaacc

SEQ ID NO: 1314867 - DNA, 22 bp, Artificial Sequence
  chemically synthesized
tggaggggataaatagtgaaac

SEQ ID NO: 1314868 - DNA, 22 bp, Artificial Sequence
  chemically synthesized
aattttggaggggataaatagt

SEQ ID NO: 1314869 - DNA, 22 bp, Artificial Sequence
  chemically synthesized
ctatggtttcactatttatccc

SEQ ID NO: 1314870 - DNA, 22 bp, Artificial Sequence
  chemically synthesized
tggtttcactatttatcccctc

SEQ ID NO: 1314871 - DNA, 22 bp, Artificial Sequence
  chemically synthesized
ggggttaaattttggaggggat

SEQ ID NO: 1314872 - DNA, 22 bp, Artificial Sequence
  chemically synthesized
cactatttatcccctccaaaat

SEQ ID NO: 1314873 - DNA, 22 bp, Artificial Sequence
  chemically synthesized
actatttatcccctccaaaatt

SEQ ID NO: 1314874 - DNA, 22 bp, Artificial Sequence
  chemically synthesized
ccacactgggggttaaattttg

SEQ ID NO: 1314875 - DNA, 22 bp, Artificial Sequence
  chemically synthesized
tttatcccctccaaaatttaac

SEQ ID NO: 1314876 - DNA, 22 bp, Artificial Sequence
  chemically synthesized
atcccctccaaaatttaacccc

SEQ ID NO: 1314877 - DNA, 22 bp, Artificial Sequence
  chemically synthesized
tcccctccaaaatttaaccccc

SEQ ID NO: 1314878 - DNA, 22 bp, Artificial Sequence
  chemically synthesized
aatactgccacactgggggtta

SEQ ID NO: 1314879 - DNA, 22 bp, Artificial Sequence
  chemically synthesized
tcaatactgccacactgggggt

SEQ ID NO: 1314880 - DNA, 22 bp, Artificial Sequence
  chemically synthesized
caaaatttaacccccagtgtgg

SEQ ID NO: 1314881 - DNA, 22 bp, Artificial Sequence
  chemically synthesized
ccctctcaatactgccacactg

SEQ ID NO: 1314882 - DNA, 22 bp, Artificial Sequence
  chemically synthesized
aacccccagtgtggcagtattg

SEQ ID NO: 1314883 - DNA, 22 bp, Artificial Sequence
  chemically synthesized
acccccagtgtggcagtattga

SEQ ID NO: 1314884 - DNA, 22 bp, Artificial Sequence
  chemically synthesized
aaggcctcccctctcaatactg

SEQ ID NO: 1314885 - DNA, 22 bp, Artificial Sequence
  chemically synthesized
aaaggcctcccctctcaatact

SEQ ID NO: 1314886 - DNA, 22 bp, Artificial Sequence
  chemically synthesized
ttaaaggcctcccctctcaata

SEQ ID NO: 1314887 - DNA, 22 bp, Artificial Sequence
  chemically synthesized
atgatccaagtgcctcttaaag

SEQ ID NO: 1314888 - DNA, 22 bp, Artificial Sequence
  chemically synthesized
agaggggaggcctttaagaggc

SEQ ID NO: 1314889 - DNA, 22 bp, Artificial Sequence
  chemically synthesized
catgatccaagtgcctcttaaa

SEQ ID NO: 1314890 - DNA, 22 bp, Artificial Sequence
  chemically synthesized
tcatgatccaagtgcctcttaa

SEQ ID NO: 1314891 - DNA, 22 bp, Artificial Sequence
  chemically synthesized
gggcagaactttcatgatccaa

SEQ ID NO: 1314892 - DNA, 22 bp, Artificial Sequence
  chemically synthesized
taagaggcacttggatcatgaa

SEQ ID NO: 1314893 - DNA, 22 bp, Artificial Sequence
  chemically synthesized
aagaggcacttggatcatgaaa

SEQ ID NO: 1314894 - DNA, 22 bp, Artificial Sequence
  chemically synthesized
agaggcacttggatcatgaaag

SEQ ID NO: 1314895 - DNA, 22 bp, Artificial Sequence
  chemically synthesized
atccattagggcagaactttca

SEQ ID NO: 1314896 - DNA, 22 bp, Artificial Sequence
  chemically synthesized
attaatccattagggcagaact

SEQ ID NO: 1314897 - DNA, 22 bp, Artificial Sequence
  chemically synthesized
ggatcatgaaagttctgcccta

SEQ ID NO: 1314898 - DNA, 22 bp, Artificial Sequence
  chemically synthesized
gatcatgaaagttctgccctaa

SEQ ID NO: 1314899 - DNA, 22 bp, Artificial Sequence
  chemically synthesized
actcattaatccattagggcag

SEQ ID NO: 1314900 - DNA, 22 bp, Artificial Sequence
  chemically synthesized
atccattaactcattaatccat

SEQ ID NO: 1314901 - DNA, 22 bp, Artificial Sequence
  chemically synthesized
tgccctaatggattaatgagtt

SEQ ID NO: 1314902 - DNA, 22 bp, Artificial Sequence
  chemically synthesized
ccctaatggattaatgagttaa

SEQ ID NO: 1314903 - DNA, 22 bp, Artificial Sequence
  chemically synthesized
atggattaatgagttaatggat

SEQ ID NO: 1314904 - DNA, 22 bp, Artificial Sequence
  chemically synthesized
ccatgataatgcattaatccat

SEQ ID NO: 1314905 - DNA, 22 bp, Artificial Sequence
  chemically synthesized
atgagttaatggattaatgcat

SEQ ID NO: 1314906 - DNA, 22 bp, Artificial Sequence
  chemically synthesized
atggattaatgcattatcatgg

SEQ ID NO: 1314907 - DNA, 22 bp, Artificial Sequence
  chemically synthesized
atgcattatcatgggaatggca

SEQ ID NO: 1314908 - DNA, 22 bp, Artificial Sequence
  chemically synthesized
tcaagccaccagtgccattccc

SEQ ID NO: 1314909 - DNA, 22 bp, Artificial Sequence
  chemically synthesized
atcaagccaccagtgccattcc

SEQ ID NO: 1314910 - DNA, 22 bp, Artificial Sequence
  chemically synthesized
ttatcaagccaccagtgccatt

SEQ ID NO: 1314911 - DNA, 22 bp, Artificial Sequence
  chemically synthesized
cttatcaagccaccagtgccat

SEQ ID NO: 1314912 - DNA, 22 bp, Artificial Sequence
  chemically synthesized
ttcttatcaagccaccagtgcc

SEQ ID NO: 1314913 - DNA, 22 bp, Artificial Sequence
  chemically synthesized
tcatgggaatggcactggtggc

SEQ ID NO: 1314914 - DNA, 22 bp, Artificial Sequence
  chemically synthesized
tcttcttatcaagccaccagtg

SEQ ID NO: 1314915 - DNA, 22 bp, Artificial Sequence
  chemically synthesized
aggtctctcttcttatcaagcc

SEQ ID NO: 1314916 - DNA, 22 bp, Artificial Sequence
  chemically synthesized
gctcaggtctctcttcttatca

SEQ ID NO: 1314917 - DNA, 22 bp, Artificial Sequence
  chemically synthesized
ctagctcaggtctctcttctta

SEQ ID NO: 1314918 - DNA, 22 bp, Artificial Sequence
  chemically synthesized
gctagctcaggtctctcttctt

SEQ ID NO: 1314919 - DNA, 22 bp, Artificial Sequence
  chemically synthesized
gtggcttgataagaagagagac

SEQ ID NO: 1314920 - DNA, 22 bp, Artificial Sequence
  chemically synthesized
acttgctagctcaggtctctct

SEQ ID NO: 1314921 - DNA, 22 bp, Artificial Sequence
  chemically synthesized
gataagaagagagacctgagct

SEQ ID NO: 1314922 - DNA, 22 bp, Artificial Sequence
  chemically synthesized
ataagaagagagacctgagcta

SEQ ID NO: 1314923 - DNA, 22 bp, Artificial Sequence
  chemically synthesized
tgtatgctaacttgctagctca

SEQ ID NO: 1314924 - DNA, 22 bp, Artificial Sequence
  chemically synthesized
agctagcaagttagcatacaca

SEQ ID NO: 1314925 - DNA, 22 bp, Artificial Sequence
  chemically synthesized
gcaagttagcatacacagccct

SEQ ID NO: 1314926 - DNA, 22 bp, Artificial Sequence
  chemically synthesized
gggcatcacatggcaggagggc

SEQ ID NO: 1314927 - DNA, 22 bp, Artificial Sequence
  chemically synthesized
gcatacacagccctcctgccat

SEQ ID NO: 1314928 - DNA, 22 bp, Artificial Sequence
  chemically synthesized
ctgccatgtgatgccccaggcc

SEQ ID NO: 1314929 - DNA, 22 bp, Artificial Sequence
  chemically synthesized
cagggtcccaatggcctggggc

SEQ ID NO: 1314930 - DNA, 22 bp, Artificial Sequence
  chemically synthesized
tacagggtcccaatggcctggg

SEQ ID NO: 1314931 - DNA, 22 bp, Artificial Sequence
  chemically synthesized
ccatgtgatgccccaggccatt

SEQ ID NO: 1314932 - DNA, 22 bp, Artificial Sequence
  chemically synthesized
tctacagggtcccaatggcctg

SEQ ID NO: 1314933 - DNA, 22 bp, Artificial Sequence
  chemically synthesized
gtgggaactctctacagggtcc

SEQ ID NO: 1314934 - DNA, 22 bp, Artificial Sequence
  chemically synthesized
ctggtgggaactctctacaggg

SEQ ID NO: 1314935 - DNA, 22 bp, Artificial Sequence
  chemically synthesized
gctggtgggaactctctacagg

SEQ ID NO: 1314936 - DNA, 22 bp, Artificial Sequence
  chemically synthesized
ttgctggtgggaactctctaca

SEQ ID NO: 1314937 - DNA, 22 bp, Artificial Sequence
  chemically synthesized
cttgctggtgggaactctctac

SEQ ID NO: 1314938 - DNA, 22 bp, Artificial Sequence
  chemically synthesized
ggaccctgtagagagttcccac

SEQ ID NO: 1314939 - DNA, 22 bp, Artificial Sequence
  chemically synthesized
gtgagggccttcttgctggtgg

SEQ ID NO: 1314940 - DNA, 22 bp, Artificial Sequence
  chemically synthesized
tagagagttcccaccagcaaga

SEQ ID NO: 1314941 - DNA, 22 bp, Artificial Sequence
  chemically synthesized
ccaccagcaagaaggccctcac

SEQ ID NO: 1314942 - DNA, 22 bp, Artificial Sequence
  chemically synthesized
aagaagtcccaggtcaaaagga

SEQ ID NO: 1314943 - DNA, 22 bp, Artificial Sequence
  chemically synthesized
caagaagtcccaggtcaaaagg

SEQ ID NO: 1314944 - DNA, 22 bp, Artificial Sequence
  chemically synthesized
accagatgtgtccttttgacct

SEQ ID NO: 1314945 - DNA, 22 bp, Artificial Sequence
  chemically synthesized
caaagaccatttcaagaagtcc

SEQ ID NO: 1314946 - DNA, 22 bp, Artificial Sequence
  chemically synthesized
gcaaagaccatttcaagaagtc

SEQ ID NO: 1314947 - DNA, 22 bp, Artificial Sequence
  chemically synthesized
tgcaaagaccatttcaagaagt

SEQ ID NO: 1314948 - DNA, 22 bp, Artificial Sequence
  chemically synthesized
ttgcaaagaccatttcaagaag

SEQ ID NO: 1314949 - DNA, 22 bp, Artificial Sequence
  chemically synthesized
ttgacctgggacttcttgaaat

SEQ ID NO: 1314950 - DNA, 22 bp, Artificial Sequence
  chemically synthesized
tgacctgggacttcttgaaatg

SEQ ID NO: 1314951 - DNA, 22 bp, Artificial Sequence
  chemically synthesized
gacctgggacttcttgaaatgg

SEQ ID NO: 1314952 - DNA, 22 bp, Artificial Sequence
  chemically synthesized
acctgggacttcttgaaatggt

SEQ ID NO: 1314953 - DNA, 22 bp, Artificial Sequence
  chemically synthesized
taatttttgcaaagaccatttc

SEQ ID NO: 1314954 - DNA, 22 bp, Artificial Sequence
  chemically synthesized
ggacttcttgaaatggtctttg

SEQ ID NO: 1314955 - DNA, 22 bp, Artificial Sequence
  chemically synthesized
accgttataatttttgcaaaga

SEQ ID NO: 1314956 - DNA, 22 bp, Artificial Sequence
  chemically synthesized
cttgaaatggtctttgcaaaaa

SEQ ID NO: 1314957 - DNA, 22 bp, Artificial Sequence
  chemically synthesized
tcaccgttataatttttgcaaa

SEQ ID NO: 1314958 - DNA, 22 bp, Artificial Sequence
  chemically synthesized
ttgaaatggtctttgcaaaaat

SEQ ID NO: 1314959 - DNA, 22 bp, Artificial Sequence
  chemically synthesized
ctcaccgttataatttttgcaa

SEQ ID NO: 1314960 - DNA, 22 bp, Artificial Sequence
  chemically synthesized
tctcaccgttataatttttgca

SEQ ID NO: 1314961 - DNA, 22 bp, Artificial Sequence
  chemically synthesized
gaaatggtctttgcaaaaatta

SEQ ID NO: 1314962 - DNA, 22 bp, Artificial Sequence
  chemically synthesized
aaatggtctttgcaaaaattat

SEQ ID NO: 1314963 - DNA, 22 bp, Artificial Sequence
  chemically synthesized
catcattttctcaccgttataa

SEQ ID NO: 1314964 - DNA, 22 bp, Artificial Sequence
  chemically synthesized
ccatcattttctcaccgttata

SEQ ID NO: 1314965 - DNA, 22 bp, Artificial Sequence
  chemically synthesized
tgcaaaaattataacggtgaga

SEQ ID NO: 1314966 - DNA, 22 bp, Artificial Sequence
  chemically synthesized
gcaaaaattataacggtgagaa

SEQ ID NO: 1314967 - DNA, 22 bp, Artificial Sequence
  chemically synthesized
acttccatcattttctcaccgt

SEQ ID NO: 1314968 - DNA, 22 bp, Artificial Sequence
  chemically synthesized
caaaaattataacggtgagaaa

SEQ ID NO: 1314969 - DNA, 22 bp, Artificial Sequence
  chemically synthesized
cacttccatcattttctcaccg

SEQ ID NO: 1314970 - DNA, 22 bp, Artificial Sequence
  chemically synthesized
tcacttccatcattttctcacc

SEQ ID NO: 1314971 - DNA, 22 bp, Artificial Sequence
  chemically synthesized
taacggtgagaaaatgatggaa

SEQ ID NO: 1314972 - DNA, 22 bp, Artificial Sequence
  chemically synthesized
gatccctttcacttccatcatt

SEQ ID NO: 1314973 - DNA, 22 bp, Artificial Sequence
  chemically synthesized
gattagatccctttcacttcca

SEQ ID NO: 1314974 - DNA, 22 bp, Artificial Sequence
  chemically synthesized
gctagattagatccctttcact

SEQ ID NO: 1314975 - DNA, 22 bp, Artificial Sequence
  chemically synthesized
aaggcaagagaggagttggcta

SEQ ID NO: 1314976 - DNA, 22 bp, Artificial Sequence
  chemically synthesized
aaggctaaaggcaagagaggag

SEQ ID NO: 1314977 - DNA, 22 bp, Artificial Sequence
  chemically synthesized
gaaggctaaaggcaagagagga

SEQ ID NO: 1314978 - DNA, 22 bp, Artificial Sequence
  chemically synthesized
atctagccaactcctctcttgc

SEQ ID NO: 1314979 - DNA, 22 bp, Artificial Sequence
  chemically synthesized
gccaactcctctcttgccttta

SEQ ID NO: 1314980 - DNA, 22 bp, Artificial Sequence
  chemically synthesized
agagcagcttgaaggctaaagg

SEQ ID NO: 1314981 - DNA, 22 bp, Artificial Sequence
  chemically synthesized
ctctcttgcctttagccttcaa

SEQ ID NO: 1314982 - DNA, 22 bp, Artificial Sequence
  chemically synthesized
tcttgcctttagccttcaagct

SEQ ID NO: 1314983 - DNA, 22 bp, Artificial Sequence
  chemically synthesized
ttgcctttagccttcaagctgc

SEQ ID NO: 1314984 - DNA, 22 bp, Artificial Sequence
  chemically synthesized
gcctttagccttcaagctgctc

SEQ ID NO: 1314985 - DNA, 22 bp, Artificial Sequence
  chemically synthesized
cctttagccttcaagctgctct

SEQ ID NO: 1314986 - DNA, 22 bp, Artificial Sequence
  chemically synthesized
tagccttcaagctgctcttaat

SEQ ID NO: 1314987 - DNA, 22 bp, Artificial Sequence
  chemically synthesized
agccttcaagctgctcttaatt

SEQ ID NO: 1314988 - DNA, 22 bp, Artificial Sequence
  chemically synthesized
gccttcaagctgctcttaatta

SEQ ID NO: 1314989 - DNA, 22 bp, Artificial Sequence
  chemically synthesized
gcataagcccaggaataattaa

SEQ ID NO: 1314990 - DNA, 22 bp, Artificial Sequence
  chemically synthesized
ggcataagcccaggaataatta

SEQ ID NO: 1314991 - DNA, 22 bp, Artificial Sequence
  chemically synthesized
caagctgctcttaattattcct

SEQ ID NO: 1314992 - DNA, 22 bp, Artificial Sequence
  chemically synthesized
aagctgctcttaattattcctg

SEQ ID NO: 1314993 - DNA, 22 bp, Artificial Sequence
  chemically synthesized
gcttggcataagcccaggaata

SEQ ID NO: 1314994 - DNA, 22 bp, Artificial Sequence
  chemically synthesized
ctcttaattattcctgggctta

SEQ ID NO: 1314995 - DNA, 22 bp, Artificial Sequence
  chemically synthesized
ttaattattcctgggcttatgc

SEQ ID NO: 1314996 - DNA, 22 bp, Artificial Sequence
  chemically synthesized
aattattcctgggcttatgcca

SEQ ID NO: 1314997 - DNA, 22 bp, Artificial Sequence
  chemically synthesized
ccaaagttagcttggcataagc

SEQ ID NO: 1314998 - DNA, 22 bp, Artificial Sequence
  chemically synthesized
attattcctgggcttatgccaa

SEQ ID NO: 1314999 - DNA, 22 bp, Artificial Sequence
  chemically synthesized
ttcctgggcttatgccaagcta

SEQ ID NO: 1315000 - DNA, 22 bp, Artificial Sequence
  chemically synthesized
ctgggcttatgccaagctaact

SEQ ID NO: 1315001 - DNA, 22 bp, Artificial Sequence
  chemically synthesized
taaatgtctcccaaagttagct

SEQ ID NO: 1315002 - DNA, 22 bp, Artificial Sequence
  chemically synthesized
ggcttatgccaagctaactttg

SEQ ID NO: 1315003 - DNA, 22 bp, Artificial Sequence
  chemically synthesized
aactataaatgtctcccaaagt

SEQ ID NO: 1315004 - DNA, 22 bp, Artificial Sequence
  chemically synthesized
atgccaagctaactttgggaga

SEQ ID NO: 1315005 - DNA, 22 bp, Artificial Sequence
  chemically synthesized
aaactataaatgtctcccaaag

SEQ ID NO: 1315006 - DNA, 22 bp, Artificial Sequence
  chemically synthesized
tgccaagctaactttgggagac

SEQ ID NO: 1315007 - DNA, 22 bp, Artificial Sequence
  chemically synthesized
tcatttaaactataaatgtctc

SEQ ID NO: 1315008 - DNA, 22 bp, Artificial Sequence
  chemically synthesized
ttgtcatttaaactataaatgt

SEQ ID NO: 1315009 - DNA, 22 bp, Artificial Sequence
  chemically synthesized
actttgggagacatttatagtt

SEQ ID NO: 1315010 - DNA, 22 bp, Artificial Sequence
  chemically synthesized
tgggagacatttatagtttaaa

SEQ ID NO: 1315011 - DNA, 22 bp, Artificial Sequence
  chemically synthesized
gggagacatttatagtttaaat

SEQ ID NO: 1315012 - DNA, 22 bp, Artificial Sequence
  chemically synthesized
ggagacatttatagtttaaatg

SEQ ID NO: 1315013 - DNA, 22 bp, Artificial Sequence
  chemically synthesized
gggaagggctattgtcatttaa

SEQ ID NO: 1315014 - DNA, 22 bp, Artificial Sequence
  chemically synthesized
ggggaagggctattgtcattta

SEQ ID NO: 1315015 - DNA, 22 bp, Artificial Sequence
  chemically synthesized
tggggaagggctattgtcattt

SEQ ID NO: 1315016 - DNA, 22 bp, Artificial Sequence
  chemically synthesized
atagtttaaatgacaatagccc

SEQ ID NO: 1315017 - DNA, 22 bp, Artificial Sequence
  chemically synthesized
agttttggggaagggctattgt

SEQ ID NO: 1315018 - DNA, 22 bp, Artificial Sequence
  chemically synthesized
tagtttaaatgacaatagccct

SEQ ID NO: 1315019 - DNA, 22 bp, Artificial Sequence
  chemically synthesized
aaatgacaatagcccttcccca

SEQ ID NO: 1315020 - DNA, 22 bp, Artificial Sequence
  chemically synthesized
aatgacaatagcccttccccaa

SEQ ID NO: 1315021 - DNA, 22 bp, Artificial Sequence
  chemically synthesized
caaacgcggttgagttttgggg

SEQ ID NO: 1315022 - DNA, 22 bp, Artificial Sequence
  chemically synthesized
tacaaacgcggttgagttttgg

SEQ ID NO: 1315023 - DNA, 22 bp, Artificial Sequence
  chemically synthesized
gctctacaaacgcggttgagtt

SEQ ID NO: 1315024 - DNA, 22 bp, Artificial Sequence
  chemically synthesized
attagctctacaaacgcggttg

SEQ ID NO: 1315025 - DNA, 22 bp, Artificial Sequence
  chemically synthesized
ccccaaaactcaaccgcgtttg

SEQ ID NO: 1315026 - DNA, 22 bp, Artificial Sequence
  chemically synthesized
tcattagctctacaaacgcggt

SEQ ID NO: 1315027 - DNA, 22 bp, Artificial Sequence
  chemically synthesized
cccaaaactcaaccgcgtttgt

SEQ ID NO: 1315028 - DNA, 22 bp, Artificial Sequence
  chemically synthesized
gtggtctctcattagctctaca

SEQ ID NO: 1315029 - DNA, 22 bp, Artificial Sequence
  chemically synthesized
aaccgcgtttgtagagctaatg

SEQ ID NO: 1315030 - DNA, 22 bp, Artificial Sequence
  chemically synthesized
gcctggtggtctctcattagct

SEQ ID NO: 1315031 - DNA, 22 bp, Artificial Sequence
  chemically synthesized
ctagcctggtggtctctcatta

SEQ ID NO: 1315032 - DNA, 22 bp, Artificial Sequence
  chemically synthesized
gtagagctaatgagagaccacc

SEQ ID NO: 1315033 - DNA, 22 bp, Artificial Sequence
  chemically synthesized
tcctcctagcctggtggtctct

SEQ ID NO: 1315034 - DNA, 22 bp, Artificial Sequence
  chemically synthesized
tagagctaatgagagaccacca

SEQ ID NO: 1315035 - DNA, 22 bp, Artificial Sequence
  chemically synthesized
ccctatcctcctagcctggtgg

SEQ ID NO: 1315036 - DNA, 22 bp, Artificial Sequence
  chemically synthesized
cccctatcctcctagcctggtg

SEQ ID NO: 1315037 - DNA, 22 bp, Artificial Sequence
  chemically synthesized
atgagagaccaccaggctagga

SEQ ID NO: 1315038 - DNA, 22 bp, Artificial Sequence
  chemically synthesized
gtttcccctatcctcctagcct

SEQ ID NO: 1315039 - DNA, 22 bp, Artificial Sequence
  chemically synthesized
agtttcccctatcctcctagcc

SEQ ID NO: 1315040 - DNA, 22 bp, Artificial Sequence
  chemically synthesized
caccgcagcagaatttagtttc

SEQ ID NO: 1315041 - DNA, 22 bp, Artificial Sequence
  chemically synthesized
ggaggataggggaaactaaatt

SEQ ID NO: 1315042 - DNA, 22 bp, Artificial Sequence
  chemically synthesized
tatgtctacaccgcagcagaat

SEQ ID NO: 1315043 - DNA, 22 bp, Artificial Sequence
  chemically synthesized
gcaatcctgtatgtctacaccg

SEQ ID NO: 1315044 - DNA, 22 bp, Artificial Sequence
  chemically synthesized
aattctgctgcggtgtagacat

SEQ ID NO: 1315045 - DNA, 22 bp, Artificial Sequence
  chemically synthesized
tgctgcggtgtagacatacagg

SEQ ID NO: 1315046 - DNA, 22 bp, Artificial Sequence
  chemically synthesized
ctgcggtgtagacatacaggat

SEQ ID NO: 1315047 - DNA, 22 bp, Artificial Sequence
  chemically synthesized
cggtgtagacatacaggattgc

SEQ ID NO: 1315048 - DNA, 22 bp, Artificial Sequence
  chemically synthesized
gaataatggctggcaatcctgt

SEQ ID NO: 1315049 - DNA, 22 bp, Artificial Sequence
  chemically synthesized
tggaataatggctggcaatcct

SEQ ID NO: 1315050 - DNA, 22 bp, Artificial Sequence
  chemically synthesized
tgacctctggaataatggctgg

SEQ ID NO: 1315051 - DNA, 22 bp, Artificial Sequence
  chemically synthesized
gtgacctctggaataatggctg

SEQ ID NO: 1315052 - DNA, 22 bp, Artificial Sequence
  chemically synthesized
ccagccattattccagaggtca

SEQ ID NO: 1315053 - DNA, 22 bp, Artificial Sequence
  chemically synthesized
gggaagtcgcgtgtcttgtgac

SEQ ID NO: 1315054 - DNA, 22 bp, Artificial Sequence
  chemically synthesized
ttccagaggtcacaagacacgc

SEQ ID NO: 1315055 - DNA, 22 bp, Artificial Sequence
  chemically synthesized
cagaggtcacaagacacgcgac

SEQ ID NO: 1315056 - DNA, 22 bp, Artificial Sequence
  chemically synthesized
caagagtagttggggaagtcgc

SEQ ID NO: 1315057 - DNA, 22 bp, Artificial Sequence
  chemically synthesized
tctgcaagagtagttggggaag

SEQ ID NO: 1315058 - DNA, 22 bp, Artificial Sequence
  chemically synthesized
caatagtgatgttgtctgcaag

SEQ ID NO: 1315059 - DNA, 22 bp, Artificial Sequence
  chemically synthesized
ccccaactactcttgcagacaa

SEQ ID NO: 1315060 - DNA, 22 bp, Artificial Sequence
  chemically synthesized
cccaactactcttgcagacaac

SEQ ID NO: 1315061 - DNA, 22 bp, Artificial Sequence
  chemically synthesized
tacaatagtgatgttgtctgca

SEQ ID NO: 1315062 - DNA, 22 bp, Artificial Sequence
  chemically synthesized
agttctacaatagtgatgttgt

SEQ ID NO: 1315063 - DNA, 22 bp, Artificial Sequence
  chemically synthesized
aagttctacaatagtgatgttg

SEQ ID NO: 1315064 - DNA, 22 bp, Artificial Sequence
  chemically synthesized
ctcttgcagacaacatcactat

SEQ ID NO: 1315065 - DNA, 22 bp, Artificial Sequence
  chemically synthesized
ttgcagacaacatcactattgt

SEQ ID NO: 1315066 - DNA, 22 bp, Artificial Sequence
  chemically synthesized
gcagacaacatcactattgtag

SEQ ID NO: 1315067 - DNA, 22 bp, Artificial Sequence
  chemically synthesized
cagacaacatcactattgtaga

SEQ ID NO: 1315068 - DNA, 22 bp, Artificial Sequence
  chemically synthesized
aaaaggccaatcttaagttcta

SEQ ID NO: 1315069 - DNA, 22 bp, Artificial Sequence
  chemically synthesized
ttgtagaacttaagattggcct

SEQ ID NO: 1315070 - DNA, 22 bp, Artificial Sequence
  chemically synthesized
tagaacttaagattggcctttt

SEQ ID NO: 1315071 - DNA, 22 bp, Artificial Sequence
  chemically synthesized
aacagatatctcaaaaggccaa

SEQ ID NO: 1315072 - DNA, 22 bp, Artificial Sequence
  chemically synthesized
aagattggccttttgagatatc

SEQ ID NO: 1315073 - DNA, 22 bp, Artificial Sequence
  chemically synthesized
agattggccttttgagatatct

SEQ ID NO: 1315074 - DNA, 22 bp, Artificial Sequence
  chemically synthesized
gccttttgagatatctgttcag

SEQ ID NO: 1315075 - DNA, 22 bp, Artificial Sequence
  chemically synthesized
ttgagatatctgttcagatata

SEQ ID NO: 1315076 - DNA, 22 bp, Artificial Sequence
  chemically synthesized
tgagatatctgttcagatatat

SEQ ID NO: 1315077 - DNA, 22 bp, Artificial Sequence
  chemically synthesized
gagatatctgttcagatatatt

SEQ ID NO: 1315078 - DNA, 22 bp, Artificial Sequence
  chemically synthesized
agatatctgttcagatatattt

SEQ ID NO: 1315079 - DNA, 22 bp, Artificial Sequence
  chemically synthesized
ttcagatatatttcatgtctga

SEQ ID NO: 1315080 - DNA, 22 bp, Artificial Sequence
  chemically synthesized
agatatatttcatgtctgatga

SEQ ID NO: 1315081 - DNA, 22 bp, Artificial Sequence
  chemically synthesized
catgtctgatgactgatggctc

SEQ ID NO: 1315082 - DNA, 22 bp, Artificial Sequence
  chemically synthesized
atgtctgatgactgatggctcc

SEQ ID NO: 1315083 - DNA, 22 bp, Artificial Sequence
  chemically synthesized
gcaggtgcaggtggagccatca

SEQ ID NO: 1315084 - DNA, 22 bp, Artificial Sequence
  chemically synthesized
atgactgatggctccacctgca

SEQ ID NO: 1315085 - DNA, 22 bp, Artificial Sequence
  chemically synthesized
atggctccacctgcacctgcca

SEQ ID NO: 1315086 - DNA, 22 bp, Artificial Sequence
  chemically synthesized
cacctgcacctgccaactgctc

SEQ ID NO: 1315087 - DNA, 22 bp, Artificial Sequence
  chemically synthesized
ggcggggccacaggagcagttg

SEQ ID NO: 1315088 - DNA, 22 bp, Artificial Sequence
  chemically synthesized
tgggcggggccacaggagcagt

SEQ ID NO: 1315089 - DNA, 22 bp, Artificial Sequence
  chemically synthesized
ctgggcggggccacaggagcag

SEQ ID NO: 1315090 - DNA, 22 bp, Artificial Sequence
  chemically synthesized
cacctgccaactgctcctgtgg

SEQ ID NO: 1315091 - DNA, 22 bp, Artificial Sequence
  chemically synthesized
ttctgggcggggccacaggagc

SEQ ID NO: 1315092 - DNA, 22 bp, Artificial Sequence
  chemically synthesized
ccaactgctcctgtggccccgc

SEQ ID NO: 1315093 - DNA, 22 bp, Artificial Sequence
  chemically synthesized
agtctcttctgggcggggccac

SEQ ID NO: 1315094 - DNA, 22 bp, Artificial Sequence
  chemically synthesized
ctcctgtggccccgcccagaag

SEQ ID NO: 1315095 - DNA, 22 bp, Artificial Sequence
  chemically synthesized
tgcactgagtctcttctgggcg

SEQ ID NO: 1315096 - DNA, 22 bp, Artificial Sequence
  chemically synthesized
ctgtggccccgcccagaagaga

SEQ ID NO: 1315097 - DNA, 22 bp, Artificial Sequence
  chemically synthesized
ctgtgcactgagtctcttctgg

SEQ ID NO: 1315098 - DNA, 22 bp, Artificial Sequence
  chemically synthesized
tggccccgcccagaagagactc

SEQ ID NO: 1315099 - DNA, 22 bp, Artificial Sequence
  chemically synthesized
tgggcaagggtcctcctgtgca

SEQ ID NO: 1315100 - DNA, 22 bp, Artificial Sequence
  chemically synthesized
agtgcacaggaggacccttgcc

SEQ ID NO: 1315101 - DNA, 22 bp, Artificial Sequence
  chemically synthesized
caatcataggactgtgggcaag

SEQ ID NO: 1315102 - DNA, 22 bp, Artificial Sequence
  chemically synthesized
gtagggattgcaatcataggac

SEQ ID NO: 1315103 - DNA, 22 bp, Artificial Sequence
  chemically synthesized
actggtagggattgcaatcata

SEQ ID NO: 1315104 - DNA, 22 bp, Artificial Sequence
  chemically synthesized
gcccacagtcctatgattgcaa

SEQ ID NO: 1315105 - DNA, 22 bp, Artificial Sequence
  chemically synthesized
cccacagtcctatgattgcaat

SEQ ID NO: 1315106 - DNA, 22 bp, Artificial Sequence
  chemically synthesized
ctgactggtagggattgcaatc

SEQ ID NO: 1315107 - DNA, 22 bp, Artificial Sequence
  chemically synthesized
ctgctgactggtagggattgca

SEQ ID NO: 1315108 - DNA, 22 bp, Artificial Sequence
  chemically synthesized
gctgctgactggtagggattgc

SEQ ID NO: 1315109 - DNA, 22 bp, Artificial Sequence
  chemically synthesized
tgattgcaatccctaccagtca

SEQ ID NO: 1315110 - DNA, 22 bp, Artificial Sequence
  chemically synthesized
caatccctaccagtcagcagca

SEQ ID NO: 1315111 - DNA, 22 bp, Artificial Sequence
  chemically synthesized
cgcaataggtgcttgctgctga

SEQ ID NO: 1315112 - DNA, 22 bp, Artificial Sequence
  chemically synthesized
ccagtcagcagcaagcacctat

SEQ ID NO: 1315113 - DNA, 22 bp, Artificial Sequence
  chemically synthesized
gggaaaggcatgtggaaagcta

SEQ ID NO: 1315114 - DNA, 22 bp, Artificial Sequence
  chemically synthesized
ggggaaaggcatgtggaaagct

SEQ ID NO: 1315115 - DNA, 22 bp, Artificial Sequence
  chemically synthesized
ttgcgtagctttccacatgcct

SEQ ID NO: 1315116 - DNA, 22 bp, Artificial Sequence
  chemically synthesized
cgtagctttccacatgcctttc

SEQ ID NO: 1315117 - DNA, 22 bp, Artificial Sequence
  chemically synthesized
aagatcggtttggggaaaggca

SEQ ID NO: 1315118 - DNA, 22 bp, Artificial Sequence
  chemically synthesized
caagatcggtttggggaaaggc

SEQ ID NO: 1315119 - DNA, 22 bp, Artificial Sequence
  chemically synthesized
tcaagatcggtttggggaaagg

SEQ ID NO: 1315120 - DNA, 22 bp, Artificial Sequence
  chemically synthesized
tccacatgcctttccccaaacc

SEQ ID NO: 1315121 - DNA, 22 bp, Artificial Sequence
  chemically synthesized
ccacatgcctttccccaaaccg

SEQ ID NO: 1315122 - DNA, 22 bp, Artificial Sequence
  chemically synthesized
cacatgcctttccccaaaccga

SEQ ID NO: 1315123 - DNA, 22 bp, Artificial Sequence
  chemically synthesized
gggttttcaagatcggtttggg

SEQ ID NO: 1315124 - DNA, 22 bp, Artificial Sequence
  chemically synthesized
aggctagggttttcaagatcgg

SEQ ID NO: 1315125 - DNA, 22 bp, Artificial Sequence
  chemically synthesized
tccccaaaccgatcttgaaaac

SEQ ID NO: 1315126 - DNA, 22 bp, Artificial Sequence
  chemically synthesized
ccccaaaccgatcttgaaaacc

SEQ ID NO: 1315127 - DNA, 22 bp, Artificial Sequence
  chemically synthesized
cccaaaccgatcttgaaaaccc

SEQ ID NO: 1315128 - DNA, 22 bp, Artificial Sequence
  chemically synthesized
aagaagtctgaggctagggttt

SEQ ID NO: 1315129 - DNA, 22 bp, Artificial Sequence
  chemically synthesized
ctcaagaagtctgaggctaggg

SEQ ID NO: 1315130 - DNA, 22 bp, Artificial Sequence
  chemically synthesized
gaaaaccctagcctcagacttc

SEQ ID NO: 1315131 - DNA, 22 bp, Artificial Sequence
  chemically synthesized
aaaaccctagcctcagacttct

SEQ ID NO: 1315132 - DNA, 22 bp, Artificial Sequence
  chemically synthesized
aaatcagtctcctcaagaagtc

SEQ ID NO: 1315133 - DNA, 22 bp, Artificial Sequence
  chemically synthesized
ctcaaatcagtctcctcaagaa

SEQ ID NO: 1315134 - DNA, 22 bp, Artificial Sequence
  chemically synthesized
gcctcagacttcttgaggagac

SEQ ID NO: 1315135 - DNA, 22 bp, Artificial Sequence
  chemically synthesized
ttactcaaatcagtctcctcaa

SEQ ID NO: 1315136 - DNA, 22 bp, Artificial Sequence
  chemically synthesized
ctattactcaaatcagtctcct

SEQ ID NO: 1315137 - DNA, 22 bp, Artificial Sequence
  chemically synthesized
actattactcaaatcagtctcc

SEQ ID NO: 1315138 - DNA, 22 bp, Artificial Sequence
  chemically synthesized
agacttcttgaggagactgatt

SEQ ID NO: 1315139 - DNA, 22 bp, Artificial Sequence
  chemically synthesized
tactattactcaaatcagtctc

SEQ ID NO: 1315140 - DNA, 22 bp, Artificial Sequence
  chemically synthesized
cttgaggagactgatttgagta

SEQ ID NO: 1315141 - DNA, 22 bp, Artificial Sequence
  chemically synthesized
ttgaggagactgatttgagtaa

SEQ ID NO: 1315142 - DNA, 22 bp, Artificial Sequence
  chemically synthesized
gaggagactgatttgagtaata

SEQ ID NO: 1315143 - DNA, 22 bp, Artificial Sequence
  chemically synthesized
aggagactgatttgagtaatag

SEQ ID NO: 1315144 - DNA, 22 bp, Artificial Sequence
  chemically synthesized
agcagaagatcagagttttact

SEQ ID NO: 1315145 - DNA, 22 bp, Artificial Sequence
  chemically synthesized
atttgagtaatagtaaaactct

SEQ ID NO: 1315146 - DNA, 22 bp, Artificial Sequence
  chemically synthesized
gagtaatagtaaaactctgatc

SEQ ID NO: 1315147 - DNA, 22 bp, Artificial Sequence
  chemically synthesized
agtaatagtaaaactctgatct

SEQ ID NO: 1315148 - DNA, 22 bp, Artificial Sequence
  chemically synthesized
tacatgtacagccaccagctaa

SEQ ID NO: 1315149 - DNA, 22 bp, Artificial Sequence
  chemically synthesized
tgatcttctgcttagctggtgg

SEQ ID NO: 1315150 - DNA, 22 bp, Artificial Sequence
  chemically synthesized
atacatgtacagccaccagcta

SEQ ID NO: 1315151 - DNA, 22 bp, Artificial Sequence
  chemically synthesized
tatacatgtacagccaccagct

SEQ ID NO: 1315152 - DNA, 22 bp, Artificial Sequence
  chemically synthesized
atcttctgcttagctggtggct

SEQ ID NO: 1315153 - DNA, 22 bp, Artificial Sequence
  chemically synthesized
ctgcttagctggtggctgtaca

SEQ ID NO: 1315154 - DNA, 22 bp, Artificial Sequence
  chemically synthesized
tgcttagctggtggctgtacat

SEQ ID NO: 1315155 - DNA, 22 bp, Artificial Sequence
  chemically synthesized
cttagctggtggctgtacatgt

SEQ ID NO: 1315156 - DNA, 22 bp, Artificial Sequence
  chemically synthesized
agctggtggctgtacatgtata

SEQ ID NO: 1315157 - DNA, 22 bp, Artificial Sequence
  chemically synthesized
gctggtggctgtacatgtataa

SEQ ID NO: 1315158 - DNA, 22 bp, Artificial Sequence
  chemically synthesized
caatggagagttttatacatgt

SEQ ID NO: 1315159 - DNA, 22 bp, Artificial Sequence
  chemically synthesized
gtggctgtacatgtataaaact

SEQ ID NO: 1315160 - DNA, 22 bp, Artificial Sequence
  chemically synthesized
tacatgtataaaactctccatt

SEQ ID NO: 1315161 - DNA, 22 bp, Artificial Sequence
  chemically synthesized
tcaagacaagggaattgcaatg

SEQ ID NO: 1315162 - DNA, 22 bp, Artificial Sequence
  chemically synthesized
atcaagacaagggaattgcaat

SEQ ID NO: 1315163 - DNA, 22 bp, Artificial Sequence
  chemically synthesized
atttatcaagacaagggaattg

SEQ ID NO: 1315164 - DNA, 22 bp, Artificial Sequence
  chemically synthesized
tccattgcaattcccttgtctt

SEQ ID NO: 1315165 - DNA, 22 bp, Artificial Sequence
  chemically synthesized
cattgcaattcccttgtcttga

SEQ ID NO: 1315166 - DNA, 22 bp, Artificial Sequence
  chemically synthesized
caattcccttgtcttgataaat

SEQ ID NO: 1315167 - DNA, 22 bp, Artificial Sequence
  chemically synthesized
cccaggtagagctgatttatca

SEQ ID NO: 1315168 - DNA, 22 bp, Artificial Sequence
  chemically synthesized
ctgcccaggtagagctgattta

SEQ ID NO: 1315169 - DNA, 22 bp, Artificial Sequence
  chemically synthesized
ccttgtcttgataaatcagctc

SEQ ID NO: 1315170 - DNA, 22 bp, Artificial Sequence
  chemically synthesized
ctgctgcccaggtagagctgat

SEQ ID NO: 1315171 - DNA, 22 bp, Artificial Sequence
  chemically synthesized
cctgctgcccaggtagagctga

SEQ ID NO: 1315172 - DNA, 22 bp, Artificial Sequence
  chemically synthesized
gtcttgataaatcagctctacc

SEQ ID NO: 1315173 - DNA, 22 bp, Artificial Sequence
  chemically synthesized
tcctgctgcccaggtagagctg

SEQ ID NO: 1315174 - DNA, 22 bp, Artificial Sequence
  chemically synthesized
tcttgataaatcagctctacct

SEQ ID NO: 1315175 - DNA, 22 bp, Artificial Sequence
  chemically synthesized
tttcctgctgcccaggtagagc

SEQ ID NO: 1315176 - DNA, 22 bp, Artificial Sequence
  chemically synthesized
ctttcctgctgcccaggtagag

SEQ ID NO: 1315177 - DNA, 22 bp, Artificial Sequence
  chemically synthesized
gataaatcagctctacctgggc

SEQ ID NO: 1315178 - DNA, 22 bp, Artificial Sequence
  chemically synthesized
ttctttcctgctgcccaggtag

SEQ ID NO: 1315179 - DNA, 22 bp, Artificial Sequence
  chemically synthesized
ataaatcagctctacctgggca

SEQ ID NO: 1315180 - DNA, 22 bp, Artificial Sequence
  chemically synthesized
cacaataggttcttctttcctg

SEQ ID NO: 1315181 - DNA, 22 bp, Artificial Sequence
  chemically synthesized
tacctgggcagcaggaaagaag

SEQ ID NO: 1315182 - DNA, 22 bp, Artificial Sequence
  chemically synthesized
cctgggcagcaggaaagaagaa

SEQ ID NO: 1315183 - DNA, 22 bp, Artificial Sequence
  chemically synthesized
ggcagcaggaaagaagaaccta

SEQ ID NO: 1315184 - DNA, 22 bp, Artificial Sequence
  chemically synthesized
agaatgtatctgcacaataggt

SEQ ID NO: 1315185 - DNA, 22 bp, Artificial Sequence
  chemically synthesized
tggaggctcagaatgtatctgc

SEQ ID NO: 1315186 - DNA, 22 bp, Artificial Sequence
  chemically synthesized
cagttatggaggctcagaatgt

SEQ ID NO: 1315187 - DNA, 22 bp, Artificial Sequence
  chemically synthesized
acagttatggaggctcagaatg

SEQ ID NO: 1315188 - DNA, 22 bp, Artificial Sequence
  chemically synthesized
ttgtgcagatacattctgagcc

SEQ ID NO: 1315189 - DNA, 22 bp, Artificial Sequence
  chemically synthesized
ttacagttatggaggctcagaa

SEQ ID NO: 1315190 - DNA, 22 bp, Artificial Sequence
  chemically synthesized
cttacagttatggaggctcaga

SEQ ID NO: 1315191 - DNA, 22 bp, Artificial Sequence
  chemically synthesized
tgcagatacattctgagcctcc

SEQ ID NO: 1315192 - DNA, 22 bp, Artificial Sequence
  chemically synthesized
tttcttacagttatggaggctc

SEQ ID NO: 1315193 - DNA, 22 bp, Artificial Sequence
  chemically synthesized
atttcttacagttatggaggct

SEQ ID NO: 1315194 - DNA, 22 bp, Artificial Sequence
  chemically synthesized
tgagcctccataactgtaagaa

SEQ ID NO: 1315195 - DNA, 22 bp, Artificial Sequence
  chemically synthesized
agcctccataactgtaagaaat

SEQ ID NO: 1315196 - DNA, 22 bp, Artificial Sequence
  chemically synthesized
aaaaaggaacttatttcttaca

SEQ ID NO: 1315197 - DNA, 22 bp, Artificial Sequence
  chemically synthesized
caaaaaggaacttatttcttac

SEQ ID NO: 1315198 - DNA, 22 bp, Artificial Sequence
  chemically synthesized
tttcaaaaaggaacttatttct

SEQ ID NO: 1315199 - DNA, 22 bp, Artificial Sequence
  chemically synthesized
atttcaaaaaggaacttatttc

SEQ ID NO: 1315200 - DNA, 22 bp, Artificial Sequence
  chemically synthesized
cataactgtaagaaataagttc

SEQ ID NO: 1315201 - DNA, 22 bp, Artificial Sequence
  chemically synthesized
cttatttcaaaaaggaacttat

SEQ ID NO: 1315202 - DNA, 22 bp, Artificial Sequence
  chemically synthesized
ggttacttatttcaaaaaggaa

SEQ ID NO: 1315203 - DNA, 22 bp, Artificial Sequence
  chemically synthesized
taagaaataagttcctttttga

SEQ ID NO: 1315204 - DNA, 22 bp, Artificial Sequence
  chemically synthesized
aaactaggttacttatttcaaa

SEQ ID NO: 1315205 - DNA, 22 bp, Artificial Sequence
  chemically synthesized
ctttttgaaataagtaacctag

SEQ ID NO: 1315206 - DNA, 22 bp, Artificial Sequence
  chemically synthesized
tttgaaataagtaacctagttt

SEQ ID NO: 1315207 - DNA, 22 bp, Artificial Sequence
  chemically synthesized
ttgaaataagtaacctagtttc

SEQ ID NO: 1315208 - DNA, 22 bp, Artificial Sequence
  chemically synthesized
tgaaataagtaacctagtttca

SEQ ID NO: 1315209 - DNA, 22 bp, Artificial Sequence
  chemically synthesized
gaaataagtaacctagtttcag

SEQ ID NO: 1315210 - DNA, 22 bp, Artificial Sequence
  chemically synthesized
aaataagtaacctagtttcagg

SEQ ID NO: 1315211 - DNA, 22 bp, Artificial Sequence
  chemically synthesized
taaaacagaatacctgaaacta

SEQ ID NO: 1315212 - DNA, 22 bp, Artificial Sequence
  chemically synthesized
ctataaaacagaatacctgaaa

SEQ ID NO: 1315213 - DNA, 22 bp, Artificial Sequence
  chemically synthesized
ttgctataaaacagaatacctg

SEQ ID NO: 1315214 - DNA, 22 bp, Artificial Sequence
  chemically synthesized
ctgttgctataaaacagaatac

SEQ ID NO: 1315215 - DNA, 22 bp, Artificial Sequence
  chemically synthesized
gctgttgctataaaacagaata

SEQ ID NO: 1315216 - DNA, 22 bp, Artificial Sequence
  chemically synthesized
gtttcaggtattctgttttata

SEQ ID NO: 1315217 - DNA, 22 bp, Artificial Sequence
  chemically synthesized
atttgctgttgctataaaacag

SEQ ID NO: 1315218 - DNA, 22 bp, Artificial Sequence
  chemically synthesized
caggtattctgttttatagcaa

SEQ ID NO: 1315219 - DNA, 22 bp, Artificial Sequence
  chemically synthesized
attcatttgctgttgctataaa

SEQ ID NO: 1315220 - DNA, 22 bp, Artificial Sequence
  chemically synthesized
aggtattctgttttatagcaac

SEQ ID NO: 1315221 - DNA, 22 bp, Artificial Sequence
  chemically synthesized
ggtattaattcatttgctgttg

SEQ ID NO: 1315222 - DNA, 22 bp, Artificial Sequence
  chemically synthesized
tgttttatagcaacagcaaatg

SEQ ID NO: 1315223 - DNA, 22 bp, Artificial Sequence
  chemically synthesized
ctcggtattaattcatttgctg

SEQ ID NO: 1315224 - DNA, 22 bp, Artificial Sequence
  chemically synthesized
ttttatagcaacagcaaatgaa

SEQ ID NO: 1315225 - DNA, 22 bp, Artificial Sequence
  chemically synthesized
gctcggtattaattcatttgct

SEQ ID NO: 1315226 - DNA, 22 bp, Artificial Sequence
  chemically synthesized
tatagcaacagcaaatgaatta

SEQ ID NO: 1315227 - DNA, 22 bp, Artificial Sequence
  chemically synthesized
atagcaacagcaaatgaattaa

SEQ ID NO: 1315228 - DNA, 22 bp, Artificial Sequence
  chemically synthesized
atttgctcggtattaattcatt

SEQ ID NO: 1315229 - DNA, 22 bp, Artificial Sequence
  chemically synthesized
tagcaacagcaaatgaattaat

SEQ ID NO: 1315230 - DNA, 22 bp, Artificial Sequence
  chemically synthesized
attcatttgctcggtattaatt

SEQ ID NO: 1315231 - DNA, 22 bp, Artificial Sequence
  chemically synthesized
ataccgagcaaatgaattaata

SEQ ID NO: 1315232 - DNA, 22 bp, Artificial Sequence
  chemically synthesized
agatatcccaatacggtattaa

SEQ ID NO: 1315233 - DNA, 22 bp, Artificial Sequence
  chemically synthesized
ataccgtattgggatatcttag

SEQ ID NO: 1315234 - DNA, 22 bp, Artificial Sequence
  chemically synthesized
aatgccaaaacatctaagatat

SEQ ID NO: 1315235 - DNA, 22 bp, Artificial Sequence
  chemically synthesized
caatgccaaaacatctaagata

SEQ ID NO: 1315236 - DNA, 22 bp, Artificial Sequence
  chemically synthesized
ggatatcttagatgttttggca

SEQ ID NO: 1315237 - DNA, 22 bp, Artificial Sequence
  chemically synthesized
gtaagacaaagcttcaatgcca

SEQ ID NO: 1315238 - DNA, 22 bp, Artificial Sequence
  chemically synthesized
cgtaagacaaagcttcaatgcc

SEQ ID NO: 1315239 - DNA, 22 bp, Artificial Sequence
  chemically synthesized
tcgtaagacaaagcttcaatgc

SEQ ID NO: 1315240 - DNA, 22 bp, Artificial Sequence
  chemically synthesized
agatgttttggcattgaagctt

SEQ ID NO: 1315241 - DNA, 22 bp, Artificial Sequence
  chemically synthesized
gatgttttggcattgaagcttt

SEQ ID NO: 1315242 - DNA, 22 bp, Artificial Sequence
  chemically synthesized
aatgcattttcgtaagacaaag

SEQ ID NO: 1315243 - DNA, 22 bp, Artificial Sequence
  chemically synthesized
tggcattgaagctttgtcttac

SEQ ID NO: 1315244 - DNA, 22 bp, Artificial Sequence
  chemically synthesized
ggcattgaagctttgtcttacg

SEQ ID NO: 1315245 - DNA, 22 bp, Artificial Sequence
  chemically synthesized
gcattgaagctttgtcttacga

SEQ ID NO: 1315246 - DNA, 22 bp, Artificial Sequence
  chemically synthesized
aatacctgaatgcattttcgta

SEQ ID NO: 1315247 - DNA, 22 bp, Artificial Sequence
  chemically synthesized
aagctttgtcttacgaaaatgc

SEQ ID NO: 1315248 - DNA, 22 bp, Artificial Sequence
  chemically synthesized
caatacctgaatgcattttcgt

SEQ ID NO: 1315249 - DNA, 22 bp, Artificial Sequence
  chemically synthesized
tgtcttacgaaaatgcattcag

SEQ ID NO: 1315250 - DNA, 22 bp, Artificial Sequence
  chemically synthesized
gtcttacgaaaatgcattcagg

SEQ ID NO: 1315251 - DNA, 22 bp, Artificial Sequence
  chemically synthesized
tcttacgaaaatgcattcaggt

SEQ ID NO: 1315252 - DNA, 22 bp, Artificial Sequence
  chemically synthesized
acgaaaatgcattcaggtattg

SEQ ID NO: 1315253 - DNA, 22 bp, Artificial Sequence
  chemically synthesized
caatggtggtttcaatacctga

SEQ ID NO: 1315254 - DNA, 22 bp, Artificial Sequence
  chemically synthesized
cgaaaatgcattcaggtattga

SEQ ID NO: 1315255 - DNA, 22 bp, Artificial Sequence
  chemically synthesized
gcaatggtggtttcaatacctg

SEQ ID NO: 1315256 - DNA, 22 bp, Artificial Sequence
  chemically synthesized
tgcaatggtggtttcaatacct

SEQ ID NO: 1315257 - DNA, 22 bp, Artificial Sequence
  chemically synthesized
taattttgcaatggtggtttca

SEQ ID NO: 1315258 - DNA, 22 bp, Artificial Sequence
  chemically synthesized
agttataattttgcaatggtgg

SEQ ID NO: 1315259 - DNA, 22 bp, Artificial Sequence
  chemically synthesized
aggtattgaaaccaccattgca

SEQ ID NO: 1315260 - DNA, 22 bp, Artificial Sequence
  chemically synthesized
cagttataattttgcaatggtg

SEQ ID NO: 1315261 - DNA, 22 bp, Artificial Sequence
  chemically synthesized
tttcagttataattttgcaatg

SEQ ID NO: 1315262 - DNA, 22 bp, Artificial Sequence
  chemically synthesized
actatttcagttataattttgc

SEQ ID NO: 1315263 - DNA, 22 bp, Artificial Sequence
  chemically synthesized
aaaccaccattgcaaaattata

SEQ ID NO: 1315264 - DNA, 22 bp, Artificial Sequence
  chemically synthesized
cactatttcagttataattttg

SEQ ID NO: 1315265 - DNA, 22 bp, Artificial Sequence
  chemically synthesized
tcactatttcagttataatttt

SEQ ID NO: 1315266 - DNA, 22 bp, Artificial Sequence
  chemically synthesized
tttcactatttcagttataatt

SEQ ID NO: 1315267 - DNA, 22 bp, Artificial Sequence
  chemically synthesized
caaaattataactgaaatagtg

SEQ ID NO: 1315268 - DNA, 22 bp, Artificial Sequence
  chemically synthesized
catcagatctctttcactattt

SEQ ID NO: 1315269 - DNA, 22 bp, Artificial Sequence
  chemically synthesized
gttacatcagatctctttcact

SEQ ID NO: 1315270 - DNA, 22 bp, Artificial Sequence
  chemically synthesized
taactgaaatagtgaaagagat

SEQ ID NO: 1315271 - DNA, 22 bp, Artificial Sequence
  chemically synthesized
aaatagtgaaagagatctgatg

SEQ ID NO: 1315272 - DNA, 22 bp, Artificial Sequence
  chemically synthesized
gatgcaagagggagttggttac

SEQ ID NO: 1315273 - DNA, 22 bp, Artificial Sequence
  chemically synthesized
agatgcaagagggagttggtta

SEQ ID NO: 1315274 - DNA, 22 bp, Artificial Sequence
  chemically synthesized
gggcttagatgcaagagggagt

SEQ ID NO: 1315275 - DNA, 22 bp, Artificial Sequence
  chemically synthesized
atgtaaccaactccctcttgca

SEQ ID NO: 1315276 - DNA, 22 bp, Artificial Sequence
  chemically synthesized
cctcttgcatctaagccccagg

SEQ ID NO: 1315277 - DNA, 22 bp, Artificial Sequence
  chemically synthesized
ttgcatctaagccccaggctgt

SEQ ID NO: 1315278 - DNA, 22 bp, Artificial Sequence
  chemically synthesized
gcatctaagccccaggctgtcc

SEQ ID NO: 1315279 - DNA, 22 bp, Artificial Sequence
  chemically synthesized
catctaagccccaggctgtcct

SEQ ID NO: 1315280 - DNA, 22 bp, Artificial Sequence
  chemically synthesized
cccccaggaatgagcaaggaca

SEQ ID NO: 1315281 - DNA, 22 bp, Artificial Sequence
  chemically synthesized
acccccaggaatgagcaaggac

SEQ ID NO: 1315282 - DNA, 22 bp, Artificial Sequence
  chemically synthesized
agccccaggctgtccttgctca

SEQ ID NO: 1315283 - DNA, 22 bp, Artificial Sequence
  chemically synthesized
agcttacccccaggaatgagca

SEQ ID NO: 1315284 - DNA, 22 bp, Artificial Sequence
  chemically synthesized
cagcttacccccaggaatgagc

SEQ ID NO: 1315285 - DNA, 22 bp, Artificial Sequence
  chemically synthesized
tttcagcttacccccaggaatg

SEQ ID NO: 1315286 - DNA, 22 bp, Artificial Sequence
  chemically synthesized
tccttgctcattcctgggggta

SEQ ID NO: 1315287 - DNA, 22 bp, Artificial Sequence
  chemically synthesized
gctcattcctgggggtaagctg

SEQ ID NO: 1315288 - DNA, 22 bp, Artificial Sequence
  chemically synthesized
ccaaagttatttcagcttaccc

SEQ ID NO: 1315289 - DNA, 22 bp, Artificial Sequence
  chemically synthesized
ctcattcctgggggtaagctga

SEQ ID NO: 1315290 - DNA, 22 bp, Artificial Sequence
  chemically synthesized
ctcccaaagttatttcagctta

SEQ ID NO: 1315291 - DNA, 22 bp, Artificial Sequence
  chemically synthesized
attcctgggggtaagctgaaat

SEQ ID NO: 1315292 - DNA, 22 bp, Artificial Sequence
  chemically synthesized
ctgggggtaagctgaaataact

SEQ ID NO: 1315293 - DNA, 22 bp, Artificial Sequence
  chemically synthesized
agttcctcccaaagttatttca

SEQ ID NO: 1315294 - DNA, 22 bp, Artificial Sequence
  chemically synthesized
ggggtaagctgaaataactttg

SEQ ID NO: 1315295 - DNA, 22 bp, Artificial Sequence
  chemically synthesized
taaactaagttcctcccaaagt

SEQ ID NO: 1315296 - DNA, 22 bp, Artificial Sequence
  chemically synthesized
aaataactttgggaggaactta

SEQ ID NO: 1315297 - DNA, 22 bp, Artificial Sequence
  chemically synthesized
aaccataagctataaactaagt

SEQ ID NO: 1315298 - DNA, 22 bp, Artificial Sequence
  chemically synthesized
aaaccataagctataaactaag

SEQ ID NO: 1315299 - DNA, 22 bp, Artificial Sequence
  chemically synthesized
taaaccataagctataaactaa

SEQ ID NO: 1315300 - DNA, 22 bp, Artificial Sequence
  chemically synthesized
tgggaggaacttagtttatagc

SEQ ID NO: 1315301 - DNA, 22 bp, Artificial Sequence
  chemically synthesized
gggaggaacttagtttatagct

SEQ ID NO: 1315302 - DNA, 22 bp, Artificial Sequence
  chemically synthesized
ttttaaaccataagctataaac

SEQ ID NO: 1315303 - DNA, 22 bp, Artificial Sequence
  chemically synthesized
ggaggaacttagtttatagctt

SEQ ID NO: 1315304 - DNA, 22 bp, Artificial Sequence
  chemically synthesized
gttttaaaccataagctataaa

SEQ ID NO: 1315305 - DNA, 22 bp, Artificial Sequence
  chemically synthesized
tgttttaaaccataagctataa

SEQ ID NO: 1315306 - DNA, 22 bp, Artificial Sequence
  chemically synthesized
cctttgttttaaaccataagct

SEQ ID NO: 1315307 - DNA, 22 bp, Artificial Sequence
  chemically synthesized
agtttatagcttatggtttaaa

SEQ ID NO: 1315308 - DNA, 22 bp, Artificial Sequence
  chemically synthesized
gtttatagcttatggtttaaaa

SEQ ID NO: 1315309 - DNA, 22 bp, Artificial Sequence
  chemically synthesized
tcattgcctttgttttaaacca

SEQ ID NO: 1315310 - DNA, 22 bp, Artificial Sequence
  chemically synthesized
atagcttatggtttaaaacaaa

SEQ ID NO: 1315311 - DNA, 22 bp, Artificial Sequence
  chemically synthesized
tagcttatggtttaaaacaaag

SEQ ID NO: 1315312 - DNA, 22 bp, Artificial Sequence
  chemically synthesized
atggtttaaaacaaaggcaatg

SEQ ID NO: 1315313 - DNA, 22 bp, Artificial Sequence
  chemically synthesized
gggaagggttgtcattgccttt

SEQ ID NO: 1315314 - DNA, 22 bp, Artificial Sequence
  chemically synthesized
tggtttaaaacaaaggcaatga

SEQ ID NO: 1315315 - DNA, 22 bp, Artificial Sequence
  chemically synthesized
ggggaagggttgtcattgcctt

SEQ ID NO: 1315316 - DNA, 22 bp, Artificial Sequence
  chemically synthesized
tggggaagggttgtcattgcct

SEQ ID NO: 1315317 - DNA, 22 bp, Artificial Sequence
  chemically synthesized
gttttggggaagggttgtcatt

SEQ ID NO: 1315318 - DNA, 22 bp, Artificial Sequence
  chemically synthesized
aaaacaaaggcaatgacaaccc

SEQ ID NO: 1315319 - DNA, 22 bp, Artificial Sequence
  chemically synthesized
aaacaaaggcaatgacaaccct

SEQ ID NO: 1315320 - DNA, 22 bp, Artificial Sequence
  chemically synthesized
gtccccaggcaagaaggaggtt

SEQ ID NO: 1315321 - DNA, 22 bp, Artificial Sequence
  chemically synthesized
ccccaaaaccaacctccttctt

SEQ ID NO: 1315322 - DNA, 22 bp, Artificial Sequence
  chemically synthesized
cccaaaaccaacctccttcttg

SEQ ID NO: 1315323 - DNA, 22 bp, Artificial Sequence
  chemically synthesized
caaaggcagtctagtccccagg

SEQ ID NO: 1315324 - DNA, 22 bp, Artificial Sequence
  chemically synthesized
cttcttgcctggggactagact

SEQ ID NO: 1315325 - DNA, 22 bp, Artificial Sequence
  chemically synthesized
gtcctacaaaggcagtctagtc

SEQ ID NO: 1315326 - DNA, 22 bp, Artificial Sequence
  chemically synthesized
cttgcctggggactagactgcc

SEQ ID NO: 1315327 - DNA, 22 bp, Artificial Sequence
  chemically synthesized
ttgcctggggactagactgcct

SEQ ID NO: 1315328 - DNA, 22 bp, Artificial Sequence
  chemically synthesized
ttagtcctacaaaggcagtcta

SEQ ID NO: 1315329 - DNA, 22 bp, Artificial Sequence
  chemically synthesized
gttagtcctacaaaggcagtct

SEQ ID NO: 1315330 - DNA, 22 bp, Artificial Sequence
  chemically synthesized
gcctggggactagactgccttt

SEQ ID NO: 1315331 - DNA, 22 bp, Artificial Sequence
  chemically synthesized
tgttagtcctacaaaggcagtc

SEQ ID NO: 1315332 - DNA, 22 bp, Artificial Sequence
  chemically synthesized
cctggggactagactgcctttg

SEQ ID NO: 1315333 - DNA, 22 bp, Artificial Sequence
  chemically synthesized
ttttgttagtcctacaaaggca

SEQ ID NO: 1315334 - DNA, 22 bp, Artificial Sequence
  chemically synthesized
gggactagactgcctttgtagg

SEQ ID NO: 1315335 - DNA, 22 bp, Artificial Sequence
  chemically synthesized
gctattttgttagtcctacaaa

SEQ ID NO: 1315336 - DNA, 22 bp, Artificial Sequence
  chemically synthesized
ggctattttgttagtcctacaa

SEQ ID NO: 1315337 - DNA, 22 bp, Artificial Sequence
  chemically synthesized
tggctattttgttagtcctaca

SEQ ID NO: 1315338 - DNA, 22 bp, Artificial Sequence
  chemically synthesized
ttggctattttgttagtcctac

SEQ ID NO: 1315339 - DNA, 22 bp, Artificial Sequence
  chemically synthesized
gactgcctttgtaggactaaca

SEQ ID NO: 1315340 - DNA, 22 bp, Artificial Sequence
  chemically synthesized
atcttttggctattttgttagt

SEQ ID NO: 1315341 - DNA, 22 bp, Artificial Sequence
  chemically synthesized
cctttgtaggactaacaaaata

SEQ ID NO: 1315342 - DNA, 22 bp, Artificial Sequence
  chemically synthesized
taatcttttggctattttgtta

SEQ ID NO: 1315343 - DNA, 22 bp, Artificial Sequence
  chemically synthesized
ctaatcttttggctattttgtt

SEQ ID NO: 1315344 - DNA, 22 bp, Artificial Sequence
  chemically synthesized
tgtaggactaacaaaatagcca

SEQ ID NO: 1315345 - DNA, 22 bp, Artificial Sequence
  chemically synthesized
gtaggactaacaaaatagccaa

SEQ ID NO: 1315346 - DNA, 22 bp, Artificial Sequence
  chemically synthesized
taggactaacaaaatagccaaa

SEQ ID NO: 1315347 - DNA, 22 bp, Artificial Sequence
  chemically synthesized
aaccgtaatttctaatcttttg

SEQ ID NO: 1315348 - DNA, 22 bp, Artificial Sequence
  chemically synthesized
acaaaatagccaaaagattaga

SEQ ID NO: 1315349 - DNA, 22 bp, Artificial Sequence
  chemically synthesized
ctaaaccgtaatttctaatctt

SEQ ID NO: 1315350 - DNA, 22 bp, Artificial Sequence
  chemically synthesized
catgactactaaaccgtaattt

SEQ ID NO: 1315351 - DNA, 22 bp, Artificial Sequence
  chemically synthesized
gctgcatgactactaaaccgta

SEQ ID NO: 1315352 - DNA, 22 bp, Artificial Sequence
  chemically synthesized
tagctgcatgactactaaaccg

SEQ ID NO: 1315353 - DNA, 22 bp, Artificial Sequence
  chemically synthesized
gaaattacggtttagtagtcat

SEQ ID NO: 1315354 - DNA, 22 bp, Artificial Sequence
  chemically synthesized
tagtctctagctgcatgactac

SEQ ID NO: 1315355 - DNA, 22 bp, Artificial Sequence
  chemically synthesized
gtagtctctagctgcatgacta

SEQ ID NO: 1315356 - DNA, 22 bp, Artificial Sequence
  chemically synthesized
cggtttagtagtcatgcagcta

SEQ ID NO: 1315357 - DNA, 22 bp, Artificial Sequence
  chemically synthesized
agtagtcatgcagctagagact

SEQ ID NO: 1315358 - DNA, 22 bp, Artificial Sequence
  chemically synthesized
gtagtcatgcagctagagacta

SEQ ID NO: 1315359 - DNA, 22 bp, Artificial Sequence
  chemically synthesized
gggagaagcagtatcttgtagt

SEQ ID NO: 1315360 - DNA, 22 bp, Artificial Sequence
  chemically synthesized
ggggagaagcagtatcttgtag

SEQ ID NO: 1315361 - DNA, 22 bp, Artificial Sequence
  chemically synthesized
gagactacaagatactgcttct

SEQ ID NO: 1315362 - DNA, 22 bp, Artificial Sequence
  chemically synthesized
caagatactgcttctccccaaa

SEQ ID NO: 1315363 - DNA, 22 bp, Artificial Sequence
  chemically synthesized
tgcccaggagcaatttggggag

SEQ ID NO: 1315364 - DNA, 22 bp, Artificial Sequence
  chemically synthesized
atgcccaggagcaatttgggga

SEQ ID NO: 1315365 - DNA, 22 bp, Artificial Sequence
  chemically synthesized
tatgcccaggagcaatttgggg

SEQ ID NO: 1315366 - DNA, 22 bp, Artificial Sequence
  chemically synthesized
cttctccccaaattgctcctgg

SEQ ID NO: 1315367 - DNA, 22 bp, Artificial Sequence
  chemically synthesized
ctccccaaattgctcctgggca

SEQ ID NO: 1315368 - DNA, 22 bp, Artificial Sequence
  chemically synthesized
tccccaaattgctcctgggcat

SEQ ID NO: 1315369 - DNA, 22 bp, Artificial Sequence
  chemically synthesized
caatggtgactttatgcccagg

SEQ ID NO: 1315370 - DNA, 22 bp, Artificial Sequence
  chemically synthesized
cccaaattgctcctgggcataa

SEQ ID NO: 1315371 - DNA, 22 bp, Artificial Sequence
  chemically synthesized
acaatggtgactttatgcccag

SEQ ID NO: 1315372 - DNA, 22 bp, Artificial Sequence
  chemically synthesized
tacaatggtgactttatgccca

SEQ ID NO: 1315373 - DNA, 22 bp, Artificial Sequence
  chemically synthesized
ggctttacaatggtgactttat

SEQ ID NO: 1315374 - DNA, 22 bp, Artificial Sequence
  chemically synthesized
aggctttacaatggtgacttta

SEQ ID NO: 1315375 - DNA, 22 bp, Artificial Sequence
  chemically synthesized
ctcctgggcataaagtcaccat

SEQ ID NO: 1315376 - DNA, 22 bp, Artificial Sequence
  chemically synthesized
ctgggcataaagtcaccattgt

SEQ ID NO: 1315377 - DNA, 22 bp, Artificial Sequence
  chemically synthesized
atcttaggctttacaatggtga

SEQ ID NO: 1315378 - DNA, 22 bp, Artificial Sequence
  chemically synthesized
ggcataaagtcaccattgtaaa

SEQ ID NO: 1315379 - DNA, 22 bp, Artificial Sequence
  chemically synthesized
aagcactgatcttaggctttac

SEQ ID NO: 1315380 - DNA, 22 bp, Artificial Sequence
  chemically synthesized
caaaacgtctcaagcactgatc

SEQ ID NO: 1315381 - DNA, 22 bp, Artificial Sequence
  chemically synthesized
taaagcctaagatcagtgcttg

SEQ ID NO: 1315382 - DNA, 22 bp, Artificial Sequence
  chemically synthesized
agatcagtgcttgagacgtttt

SEQ ID NO: 1315383 - DNA, 22 bp, Artificial Sequence
  chemically synthesized
atccatcgagtgcagggtctgc

SEQ ID NO: 1315384 - DNA, 22 bp, Artificial Sequence
  chemically synthesized
gagacgttttgcagaccctgca

SEQ ID NO: 1315385 - DNA, 22 bp, Artificial Sequence
  chemically synthesized
agacgttttgcagaccctgcac

SEQ ID NO: 1315386 - DNA, 22 bp, Artificial Sequence
  chemically synthesized
tgcagaccctgcactcgatgga

SEQ ID NO: 1315387 - DNA, 22 bp, Artificial Sequence
  chemically synthesized
gcagaccctgcactcgatggat

SEQ ID NO: 1315388 - DNA, 22 bp, Artificial Sequence
  chemically synthesized
cagaccctgcactcgatggatc

SEQ ID NO: 1315389 - DNA, 22 bp, Artificial Sequence
  chemically synthesized
tgtggtaccagttgatccatcg

SEQ ID NO: 1315390 - DNA, 22 bp, Artificial Sequence
  chemically synthesized
atctgtgtggtaccagttgatc

SEQ ID NO: 1315391 - DNA, 22 bp, Artificial Sequence
  chemically synthesized
cactcgatggatcaactggtac

SEQ ID NO: 1315392 - DNA, 22 bp, Artificial Sequence
  chemically synthesized
ttgatctgtgtggtaccagttg

SEQ ID NO: 1315393 - DNA, 22 bp, Artificial Sequence
  chemically synthesized
attgatctgtgtggtaccagtt

SEQ ID NO: 1315394 - DNA, 22 bp, Artificial Sequence
  chemically synthesized
gatggatcaactggtaccacac

SEQ ID NO: 1315395 - DNA, 22 bp, Artificial Sequence
  chemically synthesized
gtaccacacagatcaataaact

SEQ ID NO: 1315396 - DNA, 22 bp, Artificial Sequence
  chemically synthesized
agtggggggtcataggatgaga

SEQ ID NO: 1315397 - DNA, 22 bp, Artificial Sequence
  chemically synthesized
ctgagtggggggtcataggatg

SEQ ID NO: 1315398 - DNA, 22 bp, Artificial Sequence
  chemically synthesized
gctcatctcatcctatgacccc

SEQ ID NO: 1315399 - DNA, 22 bp, Artificial Sequence
  chemically synthesized
atctcatcctatgaccccccac

SEQ ID NO: 1315400 - DNA, 22 bp, Artificial Sequence
  chemically synthesized
agtcagttcctgagtggggggt

SEQ ID NO: 1315401 - DNA, 22 bp, Artificial Sequence
  chemically synthesized
atcctatgaccccccactcagg

SEQ ID NO: 1315402 - DNA, 22 bp, Artificial Sequence
  chemically synthesized
ccctgagtcagttcctgagtgg

SEQ ID NO: 1315403 - DNA, 22 bp, Artificial Sequence
  chemically synthesized
gccctgagtcagttcctgagtg

SEQ ID NO: 1315404 - DNA, 22 bp, Artificial Sequence
  chemically synthesized
tgaccccccactcaggaactga

SEQ ID NO: 1315405 - DNA, 22 bp, Artificial Sequence
  chemically synthesized
tcttgccctgagtcagttcctg

SEQ ID NO: 1315406 - DNA, 22 bp, Artificial Sequence
  chemically synthesized
aggaactgactcagggcaagac

SEQ ID NO: 1315407 - DNA, 22 bp, Artificial Sequence
  chemically synthesized
actcagggcaagacagctttga

SEQ ID NO: 1315408 - DNA, 22 bp, Artificial Sequence
  chemically synthesized
agggcaagacagctttgactcc

SEQ ID NO: 1315409 - DNA, 22 bp, Artificial Sequence
  chemically synthesized
gatcagagatgaaatcataggg

SEQ ID NO: 1315410 - DNA, 22 bp, Artificial Sequence
  chemically synthesized
gttggatcagagatgaaatcat

SEQ ID NO: 1315411 - DNA, 22 bp, Artificial Sequence
  chemically synthesized
tgactccctatgatttcatctc

SEQ ID NO: 1315412 - DNA, 22 bp, Artificial Sequence
  chemically synthesized
gactccctatgatttcatctct

SEQ ID NO: 1315413 - DNA, 22 bp, Artificial Sequence
  chemically synthesized
actccctatgatttcatctctg

SEQ ID NO: 1315414 - DNA, 22 bp, Artificial Sequence
  chemically synthesized
cctatgatttcatctctgatcc

SEQ ID NO: 1315415 - DNA, 22 bp, Artificial Sequence
  chemically synthesized
tgatttcatctctgatccaacc

SEQ ID NO: 1315416 - DNA, 22 bp, Artificial Sequence
  chemically synthesized
catctctgatccaaccaatcat

SEQ ID NO: 1315417 - DNA, 22 bp, Artificial Sequence
  chemically synthesized
atctctgatccaaccaatcatt

SEQ ID NO: 1315418 - DNA, 22 bp, Artificial Sequence
  chemically synthesized
tgatccaaccaatcattacttc

SEQ ID NO: 1315419 - DNA, 22 bp, Artificial Sequence
  chemically synthesized
atccaaccaatcattacttctg

SEQ ID NO: 1315420 - DNA, 22 bp, Artificial Sequence
  chemically synthesized
gtgggtggggagcagccagtgg

SEQ ID NO: 1315421 - DNA, 22 bp, Artificial Sequence
  chemically synthesized
ggtgggtggggagcagccagtg

SEQ ID NO: 1315422 - DNA, 22 bp, Artificial Sequence
  chemically synthesized
cttctgaccactggctgctccc

SEQ ID NO: 1315423 - DNA, 22 bp, Artificial Sequence
  chemically synthesized
ctgaccactggctgctccccac

SEQ ID NO: 1315424 - DNA, 22 bp, Artificial Sequence
  chemically synthesized
tgaccactggctgctccccacc

SEQ ID NO: 1315425 - DNA, 22 bp, Artificial Sequence
  chemically synthesized
accactggctgctccccaccca

SEQ ID NO: 1315426 - DNA, 22 bp, Artificial Sequence
  chemically synthesized
aggacaatttggtgggtgggga

SEQ ID NO: 1315427 - DNA, 22 bp, Artificial Sequence
  chemically synthesized
aaggacaatttggtgggtgggg

SEQ ID NO: 1315428 - DNA, 22 bp, Artificial Sequence
  chemically synthesized
taaggacaatttggtgggtggg

SEQ ID NO: 1315429 - DNA, 22 bp, Artificial Sequence
  chemically synthesized
ttaaggacaatttggtgggtgg

SEQ ID NO: 1315430 - DNA, 22 bp, Artificial Sequence
  chemically synthesized
gctgctccccacccaccaaatt

SEQ ID NO: 1315431 - DNA, 22 bp, Artificial Sequence
  chemically synthesized
ctccccacccaccaaattgtcc

SEQ ID NO: 1315432 - DNA, 22 bp, Artificial Sequence
  chemically synthesized
cccacccaccaaattgtcctta

SEQ ID NO: 1315433 - DNA, 22 bp, Artificial Sequence
  chemically synthesized
gggaccagggtttttaaggaca

SEQ ID NO: 1315434 - DNA, 22 bp, Artificial Sequence
  chemically synthesized
ggggaccagggtttttaaggac

SEQ ID NO: 1315435 - DNA, 22 bp, Artificial Sequence
  chemically synthesized
agcatttggggaccagggtttt

SEQ ID NO: 1315436 - DNA, 22 bp, Artificial Sequence
  chemically synthesized
cctgagcatttggggaccaggg

SEQ ID NO: 1315437 - DNA, 22 bp, Artificial Sequence
  chemically synthesized
tccttaaaaaccctggtcccca

SEQ ID NO: 1315438 - DNA, 22 bp, Artificial Sequence
  chemically synthesized
aaaaaccctggtccccaaatgc

SEQ ID NO: 1315439 - DNA, 22 bp, Artificial Sequence
  chemically synthesized
aaaaccctggtccccaaatgct

SEQ ID NO: 1315440 - DNA, 22 bp, Artificial Sequence
  chemically synthesized
aaatcagtctccctgagcattt

SEQ ID NO: 1315441 - DNA, 22 bp, Artificial Sequence
  chemically synthesized
ctcaaatcagtctccctgagca

SEQ ID NO: 1315442 - DNA, 22 bp, Artificial Sequence
  chemically synthesized
gtccccaaatgctcagggagac

SEQ ID NO: 1315443 - DNA, 22 bp, Artificial Sequence
  chemically synthesized
ttactcaaatcagtctccctga

SEQ ID NO: 1315444 - DNA, 22 bp, Artificial Sequence
  chemically synthesized
ttattactcaaatcagtctccc

SEQ ID NO: 1315445 - DNA, 22 bp, Artificial Sequence
  chemically synthesized
attattactcaaatcagtctcc

SEQ ID NO: 1315446 - DNA, 22 bp, Artificial Sequence
  chemically synthesized
tattattactcaaatcagtctc

SEQ ID NO: 1315447 - DNA, 22 bp, Artificial Sequence
  chemically synthesized
gagttttattattactcaaatc

SEQ ID NO: 1315448 - DNA, 22 bp, Artificial Sequence
  chemically synthesized
agggagactgatttgagtaata

SEQ ID NO: 1315449 - DNA, 22 bp, Artificial Sequence
  chemically synthesized
tatgggagactggagttttatt

SEQ ID NO: 1315450 - DNA, 22 bp, Artificial Sequence
  chemically synthesized
atttgagtaataataaaactcc

SEQ ID NO: 1315451 - DNA, 22 bp, Artificial Sequence
  chemically synthesized
gagtaataataaaactccagtc

SEQ ID NO: 1315452 - DNA, 22 bp, Artificial Sequence
  chemically synthesized
agtaataataaaactccagtct

SEQ ID NO: 1315453 - DNA, 22 bp, Artificial Sequence
  chemically synthesized
atgcagagcaggctgtatggga

SEQ ID NO: 1315454 - DNA, 22 bp, Artificial Sequence
  chemically synthesized
cagtctcccatacagcctgctc

SEQ ID NO: 1315455 - DNA, 22 bp, Artificial Sequence
  chemically synthesized
ccatacagcctgctctgcatga

SEQ ID NO: 1315456 - DNA, 22 bp, Artificial Sequence
  chemically synthesized
caatagagaaagagtaattcat

SEQ ID NO: 1315457 - DNA, 22 bp, Artificial Sequence
  chemically synthesized
ctctgcatgaattactctttct

SEQ ID NO: 1315458 - DNA, 22 bp, Artificial Sequence
  chemically synthesized
tgcatgaattactctttctcta

SEQ ID NO: 1315459 - DNA, 22 bp, Artificial Sequence
  chemically synthesized
catgaattactctttctctatt

SEQ ID NO: 1315460 - DNA, 22 bp, Artificial Sequence
  chemically synthesized
tcaagacagggaaattgcaata

SEQ ID NO: 1315461 - DNA, 22 bp, Artificial Sequence
  chemically synthesized
atcaagacagggaaattgcaat

SEQ ID NO: 1315462 - DNA, 22 bp, Artificial Sequence
  chemically synthesized
ctctttctctattgcaatttcc

SEQ ID NO: 1315463 - DNA, 22 bp, Artificial Sequence
  chemically synthesized
atttatcaagacagggaaattg

SEQ ID NO: 1315464 - DNA, 22 bp, Artificial Sequence
  chemically synthesized
tttctctattgcaatttccctg

SEQ ID NO: 1315465 - DNA, 22 bp, Artificial Sequence
  chemically synthesized
tctctattgcaatttccctgtc

SEQ ID NO: 1315466 - DNA, 22 bp, Artificial Sequence
  chemically synthesized
ctctattgcaatttccctgtct

SEQ ID NO: 1315467 - DNA, 22 bp, Artificial Sequence
  chemically synthesized
tctattgcaatttccctgtctt

SEQ ID NO: 1315468 - DNA, 22 bp, Artificial Sequence
  chemically synthesized
tattgcaatttccctgtcttga

SEQ ID NO: 1315469 - DNA, 22 bp, Artificial Sequence
  chemically synthesized
ttgcaatttccctgtcttgata

SEQ ID NO: 1315470 - DNA, 22 bp, Artificial Sequence
  chemically synthesized
gacagagttgatttatcaagac

SEQ ID NO: 1315471 - DNA, 22 bp, Artificial Sequence
  chemically synthesized
caatttccctgtcttgataaat

SEQ ID NO: 1315472 - DNA, 22 bp, Artificial Sequence
  chemically synthesized
tagacagagttgatttatcaag

SEQ ID NO: 1315473 - DNA, 22 bp, Artificial Sequence
  chemically synthesized
tctagacagagttgatttatca

SEQ ID NO: 1315474 - DNA, 22 bp, Artificial Sequence
  chemically synthesized
ccctgtcttgataaatcaactc

SEQ ID NO: 1315475 - DNA, 22 bp, Artificial Sequence
  chemically synthesized
cctgtcttgataaatcaactct

SEQ ID NO: 1315476 - DNA, 22 bp, Artificial Sequence
  chemically synthesized
cccactctctagacagagttga

SEQ ID NO: 1315477 - DNA, 22 bp, Artificial Sequence
  chemically synthesized
gcccactctctagacagagttg

SEQ ID NO: 1315478 - DNA, 22 bp, Artificial Sequence
  chemically synthesized
tcttgataaatcaactctgtct

SEQ ID NO: 1315479 - DNA, 22 bp, Artificial Sequence
  chemically synthesized
gataaatcaactctgtctagag

SEQ ID NO: 1315480 - DNA, 22 bp, Artificial Sequence
  chemically synthesized
accttgcccactctctagacag

SEQ ID NO: 1315481 - DNA, 22 bp, Artificial Sequence
  chemically synthesized
ataaatcaactctgtctagaga

SEQ ID NO: 1315482 - DNA, 22 bp, Artificial Sequence
  chemically synthesized
ccatcaggttcaccttgcccac

SEQ ID NO: 1315483 - DNA, 22 bp, Artificial Sequence
  chemically synthesized
tgtctagagagtgggcaaggtg

SEQ ID NO: 1315484 - DNA, 22 bp, Artificial Sequence
  chemically synthesized
tctagagagtgggcaaggtgaa

SEQ ID NO: 1315485 - DNA, 22 bp, Artificial Sequence
  chemically synthesized
caattgccatcaggttcacctt

SEQ ID NO: 1315486 - DNA, 22 bp, Artificial Sequence
  chemically synthesized
gagagtgggcaaggtgaacctg

SEQ ID NO: 1315487 - DNA, 22 bp, Artificial Sequence
  chemically synthesized
ggtatacatacatactgcaatt

SEQ ID NO: 1315488 - DNA, 22 bp, Artificial Sequence
  chemically synthesized
atggcaattgcagtatgtatgt

SEQ ID NO: 1315489 - DNA, 22 bp, Artificial Sequence
  chemically synthesized
catacaagatgttgggtataca

SEQ ID NO: 1315490 - DNA, 22 bp, Artificial Sequence
  chemically synthesized
cagtatgtatgtatacccaaca

SEQ ID NO: 1315491 - DNA, 22 bp, Artificial Sequence
  chemically synthesized
aaattacatacaagatgttggg

SEQ ID NO: 1315492 - DNA, 22 bp, Artificial Sequence
  chemically synthesized
aaaattacatacaagatgttgg

SEQ ID NO: 1315493 - DNA, 22 bp, Artificial Sequence
  chemically synthesized
catcccttaaaattacatacaa

SEQ ID NO: 1315494 - DNA, 22 bp, Artificial Sequence
  chemically synthesized
gcatcccttaaaattacataca

SEQ ID NO: 1315495 - DNA, 22 bp, Artificial Sequence
  chemically synthesized
ggatccttgcatcccttaaaat

SEQ ID NO: 1315496 - DNA, 22 bp, Artificial Sequence
  chemically synthesized
gggatccttgcatcccttaaaa

SEQ ID NO: 1315497 - DNA, 22 bp, Artificial Sequence
  chemically synthesized
tgggatccttgcatcccttaaa

SEQ ID NO: 1315498 - DNA, 22 bp, Artificial Sequence
  chemically synthesized
gtatgtaattttaagggatgca

SEQ ID NO: 1315499 - DNA, 22 bp, Artificial Sequence
  chemically synthesized
ttttgggatccttgcatccctt

SEQ ID NO: 1315500 - DNA, 22 bp, Artificial Sequence
  chemically synthesized
tatgtaattttaagggatgcaa

SEQ ID NO: 1315501 - DNA, 22 bp, Artificial Sequence
  chemically synthesized
attttgggatccttgcatccct

SEQ ID NO: 1315502 - DNA, 22 bp, Artificial Sequence
  chemically synthesized
gtttattttgggatccttgcat

SEQ ID NO: 1315503 - DNA, 22 bp, Artificial Sequence
  chemically synthesized
tagtttattttgggatccttgc

SEQ ID NO: 1315504 - DNA, 22 bp, Artificial Sequence
  chemically synthesized
taagggatgcaaggatcccaaa

SEQ ID NO: 1315505 - DNA, 22 bp, Artificial Sequence
  chemically synthesized
aagggatgcaaggatcccaaaa

SEQ ID NO: 1315506 - DNA, 22 bp, Artificial Sequence
  chemically synthesized
agggatgcaaggatcccaaaat

SEQ ID NO: 1315507 - DNA, 22 bp, Artificial Sequence
  chemically synthesized
aagttctagtttattttgggat

SEQ ID NO: 1315508 - DNA, 22 bp, Artificial Sequence
  chemically synthesized
gatcaccctaaagttctagttt

SEQ ID NO: 1315509 - DNA, 22 bp, Artificial Sequence
  chemically synthesized
gaactttagggtgatcgagtgt

SEQ ID NO: 1315510 - DNA, 22 bp, Artificial Sequence
  chemically synthesized
gcccccaggcacaccagacact

SEQ ID NO: 1315511 - DNA, 22 bp, Artificial Sequence
  chemically synthesized
tagggtgatcgagtgtctggtg

SEQ ID NO: 1315512 - DNA, 22 bp, Artificial Sequence
  chemically synthesized
agcccccaggcacaccagacac

SEQ ID NO: 1315513 - DNA, 22 bp, Artificial Sequence
  chemically synthesized
agggtgatcgagtgtctggtgt

SEQ ID NO: 1315514 - DNA, 22 bp, Artificial Sequence
  chemically synthesized
gggtgatcgagtgtctggtgtg

SEQ ID NO: 1315515 - DNA, 22 bp, Artificial Sequence
  chemically synthesized
cttagcccccaggcacaccaga

SEQ ID NO: 1315516 - DNA, 22 bp, Artificial Sequence
  chemically synthesized
gtgtgcctgggggctaagcagg

SEQ ID NO: 1315517 - DNA, 22 bp, Artificial Sequence
  chemically synthesized
aagtcccatatcccacaaacct

SEQ ID NO: 1315518 - DNA, 22 bp, Artificial Sequence
  chemically synthesized
aaagtcccatatcccacaaacc

SEQ ID NO: 1315519 - DNA, 22 bp, Artificial Sequence
  chemically synthesized
ggggctaagcaggtttgtggga

SEQ ID NO: 1315520 - DNA, 22 bp, Artificial Sequence
  chemically synthesized
aaatttaaagtcccatatccca

SEQ ID NO: 1315521 - DNA, 22 bp, Artificial Sequence
  chemically synthesized
aaaatttaaagtcccatatccc

SEQ ID NO: 1315522 - DNA, 22 bp, Artificial Sequence
  chemically synthesized
agcaggtttgtgggatatggga

SEQ ID NO: 1315523 - DNA, 22 bp, Artificial Sequence
  chemically synthesized
taaaatttaaagtcccatatcc

SEQ ID NO: 1315524 - DNA, 22 bp, Artificial Sequence
  chemically synthesized
agttttaaaatttaaagtccca

SEQ ID NO: 1315525 - DNA, 22 bp, Artificial Sequence
  chemically synthesized
tcagttttaaaatttaaagtcc

SEQ ID NO: 1315526 - DNA, 22 bp, Artificial Sequence
  chemically synthesized
ctcagttttaaaatttaaagtc

SEQ ID NO: 1315527 - DNA, 22 bp, Artificial Sequence
  chemically synthesized
gtgggatatgggactttaaatt

SEQ ID NO: 1315528 - DNA, 22 bp, Artificial Sequence
  chemically synthesized
tgggatatgggactttaaattt

SEQ ID NO: 1315529 - DNA, 22 bp, Artificial Sequence
  chemically synthesized
aggaatttctcagttttaaaat

SEQ ID NO: 1315530 - DNA, 22 bp, Artificial Sequence
  chemically synthesized
caggaatttctcagttttaaaa

SEQ ID NO: 1315531 - DNA, 22 bp, Artificial Sequence
  chemically synthesized
tcaggaatttctcagttttaaa

SEQ ID NO: 1315532 - DNA, 22 bp, Artificial Sequence
  chemically synthesized
ttcaggaatttctcagttttaa

SEQ ID NO: 1315533 - DNA, 22 bp, Artificial Sequence
  chemically synthesized
tttttcaggaatttctcagttt

SEQ ID NO: 1315534 - DNA, 22 bp, Artificial Sequence
  chemically synthesized
gtttttcaggaatttctcagtt

SEQ ID NO: 1315535 - DNA, 22 bp, Artificial Sequence
  chemically synthesized
tgtttttcaggaatttctcagt

SEQ ID NO: 1315536 - DNA, 22 bp, Artificial Sequence
  chemically synthesized
taaattttaaaactgagaaatt

SEQ ID NO: 1315537 - DNA, 22 bp, Artificial Sequence
  chemically synthesized
ttgtttttcaggaatttctcag

SEQ ID NO: 1315538 - DNA, 22 bp, Artificial Sequence
  chemically synthesized
aaattttaaaactgagaaattc

SEQ ID NO: 1315539 - DNA, 22 bp, Artificial Sequence
  chemically synthesized
aattttaaaactgagaaattcc

SEQ ID NO: 1315540 - DNA, 22 bp, Artificial Sequence
  chemically synthesized
tttttgtttttcaggaatttct

SEQ ID NO: 1315541 - DNA, 22 bp, Artificial Sequence
  chemically synthesized
gtttttgtttttcaggaatttc

SEQ ID NO: 1315542 - DNA, 22 bp, Artificial Sequence
  chemically synthesized
taaaactgagaaattcctgaaa

SEQ ID NO: 1315543 - DNA, 22 bp, Artificial Sequence
  chemically synthesized
tttgtttttgtttttcaggaat

SEQ ID NO: 1315544 - DNA, 22 bp, Artificial Sequence
  chemically synthesized
aaaactgagaaattcctgaaaa

SEQ ID NO: 1315545 - DNA, 22 bp, Artificial Sequence
  chemically synthesized
gtttgtttttgtttttcaggaa

SEQ ID NO: 1315546 - DNA, 22 bp, Artificial Sequence
  chemically synthesized
aaactgagaaattcctgaaaaa

SEQ ID NO: 1315547 - DNA, 22 bp, Artificial Sequence
  chemically synthesized
tgtttgtttttgtttttcagga

SEQ ID NO: 1315548 - DNA, 22 bp, Artificial Sequence
  chemically synthesized
ttgtttgtttttgtttttcagg

SEQ ID NO: 1315549 - DNA, 22 bp, Artificial Sequence
  chemically synthesized
tttttgtttgtttttgtttttc

SEQ ID NO: 1315550 - DNA, 22 bp, Artificial Sequence
  chemically synthesized
atttttgtttgtttttgttttt

SEQ ID NO: 1315551 - DNA, 22 bp, Artificial Sequence
  chemically synthesized
agaaattcctgaaaaacaaaaa

SEQ ID NO: 1315552 - DNA, 22 bp, Artificial Sequence
  chemically synthesized
tatttttgtttgtttttgtttt

SEQ ID NO: 1315553 - DNA, 22 bp, Artificial Sequence
  chemically synthesized
ttttatttttgtttgtttttgt

SEQ ID NO: 1315554 - DNA, 22 bp, Artificial Sequence
  chemically synthesized
gttttatttttgtttgtttttg

SEQ ID NO: 1315555 - DNA, 22 bp, Artificial Sequence
  chemically synthesized
ttgttttatttttgtttgtttt

SEQ ID NO: 1315556 - DNA, 22 bp, Artificial Sequence
  chemically synthesized
cttgttttatttttgtttgttt

SEQ ID NO: 1315557 - DNA, 22 bp, Artificial Sequence
  chemically synthesized
ctgaaaaacaaaaacaaacaaa

SEQ ID NO: 1315558 - DNA, 22 bp, Artificial Sequence
  chemically synthesized
tcttgttttatttttgtttgtt

SEQ ID NO: 1315559 - DNA, 22 bp, Artificial Sequence
  chemically synthesized
ttcttgttttatttttgtttgt

SEQ ID NO: 1315560 - DNA, 22 bp, Artificial Sequence
  chemically synthesized
aaaaacaaaaacaaacaaaaat

SEQ ID NO: 1315561 - DNA, 22 bp, Artificial Sequence
  chemically synthesized
gggtaaccaacttttcttgttt

SEQ ID NO: 1315562 - DNA, 22 bp, Artificial Sequence
  chemically synthesized
agggtaaccaacttttcttgtt

SEQ ID NO: 1315563 - DNA, 22 bp, Artificial Sequence
  chemically synthesized
tagggtaaccaacttttcttgt

SEQ ID NO: 1315564 - DNA, 22 bp, Artificial Sequence
  chemically synthesized
cattttagggtaaccaactttt

SEQ ID NO: 1315565 - DNA, 22 bp, Artificial Sequence
  chemically synthesized
tataaacgttacattttagggt

SEQ ID NO: 1315566 - DNA, 22 bp, Artificial Sequence
  chemically synthesized
aagtgctatataaacgttacat

SEQ ID NO: 1315567 - DNA, 22 bp, Artificial Sequence
  chemically synthesized
gttaccctaaaatgtaacgttt

SEQ ID NO: 1315568 - DNA, 22 bp, Artificial Sequence
  chemically synthesized
ttaaagtgctatataaacgtta

SEQ ID NO: 1315569 - DNA, 22 bp, Artificial Sequence
  chemically synthesized
attaaagtgctatataaacgtt

SEQ ID NO: 1315570 - DNA, 22 bp, Artificial Sequence
  chemically synthesized
ccctaaaatgtaacgtttatat

SEQ ID NO: 1315571 - DNA, 22 bp, Artificial Sequence
  chemically synthesized
aaatgtaacgtttatatagcac

SEQ ID NO: 1315572 - DNA, 22 bp, Artificial Sequence
  chemically synthesized
gtaaatagtatttattaaagtg

SEQ ID NO: 1315573 - DNA, 22 bp, Artificial Sequence
  chemically synthesized
tagtaaatagtatttattaaag

SEQ ID NO: 1315574 - DNA, 22 bp, Artificial Sequence
  chemically synthesized
ctagtaaatagtatttattaaa

SEQ ID NO: 1315575 - DNA, 22 bp, Artificial Sequence
  chemically synthesized
atatagcactttaataaatact

SEQ ID NO: 1315576 - DNA, 22 bp, Artificial Sequence
  chemically synthesized
tatagcactttaataaatacta

SEQ ID NO: 1315577 - DNA, 22 bp, Artificial Sequence
  chemically synthesized
gcttctagtaaatagtatttat

SEQ ID NO: 1315578 - DNA, 22 bp, Artificial Sequence
  chemically synthesized
agcttctagtaaatagtattta

SEQ ID NO: 1315579 - DNA, 22 bp, Artificial Sequence
  chemically synthesized
taataaatactatttactagaa

SEQ ID NO: 1315580 - DNA, 22 bp, Artificial Sequence
  chemically synthesized
aataaatactatttactagaag

SEQ ID NO: 1315581 - DNA, 22 bp, Artificial Sequence
  chemically synthesized
ataaatactatttactagaagc

SEQ ID NO: 1315582 - DNA, 22 bp, Artificial Sequence
  chemically synthesized
tttactagaagctaaggctttt

SEQ ID NO: 1315583 - DNA, 22 bp, Artificial Sequence
  chemically synthesized
taatatacataaccaaaagcct

SEQ ID NO: 1315584 - DNA, 22 bp, Artificial Sequence
  chemically synthesized
actagaagctaaggcttttggt

SEQ ID NO: 1315585 - DNA, 22 bp, Artificial Sequence
  chemically synthesized
ataatatacataaccaaaagcc

SEQ ID NO: 1315586 - DNA, 22 bp, Artificial Sequence
  chemically synthesized
ctagaagctaaggcttttggtt

SEQ ID NO: 1315587 - DNA, 22 bp, Artificial Sequence
  chemically synthesized
gaagctaaggcttttggttatg

SEQ ID NO: 1315588 - DNA, 22 bp, Artificial Sequence
  chemically synthesized
atttataatatacataaccaaa

SEQ ID NO: 1315589 - DNA, 22 bp, Artificial Sequence
  chemically synthesized
aggcttttggttatgtatatta

SEQ ID NO: 1315590 - DNA, 22 bp, Artificial Sequence
  chemically synthesized
tggcctaatttataatatacat

SEQ ID NO: 1315591 - DNA, 22 bp, Artificial Sequence
  chemically synthesized
ccctatggcctaatttataata

SEQ ID NO: 1315592 - DNA, 22 bp, Artificial Sequence
  chemically synthesized
ttggttatgtatattataaatt

SEQ ID NO: 1315593 - DNA, 22 bp, Artificial Sequence
  chemically synthesized
gccctatggcctaatttataat

SEQ ID NO: 1315594 - DNA, 22 bp, Artificial Sequence
  chemically synthesized
tggttatgtatattataaatta

SEQ ID NO: 1315595 - DNA, 22 bp, Artificial Sequence
  chemically synthesized
tgccctatggcctaatttataa

SEQ ID NO: 1315596 - DNA, 22 bp, Artificial Sequence
  chemically synthesized
ggttatgtatattataaattag

SEQ ID NO: 1315597 - DNA, 22 bp, Artificial Sequence
  chemically synthesized
gttatgtatattataaattagg

SEQ ID NO: 1315598 - DNA, 22 bp, Artificial Sequence
  chemically synthesized
ctttgccctatggcctaattta

SEQ ID NO: 1315599 - DNA, 22 bp, Artificial Sequence
  chemically synthesized
gctttgccctatggcctaattt

SEQ ID NO: 1315600 - DNA, 22 bp, Artificial Sequence
  chemically synthesized
tgtatattataaattaggccat

SEQ ID NO: 1315601 - DNA, 22 bp, Artificial Sequence
  chemically synthesized
ttgctttgccctatggcctaat

SEQ ID NO: 1315602 - DNA, 22 bp, Artificial Sequence
  chemically synthesized
cttgctttgccctatggcctaa

SEQ ID NO: 1315603 - DNA, 22 bp, Artificial Sequence
  chemically synthesized
tcttgctttgccctatggccta

SEQ ID NO: 1315604 - DNA, 22 bp, Artificial Sequence
  chemically synthesized
attttcttgctttgccctatgg

SEQ ID NO: 1315605 - DNA, 22 bp, Artificial Sequence
  chemically synthesized
cattttcttgctttgccctatg

SEQ ID NO: 1315606 - DNA, 22 bp, Artificial Sequence
  chemically synthesized
tcattttcttgctttgccctat

SEQ ID NO: 1315607 - DNA, 22 bp, Artificial Sequence
  chemically synthesized
taaattaggccatagggcaaag

SEQ ID NO: 1315608 - DNA, 22 bp, Artificial Sequence
  chemically synthesized
ggccatagggcaaagcaagaaa

SEQ ID NO: 1315609 - DNA, 22 bp, Artificial Sequence
  chemically synthesized
gtaaagctttcattttcttgct

SEQ ID NO: 1315610 - DNA, 22 bp, Artificial Sequence
  chemically synthesized
acctagtaaagctttcattttc

SEQ ID NO: 1315611 - DNA, 22 bp, Artificial Sequence
  chemically synthesized
gacctagtaaagctttcatttt

SEQ ID NO: 1315612 - DNA, 22 bp, Artificial Sequence
  chemically synthesized
tgacctagtaaagctttcattt

SEQ ID NO: 1315613 - DNA, 22 bp, Artificial Sequence
  chemically synthesized
ggcggtcacagttttgacctag

SEQ ID NO: 1315614 - DNA, 22 bp, Artificial Sequence
  chemically synthesized
gggcggtcacagttttgaccta

SEQ ID NO: 1315615 - DNA, 22 bp, Artificial Sequence
  chemically synthesized
ttgggcggtcacagttttgacc

SEQ ID NO: 1315616 - DNA, 22 bp, Artificial Sequence
  chemically synthesized
aacctcttgggcggtcacagtt

SEQ ID NO: 1315617 - DNA, 22 bp, Artificial Sequence
  chemically synthesized
tactaggtcaaaactgtgaccg

SEQ ID NO: 1315618 - DNA, 22 bp, Artificial Sequence
  chemically synthesized
actaggtcaaaactgtgaccgc

SEQ ID NO: 1315619 - DNA, 22 bp, Artificial Sequence
  chemically synthesized
ctaggtcaaaactgtgaccgcc

SEQ ID NO: 1315620 - DNA, 22 bp, Artificial Sequence
  chemically synthesized
ggtcaaaactgtgaccgcccaa

SEQ ID NO: 1315621 - DNA, 22 bp, Artificial Sequence
  chemically synthesized
tgaccgcccaagaggttcaact

SEQ ID NO: 1315622 - DNA, 22 bp, Artificial Sequence
  chemically synthesized
tccaggcagcaggcgagttgaa

SEQ ID NO: 1315623 - DNA, 22 bp, Artificial Sequence
  chemically synthesized
tgtccaggcagcaggcgagttg

SEQ ID NO: 1315624 - DNA, 22 bp, Artificial Sequence
  chemically synthesized
atgaatcggctctgtccaggca

SEQ ID NO: 1315625 - DNA, 22 bp, Artificial Sequence
  chemically synthesized
aactcgcctgctgcctggacag

SEQ ID NO: 1315626 - DNA, 22 bp, Artificial Sequence
  chemically synthesized
gatgaatcggctctgtccaggc

SEQ ID NO: 1315627 - DNA, 22 bp, Artificial Sequence
  chemically synthesized
tcttgatgaatcggctctgtcc

SEQ ID NO: 1315628 - DNA, 22 bp, Artificial Sequence
  chemically synthesized
gcctgctgcctggacagagccg

SEQ ID NO: 1315629 - DNA, 22 bp, Artificial Sequence
  chemically synthesized
ccctgtcttgatgaatcggctc

SEQ ID NO: 1315630 - DNA, 22 bp, Artificial Sequence
  chemically synthesized
ctgcctggacagagccgattca

SEQ ID NO: 1315631 - DNA, 22 bp, Artificial Sequence
  chemically synthesized
cctggacagagccgattcatca

SEQ ID NO: 1315632 - DNA, 22 bp, Artificial Sequence
  chemically synthesized
caattcccctgtcttgatgaat

SEQ ID NO: 1315633 - DNA, 22 bp, Artificial Sequence
  chemically synthesized
gacagagccgattcatcaagac

SEQ ID NO: 1315634 - DNA, 22 bp, Artificial Sequence
  chemically synthesized
ttgcaattcccctgtcttgatg

SEQ ID NO: 1315635 - DNA, 22 bp, Artificial Sequence
  chemically synthesized
tattgcaattcccctgtcttga

SEQ ID NO: 1315636 - DNA, 22 bp, Artificial Sequence
  chemically synthesized
tctattgcaattcccctgtctt

SEQ ID NO: 1315637 - DNA, 22 bp, Artificial Sequence
  chemically synthesized
ctctattgcaattcccctgtct

SEQ ID NO: 1315638 - DNA, 22 bp, Artificial Sequence
  chemically synthesized
tctctattgcaattcccctgtc

SEQ ID NO: 1315639 - DNA, 22 bp, Artificial Sequence
  chemically synthesized
tttctctattgcaattcccctg

SEQ ID NO: 1315640 - DNA, 22 bp, Artificial Sequence
  chemically synthesized
ctctttctctattgcaattccc

SEQ ID NO: 1315641 - DNA, 22 bp, Artificial Sequence
  chemically synthesized
atcaagacaggggaattgcaat

SEQ ID NO: 1315642 - DNA, 22 bp, Artificial Sequence
  chemically synthesized
agggagttactctttctctatt

SEQ ID NO: 1315643 - DNA, 22 bp, Artificial Sequence
  chemically synthesized
tgagggagttactctttctcta

SEQ ID NO: 1315644 - DNA, 22 bp, Artificial Sequence
  chemically synthesized
gctctgagggagttactctttc

SEQ ID NO: 1315645 - DNA, 22 bp, Artificial Sequence
  chemically synthesized
caatagagaaagagtaactccc

SEQ ID NO: 1315646 - DNA, 22 bp, Artificial Sequence
  chemically synthesized
ccgcacagctggctctgaggga

SEQ ID NO: 1315647 - DNA, 22 bp, Artificial Sequence
  chemically synthesized
ggtctcccgcacagctggctct

SEQ ID NO: 1315648 - DNA, 22 bp, Artificial Sequence
  chemically synthesized
cggtctcccgcacagctggctc

SEQ ID NO: 1315649 - DNA, 22 bp, Artificial Sequence
  chemically synthesized
cctcagagccagctgtgcggga

SEQ ID NO: 1315650 - DNA, 22 bp, Artificial Sequence
  chemically synthesized
agagccagctgtgcgggagacc

SEQ ID NO: 1315651 - DNA, 22 bp, Artificial Sequence
  chemically synthesized
agtaataataaaacttcggtct

SEQ ID NO: 1315652 - DNA, 22 bp, Artificial Sequence
  chemically synthesized
gagtaataataaaacttcggtc

SEQ ID NO: 1315653 - DNA, 22 bp, Artificial Sequence
  chemically synthesized
atttgagtaataataaaacttc

SEQ ID NO: 1315654 - DNA, 22 bp, Artificial Sequence
  chemically synthesized
tgcgggagaccgaagttttatt

SEQ ID NO: 1315655 - DNA, 22 bp, Artificial Sequence
  chemically synthesized
gggagactgatttgagtaataa

SEQ ID NO: 1315656 - DNA, 22 bp, Artificial Sequence
  chemically synthesized
ggggagactgatttgagtaata

SEQ ID NO: 1315657 - DNA, 22 bp, Artificial Sequence
  chemically synthesized
tattattactcaaatcagtctc

SEQ ID NO: 1315658 - DNA, 22 bp, Artificial Sequence
  chemically synthesized
attattactcaaatcagtctcc

SEQ ID NO: 1315659 - DNA, 22 bp, Artificial Sequence
  chemically synthesized
ttattactcaaatcagtctccc

SEQ ID NO: 1315660 - DNA, 22 bp, Artificial Sequence
  chemically synthesized
cccgaatgcttggggagactga

SEQ ID NO: 1315661 - DNA, 22 bp, Artificial Sequence
  chemically synthesized
ttactcaaatcagtctccccaa

SEQ ID NO: 1315662 - DNA, 22 bp, Artificial Sequence
  chemically synthesized
ctccccgaatgcttggggagac

SEQ ID NO: 1315663 - DNA, 22 bp, Artificial Sequence
  chemically synthesized
tgctccccgaatgcttggggag

SEQ ID NO: 1315664 - DNA, 22 bp, Artificial Sequence
  chemically synthesized
ctcaaatcagtctccccaagca

SEQ ID NO: 1315665 - DNA, 22 bp, Artificial Sequence
  chemically synthesized
aaatcagtctccccaagcattc

SEQ ID NO: 1315666 - DNA, 22 bp, Artificial Sequence
  chemically synthesized
aaaactctgctccccgaatgct

SEQ ID NO: 1315667 - DNA, 22 bp, Artificial Sequence
  chemically synthesized
aaaaactctgctccccgaatgc

SEQ ID NO: 1315668 - DNA, 22 bp, Artificial Sequence
  chemically synthesized
tccttaaaaactctgctccccg

SEQ ID NO: 1315669 - DNA, 22 bp, Artificial Sequence
  chemically synthesized
cccaagcattcggggagcagag

SEQ ID NO: 1315670 - DNA, 22 bp, Artificial Sequence
  chemically synthesized
ggggagcagagtttttaaggat

SEQ ID NO: 1315671 - DNA, 22 bp, Artificial Sequence
  chemically synthesized
cccccacccaccaagttatcct

SEQ ID NO: 1315672 - DNA, 22 bp, Artificial Sequence
  chemically synthesized
ccccccacccaccaagttatcc

SEQ ID NO: 1315673 - DNA, 22 bp, Artificial Sequence
  chemically synthesized
gcttccccccacccaccaagtt

SEQ ID NO: 1315674 - DNA, 22 bp, Artificial Sequence
  chemically synthesized
ttaaggataacttggtgggtgg

SEQ ID NO: 1315675 - DNA, 22 bp, Artificial Sequence
  chemically synthesized
actggcttccccccacccacca

SEQ ID NO: 1315676 - DNA, 22 bp, Artificial Sequence
  chemically synthesized
taaggataacttggtgggtggg

SEQ ID NO: 1315677 - DNA, 22 bp, Artificial Sequence
  chemically synthesized
aaggataacttggtgggtgggg

SEQ ID NO: 1315678 - DNA, 22 bp, Artificial Sequence
  chemically synthesized
aggataacttggtgggtggggg

SEQ ID NO: 1315679 - DNA, 22 bp, Artificial Sequence
  chemically synthesized
gctcactggcttccccccaccc

SEQ ID NO: 1315680 - DNA, 22 bp, Artificial Sequence
  chemically synthesized
ctggctcactggcttcccccca

SEQ ID NO: 1315681 - DNA, 22 bp, Artificial Sequence
  chemically synthesized
ggtgggtggggggaagccagtg

SEQ ID NO: 1315682 - DNA, 22 bp, Artificial Sequence
  chemically synthesized
gtgggtggggggaagccagtga

SEQ ID NO: 1315683 - DNA, 22 bp, Artificial Sequence
  chemically synthesized
accagtcagcactcctggctca

SEQ ID NO: 1315684 - DNA, 22 bp, Artificial Sequence
  chemically synthesized
tgaccagtcagcactcctggct

SEQ ID NO: 1315685 - DNA, 22 bp, Artificial Sequence
  chemically synthesized
atctctgaccagtcagcactcc

SEQ ID NO: 1315686 - DNA, 22 bp, Artificial Sequence
  chemically synthesized
catctctgaccagtcagcactc

SEQ ID NO: 1315687 - DNA, 22 bp, Artificial Sequence
  chemically synthesized
tgatttcatctctgaccagtca

SEQ ID NO: 1315688 - DNA, 22 bp, Artificial Sequence
  chemically synthesized
cctgtgatttcatctctgacca

SEQ ID NO: 1315689 - DNA, 22 bp, Artificial Sequence
  chemically synthesized
cgactccctgtgatttcatctc

SEQ ID NO: 1315690 - DNA, 22 bp, Artificial Sequence
  chemically synthesized
actggtcagagatgaaatcaca

SEQ ID NO: 1315691 - DNA, 22 bp, Artificial Sequence
  chemically synthesized
gtcagagatgaaatcacaggga

SEQ ID NO: 1315692 - DNA, 22 bp, Artificial Sequence
  chemically synthesized
agcgcaagaagacagctccgac

SEQ ID NO: 1315693 - DNA, 22 bp, Artificial Sequence
  chemically synthesized
actcagcgcaagaagacagctc

SEQ ID NO: 1315694 - DNA, 22 bp, Artificial Sequence
  chemically synthesized
cacccaggaactgactcagcgc

SEQ ID NO: 1315695 - DNA, 22 bp, Artificial Sequence
  chemically synthesized
tcttcttgcgctgagtcagttc

SEQ ID NO: 1315696 - DNA, 22 bp, Artificial Sequence
  chemically synthesized
tggcctccacccaggaactgac

SEQ ID NO: 1315697 - DNA, 22 bp, Artificial Sequence
  chemically synthesized
gtggcctccacccaggaactga

SEQ ID NO: 1315698 - DNA, 22 bp, Artificial Sequence
  chemically synthesized
cttgcgctgagtcagttcctgg

SEQ ID NO: 1315699 - DNA, 22 bp, Artificial Sequence
  chemically synthesized
ttgcgctgagtcagttcctggg

SEQ ID NO: 1315700 - DNA, 22 bp, Artificial Sequence
  chemically synthesized
gcgctgagtcagttcctgggtg

SEQ ID NO: 1315701 - DNA, 22 bp, Artificial Sequence
  chemically synthesized
cgctgagtcagttcctgggtgg

SEQ ID NO: 1315702 - DNA, 22 bp, Artificial Sequence
  chemically synthesized
atcttgtggcctccacccagga

SEQ ID NO: 1315703 - DNA, 22 bp, Artificial Sequence
  chemically synthesized
agtcagttcctgggtggaggcc

SEQ ID NO: 1315704 - DNA, 22 bp, Artificial Sequence
  chemically synthesized
atctgatcttgtggcctccacc

SEQ ID NO: 1315705 - DNA, 22 bp, Artificial Sequence
  chemically synthesized
gctcatctgatcttgtggcctc

SEQ ID NO: 1315706 - DNA, 22 bp, Artificial Sequence
  chemically synthesized
ctgggtggaggccacaagatca

SEQ ID NO: 1315707 - DNA, 22 bp, Artificial Sequence
  chemically synthesized
ggtggaggccacaagatcagat

SEQ ID NO: 1315708 - DNA, 22 bp, Artificial Sequence
  chemically synthesized
gcaccacccagatcaataaact

SEQ ID NO: 1315709 - DNA, 22 bp, Artificial Sequence
  chemically synthesized
atggatcagctggcaccaccca

SEQ ID NO: 1315710 - DNA, 22 bp, Artificial Sequence
  chemically synthesized
gatggatcagctggcaccaccc

SEQ ID NO: 1315711 - DNA, 22 bp, Artificial Sequence
  chemically synthesized
attgatctgggtggtgccagct

SEQ ID NO: 1315712 - DNA, 22 bp, Artificial Sequence
  chemically synthesized
ttgatctgggtggtgccagctg

SEQ ID NO: 1315713 - DNA, 22 bp, Artificial Sequence
  chemically synthesized
cacttgatggatcagctggcac

SEQ ID NO: 1315714 - DNA, 22 bp, Artificial Sequence
  chemically synthesized
atctgggtggtgccagctgatc

SEQ ID NO: 1315715 - DNA, 22 bp, Artificial Sequence
  chemically synthesized
ggtggtgccagctgatccatca

SEQ ID NO: 1315716 - DNA, 22 bp, Artificial Sequence
  chemically synthesized
cagaccctgcacttgatggatc

SEQ ID NO: 1315717 - DNA, 22 bp, Artificial Sequence
  chemically synthesized
gcagaccctgcacttgatggat

SEQ ID NO: 1315718 - DNA, 22 bp, Artificial Sequence
  chemically synthesized
tgcagaccctgcacttgatgga

SEQ ID NO: 1315719 - DNA, 22 bp, Artificial Sequence
  chemically synthesized
agatattttgcagaccctgcac

SEQ ID NO: 1315720 - DNA, 22 bp, Artificial Sequence
  chemically synthesized
gagatattttgcagaccctgca

SEQ ID NO: 1315721 - DNA, 22 bp, Artificial Sequence
  chemically synthesized
atccatcaagtgcagggtctgc

SEQ ID NO: 1315722 - DNA, 22 bp, Artificial Sequence
  chemically synthesized
agatcagtgcttgagatatttt

SEQ ID NO: 1315723 - DNA, 22 bp, Artificial Sequence
  chemically synthesized
ctaagatcagtgcttgagatat

SEQ ID NO: 1315724 - DNA, 22 bp, Artificial Sequence
  chemically synthesized
ctcctaagatcagtgcttgaga

SEQ ID NO: 1315725 - DNA, 22 bp, Artificial Sequence
  chemically synthesized
caaaatatctcaagcactgatc

SEQ ID NO: 1315726 - DNA, 22 bp, Artificial Sequence
  chemically synthesized
acccccaccaaactgctcctaa

SEQ ID NO: 1315727 - DNA, 22 bp, Artificial Sequence
  chemically synthesized
aagcactgatcttaggagcagt

SEQ ID NO: 1315728 - DNA, 22 bp, Artificial Sequence
  chemically synthesized
tgacccccaccaaactgctcct

SEQ ID NO: 1315729 - DNA, 22 bp, Artificial Sequence
  chemically synthesized
atcttaggagcagtttggtggg

SEQ ID NO: 1315730 - DNA, 22 bp, Artificial Sequence
  chemically synthesized
aggagcagtttggtgggggtca

SEQ ID NO: 1315731 - DNA, 22 bp, Artificial Sequence
  chemically synthesized
ggagcagtttggtgggggtcag

SEQ ID NO: 1315732 - DNA, 22 bp, Artificial Sequence
  chemically synthesized
gaggcaacaagattctgacccc

SEQ ID NO: 1315733 - DNA, 22 bp, Artificial Sequence
  chemically synthesized
ggtgggggtcagaatcttgttg

SEQ ID NO: 1315734 - DNA, 22 bp, Artificial Sequence
  chemically synthesized
gtgggggtcagaatcttgttgc

SEQ ID NO: 1315735 - DNA, 22 bp, Artificial Sequence
  chemically synthesized
ggagtcatgcagctggaggcaa

SEQ ID NO: 1315736 - DNA, 22 bp, Artificial Sequence
  chemically synthesized
aggagtcatgcagctggaggca

SEQ ID NO: 1315737 - DNA, 22 bp, Artificial Sequence
  chemically synthesized
tggtttaggagtcatgcagctg

SEQ ID NO: 1315738 - DNA, 22 bp, Artificial Sequence
  chemically synthesized
gttgcctccagctgcatgactc

SEQ ID NO: 1315739 - DNA, 22 bp, Artificial Sequence
  chemically synthesized
ttgcctccagctgcatgactcc

SEQ ID NO: 1315740 - DNA, 22 bp, Artificial Sequence
  chemically synthesized
gaaattatggtttaggagtcat

SEQ ID NO: 1315741 - DNA, 22 bp, Artificial Sequence
  chemically synthesized
cctccagctgcatgactcctaa

SEQ ID NO: 1315742 - DNA, 22 bp, Artificial Sequence
  chemically synthesized
cagctgcatgactcctaaacca

SEQ ID NO: 1315743 - DNA, 22 bp, Artificial Sequence
  chemically synthesized
catgactcctaaaccataattt

SEQ ID NO: 1315744 - DNA, 22 bp, Artificial Sequence
  chemically synthesized
acatcagccacagtgttagaaa

SEQ ID NO: 1315745 - DNA, 22 bp, Artificial Sequence
  chemically synthesized
ctaaaccataatttctaacact

SEQ ID NO: 1315746 - DNA, 22 bp, Artificial Sequence
  chemically synthesized
aaccataatttctaacactgtg

SEQ ID NO: 1315747 - DNA, 22 bp, Artificial Sequence
  chemically synthesized
taggactaacatcagccacagt

SEQ ID NO: 1315748 - DNA, 22 bp, Artificial Sequence
  chemically synthesized
gtaggactaacatcagccacag

SEQ ID NO: 1315749 - DNA, 22 bp, Artificial Sequence
  chemically synthesized
cgtttgtaggactaacatcagc

SEQ ID NO: 1315750 - DNA, 22 bp, Artificial Sequence
  chemically synthesized
ctaacactgtggctgatgttag

SEQ ID NO: 1315751 - DNA, 22 bp, Artificial Sequence
  chemically synthesized
gcgtttgtaggactaacatcag

SEQ ID NO: 1315752 - DNA, 22 bp, Artificial Sequence
  chemically synthesized
taacactgtggctgatgttagt

SEQ ID NO: 1315753 - DNA, 22 bp, Artificial Sequence
  chemically synthesized
acactgtggctgatgttagtcc

SEQ ID NO: 1315754 - DNA, 22 bp, Artificial Sequence
  chemically synthesized
ggacttgcgtttgtaggactaa

SEQ ID NO: 1315755 - DNA, 22 bp, Artificial Sequence
  chemically synthesized
tggctgatgttagtcctacaaa

SEQ ID NO: 1315756 - DNA, 22 bp, Artificial Sequence
  chemically synthesized
cctgggacttgcgtttgtagga

SEQ ID NO: 1315757 - DNA, 22 bp, Artificial Sequence
  chemically synthesized
gcctgggacttgcgtttgtagg

SEQ ID NO: 1315758 - DNA, 22 bp, Artificial Sequence
  chemically synthesized
ttgcctgggacttgcgtttgta

SEQ ID NO: 1315759 - DNA, 22 bp, Artificial Sequence
  chemically synthesized
cttgcctgggacttgcgtttgt

SEQ ID NO: 1315760 - DNA, 22 bp, Artificial Sequence
  chemically synthesized
atgttagtcctacaaacgcaag

SEQ ID NO: 1315761 - DNA, 22 bp, Artificial Sequence
  chemically synthesized
cttcttgcctgggacttgcgtt

SEQ ID NO: 1315762 - DNA, 22 bp, Artificial Sequence
  chemically synthesized
gtcctacaaacgcaagtcccag

SEQ ID NO: 1315763 - DNA, 22 bp, Artificial Sequence
  chemically synthesized
caaacgcaagtcccaggcaaga

SEQ ID NO: 1315764 - DNA, 22 bp, Artificial Sequence
  chemically synthesized
ccagagcaaaattccttcttgc

SEQ ID NO: 1315765 - DNA, 22 bp, Artificial Sequence
  chemically synthesized
cccagagcaaaattccttcttg

SEQ ID NO: 1315766 - DNA, 22 bp, Artificial Sequence
  chemically synthesized
tcccagagcaaaattccttctt

SEQ ID NO: 1315767 - DNA, 22 bp, Artificial Sequence
  chemically synthesized
aagatggtaacagccctttccc

SEQ ID NO: 1315768 - DNA, 22 bp, Artificial Sequence
  chemically synthesized
aaagatggtaacagccctttcc

SEQ ID NO: 1315769 - DNA, 22 bp, Artificial Sequence
  chemically synthesized
tgctctgggaaagggctgttac

SEQ ID NO: 1315770 - DNA, 22 bp, Artificial Sequence
  chemically synthesized
gctctgggaaagggctgttacc

SEQ ID NO: 1315771 - DNA, 22 bp, Artificial Sequence
  chemically synthesized
cagtttaaagatggtaacagcc

SEQ ID NO: 1315772 - DNA, 22 bp, Artificial Sequence
  chemically synthesized
ctctgggaaagggctgttacca

SEQ ID NO: 1315773 - DNA, 22 bp, Artificial Sequence
  chemically synthesized
acagtttaaagatggtaacagc

SEQ ID NO: 1315774 - DNA, 22 bp, Artificial Sequence
  chemically synthesized
tgggaaagggctgttaccatct

SEQ ID NO: 1315775 - DNA, 22 bp, Artificial Sequence
  chemically synthesized
gtttacagtttaaagatggtaa

SEQ ID NO: 1315776 - DNA, 22 bp, Artificial Sequence
  chemically synthesized
ggaaagggctgttaccatcttt

SEQ ID NO: 1315777 - DNA, 22 bp, Artificial Sequence
  chemically synthesized
agtttacagtttaaagatggta

SEQ ID NO: 1315778 - DNA, 22 bp, Artificial Sequence
  chemically synthesized
ggagaaacttagtttacagttt

SEQ ID NO: 1315779 - DNA, 22 bp, Artificial Sequence
  chemically synthesized
ttaccatctttaaactgtaaac

SEQ ID NO: 1315780 - DNA, 22 bp, Artificial Sequence
  chemically synthesized
gggagaaacttagtttacagtt

SEQ ID NO: 1315781 - DNA, 22 bp, Artificial Sequence
  chemically synthesized
tgggagaaacttagtttacagt

SEQ ID NO: 1315782 - DNA, 22 bp, Artificial Sequence
  chemically synthesized
ccatctttaaactgtaaactaa

SEQ ID NO: 1315783 - DNA, 22 bp, Artificial Sequence
  chemically synthesized
actttgggagaaacttagttta

SEQ ID NO: 1315784 - DNA, 22 bp, Artificial Sequence
  chemically synthesized
taaactgtaaactaagtttctc

SEQ ID NO: 1315785 - DNA, 22 bp, Artificial Sequence
  chemically synthesized
aactaactttgggagaaactta

SEQ ID NO: 1315786 - DNA, 22 bp, Artificial Sequence
  chemically synthesized
aaactgtaaactaagtttctcc

SEQ ID NO: 1315787 - DNA, 22 bp, Artificial Sequence
  chemically synthesized
aactgtaaactaagtttctccc

SEQ ID NO: 1315788 - DNA, 22 bp, Artificial Sequence
  chemically synthesized
taaactaagtttctcccaaagt

SEQ ID NO: 1315789 - DNA, 22 bp, Artificial Sequence
  chemically synthesized
ggcataggctgaactaactttg

SEQ ID NO: 1315790 - DNA, 22 bp, Artificial Sequence
  chemically synthesized
agtttctcccaaagttagttca

SEQ ID NO: 1315791 - DNA, 22 bp, Artificial Sequence
  chemically synthesized
ctgggcataggctgaactaact

SEQ ID NO: 1315792 - DNA, 22 bp, Artificial Sequence
  chemically synthesized
attcctgggcataggctgaact

SEQ ID NO: 1315793 - DNA, 22 bp, Artificial Sequence
  chemically synthesized
ctcccaaagttagttcagccta

SEQ ID NO: 1315794 - DNA, 22 bp, Artificial Sequence
  chemically synthesized
tcccaaagttagttcagcctat

SEQ ID NO: 1315795 - DNA, 22 bp, Artificial Sequence
  chemically synthesized
ccaaagttagttcagcctatgc

SEQ ID NO: 1315796 - DNA, 22 bp, Artificial Sequence
  chemically synthesized
gttcattcctgggcataggctg

SEQ ID NO: 1315797 - DNA, 22 bp, Artificial Sequence
  chemically synthesized
cgttcattcctgggcataggct

SEQ ID NO: 1315798 - DNA, 22 bp, Artificial Sequence
  chemically synthesized
tcttcgttcattcctgggcata

SEQ ID NO: 1315799 - DNA, 22 bp, Artificial Sequence
  chemically synthesized
gttcagcctatgcccaggaatg

SEQ ID NO: 1315800 - DNA, 22 bp, Artificial Sequence
  chemically synthesized
caagctgtcttcgttcattcct

SEQ ID NO: 1315801 - DNA, 22 bp, Artificial Sequence
  chemically synthesized
agcctatgcccaggaatgaacg

SEQ ID NO: 1315802 - DNA, 22 bp, Artificial Sequence
  chemically synthesized
acctccaagctgtcttcgttca

SEQ ID NO: 1315803 - DNA, 22 bp, Artificial Sequence
  chemically synthesized
tgcccaggaatgaacgaagaca

SEQ ID NO: 1315804 - DNA, 22 bp, Artificial Sequence
  chemically synthesized
taacctccaagctgtcttcgtt

SEQ ID NO: 1315805 - DNA, 22 bp, Artificial Sequence
  chemically synthesized
ctaacctccaagctgtcttcgt

SEQ ID NO: 1315806 - DNA, 22 bp, Artificial Sequence
  chemically synthesized
cttctaacctccaagctgtctt

SEQ ID NO: 1315807 - DNA, 22 bp, Artificial Sequence
  chemically synthesized
gcttctaacctccaagctgtct

SEQ ID NO: 1315808 - DNA, 22 bp, Artificial Sequence
  chemically synthesized
catcttgcttctaacctccaag

SEQ ID NO: 1315809 - DNA, 22 bp, Artificial Sequence
  chemically synthesized
actccatcttgcttctaacctc

SEQ ID NO: 1315810 - DNA, 22 bp, Artificial Sequence
  chemically synthesized
actgactccatcttgcttctaa

SEQ ID NO: 1315811 - DNA, 22 bp, Artificial Sequence
  chemically synthesized
aactgactccatcttgcttcta

SEQ ID NO: 1315812 - DNA, 22 bp, Artificial Sequence
  chemically synthesized
acttaactgactccatcttgct

SEQ ID NO: 1315813 - DNA, 22 bp, Artificial Sequence
  chemically synthesized
ggaggttagaagcaagatggag

SEQ ID NO: 1315814 - DNA, 22 bp, Artificial Sequence
  chemically synthesized
gaggttagaagcaagatggagt

SEQ ID NO: 1315815 - DNA, 22 bp, Artificial Sequence
  chemically synthesized
gaagcaagatggagtcagttaa

SEQ ID NO: 1315816 - DNA, 22 bp, Artificial Sequence
  chemically synthesized
agacagtgaaaacaatctaact

SEQ ID NO: 1315817 - DNA, 22 bp, Artificial Sequence
  chemically synthesized
ggtctgagacagtgaaaacaat

SEQ ID NO: 1315818 - DNA, 22 bp, Artificial Sequence
  chemically synthesized
agttagattgttttcactgtct

SEQ ID NO: 1315819 - DNA, 22 bp, Artificial Sequence
  chemically synthesized
caaaattaggtctgagacagtg

SEQ ID NO: 1315820 - DNA, 22 bp, Artificial Sequence
  chemically synthesized
gcaaaattaggtctgagacagt

SEQ ID NO: 1315821 - DNA, 22 bp, Artificial Sequence
  chemically synthesized
tgcaaaattaggtctgagacag

SEQ ID NO: 1315822 - DNA, 22 bp, Artificial Sequence
  chemically synthesized
gattgttttcactgtctcagac

SEQ ID NO: 1315823 - DNA, 22 bp, Artificial Sequence
  chemically synthesized
ttttcactgtctcagacctaat

SEQ ID NO: 1315824 - DNA, 22 bp, Artificial Sequence
  chemically synthesized
tcactgtctcagacctaatttt

SEQ ID NO: 1315825 - DNA, 22 bp, Artificial Sequence
  chemically synthesized
cactgtctcagacctaattttg

SEQ ID NO: 1315826 - DNA, 22 bp, Artificial Sequence
  chemically synthesized
aaaccacctttgcaaaattagg

SEQ ID NO: 1315827 - DNA, 22 bp, Artificial Sequence
  chemically synthesized
actgtctcagacctaattttgc

SEQ ID NO: 1315828 - DNA, 22 bp, Artificial Sequence
  chemically synthesized
tctcagacctaattttgcaaag

SEQ ID NO: 1315829 - DNA, 22 bp, Artificial Sequence
  chemically synthesized
agacctaattttgcaaaggtgg

SEQ ID NO: 1315830 - DNA, 22 bp, Artificial Sequence
  chemically synthesized
attttgcaaaggtggtttcaat

SEQ ID NO: 1315831 - DNA, 22 bp, Artificial Sequence
  chemically synthesized
tgcaaaggtggtttcaatccct

SEQ ID NO: 1315832 - DNA, 22 bp, Artificial Sequence
  chemically synthesized
gcaaaggtggtttcaatccctt

SEQ ID NO: 1315833 - DNA, 22 bp, Artificial Sequence
  chemically synthesized
caaaggtggtttcaatcccttc

SEQ ID NO: 1315834 - DNA, 22 bp, Artificial Sequence
  chemically synthesized
gaaaacccaaaggaagggattg

SEQ ID NO: 1315835 - DNA, 22 bp, Artificial Sequence
  chemically synthesized
aagtgttagaaaacccaaagga

SEQ ID NO: 1315836 - DNA, 22 bp, Artificial Sequence
  chemically synthesized
caatcccttcctttgggttttc

SEQ ID NO: 1315837 - DNA, 22 bp, Artificial Sequence
  chemically synthesized
aatcccttcctttgggttttct

SEQ ID NO: 1315838 - DNA, 22 bp, Artificial Sequence
  chemically synthesized
gggttaaagtgttagaaaaccc

SEQ ID NO: 1315839 - DNA, 22 bp, Artificial Sequence
  chemically synthesized
agggttaaagtgttagaaaacc

SEQ ID NO: 1315840 - DNA, 22 bp, Artificial Sequence
  chemically synthesized
cctttgggttttctaacacttt

SEQ ID NO: 1315841 - DNA, 22 bp, Artificial Sequence
  chemically synthesized
taccttagggttaaagtgttag

SEQ ID NO: 1315842 - DNA, 22 bp, Artificial Sequence
  chemically synthesized
ctttgggttttctaacacttta

SEQ ID NO: 1315843 - DNA, 22 bp, Artificial Sequence
  chemically synthesized
tgggttttctaacactttaacc

SEQ ID NO: 1315844 - DNA, 22 bp, Artificial Sequence
  chemically synthesized
gggttttctaacactttaaccc

SEQ ID NO: 1315845 - DNA, 22 bp, Artificial Sequence
  chemically synthesized
ggttttctaacactttaaccct

SEQ ID NO: 1315846 - DNA, 22 bp, Artificial Sequence
  chemically synthesized
tagcctataccttagggttaaa

SEQ ID NO: 1315847 - DNA, 22 bp, Artificial Sequence
  chemically synthesized
atagcctataccttagggttaa

SEQ ID NO: 1315848 - DNA, 22 bp, Artificial Sequence
  chemically synthesized
tatagcctataccttagggtta

SEQ ID NO: 1315849 - DNA, 22 bp, Artificial Sequence
  chemically synthesized
tctaacactttaaccctaaggt

SEQ ID NO: 1315850 - DNA, 22 bp, Artificial Sequence
  chemically synthesized
ctaacactttaaccctaaggta

SEQ ID NO: 1315851 - DNA, 22 bp, Artificial Sequence
  chemically synthesized
taacactttaaccctaaggtat

SEQ ID NO: 1315852 - DNA, 22 bp, Artificial Sequence
  chemically synthesized
acactttaaccctaaggtatag

SEQ ID NO: 1315853 - DNA, 22 bp, Artificial Sequence
  chemically synthesized
ccatctttatagcctatacctt

SEQ ID NO: 1315854 - DNA, 22 bp, Artificial Sequence
  chemically synthesized
cccatctttatagcctatacct

SEQ ID NO: 1315855 - DNA, 22 bp, Artificial Sequence
  chemically synthesized
tcccatctttatagcctatacc

SEQ ID NO: 1315856 - DNA, 22 bp, Artificial Sequence
  chemically synthesized
ttcccatctttatagcctatac

SEQ ID NO: 1315857 - DNA, 22 bp, Artificial Sequence
  chemically synthesized
taaccctaaggtataggctata

SEQ ID NO: 1315858 - DNA, 22 bp, Artificial Sequence
  chemically synthesized
aaccctaaggtataggctataa

SEQ ID NO: 1315859 - DNA, 22 bp, Artificial Sequence
  chemically synthesized
accctaaggtataggctataaa

SEQ ID NO: 1315860 - DNA, 22 bp, Artificial Sequence
  chemically synthesized
aggtataggctataaagatggg

SEQ ID NO: 1315861 - DNA, 22 bp, Artificial Sequence
  chemically synthesized
taaagatgggaaaaggccgtcg

SEQ ID NO: 1315862 - DNA, 22 bp, Artificial Sequence
  chemically synthesized
ccccatcagcaggaagaagcca

SEQ ID NO: 1315863 - DNA, 22 bp, Artificial Sequence
  chemically synthesized
cccccatcagcaggaagaagcc

SEQ ID NO: 1315864 - DNA, 22 bp, Artificial Sequence
  chemically synthesized
cttcccccatcagcaggaagaa

SEQ ID NO: 1315865 - DNA, 22 bp, Artificial Sequence
  chemically synthesized
ccgctacttcccccatcagcag

SEQ ID NO: 1315866 - DNA, 22 bp, Artificial Sequence
  chemically synthesized
tggcttcttcctgctgatgggg

SEQ ID NO: 1315867 - DNA, 22 bp, Artificial Sequence
  chemically synthesized
gcttcttcctgctgatggggga

SEQ ID NO: 1315868 - DNA, 22 bp, Artificial Sequence
  chemically synthesized
ccattcccgctacttcccccat

SEQ ID NO: 1315869 - DNA, 22 bp, Artificial Sequence
  chemically synthesized
cttcctgctgatgggggaagta

SEQ ID NO: 1315870 - DNA, 22 bp, Artificial Sequence
  chemically synthesized
ttcctgctgatgggggaagtag

SEQ ID NO: 1315871 - DNA, 22 bp, Artificial Sequence
  chemically synthesized
gttcccattcccgctacttccc

SEQ ID NO: 1315872 - DNA, 22 bp, Artificial Sequence
  chemically synthesized
cctgctgatgggggaagtagcg

SEQ ID NO: 1315873 - DNA, 22 bp, Artificial Sequence
  chemically synthesized
ctgctgatgggggaagtagcgg

SEQ ID NO: 1315874 - DNA, 22 bp, Artificial Sequence
  chemically synthesized
ctgatgggggaagtagcgggaa

SEQ ID NO: 1315875 - DNA, 22 bp, Artificial Sequence
  chemically synthesized
gagttcgttcccattcccgcta

SEQ ID NO: 1315876 - DNA, 22 bp, Artificial Sequence
  chemically synthesized
ggagttcgttcccattcccgct

SEQ ID NO: 1315877 - DNA, 22 bp, Artificial Sequence
  chemically synthesized
atgggggaagtagcgggaatgg

SEQ ID NO: 1315878 - DNA, 22 bp, Artificial Sequence
  chemically synthesized
accttggagttcgttcccattc

SEQ ID NO: 1315879 - DNA, 22 bp, Artificial Sequence
  chemically synthesized
tcaccttggagttcgttcccat

SEQ ID NO: 1315880 - DNA, 22 bp, Artificial Sequence
  chemically synthesized
ctcaccttggagttcgttccca

SEQ ID NO: 1315881 - DNA, 22 bp, Artificial Sequence
  chemically synthesized
ttctcaccttggagttcgttcc

SEQ ID NO: 1315882 - DNA, 22 bp, Artificial Sequence
  chemically synthesized
cactcttctcaccttggagttc

SEQ ID NO: 1315883 - DNA, 22 bp, Artificial Sequence
  chemically synthesized
caaagcagttccactcttctca

SEQ ID NO: 1315884 - DNA, 22 bp, Artificial Sequence
  chemically synthesized
caaggtgagaagagtggaactg

SEQ ID NO: 1315885 - DNA, 22 bp, Artificial Sequence
  chemically synthesized
aaacagttgcaaagcagttcca

SEQ ID NO: 1315886 - DNA, 22 bp, Artificial Sequence
  chemically synthesized
catgaatccactcaaacagttg

SEQ ID NO: 1315887 - DNA, 22 bp, Artificial Sequence
  chemically synthesized
ggcctgcatgaatccactcaaa

SEQ ID NO: 1315888 - DNA, 22 bp, Artificial Sequence
  chemically synthesized
ctttgcaactgtttgagtggat

SEQ ID NO: 1315889 - DNA, 22 bp, Artificial Sequence
  chemically synthesized
tgcaactgtttgagtggattca

SEQ ID NO: 1315890 - DNA, 22 bp, Artificial Sequence
  chemically synthesized
gcaactgtttgagtggattcat

SEQ ID NO: 1315891 - DNA, 22 bp, Artificial Sequence
  chemically synthesized
caactgtttgagtggattcatg

SEQ ID NO: 1315892 - DNA, 22 bp, Artificial Sequence
  chemically synthesized
tttgagtggattcatgcaggcc

SEQ ID NO: 1315893 - DNA, 22 bp, Artificial Sequence
  chemically synthesized
gaagcccaattaggcctgcatg

SEQ ID NO: 1315894 - DNA, 22 bp, Artificial Sequence
  chemically synthesized
ggaagcccaattaggcctgcat

SEQ ID NO: 1315895 - DNA, 22 bp, Artificial Sequence
  chemically synthesized
gagtggattcatgcaggcctaa

SEQ ID NO: 1315896 - DNA, 22 bp, Artificial Sequence
  chemically synthesized
agtggattcatgcaggcctaat

SEQ ID NO: 1315897 - DNA, 22 bp, Artificial Sequence
  chemically synthesized
atgcaggcctaattgggcttcc

SEQ ID NO: 1315898 - DNA, 22 bp, Artificial Sequence
  chemically synthesized
ccacgcaagccttggaagccca

SEQ ID NO: 1315899 - DNA, 22 bp, Artificial Sequence
  chemically synthesized
tgccacgcaagccttggaagcc

SEQ ID NO: 1315900 - DNA, 22 bp, Artificial Sequence
  chemically synthesized
ctgccacgcaagccttggaagc

SEQ ID NO: 1315901 - DNA, 22 bp, Artificial Sequence
  chemically synthesized
attgggcttccaaggcttgcgt

SEQ ID NO: 1315902 - DNA, 22 bp, Artificial Sequence
  chemically synthesized
ggcttccaaggcttgcgtggca

SEQ ID NO: 1315903 - DNA, 22 bp, Artificial Sequence
  chemically synthesized
ccaaggcttgcgtggcagaaac

SEQ ID NO: 1315904 - DNA, 22 bp, Artificial Sequence
  chemically synthesized
caaggcttgcgtggcagaaaca

SEQ ID NO: 1315905 - DNA, 22 bp, Artificial Sequence
  chemically synthesized
tagatgagagtaataatgtttc

SEQ ID NO: 1315906 - DNA, 22 bp, Artificial Sequence
  chemically synthesized
gcgtggcagaaacattattact

SEQ ID NO: 1315907 - DNA, 22 bp, Artificial Sequence
  chemically synthesized
cgtggcagaaacattattactc

SEQ ID NO: 1315908 - DNA, 22 bp, Artificial Sequence
  chemically synthesized
tagtaaaactatagatgagagt

SEQ ID NO: 1315909 - DNA, 22 bp, Artificial Sequence
  chemically synthesized
ttactctcatctatagttttac

SEQ ID NO: 1315910 - DNA, 22 bp, Artificial Sequence
  chemically synthesized
acataaacactgtagtaaaact

SEQ ID NO: 1315911 - DNA, 22 bp, Artificial Sequence
  chemically synthesized
ctctcatctatagttttactac

SEQ ID NO: 1315912 - DNA, 22 bp, Artificial Sequence
  chemically synthesized
ttcacataaacactgtagtaaa

SEQ ID NO: 1315913 - DNA, 22 bp, Artificial Sequence
  chemically synthesized
tcatctatagttttactacagt

SEQ ID NO: 1315914 - DNA, 22 bp, Artificial Sequence
  chemically synthesized
atctatagttttactacagtgt

SEQ ID NO: 1315915 - DNA, 22 bp, Artificial Sequence
  chemically synthesized
tagttttactacagtgtttatg

SEQ ID NO: 1315916 - DNA, 22 bp, Artificial Sequence
  chemically synthesized
tagtaggctattcacataaaca

SEQ ID NO: 1315917 - DNA, 22 bp, Artificial Sequence
  chemically synthesized
atagtaggctattcacataaac

SEQ ID NO: 1315918 - DNA, 22 bp, Artificial Sequence
  chemically synthesized
tactacagtgtttatgtgaata

SEQ ID NO: 1315919 - DNA, 22 bp, Artificial Sequence
  chemically synthesized
actacagtgtttatgtgaatag

SEQ ID NO: 1315920 - DNA, 22 bp, Artificial Sequence
  chemically synthesized
ctacagtgtttatgtgaatagc

SEQ ID NO: 1315921 - DNA, 22 bp, Artificial Sequence
  chemically synthesized
taccttatagtaggctattcac

SEQ ID NO: 1315922 - DNA, 22 bp, Artificial Sequence
  chemically synthesized
cagtgtttatgtgaatagccta

SEQ ID NO: 1315923 - DNA, 22 bp, Artificial Sequence
  chemically synthesized
attataccttatagtaggctat

SEQ ID NO: 1315924 - DNA, 22 bp, Artificial Sequence
  chemically synthesized
atgtgaatagcctactataagg

SEQ ID NO: 1315925 - DNA, 22 bp, Artificial Sequence
  chemically synthesized
ggactcattataccttatagta

SEQ ID NO: 1315926 - DNA, 22 bp, Artificial Sequence
  chemically synthesized
tgtgaatagcctactataaggt

SEQ ID NO: 1315927 - DNA, 22 bp, Artificial Sequence
  chemically synthesized
atcctaggactcattatacctt

SEQ ID NO: 1315928 - DNA, 22 bp, Artificial Sequence
  chemically synthesized
tcatcctaggactcattatacc

SEQ ID NO: 1315929 - DNA, 22 bp, Artificial Sequence
  chemically synthesized
ctcatcctaggactcattatac

SEQ ID NO: 1315930 - DNA, 22 bp, Artificial Sequence
  chemically synthesized
ctataaggtataatgagtccta

SEQ ID NO: 1315931 - DNA, 22 bp, Artificial Sequence
  chemically synthesized
tacttctcatcctaggactcat

SEQ ID NO: 1315932 - DNA, 22 bp, Artificial Sequence
  chemically synthesized
taaggtataatgagtcctagga

SEQ ID NO: 1315933 - DNA, 22 bp, Artificial Sequence
  chemically synthesized
ggaattgtacttctcatcctag

SEQ ID NO: 1315934 - DNA, 22 bp, Artificial Sequence
  chemically synthesized
aaattgggaattgtacttctca

SEQ ID NO: 1315935 - DNA, 22 bp, Artificial Sequence
  chemically synthesized
aaaattgggaattgtacttctc

SEQ ID NO: 1315936 - DNA, 22 bp, Artificial Sequence
  chemically synthesized
taaaattgggaattgtacttct

SEQ ID NO: 1315937 - DNA, 22 bp, Artificial Sequence
  chemically synthesized
ttaaaattgggaattgtacttc

SEQ ID NO: 1315938 - DNA, 22 bp, Artificial Sequence
  chemically synthesized
cttttaaaattgggaattgtac

SEQ ID NO: 1315939 - DNA, 22 bp, Artificial Sequence
  chemically synthesized
gcttttaaaattgggaattgta

SEQ ID NO: 1315940 - DNA, 22 bp, Artificial Sequence
  chemically synthesized
ggatgagaagtacaattcccaa

SEQ ID NO: 1315941 - DNA, 22 bp, Artificial Sequence
  chemically synthesized
aaatgtttgcttttaaaattgg

SEQ ID NO: 1315942 - DNA, 22 bp, Artificial Sequence
  chemically synthesized
caaatgtttgcttttaaaattg

SEQ ID NO: 1315943 - DNA, 22 bp, Artificial Sequence
  chemically synthesized
atgatttcaaatgtttgctttt

SEQ ID NO: 1315944 - DNA, 22 bp, Artificial Sequence
  chemically synthesized
ccaattttaaaagcaaacattt

SEQ ID NO: 1315945 - DNA, 22 bp, Artificial Sequence
  chemically synthesized
ccaaactaatgatttcaaatgt

SEQ ID NO: 1315946 - DNA, 22 bp, Artificial Sequence
  chemically synthesized
taaaagcaaacatttgaaatca

SEQ ID NO: 1315947 - DNA, 22 bp, Artificial Sequence
  chemically synthesized
aaaagcaaacatttgaaatcat

SEQ ID NO: 1315948 - DNA, 22 bp, Artificial Sequence
  chemically synthesized
aaagcaaacatttgaaatcatt

SEQ ID NO: 1315949 - DNA, 22 bp, Artificial Sequence
  chemically synthesized
gaagttcccaaactaatgattt

SEQ ID NO: 1315950 - DNA, 22 bp, Artificial Sequence
  chemically synthesized
tgggttagaagttcccaaacta

SEQ ID NO: 1315951 - DNA, 22 bp, Artificial Sequence
  chemically synthesized
gtgggttagaagttcccaaact

SEQ ID NO: 1315952 - DNA, 22 bp, Artificial Sequence
  chemically synthesized
gaaatcattagtttgggaactt

SEQ ID NO: 1315953 - DNA, 22 bp, Artificial Sequence
  chemically synthesized
tttgtgggttagaagttcccaa

SEQ ID NO: 1315954 - DNA, 22 bp, Artificial Sequence
  chemically synthesized
aaatcattagtttgggaacttc

SEQ ID NO: 1315955 - DNA, 22 bp, Artificial Sequence
  chemically synthesized
aattgtttgtgggttagaagtt

SEQ ID NO: 1315956 - DNA, 22 bp, Artificial Sequence
  chemically synthesized
taaattgtttgtgggttagaag

SEQ ID NO: 1315957 - DNA, 22 bp, Artificial Sequence
  chemically synthesized
gtttgggaacttctaacccaca

SEQ ID NO: 1315958 - DNA, 22 bp, Artificial Sequence
  chemically synthesized
aattctaaattgtttgtgggtt

SEQ ID NO: 1315959 - DNA, 22 bp, Artificial Sequence
  chemically synthesized
gggaacttctaacccacaaaca

SEQ ID NO: 1315960 - DNA, 22 bp, Artificial Sequence
  chemically synthesized
ggaacttctaacccacaaacaa

SEQ ID NO: 1315961 - DNA, 22 bp, Artificial Sequence
  chemically synthesized
gactaaattctaaattgtttgt

SEQ ID NO: 1315962 - DNA, 22 bp, Artificial Sequence
  chemically synthesized
agactaaattctaaattgtttg

SEQ ID NO: 1315963 - DNA, 22 bp, Artificial Sequence
  chemically synthesized
ctaacccacaaacaatttagaa

SEQ ID NO: 1315964 - DNA, 22 bp, Artificial Sequence
  chemically synthesized
taacccacaaacaatttagaat

SEQ ID NO: 1315965 - DNA, 22 bp, Artificial Sequence
  chemically synthesized
agtttagactaaattctaaatt

SEQ ID NO: 1315966 - DNA, 22 bp, Artificial Sequence
  chemically synthesized
cagtttagactaaattctaaat

SEQ ID NO: 1315967 - DNA, 22 bp, Artificial Sequence
  chemically synthesized
acccacaaacaatttagaattt

SEQ ID NO: 1315968 - DNA, 22 bp, Artificial Sequence
  chemically synthesized
ttcagtttagactaaattctaa

SEQ ID NO: 1315969 - DNA, 22 bp, Artificial Sequence
  chemically synthesized
attcttcagtttagactaaatt

SEQ ID NO: 1315970 - DNA, 22 bp, Artificial Sequence
  chemically synthesized
aggttaattcttcagtttagac

SEQ ID NO: 1315971 - DNA, 22 bp, Artificial Sequence
  chemically synthesized
gaggttaattcttcagtttaga

SEQ ID NO: 1315972 - DNA, 22 bp, Artificial Sequence
  chemically synthesized
ttgaggttaattcttcagttta

SEQ ID NO: 1315973 - DNA, 22 bp, Artificial Sequence
  chemically synthesized
agaatttagtctaaactgaaga

SEQ ID NO: 1315974 - DNA, 22 bp, Artificial Sequence
  chemically synthesized
gaatttagtctaaactgaagaa

SEQ ID NO: 1315975 - DNA, 22 bp, Artificial Sequence
  chemically synthesized
ttcttgaggttaattcttcagt

SEQ ID NO: 1315976 - DNA, 22 bp, Artificial Sequence
  chemically synthesized
gctattcttgaggttaattctt

SEQ ID NO: 1315977 - DNA, 22 bp, Artificial Sequence
  chemically synthesized
agtctaaactgaagaattaacc

SEQ ID NO: 1315978 - DNA, 22 bp, Artificial Sequence
  chemically synthesized
gtctaaactgaagaattaacct

SEQ ID NO: 1315979 - DNA, 22 bp, Artificial Sequence
  chemically synthesized
ttagctattcttgaggttaatt

SEQ ID NO: 1315980 - DNA, 22 bp, Artificial Sequence
  chemically synthesized
aactgaagaattaacctcaaga

SEQ ID NO: 1315981 - DNA, 22 bp, Artificial Sequence
  chemically synthesized
aagaattaacctcaagaatagc

SEQ ID NO: 1315982 - DNA, 22 bp, Artificial Sequence
  chemically synthesized
tagtaaactattagctattctt

SEQ ID NO: 1315983 - DNA, 22 bp, Artificial Sequence
  chemically synthesized
acctcaagaatagctaatagtt

SEQ ID NO: 1315984 - DNA, 22 bp, Artificial Sequence
  chemically synthesized
aagaatagctaatagtttacta

SEQ ID NO: 1315985 - DNA, 22 bp, Artificial Sequence
  chemically synthesized
aaaagaaaatctatagtaaact

SEQ ID NO: 1315986 - DNA, 22 bp, Artificial Sequence
  chemically synthesized
caaaagaaaatctatagtaaac

SEQ ID NO: 1315987 - DNA, 22 bp, Artificial Sequence
  chemically synthesized
tgcttcaaaagaaaatctatag

SEQ ID NO: 1315988 - DNA, 22 bp, Artificial Sequence
  chemically synthesized
atagtttactatagattttctt

SEQ ID NO: 1315989 - DNA, 22 bp, Artificial Sequence
  chemically synthesized
actatagattttcttttgaagc

SEQ ID NO: 1315990 - DNA, 22 bp, Artificial Sequence
  chemically synthesized
ctatagattttcttttgaagca

SEQ ID NO: 1315991 - DNA, 22 bp, Artificial Sequence
  chemically synthesized
tagattttcttttgaagcataa

SEQ ID NO: 1315992 - DNA, 22 bp, Artificial Sequence
  chemically synthesized
aacagagaaatattatgcttca

SEQ ID NO: 1315993 - DNA, 22 bp, Artificial Sequence
  chemically synthesized
tcttttgaagcataatatttct

SEQ ID NO: 1315994 - DNA, 22 bp, Artificial Sequence
  chemically synthesized
cttttgaagcataatatttctc

SEQ ID NO: 1315995 - DNA, 22 bp, Artificial Sequence
  chemically synthesized
ttttgaagcataatatttctct

SEQ ID NO: 1315996 - DNA, 22 bp, Artificial Sequence
  chemically synthesized
ttgaagcataatatttctctgt

SEQ ID NO: 1315997 - DNA, 22 bp, Artificial Sequence
  chemically synthesized
tgaagcataatatttctctgtt

SEQ ID NO: 1315998 - DNA, 22 bp, Artificial Sequence
  chemically synthesized
gaagcataatatttctctgttc

SEQ ID NO: 1315999 - DNA, 22 bp, Artificial Sequence
  chemically synthesized
aagcataatatttctctgttca

SEQ ID NO: 1316000 - DNA, 22 bp, Artificial Sequence
  chemically synthesized
ataaaaatggggactgaacaga

SEQ ID NO: 1316001 - DNA, 22 bp, Artificial Sequence
  chemically synthesized
aataaaaatggggactgaacag

SEQ ID NO: 1316002 - DNA, 22 bp, Artificial Sequence
  chemically synthesized
taataaaaatggggactgaaca

SEQ ID NO: 1316003 - DNA, 22 bp, Artificial Sequence
  chemically synthesized
ttaataaaaatggggactgaac

SEQ ID NO: 1316004 - DNA, 22 bp, Artificial Sequence
  chemically synthesized
tttttaataaaaatggggactg

SEQ ID NO: 1316005 - DNA, 22 bp, Artificial Sequence
  chemically synthesized
gtttttaataaaaatggggact

SEQ ID NO: 1316006 - DNA, 22 bp, Artificial Sequence
  chemically synthesized
ctctgttcagtccccattttta

SEQ ID NO: 1316007 - DNA, 22 bp, Artificial Sequence
  chemically synthesized
tctgttcagtccccatttttat

SEQ ID NO: 1316008 - DNA, 22 bp, Artificial Sequence
  chemically synthesized
tgttcagtccccatttttatta

SEQ ID NO: 1316009 - DNA, 22 bp, Artificial Sequence
  chemically synthesized
ttcagtccccatttttattaaa

SEQ ID NO: 1316010 - DNA, 22 bp, Artificial Sequence
  chemically synthesized
tcatgatttgtttttaataaaa

SEQ ID NO: 1316011 - DNA, 22 bp, Artificial Sequence
  chemically synthesized
tatcatgatttgtttttaataa

SEQ ID NO: 1316012 - DNA, 22 bp, Artificial Sequence
  chemically synthesized
agtccccatttttattaaaaac

SEQ ID NO: 1316013 - DNA, 22 bp, Artificial Sequence
  chemically synthesized
ctatcatgatttgtttttaata

SEQ ID NO: 1316014 - DNA, 22 bp, Artificial Sequence
  chemically synthesized
ttattaaaaacaaatcatgata

SEQ ID NO: 1316015 - DNA, 22 bp, Artificial Sequence
  chemically synthesized
tattaaaaacaaatcatgatag

SEQ ID NO: 1316016 - DNA, 22 bp, Artificial Sequence
  chemically synthesized
attaaaaacaaatcatgataga

SEQ ID NO: 1316017 - DNA, 22 bp, Artificial Sequence
  chemically synthesized
ttaaaaacaaatcatgatagaa

SEQ ID NO: 1316018 - DNA, 22 bp, Artificial Sequence
  chemically synthesized
taagcaaatcatttctatcatg

SEQ ID NO: 1316019 - DNA, 22 bp, Artificial Sequence
  chemically synthesized
ataagcaaatcatttctatcat

SEQ ID NO: 1316020 - DNA, 22 bp, Artificial Sequence
  chemically synthesized
tataagcaaatcatttctatca

SEQ ID NO: 1316021 - DNA, 22 bp, Artificial Sequence
  chemically synthesized
aaaacaaatcatgatagaaatg

SEQ ID NO: 1316022 - DNA, 22 bp, Artificial Sequence
  chemically synthesized
aaatgcattttataagcaaatc

SEQ ID NO: 1316023 - DNA, 22 bp, Artificial Sequence
  chemically synthesized
gcttataaaatgcattttagtc

SEQ ID NO: 1316024 - DNA, 22 bp, Artificial Sequence
  chemically synthesized
cttataaaatgcattttagtct

SEQ ID NO: 1316025 - DNA, 22 bp, Artificial Sequence
  chemically synthesized
ataaaatgcattttagtcttac

SEQ ID NO: 1316026 - DNA, 22 bp, Artificial Sequence
  chemically synthesized
taaaatgcattttagtcttact

SEQ ID NO: 1316027 - DNA, 22 bp, Artificial Sequence
  chemically synthesized
atgcaaataatcaggccaagta

SEQ ID NO: 1316028 - DNA, 22 bp, Artificial Sequence
  chemically synthesized
tagtcttactgtacttggcctg

SEQ ID NO: 1316029 - DNA, 22 bp, Artificial Sequence
  chemically synthesized
catgcaaataatcaggccaagt

SEQ ID NO: 1316030 - DNA, 22 bp, Artificial Sequence
  chemically synthesized
agtcttactgtacttggcctga

SEQ ID NO: 1316031 - DNA, 22 bp, Artificial Sequence
  chemically synthesized
gtcttactgtacttggcctgat

SEQ ID NO: 1316032 - DNA, 22 bp, Artificial Sequence
  chemically synthesized
cacttcatgcaaataatcaggc

SEQ ID NO: 1316033 - DNA, 22 bp, Artificial Sequence
  chemically synthesized
actgtacttggcctgattattt

SEQ ID NO: 1316034 - DNA, 22 bp, Artificial Sequence
  chemically synthesized
ctgtacttggcctgattatttg

SEQ ID NO: 1316035 - DNA, 22 bp, Artificial Sequence
  chemically synthesized
ctgcacttcatgcaaataatca

SEQ ID NO: 1316036 - DNA, 22 bp, Artificial Sequence
  chemically synthesized
gctgcacttcatgcaaataatc

SEQ ID NO: 1316037 - DNA, 22 bp, Artificial Sequence
  chemically synthesized
tacttggcctgattatttgcat

SEQ ID NO: 1316038 - DNA, 22 bp, Artificial Sequence
  chemically synthesized
ttgctgcacttcatgcaaataa

SEQ ID NO: 1316039 - DNA, 22 bp, Artificial Sequence
  chemically synthesized
ttcttgctgcacttcatgcaaa

SEQ ID NO: 1316040 - DNA, 22 bp, Artificial Sequence
  chemically synthesized
ggcctgattatttgcatgaagt

SEQ ID NO: 1316041 - DNA, 22 bp, Artificial Sequence
  chemically synthesized
gcctgattatttgcatgaagtg

SEQ ID NO: 1316042 - DNA, 22 bp, Artificial Sequence
  chemically synthesized
attatttgcatgaagtgcagca

SEQ ID NO: 1316043 - DNA, 22 bp, Artificial Sequence
  chemically synthesized
tttgcatgaagtgcagcaagaa

SEQ ID NO: 1316044 - DNA, 22 bp, Artificial Sequence
  chemically synthesized
gcatgaagtgcagcaagaataa

SEQ ID NO: 1316045 - DNA, 22 bp, Artificial Sequence
  chemically synthesized
agtgaaaaataattattcttgc

SEQ ID NO: 1316046 - DNA, 22 bp, Artificial Sequence
  chemically synthesized
catgaagtgcagcaagaataat

SEQ ID NO: 1316047 - DNA, 22 bp, Artificial Sequence
  chemically synthesized
aaaagcctaagtgaaaaataat

SEQ ID NO: 1316048 - DNA, 22 bp, Artificial Sequence
  chemically synthesized
aaaaagcctaagtgaaaaataa

SEQ ID NO: 1316049 - DNA, 22 bp, Artificial Sequence
  chemically synthesized
tttttcacttaggctttttaaa

SEQ ID NO: 1316050 - DNA, 22 bp, Artificial Sequence
  chemically synthesized
catcaaagccaatttaaaaagc

SEQ ID NO: 1316051 - DNA, 22 bp, Artificial Sequence
  chemically synthesized
ttcacttaggctttttaaattg

SEQ ID NO: 1316052 - DNA, 22 bp, Artificial Sequence
  chemically synthesized
tcacttaggctttttaaattgg

SEQ ID NO: 1316053 - DNA, 22 bp, Artificial Sequence
  chemically synthesized
cacttaggctttttaaattggc

SEQ ID NO: 1316054 - DNA, 22 bp, Artificial Sequence
  chemically synthesized
acttaggctttttaaattggct

SEQ ID NO: 1316055 - DNA, 22 bp, Artificial Sequence
  chemically synthesized
aggctttttaaattggctttga

SEQ ID NO: 1316056 - DNA, 22 bp, Artificial Sequence
  chemically synthesized
ggctttttaaattggctttgat

SEQ ID NO: 1316057 - DNA, 22 bp, Artificial Sequence
  chemically synthesized
atggaacagagttccatcaaag

SEQ ID NO: 1316058 - DNA, 22 bp, Artificial Sequence
  chemically synthesized
catggaacagagttccatcaaa

SEQ ID NO: 1316059 - DNA, 22 bp, Artificial Sequence
  chemically synthesized
tttaaattggctttgatggaac

SEQ ID NO: 1316060 - DNA, 22 bp, Artificial Sequence
  chemically synthesized
ttaaattggctttgatggaact

SEQ ID NO: 1316061 - DNA, 22 bp, Artificial Sequence
  chemically synthesized
ttcatggaacagagttccatca

SEQ ID NO: 1316062 - DNA, 22 bp, Artificial Sequence
  chemically synthesized
taaattggctttgatggaactc

SEQ ID NO: 1316063 - DNA, 22 bp, Artificial Sequence
  chemically synthesized
aaattggctttgatggaactct

SEQ ID NO: 1316064 - DNA, 22 bp, Artificial Sequence
  chemically synthesized
aattggctttgatggaactctg

SEQ ID NO: 1316065 - DNA, 22 bp, Artificial Sequence
  chemically synthesized
agattcttcatggaacagagtt

SEQ ID NO: 1316066 - DNA, 22 bp, Artificial Sequence
  chemically synthesized
gctttgatggaactctgttcca

SEQ ID NO: 1316067 - DNA, 22 bp, Artificial Sequence
  chemically synthesized
tctgagattcttcatggaacag

SEQ ID NO: 1316068 - DNA, 22 bp, Artificial Sequence
  chemically synthesized
atctgagattcttcatggaaca

SEQ ID NO: 1316069 - DNA, 22 bp, Artificial Sequence
  chemically synthesized
tgatggaactctgttccatgaa

SEQ ID NO: 1316070 - DNA, 22 bp, Artificial Sequence
  chemically synthesized
gatggaactctgttccatgaag

SEQ ID NO: 1316071 - DNA, 22 bp, Artificial Sequence
  chemically synthesized
atggaactctgttccatgaaga

SEQ ID NO: 1316072 - DNA, 22 bp, Artificial Sequence
  chemically synthesized
aaaaagtcttatctgagattct

SEQ ID NO: 1316073 - DNA, 22 bp, Artificial Sequence
  chemically synthesized
caaaaagtcttatctgagattc

SEQ ID NO: 1316074 - DNA, 22 bp, Artificial Sequence
  chemically synthesized
tgttccatgaagaatctcagat

SEQ ID NO: 1316075 - DNA, 22 bp, Artificial Sequence
  chemically synthesized
tcaaaaagtcttatctgagatt

SEQ ID NO: 1316076 - DNA, 22 bp, Artificial Sequence
  chemically synthesized
ttccatgaagaatctcagataa

SEQ ID NO: 1316077 - DNA, 22 bp, Artificial Sequence
  chemically synthesized
catgaagaatctcagataagac

SEQ ID NO: 1316078 - DNA, 22 bp, Artificial Sequence
  chemically synthesized
ggctttcaaaaagtcttatctg

SEQ ID NO: 1316079 - DNA, 22 bp, Artificial Sequence
  chemically synthesized
ggctcggctttcaaaaagtctt

SEQ ID NO: 1316080 - DNA, 22 bp, Artificial Sequence
  chemically synthesized
agataagactttttgaaagccg

SEQ ID NO: 1316081 - DNA, 22 bp, Artificial Sequence
  chemically synthesized
tttgaaagccgagcccagccat

SEQ ID NO: 1316082 - DNA, 22 bp, Artificial Sequence
  chemically synthesized
ttgaaagccgagcccagccatg

SEQ ID NO: 1316083 - DNA, 22 bp, Artificial Sequence
  chemically synthesized
agggtacaaacccatggctggg

SEQ ID NO: 1316084 - DNA, 22 bp, Artificial Sequence
  chemically synthesized
tgaaagccgagcccagccatgg

SEQ ID NO: 1316085 - DNA, 22 bp, Artificial Sequence
  chemically synthesized
gagggtacaaacccatggctgg

SEQ ID NO: 1316086 - DNA, 22 bp, Artificial Sequence
  chemically synthesized
gaaagccgagcccagccatggg

SEQ ID NO: 1316087 - DNA, 22 bp, Artificial Sequence
  chemically synthesized
aaagccgagcccagccatgggt

SEQ ID NO: 1316088 - DNA, 22 bp, Artificial Sequence
  chemically synthesized
ataggtatttgagggtacaaac

SEQ ID NO: 1316089 - DNA, 22 bp, Artificial Sequence
  chemically synthesized
gtcaactcataggtatttgagg

SEQ ID NO: 1316090 - DNA, 22 bp, Artificial Sequence
  chemically synthesized
ggtcaactcataggtatttgag

SEQ ID NO: 1316091 - DNA, 22 bp, Artificial Sequence
  chemically synthesized
tggtcaactcataggtatttga

SEQ ID NO: 1316092 - DNA, 22 bp, Artificial Sequence
  chemically synthesized
gtaccctcaaatacctatgagt

SEQ ID NO: 1316093 - DNA, 22 bp, Artificial Sequence
  chemically synthesized
taccctcaaatacctatgagtt

SEQ ID NO: 1316094 - DNA, 22 bp, Artificial Sequence
  chemically synthesized
aaatacctatgagttgaccaaa

SEQ ID NO: 1316095 - DNA, 22 bp, Artificial Sequence
  chemically synthesized
aagaggagaggactttggtcaa

SEQ ID NO: 1316096 - DNA, 22 bp, Artificial Sequence
  chemically synthesized
ggacctcaagaggagaggactt

SEQ ID NO: 1316097 - DNA, 22 bp, Artificial Sequence
  chemically synthesized
tgagttgaccaaagtcctctcc

SEQ ID NO: 1316098 - DNA, 22 bp, Artificial Sequence
  chemically synthesized
gggacctcaagaggagaggact

SEQ ID NO: 1316099 - DNA, 22 bp, Artificial Sequence
  chemically synthesized
tcttgggacctcaagaggagag

SEQ ID NO: 1316100 - DNA, 22 bp, Artificial Sequence
  chemically synthesized
accaaagtcctctcctcttgag

SEQ ID NO: 1316101 - DNA, 22 bp, Artificial Sequence
  chemically synthesized
tcctcttgaggtcccaagataa

SEQ ID NO: 1316102 - DNA, 22 bp, Artificial Sequence
  chemically synthesized
ctcttgaggtcccaagataact

SEQ ID NO: 1316103 - DNA, 22 bp, Artificial Sequence
  chemically synthesized
ttgaggtcccaagataacttgg

SEQ ID NO: 1316104 - DNA, 22 bp, Artificial Sequence
  chemically synthesized
gaggtcccaagataacttgggg

SEQ ID NO: 1316105 - DNA, 22 bp, Artificial Sequence
  chemically synthesized
aggtcccaagataacttggggt

SEQ ID NO: 1316106 - DNA, 22 bp, Artificial Sequence
  chemically synthesized
acaggcccaggaaccccaagtt

SEQ ID NO: 1316107 - DNA, 22 bp, Artificial Sequence
  chemically synthesized
taacaggcccaggaaccccaag

SEQ ID NO: 1316108 - DNA, 22 bp, Artificial Sequence
  chemically synthesized
ctaacaggcccaggaaccccaa

SEQ ID NO: 1316109 - DNA, 22 bp, Artificial Sequence
  chemically synthesized
tctaacaggcccaggaacccca

SEQ ID NO: 1316110 - DNA, 22 bp, Artificial Sequence
  chemically synthesized
ggggttcctgggcctgttagaa

SEQ ID NO: 1316111 - DNA, 22 bp, Artificial Sequence
  chemically synthesized
gggttcctgggcctgttagaaa

SEQ ID NO: 1316112 - DNA, 22 bp, Artificial Sequence
  chemically synthesized
ctgggcctgttagaaagtgaca

SEQ ID NO: 1316113 - DNA, 22 bp, Artificial Sequence
  chemically synthesized
tggtaagtaaagaatgtcactt

SEQ ID NO: 1316114 - DNA, 22 bp, Artificial Sequence
  chemically synthesized
ggcctgttagaaagtgacattc

SEQ ID NO: 1316115 - DNA, 22 bp, Artificial Sequence
  chemically synthesized
acctgtggtaagtaaagaatgt

SEQ ID NO: 1316116 - DNA, 22 bp, Artificial Sequence
  chemically synthesized
ttagaaagtgacattctttact

SEQ ID NO: 1316117 - DNA, 22 bp, Artificial Sequence
  chemically synthesized
ctgacctgtggtaagtaaagaa

SEQ ID NO: 1316118 - DNA, 22 bp, Artificial Sequence
  chemically synthesized
gaaagtgacattctttacttac

SEQ ID NO: 1316119 - DNA, 22 bp, Artificial Sequence
  chemically synthesized
tacaaggttcctgacctgtggt

SEQ ID NO: 1316120 - DNA, 22 bp, Artificial Sequence
  chemically synthesized
tttacttaccacaggtcaggaa

SEQ ID NO: 1316121 - DNA, 22 bp, Artificial Sequence
  chemically synthesized
tacttaccacaggtcaggaacc

SEQ ID NO: 1316122 - DNA, 22 bp, Artificial Sequence
  chemically synthesized
acttaccacaggtcaggaacct

SEQ ID NO: 1316123 - DNA, 22 bp, Artificial Sequence
  chemically synthesized
cttaccacaggtcaggaacctt

SEQ ID NO: 1316124 - DNA, 22 bp, Artificial Sequence
  chemically synthesized
accacaggtcaggaaccttgta

SEQ ID NO: 1316125 - DNA, 22 bp, Artificial Sequence
  chemically synthesized
ccacaggtcaggaaccttgtac

SEQ ID NO: 1316126 - DNA, 22 bp, Artificial Sequence
  chemically synthesized
tccacacagagtccctgtacaa

SEQ ID NO: 1316127 - DNA, 22 bp, Artificial Sequence
  chemically synthesized
gtccacacagagtccctgtaca

SEQ ID NO: 1316128 - DNA, 22 bp, Artificial Sequence
  chemically synthesized
ataccttgtccacacagagtcc

SEQ ID NO: 1316129 - DNA, 22 bp, Artificial Sequence
  chemically synthesized
gcctcataccttgtccacacag

SEQ ID NO: 1316130 - DNA, 22 bp, Artificial Sequence
  chemically synthesized
gtacagggactctgtgtggaca

SEQ ID NO: 1316131 - DNA, 22 bp, Artificial Sequence
  chemically synthesized
tacagggactctgtgtggacaa

SEQ ID NO: 1316132 - DNA, 22 bp, Artificial Sequence
  chemically synthesized
gggaatctggcctcataccttg

SEQ ID NO: 1316133 - DNA, 22 bp, Artificial Sequence
  chemically synthesized
tgtgtggacaaggtatgaggcc

SEQ ID NO: 1316134 - DNA, 22 bp, Artificial Sequence
  chemically synthesized
tgtggacaaggtatgaggccag

SEQ ID NO: 1316135 - DNA, 22 bp, Artificial Sequence
  chemically synthesized
aagcccgttggggaatctggcc

SEQ ID NO: 1316136 - DNA, 22 bp, Artificial Sequence
  chemically synthesized
aaagcccgttggggaatctggc

SEQ ID NO: 1316137 - DNA, 22 bp, Artificial Sequence
  chemically synthesized
tagagccatttaaagcccgttg

SEQ ID NO: 1316138 - DNA, 22 bp, Artificial Sequence
  chemically synthesized
atagagccatttaaagcccgtt

SEQ ID NO: 1316139 - DNA, 22 bp, Artificial Sequence
  chemically synthesized
acttatagagccatttaaagcc

SEQ ID NO: 1316140 - DNA, 22 bp, Artificial Sequence
  chemically synthesized
cccaacgggctttaaatggctc

SEQ ID NO: 1316141 - DNA, 22 bp, Artificial Sequence
  chemically synthesized
aagaatcaaagttgacttatag

SEQ ID NO: 1316142 - DNA, 22 bp, Artificial Sequence
  chemically synthesized
aaagaatcaaagttgacttata

SEQ ID NO: 1316143 - DNA, 22 bp, Artificial Sequence
  chemically synthesized
taaagaatcaaagttgacttat

SEQ ID NO: 1316144 - DNA, 22 bp, Artificial Sequence
  chemically synthesized
taaatggctctataagtcaact

SEQ ID NO: 1316145 - DNA, 22 bp, Artificial Sequence
  chemically synthesized
aaatggctctataagtcaactt

SEQ ID NO: 1316146 - DNA, 22 bp, Artificial Sequence
  chemically synthesized
aatggctctataagtcaacttt

SEQ ID NO: 1316147 - DNA, 22 bp, Artificial Sequence
  chemically synthesized
ctttaaagaatcaaagttgact

SEQ ID NO: 1316148 - DNA, 22 bp, Artificial Sequence
  chemically synthesized
cctttaaagaatcaaagttgac

SEQ ID NO: 1316149 - DNA, 22 bp, Artificial Sequence
  chemically synthesized
tataagtcaactttgattcttt

SEQ ID NO: 1316150 - DNA, 22 bp, Artificial Sequence
  chemically synthesized
taagtcaactttgattctttaa

SEQ ID NO: 1316151 - DNA, 22 bp, Artificial Sequence
  chemically synthesized
gaatggcatgcttcctttaaag

SEQ ID NO: 1316152 - DNA, 22 bp, Artificial Sequence
  chemically synthesized
actggaatggcatgcttccttt

SEQ ID NO: 1316153 - DNA, 22 bp, Artificial Sequence
  chemically synthesized
gactggaatggcatgcttcctt

SEQ ID NO: 1316154 - DNA, 22 bp, Artificial Sequence
  chemically synthesized
tgactggaatggcatgcttcct

SEQ ID NO: 1316155 - DNA, 22 bp, Artificial Sequence
  chemically synthesized
tgattctttaaaggaagcatgc

SEQ ID NO: 1316156 - DNA, 22 bp, Artificial Sequence
  chemically synthesized
gattctttaaaggaagcatgcc

SEQ ID NO: 1316157 - DNA, 22 bp, Artificial Sequence
  chemically synthesized
attctttaaaggaagcatgcca

SEQ ID NO: 1316158 - DNA, 22 bp, Artificial Sequence
  chemically synthesized
tttaaaggaagcatgccattcc

SEQ ID NO: 1316159 - DNA, 22 bp, Artificial Sequence
  chemically synthesized
taaaggaagcatgccattccag

SEQ ID NO: 1316160 - DNA, 22 bp, Artificial Sequence
  chemically synthesized
ccaaggctttgactggaatggc

SEQ ID NO: 1316161 - DNA, 22 bp, Artificial Sequence
  chemically synthesized
aaaggaagcatgccattccagt

SEQ ID NO: 1316162 - DNA, 22 bp, Artificial Sequence
  chemically synthesized
accaaggctttgactggaatgg

SEQ ID NO: 1316163 - DNA, 22 bp, Artificial Sequence
  chemically synthesized
aaggaagcatgccattccagtc

SEQ ID NO: 1316164 - DNA, 22 bp, Artificial Sequence
  chemically synthesized
taccaaggctttgactggaatg

SEQ ID NO: 1316165 - DNA, 22 bp, Artificial Sequence
  chemically synthesized
gtcattttaccaaggctttgac

SEQ ID NO: 1316166 - DNA, 22 bp, Artificial Sequence
  chemically synthesized
gagaaattggtcattttaccaa

SEQ ID NO: 1316167 - DNA, 22 bp, Artificial Sequence
  chemically synthesized
cagtcaaagccttggtaaaatg

SEQ ID NO: 1316168 - DNA, 22 bp, Artificial Sequence
  chemically synthesized
ggtaaaatgaccaatttctcca

SEQ ID NO: 1316169 - DNA, 22 bp, Artificial Sequence
  chemically synthesized
gtaaaatgaccaatttctccaa

SEQ ID NO: 1316170 - DNA, 22 bp, Artificial Sequence
  chemically synthesized
taacaggacaccattggagaaa

SEQ ID NO: 1316171 - DNA, 22 bp, Artificial Sequence
  chemically synthesized
gtaacaggacaccattggagaa

SEQ ID NO: 1316172 - DNA, 22 bp, Artificial Sequence
  chemically synthesized
tgtaacaggacaccattggaga

SEQ ID NO: 1316173 - DNA, 22 bp, Artificial Sequence
  chemically synthesized
ttgtaacaggacaccattggag

SEQ ID NO: 1316174 - DNA, 22 bp, Artificial Sequence
  chemically synthesized
ttttgtaacaggacaccattgg

SEQ ID NO: 1316175 - DNA, 22 bp, Artificial Sequence
  chemically synthesized
cttttgtaacaggacaccattg

SEQ ID NO: 1316176 - DNA, 22 bp, Artificial Sequence
  chemically synthesized
tcttttgtaacaggacaccatt

SEQ ID NO: 1316177 - DNA, 22 bp, Artificial Sequence
  chemically synthesized
ttttcttttgtaacaggacacc

SEQ ID NO: 1316178 - DNA, 22 bp, Artificial Sequence
  chemically synthesized
ctccaatggtgtcctgttacaa

SEQ ID NO: 1316179 - DNA, 22 bp, Artificial Sequence
  chemically synthesized
tccaatggtgtcctgttacaaa

SEQ ID NO: 1316180 - DNA, 22 bp, Artificial Sequence
  chemically synthesized
caatggtgtcctgttacaaaag

SEQ ID NO: 1316181 - DNA, 22 bp, Artificial Sequence
  chemically synthesized
ttacaaaagaaaacagattctt

SEQ ID NO: 1316182 - DNA, 22 bp, Artificial Sequence
  chemically synthesized
catacgtgcaataagaatctgt

SEQ ID NO: 1316183 - DNA, 22 bp, Artificial Sequence
  chemically synthesized
caaaagaaaacagattcttatt

SEQ ID NO: 1316184 - DNA, 22 bp, Artificial Sequence
  chemically synthesized
attgcatacgtgcaataagaat

SEQ ID NO: 1316185 - DNA, 22 bp, Artificial Sequence
  chemically synthesized
tgacagtatagttaattgcata

SEQ ID NO: 1316186 - DNA, 22 bp, Artificial Sequence
  chemically synthesized
atgacagtatagttaattgcat

SEQ ID NO: 1316187 - DNA, 22 bp, Artificial Sequence
  chemically synthesized
ttattgcacgtatgcaattaac

SEQ ID NO: 1316188 - DNA, 22 bp, Artificial Sequence
  chemically synthesized
attgcacgtatgcaattaacta

SEQ ID NO: 1316189 - DNA, 22 bp, Artificial Sequence
  chemically synthesized
ttgcacgtatgcaattaactat

SEQ ID NO: 1316190 - DNA, 22 bp, Artificial Sequence
  chemically synthesized
aatttatgacagtatagttaat

SEQ ID NO: 1316191 - DNA, 22 bp, Artificial Sequence
  chemically synthesized
cacgtatgcaattaactatact

SEQ ID NO: 1316192 - DNA, 22 bp, Artificial Sequence
  chemically synthesized
tcaatttatgacagtatagtta

SEQ ID NO: 1316193 - DNA, 22 bp, Artificial Sequence
  chemically synthesized
tgagtattctcaatttatgaca

SEQ ID NO: 1316194 - DNA, 22 bp, Artificial Sequence
  chemically synthesized
gtgagtattctcaatttatgac

SEQ ID NO: 1316195 - DNA, 22 bp, Artificial Sequence
  chemically synthesized
actatactgtcataaattgaga

SEQ ID NO: 1316196 - DNA, 22 bp, Artificial Sequence
  chemically synthesized
tactgtcataaattgagaatac

SEQ ID NO: 1316197 - DNA, 22 bp, Artificial Sequence
  chemically synthesized
gaaaccatttgtgagtattctc

SEQ ID NO: 1316198 - DNA, 22 bp, Artificial Sequence
  chemically synthesized
ggaaaccatttgtgagtattct

SEQ ID NO: 1316199 - DNA, 22 bp, Artificial Sequence
  chemically synthesized
tcataaattgagaatactcaca

SEQ ID NO: 1316200 - DNA, 22 bp, Artificial Sequence
  chemically synthesized
gaatttggaaaccatttgtgag

SEQ ID NO: 1316201 - DNA, 22 bp, Artificial Sequence
  chemically synthesized
tagaatttggaaaccatttgtg

SEQ ID NO: 1316202 - DNA, 22 bp, Artificial Sequence
  chemically synthesized
tctagaatttggaaaccatttg

SEQ ID NO: 1316203 - DNA, 22 bp, Artificial Sequence
  chemically synthesized
ctctagaatttggaaaccattt

SEQ ID NO: 1316204 - DNA, 22 bp, Artificial Sequence
  chemically synthesized
agaatactcacaaatggtttcc

SEQ ID NO: 1316205 - DNA, 22 bp, Artificial Sequence
  chemically synthesized
atttctctagaatttggaaacc

SEQ ID NO: 1316206 - DNA, 22 bp, Artificial Sequence
  chemically synthesized
cctgatttctctagaatttgga

SEQ ID NO: 1316207 - DNA, 22 bp, Artificial Sequence
  chemically synthesized
acaaatggtttccaaattctag

SEQ ID NO: 1316208 - DNA, 22 bp, Artificial Sequence
  chemically synthesized
tacctgatttctctagaatttg

SEQ ID NO: 1316209 - DNA, 22 bp, Artificial Sequence
  chemically synthesized
tctacctgatttctctagaatt

SEQ ID NO: 1316210 - DNA, 22 bp, Artificial Sequence
  chemically synthesized
tctctacctgatttctctagaa

SEQ ID NO: 1316211 - DNA, 22 bp, Artificial Sequence
  chemically synthesized
ctctctacctgatttctctaga

SEQ ID NO: 1316212 - DNA, 22 bp, Artificial Sequence
  chemically synthesized
tttctctctacctgatttctct

SEQ ID NO: 1316213 - DNA, 22 bp, Artificial Sequence
  chemically synthesized
gtttctctctacctgatttctc

SEQ ID NO: 1316214 - DNA, 22 bp, Artificial Sequence
  chemically synthesized
ccaaattctagagaaatcaggt

SEQ ID NO: 1316215 - DNA, 22 bp, Artificial Sequence
  chemically synthesized
caaattctagagaaatcaggta

SEQ ID NO: 1316216 - DNA, 22 bp, Artificial Sequence
  chemically synthesized
tagagaaatcaggtagagagaa

SEQ ID NO: 1316217 - DNA, 22 bp, Artificial Sequence
  chemically synthesized
gagcaaatttgtttctctctac

SEQ ID NO: 1316218 - DNA, 22 bp, Artificial Sequence
  chemically synthesized
ggagcaaatttgtttctctcta

SEQ ID NO: 1316219 - DNA, 22 bp, Artificial Sequence
  chemically synthesized
gagaaatcaggtagagagaaac

SEQ ID NO: 1316220 - DNA, 22 bp, Artificial Sequence
  chemically synthesized
tggagcaaatttgtttctctct

SEQ ID NO: 1316221 - DNA, 22 bp, Artificial Sequence
  chemically synthesized
agtgacaaattttggagcaaat

SEQ ID NO: 1316222 - DNA, 22 bp, Artificial Sequence
  chemically synthesized
gctccaaaatttgtcactgagt

SEQ ID NO: 1316223 - DNA, 22 bp, Artificial Sequence
  chemically synthesized
ctccaaaatttgtcactgagtg

SEQ ID NO: 1316224 - DNA, 22 bp, Artificial Sequence
  chemically synthesized
caaaatttgtcactgagtgtat

SEQ ID NO: 1316225 - DNA, 22 bp, Artificial Sequence
  chemically synthesized
ccgagtgagtaaaatacactca

SEQ ID NO: 1316226 - DNA, 22 bp, Artificial Sequence
  chemically synthesized
accgagtgagtaaaatacactc

SEQ ID NO: 1316227 - DNA, 22 bp, Artificial Sequence
  chemically synthesized
taccgagtgagtaaaatacact

SEQ ID NO: 1316228 - DNA, 22 bp, Artificial Sequence
  chemically synthesized
ttaccgagtgagtaaaatacac

SEQ ID NO: 1316229 - DNA, 22 bp, Artificial Sequence
  chemically synthesized
gtcactgagtgtattttactca

SEQ ID NO: 1316230 - DNA, 22 bp, Artificial Sequence
  chemically synthesized
tcactgagtgtattttactcac

SEQ ID NO: 1316231 - DNA, 22 bp, Artificial Sequence
  chemically synthesized
ccacttttaccgagtgagtaaa

SEQ ID NO: 1316232 - DNA, 22 bp, Artificial Sequence
  chemically synthesized
gccacttttaccgagtgagtaa

SEQ ID NO: 1316233 - DNA, 22 bp, Artificial Sequence
  chemically synthesized
tttgccacttttaccgagtgag

SEQ ID NO: 1316234 - DNA, 22 bp, Artificial Sequence
  chemically synthesized
agtgtattttactcactcggta

SEQ ID NO: 1316235 - DNA, 22 bp, Artificial Sequence
  chemically synthesized
gagctatttgccacttttaccg

SEQ ID NO: 1316236 - DNA, 22 bp, Artificial Sequence
  chemically synthesized
agagctatttgccacttttacc

SEQ ID NO: 1316237 - DNA, 22 bp, Artificial Sequence
  chemically synthesized
tagagctatttgccacttttac

SEQ ID NO: 1316238 - DNA, 22 bp, Artificial Sequence
  chemically synthesized
tactcactcggtaaaagtggca

SEQ ID NO: 1316239 - DNA, 22 bp, Artificial Sequence
  chemically synthesized
tttagagctatttgccactttt

SEQ ID NO: 1316240 - DNA, 22 bp, Artificial Sequence
  chemically synthesized
actcactcggtaaaagtggcaa

SEQ ID NO: 1316241 - DNA, 22 bp, Artificial Sequence
  chemically synthesized
ctttagagctatttgccacttt

SEQ ID NO: 1316242 - DNA, 22 bp, Artificial Sequence
  chemically synthesized
ctcactcggtaaaagtggcaaa

SEQ ID NO: 1316243 - DNA, 22 bp, Artificial Sequence
  chemically synthesized
tttctttagagctatttgccac

SEQ ID NO: 1316244 - DNA, 22 bp, Artificial Sequence
  chemically synthesized
actcggtaaaagtggcaaatag

SEQ ID NO: 1316245 - DNA, 22 bp, Artificial Sequence
  chemically synthesized
atttctttagagctatttgcca

SEQ ID NO: 1316246 - DNA, 22 bp, Artificial Sequence
  chemically synthesized
ggtaaaagtggcaaatagctct

SEQ ID NO: 1316247 - DNA, 22 bp, Artificial Sequence
  chemically synthesized
agagtcaacataacttatttct

SEQ ID NO: 1316248 - DNA, 22 bp, Artificial Sequence
  chemically synthesized
cagagtcaacataacttatttc

SEQ ID NO: 1316249 - DNA, 22 bp, Artificial Sequence
  chemically synthesized
tcagagtcaacataacttattt

SEQ ID NO: 1316250 - DNA, 22 bp, Artificial Sequence
  chemically synthesized
ttttcagagtcaacataactta

SEQ ID NO: 1316251 - DNA, 22 bp, Artificial Sequence
  chemically synthesized
gttttcagagtcaacataactt

SEQ ID NO: 1316252 - DNA, 22 bp, Artificial Sequence
  chemically synthesized
tgttttcagagtcaacataact

SEQ ID NO: 1316253 - DNA, 22 bp, Artificial Sequence
  chemically synthesized
ttgttttcagagtcaacataac

SEQ ID NO: 1316254 - DNA, 22 bp, Artificial Sequence
  chemically synthesized
taaagaaataagttatgttgac

SEQ ID NO: 1316255 - DNA, 22 bp, Artificial Sequence
  chemically synthesized
aagaaataagttatgttgactc

SEQ ID NO: 1316256 - DNA, 22 bp, Artificial Sequence
  chemically synthesized
atccttttgttttcagagtcaa

SEQ ID NO: 1316257 - DNA, 22 bp, Artificial Sequence
  chemically synthesized
ctaatccttttgttttcagagt

SEQ ID NO: 1316258 - DNA, 22 bp, Artificial Sequence
  chemically synthesized
tgttgactctgaaaacaaaagg

SEQ ID NO: 1316259 - DNA, 22 bp, Artificial Sequence
  chemically synthesized
aacattgctaatccttttgttt

SEQ ID NO: 1316260 - DNA, 22 bp, Artificial Sequence
  chemically synthesized
actctgaaaacaaaaggattag

SEQ ID NO: 1316261 - DNA, 22 bp, Artificial Sequence
  chemically synthesized
atgtgttaaacattgctaatcc

SEQ ID NO: 1316262 - DNA, 22 bp, Artificial Sequence
  chemically synthesized
tgaaaacaaaaggattagcaat

SEQ ID NO: 1316263 - DNA, 22 bp, Artificial Sequence
  chemically synthesized
aaaacaaaaggattagcaatgt

SEQ ID NO: 1316264 - DNA, 22 bp, Artificial Sequence
  chemically synthesized
aatgtggcaaactgatgtgtta

SEQ ID NO: 1316265 - DNA, 22 bp, Artificial Sequence
  chemically synthesized
gcaatgtttaacacatcagttt

SEQ ID NO: 1316266 - DNA, 22 bp, Artificial Sequence
  chemically synthesized
aacacatcagtttgccacattt

SEQ ID NO: 1316267 - DNA, 22 bp, Artificial Sequence
  chemically synthesized
acacatcagtttgccacattta

SEQ ID NO: 1316268 - DNA, 22 bp, Artificial Sequence
  chemically synthesized
gaatagagggaaaaaacatcta

SEQ ID NO: 1316269 - DNA, 22 bp, Artificial Sequence
  chemically synthesized
ggaatagagggaaaaaacatct

SEQ ID NO: 1316270 - DNA, 22 bp, Artificial Sequence
  chemically synthesized
ttggaatagagggaaaaaacat

SEQ ID NO: 1316271 - DNA, 22 bp, Artificial Sequence
  chemically synthesized
gccacatttagatgttttttcc

SEQ ID NO: 1316272 - DNA, 22 bp, Artificial Sequence
  chemically synthesized
ccacatttagatgttttttccc

SEQ ID NO: 1316273 - DNA, 22 bp, Artificial Sequence
  chemically synthesized
tgctcttggaatagagggaaaa

SEQ ID NO: 1316274 - DNA, 22 bp, Artificial Sequence
  chemically synthesized
agatgttttttccctctattcc

SEQ ID NO: 1316275 - DNA, 22 bp, Artificial Sequence
  chemically synthesized
gatgttttttccctctattcca

SEQ ID NO: 1316276 - DNA, 22 bp, Artificial Sequence
  chemically synthesized
aaaattatgctcttggaataga

SEQ ID NO: 1316277 - DNA, 22 bp, Artificial Sequence
  chemically synthesized
aaaaattatgctcttggaatag

SEQ ID NO: 1316278 - DNA, 22 bp, Artificial Sequence
  chemically synthesized
taaaaattatgctcttggaata

SEQ ID NO: 1316279 - DNA, 22 bp, Artificial Sequence
  chemically synthesized
tttccctctattccaagagcat

SEQ ID NO: 1316280 - DNA, 22 bp, Artificial Sequence
  chemically synthesized
ttccctctattccaagagcata

SEQ ID NO: 1316281 - DNA, 22 bp, Artificial Sequence
  chemically synthesized
tccctctattccaagagcataa

SEQ ID NO: 1316282 - DNA, 22 bp, Artificial Sequence
  chemically synthesized
ccctctattccaagagcataat

SEQ ID NO: 1316283 - DNA, 22 bp, Artificial Sequence
  chemically synthesized
cctctattccaagagcataatt

SEQ ID NO: 1316284 - DNA, 22 bp, Artificial Sequence
  chemically synthesized
gataactttaaaaattatgctc

SEQ ID NO: 1316285 - DNA, 22 bp, Artificial Sequence
  chemically synthesized
agataactttaaaaattatgct

SEQ ID NO: 1316286 - DNA, 22 bp, Artificial Sequence
  chemically synthesized
tattccaagagcataattttta

SEQ ID NO: 1316287 - DNA, 22 bp, Artificial Sequence
  chemically synthesized
ttccaagagcataatttttaaa

SEQ ID NO: 1316288 - DNA, 22 bp, Artificial Sequence
  chemically synthesized
caagagcataatttttaaagtt

SEQ ID NO: 1316289 - DNA, 22 bp, Artificial Sequence
  chemically synthesized
agtgcaggtcttagataacttt

SEQ ID NO: 1316290 - DNA, 22 bp, Artificial Sequence
  chemically synthesized
tgagtgcaggtcttagataact

SEQ ID NO: 1316291 - DNA, 22 bp, Artificial Sequence
  chemically synthesized
ttaaagttatctaagacctgca

SEQ ID NO: 1316292 - DNA, 22 bp, Artificial Sequence
  chemically synthesized
taaagttatctaagacctgcac

SEQ ID NO: 1316293 - DNA, 22 bp, Artificial Sequence
  chemically synthesized
aaagttatctaagacctgcact

SEQ ID NO: 1316294 - DNA, 22 bp, Artificial Sequence
  chemically synthesized
aagttatctaagacctgcactc

SEQ ID NO: 1316295 - DNA, 22 bp, Artificial Sequence
  chemically synthesized
tctaagacctgcactcagagta

SEQ ID NO: 1316296 - DNA, 22 bp, Artificial Sequence
  chemically synthesized
taatcggatataatactctgag

SEQ ID NO: 1316297 - DNA, 22 bp, Artificial Sequence
  chemically synthesized
ataatcggatataatactctga

SEQ ID NO: 1316298 - DNA, 22 bp, Artificial Sequence
  chemically synthesized
agacctgcactcagagtattat

SEQ ID NO: 1316299 - DNA, 22 bp, Artificial Sequence
  chemically synthesized
cactcagagtattatatccgat

SEQ ID NO: 1316300 - DNA, 22 bp, Artificial Sequence
  chemically synthesized
aaaaggcagtttataatcggat

SEQ ID NO: 1316301 - DNA, 22 bp, Artificial Sequence
  chemically synthesized
caaaaggcagtttataatcgga

SEQ ID NO: 1316302 - DNA, 22 bp, Artificial Sequence
  chemically synthesized
agagtattatatccgattataa

SEQ ID NO: 1316303 - DNA, 22 bp, Artificial Sequence
  chemically synthesized
tcaaaaggcagtttataatcgg

SEQ ID NO: 1316304 - DNA, 22 bp, Artificial Sequence
  chemically synthesized
ttcaaaaggcagtttataatcg

SEQ ID NO: 1316305 - DNA, 22 bp, Artificial Sequence
  chemically synthesized
gtccttttcaaaaggcagttta

SEQ ID NO: 1316306 - DNA, 22 bp, Artificial Sequence
  chemically synthesized
ggtccttttcaaaaggcagttt

SEQ ID NO: 1316307 - DNA, 22 bp, Artificial Sequence
  chemically synthesized
tatccgattataaactgccttt

SEQ ID NO: 1316308 - DNA, 22 bp, Artificial Sequence
  chemically synthesized
tggtccttttcaaaaggcagtt

SEQ ID NO: 1316309 - DNA, 22 bp, Artificial Sequence
  chemically synthesized
ctttggtccttttcaaaaggca

SEQ ID NO: 1316310 - DNA, 22 bp, Artificial Sequence
  chemically synthesized
gctttggtccttttcaaaaggc

SEQ ID NO: 1316311 - DNA, 22 bp, Artificial Sequence
  chemically synthesized
tcttgctttggtccttttcaaa

SEQ ID NO: 1316312 - DNA, 22 bp, Artificial Sequence
  chemically synthesized
atcttgctttggtccttttcaa

SEQ ID NO: 1316313 - DNA, 22 bp, Artificial Sequence
  chemically synthesized
taaactgccttttgaaaaggac

SEQ ID NO: 1316314 - DNA, 22 bp, Artificial Sequence
  chemically synthesized
tatcttgctttggtccttttca

SEQ ID NO: 1316315 - DNA, 22 bp, Artificial Sequence
  chemically synthesized
ccttttgaaaaggaccaaagca

SEQ ID NO: 1316316 - DNA, 22 bp, Artificial Sequence
  chemically synthesized
ttgaaaaggaccaaagcaagat

SEQ ID NO: 1316317 - DNA, 22 bp, Artificial Sequence
  chemically synthesized
tgaaaaggaccaaagcaagata

SEQ ID NO: 1316318 - DNA, 22 bp, Artificial Sequence
  chemically synthesized
gaaaaggaccaaagcaagataa

SEQ ID NO: 1316319 - DNA, 22 bp, Artificial Sequence
  chemically synthesized
aaaaggaccaaagcaagataaa

SEQ ID NO: 1316320 - DNA, 22 bp, Artificial Sequence
  chemically synthesized
tcatccacagacattttatctt

SEQ ID NO: 1316321 - DNA, 22 bp, Artificial Sequence
  chemically synthesized
gtcatccacagacattttatct

SEQ ID NO: 1316322 - DNA, 22 bp, Artificial Sequence
  chemically synthesized
tgtcatccacagacattttatc

SEQ ID NO: 1316323 - DNA, 22 bp, Artificial Sequence
  chemically synthesized
ttgtcatccacagacattttat

SEQ ID NO: 1316324 - DNA, 22 bp, Artificial Sequence
  chemically synthesized
tagacttttgtcatccacagac

SEQ ID NO: 1316325 - DNA, 22 bp, Artificial Sequence
  chemically synthesized
ataatggctgtagacttttgtc

SEQ ID NO: 1316326 - DNA, 22 bp, Artificial Sequence
  chemically synthesized
aataatggctgtagacttttgt

SEQ ID NO: 1316327 - DNA, 22 bp, Artificial Sequence
  chemically synthesized
taataatggctgtagacttttg

SEQ ID NO: 1316328 - DNA, 22 bp, Artificial Sequence
  chemically synthesized
tggatgacaaaagtctacagcc

SEQ ID NO: 1316329 - DNA, 22 bp, Artificial Sequence
  chemically synthesized
tagctttaataatggctgtaga

SEQ ID NO: 1316330 - DNA, 22 bp, Artificial Sequence
  chemically synthesized
gtcaattgtagctttaataatg

SEQ ID NO: 1316331 - DNA, 22 bp, Artificial Sequence
  chemically synthesized
ctagtcaattgtagctttaata

SEQ ID NO: 1316332 - DNA, 22 bp, Artificial Sequence
  chemically synthesized
cagccattattaaagctacaat

SEQ ID NO: 1316333 - DNA, 22 bp, Artificial Sequence
  chemically synthesized
ttaaagctacaattgactagga

SEQ ID NO: 1316334 - DNA, 22 bp, Artificial Sequence
  chemically synthesized
aagctacaattgactaggaatt

SEQ ID NO: 1316335 - DNA, 22 bp, Artificial Sequence
  chemically synthesized
caattgactaggaattttggtt

SEQ ID NO: 1316336 - DNA, 22 bp, Artificial Sequence
  chemically synthesized
tgtgccacggaagtaaccaaaa

SEQ ID NO: 1316337 - DNA, 22 bp, Artificial Sequence
  chemically synthesized
ttgtgtgccacggaagtaacca

SEQ ID NO: 1316338 - DNA, 22 bp, Artificial Sequence
  chemically synthesized
actaggaattttggttacttcc

SEQ ID NO: 1316339 - DNA, 22 bp, Artificial Sequence
  chemically synthesized
ggaattttggttacttccgtgg

SEQ ID NO: 1316340 - DNA, 22 bp, Artificial Sequence
  chemically synthesized
tgtaaaattgttgtgtgccacg

SEQ ID NO: 1316341 - DNA, 22 bp, Artificial Sequence
  chemically synthesized
tggttacttccgtggcacacaa

SEQ ID NO: 1316342 - DNA, 22 bp, Artificial Sequence
  chemically synthesized
ggttacttccgtggcacacaac

SEQ ID NO: 1316343 - DNA, 22 bp, Artificial Sequence
  chemically synthesized
ttatgtaaaattgttgtgtgcc

SEQ ID NO: 1316344 - DNA, 22 bp, Artificial Sequence
  chemically synthesized
gttacttccgtggcacacaaca

SEQ ID NO: 1316345 - DNA, 22 bp, Artificial Sequence
  chemically synthesized
cttccgtggcacacaacaattt

SEQ ID NO: 1316346 - DNA, 22 bp, Artificial Sequence
  chemically synthesized
taattgttatgtaaaattgttg

SEQ ID NO: 1316347 - DNA, 22 bp, Artificial Sequence
  chemically synthesized
ccgtggcacacaacaattttac

SEQ ID NO: 1316348 - DNA, 22 bp, Artificial Sequence
  chemically synthesized
cgtggcacacaacaattttaca

SEQ ID NO: 1316349 - DNA, 22 bp, Artificial Sequence
  chemically synthesized
ataattataattgttatgtaaa

SEQ ID NO: 1316350 - DNA, 22 bp, Artificial Sequence
  chemically synthesized
ttaataattataattgttatgt

SEQ ID NO: 1316351 - DNA, 22 bp, Artificial Sequence
  chemically synthesized
actattaataattataattgtt

SEQ ID NO: 1316352 - DNA, 22 bp, Artificial Sequence
  chemically synthesized
cactattaataattataattgt

SEQ ID NO: 1316353 - DNA, 22 bp, Artificial Sequence
  chemically synthesized
tacataacaattataattatta

SEQ ID NO: 1316354 - DNA, 22 bp, Artificial Sequence
  chemically synthesized
acataacaattataattattaa

SEQ ID NO: 1316355 - DNA, 22 bp, Artificial Sequence
  chemically synthesized
cataacaattataattattaat

SEQ ID NO: 1316356 - DNA, 22 bp, Artificial Sequence
  chemically synthesized
atatgatttcactattaataat

SEQ ID NO: 1316357 - DNA, 22 bp, Artificial Sequence
  chemically synthesized
tgatatgatttcactattaata

SEQ ID NO: 1316358 - DNA, 22 bp, Artificial Sequence
  chemically synthesized
taattctgatatgatttcacta

SEQ ID NO: 1316359 - DNA, 22 bp, Artificial Sequence
  chemically synthesized
taattattaatagtgaaatcat

SEQ ID NO: 1316360 - DNA, 22 bp, Artificial Sequence
  chemically synthesized
tataattctgatatgatttcac

SEQ ID NO: 1316361 - DNA, 22 bp, Artificial Sequence
  chemically synthesized
ctataattctgatatgatttca

SEQ ID NO: 1316362 - DNA, 22 bp, Artificial Sequence
  chemically synthesized
ttaatagtgaaatcatatcaga

SEQ ID NO: 1316363 - DNA, 22 bp, Artificial Sequence
  chemically synthesized
atagtgaaatcatatcagaatt

SEQ ID NO: 1316364 - DNA, 22 bp, Artificial Sequence
  chemically synthesized
tgggaaacttctataattctga

SEQ ID NO: 1316365 - DNA, 22 bp, Artificial Sequence
  chemically synthesized
caaaaattatgggaaacttcta

SEQ ID NO: 1316366 - DNA, 22 bp, Artificial Sequence
  chemically synthesized
gtgtgtgttccaaaaattatgg

SEQ ID NO: 1316367 - DNA, 22 bp, Artificial Sequence
  chemically synthesized
tagaagtttcccataatttttg

SEQ ID NO: 1316368 - DNA, 22 bp, Artificial Sequence
  chemically synthesized
ttagtgtgtgttccaaaaatta

SEQ ID NO: 1316369 - DNA, 22 bp, Artificial Sequence
  chemically synthesized
cccataatttttggaacacaca

SEQ ID NO: 1316370 - DNA, 22 bp, Artificial Sequence
  chemically synthesized
ccataatttttggaacacacac

SEQ ID NO: 1316371 - DNA, 22 bp, Artificial Sequence
  chemically synthesized
tataaatatgttattagtgtgt

SEQ ID NO: 1316372 - DNA, 22 bp, Artificial Sequence
  chemically synthesized
gtataaatatgttattagtgtg

SEQ ID NO: 1316373 - DNA, 22 bp, Artificial Sequence
  chemically synthesized
ttggaacacacactaataacat

SEQ ID NO: 1316374 - DNA, 22 bp, Artificial Sequence
  chemically synthesized
tggaacacacactaataacata

SEQ ID NO: 1316375 - DNA, 22 bp, Artificial Sequence
  chemically synthesized
tatttgtataaatatgttatta

SEQ ID NO: 1316376 - DNA, 22 bp, Artificial Sequence
  chemically synthesized
ggaacacacactaataacatat

SEQ ID NO: 1316377 - DNA, 22 bp, Artificial Sequence
  chemically synthesized
gaacacacactaataacatatt

SEQ ID NO: 1316378 - DNA, 22 bp, Artificial Sequence
  chemically synthesized
gactgtatttgtataaatatgt

SEQ ID NO: 1316379 - DNA, 22 bp, Artificial Sequence
  chemically synthesized
ggactgtatttgtataaatatg

SEQ ID NO: 1316380 - DNA, 22 bp, Artificial Sequence
  chemically synthesized
tggactgtatttgtataaatat

SEQ ID NO: 1316381 - DNA, 22 bp, Artificial Sequence
  chemically synthesized
tttggactgtatttgtataaat

SEQ ID NO: 1316382 - DNA, 22 bp, Artificial Sequence
  chemically synthesized
ctttggactgtatttgtataaa

SEQ ID NO: 1316383 - DNA, 22 bp, Artificial Sequence
  chemically synthesized
tctttggactgtatttgtataa

SEQ ID NO: 1316384 - DNA, 22 bp, Artificial Sequence
  chemically synthesized
ataacatatttatacaaataca

SEQ ID NO: 1316385 - DNA, 22 bp, Artificial Sequence
  chemically synthesized
gttttctttggactgtatttgt

SEQ ID NO: 1316386 - DNA, 22 bp, Artificial Sequence
  chemically synthesized
ggttttctttggactgtatttg

SEQ ID NO: 1316387 - DNA, 22 bp, Artificial Sequence
  chemically synthesized
atacaaatacagtccaaagaaa

SEQ ID NO: 1316388 - DNA, 22 bp, Artificial Sequence
  chemically synthesized
tacaaatacagtccaaagaaaa

SEQ ID NO: 1316389 - DNA, 22 bp, Artificial Sequence
  chemically synthesized
aaatagaagagtgaatggtgtt

SEQ ID NO: 1316390 - DNA, 22 bp, Artificial Sequence
  chemically synthesized
caaatagaagagtgaatggtgt

SEQ ID NO: 1316391 - DNA, 22 bp, Artificial Sequence
  chemically synthesized
tcaaatagaagagtgaatggtg

SEQ ID NO: 1316392 - DNA, 22 bp, Artificial Sequence
  chemically synthesized
gaatagaaggaaaactttcaaa

SEQ ID NO: 1316393 - DNA, 22 bp, Artificial Sequence
  chemically synthesized
actcttctatttgaaagttttc

SEQ ID NO: 1316394 - DNA, 22 bp, Artificial Sequence
  chemically synthesized
ttctatttgaaagttttccttc

SEQ ID NO: 1316395 - DNA, 22 bp, Artificial Sequence
  chemically synthesized
tgacgttagaatagaaggaaaa

SEQ ID NO: 1316396 - DNA, 22 bp, Artificial Sequence
  chemically synthesized
ctatttgaaagttttccttcta

SEQ ID NO: 1316397 - DNA, 22 bp, Artificial Sequence
  chemically synthesized
tatttgaaagttttccttctat

SEQ ID NO: 1316398 - DNA, 22 bp, Artificial Sequence
  chemically synthesized
tttgaaagttttccttctattc

SEQ ID NO: 1316399 - DNA, 22 bp, Artificial Sequence
  chemically synthesized
gaaagttttccttctattctaa

SEQ ID NO: 1316400 - DNA, 22 bp, Artificial Sequence
  chemically synthesized
gagattgtgacgttagaataga

SEQ ID NO: 1316401 - DNA, 22 bp, Artificial Sequence
  chemically synthesized
aaagttttccttctattctaac

SEQ ID NO: 1316402 - DNA, 22 bp, Artificial Sequence
  chemically synthesized
tggagattgtgacgttagaata

SEQ ID NO: 1316403 - DNA, 22 bp, Artificial Sequence
  chemically synthesized
tccttctattctaacgtcacaa

SEQ ID NO: 1316404 - DNA, 22 bp, Artificial Sequence
  chemically synthesized
ccttctattctaacgtcacaat

SEQ ID NO: 1316405 - DNA, 22 bp, Artificial Sequence
  chemically synthesized
ataactctggagattgtgacgt

SEQ ID NO: 1316406 - DNA, 22 bp, Artificial Sequence
  chemically synthesized
cttctattctaacgtcacaatc

SEQ ID NO: 1316407 - DNA, 22 bp, Artificial Sequence
  chemically synthesized
ctattctaacgtcacaatctcc

SEQ ID NO: 1316408 - DNA, 22 bp, Artificial Sequence
  chemically synthesized
attaataactctggagattgtg

SEQ ID NO: 1316409 - DNA, 22 bp, Artificial Sequence
  chemically synthesized
tattctaacgtcacaatctcca

SEQ ID NO: 1316410 - DNA, 22 bp, Artificial Sequence
  chemically synthesized
tgattaataactctggagattg

SEQ ID NO: 1316411 - DNA, 22 bp, Artificial Sequence
  chemically synthesized
ttctaacgtcacaatctccaga

SEQ ID NO: 1316412 - DNA, 22 bp, Artificial Sequence
  chemically synthesized
ctgattaataactctggagatt

SEQ ID NO: 1316413 - DNA, 22 bp, Artificial Sequence
  chemically synthesized
taacgtcacaatctccagagtt

SEQ ID NO: 1316414 - DNA, 22 bp, Artificial Sequence
  chemically synthesized
acgtcacaatctccagagttat

SEQ ID NO: 1316415 - DNA, 22 bp, Artificial Sequence
  chemically synthesized
aatgcaggtttctgattaataa

SEQ ID NO: 1316416 - DNA, 22 bp, Artificial Sequence
  chemically synthesized
aaatgcaggtttctgattaata

SEQ ID NO: 1316417 - DNA, 22 bp, Artificial Sequence
  chemically synthesized
cagagttattaatcagaaacct

SEQ ID NO: 1316418 - DNA, 22 bp, Artificial Sequence
  chemically synthesized
ttaatcagaaacctgcatttaa

SEQ ID NO: 1316419 - DNA, 22 bp, Artificial Sequence
  chemically synthesized
atcagaaacctgcatttaagac

SEQ ID NO: 1316420 - DNA, 22 bp, Artificial Sequence
  chemically synthesized
taaaatgtaacaggtggtctta

SEQ ID NO: 1316421 - DNA, 22 bp, Artificial Sequence
  chemically synthesized
catttaagaccacctgttacat

SEQ ID NO: 1316422 - DNA, 22 bp, Artificial Sequence
  chemically synthesized
ataccagctgtaaaatgtaaca

SEQ ID NO: 1316423 - DNA, 22 bp, Artificial Sequence
  chemically synthesized
aataccagctgtaaaatgtaac

SEQ ID NO: 1316424 - DNA, 22 bp, Artificial Sequence
  chemically synthesized
taataccagctgtaaaatgtaa

SEQ ID NO: 1316425 - DNA, 22 bp, Artificial Sequence
  chemically synthesized
aagaccacctgttacattttac

SEQ ID NO: 1316426 - DNA, 22 bp, Artificial Sequence
  chemically synthesized
agaccacctgttacattttaca

SEQ ID NO: 1316427 - DNA, 22 bp, Artificial Sequence
  chemically synthesized
ttacattttacagctggtatta

SEQ ID NO: 1316428 - DNA, 22 bp, Artificial Sequence
  chemically synthesized
cattttacagctggtattaaaa

SEQ ID NO: 1316429 - DNA, 22 bp, Artificial Sequence
  chemically synthesized
aaaaaaaaatggttttaatacc

SEQ ID NO: 1316430 - DNA, 22 bp, Artificial Sequence
  chemically synthesized
tctcaaaaaaaaatggttttaa

SEQ ID NO: 1316431 - DNA, 22 bp, Artificial Sequence
  chemically synthesized
tacagctggtattaaaaccatt

SEQ ID NO: 1316432 - DNA, 22 bp, Artificial Sequence
  chemically synthesized
acagctggtattaaaaccattt

SEQ ID NO: 1316433 - DNA, 22 bp, Artificial Sequence
  chemically synthesized
tgtctcaaaaaaaaatggtttt

SEQ ID NO: 1316434 - DNA, 22 bp, Artificial Sequence
  chemically synthesized
cagctggtattaaaaccatttt

SEQ ID NO: 1316435 - DNA, 22 bp, Artificial Sequence
  chemically synthesized
gtattaaaaccatttttttttg

SEQ ID NO: 1316436 - DNA, 22 bp, Artificial Sequence
  chemically synthesized
aaaccatttttttttgagacag

SEQ ID NO: 1316437 - DNA, 22 bp, Artificial Sequence
  chemically synthesized
ggcaacaagagagaaactctgt

SEQ ID NO: 1316438 - DNA, 22 bp, Artificial Sequence
  chemically synthesized
ttttttgagacagagtttctct

SEQ ID NO: 1316439 - DNA, 22 bp, Artificial Sequence
  chemically synthesized
tttttgagacagagtttctctc

SEQ ID NO: 1316440 - DNA, 22 bp, Artificial Sequence
  chemically synthesized
ttttgagacagagtttctctct

SEQ ID NO: 1316441 - DNA, 22 bp, Artificial Sequence
  chemically synthesized
tttgagacagagtttctctctt

SEQ ID NO: 1316442 - DNA, 22 bp, Artificial Sequence
  chemically synthesized
ttgagacagagtttctctcttg

SEQ ID NO: 1316443 - DNA, 22 bp, Artificial Sequence
  chemically synthesized
cagcctgggcaacaagagagaa

SEQ ID NO: 1316444 - DNA, 22 bp, Artificial Sequence
  chemically synthesized
tgagacagagtttctctcttgt

SEQ ID NO: 1316445 - DNA, 22 bp, Artificial Sequence
  chemically synthesized
gagacagagtttctctcttgtt

SEQ ID NO: 1316446 - DNA, 22 bp, Artificial Sequence
  chemically synthesized
agacagagtttctctcttgttg

SEQ ID NO: 1316447 - DNA, 22 bp, Artificial Sequence
  chemically synthesized
cactccagcctgggcaacaaga

SEQ ID NO: 1316448 - DNA, 22 bp, Artificial Sequence
  chemically synthesized
ctctcttgttgcccaggctgga

SEQ ID NO: 1316449 - DNA, 22 bp, Artificial Sequence
  chemically synthesized
tctcttgttgcccaggctggag

SEQ ID NO: 1316450 - DNA, 22 bp, Artificial Sequence
  chemically synthesized
tcttgttgcccaggctggagtg

SEQ ID NO: 1316451 - DNA, 22 bp, Artificial Sequence
  chemically synthesized
ttgttgcccaggctggagtgca

SEQ ID NO: 1316452 - DNA, 22 bp, Artificial Sequence
  chemically synthesized
gttgcccaggctggagtgcaat

SEQ ID NO: 1316453 - DNA, 22 bp, Artificial Sequence
  chemically synthesized
ttgcccaggctggagtgcaatg

SEQ ID NO: 1316454 - DNA, 22 bp, Artificial Sequence
  chemically synthesized
cccaggctggagtgcaatggca

SEQ ID NO: 1316455 - DNA, 22 bp, Artificial Sequence
  chemically synthesized
cggtgagccaagatcatgccat

SEQ ID NO: 1316456 - DNA, 22 bp, Artificial Sequence
  chemically synthesized
gagtgcaatggcatgatcttgg

SEQ ID NO: 1316457 - DNA, 22 bp, Artificial Sequence
  chemically synthesized
ggaggcggaggttgcggtgagc

SEQ ID NO: 1316458 - DNA, 22 bp, Artificial Sequence
  chemically synthesized
aacctaggaggcggaggttgcg

SEQ ID NO: 1316459 - DNA, 22 bp, Artificial Sequence
  chemically synthesized
gaacctaggaggcggaggttgc

SEQ ID NO: 1316460 - DNA, 22 bp, Artificial Sequence
  chemically synthesized
ggctcaccgcaacctccgcctc

SEQ ID NO: 1316461 - DNA, 22 bp, Artificial Sequence
  chemically synthesized
gctcaccgcaacctccgcctcc

SEQ ID NO: 1316462 - DNA, 22 bp, Artificial Sequence
  chemically synthesized
accgcaacctccgcctcctagg

SEQ ID NO: 1316463 - DNA, 22 bp, Artificial Sequence
  chemically synthesized
cgcctcctaggttcaagcgatt

SEQ ID NO: 1316464 - DNA, 22 bp, Artificial Sequence
  chemically synthesized
ctaggttcaagcgattctcctg

SEQ ID NO: 1316465 - DNA, 22 bp, Artificial Sequence
  chemically synthesized
gggagaccgaggcaggagaatc

SEQ ID NO: 1316466 - DNA, 22 bp, Artificial Sequence
  chemically synthesized
ggttcaagcgattctcctgcct

SEQ ID NO: 1316467 - DNA, 22 bp, Artificial Sequence
  chemically synthesized
ctcgggagaccgaggcaggaga

SEQ ID NO: 1316468 - DNA, 22 bp, Artificial Sequence
  chemically synthesized
aagcgattctcctgcctcggtc

SEQ ID NO: 1316469 - DNA, 22 bp, Artificial Sequence
  chemically synthesized
taatcccagctactcgggagac

SEQ ID NO: 1316470 - DNA, 22 bp, Artificial Sequence
  chemically synthesized
tcctgcctcggtctcccgagta

SEQ ID NO: 1316471 - DNA, 22 bp, Artificial Sequence
  chemically synthesized
ctgtaatcccagctactcggga

SEQ ID NO: 1316472 - DNA, 22 bp, Artificial Sequence
  chemically synthesized
ctgcctcggtctcccgagtagc

SEQ ID NO: 1316473 - DNA, 22 bp, Artificial Sequence
  chemically synthesized
cctcggtctcccgagtagctgg

SEQ ID NO: 1316474 - DNA, 22 bp, Artificial Sequence
  chemically synthesized
ggtctcccgagtagctgggatt

SEQ ID NO: 1316475 - DNA, 22 bp, Artificial Sequence
  chemically synthesized
ccgagtagctgggattacagga

SEQ ID NO: 1316476 - DNA, 22 bp, Artificial Sequence
  chemically synthesized
aaaatacaaaatcattcctgta

SEQ ID NO: 1316477 - DNA, 22 bp, Artificial Sequence
  chemically synthesized
ctaaaaatacaaaatcattcct

SEQ ID NO: 1316478 - DNA, 22 bp, Artificial Sequence
  chemically synthesized
tactaaaaatacaaaatcattc

SEQ ID NO: 1316479 - DNA, 22 bp, Artificial Sequence
  chemically synthesized
ggattacaggaatgattttgta

SEQ ID NO: 1316480 - DNA, 22 bp, Artificial Sequence
  chemically synthesized
caggaatgattttgtattttta

SEQ ID NO: 1316481 - DNA, 22 bp, Artificial Sequence
  chemically synthesized
tgtatttttagtagagatgggg

SEQ ID NO: 1316482 - DNA, 22 bp, Artificial Sequence
  chemically synthesized
gtatttttagtagagatggggt

SEQ ID NO: 1316483 - DNA, 22 bp, Artificial Sequence
  chemically synthesized
tatttttagtagagatggggtt

SEQ ID NO: 1316484 - DNA, 22 bp, Artificial Sequence
  chemically synthesized
accaacatggagaaaccccatc

SEQ ID NO: 1316485 - DNA, 22 bp, Artificial Sequence
  chemically synthesized
ttagtagagatggggtttctcc

SEQ ID NO: 1316486 - DNA, 22 bp, Artificial Sequence
  chemically synthesized
tagtagagatggggtttctcca

SEQ ID NO: 1316487 - DNA, 22 bp, Artificial Sequence
  chemically synthesized
agtagagatggggtttctccat

SEQ ID NO: 1316488 - DNA, 22 bp, Artificial Sequence
  chemically synthesized
gtagagatggggtttctccatg

SEQ ID NO: 1316489 - DNA, 22 bp, Artificial Sequence
  chemically synthesized
aagaccagcctgaccaacatgg

SEQ ID NO: 1316490 - DNA, 22 bp, Artificial Sequence
  chemically synthesized
ctccatgttggtcaggctggtc

SEQ ID NO: 1316491 - DNA, 22 bp, Artificial Sequence
  chemically synthesized
tccatgttggtcaggctggtct

SEQ ID NO: 1316492 - DNA, 22 bp, Artificial Sequence
  chemically synthesized
catgttggtcaggctggtcttg

SEQ ID NO: 1316493 - DNA, 22 bp, Artificial Sequence
  chemically synthesized
aggtcgggagttcaagaccagc

SEQ ID NO: 1316494 - DNA, 22 bp, Artificial Sequence
  chemically synthesized
gtcaggctggtcttgaactccc

SEQ ID NO: 1316495 - DNA, 22 bp, Artificial Sequence
  chemically synthesized
gtcttgaactcccgacctcagg

SEQ ID NO: 1316496 - DNA, 22 bp, Artificial Sequence
  chemically synthesized
gaactcccgacctcaggtgatc

SEQ ID NO: 1316497 - DNA, 22 bp, Artificial Sequence
  chemically synthesized
aactcccgacctcaggtgatct

SEQ ID NO: 1316498 - DNA, 22 bp, Artificial Sequence
  chemically synthesized
ggaggccgaggtgggcagatca

SEQ ID NO: 1316499 - DNA, 22 bp, Artificial Sequence
  chemically synthesized
ccgacctcaggtgatctgccca

SEQ ID NO: 1316500 - DNA, 22 bp, Artificial Sequence
  chemically synthesized
aggtgatctgcccacctcggcc

SEQ ID NO: 1316501 - DNA, 22 bp, Artificial Sequence
  chemically synthesized
taatcccagcacgttaggaggc

SEQ ID NO: 1316502 - DNA, 22 bp, Artificial Sequence
  chemically synthesized
cccacctcggcctcctaacgtg

SEQ ID NO: 1316503 - DNA, 22 bp, Artificial Sequence
  chemically synthesized
atgcctgtaatcccagcacgtt

SEQ ID NO: 1316504 - DNA, 22 bp, Artificial Sequence
  chemically synthesized
ggcctcctaacgtgctgggatt

SEQ ID NO: 1316505 - DNA, 22 bp, Artificial Sequence
  chemically synthesized
ctaacgtgctgggattacaggc

SEQ ID NO: 1316506 - DNA, 22 bp, Artificial Sequence
  chemically synthesized
acgtgctgggattacaggcatg

SEQ ID NO: 1316507 - DNA, 22 bp, Artificial Sequence
  chemically synthesized
taggccgggcatggtggctcat

SEQ ID NO: 1316508 - DNA, 22 bp, Artificial Sequence
  chemically synthesized
ggattacaggcatgagccacca

SEQ ID NO: 1316509 - DNA, 22 bp, Artificial Sequence
  chemically synthesized
ataggccgggcatggtggctca

SEQ ID NO: 1316510 - DNA, 22 bp, Artificial Sequence
  chemically synthesized
tataggccgggcatggtggctc

SEQ ID NO: 1316511 - DNA, 22 bp, Artificial Sequence
  chemically synthesized
caggcatgagccaccatgcccg

SEQ ID NO: 1316512 - DNA, 22 bp, Artificial Sequence
  chemically synthesized
aaagatggttttataggccggg

SEQ ID NO: 1316513 - DNA, 22 bp, Artificial Sequence
  chemically synthesized
aaaagatggttttataggccgg

SEQ ID NO: 1316514 - DNA, 22 bp, Artificial Sequence
  chemically synthesized
ttaaaagatggttttataggcc

SEQ ID NO: 1316515 - DNA, 22 bp, Artificial Sequence
  chemically synthesized
tcctcttaaaagatggttttat

SEQ ID NO: 1316516 - DNA, 22 bp, Artificial Sequence
  chemically synthesized
gtcctcttaaaagatggtttta

SEQ ID NO: 1316517 - DNA, 22 bp, Artificial Sequence
  chemically synthesized
tgtcctcttaaaagatggtttt

SEQ ID NO: 1316518 - DNA, 22 bp, Artificial Sequence
  chemically synthesized
ttgtcctcttaaaagatggttt

SEQ ID NO: 1316519 - DNA, 22 bp, Artificial Sequence
  chemically synthesized
atttttgtcctcttaaaagatg

SEQ ID NO: 1316520 - DNA, 22 bp, Artificial Sequence
  chemically synthesized
tctcatttttgtcctcttaaaa

SEQ ID NO: 1316521 - DNA, 22 bp, Artificial Sequence
  chemically synthesized
taaaaccatcttttaagaggac

SEQ ID NO: 1316522 - DNA, 22 bp, Artificial Sequence
  chemically synthesized
ttgtctcatttttgtcctctta

SEQ ID NO: 1316523 - DNA, 22 bp, Artificial Sequence
  chemically synthesized
ttaagaggacaaaaatgagaca

SEQ ID NO: 1316524 - DNA, 22 bp, Artificial Sequence
  chemically synthesized
taagaggacaaaaatgagacaa

SEQ ID NO: 1316525 - DNA, 22 bp, Artificial Sequence
  chemically synthesized
aagaggacaaaaatgagacaac

SEQ ID NO: 1316526 - DNA, 22 bp, Artificial Sequence
  chemically synthesized
agaggacaaaaatgagacaaca

SEQ ID NO: 1316527 - DNA, 22 bp, Artificial Sequence
  chemically synthesized
tgtcgtccacaggcaattgttg

SEQ ID NO: 1316528 - DNA, 22 bp, Artificial Sequence
  chemically synthesized
gtgtcgtccacaggcaattgtt

SEQ ID NO: 1316529 - DNA, 22 bp, Artificial Sequence
  chemically synthesized
caatgtttgtgtcgtccacagg

SEQ ID NO: 1316530 - DNA, 22 bp, Artificial Sequence
  chemically synthesized
tacaatgtttgtgtcgtccaca

SEQ ID NO: 1316531 - DNA, 22 bp, Artificial Sequence
  chemically synthesized
ctctacaatgtttgtgtcgtcc

SEQ ID NO: 1316532 - DNA, 22 bp, Artificial Sequence
  chemically synthesized
gctactctacaatgtttgtgtc

SEQ ID NO: 1316533 - DNA, 22 bp, Artificial Sequence
  chemically synthesized
tggctactctacaatgtttgtg

SEQ ID NO: 1316534 - DNA, 22 bp, Artificial Sequence
  chemically synthesized
cctgtggacgacacaaacattg

SEQ ID NO: 1316535 - DNA, 22 bp, Artificial Sequence
  chemically synthesized
actctggctactctacaatgtt

SEQ ID NO: 1316536 - DNA, 22 bp, Artificial Sequence
  chemically synthesized
tggacgacacaaacattgtaga

SEQ ID NO: 1316537 - DNA, 22 bp, Artificial Sequence
  chemically synthesized
aactctggctactctacaatgt

SEQ ID NO: 1316538 - DNA, 22 bp, Artificial Sequence
  chemically synthesized
taactctggctactctacaatg

SEQ ID NO: 1316539 - DNA, 22 bp, Artificial Sequence
  chemically synthesized
tgtctttaactctggctactct

SEQ ID NO: 1316540 - DNA, 22 bp, Artificial Sequence
  chemically synthesized
tcgattgtgtctttaactctgg

SEQ ID NO: 1316541 - DNA, 22 bp, Artificial Sequence
  chemically synthesized
gtcgattgtgtctttaactctg

SEQ ID NO: 1316542 - DNA, 22 bp, Artificial Sequence
  chemically synthesized
tagagtagccagagttaaagac

SEQ ID NO: 1316543 - DNA, 22 bp, Artificial Sequence
  chemically synthesized
cttgtcgattgtgtctttaact

SEQ ID NO: 1316544 - DNA, 22 bp, Artificial Sequence
  chemically synthesized
ccttgtcgattgtgtctttaac

SEQ ID NO: 1316545 - DNA, 22 bp, Artificial Sequence
  chemically synthesized
aagacacaatcgacaaggaaat

SEQ ID NO: 1316546 - DNA, 22 bp, Artificial Sequence
  chemically synthesized
tgtgccacagaggtaacaaatt

SEQ ID NO: 1316547 - DNA, 22 bp, Artificial Sequence
  chemically synthesized
aatggctatgtgccacagaggt

SEQ ID NO: 1316548 - DNA, 22 bp, Artificial Sequence
  chemically synthesized
tgttaaatggctatgtgccaca

SEQ ID NO: 1316549 - DNA, 22 bp, Artificial Sequence
  chemically synthesized
gttacctctgtggcacatagcc

SEQ ID NO: 1316550 - DNA, 22 bp, Artificial Sequence
  chemically synthesized
ttacctctgtggcacatagcca

SEQ ID NO: 1316551 - DNA, 22 bp, Artificial Sequence
  chemically synthesized
taattatgttaaatggctatgt

SEQ ID NO: 1316552 - DNA, 22 bp, Artificial Sequence
  chemically synthesized
cctctgtggcacatagccattt

SEQ ID NO: 1316553 - DNA, 22 bp, Artificial Sequence
  chemically synthesized
tgtggcacatagccatttaaca

SEQ ID NO: 1316554 - DNA, 22 bp, Artificial Sequence
  chemically synthesized
tggcacatagccatttaacata

SEQ ID NO: 1316555 - DNA, 22 bp, Artificial Sequence
  chemically synthesized
tcagtaataattgtaattatgt

SEQ ID NO: 1316556 - DNA, 22 bp, Artificial Sequence
  chemically synthesized
gtatatgttatcagtaataatt

SEQ ID NO: 1316557 - DNA, 22 bp, Artificial Sequence
  chemically synthesized
aacataattacaattattactg

SEQ ID NO: 1316558 - DNA, 22 bp, Artificial Sequence
  chemically synthesized
agtatatgttatcagtaataat

SEQ ID NO: 1316559 - DNA, 22 bp, Artificial Sequence
  chemically synthesized
acataattacaattattactga

SEQ ID NO: 1316560 - DNA, 22 bp, Artificial Sequence
  chemically synthesized
atatgacttagtatatgttatc

SEQ ID NO: 1316561 - DNA, 22 bp, Artificial Sequence
  chemically synthesized
caattattactgataacatata

SEQ ID NO: 1316562 - DNA, 22 bp, Artificial Sequence
  chemically synthesized
taatatgacttagtatatgtta

SEQ ID NO: 1316563 - DNA, 22 bp, Artificial Sequence
  chemically synthesized
ttactgataacatatactaagt

SEQ ID NO: 1316564 - DNA, 22 bp, Artificial Sequence
  chemically synthesized
taattctaatatgacttagtat

SEQ ID NO: 1316565 - DNA, 22 bp, Artificial Sequence
  chemically synthesized
ctgataacatatactaagtcat

SEQ ID NO: 1316566 - DNA, 22 bp, Artificial Sequence
  chemically synthesized
ctataattctaatatgacttag

SEQ ID NO: 1316567 - DNA, 22 bp, Artificial Sequence
  chemically synthesized
ataacatatactaagtcatatt

SEQ ID NO: 1316568 - DNA, 22 bp, Artificial Sequence
  chemically synthesized
tgtaaaactcctataattctaa

SEQ ID NO: 1316569 - DNA, 22 bp, Artificial Sequence
  chemically synthesized
agtcatattagaattataggag

SEQ ID NO: 1316570 - DNA, 22 bp, Artificial Sequence
  chemically synthesized
agattatgtaaaactcctataa

SEQ ID NO: 1316571 - DNA, 22 bp, Artificial Sequence
  chemically synthesized
tgagattatgtaaaactcctat

SEQ ID NO: 1316572 - DNA, 22 bp, Artificial Sequence
  chemically synthesized
gaattataggagttttacataa

SEQ ID NO: 1316573 - DNA, 22 bp, Artificial Sequence
  chemically synthesized
acatatgttctgagattatgta

SEQ ID NO: 1316574 - DNA, 22 bp, Artificial Sequence
  chemically synthesized
taggagttttacataatctcag

SEQ ID NO: 1316575 - DNA, 22 bp, Artificial Sequence
  chemically synthesized
tacataatctcagaacatatgt

SEQ ID NO: 1316576 - DNA, 22 bp, Artificial Sequence
  chemically synthesized
acataatctcagaacatatgtc

SEQ ID NO: 1316577 - DNA, 22 bp, Artificial Sequence
  chemically synthesized
cataatctcagaacatatgtca

SEQ ID NO: 1316578 - DNA, 22 bp, Artificial Sequence
  chemically synthesized
tgtaaatatatgattgacatat

SEQ ID NO: 1316579 - DNA, 22 bp, Artificial Sequence
  chemically synthesized
gtgtaaatatatgattgacata

SEQ ID NO: 1316580 - DNA, 22 bp, Artificial Sequence
  chemically synthesized
tatttgtgtaaatatatgattg

SEQ ID NO: 1316581 - DNA, 22 bp, Artificial Sequence
  chemically synthesized
agaacatatgtcaatcatatat

SEQ ID NO: 1316582 - DNA, 22 bp, Artificial Sequence
  chemically synthesized
ggggctatatttgtgtaaatat

SEQ ID NO: 1316583 - DNA, 22 bp, Artificial Sequence
  chemically synthesized
gggggctatatttgtgtaaata

SEQ ID NO: 1316584 - DNA, 22 bp, Artificial Sequence
  chemically synthesized
tgggggctatatttgtgtaaat

SEQ ID NO: 1316585 - DNA, 22 bp, Artificial Sequence
  chemically synthesized
ttgggggctatatttgtgtaaa

SEQ ID NO: 1316586 - DNA, 22 bp, Artificial Sequence
  chemically synthesized
tttgggggctatatttgtgtaa

SEQ ID NO: 1316587 - DNA, 22 bp, Artificial Sequence
  chemically synthesized
gctttttgggggctatatttgt

SEQ ID NO: 1316588 - DNA, 22 bp, Artificial Sequence
  chemically synthesized
ggctttttgggggctatatttg

SEQ ID NO: 1316589 - DNA, 22 bp, Artificial Sequence
  chemically synthesized
acacaaatatagcccccaaaaa

SEQ ID NO: 1316590 - DNA, 22 bp, Artificial Sequence
  chemically synthesized
cacaaatatagcccccaaaaag

SEQ ID NO: 1316591 - DNA, 22 bp, Artificial Sequence
  chemically synthesized
tcaaatatgaaatggtgtttgg

SEQ ID NO: 1316592 - DNA, 22 bp, Artificial Sequence
  chemically synthesized
catatttgacaatgtttcctgt

SEQ ID NO: 1316593 - DNA, 22 bp, Artificial Sequence
  chemically synthesized
cataaaaatcatacaggaaaca

SEQ ID NO: 1316594 - DNA, 22 bp, Artificial Sequence
  chemically synthesized
atatttgacaatgtttcctgta

SEQ ID NO: 1316595 - DNA, 22 bp, Artificial Sequence
  chemically synthesized
gcataaaaatcatacaggaaac

SEQ ID NO: 1316596 - DNA, 22 bp, Artificial Sequence
  chemically synthesized
tgcataaaaatcatacaggaaa

SEQ ID NO: 1316597 - DNA, 22 bp, Artificial Sequence
  chemically synthesized
gacaatgtttcctgtatgattt

SEQ ID NO: 1316598 - DNA, 22 bp, Artificial Sequence
  chemically synthesized
acaatgtttcctgtatgatttt

SEQ ID NO: 1316599 - DNA, 22 bp, Artificial Sequence
  chemically synthesized
gcgtattttgcataaaaatcat

SEQ ID NO: 1316600 - DNA, 22 bp, Artificial Sequence
  chemically synthesized
ggcgtattttgcataaaaatca

SEQ ID NO: 1316601 - DNA, 22 bp, Artificial Sequence
  chemically synthesized
cctgtatgatttttatgcaaaa

SEQ ID NO: 1316602 - DNA, 22 bp, Artificial Sequence
  chemically synthesized
ctgtatgatttttatgcaaaat

SEQ ID NO: 1316603 - DNA, 22 bp, Artificial Sequence
  chemically synthesized
tatgatttttatgcaaaatacg

SEQ ID NO: 1316604 - DNA, 22 bp, Artificial Sequence
  chemically synthesized
ttatgcaaaatacgccaaatgt

SEQ ID NO: 1316605 - DNA, 22 bp, Artificial Sequence
  chemically synthesized
tatgcaaaatacgccaaatgtc

SEQ ID NO: 1316606 - DNA, 22 bp, Artificial Sequence
  chemically synthesized
aagtccaaaaatgacatttggc

SEQ ID NO: 1316607 - DNA, 22 bp, Artificial Sequence
  chemically synthesized
atgcaaaatacgccaaatgtca

SEQ ID NO: 1316608 - DNA, 22 bp, Artificial Sequence
  chemically synthesized
tgcaaaatacgccaaatgtcat

SEQ ID NO: 1316609 - DNA, 22 bp, Artificial Sequence
  chemically synthesized
taaagtccaaaaatgacatttg

SEQ ID NO: 1316610 - DNA, 22 bp, Artificial Sequence
  chemically synthesized
ggtcctctaaagtccaaaaatg

SEQ ID NO: 1316611 - DNA, 22 bp, Artificial Sequence
  chemically synthesized
gatattaggtcctctaaagtcc

SEQ ID NO: 1316612 - DNA, 22 bp, Artificial Sequence
  chemically synthesized
agatattaggtcctctaaagtc

SEQ ID NO: 1316613 - DNA, 22 bp, Artificial Sequence
  chemically synthesized
tagatattaggtcctctaaagt

SEQ ID NO: 1316614 - DNA, 22 bp, Artificial Sequence
  chemically synthesized
ttagatattaggtcctctaaag

SEQ ID NO: 1316615 - DNA, 22 bp, Artificial Sequence
  chemically synthesized
atcttttagatattaggtcctc

SEQ ID NO: 1316616 - DNA, 22 bp, Artificial Sequence
  chemically synthesized
ttggactttagaggacctaata

SEQ ID NO: 1316617 - DNA, 22 bp, Artificial Sequence
  chemically synthesized
tggactttagaggacctaatat

SEQ ID NO: 1316618 - DNA, 22 bp, Artificial Sequence
  chemically synthesized
ggactttagaggacctaatatc

SEQ ID NO: 1316619 - DNA, 22 bp, Artificial Sequence
  chemically synthesized
gactttagaggacctaatatct

SEQ ID NO: 1316620 - DNA, 22 bp, Artificial Sequence
  chemically synthesized
gcctaatcttttagatattagg

SEQ ID NO: 1316621 - DNA, 22 bp, Artificial Sequence
  chemically synthesized
tggcctaatcttttagatatta

SEQ ID NO: 1316622 - DNA, 22 bp, Artificial Sequence
  chemically synthesized
ctggcctaatcttttagatatt

SEQ ID NO: 1316623 - DNA, 22 bp, Artificial Sequence
  chemically synthesized
tctggcctaatcttttagatat

SEQ ID NO: 1316624 - DNA, 22 bp, Artificial Sequence
  chemically synthesized
tagaggacctaatatctaaaag

SEQ ID NO: 1316625 - DNA, 22 bp, Artificial Sequence
  chemically synthesized
agaggacctaatatctaaaaga

SEQ ID NO: 1316626 - DNA, 22 bp, Artificial Sequence
  chemically synthesized
tttctggcctaatcttttagat

SEQ ID NO: 1316627 - DNA, 22 bp, Artificial Sequence
  chemically synthesized
gaggacctaatatctaaaagat

SEQ ID NO: 1316628 - DNA, 22 bp, Artificial Sequence
  chemically synthesized
tgtctctttctggcctaatctt

SEQ ID NO: 1316629 - DNA, 22 bp, Artificial Sequence
  chemically synthesized
atatctaaaagattaggccaga

SEQ ID NO: 1316630 - DNA, 22 bp, Artificial Sequence
  chemically synthesized
taaattatgtctctttctggcc

SEQ ID NO: 1316631 - DNA, 22 bp, Artificial Sequence
  chemically synthesized
aaagattaggccagaaagagac

SEQ ID NO: 1316632 - DNA, 22 bp, Artificial Sequence
  chemically synthesized
ggccagaaagagacataattta

SEQ ID NO: 1316633 - DNA, 22 bp, Artificial Sequence
  chemically synthesized
caaaatcaaattataaattatg

SEQ ID NO: 1316634 - DNA, 22 bp, Artificial Sequence
  chemically synthesized
ccaaaatcaaattataaattat

SEQ ID NO: 1316635 - DNA, 22 bp, Artificial Sequence
  chemically synthesized
tccaaaatcaaattataaatta

SEQ ID NO: 1316636 - DNA, 22 bp, Artificial Sequence
  chemically synthesized
gcaaactttccaaaatcaaatt

SEQ ID NO: 1316637 - DNA, 22 bp, Artificial Sequence
  chemically synthesized
ggcaaactttccaaaatcaaat

SEQ ID NO: 1316638 - DNA, 22 bp, Artificial Sequence
  chemically synthesized
atatttggcaaactttccaaaa

SEQ ID NO: 1316639 - DNA, 22 bp, Artificial Sequence
  chemically synthesized
gatatttggcaaactttccaaa

SEQ ID NO: 1316640 - DNA, 22 bp, Artificial Sequence
  chemically synthesized
tgatatttggcaaactttccaa

SEQ ID NO: 1316641 - DNA, 22 bp, Artificial Sequence
  chemically synthesized
ataatttgattttggaaagttt

SEQ ID NO: 1316642 - DNA, 22 bp, Artificial Sequence
  chemically synthesized
taatttgattttggaaagtttg

SEQ ID NO: 1316643 - DNA, 22 bp, Artificial Sequence
  chemically synthesized
aacctttgatatttggcaaact

SEQ ID NO: 1316644 - DNA, 22 bp, Artificial Sequence
  chemically synthesized
aaacctttgatatttggcaaac

SEQ ID NO: 1316645 - DNA, 22 bp, Artificial Sequence
  chemically synthesized
gattttggaaagtttgccaaat

SEQ ID NO: 1316646 - DNA, 22 bp, Artificial Sequence
  chemically synthesized
taaacctttgatatttggcaaa

SEQ ID NO: 1316647 - DNA, 22 bp, Artificial Sequence
  chemically synthesized
attttggaaagtttgccaaata

SEQ ID NO: 1316648 - DNA, 22 bp, Artificial Sequence
  chemically synthesized
tggaaagtttgccaaatatcaa

SEQ ID NO: 1316649 - DNA, 22 bp, Artificial Sequence
  chemically synthesized
ggaaagtttgccaaatatcaaa

SEQ ID NO: 1316650 - DNA, 22 bp, Artificial Sequence
  chemically synthesized
gaaagtttgccaaatatcaaag

SEQ ID NO: 1316651 - DNA, 22 bp, Artificial Sequence
  chemically synthesized
gccaaatatcaaaggtttaaaa

SEQ ID NO: 1316652 - DNA, 22 bp, Artificial Sequence
  chemically synthesized
tgatatccagtgttttaaacct

SEQ ID NO: 1316653 - DNA, 22 bp, Artificial Sequence
  chemically synthesized
ccaaatatcaaaggtttaaaac

SEQ ID NO: 1316654 - DNA, 22 bp, Artificial Sequence
  chemically synthesized
gtgatatccagtgttttaaacc

SEQ ID NO: 1316655 - DNA, 22 bp, Artificial Sequence
  chemically synthesized
tgtgatatccagtgttttaaac

SEQ ID NO: 1316656 - DNA, 22 bp, Artificial Sequence
  chemically synthesized
ttttgtgatatccagtgtttta

SEQ ID NO: 1316657 - DNA, 22 bp, Artificial Sequence
  chemically synthesized
tattttgtgatatccagtgttt

SEQ ID NO: 1316658 - DNA, 22 bp, Artificial Sequence
  chemically synthesized
ggattctattttgtgatatcca

SEQ ID NO: 1316659 - DNA, 22 bp, Artificial Sequence
  chemically synthesized
aaaacactggatatcacaaaat

SEQ ID NO: 1316660 - DNA, 22 bp, Artificial Sequence
  chemically synthesized
aaacactggatatcacaaaata

SEQ ID NO: 1316661 - DNA, 22 bp, Artificial Sequence
  chemically synthesized
tggtgacctgggattctatttt

SEQ ID NO: 1316662 - DNA, 22 bp, Artificial Sequence
  chemically synthesized
atggtgacctgggattctattt

SEQ ID NO: 1316663 - DNA, 22 bp, Artificial Sequence
  chemically synthesized
gatatcacaaaatagaatccca

SEQ ID NO: 1316664 - DNA, 22 bp, Artificial Sequence
  chemically synthesized
gtcaaatgaatgacttatggtg

SEQ ID NO: 1316665 - DNA, 22 bp, Artificial Sequence
  chemically synthesized
ggtcaaatgaatgacttatggt

SEQ ID NO: 1316666 - DNA, 22 bp, Artificial Sequence
  chemically synthesized
tggtcaaatgaatgacttatgg

SEQ ID NO: 1316667 - DNA, 22 bp, Artificial Sequence
  chemically synthesized
tcgttttggtcaaatgaatgac

SEQ ID NO: 1316668 - DNA, 22 bp, Artificial Sequence
  chemically synthesized
gagttatcgttttggtcaaatg

SEQ ID NO: 1316669 - DNA, 22 bp, Artificial Sequence
  chemically synthesized
ggagttatcgttttggtcaaat

SEQ ID NO: 1316670 - DNA, 22 bp, Artificial Sequence
  chemically synthesized
tggagttatcgttttggtcaaa

SEQ ID NO: 1316671 - DNA, 22 bp, Artificial Sequence
  chemically synthesized
agattttggagttatcgttttg

SEQ ID NO: 1316672 - DNA, 22 bp, Artificial Sequence
  chemically synthesized
aagattttggagttatcgtttt

SEQ ID NO: 1316673 - DNA, 22 bp, Artificial Sequence
  chemically synthesized
taagattttggagttatcgttt

SEQ ID NO: 1316674 - DNA, 22 bp, Artificial Sequence
  chemically synthesized
ttaagattttggagttatcgtt

SEQ ID NO: 1316675 - DNA, 22 bp, Artificial Sequence
  chemically synthesized
atttgaccaaaacgataactcc

SEQ ID NO: 1316676 - DNA, 22 bp, Artificial Sequence
  chemically synthesized
ttttaagattttggagttatcg

SEQ ID NO: 1316677 - DNA, 22 bp, Artificial Sequence
  chemically synthesized
cttttaagattttggagttatc

SEQ ID NO: 1316678 - DNA, 22 bp, Artificial Sequence
  chemically synthesized
tcttttaagattttggagttat

SEQ ID NO: 1316679 - DNA, 22 bp, Artificial Sequence
  chemically synthesized
ttcttttaagattttggagtta

SEQ ID NO: 1316680 - DNA, 22 bp, Artificial Sequence
  chemically synthesized
gaccaaaacgataactccaaaa

SEQ ID NO: 1316681 - DNA, 22 bp, Artificial Sequence
  chemically synthesized
accaaaacgataactccaaaat

SEQ ID NO: 1316682 - DNA, 22 bp, Artificial Sequence
  chemically synthesized
tcagaataaaggtttttctttt

SEQ ID NO: 1316683 - DNA, 22 bp, Artificial Sequence
  chemically synthesized
tgtcagaataaaggtttttctt

SEQ ID NO: 1316684 - DNA, 22 bp, Artificial Sequence
  chemically synthesized
caaaatcttaaaagaaaaacct

SEQ ID NO: 1316685 - DNA, 22 bp, Artificial Sequence
  chemically synthesized
ctctgtcagaataaaggttttt

SEQ ID NO: 1316686 - DNA, 22 bp, Artificial Sequence
  chemically synthesized
agtctcctctgtcagaataaag

SEQ ID NO: 1316687 - DNA, 22 bp, Artificial Sequence
  chemically synthesized
aaaagaaaaacctttattctga

SEQ ID NO: 1316688 - DNA, 22 bp, Artificial Sequence
  chemically synthesized
aaagaaaaacctttattctgac

SEQ ID NO: 1316689 - DNA, 22 bp, Artificial Sequence
  chemically synthesized
gaaagctaagtctcctctgtca

SEQ ID NO: 1316690 - DNA, 22 bp, Artificial Sequence
  chemically synthesized
ggaaagctaagtctcctctgtc

SEQ ID NO: 1316691 - DNA, 22 bp, Artificial Sequence
  chemically synthesized
tttggaaagctaagtctcctct

SEQ ID NO: 1316692 - DNA, 22 bp, Artificial Sequence
  chemically synthesized
gtttggaaagctaagtctcctc

SEQ ID NO: 1316693 - DNA, 22 bp, Artificial Sequence
  chemically synthesized
tattctgacagaggagacttag

SEQ ID NO: 1316694 - DNA, 22 bp, Artificial Sequence
  chemically synthesized
attctgacagaggagacttagc

SEQ ID NO: 1316695 - DNA, 22 bp, Artificial Sequence
  chemically synthesized
ttctgacagaggagacttagct

SEQ ID NO: 1316696 - DNA, 22 bp, Artificial Sequence
  chemically synthesized
ggtcttgtttggaaagctaagt

SEQ ID NO: 1316697 - DNA, 22 bp, Artificial Sequence
  chemically synthesized
tgacagaggagacttagctttc

SEQ ID NO: 1316698 - DNA, 22 bp, Artificial Sequence
  chemically synthesized
acagaggagacttagctttcca

SEQ ID NO: 1316699 - DNA, 22 bp, Artificial Sequence
  chemically synthesized
ttgggtcttgtttggaaagcta

SEQ ID NO: 1316700 - DNA, 22 bp, Artificial Sequence
  chemically synthesized
attgggtcttgtttggaaagct

SEQ ID NO: 1316701 - DNA, 22 bp, Artificial Sequence
  chemically synthesized
tattgggtcttgtttggaaagc

SEQ ID NO: 1316702 - DNA, 22 bp, Artificial Sequence
  chemically synthesized
tctttattgggtcttgtttgga

SEQ ID NO: 1316703 - DNA, 22 bp, Artificial Sequence
  chemically synthesized
atgctgtctttattgggtcttg

SEQ ID NO: 1316704 - DNA, 22 bp, Artificial Sequence
  chemically synthesized
agctttccaaacaagacccaat

SEQ ID NO: 1316705 - DNA, 22 bp, Artificial Sequence
  chemically synthesized
gctttccaaacaagacccaata

SEQ ID NO: 1316706 - DNA, 22 bp, Artificial Sequence
  chemically synthesized
tcctcatgctgtctttattggg

SEQ ID NO: 1316707 - DNA, 22 bp, Artificial Sequence
  chemically synthesized
tccaaacaagacccaataaaga

SEQ ID NO: 1316708 - DNA, 22 bp, Artificial Sequence
  chemically synthesized
ccaaacaagacccaataaagac

SEQ ID NO: 1316709 - DNA, 22 bp, Artificial Sequence
  chemically synthesized
caaacaagacccaataaagaca

SEQ ID NO: 1316710 - DNA, 22 bp, Artificial Sequence
  chemically synthesized
agttatcctcatgctgtcttta

SEQ ID NO: 1316711 - DNA, 22 bp, Artificial Sequence
  chemically synthesized
aatttgtctcttctctctcccc

SEQ ID NO: 1316712 - DNA, 22 bp, Artificial Sequence
  chemically synthesized
gtctcttctctctccccttttc

SEQ ID NO: 1316713 - DNA, 22 bp, Artificial Sequence
  chemically synthesized
tctcttctctctccccttttcc

SEQ ID NO: 1316714 - DNA, 22 bp, Artificial Sequence
  chemically synthesized
ggtaaatggcaggggaaaaggg

SEQ ID NO: 1316715 - DNA, 22 bp, Artificial Sequence
  chemically synthesized
gggtaaatggcaggggaaaagg

SEQ ID NO: 1316716 - DNA, 22 bp, Artificial Sequence
  chemically synthesized
tgggtaaatggcaggggaaaag

SEQ ID NO: 1316717 - DNA, 22 bp, Artificial Sequence
  chemically synthesized
ttctctctccccttttcccctg

SEQ ID NO: 1316718 - DNA, 22 bp, Artificial Sequence
  chemically synthesized
ctctctccccttttcccctgcc

SEQ ID NO: 1316719 - DNA, 22 bp, Artificial Sequence
  chemically synthesized
ctttgggtaaatggcaggggaa

SEQ ID NO: 1316720 - DNA, 22 bp, Artificial Sequence
  chemically synthesized
tctctccccttttcccctgcca

SEQ ID NO: 1316721 - DNA, 22 bp, Artificial Sequence
  chemically synthesized
tcctttgggtaaatggcagggg

SEQ ID NO: 1316722 - DNA, 22 bp, Artificial Sequence
  chemically synthesized
tctccccttttcccctgccatt

SEQ ID NO: 1316723 - DNA, 22 bp, Artificial Sequence
  chemically synthesized
ctcctttgggtaaatggcaggg

SEQ ID NO: 1316724 - DNA, 22 bp, Artificial Sequence
  chemically synthesized
tctcctttgggtaaatggcagg

SEQ ID NO: 1316725 - DNA, 22 bp, Artificial Sequence
  chemically synthesized
tccccttttcccctgccattta

SEQ ID NO: 1316726 - DNA, 22 bp, Artificial Sequence
  chemically synthesized
cccttttcccctgccatttacc

SEQ ID NO: 1316727 - DNA, 22 bp, Artificial Sequence
  chemically synthesized
gctttctcctttgggtaaatgg

SEQ ID NO: 1316728 - DNA, 22 bp, Artificial Sequence
  chemically synthesized
ggctttctcctttgggtaaatg

SEQ ID NO: 1316729 - DNA, 22 bp, Artificial Sequence
  chemically synthesized
ttcccctgccatttacccaaag

SEQ ID NO: 1316730 - DNA, 22 bp, Artificial Sequence
  chemically synthesized
tcccctgccatttacccaaagg

SEQ ID NO: 1316731 - DNA, 22 bp, Artificial Sequence
  chemically synthesized
cccctgccatttacccaaagga

SEQ ID NO: 1316732 - DNA, 22 bp, Artificial Sequence
  chemically synthesized
ccctgccatttacccaaaggag

SEQ ID NO: 1316733 - DNA, 22 bp, Artificial Sequence
  chemically synthesized
ccatttacccaaaggagaaagc

SEQ ID NO: 1316734 - DNA, 22 bp, Artificial Sequence
  chemically synthesized
acccaaaggagaaagccaaacc

SEQ ID NO: 1316735 - DNA, 22 bp, Artificial Sequence
  chemically synthesized
cccaaaggagaaagccaaaccc

SEQ ID NO: 1316736 - DNA, 22 bp, Artificial Sequence
  chemically synthesized
aaagataatgaaagggtttggc

SEQ ID NO: 1316737 - DNA, 22 bp, Artificial Sequence
  chemically synthesized
taacgttaaaagataatgaaag

SEQ ID NO: 1316738 - DNA, 22 bp, Artificial Sequence
  chemically synthesized
gtaacgttaaaagataatgaaa

SEQ ID NO: 1316739 - DNA, 22 bp, Artificial Sequence
  chemically synthesized
tgtaacgttaaaagataatgaa

SEQ ID NO: 1316740 - DNA, 22 bp, Artificial Sequence
  chemically synthesized
ttgtaacgttaaaagataatga

SEQ ID NO: 1316741 - DNA, 22 bp, Artificial Sequence
  chemically synthesized
tttgtaacgttaaaagataatg

SEQ ID NO: 1316742 - DNA, 22 bp, Artificial Sequence
  chemically synthesized
ttttgtaacgttaaaagataat

SEQ ID NO: 1316743 - DNA, 22 bp, Artificial Sequence
  chemically synthesized
tcattatcttttaacgttacaa

SEQ ID NO: 1316744 - DNA, 22 bp, Artificial Sequence
  chemically synthesized
aagacgatttttttgtaacgtt

SEQ ID NO: 1316745 - DNA, 22 bp, Artificial Sequence
  chemically synthesized
cattatcttttaacgttacaaa

SEQ ID NO: 1316746 - DNA, 22 bp, Artificial Sequence
  chemically synthesized
gaagacgatttttttgtaacgt

SEQ ID NO: 1316747 - DNA, 22 bp, Artificial Sequence
  chemically synthesized
attatcttttaacgttacaaaa

SEQ ID NO: 1316748 - DNA, 22 bp, Artificial Sequence
  chemically synthesized
tgaagacgatttttttgtaacg

SEQ ID NO: 1316749 - DNA, 22 bp, Artificial Sequence
  chemically synthesized
ttgaagacgatttttttgtaac

SEQ ID NO: 1316750 - DNA, 22 bp, Artificial Sequence
  chemically synthesized
ttttgaagacgatttttttgta

SEQ ID NO: 1316751 - DNA, 22 bp, Artificial Sequence
  chemically synthesized
tcttttaacgttacaaaaaaat

SEQ ID NO: 1316752 - DNA, 22 bp, Artificial Sequence
  chemically synthesized
tcttttgaagacgatttttttg

SEQ ID NO: 1316753 - DNA, 22 bp, Artificial Sequence
  chemically synthesized
ctcttttgaagacgattttttt

SEQ ID NO: 1316754 - DNA, 22 bp, Artificial Sequence
  chemically synthesized
tctcttttgaagacgatttttt

SEQ ID NO: 1316755 - DNA, 22 bp, Artificial Sequence
  chemically synthesized
ttaacgttacaaaaaaatcgtc

SEQ ID NO: 1316756 - DNA, 22 bp, Artificial Sequence
  chemically synthesized
taacgttacaaaaaaatcgtct

SEQ ID NO: 1316757 - DNA, 22 bp, Artificial Sequence
  chemically synthesized
aacgttacaaaaaaatcgtctt

SEQ ID NO: 1316758 - DNA, 22 bp, Artificial Sequence
  chemically synthesized
acgttacaaaaaaatcgtcttc

SEQ ID NO: 1316759 - DNA, 22 bp, Artificial Sequence
  chemically synthesized
gttttctcttttgaagacgatt

SEQ ID NO: 1316760 - DNA, 22 bp, Artificial Sequence
  chemically synthesized
ggttttctcttttgaagacgat

SEQ ID NO: 1316761 - DNA, 22 bp, Artificial Sequence
  chemically synthesized
caaaaaaatcgtcttcaaaaga

SEQ ID NO: 1316762 - DNA, 22 bp, Artificial Sequence
  chemically synthesized
atgcgaacatgaaatttggttt

SEQ ID NO: 1316763 - DNA, 22 bp, Artificial Sequence
  chemically synthesized
caaaagagaaaaccaaatttca

SEQ ID NO: 1316764 - DNA, 22 bp, Artificial Sequence
  chemically synthesized
aaaagagaaaaccaaatttcat

SEQ ID NO: 1316765 - DNA, 22 bp, Artificial Sequence
  chemically synthesized
aagatgcactaatgcgaacatg

SEQ ID NO: 1316766 - DNA, 22 bp, Artificial Sequence
  chemically synthesized
gcattaaagatgcactaatgcg

SEQ ID NO: 1316767 - DNA, 22 bp, Artificial Sequence
  chemically synthesized
agcattaaagatgcactaatgc

SEQ ID NO: 1316768 - DNA, 22 bp, Artificial Sequence
  chemically synthesized
tagcattaaagatgcactaatg

SEQ ID NO: 1316769 - DNA, 22 bp, Artificial Sequence
  chemically synthesized
catgttcgcattagtgcatctt

SEQ ID NO: 1316770 - DNA, 22 bp, Artificial Sequence
  chemically synthesized
gctttagcattaaagatgcact

SEQ ID NO: 1316771 - DNA, 22 bp, Artificial Sequence
  chemically synthesized
atgttcgcattagtgcatcttt

SEQ ID NO: 1316772 - DNA, 22 bp, Artificial Sequence
  chemically synthesized
gcattagtgcatctttaatgct

SEQ ID NO: 1316773 - DNA, 22 bp, Artificial Sequence
  chemically synthesized
aaaactagctttagcattaaag

SEQ ID NO: 1316774 - DNA, 22 bp, Artificial Sequence
  chemically synthesized
aaaaactagctttagcattaaa

SEQ ID NO: 1316775 - DNA, 22 bp, Artificial Sequence
  chemically synthesized
tttaaaaactagctttagcatt

SEQ ID NO: 1316776 - DNA, 22 bp, Artificial Sequence
  chemically synthesized
atttaaaaactagctttagcat

SEQ ID NO: 1316777 - DNA, 22 bp, Artificial Sequence
  chemically synthesized
gtgcatctttaatgctaaagct

SEQ ID NO: 1316778 - DNA, 22 bp, Artificial Sequence
  chemically synthesized
tatttaaaaactagctttagca

SEQ ID NO: 1316779 - DNA, 22 bp, Artificial Sequence
  chemically synthesized
taatgctaaagctagtttttaa

SEQ ID NO: 1316780 - DNA, 22 bp, Artificial Sequence
  chemically synthesized
aatgctaaagctagtttttaaa

SEQ ID NO: 1316781 - DNA, 22 bp, Artificial Sequence
  chemically synthesized
atgctaaagctagtttttaaat

SEQ ID NO: 1316782 - DNA, 22 bp, Artificial Sequence
  chemically synthesized
aagctagtttttaaataaaatt

SEQ ID NO: 1316783 - DNA, 22 bp, Artificial Sequence
  chemically synthesized
gatagatacataaaattttatt

SEQ ID NO: 1316784 - DNA, 22 bp, Artificial Sequence
  chemically synthesized
gtttttaaataaaattttatgt

SEQ ID NO: 1316785 - DNA, 22 bp, Artificial Sequence
  chemically synthesized
aaactggatagatacataaaat

SEQ ID NO: 1316786 - DNA, 22 bp, Artificial Sequence
  chemically synthesized
ttaaataaaattttatgtatct

SEQ ID NO: 1316787 - DNA, 22 bp, Artificial Sequence
  chemically synthesized
taaataaaattttatgtatcta

SEQ ID NO: 1316788 - DNA, 22 bp, Artificial Sequence
  chemically synthesized
attaaaactggatagatacata

SEQ ID NO: 1316789 - DNA, 22 bp, Artificial Sequence
  chemically synthesized
aaataaaattttatgtatctat

SEQ ID NO: 1316790 - DNA, 22 bp, Artificial Sequence
  chemically synthesized
aataaaattttatgtatctatc

SEQ ID NO: 1316791 - DNA, 22 bp, Artificial Sequence
  chemically synthesized
tggtcaaactaattaaaactgg

SEQ ID NO: 1316792 - DNA, 22 bp, Artificial Sequence
  chemically synthesized
tatgtatctatccagttttaat

SEQ ID NO: 1316793 - DNA, 22 bp, Artificial Sequence
  chemically synthesized
gtggtcaaactaattaaaactg

SEQ ID NO: 1316794 - DNA, 22 bp, Artificial Sequence
  chemically synthesized
atgtatctatccagttttaatt

SEQ ID NO: 1316795 - DNA, 22 bp, Artificial Sequence
  chemically synthesized
tgtatctatccagttttaatta

SEQ ID NO: 1316796 - DNA, 22 bp, Artificial Sequence
  chemically synthesized
tccagttttaattagtttgacc

SEQ ID NO: 1316797 - DNA, 22 bp, Artificial Sequence
  chemically synthesized
tgagaatgtcaccttgtggtca

SEQ ID NO: 1316798 - DNA, 22 bp, Artificial Sequence
  chemically synthesized
atgagaatgtcaccttgtggtc

SEQ ID NO: 1316799 - DNA, 22 bp, Artificial Sequence
  chemically synthesized
taattagtttgaccacaaggtg

SEQ ID NO: 1316800 - DNA, 22 bp, Artificial Sequence
  chemically synthesized
aattagtttgaccacaaggtga

SEQ ID NO: 1316801 - DNA, 22 bp, Artificial Sequence
  chemically synthesized
attagtttgaccacaaggtgac

SEQ ID NO: 1316802 - DNA, 22 bp, Artificial Sequence
  chemically synthesized
gtttgaccacaaggtgacattc

SEQ ID NO: 1316803 - DNA, 22 bp, Artificial Sequence
  chemically synthesized
aaaagtttatgagaatgtcacc

SEQ ID NO: 1316804 - DNA, 22 bp, Artificial Sequence
  chemically synthesized
taaaaagtttatgagaatgtca

SEQ ID NO: 1316805 - DNA, 22 bp, Artificial Sequence
  chemically synthesized
gaccacaaggtgacattctcat

SEQ ID NO: 1316806 - DNA, 22 bp, Artificial Sequence
  chemically synthesized
accacaaggtgacattctcata

SEQ ID NO: 1316807 - DNA, 22 bp, Artificial Sequence
  chemically synthesized
taaagcgttctaaaaagtttat

SEQ ID NO: 1316808 - DNA, 22 bp, Artificial Sequence
  chemically synthesized
tcataaactttttagaacgctt

SEQ ID NO: 1316809 - DNA, 22 bp, Artificial Sequence
  chemically synthesized
atggaaaattataaagcgttct

SEQ ID NO: 1316810 - DNA, 22 bp, Artificial Sequence
  chemically synthesized
ataaactttttagaacgcttta

SEQ ID NO: 1316811 - DNA, 22 bp, Artificial Sequence
  chemically synthesized
aatggaaaattataaagcgttc

SEQ ID NO: 1316812 - DNA, 22 bp, Artificial Sequence
  chemically synthesized
tttaatggaaaattataaagcg

SEQ ID NO: 1316813 - DNA, 22 bp, Artificial Sequence
  chemically synthesized
ctgtttaatggaaaattataaa

SEQ ID NO: 1316814 - DNA, 22 bp, Artificial Sequence
  chemically synthesized
tttagaacgctttataattttc

SEQ ID NO: 1316815 - DNA, 22 bp, Artificial Sequence
  chemically synthesized
ttagaacgctttataattttcc

SEQ ID NO: 1316816 - DNA, 22 bp, Artificial Sequence
  chemically synthesized
tagaacgctttataattttcca

SEQ ID NO: 1316817 - DNA, 22 bp, Artificial Sequence
  chemically synthesized
agaacgctttataattttccat

SEQ ID NO: 1316818 - DNA, 22 bp, Artificial Sequence
  chemically synthesized
atctgctgtttaatggaaaatt

SEQ ID NO: 1316819 - DNA, 22 bp, Artificial Sequence
  chemically synthesized
gaacgctttataattttccatt

SEQ ID NO: 1316820 - DNA, 22 bp, Artificial Sequence
  chemically synthesized
gaaaattgatctgctgtttaat

SEQ ID NO: 1316821 - DNA, 22 bp, Artificial Sequence
  chemically synthesized
tataattttccattaaacagca

SEQ ID NO: 1316822 - DNA, 22 bp, Artificial Sequence
  chemically synthesized
agaaaattgatctgctgtttaa

SEQ ID NO: 1316823 - DNA, 22 bp, Artificial Sequence
  chemically synthesized
ataattttccattaaacagcag

SEQ ID NO: 1316824 - DNA, 22 bp, Artificial Sequence
  chemically synthesized
taattttccattaaacagcaga

SEQ ID NO: 1316825 - DNA, 22 bp, Artificial Sequence
  chemically synthesized
ttagaaaattgatctgctgttt

SEQ ID NO: 1316826 - DNA, 22 bp, Artificial Sequence
  chemically synthesized
cttagaaaattgatctgctgtt

SEQ ID NO: 1316827 - DNA, 22 bp, Artificial Sequence
  chemically synthesized
tccattaaacagcagatcaatt

SEQ ID NO: 1316828 - DNA, 22 bp, Artificial Sequence
  chemically synthesized
ccattaaacagcagatcaattt

SEQ ID NO: 1316829 - DNA, 22 bp, Artificial Sequence
  chemically synthesized
cattaaacagcagatcaatttt

SEQ ID NO: 1316830 - DNA, 22 bp, Artificial Sequence
  chemically synthesized
aacagcagatcaattttctaag

SEQ ID NO: 1316831 - DNA, 22 bp, Artificial Sequence
  chemically synthesized
tctaagaagaccctgttatttg

SEQ ID NO: 1316832 - DNA, 22 bp, Artificial Sequence
  chemically synthesized
ggcccatgtgtccaaataacag

SEQ ID NO: 1316833 - DNA, 22 bp, Artificial Sequence
  chemically synthesized
ctaagaagaccctgttatttgg

SEQ ID NO: 1316834 - DNA, 22 bp, Artificial Sequence
  chemically synthesized
taagaagaccctgttatttgga

SEQ ID NO: 1316835 - DNA, 22 bp, Artificial Sequence
  chemically synthesized
agaagaccctgttatttggaca

SEQ ID NO: 1316836 - DNA, 22 bp, Artificial Sequence
  chemically synthesized
ttatttggacacatgggcccag

SEQ ID NO: 1316837 - DNA, 22 bp, Artificial Sequence
  chemically synthesized
tggggccagaatctgggcccat

SEQ ID NO: 1316838 - DNA, 22 bp, Artificial Sequence
  chemically synthesized
tttggacacatgggcccagatt

SEQ ID NO: 1316839 - DNA, 22 bp, Artificial Sequence
  chemically synthesized
ggacacatgggcccagattctg

SEQ ID NO: 1316840 - DNA, 22 bp, Artificial Sequence
  chemically synthesized
gacacatgggcccagattctgg

SEQ ID NO: 1316841 - DNA, 22 bp, Artificial Sequence
  chemically synthesized
aagtcatactgtggggccagaa

SEQ ID NO: 1316842 - DNA, 22 bp, Artificial Sequence
  chemically synthesized
aaatattaaagtcatactgtgg

SEQ ID NO: 1316843 - DNA, 22 bp, Artificial Sequence
  chemically synthesized
tggccccacagtatgactttaa

SEQ ID NO: 1316844 - DNA, 22 bp, Artificial Sequence
  chemically synthesized
taggttaaaatattaaagtcat

SEQ ID NO: 1316845 - DNA, 22 bp, Artificial Sequence
  chemically synthesized
gccccacagtatgactttaata

SEQ ID NO: 1316846 - DNA, 22 bp, Artificial Sequence
  chemically synthesized
tataggttaaaatattaaagtc

SEQ ID NO: 1316847 - DNA, 22 bp, Artificial Sequence
  chemically synthesized
ctataggttaaaatattaaagt

SEQ ID NO: 1316848 - DNA, 22 bp, Artificial Sequence
  chemically synthesized
tctataggttaaaatattaaag

SEQ ID NO: 1316849 - DNA, 22 bp, Artificial Sequence
  chemically synthesized
ttctataggttaaaatattaaa

SEQ ID NO: 1316850 - DNA, 22 bp, Artificial Sequence
  chemically synthesized
tttctataggttaaaatattaa

SEQ ID NO: 1316851 - DNA, 22 bp, Artificial Sequence
  chemically synthesized
gctttttctataggttaaaata

SEQ ID NO: 1316852 - DNA, 22 bp, Artificial Sequence
  chemically synthesized
agctttttctataggttaaaat

SEQ ID NO: 1316853 - DNA, 22 bp, Artificial Sequence
  chemically synthesized
tttagctttttctataggttaa

SEQ ID NO: 1316854 - DNA, 22 bp, Artificial Sequence
  chemically synthesized
taatattttaacctatagaaaa

SEQ ID NO: 1316855 - DNA, 22 bp, Artificial Sequence
  chemically synthesized
aatattttaacctatagaaaaa

SEQ ID NO: 1316856 - DNA, 22 bp, Artificial Sequence
  chemically synthesized
atattttaacctatagaaaaag

SEQ ID NO: 1316857 - DNA, 22 bp, Artificial Sequence
  chemically synthesized
aaaaaggttatttagctttttc

SEQ ID NO: 1316858 - DNA, 22 bp, Artificial Sequence
  chemically synthesized
gaaaaaggttatttagcttttt

SEQ ID NO: 1316859 - DNA, 22 bp, Artificial Sequence
  chemically synthesized
taacctatagaaaaagctaaat

SEQ ID NO: 1316860 - DNA, 22 bp, Artificial Sequence
  chemically synthesized
aacctatagaaaaagctaaata

SEQ ID NO: 1316861 - DNA, 22 bp, Artificial Sequence
  chemically synthesized
acctatagaaaaagctaaataa

SEQ ID NO: 1316862 - DNA, 22 bp, Artificial Sequence
  chemically synthesized
agatttgaaaaaggttatttag

SEQ ID NO: 1316863 - DNA, 22 bp, Artificial Sequence
  chemically synthesized
tagaaaaagctaaataaccttt

SEQ ID NO: 1316864 - DNA, 22 bp, Artificial Sequence
  chemically synthesized
gctaagatttgaaaaaggttat

SEQ ID NO: 1316865 - DNA, 22 bp, Artificial Sequence
  chemically synthesized
aataacctttttcaaatcttag

SEQ ID NO: 1316866 - DNA, 22 bp, Artificial Sequence
  chemically synthesized
tgggtataaacaagttggctaa

SEQ ID NO: 1316867 - DNA, 22 bp, Artificial Sequence
  chemically synthesized
tgtgggtataaacaagttggct

SEQ ID NO: 1316868 - DNA, 22 bp, Artificial Sequence
  chemically synthesized
tttcaaatcttagccaacttgt

SEQ ID NO: 1316869 - DNA, 22 bp, Artificial Sequence
  chemically synthesized
ttcaaatcttagccaacttgtt

SEQ ID NO: 1316870 - DNA, 22 bp, Artificial Sequence
  chemically synthesized
tcaaatcttagccaacttgttt

SEQ ID NO: 1316871 - DNA, 22 bp, Artificial Sequence
  chemically synthesized
caaatcttagccaacttgttta

SEQ ID NO: 1316872 - DNA, 22 bp, Artificial Sequence
  chemically synthesized
aaatcttagccaacttgtttat

SEQ ID NO: 1316873 - DNA, 22 bp, Artificial Sequence
  chemically synthesized
agccaacttgtttatacccaca

SEQ ID NO: 1316874 - DNA, 22 bp, Artificial Sequence
  chemically synthesized
gccaacttgtttatacccacag

SEQ ID NO: 1316875 - DNA, 22 bp, Artificial Sequence
  chemically synthesized
aaaaaaaaaattctgtgggtat

SEQ ID NO: 1316876 - DNA, 22 bp, Artificial Sequence
  chemically synthesized
atcctgaaaaaaaaaattctgt

SEQ ID NO: 1316877 - DNA, 22 bp, Artificial Sequence
  chemically synthesized
gtttatacccacagaatttttt

SEQ ID NO: 1316878 - DNA, 22 bp, Artificial Sequence
  chemically synthesized
tttatacccacagaattttttt

SEQ ID NO: 1316879 - DNA, 22 bp, Artificial Sequence
  chemically synthesized
atacccacagaatttttttttt

SEQ ID NO: 1316880 - DNA, 22 bp, Artificial Sequence
  chemically synthesized
tacccacagaattttttttttc

SEQ ID NO: 1316881 - DNA, 22 bp, Artificial Sequence
  chemically synthesized
tacagggttgatcctgaaaaaa

SEQ ID NO: 1316882 - DNA, 22 bp, Artificial Sequence
  chemically synthesized
atacagggttgatcctgaaaaa

SEQ ID NO: 1316883 - DNA, 22 bp, Artificial Sequence
  chemically synthesized
tttttttcaggatcaaccctgt

SEQ ID NO: 1316884 - DNA, 22 bp, Artificial Sequence
  chemically synthesized
ttttttcaggatcaaccctgta

SEQ ID NO: 1316885 - DNA, 22 bp, Artificial Sequence
  chemically synthesized
tttttcaggatcaaccctgtat

SEQ ID NO: 1316886 - DNA, 22 bp, Artificial Sequence
  chemically synthesized
ttttcaggatcaaccctgtata

SEQ ID NO: 1316887 - DNA, 22 bp, Artificial Sequence
  chemically synthesized
tttcaggatcaaccctgtataa

SEQ ID NO: 1316888 - DNA, 22 bp, Artificial Sequence
  chemically synthesized
ttcaggatcaaccctgtataaa

SEQ ID NO: 1316889 - DNA, 22 bp, Artificial Sequence
  chemically synthesized
tcaggatcaaccctgtataaac

SEQ ID NO: 1316890 - DNA, 22 bp, Artificial Sequence
  chemically synthesized
caggatcaaccctgtataaacc

SEQ ID NO: 1316891 - DNA, 22 bp, Artificial Sequence
  chemically synthesized
aggatcaaccctgtataaaccc

SEQ ID NO: 1316892 - DNA, 22 bp, Artificial Sequence
  chemically synthesized
agcaaagtgaaaagggtttata

SEQ ID NO: 1316893 - DNA, 22 bp, Artificial Sequence
  chemically synthesized
aagcaaagtgaaaagggtttat

SEQ ID NO: 1316894 - DNA, 22 bp, Artificial Sequence
  chemically synthesized
agggtttaagcaaagtgaaaag

SEQ ID NO: 1316895 - DNA, 22 bp, Artificial Sequence
  chemically synthesized
tataaacccttttcactttgct

SEQ ID NO: 1316896 - DNA, 22 bp, Artificial Sequence
  chemically synthesized
ttcactttgcttaaaccctcag

SEQ ID NO: 1316897 - DNA, 22 bp, Artificial Sequence
  chemically synthesized
tcactttgcttaaaccctcagt

SEQ ID NO: 1316898 - DNA, 22 bp, Artificial Sequence
  chemically synthesized
cactttgcttaaaccctcagtt

SEQ ID NO: 1316899 - DNA, 22 bp, Artificial Sequence
  chemically synthesized
actttgcttaaaccctcagttt

SEQ ID NO: 1316900 - DNA, 22 bp, Artificial Sequence
  chemically synthesized
tgcttaaaccctcagtttcgtt

SEQ ID NO: 1316901 - DNA, 22 bp, Artificial Sequence
  chemically synthesized
aaagagtaacggaacgaaactg

SEQ ID NO: 1316902 - DNA, 22 bp, Artificial Sequence
  chemically synthesized
gcttaaaccctcagtttcgttc

SEQ ID NO: 1316903 - DNA, 22 bp, Artificial Sequence
  chemically synthesized
cttaaaccctcagtttcgttcc

SEQ ID NO: 1316904 - DNA, 22 bp, Artificial Sequence
  chemically synthesized
aaaccctcagtttcgttccgtt

SEQ ID NO: 1316905 - DNA, 22 bp, Artificial Sequence
  chemically synthesized
aactaaaagagtaacggaacga

SEQ ID NO: 1316906 - DNA, 22 bp, Artificial Sequence
  chemically synthesized
aaccctcagtttcgttccgtta

SEQ ID NO: 1316907 - DNA, 22 bp, Artificial Sequence
  chemically synthesized
aaactaaaagagtaacggaacg

SEQ ID NO: 1316908 - DNA, 22 bp, Artificial Sequence
  chemically synthesized
tcttaaactaaaagagtaacgg

SEQ ID NO: 1316909 - DNA, 22 bp, Artificial Sequence
  chemically synthesized
agtttcgttccgttactctttt

SEQ ID NO: 1316910 - DNA, 22 bp, Artificial Sequence
  chemically synthesized
aagactgtcttaaactaaaaga

SEQ ID NO: 1316911 - DNA, 22 bp, Artificial Sequence
  chemically synthesized
cgttccgttactcttttagttt

SEQ ID NO: 1316912 - DNA, 22 bp, Artificial Sequence
  chemically synthesized
aaagactgtcttaaactaaaag

SEQ ID NO: 1316913 - DNA, 22 bp, Artificial Sequence
  chemically synthesized
gttccgttactcttttagttta

SEQ ID NO: 1316914 - DNA, 22 bp, Artificial Sequence
  chemically synthesized
taaagactgtcttaaactaaaa

SEQ ID NO: 1316915 - DNA, 22 bp, Artificial Sequence
  chemically synthesized
cgttactcttttagtttaagac

SEQ ID NO: 1316916 - DNA, 22 bp, Artificial Sequence
  chemically synthesized
agaggttttaaagactgtctta

SEQ ID NO: 1316917 - DNA, 22 bp, Artificial Sequence
  chemically synthesized
ctcttttagtttaagacagtct

SEQ ID NO: 1316918 - DNA, 22 bp, Artificial Sequence
  chemically synthesized
ttttagtttaagacagtcttta

SEQ ID NO: 1316919 - DNA, 22 bp, Artificial Sequence
  chemically synthesized
gttcagaggttttaaagactgt

SEQ ID NO: 1316920 - DNA, 22 bp, Artificial Sequence
  chemically synthesized
ttagtttaagacagtctttaaa

SEQ ID NO: 1316921 - DNA, 22 bp, Artificial Sequence
  chemically synthesized
tagtttaagacagtctttaaaa

SEQ ID NO: 1316922 - DNA, 22 bp, Artificial Sequence
  chemically synthesized
agtttaagacagtctttaaaac

SEQ ID NO: 1316923 - DNA, 22 bp, Artificial Sequence
  chemically synthesized
tctagttcagaggttttaaaga

SEQ ID NO: 1316924 - DNA, 22 bp, Artificial Sequence
  chemically synthesized
gtttaagacagtctttaaaacc

SEQ ID NO: 1316925 - DNA, 22 bp, Artificial Sequence
  chemically synthesized
gtctagttcagaggttttaaag

SEQ ID NO: 1316926 - DNA, 22 bp, Artificial Sequence
  chemically synthesized
tgtctagttcagaggttttaaa

SEQ ID NO: 1316927 - DNA, 22 bp, Artificial Sequence
  chemically synthesized
aagacagtctttaaaacctctg

SEQ ID NO: 1316928 - DNA, 22 bp, Artificial Sequence
  chemically synthesized
agacagtctttaaaacctctga

SEQ ID NO: 1316929 - DNA, 22 bp, Artificial Sequence
  chemically synthesized
taaaacctctgaactagacaaa

SEQ ID NO: 1316930 - DNA, 22 bp, Artificial Sequence
  chemically synthesized
aaaacctctgaactagacaaaa

SEQ ID NO: 1316931 - DNA, 22 bp, Artificial Sequence
  chemically synthesized
aagagaatgtaattttgtctag

SEQ ID NO: 1316932 - DNA, 22 bp, Artificial Sequence
  chemically synthesized
aaacctctgaactagacaaaat

SEQ ID NO: 1316933 - DNA, 22 bp, Artificial Sequence
  chemically synthesized
ttgaagagaatgtaattttgtc

SEQ ID NO: 1316934 - DNA, 22 bp, Artificial Sequence
  chemically synthesized
gttgaagagaatgtaattttgt

SEQ ID NO: 1316935 - DNA, 22 bp, Artificial Sequence
  chemically synthesized
tgttgaagagaatgtaattttg

SEQ ID NO: 1316936 - DNA, 22 bp, Artificial Sequence
  chemically synthesized
ttgttgaagagaatgtaatttt

SEQ ID NO: 1316937 - DNA, 22 bp, Artificial Sequence
  chemically synthesized
tgaactagacaaaattacattc

SEQ ID NO: 1316938 - DNA, 22 bp, Artificial Sequence
  chemically synthesized
aactagacaaaattacattctc

SEQ ID NO: 1316939 - DNA, 22 bp, Artificial Sequence
  chemically synthesized
gacaaaattacattctcttcaa

SEQ ID NO: 1316940 - DNA, 22 bp, Artificial Sequence
  chemically synthesized
cattctcttcaacaaaagccat

SEQ ID NO: 1316941 - DNA, 22 bp, Artificial Sequence
  chemically synthesized
tcttcaacaaaagccatattcc

SEQ ID NO: 1316942 - DNA, 22 bp, Artificial Sequence
  chemically synthesized
ttcaacaaaagccatattccta

SEQ ID NO: 1316943 - DNA, 22 bp, Artificial Sequence
  chemically synthesized
caacaaaagccatattcctatg

SEQ ID NO: 1316944 - DNA, 22 bp, Artificial Sequence
  chemically synthesized
aacaaaagccatattcctatgc

SEQ ID NO: 1316945 - DNA, 22 bp, Artificial Sequence
  chemically synthesized
gtgaaagataataaggcatagg

SEQ ID NO: 1316946 - DNA, 22 bp, Artificial Sequence
  chemically synthesized
ggtgaaagataataaggcatag

SEQ ID NO: 1316947 - DNA, 22 bp, Artificial Sequence
  chemically synthesized
tggtgaaagataataaggcata

SEQ ID NO: 1316948 - DNA, 22 bp, Artificial Sequence
  chemically synthesized
ttggtgaaagataataaggcat

SEQ ID NO: 1316949 - DNA, 22 bp, Artificial Sequence
  chemically synthesized
ctatgccttattatctttcacc

SEQ ID NO: 1316950 - DNA, 22 bp, Artificial Sequence
  chemically synthesized
tgccttattatctttcaccaaa

SEQ ID NO: 1316951 - DNA, 22 bp, Artificial Sequence
  chemically synthesized
attatctttcaccaaaaacaca

SEQ ID NO: 1316952 - DNA, 22 bp, Artificial Sequence
  chemically synthesized
ttatctttcaccaaaaacacat

SEQ ID NO: 1316953 - DNA, 22 bp, Artificial Sequence
  chemically synthesized
tctttcaccaaaaacacattcc

SEQ ID NO: 1316954 - DNA, 22 bp, Artificial Sequence
  chemically synthesized
tcaccaaaaacacattccctac

SEQ ID NO: 1316955 - DNA, 22 bp, Artificial Sequence
  chemically synthesized
catacaaggtgtgtagggaatg

SEQ ID NO: 1316956 - DNA, 22 bp, Artificial Sequence
  chemically synthesized
caccaaaaacacattccctaca

SEQ ID NO: 1316957 - DNA, 22 bp, Artificial Sequence
  chemically synthesized
acatacaaggtgtgtagggaat

SEQ ID NO: 1316958 - DNA, 22 bp, Artificial Sequence
  chemically synthesized
accaaaaacacattccctacac

SEQ ID NO: 1316959 - DNA, 22 bp, Artificial Sequence
  chemically synthesized
tacatacaaggtgtgtagggaa

SEQ ID NO: 1316960 - DNA, 22 bp, Artificial Sequence
  chemically synthesized
gagaaacagttttacatacaag

SEQ ID NO: 1316961 - DNA, 22 bp, Artificial Sequence
  chemically synthesized
cctacacaccttgtatgtaaaa

SEQ ID NO: 1316962 - DNA, 22 bp, Artificial Sequence
  chemically synthesized
ctggagaaacagttttacatac

SEQ ID NO: 1316963 - DNA, 22 bp, Artificial Sequence
  chemically synthesized
cacaccttgtatgtaaaactgt

SEQ ID NO: 1316964 - DNA, 22 bp, Artificial Sequence
  chemically synthesized
gtatgtaaaactgtttctccag

SEQ ID NO: 1316965 - DNA, 22 bp, Artificial Sequence
  chemically synthesized
tatgtaaaactgtttctccagt

SEQ ID NO: 1316966 - DNA, 22 bp, Artificial Sequence
  chemically synthesized
taacatgaaatcgaggttactg

SEQ ID NO: 1316967 - DNA, 22 bp, Artificial Sequence
  chemically synthesized
tttctccagtaacctcgatttc

SEQ ID NO: 1316968 - DNA, 22 bp, Artificial Sequence
  chemically synthesized
acattgtaacatgaaatcgagg

SEQ ID NO: 1316969 - DNA, 22 bp, Artificial Sequence
  chemically synthesized
ctccagtaacctcgatttcatg

SEQ ID NO: 1316970 - DNA, 22 bp, Artificial Sequence
  chemically synthesized
tccagtaacctcgatttcatgt

SEQ ID NO: 1316971 - DNA, 22 bp, Artificial Sequence
  chemically synthesized
cagtaacctcgatttcatgtta

SEQ ID NO: 1316972 - DNA, 22 bp, Artificial Sequence
  chemically synthesized
agagttaacattgtaacatgaa

SEQ ID NO: 1316973 - DNA, 22 bp, Artificial Sequence
  chemically synthesized
ctaagagttaacattgtaacat

SEQ ID NO: 1316974 - DNA, 22 bp, Artificial Sequence
  chemically synthesized
gatttcatgttacaatgttaac

SEQ ID NO: 1316975 - DNA, 22 bp, Artificial Sequence
  chemically synthesized
catgttacaatgttaactctta

SEQ ID NO: 1316976 - DNA, 22 bp, Artificial Sequence
  chemically synthesized
atgttacaatgttaactcttag

SEQ ID NO: 1316977 - DNA, 22 bp, Artificial Sequence
  chemically synthesized
aaaatcaaagttgctaagagtt

SEQ ID NO: 1316978 - DNA, 22 bp, Artificial Sequence
  chemically synthesized
actaaaaatcaaagttgctaag

SEQ ID NO: 1316979 - DNA, 22 bp, Artificial Sequence
  chemically synthesized
caatgttaactcttagcaactt

SEQ ID NO: 1316980 - DNA, 22 bp, Artificial Sequence
  chemically synthesized
cactaaaaatcaaagttgctaa

SEQ ID NO: 1316981 - DNA, 22 bp, Artificial Sequence
  chemically synthesized
tcactaaaaatcaaagttgcta

SEQ ID NO: 1316982 - DNA, 22 bp, Artificial Sequence
  chemically synthesized
ttcactaaaaatcaaagttgct

SEQ ID NO: 1316983 - DNA, 22 bp, Artificial Sequence
  chemically synthesized
actcttagcaactttgattttt

SEQ ID NO: 1316984 - DNA, 22 bp, Artificial Sequence
  chemically synthesized
tcaggtttttcactaaaaatca

SEQ ID NO: 1316985 - DNA, 22 bp, Artificial Sequence
  chemically synthesized
atcaggtttttcactaaaaatc

SEQ ID NO: 1316986 - DNA, 22 bp, Artificial Sequence
  chemically synthesized
ttagcaactttgatttttagtg

SEQ ID NO: 1316987 - DNA, 22 bp, Artificial Sequence
  chemically synthesized
tatcaggtttttcactaaaaat

SEQ ID NO: 1316988 - DNA, 22 bp, Artificial Sequence
  chemically synthesized
ttatcaggtttttcactaaaaa

SEQ ID NO: 1316989 - DNA, 22 bp, Artificial Sequence
  chemically synthesized
agcaactttgatttttagtgaa

SEQ ID NO: 1316990 - DNA, 22 bp, Artificial Sequence
  chemically synthesized
tttatcaggtttttcactaaaa

SEQ ID NO: 1316991 - DNA, 22 bp, Artificial Sequence
  chemically synthesized
gcaactttgatttttagtgaaa

SEQ ID NO: 1316992 - DNA, 22 bp, Artificial Sequence
  chemically synthesized
ttttatcaggtttttcactaaa

SEQ ID NO: 1316993 - DNA, 22 bp, Artificial Sequence
  chemically synthesized
tgatttttagtgaaaaacctga

SEQ ID NO: 1316994 - DNA, 22 bp, Artificial Sequence
  chemically synthesized
gatttttagtgaaaaacctgat

SEQ ID NO: 1316995 - DNA, 22 bp, Artificial Sequence
  chemically synthesized
atttttagtgaaaaacctgata

SEQ ID NO: 1316996 - DNA, 22 bp, Artificial Sequence
  chemically synthesized
aaatagcttttttatcaggttt

SEQ ID NO: 1316997 - DNA, 22 bp, Artificial Sequence
  chemically synthesized
ttagtgaaaaacctgataaaaa

SEQ ID NO: 1316998 - DNA, 22 bp, Artificial Sequence
  chemically synthesized
tagtgaaaaacctgataaaaaa

SEQ ID NO: 1316999 - DNA, 22 bp, Artificial Sequence
  chemically synthesized
agtgaaaaacctgataaaaaag

SEQ ID NO: 1317000 - DNA, 22 bp, Artificial Sequence
  chemically synthesized
gtgaaaaacctgataaaaaagc

SEQ ID NO: 1317001 - DNA, 22 bp, Artificial Sequence
  chemically synthesized
gcatataattaaaatagctttt

SEQ ID NO: 1317002 - DNA, 22 bp, Artificial Sequence
  chemically synthesized
ataaaaaagctattttaattat

SEQ ID NO: 1317003 - DNA, 22 bp, Artificial Sequence
  chemically synthesized
catccctagcatataattaaaa

SEQ ID NO: 1317004 - DNA, 22 bp, Artificial Sequence
  chemically synthesized
ggctccatccctagcatataat

SEQ ID NO: 1317005 - DNA, 22 bp, Artificial Sequence
  chemically synthesized
ttttaattatatgctagggatg

SEQ ID NO: 1317006 - DNA, 22 bp, Artificial Sequence
  chemically synthesized
atgtcctaggctccatccctag

SEQ ID NO: 1317007 - DNA, 22 bp, Artificial Sequence
  chemically synthesized
taattatatgctagggatggag

SEQ ID NO: 1317008 - DNA, 22 bp, Artificial Sequence
  chemically synthesized
aattatatgctagggatggagc

SEQ ID NO: 1317009 - DNA, 22 bp, Artificial Sequence
  chemically synthesized
attatatgctagggatggagcc

SEQ ID NO: 1317010 - DNA, 22 bp, Artificial Sequence
  chemically synthesized
tctgatgtcctaggctccatcc

SEQ ID NO: 1317011 - DNA, 22 bp, Artificial Sequence
  chemically synthesized
tgtctgatgtcctaggctccat

SEQ ID NO: 1317012 - DNA, 22 bp, Artificial Sequence
  chemically synthesized
ctgtctgatgtcctaggctcca

SEQ ID NO: 1317013 - DNA, 22 bp, Artificial Sequence
  chemically synthesized
tatgctagggatggagcctagg

SEQ ID NO: 1317014 - DNA, 22 bp, Artificial Sequence
  chemically synthesized
acttctgtctgatgtcctaggc

SEQ ID NO: 1317015 - DNA, 22 bp, Artificial Sequence
  chemically synthesized
cacttctgtctgatgtcctagg

SEQ ID NO: 1317016 - DNA, 22 bp, Artificial Sequence
  chemically synthesized
gggatggagcctaggacatcag

SEQ ID NO: 1317017 - DNA, 22 bp, Artificial Sequence
  chemically synthesized
tcttcacttctgtctgatgtcc

SEQ ID NO: 1317018 - DNA, 22 bp, Artificial Sequence
  chemically synthesized
atcttcacttctgtctgatgtc

SEQ ID NO: 1317019 - DNA, 22 bp, Artificial Sequence
  chemically synthesized
ggacatcagacagaagtgaaga

SEQ ID NO: 1317020 - DNA, 22 bp, Artificial Sequence
  chemically synthesized
aaaagagtcagaccttatcttc

SEQ ID NO: 1317021 - DNA, 22 bp, Artificial Sequence
  chemically synthesized
tgctgaaaagagtcagacctta

SEQ ID NO: 1317022 - DNA, 22 bp, Artificial Sequence
  chemically synthesized
gctatgctgaaaagagtcagac

SEQ ID NO: 1317023 - DNA, 22 bp, Artificial Sequence
  chemically synthesized
tgcccctagctatgctgaaaag

SEQ ID NO: 1317024 - DNA, 22 bp, Artificial Sequence
  chemically synthesized
actcttttcagcatagctaggg

SEQ ID NO: 1317025 - DNA, 22 bp, Artificial Sequence
  chemically synthesized
ttttcagcatagctaggggcat

SEQ ID NO: 1317026 - DNA, 22 bp, Artificial Sequence
  chemically synthesized
ttcagcatagctaggggcatag

SEQ ID NO: 1317027 - DNA, 22 bp, Artificial Sequence
  chemically synthesized
tcagcatagctaggggcatagc

SEQ ID NO: 1317028 - DNA, 22 bp, Artificial Sequence
  chemically synthesized
cagcatagctaggggcatagct

SEQ ID NO: 1317029 - DNA, 22 bp, Artificial Sequence
  chemically synthesized
agcatagctaggggcatagctc

SEQ ID NO: 1317030 - DNA, 22 bp, Artificial Sequence
  chemically synthesized
gggacacgtggagagctatgcc

SEQ ID NO: 1317031 - DNA, 22 bp, Artificial Sequence
  chemically synthesized
ggggcatagctctccacgtgtc

SEQ ID NO: 1317032 - DNA, 22 bp, Artificial Sequence
  chemically synthesized
tagatgaggcctggggacacgt

SEQ ID NO: 1317033 - DNA, 22 bp, Artificial Sequence
  chemically synthesized
tattatagatgaggcctgggga

SEQ ID NO: 1317034 - DNA, 22 bp, Artificial Sequence
  chemically synthesized
tccacgtgtccccaggcctcat

SEQ ID NO: 1317035 - DNA, 22 bp, Artificial Sequence
  chemically synthesized
cacgtgtccccaggcctcatct

SEQ ID NO: 1317036 - DNA, 22 bp, Artificial Sequence
  chemically synthesized
gagcattatattatagatgagg

SEQ ID NO: 1317037 - DNA, 22 bp, Artificial Sequence
  chemically synthesized
ggagcattatattatagatgag

SEQ ID NO: 1317038 - DNA, 22 bp, Artificial Sequence
  chemically synthesized
tggagcattatattatagatga

SEQ ID NO: 1317039 - DNA, 22 bp, Artificial Sequence
  chemically synthesized
ctttggagcattatattataga

SEQ ID NO: 1317040 - DNA, 22 bp, Artificial Sequence
  chemically synthesized
actttggagcattatattatag

SEQ ID NO: 1317041 - DNA, 22 bp, Artificial Sequence
  chemically synthesized
tttactttggagcattatatta

SEQ ID NO: 1317042 - DNA, 22 bp, Artificial Sequence
  chemically synthesized
atttactttggagcattatatt

SEQ ID NO: 1317043 - DNA, 22 bp, Artificial Sequence
  chemically synthesized
aatttatttactttggagcatt

SEQ ID NO: 1317044 - DNA, 22 bp, Artificial Sequence
  chemically synthesized
atctataatataatgctccaaa

SEQ ID NO: 1317045 - DNA, 22 bp, Artificial Sequence
  chemically synthesized
ttcaatttatttactttggagc

SEQ ID NO: 1317046 - DNA, 22 bp, Artificial Sequence
  chemically synthesized
taatataatgctccaaagtaaa

SEQ ID NO: 1317047 - DNA, 22 bp, Artificial Sequence
  chemically synthesized
gaaaattgttcaatttatttac

SEQ ID NO: 1317048 - DNA, 22 bp, Artificial Sequence
  chemically synthesized
ggaaaattgttcaatttattta

SEQ ID NO: 1317049 - DNA, 22 bp, Artificial Sequence
  chemically synthesized
tggaaaattgttcaatttattt

SEQ ID NO: 1317050 - DNA, 22 bp, Artificial Sequence
  chemically synthesized
actttggaaaattgttcaattt

SEQ ID NO: 1317051 - DNA, 22 bp, Artificial Sequence
  chemically synthesized
gactttggaaaattgttcaatt

SEQ ID NO: 1317052 - DNA, 22 bp, Artificial Sequence
  chemically synthesized
caaagtaaataaattgaacaat

SEQ ID NO: 1317053 - DNA, 22 bp, Artificial Sequence
  chemically synthesized
cttgactttggaaaattgttca

SEQ ID NO: 1317054 - DNA, 22 bp, Artificial Sequence
  chemically synthesized
ccttgactttggaaaattgttc

SEQ ID NO: 1317055 - DNA, 22 bp, Artificial Sequence
  chemically synthesized
tttccttgactttggaaaattg

SEQ ID NO: 1317056 - DNA, 22 bp, Artificial Sequence
  chemically synthesized
aacaattttccaaagtcaagga

SEQ ID NO: 1317057 - DNA, 22 bp, Artificial Sequence
  chemically synthesized
aggtcaaactgtttccttgact

SEQ ID NO: 1317058 - DNA, 22 bp, Artificial Sequence
  chemically synthesized
aaggtcaaactgtttccttgac

SEQ ID NO: 1317059 - DNA, 22 bp, Artificial Sequence
  chemically synthesized
taaggtcaaactgtttccttga

SEQ ID NO: 1317060 - DNA, 22 bp, Artificial Sequence
  chemically synthesized
tttaaggtcaaactgtttcctt

SEQ ID NO: 1317061 - DNA, 22 bp, Artificial Sequence
  chemically synthesized
tccaaagtcaaggaaacagttt

SEQ ID NO: 1317062 - DNA, 22 bp, Artificial Sequence
  chemically synthesized
ccaaagtcaaggaaacagtttg

SEQ ID NO: 1317063 - DNA, 22 bp, Artificial Sequence
  chemically synthesized
caaagtcaaggaaacagtttga

SEQ ID NO: 1317064 - DNA, 22 bp, Artificial Sequence
  chemically synthesized
aattctttaaggtcaaactgtt

SEQ ID NO: 1317065 - DNA, 22 bp, Artificial Sequence
  chemically synthesized
ctaaattctttaaggtcaaact

SEQ ID NO: 1317066 - DNA, 22 bp, Artificial Sequence
  chemically synthesized
gctaaattctttaaggtcaaac

SEQ ID NO: 1317067 - DNA, 22 bp, Artificial Sequence
  chemically synthesized
tcagatttgctaaattctttaa

SEQ ID NO: 1317068 - DNA, 22 bp, Artificial Sequence
  chemically synthesized
gaccttaaagaatttagcaaat

SEQ ID NO: 1317069 - DNA, 22 bp, Artificial Sequence
  chemically synthesized
accttaaagaatttagcaaatc

SEQ ID NO: 1317070 - DNA, 22 bp, Artificial Sequence
  chemically synthesized
aggtcagctatcagatttgcta

SEQ ID NO: 1317071 - DNA, 22 bp, Artificial Sequence
  chemically synthesized
aaagaatttagcaaatctgata

SEQ ID NO: 1317072 - DNA, 22 bp, Artificial Sequence
  chemically synthesized
aagaatttagcaaatctgatag

SEQ ID NO: 1317073 - DNA, 22 bp, Artificial Sequence
  chemically synthesized
aattaaggtcagctatcagatt

SEQ ID NO: 1317074 - DNA, 22 bp, Artificial Sequence
  chemically synthesized
gtctaaattaaggtcagctatc

SEQ ID NO: 1317075 - DNA, 22 bp, Artificial Sequence
  chemically synthesized
ggtctaaattaaggtcagctat

SEQ ID NO: 1317076 - DNA, 22 bp, Artificial Sequence
  chemically synthesized
agcaaatctgatagctgacctt

SEQ ID NO: 1317077 - DNA, 22 bp, Artificial Sequence
  chemically synthesized
gcaaatctgatagctgacctta

SEQ ID NO: 1317078 - DNA, 22 bp, Artificial Sequence
  chemically synthesized
atagctgaccttaatttagacc

SEQ ID NO: 1317079 - DNA, 22 bp, Artificial Sequence
  chemically synthesized
aaaatgtagacatttggtctaa

SEQ ID NO: 1317080 - DNA, 22 bp, Artificial Sequence
  chemically synthesized
gaaaatgtagacatttggtcta

SEQ ID NO: 1317081 - DNA, 22 bp, Artificial Sequence
  chemically synthesized
accttaatttagaccaaatgtc

SEQ ID NO: 1317082 - DNA, 22 bp, Artificial Sequence
  chemically synthesized
aatttagaccaaatgtctacat

SEQ ID NO: 1317083 - DNA, 22 bp, Artificial Sequence
  chemically synthesized
atttagaccaaatgtctacatt

SEQ ID NO: 1317084 - DNA, 22 bp, Artificial Sequence
  chemically synthesized
agaccaaatgtctacattttca

SEQ ID NO: 1317085 - DNA, 22 bp, Artificial Sequence
  chemically synthesized
gaccaaatgtctacattttcaa

SEQ ID NO: 1317086 - DNA, 22 bp, Artificial Sequence
  chemically synthesized
aagtaaaatatcttgaaaatgt

SEQ ID NO: 1317087 - DNA, 22 bp, Artificial Sequence
  chemically synthesized
ttaaagtaaaatatcttgaaaa

SEQ ID NO: 1317088 - DNA, 22 bp, Artificial Sequence
  chemically synthesized
ttgttaaagtaaaatatcttga

SEQ ID NO: 1317089 - DNA, 22 bp, Artificial Sequence
  chemically synthesized
cattttcaagatattttacttt

SEQ ID NO: 1317090 - DNA, 22 bp, Artificial Sequence
  chemically synthesized
aagattattgttaaagtaaaat

SEQ ID NO: 1317091 - DNA, 22 bp, Artificial Sequence
  chemically synthesized
aaagattattgttaaagtaaaa

SEQ ID NO: 1317092 - DNA, 22 bp, Artificial Sequence
  chemically synthesized
taaagattattgttaaagtaaa

SEQ ID NO: 1317093 - DNA, 22 bp, Artificial Sequence
  chemically synthesized
tcaagatattttactttaacaa

SEQ ID NO: 1317094 - DNA, 22 bp, Artificial Sequence
  chemically synthesized
caagatattttactttaacaat

SEQ ID NO: 1317095 - DNA, 22 bp, Artificial Sequence
  chemically synthesized
aagatattttactttaacaata

SEQ ID NO: 1317096 - DNA, 22 bp, Artificial Sequence
  chemically synthesized
tactttaacaataatctttaaa

SEQ ID NO: 1317097 - DNA, 22 bp, Artificial Sequence
  chemically synthesized
actttaacaataatctttaaaa

SEQ ID NO: 1317098 - DNA, 22 bp, Artificial Sequence
  chemically synthesized
ctttaacaataatctttaaaat

SEQ ID NO: 1317099 - DNA, 22 bp, Artificial Sequence
  chemically synthesized
gcaataaagacaattttaaaga

SEQ ID NO: 1317100 - DNA, 22 bp, Artificial Sequence
  chemically synthesized
ggcaataaagacaattttaaag

SEQ ID NO: 1317101 - DNA, 22 bp, Artificial Sequence
  chemically synthesized
tggcaataaagacaattttaaa

SEQ ID NO: 1317102 - DNA, 22 bp, Artificial Sequence
  chemically synthesized
taacaataatctttaaaattgt

SEQ ID NO: 1317103 - DNA, 22 bp, Artificial Sequence
  chemically synthesized
ttggcaataaagacaattttaa

SEQ ID NO: 1317104 - DNA, 22 bp, Artificial Sequence
  chemically synthesized
aacaataatctttaaaattgtc

SEQ ID NO: 1317105 - DNA, 22 bp, Artificial Sequence
  chemically synthesized
acaataatctttaaaattgtct

SEQ ID NO: 1317106 - DNA, 22 bp, Artificial Sequence
  chemically synthesized
gtaatcttttggcaataaagac

SEQ ID NO: 1317107 - DNA, 22 bp, Artificial Sequence
  chemically synthesized
agtaatcttttggcaataaaga

SEQ ID NO: 1317108 - DNA, 22 bp, Artificial Sequence
  chemically synthesized
tagtaatcttttggcaataaag

SEQ ID NO: 1317109 - DNA, 22 bp, Artificial Sequence
  chemically synthesized
taaaattgtctttattgccaaa

SEQ ID NO: 1317110 - DNA, 22 bp, Artificial Sequence
  chemically synthesized
aaaattgtctttattgccaaaa

SEQ ID NO: 1317111 - DNA, 22 bp, Artificial Sequence
  chemically synthesized
aaattgtctttattgccaaaag

SEQ ID NO: 1317112 - DNA, 22 bp, Artificial Sequence
  chemically synthesized
acatgactttagtaatcttttg

SEQ ID NO: 1317113 - DNA, 22 bp, Artificial Sequence
  chemically synthesized
tctttattgccaaaagattact

SEQ ID NO: 1317114 - DNA, 22 bp, Artificial Sequence
  chemically synthesized
ttcacatgactttagtaatctt

SEQ ID NO: 1317115 - DNA, 22 bp, Artificial Sequence
  chemically synthesized
gttcacatgactttagtaatct

SEQ ID NO: 1317116 - DNA, 22 bp, Artificial Sequence
  chemically synthesized
tgttcacatgactttagtaatc

SEQ ID NO: 1317117 - DNA, 22 bp, Artificial Sequence
  chemically synthesized
tattgccaaaagattactaaag

SEQ ID NO: 1317118 - DNA, 22 bp, Artificial Sequence
  chemically synthesized
ttgttcacatgactttagtaat

SEQ ID NO: 1317119 - DNA, 22 bp, Artificial Sequence
  chemically synthesized
attgccaaaagattactaaagt

SEQ ID NO: 1317120 - DNA, 22 bp, Artificial Sequence
  chemically synthesized
tttgttcacatgactttagtaa

SEQ ID NO: 1317121 - DNA, 22 bp, Artificial Sequence
  chemically synthesized
ttgccaaaagattactaaagtc

SEQ ID NO: 1317122 - DNA, 22 bp, Artificial Sequence
  chemically synthesized
ccaaaagattactaaagtcatg

SEQ ID NO: 1317123 - DNA, 22 bp, Artificial Sequence
  chemically synthesized
atgactttttgttcacatgact

SEQ ID NO: 1317124 - DNA, 22 bp, Artificial Sequence
  chemically synthesized
gatgactttttgttcacatgac

SEQ ID NO: 1317125 - DNA, 22 bp, Artificial Sequence
  chemically synthesized
tgatgactttttgttcacatga

SEQ ID NO: 1317126 - DNA, 22 bp, Artificial Sequence
  chemically synthesized
ctaaagtcatgtgaacaaaaag

SEQ ID NO: 1317127 - DNA, 22 bp, Artificial Sequence
  chemically synthesized
aagtcatgtgaacaaaaagtca

SEQ ID NO: 1317128 - DNA, 22 bp, Artificial Sequence
  chemically synthesized
tcagaaaaatagaaactttgat

SEQ ID NO: 1317129 - DNA, 22 bp, Artificial Sequence
  chemically synthesized
gtcagaaaaatagaaactttga

SEQ ID NO: 1317130 - DNA, 22 bp, Artificial Sequence
  chemically synthesized
tgtcagaaaaatagaaactttg

SEQ ID NO: 1317131 - DNA, 22 bp, Artificial Sequence
  chemically synthesized
aataaaaaaatattttgtcaga

SEQ ID NO: 1317132 - DNA, 22 bp, Artificial Sequence
  chemically synthesized
aaataaaaaaatattttgtcag

SEQ ID NO: 1317133 - DNA, 22 bp, Artificial Sequence
  chemically synthesized
ctatttttctgacaaaatattt

SEQ ID NO: 1317134 - DNA, 22 bp, Artificial Sequence
  chemically synthesized
tatttttctgacaaaatatttt

SEQ ID NO: 1317135 - DNA, 22 bp, Artificial Sequence
  chemically synthesized
tttttctgacaaaatatttttt

SEQ ID NO: 1317136 - DNA, 22 bp, Artificial Sequence
  chemically synthesized
ttctgacaaaatatttttttat

SEQ ID NO: 1317137 - DNA, 22 bp, Artificial Sequence
  chemically synthesized
tctgacaaaatatttttttatt

SEQ ID NO: 1317138 - DNA, 22 bp, Artificial Sequence
  chemically synthesized
ctgacaaaatatttttttattt

SEQ ID NO: 1317139 - DNA, 22 bp, Artificial Sequence
  chemically synthesized
tgacaaaatatttttttattta

SEQ ID NO: 1317140 - DNA, 22 bp, Artificial Sequence
  chemically synthesized
gaaaataagtgcttaaataaaa

SEQ ID NO: 1317141 - DNA, 22 bp, Artificial Sequence
  chemically synthesized
acaaaatatttttttatttaag

SEQ ID NO: 1317142 - DNA, 22 bp, Artificial Sequence
  chemically synthesized
ggaaaataagtgcttaaataaa

SEQ ID NO: 1317143 - DNA, 22 bp, Artificial Sequence
  chemically synthesized
gcttggaaaataagtgcttaaa

SEQ ID NO: 1317144 - DNA, 22 bp, Artificial Sequence
  chemically synthesized
attggcttggaaaataagtgct

SEQ ID NO: 1317145 - DNA, 22 bp, Artificial Sequence
  chemically synthesized
ttttatttaagcacttattttc

SEQ ID NO: 1317146 - DNA, 22 bp, Artificial Sequence
  chemically synthesized
tttatttaagcacttattttcc

SEQ ID NO: 1317147 - DNA, 22 bp, Artificial Sequence
  chemically synthesized
attaattggcttggaaaataag

SEQ ID NO: 1317148 - DNA, 22 bp, Artificial Sequence
  chemically synthesized
ttatttaagcacttattttcca

SEQ ID NO: 1317149 - DNA, 22 bp, Artificial Sequence
  chemically synthesized
tatttaagcacttattttccaa

SEQ ID NO: 1317150 - DNA, 22 bp, Artificial Sequence
  chemically synthesized
tgattaattggcttggaaaata

SEQ ID NO: 1317151 - DNA, 22 bp, Artificial Sequence
  chemically synthesized
atttaagcacttattttccaag

SEQ ID NO: 1317152 - DNA, 22 bp, Artificial Sequence
  chemically synthesized
tttaagcacttattttccaagc

SEQ ID NO: 1317153 - DNA, 22 bp, Artificial Sequence
  chemically synthesized
aagcacttattttccaagccaa

SEQ ID NO: 1317154 - DNA, 22 bp, Artificial Sequence
  chemically synthesized
agcacttattttccaagccaat

SEQ ID NO: 1317155 - DNA, 22 bp, Artificial Sequence
  chemically synthesized
taaaagagctctgattaattgg

SEQ ID NO: 1317156 - DNA, 22 bp, Artificial Sequence
  chemically synthesized
ataaaagagctctgattaattg

SEQ ID NO: 1317157 - DNA, 22 bp, Artificial Sequence
  chemically synthesized
attttccaagccaattaatcag

SEQ ID NO: 1317158 - DNA, 22 bp, Artificial Sequence
  chemically synthesized
ttttccaagccaattaatcaga

SEQ ID NO: 1317159 - DNA, 22 bp, Artificial Sequence
  chemically synthesized
tccaagccaattaatcagagct

SEQ ID NO: 1317160 - DNA, 22 bp, Artificial Sequence
  chemically synthesized
ccaagccaattaatcagagctc

SEQ ID NO: 1317161 - DNA, 22 bp, Artificial Sequence
  chemically synthesized
caagccaattaatcagagctct

SEQ ID NO: 1317162 - DNA, 22 bp, Artificial Sequence
  chemically synthesized
atcagagctcttttataaacat

SEQ ID NO: 1317163 - DNA, 22 bp, Artificial Sequence
  chemically synthesized
ttttataaacatcacacacaca

SEQ ID NO: 1317164 - DNA, 22 bp, Artificial Sequence
  chemically synthesized
ttataaacatcacacacacaca

SEQ ID NO: 1317165 - DNA, 22 bp, Artificial Sequence
  chemically synthesized
tataaacatcacacacacacac

SEQ ID NO: 1317166 - DNA, 22 bp, Artificial Sequence
  chemically synthesized
ataaacatcacacacacacaca

SEQ ID NO: 1317167 - DNA, 22 bp, Artificial Sequence
  chemically synthesized
taaacatcacacacacacacac

SEQ ID NO: 1317168 - DNA, 22 bp, Artificial Sequence
  chemically synthesized
tgtgtgtgtgtgtgtgtgtgtg

SEQ ID NO: 1317169 - DNA, 22 bp, Artificial Sequence
  chemically synthesized
gtgtgtgtgtgtgtgtgtgtgt

SEQ ID NO: 1317170 - DNA, 22 bp, Artificial Sequence
  chemically synthesized
tgtgtgtgtgtgtgtgtgtgtg

SEQ ID NO: 1317171 - DNA, 22 bp, Artificial Sequence
  chemically synthesized
ttgtgtgtgtgtgtgtgtgtgt

SEQ ID NO: 1317172 - DNA, 22 bp, Artificial Sequence
  chemically synthesized
catgtgtttttgtgtgtgtgtg

SEQ ID NO: 1317173 - DNA, 22 bp, Artificial Sequence
  chemically synthesized
acatgtgtttttgtgtgtgtgt

SEQ ID NO: 1317174 - DNA, 22 bp, Artificial Sequence
  chemically synthesized
tatttacatgtgtttttgtgtg

SEQ ID NO: 1317175 - DNA, 22 bp, Artificial Sequence
  chemically synthesized
tctgtatttacatgtgtttttg

SEQ ID NO: 1317176 - DNA, 22 bp, Artificial Sequence
  chemically synthesized
tgtctgtatttacatgtgtttt

SEQ ID NO: 1317177 - DNA, 22 bp, Artificial Sequence
  chemically synthesized
ctgtctgtatttacatgtgttt

SEQ ID NO: 1317178 - DNA, 22 bp, Artificial Sequence
  chemically synthesized
tcagtgccaaatcttctgtctg

SEQ ID NO: 1317179 - DNA, 22 bp, Artificial Sequence
  chemically synthesized
atcagtgccaaatcttctgtct

SEQ ID NO: 1317180 - DNA, 22 bp, Artificial Sequence
  chemically synthesized
gcaaataaaaagtcttatcagt

SEQ ID NO: 1317181 - DNA, 22 bp, Artificial Sequence
  chemically synthesized
agaaactggcaaataaaaagtc

SEQ ID NO: 1317182 - DNA, 22 bp, Artificial Sequence
  chemically synthesized
ggcactgataagactttttatt

SEQ ID NO: 1317183 - DNA, 22 bp, Artificial Sequence
  chemically synthesized
gcactgataagactttttattt

SEQ ID NO: 1317184 - DNA, 22 bp, Artificial Sequence
  chemically synthesized
attaagaaactggcaaataaaa

SEQ ID NO: 1317185 - DNA, 22 bp, Artificial Sequence
  chemically synthesized
ataagactttttatttgccagt

SEQ ID NO: 1317186 - DNA, 22 bp, Artificial Sequence
  chemically synthesized
tttatttgccagtttcttaatc

SEQ ID NO: 1317187 - DNA, 22 bp, Artificial Sequence
  chemically synthesized
ttatttgccagtttcttaatca

SEQ ID NO: 1317188 - DNA, 22 bp, Artificial Sequence
  chemically synthesized
aagccagtaatctgattaagaa

SEQ ID NO: 1317189 - DNA, 22 bp, Artificial Sequence
  chemically synthesized
tatttgccagtttcttaatcag

SEQ ID NO: 1317190 - DNA, 22 bp, Artificial Sequence
  chemically synthesized
atttgccagtttcttaatcaga

SEQ ID NO: 1317191 - DNA, 22 bp, Artificial Sequence
  chemically synthesized
tttgccagtttcttaatcagat

SEQ ID NO: 1317192 - DNA, 22 bp, Artificial Sequence
  chemically synthesized
gccagtttcttaatcagattac

SEQ ID NO: 1317193 - DNA, 22 bp, Artificial Sequence
  chemically synthesized
ccagtttcttaatcagattact

SEQ ID NO: 1317194 - DNA, 22 bp, Artificial Sequence
  chemically synthesized
caccctgaagccagtaatctga

SEQ ID NO: 1317195 - DNA, 22 bp, Artificial Sequence
  chemically synthesized
cttaatcagattactggcttca

SEQ ID NO: 1317196 - DNA, 22 bp, Artificial Sequence
  chemically synthesized
ttaatcagattactggcttcag

SEQ ID NO: 1317197 - DNA, 22 bp, Artificial Sequence
  chemically synthesized
caaaggctccaccctgaagcca

SEQ ID NO: 1317198 - DNA, 22 bp, Artificial Sequence
  chemically synthesized
aatcagattactggcttcaggg

SEQ ID NO: 1317199 - DNA, 22 bp, Artificial Sequence
  chemically synthesized
atcagattactggcttcagggt

SEQ ID NO: 1317200 - DNA, 22 bp, Artificial Sequence
  chemically synthesized
ctccaaaggctccaccctgaag

SEQ ID NO: 1317201 - DNA, 22 bp, Artificial Sequence
  chemically synthesized
ttcctccaaaggctccaccctg

SEQ ID NO: 1317202 - DNA, 22 bp, Artificial Sequence
  chemically synthesized
ctggcttcagggtggagccttt

SEQ ID NO: 1317203 - DNA, 22 bp, Artificial Sequence
  chemically synthesized
gccctgttcctccaaaggctcc

SEQ ID NO: 1317204 - DNA, 22 bp, Artificial Sequence
  chemically synthesized
gcttcagggtggagcctttgga

SEQ ID NO: 1317205 - DNA, 22 bp, Artificial Sequence
  chemically synthesized
ctggccctgttcctccaaaggc

SEQ ID NO: 1317206 - DNA, 22 bp, Artificial Sequence
  chemically synthesized
cctggccctgttcctccaaagg

SEQ ID NO: 1317207 - DNA, 22 bp, Artificial Sequence
  chemically synthesized
tcctggccctgttcctccaaag

SEQ ID NO: 1317208 - DNA, 22 bp, Artificial Sequence
  chemically synthesized
cagggtggagcctttggaggaa

SEQ ID NO: 1317209 - DNA, 22 bp, Artificial Sequence
  chemically synthesized
agggtggagcctttggaggaac

SEQ ID NO: 1317210 - DNA, 22 bp, Artificial Sequence
  chemically synthesized
gaaatgcatactttcctggccc

SEQ ID NO: 1317211 - DNA, 22 bp, Artificial Sequence
  chemically synthesized
agaaatgcatactttcctggcc

SEQ ID NO: 1317212 - DNA, 22 bp, Artificial Sequence
  chemically synthesized
tggaggaacagggccaggaaag

SEQ ID NO: 1317213 - DNA, 22 bp, Artificial Sequence
  chemically synthesized
ggaggaacagggccaggaaagt

SEQ ID NO: 1317214 - DNA, 22 bp, Artificial Sequence
  chemically synthesized
gaggaacagggccaggaaagta

SEQ ID NO: 1317215 - DNA, 22 bp, Artificial Sequence
  chemically synthesized
agccttagaaatgcatactttc

SEQ ID NO: 1317216 - DNA, 22 bp, Artificial Sequence
  chemically synthesized
tgattaagccttagaaatgcat

SEQ ID NO: 1317217 - DNA, 22 bp, Artificial Sequence
  chemically synthesized
agctgtgattaagccttagaaa

SEQ ID NO: 1317218 - DNA, 22 bp, Artificial Sequence
  chemically synthesized
cagctgtgattaagccttagaa

SEQ ID NO: 1317219 - DNA, 22 bp, Artificial Sequence
  chemically synthesized
ccttcagctgtgattaagcctt

SEQ ID NO: 1317220 - DNA, 22 bp, Artificial Sequence
  chemically synthesized
gccttcagctgtgattaagcct

SEQ ID NO: 1317221 - DNA, 22 bp, Artificial Sequence
  chemically synthesized
tgccttcagctgtgattaagcc

SEQ ID NO: 1317222 - DNA, 22 bp, Artificial Sequence
  chemically synthesized
tctttgccttcagctgtgatta

SEQ ID NO: 1317223 - DNA, 22 bp, Artificial Sequence
  chemically synthesized
tgtctttgccttcagctgtgat

SEQ ID NO: 1317224 - DNA, 22 bp, Artificial Sequence
  chemically synthesized
ctaaggcttaatcacagctgaa

SEQ ID NO: 1317225 - DNA, 22 bp, Artificial Sequence
  chemically synthesized
taaggcttaatcacagctgaag

SEQ ID NO: 1317226 - DNA, 22 bp, Artificial Sequence
  chemically synthesized
aggcttaatcacagctgaaggc

SEQ ID NO: 1317227 - DNA, 22 bp, Artificial Sequence
  chemically synthesized
ggagttctgtctttgccttcag

SEQ ID NO: 1317228 - DNA, 22 bp, Artificial Sequence
  chemically synthesized
gggagttctgtctttgccttca

SEQ ID NO: 1317229 - DNA, 22 bp, Artificial Sequence
  chemically synthesized
aatcacagctgaaggcaaagac

SEQ ID NO: 1317230 - DNA, 22 bp, Artificial Sequence
  chemically synthesized
atcacagctgaaggcaaagaca

SEQ ID NO: 1317231 - DNA, 22 bp, Artificial Sequence
  chemically synthesized
atttgggagttctgtctttgcc

SEQ ID NO: 1317232 - DNA, 22 bp, Artificial Sequence
  chemically synthesized
aatttgggagttctgtctttgc

SEQ ID NO: 1317233 - DNA, 22 bp, Artificial Sequence
  chemically synthesized
aaggcaaagacagaactcccaa

SEQ ID NO: 1317234 - DNA, 22 bp, Artificial Sequence
  chemically synthesized
cagtataaaatggtgcccttaa

SEQ ID NO: 1317235 - DNA, 22 bp, Artificial Sequence
  chemically synthesized
ggttgcagtataaaatggtgcc

SEQ ID NO: 1317236 - DNA, 22 bp, Artificial Sequence
  chemically synthesized
gggttgcagtataaaatggtgc

SEQ ID NO: 1317237 - DNA, 22 bp, Artificial Sequence
  chemically synthesized
ccaaattaagggcaccatttta

SEQ ID NO: 1317238 - DNA, 22 bp, Artificial Sequence
  chemically synthesized
tgggttgcagtataaaatggtg

SEQ ID NO: 1317239 - DNA, 22 bp, Artificial Sequence
  chemically synthesized
ttgggttgcagtataaaatggt

SEQ ID NO: 1317240 - DNA, 22 bp, Artificial Sequence
  chemically synthesized
cttttgggttgcagtataaaat

SEQ ID NO: 1317241 - DNA, 22 bp, Artificial Sequence
  chemically synthesized
tccttttgggttgcagtataaa

SEQ ID NO: 1317242 - DNA, 22 bp, Artificial Sequence
  chemically synthesized
agggcaccattttatactgcaa

SEQ ID NO: 1317243 - DNA, 22 bp, Artificial Sequence
  chemically synthesized
tctccttttgggttgcagtata

SEQ ID NO: 1317244 - DNA, 22 bp, Artificial Sequence
  chemically synthesized
ctctccttttgggttgcagtat

SEQ ID NO: 1317245 - DNA, 22 bp, Artificial Sequence
  chemically synthesized
tatactgcaacccaaaaggaga

SEQ ID NO: 1317246 - DNA, 22 bp, Artificial Sequence
  chemically synthesized
ccgtagtatttctctccttttg

SEQ ID NO: 1317247 - DNA, 22 bp, Artificial Sequence
  chemically synthesized
atactgcaacccaaaaggagag

SEQ ID NO: 1317248 - DNA, 22 bp, Artificial Sequence
  chemically synthesized
tactgcaacccaaaaggagaga

SEQ ID NO: 1317249 - DNA, 22 bp, Artificial Sequence
  chemically synthesized
tcccgtagtatttctctccttt

SEQ ID NO: 1317250 - DNA, 22 bp, Artificial Sequence
  chemically synthesized
ctcccgtagtatttctctcctt

SEQ ID NO: 1317251 - DNA, 22 bp, Artificial Sequence
  chemically synthesized
caacccaaaaggagagaaatac

SEQ ID NO: 1317252 - DNA, 22 bp, Artificial Sequence
  chemically synthesized
tcttctcccgtagtatttctct

SEQ ID NO: 1317253 - DNA, 22 bp, Artificial Sequence
  chemically synthesized
tactgtcttctcccgtagtatt

SEQ ID NO: 1317254 - DNA, 22 bp, Artificial Sequence
  chemically synthesized
cgggagaagacagtacagtgct

SEQ ID NO: 1317255 - DNA, 22 bp, Artificial Sequence
  chemically synthesized
ctaccctacatttcttttctta

SEQ ID NO: 1317256 - DNA, 22 bp, Artificial Sequence
  chemically synthesized
taccctacatttcttttcttat

SEQ ID NO: 1317257 - DNA, 22 bp, Artificial Sequence
  chemically synthesized
ccctacatttcttttcttattt

SEQ ID NO: 1317258 - DNA, 22 bp, Artificial Sequence
  chemically synthesized
catttcttttcttatttttgtt

SEQ ID NO: 1317259 - DNA, 22 bp, Artificial Sequence
  chemically synthesized
aaaagaaagaaagaaacaaaaa

SEQ ID NO: 1317260 - DNA, 22 bp, Artificial Sequence
  chemically synthesized
aaaaagaaagaaagaaacaaaa

SEQ ID NO: 1317261 - DNA, 22 bp, Artificial Sequence
  chemically synthesized
cttttcttatttttgtttcttt

SEQ ID NO: 1317262 - DNA, 22 bp, Artificial Sequence
  chemically synthesized
ttttcttatttttgtttctttc

SEQ ID NO: 1317263 - DNA, 22 bp, Artificial Sequence
  chemically synthesized
ttcttatttttgtttctttctt

SEQ ID NO: 1317264 - DNA, 22 bp, Artificial Sequence
  chemically synthesized
tcttatttttgtttctttcttt

SEQ ID NO: 1317265 - DNA, 22 bp, Artificial Sequence
  chemically synthesized
cgtcttaaaaagaaagaaagaa

SEQ ID NO: 1317266 - DNA, 22 bp, Artificial Sequence
  chemically synthesized
cttatttttgtttctttctttc

SEQ ID NO: 1317267 - DNA, 22 bp, Artificial Sequence
  chemically synthesized
ttatttttgtttctttctttct

SEQ ID NO: 1317268 - DNA, 22 bp, Artificial Sequence
  chemically synthesized
atttttgtttctttctttcttt

SEQ ID NO: 1317269 - DNA, 22 bp, Artificial Sequence
  chemically synthesized
tttttgtttctttctttctttt

SEQ ID NO: 1317270 - DNA, 22 bp, Artificial Sequence
  chemically synthesized
ttgtttctttctttctttttaa

SEQ ID NO: 1317271 - DNA, 22 bp, Artificial Sequence
  chemically synthesized
tgtttctttctttctttttaag

SEQ ID NO: 1317272 - DNA, 22 bp, Artificial Sequence
  chemically synthesized
gtttctttctttctttttaaga

SEQ ID NO: 1317273 - DNA, 22 bp, Artificial Sequence
  chemically synthesized
tttctttctttctttttaagac

SEQ ID NO: 1317274 - DNA, 22 bp, Artificial Sequence
  chemically synthesized
ctttctttctttttaagacgga

SEQ ID NO: 1317275 - DNA, 22 bp, Artificial Sequence
  chemically synthesized
tttctttctttttaagacggag

SEQ ID NO: 1317276 - DNA, 22 bp, Artificial Sequence
  chemically synthesized
tctttctttttaagacggagtc

SEQ ID NO: 1317277 - DNA, 22 bp, Artificial Sequence
  chemically synthesized
ctttctttttaagacggagtct

SEQ ID NO: 1317278 - DNA, 22 bp, Artificial Sequence
  chemically synthesized
ggtgacagagcgagactccgtc

SEQ ID NO: 1317279 - DNA, 22 bp, Artificial Sequence
  chemically synthesized
tttctttttaagacggagtctc

SEQ ID NO: 1317280 - DNA, 22 bp, Artificial Sequence
  chemically synthesized
tctttttaagacggagtctcgc

SEQ ID NO: 1317281 - DNA, 22 bp, Artificial Sequence
  chemically synthesized
ctttttaagacggagtctcgct

SEQ ID NO: 1317282 - DNA, 22 bp, Artificial Sequence
  chemically synthesized
tttttaagacggagtctcgctc

SEQ ID NO: 1317283 - DNA, 22 bp, Artificial Sequence
  chemically synthesized
tttaagacggagtctcgctctg

SEQ ID NO: 1317284 - DNA, 22 bp, Artificial Sequence
  chemically synthesized
cagcctgggtgacagagcgaga

SEQ ID NO: 1317285 - DNA, 22 bp, Artificial Sequence
  chemically synthesized
ttaagacggagtctcgctctgt

SEQ ID NO: 1317286 - DNA, 22 bp, Artificial Sequence
  chemically synthesized
taagacggagtctcgctctgtc

SEQ ID NO: 1317287 - DNA, 22 bp, Artificial Sequence
  chemically synthesized
aagacggagtctcgctctgtca

SEQ ID NO: 1317288 - DNA, 22 bp, Artificial Sequence
  chemically synthesized
agacggagtctcgctctgtcac

SEQ ID NO: 1317289 - DNA, 22 bp, Artificial Sequence
  chemically synthesized
cactccagcctgggtgacagag

SEQ ID NO: 1317290 - DNA, 22 bp, Artificial Sequence
  chemically synthesized
gctctgtcacccaggctggagt

SEQ ID NO: 1317291 - DNA, 22 bp, Artificial Sequence
  chemically synthesized
agatagcaccactgcactccag

SEQ ID NO: 1317292 - DNA, 22 bp, Artificial Sequence
  chemically synthesized
tgtcacccaggctggagtgcag

SEQ ID NO: 1317293 - DNA, 22 bp, Artificial Sequence
  chemically synthesized
tcacccaggctggagtgcagtg

SEQ ID NO: 1317294 - DNA, 22 bp, Artificial Sequence
  chemically synthesized
cagtgagctgagatagcaccac

SEQ ID NO: 1317295 - DNA, 22 bp, Artificial Sequence
  chemically synthesized
gagtgcagtggtgctatctcag

SEQ ID NO: 1317296 - DNA, 22 bp, Artificial Sequence
  chemically synthesized
aacccaggaggcggaggttgca

SEQ ID NO: 1317297 - DNA, 22 bp, Artificial Sequence
  chemically synthesized
tctcagctcactgcaacctccg

SEQ ID NO: 1317298 - DNA, 22 bp, Artificial Sequence
  chemically synthesized
gaacccaggaggcggaggttgc

SEQ ID NO: 1317299 - DNA, 22 bp, Artificial Sequence
  chemically synthesized
agctcactgcaacctccgcctc

SEQ ID NO: 1317300 - DNA, 22 bp, Artificial Sequence
  chemically synthesized
actgcaacctccgcctcctggg

SEQ ID NO: 1317301 - DNA, 22 bp, Artificial Sequence
  chemically synthesized
caacctccgcctcctgggttca

SEQ ID NO: 1317302 - DNA, 22 bp, Artificial Sequence
  chemically synthesized
aggcaggagaatcccttgaacc

SEQ ID NO: 1317303 - DNA, 22 bp, Artificial Sequence
  chemically synthesized
cgcctcctgggttcaagggatt

SEQ ID NO: 1317304 - DNA, 22 bp, Artificial Sequence
  chemically synthesized
agaggctaaggcaggagaatcc

SEQ ID NO: 1317305 - DNA, 22 bp, Artificial Sequence
  chemically synthesized
ctgggttcaagggattctcctg

SEQ ID NO: 1317306 - DNA, 22 bp, Artificial Sequence
  chemically synthesized
gagaggctaaggcaggagaatc

SEQ ID NO: 1317307 - DNA, 22 bp, Artificial Sequence
  chemically synthesized
ggttcaagggattctcctgcct

SEQ ID NO: 1317308 - DNA, 22 bp, Artificial Sequence
  chemically synthesized
cttgagaggctaaggcaggaga

SEQ ID NO: 1317309 - DNA, 22 bp, Artificial Sequence
  chemically synthesized
aagggattctcctgccttagcc

SEQ ID NO: 1317310 - DNA, 22 bp, Artificial Sequence
  chemically synthesized
taatcccagctacttgagaggc

SEQ ID NO: 1317311 - DNA, 22 bp, Artificial Sequence
  chemically synthesized
tcctgccttagcctctcaagta

SEQ ID NO: 1317312 - DNA, 22 bp, Artificial Sequence
  chemically synthesized
ctgccttagcctctcaagtagc

SEQ ID NO: 1317313 - DNA, 22 bp, Artificial Sequence
  chemically synthesized
ccttagcctctcaagtagctgg

SEQ ID NO: 1317314 - DNA, 22 bp, Artificial Sequence
  chemically synthesized
agcctctcaagtagctgggatt

SEQ ID NO: 1317315 - DNA, 22 bp, Artificial Sequence
  chemically synthesized
gcctctcaagtagctgggatta

SEQ ID NO: 1317316 - DNA, 22 bp, Artificial Sequence
  chemically synthesized
tcaagtagctgggattacaggc

SEQ ID NO: 1317317 - DNA, 22 bp, Artificial Sequence
  chemically synthesized
aagtagctgggattacaggcat

SEQ ID NO: 1317318 - DNA, 22 bp, Artificial Sequence
  chemically synthesized
gccaggcgtggtggcacatgcc

SEQ ID NO: 1317319 - DNA, 22 bp, Artificial Sequence
  chemically synthesized
ggattacaggcatgtgccacca

SEQ ID NO: 1317320 - DNA, 22 bp, Artificial Sequence
  chemically synthesized
caggcatgtgccaccacgcctg

SEQ ID NO: 1317321 - DNA, 22 bp, Artificial Sequence
  chemically synthesized
agaaaaatacaaaaattagcca

SEQ ID NO: 1317322 - DNA, 22 bp, Artificial Sequence
  chemically synthesized
taagaaaaatacaaaaattagc

SEQ ID NO: 1317323 - DNA, 22 bp, Artificial Sequence
  chemically synthesized
gctaatttttgtatttttctta

SEQ ID NO: 1317324 - DNA, 22 bp, Artificial Sequence
  chemically synthesized
atttttgtatttttcttagaga

SEQ ID NO: 1317325 - DNA, 22 bp, Artificial Sequence
  chemically synthesized
ttgtatttttcttagagacggg

SEQ ID NO: 1317326 - DNA, 22 bp, Artificial Sequence
  chemically synthesized
tgtatttttcttagagacgggg

SEQ ID NO: 1317327 - DNA, 22 bp, Artificial Sequence
  chemically synthesized
gtatttttcttagagacggggt

SEQ ID NO: 1317328 - DNA, 22 bp, Artificial Sequence
  chemically synthesized
tatttttcttagagacggggtt

SEQ ID NO: 1317329 - DNA, 22 bp, Artificial Sequence
  chemically synthesized
gccaacatggtgaaaccccgtc

SEQ ID NO: 1317330 - DNA, 22 bp, Artificial Sequence
  chemically synthesized
ttcttagagacggggtttcacc

SEQ ID NO: 1317331 - DNA, 22 bp, Artificial Sequence
  chemically synthesized
tcttagagacggggtttcacca

SEQ ID NO: 1317332 - DNA, 22 bp, Artificial Sequence
  chemically synthesized
cttagagacggggtttcaccat

SEQ ID NO: 1317333 - DNA, 22 bp, Artificial Sequence
  chemically synthesized
ttagagacggggtttcaccatg

SEQ ID NO: 1317334 - DNA, 22 bp, Artificial Sequence
  chemically synthesized
agagacggggtttcaccatgtt

SEQ ID NO: 1317335 - DNA, 22 bp, Artificial Sequence
  chemically synthesized
gagacggggtttcaccatgttg

SEQ ID NO: 1317336 - DNA, 22 bp, Artificial Sequence
  chemically synthesized
agaccagcctggccaacatggt

SEQ ID NO: 1317337 - DNA, 22 bp, Artificial Sequence
  chemically synthesized
gagaccagcctggccaacatgg

SEQ ID NO: 1317338 - DNA, 22 bp, Artificial Sequence
  chemically synthesized
caccatgttggccaggctggtc

SEQ ID NO: 1317339 - DNA, 22 bp, Artificial Sequence
  chemically synthesized
accatgttggccaggctggtct

SEQ ID NO: 1317340 - DNA, 22 bp, Artificial Sequence
  chemically synthesized
aggtcagcagtttgagaccagc

SEQ ID NO: 1317341 - DNA, 22 bp, Artificial Sequence
  chemically synthesized
gaggtcagcagtttgagaccag

SEQ ID NO: 1317342 - DNA, 22 bp, Artificial Sequence
  chemically synthesized
gccaggctggtctcaaactgct

SEQ ID NO: 1317343 - DNA, 22 bp, Artificial Sequence
  chemically synthesized
gtctcaaactgctgacctcaag

SEQ ID NO: 1317344 - DNA, 22 bp, Artificial Sequence
  chemically synthesized
aaactgctgacctcaagtgatc

SEQ ID NO: 1317345 - DNA, 22 bp, Artificial Sequence
  chemically synthesized
ggaggccgaggagggcggatca

SEQ ID NO: 1317346 - DNA, 22 bp, Artificial Sequence
  chemically synthesized
ctgacctcaagtgatccgccct

SEQ ID NO: 1317347 - DNA, 22 bp, Artificial Sequence
  chemically synthesized
gggaggccgaggagggcggatc

SEQ ID NO: 1317348 - DNA, 22 bp, Artificial Sequence
  chemically synthesized
tgggaggccgaggagggcggat

SEQ ID NO: 1317349 - DNA, 22 bp, Artificial Sequence
  chemically synthesized
acctcaagtgatccgccctcct

SEQ ID NO: 1317350 - DNA, 22 bp, Artificial Sequence
  chemically synthesized
cactttgggaggccgaggaggg

SEQ ID NO: 1317351 - DNA, 22 bp, Artificial Sequence
  chemically synthesized
aagtgatccgccctcctcggcc

SEQ ID NO: 1317352 - DNA, 22 bp, Artificial Sequence
  chemically synthesized
ggaggctgcactttgggaggcc

SEQ ID NO: 1317353 - DNA, 22 bp, Artificial Sequence
  chemically synthesized
gggaggctgcactttgggaggc

SEQ ID NO: 1317354 - DNA, 22 bp, Artificial Sequence
  chemically synthesized
tgggaggctgcactttgggagg

SEQ ID NO: 1317355 - DNA, 22 bp, Artificial Sequence
  chemically synthesized
ctcggcctcccaaagtgcagcc

SEQ ID NO: 1317356 - DNA, 22 bp, Artificial Sequence
  chemically synthesized
ggcctcccaaagtgcagcctcc

SEQ ID NO: 1317357 - DNA, 22 bp, Artificial Sequence
  chemically synthesized
taatccaagcactttgggaggc

SEQ ID NO: 1317358 - DNA, 22 bp, Artificial Sequence
  chemically synthesized
gtaatccaagcactttgggagg

SEQ ID NO: 1317359 - DNA, 22 bp, Artificial Sequence
  chemically synthesized
ccaaagtgcagcctcccaaagt

SEQ ID NO: 1317360 - DNA, 22 bp, Artificial Sequence
  chemically synthesized
gtgcttgtaatccaagcacttt

SEQ ID NO: 1317361 - DNA, 22 bp, Artificial Sequence
  chemically synthesized
ccaaagtgcttggattacaagc

SEQ ID NO: 1317362 - DNA, 22 bp, Artificial Sequence
  chemically synthesized
ggattacaagcacgagccacgg

SEQ ID NO: 1317363 - DNA, 22 bp, Artificial Sequence
  chemically synthesized
gattacaagcacgagccacggc

SEQ ID NO: 1317364 - DNA, 22 bp, Artificial Sequence
  chemically synthesized
caagcacgagccacggcacccg

SEQ ID NO: 1317365 - DNA, 22 bp, Artificial Sequence
  chemically synthesized
caatgaaatgcagggtatggcc

SEQ ID NO: 1317366 - DNA, 22 bp, Artificial Sequence
  chemically synthesized
gcaatgaaatgcagggtatggc

SEQ ID NO: 1317367 - DNA, 22 bp, Artificial Sequence
  chemically synthesized
ccttgcaatgaaatgcagggta

SEQ ID NO: 1317368 - DNA, 22 bp, Artificial Sequence
  chemically synthesized
ggttgccttgcaatgaaatgca

SEQ ID NO: 1317369 - DNA, 22 bp, Artificial Sequence
  chemically synthesized
gggttgccttgcaatgaaatgc

SEQ ID NO: 1317370 - DNA, 22 bp, Artificial Sequence
  chemically synthesized
tgggttgccttgcaatgaaatg

SEQ ID NO: 1317371 - DNA, 22 bp, Artificial Sequence
  chemically synthesized
actttgggttgccttgcaatga

SEQ ID NO: 1317372 - DNA, 22 bp, Artificial Sequence
  chemically synthesized
attgactttgggttgccttgca

SEQ ID NO: 1317373 - DNA, 22 bp, Artificial Sequence
  chemically synthesized
catttcattgcaaggcaaccca

SEQ ID NO: 1317374 - DNA, 22 bp, Artificial Sequence
  chemically synthesized
cattgcaaggcaacccaaagtc

SEQ ID NO: 1317375 - DNA, 22 bp, Artificial Sequence
  chemically synthesized
attgcaaggcaacccaaagtca

SEQ ID NO: 1317376 - DNA, 22 bp, Artificial Sequence
  chemically synthesized
caaaatgggctgattgactttg

SEQ ID NO: 1317377 - DNA, 22 bp, Artificial Sequence
  chemically synthesized
caaggcaacccaaagtcaatca

SEQ ID NO: 1317378 - DNA, 22 bp, Artificial Sequence
  chemically synthesized
attacaaaatgggctgattgac

SEQ ID NO: 1317379 - DNA, 22 bp, Artificial Sequence
  chemically synthesized
ccatgaaggacgggctgattac

SEQ ID NO: 1317380 - DNA, 22 bp, Artificial Sequence
  chemically synthesized
tgtaatcagcccgtccttcatg

SEQ ID NO: 1317381 - DNA, 22 bp, Artificial Sequence
  chemically synthesized
gtaatcagcccgtccttcatgg

SEQ ID NO: 1317382 - DNA, 22 bp, Artificial Sequence
  chemically synthesized
taatcagcccgtccttcatggg

SEQ ID NO: 1317383 - DNA, 22 bp, Artificial Sequence
  chemically synthesized
ggagatcagactcccatgaagg

SEQ ID NO: 1317384 - DNA, 22 bp, Artificial Sequence
  chemically synthesized
cactgggagatcagactcccat

SEQ ID NO: 1317385 - DNA, 22 bp, Artificial Sequence
  chemically synthesized
accctccactgggagatcagac

SEQ ID NO: 1317386 - DNA, 22 bp, Artificial Sequence
  chemically synthesized
ctcaccctccactgggagatca

SEQ ID NO: 1317387 - DNA, 22 bp, Artificial Sequence
  chemically synthesized
catgggagtctgatctcccagt

SEQ ID NO: 1317388 - DNA, 22 bp, Artificial Sequence
  chemically synthesized
atgggagtctgatctcccagtg

SEQ ID NO: 1317389 - DNA, 22 bp, Artificial Sequence
  chemically synthesized
atctcccagtggagggtgagga

SEQ ID NO: 1317390 - DNA, 22 bp, Artificial Sequence
  chemically synthesized
ccagtggagggtgaggaatgtt

SEQ ID NO: 1317391 - DNA, 22 bp, Artificial Sequence
  chemically synthesized
gtcacccggaagataaggaaac

SEQ ID NO: 1317392 - DNA, 22 bp, Artificial Sequence
  chemically synthesized
ggtcacccggaagataaggaaa

SEQ ID NO: 1317393 - DNA, 22 bp, Artificial Sequence
  chemically synthesized
tggtcacccggaagataaggaa

SEQ ID NO: 1317394 - DNA, 22 bp, Artificial Sequence
  chemically synthesized
ttggtcacccggaagataagga

SEQ ID NO: 1317395 - DNA, 22 bp, Artificial Sequence
  chemically synthesized
ccttatcttccgggtgaccaaa

SEQ ID NO: 1317396 - DNA, 22 bp, Artificial Sequence
  chemically synthesized
cttatcttccgggtgaccaaaa

SEQ ID NO: 1317397 - DNA, 22 bp, Artificial Sequence
  chemically synthesized
atcttccgggtgaccaaaagca

SEQ ID NO: 1317398 - DNA, 22 bp, Artificial Sequence
  chemically synthesized
tcttccgggtgaccaaaagcat

SEQ ID NO: 1317399 - DNA, 22 bp, Artificial Sequence
  chemically synthesized
gatccagagaagcatgcttttg

SEQ ID NO: 1317400 - DNA, 22 bp, Artificial Sequence
  chemically synthesized
ggatccagagaagcatgctttt

SEQ ID NO: 1317401 - DNA, 22 bp, Artificial Sequence
  chemically synthesized
ccgggtgaccaaaagcatgctt

SEQ ID NO: 1317402 - DNA, 22 bp, Artificial Sequence
  chemically synthesized
cgggtgaccaaaagcatgcttc

SEQ ID NO: 1317403 - DNA, 22 bp, Artificial Sequence
  chemically synthesized
cacacttggatccagagaagca

SEQ ID NO: 1317404 - DNA, 22 bp, Artificial Sequence
  chemically synthesized
gcacacttggatccagagaagc

SEQ ID NO: 1317405 - DNA, 22 bp, Artificial Sequence
  chemically synthesized
tgcacacttggatccagagaag

SEQ ID NO: 1317406 - DNA, 22 bp, Artificial Sequence
  chemically synthesized
tttgcacacttggatccagaga

SEQ ID NO: 1317407 - DNA, 22 bp, Artificial Sequence
  chemically synthesized
actctttgcacacttggatcca

SEQ ID NO: 1317408 - DNA, 22 bp, Artificial Sequence
  chemically synthesized
gactctttgcacacttggatcc

SEQ ID NO: 1317409 - DNA, 22 bp, Artificial Sequence
  chemically synthesized
ctctggatccaagtgtgcaaag

SEQ ID NO: 1317410 - DNA, 22 bp, Artificial Sequence
  chemically synthesized
tctggatccaagtgtgcaaaga

SEQ ID NO: 1317411 - DNA, 22 bp, Artificial Sequence
  chemically synthesized
tggatccaagtgtgcaaagagt

SEQ ID NO: 1317412 - DNA, 22 bp, Artificial Sequence
  chemically synthesized
gatccaagtgtgcaaagagtca

SEQ ID NO: 1317413 - DNA, 22 bp, Artificial Sequence
  chemically synthesized
tacagggatacttgactctttg

SEQ ID NO: 1317414 - DNA, 22 bp, Artificial Sequence
  chemically synthesized
atggtagttatacagggatact

SEQ ID NO: 1317415 - DNA, 22 bp, Artificial Sequence
  chemically synthesized
agggatggctaatggtagttat

SEQ ID NO: 1317416 - DNA, 22 bp, Artificial Sequence
  chemically synthesized
aagggatggctaatggtagtta

SEQ ID NO: 1317417 - DNA, 22 bp, Artificial Sequence
  chemically synthesized
taagggatggctaatggtagtt

SEQ ID NO: 1317418 - DNA, 22 bp, Artificial Sequence
  chemically synthesized
tataactaccattagccatccc

SEQ ID NO: 1317419 - DNA, 22 bp, Artificial Sequence
  chemically synthesized
gataggaaatatactttaaggg

SEQ ID NO: 1317420 - DNA, 22 bp, Artificial Sequence
  chemically synthesized
ccattagccatcccttaaagta

SEQ ID NO: 1317421 - DNA, 22 bp, Artificial Sequence
  chemically synthesized
gccatcccttaaagtatatttc

SEQ ID NO: 1317422 - DNA, 22 bp, Artificial Sequence
  chemically synthesized
gtgtgtaataactagataggaa

SEQ ID NO: 1317423 - DNA, 22 bp, Artificial Sequence
  chemically synthesized
agtgtgtaataactagatagga

SEQ ID NO: 1317424 - DNA, 22 bp, Artificial Sequence
  chemically synthesized
tagtgtgtaataactagatagg

SEQ ID NO: 1317425 - DNA, 22 bp, Artificial Sequence
  chemically synthesized
aaagtatatttcctatctagtt

SEQ ID NO: 1317426 - DNA, 22 bp, Artificial Sequence
  chemically synthesized
aagtatatttcctatctagtta

SEQ ID NO: 1317427 - DNA, 22 bp, Artificial Sequence
  chemically synthesized
tgagggagctttagtgtgtaat

SEQ ID NO: 1317428 - DNA, 22 bp, Artificial Sequence
  chemically synthesized
cctatctagttattacacacta

SEQ ID NO: 1317429 - DNA, 22 bp, Artificial Sequence
  chemically synthesized
ctatctagttattacacactaa

SEQ ID NO: 1317430 - DNA, 22 bp, Artificial Sequence
  chemically synthesized
tctagttattacacactaaagc

SEQ ID NO: 1317431 - DNA, 22 bp, Artificial Sequence
  chemically synthesized
acattatgagggagctttagtg

SEQ ID NO: 1317432 - DNA, 22 bp, Artificial Sequence
  chemically synthesized
cacattatgagggagctttagt

SEQ ID NO: 1317433 - DNA, 22 bp, Artificial Sequence
  chemically synthesized
gttattacacactaaagctccc

SEQ ID NO: 1317434 - DNA, 22 bp, Artificial Sequence
  chemically synthesized
cttcacattatgagggagcttt

SEQ ID NO: 1317435 - DNA, 22 bp, Artificial Sequence
  chemically synthesized
ttacacactaaagctccctcat

SEQ ID NO: 1317436 - DNA, 22 bp, Artificial Sequence
  chemically synthesized
cacactaaagctccctcataat

SEQ ID NO: 1317437 - DNA, 22 bp, Artificial Sequence
  chemically synthesized
aagctccctcataatgtgaagt

SEQ ID NO: 1317438 - DNA, 22 bp, Artificial Sequence
  chemically synthesized
gggatatcagaaattacttcac

SEQ ID NO: 1317439 - DNA, 22 bp, Artificial Sequence
  chemically synthesized
ggggatatcagaaattacttca

SEQ ID NO: 1317440 - DNA, 22 bp, Artificial Sequence
  chemically synthesized
tggggatatcagaaattacttc

SEQ ID NO: 1317441 - DNA, 22 bp, Artificial Sequence
  chemically synthesized
cctcataatgtgaagtaatttc

SEQ ID NO: 1317442 - DNA, 22 bp, Artificial Sequence
  chemically synthesized
ataatgtgaagtaatttctgat

SEQ ID NO: 1317443 - DNA, 22 bp, Artificial Sequence
  chemically synthesized
agttttggggatatcagaaatt

SEQ ID NO: 1317444 - DNA, 22 bp, Artificial Sequence
  chemically synthesized
gagttttggggatatcagaaat

SEQ ID NO: 1317445 - DNA, 22 bp, Artificial Sequence
  chemically synthesized
tgagttttggggatatcagaaa

SEQ ID NO: 1317446 - DNA, 22 bp, Artificial Sequence
  chemically synthesized
atggttttgagttttggggata

SEQ ID NO: 1317447 - DNA, 22 bp, Artificial Sequence
  chemically synthesized
tctgatggttttgagttttggg

SEQ ID NO: 1317448 - DNA, 22 bp, Artificial Sequence
  chemically synthesized
ctgatatccccaaaactcaaaa

SEQ ID NO: 1317449 - DNA, 22 bp, Artificial Sequence
  chemically synthesized
tgatatccccaaaactcaaaac

SEQ ID NO: 1317450 - DNA, 22 bp, Artificial Sequence
  chemically synthesized
tgttatctgatggttttgagtt

SEQ ID NO: 1317451 - DNA, 22 bp, Artificial Sequence
  chemically synthesized
atatccccaaaactcaaaacca

SEQ ID NO: 1317452 - DNA, 22 bp, Artificial Sequence
  chemically synthesized
attgtgttatctgatggttttg

SEQ ID NO: 1317453 - DNA, 22 bp, Artificial Sequence
  chemically synthesized
cattgtgttatctgatggtttt

SEQ ID NO: 1317454 - DNA, 22 bp, Artificial Sequence
  chemically synthesized
tcattgtgttatctgatggttt

SEQ ID NO: 1317455 - DNA, 22 bp, Artificial Sequence
  chemically synthesized
ttcattgtgttatctgatggtt

SEQ ID NO: 1317456 - DNA, 22 bp, Artificial Sequence
  chemically synthesized
tttttcattgtgttatctgatg

SEQ ID NO: 1317457 - DNA, 22 bp, Artificial Sequence
  chemically synthesized
tgtttttcattgtgttatctga

SEQ ID NO: 1317458 - DNA, 22 bp, Artificial Sequence
  chemically synthesized
ctctgtttttcattgtgttatc

SEQ ID NO: 1317459 - DNA, 22 bp, Artificial Sequence
  chemically synthesized
aaaaccatcagataacacaatg

SEQ ID NO: 1317460 - DNA, 22 bp, Artificial Sequence
  chemically synthesized
tgctctgtttttcattgtgtta

SEQ ID NO: 1317461 - DNA, 22 bp, Artificial Sequence
  chemically synthesized
aaaatcaaagactctgctctgt

SEQ ID NO: 1317462 - DNA, 22 bp, Artificial Sequence
  chemically synthesized
tcaaaatcaaagactctgctct

SEQ ID NO: 1317463 - DNA, 22 bp, Artificial Sequence
  chemically synthesized
aaaacagatggatccctctcaa

SEQ ID NO: 1317464 - DNA, 22 bp, Artificial Sequence
  chemically synthesized
tgattttgagagggatccatct

SEQ ID NO: 1317465 - DNA, 22 bp, Artificial Sequence
  chemically synthesized
gattttgagagggatccatctg

SEQ ID NO: 1317466 - DNA, 22 bp, Artificial Sequence
  chemically synthesized
attttgagagggatccatctgt

SEQ ID NO: 1317467 - DNA, 22 bp, Artificial Sequence
  chemically synthesized
tgagagggatccatctgttttt

SEQ ID NO: 1317468 - DNA, 22 bp, Artificial Sequence
  chemically synthesized
gagagggatccatctgttttta

SEQ ID NO: 1317469 - DNA, 22 bp, Artificial Sequence
  chemically synthesized
agagggatccatctgtttttaa

SEQ ID NO: 1317470 - DNA, 22 bp, Artificial Sequence
  chemically synthesized
cacatgaaaccccaggaattaa

SEQ ID NO: 1317471 - DNA, 22 bp, Artificial Sequence
  chemically synthesized
ccacatgaaaccccaggaatta

SEQ ID NO: 1317472 - DNA, 22 bp, Artificial Sequence
  chemically synthesized
tccacatgaaaccccaggaatt

SEQ ID NO: 1317473 - DNA, 22 bp, Artificial Sequence
  chemically synthesized
ttttccacatgaaaccccagga

SEQ ID NO: 1317474 - DNA, 22 bp, Artificial Sequence
  chemically synthesized
tttttaattcctggggtttcat

SEQ ID NO: 1317475 - DNA, 22 bp, Artificial Sequence
  chemically synthesized
ttaattcctggggtttcatgtg

SEQ ID NO: 1317476 - DNA, 22 bp, Artificial Sequence
  chemically synthesized
taattcctggggtttcatgtgg

SEQ ID NO: 1317477 - DNA, 22 bp, Artificial Sequence
  chemically synthesized
aattcctggggtttcatgtgga

SEQ ID NO: 1317478 - DNA, 22 bp, Artificial Sequence
  chemically synthesized
attcctggggtttcatgtggaa

SEQ ID NO: 1317479 - DNA, 22 bp, Artificial Sequence
  chemically synthesized
ctggggtttcatgtggaaaaca

SEQ ID NO: 1317480 - DNA, 22 bp, Artificial Sequence
  chemically synthesized
gggtttcatgtggaaaacagtt

SEQ ID NO: 1317481 - DNA, 22 bp, Artificial Sequence
  chemically synthesized
gggaaaaaaaaaaaaaactgtt

SEQ ID NO: 1317482 - DNA, 22 bp, Artificial Sequence
  chemically synthesized
agggaaaaaaaaaaaaaactgt

SEQ ID NO: 1317483 - DNA, 22 bp, Artificial Sequence
  chemically synthesized
tagggaaaaaaaaaaaaaactg

SEQ ID NO: 1317484 - DNA, 22 bp, Artificial Sequence
  chemically synthesized
catgtggaaaacagtttttttt

SEQ ID NO: 1317485 - DNA, 22 bp, Artificial Sequence
  chemically synthesized
atgtggaaaacagttttttttt

SEQ ID NO: 1317486 - DNA, 22 bp, Artificial Sequence
  chemically synthesized
tttttttttttccctaaaacgg

SEQ ID NO: 1317487 - DNA, 22 bp, Artificial Sequence
  chemically synthesized
ttttttttttccctaaaacggg

SEQ ID NO: 1317488 - DNA, 22 bp, Artificial Sequence
  chemically synthesized
tttttttttccctaaaacgggt

SEQ ID NO: 1317489 - DNA, 22 bp, Artificial Sequence
  chemically synthesized
ttttttttccctaaaacgggtt

SEQ ID NO: 1317490 - DNA, 22 bp, Artificial Sequence
  chemically synthesized
tttttttccctaaaacgggttc

SEQ ID NO: 1317491 - DNA, 22 bp, Artificial Sequence
  chemically synthesized
ttttttccctaaaacgggttct

SEQ ID NO: 1317492 - DNA, 22 bp, Artificial Sequence
  chemically synthesized
tttttccctaaaacgggttctg

SEQ ID NO: 1317493 - DNA, 22 bp, Artificial Sequence
  chemically synthesized
ttttccctaaaacgggttctgt

SEQ ID NO: 1317494 - DNA, 22 bp, Artificial Sequence
  chemically synthesized
tttccctaaaacgggttctgtg

SEQ ID NO: 1317495 - DNA, 22 bp, Artificial Sequence
  chemically synthesized
ttccctaaaacgggttctgtgg

SEQ ID NO: 1317496 - DNA, 22 bp, Artificial Sequence
  chemically synthesized
tccctaaaacgggttctgtggt

SEQ ID NO: 1317497 - DNA, 22 bp, Artificial Sequence
  chemically synthesized
ccctaaaacgggttctgtggtg

SEQ ID NO: 1317498 - DNA, 22 bp, Artificial Sequence
  chemically synthesized
cctaaaacgggttctgtggtgc

SEQ ID NO: 1317499 - DNA, 22 bp, Artificial Sequence
  chemically synthesized
ggaaaaacagaggaggcaccac

SEQ ID NO: 1317500 - DNA, 22 bp, Artificial Sequence
  chemically synthesized
aaacgggttctgtggtgcctcc

SEQ ID NO: 1317501 - DNA, 22 bp, Artificial Sequence
  chemically synthesized
attgggaaaaacagaggaggca

SEQ ID NO: 1317502 - DNA, 22 bp, Artificial Sequence
  chemically synthesized
ggactcattgggaaaaacagag

SEQ ID NO: 1317503 - DNA, 22 bp, Artificial Sequence
  chemically synthesized
tgtggtgcctcctctgtttttc

SEQ ID NO: 1317504 - DNA, 22 bp, Artificial Sequence
  chemically synthesized
tggtgcctcctctgtttttccc

SEQ ID NO: 1317505 - DNA, 22 bp, Artificial Sequence
  chemically synthesized
gtagcctgggactcattgggaa

SEQ ID NO: 1317506 - DNA, 22 bp, Artificial Sequence
  chemically synthesized
tggtagcctgggactcattggg

SEQ ID NO: 1317507 - DNA, 22 bp, Artificial Sequence
  chemically synthesized
ctggtagcctgggactcattgg

SEQ ID NO: 1317508 - DNA, 22 bp, Artificial Sequence
  chemically synthesized
ctctgtttttcccaatgagtcc

SEQ ID NO: 1317509 - DNA, 22 bp, Artificial Sequence
  chemically synthesized
tgtttttcccaatgagtcccag

SEQ ID NO: 1317510 - DNA, 22 bp, Artificial Sequence
  chemically synthesized
tttttcccaatgagtcccaggc

SEQ ID NO: 1317511 - DNA, 22 bp, Artificial Sequence
  chemically synthesized
ttcccaatgagtcccaggctac

SEQ ID NO: 1317512 - DNA, 22 bp, Artificial Sequence
  chemically synthesized
agataacttctggtagcctggg

SEQ ID NO: 1317513 - DNA, 22 bp, Artificial Sequence
  chemically synthesized
tcccaatgagtcccaggctacc

SEQ ID NO: 1317514 - DNA, 22 bp, Artificial Sequence
  chemically synthesized
cccaatgagtcccaggctacca

SEQ ID NO: 1317515 - DNA, 22 bp, Artificial Sequence
  chemically synthesized
ccaatgagtcccaggctaccag

SEQ ID NO: 1317516 - DNA, 22 bp, Artificial Sequence
  chemically synthesized
acgcacacgtgagtccctaaga

SEQ ID NO: 1317517 - DNA, 22 bp, Artificial Sequence
  chemically synthesized
aacgcacacgtgagtccctaag

SEQ ID NO: 1317518 - DNA, 22 bp, Artificial Sequence
  chemically synthesized
ccagaagttatcttagggactc

SEQ ID NO: 1317519 - DNA, 22 bp, Artificial Sequence
  chemically synthesized
ttaacgcacacgtgagtcccta

SEQ ID NO: 1317520 - DNA, 22 bp, Artificial Sequence
  chemically synthesized
ccactcttaacgcacacgtgag

SEQ ID NO: 1317521 - DNA, 22 bp, Artificial Sequence
  chemically synthesized
gccactcttaacgcacacgtga

SEQ ID NO: 1317522 - DNA, 22 bp, Artificial Sequence
  chemically synthesized
tcttagggactcacgtgtgcgt

SEQ ID NO: 1317523 - DNA, 22 bp, Artificial Sequence
  chemically synthesized
tcttgccactcttaacgcacac

SEQ ID NO: 1317524 - DNA, 22 bp, Artificial Sequence
  chemically synthesized
gtcttgccactcttaacgcaca

SEQ ID NO: 1317525 - DNA, 22 bp, Artificial Sequence
  chemically synthesized
agggactcacgtgtgcgttaag

SEQ ID NO: 1317526 - DNA, 22 bp, Artificial Sequence
  chemically synthesized
tgtcttgccactcttaacgcac

SEQ ID NO: 1317527 - DNA, 22 bp, Artificial Sequence
  chemically synthesized
gggactcacgtgtgcgttaaga

SEQ ID NO: 1317528 - DNA, 22 bp, Artificial Sequence
  chemically synthesized
ttgtcttgccactcttaacgca

SEQ ID NO: 1317529 - DNA, 22 bp, Artificial Sequence
  chemically synthesized
tttgtcttgccactcttaacgc

SEQ ID NO: 1317530 - DNA, 22 bp, Artificial Sequence
  chemically synthesized
ttttgtcttgccactcttaacg

SEQ ID NO: 1317531 - DNA, 22 bp, Artificial Sequence
  chemically synthesized
atttttttgtcttgccactctt

SEQ ID NO: 1317532 - DNA, 22 bp, Artificial Sequence
  chemically synthesized
acgtgtgcgttaagagtggcaa

SEQ ID NO: 1317533 - DNA, 22 bp, Artificial Sequence
  chemically synthesized
aatttttttgtcttgccactct

SEQ ID NO: 1317534 - DNA, 22 bp, Artificial Sequence
  chemically synthesized
taatttttttgtcttgccactc

SEQ ID NO: 1317535 - DNA, 22 bp, Artificial Sequence
  chemically synthesized
ttaatttttttgtcttgccact

SEQ ID NO: 1317536 - DNA, 22 bp, Artificial Sequence
  chemically synthesized
tttaatttttttgtcttgccac

SEQ ID NO: 1317537 - DNA, 22 bp, Artificial Sequence
  chemically synthesized
ttttaatttttttgtcttgcca

SEQ ID NO: 1317538 - DNA, 22 bp, Artificial Sequence
  chemically synthesized
ttttttaatttttttgtcttgc

SEQ ID NO: 1317539 - DNA, 22 bp, Artificial Sequence
  chemically synthesized
tcttttttaatttttttgtctt

SEQ ID NO: 1317540 - DNA, 22 bp, Artificial Sequence
  chemically synthesized
ctcttttttaatttttttgtct

SEQ ID NO: 1317541 - DNA, 22 bp, Artificial Sequence
  chemically synthesized
tctcttttttaatttttttgtc

SEQ ID NO: 1317542 - DNA, 22 bp, Artificial Sequence
  chemically synthesized
ttctcttttttaatttttttgt

SEQ ID NO: 1317543 - DNA, 22 bp, Artificial Sequence
  chemically synthesized
agagtggcaagacaaaaaaatt

SEQ ID NO: 1317544 - DNA, 22 bp, Artificial Sequence
  chemically synthesized
tttctcttttttaatttttttg

SEQ ID NO: 1317545 - DNA, 22 bp, Artificial Sequence
  chemically synthesized
ttttctcttttttaattttttt

SEQ ID NO: 1317546 - DNA, 22 bp, Artificial Sequence
  chemically synthesized
catttttttctcttttttaatt

SEQ ID NO: 1317547 - DNA, 22 bp, Artificial Sequence
  chemically synthesized
tccatttttttctcttttttaa

SEQ ID NO: 1317548 - DNA, 22 bp, Artificial Sequence
  chemically synthesized
ctccatttttttctctttttta

SEQ ID NO: 1317549 - DNA, 22 bp, Artificial Sequence
  chemically synthesized
tctccatttttttctctttttt

SEQ ID NO: 1317550 - DNA, 22 bp, Artificial Sequence
  chemically synthesized
ttctccatttttttctcttttt

SEQ ID NO: 1317551 - DNA, 22 bp, Artificial Sequence
  chemically synthesized
tttttctccatttttttctctt

SEQ ID NO: 1317552 - DNA, 22 bp, Artificial Sequence
  chemically synthesized
aattatttttctccattttttt

SEQ ID NO: 1317553 - DNA, 22 bp, Artificial Sequence
  chemically synthesized
aaaaagagaaaaaaatggagaa

SEQ ID NO: 1317554 - DNA, 22 bp, Artificial Sequence
  chemically synthesized
agccgactgaattatttttctc

SEQ ID NO: 1317555 - DNA, 22 bp, Artificial Sequence
  chemically synthesized
tcagccgactgaattatttttc

SEQ ID NO: 1317556 - DNA, 22 bp, Artificial Sequence
  chemically synthesized
ctcagccgactgaattattttt

SEQ ID NO: 1317557 - DNA, 22 bp, Artificial Sequence
  chemically synthesized
ttctcagccgactgaattattt

SEQ ID NO: 1317558 - DNA, 22 bp, Artificial Sequence
  chemically synthesized
cttctcagccgactgaattatt

SEQ ID NO: 1317559 - DNA, 22 bp, Artificial Sequence
  chemically synthesized
tcttctcagccgactgaattat

SEQ ID NO: 1317560 - DNA, 22 bp, Artificial Sequence
  chemically synthesized
ttcttctcagccgactgaatta

SEQ ID NO: 1317561 - DNA, 22 bp, Artificial Sequence
  chemically synthesized
tttcttctcagccgactgaatt

SEQ ID NO: 1317562 - DNA, 22 bp, Artificial Sequence
  chemically synthesized
gaaaaagttttttcttctcagc

SEQ ID NO: 1317563 - DNA, 22 bp, Artificial Sequence
  chemically synthesized
ggaaaaagttttttcttctcag

SEQ ID NO: 1317564 - DNA, 22 bp, Artificial Sequence
  chemically synthesized
tggaaaaagttttttcttctca

SEQ ID NO: 1317565 - DNA, 22 bp, Artificial Sequence
  chemically synthesized
ttggaaaaagttttttcttctc

SEQ ID NO: 1317566 - DNA, 22 bp, Artificial Sequence
  chemically synthesized
tttggaaaaagttttttcttct

SEQ ID NO: 1317567 - DNA, 22 bp, Artificial Sequence
  chemically synthesized
ttttggaaaaagttttttcttc

SEQ ID NO: 1317568 - DNA, 22 bp, Artificial Sequence
  chemically synthesized
agtcggctgagaagaaaaaact

SEQ ID NO: 1317569 - DNA, 22 bp, Artificial Sequence
  chemically synthesized
tttttttggaaaaagttttttc

SEQ ID NO: 1317570 - DNA, 22 bp, Artificial Sequence
  chemically synthesized
gtttttttggaaaaagtttttt

SEQ ID NO: 1317571 - DNA, 22 bp, Artificial Sequence
  chemically synthesized
gaacttgtttttttggaaaaag

SEQ ID NO: 1317572 - DNA, 22 bp, Artificial Sequence
  chemically synthesized
agaagaaaaaactttttccaaa

SEQ ID NO: 1317573 - DNA, 22 bp, Artificial Sequence
  chemically synthesized
ggaacttgtttttttggaaaaa

SEQ ID NO: 1317574 - DNA, 22 bp, Artificial Sequence
  chemically synthesized
ttggaacttgtttttttggaaa

SEQ ID NO: 1317575 - DNA, 22 bp, Artificial Sequence
  chemically synthesized
cttggaacttgtttttttggaa

SEQ ID NO: 1317576 - DNA, 22 bp, Artificial Sequence
  chemically synthesized
ttcttggaacttgtttttttgg

SEQ ID NO: 1317577 - DNA, 22 bp, Artificial Sequence
  chemically synthesized
tcttcttggaacttgttttttt

SEQ ID NO: 1317578 - DNA, 22 bp, Artificial Sequence
  chemically synthesized
ctcttcttggaacttgtttttt

SEQ ID NO: 1317579 - DNA, 22 bp, Artificial Sequence
  chemically synthesized
tctcttcttggaacttgttttt

SEQ ID NO: 1317580 - DNA, 22 bp, Artificial Sequence
  chemically synthesized
ttctcttcttggaacttgtttt

SEQ ID NO: 1317581 - DNA, 22 bp, Artificial Sequence
  chemically synthesized
tttccaaaaaaacaagttccaa

SEQ ID NO: 1317582 - DNA, 22 bp, Artificial Sequence
  chemically synthesized
ttccaaaaaaacaagttccaag

SEQ ID NO: 1317583 - DNA, 22 bp, Artificial Sequence
  chemically synthesized
tgtttttctcttcttggaactt

SEQ ID NO: 1317584 - DNA, 22 bp, Artificial Sequence
  chemically synthesized
tccaaaaaaacaagttccaaga

SEQ ID NO: 1317585 - DNA, 22 bp, Artificial Sequence
  chemically synthesized
atgtttttctcttcttggaact

SEQ ID NO: 1317586 - DNA, 22 bp, Artificial Sequence
  chemically synthesized
ccaaaaaaacaagttccaagaa

SEQ ID NO: 1317587 - DNA, 22 bp, Artificial Sequence
  chemically synthesized
tatgtttttctcttcttggaac

SEQ ID NO: 1317588 - DNA, 22 bp, Artificial Sequence
  chemically synthesized
caaaaaaacaagttccaagaag

SEQ ID NO: 1317589 - DNA, 22 bp, Artificial Sequence
  chemically synthesized
aaaggcctttatgtttttctct

SEQ ID NO: 1317590 - DNA, 22 bp, Artificial Sequence
  chemically synthesized
aaaaggcctttatgtttttctc

SEQ ID NO: 1317591 - DNA, 22 bp, Artificial Sequence
  chemically synthesized
caagaagagaaaaacataaagg

SEQ ID NO: 1317592 - DNA, 22 bp, Artificial Sequence
  chemically synthesized
tagatatatttaaaaggccttt

SEQ ID NO: 1317593 - DNA, 22 bp, Artificial Sequence
  chemically synthesized
agagtggataaacaagctatag

SEQ ID NO: 1317594 - DNA, 22 bp, Artificial Sequence
  chemically synthesized
ttaaatatatctatagcttgtt

SEQ ID NO: 1317595 - DNA, 22 bp, Artificial Sequence
  chemically synthesized
taaatatatctatagcttgttt

SEQ ID NO: 1317596 - DNA, 22 bp, Artificial Sequence
  chemically synthesized
aaatatatctatagcttgttta

SEQ ID NO: 1317597 - DNA, 22 bp, Artificial Sequence
  chemically synthesized
attaagagtggataaacaagct

SEQ ID NO: 1317598 - DNA, 22 bp, Artificial Sequence
  chemically synthesized
aatatatctatagcttgtttat

SEQ ID NO: 1317599 - DNA, 22 bp, Artificial Sequence
  chemically synthesized
aattaagagtggataaacaagc

SEQ ID NO: 1317600 - DNA, 22 bp, Artificial Sequence
  chemically synthesized
tagcttgtttatccactcttaa

SEQ ID NO: 1317601 - DNA, 22 bp, Artificial Sequence
  chemically synthesized
aaagtcagcttaattaagagtg

SEQ ID NO: 1317602 - DNA, 22 bp, Artificial Sequence
  chemically synthesized
gtttatccactcttaattaagc

SEQ ID NO: 1317603 - DNA, 22 bp, Artificial Sequence
  chemically synthesized
tttatccactcttaattaagct

SEQ ID NO: 1317604 - DNA, 22 bp, Artificial Sequence
  chemically synthesized
tggttaaaagtcagcttaatta

SEQ ID NO: 1317605 - DNA, 22 bp, Artificial Sequence
  chemically synthesized
atccactcttaattaagctgac

SEQ ID NO: 1317606 - DNA, 22 bp, Artificial Sequence
  chemically synthesized
tccactcttaattaagctgact

SEQ ID NO: 1317607 - DNA, 22 bp, Artificial Sequence
  chemically synthesized
aagagcactatggttaaaagtc

SEQ ID NO: 1317608 - DNA, 22 bp, Artificial Sequence
  chemically synthesized
ttaattaagctgacttttaacc

SEQ ID NO: 1317609 - DNA, 22 bp, Artificial Sequence
  chemically synthesized
aaagagcactatggttaaaagt

SEQ ID NO: 1317610 - DNA, 22 bp, Artificial Sequence
  chemically synthesized
taaagagcactatggttaaaag

SEQ ID NO: 1317611 - DNA, 22 bp, Artificial Sequence
  chemically synthesized
aattaagctgacttttaaccat

SEQ ID NO: 1317612 - DNA, 22 bp, Artificial Sequence
  chemically synthesized
ttaaagagcactatggttaaaa

SEQ ID NO: 1317613 - DNA, 22 bp, Artificial Sequence
  chemically synthesized
attaagctgacttttaaccata

SEQ ID NO: 1317614 - DNA, 22 bp, Artificial Sequence
  chemically synthesized
tttaaagagcactatggttaaa

SEQ ID NO: 1317615 - DNA, 22 bp, Artificial Sequence
  chemically synthesized
ttttaaagagcactatggttaa

SEQ ID NO: 1317616 - DNA, 22 bp, Artificial Sequence
  chemically synthesized
ttttttaaagagcactatggtt

SEQ ID NO: 1317617 - DNA, 22 bp, Artificial Sequence
  chemically synthesized
agctgacttttaaccatagtgc

SEQ ID NO: 1317618 - DNA, 22 bp, Artificial Sequence
  chemically synthesized
cttttttaaagagcactatggt

SEQ ID NO: 1317619 - DNA, 22 bp, Artificial Sequence
  chemically synthesized
acttttaaccatagtgctcttt

SEQ ID NO: 1317620 - DNA, 22 bp, Artificial Sequence
  chemically synthesized
ttaaccatagtgctctttaaaa

SEQ ID NO: 1317621 - DNA, 22 bp, Artificial Sequence
  chemically synthesized
aaagaatttcttttttaaagag

SEQ ID NO: 1317622 - DNA, 22 bp, Artificial Sequence
  chemically synthesized
taaccatagtgctctttaaaaa

SEQ ID NO: 1317623 - DNA, 22 bp, Artificial Sequence
  chemically synthesized
aaccatagtgctctttaaaaaa

SEQ ID NO: 1317624 - DNA, 22 bp, Artificial Sequence
  chemically synthesized
accatagtgctctttaaaaaag

SEQ ID NO: 1317625 - DNA, 22 bp, Artificial Sequence
  chemically synthesized
tttaaaaaagaaattcttttag

SEQ ID NO: 1317626 - DNA, 22 bp, Artificial Sequence
  chemically synthesized
ggtaataagagatctaaaagaa

SEQ ID NO: 1317627 - DNA, 22 bp, Artificial Sequence
  chemically synthesized
taaaaaagaaattcttttagat

SEQ ID NO: 1317628 - DNA, 22 bp, Artificial Sequence
  chemically synthesized
aaaaaagaaattcttttagatc

SEQ ID NO: 1317629 - DNA, 22 bp, Artificial Sequence
  chemically synthesized
aaaaagaaattcttttagatct

SEQ ID NO: 1317630 - DNA, 22 bp, Artificial Sequence
  chemically synthesized
aaattaggtaataagagatcta

SEQ ID NO: 1317631 - DNA, 22 bp, Artificial Sequence
  chemically synthesized
ttttagatctcttattacctaa

SEQ ID NO: 1317632 - DNA, 22 bp, Artificial Sequence
  chemically synthesized
gcatggctaaaattaggtaata

SEQ ID NO: 1317633 - DNA, 22 bp, Artificial Sequence
  chemically synthesized
ggcatggctaaaattaggtaat

SEQ ID NO: 1317634 - DNA, 22 bp, Artificial Sequence
  chemically synthesized
ttagatctcttattacctaatt

SEQ ID NO: 1317635 - DNA, 22 bp, Artificial Sequence
  chemically synthesized
tagatctcttattacctaattt

SEQ ID NO: 1317636 - DNA, 22 bp, Artificial Sequence
  chemically synthesized
agatctcttattacctaatttt

SEQ ID NO: 1317637 - DNA, 22 bp, Artificial Sequence
  chemically synthesized
gatctcttattacctaatttta

SEQ ID NO: 1317638 - DNA, 22 bp, Artificial Sequence
  chemically synthesized
tccacttggcatggctaaaatt

SEQ ID NO: 1317639 - DNA, 22 bp, Artificial Sequence
  chemically synthesized
ttattacctaattttagccatg

SEQ ID NO: 1317640 - DNA, 22 bp, Artificial Sequence
  chemically synthesized
attacctaattttagccatgcc

SEQ ID NO: 1317641 - DNA, 22 bp, Artificial Sequence
  chemically synthesized
ttacctaattttagccatgcca

SEQ ID NO: 1317642 - DNA, 22 bp, Artificial Sequence
  chemically synthesized
cctaattttagccatgccaagt

SEQ ID NO: 1317643 - DNA, 22 bp, Artificial Sequence
  chemically synthesized
aaaatattgtccacttggcatg

SEQ ID NO: 1317644 - DNA, 22 bp, Artificial Sequence
  chemically synthesized
attttagccatgccaagtggac

SEQ ID NO: 1317645 - DNA, 22 bp, Artificial Sequence
  chemically synthesized
tagccatgccaagtggacaata

SEQ ID NO: 1317646 - DNA, 22 bp, Artificial Sequence
  chemically synthesized
agaagctaaaaatattgtccac

SEQ ID NO: 1317647 - DNA, 22 bp, Artificial Sequence
  chemically synthesized
agccatgccaagtggacaatat

SEQ ID NO: 1317648 - DNA, 22 bp, Artificial Sequence
  chemically synthesized
gccatgccaagtggacaatatt

SEQ ID NO: 1317649 - DNA, 22 bp, Artificial Sequence
  chemically synthesized
gtaaagttcagaagctaaaaat

SEQ ID NO: 1317650 - DNA, 22 bp, Artificial Sequence
  chemically synthesized
ggtaaagttcagaagctaaaaa

SEQ ID NO: 1317651 - DNA, 22 bp, Artificial Sequence
  chemically synthesized
tggtaaagttcagaagctaaaa

SEQ ID NO: 1317652 - DNA, 22 bp, Artificial Sequence
  chemically synthesized
ctttggtaaagttcagaagcta

SEQ ID NO: 1317653 - DNA, 22 bp, Artificial Sequence
  chemically synthesized
cctttggtaaagttcagaagct

SEQ ID NO: 1317654 - DNA, 22 bp, Artificial Sequence
  chemically synthesized
ggaggtttcctttggtaaagtt

SEQ ID NO: 1317655 - DNA, 22 bp, Artificial Sequence
  chemically synthesized
ttagcttctgaactttaccaaa

SEQ ID NO: 1317656 - DNA, 22 bp, Artificial Sequence
  chemically synthesized
tagcttctgaactttaccaaag

SEQ ID NO: 1317657 - DNA, 22 bp, Artificial Sequence
  chemically synthesized
agcttctgaactttaccaaagg

SEQ ID NO: 1317658 - DNA, 22 bp, Artificial Sequence
  chemically synthesized
gcttctgaactttaccaaagga

SEQ ID NO: 1317659 - DNA, 22 bp, Artificial Sequence
  chemically synthesized
ctgaactttaccaaaggaaacc

SEQ ID NO: 1317660 - DNA, 22 bp, Artificial Sequence
  chemically synthesized
cagcacctaggaggtttccttt

SEQ ID NO: 1317661 - DNA, 22 bp, Artificial Sequence
  chemically synthesized
tgaactttaccaaaggaaacct

SEQ ID NO: 1317662 - DNA, 22 bp, Artificial Sequence
  chemically synthesized
gcagcacctaggaggtttcctt

SEQ ID NO: 1317663 - DNA, 22 bp, Artificial Sequence
  chemically synthesized
tgcagcacctaggaggtttcct

SEQ ID NO: 1317664 - DNA, 22 bp, Artificial Sequence
  chemically synthesized
aactttaccaaaggaaacctcc

SEQ ID NO: 1317665 - DNA, 22 bp, Artificial Sequence
  chemically synthesized
taccaaaggaaacctcctaggt

SEQ ID NO: 1317666 - DNA, 22 bp, Artificial Sequence
  chemically synthesized
tgtctttgcagcacctaggagg

SEQ ID NO: 1317667 - DNA, 22 bp, Artificial Sequence
  chemically synthesized
accaaaggaaacctcctaggtg

SEQ ID NO: 1317668 - DNA, 22 bp, Artificial Sequence
  chemically synthesized
ccaaaggaaacctcctaggtgc

SEQ ID NO: 1317669 - DNA, 22 bp, Artificial Sequence
  chemically synthesized
ctatgtctttgcagcacctagg

SEQ ID NO: 1317670 - DNA, 22 bp, Artificial Sequence
  chemically synthesized
actatgtctttgcagcacctag

SEQ ID NO: 1317671 - DNA, 22 bp, Artificial Sequence
  chemically synthesized
ttactatgtctttgcagcacct

SEQ ID NO: 1317672 - DNA, 22 bp, Artificial Sequence
  chemically synthesized
cttactatgtctttgcagcacc

SEQ ID NO: 1317673 - DNA, 22 bp, Artificial Sequence
  chemically synthesized
ctaggtgctgcaaagacatagt

SEQ ID NO: 1317674 - DNA, 22 bp, Artificial Sequence
  chemically synthesized
ggtgctgcaaagacatagtaag

SEQ ID NO: 1317675 - DNA, 22 bp, Artificial Sequence
  chemically synthesized
taaaaagaaacttcttactatg

SEQ ID NO: 1317676 - DNA, 22 bp, Artificial Sequence
  chemically synthesized
gtaaaaagaaacttcttactat

SEQ ID NO: 1317677 - DNA, 22 bp, Artificial Sequence
  chemically synthesized
caaagacatagtaagaagtttc

SEQ ID NO: 1317678 - DNA, 22 bp, Artificial Sequence
  chemically synthesized
aatcttgtaaaaagaaacttct

SEQ ID NO: 1317679 - DNA, 22 bp, Artificial Sequence
  chemically synthesized
taaatcttgtaaaaagaaactt

SEQ ID NO: 1317680 - DNA, 22 bp, Artificial Sequence
  chemically synthesized
tggagattctaaatcttgtaaa

SEQ ID NO: 1317681 - DNA, 22 bp, Artificial Sequence
  chemically synthesized
gtggagattctaaatcttgtaa

SEQ ID NO: 1317682 - DNA, 22 bp, Artificial Sequence
  chemically synthesized
ccttgtggagattctaaatctt

SEQ ID NO: 1317683 - DNA, 22 bp, Artificial Sequence
  chemically synthesized
ctttttacaagatttagaatct

SEQ ID NO: 1317684 - DNA, 22 bp, Artificial Sequence
  chemically synthesized
tttttacaagatttagaatctc

SEQ ID NO: 1317685 - DNA, 22 bp, Artificial Sequence
  chemically synthesized
gactaccttgtggagattctaa

SEQ ID NO: 1317686 - DNA, 22 bp, Artificial Sequence
  chemically synthesized
tttacaagatttagaatctcca

SEQ ID NO: 1317687 - DNA, 22 bp, Artificial Sequence
  chemically synthesized
tggactaccttgtggagattct

SEQ ID NO: 1317688 - DNA, 22 bp, Artificial Sequence
  chemically synthesized
ttacaagatttagaatctccac

SEQ ID NO: 1317689 - DNA, 22 bp, Artificial Sequence
  chemically synthesized
tacaagatttagaatctccaca

SEQ ID NO: 1317690 - DNA, 22 bp, Artificial Sequence
  chemically synthesized
tctggactaccttgtggagatt

SEQ ID NO: 1317691 - DNA, 22 bp, Artificial Sequence
  chemically synthesized
acaagatttagaatctccacaa

SEQ ID NO: 1317692 - DNA, 22 bp, Artificial Sequence
  chemically synthesized
ctctggactaccttgtggagat

SEQ ID NO: 1317693 - DNA, 22 bp, Artificial Sequence
  chemically synthesized
caagatttagaatctccacaag

SEQ ID NO: 1317694 - DNA, 22 bp, Artificial Sequence
  chemically synthesized
tctctggactaccttgtggaga

SEQ ID NO: 1317695 - DNA, 22 bp, Artificial Sequence
  chemically synthesized
ctttctctggactaccttgtgg

SEQ ID NO: 1317696 - DNA, 22 bp, Artificial Sequence
  chemically synthesized
cctttctctggactaccttgtg

SEQ ID NO: 1317697 - DNA, 22 bp, Artificial Sequence
  chemically synthesized
tcctttctctggactaccttgt

SEQ ID NO: 1317698 - DNA, 22 bp, Artificial Sequence
  chemically synthesized
agaatctccacaaggtagtcca

SEQ ID NO: 1317699 - DNA, 22 bp, Artificial Sequence
  chemically synthesized
gaatctccacaaggtagtccag

SEQ ID NO: 1317700 - DNA, 22 bp, Artificial Sequence
  chemically synthesized
aattttcctttctctggactac

SEQ ID NO: 1317701 - DNA, 22 bp, Artificial Sequence
  chemically synthesized
gaattttcctttctctggacta

SEQ ID NO: 1317702 - DNA, 22 bp, Artificial Sequence
  chemically synthesized
ttgaattttcctttctctggac

SEQ ID NO: 1317703 - DNA, 22 bp, Artificial Sequence
  chemically synthesized
tcttgaattttcctttctctgg

SEQ ID NO: 1317704 - DNA, 22 bp, Artificial Sequence
  chemically synthesized
cacaaggtagtccagagaaagg

SEQ ID NO: 1317705 - DNA, 22 bp, Artificial Sequence
  chemically synthesized
ctctcttgaattttcctttctc

SEQ ID NO: 1317706 - DNA, 22 bp, Artificial Sequence
  chemically synthesized
cctctcttgaattttcctttct

SEQ ID NO: 1317707 - DNA, 22 bp, Artificial Sequence
  chemically synthesized
atttcctctcttgaattttcct

SEQ ID NO: 1317708 - DNA, 22 bp, Artificial Sequence
  chemically synthesized
tgatttcctctcttgaattttc

SEQ ID NO: 1317709 - DNA, 22 bp, Artificial Sequence
  chemically synthesized
ctgatttcctctcttgaatttt

SEQ ID NO: 1317710 - DNA, 22 bp, Artificial Sequence
  chemically synthesized
tctgatttcctctcttgaattt

SEQ ID NO: 1317711 - DNA, 22 bp, Artificial Sequence
  chemically synthesized
ttctgatttcctctcttgaatt

SEQ ID NO: 1317712 - DNA, 22 bp, Artificial Sequence
  chemically synthesized
ttttctgatttcctctcttgaa

SEQ ID NO: 1317713 - DNA, 22 bp, Artificial Sequence
  chemically synthesized
cttttctgatttcctctcttga

SEQ ID NO: 1317714 - DNA, 22 bp, Artificial Sequence
  chemically synthesized
agtttcttttctgatttcctct

SEQ ID NO: 1317715 - DNA, 22 bp, Artificial Sequence
  chemically synthesized
ttaagtttcttttctgatttcc

SEQ ID NO: 1317716 - DNA, 22 bp, Artificial Sequence
  chemically synthesized
attaagtttcttttctgatttc

SEQ ID NO: 1317717 - DNA, 22 bp, Artificial Sequence
  chemically synthesized
aagagaggaaatcagaaaagaa

SEQ ID NO: 1317718 - DNA, 22 bp, Artificial Sequence
  chemically synthesized
ccatttattaagtttcttttct

SEQ ID NO: 1317719 - DNA, 22 bp, Artificial Sequence
  chemically synthesized
gccatttattaagtttcttttc

SEQ ID NO: 1317720 - DNA, 22 bp, Artificial Sequence
  chemically synthesized
tgccatttattaagtttctttt

SEQ ID NO: 1317721 - DNA, 22 bp, Artificial Sequence
  chemically synthesized
tgtagctttgccatttattaag

SEQ ID NO: 1317722 - DNA, 22 bp, Artificial Sequence
  chemically synthesized
gtgtagctttgccatttattaa

SEQ ID NO: 1317723 - DNA, 22 bp, Artificial Sequence
  chemically synthesized
tttgtgtagctttgccatttat

SEQ ID NO: 1317724 - DNA, 22 bp, Artificial Sequence
  chemically synthesized
ttatttgtgtagctttgccatt

SEQ ID NO: 1317725 - DNA, 22 bp, Artificial Sequence
  chemically synthesized
gttatttgtgtagctttgccat

SEQ ID NO: 1317726 - DNA, 22 bp, Artificial Sequence
  chemically synthesized
atttgttatttgtgtagctttg

SEQ ID NO: 1317727 - DNA, 22 bp, Artificial Sequence
  chemically synthesized
tgatttgttatttgtgtagctt

SEQ ID NO: 1317728 - DNA, 22 bp, Artificial Sequence
  chemically synthesized
aataaatggcaaagctacacaa

SEQ ID NO: 1317729 - DNA, 22 bp, Artificial Sequence
  chemically synthesized
ctgatttgttatttgtgtagct

SEQ ID NO: 1317730 - DNA, 22 bp, Artificial Sequence
  chemically synthesized
ataaatggcaaagctacacaaa

SEQ ID NO: 1317731 - DNA, 22 bp, Artificial Sequence
  chemically synthesized
tctgatttgttatttgtgtagc

SEQ ID NO: 1317732 - DNA, 22 bp, Artificial Sequence
  chemically synthesized
ctttctgatttgttatttgtgt

SEQ ID NO: 1317733 - DNA, 22 bp, Artificial Sequence
  chemically synthesized
gaatgattcctttctgatttgt

SEQ ID NO: 1317734 - DNA, 22 bp, Artificial Sequence
  chemically synthesized
tggaatgattcctttctgattt

SEQ ID NO: 1317735 - DNA, 22 bp, Artificial Sequence
  chemically synthesized
ctggaatgattcctttctgatt

SEQ ID NO: 1317736 - DNA, 22 bp, Artificial Sequence
  chemically synthesized
cacaaataacaaatcagaaagg

SEQ ID NO: 1317737 - DNA, 22 bp, Artificial Sequence
  chemically synthesized
gcttctggaatgattcctttct

SEQ ID NO: 1317738 - DNA, 22 bp, Artificial Sequence
  chemically synthesized
ttggcttctggaatgattcctt

SEQ ID NO: 1317739 - DNA, 22 bp, Artificial Sequence
  chemically synthesized
aattgttggcttctggaatgat

SEQ ID NO: 1317740 - DNA, 22 bp, Artificial Sequence
  chemically synthesized
ggttcaattgttggcttctgga

SEQ ID NO: 1317741 - DNA, 22 bp, Artificial Sequence
  chemically synthesized
cagaagccaacaattgaaccca

SEQ ID NO: 1317742 - DNA, 22 bp, Artificial Sequence
  chemically synthesized
acagtggtggcctgggttcaat

SEQ ID NO: 1317743 - DNA, 22 bp, Artificial Sequence
  chemically synthesized
gacagtggtggcctgggttcaa

SEQ ID NO: 1317744 - DNA, 22 bp, Artificial Sequence
  chemically synthesized
tgacagtggtggcctgggttca

SEQ ID NO: 1317745 - DNA, 22 bp, Artificial Sequence
  chemically synthesized
ttgacagtggtggcctgggttc

SEQ ID NO: 1317746 - DNA, 22 bp, Artificial Sequence
  chemically synthesized
tcttttgacagtggtggcctgg

SEQ ID NO: 1317747 - DNA, 22 bp, Artificial Sequence
  chemically synthesized
gtcttttgacagtggtggcctg

SEQ ID NO: 1317748 - DNA, 22 bp, Artificial Sequence
  chemically synthesized
tgtcttttgacagtggtggcct

SEQ ID NO: 1317749 - DNA, 22 bp, Artificial Sequence
  chemically synthesized
aggctttgtcttttgacagtgg

SEQ ID NO: 1317750 - DNA, 22 bp, Artificial Sequence
  chemically synthesized
aacccaggccaccactgtcaaa

SEQ ID NO: 1317751 - DNA, 22 bp, Artificial Sequence
  chemically synthesized
agtagctaaggctttgtctttt

SEQ ID NO: 1317752 - DNA, 22 bp, Artificial Sequence
  chemically synthesized
tcaaaagacaaagccttagcta

SEQ ID NO: 1317753 - DNA, 22 bp, Artificial Sequence
  chemically synthesized
tatatagctcagtagctaaggc

SEQ ID NO: 1317754 - DNA, 22 bp, Artificial Sequence
  chemically synthesized
aacgctgtatatagctcagtag

SEQ ID NO: 1317755 - DNA, 22 bp, Artificial Sequence
  chemically synthesized
tcaacgctgtatatagctcagt

SEQ ID NO: 1317756 - DNA, 22 bp, Artificial Sequence
  chemically synthesized
ctcaacgctgtatatagctcag

SEQ ID NO: 1317757 - DNA, 22 bp, Artificial Sequence
  chemically synthesized
agctactgagctatatacagcg

SEQ ID NO: 1317758 - DNA, 22 bp, Artificial Sequence
  chemically synthesized
gctactgagctatatacagcgt

SEQ ID NO: 1317759 - DNA, 22 bp, Artificial Sequence
  chemically synthesized
ctgagctatatacagcgttgag

SEQ ID NO: 1317760 - DNA, 22 bp, Artificial Sequence
  chemically synthesized
agctatatacagcgttgagaaa

SEQ ID NO: 1317761 - DNA, 22 bp, Artificial Sequence
  chemically synthesized
ggaaaagcagtagaaatttctc

SEQ ID NO: 1317762 - DNA, 22 bp, Artificial Sequence
  chemically synthesized
tatacagcgttgagaaatttct

SEQ ID NO: 1317763 - DNA, 22 bp, Artificial Sequence
  chemically synthesized
tgggaaaagcagtagaaatttc

SEQ ID NO: 1317764 - DNA, 22 bp, Artificial Sequence
  chemically synthesized
ctgggaaaagcagtagaaattt

SEQ ID NO: 1317765 - DNA, 22 bp, Artificial Sequence
  chemically synthesized
cttctgggaaaagcagtagaaa

SEQ ID NO: 1317766 - DNA, 22 bp, Artificial Sequence
  chemically synthesized
ggctccttctgggaaaagcagt

SEQ ID NO: 1317767 - DNA, 22 bp, Artificial Sequence
  chemically synthesized
agaaatttctactgcttttccc

SEQ ID NO: 1317768 - DNA, 22 bp, Artificial Sequence
  chemically synthesized
taggctccttctgggaaaagca

SEQ ID NO: 1317769 - DNA, 22 bp, Artificial Sequence
  chemically synthesized
tctaggctccttctgggaaaag

SEQ ID NO: 1317770 - DNA, 22 bp, Artificial Sequence
  chemically synthesized
ctctaggctccttctgggaaaa

SEQ ID NO: 1317771 - DNA, 22 bp, Artificial Sequence
  chemically synthesized
gcttctctaggctccttctggg

SEQ ID NO: 1317772 - DNA, 22 bp, Artificial Sequence
  chemically synthesized
ctactgcttttcccagaaggag

SEQ ID NO: 1317773 - DNA, 22 bp, Artificial Sequence
  chemically synthesized
tactgcttttcccagaaggagc

SEQ ID NO: 1317774 - DNA, 22 bp, Artificial Sequence
  chemically synthesized
ctgcttttcccagaaggagcct

SEQ ID NO: 1317775 - DNA, 22 bp, Artificial Sequence
  chemically synthesized
aaactggcttctctaggctcct

SEQ ID NO: 1317776 - DNA, 22 bp, Artificial Sequence
  chemically synthesized
cttttcccagaaggagcctaga

SEQ ID NO: 1317777 - DNA, 22 bp, Artificial Sequence
  chemically synthesized
ttcccagaaggagcctagagaa

SEQ ID NO: 1317778 - DNA, 22 bp, Artificial Sequence
  chemically synthesized
tcccagaaggagcctagagaag

SEQ ID NO: 1317779 - DNA, 22 bp, Artificial Sequence
  chemically synthesized
cccagaaggagcctagagaagc

SEQ ID NO: 1317780 - DNA, 22 bp, Artificial Sequence
  chemically synthesized
ccagaaggagcctagagaagcc

SEQ ID NO: 1317781 - DNA, 22 bp, Artificial Sequence
  chemically synthesized
caagcctgaaactggcttctct

SEQ ID NO: 1317782 - DNA, 22 bp, Artificial Sequence
  chemically synthesized
gcaagcctgaaactggcttctc

SEQ ID NO: 1317783 - DNA, 22 bp, Artificial Sequence
  chemically synthesized
aaagccttgcaagcctgaaact

SEQ ID NO: 1317784 - DNA, 22 bp, Artificial Sequence
  chemically synthesized
gagaagccagtttcaggcttgc

SEQ ID NO: 1317785 - DNA, 22 bp, Artificial Sequence
  chemically synthesized
agcagttaaaagccttgcaagc

SEQ ID NO: 1317786 - DNA, 22 bp, Artificial Sequence
  chemically synthesized
gagcagttaaaagccttgcaag

SEQ ID NO: 1317787 - DNA, 22 bp, Artificial Sequence
  chemically synthesized
ttgagcagttaaaagccttgca

SEQ ID NO: 1317788 - DNA, 22 bp, Artificial Sequence
  chemically synthesized
cttgagcagttaaaagccttgc

SEQ ID NO: 1317789 - DNA, 22 bp, Artificial Sequence
  chemically synthesized
tcttgagcagttaaaagccttg

SEQ ID NO: 1317790 - DNA, 22 bp, Artificial Sequence
  chemically synthesized
ttcttgagcagttaaaagcctt

SEQ ID NO: 1317791 - DNA, 22 bp, Artificial Sequence
  chemically synthesized
caggcttgcaaggcttttaact

SEQ ID NO: 1317792 - DNA, 22 bp, Artificial Sequence
  chemically synthesized
aggcttgcaaggcttttaactg

SEQ ID NO: 1317793 - DNA, 22 bp, Artificial Sequence
  chemically synthesized
agatttttcttgagcagttaaa

SEQ ID NO: 1317794 - DNA, 22 bp, Artificial Sequence
  chemically synthesized
ctaagatttttcttgagcagtt

SEQ ID NO: 1317795 - DNA, 22 bp, Artificial Sequence
  chemically synthesized
gcaaggcttttaactgctcaag

SEQ ID NO: 1317796 - DNA, 22 bp, Artificial Sequence
  chemically synthesized
caaggcttttaactgctcaaga

SEQ ID NO: 1317797 - DNA, 22 bp, Artificial Sequence
  chemically synthesized
ctcctaagatttttcttgagca

SEQ ID NO: 1317798 - DNA, 22 bp, Artificial Sequence
  chemically synthesized
ttaactgctcaagaaaaatctt

SEQ ID NO: 1317799 - DNA, 22 bp, Artificial Sequence
  chemically synthesized
taactgctcaagaaaaatctta

SEQ ID NO: 1317800 - DNA, 22 bp, Artificial Sequence
  chemically synthesized
aactgctcaagaaaaatcttag

SEQ ID NO: 1317801 - DNA, 22 bp, Artificial Sequence
  chemically synthesized
actgctcaagaaaaatcttagg

SEQ ID NO: 1317802 - DNA, 22 bp, Artificial Sequence
  chemically synthesized
atgtcatagttactcctaagat

SEQ ID NO: 1317803 - DNA, 22 bp, Artificial Sequence
  chemically synthesized
ctcaagaaaaatcttaggagta

SEQ ID NO: 1317804 - DNA, 22 bp, Artificial Sequence
  chemically synthesized
aagaaaaatcttaggagtaact

SEQ ID NO: 1317805 - DNA, 22 bp, Artificial Sequence
  chemically synthesized
gggttcatgtcatagttactcc

SEQ ID NO: 1317806 - DNA, 22 bp, Artificial Sequence
  chemically synthesized
ggggttcatgtcatagttactc

SEQ ID NO: 1317807 - DNA, 22 bp, Artificial Sequence
  chemically synthesized
tggggttcatgtcatagttact

SEQ ID NO: 1317808 - DNA, 22 bp, Artificial Sequence
  chemically synthesized
aggagtaactatgacatgaacc

SEQ ID NO: 1317809 - DNA, 22 bp, Artificial Sequence
  chemically synthesized
ggagtaactatgacatgaaccc

SEQ ID NO: 1317810 - DNA, 22 bp, Artificial Sequence
  chemically synthesized
tgacatgaaccccaaaattcct

SEQ ID NO: 1317811 - DNA, 22 bp, Artificial Sequence
  chemically synthesized
ccatccagaggacaggaatttt

SEQ ID NO: 1317812 - DNA, 22 bp, Artificial Sequence
  chemically synthesized
taccatccagaggacaggaatt

SEQ ID NO: 1317813 - DNA, 22 bp, Artificial Sequence
  chemically synthesized
ctaccatccagaggacaggaat

SEQ ID NO: 1317814 - DNA, 22 bp, Artificial Sequence
  chemically synthesized
gtttctaccatccagaggacag

SEQ ID NO: 1317815 - DNA, 22 bp, Artificial Sequence
  chemically synthesized
ggtttctaccatccagaggaca

SEQ ID NO: 1317816 - DNA, 22 bp, Artificial Sequence
  chemically synthesized
tggtttctaccatccagaggac

SEQ ID NO: 1317817 - DNA, 22 bp, Artificial Sequence
  chemically synthesized
ttggtttctaccatccagagga

SEQ ID NO: 1317818 - DNA, 22 bp, Artificial Sequence
  chemically synthesized
ttttggtttctaccatccagag

SEQ ID NO: 1317819 - DNA, 22 bp, Artificial Sequence
  chemically synthesized
cttttggtttctaccatccaga

SEQ ID NO: 1317820 - DNA, 22 bp, Artificial Sequence
  chemically synthesized
tcttttggtttctaccatccag

SEQ ID NO: 1317821 - DNA, 22 bp, Artificial Sequence
  chemically synthesized
ctgtcctctggatggtagaaac

SEQ ID NO: 1317822 - DNA, 22 bp, Artificial Sequence
  chemically synthesized
tcctctggatggtagaaaccaa

SEQ ID NO: 1317823 - DNA, 22 bp, Artificial Sequence
  chemically synthesized
tggatggtagaaaccaaaagaa

SEQ ID NO: 1317824 - DNA, 22 bp, Artificial Sequence
  chemically synthesized
gatggtagaaaccaaaagaaag

SEQ ID NO: 1317825 - DNA, 22 bp, Artificial Sequence
  chemically synthesized
tgaccatgtggggatactttct

SEQ ID NO: 1317826 - DNA, 22 bp, Artificial Sequence
  chemically synthesized
gtgaccatgtggggatactttc

SEQ ID NO: 1317827 - DNA, 22 bp, Artificial Sequence
  chemically synthesized
accttgtgaccatgtggggata

SEQ ID NO: 1317828 - DNA, 22 bp, Artificial Sequence
  chemically synthesized
aaccttgtgaccatgtggggat

SEQ ID NO: 1317829 - DNA, 22 bp, Artificial Sequence
  chemically synthesized
agagcttaaccttgtgaccatg

SEQ ID NO: 1317830 - DNA, 22 bp, Artificial Sequence
  chemically synthesized
aagagcttaaccttgtgaccat

SEQ ID NO: 1317831 - DNA, 22 bp, Artificial Sequence
  chemically synthesized
tgtccttaagagcttaaccttg

SEQ ID NO: 1317832 - DNA, 22 bp, Artificial Sequence
  chemically synthesized
gtgtccttaagagcttaacctt

SEQ ID NO: 1317833 - DNA, 22 bp, Artificial Sequence
  chemically synthesized
tgtgtccttaagagcttaacct

SEQ ID NO: 1317834 - DNA, 22 bp, Artificial Sequence
  chemically synthesized
ttttgtgtccttaagagcttaa

SEQ ID NO: 1317835 - DNA, 22 bp, Artificial Sequence
  chemically synthesized
gttttgtgtccttaagagctta

SEQ ID NO: 1317836 - DNA, 22 bp, Artificial Sequence
  chemically synthesized
tcttgttttgtgtccttaagag

SEQ ID NO: 1317837 - DNA, 22 bp, Artificial Sequence
  chemically synthesized
tgtcttgttttgtgtccttaag

SEQ ID NO: 1317838 - DNA, 22 bp, Artificial Sequence
  chemically synthesized
tctgtcttgttttgtgtcctta

SEQ ID NO: 1317839 - DNA, 22 bp, Artificial Sequence
  chemically synthesized
ctctgtcttgttttgtgtcctt

SEQ ID NO: 1317840 - DNA, 22 bp, Artificial Sequence
  chemically synthesized
agctcttaaggacacaaaacaa

SEQ ID NO: 1317841 - DNA, 22 bp, Artificial Sequence
  chemically synthesized
tgaaatttctctgtcttgtttt

SEQ ID NO: 1317842 - DNA, 22 bp, Artificial Sequence
  chemically synthesized
ttaaggacacaaaacaagacag

SEQ ID NO: 1317843 - DNA, 22 bp, Artificial Sequence
  chemically synthesized
tatgaaatttctctgtcttgtt

SEQ ID NO: 1317844 - DNA, 22 bp, Artificial Sequence
  chemically synthesized
aaggacacaaaacaagacagag

SEQ ID NO: 1317845 - DNA, 22 bp, Artificial Sequence
  chemically synthesized
aggacacaaaacaagacagaga

SEQ ID NO: 1317846 - DNA, 22 bp, Artificial Sequence
  chemically synthesized
aaaccaatactctatgaaattt

SEQ ID NO: 1317847 - DNA, 22 bp, Artificial Sequence
  chemically synthesized
caggtccctgaaaccaatactc

SEQ ID NO: 1317848 - DNA, 22 bp, Artificial Sequence
  chemically synthesized
ctacaggtccctgaaaccaata

SEQ ID NO: 1317849 - DNA, 22 bp, Artificial Sequence
  chemically synthesized
gctacaggtccctgaaaccaat

SEQ ID NO: 1317850 - DNA, 22 bp, Artificial Sequence
  chemically synthesized
tgctacaggtccctgaaaccaa

SEQ ID NO: 1317851 - DNA, 22 bp, Artificial Sequence
  chemically synthesized
catagagtattggtttcaggga

SEQ ID NO: 1317852 - DNA, 22 bp, Artificial Sequence
  chemically synthesized
atagagtattggtttcagggac

SEQ ID NO: 1317853 - DNA, 22 bp, Artificial Sequence
  chemically synthesized
caaactttgctacaggtccctg

SEQ ID NO: 1317854 - DNA, 22 bp, Artificial Sequence
  chemically synthesized
gtttcagggacctgtagcaaag

SEQ ID NO: 1317855 - DNA, 22 bp, Artificial Sequence
  chemically synthesized
gtcagctacaaactttgctaca

SEQ ID NO: 1317856 - DNA, 22 bp, Artificial Sequence
  chemically synthesized
cagggacctgtagcaaagtttg

SEQ ID NO: 1317857 - DNA, 22 bp, Artificial Sequence
  chemically synthesized
agggacctgtagcaaagtttgt

SEQ ID NO: 1317858 - DNA, 22 bp, Artificial Sequence
  chemically synthesized
ggaggctggtcagctacaaact

SEQ ID NO: 1317859 - DNA, 22 bp, Artificial Sequence
  chemically synthesized
gggaggctggtcagctacaaac

SEQ ID NO: 1317860 - DNA, 22 bp, Artificial Sequence
  chemically synthesized
tagcaaagtttgtagctgacca

SEQ ID NO: 1317861 - DNA, 22 bp, Artificial Sequence
  chemically synthesized
aagtcagcttgggaggctggtc

SEQ ID NO: 1317862 - DNA, 22 bp, Artificial Sequence
  chemically synthesized
caagtcagcttgggaggctggt

SEQ ID NO: 1317863 - DNA, 22 bp, Artificial Sequence
  chemically synthesized
tcaagtcagcttgggaggctgg

SEQ ID NO: 1317864 - DNA, 22 bp, Artificial Sequence
  chemically synthesized
ttcaagtcagcttgggaggctg

SEQ ID NO: 1317865 - DNA, 22 bp, Artificial Sequence
  chemically synthesized
gtagctgaccagcctcccaagc

SEQ ID NO: 1317866 - DNA, 22 bp, Artificial Sequence
  chemically synthesized
cttttcaagtcagcttgggagg

SEQ ID NO: 1317867 - DNA, 22 bp, Artificial Sequence
  chemically synthesized
tagctgaccagcctcccaagct

SEQ ID NO: 1317868 - DNA, 22 bp, Artificial Sequence
  chemically synthesized
accagcctcccaagctgacttg

SEQ ID NO: 1317869 - DNA, 22 bp, Artificial Sequence
  chemically synthesized
ccaagctgacttgaaaagcaga

SEQ ID NO: 1317870 - DNA, 22 bp, Artificial Sequence
  chemically synthesized
ggacacccataagtctgctttt

SEQ ID NO: 1317871 - DNA, 22 bp, Artificial Sequence
  chemically synthesized
acttgaaaagcagacttatggg

SEQ ID NO: 1317872 - DNA, 22 bp, Artificial Sequence
  chemically synthesized
gaaaagcagacttatgggtgtc

SEQ ID NO: 1317873 - DNA, 22 bp, Artificial Sequence
  chemically synthesized
aaaagcagacttatgggtgtcc

SEQ ID NO: 1317874 - DNA, 22 bp, Artificial Sequence
  chemically synthesized
atgggtgtcctaacccacgttc

SEQ ID NO: 1317875 - DNA, 22 bp, Artificial Sequence
  chemically synthesized
tgggtgtcctaacccacgttct

SEQ ID NO: 1317876 - DNA, 22 bp, Artificial Sequence
  chemically synthesized
acccacgttctatcacgtgata

SEQ ID NO: 1317877 - DNA, 22 bp, Artificial Sequence
  chemically synthesized
tgtaatggagagagggatatca

SEQ ID NO: 1317878 - DNA, 22 bp, Artificial Sequence
  chemically synthesized
tatcacgtgatatccctctctc

SEQ ID NO: 1317879 - DNA, 22 bp, Artificial Sequence
  chemically synthesized
tgttatgtaatggagagaggga

SEQ ID NO: 1317880 - DNA, 22 bp, Artificial Sequence
  chemically synthesized
tcacgtgatatccctctctcca

SEQ ID NO: 1317881 - DNA, 22 bp, Artificial Sequence
  chemically synthesized
tgtgttatgtaatggagagagg

SEQ ID NO: 1317882 - DNA, 22 bp, Artificial Sequence
  chemically synthesized
ctgtgttatgtaatggagagag

SEQ ID NO: 1317883 - DNA, 22 bp, Artificial Sequence
  chemically synthesized
tctgtgttatgtaatggagaga

SEQ ID NO: 1317884 - DNA, 22 bp, Artificial Sequence
  chemically synthesized
tctttctgtgttatgtaatgga

SEQ ID NO: 1317885 - DNA, 22 bp, Artificial Sequence
  chemically synthesized
gtctttctgtgttatgtaatgg

SEQ ID NO: 1317886 - DNA, 22 bp, Artificial Sequence
  chemically synthesized
agaatttgtctttctgtgttat

SEQ ID NO: 1317887 - DNA, 22 bp, Artificial Sequence
  chemically synthesized
tctccattacataacacagaaa

SEQ ID NO: 1317888 - DNA, 22 bp, Artificial Sequence
  chemically synthesized
tccattacataacacagaaaga

SEQ ID NO: 1317889 - DNA, 22 bp, Artificial Sequence
  chemically synthesized
tgctaagaatttgtctttctgt

SEQ ID NO: 1317890 - DNA, 22 bp, Artificial Sequence
  chemically synthesized
cattacataacacagaaagaca

SEQ ID NO: 1317891 - DNA, 22 bp, Artificial Sequence
  chemically synthesized
gtgctaagaatttgtctttctg

SEQ ID NO: 1317892 - DNA, 22 bp, Artificial Sequence
  chemically synthesized
cataacacagaaagacaaattc

SEQ ID NO: 1317893 - DNA, 22 bp, Artificial Sequence
  chemically synthesized
atgtagtttgtgctaagaattt

SEQ ID NO: 1317894 - DNA, 22 bp, Artificial Sequence
  chemically synthesized
gcacatctgatgtagtttgtgc

SEQ ID NO: 1317895 - DNA, 22 bp, Artificial Sequence
  chemically synthesized
agcacatctgatgtagtttgtg

SEQ ID NO: 1317896 - DNA, 22 bp, Artificial Sequence
  chemically synthesized
atcttagcacatctgatgtagt

SEQ ID NO: 1317897 - DNA, 22 bp, Artificial Sequence
  chemically synthesized
ttagcacaaactacatcagatg

SEQ ID NO: 1317898 - DNA, 22 bp, Artificial Sequence
  chemically synthesized
agcacaaactacatcagatgtg

SEQ ID NO: 1317899 - DNA, 22 bp, Artificial Sequence
  chemically synthesized
gcacaaactacatcagatgtgc

SEQ ID NO: 1317900 - DNA, 22 bp, Artificial Sequence
  chemically synthesized
tgagactaatcttagcacatct

SEQ ID NO: 1317901 - DNA, 22 bp, Artificial Sequence
  chemically synthesized
gtgagactaatcttagcacatc

SEQ ID NO: 1317902 - DNA, 22 bp, Artificial Sequence
  chemically synthesized
catcagatgtgctaagattagt

SEQ ID NO: 1317903 - DNA, 22 bp, Artificial Sequence
  chemically synthesized
atagaaagaaggatttgtgaga

SEQ ID NO: 1317904 - DNA, 22 bp, Artificial Sequence
  chemically synthesized
gttaatagaaagaaggatttgt

SEQ ID NO: 1317905 - DNA, 22 bp, Artificial Sequence
  chemically synthesized
agattagtctcacaaatccttc

SEQ ID NO: 1317906 - DNA, 22 bp, Artificial Sequence
  chemically synthesized
ggttaatagaaagaaggatttg

SEQ ID NO: 1317907 - DNA, 22 bp, Artificial Sequence
  chemically synthesized
gtctcacaaatccttctttcta

SEQ ID NO: 1317908 - DNA, 22 bp, Artificial Sequence
  chemically synthesized
caagggtttggttaatagaaag

SEQ ID NO: 1317909 - DNA, 22 bp, Artificial Sequence
  chemically synthesized
acaaatccttctttctattaac

SEQ ID NO: 1317910 - DNA, 22 bp, Artificial Sequence
  chemically synthesized
tgcaagggtttggttaatagaa

SEQ ID NO: 1317911 - DNA, 22 bp, Artificial Sequence
  chemically synthesized
ctctgcaagggtttggttaata

SEQ ID NO: 1317912 - DNA, 22 bp, Artificial Sequence
  chemically synthesized
tctcctctgcaagggtttggtt

SEQ ID NO: 1317913 - DNA, 22 bp, Artificial Sequence
  chemically synthesized
gtctcctctgcaagggtttggt

SEQ ID NO: 1317914 - DNA, 22 bp, Artificial Sequence
  chemically synthesized
ctttctattaaccaaacccttg

SEQ ID NO: 1317915 - DNA, 22 bp, Artificial Sequence
  chemically synthesized
tttctattaaccaaacccttgc

SEQ ID NO: 1317916 - DNA, 22 bp, Artificial Sequence
  chemically synthesized
tttgtctcctctgcaagggttt

SEQ ID NO: 1317917 - DNA, 22 bp, Artificial Sequence
  chemically synthesized
tctattaaccaaacccttgcag

SEQ ID NO: 1317918 - DNA, 22 bp, Artificial Sequence
  chemically synthesized
ctattaaccaaacccttgcaga

SEQ ID NO: 1317919 - DNA, 22 bp, Artificial Sequence
  chemically synthesized
tattaaccaaacccttgcagag

SEQ ID NO: 1317920 - DNA, 22 bp, Artificial Sequence
  chemically synthesized
ttaaccaaacccttgcagagga

SEQ ID NO: 1317921 - DNA, 22 bp, Artificial Sequence
  chemically synthesized
accaaacccttgcagaggagac

SEQ ID NO: 1317922 - DNA, 22 bp, Artificial Sequence
  chemically synthesized
aatagtaaactatttgtctcct

SEQ ID NO: 1317923 - DNA, 22 bp, Artificial Sequence
  chemically synthesized
ttaaatagtaaactatttgtct

SEQ ID NO: 1317924 - DNA, 22 bp, Artificial Sequence
  chemically synthesized
gcagaggagacaaatagtttac

SEQ ID NO: 1317925 - DNA, 22 bp, Artificial Sequence
  chemically synthesized
cattgttaaatagtaaactatt

SEQ ID NO: 1317926 - DNA, 22 bp, Artificial Sequence
  chemically synthesized
cagaggagacaaatagtttact

SEQ ID NO: 1317927 - DNA, 22 bp, Artificial Sequence
  chemically synthesized
tgcattgttaaatagtaaacta

SEQ ID NO: 1317928 - DNA, 22 bp, Artificial Sequence
  chemically synthesized
tctgcattgttaaatagtaaac

SEQ ID NO: 1317929 - DNA, 22 bp, Artificial Sequence
  chemically synthesized
ctctgcattgttaaatagtaaa

SEQ ID NO: 1317930 - DNA, 22 bp, Artificial Sequence
  chemically synthesized
tctctgcattgttaaatagtaa

SEQ ID NO: 1317931 - DNA, 22 bp, Artificial Sequence
  chemically synthesized
tttctctgcattgttaaatagt

SEQ ID NO: 1317932 - DNA, 22 bp, Artificial Sequence
  chemically synthesized
tctttctctgcattgttaaata

SEQ ID NO: 1317933 - DNA, 22 bp, Artificial Sequence
  chemically synthesized
tctctttctctgcattgttaaa

SEQ ID NO: 1317934 - DNA, 22 bp, Artificial Sequence
  chemically synthesized
tctctctttctctgcattgtta

SEQ ID NO: 1317935 - DNA, 22 bp, Artificial Sequence
  chemically synthesized
tctctctctttctctgcattgt

SEQ ID NO: 1317936 - DNA, 22 bp, Artificial Sequence
  chemically synthesized
tctctctctctttctctgcatt

SEQ ID NO: 1317937 - DNA, 22 bp, Artificial Sequence
  chemically synthesized
actatttaacaatgcagagaaa

SEQ ID NO: 1317938 - DNA, 22 bp, Artificial Sequence
  chemically synthesized
tctctctctctctttctctgca

SEQ ID NO: 1317939 - DNA, 22 bp, Artificial Sequence
  chemically synthesized
ctatttaacaatgcagagaaag

SEQ ID NO: 1317940 - DNA, 22 bp, Artificial Sequence
  chemically synthesized
tctctctctctctctttctctg

SEQ ID NO: 1317941 - DNA, 22 bp, Artificial Sequence
  chemically synthesized
tttaacaatgcagagaaagaga

SEQ ID NO: 1317942 - DNA, 22 bp, Artificial Sequence
  chemically synthesized
tctctctctctctctctttctc

SEQ ID NO: 1317943 - DNA, 22 bp, Artificial Sequence
  chemically synthesized
aacaatgcagagaaagagagag

SEQ ID NO: 1317944 - DNA, 22 bp, Artificial Sequence
  chemically synthesized
acaatgcagagaaagagagaga

SEQ ID NO: 1317945 - DNA, 22 bp, Artificial Sequence
  chemically synthesized
gtctctctctctctctctctct

SEQ ID NO: 1317946 - DNA, 22 bp, Artificial Sequence
  chemically synthesized
tggtctctctctctctctctct

SEQ ID NO: 1317947 - DNA, 22 bp, Artificial Sequence
  chemically synthesized
ctggtctctctctctctctctc

SEQ ID NO: 1317948 - DNA, 22 bp, Artificial Sequence
  chemically synthesized
tcagtcaagtttctggtctctc

SEQ ID NO: 1317949 - DNA, 22 bp, Artificial Sequence
  chemically synthesized
atcagtcaagtttctggtctct

SEQ ID NO: 1317950 - DNA, 22 bp, Artificial Sequence
  chemically synthesized
ttatcagtcaagtttctggtct

SEQ ID NO: 1317951 - DNA, 22 bp, Artificial Sequence
  chemically synthesized
gactgataagaatttcttaccc

SEQ ID NO: 1317952 - DNA, 22 bp, Artificial Sequence
  chemically synthesized
actgataagaatttcttaccct

SEQ ID NO: 1317953 - DNA, 22 bp, Artificial Sequence
  chemically synthesized
gcatcccagcaataagggtaag

SEQ ID NO: 1317954 - DNA, 22 bp, Artificial Sequence
  chemically synthesized
ataagaatttcttacccttatt

SEQ ID NO: 1317955 - DNA, 22 bp, Artificial Sequence
  chemically synthesized
cttacccttattgctgggatgc

SEQ ID NO: 1317956 - DNA, 22 bp, Artificial Sequence
  chemically synthesized
ttacccttattgctgggatgcc

SEQ ID NO: 1317957 - DNA, 22 bp, Artificial Sequence
  chemically synthesized
acccttattgctgggatgccag

SEQ ID NO: 1317958 - DNA, 22 bp, Artificial Sequence
  chemically synthesized
cccttattgctgggatgccagg

SEQ ID NO: 1317959 - DNA, 22 bp, Artificial Sequence
  chemically synthesized
attgctgggatgccaggtttct

SEQ ID NO: 1317960 - DNA, 22 bp, Artificial Sequence
  chemically synthesized
ttgctgggatgccaggtttctg

SEQ ID NO: 1317961 - DNA, 22 bp, Artificial Sequence
  chemically synthesized
ctgggatgccaggtttctgggt

SEQ ID NO: 1317962 - DNA, 22 bp, Artificial Sequence
  chemically synthesized
cagagaaagggaacccagaaac

SEQ ID NO: 1317963 - DNA, 22 bp, Artificial Sequence
  chemically synthesized
ggatgccaggtttctgggttcc

SEQ ID NO: 1317964 - DNA, 22 bp, Artificial Sequence
  chemically synthesized
gaagctgcagagaaagggaacc

SEQ ID NO: 1317965 - DNA, 22 bp, Artificial Sequence
  chemically synthesized
tggaagctgcagagaaagggaa

SEQ ID NO: 1317966 - DNA, 22 bp, Artificial Sequence
  chemically synthesized
ctggaagctgcagagaaaggga

SEQ ID NO: 1317967 - DNA, 22 bp, Artificial Sequence
  chemically synthesized
ttctggaagctgcagagaaagg

SEQ ID NO: 1317968 - DNA, 22 bp, Artificial Sequence
  chemically synthesized
ctgggttccctttctctgcagc

SEQ ID NO: 1317969 - DNA, 22 bp, Artificial Sequence
  chemically synthesized
tgggttccctttctctgcagct

SEQ ID NO: 1317970 - DNA, 22 bp, Artificial Sequence
  chemically synthesized
cgttcttctggaagctgcagag

SEQ ID NO: 1317971 - DNA, 22 bp, Artificial Sequence
  chemically synthesized
ggttccctttctctgcagcttc

SEQ ID NO: 1317972 - DNA, 22 bp, Artificial Sequence
  chemically synthesized
cctttctctgcagcttccagaa

SEQ ID NO: 1317973 - DNA, 22 bp, Artificial Sequence
  chemically synthesized
tctctgcagcttccagaagaac

SEQ ID NO: 1317974 - DNA, 22 bp, Artificial Sequence
  chemically synthesized
ctctgcagcttccagaagaacg

SEQ ID NO: 1317975 - DNA, 22 bp, Artificial Sequence
  chemically synthesized
tctgcagcttccagaagaacgg

SEQ ID NO: 1317976 - DNA, 22 bp, Artificial Sequence
  chemically synthesized
tgcagcttccagaagaacggag

SEQ ID NO: 1317977 - DNA, 22 bp, Artificial Sequence
  chemically synthesized
cagcttccagaagaacggagtg

SEQ ID NO: 1317978 - DNA, 22 bp, Artificial Sequence
  chemically synthesized
ccagaagaacggagtggcgtct

SEQ ID NO: 1317979 - DNA, 22 bp, Artificial Sequence
  chemically synthesized
cagaagaacggagtggcgtctt

SEQ ID NO: 1317980 - DNA, 22 bp, Artificial Sequence
  chemically synthesized
tagcacaagcaagcagggtcgt

SEQ ID NO: 1317981 - DNA, 22 bp, Artificial Sequence
  chemically synthesized
acgaccctgcttgcttgtgcta

SEQ ID NO: 1317982 - DNA, 22 bp, Artificial Sequence
  chemically synthesized
cgaccctgcttgcttgtgctat

SEQ ID NO: 1317983 - DNA, 22 bp, Artificial Sequence
  chemically synthesized
aaccccacagctatagcacaag

SEQ ID NO: 1317984 - DNA, 22 bp, Artificial Sequence
  chemically synthesized
aaaccccacagctatagcacaa

SEQ ID NO: 1317985 - DNA, 22 bp, Artificial Sequence
  chemically synthesized
cttgcttgtgctatagctgtgg

SEQ ID NO: 1317986 - DNA, 22 bp, Artificial Sequence
  chemically synthesized
gcttgtgctatagctgtggggt

SEQ ID NO: 1317987 - DNA, 22 bp, Artificial Sequence
  chemically synthesized
cttgtgctatagctgtggggtt

SEQ ID NO: 1317988 - DNA, 22 bp, Artificial Sequence
  chemically synthesized
taaagtggcttaaaccccacag

SEQ ID NO: 1317989 - DNA, 22 bp, Artificial Sequence
  chemically synthesized
gtaaagtggcttaaaccccaca

SEQ ID NO: 1317990 - DNA, 22 bp, Artificial Sequence
  chemically synthesized
gtgctatagctgtggggtttaa

SEQ ID NO: 1317991 - DNA, 22 bp, Artificial Sequence
  chemically synthesized
tgctatagctgtggggtttaag

SEQ ID NO: 1317992 - DNA, 22 bp, Artificial Sequence
  chemically synthesized
tcttgtaaagtggcttaaaccc

SEQ ID NO: 1317993 - DNA, 22 bp, Artificial Sequence
  chemically synthesized
atcttgtaaagtggcttaaacc

SEQ ID NO: 1317994 - DNA, 22 bp, Artificial Sequence
  chemically synthesized
tatcttgtaaagtggcttaaac

SEQ ID NO: 1317995 - DNA, 22 bp, Artificial Sequence
  chemically synthesized
tagctgtggggtttaagccact

SEQ ID NO: 1317996 - DNA, 22 bp, Artificial Sequence
  chemically synthesized
tggggtttaagccactttacaa

SEQ ID NO: 1317997 - DNA, 22 bp, Artificial Sequence
  chemically synthesized
aagccactttacaagataaaat

SEQ ID NO: 1317998 - DNA, 22 bp, Artificial Sequence
  chemically synthesized
agccactttacaagataaaatc

SEQ ID NO: 1317999 - DNA, 22 bp, Artificial Sequence
  chemically synthesized
cataaaatggtaaagggtgatt

SEQ ID NO: 1318000 - DNA, 22 bp, Artificial Sequence
  chemically synthesized
tacaagataaaatcacccttta

SEQ ID NO: 1318001 - DNA, 22 bp, Artificial Sequence
  chemically synthesized
acaagataaaatcaccctttac

SEQ ID NO: 1318002 - DNA, 22 bp, Artificial Sequence
  chemically synthesized
caagataaaatcaccctttacc

SEQ ID NO: 1318003 - DNA, 22 bp, Artificial Sequence
  chemically synthesized
tggttccataaaatggtaaagg

SEQ ID NO: 1318004 - DNA, 22 bp, Artificial Sequence
  chemically synthesized
atggttccataaaatggtaaag

SEQ ID NO: 1318005 - DNA, 22 bp, Artificial Sequence
  chemically synthesized
tttatggttccataaaatggta

SEQ ID NO: 1318006 - DNA, 22 bp, Artificial Sequence
  chemically synthesized
gtttatggttccataaaatggt

SEQ ID NO: 1318007 - DNA, 22 bp, Artificial Sequence
  chemically synthesized
agaatcttgtttatggttccat

SEQ ID NO: 1318008 - DNA, 22 bp, Artificial Sequence
  chemically synthesized
taccattttatggaaccataaa

SEQ ID NO: 1318009 - DNA, 22 bp, Artificial Sequence
  chemically synthesized
accattttatggaaccataaac

SEQ ID NO: 1318010 - DNA, 22 bp, Artificial Sequence
  chemically synthesized
ccattttatggaaccataaaca

SEQ ID NO: 1318011 - DNA, 22 bp, Artificial Sequence
  chemically synthesized
caaattaagaatcttgtttatg

SEQ ID NO: 1318012 - DNA, 22 bp, Artificial Sequence
  chemically synthesized
gcaaattaagaatcttgtttat

SEQ ID NO: 1318013 - DNA, 22 bp, Artificial Sequence
  chemically synthesized
tatggaaccataaacaagattc

SEQ ID NO: 1318014 - DNA, 22 bp, Artificial Sequence
  chemically synthesized
atggaaccataaacaagattct

SEQ ID NO: 1318015 - DNA, 22 bp, Artificial Sequence
  chemically synthesized
tggaaccataaacaagattctt

SEQ ID NO: 1318016 - DNA, 22 bp, Artificial Sequence
  chemically synthesized
ggcagaatcttgcaaattaaga

SEQ ID NO: 1318017 - DNA, 22 bp, Artificial Sequence
  chemically synthesized
ttaatttgcaagattctgccca

SEQ ID NO: 1318018 - DNA, 22 bp, Artificial Sequence
  chemically synthesized
aatttgcaagattctgcccaac

SEQ ID NO: 1318019 - DNA, 22 bp, Artificial Sequence
  chemically synthesized
cccatgcagcccgttgggcaga

SEQ ID NO: 1318020 - DNA, 22 bp, Artificial Sequence
  chemically synthesized
atttgcaagattctgcccaacg

SEQ ID NO: 1318021 - DNA, 22 bp, Artificial Sequence
  chemically synthesized
gcaagattctgcccaacgggct

SEQ ID NO: 1318022 - DNA, 22 bp, Artificial Sequence
  chemically synthesized
agttccccatgcagcccgttgg

SEQ ID NO: 1318023 - DNA, 22 bp, Artificial Sequence
  chemically synthesized
caagattctgcccaacgggctg

SEQ ID NO: 1318024 - DNA, 22 bp, Artificial Sequence
  chemically synthesized
attcagttccccatgcagcccg

SEQ ID NO: 1318025 - DNA, 22 bp, Artificial Sequence
  chemically synthesized
tgcccaacgggctgcatgggga

SEQ ID NO: 1318026 - DNA, 22 bp, Artificial Sequence
  chemically synthesized
cccaacgggctgcatggggaac

SEQ ID NO: 1318027 - DNA, 22 bp, Artificial Sequence
  chemically synthesized
gaaaatgttaattcagttcccc

SEQ ID NO: 1318028 - DNA, 22 bp, Artificial Sequence
  chemically synthesized
ggttggaaaatgttaattcagt

SEQ ID NO: 1318029 - DNA, 22 bp, Artificial Sequence
  chemically synthesized
ctgggttggaaaatgttaattc

SEQ ID NO: 1318030 - DNA, 22 bp, Artificial Sequence
  chemically synthesized
catggggaactgaattaacatt

SEQ ID NO: 1318031 - DNA, 22 bp, Artificial Sequence
  chemically synthesized
gctgggttggaaaatgttaatt

SEQ ID NO: 1318032 - DNA, 22 bp, Artificial Sequence
  chemically synthesized
tgctgggttggaaaatgttaat

SEQ ID NO: 1318033 - DNA, 22 bp, Artificial Sequence
  chemically synthesized
tgtgtattttgctgggttggaa

SEQ ID NO: 1318034 - DNA, 22 bp, Artificial Sequence
  chemically synthesized
aattaacattttccaacccagc

SEQ ID NO: 1318035 - DNA, 22 bp, Artificial Sequence
  chemically synthesized
ttatgtgtattttgctgggttg

SEQ ID NO: 1318036 - DNA, 22 bp, Artificial Sequence
  chemically synthesized
gttatgtgtattttgctgggtt

SEQ ID NO: 1318037 - DNA, 22 bp, Artificial Sequence
  chemically synthesized
tgttatgtgtattttgctgggt

SEQ ID NO: 1318038 - DNA, 22 bp, Artificial Sequence
  chemically synthesized
acattttccaacccagcaaaat

SEQ ID NO: 1318039 - DNA, 22 bp, Artificial Sequence
  chemically synthesized
ttttgttatgtgtattttgctg

SEQ ID NO: 1318040 - DNA, 22 bp, Artificial Sequence
  chemically synthesized
tccaacccagcaaaatacacat

SEQ ID NO: 1318041 - DNA, 22 bp, Artificial Sequence
  chemically synthesized
ccaacccagcaaaatacacata

SEQ ID NO: 1318042 - DNA, 22 bp, Artificial Sequence
  chemically synthesized
caacccagcaaaatacacataa

SEQ ID NO: 1318043 - DNA, 22 bp, Artificial Sequence
  chemically synthesized
atgtctgttttgttatgtgtat

SEQ ID NO: 1318044 - DNA, 22 bp, Artificial Sequence
  chemically synthesized
ggtgcggaaagaggtgactaat

SEQ ID NO: 1318045 - DNA, 22 bp, Artificial Sequence
  chemically synthesized
atattgggtgcggaaagaggtg

SEQ ID NO: 1318046 - DNA, 22 bp, Artificial Sequence
  chemically synthesized
ccaggctgatattgggtgcgga

SEQ ID NO: 1318047 - DNA, 22 bp, Artificial Sequence
  chemically synthesized
gccaggctgatattgggtgcgg

SEQ ID NO: 1318048 - DNA, 22 bp, Artificial Sequence
  chemically synthesized
gtcacctctttccgcacccaat

SEQ ID NO: 1318049 - DNA, 22 bp, Artificial Sequence
  chemically synthesized
tgccaggctgatattgggtgcg

SEQ ID NO: 1318050 - DNA, 22 bp, Artificial Sequence
  chemically synthesized
agctttgccaggctgatattgg

SEQ ID NO: 1318051 - DNA, 22 bp, Artificial Sequence
  chemically synthesized
gagctttgccaggctgatattg

SEQ ID NO: 1318052 - DNA, 22 bp, Artificial Sequence
  chemically synthesized
tgagctttgccaggctgatatt

SEQ ID NO: 1318053 - DNA, 22 bp, Artificial Sequence
  chemically synthesized
tttccgcacccaatatcagcct

SEQ ID NO: 1318054 - DNA, 22 bp, Artificial Sequence
  chemically synthesized
tccgcacccaatatcagcctgg

SEQ ID NO: 1318055 - DNA, 22 bp, Artificial Sequence
  chemically synthesized
ccgcacccaatatcagcctggc

SEQ ID NO: 1318056 - DNA, 22 bp, Artificial Sequence
  chemically synthesized
cgcacccaatatcagcctggca

SEQ ID NO: 1318057 - DNA, 22 bp, Artificial Sequence
  chemically synthesized
gcaaagctcaaaatttttcatc

SEQ ID NO: 1318058 - DNA, 22 bp, Artificial Sequence
  chemically synthesized
aaaatttttcatcttggtccct

SEQ ID NO: 1318059 - DNA, 22 bp, Artificial Sequence
  chemically synthesized
gtgtggatcaaagacaacaggg

SEQ ID NO: 1318060 - DNA, 22 bp, Artificial Sequence
  chemically synthesized
ttcatcttggtccctgttgtct

SEQ ID NO: 1318061 - DNA, 22 bp, Artificial Sequence
  chemically synthesized
tcatcttggtccctgttgtctt

SEQ ID NO: 1318062 - DNA, 22 bp, Artificial Sequence
  chemically synthesized
catcttggtccctgttgtcttt

SEQ ID NO: 1318063 - DNA, 22 bp, Artificial Sequence
  chemically synthesized
atcttggtccctgttgtctttg

SEQ ID NO: 1318064 - DNA, 22 bp, Artificial Sequence
  chemically synthesized
ggtccctgttgtctttgatcca

SEQ ID NO: 1318065 - DNA, 22 bp, Artificial Sequence
  chemically synthesized
gtccctgttgtctttgatccac

SEQ ID NO: 1318066 - DNA, 22 bp, Artificial Sequence
  chemically synthesized
ttgtctttgatccacaccaggt

SEQ ID NO: 1318067 - DNA, 22 bp, Artificial Sequence
  chemically synthesized
tctttgatccacaccaggtggg

SEQ ID NO: 1318068 - DNA, 22 bp, Artificial Sequence
  chemically synthesized
agaggtcatccgtccccacctg

SEQ ID NO: 1318069 - DNA, 22 bp, Artificial Sequence
  chemically synthesized
tgatccacaccaggtggggacg

SEQ ID NO: 1318070 - DNA, 22 bp, Artificial Sequence
  chemically synthesized
gatccacaccaggtggggacgg

SEQ ID NO: 1318071 - DNA, 22 bp, Artificial Sequence
  chemically synthesized
atccacaccaggtggggacgga

SEQ ID NO: 1318072 - DNA, 22 bp, Artificial Sequence
  chemically synthesized
ccgttcagaggtcatccgtccc

SEQ ID NO: 1318073 - DNA, 22 bp, Artificial Sequence
  chemically synthesized
tgaattaccgttcagaggtcat

SEQ ID NO: 1318074 - DNA, 22 bp, Artificial Sequence
  chemically synthesized
attgtgaattaccgttcagagg

SEQ ID NO: 1318075 - DNA, 22 bp, Artificial Sequence
  chemically synthesized
cccagagacctcattgtgaatt

SEQ ID NO: 1318076 - DNA, 22 bp, Artificial Sequence
  chemically synthesized
gcccagagacctcattgtgaat

SEQ ID NO: 1318077 - DNA, 22 bp, Artificial Sequence
  chemically synthesized
tgaacggtaattcacaatgagg

SEQ ID NO: 1318078 - DNA, 22 bp, Artificial Sequence
  chemically synthesized
ccttgcccagagacctcattgt

SEQ ID NO: 1318079 - DNA, 22 bp, Artificial Sequence
  chemically synthesized
aacggtaattcacaatgaggtc

SEQ ID NO: 1318080 - DNA, 22 bp, Artificial Sequence
  chemically synthesized
cccttgcccagagacctcattg

SEQ ID NO: 1318081 - DNA, 22 bp, Artificial Sequence
  chemically synthesized
tcccttgcccagagacctcatt

SEQ ID NO: 1318082 - DNA, 22 bp, Artificial Sequence
  chemically synthesized
tttcccttgcccagagacctca

SEQ ID NO: 1318083 - DNA, 22 bp, Artificial Sequence
  chemically synthesized
ctctttcccttgcccagagacc

SEQ ID NO: 1318084 - DNA, 22 bp, Artificial Sequence
  chemically synthesized
tctgctctttcccttgcccaga

SEQ ID NO: 1318085 - DNA, 22 bp, Artificial Sequence
  chemically synthesized
acaatgaggtctctgggcaagg

SEQ ID NO: 1318086 - DNA, 22 bp, Artificial Sequence
  chemically synthesized
agggtgactatctgctctttcc

SEQ ID NO: 1318087 - DNA, 22 bp, Artificial Sequence
  chemically synthesized
tcagggtgactatctgctcttt

SEQ ID NO: 1318088 - DNA, 22 bp, Artificial Sequence
  chemically synthesized
tgggcaagggaaagagcagata

SEQ ID NO: 1318089 - DNA, 22 bp, Artificial Sequence
  chemically synthesized
ggcaagggaaagagcagatagt

SEQ ID NO: 1318090 - DNA, 22 bp, Artificial Sequence
  chemically synthesized
tctctcagggtgactatctgct

SEQ ID NO: 1318091 - DNA, 22 bp, Artificial Sequence
  chemically synthesized
aacagtcctgtctctcagggtg

SEQ ID NO: 1318092 - DNA, 22 bp, Artificial Sequence
  chemically synthesized
aagaaggctcaacagtcctgtc

SEQ ID NO: 1318093 - DNA, 22 bp, Artificial Sequence
  chemically synthesized
taaagaaggctcaacagtcctg

SEQ ID NO: 1318094 - DNA, 22 bp, Artificial Sequence
  chemically synthesized
agagacaggactgttgagcctt

SEQ ID NO: 1318095 - DNA, 22 bp, Artificial Sequence
  chemically synthesized
agtgagctctaaagaaggctca

SEQ ID NO: 1318096 - DNA, 22 bp, Artificial Sequence
  chemically synthesized
gtcacattcagtgagctctaaa

SEQ ID NO: 1318097 - DNA, 22 bp, Artificial Sequence
  chemically synthesized
ttgagccttctttagagctcac

SEQ ID NO: 1318098 - DNA, 22 bp, Artificial Sequence
  chemically synthesized
tctggtcacattcagtgagctc

SEQ ID NO: 1318099 - DNA, 22 bp, Artificial Sequence
  chemically synthesized
agccttctttagagctcactga

SEQ ID NO: 1318100 - DNA, 22 bp, Artificial Sequence
  chemically synthesized
gtctggtcacattcagtgagct

SEQ ID NO: 1318101 - DNA, 22 bp, Artificial Sequence
  chemically synthesized
tttgtctggtcacattcagtga

SEQ ID NO: 1318102 - DNA, 22 bp, Artificial Sequence
  chemically synthesized
atttgtctggtcacattcagtg

SEQ ID NO: 1318103 - DNA, 22 bp, Artificial Sequence
  chemically synthesized
ctttagagctcactgaatgtga

SEQ ID NO: 1318104 - DNA, 22 bp, Artificial Sequence
  chemically synthesized
tttagagctcactgaatgtgac

SEQ ID NO: 1318105 - DNA, 22 bp, Artificial Sequence
  chemically synthesized
cttatttgtctggtcacattca

SEQ ID NO: 1318106 - DNA, 22 bp, Artificial Sequence
  chemically synthesized
tagagctcactgaatgtgacca

SEQ ID NO: 1318107 - DNA, 22 bp, Artificial Sequence
  chemically synthesized
agagctcactgaatgtgaccag

SEQ ID NO: 1318108 - DNA, 22 bp, Artificial Sequence
  chemically synthesized
gagctcactgaatgtgaccaga

SEQ ID NO: 1318109 - DNA, 22 bp, Artificial Sequence
  chemically synthesized
actgaatgtgaccagacaaata

SEQ ID NO: 1318110 - DNA, 22 bp, Artificial Sequence
  chemically synthesized
agagaaccctccttatttgtct

SEQ ID NO: 1318111 - DNA, 22 bp, Artificial Sequence
  chemically synthesized
aatgtgaccagacaaataagga

SEQ ID NO: 1318112 - DNA, 22 bp, Artificial Sequence
  chemically synthesized
actcagagaaccctccttattt

SEQ ID NO: 1318113 - DNA, 22 bp, Artificial Sequence
  chemically synthesized
atagaagtccagcatgcctaac

SEQ ID NO: 1318114 - DNA, 22 bp, Artificial Sequence
  chemically synthesized
ctgatagaagtccagcatgcct

SEQ ID NO: 1318115 - DNA, 22 bp, Artificial Sequence
  chemically synthesized
tctgagttaggcatgctggact

SEQ ID NO: 1318116 - DNA, 22 bp, Artificial Sequence
  chemically synthesized
tgagttaggcatgctggacttc

SEQ ID NO: 1318117 - DNA, 22 bp, Artificial Sequence
  chemically synthesized
agttaggcatgctggacttcta

SEQ ID NO: 1318118 - DNA, 22 bp, Artificial Sequence
  chemically synthesized
agaaggggttgctgatagaagt

SEQ ID NO: 1318119 - DNA, 22 bp, Artificial Sequence
  chemically synthesized
ggcatgctggacttctatcagc

SEQ ID NO: 1318120 - DNA, 22 bp, Artificial Sequence
  chemically synthesized
gacttctatcagcaaccccttc

SEQ ID NO: 1318121 - DNA, 22 bp, Artificial Sequence
  chemically synthesized
ctatcagcaaccccttctgaga

SEQ ID NO: 1318122 - DNA, 22 bp, Artificial Sequence
  chemically synthesized
tatcagcaaccccttctgagat

SEQ ID NO: 1318123 - DNA, 22 bp, Artificial Sequence
  chemically synthesized
tcagcaaccccttctgagatcc

SEQ ID NO: 1318124 - DNA, 22 bp, Artificial Sequence
  chemically synthesized
aatatgtgaaagggatctcaga

SEQ ID NO: 1318125 - DNA, 22 bp, Artificial Sequence
  chemically synthesized
aaatatgtgaaagggatctcag

SEQ ID NO: 1318126 - DNA, 22 bp, Artificial Sequence
  chemically synthesized
catgtgtttaaatatgtgaaag

SEQ ID NO: 1318127 - DNA, 22 bp, Artificial Sequence
  chemically synthesized
gcatgtgtttaaatatgtgaaa

SEQ ID NO: 1318128 - DNA, 22 bp, Artificial Sequence
  chemically synthesized
tgcatgtgtttaaatatgtgaa

SEQ ID NO: 1318129 - DNA, 22 bp, Artificial Sequence
  chemically synthesized
ctgagatccctttcacatattt

SEQ ID NO: 1318130 - DNA, 22 bp, Artificial Sequence
  chemically synthesized
tgagatccctttcacatattta

SEQ ID NO: 1318131 - DNA, 22 bp, Artificial Sequence
  chemically synthesized
agatccctttcacatatttaaa

SEQ ID NO: 1318132 - DNA, 22 bp, Artificial Sequence
  chemically synthesized
tctttgcatgtgtttaaatatg

SEQ ID NO: 1318133 - DNA, 22 bp, Artificial Sequence
  chemically synthesized
gtctttgcatgtgtttaaatat

SEQ ID NO: 1318134 - DNA, 22 bp, Artificial Sequence
  chemically synthesized
ttgtctttgcatgtgtttaaat

SEQ ID NO: 1318135 - DNA, 22 bp, Artificial Sequence
  chemically synthesized
tcacatatttaaacacatgcaa

SEQ ID NO: 1318136 - DNA, 22 bp, Artificial Sequence
  chemically synthesized
tccctcttgtctttgcatgtgt

SEQ ID NO: 1318137 - DNA, 22 bp, Artificial Sequence
  chemically synthesized
cacatatttaaacacatgcaaa

SEQ ID NO: 1318138 - DNA, 22 bp, Artificial Sequence
  chemically synthesized
acatatttaaacacatgcaaag

SEQ ID NO: 1318139 - DNA, 22 bp, Artificial Sequence
  chemically synthesized
tgtccctcttgtctttgcatgt

SEQ ID NO: 1318140 - DNA, 22 bp, Artificial Sequence
  chemically synthesized
ctgtccctcttgtctttgcatg

SEQ ID NO: 1318141 - DNA, 22 bp, Artificial Sequence
  chemically synthesized
aaacacatgcaaagacaagagg

SEQ ID NO: 1318142 - DNA, 22 bp, Artificial Sequence
  chemically synthesized
aacacatgcaaagacaagaggg

SEQ ID NO: 1318143 - DNA, 22 bp, Artificial Sequence
  chemically synthesized
gaaggccttctgtccctcttgt

SEQ ID NO: 1318144 - DNA, 22 bp, Artificial Sequence
  chemically synthesized
ggaaggccttctgtccctcttg

SEQ ID NO: 1318145 - DNA, 22 bp, Artificial Sequence
  chemically synthesized
atttggaaggccttctgtccct

SEQ ID NO: 1318146 - DNA, 22 bp, Artificial Sequence
  chemically synthesized
gggatctgatttggaaggcctt

SEQ ID NO: 1318147 - DNA, 22 bp, Artificial Sequence
  chemically synthesized
gttagggatctgatttggaagg

SEQ ID NO: 1318148 - DNA, 22 bp, Artificial Sequence
  chemically synthesized
ggttagggatctgatttggaag

SEQ ID NO: 1318149 - DNA, 22 bp, Artificial Sequence
  chemically synthesized
ttggttagggatctgatttgga

SEQ ID NO: 1318150 - DNA, 22 bp, Artificial Sequence
  chemically synthesized
cttggttagggatctgatttgg

SEQ ID NO: 1318151 - DNA, 22 bp, Artificial Sequence
  chemically synthesized
gacttcttggttagggatctga

SEQ ID NO: 1318152 - DNA, 22 bp, Artificial Sequence
  chemically synthesized
ggacttcttggttagggatctg

SEQ ID NO: 1318153 - DNA, 22 bp, Artificial Sequence
  chemically synthesized
ttggacttcttggttagggatc

SEQ ID NO: 1318154 - DNA, 22 bp, Artificial Sequence
  chemically synthesized
ccaaatcagatccctaaccaag

SEQ ID NO: 1318155 - DNA, 22 bp, Artificial Sequence
  chemically synthesized
caaatcagatccctaaccaaga

SEQ ID NO: 1318156 - DNA, 22 bp, Artificial Sequence
  chemically synthesized
gaagggatactcttggacttct

SEQ ID NO: 1318157 - DNA, 22 bp, Artificial Sequence
  chemically synthesized
ggaagggatactcttggacttc

SEQ ID NO: 1318158 - DNA, 22 bp, Artificial Sequence
  chemically synthesized
accaagaagtccaagagtatcc

SEQ ID NO: 1318159 - DNA, 22 bp, Artificial Sequence
  chemically synthesized
atacagaaaataggaggatagt

SEQ ID NO: 1318160 - DNA, 22 bp, Artificial Sequence
  chemically synthesized
tcatacagaaaataggaggata

SEQ ID NO: 1318161 - DNA, 22 bp, Artificial Sequence
  chemically synthesized
ctcatacagaaaataggaggat

SEQ ID NO: 1318162 - DNA, 22 bp, Artificial Sequence
  chemically synthesized
ccaaactatcctcctattttct

SEQ ID NO: 1318163 - DNA, 22 bp, Artificial Sequence
  chemically synthesized
caaactatcctcctattttctg

SEQ ID NO: 1318164 - DNA, 22 bp, Artificial Sequence
  chemically synthesized
aggaggtttctcatacagaaaa

SEQ ID NO: 1318165 - DNA, 22 bp, Artificial Sequence
  chemically synthesized
gaggaggtttctcatacagaaa

SEQ ID NO: 1318166 - DNA, 22 bp, Artificial Sequence
  chemically synthesized
tgaggaggtttctcatacagaa

SEQ ID NO: 1318167 - DNA, 22 bp, Artificial Sequence
  chemically synthesized
tcctcctattttctgtatgaga

SEQ ID NO: 1318168 - DNA, 22 bp, Artificial Sequence
  chemically synthesized
ctattttctgtatgagaaacct

SEQ ID NO: 1318169 - DNA, 22 bp, Artificial Sequence
  chemically synthesized
ttttctgtatgagaaacctcct

SEQ ID NO: 1318170 - DNA, 22 bp, Artificial Sequence
  chemically synthesized
tctgtatgagaaacctcctcaa

SEQ ID NO: 1318171 - DNA, 22 bp, Artificial Sequence
  chemically synthesized
ctgtatgagaaacctcctcaaa

SEQ ID NO: 1318172 - DNA, 22 bp, Artificial Sequence
  chemically synthesized
aatcaggaagattttgaggagg

SEQ ID NO: 1318173 - DNA, 22 bp, Artificial Sequence
  chemically synthesized
tgtatgagaaacctcctcaaaa

SEQ ID NO: 1318174 - DNA, 22 bp, Artificial Sequence
  chemically synthesized
caatcaggaagattttgaggag

SEQ ID NO: 1318175 - DNA, 22 bp, Artificial Sequence
  chemically synthesized
tatgagaaacctcctcaaaatc

SEQ ID NO: 1318176 - DNA, 22 bp, Artificial Sequence
  chemically synthesized
ttcaatcaggaagattttgagg

SEQ ID NO: 1318177 - DNA, 22 bp, Artificial Sequence
  chemically synthesized
tcttcaatcaggaagattttga

SEQ ID NO: 1318178 - DNA, 22 bp, Artificial Sequence
  chemically synthesized
ctcttcaatcaggaagattttg

SEQ ID NO: 1318179 - DNA, 22 bp, Artificial Sequence
  chemically synthesized
ggagacttctcttcaatcagga

SEQ ID NO: 1318180 - DNA, 22 bp, Artificial Sequence
  chemically synthesized
gggagacttctcttcaatcagg

SEQ ID NO: 1318181 - DNA, 22 bp, Artificial Sequence
  chemically synthesized
ctcaaaatcttcctgattgaag

SEQ ID NO: 1318182 - DNA, 22 bp, Artificial Sequence
  chemically synthesized
aaaatcttcctgattgaagaga

SEQ ID NO: 1318183 - DNA, 22 bp, Artificial Sequence
  chemically synthesized
gtttgggagacttctcttcaat

SEQ ID NO: 1318184 - DNA, 22 bp, Artificial Sequence
  chemically synthesized
ctggtttgggagacttctcttc

SEQ ID NO: 1318185 - DNA, 22 bp, Artificial Sequence
  chemically synthesized
cctgattgaagagaagtctccc

SEQ ID NO: 1318186 - DNA, 22 bp, Artificial Sequence
  chemically synthesized
ctgattgaagagaagtctccca

SEQ ID NO: 1318187 - DNA, 22 bp, Artificial Sequence
  chemically synthesized
attgaagagaagtctcccaaac

SEQ ID NO: 1318188 - DNA, 22 bp, Artificial Sequence
  chemically synthesized
gtaggaagactactggtttggg

SEQ ID NO: 1318189 - DNA, 22 bp, Artificial Sequence
  chemically synthesized
aagagaagtctcccaaaccagt

SEQ ID NO: 1318190 - DNA, 22 bp, Artificial Sequence
  chemically synthesized
actagtaggaagactactggtt

SEQ ID NO: 1318191 - DNA, 22 bp, Artificial Sequence
  chemically synthesized
taactagtaggaagactactgg

SEQ ID NO: 1318192 - DNA, 22 bp, Artificial Sequence
  chemically synthesized
ctaactagtaggaagactactg

SEQ ID NO: 1318193 - DNA, 22 bp, Artificial Sequence
  chemically synthesized
tctaactagtaggaagactact

SEQ ID NO: 1318194 - DNA, 22 bp, Artificial Sequence
  chemically synthesized
tttctaactagtaggaagacta

SEQ ID NO: 1318195 - DNA, 22 bp, Artificial Sequence
  chemically synthesized
ccaaaccagtagtcttcctact

SEQ ID NO: 1318196 - DNA, 22 bp, Artificial Sequence
  chemically synthesized
gctctttctaactagtaggaag

SEQ ID NO: 1318197 - DNA, 22 bp, Artificial Sequence
  chemically synthesized
agttcgctctttctaactagta

SEQ ID NO: 1318198 - DNA, 22 bp, Artificial Sequence
  chemically synthesized
ggaggtctcagttcgctctttc

SEQ ID NO: 1318199 - DNA, 22 bp, Artificial Sequence
  chemically synthesized
cctactagttagaaagagcgaa

SEQ ID NO: 1318200 - DNA, 22 bp, Artificial Sequence
  chemically synthesized
ctactagttagaaagagcgaac

SEQ ID NO: 1318201 - DNA, 22 bp, Artificial Sequence
  chemically synthesized
ctgggaggtctcagttcgctct

SEQ ID NO: 1318202 - DNA, 22 bp, Artificial Sequence
  chemically synthesized
ctagttagaaagagcgaactga

SEQ ID NO: 1318203 - DNA, 22 bp, Artificial Sequence
  chemically synthesized
gttagaaagagcgaactgagac

SEQ ID NO: 1318204 - DNA, 22 bp, Artificial Sequence
  chemically synthesized
agctcctgggaggtctcagttc

SEQ ID NO: 1318205 - DNA, 22 bp, Artificial Sequence
  chemically synthesized
ttcagctcctgggaggtctcag

SEQ ID NO: 1318206 - DNA, 22 bp, Artificial Sequence
  chemically synthesized
gaaagagcgaactgagacctcc

SEQ ID NO: 1318207 - DNA, 22 bp, Artificial Sequence
  chemically synthesized
tggggtgtctgttcagctcctg

SEQ ID NO: 1318208 - DNA, 22 bp, Artificial Sequence
  chemically synthesized
agacctcccaggagctgaacag

SEQ ID NO: 1318209 - DNA, 22 bp, Artificial Sequence
  chemically synthesized
cattgtggggtgtctgttcagc

SEQ ID NO: 1318210 - DNA, 22 bp, Artificial Sequence
  chemically synthesized
ctccattgtggggtgtctgttc

SEQ ID NO: 1318211 - DNA, 22 bp, Artificial Sequence
  chemically synthesized
ccaggagctgaacagacacccc

SEQ ID NO: 1318212 - DNA, 22 bp, Artificial Sequence
  chemically synthesized
ttactccattgtggggtgtctg

SEQ ID NO: 1318213 - DNA, 22 bp, Artificial Sequence
  chemically synthesized
tctgttactccattgtggggtg

SEQ ID NO: 1318214 - DNA, 22 bp, Artificial Sequence
  chemically synthesized
tgtctgttactccattgtgggg

SEQ ID NO: 1318215 - DNA, 22 bp, Artificial Sequence
  chemically synthesized
aacagacaccccacaatggagt

SEQ ID NO: 1318216 - DNA, 22 bp, Artificial Sequence
  chemically synthesized
tagatccagcatggggtgtctc

SEQ ID NO: 1318217 - DNA, 22 bp, Artificial Sequence
  chemically synthesized
tggggtgtctgtagatccagca

SEQ ID NO: 1318218 - DNA, 22 bp, Artificial Sequence
  chemically synthesized
tagccccattgtggggtgtctg

SEQ ID NO: 1318219 - DNA, 22 bp, Artificial Sequence
  chemically synthesized
gatctacagacaccccacaatg

SEQ ID NO: 1318220 - DNA, 22 bp, Artificial Sequence
  chemically synthesized
cagacaccccacaatggggcta

SEQ ID NO: 1318221 - DNA, 22 bp, Artificial Sequence
  chemically synthesized
tggtggggtgtctgtagcccca

SEQ ID NO: 1318222 - DNA, 22 bp, Artificial Sequence
  chemically synthesized
tagccctatggtggggtgtctg

SEQ ID NO: 1318223 - DNA, 22 bp, Artificial Sequence
  chemically synthesized
tgtagccctatggtggggtgtc

SEQ ID NO: 1318224 - DNA, 22 bp, Artificial Sequence
  chemically synthesized
gttctgtagccctatggtgggg

SEQ ID NO: 1318225 - DNA, 22 bp, Artificial Sequence
  chemically synthesized
actggttctgtagccctatggt

SEQ ID NO: 1318226 - DNA, 22 bp, Artificial Sequence
  chemically synthesized
cagacaccccaccatagggcta

SEQ ID NO: 1318227 - DNA, 22 bp, Artificial Sequence
  chemically synthesized
ctgactggttctgtagccctat

SEQ ID NO: 1318228 - DNA, 22 bp, Artificial Sequence
  chemically synthesized
tcctgactggttctgtagccct

SEQ ID NO: 1318229 - DNA, 22 bp, Artificial Sequence
  chemically synthesized
attctcctgactggttctgtag

SEQ ID NO: 1318230 - DNA, 22 bp, Artificial Sequence
  chemically synthesized
cattctcctgactggttctgta

SEQ ID NO: 1318231 - DNA, 22 bp, Artificial Sequence
  chemically synthesized
cttcattctcctgactggttct

SEQ ID NO: 1318232 - DNA, 22 bp, Artificial Sequence
  chemically synthesized
ccaatgcctgcttcattctcct

SEQ ID NO: 1318233 - DNA, 22 bp, Artificial Sequence
  chemically synthesized
cagaaccagtcaggagaatgaa

SEQ ID NO: 1318234 - DNA, 22 bp, Artificial Sequence
  chemically synthesized
ggtgctgccaatgcctgcttca

SEQ ID NO: 1318235 - DNA, 22 bp, Artificial Sequence
  chemically synthesized
gtgagtatcctaggtgctgcca

SEQ ID NO: 1318236 - DNA, 22 bp, Artificial Sequence
  chemically synthesized
gattggtgagtatcctaggtgc

SEQ ID NO: 1318237 - DNA, 22 bp, Artificial Sequence
  chemically synthesized
gcagcacctaggatactcacca

SEQ ID NO: 1318238 - DNA, 22 bp, Artificial Sequence
  chemically synthesized
gggtgtctggattggtgagtat

SEQ ID NO: 1318239 - DNA, 22 bp, Artificial Sequence
  chemically synthesized
ggggtgtctggattggtgagta

SEQ ID NO: 1318240 - DNA, 22 bp, Artificial Sequence
  chemically synthesized
tggggtgtctggattggtgagt

SEQ ID NO: 1318241 - DNA, 22 bp, Artificial Sequence
  chemically synthesized
cgttttggggtgtctggattgg

SEQ ID NO: 1318242 - DNA, 22 bp, Artificial Sequence
  chemically synthesized
ggatactcaccaatccagacac

SEQ ID NO: 1318243 - DNA, 22 bp, Artificial Sequence
  chemically synthesized
tagctccgttttggggtgtctg

SEQ ID NO: 1318244 - DNA, 22 bp, Artificial Sequence
  chemically synthesized
tctgtagctccgttttggggtg

SEQ ID NO: 1318245 - DNA, 22 bp, Artificial Sequence
  chemically synthesized
accaatccagacaccccaaaac

SEQ ID NO: 1318246 - DNA, 22 bp, Artificial Sequence
  chemically synthesized
atggtggggtgtctatctgtag

SEQ ID NO: 1318247 - DNA, 22 bp, Artificial Sequence
  chemically synthesized
tagcctcatggtggggtgtcta

SEQ ID NO: 1318248 - DNA, 22 bp, Artificial Sequence
  chemically synthesized
cagatagacaccccaccatgag

SEQ ID NO: 1318249 - DNA, 22 bp, Artificial Sequence
  chemically synthesized
cagggtatctgtagcctcatgg

SEQ ID NO: 1318250 - DNA, 22 bp, Artificial Sequence
  chemically synthesized
ttacagggtatctgtagcctca

SEQ ID NO: 1318251 - DNA, 22 bp, Artificial Sequence
  chemically synthesized
tagccctattacagggtatctg

SEQ ID NO: 1318252 - DNA, 22 bp, Artificial Sequence
  chemically synthesized
actgtagccctattacagggta

SEQ ID NO: 1318253 - DNA, 22 bp, Artificial Sequence
  chemically synthesized
aactgtagccctattacagggt

SEQ ID NO: 1318254 - DNA, 22 bp, Artificial Sequence
  chemically synthesized
cagataccctgtaatagggcta

SEQ ID NO: 1318255 - DNA, 22 bp, Artificial Sequence
  chemically synthesized
taatagggctacagttaaggga

SEQ ID NO: 1318256 - DNA, 22 bp, Artificial Sequence
  chemically synthesized
cagttaagggacatctccccat

SEQ ID NO: 1318257 - DNA, 22 bp, Artificial Sequence
  chemically synthesized
caatggaaaaatagtcatgggg

SEQ ID NO: 1318258 - DNA, 22 bp, Artificial Sequence
  chemically synthesized
agggacatctccccatgactat

SEQ ID NO: 1318259 - DNA, 22 bp, Artificial Sequence
  chemically synthesized
attgcaatggaaaaatagtcat

SEQ ID NO: 1318260 - DNA, 22 bp, Artificial Sequence
  chemically synthesized
aattgcaatggaaaaatagtca

SEQ ID NO: 1318261 - DNA, 22 bp, Artificial Sequence
  chemically synthesized
cccatgactatttttccattgc

SEQ ID NO: 1318262 - DNA, 22 bp, Artificial Sequence
  chemically synthesized
tttttccattgcaattaagtcc

SEQ ID NO: 1318263 - DNA, 22 bp, Artificial Sequence
  chemically synthesized
ttccattgcaattaagtccacg

SEQ ID NO: 1318264 - DNA, 22 bp, Artificial Sequence
  chemically synthesized
caacccaatgtgcgtggactta

SEQ ID NO: 1318265 - DNA, 22 bp, Artificial Sequence
  chemically synthesized
tccattgcaattaagtccacgc

SEQ ID NO: 1318266 - DNA, 22 bp, Artificial Sequence
  chemically synthesized
ccattgcaattaagtccacgca

SEQ ID NO: 1318267 - DNA, 22 bp, Artificial Sequence
  chemically synthesized
cattgcaattaagtccacgcac

SEQ ID NO: 1318268 - DNA, 22 bp, Artificial Sequence
  chemically synthesized
caattaagtccacgcacattgg

SEQ ID NO: 1318269 - DNA, 22 bp, Artificial Sequence
  chemically synthesized
gtggggtattccaacccaatgt

SEQ ID NO: 1318270 - DNA, 22 bp, Artificial Sequence
  chemically synthesized
agtccacgcacattgggttgga

SEQ ID NO: 1318271 - DNA, 22 bp, Artificial Sequence
  chemically synthesized
ctggtggggtattccaacccaa

SEQ ID NO: 1318272 - DNA, 22 bp, Artificial Sequence
  chemically synthesized
tctactggtggggtattccaac

SEQ ID NO: 1318273 - DNA, 22 bp, Artificial Sequence
  chemically synthesized
tgtctactggtggggtattcca

SEQ ID NO: 1318274 - DNA, 22 bp, Artificial Sequence
  chemically synthesized
ctctgtctactggtggggtatt

SEQ ID NO: 1318275 - DNA, 22 bp, Artificial Sequence
  chemically synthesized
ttactctgtctactggtggggt

SEQ ID NO: 1318276 - DNA, 22 bp, Artificial Sequence
  chemically synthesized
tgttactctgtctactggtggg

SEQ ID NO: 1318277 - DNA, 22 bp, Artificial Sequence
  chemically synthesized
ggttggaataccccaccagtag

SEQ ID NO: 1318278 - DNA, 22 bp, Artificial Sequence
  chemically synthesized
actctgttactctgtctactgg

SEQ ID NO: 1318279 - DNA, 22 bp, Artificial Sequence
  chemically synthesized
gaataccccaccagtagacaga

SEQ ID NO: 1318280 - DNA, 22 bp, Artificial Sequence
  chemically synthesized
ggggctgactctgttactctgt

SEQ ID NO: 1318281 - DNA, 22 bp, Artificial Sequence
  chemically synthesized
gactgggggctgactctgttac

SEQ ID NO: 1318282 - DNA, 22 bp, Artificial Sequence
  chemically synthesized
ggactgggggctgactctgtta

SEQ ID NO: 1318283 - DNA, 22 bp, Artificial Sequence
  chemically synthesized
ttggactgggggctgactctgt

SEQ ID NO: 1318284 - DNA, 22 bp, Artificial Sequence
  chemically synthesized
tcttggactgggggctgactct

SEQ ID NO: 1318285 - DNA, 22 bp, Artificial Sequence
  chemically synthesized
attctcttggactgggggctga

SEQ ID NO: 1318286 - DNA, 22 bp, Artificial Sequence
  chemically synthesized
cctaattctcttggactggggg

SEQ ID NO: 1318287 - DNA, 22 bp, Artificial Sequence
  chemically synthesized
ggcagccacttgggctgccttc

SEQ ID NO: 1318288 - DNA, 22 bp, Artificial Sequence
  chemically synthesized
agtgatggatccagaaggcagc

SEQ ID NO: 1318289 - DNA, 22 bp, Artificial Sequence
  chemically synthesized
cagtgatggatccagaaggcag

SEQ ID NO: 1318290 - DNA, 22 bp, Artificial Sequence
  chemically synthesized
tcagtgatggatccagaaggca

SEQ ID NO: 1318291 - DNA, 22 bp, Artificial Sequence
  chemically synthesized
gggctgccttctggatccatca

SEQ ID NO: 1318292 - DNA, 22 bp, Artificial Sequence
  chemically synthesized
ggctgccttctggatccatcac

SEQ ID NO: 1318293 - DNA, 22 bp, Artificial Sequence
  chemically synthesized
gtggccccctttcagtgatgga

SEQ ID NO: 1318294 - DNA, 22 bp, Artificial Sequence
  chemically synthesized
ggtggccccctttcagtgatgg

SEQ ID NO: 1318295 - DNA, 22 bp, Artificial Sequence
  chemically synthesized
ccttctggatccatcactgaaa

SEQ ID NO: 1318296 - DNA, 22 bp, Artificial Sequence
  chemically synthesized
tttggtggccccctttcagtga

SEQ ID NO: 1318297 - DNA, 22 bp, Artificial Sequence
  chemically synthesized
ctggatccatcactgaaagggg

SEQ ID NO: 1318298 - DNA, 22 bp, Artificial Sequence
  chemically synthesized
ttgtttggtggccccctttcag

SEQ ID NO: 1318299 - DNA, 22 bp, Artificial Sequence
  chemically synthesized
tggatccatcactgaaaggggg

SEQ ID NO: 1318300 - DNA, 22 bp, Artificial Sequence
  chemically synthesized
gatccatcactgaaagggggcc

SEQ ID NO: 1318301 - DNA, 22 bp, Artificial Sequence
  chemically synthesized
cctgttgtttggtggccccctt

SEQ ID NO: 1318302 - DNA, 22 bp, Artificial Sequence
  chemically synthesized
cctgcctgttgtttggtggccc

SEQ ID NO: 1318303 - DNA, 22 bp, Artificial Sequence
  chemically synthesized
tggctacctgcctgttgtttgg

SEQ ID NO: 1318304 - DNA, 22 bp, Artificial Sequence
  chemically synthesized
aaagggggccaccaaacaacag

SEQ ID NO: 1318305 - DNA, 22 bp, Artificial Sequence
  chemically synthesized
cccctgtggctacctgcctgtt

SEQ ID NO: 1318306 - DNA, 22 bp, Artificial Sequence
  chemically synthesized
acccaggattgcccctgtggct

SEQ ID NO: 1318307 - DNA, 22 bp, Artificial Sequence
  chemically synthesized
ggggctcacccaggattgcccc

SEQ ID NO: 1318308 - DNA, 22 bp, Artificial Sequence
  chemically synthesized
gggggctcacccaggattgccc

SEQ ID NO: 1318309 - DNA, 22 bp, Artificial Sequence
  chemically synthesized
caaatttgggggctcacccagg

SEQ ID NO: 1318310 - DNA, 22 bp, Artificial Sequence
  chemically synthesized
ggtggttacaaatttgggggct

SEQ ID NO: 1318311 - DNA, 22 bp, Artificial Sequence
  chemically synthesized
gggtggttacaaatttgggggc

SEQ ID NO: 1318312 - DNA, 22 bp, Artificial Sequence
  chemically synthesized
ggtgagcccccaaatttgtaac

SEQ ID NO: 1318313 - DNA, 22 bp, Artificial Sequence
  chemically synthesized
gtaaccacccaaggggttcacc

SEQ ID NO: 1318314 - DNA, 22 bp, Artificial Sequence
  chemically synthesized
ggcagtgggcaaggtgaacccc

SEQ ID NO: 1318315 - DNA, 22 bp, Artificial Sequence
  chemically synthesized
taaccacccaaggggttcacct

SEQ ID NO: 1318316 - DNA, 22 bp, Artificial Sequence
  chemically synthesized
tctaggcagtgggcaaggtgaa

SEQ ID NO: 1318317 - DNA, 22 bp, Artificial Sequence
  chemically synthesized
tgtctaggcagtgggcaaggtg

SEQ ID NO: 1318318 - DNA, 22 bp, Artificial Sequence
  chemically synthesized
agtcagctctgtctaggcagtg

SEQ ID NO: 1318319 - DNA, 22 bp, Artificial Sequence
  chemically synthesized
ctgagtcagctctgtctaggca

SEQ ID NO: 1318320 - DNA, 22 bp, Artificial Sequence
  chemically synthesized
accttgcccactgcctagacag

SEQ ID NO: 1318321 - DNA, 22 bp, Artificial Sequence
  chemically synthesized
gctgagtcagctctgtctaggc

SEQ ID NO: 1318322 - DNA, 22 bp, Artificial Sequence
  chemically synthesized
tcttgctgagtcagctctgtct

SEQ ID NO: 1318323 - DNA, 22 bp, Artificial Sequence
  chemically synthesized
gcccactgcctagacagagctg

SEQ ID NO: 1318324 - DNA, 22 bp, Artificial Sequence
  chemically synthesized
cccactgcctagacagagctga

SEQ ID NO: 1318325 - DNA, 22 bp, Artificial Sequence
  chemically synthesized
ccctgtcttgctgagtcagctc

SEQ ID NO: 1318326 - DNA, 22 bp, Artificial Sequence
  chemically synthesized
cctagacagagctgactcagca

SEQ ID NO: 1318327 - DNA, 22 bp, Artificial Sequence
  chemically synthesized
caattcccctgtcttgctgagt

SEQ ID NO: 1318328 - DNA, 22 bp, Artificial Sequence
  chemically synthesized
gacagagctgactcagcaagac

SEQ ID NO: 1318329 - DNA, 22 bp, Artificial Sequence
  chemically synthesized
attgcaattcccctgtcttgct

SEQ ID NO: 1318330 - DNA, 22 bp, Artificial Sequence
  chemically synthesized
cattgcaattcccctgtcttgc

SEQ ID NO: 1318331 - DNA, 22 bp, Artificial Sequence
  chemically synthesized
ttcattgcaattcccctgtctt

SEQ ID NO: 1318332 - DNA, 22 bp, Artificial Sequence
  chemically synthesized
cttcattgcaattcccctgtct

SEQ ID NO: 1318333 - DNA, 22 bp, Artificial Sequence
  chemically synthesized
tcttcattgcaattcccctgtc

SEQ ID NO: 1318334 - DNA, 22 bp, Artificial Sequence
  chemically synthesized
tttcttcattgcaattcccctg

SEQ ID NO: 1318335 - DNA, 22 bp, Artificial Sequence
  chemically synthesized
actcagcaagacaggggaattg

SEQ ID NO: 1318336 - DNA, 22 bp, Artificial Sequence
  chemically synthesized
ctctttcttcattgcaattccc

SEQ ID NO: 1318337 - DNA, 22 bp, Artificial Sequence
  chemically synthesized
agcaagacaggggaattgcaat

SEQ ID NO: 1318338 - DNA, 22 bp, Artificial Sequence
  chemically synthesized
catgaattactctttcttcatt

SEQ ID NO: 1318339 - DNA, 22 bp, Artificial Sequence
  chemically synthesized
tgcatgaattactctttcttca

SEQ ID NO: 1318340 - DNA, 22 bp, Artificial Sequence
  chemically synthesized
caatgaagaaagagtaattcat

SEQ ID NO: 1318341 - DNA, 22 bp, Artificial Sequence
  chemically synthesized
cagtgtcccacacagccagctc

SEQ ID NO: 1318342 - DNA, 22 bp, Artificial Sequence
  chemically synthesized
atgcagagctggctgtgtggga

SEQ ID NO: 1318343 - DNA, 22 bp, Artificial Sequence
  chemically synthesized
agtaataacaaaactccagtgt

SEQ ID NO: 1318344 - DNA, 22 bp, Artificial Sequence
  chemically synthesized
gagtaataacaaaactccagtg

SEQ ID NO: 1318345 - DNA, 22 bp, Artificial Sequence
  chemically synthesized
gctgtgtgggacactggagttt

SEQ ID NO: 1318346 - DNA, 22 bp, Artificial Sequence
  chemically synthesized
atttgagtaataacaaaactcc

SEQ ID NO: 1318347 - DNA, 22 bp, Artificial Sequence
  chemically synthesized
tgtgggacactggagttttgtt

SEQ ID NO: 1318348 - DNA, 22 bp, Artificial Sequence
  chemically synthesized
ctgatttgagtaataacaaaac

SEQ ID NO: 1318349 - DNA, 22 bp, Artificial Sequence
  chemically synthesized
gctgatttgagtaataacaaaa

SEQ ID NO: 1318350 - DNA, 22 bp, Artificial Sequence
  chemically synthesized
gagttttgttattactcaaatc

SEQ ID NO: 1318351 - DNA, 22 bp, Artificial Sequence
  chemically synthesized
gggagaccgatttgctgatttg

SEQ ID NO: 1318352 - DNA, 22 bp, Artificial Sequence
  chemically synthesized
tgttattactcaaatcagcaaa

SEQ ID NO: 1318353 - DNA, 22 bp, Artificial Sequence
  chemically synthesized
gttattactcaaatcagcaaat

SEQ ID NO: 1318354 - DNA, 22 bp, Artificial Sequence
  chemically synthesized
ttattactcaaatcagcaaatc

SEQ ID NO: 1318355 - DNA, 22 bp, Artificial Sequence
  chemically synthesized
ttactcaaatcagcaaatcggt

SEQ ID NO: 1318356 - DNA, 22 bp, Artificial Sequence
  chemically synthesized
ctcaaatcagcaaatcggtctc

SEQ ID NO: 1318357 - DNA, 22 bp, Artificial Sequence
  chemically synthesized
cccgaatgcctggggagaccga

SEQ ID NO: 1318358 - DNA, 22 bp, Artificial Sequence
  chemically synthesized
aaatcagcaaatcggtctcccc

SEQ ID NO: 1318359 - DNA, 22 bp, Artificial Sequence
  chemically synthesized
ttccccgaatgcctggggagac

SEQ ID NO: 1318360 - DNA, 22 bp, Artificial Sequence
  chemically synthesized
tgttccccgaatgcctggggag

SEQ ID NO: 1318361 - DNA, 22 bp, Artificial Sequence
  chemically synthesized
aaaactctgttccccgaatgcc

SEQ ID NO: 1318362 - DNA, 22 bp, Artificial Sequence
  chemically synthesized
aaaaactctgttccccgaatgc

SEQ ID NO: 1318363 - DNA, 22 bp, Artificial Sequence
  chemically synthesized
tccttaaaaactctgttccccg

SEQ ID NO: 1318364 - DNA, 22 bp, Artificial Sequence
  chemically synthesized
cccaggcattcggggaacagag

SEQ ID NO: 1318365 - DNA, 22 bp, Artificial Sequence
  chemically synthesized
ggggaacagagtttttaaggat

SEQ ID NO: 1318366 - DNA, 22 bp, Artificial Sequence
  chemically synthesized
ccccgacccaccaagttatcct

SEQ ID NO: 1318367 - DNA, 22 bp, Artificial Sequence
  chemically synthesized
cccccgacccaccaagttatcc

SEQ ID NO: 1318368 - DNA, 22 bp, Artificial Sequence
  chemically synthesized
gcttcccccgacccaccaagtt

SEQ ID NO: 1318369 - DNA, 22 bp, Artificial Sequence
  chemically synthesized
ttaaggataacttggtgggtcg

SEQ ID NO: 1318370 - DNA, 22 bp, Artificial Sequence
  chemically synthesized
actggcttcccccgacccacca

SEQ ID NO: 1318371 - DNA, 22 bp, Artificial Sequence
  chemically synthesized
taaggataacttggtgggtcgg

SEQ ID NO: 1318372 - DNA, 22 bp, Artificial Sequence
  chemically synthesized
aaggataacttggtgggtcggg

SEQ ID NO: 1318373 - DNA, 22 bp, Artificial Sequence
  chemically synthesized
aggataacttggtgggtcgggg

SEQ ID NO: 1318374 - DNA, 22 bp, Artificial Sequence
  chemically synthesized
gctcactggcttcccccgaccc

SEQ ID NO: 1318375 - DNA, 22 bp, Artificial Sequence
  chemically synthesized
ctggctcactggcttcccccga

SEQ ID NO: 1318376 - DNA, 22 bp, Artificial Sequence
  chemically synthesized
ggtgggtcgggggaagccagtg

SEQ ID NO: 1318377 - DNA, 22 bp, Artificial Sequence
  chemically synthesized
gtgggtcgggggaagccagtga

SEQ ID NO: 1318378 - DNA, 22 bp, Artificial Sequence
  chemically synthesized
accagtcagcactcctggctca

SEQ ID NO: 1318379 - DNA, 22 bp, Artificial Sequence
  chemically synthesized
tgaccagtcagcactcctggct

SEQ ID NO: 1318380 - DNA, 22 bp, Artificial Sequence
  chemically synthesized
atctctgaccagtcagcactcc

SEQ ID NO: 1318381 - DNA, 22 bp, Artificial Sequence
  chemically synthesized
catctctgaccagtcagcactc

SEQ ID NO: 1318382 - DNA, 22 bp, Artificial Sequence
  chemically synthesized
tgatttcatctctgaccagtca

SEQ ID NO: 1318383 - DNA, 22 bp, Artificial Sequence
  chemically synthesized
cctgtgatttcatctctgacca

SEQ ID NO: 1318384 - DNA, 22 bp, Artificial Sequence
  chemically synthesized
caactccctgtgatttcatctc

SEQ ID NO: 1318385 - DNA, 22 bp, Artificial Sequence
  chemically synthesized
actggtcagagatgaaatcaca

SEQ ID NO: 1318386 - DNA, 22 bp, Artificial Sequence
  chemically synthesized
gtcagagatgaaatcacaggga

SEQ ID NO: 1318387 - DNA, 22 bp, Artificial Sequence
  chemically synthesized
agcgcaagaagacagctccaac

SEQ ID NO: 1318388 - DNA, 22 bp, Artificial Sequence
  chemically synthesized
actcagcgcaagaagacagctc

SEQ ID NO: 1318389 - DNA, 22 bp, Artificial Sequence
  chemically synthesized
gagctgtcttcttgcgctgagt

SEQ ID NO: 1318390 - DNA, 22 bp, Artificial Sequence
  chemically synthesized
cacccaggaactgactcagcgc

SEQ ID NO: 1318391 - DNA, 22 bp, Artificial Sequence
  chemically synthesized
tcttcttgcgctgagtcagttc

SEQ ID NO: 1318392 - DNA, 22 bp, Artificial Sequence
  chemically synthesized
tggcctccacccaggaactgac

SEQ ID NO: 1318393 - DNA, 22 bp, Artificial Sequence
  chemically synthesized
gtggcctccacccaggaactga

SEQ ID NO: 1318394 - DNA, 22 bp, Artificial Sequence
  chemically synthesized
cttgcgctgagtcagttcctgg

SEQ ID NO: 1318395 - DNA, 22 bp, Artificial Sequence
  chemically synthesized
ttgcgctgagtcagttcctggg

SEQ ID NO: 1318396 - DNA, 22 bp, Artificial Sequence
  chemically synthesized
gcgctgagtcagttcctgggtg

SEQ ID NO: 1318397 - DNA, 22 bp, Artificial Sequence
  chemically synthesized
cgctgagtcagttcctgggtgg

SEQ ID NO: 1318398 - DNA, 22 bp, Artificial Sequence
  chemically synthesized
atcttgtggcctccacccagga

SEQ ID NO: 1318399 - DNA, 22 bp, Artificial Sequence
  chemically synthesized
agtcagttcctgggtggaggcc

SEQ ID NO: 1318400 - DNA, 22 bp, Artificial Sequence
  chemically synthesized
atctgatcttgtggcctccacc

SEQ ID NO: 1318401 - DNA, 22 bp, Artificial Sequence
  chemically synthesized
gctcatctgatcttgtggcctc

SEQ ID NO: 1318402 - DNA, 22 bp, Artificial Sequence
  chemically synthesized
ctgggtggaggccacaagatca

SEQ ID NO: 1318403 - DNA, 22 bp, Artificial Sequence
  chemically synthesized
ggtggaggccacaagatcagat

SEQ ID NO: 1318404 - DNA, 22 bp, Artificial Sequence
  chemically synthesized
cccatatcaataaactggctca

SEQ ID NO: 1318405 - DNA, 22 bp, Artificial Sequence
  chemically synthesized
gcactacccatatcaataaact

SEQ ID NO: 1318406 - DNA, 22 bp, Artificial Sequence
  chemically synthesized
atggatcagctggcactaccca

SEQ ID NO: 1318407 - DNA, 22 bp, Artificial Sequence
  chemically synthesized
gatggatcagctggcactaccc

SEQ ID NO: 1318408 - DNA, 22 bp, Artificial Sequence
  chemically synthesized
attgatatgggtagtgccagct

SEQ ID NO: 1318409 - DNA, 22 bp, Artificial Sequence
  chemically synthesized
ttgatatgggtagtgccagctg

SEQ ID NO: 1318410 - DNA, 22 bp, Artificial Sequence
  chemically synthesized
cacttgatggatcagctggcac

SEQ ID NO: 1318411 - DNA, 22 bp, Artificial Sequence
  chemically synthesized
atatgggtagtgccagctgatc

SEQ ID NO: 1318412 - DNA, 22 bp, Artificial Sequence
  chemically synthesized
cagaccctgcacttgatggatc

SEQ ID NO: 1318413 - DNA, 22 bp, Artificial Sequence
  chemically synthesized
gcagaccctgcacttgatggat

SEQ ID NO: 1318414 - DNA, 22 bp, Artificial Sequence
  chemically synthesized
agataatttgcagaccctgcac

SEQ ID NO: 1318415 - DNA, 22 bp, Artificial Sequence
  chemically synthesized
gagataatttgcagaccctgca

SEQ ID NO: 1318416 - DNA, 22 bp, Artificial Sequence
  chemically synthesized
atccatcaagtgcagggtctgc

SEQ ID NO: 1318417 - DNA, 22 bp, Artificial Sequence
  chemically synthesized
agatcagtgcttgagataattt

SEQ ID NO: 1318418 - DNA, 22 bp, Artificial Sequence
  chemically synthesized
ctaagatcagtgcttgagataa

SEQ ID NO: 1318419 - DNA, 22 bp, Artificial Sequence
  chemically synthesized
ctcctaagatcagtgcttgaga

SEQ ID NO: 1318420 - DNA, 22 bp, Artificial Sequence
  chemically synthesized
caaattatctcaagcactgatc

SEQ ID NO: 1318421 - DNA, 22 bp, Artificial Sequence
  chemically synthesized
tctcaagcactgatcttaggag

SEQ ID NO: 1318422 - DNA, 22 bp, Artificial Sequence
  chemically synthesized
acccccaccaaactgctcctaa

SEQ ID NO: 1318423 - DNA, 22 bp, Artificial Sequence
  chemically synthesized
aagcactgatcttaggagcagt

SEQ ID NO: 1318424 - DNA, 22 bp, Artificial Sequence
  chemically synthesized
tgacccccaccaaactgctcct

SEQ ID NO: 1318425 - DNA, 22 bp, Artificial Sequence
  chemically synthesized
atcttaggagcagtttggtggg

SEQ ID NO: 1318426 - DNA, 22 bp, Artificial Sequence
  chemically synthesized
aggagcagtttggtgggggtca

SEQ ID NO: 1318427 - DNA, 22 bp, Artificial Sequence
  chemically synthesized
ggagcagtttggtgggggtcag

SEQ ID NO: 1318428 - DNA, 22 bp, Artificial Sequence
  chemically synthesized
gaggcaacaagattctgacccc

SEQ ID NO: 1318429 - DNA, 22 bp, Artificial Sequence
  chemically synthesized
ggtgggggtcagaatcttgttg

SEQ ID NO: 1318430 - DNA, 22 bp, Artificial Sequence
  chemically synthesized
gtgggggtcagaatcttgttgc

SEQ ID NO: 1318431 - DNA, 22 bp, Artificial Sequence
  chemically synthesized
ggagtcatgcagctggaggcaa

SEQ ID NO: 1318432 - DNA, 22 bp, Artificial Sequence
  chemically synthesized
aggagtcatgcagctggaggca

SEQ ID NO: 1318433 - DNA, 22 bp, Artificial Sequence
  chemically synthesized
tggtttaggagtcatgcagctg

SEQ ID NO: 1318434 - DNA, 22 bp, Artificial Sequence
  chemically synthesized
gttgcctccagctgcatgactc

SEQ ID NO: 1318435 - DNA, 22 bp, Artificial Sequence
  chemically synthesized
ttgcctccagctgcatgactcc

SEQ ID NO: 1318436 - DNA, 22 bp, Artificial Sequence
  chemically synthesized
gaaattatggtttaggagtcat

SEQ ID NO: 1318437 - DNA, 22 bp, Artificial Sequence
  chemically synthesized
cctccagctgcatgactcctaa

SEQ ID NO: 1318438 - DNA, 22 bp, Artificial Sequence
  chemically synthesized
cagctgcatgactcctaaacca

SEQ ID NO: 1318439 - DNA, 22 bp, Artificial Sequence
  chemically synthesized
catgactcctaaaccataattt

SEQ ID NO: 1318440 - DNA, 22 bp, Artificial Sequence
  chemically synthesized
acatcagccacagtattagaaa

SEQ ID NO: 1318441 - DNA, 22 bp, Artificial Sequence
  chemically synthesized
ctaaaccataatttctaatact

SEQ ID NO: 1318442 - DNA, 22 bp, Artificial Sequence
  chemically synthesized
aaccataatttctaatactgtg

SEQ ID NO: 1318443 - DNA, 22 bp, Artificial Sequence
  chemically synthesized
taggactaacatcagccacagt

SEQ ID NO: 1318444 - DNA, 22 bp, Artificial Sequence
  chemically synthesized
tgtaggactaacatcagccaca

SEQ ID NO: 1318445 - DNA, 22 bp, Artificial Sequence
  chemically synthesized
cctctgtaggactaacatcagc

SEQ ID NO: 1318446 - DNA, 22 bp, Artificial Sequence
  chemically synthesized
ctaatactgtggctgatgttag

SEQ ID NO: 1318447 - DNA, 22 bp, Artificial Sequence
  chemically synthesized
taatactgtggctgatgttagt

SEQ ID NO: 1318448 - DNA, 22 bp, Artificial Sequence
  chemically synthesized
atactgtggctgatgttagtcc

SEQ ID NO: 1318449 - DNA, 22 bp, Artificial Sequence
  chemically synthesized
gattgcctctgtaggactaaca

SEQ ID NO: 1318450 - DNA, 22 bp, Artificial Sequence
  chemically synthesized
tggctgatgttagtcctacaga

SEQ ID NO: 1318451 - DNA, 22 bp, Artificial Sequence
  chemically synthesized
gggactagattgcctctgtagg

SEQ ID NO: 1318452 - DNA, 22 bp, Artificial Sequence
  chemically synthesized
atgttagtcctacagaggcaat

SEQ ID NO: 1318453 - DNA, 22 bp, Artificial Sequence
  chemically synthesized
cctggggactagattgcctctg

SEQ ID NO: 1318454 - DNA, 22 bp, Artificial Sequence
  chemically synthesized
gcctggggactagattgcctct

SEQ ID NO: 1318455 - DNA, 22 bp, Artificial Sequence
  chemically synthesized
ttgcctggggactagattgcct

SEQ ID NO: 1318456 - DNA, 22 bp, Artificial Sequence
  chemically synthesized
cttgcctggggactagattgcc

SEQ ID NO: 1318457 - DNA, 22 bp, Artificial Sequence
  chemically synthesized
gtcctacagaggcaatctagtc

SEQ ID NO: 1318458 - DNA, 22 bp, Artificial Sequence
  chemically synthesized
cagaggcaatctagtccccagg

SEQ ID NO: 1318459 - DNA, 22 bp, Artificial Sequence
  chemically synthesized
ccaaagcagaccttcttgcctg

SEQ ID NO: 1318460 - DNA, 22 bp, Artificial Sequence
  chemically synthesized
cccaaagcagaccttcttgcct

SEQ ID NO: 1318461 - DNA, 22 bp, Artificial Sequence
  chemically synthesized
tcccaaagcagaccttcttgcc

SEQ ID NO: 1318462 - DNA, 22 bp, Artificial Sequence
  chemically synthesized
gtccccaggcaagaaggtctgc

SEQ ID NO: 1318463 - DNA, 22 bp, Artificial Sequence
  chemically synthesized
aacaaacatcataacagccctt

SEQ ID NO: 1318464 - DNA, 22 bp, Artificial Sequence
  chemically synthesized
aaacaaacatcataacagccct

SEQ ID NO: 1318465 - DNA, 22 bp, Artificial Sequence
  chemically synthesized
ctttgggaaagggctgttatga

SEQ ID NO: 1318466 - DNA, 22 bp, Artificial Sequence
  chemically synthesized
tgggaaagggctgttatgatgt

SEQ ID NO: 1318467 - DNA, 22 bp, Artificial Sequence
  chemically synthesized
tcgtttaaacaaacatcataac

SEQ ID NO: 1318468 - DNA, 22 bp, Artificial Sequence
  chemically synthesized
gggaaagggctgttatgatgtt

SEQ ID NO: 1318469 - DNA, 22 bp, Artificial Sequence
  chemically synthesized
atcgtttaaacaaacatcataa

SEQ ID NO: 1318470 - DNA, 22 bp, Artificial Sequence
  chemically synthesized
ggaaagggctgttatgatgttt

SEQ ID NO: 1318471 - DNA, 22 bp, Artificial Sequence
  chemically synthesized
tagtttatcgtttaaacaaaca

SEQ ID NO: 1318472 - DNA, 22 bp, Artificial Sequence
  chemically synthesized
atagtttatcgtttaaacaaac

SEQ ID NO: 1318473 - DNA, 22 bp, Artificial Sequence
  chemically synthesized
atttatagtttatcgtttaaac

SEQ ID NO: 1318474 - DNA, 22 bp, Artificial Sequence
  chemically synthesized
ttatgatgtttgtttaaacgat

SEQ ID NO: 1318475 - DNA, 22 bp, Artificial Sequence
  chemically synthesized
tgatgtttgtttaaacgataaa

SEQ ID NO: 1318476 - DNA, 22 bp, Artificial Sequence
  chemically synthesized
cactaatttatagtttatcgtt

SEQ ID NO: 1318477 - DNA, 22 bp, Artificial Sequence
  chemically synthesized
acctccactaatttatagttta

SEQ ID NO: 1318478 - DNA, 22 bp, Artificial Sequence
  chemically synthesized
gtttaaacgataaactataaat

SEQ ID NO: 1318479 - DNA, 22 bp, Artificial Sequence
  chemically synthesized
taacctccactaatttatagtt

SEQ ID NO: 1318480 - DNA, 22 bp, Artificial Sequence
  chemically synthesized
tttaaacgataaactataaatt

SEQ ID NO: 1318481 - DNA, 22 bp, Artificial Sequence
  chemically synthesized
ctaacctccactaatttatagt

SEQ ID NO: 1318482 - DNA, 22 bp, Artificial Sequence
  chemically synthesized
aaacgataaactataaattagt

SEQ ID NO: 1318483 - DNA, 22 bp, Artificial Sequence
  chemically synthesized
cttctaacctccactaatttat

SEQ ID NO: 1318484 - DNA, 22 bp, Artificial Sequence
  chemically synthesized
aacgataaactataaattagtg

SEQ ID NO: 1318485 - DNA, 22 bp, Artificial Sequence
  chemically synthesized
gcttctaacctccactaattta

SEQ ID NO: 1318486 - DNA, 22 bp, Artificial Sequence
  chemically synthesized
catcttgcttctaacctccact

SEQ ID NO: 1318487 - DNA, 22 bp, Artificial Sequence
  chemically synthesized
actccatcttgcttctaacctc

SEQ ID NO: 1318488 - DNA, 22 bp, Artificial Sequence
  chemically synthesized
taaattagtggaggttagaagc

SEQ ID NO: 1318489 - DNA, 22 bp, Artificial Sequence
  chemically synthesized
actgactccatcttgcttctaa

SEQ ID NO: 1318490 - DNA, 22 bp, Artificial Sequence
  chemically synthesized
aactgactccatcttgcttcta

SEQ ID NO: 1318491 - DNA, 22 bp, Artificial Sequence
  chemically synthesized
gtggaggttagaagcaagatgg

SEQ ID NO: 1318492 - DNA, 22 bp, Artificial Sequence
  chemically synthesized
acttaactgactccatcttgct

SEQ ID NO: 1318493 - DNA, 22 bp, Artificial Sequence
  chemically synthesized
gaagcaagatggagtcagttaa

SEQ ID NO: 1318494 - DNA, 22 bp, Artificial Sequence
  chemically synthesized
agacagtgaaagagatctaact

SEQ ID NO: 1318495 - DNA, 22 bp, Artificial Sequence
  chemically synthesized
ggactgagacagtgaaagagat

SEQ ID NO: 1318496 - DNA, 22 bp, Artificial Sequence
  chemically synthesized
agttagatctctttcactgtct

SEQ ID NO: 1318497 - DNA, 22 bp, Artificial Sequence
  chemically synthesized
caaaattaggactgagacagtg

SEQ ID NO: 1318498 - DNA, 22 bp, Artificial Sequence
  chemically synthesized
gatctctttcactgtctcagtc

SEQ ID NO: 1318499 - DNA, 22 bp, Artificial Sequence
  chemically synthesized
tttcactgtctcagtcctaatt

SEQ ID NO: 1318500 - DNA, 22 bp, Artificial Sequence
  chemically synthesized
tcactgtctcagtcctaatttt

SEQ ID NO: 1318501 - DNA, 22 bp, Artificial Sequence
  chemically synthesized
cactgtctcagtcctaattttg

SEQ ID NO: 1318502 - DNA, 22 bp, Artificial Sequence
  chemically synthesized
aaaccaccactgcaaaattagg

SEQ ID NO: 1318503 - DNA, 22 bp, Artificial Sequence
  chemically synthesized
actgtctcagtcctaattttgc

SEQ ID NO: 1318504 - DNA, 22 bp, Artificial Sequence
  chemically synthesized
gaaaccaccactgcaaaattag

SEQ ID NO: 1318505 - DNA, 22 bp, Artificial Sequence
  chemically synthesized
tgaaaccaccactgcaaaatta

SEQ ID NO: 1318506 - DNA, 22 bp, Artificial Sequence
  chemically synthesized
tctcagtcctaattttgcagtg

SEQ ID NO: 1318507 - DNA, 22 bp, Artificial Sequence
  chemically synthesized
agtcctaattttgcagtggtgg

SEQ ID NO: 1318508 - DNA, 22 bp, Artificial Sequence
  chemically synthesized
attttgcagtggtggtttcaaa

SEQ ID NO: 1318509 - DNA, 22 bp, Artificial Sequence
  chemically synthesized
tgcagtggtggtttcaaaaccc

SEQ ID NO: 1318510 - DNA, 22 bp, Artificial Sequence
  chemically synthesized
gcagtggtggtttcaaaaccct

SEQ ID NO: 1318511 - DNA, 22 bp, Artificial Sequence
  chemically synthesized
cagtggtggtttcaaaaccctt

SEQ ID NO: 1318512 - DNA, 22 bp, Artificial Sequence
  chemically synthesized
tggtaaaataaagtataagggt

SEQ ID NO: 1318513 - DNA, 22 bp, Artificial Sequence
  chemically synthesized
atggtaaaataaagtataaggg

SEQ ID NO: 1318514 - DNA, 22 bp, Artificial Sequence
  chemically synthesized
tttatggtaaaataaagtataa

SEQ ID NO: 1318515 - DNA, 22 bp, Artificial Sequence
  chemically synthesized
gtttatggtaaaataaagtata

SEQ ID NO: 1318516 - DNA, 22 bp, Artificial Sequence
  chemically synthesized
caaaacccttatactttatttt

SEQ ID NO: 1318517 - DNA, 22 bp, Artificial Sequence
  chemically synthesized
aaaacccttatactttatttta

SEQ ID NO: 1318518 - DNA, 22 bp, Artificial Sequence
  chemically synthesized
atttgtttatggtaaaataaag

SEQ ID NO: 1318519 - DNA, 22 bp, Artificial Sequence
  chemically synthesized
aaagctcatttgtttatggtaa

SEQ ID NO: 1318520 - DNA, 22 bp, Artificial Sequence
  chemically synthesized
atactttattttaccataaaca

SEQ ID NO: 1318521 - DNA, 22 bp, Artificial Sequence
  chemically synthesized
tactttattttaccataaacaa

SEQ ID NO: 1318522 - DNA, 22 bp, Artificial Sequence
  chemically synthesized
ctaaaagctcatttgtttatgg

SEQ ID NO: 1318523 - DNA, 22 bp, Artificial Sequence
  chemically synthesized
attactaaaagctcatttgttt

SEQ ID NO: 1318524 - DNA, 22 bp, Artificial Sequence
  chemically synthesized
tattttaccataaacaaatgag

SEQ ID NO: 1318525 - DNA, 22 bp, Artificial Sequence
  chemically synthesized
attttaccataaacaaatgagc

SEQ ID NO: 1318526 - DNA, 22 bp, Artificial Sequence
  chemically synthesized
ttttaccataaacaaatgagct

SEQ ID NO: 1318527 - DNA, 22 bp, Artificial Sequence
  chemically synthesized
taccataaacaaatgagctttt

SEQ ID NO: 1318528 - DNA, 22 bp, Artificial Sequence
  chemically synthesized
gaattcattactaaaagctcat

SEQ ID NO: 1318529 - DNA, 22 bp, Artificial Sequence
  chemically synthesized
accataaacaaatgagctttta

SEQ ID NO: 1318530 - DNA, 22 bp, Artificial Sequence
  chemically synthesized
ccataaacaaatgagcttttag

SEQ ID NO: 1318531 - DNA, 22 bp, Artificial Sequence
  chemically synthesized
cagtcattagaattcattacta

SEQ ID NO: 1318532 - DNA, 22 bp, Artificial Sequence
  chemically synthesized
ttagtaatgaattctaatgact

SEQ ID NO: 1318533 - DNA, 22 bp, Artificial Sequence
  chemically synthesized
tagtaatgaattctaatgactg

SEQ ID NO: 1318534 - DNA, 22 bp, Artificial Sequence
  chemically synthesized
agtaatgaattctaatgactgc

SEQ ID NO: 1318535 - DNA, 22 bp, Artificial Sequence
  chemically synthesized
gtaatgaattctaatgactgca

SEQ ID NO: 1318536 - DNA, 22 bp, Artificial Sequence
  chemically synthesized
accacccccaccccattgcagt

SEQ ID NO: 1318537 - DNA, 22 bp, Artificial Sequence
  chemically synthesized
actcaccacccccaccccattg

SEQ ID NO: 1318538 - DNA, 22 bp, Artificial Sequence
  chemically synthesized
taatgactgcaatggggtgggg

SEQ ID NO: 1318539 - DNA, 22 bp, Artificial Sequence
  chemically synthesized
atgactgcaatggggtgggggt

SEQ ID NO: 1318540 - DNA, 22 bp, Artificial Sequence
  chemically synthesized
ataacaattaactcaccacccc

SEQ ID NO: 1318541 - DNA, 22 bp, Artificial Sequence
  chemically synthesized
caatggggtgggggtggtgagt

SEQ ID NO: 1318542 - DNA, 22 bp, Artificial Sequence
  chemically synthesized
tacaactgataacaattaactc

SEQ ID NO: 1318543 - DNA, 22 bp, Artificial Sequence
  chemically synthesized
gtacaactgataacaattaact

SEQ ID NO: 1318544 - DNA, 22 bp, Artificial Sequence
  chemically synthesized
caataaaacaaccttgtacaac

SEQ ID NO: 1318545 - DNA, 22 bp, Artificial Sequence
  chemically synthesized
attgttatcagttgtacaaggt

SEQ ID NO: 1318546 - DNA, 22 bp, Artificial Sequence
  chemically synthesized
agctacaataaaacaaccttgt

SEQ ID NO: 1318547 - DNA, 22 bp, Artificial Sequence
  chemically synthesized
ttatcagttgtacaaggttgtt

SEQ ID NO: 1318548 - DNA, 22 bp, Artificial Sequence
  chemically synthesized
gagctacaataaaacaaccttg

SEQ ID NO: 1318549 - DNA, 22 bp, Artificial Sequence
  chemically synthesized
tcagttgtacaaggttgtttta

SEQ ID NO: 1318550 - DNA, 22 bp, Artificial Sequence
  chemically synthesized
caacatttgagctacaataaaa

SEQ ID NO: 1318551 - DNA, 22 bp, Artificial Sequence
  chemically synthesized
tacaaggttgttttattgtagc

SEQ ID NO: 1318552 - DNA, 22 bp, Artificial Sequence
  chemically synthesized
ctccaacatttgagctacaata

SEQ ID NO: 1318553 - DNA, 22 bp, Artificial Sequence
  chemically synthesized
cctccaacatttgagctacaat

SEQ ID NO: 1318554 - DNA, 22 bp, Artificial Sequence
  chemically synthesized
tcctccaacatttgagctacaa

SEQ ID NO: 1318555 - DNA, 22 bp, Artificial Sequence
  chemically synthesized
cctttcctccaacatttgagct

SEQ ID NO: 1318556 - DNA, 22 bp, Artificial Sequence
  chemically synthesized
ccctttcctccaacatttgagc

SEQ ID NO: 1318557 - DNA, 22 bp, Artificial Sequence
  chemically synthesized
ttttattgtagctcaaatgttg

SEQ ID NO: 1318558 - DNA, 22 bp, Artificial Sequence
  chemically synthesized
tattgtagctcaaatgttggag

SEQ ID NO: 1318559 - DNA, 22 bp, Artificial Sequence
  chemically synthesized
attgtagctcaaatgttggagg

SEQ ID NO: 1318560 - DNA, 22 bp, Artificial Sequence
  chemically synthesized
ttgtagctcaaatgttggagga

SEQ ID NO: 1318561 - DNA, 22 bp, Artificial Sequence
  chemically synthesized
tagctcaaatgttggaggaaag

SEQ ID NO: 1318562 - DNA, 22 bp, Artificial Sequence
  chemically synthesized
aaatgttggaggaaagggaagc

SEQ ID NO: 1318563 - DNA, 22 bp, Artificial Sequence
  chemically synthesized
gaggaaagggaagctttatggt

SEQ ID NO: 1318564 - DNA, 22 bp, Artificial Sequence
  chemically synthesized
atgaaacataataccataaagc

SEQ ID NO: 1318565 - DNA, 22 bp, Artificial Sequence
  chemically synthesized
aatgaaacataataccataaag

SEQ ID NO: 1318566 - DNA, 22 bp, Artificial Sequence
  chemically synthesized
gtttaatgaaacataataccat

SEQ ID NO: 1318567 - DNA, 22 bp, Artificial Sequence
  chemically synthesized
agtttaatgaaacataatacca

SEQ ID NO: 1318568 - DNA, 22 bp, Artificial Sequence
  chemically synthesized
tcttagtttaatgaaacataat

SEQ ID NO: 1318569 - DNA, 22 bp, Artificial Sequence
  chemically synthesized
tatggtattatgtttcattaaa

SEQ ID NO: 1318570 - DNA, 22 bp, Artificial Sequence
  chemically synthesized
atggtattatgtttcattaaac

SEQ ID NO: 1318571 - DNA, 22 bp, Artificial Sequence
  chemically synthesized
tggtattatgtttcattaaact

SEQ ID NO: 1318572 - DNA, 22 bp, Artificial Sequence
  chemically synthesized
aaagcctatcttagtttaatga

SEQ ID NO: 1318573 - DNA, 22 bp, Artificial Sequence
  chemically synthesized
tgaaagcctatcttagtttaat

SEQ ID NO: 1318574 - DNA, 22 bp, Artificial Sequence
  chemically synthesized
tgtttcattaaactaagatagg

SEQ ID NO: 1318575 - DNA, 22 bp, Artificial Sequence
  chemically synthesized
tacaattctgaaagcctatctt

SEQ ID NO: 1318576 - DNA, 22 bp, Artificial Sequence
  chemically synthesized
gtacaattctgaaagcctatct

SEQ ID NO: 1318577 - DNA, 22 bp, Artificial Sequence
  chemically synthesized
tgtacaattctgaaagcctatc

SEQ ID NO: 1318578 - DNA, 22 bp, Artificial Sequence
  chemically synthesized
cattaaactaagataggctttc

SEQ ID NO: 1318579 - DNA, 22 bp, Artificial Sequence
  chemically synthesized
attaaactaagataggctttca

SEQ ID NO: 1318580 - DNA, 22 bp, Artificial Sequence
  chemically synthesized
aactaagataggctttcagaat

SEQ ID NO: 1318581 - DNA, 22 bp, Artificial Sequence
  chemically synthesized
aaaatgttttgtacaattctga

SEQ ID NO: 1318582 - DNA, 22 bp, Artificial Sequence
  chemically synthesized
aaaaatgttttgtacaattctg

SEQ ID NO: 1318583 - DNA, 22 bp, Artificial Sequence
  chemically synthesized
agataggctttcagaattgtac

SEQ ID NO: 1318584 - DNA, 22 bp, Artificial Sequence
  chemically synthesized
tcagaattgtacaaaacatttt

SEQ ID NO: 1318585 - DNA, 22 bp, Artificial Sequence
  chemically synthesized
cagaattgtacaaaacattttt

SEQ ID NO: 1318586 - DNA, 22 bp, Artificial Sequence
  chemically synthesized
agaattgtacaaaacattttta

SEQ ID NO: 1318587 - DNA, 22 bp, Artificial Sequence
  chemically synthesized
tacaaaacatttttaaacctat

SEQ ID NO: 1318588 - DNA, 22 bp, Artificial Sequence
  chemically synthesized
aatcatcagtaatacatatagg

SEQ ID NO: 1318589 - DNA, 22 bp, Artificial Sequence
  chemically synthesized
aaatcatcagtaatacatatag

SEQ ID NO: 1318590 - DNA, 22 bp, Artificial Sequence
  chemically synthesized
acttaaatcatcagtaatacat

SEQ ID NO: 1318591 - DNA, 22 bp, Artificial Sequence
  chemically synthesized
ttaaacctatatgtattactga

SEQ ID NO: 1318592 - DNA, 22 bp, Artificial Sequence
  chemically synthesized
taaacctatatgtattactgat

SEQ ID NO: 1318593 - DNA, 22 bp, Artificial Sequence
  chemically synthesized
aaacctatatgtattactgatg

SEQ ID NO: 1318594 - DNA, 22 bp, Artificial Sequence
  chemically synthesized
aacctatatgtattactgatga

SEQ ID NO: 1318595 - DNA, 22 bp, Artificial Sequence
  chemically synthesized
atacactcacttaaatcatcag

SEQ ID NO: 1318596 - DNA, 22 bp, Artificial Sequence
  chemically synthesized
tatgtattactgatgatttaag

SEQ ID NO: 1318597 - DNA, 22 bp, Artificial Sequence
  chemically synthesized
cctgatacactcacttaaatca

SEQ ID NO: 1318598 - DNA, 22 bp, Artificial Sequence
  chemically synthesized
ccctgatacactcacttaaatc

SEQ ID NO: 1318599 - DNA, 22 bp, Artificial Sequence
  chemically synthesized
tttccctgatacactcacttaa

SEQ ID NO: 1318600 - DNA, 22 bp, Artificial Sequence
  chemically synthesized
ctgatgatttaagtgagtgtat

SEQ ID NO: 1318601 - DNA, 22 bp, Artificial Sequence
  chemically synthesized
atgatttaagtgagtgtatcag

SEQ ID NO: 1318602 - DNA, 22 bp, Artificial Sequence
  chemically synthesized
accaaacaagttatttccctga

SEQ ID NO: 1318603 - DNA, 22 bp, Artificial Sequence
  chemically synthesized
aagtgagtgtatcagggaaata

SEQ ID NO: 1318604 - DNA, 22 bp, Artificial Sequence
  chemically synthesized
caccaaacaagttatttccctg

SEQ ID NO: 1318605 - DNA, 22 bp, Artificial Sequence
  chemically synthesized
agtgagtgtatcagggaaataa

SEQ ID NO: 1318606 - DNA, 22 bp, Artificial Sequence
  chemically synthesized
tcaccaaacaagttatttccct

SEQ ID NO: 1318607 - DNA, 22 bp, Artificial Sequence
  chemically synthesized
ttcaccaaacaagttatttccc

SEQ ID NO: 1318608 - DNA, 22 bp, Artificial Sequence
  chemically synthesized
catttttcaccaaacaagttat

SEQ ID NO: 1318609 - DNA, 22 bp, Artificial Sequence
  chemically synthesized
aggccatattccatttttcacc

SEQ ID NO: 1318610 - DNA, 22 bp, Artificial Sequence
  chemically synthesized
caggccatattccatttttcac

SEQ ID NO: 1318611 - DNA, 22 bp, Artificial Sequence
  chemically synthesized
tcaggccatattccatttttca

SEQ ID NO: 1318612 - DNA, 22 bp, Artificial Sequence
  chemically synthesized
tgttttcaggccatattccatt

SEQ ID NO: 1318613 - DNA, 22 bp, Artificial Sequence
  chemically synthesized
gtttggtgaaaaatggaatatg

SEQ ID NO: 1318614 - DNA, 22 bp, Artificial Sequence
  chemically synthesized
tttggtgaaaaatggaatatgg

SEQ ID NO: 1318615 - DNA, 22 bp, Artificial Sequence
  chemically synthesized
ttatgttttcaggccatattcc

SEQ ID NO: 1318616 - DNA, 22 bp, Artificial Sequence
  chemically synthesized
ggtgaaaaatggaatatggcct

SEQ ID NO: 1318617 - DNA, 22 bp, Artificial Sequence
  chemically synthesized
gtgaaaaatggaatatggcctg

SEQ ID NO: 1318618 - DNA, 22 bp, Artificial Sequence
  chemically synthesized
ttgttatgttttcaggccatat

SEQ ID NO: 1318619 - DNA, 22 bp, Artificial Sequence
  chemically synthesized
cgaagttgttgttatgttttca

SEQ ID NO: 1318620 - DNA, 22 bp, Artificial Sequence
  chemically synthesized
acgaagttgttgttatgttttc

SEQ ID NO: 1318621 - DNA, 22 bp, Artificial Sequence
  chemically synthesized
aaaacataacaacaacttcgta

SEQ ID NO: 1318622 - DNA, 22 bp, Artificial Sequence
  chemically synthesized
tgagaaaatggacaacttacga

SEQ ID NO: 1318623 - DNA, 22 bp, Artificial Sequence
  chemically synthesized
atgagaaaatggacaacttacg

SEQ ID NO: 1318624 - DNA, 22 bp, Artificial Sequence
  chemically synthesized
tatgagaaaatggacaacttac

SEQ ID NO: 1318625 - DNA, 22 bp, Artificial Sequence
  chemically synthesized
ttatgagaaaatggacaactta

SEQ ID NO: 1318626 - DNA, 22 bp, Artificial Sequence
  chemically synthesized
tttttatgagaaaatggacaac

SEQ ID NO: 1318627 - DNA, 22 bp, Artificial Sequence
  chemically synthesized
cgtaagttgtccattttctcat

SEQ ID NO: 1318628 - DNA, 22 bp, Artificial Sequence
  chemically synthesized
gtaagttgtccattttctcata

SEQ ID NO: 1318629 - DNA, 22 bp, Artificial Sequence
  chemically synthesized
tccattttctcataaaaataat

SEQ ID NO: 1318630 - DNA, 22 bp, Artificial Sequence
  chemically synthesized
atatataagtaagtcaatatta

SEQ ID NO: 1318631 - DNA, 22 bp, Artificial Sequence
  chemically synthesized
tctcataaaaataatattgact

SEQ ID NO: 1318632 - DNA, 22 bp, Artificial Sequence
  chemically synthesized
aatatataagtaagtcaatatt

SEQ ID NO: 1318633 - DNA, 22 bp, Artificial Sequence
  chemically synthesized
ctcataaaaataatattgactt

SEQ ID NO: 1318634 - DNA, 22 bp, Artificial Sequence
  chemically synthesized
tcataaaaataatattgactta

SEQ ID NO: 1318635 - DNA, 22 bp, Artificial Sequence
  chemically synthesized
ataaaaataatattgacttact

SEQ ID NO: 1318636 - DNA, 22 bp, Artificial Sequence
  chemically synthesized
atttaatatataagtaagtcaa

SEQ ID NO: 1318637 - DNA, 22 bp, Artificial Sequence
  chemically synthesized
aatcactaatttaatatataag

SEQ ID NO: 1318638 - DNA, 22 bp, Artificial Sequence
  chemically synthesized
acttacttatatattaaattag

SEQ ID NO: 1318639 - DNA, 22 bp, Artificial Sequence
  chemically synthesized
gaaattgaatcactaatttaat

SEQ ID NO: 1318640 - DNA, 22 bp, Artificial Sequence
  chemically synthesized
agaaattgaatcactaatttaa

SEQ ID NO: 1318641 - DNA, 22 bp, Artificial Sequence
  chemically synthesized
tagaaattgaatcactaattta

SEQ ID NO: 1318642 - DNA, 22 bp, Artificial Sequence
  chemically synthesized
acttatatattaaattagtgat

SEQ ID NO: 1318643 - DNA, 22 bp, Artificial Sequence
  chemically synthesized
cttatatattaaattagtgatt

SEQ ID NO: 1318644 - DNA, 22 bp, Artificial Sequence
  chemically synthesized
atatattaaattagtgattcaa

SEQ ID NO: 1318645 - DNA, 22 bp, Artificial Sequence
  chemically synthesized
tatattaaattagtgattcaat

SEQ ID NO: 1318646 - DNA, 22 bp, Artificial Sequence
  chemically synthesized
taaggcctttagaaattgaatc

SEQ ID NO: 1318647 - DNA, 22 bp, Artificial Sequence
  chemically synthesized
gtaaggcctttagaaattgaat

SEQ ID NO: 1318648 - DNA, 22 bp, Artificial Sequence
  chemically synthesized
tgtaaggcctttagaaattgaa

SEQ ID NO: 1318649 - DNA, 22 bp, Artificial Sequence
  chemically synthesized
aattagtgattcaatttctaaa

SEQ ID NO: 1318650 - DNA, 22 bp, Artificial Sequence
  chemically synthesized
tatctttgtaaggcctttagaa

SEQ ID NO: 1318651 - DNA, 22 bp, Artificial Sequence
  chemically synthesized
gtgattcaatttctaaaggcct

SEQ ID NO: 1318652 - DNA, 22 bp, Artificial Sequence
  chemically synthesized
aattatatctttgtaaggcctt

SEQ ID NO: 1318653 - DNA, 22 bp, Artificial Sequence
  chemically synthesized
aatttctaaaggccttacaaag

SEQ ID NO: 1318654 - DNA, 22 bp, Artificial Sequence
  chemically synthesized
ctaaaggccttacaaagatata

SEQ ID NO: 1318655 - DNA, 22 bp, Artificial Sequence
  chemically synthesized
taaaggccttacaaagatataa

SEQ ID NO: 1318656 - DNA, 22 bp, Artificial Sequence
  chemically synthesized
aaggccttacaaagatataatt

SEQ ID NO: 1318657 - DNA, 22 bp, Artificial Sequence
  chemically synthesized
ccataaaatactgaattatatc

SEQ ID NO: 1318658 - DNA, 22 bp, Artificial Sequence
  chemically synthesized
acaaagatataattcagtattt

SEQ ID NO: 1318659 - DNA, 22 bp, Artificial Sequence
  chemically synthesized
caaagatataattcagtatttt

SEQ ID NO: 1318660 - DNA, 22 bp, Artificial Sequence
  chemically synthesized
gaaaataattaccataaaatac

SEQ ID NO: 1318661 - DNA, 22 bp, Artificial Sequence
  chemically synthesized
attagaaaataattaccataaa

SEQ ID NO: 1318662 - DNA, 22 bp, Artificial Sequence
  chemically synthesized
taattagaaaataattaccata

SEQ ID NO: 1318663 - DNA, 22 bp, Artificial Sequence
  chemically synthesized
ctaattagaaaataattaccat

SEQ ID NO: 1318664 - DNA, 22 bp, Artificial Sequence
  chemically synthesized
agtattttatggtaattatttt

SEQ ID NO: 1318665 - DNA, 22 bp, Artificial Sequence
  chemically synthesized
tatggtaattattttctaatta

SEQ ID NO: 1318666 - DNA, 22 bp, Artificial Sequence
  chemically synthesized
atggtaattattttctaattag

SEQ ID NO: 1318667 - DNA, 22 bp, Artificial Sequence
  chemically synthesized
tggtaattattttctaattaga

SEQ ID NO: 1318668 - DNA, 22 bp, Artificial Sequence
  chemically synthesized
tagtaaaagtaaatttctaatt

SEQ ID NO: 1318669 - DNA, 22 bp, Artificial Sequence
  chemically synthesized
ttttctaattagaaatttactt

SEQ ID NO: 1318670 - DNA, 22 bp, Artificial Sequence
  chemically synthesized
gtgctatagtaaaagtaaattt

SEQ ID NO: 1318671 - DNA, 22 bp, Artificial Sequence
  chemically synthesized
agtgctatagtaaaagtaaatt

SEQ ID NO: 1318672 - DNA, 22 bp, Artificial Sequence
  chemically synthesized
tctaattagaaatttactttta

SEQ ID NO: 1318673 - DNA, 22 bp, Artificial Sequence
  chemically synthesized
ctaattagaaatttacttttac

SEQ ID NO: 1318674 - DNA, 22 bp, Artificial Sequence
  chemically synthesized
taattagaaatttacttttact

SEQ ID NO: 1318675 - DNA, 22 bp, Artificial Sequence
  chemically synthesized
attagaaatttacttttactat

SEQ ID NO: 1318676 - DNA, 22 bp, Artificial Sequence
  chemically synthesized
gtggcacttagtgctatagtaa

SEQ ID NO: 1318677 - DNA, 22 bp, Artificial Sequence
  chemically synthesized
gaaatttacttttactatagca

SEQ ID NO: 1318678 - DNA, 22 bp, Artificial Sequence
  chemically synthesized
atactggtggcacttagtgcta

SEQ ID NO: 1318679 - DNA, 22 bp, Artificial Sequence
  chemically synthesized
acttttactatagcactaagtg

SEQ ID NO: 1318680 - DNA, 22 bp, Artificial Sequence
  chemically synthesized
cttttactatagcactaagtgc

SEQ ID NO: 1318681 - DNA, 22 bp, Artificial Sequence
  chemically synthesized
ttactatagcactaagtgccac

SEQ ID NO: 1318682 - DNA, 22 bp, Artificial Sequence
  chemically synthesized
tactatagcactaagtgccacc

SEQ ID NO: 1318683 - DNA, 22 bp, Artificial Sequence
  chemically synthesized
actatagcactaagtgccacca

SEQ ID NO: 1318684 - DNA, 22 bp, Artificial Sequence
  chemically synthesized
ctatagcactaagtgccaccag

SEQ ID NO: 1318685 - DNA, 22 bp, Artificial Sequence
  chemically synthesized
tagcactaagtgccaccagtat

SEQ ID NO: 1318686 - DNA, 22 bp, Artificial Sequence
  chemically synthesized
agtgccaccagtattaattatt

SEQ ID NO: 1318687 - DNA, 22 bp, Artificial Sequence
  chemically synthesized
ggaacaagtatggtgtaaggaa

SEQ ID NO: 1318688 - DNA, 22 bp, Artificial Sequence
  chemically synthesized
attattgttatttccttacacc

SEQ ID NO: 1318689 - DNA, 22 bp, Artificial Sequence
  chemically synthesized
ctaggaacaagtatggtgtaag

SEQ ID NO: 1318690 - DNA, 22 bp, Artificial Sequence
  chemically synthesized
actaggaacaagtatggtgtaa

SEQ ID NO: 1318691 - DNA, 22 bp, Artificial Sequence
  chemically synthesized
ttgttatttccttacaccatac

SEQ ID NO: 1318692 - DNA, 22 bp, Artificial Sequence
  chemically synthesized
tactaggaacaagtatggtgta

SEQ ID NO: 1318693 - DNA, 22 bp, Artificial Sequence
  chemically synthesized
ttatttccttacaccatacttg

SEQ ID NO: 1318694 - DNA, 22 bp, Artificial Sequence
  chemically synthesized
ttttactaggaacaagtatggt

SEQ ID NO: 1318695 - DNA, 22 bp, Artificial Sequence
  chemically synthesized
gttttactaggaacaagtatgg

SEQ ID NO: 1318696 - DNA, 22 bp, Artificial Sequence
  chemically synthesized
tttccttacaccatacttgttc

SEQ ID NO: 1318697 - DNA, 22 bp, Artificial Sequence
  chemically synthesized
ccttacaccatacttgttccta

SEQ ID NO: 1318698 - DNA, 22 bp, Artificial Sequence
  chemically synthesized
cttacaccatacttgttcctag

SEQ ID NO: 1318699 - DNA, 22 bp, Artificial Sequence
  chemically synthesized
aagcttgttttactaggaacaa

SEQ ID NO: 1318700 - DNA, 22 bp, Artificial Sequence
  chemically synthesized
acaccatacttgttcctagtaa

SEQ ID NO: 1318701 - DNA, 22 bp, Artificial Sequence
  chemically synthesized
caccatacttgttcctagtaaa

SEQ ID NO: 1318702 - DNA, 22 bp, Artificial Sequence
  chemically synthesized
gttcctagtaaaacaagcttca

SEQ ID NO: 1318703 - DNA, 22 bp, Artificial Sequence
  chemically synthesized
ttcctagtaaaacaagcttcag

SEQ ID NO: 1318704 - DNA, 22 bp, Artificial Sequence
  chemically synthesized
tagagaacagtggctgaagctt

SEQ ID NO: 1318705 - DNA, 22 bp, Artificial Sequence
  chemically synthesized
atagagaacagtggctgaagct

SEQ ID NO: 1318706 - DNA, 22 bp, Artificial Sequence
  chemically synthesized
ctagtaaaacaagcttcagcca

SEQ ID NO: 1318707 - DNA, 22 bp, Artificial Sequence
  chemically synthesized
tatagagaacagtggctgaagc

SEQ ID NO: 1318708 - DNA, 22 bp, Artificial Sequence
  chemically synthesized
gtaaaacaagcttcagccactg

SEQ ID NO: 1318709 - DNA, 22 bp, Artificial Sequence
  chemically synthesized
gaagacaccatattttatagag

SEQ ID NO: 1318710 - DNA, 22 bp, Artificial Sequence
  chemically synthesized
cagccactgttctctataaaat

SEQ ID NO: 1318711 - DNA, 22 bp, Artificial Sequence
  chemically synthesized
agccactgttctctataaaata

SEQ ID NO: 1318712 - DNA, 22 bp, Artificial Sequence
  chemically synthesized
ccatctagaagacaccatattt

SEQ ID NO: 1318713 - DNA, 22 bp, Artificial Sequence
  chemically synthesized
ttctctataaaatatggtgtct

SEQ ID NO: 1318714 - DNA, 22 bp, Artificial Sequence
  chemically synthesized
ttcccatctagaagacaccata

SEQ ID NO: 1318715 - DNA, 22 bp, Artificial Sequence
  chemically synthesized
gttcccatctagaagacaccat

SEQ ID NO: 1318716 - DNA, 22 bp, Artificial Sequence
  chemically synthesized
tctataaaatatggtgtcttct

SEQ ID NO: 1318717 - DNA, 22 bp, Artificial Sequence
  chemically synthesized
ttgttcccatctagaagacacc

SEQ ID NO: 1318718 - DNA, 22 bp, Artificial Sequence
  chemically synthesized
tataaaatatggtgtcttctag

SEQ ID NO: 1318719 - DNA, 22 bp, Artificial Sequence
  chemically synthesized
taaaatatggtgtcttctagat

SEQ ID NO: 1318720 - DNA, 22 bp, Artificial Sequence
  chemically synthesized
taaaatattcttgttcccatct

SEQ ID NO: 1318721 - DNA, 22 bp, Artificial Sequence
  chemically synthesized
tgtgttgtaaaatattcttgtt

SEQ ID NO: 1318722 - DNA, 22 bp, Artificial Sequence
  chemically synthesized
ctagatgggaacaagaatattt

SEQ ID NO: 1318723 - DNA, 22 bp, Artificial Sequence
  chemically synthesized
tagatgggaacaagaatatttt

SEQ ID NO: 1318724 - DNA, 22 bp, Artificial Sequence
  chemically synthesized
gatgggaacaagaatattttac

SEQ ID NO: 1318725 - DNA, 22 bp, Artificial Sequence
  chemically synthesized
gaaatgggaggttatgtgttgt

SEQ ID NO: 1318726 - DNA, 22 bp, Artificial Sequence
  chemically synthesized
tacaacacataacctcccattt

SEQ ID NO: 1318727 - DNA, 22 bp, Artificial Sequence
  chemically synthesized
tcacaaccctagaaatgggagg

SEQ ID NO: 1318728 - DNA, 22 bp, Artificial Sequence
  chemically synthesized
acaacacataacctcccatttc

SEQ ID NO: 1318729 - DNA, 22 bp, Artificial Sequence
  chemically synthesized
gtcacaaccctagaaatgggag

SEQ ID NO: 1318730 - DNA, 22 bp, Artificial Sequence
  chemically synthesized
caacacataacctcccatttct

SEQ ID NO: 1318731 - DNA, 22 bp, Artificial Sequence
  chemically synthesized
tgtcacaaccctagaaatggga

SEQ ID NO: 1318732 - DNA, 22 bp, Artificial Sequence
  chemically synthesized
ccatttctagggttgtgacaaa

SEQ ID NO: 1318733 - DNA, 22 bp, Artificial Sequence
  chemically synthesized
aaataaaatgcattttgtcaca

SEQ ID NO: 1318734 - DNA, 22 bp, Artificial Sequence
  chemically synthesized
gaaataaaatgcattttgtcac

SEQ ID NO: 1318735 - DNA, 22 bp, Artificial Sequence
  chemically synthesized
ctagggttgtgacaaaatgcat

SEQ ID NO: 1318736 - DNA, 22 bp, Artificial Sequence
  chemically synthesized
tagggttgtgacaaaatgcatt

SEQ ID NO: 1318737 - DNA, 22 bp, Artificial Sequence
  chemically synthesized
gggttgtgacaaaatgcatttt

SEQ ID NO: 1318738 - DNA, 22 bp, Artificial Sequence
  chemically synthesized
cgtgccatttgaaataaaatgc

SEQ ID NO: 1318739 - DNA, 22 bp, Artificial Sequence
  chemically synthesized
tgacaaaatgcattttatttca

SEQ ID NO: 1318740 - DNA, 22 bp, Artificial Sequence
  chemically synthesized
atattgcgtgccatttgaaata

SEQ ID NO: 1318741 - DNA, 22 bp, Artificial Sequence
  chemically synthesized
aatattgcgtgccatttgaaat

SEQ ID NO: 1318742 - DNA, 22 bp, Artificial Sequence
  chemically synthesized
taatattgcgtgccatttgaaa

SEQ ID NO: 1318743 - DNA, 22 bp, Artificial Sequence
  chemically synthesized
ttttaatattgcgtgccatttg

SEQ ID NO: 1318744 - DNA, 22 bp, Artificial Sequence
  chemically synthesized
agttgttttaatattgcgtgcc

SEQ ID NO: 1318745 - DNA, 22 bp, Artificial Sequence
  chemically synthesized
tatttcaaatggcacgcaatat

SEQ ID NO: 1318746 - DNA, 22 bp, Artificial Sequence
  chemically synthesized
atttcaaatggcacgcaatatt

SEQ ID NO: 1318747 - DNA, 22 bp, Artificial Sequence
  chemically synthesized
tttcaaatggcacgcaatatta

SEQ ID NO: 1318748 - DNA, 22 bp, Artificial Sequence
  chemically synthesized
caaatggcacgcaatattaaaa

SEQ ID NO: 1318749 - DNA, 22 bp, Artificial Sequence
  chemically synthesized
aaatggcacgcaatattaaaac

SEQ ID NO: 1318750 - DNA, 22 bp, Artificial Sequence
  chemically synthesized
atgaaacataaactgagttgtt

SEQ ID NO: 1318751 - DNA, 22 bp, Artificial Sequence
  chemically synthesized
attaatgaaacataaactgagt

SEQ ID NO: 1318752 - DNA, 22 bp, Artificial Sequence
  chemically synthesized
gattaatgaaacataaactgag

SEQ ID NO: 1318753 - DNA, 22 bp, Artificial Sequence
  chemically synthesized
ttgattaatgaaacataaactg

SEQ ID NO: 1318754 - DNA, 22 bp, Artificial Sequence
  chemically synthesized
aaacaactcagtttatgtttca

SEQ ID NO: 1318755 - DNA, 22 bp, Artificial Sequence
  chemically synthesized
aattcttgattaatgaaacata

SEQ ID NO: 1318756 - DNA, 22 bp, Artificial Sequence
  chemically synthesized
gaattcttgattaatgaaacat

SEQ ID NO: 1318757 - DNA, 22 bp, Artificial Sequence
  chemically synthesized
tgaattcttgattaatgaaaca

SEQ ID NO: 1318758 - DNA, 22 bp, Artificial Sequence
  chemically synthesized
ttttgaattcttgattaatgaa

SEQ ID NO: 1318759 - DNA, 22 bp, Artificial Sequence
  chemically synthesized
agtttatgtttcattaatcaag

SEQ ID NO: 1318760 - DNA, 22 bp, Artificial Sequence
  chemically synthesized
atgtttcattaatcaagaattc

SEQ ID NO: 1318761 - DNA, 22 bp, Artificial Sequence
  chemically synthesized
tgtttcattaatcaagaattca

SEQ ID NO: 1318762 - DNA, 22 bp, Artificial Sequence
  chemically synthesized
caaaatgaggttgttttgaatt

SEQ ID NO: 1318763 - DNA, 22 bp, Artificial Sequence
  chemically synthesized
cattaatcaagaattcaaaaca

SEQ ID NO: 1318764 - DNA, 22 bp, Artificial Sequence
  chemically synthesized
acaaaatgaggttgttttgaat

SEQ ID NO: 1318765 - DNA, 22 bp, Artificial Sequence
  chemically synthesized
attaatcaagaattcaaaacaa

SEQ ID NO: 1318766 - DNA, 22 bp, Artificial Sequence
  chemically synthesized
atcaagaattcaaaacaacctc

SEQ ID NO: 1318767 - DNA, 22 bp, Artificial Sequence
  chemically synthesized
tggatttacaaaatgaggttgt

SEQ ID NO: 1318768 - DNA, 22 bp, Artificial Sequence
  chemically synthesized
catattatggatttacaaaatg

SEQ ID NO: 1318769 - DNA, 22 bp, Artificial Sequence
  chemically synthesized
gcatattatggatttacaaaat

SEQ ID NO: 1318770 - DNA, 22 bp, Artificial Sequence
  chemically synthesized
aaaacaacctcattttgtaaat

SEQ ID NO: 1318771 - DNA, 22 bp, Artificial Sequence
  chemically synthesized
tagccaagtttgcatattatgg

SEQ ID NO: 1318772 - DNA, 22 bp, Artificial Sequence
  chemically synthesized
attttgtaaatccataatatgc

SEQ ID NO: 1318773 - DNA, 22 bp, Artificial Sequence
  chemically synthesized
tgtaaatccataatatgcaaac

SEQ ID NO: 1318774 - DNA, 22 bp, Artificial Sequence
  chemically synthesized
gtaaatccataatatgcaaact

SEQ ID NO: 1318775 - DNA, 22 bp, Artificial Sequence
  chemically synthesized
taaatccataatatgcaaactt

SEQ ID NO: 1318776 - DNA, 22 bp, Artificial Sequence
  chemically synthesized
gacagtctgtagccaagtttgc

SEQ ID NO: 1318777 - DNA, 22 bp, Artificial Sequence
  chemically synthesized
attggacagtctgtagccaagt

SEQ ID NO: 1318778 - DNA, 22 bp, Artificial Sequence
  chemically synthesized
ggctacagactgtccaatcaga

SEQ ID NO: 1318779 - DNA, 22 bp, Artificial Sequence
  chemically synthesized
gctacagactgtccaatcagat

SEQ ID NO: 1318780 - DNA, 22 bp, Artificial Sequence
  chemically synthesized
aaaggagaataaaatctgattg

SEQ ID NO: 1318781 - DNA, 22 bp, Artificial Sequence
  chemically synthesized
gaaaggagaataaaatctgatt

SEQ ID NO: 1318782 - DNA, 22 bp, Artificial Sequence
  chemically synthesized
cagactgtccaatcagatttta

SEQ ID NO: 1318783 - DNA, 22 bp, Artificial Sequence
  chemically synthesized
acttgaaaggagaataaaatct

SEQ ID NO: 1318784 - DNA, 22 bp, Artificial Sequence
  chemically synthesized
tccaatcagattttattctcct

SEQ ID NO: 1318785 - DNA, 22 bp, Artificial Sequence
  chemically synthesized
tattctcctttcaagtcagatt

SEQ ID NO: 1318786 - DNA, 22 bp, Artificial Sequence
  chemically synthesized
attctcctttcaagtcagattt

SEQ ID NO: 1318787 - DNA, 22 bp, Artificial Sequence
  chemically synthesized
ttctcctttcaagtcagatttt

SEQ ID NO: 1318788 - DNA, 22 bp, Artificial Sequence
  chemically synthesized
tcctttcaagtcagattttcct

SEQ ID NO: 1318789 - DNA, 22 bp, Artificial Sequence
  chemically synthesized
ctttcaagtcagattttcctta

SEQ ID NO: 1318790 - DNA, 22 bp, Artificial Sequence
  chemically synthesized
tcaagtcagattttccttatcc

SEQ ID NO: 1318791 - DNA, 22 bp, Artificial Sequence
  chemically synthesized
caagtcagattttccttatcct

SEQ ID NO: 1318792 - DNA, 22 bp, Artificial Sequence
  chemically synthesized
aagtcagattttccttatcctc

SEQ ID NO: 1318793 - DNA, 22 bp, Artificial Sequence
  chemically synthesized
gtaagatagtgtaagtaaagag

SEQ ID NO: 1318794 - DNA, 22 bp, Artificial Sequence
  chemically synthesized
ttggtaagatagtgtaagtaaa

SEQ ID NO: 1318795 - DNA, 22 bp, Artificial Sequence
  chemically synthesized
tccttatcctctttacttacac

SEQ ID NO: 1318796 - DNA, 22 bp, Artificial Sequence
  chemically synthesized
ccttatcctctttacttacact

SEQ ID NO: 1318797 - DNA, 22 bp, Artificial Sequence
  chemically synthesized
cttatcctctttacttacacta

SEQ ID NO: 1318798 - DNA, 22 bp, Artificial Sequence
  chemically synthesized
atcctctttacttacactatct

SEQ ID NO: 1318799 - DNA, 22 bp, Artificial Sequence
  chemically synthesized
tcctctttacttacactatctt

SEQ ID NO: 1318800 - DNA, 22 bp, Artificial Sequence
  chemically synthesized
acagcctattggtaagatagtg

SEQ ID NO: 1318801 - DNA, 22 bp, Artificial Sequence
  chemically synthesized
tttacttacactatcttaccaa

SEQ ID NO: 1318802 - DNA, 22 bp, Artificial Sequence
  chemically synthesized
tacttacactatcttaccaata

SEQ ID NO: 1318803 - DNA, 22 bp, Artificial Sequence
  chemically synthesized
acttacactatcttaccaatag

SEQ ID NO: 1318804 - DNA, 22 bp, Artificial Sequence
  chemically synthesized
gcatctgacagcctattggtaa

SEQ ID NO: 1318805 - DNA, 22 bp, Artificial Sequence
  chemically synthesized
cttacactatcttaccaatagg

SEQ ID NO: 1318806 - DNA, 22 bp, Artificial Sequence
  chemically synthesized
acactatcttaccaataggctg

SEQ ID NO: 1318807 - DNA, 22 bp, Artificial Sequence
  chemically synthesized
cactatcttaccaataggctgt

SEQ ID NO: 1318808 - DNA, 22 bp, Artificial Sequence
  chemically synthesized
tcttaccaataggctgtcagat

SEQ ID NO: 1318809 - DNA, 22 bp, Artificial Sequence
  chemically synthesized
agaacatactagcatctgacag

SEQ ID NO: 1318810 - DNA, 22 bp, Artificial Sequence
  chemically synthesized
accaataggctgtcagatgcta

SEQ ID NO: 1318811 - DNA, 22 bp, Artificial Sequence
  chemically synthesized
ccaataggctgtcagatgctag

SEQ ID NO: 1318812 - DNA, 22 bp, Artificial Sequence
  chemically synthesized
aatgtctcagaacatactagca

SEQ ID NO: 1318813 - DNA, 22 bp, Artificial Sequence
  chemically synthesized
tcagatgctagtatgttctgag

SEQ ID NO: 1318814 - DNA, 22 bp, Artificial Sequence
  chemically synthesized
gtatgttctgagacattcagta

SEQ ID NO: 1318815 - DNA, 22 bp, Artificial Sequence
  chemically synthesized
tgagacattcagtatctcttat

SEQ ID NO: 1318816 - DNA, 22 bp, Artificial Sequence
  chemically synthesized
agacattcagtatctcttatca

SEQ ID NO: 1318817 - DNA, 22 bp, Artificial Sequence
  chemically synthesized
agagtatatgagtggtgagtga

SEQ ID NO: 1318818 - DNA, 22 bp, Artificial Sequence
  chemically synthesized
agtatctcttatcactcaccac

SEQ ID NO: 1318819 - DNA, 22 bp, Artificial Sequence
  chemically synthesized
tccctgagagtatatgagtggt

SEQ ID NO: 1318820 - DNA, 22 bp, Artificial Sequence
  chemically synthesized
atccctgagagtatatgagtgg

SEQ ID NO: 1318821 - DNA, 22 bp, Artificial Sequence
  chemically synthesized
tatccctgagagtatatgagtg

SEQ ID NO: 1318822 - DNA, 22 bp, Artificial Sequence
  chemically synthesized
ttatcactcaccactcatatac

SEQ ID NO: 1318823 - DNA, 22 bp, Artificial Sequence
  chemically synthesized
atcactcaccactcatatactc

SEQ ID NO: 1318824 - DNA, 22 bp, Artificial Sequence
  chemically synthesized
tcactcaccactcatatactct

SEQ ID NO: 1318825 - DNA, 22 bp, Artificial Sequence
  chemically synthesized
cagaattttatccctgagagta

SEQ ID NO: 1318826 - DNA, 22 bp, Artificial Sequence
  chemically synthesized
accactcatatactctcaggga

SEQ ID NO: 1318827 - DNA, 22 bp, Artificial Sequence
  chemically synthesized
tacagaattttatccctgagag

SEQ ID NO: 1318828 - DNA, 22 bp, Artificial Sequence
  chemically synthesized
atatactctcagggataaaatt

SEQ ID NO: 1318829 - DNA, 22 bp, Artificial Sequence
  chemically synthesized
agtgcctctacagaattttatc

SEQ ID NO: 1318830 - DNA, 22 bp, Artificial Sequence
  chemically synthesized
tcagggataaaattctgtagag

SEQ ID NO: 1318831 - DNA, 22 bp, Artificial Sequence
  chemically synthesized
agggataaaattctgtagaggc

SEQ ID NO: 1318832 - DNA, 22 bp, Artificial Sequence
  chemically synthesized
tgcgaattgagtgcctctacag

SEQ ID NO: 1318833 - DNA, 22 bp, Artificial Sequence
  chemically synthesized
tatgcgaattgagtgcctctac

SEQ ID NO: 1318834 - DNA, 22 bp, Artificial Sequence
  chemically synthesized
ctatgcgaattgagtgcctcta

SEQ ID NO: 1318835 - DNA, 22 bp, Artificial Sequence
  chemically synthesized
tttctatgcgaattgagtgcct

SEQ ID NO: 1318836 - DNA, 22 bp, Artificial Sequence
  chemically synthesized
tggttgtttctatgcgaattga

SEQ ID NO: 1318837 - DNA, 22 bp, Artificial Sequence
  chemically synthesized
tgtagaggcactcaattcgcat

SEQ ID NO: 1318838 - DNA, 22 bp, Artificial Sequence
  chemically synthesized
atggttgtttctatgcgaattg

SEQ ID NO: 1318839 - DNA, 22 bp, Artificial Sequence
  chemically synthesized
tatggttgtttctatgcgaatt

SEQ ID NO: 1318840 - DNA, 22 bp, Artificial Sequence
  chemically synthesized
tagaggcactcaattcgcatag

SEQ ID NO: 1318841 - DNA, 22 bp, Artificial Sequence
  chemically synthesized
ggttttatggttgtttctatgc

SEQ ID NO: 1318842 - DNA, 22 bp, Artificial Sequence
  chemically synthesized
aattcgcatagaaacaaccata

SEQ ID NO: 1318843 - DNA, 22 bp, Artificial Sequence
  chemically synthesized
caaaactgggttttatggttgt

SEQ ID NO: 1318844 - DNA, 22 bp, Artificial Sequence
  chemically synthesized
gcaaaactgggttttatggttg

SEQ ID NO: 1318845 - DNA, 22 bp, Artificial Sequence
  chemically synthesized
gcatagaaacaaccataaaacc

SEQ ID NO: 1318846 - DNA, 22 bp, Artificial Sequence
  chemically synthesized
atatttgcaaaactgggtttta

SEQ ID NO: 1318847 - DNA, 22 bp, Artificial Sequence
  chemically synthesized
aatatttgcaaaactgggtttt

SEQ ID NO: 1318848 - DNA, 22 bp, Artificial Sequence
  chemically synthesized
acttaatatttgcaaaactggg

SEQ ID NO: 1318849 - DNA, 22 bp, Artificial Sequence
  chemically synthesized
taacttaatatttgcaaaactg

SEQ ID NO: 1318850 - DNA, 22 bp, Artificial Sequence
  chemically synthesized
ctaacttaatatttgcaaaact

SEQ ID NO: 1318851 - DNA, 22 bp, Artificial Sequence
  chemically synthesized
tctaacttaatatttgcaaaac

SEQ ID NO: 1318852 - DNA, 22 bp, Artificial Sequence
  chemically synthesized
ttttctaacttaatatttgcaa

SEQ ID NO: 1318853 - DNA, 22 bp, Artificial Sequence
  chemically synthesized
tgccaattgttttctaacttaa

SEQ ID NO: 1318854 - DNA, 22 bp, Artificial Sequence
  chemically synthesized
tgcaaatattaagttagaaaac

SEQ ID NO: 1318855 - DNA, 22 bp, Artificial Sequence
  chemically synthesized
gcaaatattaagttagaaaaca

SEQ ID NO: 1318856 - DNA, 22 bp, Artificial Sequence
  chemically synthesized
caaatattaagttagaaaacaa

SEQ ID NO: 1318857 - DNA, 22 bp, Artificial Sequence
  chemically synthesized
agttagaaaacaattggcatag

SEQ ID NO: 1318858 - DNA, 22 bp, Artificial Sequence
  chemically synthesized
ccatagtgtaatgctatgccaa

SEQ ID NO: 1318859 - DNA, 22 bp, Artificial Sequence
  chemically synthesized
gaaaacaattggcatagcatta

SEQ ID NO: 1318860 - DNA, 22 bp, Artificial Sequence
  chemically synthesized
gcatagcattacactatggtaa

SEQ ID NO: 1318861 - DNA, 22 bp, Artificial Sequence
  chemically synthesized
ggagtgcatagtaagtattacc

SEQ ID NO: 1318862 - DNA, 22 bp, Artificial Sequence
  chemically synthesized
aggagtgcatagtaagtattac

SEQ ID NO: 1318863 - DNA, 22 bp, Artificial Sequence
  chemically synthesized
taggagtgcatagtaagtatta

SEQ ID NO: 1318864 - DNA, 22 bp, Artificial Sequence
  chemically synthesized
cactatggtaatacttactatg

SEQ ID NO: 1318865 - DNA, 22 bp, Artificial Sequence
  chemically synthesized
aattttaggagtgcatagtaag

SEQ ID NO: 1318866 - DNA, 22 bp, Artificial Sequence
  chemically synthesized
tggtaatacttactatgcactc

SEQ ID NO: 1318867 - DNA, 22 bp, Artificial Sequence
  chemically synthesized
actatgcactcctaaaatttag

SEQ ID NO: 1318868 - DNA, 22 bp, Artificial Sequence
  chemically synthesized
ctatgcactcctaaaatttagt

SEQ ID NO: 1318869 - DNA, 22 bp, Artificial Sequence
  chemically synthesized
tgcactcctaaaatttagtgtt

SEQ ID NO: 1318870 - DNA, 22 bp, Artificial Sequence
  chemically synthesized
catcatggcataagatcaacac

SEQ ID NO: 1318871 - DNA, 22 bp, Artificial Sequence
  chemically synthesized
acatcatggcataagatcaaca

SEQ ID NO: 1318872 - DNA, 22 bp, Artificial Sequence
  chemically synthesized
ctaaaatttagtgttgatctta

SEQ ID NO: 1318873 - DNA, 22 bp, Artificial Sequence
  chemically synthesized
tacatcatggcataagatcaac

SEQ ID NO: 1318874 - DNA, 22 bp, Artificial Sequence
  chemically synthesized
ttacatcatggcataagatcaa

SEQ ID NO: 1318875 - DNA, 22 bp, Artificial Sequence
  chemically synthesized
aaatttagtgttgatcttatgc

SEQ ID NO: 1318876 - DNA, 22 bp, Artificial Sequence
  chemically synthesized
tttttacatcatggcataagat

SEQ ID NO: 1318877 - DNA, 22 bp, Artificial Sequence
  chemically synthesized
gtttttacatcatggcataaga

SEQ ID NO: 1318878 - DNA, 22 bp, Artificial Sequence
  chemically synthesized
tgtttttacatcatggcataag

SEQ ID NO: 1318879 - DNA, 22 bp, Artificial Sequence
  chemically synthesized
ttgtttttacatcatggcataa

SEQ ID NO: 1318880 - DNA, 22 bp, Artificial Sequence
  chemically synthesized
tttgtttttacatcatggcata

SEQ ID NO: 1318881 - DNA, 22 bp, Artificial Sequence
  chemically synthesized
agtgttgatcttatgccatgat

SEQ ID NO: 1318882 - DNA, 22 bp, Artificial Sequence
  chemically synthesized
ttttgtttttacatcatggcat

SEQ ID NO: 1318883 - DNA, 22 bp, Artificial Sequence
  chemically synthesized
gtgttgatcttatgccatgatg

SEQ ID NO: 1318884 - DNA, 22 bp, Artificial Sequence
  chemically synthesized
tttttgtttttacatcatggca

SEQ ID NO: 1318885 - DNA, 22 bp, Artificial Sequence
  chemically synthesized
tttttttgtttttacatcatgg

SEQ ID NO: 1318886 - DNA, 22 bp, Artificial Sequence
  chemically synthesized
ctttttttgtttttacatcatg

SEQ ID NO: 1318887 - DNA, 22 bp, Artificial Sequence
  chemically synthesized
tctttttttgtttttacatcat

SEQ ID NO: 1318888 - DNA, 22 bp, Artificial Sequence
  chemically synthesized
ttctttttttgtttttacatca

SEQ ID NO: 1318889 - DNA, 22 bp, Artificial Sequence
  chemically synthesized
atcttatgccatgatgtaaaaa

SEQ ID NO: 1318890 - DNA, 22 bp, Artificial Sequence
  chemically synthesized
tttctttttttgtttttacatc

SEQ ID NO: 1318891 - DNA, 22 bp, Artificial Sequence
  chemically synthesized
ttttctttttttgtttttacat

SEQ ID NO: 1318892 - DNA, 22 bp, Artificial Sequence
  chemically synthesized
tttttctttttttgtttttaca

SEQ ID NO: 1318893 - DNA, 22 bp, Artificial Sequence
  chemically synthesized
atgccatgatgtaaaaacaaaa

SEQ ID NO: 1318894 - DNA, 22 bp, Artificial Sequence
  chemically synthesized
tgccatgatgtaaaaacaaaaa

SEQ ID NO: 1318895 - DNA, 22 bp, Artificial Sequence
  chemically synthesized
ataactttttttctttttttgt

SEQ ID NO: 1318896 - DNA, 22 bp, Artificial Sequence
  chemically synthesized
tactaataactttttttctttt

SEQ ID NO: 1318897 - DNA, 22 bp, Artificial Sequence
  chemically synthesized
gtactaataactttttttcttt

SEQ ID NO: 1318898 - DNA, 22 bp, Artificial Sequence
  chemically synthesized
tgtactaataactttttttctt

SEQ ID NO: 1318899 - DNA, 22 bp, Artificial Sequence
  chemically synthesized
tttgtactaataactttttttc

SEQ ID NO: 1318900 - DNA, 22 bp, Artificial Sequence
  chemically synthesized
tctttgtactaataactttttt

SEQ ID NO: 1318901 - DNA, 22 bp, Artificial Sequence
  chemically synthesized
ctctttgtactaataacttttt

SEQ ID NO: 1318902 - DNA, 22 bp, Artificial Sequence
  chemically synthesized
tctctttgtactaataactttt

SEQ ID NO: 1318903 - DNA, 22 bp, Artificial Sequence
  chemically synthesized
ttctctttgtactaataacttt

SEQ ID NO: 1318904 - DNA, 22 bp, Artificial Sequence
  chemically synthesized
acatttttctctttgtactaat

SEQ ID NO: 1318905 - DNA, 22 bp, Artificial Sequence
  chemically synthesized
tacacatctgacatttttctct

SEQ ID NO: 1318906 - DNA, 22 bp, Artificial Sequence
  chemically synthesized
ttagtacaaagagaaaaatgtc

SEQ ID NO: 1318907 - DNA, 22 bp, Artificial Sequence
  chemically synthesized
tattatacacatctgacatttt

SEQ ID NO: 1318908 - DNA, 22 bp, Artificial Sequence
  chemically synthesized
gtacaaagagaaaaatgtcaga

SEQ ID NO: 1318909 - DNA, 22 bp, Artificial Sequence
  chemically synthesized
gtcaaatcagaggttatattat

SEQ ID NO: 1318910 - DNA, 22 bp, Artificial Sequence
  chemically synthesized
agtcaaatcagaggttatatta

SEQ ID NO: 1318911 - DNA, 22 bp, Artificial Sequence
  chemically synthesized
tagtcaaatcagaggttatatt

SEQ ID NO: 1318912 - DNA, 22 bp, Artificial Sequence
  chemically synthesized
tcacatattttagtcaaatcag

SEQ ID NO: 1318913 - DNA, 22 bp, Artificial Sequence
  chemically synthesized
tgaatgttatcacatattttag

SEQ ID NO: 1318914 - DNA, 22 bp, Artificial Sequence
  chemically synthesized
gtgaatgttatcacatatttta

SEQ ID NO: 1318915 - DNA, 22 bp, Artificial Sequence
  chemically synthesized
tgatttgactaaaatatgtgat

SEQ ID NO: 1318916 - DNA, 22 bp, Artificial Sequence
  chemically synthesized
gcttgtgaatgttatcacatat

SEQ ID NO: 1318917 - DNA, 22 bp, Artificial Sequence
  chemically synthesized
atttgactaaaatatgtgataa

SEQ ID NO: 1318918 - DNA, 22 bp, Artificial Sequence
  chemically synthesized
tggcttgtgaatgttatcacat

SEQ ID NO: 1318919 - DNA, 22 bp, Artificial Sequence
  chemically synthesized
gactaaaatatgtgataacatt

SEQ ID NO: 1318920 - DNA, 22 bp, Artificial Sequence
  chemically synthesized
actaaaatatgtgataacattc

SEQ ID NO: 1318921 - DNA, 22 bp, Artificial Sequence
  chemically synthesized
aattctggcttgtgaatgttat

SEQ ID NO: 1318922 - DNA, 22 bp, Artificial Sequence
  chemically synthesized
aaatatgtgataacattcacaa

SEQ ID NO: 1318923 - DNA, 22 bp, Artificial Sequence
  chemically synthesized
ctcaattctggcttgtgaatgt

SEQ ID NO: 1318924 - DNA, 22 bp, Artificial Sequence
  chemically synthesized
tactcaattctggcttgtgaat

SEQ ID NO: 1318925 - DNA, 22 bp, Artificial Sequence
  chemically synthesized
ccagctctactcaattctggct

SEQ ID NO: 1318926 - DNA, 22 bp, Artificial Sequence
  chemically synthesized
tgaactgccagctctactcaat

SEQ ID NO: 1318927 - DNA, 22 bp, Artificial Sequence
  chemically synthesized
acaagccagaattgagtagagc

SEQ ID NO: 1318928 - DNA, 22 bp, Artificial Sequence
  chemically synthesized
tgtgaactgccagctctactca

SEQ ID NO: 1318929 - DNA, 22 bp, Artificial Sequence
  chemically synthesized
ctgtgaactgccagctctactc

SEQ ID NO: 1318930 - DNA, 22 bp, Artificial Sequence
  chemically synthesized
aggccttctgtgaactgccagc

SEQ ID NO: 1318931 - DNA, 22 bp, Artificial Sequence
  chemically synthesized
caggccttctgtgaactgccag

SEQ ID NO: 1318932 - DNA, 22 bp, Artificial Sequence
  chemically synthesized
agtagagctggcagttcacaga

SEQ ID NO: 1318933 - DNA, 22 bp, Artificial Sequence
  chemically synthesized
ggcttcaggccttctgtgaact

SEQ ID NO: 1318934 - DNA, 22 bp, Artificial Sequence
  chemically synthesized
catctaggcttcaggccttctg

SEQ ID NO: 1318935 - DNA, 22 bp, Artificial Sequence
  chemically synthesized
gcagttcacagaaggcctgaag

SEQ ID NO: 1318936 - DNA, 22 bp, Artificial Sequence
  chemically synthesized
attacatctaggcttcaggcct

SEQ ID NO: 1318937 - DNA, 22 bp, Artificial Sequence
  chemically synthesized
acagaaggcctgaagcctagat

SEQ ID NO: 1318938 - DNA, 22 bp, Artificial Sequence
  chemically synthesized
tgtcattgattacatctaggct

SEQ ID NO: 1318939 - DNA, 22 bp, Artificial Sequence
  chemically synthesized
agctatgtcattgattacatct

SEQ ID NO: 1318940 - DNA, 22 bp, Artificial Sequence
  chemically synthesized
aagcctagatgtaatcaatgac

SEQ ID NO: 1318941 - DNA, 22 bp, Artificial Sequence
  chemically synthesized
tcaagttcagctatgtcattga

SEQ ID NO: 1318942 - DNA, 22 bp, Artificial Sequence
  chemically synthesized
atcaagttcagctatgtcattg

SEQ ID NO: 1318943 - DNA, 22 bp, Artificial Sequence
  chemically synthesized
gatgtaatcaatgacatagctg

SEQ ID NO: 1318944 - DNA, 22 bp, Artificial Sequence
  chemically synthesized
atttatcaagttcagctatgtc

SEQ ID NO: 1318945 - DNA, 22 bp, Artificial Sequence
  chemically synthesized
tgtaaatgtgttgatttatcaa

SEQ ID NO: 1318946 - DNA, 22 bp, Artificial Sequence
  chemically synthesized
atgtaaatgtgttgatttatca

SEQ ID NO: 1318947 - DNA, 22 bp, Artificial Sequence
  chemically synthesized
cttatgtaaatgtgttgattta

SEQ ID NO: 1318948 - DNA, 22 bp, Artificial Sequence
  chemically synthesized
ccttatgtaaatgtgttgattt

SEQ ID NO: 1318949 - DNA, 22 bp, Artificial Sequence
  chemically synthesized
tccttatgtaaatgtgttgatt

SEQ ID NO: 1318950 - DNA, 22 bp, Artificial Sequence
  chemically synthesized
aacttgataaatcaacacattt

SEQ ID NO: 1318951 - DNA, 22 bp, Artificial Sequence
  chemically synthesized
gataaatcaacacatttacata

SEQ ID NO: 1318952 - DNA, 22 bp, Artificial Sequence
  chemically synthesized
ataaatcaacacatttacataa

SEQ ID NO: 1318953 - DNA, 22 bp, Artificial Sequence
  chemically synthesized
tgataatcagggatattttcct

SEQ ID NO: 1318954 - DNA, 22 bp, Artificial Sequence
  chemically synthesized
acataaggaaaatatccctgat

SEQ ID NO: 1318955 - DNA, 22 bp, Artificial Sequence
  chemically synthesized
aatcctatgataatcagggata

SEQ ID NO: 1318956 - DNA, 22 bp, Artificial Sequence
  chemically synthesized
cataaggaaaatatccctgatt

SEQ ID NO: 1318957 - DNA, 22 bp, Artificial Sequence
  chemically synthesized
gaaggttcaatcctatgataat

SEQ ID NO: 1318958 - DNA, 22 bp, Artificial Sequence
  chemically synthesized
agaaggttcaatcctatgataa

SEQ ID NO: 1318959 - DNA, 22 bp, Artificial Sequence
  chemically synthesized
attatcataggattgaaccttc

SEQ ID NO: 1318960 - DNA, 22 bp, Artificial Sequence
  chemically synthesized
tcaacagataatttagaaggtt

SEQ ID NO: 1318961 - DNA, 22 bp, Artificial Sequence
  chemically synthesized
tcataggattgaaccttctaaa

SEQ ID NO: 1318962 - DNA, 22 bp, Artificial Sequence
  chemically synthesized
actgtcaacagataatttagaa

SEQ ID NO: 1318963 - DNA, 22 bp, Artificial Sequence
  chemically synthesized
aaccttctaaattatctgttga

SEQ ID NO: 1318964 - DNA, 22 bp, Artificial Sequence
  chemically synthesized
ctaaattatctgttgacagtca

SEQ ID NO: 1318965 - DNA, 22 bp, Artificial Sequence
  chemically synthesized
taaattatctgttgacagtcaa

SEQ ID NO: 1318966 - DNA, 22 bp, Artificial Sequence
  chemically synthesized
aattatctgttgacagtcaata

SEQ ID NO: 1318967 - DNA, 22 bp, Artificial Sequence
  chemically synthesized
tctgttgacagtcaatattctg

SEQ ID NO: 1318968 - DNA, 22 bp, Artificial Sequence
  chemically synthesized
ttgacagtcaatattctgatca

SEQ ID NO: 1318969 - DNA, 22 bp, Artificial Sequence
  chemically synthesized
acagtgaagaaaatgatcagaa

SEQ ID NO: 1318970 - DNA, 22 bp, Artificial Sequence
  chemically synthesized
acagtcaatattctgatcattt

SEQ ID NO: 1318971 - DNA, 22 bp, Artificial Sequence
  chemically synthesized
aattcacagtgaagaaaatgat

SEQ ID NO: 1318972 - DNA, 22 bp, Artificial Sequence
  chemically synthesized
tctgaattcacagtgaagaaaa

SEQ ID NO: 1318973 - DNA, 22 bp, Artificial Sequence
  chemically synthesized
tgatcattttcttcactgtgaa

SEQ ID NO: 1318974 - DNA, 22 bp, Artificial Sequence
  chemically synthesized
atcattttcttcactgtgaatt

SEQ ID NO: 1318975 - DNA, 22 bp, Artificial Sequence
  chemically synthesized
aatgatagtctgtctgaattca

SEQ ID NO: 1318976 - DNA, 22 bp, Artificial Sequence
  chemically synthesized
gaatgatagtctgtctgaattc

SEQ ID NO: 1318977 - DNA, 22 bp, Artificial Sequence
  chemically synthesized
tgaatgatagtctgtctgaatt

SEQ ID NO: 1318978 - DNA, 22 bp, Artificial Sequence
  chemically synthesized
tcttcactgtgaattcagacag

SEQ ID NO: 1318979 - DNA, 22 bp, Artificial Sequence
  chemically synthesized
cttcactgtgaattcagacaga

SEQ ID NO: 1318980 - DNA, 22 bp, Artificial Sequence
  chemically synthesized
ttcactgtgaattcagacagac

SEQ ID NO: 1318981 - DNA, 22 bp, Artificial Sequence
  chemically synthesized
cactgtgaattcagacagacta

SEQ ID NO: 1318982 - DNA, 22 bp, Artificial Sequence
  chemically synthesized
actgtgaattcagacagactat

SEQ ID NO: 1318983 - DNA, 22 bp, Artificial Sequence
  chemically synthesized
tgaattcagacagactatcatt

SEQ ID NO: 1318984 - DNA, 22 bp, Artificial Sequence
  chemically synthesized
tatagcaaacctttgaatgata

SEQ ID NO: 1318985 - DNA, 22 bp, Artificial Sequence
  chemically synthesized
tgtatagcaaacctttgaatga

SEQ ID NO: 1318986 - DNA, 22 bp, Artificial Sequence
  chemically synthesized
ctgtatagcaaacctttgaatg

SEQ ID NO: 1318987 - DNA, 22 bp, Artificial Sequence
  chemically synthesized
agacagactatcattcaaaggt

SEQ ID NO: 1318988 - DNA, 22 bp, Artificial Sequence
  chemically synthesized
tctgtatagcaaacctttgaat

SEQ ID NO: 1318989 - DNA, 22 bp, Artificial Sequence
  chemically synthesized
tttctgtatagcaaacctttga

SEQ ID NO: 1318990 - DNA, 22 bp, Artificial Sequence
  chemically synthesized
tctttctgtatagcaaaccttt

SEQ ID NO: 1318991 - DNA, 22 bp, Artificial Sequence
  chemically synthesized
ctctttctgtatagcaaacctt

SEQ ID NO: 1318992 - DNA, 22 bp, Artificial Sequence
  chemically synthesized
tctctttctgtatagcaaacct

SEQ ID NO: 1318993 - DNA, 22 bp, Artificial Sequence
  chemically synthesized
ttctctttctgtatagcaaacc

SEQ ID NO: 1318994 - DNA, 22 bp, Artificial Sequence
  chemically synthesized
tcattcaaaggtttgctataca

SEQ ID NO: 1318995 - DNA, 22 bp, Artificial Sequence
  chemically synthesized
gtatttttctctttctgtatag

SEQ ID NO: 1318996 - DNA, 22 bp, Artificial Sequence
  chemically synthesized
ggtatttttctctttctgtata

SEQ ID NO: 1318997 - DNA, 22 bp, Artificial Sequence
  chemically synthesized
tggtatttttctctttctgtat

SEQ ID NO: 1318998 - DNA, 22 bp, Artificial Sequence
  chemically synthesized
aaaggtttgctatacagaaaga

SEQ ID NO: 1318999 - DNA, 22 bp, Artificial Sequence
  chemically synthesized
gcattttggtatttttctcttt

SEQ ID NO: 1319000 - DNA, 22 bp, Artificial Sequence
  chemically synthesized
agcattttggtatttttctctt

SEQ ID NO: 1319001 - DNA, 22 bp, Artificial Sequence
  chemically synthesized
gctatacagaaagagaaaaata

SEQ ID NO: 1319002 - DNA, 22 bp, Artificial Sequence
  chemically synthesized
ctatacagaaagagaaaaatac

SEQ ID NO: 1319003 - DNA, 22 bp, Artificial Sequence
  chemically synthesized
tacagaaagagaaaaataccaa

SEQ ID NO: 1319004 - DNA, 22 bp, Artificial Sequence
  chemically synthesized
tgccttagcattttggtatttt

SEQ ID NO: 1319005 - DNA, 22 bp, Artificial Sequence
  chemically synthesized
gtgccttagcattttggtattt

SEQ ID NO: 1319006 - DNA, 22 bp, Artificial Sequence
  chemically synthesized
atatttgtgccttagcattttg

SEQ ID NO: 1319007 - DNA, 22 bp, Artificial Sequence
  chemically synthesized
gatatttgtgccttagcatttt

SEQ ID NO: 1319008 - DNA, 22 bp, Artificial Sequence
  chemically synthesized
atgggaaagagatttgatattt

SEQ ID NO: 1319009 - DNA, 22 bp, Artificial Sequence
  chemically synthesized
catgggaaagagatttgatatt

SEQ ID NO: 1319010 - DNA, 22 bp, Artificial Sequence
  chemically synthesized
tcatgggaaagagatttgatat

SEQ ID NO: 1319011 - DNA, 22 bp, Artificial Sequence
  chemically synthesized
aggcacaaatatcaaatctctt

SEQ ID NO: 1319012 - DNA, 22 bp, Artificial Sequence
  chemically synthesized
attttcatgggaaagagatttg

SEQ ID NO: 1319013 - DNA, 22 bp, Artificial Sequence
  chemically synthesized
tctgattttcatgggaaagaga

SEQ ID NO: 1319014 - DNA, 22 bp, Artificial Sequence
  chemically synthesized
aattatctgattttcatgggaa

SEQ ID NO: 1319015 - DNA, 22 bp, Artificial Sequence
  chemically synthesized
taaattatctgattttcatggg

SEQ ID NO: 1319016 - DNA, 22 bp, Artificial Sequence
  chemically synthesized
aaaaattctaaattatctgatt

SEQ ID NO: 1319017 - DNA, 22 bp, Artificial Sequence
  chemically synthesized
tttcccatgaaaatcagataat

SEQ ID NO: 1319018 - DNA, 22 bp, Artificial Sequence
  chemically synthesized
aaaaaattctaaattatctgat

SEQ ID NO: 1319019 - DNA, 22 bp, Artificial Sequence
  chemically synthesized
taaaaaattctaaattatctga

SEQ ID NO: 1319020 - DNA, 22 bp, Artificial Sequence
  chemically synthesized
tcccatgaaaatcagataattt

SEQ ID NO: 1319021 - DNA, 22 bp, Artificial Sequence
  chemically synthesized
cccatgaaaatcagataattta

SEQ ID NO: 1319022 - DNA, 22 bp, Artificial Sequence
  chemically synthesized
ccatgaaaatcagataatttag

SEQ ID NO: 1319023 - DNA, 22 bp, Artificial Sequence
  chemically synthesized
actttaaaaaattctaaattat

SEQ ID NO: 1319024 - DNA, 22 bp, Artificial Sequence
  chemically synthesized
aaggttaactttaaaaaattct

SEQ ID NO: 1319025 - DNA, 22 bp, Artificial Sequence
  chemically synthesized
caaggttaactttaaaaaattc

SEQ ID NO: 1319026 - DNA, 22 bp, Artificial Sequence
  chemically synthesized
agaattttttaaagttaacctt

SEQ ID NO: 1319027 - DNA, 22 bp, Artificial Sequence
  chemically synthesized
gaattttttaaagttaaccttg

SEQ ID NO: 1319028 - DNA, 22 bp, Artificial Sequence
  chemically synthesized
catagtcacatttcaaggttaa

SEQ ID NO: 1319029 - DNA, 22 bp, Artificial Sequence
  chemically synthesized
attacatagtcacatttcaagg

SEQ ID NO: 1319030 - DNA, 22 bp, Artificial Sequence
  chemically synthesized
tttaaagttaaccttgaaatgt

SEQ ID NO: 1319031 - DNA, 22 bp, Artificial Sequence
  chemically synthesized
aattacatagtcacatttcaag

SEQ ID NO: 1319032 - DNA, 22 bp, Artificial Sequence
  chemically synthesized
ttaaagttaaccttgaaatgtg

SEQ ID NO: 1319033 - DNA, 22 bp, Artificial Sequence
  chemically synthesized
taattacatagtcacatttcaa

SEQ ID NO: 1319034 - DNA, 22 bp, Artificial Sequence
  chemically synthesized
taaagttaaccttgaaatgtga

SEQ ID NO: 1319035 - DNA, 22 bp, Artificial Sequence
  chemically synthesized
ttaattacatagtcacatttca

SEQ ID NO: 1319036 - DNA, 22 bp, Artificial Sequence
  chemically synthesized
aaagttaaccttgaaatgtgac

SEQ ID NO: 1319037 - DNA, 22 bp, Artificial Sequence
  chemically synthesized
tttaattacatagtcacatttc

SEQ ID NO: 1319038 - DNA, 22 bp, Artificial Sequence
  chemically synthesized
aagttaaccttgaaatgtgact

SEQ ID NO: 1319039 - DNA, 22 bp, Artificial Sequence
  chemically synthesized
ttttaattacatagtcacattt

SEQ ID NO: 1319040 - DNA, 22 bp, Artificial Sequence
  chemically synthesized
tttttaattacatagtcacatt

SEQ ID NO: 1319041 - DNA, 22 bp, Artificial Sequence
  chemically synthesized
ttttttttaattacatagtcac

SEQ ID NO: 1319042 - DNA, 22 bp, Artificial Sequence
  chemically synthesized
attttttttaattacatagtca

SEQ ID NO: 1319043 - DNA, 22 bp, Artificial Sequence
  chemically synthesized
accttgaaatgtgactatgtaa

SEQ ID NO: 1319044 - DNA, 22 bp, Artificial Sequence
  chemically synthesized
tattttttttaattacatagtc

SEQ ID NO: 1319045 - DNA, 22 bp, Artificial Sequence
  chemically synthesized
gaaatgtgactatgtaattaaa

SEQ ID NO: 1319046 - DNA, 22 bp, Artificial Sequence
  chemically synthesized
aaatgtgactatgtaattaaaa

SEQ ID NO: 1319047 - DNA, 22 bp, Artificial Sequence
  chemically synthesized
tcacaaaaaagtattttatttt

SEQ ID NO: 1319048 - DNA, 22 bp, Artificial Sequence
  chemically synthesized
tgtaattaaaaaaaataaaata

SEQ ID NO: 1319049 - DNA, 22 bp, Artificial Sequence
  chemically synthesized
atcacaaaaaagtattttattt

SEQ ID NO: 1319050 - DNA, 22 bp, Artificial Sequence
  chemically synthesized
acttatcacaaaaaagtatttt

SEQ ID NO: 1319051 - DNA, 22 bp, Artificial Sequence
  chemically synthesized
gacttatcacaaaaaagtattt

SEQ ID NO: 1319052 - DNA, 22 bp, Artificial Sequence
  chemically synthesized
tgacttatcacaaaaaagtatt

SEQ ID NO: 1319053 - DNA, 22 bp, Artificial Sequence
  chemically synthesized
ttgacttatcacaaaaaagtat

SEQ ID NO: 1319054 - DNA, 22 bp, Artificial Sequence
  chemically synthesized
aaaaaaataaaatacttttttg

SEQ ID NO: 1319055 - DNA, 22 bp, Artificial Sequence
  chemically synthesized
gtttttgacttatcacaaaaaa

SEQ ID NO: 1319056 - DNA, 22 bp, Artificial Sequence
  chemically synthesized
taattagtttttgacttatcac

SEQ ID NO: 1319057 - DNA, 22 bp, Artificial Sequence
  chemically synthesized
ataattagtttttgacttatca

SEQ ID NO: 1319058 - DNA, 22 bp, Artificial Sequence
  chemically synthesized
ccttataattagtttttgactt

SEQ ID NO: 1319059 - DNA, 22 bp, Artificial Sequence
  chemically synthesized
taccttataattagtttttgac

SEQ ID NO: 1319060 - DNA, 22 bp, Artificial Sequence
  chemically synthesized
ttttgtgataagtcaaaaacta

SEQ ID NO: 1319061 - DNA, 22 bp, Artificial Sequence
  chemically synthesized
tttgtgataagtcaaaaactaa

SEQ ID NO: 1319062 - DNA, 22 bp, Artificial Sequence
  chemically synthesized
ttgtgataagtcaaaaactaat

SEQ ID NO: 1319063 - DNA, 22 bp, Artificial Sequence
  chemically synthesized
tgtgataagtcaaaaactaatt

SEQ ID NO: 1319064 - DNA, 22 bp, Artificial Sequence
  chemically synthesized
gtgataagtcaaaaactaatta

SEQ ID NO: 1319065 - DNA, 22 bp, Artificial Sequence
  chemically synthesized
tgataagtcaaaaactaattat

SEQ ID NO: 1319066 - DNA, 22 bp, Artificial Sequence
  chemically synthesized
gcaaatgttctaccttataatt

SEQ ID NO: 1319067 - DNA, 22 bp, Artificial Sequence
  chemically synthesized
tattagcaaatgttctacctta

SEQ ID NO: 1319068 - DNA, 22 bp, Artificial Sequence
  chemically synthesized
aaatctatattagcaaatgttc

SEQ ID NO: 1319069 - DNA, 22 bp, Artificial Sequence
  chemically synthesized
attataaggtagaacatttgct

SEQ ID NO: 1319070 - DNA, 22 bp, Artificial Sequence
  chemically synthesized
gaaatctatattagcaaatgtt

SEQ ID NO: 1319071 - DNA, 22 bp, Artificial Sequence
  chemically synthesized
tgaaatctatattagcaaatgt

SEQ ID NO: 1319072 - DNA, 22 bp, Artificial Sequence
  chemically synthesized
taaggtagaacatttgctaata

SEQ ID NO: 1319073 - DNA, 22 bp, Artificial Sequence
  chemically synthesized
ctttgaaatctatattagcaaa

SEQ ID NO: 1319074 - DNA, 22 bp, Artificial Sequence
  chemically synthesized
acaggtgttgctttgaaatcta

SEQ ID NO: 1319075 - DNA, 22 bp, Artificial Sequence
  chemically synthesized
ttaacaggtgttgctttgaaat

SEQ ID NO: 1319076 - DNA, 22 bp, Artificial Sequence
  chemically synthesized
gctaatatagatttcaaagcaa

SEQ ID NO: 1319077 - DNA, 22 bp, Artificial Sequence
  chemically synthesized
ctaatatagatttcaaagcaac

SEQ ID NO: 1319078 - DNA, 22 bp, Artificial Sequence
  chemically synthesized
atatagatttcaaagcaacacc

SEQ ID NO: 1319079 - DNA, 22 bp, Artificial Sequence
  chemically synthesized
caaagcaacacctgttaataac

SEQ ID NO: 1319080 - DNA, 22 bp, Artificial Sequence
  chemically synthesized
aaagcaacacctgttaataaca

SEQ ID NO: 1319081 - DNA, 22 bp, Artificial Sequence
  chemically synthesized
aaatgggaacatatgttattaa

SEQ ID NO: 1319082 - DNA, 22 bp, Artificial Sequence
  chemically synthesized
aaaatgggaacatatgttatta

SEQ ID NO: 1319083 - DNA, 22 bp, Artificial Sequence
  chemically synthesized
taaaatgggaacatatgttatt

SEQ ID NO: 1319084 - DNA, 22 bp, Artificial Sequence
  chemically synthesized
ttaaaatgggaacatatgttat

SEQ ID NO: 1319085 - DNA, 22 bp, Artificial Sequence
  chemically synthesized
cttttaaaatgggaacatatgt

SEQ ID NO: 1319086 - DNA, 22 bp, Artificial Sequence
  chemically synthesized
cctacttttaaaatgggaacat

SEQ ID NO: 1319087 - DNA, 22 bp, Artificial Sequence
  chemically synthesized
ttaataacatatgttcccattt

SEQ ID NO: 1319088 - DNA, 22 bp, Artificial Sequence
  chemically synthesized
ttacctacttttaaaatgggaa

SEQ ID NO: 1319089 - DNA, 22 bp, Artificial Sequence
  chemically synthesized
ataacatatgttcccattttaa

SEQ ID NO: 1319090 - DNA, 22 bp, Artificial Sequence
  chemically synthesized
tgttacctacttttaaaatggg

SEQ ID NO: 1319091 - DNA, 22 bp, Artificial Sequence
  chemically synthesized
ctgttacctacttttaaaatgg

SEQ ID NO: 1319092 - DNA, 22 bp, Artificial Sequence
  chemically synthesized
atttctgttacctacttttaaa

SEQ ID NO: 1319093 - DNA, 22 bp, Artificial Sequence
  chemically synthesized
ttaatttctgttacctactttt

SEQ ID NO: 1319094 - DNA, 22 bp, Artificial Sequence
  chemically synthesized
ccattttaaaagtaggtaacag

SEQ ID NO: 1319095 - DNA, 22 bp, Artificial Sequence
  chemically synthesized
tgagttattaatttctgttacc

SEQ ID NO: 1319096 - DNA, 22 bp, Artificial Sequence
  chemically synthesized
taaaagtaggtaacagaaatta

SEQ ID NO: 1319097 - DNA, 22 bp, Artificial Sequence
  chemically synthesized
aaaagtaggtaacagaaattaa

SEQ ID NO: 1319098 - DNA, 22 bp, Artificial Sequence
  chemically synthesized
aaagtaggtaacagaaattaat

SEQ ID NO: 1319099 - DNA, 22 bp, Artificial Sequence
  chemically synthesized
tataactatgagttattaattt

SEQ ID NO: 1319100 - DNA, 22 bp, Artificial Sequence
  chemically synthesized
gaaccccattatataactatga

SEQ ID NO: 1319101 - DNA, 22 bp, Artificial Sequence
  chemically synthesized
ggaaccccattatataactatg

SEQ ID NO: 1319102 - DNA, 22 bp, Artificial Sequence
  chemically synthesized
ataactcatagttatataatgg

SEQ ID NO: 1319103 - DNA, 22 bp, Artificial Sequence
  chemically synthesized
taaaatcttggaaccccattat

SEQ ID NO: 1319104 - DNA, 22 bp, Artificial Sequence
  chemically synthesized
atagttatataatggggttcca

SEQ ID NO: 1319105 - DNA, 22 bp, Artificial Sequence
  chemically synthesized
atactataaaatcttggaaccc

SEQ ID NO: 1319106 - DNA, 22 bp, Artificial Sequence
  chemically synthesized
catactataaaatcttggaacc

SEQ ID NO: 1319107 - DNA, 22 bp, Artificial Sequence
  chemically synthesized
tataatggggttccaagatttt

SEQ ID NO: 1319108 - DNA, 22 bp, Artificial Sequence
  chemically synthesized
ccacatttcatactataaaatc

SEQ ID NO: 1319109 - DNA, 22 bp, Artificial Sequence
  chemically synthesized
accacatttcatactataaaat

SEQ ID NO: 1319110 - DNA, 22 bp, Artificial Sequence
  chemically synthesized
taccacatttcatactataaaa

SEQ ID NO: 1319111 - DNA, 22 bp, Artificial Sequence
  chemically synthesized
ttaccacatttcatactataaa

SEQ ID NO: 1319112 - DNA, 22 bp, Artificial Sequence
  chemically synthesized
caagattttatagtatgaaatg

SEQ ID NO: 1319113 - DNA, 22 bp, Artificial Sequence
  chemically synthesized
tatagtatgaaatgtggtaaaa

SEQ ID NO: 1319114 - DNA, 22 bp, Artificial Sequence
  chemically synthesized
atagtatgaaatgtggtaaaag

SEQ ID NO: 1319115 - DNA, 22 bp, Artificial Sequence
  chemically synthesized
tagtatgaaatgtggtaaaagg

SEQ ID NO: 1319116 - DNA, 22 bp, Artificial Sequence
  chemically synthesized
taataaataccaaaccttttac

SEQ ID NO: 1319117 - DNA, 22 bp, Artificial Sequence
  chemically synthesized
acatcctataataaataccaaa

SEQ ID NO: 1319118 - DNA, 22 bp, Artificial Sequence
  chemically synthesized
cacatcctataataaataccaa

SEQ ID NO: 1319119 - DNA, 22 bp, Artificial Sequence
  chemically synthesized
tcacatcctataataaatacca

SEQ ID NO: 1319120 - DNA, 22 bp, Artificial Sequence
  chemically synthesized
gggggcctttcacatcctataa

SEQ ID NO: 1319121 - DNA, 22 bp, Artificial Sequence
  chemically synthesized
agggggcctttcacatcctata

SEQ ID NO: 1319122 - DNA, 22 bp, Artificial Sequence
  chemically synthesized
tagggggcctttcacatcctat

SEQ ID NO: 1319123 - DNA, 22 bp, Artificial Sequence
  chemically synthesized
ggtatttattataggatgtgaa

SEQ ID NO: 1319124 - DNA, 22 bp, Artificial Sequence
  chemically synthesized
gtatttattataggatgtgaaa

SEQ ID NO: 1319125 - DNA, 22 bp, Artificial Sequence
  chemically synthesized
attataggatgtgaaaggcccc

SEQ ID NO: 1319126 - DNA, 22 bp, Artificial Sequence
  chemically synthesized
aaagtgctttagggggcctttc

SEQ ID NO: 1319127 - DNA, 22 bp, Artificial Sequence
  chemically synthesized
ttataggatgtgaaaggccccc

SEQ ID NO: 1319128 - DNA, 22 bp, Artificial Sequence
  chemically synthesized
taggatgtgaaaggccccctaa

SEQ ID NO: 1319129 - DNA, 22 bp, Artificial Sequence
  chemically synthesized
atgaatgagtaattaaaagtgc

SEQ ID NO: 1319130 - DNA, 22 bp, Artificial Sequence
  chemically synthesized
gcaattcatgaatgagtaatta

SEQ ID NO: 1319131 - DNA, 22 bp, Artificial Sequence
  chemically synthesized
aagcacttttaattactcattc

SEQ ID NO: 1319132 - DNA, 22 bp, Artificial Sequence
  chemically synthesized
attagcaattcatgaatgagta

SEQ ID NO: 1319133 - DNA, 22 bp, Artificial Sequence
  chemically synthesized
ttaattactcattcatgaattg

SEQ ID NO: 1319134 - DNA, 22 bp, Artificial Sequence
  chemically synthesized
taattactcattcatgaattgc

SEQ ID NO: 1319135 - DNA, 22 bp, Artificial Sequence
  chemically synthesized
aattactcattcatgaattgct

SEQ ID NO: 1319136 - DNA, 22 bp, Artificial Sequence
  chemically synthesized
gaagtattaattagcaattcat

SEQ ID NO: 1319137 - DNA, 22 bp, Artificial Sequence
  chemically synthesized
attactcattcatgaattgcta

SEQ ID NO: 1319138 - DNA, 22 bp, Artificial Sequence
  chemically synthesized
ggaagtattaattagcaattca

SEQ ID NO: 1319139 - DNA, 22 bp, Artificial Sequence
  chemically synthesized
ctcattcatgaattgctaatta

SEQ ID NO: 1319140 - DNA, 22 bp, Artificial Sequence
  chemically synthesized
gtttggaagtattaattagcaa

SEQ ID NO: 1319141 - DNA, 22 bp, Artificial Sequence
  chemically synthesized
agtttggaagtattaattagca

SEQ ID NO: 1319142 - DNA, 22 bp, Artificial Sequence
  chemically synthesized
tagtttggaagtattaattagc

SEQ ID NO: 1319143 - DNA, 22 bp, Artificial Sequence
  chemically synthesized
attcatgaattgctaattaata

SEQ ID NO: 1319144 - DNA, 22 bp, Artificial Sequence
  chemically synthesized
atgaattgctaattaatacttc

SEQ ID NO: 1319145 - DNA, 22 bp, Artificial Sequence
  chemically synthesized
atattttagtttggaagtatta

SEQ ID NO: 1319146 - DNA, 22 bp, Artificial Sequence
  chemically synthesized
aatattttagtttggaagtatt

SEQ ID NO: 1319147 - DNA, 22 bp, Artificial Sequence
  chemically synthesized
ctaattaatacttccaaactaa

SEQ ID NO: 1319148 - DNA, 22 bp, Artificial Sequence
  chemically synthesized
aagtgtttaatattttagtttg

SEQ ID NO: 1319149 - DNA, 22 bp, Artificial Sequence
  chemically synthesized
attaatacttccaaactaaaat

SEQ ID NO: 1319150 - DNA, 22 bp, Artificial Sequence
  chemically synthesized
taaagtgtttaatattttagtt

SEQ ID NO: 1319151 - DNA, 22 bp, Artificial Sequence
  chemically synthesized
ctaaagtgtttaatattttagt

SEQ ID NO: 1319152 - DNA, 22 bp, Artificial Sequence
  chemically synthesized
tctaaagtgtttaatattttag

SEQ ID NO: 1319153 - DNA, 22 bp, Artificial Sequence
  chemically synthesized
atacttccaaactaaaatatta

SEQ ID NO: 1319154 - DNA, 22 bp, Artificial Sequence
  chemically synthesized
ccaaactaaaatattaaacact

SEQ ID NO: 1319155 - DNA, 22 bp, Artificial Sequence
  chemically synthesized
caaactaaaatattaaacactt

SEQ ID NO: 1319156 - DNA, 22 bp, Artificial Sequence
  chemically synthesized
ggtcagtctttctaaagtgttt

SEQ ID NO: 1319157 - DNA, 22 bp, Artificial Sequence
  chemically synthesized
aaatattaaacactttagaaag

SEQ ID NO: 1319158 - DNA, 22 bp, Artificial Sequence
  chemically synthesized
atattgggtcagtctttctaaa

SEQ ID NO: 1319159 - DNA, 22 bp, Artificial Sequence
  chemically synthesized
aatattgggtcagtctttctaa

SEQ ID NO: 1319160 - DNA, 22 bp, Artificial Sequence
  chemically synthesized
taatattgggtcagtctttcta

SEQ ID NO: 1319161 - DNA, 22 bp, Artificial Sequence
  chemically synthesized
aacactttagaaagactgaccc

SEQ ID NO: 1319162 - DNA, 22 bp, Artificial Sequence
  chemically synthesized
gattttaatattgggtcagtct

SEQ ID NO: 1319163 - DNA, 22 bp, Artificial Sequence
  chemically synthesized
ggattttaatattgggtcagtc

SEQ ID NO: 1319164 - DNA, 22 bp, Artificial Sequence
  chemically synthesized
tagaaagactgacccaatatta

SEQ ID NO: 1319165 - DNA, 22 bp, Artificial Sequence
  chemically synthesized
agaaagactgacccaatattaa

SEQ ID NO: 1319166 - DNA, 22 bp, Artificial Sequence
  chemically synthesized
acagcttggattttaatattgg

SEQ ID NO: 1319167 - DNA, 22 bp, Artificial Sequence
  chemically synthesized
gaaagactgacccaatattaaa

SEQ ID NO: 1319168 - DNA, 22 bp, Artificial Sequence
  chemically synthesized
aaatctaacagcttggatttta

SEQ ID NO: 1319169 - DNA, 22 bp, Artificial Sequence
  chemically synthesized
aaaatctaacagcttggatttt

SEQ ID NO: 1319170 - DNA, 22 bp, Artificial Sequence
  chemically synthesized
taaaatctaacagcttggattt

SEQ ID NO: 1319171 - DNA, 22 bp, Artificial Sequence
  chemically synthesized
acccaatattaaaatccaagct

SEQ ID NO: 1319172 - DNA, 22 bp, Artificial Sequence
  chemically synthesized
acatacactttaaaatctaaca

SEQ ID NO: 1319173 - DNA, 22 bp, Artificial Sequence
  chemically synthesized
aacatacactttaaaatctaac

SEQ ID NO: 1319174 - DNA, 22 bp, Artificial Sequence
  chemically synthesized
aaatccaagctgttagatttta

SEQ ID NO: 1319175 - DNA, 22 bp, Artificial Sequence
  chemically synthesized
taacatacactttaaaatctaa

SEQ ID NO: 1319176 - DNA, 22 bp, Artificial Sequence
  chemically synthesized
ttaacatacactttaaaatcta

SEQ ID NO: 1319177 - DNA, 22 bp, Artificial Sequence
  chemically synthesized
tttaacatacactttaaaatct

SEQ ID NO: 1319178 - DNA, 22 bp, Artificial Sequence
  chemically synthesized
aatattttttaacatacacttt

SEQ ID NO: 1319179 - DNA, 22 bp, Artificial Sequence
  chemically synthesized
aaatattttttaacatacactt

SEQ ID NO: 1319180 - DNA, 22 bp, Artificial Sequence
  chemically synthesized
ttagattttaaagtgtatgtta

SEQ ID NO: 1319181 - DNA, 22 bp, Artificial Sequence
  chemically synthesized
gattttaaagtgtatgttaaaa

SEQ ID NO: 1319182 - DNA, 22 bp, Artificial Sequence
  chemically synthesized
tagtttaaatattttttaacat

SEQ ID NO: 1319183 - DNA, 22 bp, Artificial Sequence
  chemically synthesized
taaagtgtatgttaaaaaatat

SEQ ID NO: 1319184 - DNA, 22 bp, Artificial Sequence
  chemically synthesized
aaagtgtatgttaaaaaatatt

SEQ ID NO: 1319185 - DNA, 22 bp, Artificial Sequence
  chemically synthesized
aagtgtatgttaaaaaatattt

SEQ ID NO: 1319186 - DNA, 22 bp, Artificial Sequence
  chemically synthesized
agagatattatagtttaaatat

SEQ ID NO: 1319187 - DNA, 22 bp, Artificial Sequence
  chemically synthesized
aaaaatatttaaactataatat

SEQ ID NO: 1319188 - DNA, 22 bp, Artificial Sequence
  chemically synthesized
tgtgtatatatacactaagaga

SEQ ID NO: 1319189 - DNA, 22 bp, Artificial Sequence
  chemically synthesized
aaactataatatctcttagtgt

SEQ ID NO: 1319190 - DNA, 22 bp, Artificial Sequence
  chemically synthesized
gtgtgtatatatacactaagag

SEQ ID NO: 1319191 - DNA, 22 bp, Artificial Sequence
  chemically synthesized
aactataatatctcttagtgta

SEQ ID NO: 1319192 - DNA, 22 bp, Artificial Sequence
  chemically synthesized
taatatctcttagtgtatatat

SEQ ID NO: 1319193 - DNA, 22 bp, Artificial Sequence
  chemically synthesized
ttagtgtatatatacacacaaa

SEQ ID NO: 1319194 - DNA, 22 bp, Artificial Sequence
  chemically synthesized
agtgtatatatacacacaaata

SEQ ID NO: 1319195 - DNA, 22 bp, Artificial Sequence
  chemically synthesized
gtgtatatatacacacaaatat

SEQ ID NO: 1319196 - DNA, 22 bp, Artificial Sequence
  chemically synthesized
ttttcatatatatgtttatata

SEQ ID NO: 1319197 - DNA, 22 bp, Artificial Sequence
  chemically synthesized
tcatatatatgtttatatatat

SEQ ID NO: 1319198 - DNA, 22 bp, Artificial Sequence
  chemically synthesized
catatatatgtttatatatatt

SEQ ID NO: 1319199 - DNA, 22 bp, Artificial Sequence
  chemically synthesized
atatatatgtttatatatattt

SEQ ID NO: 1319200 - DNA, 22 bp, Artificial Sequence
  chemically synthesized
tatacatatataaaatatatat

SEQ ID NO: 1319201 - DNA, 22 bp, Artificial Sequence
  chemically synthesized
atatatattttatatatgtata

SEQ ID NO: 1319202 - DNA, 22 bp, Artificial Sequence
  chemically synthesized
tatatattttatatatgtatat

SEQ ID NO: 1319203 - DNA, 22 bp, Artificial Sequence
  chemically synthesized
tgtatatatattatatacatat

SEQ ID NO: 1319204 - DNA, 22 bp, Artificial Sequence
  chemically synthesized
tatgtatatatattatatacat

SEQ ID NO: 1319205 - DNA, 22 bp, Artificial Sequence
  chemically synthesized
tctatgtatatatattatatac

SEQ ID NO: 1319206 - DNA, 22 bp, Artificial Sequence
  chemically synthesized
tatatatgtatataatatatat

SEQ ID NO: 1319207 - DNA, 22 bp, Artificial Sequence
  chemically synthesized
atatatgtatataatatatata

SEQ ID NO: 1319208 - DNA, 22 bp, Artificial Sequence
  chemically synthesized
tcgctctctatgtatatatatt

SEQ ID NO: 1319209 - DNA, 22 bp, Artificial Sequence
  chemically synthesized
tatatgtatataatatatatac

SEQ ID NO: 1319210 - DNA, 22 bp, Artificial Sequence
  chemically synthesized
tatcgctctctatgtatatata

SEQ ID NO: 1319211 - DNA, 22 bp, Artificial Sequence
  chemically synthesized
cctctatcgctctctatgtata

SEQ ID NO: 1319212 - DNA, 22 bp, Artificial Sequence
  chemically synthesized
tctccctctatcgctctctatg

SEQ ID NO: 1319213 - DNA, 22 bp, Artificial Sequence
  chemically synthesized
atctccctctatcgctctctat

SEQ ID NO: 1319214 - DNA, 22 bp, Artificial Sequence
  chemically synthesized
tatctccctctatcgctctcta

SEQ ID NO: 1319215 - DNA, 22 bp, Artificial Sequence
  chemically synthesized
ctttatctccctctatcgctct

SEQ ID NO: 1319216 - DNA, 22 bp, Artificial Sequence
  chemically synthesized
cctttatctccctctatcgctc

SEQ ID NO: 1319217 - DNA, 22 bp, Artificial Sequence
  chemically synthesized
gacaaacaaaacccccttcctt

SEQ ID NO: 1319218 - DNA, 22 bp, Artificial Sequence
  chemically synthesized
aaatatattggacaaacaaaac

SEQ ID NO: 1319219 - DNA, 22 bp, Artificial Sequence
  chemically synthesized
tgtttgtccaatatattttagc

SEQ ID NO: 1319220 - DNA, 22 bp, Artificial Sequence
  chemically synthesized
gtttgtccaatatattttagct

SEQ ID NO: 1319221 - DNA, 22 bp, Artificial Sequence
  chemically synthesized
tttgtccaatatattttagctg

SEQ ID NO: 1319222 - DNA, 22 bp, Artificial Sequence
  chemically synthesized
gtccaatatattttagctgacc

SEQ ID NO: 1319223 - DNA, 22 bp, Artificial Sequence
  chemically synthesized
tccaatatattttagctgacca

SEQ ID NO: 1319224 - DNA, 22 bp, Artificial Sequence
  chemically synthesized
tagctgaccacatcattttatg

SEQ ID NO: 1319225 - DNA, 22 bp, Artificial Sequence
  chemically synthesized
aataaaaaaatacataaaatga

SEQ ID NO: 1319226 - DNA, 22 bp, Artificial Sequence
  chemically synthesized
agctgaccacatcattttatgt

SEQ ID NO: 1319227 - DNA, 22 bp, Artificial Sequence
  chemically synthesized
aaataaaaaaatacataaaatg

SEQ ID NO: 1319228 - DNA, 22 bp, Artificial Sequence
  chemically synthesized
gctgaccacatcattttatgta

SEQ ID NO: 1319229 - DNA, 22 bp, Artificial Sequence
  chemically synthesized
taaataaaaaaatacataaaat

SEQ ID NO: 1319230 - DNA, 22 bp, Artificial Sequence
  chemically synthesized
accacatcattttatgtatttt

SEQ ID NO: 1319231 - DNA, 22 bp, Artificial Sequence
  chemically synthesized
gccctttaaataaaaaaataca

SEQ ID NO: 1319232 - DNA, 22 bp, Artificial Sequence
  chemically synthesized
ggccctttaaataaaaaaatac

SEQ ID NO: 1319233 - DNA, 22 bp, Artificial Sequence
  chemically synthesized
cttggccctttaaataaaaaaa

SEQ ID NO: 1319234 - DNA, 22 bp, Artificial Sequence
  chemically synthesized
ttccttggccctttaaataaaa

SEQ ID NO: 1319235 - DNA, 22 bp, Artificial Sequence
  chemically synthesized
attccttggccctttaaataaa

SEQ ID NO: 1319236 - DNA, 22 bp, Artificial Sequence
  chemically synthesized
tattccttggccctttaaataa

SEQ ID NO: 1319237 - DNA, 22 bp, Artificial Sequence
  chemically synthesized
tatgtatttttttatttaaagg

SEQ ID NO: 1319238 - DNA, 22 bp, Artificial Sequence
  chemically synthesized
atgtatttttttatttaaaggg

SEQ ID NO: 1319239 - DNA, 22 bp, Artificial Sequence
  chemically synthesized
tgtatttttttatttaaagggc

SEQ ID NO: 1319240 - DNA, 22 bp, Artificial Sequence
  chemically synthesized
ttttattccttggccctttaaa

SEQ ID NO: 1319241 - DNA, 22 bp, Artificial Sequence
  chemically synthesized
attttattccttggccctttaa

SEQ ID NO: 1319242 - DNA, 22 bp, Artificial Sequence
  chemically synthesized
ttattttattccttggcccttt

SEQ ID NO: 1319243 - DNA, 22 bp, Artificial Sequence
  chemically synthesized
ttttatttaaagggccaaggaa

SEQ ID NO: 1319244 - DNA, 22 bp, Artificial Sequence
  chemically synthesized
tttatttaaagggccaaggaat

SEQ ID NO: 1319245 - DNA, 22 bp, Artificial Sequence
  chemically synthesized
ttatttaaagggccaaggaata

SEQ ID NO: 1319246 - DNA, 22 bp, Artificial Sequence
  chemically synthesized
gcattcttattttattccttgg

SEQ ID NO: 1319247 - DNA, 22 bp, Artificial Sequence
  chemically synthesized
tatttaaagggccaaggaataa

SEQ ID NO: 1319248 - DNA, 22 bp, Artificial Sequence
  chemically synthesized
cgcattcttattttattccttg

SEQ ID NO: 1319249 - DNA, 22 bp, Artificial Sequence
  chemically synthesized
atttaaagggccaaggaataaa

SEQ ID NO: 1319250 - DNA, 22 bp, Artificial Sequence
  chemically synthesized
tttaaagggccaaggaataaaa

SEQ ID NO: 1319251 - DNA, 22 bp, Artificial Sequence
  chemically synthesized
ccttcgcattcttattttattc

SEQ ID NO: 1319252 - DNA, 22 bp, Artificial Sequence
  chemically synthesized
aaagggccaaggaataaaataa

SEQ ID NO: 1319253 - DNA, 22 bp, Artificial Sequence
  chemically synthesized
aagggccaaggaataaaataag

SEQ ID NO: 1319254 - DNA, 22 bp, Artificial Sequence
  chemically synthesized
taccttcgcattcttattttat

SEQ ID NO: 1319255 - DNA, 22 bp, Artificial Sequence
  chemically synthesized
cattctaccttcgcattcttat

SEQ ID NO: 1319256 - DNA, 22 bp, Artificial Sequence
  chemically synthesized
aggataaagtgctgcattctac

SEQ ID NO: 1319257 - DNA, 22 bp, Artificial Sequence
  chemically synthesized
attgaggataaagtgctgcatt

SEQ ID NO: 1319258 - DNA, 22 bp, Artificial Sequence
  chemically synthesized
taattgaggataaagtgctgca

SEQ ID NO: 1319259 - DNA, 22 bp, Artificial Sequence
  chemically synthesized
ctaattgaggataaagtgctgc

SEQ ID NO: 1319260 - DNA, 22 bp, Artificial Sequence
  chemically synthesized
tctaattgaggataaagtgctg

SEQ ID NO: 1319261 - DNA, 22 bp, Artificial Sequence
  chemically synthesized
ttctaattgaggataaagtgct

SEQ ID NO: 1319262 - DNA, 22 bp, Artificial Sequence
  chemically synthesized
catttttctaattgaggataaa

SEQ ID NO: 1319263 - DNA, 22 bp, Artificial Sequence
  chemically synthesized
tgcatttttctaattgaggata

SEQ ID NO: 1319264 - DNA, 22 bp, Artificial Sequence
  chemically synthesized
ctctgcatttttctaattgagg

SEQ ID NO: 1319265 - DNA, 22 bp, Artificial Sequence
  chemically synthesized
aattcctctgcatttttctaat

SEQ ID NO: 1319266 - DNA, 22 bp, Artificial Sequence
  chemically synthesized
aaattcctctgcatttttctaa

SEQ ID NO: 1319267 - DNA, 22 bp, Artificial Sequence
  chemically synthesized
tatcctcaattagaaaaatgca

SEQ ID NO: 1319268 - DNA, 22 bp, Artificial Sequence
  chemically synthesized
tttaaattcctctgcatttttc

SEQ ID NO: 1319269 - DNA, 22 bp, Artificial Sequence
  chemically synthesized
atcctcaattagaaaaatgcag

SEQ ID NO: 1319270 - DNA, 22 bp, Artificial Sequence
  chemically synthesized
tcctcaattagaaaaatgcaga

SEQ ID NO: 1319271 - DNA, 22 bp, Artificial Sequence
  chemically synthesized
attatttaaattcctctgcatt

SEQ ID NO: 1319272 - DNA, 22 bp, Artificial Sequence
  chemically synthesized
aattagaaaaatgcagaggaat

SEQ ID NO: 1319273 - DNA, 22 bp, Artificial Sequence
  chemically synthesized
gaaaaatgcagaggaatttaaa

SEQ ID NO: 1319274 - DNA, 22 bp, Artificial Sequence
  chemically synthesized
tggaaaagtctaattatttaaa

SEQ ID NO: 1319275 - DNA, 22 bp, Artificial Sequence
  chemically synthesized
gtggaaaagtctaattatttaa

SEQ ID NO: 1319276 - DNA, 22 bp, Artificial Sequence
  chemically synthesized
aaataattagacttttccacaa

SEQ ID NO: 1319277 - DNA, 22 bp, Artificial Sequence
  chemically synthesized
aataattagacttttccacaaa

SEQ ID NO: 1319278 - DNA, 22 bp, Artificial Sequence
  chemically synthesized
gcaacaaacataacatttgtgg

SEQ ID NO: 1319279 - DNA, 22 bp, Artificial Sequence
  chemically synthesized
ctggcaacaaacataacatttg

SEQ ID NO: 1319280 - DNA, 22 bp, Artificial Sequence
  chemically synthesized
cctggcaacaaacataacattt

SEQ ID NO: 1319281 - DNA, 22 bp, Artificial Sequence
  chemically synthesized
gacttttccacaaatgttatgt

SEQ ID NO: 1319282 - DNA, 22 bp, Artificial Sequence
  chemically synthesized
tgtttcctggcaacaaacataa

SEQ ID NO: 1319283 - DNA, 22 bp, Artificial Sequence
  chemically synthesized
ttccacaaatgttatgtttgtt

SEQ ID NO: 1319284 - DNA, 22 bp, Artificial Sequence
  chemically synthesized
tccacaaatgttatgtttgttg

SEQ ID NO: 1319285 - DNA, 22 bp, Artificial Sequence
  chemically synthesized
ccacaaatgttatgtttgttgc

SEQ ID NO: 1319286 - DNA, 22 bp, Artificial Sequence
  chemically synthesized
cacaaatgttatgtttgttgcc

SEQ ID NO: 1319287 - DNA, 22 bp, Artificial Sequence
  chemically synthesized
gaagcacctgtgtttcctggca

SEQ ID NO: 1319288 - DNA, 22 bp, Artificial Sequence
  chemically synthesized
agaagcacctgtgtttcctggc

SEQ ID NO: 1319289 - DNA, 22 bp, Artificial Sequence
  chemically synthesized
tgtttgttgccaggaaacacag

SEQ ID NO: 1319290 - DNA, 22 bp, Artificial Sequence
  chemically synthesized
gttgccaggaaacacaggtgct

SEQ ID NO: 1319291 - DNA, 22 bp, Artificial Sequence
  chemically synthesized
ttgccaggaaacacaggtgctt

SEQ ID NO: 1319292 - DNA, 22 bp, Artificial Sequence
  chemically synthesized
ccaggaaacacaggtgcttcta

SEQ ID NO: 1319293 - DNA, 22 bp, Artificial Sequence
  chemically synthesized
aagcagtgagtttagaagcacc

SEQ ID NO: 1319294 - DNA, 22 bp, Artificial Sequence
  chemically synthesized
catggcctaaagcagtgagttt

SEQ ID NO: 1319295 - DNA, 22 bp, Artificial Sequence
  chemically synthesized
gcatggcctaaagcagtgagtt

SEQ ID NO: 1319296 - DNA, 22 bp, Artificial Sequence
  chemically synthesized
tgcatggcctaaagcagtgagt

SEQ ID NO: 1319297 - DNA, 22 bp, Artificial Sequence
  chemically synthesized
aattttgcatggcctaaagcag

SEQ ID NO: 1319298 - DNA, 22 bp, Artificial Sequence
  chemically synthesized
ctaaactcactgctttaggcca

SEQ ID NO: 1319299 - DNA, 22 bp, Artificial Sequence
  chemically synthesized
ctaaattttgcatggcctaaag

SEQ ID NO: 1319300 - DNA, 22 bp, Artificial Sequence
  chemically synthesized
taaactcactgctttaggccat

SEQ ID NO: 1319301 - DNA, 22 bp, Artificial Sequence
  chemically synthesized
aactcactgctttaggccatgc

SEQ ID NO: 1319302 - DNA, 22 bp, Artificial Sequence
  chemically synthesized
tctcctaaattttgcatggcct

SEQ ID NO: 1319303 - DNA, 22 bp, Artificial Sequence
  chemically synthesized
actgctttaggccatgcaaaat

SEQ ID NO: 1319304 - DNA, 22 bp, Artificial Sequence
  chemically synthesized
gcctgtctcctaaattttgcat

SEQ ID NO: 1319305 - DNA, 22 bp, Artificial Sequence
  chemically synthesized
ctttaggccatgcaaaatttag

SEQ ID NO: 1319306 - DNA, 22 bp, Artificial Sequence
  chemically synthesized
taggccatgcaaaatttaggag

SEQ ID NO: 1319307 - DNA, 22 bp, Artificial Sequence
  chemically synthesized
aggccatgcaaaatttaggaga

SEQ ID NO: 1319308 - DNA, 22 bp, Artificial Sequence
  chemically synthesized
ggccatgcaaaatttaggagac

SEQ ID NO: 1319309 - DNA, 22 bp, Artificial Sequence
  chemically synthesized
gaggaggggaattggcctgtct

SEQ ID NO: 1319310 - DNA, 22 bp, Artificial Sequence
  chemically synthesized
cctagaggaggggaattggcct

SEQ ID NO: 1319311 - DNA, 22 bp, Artificial Sequence
  chemically synthesized
ctccctagaggaggggaattgg

SEQ ID NO: 1319312 - DNA, 22 bp, Artificial Sequence
  chemically synthesized
cctccctagaggaggggaattg

SEQ ID NO: 1319313 - DNA, 22 bp, Artificial Sequence
  chemically synthesized
aggagacaggccaattcccctc

SEQ ID NO: 1319314 - DNA, 22 bp, Artificial Sequence
  chemically synthesized
ggagacaggccaattcccctcc

SEQ ID NO: 1319315 - DNA, 22 bp, Artificial Sequence
  chemically synthesized
acaagtttcctccctagaggag

SEQ ID NO: 1319316 - DNA, 22 bp, Artificial Sequence
  chemically synthesized
actgacaagtttcctccctaga

SEQ ID NO: 1319317 - DNA, 22 bp, Artificial Sequence
  chemically synthesized
ctgactgacaagtttcctccct

SEQ ID NO: 1319318 - DNA, 22 bp, Artificial Sequence
  chemically synthesized
cctgactgacaagtttcctccc

SEQ ID NO: 1319319 - DNA, 22 bp, Artificial Sequence
  chemically synthesized
tcctgactgacaagtttcctcc

SEQ ID NO: 1319320 - DNA, 22 bp, Artificial Sequence
  chemically synthesized
ccctcctctagggaggaaactt

SEQ ID NO: 1319321 - DNA, 22 bp, Artificial Sequence
  chemically synthesized
agctttcctgactgacaagttt

SEQ ID NO: 1319322 - DNA, 22 bp, Artificial Sequence
  chemically synthesized
ctctagggaggaaacttgtcag

SEQ ID NO: 1319323 - DNA, 22 bp, Artificial Sequence
  chemically synthesized
gagctttcctgactgacaagtt

SEQ ID NO: 1319324 - DNA, 22 bp, Artificial Sequence
  chemically synthesized
ttgagctttcctgactgacaag

SEQ ID NO: 1319325 - DNA, 22 bp, Artificial Sequence
  chemically synthesized
tagggaggaaacttgtcagtca

SEQ ID NO: 1319326 - DNA, 22 bp, Artificial Sequence
  chemically synthesized
gggaggaaacttgtcagtcagg

SEQ ID NO: 1319327 - DNA, 22 bp, Artificial Sequence
  chemically synthesized
atctcttgagctttcctgactg

SEQ ID NO: 1319328 - DNA, 22 bp, Artificial Sequence
  chemically synthesized
gatgctaatctcttgagctttc

SEQ ID NO: 1319329 - DNA, 22 bp, Artificial Sequence
  chemically synthesized
ggatgctaatctcttgagcttt

SEQ ID NO: 1319330 - DNA, 22 bp, Artificial Sequence
  chemically synthesized
tggatgctaatctcttgagctt

SEQ ID NO: 1319331 - DNA, 22 bp, Artificial Sequence
  chemically synthesized
gtcagtcaggaaagctcaagag

SEQ ID NO: 1319332 - DNA, 22 bp, Artificial Sequence
  chemically synthesized
tcagtcaggaaagctcaagaga

SEQ ID NO: 1319333 - DNA, 22 bp, Artificial Sequence
  chemically synthesized
gctttggatgctaatctcttga

SEQ ID NO: 1319334 - DNA, 22 bp, Artificial Sequence
  chemically synthesized
aagagattagcatccaaagcca

SEQ ID NO: 1319335 - DNA, 22 bp, Artificial Sequence
  chemically synthesized
accagccccagaagtaaactgg

SEQ ID NO: 1319336 - DNA, 22 bp, Artificial Sequence
  chemically synthesized
aaccagccccagaagtaaactg

SEQ ID NO: 1319337 - DNA, 22 bp, Artificial Sequence
  chemically synthesized
gcatccaaagccagtttacttc

SEQ ID NO: 1319338 - DNA, 22 bp, Artificial Sequence
  chemically synthesized
taaccagccccagaagtaaact

SEQ ID NO: 1319339 - DNA, 22 bp, Artificial Sequence
  chemically synthesized
ttaaccagccccagaagtaaac

SEQ ID NO: 1319340 - DNA, 22 bp, Artificial Sequence
  chemically synthesized
aaagcttttaaccagccccaga

SEQ ID NO: 1319341 - DNA, 22 bp, Artificial Sequence
  chemically synthesized
tgaaagcttttaaccagcccca

SEQ ID NO: 1319342 - DNA, 22 bp, Artificial Sequence
  chemically synthesized
acttctggggctggttaaaagc

SEQ ID NO: 1319343 - DNA, 22 bp, Artificial Sequence
  chemically synthesized
cttctggggctggttaaaagct

SEQ ID NO: 1319344 - DNA, 22 bp, Artificial Sequence
  chemically synthesized
ctggggctggttaaaagctttc

SEQ ID NO: 1319345 - DNA, 22 bp, Artificial Sequence
  chemically synthesized
tggggctggttaaaagctttca

SEQ ID NO: 1319346 - DNA, 22 bp, Artificial Sequence
  chemically synthesized
cacaggaatcctctgaaagctt

SEQ ID NO: 1319347 - DNA, 22 bp, Artificial Sequence
  chemically synthesized
gggctggttaaaagctttcaga

SEQ ID NO: 1319348 - DNA, 22 bp, Artificial Sequence
  chemically synthesized
gttaaaagctttcagaggattc

SEQ ID NO: 1319349 - DNA, 22 bp, Artificial Sequence
  chemically synthesized
gcaattacacaggaatcctctg

SEQ ID NO: 1319350 - DNA, 22 bp, Artificial Sequence
  chemically synthesized
agcaattacacaggaatcctct

SEQ ID NO: 1319351 - DNA, 22 bp, Artificial Sequence
  chemically synthesized
aaagctttcagaggattcctgt

SEQ ID NO: 1319352 - DNA, 22 bp, Artificial Sequence
  chemically synthesized
caatatttagcaattacacagg

SEQ ID NO: 1319353 - DNA, 22 bp, Artificial Sequence
  chemically synthesized
tcagaggattcctgtgtaattg

SEQ ID NO: 1319354 - DNA, 22 bp, Artificial Sequence
  chemically synthesized
cagaggattcctgtgtaattgc

SEQ ID NO: 1319355 - DNA, 22 bp, Artificial Sequence
  chemically synthesized
agaggattcctgtgtaattgct

SEQ ID NO: 1319356 - DNA, 22 bp, Artificial Sequence
  chemically synthesized
gcctacaatatttagcaattac

SEQ ID NO: 1319357 - DNA, 22 bp, Artificial Sequence
  chemically synthesized
agcctacaatatttagcaatta

SEQ ID NO: 1319358 - DNA, 22 bp, Artificial Sequence
  chemically synthesized
atttagcctacaatatttagca

SEQ ID NO: 1319359 - DNA, 22 bp, Artificial Sequence
  chemically synthesized
aatttagcctacaatatttagc

SEQ ID NO: 1319360 - DNA, 22 bp, Artificial Sequence
  chemically synthesized
taatttagcctacaatatttag

SEQ ID NO: 1319361 - DNA, 22 bp, Artificial Sequence
  chemically synthesized
ctgtgtaattgctaaatattgt

SEQ ID NO: 1319362 - DNA, 22 bp, Artificial Sequence
  chemically synthesized
tgtaattgctaaatattgtagg

SEQ ID NO: 1319363 - DNA, 22 bp, Artificial Sequence
  chemically synthesized
aataacaactttaatttagcct

SEQ ID NO: 1319364 - DNA, 22 bp, Artificial Sequence
  chemically synthesized
ctaaatattgtaggctaaatta

SEQ ID NO: 1319365 - DNA, 22 bp, Artificial Sequence
  chemically synthesized
aaataacaactttaatttagcc

SEQ ID NO: 1319366 - DNA, 22 bp, Artificial Sequence
  chemically synthesized
taaataacaactttaatttagc

SEQ ID NO: 1319367 - DNA, 22 bp, Artificial Sequence
  chemically synthesized
aatattgtaggctaaattaaag

SEQ ID NO: 1319368 - DNA, 22 bp, Artificial Sequence
  chemically synthesized
cattttaaataacaactttaat

SEQ ID NO: 1319369 - DNA, 22 bp, Artificial Sequence
  chemically synthesized
acattttaaataacaactttaa

SEQ ID NO: 1319370 - DNA, 22 bp, Artificial Sequence
  chemically synthesized
taggctaaattaaagttgttat

SEQ ID NO: 1319371 - DNA, 22 bp, Artificial Sequence
  chemically synthesized
atgtttacattttaaataacaa

SEQ ID NO: 1319372 - DNA, 22 bp, Artificial Sequence
  chemically synthesized
ttgatgtttacattttaaataa

SEQ ID NO: 1319373 - DNA, 22 bp, Artificial Sequence
  chemically synthesized
aattaaagttgttatttaaaat

SEQ ID NO: 1319374 - DNA, 22 bp, Artificial Sequence
  chemically synthesized
ctattgatgtttacattttaaa

SEQ ID NO: 1319375 - DNA, 22 bp, Artificial Sequence
  chemically synthesized
aagttgttatttaaaatgtaaa

SEQ ID NO: 1319376 - DNA, 22 bp, Artificial Sequence
  chemically synthesized
gttgctattgatgtttacattt

SEQ ID NO: 1319377 - DNA, 22 bp, Artificial Sequence
  chemically synthesized
ttatttaaaatgtaaacatcaa

SEQ ID NO: 1319378 - DNA, 22 bp, Artificial Sequence
  chemically synthesized
tttaaaatgtaaacatcaatag

SEQ ID NO: 1319379 - DNA, 22 bp, Artificial Sequence
  chemically synthesized
aaaatgtaaacatcaatagcaa

SEQ ID NO: 1319380 - DNA, 22 bp, Artificial Sequence
  chemically synthesized
aaatgtaaacatcaatagcaac

SEQ ID NO: 1319381 - DNA, 22 bp, Artificial Sequence
  chemically synthesized
taccaagagcaagaatcaaatg

SEQ ID NO: 1319382 - DNA, 22 bp, Artificial Sequence
  chemically synthesized
ataccaagagcaagaatcaaat

SEQ ID NO: 1319383 - DNA, 22 bp, Artificial Sequence
  chemically synthesized
tataccaagagcaagaatcaaa

SEQ ID NO: 1319384 - DNA, 22 bp, Artificial Sequence
  chemically synthesized
ttataccaagagcaagaatcaa

SEQ ID NO: 1319385 - DNA, 22 bp, Artificial Sequence
  chemically synthesized
tttataccaagagcaagaatca

SEQ ID NO: 1319386 - DNA, 22 bp, Artificial Sequence
  chemically synthesized
ttttataccaagagcaagaatc

SEQ ID NO: 1319387 - DNA, 22 bp, Artificial Sequence
  chemically synthesized
cttttttataccaagagcaaga

SEQ ID NO: 1319388 - DNA, 22 bp, Artificial Sequence
  chemically synthesized
acatttgattcttgctcttggt

SEQ ID NO: 1319389 - DNA, 22 bp, Artificial Sequence
  chemically synthesized
ttgcttttttataccaagagca

SEQ ID NO: 1319390 - DNA, 22 bp, Artificial Sequence
  chemically synthesized
attgcttttttataccaagagc

SEQ ID NO: 1319391 - DNA, 22 bp, Artificial Sequence
  chemically synthesized
tattgcttttttataccaagag

SEQ ID NO: 1319392 - DNA, 22 bp, Artificial Sequence
  chemically synthesized
gattcttgctcttggtataaaa

SEQ ID NO: 1319393 - DNA, 22 bp, Artificial Sequence
  chemically synthesized
attcttgctcttggtataaaaa

SEQ ID NO: 1319394 - DNA, 22 bp, Artificial Sequence
  chemically synthesized
ataattttattgcttttttata

SEQ ID NO: 1319395 - DNA, 22 bp, Artificial Sequence
  chemically synthesized
ttgctcttggtataaaaaagca

SEQ ID NO: 1319396 - DNA, 22 bp, Artificial Sequence
  chemically synthesized
gctcttggtataaaaaagcaat

SEQ ID NO: 1319397 - DNA, 22 bp, Artificial Sequence
  chemically synthesized
ctcttggtataaaaaagcaata

SEQ ID NO: 1319398 - DNA, 22 bp, Artificial Sequence
  chemically synthesized
ttggtataaaaaagcaataaaa

SEQ ID NO: 1319399 - DNA, 22 bp, Artificial Sequence
  chemically synthesized
ggtataaaaaagcaataaaatt

SEQ ID NO: 1319400 - DNA, 22 bp, Artificial Sequence
  chemically synthesized
caaggtgttaataattttattg

SEQ ID NO: 1319401 - DNA, 22 bp, Artificial Sequence
  chemically synthesized
gtataaaaaagcaataaaatta

SEQ ID NO: 1319402 - DNA, 22 bp, Artificial Sequence
  chemically synthesized
ccaaggtgttaataattttatt

SEQ ID NO: 1319403 - DNA, 22 bp, Artificial Sequence
  chemically synthesized
tccaaggtgttaataattttat

SEQ ID NO: 1319404 - DNA, 22 bp, Artificial Sequence
  chemically synthesized
aaatctttccaaggtgttaata

SEQ ID NO: 1319405 - DNA, 22 bp, Artificial Sequence
  chemically synthesized
caaatctttccaaggtgttaat

SEQ ID NO: 1319406 - DNA, 22 bp, Artificial Sequence
  chemically synthesized
tcaaatctttccaaggtgttaa

SEQ ID NO: 1319407 - DNA, 22 bp, Artificial Sequence
  chemically synthesized
ccaatgaattttcaaatctttc

SEQ ID NO: 1319408 - DNA, 22 bp, Artificial Sequence
  chemically synthesized
ttaacaccttggaaagatttga

SEQ ID NO: 1319409 - DNA, 22 bp, Artificial Sequence
  chemically synthesized
acaccttggaaagatttgaaaa

SEQ ID NO: 1319410 - DNA, 22 bp, Artificial Sequence
  chemically synthesized
atgctaccaatgaattttcaaa

SEQ ID NO: 1319411 - DNA, 22 bp, Artificial Sequence
  chemically synthesized
aatgctaccaatgaattttcaa

SEQ ID NO: 1319412 - DNA, 22 bp, Artificial Sequence
  chemically synthesized
cttaatgctaccaatgaatttt

SEQ ID NO: 1319413 - DNA, 22 bp, Artificial Sequence
  chemically synthesized
ggaaagatttgaaaattcattg

SEQ ID NO: 1319414 - DNA, 22 bp, Artificial Sequence
  chemically synthesized
gcttaatgctaccaatgaattt

SEQ ID NO: 1319415 - DNA, 22 bp, Artificial Sequence
  chemically synthesized
gaaagatttgaaaattcattgg

SEQ ID NO: 1319416 - DNA, 22 bp, Artificial Sequence
  chemically synthesized
cttgcttaatgctaccaatgaa

SEQ ID NO: 1319417 - DNA, 22 bp, Artificial Sequence
  chemically synthesized
acttgcttaatgctaccaatga

SEQ ID NO: 1319418 - DNA, 22 bp, Artificial Sequence
  chemically synthesized
gaaaattcattggtagcattaa

SEQ ID NO: 1319419 - DNA, 22 bp, Artificial Sequence
  chemically synthesized
aaaattcattggtagcattaag

SEQ ID NO: 1319420 - DNA, 22 bp, Artificial Sequence
  chemically synthesized
gatatttacttgcttaatgcta

SEQ ID NO: 1319421 - DNA, 22 bp, Artificial Sequence
  chemically synthesized
attggtagcattaagcaagtaa

SEQ ID NO: 1319422 - DNA, 22 bp, Artificial Sequence
  chemically synthesized
aatgctagatatttacttgctt

SEQ ID NO: 1319423 - DNA, 22 bp, Artificial Sequence
  chemically synthesized
gtagcattaagcaagtaaatat

SEQ ID NO: 1319424 - DNA, 22 bp, Artificial Sequence
  chemically synthesized
agcaagtaaatatctagcattt

SEQ ID NO: 1319425 - DNA, 22 bp, Artificial Sequence
  chemically synthesized
gccatatgaactaaatgctaga

SEQ ID NO: 1319426 - DNA, 22 bp, Artificial Sequence
  chemically synthesized
gtctcgccatatgaactaaatg

SEQ ID NO: 1319427 - DNA, 22 bp, Artificial Sequence
  chemically synthesized
acaattggtctcgccatatgaa

SEQ ID NO: 1319428 - DNA, 22 bp, Artificial Sequence
  chemically synthesized
tcacaattggtctcgccatatg

SEQ ID NO: 1319429 - DNA, 22 bp, Artificial Sequence
  chemically synthesized
gcatttagttcatatggcgaga

SEQ ID NO: 1319430 - DNA, 22 bp, Artificial Sequence
  chemically synthesized
agttctcacaattggtctcgcc

SEQ ID NO: 1319431 - DNA, 22 bp, Artificial Sequence
  chemically synthesized
aagttctcacaattggtctcgc

SEQ ID NO: 1319432 - DNA, 22 bp, Artificial Sequence
  chemically synthesized
taagttctcacaattggtctcg

SEQ ID NO: 1319433 - DNA, 22 bp, Artificial Sequence
  chemically synthesized
agttcatatggcgagaccaatt

SEQ ID NO: 1319434 - DNA, 22 bp, Artificial Sequence
  chemically synthesized
gttcatatggcgagaccaattg

SEQ ID NO: 1319435 - DNA, 22 bp, Artificial Sequence
  chemically synthesized
atatggcgagaccaattgtgag

SEQ ID NO: 1319436 - DNA, 22 bp, Artificial Sequence
  chemically synthesized
tgagaacttaaaatacatattt

SEQ ID NO: 1319437 - DNA, 22 bp, Artificial Sequence
  chemically synthesized
aaaatacatatttgtgttgatg

SEQ ID NO: 1319438 - DNA, 22 bp, Artificial Sequence
  chemically synthesized
aaatacatatttgtgttgatga

SEQ ID NO: 1319439 - DNA, 22 bp, Artificial Sequence
  chemically synthesized
aaacagtagccagaatcatcaa

SEQ ID NO: 1319440 - DNA, 22 bp, Artificial Sequence
  chemically synthesized
tcaaacagtagccagaatcatc

SEQ ID NO: 1319441 - DNA, 22 bp, Artificial Sequence
  chemically synthesized
gtgttgatgattctggctactg

SEQ ID NO: 1319442 - DNA, 22 bp, Artificial Sequence
  chemically synthesized
tgttgatgattctggctactgt

SEQ ID NO: 1319443 - DNA, 22 bp, Artificial Sequence
  chemically synthesized
atgattctggctactgtttgag

SEQ ID NO: 1319444 - DNA, 22 bp, Artificial Sequence
  chemically synthesized
tggctactgtttgagaggttat

SEQ ID NO: 1319445 - DNA, 22 bp, Artificial Sequence
  chemically synthesized
gctactgtttgagaggttatat

SEQ ID NO: 1319446 - DNA, 22 bp, Artificial Sequence
  chemically synthesized
gggaagagggcaatataacctc

SEQ ID NO: 1319447 - DNA, 22 bp, Artificial Sequence
  chemically synthesized
ggggaagagggcaatataacct

SEQ ID NO: 1319448 - DNA, 22 bp, Artificial Sequence
  chemically synthesized
ctgtttgagaggttatattgcc

SEQ ID NO: 1319449 - DNA, 22 bp, Artificial Sequence
  chemically synthesized
tttgagaggttatattgccctc

SEQ ID NO: 1319450 - DNA, 22 bp, Artificial Sequence
  chemically synthesized
gagaggttatattgccctcttc

SEQ ID NO: 1319451 - DNA, 22 bp, Artificial Sequence
  chemically synthesized
agaggttatattgccctcttcc

SEQ ID NO: 1319452 - DNA, 22 bp, Artificial Sequence
  chemically synthesized
agaaatccttggggaagagggc

SEQ ID NO: 1319453 - DNA, 22 bp, Artificial Sequence
  chemically synthesized
gagaaatccttggggaagaggg

SEQ ID NO: 1319454 - DNA, 22 bp, Artificial Sequence
  chemically synthesized
ttgagaaatccttggggaagag

SEQ ID NO: 1319455 - DNA, 22 bp, Artificial Sequence
  chemically synthesized
cttgagaaatccttggggaaga

SEQ ID NO: 1319456 - DNA, 22 bp, Artificial Sequence
  chemically synthesized
tattgccctcttccccaaggat

SEQ ID NO: 1319457 - DNA, 22 bp, Artificial Sequence
  chemically synthesized
ccctcttccccaaggatttctc

SEQ ID NO: 1319458 - DNA, 22 bp, Artificial Sequence
  chemically synthesized
ttccccaaggatttctcaagaa

SEQ ID NO: 1319459 - DNA, 22 bp, Artificial Sequence
  chemically synthesized
ccccaaggatttctcaagaaat

SEQ ID NO: 1319460 - DNA, 22 bp, Artificial Sequence
  chemically synthesized
cccaaggatttctcaagaaatg

SEQ ID NO: 1319461 - DNA, 22 bp, Artificial Sequence
  chemically synthesized
ctcaagaaatgtttatttgatt

SEQ ID NO: 1319462 - DNA, 22 bp, Artificial Sequence
  chemically synthesized
tcaagaaatgtttatttgattt

SEQ ID NO: 1319463 - DNA, 22 bp, Artificial Sequence
  chemically synthesized
aagaaatgtttatttgatttgt

SEQ ID NO: 1319464 - DNA, 22 bp, Artificial Sequence
  chemically synthesized
gaaatgtatcatacaaatcaaa

SEQ ID NO: 1319465 - DNA, 22 bp, Artificial Sequence
  chemically synthesized
atttgatttgtatgatacattt

SEQ ID NO: 1319466 - DNA, 22 bp, Artificial Sequence
  chemically synthesized
tttgatttgtatgatacatttc

SEQ ID NO: 1319467 - DNA, 22 bp, Artificial Sequence
  chemically synthesized
agaacaaagctggaaatgtatc

SEQ ID NO: 1319468 - DNA, 22 bp, Artificial Sequence
  chemically synthesized
tgagaacaaagctggaaatgta

SEQ ID NO: 1319469 - DNA, 22 bp, Artificial Sequence
  chemically synthesized
gatttgtatgatacatttccag

SEQ ID NO: 1319470 - DNA, 22 bp, Artificial Sequence
  chemically synthesized
ctgagaacaaagctggaaatgt

SEQ ID NO: 1319471 - DNA, 22 bp, Artificial Sequence
  chemically synthesized
atttgtatgatacatttccagc

SEQ ID NO: 1319472 - DNA, 22 bp, Artificial Sequence
  chemically synthesized
gtatgatacatttccagctttg

SEQ ID NO: 1319473 - DNA, 22 bp, Artificial Sequence
  chemically synthesized
tatgatacatttccagctttgt

SEQ ID NO: 1319474 - DNA, 22 bp, Artificial Sequence
  chemically synthesized
ccagctttgttctcagaaatgt

SEQ ID NO: 1319475 - DNA, 22 bp, Artificial Sequence
  chemically synthesized
cagctttgttctcagaaatgtc

SEQ ID NO: 1319476 - DNA, 22 bp, Artificial Sequence
  chemically synthesized
tgttctcagaaatgtcttttct

SEQ ID NO: 1319477 - DNA, 22 bp, Artificial Sequence
  chemically synthesized
gttctcagaaatgtcttttcta

SEQ ID NO: 1319478 - DNA, 22 bp, Artificial Sequence
  chemically synthesized
ttctcagaaatgtcttttctac

SEQ ID NO: 1319479 - DNA, 22 bp, Artificial Sequence
  chemically synthesized
tcagaaatgtcttttctactca

SEQ ID NO: 1319480 - DNA, 22 bp, Artificial Sequence
  chemically synthesized
agaaatgtcttttctactcaca

SEQ ID NO: 1319481 - DNA, 22 bp, Artificial Sequence
  chemically synthesized
aacagaatgaatgaatgtgagt

SEQ ID NO: 1319482 - DNA, 22 bp, Artificial Sequence
  chemically synthesized
tactgaacagaatgaatgaatg

SEQ ID NO: 1319483 - DNA, 22 bp, Artificial Sequence
  chemically synthesized
ttctactcacattcattcattc

SEQ ID NO: 1319484 - DNA, 22 bp, Artificial Sequence
  chemically synthesized
tctactcacattcattcattct

SEQ ID NO: 1319485 - DNA, 22 bp, Artificial Sequence
  chemically synthesized
ctactcacattcattcattctg

SEQ ID NO: 1319486 - DNA, 22 bp, Artificial Sequence
  chemically synthesized
tactcacattcattcattctgt

SEQ ID NO: 1319487 - DNA, 22 bp, Artificial Sequence
  chemically synthesized
ctcacattcattcattctgttc

SEQ ID NO: 1319488 - DNA, 22 bp, Artificial Sequence
  chemically synthesized
acattcattcattctgttcagt

SEQ ID NO: 1319489 - DNA, 22 bp, Artificial Sequence
  chemically synthesized
attcattctgttcagtacaata

SEQ ID NO: 1319490 - DNA, 22 bp, Artificial Sequence
  chemically synthesized
attctgttcagtacaatactgt

SEQ ID NO: 1319491 - DNA, 22 bp, Artificial Sequence
  chemically synthesized
agcataatgaacacagtattgt

SEQ ID NO: 1319492 - DNA, 22 bp, Artificial Sequence
  chemically synthesized
tgttcagtacaatactgtgttc

SEQ ID NO: 1319493 - DNA, 22 bp, Artificial Sequence
  chemically synthesized
ttcagtacaatactgtgttcat

SEQ ID NO: 1319494 - DNA, 22 bp, Artificial Sequence
  chemically synthesized
aagcctcagcataatgaacaca

SEQ ID NO: 1319495 - DNA, 22 bp, Artificial Sequence
  chemically synthesized
aaagcctcagcataatgaacac

SEQ ID NO: 1319496 - DNA, 22 bp, Artificial Sequence
  chemically synthesized
agtacaatactgtgttcattat

SEQ ID NO: 1319497 - DNA, 22 bp, Artificial Sequence
  chemically synthesized
taaagcctcagcataatgaaca

SEQ ID NO: 1319498 - DNA, 22 bp, Artificial Sequence
  chemically synthesized
attttaaagcctcagcataatg

SEQ ID NO: 1319499 - DNA, 22 bp, Artificial Sequence
  chemically synthesized
taattttaaagcctcagcataa

SEQ ID NO: 1319500 - DNA, 22 bp, Artificial Sequence
  chemically synthesized
ctaattttaaagcctcagcata

SEQ ID NO: 1319501 - DNA, 22 bp, Artificial Sequence
  chemically synthesized
tgttcattatgctgaggcttta

SEQ ID NO: 1319502 - DNA, 22 bp, Artificial Sequence
  chemically synthesized
attatgctgaggctttaaaatt

SEQ ID NO: 1319503 - DNA, 22 bp, Artificial Sequence
  chemically synthesized
tgctgaggctttaaaattagaa

SEQ ID NO: 1319504 - DNA, 22 bp, Artificial Sequence
  chemically synthesized
aaacccccacagtttctaattt

SEQ ID NO: 1319505 - DNA, 22 bp, Artificial Sequence
  chemically synthesized
aggctttaaaattagaaactgt

SEQ ID NO: 1319506 - DNA, 22 bp, Artificial Sequence
  chemically synthesized
taaaattagaaactgtgggggt

SEQ ID NO: 1319507 - DNA, 22 bp, Artificial Sequence
  chemically synthesized
aaaattagaaactgtgggggtt

SEQ ID NO: 1319508 - DNA, 22 bp, Artificial Sequence
  chemically synthesized
aaattagaaactgtgggggttt

SEQ ID NO: 1319509 - DNA, 22 bp, Artificial Sequence
  chemically synthesized
gaaactgtgggggtttgaatct

SEQ ID NO: 1319510 - DNA, 22 bp, Artificial Sequence
  chemically synthesized
tcacatggcaaaaacaagattc

SEQ ID NO: 1319511 - DNA, 22 bp, Artificial Sequence
  chemically synthesized
tgggggtttgaatcttgttttt

SEQ ID NO: 1319512 - DNA, 22 bp, Artificial Sequence
  chemically synthesized
gaatcttgtttttgccatgtga

SEQ ID NO: 1319513 - DNA, 22 bp, Artificial Sequence
  chemically synthesized
aatcttgtttttgccatgtgat

SEQ ID NO: 1319514 - DNA, 22 bp, Artificial Sequence
  chemically synthesized
aggtcacacagctatcacatgg

SEQ ID NO: 1319515 - DNA, 22 bp, Artificial Sequence
  chemically synthesized
gtttttgccatgtgatagctgt

SEQ ID NO: 1319516 - DNA, 22 bp, Artificial Sequence
  chemically synthesized
tttttgccatgtgatagctgtg

SEQ ID NO: 1319517 - DNA, 22 bp, Artificial Sequence
  chemically synthesized
ttgccatgtgatagctgtgtga

SEQ ID NO: 1319518 - DNA, 22 bp, Artificial Sequence
  chemically synthesized
tgccatgtgatagctgtgtgac

SEQ ID NO: 1319519 - DNA, 22 bp, Artificial Sequence
  chemically synthesized
gccatgtgatagctgtgtgacc

SEQ ID NO: 1319520 - DNA, 22 bp, Artificial Sequence
  chemically synthesized
ccatgtgatagctgtgtgacct

SEQ ID NO: 1319521 - DNA, 22 bp, Artificial Sequence
  chemically synthesized
tgaaatatgcctaaggtcacac

SEQ ID NO: 1319522 - DNA, 22 bp, Artificial Sequence
  chemically synthesized
ggaggctgtgaaatatgcctaa

SEQ ID NO: 1319523 - DNA, 22 bp, Artificial Sequence
  chemically synthesized
ctgggaggctgtgaaatatgcc

SEQ ID NO: 1319524 - DNA, 22 bp, Artificial Sequence
  chemically synthesized
actgggaggctgtgaaatatgc

SEQ ID NO: 1319525 - DNA, 22 bp, Artificial Sequence
  chemically synthesized
tgtgaccttaggcatatttcac

SEQ ID NO: 1319526 - DNA, 22 bp, Artificial Sequence
  chemically synthesized
tactgggaggctgtgaaatatg

SEQ ID NO: 1319527 - DNA, 22 bp, Artificial Sequence
  chemically synthesized
ttttactgggaggctgtgaaat

SEQ ID NO: 1319528 - DNA, 22 bp, Artificial Sequence
  chemically synthesized
attttactgggaggctgtgaaa

SEQ ID NO: 1319529 - DNA, 22 bp, Artificial Sequence
  chemically synthesized
tattttactgggaggctgtgaa

SEQ ID NO: 1319530 - DNA, 22 bp, Artificial Sequence
  chemically synthesized
aggcatatttcacagcctccca

SEQ ID NO: 1319531 - DNA, 22 bp, Artificial Sequence
  chemically synthesized
tctttattttactgggaggctg

SEQ ID NO: 1319532 - DNA, 22 bp, Artificial Sequence
  chemically synthesized
ggcatatttcacagcctcccag

SEQ ID NO: 1319533 - DNA, 22 bp, Artificial Sequence
  chemically synthesized
atctttattttactgggaggct

SEQ ID NO: 1319534 - DNA, 22 bp, Artificial Sequence
  chemically synthesized
tatctttattttactgggaggc

SEQ ID NO: 1319535 - DNA, 22 bp, Artificial Sequence
  chemically synthesized
ttttatctttattttactggga

SEQ ID NO: 1319536 - DNA, 22 bp, Artificial Sequence
  chemically synthesized
cacagcctcccagtaaaataaa

SEQ ID NO: 1319537 - DNA, 22 bp, Artificial Sequence
  chemically synthesized
acagcctcccagtaaaataaag

SEQ ID NO: 1319538 - DNA, 22 bp, Artificial Sequence
  chemically synthesized
ccagtaaaataaagataaaaca

SEQ ID NO: 1319539 - DNA, 22 bp, Artificial Sequence
  chemically synthesized
tgaagaaagatctgttttatct

SEQ ID NO: 1319540 - DNA, 22 bp, Artificial Sequence
  chemically synthesized
tatgaagaaagatctgttttat

SEQ ID NO: 1319541 - DNA, 22 bp, Artificial Sequence
  chemically synthesized
ctatgaagaaagatctgtttta

SEQ ID NO: 1319542 - DNA, 22 bp, Artificial Sequence
  chemically synthesized
aaataatttctatgaagaaaga

SEQ ID NO: 1319543 - DNA, 22 bp, Artificial Sequence
  chemically synthesized
gaaataatttctatgaagaaag

SEQ ID NO: 1319544 - DNA, 22 bp, Artificial Sequence
  chemically synthesized
aatgcttgaaataatttctatg

SEQ ID NO: 1319545 - DNA, 22 bp, Artificial Sequence
  chemically synthesized
attgaatgcttgaaataatttc

SEQ ID NO: 1319546 - DNA, 22 bp, Artificial Sequence
  chemically synthesized
tcttcatagaaattatttcaag

SEQ ID NO: 1319547 - DNA, 22 bp, Artificial Sequence
  chemically synthesized
cttcatagaaattatttcaagc

SEQ ID NO: 1319548 - DNA, 22 bp, Artificial Sequence
  chemically synthesized
ttcatagaaattatttcaagca

SEQ ID NO: 1319549 - DNA, 22 bp, Artificial Sequence
  chemically synthesized
catagaaattatttcaagcatt

SEQ ID NO: 1319550 - DNA, 22 bp, Artificial Sequence
  chemically synthesized
atatcctcattgaatgcttgaa

SEQ ID NO: 1319551 - DNA, 22 bp, Artificial Sequence
  chemically synthesized
atagaaattatttcaagcattc

SEQ ID NO: 1319552 - DNA, 22 bp, Artificial Sequence
  chemically synthesized
aatatcctcattgaatgcttga

SEQ ID NO: 1319553 - DNA, 22 bp, Artificial Sequence
  chemically synthesized
taatatcctcattgaatgcttg

SEQ ID NO: 1319554 - DNA, 22 bp, Artificial Sequence
  chemically synthesized
tattttaatatcctcattgaat

SEQ ID NO: 1319555 - DNA, 22 bp, Artificial Sequence
  chemically synthesized
tgtattttaatatcctcattga

SEQ ID NO: 1319556 - DNA, 22 bp, Artificial Sequence
  chemically synthesized
tttcaagcattcaatgaggata

SEQ ID NO: 1319557 - DNA, 22 bp, Artificial Sequence
  chemically synthesized
caagcattcaatgaggatatta

SEQ ID NO: 1319558 - DNA, 22 bp, Artificial Sequence
  chemically synthesized
agttctgtattttaatatcctc

SEQ ID NO: 1319559 - DNA, 22 bp, Artificial Sequence
  chemically synthesized
aagcattcaatgaggatattaa

SEQ ID NO: 1319560 - DNA, 22 bp, Artificial Sequence
  chemically synthesized
aatgaggatattaaaatacaga

SEQ ID NO: 1319561 - DNA, 22 bp, Artificial Sequence
  chemically synthesized
tcaccatgtgctaagttctgta

SEQ ID NO: 1319562 - DNA, 22 bp, Artificial Sequence
  chemically synthesized
gtcaccatgtgctaagttctgt

SEQ ID NO: 1319563 - DNA, 22 bp, Artificial Sequence
  chemically synthesized
tgtcaccatgtgctaagttctg

SEQ ID NO: 1319564 - DNA, 22 bp, Artificial Sequence
  chemically synthesized
ctttgtcaccatgtgctaagtt

SEQ ID NO: 1319565 - DNA, 22 bp, Artificial Sequence
  chemically synthesized
cctttgtcaccatgtgctaagt

SEQ ID NO: 1319566 - DNA, 22 bp, Artificial Sequence
  chemically synthesized
aaatacagaacttagcacatgg

SEQ ID NO: 1319567 - DNA, 22 bp, Artificial Sequence
  chemically synthesized
agtacttcctttgtcaccatgt

SEQ ID NO: 1319568 - DNA, 22 bp, Artificial Sequence
  chemically synthesized
ttgagtacttcctttgtcacca

SEQ ID NO: 1319569 - DNA, 22 bp, Artificial Sequence
  chemically synthesized
attgagtacttcctttgtcacc

SEQ ID NO: 1319570 - DNA, 22 bp, Artificial Sequence
  chemically synthesized
tattgagtacttcctttgtcac

SEQ ID NO: 1319571 - DNA, 22 bp, Artificial Sequence
  chemically synthesized
agcacatggtgacaaaggaagt

SEQ ID NO: 1319572 - DNA, 22 bp, Artificial Sequence
  chemically synthesized
gcacatggtgacaaaggaagta

SEQ ID NO: 1319573 - DNA, 22 bp, Artificial Sequence
  chemically synthesized
taagagccaactttattgagta

SEQ ID NO: 1319574 - DNA, 22 bp, Artificial Sequence
  chemically synthesized
catcataattataagagccaac

SEQ ID NO: 1319575 - DNA, 22 bp, Artificial Sequence
  chemically synthesized
aataaagttggctcttataatt

SEQ ID NO: 1319576 - DNA, 22 bp, Artificial Sequence
  chemically synthesized
gctcttataattatgatgtagc

SEQ ID NO: 1319577 - DNA, 22 bp, Artificial Sequence
  chemically synthesized
ttataattatgatgtagctacc

SEQ ID NO: 1319578 - DNA, 22 bp, Artificial Sequence
  chemically synthesized
ataattatgatgtagctaccct

SEQ ID NO: 1319579 - DNA, 22 bp, Artificial Sequence
  chemically synthesized
taattatgatgtagctaccctc

SEQ ID NO: 1319580 - DNA, 22 bp, Artificial Sequence
  chemically synthesized
tgatgtagctaccctcaccttc

SEQ ID NO: 1319581 - DNA, 22 bp, Artificial Sequence
  chemically synthesized
agaaataatcaagaaggtgagg

SEQ ID NO: 1319582 - DNA, 22 bp, Artificial Sequence
  chemically synthesized
ccctcaccttcttgattatttc

SEQ ID NO: 1319583 - DNA, 22 bp, Artificial Sequence
  chemically synthesized
accttcttgattatttctgagt

SEQ ID NO: 1319584 - DNA, 22 bp, Artificial Sequence
  chemically synthesized
cttgattatttctgagttcttt

SEQ ID NO: 1319585 - DNA, 22 bp, Artificial Sequence
  chemically synthesized
ttgattatttctgagttctttt

SEQ ID NO: 1319586 - DNA, 22 bp, Artificial Sequence
  chemically synthesized
gattatttctgagttctttttg

SEQ ID NO: 1319587 - DNA, 22 bp, Artificial Sequence
  chemically synthesized
attatttctgagttctttttgg

SEQ ID NO: 1319588 - DNA, 22 bp, Artificial Sequence
  chemically synthesized
tttctgagttctttttggatct

SEQ ID NO: 1319589 - DNA, 22 bp, Artificial Sequence
  chemically synthesized
ctgagttctttttggatcttta

SEQ ID NO: 1319590 - DNA, 22 bp, Artificial Sequence
  chemically synthesized
tgagttctttttggatctttat

SEQ ID NO: 1319591 - DNA, 22 bp, Artificial Sequence
  chemically synthesized
agttctttttggatctttatga

SEQ ID NO: 1319592 - DNA, 22 bp, Artificial Sequence
  chemically synthesized
gtgaatataaagaagtcataaa

SEQ ID NO: 1319593 - DNA, 22 bp, Artificial Sequence
  chemically synthesized
tttttggatctttatgacttct

SEQ ID NO: 1319594 - DNA, 22 bp, Artificial Sequence
  chemically synthesized
tttggatctttatgacttcttt

SEQ ID NO: 1319595 - DNA, 22 bp, Artificial Sequence
  chemically synthesized
ttggatctttatgacttcttta

SEQ ID NO: 1319596 - DNA, 22 bp, Artificial Sequence
  chemically synthesized
tggatctttatgacttctttat

SEQ ID NO: 1319597 - DNA, 22 bp, Artificial Sequence
  chemically synthesized
ggatctttatgacttctttata

SEQ ID NO: 1319598 - DNA, 22 bp, Artificial Sequence
  chemically synthesized
gatctttatgacttctttatat

SEQ ID NO: 1319599 - DNA, 22 bp, Artificial Sequence
  chemically synthesized
tatgacttctttatattcacta

SEQ ID NO: 1319600 - DNA, 22 bp, Artificial Sequence
  chemically synthesized
atgacttctttatattcactag

SEQ ID NO: 1319601 - DNA, 22 bp, Artificial Sequence
  chemically synthesized
tgacttctttatattcactagt

SEQ ID NO: 1319602 - DNA, 22 bp, Artificial Sequence
  chemically synthesized
atcgtaagcagagggactagtg

SEQ ID NO: 1319603 - DNA, 22 bp, Artificial Sequence
  chemically synthesized
ctttatattcactagtccctct

SEQ ID NO: 1319604 - DNA, 22 bp, Artificial Sequence
  chemically synthesized
tttatattcactagtccctctg

SEQ ID NO: 1319605 - DNA, 22 bp, Artificial Sequence
  chemically synthesized
tatattcactagtccctctgct

SEQ ID NO: 1319606 - DNA, 22 bp, Artificial Sequence
  chemically synthesized
atattcactagtccctctgctt

SEQ ID NO: 1319607 - DNA, 22 bp, Artificial Sequence
  chemically synthesized
tattcactagtccctctgctta

SEQ ID NO: 1319608 - DNA, 22 bp, Artificial Sequence
  chemically synthesized
actagtccctctgcttacgatg

SEQ ID NO: 1319609 - DNA, 22 bp, Artificial Sequence
  chemically synthesized
gtccctctgcttacgatgaatt

SEQ ID NO: 1319610 - DNA, 22 bp, Artificial Sequence
  chemically synthesized
aatagacatagaaaaaattcat

SEQ ID NO: 1319611 - DNA, 22 bp, Artificial Sequence
  chemically synthesized
caatagacatagaaaaaattca

SEQ ID NO: 1319612 - DNA, 22 bp, Artificial Sequence
  chemically synthesized
tgcttacgatgaattttttcta

SEQ ID NO: 1319613 - DNA, 22 bp, Artificial Sequence
  chemically synthesized
cttacgatgaattttttctatg

SEQ ID NO: 1319614 - DNA, 22 bp, Artificial Sequence
  chemically synthesized
gaatttcaatagacatagaaaa

SEQ ID NO: 1319615 - DNA, 22 bp, Artificial Sequence
  chemically synthesized
acgatgaattttttctatgtct

SEQ ID NO: 1319616 - DNA, 22 bp, Artificial Sequence
  chemically synthesized
cgatgaattttttctatgtcta

SEQ ID NO: 1319617 - DNA, 22 bp, Artificial Sequence
  chemically synthesized
aagacatctagaatttcaatag

SEQ ID NO: 1319618 - DNA, 22 bp, Artificial Sequence
  chemically synthesized
gaagacatctagaatttcaata

SEQ ID NO: 1319619 - DNA, 22 bp, Artificial Sequence
  chemically synthesized
tttctatgtctattgaaattct

SEQ ID NO: 1319620 - DNA, 22 bp, Artificial Sequence
  chemically synthesized
ttctatgtctattgaaattcta

SEQ ID NO: 1319621 - DNA, 22 bp, Artificial Sequence
  chemically synthesized
tctatgtctattgaaattctag

SEQ ID NO: 1319622 - DNA, 22 bp, Artificial Sequence
  chemically synthesized
ctatgtctattgaaattctaga

SEQ ID NO: 1319623 - DNA, 22 bp, Artificial Sequence
  chemically synthesized
tatgtctattgaaattctagat

SEQ ID NO: 1319624 - DNA, 22 bp, Artificial Sequence
  chemically synthesized
tgtctattgaaattctagatgt

SEQ ID NO: 1319625 - DNA, 22 bp, Artificial Sequence
  chemically synthesized
ttgaaattctagatgtcttcaa

SEQ ID NO: 1319626 - DNA, 22 bp, Artificial Sequence
  chemically synthesized
aaattctagatgtcttcaagat

SEQ ID NO: 1319627 - DNA, 22 bp, Artificial Sequence
  chemically synthesized
gtaaaggaggtgacatcttgaa

SEQ ID NO: 1319628 - DNA, 22 bp, Artificial Sequence
  chemically synthesized
cgtaaaggaggtgacatcttga

SEQ ID NO: 1319629 - DNA, 22 bp, Artificial Sequence
  chemically synthesized
tagatgtcttcaagatgtcacc

SEQ ID NO: 1319630 - DNA, 22 bp, Artificial Sequence
  chemically synthesized
gtttcgtaaaggaggtgacatc

SEQ ID NO: 1319631 - DNA, 22 bp, Artificial Sequence
  chemically synthesized
gatgtcttcaagatgtcacctc

SEQ ID NO: 1319632 - DNA, 22 bp, Artificial Sequence
  chemically synthesized
agattagtttcgtaaaggaggt

SEQ ID NO: 1319633 - DNA, 22 bp, Artificial Sequence
  chemically synthesized
caagatgtcacctcctttacga

SEQ ID NO: 1319634 - DNA, 22 bp, Artificial Sequence
  chemically synthesized
aagatgtcacctcctttacgaa

SEQ ID NO: 1319635 - DNA, 22 bp, Artificial Sequence
  chemically synthesized
ggggagctaagattagtttcgt

SEQ ID NO: 1319636 - DNA, 22 bp, Artificial Sequence
  chemically synthesized
gggggagctaagattagtttcg

SEQ ID NO: 1319637 - DNA, 22 bp, Artificial Sequence
  chemically synthesized
agtttgggggagctaagattag

SEQ ID NO: 1319638 - DNA, 22 bp, Artificial Sequence
  chemically synthesized
ctttacgaaactaatcttagct

SEQ ID NO: 1319639 - DNA, 22 bp, Artificial Sequence
  chemically synthesized
tacgaaactaatcttagctccc

SEQ ID NO: 1319640 - DNA, 22 bp, Artificial Sequence
  chemically synthesized
acgaaactaatcttagctcccc

SEQ ID NO: 1319641 - DNA, 22 bp, Artificial Sequence
  chemically synthesized
cgaaactaatcttagctccccc

SEQ ID NO: 1319642 - DNA, 22 bp, Artificial Sequence
  chemically synthesized
atcttagctcccccaaactgaa

SEQ ID NO: 1319643 - DNA, 22 bp, Artificial Sequence
  chemically synthesized
agctcccccaaactgaatgcat

SEQ ID NO: 1319644 - DNA, 22 bp, Artificial Sequence
  chemically synthesized
gctcccccaaactgaatgcatc

SEQ ID NO: 1319645 - DNA, 22 bp, Artificial Sequence
  chemically synthesized
ccccaaactgaatgcatcattc

SEQ ID NO: 1319646 - DNA, 22 bp, Artificial Sequence
  chemically synthesized
tgggccgcaaagcagagaatga

SEQ ID NO: 1319647 - DNA, 22 bp, Artificial Sequence
  chemically synthesized
aatgcatcattctctgctttgc

SEQ ID NO: 1319648 - DNA, 22 bp, Artificial Sequence
  chemically synthesized
ggaagctatgggccgcaaagca

SEQ ID NO: 1319649 - DNA, 22 bp, Artificial Sequence
  chemically synthesized
gggaagctatgggccgcaaagc

SEQ ID NO: 1319650 - DNA, 22 bp, Artificial Sequence
  chemically synthesized
tgggaagctatgggccgcaaag

SEQ ID NO: 1319651 - DNA, 22 bp, Artificial Sequence
  chemically synthesized
tctgctttgcggcccatagctt

SEQ ID NO: 1319652 - DNA, 22 bp, Artificial Sequence
  chemically synthesized
tgctttgcggcccatagcttcc

SEQ ID NO: 1319653 - DNA, 22 bp, Artificial Sequence
  chemically synthesized
ctttgcggcccatagcttccca

SEQ ID NO: 1319654 - DNA, 22 bp, Artificial Sequence
  chemically synthesized
tgcggcccatagcttcccaaag

SEQ ID NO: 1319655 - DNA, 22 bp, Artificial Sequence
  chemically synthesized
aaataggggtaactttgggaag

SEQ ID NO: 1319656 - DNA, 22 bp, Artificial Sequence
  chemically synthesized
gcggcccatagcttcccaaagt

SEQ ID NO: 1319657 - DNA, 22 bp, Artificial Sequence
  chemically synthesized
cggcccatagcttcccaaagtt

SEQ ID NO: 1319658 - DNA, 22 bp, Artificial Sequence
  chemically synthesized
aatactgaaataggggtaactt

SEQ ID NO: 1319659 - DNA, 22 bp, Artificial Sequence
  chemically synthesized
agttgaatactgaaataggggt

SEQ ID NO: 1319660 - DNA, 22 bp, Artificial Sequence
  chemically synthesized
cccaaagttacccctatttcag

SEQ ID NO: 1319661 - DNA, 22 bp, Artificial Sequence
  chemically synthesized
ccaaagttacccctatttcagt

SEQ ID NO: 1319662 - DNA, 22 bp, Artificial Sequence
  chemically synthesized
cccctatttcagtattcaactc

SEQ ID NO: 1319663 - DNA, 22 bp, Artificial Sequence
  chemically synthesized
tttcagtattcaactcaatata

SEQ ID NO: 1319664 - DNA, 22 bp, Artificial Sequence
  chemically synthesized
cagtattcaactcaatatattt

SEQ ID NO: 1319665 - DNA, 22 bp, Artificial Sequence
  chemically synthesized
agtattcaactcaatatatttt

SEQ ID NO: 1319666 - DNA, 22 bp, Artificial Sequence
  chemically synthesized
aactcaatatattttattttat

SEQ ID NO: 1319667 - DNA, 22 bp, Artificial Sequence
  chemically synthesized
aaaaagcaataaaaataaaata

SEQ ID NO: 1319668 - DNA, 22 bp, Artificial Sequence
  chemically synthesized
aatatattttattttattttta

SEQ ID NO: 1319669 - DNA, 22 bp, Artificial Sequence
  chemically synthesized
catctcaaaaagcaataaaaat

SEQ ID NO: 1319670 - DNA, 22 bp, Artificial Sequence
  chemically synthesized
tattttatttttattgcttttt

SEQ ID NO: 1319671 - DNA, 22 bp, Artificial Sequence
  chemically synthesized
attttatttttattgctttttg

SEQ ID NO: 1319672 - DNA, 22 bp, Artificial Sequence
  chemically synthesized
ttttatttttattgctttttga

SEQ ID NO: 1319673 - DNA, 22 bp, Artificial Sequence
  chemically synthesized
tatttttattgctttttgagat

SEQ ID NO: 1319674 - DNA, 22 bp, Artificial Sequence
  chemically synthesized
atttttattgctttttgagatg

SEQ ID NO: 1319675 - DNA, 22 bp, Artificial Sequence
  chemically synthesized
tttttattgctttttgagatgg

SEQ ID NO: 1319676 - DNA, 22 bp, Artificial Sequence
  chemically synthesized
agtgacagagactccatctcaa

SEQ ID NO: 1319677 - DNA, 22 bp, Artificial Sequence
  chemically synthesized
ttattgctttttgagatggagt

SEQ ID NO: 1319678 - DNA, 22 bp, Artificial Sequence
  chemically synthesized
tattgctttttgagatggagtc

SEQ ID NO: 1319679 - DNA, 22 bp, Artificial Sequence
  chemically synthesized
attgctttttgagatggagtct

SEQ ID NO: 1319680 - DNA, 22 bp, Artificial Sequence
  chemically synthesized
ttgctttttgagatggagtctc

SEQ ID NO: 1319681 - DNA, 22 bp, Artificial Sequence
  chemically synthesized
cagcctgagtgacagagactcc

SEQ ID NO: 1319682 - DNA, 22 bp, Artificial Sequence
  chemically synthesized
ctttttgagatggagtctctgt

SEQ ID NO: 1319683 - DNA, 22 bp, Artificial Sequence
  chemically synthesized
tttgagatggagtctctgtcac

SEQ ID NO: 1319684 - DNA, 22 bp, Artificial Sequence
  chemically synthesized
ttgagatggagtctctgtcact

SEQ ID NO: 1319685 - DNA, 22 bp, Artificial Sequence
  chemically synthesized
cactccagcctgagtgacagag

SEQ ID NO: 1319686 - DNA, 22 bp, Artificial Sequence
  chemically synthesized
tgagatggagtctctgtcactc

SEQ ID NO: 1319687 - DNA, 22 bp, Artificial Sequence
  chemically synthesized
gagatggagtctctgtcactca

SEQ ID NO: 1319688 - DNA, 22 bp, Artificial Sequence
  chemically synthesized
agatggagtctctgtcactcag

SEQ ID NO: 1319689 - DNA, 22 bp, Artificial Sequence
  chemically synthesized
accactgcactccagcctgagt

SEQ ID NO: 1319690 - DNA, 22 bp, Artificial Sequence
  chemically synthesized
caccactgcactccagcctgag

SEQ ID NO: 1319691 - DNA, 22 bp, Artificial Sequence
  chemically synthesized
agatttcaccactgcactccag

SEQ ID NO: 1319692 - DNA, 22 bp, Artificial Sequence
  chemically synthesized
tgtcactcaggctggagtgcag

SEQ ID NO: 1319693 - DNA, 22 bp, Artificial Sequence
  chemically synthesized
tcactcaggctggagtgcagtg

SEQ ID NO: 1319694 - DNA, 22 bp, Artificial Sequence
  chemically synthesized
aggctggagtgcagtggtgaaa

SEQ ID NO: 1319695 - DNA, 22 bp, Artificial Sequence
  chemically synthesized
cagtgagctgagatttcaccac

SEQ ID NO: 1319696 - DNA, 22 bp, Artificial Sequence
  chemically synthesized
gagtgcagtggtgaaatctcag

SEQ ID NO: 1319697 - DNA, 22 bp, Artificial Sequence
  chemically synthesized
cgggaggtaaaggttgcagtga

SEQ ID NO: 1319698 - DNA, 22 bp, Artificial Sequence
  chemically synthesized
aatcctccgggaggtaaaggtt

SEQ ID NO: 1319699 - DNA, 22 bp, Artificial Sequence
  chemically synthesized
gaatcctccgggaggtaaaggt

SEQ ID NO: 1319700 - DNA, 22 bp, Artificial Sequence
  chemically synthesized
agctcactgcaacctttacctc

SEQ ID NO: 1319701 - DNA, 22 bp, Artificial Sequence
  chemically synthesized
cttgaatcctccgggaggtaaa

SEQ ID NO: 1319702 - DNA, 22 bp, Artificial Sequence
  chemically synthesized
actgcaacctttacctcccgga

SEQ ID NO: 1319703 - DNA, 22 bp, Artificial Sequence
  chemically synthesized
caacctttacctcccggaggat

SEQ ID NO: 1319704 - DNA, 22 bp, Artificial Sequence
  chemically synthesized
tacctcccggaggattcaagca

SEQ ID NO: 1319705 - DNA, 22 bp, Artificial Sequence
  chemically synthesized
agacaggagaattgcttgaatc

SEQ ID NO: 1319706 - DNA, 22 bp, Artificial Sequence
  chemically synthesized
acctcccggaggattcaagcaa

SEQ ID NO: 1319707 - DNA, 22 bp, Artificial Sequence
  chemically synthesized
cctcccggaggattcaagcaat

SEQ ID NO: 1319708 - DNA, 22 bp, Artificial Sequence
  chemically synthesized
ccggaggattcaagcaattctc

SEQ ID NO: 1319709 - DNA, 22 bp, Artificial Sequence
  chemically synthesized
gaggctgagacaggagaattgc

SEQ ID NO: 1319710 - DNA, 22 bp, Artificial Sequence
  chemically synthesized
gtctggaggctgagacaggaga

SEQ ID NO: 1319711 - DNA, 22 bp, Artificial Sequence
  chemically synthesized
aagcaattctcctgtctcagcc

SEQ ID NO: 1319712 - DNA, 22 bp, Artificial Sequence
  chemically synthesized
taatcacaactagtctggaggc

SEQ ID NO: 1319713 - DNA, 22 bp, Artificial Sequence
  chemically synthesized
tcctgtctcagcctccagacta

SEQ ID NO: 1319714 - DNA, 22 bp, Artificial Sequence
  chemically synthesized
ctgtctcagcctccagactagt

SEQ ID NO: 1319715 - DNA, 22 bp, Artificial Sequence
  chemically synthesized
tctcagcctccagactagttgt

SEQ ID NO: 1319716 - DNA, 22 bp, Artificial Sequence
  chemically synthesized
catgcctgtaatcacaactagt

SEQ ID NO: 1319717 - DNA, 22 bp, Artificial Sequence
  chemically synthesized
agcctccagactagttgtgatt

SEQ ID NO: 1319718 - DNA, 22 bp, Artificial Sequence
  chemically synthesized
gctgcatgcctgtaatcacaac

SEQ ID NO: 1319719 - DNA, 22 bp, Artificial Sequence
  chemically synthesized
cagactagttgtgattacaggc

SEQ ID NO: 1319720 - DNA, 22 bp, Artificial Sequence
  chemically synthesized
gttgtgattacaggcatgcagc

SEQ ID NO: 1319721 - DNA, 22 bp, Artificial Sequence
  chemically synthesized
aaaatagaaaaattagctgcat

SEQ ID NO: 1319722 - DNA, 22 bp, Artificial Sequence
  chemically synthesized
tgattacaggcatgcagctaat

SEQ ID NO: 1319723 - DNA, 22 bp, Artificial Sequence
  chemically synthesized
ctaaaaatagaaaaattagctg

SEQ ID NO: 1319724 - DNA, 22 bp, Artificial Sequence
  chemically synthesized
tactaaaaatagaaaaattagc

SEQ ID NO: 1319725 - DNA, 22 bp, Artificial Sequence
  chemically synthesized
caggcatgcagctaatttttct

SEQ ID NO: 1319726 - DNA, 22 bp, Artificial Sequence
  chemically synthesized
tctctactaaaaatagaaaaat

SEQ ID NO: 1319727 - DNA, 22 bp, Artificial Sequence
  chemically synthesized
atttttctatttttagtagaga

SEQ ID NO: 1319728 - DNA, 22 bp, Artificial Sequence
  chemically synthesized
ttctatttttagtagagacagg

SEQ ID NO: 1319729 - DNA, 22 bp, Artificial Sequence
  chemically synthesized
tctatttttagtagagacaggg

SEQ ID NO: 1319730 - DNA, 22 bp, Artificial Sequence
  chemically synthesized
ctatttttagtagagacagggg

SEQ ID NO: 1319731 - DNA, 22 bp, Artificial Sequence
  chemically synthesized
tatttttagtagagacaggggt

SEQ ID NO: 1319732 - DNA, 22 bp, Artificial Sequence
  chemically synthesized
tttttagtagagacaggggtct

SEQ ID NO: 1319733 - DNA, 22 bp, Artificial Sequence
  chemically synthesized
atcaacatggtgagacccctgt

SEQ ID NO: 1319734 - DNA, 22 bp, Artificial Sequence
  chemically synthesized
gatcaacatggtgagacccctg

SEQ ID NO: 1319735 - DNA, 22 bp, Artificial Sequence
  chemically synthesized
ttagtagagacaggggtctcac

SEQ ID NO: 1319736 - DNA, 22 bp, Artificial Sequence
  chemically synthesized
tagtagagacaggggtctcacc

SEQ ID NO: 1319737 - DNA, 22 bp, Artificial Sequence
  chemically synthesized
agtagagacaggggtctcacca

SEQ ID NO: 1319738 - DNA, 22 bp, Artificial Sequence
  chemically synthesized
gtagagacaggggtctcaccat

SEQ ID NO: 1319739 - DNA, 22 bp, Artificial Sequence
  chemically synthesized
gacaccagcttgatcaacatgg

SEQ ID NO: 1319740 - DNA, 22 bp, Artificial Sequence
  chemically synthesized
accatgttgatcaagctggtgt

SEQ ID NO: 1319741 - DNA, 22 bp, Artificial Sequence
  chemically synthesized
aagtcaggagttcgacaccagc

SEQ ID NO: 1319742 - DNA, 22 bp, Artificial Sequence
  chemically synthesized
gaagtcaggagttcgacaccag

SEQ ID NO: 1319743 - DNA, 22 bp, Artificial Sequence
  chemically synthesized
atcaagctggtgtcgaactcct

SEQ ID NO: 1319744 - DNA, 22 bp, Artificial Sequence
  chemically synthesized
gtgtcgaactcctgacttcaaa

SEQ ID NO: 1319745 - DNA, 22 bp, Artificial Sequence
  chemically synthesized
ggaggcggaggcggatggatca

SEQ ID NO: 1319746 - DNA, 22 bp, Artificial Sequence
  chemically synthesized
ctgacttcaaatgatccatccg

SEQ ID NO: 1319747 - DNA, 22 bp, Artificial Sequence
  chemically synthesized
gggaggcggaggcggatggatc

SEQ ID NO: 1319748 - DNA, 22 bp, Artificial Sequence
  chemically synthesized
tgggaggcggaggcggatggat

SEQ ID NO: 1319749 - DNA, 22 bp, Artificial Sequence
  chemically synthesized
acttcaaatgatccatccgcct

SEQ ID NO: 1319750 - DNA, 22 bp, Artificial Sequence
  chemically synthesized
caaatgatccatccgcctccgc

SEQ ID NO: 1319751 - DNA, 22 bp, Artificial Sequence
  chemically synthesized
aaatgatccatccgcctccgcc

SEQ ID NO: 1319752 - DNA, 22 bp, Artificial Sequence
  chemically synthesized
tgatcccagaactttgggaggc

SEQ ID NO: 1319753 - DNA, 22 bp, Artificial Sequence
  chemically synthesized
acacctgtgatcccagaacttt

SEQ ID NO: 1319754 - DNA, 22 bp, Artificial Sequence
  chemically synthesized
cgcctcccaaagttctgggatc

SEQ ID NO: 1319755 - DNA, 22 bp, Artificial Sequence
  chemically synthesized
ccaaagttctgggatcacaggt

SEQ ID NO: 1319756 - DNA, 22 bp, Artificial Sequence
  chemically synthesized
tgggatcacaggtgtgagccac

SEQ ID NO: 1319757 - DNA, 22 bp, Artificial Sequence
  chemically synthesized
ggatcacaggtgtgagccactg

SEQ ID NO: 1319758 - DNA, 22 bp, Artificial Sequence
  chemically synthesized
gtcaaagccagatgcagtggct

SEQ ID NO: 1319759 - DNA, 22 bp, Artificial Sequence
  chemically synthesized
agtcaaagccagatgcagtggc

SEQ ID NO: 1319760 - DNA, 22 bp, Artificial Sequence
  chemically synthesized
aaatatatttagtcaaagccag

SEQ ID NO: 1319761 - DNA, 22 bp, Artificial Sequence
  chemically synthesized
aattaaaatatatttagtcaaa

SEQ ID NO: 1319762 - DNA, 22 bp, Artificial Sequence
  chemically synthesized
catctggctttgactaaatata

SEQ ID NO: 1319763 - DNA, 22 bp, Artificial Sequence
  chemically synthesized
actcaattaaaatatatttagt

SEQ ID NO: 1319764 - DNA, 22 bp, Artificial Sequence
  chemically synthesized
gctttgactaaatatattttaa

SEQ ID NO: 1319765 - DNA, 22 bp, Artificial Sequence
  chemically synthesized
tgactaaatatattttaattga

SEQ ID NO: 1319766 - DNA, 22 bp, Artificial Sequence
  chemically synthesized
gactaaatatattttaattgag

SEQ ID NO: 1319767 - DNA, 22 bp, Artificial Sequence
  chemically synthesized
actaaatatattttaattgagt

SEQ ID NO: 1319768 - DNA, 22 bp, Artificial Sequence
  chemically synthesized
aatatattttaattgagttaat

SEQ ID NO: 1319769 - DNA, 22 bp, Artificial Sequence
  chemically synthesized
acagtaaggcagatcccatatt

SEQ ID NO: 1319770 - DNA, 22 bp, Artificial Sequence
  chemically synthesized
taattgagttaatatgggatct

SEQ ID NO: 1319771 - DNA, 22 bp, Artificial Sequence
  chemically synthesized
aattgagttaatatgggatctg

SEQ ID NO: 1319772 - DNA, 22 bp, Artificial Sequence
  chemically synthesized
attgagttaatatgggatctgc

SEQ ID NO: 1319773 - DNA, 22 bp, Artificial Sequence
  chemically synthesized
agttaatatgggatctgcctta

SEQ ID NO: 1319774 - DNA, 22 bp, Artificial Sequence
  chemically synthesized
atggaattcacagtaaggcaga

SEQ ID NO: 1319775 - DNA, 22 bp, Artificial Sequence
  chemically synthesized
catggaattcacagtaaggcag

SEQ ID NO: 1319776 - DNA, 22 bp, Artificial Sequence
  chemically synthesized
atatgggatctgccttactgtg

SEQ ID NO: 1319777 - DNA, 22 bp, Artificial Sequence
  chemically synthesized
acagccttcatggaattcacag

SEQ ID NO: 1319778 - DNA, 22 bp, Artificial Sequence
  chemically synthesized
cacagccttcatggaattcaca

SEQ ID NO: 1319779 - DNA, 22 bp, Artificial Sequence
  chemically synthesized
ccttactgtgaattccatgaag

SEQ ID NO: 1319780 - DNA, 22 bp, Artificial Sequence
  chemically synthesized
aataacttcacagccttcatgg

SEQ ID NO: 1319781 - DNA, 22 bp, Artificial Sequence
  chemically synthesized
actgtgaattccatgaaggctg

SEQ ID NO: 1319782 - DNA, 22 bp, Artificial Sequence
  chemically synthesized
ctgtgaattccatgaaggctgt

SEQ ID NO: 1319783 - DNA, 22 bp, Artificial Sequence
  chemically synthesized
tgaattccatgaaggctgtgaa

SEQ ID NO: 1319784 - DNA, 22 bp, Artificial Sequence
  chemically synthesized
catgaaggctgtgaagttattt

SEQ ID NO: 1319785 - DNA, 22 bp, Artificial Sequence
  chemically synthesized
gacaaagtacagaagaattaaa

SEQ ID NO: 1319786 - DNA, 22 bp, Artificial Sequence
  chemically synthesized
ggacaaagtacagaagaattaa

SEQ ID NO: 1319787 - DNA, 22 bp, Artificial Sequence
  chemically synthesized
tggacaaagtacagaagaatta

SEQ ID NO: 1319788 - DNA, 22 bp, Artificial Sequence
  chemically synthesized
tgaagttatttaattcttctgt

SEQ ID NO: 1319789 - DNA, 22 bp, Artificial Sequence
  chemically synthesized
catggctttggacaaagtacag

SEQ ID NO: 1319790 - DNA, 22 bp, Artificial Sequence
  chemically synthesized
ccatggctttggacaaagtaca

SEQ ID NO: 1319791 - DNA, 22 bp, Artificial Sequence
  chemically synthesized
tttaattcttctgtactttgtc

SEQ ID NO: 1319792 - DNA, 22 bp, Artificial Sequence
  chemically synthesized
aattcttctgtactttgtccaa

SEQ ID NO: 1319793 - DNA, 22 bp, Artificial Sequence
  chemically synthesized
attcttctgtactttgtccaaa

SEQ ID NO: 1319794 - DNA, 22 bp, Artificial Sequence
  chemically synthesized
ttctgtactttgtccaaagcca

SEQ ID NO: 1319795 - DNA, 22 bp, Artificial Sequence
  chemically synthesized
caaggtgcttccatggctttgg

SEQ ID NO: 1319796 - DNA, 22 bp, Artificial Sequence
  chemically synthesized
ctgtactttgtccaaagccatg

SEQ ID NO: 1319797 - DNA, 22 bp, Artificial Sequence
  chemically synthesized
tgtactttgtccaaagccatgg

SEQ ID NO: 1319798 - DNA, 22 bp, Artificial Sequence
  chemically synthesized
tactttgtccaaagccatggaa

SEQ ID NO: 1319799 - DNA, 22 bp, Artificial Sequence
  chemically synthesized
ccaattgcaaggtgcttccatg

SEQ ID NO: 1319800 - DNA, 22 bp, Artificial Sequence
  chemically synthesized
tgtccaaagccatggaagcacc

SEQ ID NO: 1319801 - DNA, 22 bp, Artificial Sequence
  chemically synthesized
taccaattgcaaggtgcttcca

SEQ ID NO: 1319802 - DNA, 22 bp, Artificial Sequence
  chemically synthesized
gtccaaagccatggaagcacct

SEQ ID NO: 1319803 - DNA, 22 bp, Artificial Sequence
  chemically synthesized
tccaaagccatggaagcacctt

SEQ ID NO: 1319804 - DNA, 22 bp, Artificial Sequence
  chemically synthesized
aattctaccaattgcaaggtgc

SEQ ID NO: 1319805 - DNA, 22 bp, Artificial Sequence
  chemically synthesized
ccccagtgttgaattctaccaa

SEQ ID NO: 1319806 - DNA, 22 bp, Artificial Sequence
  chemically synthesized
gcaattggtagaattcaacact

SEQ ID NO: 1319807 - DNA, 22 bp, Artificial Sequence
  chemically synthesized
agatcctcccccagtgttgaat

SEQ ID NO: 1319808 - DNA, 22 bp, Artificial Sequence
  chemically synthesized
caattggtagaattcaacactg

SEQ ID NO: 1319809 - DNA, 22 bp, Artificial Sequence
  chemically synthesized
aagatcctcccccagtgttgaa

SEQ ID NO: 1319810 - DNA, 22 bp, Artificial Sequence
  chemically synthesized
taagatcctcccccagtgttga

SEQ ID NO: 1319811 - DNA, 22 bp, Artificial Sequence
  chemically synthesized
ctttaagatcctcccccagtgt

SEQ ID NO: 1319812 - DNA, 22 bp, Artificial Sequence
  chemically synthesized
gtagaattcaacactgggggag

SEQ ID NO: 1319813 - DNA, 22 bp, Artificial Sequence
  chemically synthesized
gttactttaagatcctccccca

SEQ ID NO: 1319814 - DNA, 22 bp, Artificial Sequence
  chemically synthesized
ttcgttactttaagatcctccc

SEQ ID NO: 1319815 - DNA, 22 bp, Artificial Sequence
  chemically synthesized
attcgttactttaagatcctcc

SEQ ID NO: 1319816 - DNA, 22 bp, Artificial Sequence
  chemically synthesized
aacactgggggaggatcttaaa

SEQ ID NO: 1319817 - DNA, 22 bp, Artificial Sequence
  chemically synthesized
ggggaggatcttaaagtaacga

SEQ ID NO: 1319818 - DNA, 22 bp, Artificial Sequence
  chemically synthesized
tgacatatttattcgttacttt

SEQ ID NO: 1319819 - DNA, 22 bp, Artificial Sequence
  chemically synthesized
aaagtaacgaataaatatgtca

SEQ ID NO: 1319820 - DNA, 22 bp, Artificial Sequence
  chemically synthesized
aagtaacgaataaatatgtcac

SEQ ID NO: 1319821 - DNA, 22 bp, Artificial Sequence
  chemically synthesized
atgcacatacgattgtgacata

SEQ ID NO: 1319822 - DNA, 22 bp, Artificial Sequence
  chemically synthesized
taatgcacatacgattgtgaca

SEQ ID NO: 1319823 - DNA, 22 bp, Artificial Sequence
  chemically synthesized
tctaatgcacatacgattgtga

SEQ ID NO: 1319824 - DNA, 22 bp, Artificial Sequence
  chemically synthesized
aagaatccatagctctctaatg

SEQ ID NO: 1319825 - DNA, 22 bp, Artificial Sequence
  chemically synthesized
attaaagaatccatagctctct

SEQ ID NO: 1319826 - DNA, 22 bp, Artificial Sequence
  chemically synthesized
aattaaagaatccatagctctc

SEQ ID NO: 1319827 - DNA, 22 bp, Artificial Sequence
  chemically synthesized
ttaattaaagaatccatagctc

SEQ ID NO: 1319828 - DNA, 22 bp, Artificial Sequence
  chemically synthesized
cttaattaaagaatccatagct

SEQ ID NO: 1319829 - DNA, 22 bp, Artificial Sequence
  chemically synthesized
gcagcttcttaattaaagaatc

SEQ ID NO: 1319830 - DNA, 22 bp, Artificial Sequence
  chemically synthesized
agcagcttcttaattaaagaat

SEQ ID NO: 1319831 - DNA, 22 bp, Artificial Sequence
  chemically synthesized
gagagctatggattctttaatt

SEQ ID NO: 1319832 - DNA, 22 bp, Artificial Sequence
  chemically synthesized
ttagcagcttcttaattaaaga

SEQ ID NO: 1319833 - DNA, 22 bp, Artificial Sequence
  chemically synthesized
tggattctttaattaagaagct

SEQ ID NO: 1319834 - DNA, 22 bp, Artificial Sequence
  chemically synthesized
ccgagtagctcttagcagcttc

SEQ ID NO: 1319835 - DNA, 22 bp, Artificial Sequence
  chemically synthesized
tttaattaagaagctgctaaga

SEQ ID NO: 1319836 - DNA, 22 bp, Artificial Sequence
  chemically synthesized
taattaagaagctgctaagagc

SEQ ID NO: 1319837 - DNA, 22 bp, Artificial Sequence
  chemically synthesized
aattaagaagctgctaagagct

SEQ ID NO: 1319838 - DNA, 22 bp, Artificial Sequence
  chemically synthesized
agcctcccgagtagctcttagc

SEQ ID NO: 1319839 - DNA, 22 bp, Artificial Sequence
  chemically synthesized
attaagaagctgctaagagcta

SEQ ID NO: 1319840 - DNA, 22 bp, Artificial Sequence
  chemically synthesized
cctcagcctcccgagtagctct

SEQ ID NO: 1319841 - DNA, 22 bp, Artificial Sequence
  chemically synthesized
agaagctgctaagagctactcg

SEQ ID NO: 1319842 - DNA, 22 bp, Artificial Sequence
  chemically synthesized
ctgcctcagcctcccgagtagc

SEQ ID NO: 1319843 - DNA, 22 bp, Artificial Sequence
  chemically synthesized
tcctgcctcagcctcccgagta

SEQ ID NO: 1319844 - DNA, 22 bp, Artificial Sequence
  chemically synthesized
ctaagagctactcgggaggctg

SEQ ID NO: 1319845 - DNA, 22 bp, Artificial Sequence
  chemically synthesized
agagctactcgggaggctgagg

SEQ ID NO: 1319846 - DNA, 22 bp, Artificial Sequence
  chemically synthesized
caccattctcctgcctcagcct

SEQ ID NO: 1319847 - DNA, 22 bp, Artificial Sequence
  chemically synthesized
acaccattctcctgcctcagcc

SEQ ID NO: 1319848 - DNA, 22 bp, Artificial Sequence
  chemically synthesized
ctcgggaggctgaggcaggaga

SEQ ID NO: 1319849 - DNA, 22 bp, Artificial Sequence
  chemically synthesized
gggaggctgaggcaggagaatg

SEQ ID NO: 1319850 - DNA, 22 bp, Artificial Sequence
  chemically synthesized
ccgggtttacaccattctcctg

SEQ ID NO: 1319851 - DNA, 22 bp, Artificial Sequence
  chemically synthesized
cgcctcccgggtttacaccatt

SEQ ID NO: 1319852 - DNA, 22 bp, Artificial Sequence
  chemically synthesized
aggcaggagaatggtgtaaacc

SEQ ID NO: 1319853 - DNA, 22 bp, Artificial Sequence
  chemically synthesized
caagctccgcctcccgggttta

SEQ ID NO: 1319854 - DNA, 22 bp, Artificial Sequence
  chemically synthesized
actgcaagctccgcctcccggg

SEQ ID NO: 1319855 - DNA, 22 bp, Artificial Sequence
  chemically synthesized
gagtgcagtggcgcgatgtcgg

SEQ ID NO: 1319856 - DNA, 22 bp, Artificial Sequence
  chemically synthesized
gcagtgagccgacatcgcgcca

SEQ ID NO: 1319857 - DNA, 22 bp, Artificial Sequence
  chemically synthesized
cagtgagccgacatcgcgccac

SEQ ID NO: 1319858 - DNA, 22 bp, Artificial Sequence
  chemically synthesized
tcgcccaggctggagtgcagtg

SEQ ID NO: 1319859 - DNA, 22 bp, Artificial Sequence
  chemically synthesized
tgtcgcccaggctggagtgcag

SEQ ID NO: 1319860 - DNA, 22 bp, Artificial Sequence
  chemically synthesized
gctctgtcgcccaggctggagt

SEQ ID NO: 1319861 - DNA, 22 bp, Artificial Sequence
  chemically synthesized
cactccagcctgggcgacagag

SEQ ID NO: 1319862 - DNA, 22 bp, Artificial Sequence
  chemically synthesized
agatggagtctcgctctgtcgc

SEQ ID NO: 1319863 - DNA, 22 bp, Artificial Sequence
  chemically synthesized
gagatggagtctcgctctgtcg

SEQ ID NO: 1319864 - DNA, 22 bp, Artificial Sequence
  chemically synthesized
tgagatggagtctcgctctgtc

SEQ ID NO: 1319865 - DNA, 22 bp, Artificial Sequence
  chemically synthesized
ttgagatggagtctcgctctgt

SEQ ID NO: 1319866 - DNA, 22 bp, Artificial Sequence
  chemically synthesized
cagcctgggcgacagagcgaga

SEQ ID NO: 1319867 - DNA, 22 bp, Artificial Sequence
  chemically synthesized
tttgagatggagtctcgctctg

SEQ ID NO: 1319868 - DNA, 22 bp, Artificial Sequence
  chemically synthesized
ttttgagatggagtctcgctct

SEQ ID NO: 1319869 - DNA, 22 bp, Artificial Sequence
  chemically synthesized
tttttgagatggagtctcgctc

SEQ ID NO: 1319870 - DNA, 22 bp, Artificial Sequence
  chemically synthesized
ttttttgagatggagtctcgct

SEQ ID NO: 1319871 - DNA, 22 bp, Artificial Sequence
  chemically synthesized
ttttttttgagatggagtctcg

SEQ ID NO: 1319872 - DNA, 22 bp, Artificial Sequence
  chemically synthesized
ggcgacagagcgagactccatc

SEQ ID NO: 1319873 - DNA, 22 bp, Artificial Sequence
  chemically synthesized
ttcttttttttgagatggagtc

SEQ ID NO: 1319874 - DNA, 22 bp, Artificial Sequence
  chemically synthesized
attcttttttttgagatggagt

SEQ ID NO: 1319875 - DNA, 22 bp, Artificial Sequence
  chemically synthesized
atatttattcttttttttgaga

SEQ ID NO: 1319876 - DNA, 22 bp, Artificial Sequence
  chemically synthesized
gtaattaatatttattcttttt

SEQ ID NO: 1319877 - DNA, 22 bp, Artificial Sequence
  chemically synthesized
catctcaaaaaaaagaataaat

SEQ ID NO: 1319878 - DNA, 22 bp, Artificial Sequence
  chemically synthesized
aaaaaaaagaataaatattaat

SEQ ID NO: 1319879 - DNA, 22 bp, Artificial Sequence
  chemically synthesized
atatgtcatctggtaattaata

SEQ ID NO: 1319880 - DNA, 22 bp, Artificial Sequence
  chemically synthesized
aatatgtcatctggtaattaat

SEQ ID NO: 1319881 - DNA, 22 bp, Artificial Sequence
  chemically synthesized
taaaaatatttaatatgtcatc

SEQ ID NO: 1319882 - DNA, 22 bp, Artificial Sequence
  chemically synthesized
attaccagatgacatattaaat

SEQ ID NO: 1319883 - DNA, 22 bp, Artificial Sequence
  chemically synthesized
ccagatgacatattaaatattt

SEQ ID NO: 1319884 - DNA, 22 bp, Artificial Sequence
  chemically synthesized
atatcagaattataaaaatatt

SEQ ID NO: 1319885 - DNA, 22 bp, Artificial Sequence
  chemically synthesized
aatatcagaattataaaaatat

SEQ ID NO: 1319886 - DNA, 22 bp, Artificial Sequence
  chemically synthesized
taatatcagaattataaaaata

SEQ ID NO: 1319887 - DNA, 22 bp, Artificial Sequence
  chemically synthesized
taagttttaatatcagaattat

SEQ ID NO: 1319888 - DNA, 22 bp, Artificial Sequence
  chemically synthesized
aatatttttataattctgatat

SEQ ID NO: 1319889 - DNA, 22 bp, Artificial Sequence
  chemically synthesized
ttataagttttaatatcagaat

SEQ ID NO: 1319890 - DNA, 22 bp, Artificial Sequence
  chemically synthesized
attataagttttaatatcagaa

SEQ ID NO: 1319891 - DNA, 22 bp, Artificial Sequence
  chemically synthesized
tattataagttttaatatcaga

SEQ ID NO: 1319892 - DNA, 22 bp, Artificial Sequence
  chemically synthesized
ttttattataagttttaatatc

SEQ ID NO: 1319893 - DNA, 22 bp, Artificial Sequence
  chemically synthesized
ttataattctgatattaaaact

SEQ ID NO: 1319894 - DNA, 22 bp, Artificial Sequence
  chemically synthesized
tataattctgatattaaaactt

SEQ ID NO: 1319895 - DNA, 22 bp, Artificial Sequence
  chemically synthesized
ataattctgatattaaaactta

SEQ ID NO: 1319896 - DNA, 22 bp, Artificial Sequence
  chemically synthesized
taattctgatattaaaacttat

SEQ ID NO: 1319897 - DNA, 22 bp, Artificial Sequence
  chemically synthesized
aagttattttattataagtttt

SEQ ID NO: 1319898 - DNA, 22 bp, Artificial Sequence
  chemically synthesized
attaaagttattttattataag

SEQ ID NO: 1319899 - DNA, 22 bp, Artificial Sequence
  chemically synthesized
tgatattaaaacttataataaa

SEQ ID NO: 1319900 - DNA, 22 bp, Artificial Sequence
  chemically synthesized
atattaaaacttataataaaat

SEQ ID NO: 1319901 - DNA, 22 bp, Artificial Sequence
  chemically synthesized
aaacttataataaaataacttt

SEQ ID NO: 1319902 - DNA, 22 bp, Artificial Sequence
  chemically synthesized
caagccactcattaaagttatt

SEQ ID NO: 1319903 - DNA, 22 bp, Artificial Sequence
  chemically synthesized
ccaagccactcattaaagttat

SEQ ID NO: 1319904 - DNA, 22 bp, Artificial Sequence
  chemically synthesized
ataataaaataactttaatgag

SEQ ID NO: 1319905 - DNA, 22 bp, Artificial Sequence
  chemically synthesized
atttccaagccactcattaaag

SEQ ID NO: 1319906 - DNA, 22 bp, Artificial Sequence
  chemically synthesized
taataaaataactttaatgagt

SEQ ID NO: 1319907 - DNA, 22 bp, Artificial Sequence
  chemically synthesized
aacagttaatttccaagccact

SEQ ID NO: 1319908 - DNA, 22 bp, Artificial Sequence
  chemically synthesized
taatgagtggcttggaaattaa

SEQ ID NO: 1319909 - DNA, 22 bp, Artificial Sequence
  chemically synthesized
aaaattaaacagttaatttcca

SEQ ID NO: 1319910 - DNA, 22 bp, Artificial Sequence
  chemically synthesized
aatgagtggcttggaaattaac

SEQ ID NO: 1319911 - DNA, 22 bp, Artificial Sequence
  chemically synthesized
gaaaattaaacagttaatttcc

SEQ ID NO: 1319912 - DNA, 22 bp, Artificial Sequence
  chemically synthesized
atgagtggcttggaaattaact

SEQ ID NO: 1319913 - DNA, 22 bp, Artificial Sequence
  chemically synthesized
tgaaaattaaacagttaatttc

SEQ ID NO: 1319914 - DNA, 22 bp, Artificial Sequence
  chemically synthesized
tttgaaaattaaacagttaatt

SEQ ID NO: 1319915 - DNA, 22 bp, Artificial Sequence
  chemically synthesized
ctttgaaaattaaacagttaat

SEQ ID NO: 1319916 - DNA, 22 bp, Artificial Sequence
  chemically synthesized
ggaaattaactgtttaattttc

SEQ ID NO: 1319917 - DNA, 22 bp, Artificial Sequence
  chemically synthesized
gaaattaactgtttaattttca

SEQ ID NO: 1319918 - DNA, 22 bp, Artificial Sequence
  chemically synthesized
actgtttaattttcaaagaaat

SEQ ID NO: 1319919 - DNA, 22 bp, Artificial Sequence
  chemically synthesized
aaaaaagcaaaatatttctttg

SEQ ID NO: 1319920 - DNA, 22 bp, Artificial Sequence
  chemically synthesized
caaaaaagcaaaatatttcttt

SEQ ID NO: 1319921 - DNA, 22 bp, Artificial Sequence
  chemically synthesized
tttaattttcaaagaaatattt

SEQ ID NO: 1319922 - DNA, 22 bp, Artificial Sequence
  chemically synthesized
atttcaaaaaagcaaaatattt

SEQ ID NO: 1319923 - DNA, 22 bp, Artificial Sequence
  chemically synthesized
aattttcaaagaaatattttgc

SEQ ID NO: 1319924 - DNA, 22 bp, Artificial Sequence
  chemically synthesized
catttcaaaaaagcaaaatatt

SEQ ID NO: 1319925 - DNA, 22 bp, Artificial Sequence
  chemically synthesized
attttcaaagaaatattttgct

SEQ ID NO: 1319926 - DNA, 22 bp, Artificial Sequence
  chemically synthesized
tttcatttcaaaaaagcaaaat

SEQ ID NO: 1319927 - DNA, 22 bp, Artificial Sequence
  chemically synthesized
atttcatttcaaaaaagcaaaa

SEQ ID NO: 1319928 - DNA, 22 bp, Artificial Sequence
  chemically synthesized
tcaaagaaatattttgcttttt

SEQ ID NO: 1319929 - DNA, 22 bp, Artificial Sequence
  chemically synthesized
tatttcatttcaaaaaagcaaa

SEQ ID NO: 1319930 - DNA, 22 bp, Artificial Sequence
  chemically synthesized
caaagaaatattttgctttttt

SEQ ID NO: 1319931 - DNA, 22 bp, Artificial Sequence
  chemically synthesized
aaagaaatattttgcttttttg

SEQ ID NO: 1319932 - DNA, 22 bp, Artificial Sequence
  chemically synthesized
tgcttttttgaaatgaaataaa

SEQ ID NO: 1319933 - DNA, 22 bp, Artificial Sequence
  chemically synthesized
gcttttttgaaatgaaataaag

SEQ ID NO: 1319934 - DNA, 22 bp, Artificial Sequence
  chemically synthesized
cttttttgaaatgaaataaaga

SEQ ID NO: 1319935 - DNA, 22 bp, Artificial Sequence
  chemically synthesized
atgaacaagaaatgtctttatt

SEQ ID NO: 1319936 - DNA, 22 bp, Artificial Sequence
  chemically synthesized
ttttgaaatgaaataaagacat

SEQ ID NO: 1319937 - DNA, 22 bp, Artificial Sequence
  chemically synthesized
tttgaaatgaaataaagacatt

SEQ ID NO: 1319938 - DNA, 22 bp, Artificial Sequence
  chemically synthesized
ttgaaatgaaataaagacattt

SEQ ID NO: 1319939 - DNA, 22 bp, Artificial Sequence
  chemically synthesized
tgaaatgaaataaagacatttc

SEQ ID NO: 1319940 - DNA, 22 bp, Artificial Sequence
  chemically synthesized
gaaatgaaataaagacatttct

SEQ ID NO: 1319941 - DNA, 22 bp, Artificial Sequence
  chemically synthesized
aaatgaaataaagacatttctt

SEQ ID NO: 1319942 - DNA, 22 bp, Artificial Sequence
  chemically synthesized
ccagagccagtcattaatgaac

SEQ ID NO: 1319943 - DNA, 22 bp, Artificial Sequence
  chemically synthesized
accagagccagtcattaatgaa

SEQ ID NO: 1319944 - DNA, 22 bp, Artificial Sequence
  chemically synthesized
taccagagccagtcattaatga

SEQ ID NO: 1319945 - DNA, 22 bp, Artificial Sequence
  chemically synthesized
ttaccagagccagtcattaatg

SEQ ID NO: 1319946 - DNA, 22 bp, Artificial Sequence
  chemically synthesized
cttgttcattaatgactggctc

SEQ ID NO: 1319947 - DNA, 22 bp, Artificial Sequence
  chemically synthesized
ttgttcattaatgactggctct

SEQ ID NO: 1319948 - DNA, 22 bp, Artificial Sequence
  chemically synthesized
tgtcacttttaccagagccagt

SEQ ID NO: 1319949 - DNA, 22 bp, Artificial Sequence
  chemically synthesized
gttcattaatgactggctctgg

SEQ ID NO: 1319950 - DNA, 22 bp, Artificial Sequence
  chemically synthesized
gtgtcacttttaccagagccag

SEQ ID NO: 1319951 - DNA, 22 bp, Artificial Sequence
  chemically synthesized
ttcattaatgactggctctggt

SEQ ID NO: 1319952 - DNA, 22 bp, Artificial Sequence
  chemically synthesized
tgtgtcacttttaccagagcca

SEQ ID NO: 1319953 - DNA, 22 bp, Artificial Sequence
  chemically synthesized
ttgtgtcacttttaccagagcc

SEQ ID NO: 1319954 - DNA, 22 bp, Artificial Sequence
  chemically synthesized
tttgtgtcacttttaccagagc

SEQ ID NO: 1319955 - DNA, 22 bp, Artificial Sequence
  chemically synthesized
attaatgactggctctggtaaa

SEQ ID NO: 1319956 - DNA, 22 bp, Artificial Sequence
  chemically synthesized
atgactggctctggtaaaagtg

SEQ ID NO: 1319957 - DNA, 22 bp, Artificial Sequence
  chemically synthesized
acctttttgtgtcacttttacc

SEQ ID NO: 1319958 - DNA, 22 bp, Artificial Sequence
  chemically synthesized
cactcacctttttgtgtcactt

SEQ ID NO: 1319959 - DNA, 22 bp, Artificial Sequence
  chemically synthesized
gctctggtaaaagtgacacaaa

SEQ ID NO: 1319960 - DNA, 22 bp, Artificial Sequence
  chemically synthesized
ttacactcacctttttgtgtca

SEQ ID NO: 1319961 - DNA, 22 bp, Artificial Sequence
  chemically synthesized
tggtaaaagtgacacaaaaagg

SEQ ID NO: 1319962 - DNA, 22 bp, Artificial Sequence
  chemically synthesized
gtaaaagtgacacaaaaaggtg

SEQ ID NO: 1319963 - DNA, 22 bp, Artificial Sequence
  chemically synthesized
cataacactgttacactcacct

SEQ ID NO: 1319964 - DNA, 22 bp, Artificial Sequence
  chemically synthesized
ccataacactgttacactcacc

SEQ ID NO: 1319965 - DNA, 22 bp, Artificial Sequence
  chemically synthesized
tccataacactgttacactcac

SEQ ID NO: 1319966 - DNA, 22 bp, Artificial Sequence
  chemically synthesized
ttccataacactgttacactca

SEQ ID NO: 1319967 - DNA, 22 bp, Artificial Sequence
  chemically synthesized
tttccataacactgttacactc

SEQ ID NO: 1319968 - DNA, 22 bp, Artificial Sequence
  chemically synthesized
atctttttccataacactgtta

SEQ ID NO: 1319969 - DNA, 22 bp, Artificial Sequence
  chemically synthesized
catctttttccataacactgtt

SEQ ID NO: 1319970 - DNA, 22 bp, Artificial Sequence
  chemically synthesized
tttcatctttttccataacact

SEQ ID NO: 1319971 - DNA, 22 bp, Artificial Sequence
  chemically synthesized
tcctgtttcatctttttccata

SEQ ID NO: 1319972 - DNA, 22 bp, Artificial Sequence
  chemically synthesized
ctatcctgtttcatctttttcc

SEQ ID NO: 1319973 - DNA, 22 bp, Artificial Sequence
  chemically synthesized
actatcctgtttcatctttttc

SEQ ID NO: 1319974 - DNA, 22 bp, Artificial Sequence
  chemically synthesized
tactatcctgtttcatcttttt

SEQ ID NO: 1319975 - DNA, 22 bp, Artificial Sequence
  chemically synthesized
ttttactatcctgtttcatctt

SEQ ID NO: 1319976 - DNA, 22 bp, Artificial Sequence
  chemically synthesized
agttattttactatcctgtttc

SEQ ID NO: 1319977 - DNA, 22 bp, Artificial Sequence
  chemically synthesized
tggaaaaagatgaaacaggata

SEQ ID NO: 1319978 - DNA, 22 bp, Artificial Sequence
  chemically synthesized
tcagttattttactatcctgtt

SEQ ID NO: 1319979 - DNA, 22 bp, Artificial Sequence
  chemically synthesized
atctctcagttattttactatc

SEQ ID NO: 1319980 - DNA, 22 bp, Artificial Sequence
  chemically synthesized
ctcatctctcagttattttact

SEQ ID NO: 1319981 - DNA, 22 bp, Artificial Sequence
  chemically synthesized
gctcatctctcagttattttac

SEQ ID NO: 1319982 - DNA, 22 bp, Artificial Sequence
  chemically synthesized
tttgctcatctctcagttattt

SEQ ID NO: 1319983 - DNA, 22 bp, Artificial Sequence
  chemically synthesized
gatgggccaggctatttgctca

SEQ ID NO: 1319984 - DNA, 22 bp, Artificial Sequence
  chemically synthesized
ctggatgggccaggctatttgc

SEQ ID NO: 1319985 - DNA, 22 bp, Artificial Sequence
  chemically synthesized
agagatgagcaaatagcctggc

SEQ ID NO: 1319986 - DNA, 22 bp, Artificial Sequence
  chemically synthesized
cgttgctggatgggccaggcta

SEQ ID NO: 1319987 - DNA, 22 bp, Artificial Sequence
  chemically synthesized
gatatatgtgtctacgttgctg

SEQ ID NO: 1319988 - DNA, 22 bp, Artificial Sequence
  chemically synthesized
agatatatgtgtctacgttgct

SEQ ID NO: 1319989 - DNA, 22 bp, Artificial Sequence
  chemically synthesized
gcccatccagcaacgtagacac

SEQ ID NO: 1319990 - DNA, 22 bp, Artificial Sequence
  chemically synthesized
acatttagatatatgtgtctac

SEQ ID NO: 1319991 - DNA, 22 bp, Artificial Sequence
  chemically synthesized
cacatttagatatatgtgtcta

SEQ ID NO: 1319992 - DNA, 22 bp, Artificial Sequence
  chemically synthesized
aacccgccaacttcacatttag

SEQ ID NO: 1319993 - DNA, 22 bp, Artificial Sequence
  chemically synthesized
gaacccgccaacttcacattta

SEQ ID NO: 1319994 - DNA, 22 bp, Artificial Sequence
  chemically synthesized
gtttgaacccgccaacttcaca

SEQ ID NO: 1319995 - DNA, 22 bp, Artificial Sequence
  chemically synthesized
aatgtgaagttggcgggttcaa

SEQ ID NO: 1319996 - DNA, 22 bp, Artificial Sequence
  chemically synthesized
atggcgccaatattcgtttgaa

SEQ ID NO: 1319997 - DNA, 22 bp, Artificial Sequence
  chemically synthesized
ctcatggcgccaatattcgttt

SEQ ID NO: 1319998 - DNA, 22 bp, Artificial Sequence
  chemically synthesized
gcgggttcaaacgaatattggc

SEQ ID NO: 1319999 - DNA, 22 bp, Artificial Sequence
  chemically synthesized
aaacgaatattggcgccatgag

SEQ ID NO: 1320000 - DNA, 22 bp, Artificial Sequence
  chemically synthesized
gcgccatgaggaggctcatgat

SEQ ID NO: 1320001 - DNA, 22 bp, Artificial Sequence
  chemically synthesized
agtagcaatagatatcatgagc

SEQ ID NO: 1320002 - DNA, 22 bp, Artificial Sequence
  chemically synthesized
atgatatctattgctactcaat

SEQ ID NO: 1320003 - DNA, 22 bp, Artificial Sequence
  chemically synthesized
ttgctactcaattcattttttt

SEQ ID NO: 1320004 - DNA, 22 bp, Artificial Sequence
  chemically synthesized
aaaaaaaaaaaaaaaaaaatga

SEQ ID NO: 1320005 - DNA, 22 bp, Artificial Sequence
  chemically synthesized
ctactcaattcatttttttttt

SEQ ID NO: 1320006 - DNA, 22 bp, Artificial Sequence
  chemically synthesized
tctcaaaaaaaaaaaaaaaaaa

SEQ ID NO: 1320007 - DNA, 22 bp, Artificial Sequence
  chemically synthesized
ctcaattcattttttttttttt

SEQ ID NO: 1320008 - DNA, 22 bp, Artificial Sequence
  chemically synthesized
tgtctcaaaaaaaaaaaaaaaa

SEQ ID NO: 1320009 - DNA, 22 bp, Artificial Sequence
  chemically synthesized
aattcatttttttttttttttt

SEQ ID NO: 1320010 - DNA, 22 bp, Artificial Sequence
  chemically synthesized
atttttttttttttttttttga

SEQ ID NO: 1320011 - DNA, 22 bp, Artificial Sequence
  chemically synthesized
ttttttttttttttttgagaca

SEQ ID NO: 1320012 - DNA, 22 bp, Artificial Sequence
  chemically synthesized
tttttttttttttttgagacag

SEQ ID NO: 1320013 - DNA, 22 bp, Artificial Sequence
  chemically synthesized
ttttttttttttttgagacaga

SEQ ID NO: 1320014 - DNA, 22 bp, Artificial Sequence
  chemically synthesized
tttttttttttttgagacagag

SEQ ID NO: 1320015 - DNA, 22 bp, Artificial Sequence
  chemically synthesized
ttttttttttttgagacagagt

SEQ ID NO: 1320016 - DNA, 22 bp, Artificial Sequence
  chemically synthesized
tttttttttttgagacagagtc

SEQ ID NO: 1320017 - DNA, 22 bp, Artificial Sequence
  chemically synthesized
ttttttttttgagacagagtct

SEQ ID NO: 1320018 - DNA, 22 bp, Artificial Sequence
  chemically synthesized
ggtgacagagcaagactctgtc

SEQ ID NO: 1320019 - DNA, 22 bp, Artificial Sequence
  chemically synthesized
tttttttttgagacagagtctt

SEQ ID NO: 1320020 - DNA, 22 bp, Artificial Sequence
  chemically synthesized
ttttttttgagacagagtcttg

SEQ ID NO: 1320021 - DNA, 22 bp, Artificial Sequence
  chemically synthesized
tttttttgagacagagtcttgc

SEQ ID NO: 1320022 - DNA, 22 bp, Artificial Sequence
  chemically synthesized
ttttttgagacagagtcttgct

SEQ ID NO: 1320023 - DNA, 22 bp, Artificial Sequence
  chemically synthesized
tttttgagacagagtcttgctc

SEQ ID NO: 1320024 - DNA, 22 bp, Artificial Sequence
  chemically synthesized
ttttgagacagagtcttgctct

SEQ ID NO: 1320025 - DNA, 22 bp, Artificial Sequence
  chemically synthesized
tttgagacagagtcttgctctg

SEQ ID NO: 1320026 - DNA, 22 bp, Artificial Sequence
  chemically synthesized
cagcctgggtgacagagcaaga

SEQ ID NO: 1320027 - DNA, 22 bp, Artificial Sequence
  chemically synthesized
ttgagacagagtcttgctctgt

SEQ ID NO: 1320028 - DNA, 22 bp, Artificial Sequence
  chemically synthesized
tgagacagagtcttgctctgtc

SEQ ID NO: 1320029 - DNA, 22 bp, Artificial Sequence
  chemically synthesized
gagacagagtcttgctctgtca

SEQ ID NO: 1320030 - DNA, 22 bp, Artificial Sequence
  chemically synthesized
agacagagtcttgctctgtcac

SEQ ID NO: 1320031 - DNA, 22 bp, Artificial Sequence
  chemically synthesized
cactccagcctgggtgacagag

SEQ ID NO: 1320032 - DNA, 22 bp, Artificial Sequence
  chemically synthesized
gctctgtcacccaggctggagt

SEQ ID NO: 1320033 - DNA, 22 bp, Artificial Sequence
  chemically synthesized
ctctgtcacccaggctggagtg

SEQ ID NO: 1320034 - DNA, 22 bp, Artificial Sequence
  chemically synthesized
tgtcacccaggctggagtgcag

SEQ ID NO: 1320035 - DNA, 22 bp, Artificial Sequence
  chemically synthesized
tcacccaggctggagtgcagtg

SEQ ID NO: 1320036 - DNA, 22 bp, Artificial Sequence
  chemically synthesized
cagtgagccgagatcgtgacac

SEQ ID NO: 1320037 - DNA, 22 bp, Artificial Sequence
  chemically synthesized
gagtgcagtgtcacgatctcgg

SEQ ID NO: 1320038 - DNA, 22 bp, Artificial Sequence
  chemically synthesized
ggaggcagaggttgcagtgagc

SEQ ID NO: 1320039 - DNA, 22 bp, Artificial Sequence
  chemically synthesized
aacctgggaggcagaggttgca

SEQ ID NO: 1320040 - DNA, 22 bp, Artificial Sequence
  chemically synthesized
aaacctgggaggcagaggttgc

SEQ ID NO: 1320041 - DNA, 22 bp, Artificial Sequence
  chemically synthesized
ggctcactgcaacctctgcctc

SEQ ID NO: 1320042 - DNA, 22 bp, Artificial Sequence
  chemically synthesized
actgcaacctctgcctcccagg

SEQ ID NO: 1320043 - DNA, 22 bp, Artificial Sequence
  chemically synthesized
caacctctgcctcccaggttta

SEQ ID NO: 1320044 - DNA, 22 bp, Artificial Sequence
  chemically synthesized
aggcaggagaagtgcttaaacc

SEQ ID NO: 1320045 - DNA, 22 bp, Artificial Sequence
  chemically synthesized
tgcctcccaggtttaagcactt

SEQ ID NO: 1320046 - DNA, 22 bp, Artificial Sequence
  chemically synthesized
cctcccaggtttaagcacttct

SEQ ID NO: 1320047 - DNA, 22 bp, Artificial Sequence
  chemically synthesized
ggaggctgaggcaggagaagtg

SEQ ID NO: 1320048 - DNA, 22 bp, Artificial Sequence
  chemically synthesized
ccaggtttaagcacttctcctg

SEQ ID NO: 1320049 - DNA, 22 bp, Artificial Sequence
  chemically synthesized
gggaggctgaggcaggagaagt

SEQ ID NO: 1320050 - DNA, 22 bp, Artificial Sequence
  chemically synthesized
cttgggaggctgaggcaggaga

SEQ ID NO: 1320051 - DNA, 22 bp, Artificial Sequence
  chemically synthesized
aagcacttctcctgcctcagcc

SEQ ID NO: 1320052 - DNA, 22 bp, Artificial Sequence
  chemically synthesized
agcacttctcctgcctcagcct

SEQ ID NO: 1320053 - DNA, 22 bp, Artificial Sequence
  chemically synthesized
tagtcccagctacttgggaggc

SEQ ID NO: 1320054 - DNA, 22 bp, Artificial Sequence
  chemically synthesized
ctcctgcctcagcctcccaagt

SEQ ID NO: 1320055 - DNA, 22 bp, Artificial Sequence
  chemically synthesized
tcctgcctcagcctcccaagta

SEQ ID NO: 1320056 - DNA, 22 bp, Artificial Sequence
  chemically synthesized
ctgcctcagcctcccaagtagc

SEQ ID NO: 1320057 - DNA, 22 bp, Artificial Sequence
  chemically synthesized
cctcagcctcccaagtagctgg

SEQ ID NO: 1320058 - DNA, 22 bp, Artificial Sequence
  chemically synthesized
agcctcccaagtagctgggact

SEQ ID NO: 1320059 - DNA, 22 bp, Artificial Sequence
  chemically synthesized
ccaagtagctgggactacaggc

SEQ ID NO: 1320060 - DNA, 22 bp, Artificial Sequence
  chemically synthesized
ggtgtggtggtgcgtgcctgta

SEQ ID NO: 1320061 - DNA, 22 bp, Artificial Sequence
  chemically synthesized
gctgggtgtggtggtgcgtgcc

SEQ ID NO: 1320062 - DNA, 22 bp, Artificial Sequence
  chemically synthesized
ggactacaggcacgcaccacca

SEQ ID NO: 1320063 - DNA, 22 bp, Artificial Sequence
  chemically synthesized
caggcacgcaccaccacaccca

SEQ ID NO: 1320064 - DNA, 22 bp, Artificial Sequence
  chemically synthesized
aaaatagaaaaattagctgggt

SEQ ID NO: 1320065 - DNA, 22 bp, Artificial Sequence
  chemically synthesized
ctaaaaatagaaaaattagctg

SEQ ID NO: 1320066 - DNA, 22 bp, Artificial Sequence
  chemically synthesized
tactaaaaatagaaaaattagc

SEQ ID NO: 1320067 - DNA, 22 bp, Artificial Sequence
  chemically synthesized
atttttctatttttagtagaga

SEQ ID NO: 1320068 - DNA, 22 bp, Artificial Sequence
  chemically synthesized
ttctatttttagtagagacggg

SEQ ID NO: 1320069 - DNA, 22 bp, Artificial Sequence
  chemically synthesized
tctatttttagtagagacgggg

SEQ ID NO: 1320070 - DNA, 22 bp, Artificial Sequence
  chemically synthesized
ctatttttagtagagacggggt

SEQ ID NO: 1320071 - DNA, 22 bp, Artificial Sequence
  chemically synthesized
tatttttagtagagacggggtt

SEQ ID NO: 1320072 - DNA, 22 bp, Artificial Sequence
  chemically synthesized
gccaacatggtgaaaccccgtc

SEQ ID NO: 1320073 - DNA, 22 bp, Artificial Sequence
  chemically synthesized
tttttagtagagacggggtttc

SEQ ID NO: 1320074 - DNA, 22 bp, Artificial Sequence
  chemically synthesized
ttagtagagacggggtttcacc

SEQ ID NO: 1320075 - DNA, 22 bp, Artificial Sequence
  chemically synthesized
tagtagagacggggtttcacca

SEQ ID NO: 1320076 - DNA, 22 bp, Artificial Sequence
  chemically synthesized
agtagagacggggtttcaccat

SEQ ID NO: 1320077 - DNA, 22 bp, Artificial Sequence
  chemically synthesized
gtagagacggggtttcaccatg

SEQ ID NO: 1320078 - DNA, 22 bp, Artificial Sequence
  chemically synthesized
caccatgttggccaggatggtc

SEQ ID NO: 1320079 - DNA, 22 bp, Artificial Sequence
  chemically synthesized
accatgttggccaggatggtct

SEQ ID NO: 1320080 - DNA, 22 bp, Artificial Sequence
  chemically synthesized
gccaggatggtctcgatctctt

SEQ ID NO: 1320081 - DNA, 22 bp, Artificial Sequence
  chemically synthesized
gtggatcatgaggtcaagagat

SEQ ID NO: 1320082 - DNA, 22 bp, Artificial Sequence
  chemically synthesized
gatctcttgacctcatgatcca

SEQ ID NO: 1320083 - DNA, 22 bp, Artificial Sequence
  chemically synthesized
ggaggccgaggctggtggatca

SEQ ID NO: 1320084 - DNA, 22 bp, Artificial Sequence
  chemically synthesized
gggaggccgaggctggtggatc

SEQ ID NO: 1320085 - DNA, 22 bp, Artificial Sequence
  chemically synthesized
tgggaggccgaggctggtggat

SEQ ID NO: 1320086 - DNA, 22 bp, Artificial Sequence
  chemically synthesized
ttgacctcatgatccaccagcc

SEQ ID NO: 1320087 - DNA, 22 bp, Artificial Sequence
  chemically synthesized
gacctcatgatccaccagcctc

SEQ ID NO: 1320088 - DNA, 22 bp, Artificial Sequence
  chemically synthesized
acctcatgatccaccagcctcg

SEQ ID NO: 1320089 - DNA, 22 bp, Artificial Sequence
  chemically synthesized
acactttgggaggccgaggctg

SEQ ID NO: 1320090 - DNA, 22 bp, Artificial Sequence
  chemically synthesized
atgatccaccagcctcggcctc

SEQ ID NO: 1320091 - DNA, 22 bp, Artificial Sequence
  chemically synthesized
taatcctaacactttgggaggc

SEQ ID NO: 1320092 - DNA, 22 bp, Artificial Sequence
  chemically synthesized
acgcctgtaatcctaacacttt

SEQ ID NO: 1320093 - DNA, 22 bp, Artificial Sequence
  chemically synthesized
ggcctcccaaagtgttaggatt

SEQ ID NO: 1320094 - DNA, 22 bp, Artificial Sequence
  chemically synthesized
ccaaagtgttaggattacaggc

SEQ ID NO: 1320095 - DNA, 22 bp, Artificial Sequence
  chemically synthesized
ggattacaggcgtgagccaccg

SEQ ID NO: 1320096 - DNA, 22 bp, Artificial Sequence
  chemically synthesized
caggcgtgagccaccgtgcggc

SEQ ID NO: 1320097 - DNA, 22 bp, Artificial Sequence
  chemically synthesized
agaatggagaagcaacagggcc

SEQ ID NO: 1320098 - DNA, 22 bp, Artificial Sequence
  chemically synthesized
gagcaatcagttaagaatggag

SEQ ID NO: 1320099 - DNA, 22 bp, Artificial Sequence
  chemically synthesized
ttgcttctccattcttaactga

SEQ ID NO: 1320100 - DNA, 22 bp, Artificial Sequence
  chemically synthesized
taaagctggagcaatcagttaa

SEQ ID NO: 1320101 - DNA, 22 bp, Artificial Sequence
  chemically synthesized
cttctccattcttaactgattg

SEQ ID NO: 1320102 - DNA, 22 bp, Artificial Sequence
  chemically synthesized
gtaaagctggagcaatcagtta

SEQ ID NO: 1320103 - DNA, 22 bp, Artificial Sequence
  chemically synthesized
tgtaaagctggagcaatcagtt

SEQ ID NO: 1320104 - DNA, 22 bp, Artificial Sequence
  chemically synthesized
ctccattcttaactgattgctc

SEQ ID NO: 1320105 - DNA, 22 bp, Artificial Sequence
  chemically synthesized
tccattcttaactgattgctcc

SEQ ID NO: 1320106 - DNA, 22 bp, Artificial Sequence
  chemically synthesized
cattcttaactgattgctccag

SEQ ID NO: 1320107 - DNA, 22 bp, Artificial Sequence
  chemically synthesized
tcattttgtaaagctggagcaa

SEQ ID NO: 1320108 - DNA, 22 bp, Artificial Sequence
  chemically synthesized
atcattttgtaaagctggagca

SEQ ID NO: 1320109 - DNA, 22 bp, Artificial Sequence
  chemically synthesized
ttaactgattgctccagcttta

SEQ ID NO: 1320110 - DNA, 22 bp, Artificial Sequence
  chemically synthesized
aactgattgctccagctttaca

SEQ ID NO: 1320111 - DNA, 22 bp, Artificial Sequence
  chemically synthesized
ggtttatcattttgtaaagctg

SEQ ID NO: 1320112 - DNA, 22 bp, Artificial Sequence
  chemically synthesized
actgattgctccagctttacaa

SEQ ID NO: 1320113 - DNA, 22 bp, Artificial Sequence
  chemically synthesized
ctgggtttatcattttgtaaag

SEQ ID NO: 1320114 - DNA, 22 bp, Artificial Sequence
  chemically synthesized
attgctccagctttacaaaatg

SEQ ID NO: 1320115 - DNA, 22 bp, Artificial Sequence
  chemically synthesized
ctccagctttacaaaatgataa

SEQ ID NO: 1320116 - DNA, 22 bp, Artificial Sequence
  chemically synthesized
cagctttacaaaatgataaacc

SEQ ID NO: 1320117 - DNA, 22 bp, Artificial Sequence
  chemically synthesized
tacaaaatgataaacccaggaa

SEQ ID NO: 1320118 - DNA, 22 bp, Artificial Sequence
  chemically synthesized
acaaaatgataaacccaggaat

SEQ ID NO: 1320119 - DNA, 22 bp, Artificial Sequence
  chemically synthesized
caaaatgataaacccaggaatt

SEQ ID NO: 1320120 - DNA, 22 bp, Artificial Sequence
  chemically synthesized
taggcgtgagacacaattcctg

SEQ ID NO: 1320121 - DNA, 22 bp, Artificial Sequence
  chemically synthesized
ggattataggcgtgagacacaa

SEQ ID NO: 1320122 - DNA, 22 bp, Artificial Sequence
  chemically synthesized
tgtctcacgcctataatcccag

SEQ ID NO: 1320123 - DNA, 22 bp, Artificial Sequence
  chemically synthesized
agtcccccaggtagctgggatt

SEQ ID NO: 1320124 - DNA, 22 bp, Artificial Sequence
  chemically synthesized
cagtcccccaggtagctgggat

SEQ ID NO: 1320125 - DNA, 22 bp, Artificial Sequence
  chemically synthesized
acgcctataatcccagctacct

SEQ ID NO: 1320126 - DNA, 22 bp, Artificial Sequence
  chemically synthesized
ccacttcagtcccccaggtagc

SEQ ID NO: 1320127 - DNA, 22 bp, Artificial Sequence
  chemically synthesized
tcccacttcagtcccccaggta

SEQ ID NO: 1320128 - DNA, 22 bp, Artificial Sequence
  chemically synthesized
taatcccagctacctgggggac

SEQ ID NO: 1320129 - DNA, 22 bp, Artificial Sequence
  chemically synthesized
ttctcccacttcagtcccccag

SEQ ID NO: 1320130 - DNA, 22 bp, Artificial Sequence
  chemically synthesized
aagttattctcccacttcagtc

SEQ ID NO: 1320131 - DNA, 22 bp, Artificial Sequence
  chemically synthesized
cctgggggactgaagtgggaga

SEQ ID NO: 1320132 - DNA, 22 bp, Artificial Sequence
  chemically synthesized
ggctcaagttattctcccactt

SEQ ID NO: 1320133 - DNA, 22 bp, Artificial Sequence
  chemically synthesized
ctgggctcaagttattctccca

SEQ ID NO: 1320134 - DNA, 22 bp, Artificial Sequence
  chemically synthesized
ggggactgaagtgggagaataa

SEQ ID NO: 1320135 - DNA, 22 bp, Artificial Sequence
  chemically synthesized
gaactcctgggctcaagttatt

SEQ ID NO: 1320136 - DNA, 22 bp, Artificial Sequence
  chemically synthesized
aagtgggagaataacttgagcc

SEQ ID NO: 1320137 - DNA, 22 bp, Artificial Sequence
  chemically synthesized
gcctggaactcctgggctcaag

SEQ ID NO: 1320138 - DNA, 22 bp, Artificial Sequence
  chemically synthesized
tgatgcccaggctggcctggaa

SEQ ID NO: 1320139 - DNA, 22 bp, Artificial Sequence
  chemically synthesized
gagcccaggagttccaggccag

SEQ ID NO: 1320140 - DNA, 22 bp, Artificial Sequence
  chemically synthesized
agcccaggagttccaggccagc

SEQ ID NO: 1320141 - DNA, 22 bp, Artificial Sequence
  chemically synthesized
actatgatgcccaggctggcct

SEQ ID NO: 1320142 - DNA, 22 bp, Artificial Sequence
  chemically synthesized
caggccagcctgggcatcatag

SEQ ID NO: 1320143 - DNA, 22 bp, Artificial Sequence
  chemically synthesized
agatggtgtctcactatgatgc

SEQ ID NO: 1320144 - DNA, 22 bp, Artificial Sequence
  chemically synthesized
gagatggtgtctcactatgatg

SEQ ID NO: 1320145 - DNA, 22 bp, Artificial Sequence
  chemically synthesized
tgagatggtgtctcactatgat

SEQ ID NO: 1320146 - DNA, 22 bp, Artificial Sequence
  chemically synthesized
ttgagatggtgtctcactatga

SEQ ID NO: 1320147 - DNA, 22 bp, Artificial Sequence
  chemically synthesized
tttgagatggtgtctcactatg

SEQ ID NO: 1320148 - DNA, 22 bp, Artificial Sequence
  chemically synthesized
ttttgagatggtgtctcactat

SEQ ID NO: 1320149 - DNA, 22 bp, Artificial Sequence
  chemically synthesized
tttttgagatggtgtctcacta

SEQ ID NO: 1320150 - DNA, 22 bp, Artificial Sequence
  chemically synthesized
ttttttgagatggtgtctcact

SEQ ID NO: 1320151 - DNA, 22 bp, Artificial Sequence
  chemically synthesized
tttttttttgagatggtgtctc

SEQ ID NO: 1320152 - DNA, 22 bp, Artificial Sequence
  chemically synthesized
ggcatcatagtgagacaccatc

SEQ ID NO: 1320153 - DNA, 22 bp, Artificial Sequence
  chemically synthesized
tcaggctgtttttttttgagat

SEQ ID NO: 1320154 - DNA, 22 bp, Artificial Sequence
  chemically synthesized
ttatcaggctgtttttttttga

SEQ ID NO: 1320155 - DNA, 22 bp, Artificial Sequence
  chemically synthesized
attatcaggctgtttttttttg

SEQ ID NO: 1320156 - DNA, 22 bp, Artificial Sequence
  chemically synthesized
acgtttattatcaggctgtttt

SEQ ID NO: 1320157 - DNA, 22 bp, Artificial Sequence
  chemically synthesized
tactgacgtttattatcaggct

SEQ ID NO: 1320158 - DNA, 22 bp, Artificial Sequence
  chemically synthesized
atactgacgtttattatcaggc

SEQ ID NO: 1320159 - DNA, 22 bp, Artificial Sequence
  chemically synthesized
aaaaaaaaacagcctgataata

SEQ ID NO: 1320160 - DNA, 22 bp, Artificial Sequence
  chemically synthesized
tatactgacgtttattatcagg

SEQ ID NO: 1320161 - DNA, 22 bp, Artificial Sequence
  chemically synthesized
ctttatactgacgtttattatc

SEQ ID NO: 1320162 - DNA, 22 bp, Artificial Sequence
  chemically synthesized
tatctcctttatactgacgttt

SEQ ID NO: 1320163 - DNA, 22 bp, Artificial Sequence
  chemically synthesized
ataataaacgtcagtataaagg

SEQ ID NO: 1320164 - DNA, 22 bp, Artificial Sequence
  chemically synthesized
cgagagtcacattgtatctcct

SEQ ID NO: 1320165 - DNA, 22 bp, Artificial Sequence
  chemically synthesized
ccgagagtcacattgtatctcc

SEQ ID NO: 1320166 - DNA, 22 bp, Artificial Sequence
  chemically synthesized
tccgagagtcacattgtatctc

SEQ ID NO: 1320167 - DNA, 22 bp, Artificial Sequence
  chemically synthesized
ttccgagagtcacattgtatct

SEQ ID NO: 1320168 - DNA, 22 bp, Artificial Sequence
  chemically synthesized
aaaatttttccgagagtcacat

SEQ ID NO: 1320169 - DNA, 22 bp, Artificial Sequence
  chemically synthesized
aaaaatttttccgagagtcaca

SEQ ID NO: 1320170 - DNA, 22 bp, Artificial Sequence
  chemically synthesized
taaaaatttttccgagagtcac

SEQ ID NO: 1320171 - DNA, 22 bp, Artificial Sequence
  chemically synthesized
ttaaaaatttttccgagagtca

SEQ ID NO: 1320172 - DNA, 22 bp, Artificial Sequence
  chemically synthesized
tttaaaaatttttccgagagtc

SEQ ID NO: 1320173 - DNA, 22 bp, Artificial Sequence
  chemically synthesized
ttttaaaaatttttccgagagt

SEQ ID NO: 1320174 - DNA, 22 bp, Artificial Sequence
  chemically synthesized
ataacttttttaaaaatttttc

SEQ ID NO: 1320175 - DNA, 22 bp, Artificial Sequence
  chemically synthesized
attcataacttttttaaaaatt

SEQ ID NO: 1320176 - DNA, 22 bp, Artificial Sequence
  chemically synthesized
aattcataacttttttaaaaat

SEQ ID NO: 1320177 - DNA, 22 bp, Artificial Sequence
  chemically synthesized
taattcataacttttttaaaaa

SEQ ID NO: 1320178 - DNA, 22 bp, Artificial Sequence
  chemically synthesized
ttaattcataacttttttaaaa

SEQ ID NO: 1320179 - DNA, 22 bp, Artificial Sequence
  chemically synthesized
tttaattcataacttttttaaa

SEQ ID NO: 1320180 - DNA, 22 bp, Artificial Sequence
  chemically synthesized
tcggaaaaatttttaaaaaagt

SEQ ID NO: 1320181 - DNA, 22 bp, Artificial Sequence
  chemically synthesized
ggaaaaatttttaaaaaagtta

SEQ ID NO: 1320182 - DNA, 22 bp, Artificial Sequence
  chemically synthesized
aaagttttttaattcataactt

SEQ ID NO: 1320183 - DNA, 22 bp, Artificial Sequence
  chemically synthesized
attcaaagttttttaattcata

SEQ ID NO: 1320184 - DNA, 22 bp, Artificial Sequence
  chemically synthesized
ttaaaaaagttatgaattaaaa

SEQ ID NO: 1320185 - DNA, 22 bp, Artificial Sequence
  chemically synthesized
taaaaaagttatgaattaaaaa

SEQ ID NO: 1320186 - DNA, 22 bp, Artificial Sequence
  chemically synthesized
aaaaaagttatgaattaaaaaa

SEQ ID NO: 1320187 - DNA, 22 bp, Artificial Sequence
  chemically synthesized
aaaaagttatgaattaaaaaac

SEQ ID NO: 1320188 - DNA, 22 bp, Artificial Sequence
  chemically synthesized
gcaaggctgattcaaagttttt

SEQ ID NO: 1320189 - DNA, 22 bp, Artificial Sequence
  chemically synthesized
agcaaggctgattcaaagtttt

SEQ ID NO: 1320190 - DNA, 22 bp, Artificial Sequence
  chemically synthesized
tagcaaggctgattcaaagttt

SEQ ID NO: 1320191 - DNA, 22 bp, Artificial Sequence
  chemically synthesized
ttagcaaggctgattcaaagtt

SEQ ID NO: 1320192 - DNA, 22 bp, Artificial Sequence
  chemically synthesized
tgaattaaaaaactttgaatca

SEQ ID NO: 1320193 - DNA, 22 bp, Artificial Sequence
  chemically synthesized
cttttagcaaggctgattcaaa

SEQ ID NO: 1320194 - DNA, 22 bp, Artificial Sequence
  chemically synthesized
acttttagcaaggctgattcaa

SEQ ID NO: 1320195 - DNA, 22 bp, Artificial Sequence
  chemically synthesized
tacttttagcaaggctgattca

SEQ ID NO: 1320196 - DNA, 22 bp, Artificial Sequence
  chemically synthesized
ttacttttagcaaggctgattc

SEQ ID NO: 1320197 - DNA, 22 bp, Artificial Sequence
  chemically synthesized
ttttacttttagcaaggctgat

SEQ ID NO: 1320198 - DNA, 22 bp, Artificial Sequence
  chemically synthesized
aaaaactttgaatcagccttgc

SEQ ID NO: 1320199 - DNA, 22 bp, Artificial Sequence
  chemically synthesized
ggttcttttacttttagcaagg

SEQ ID NO: 1320200 - DNA, 22 bp, Artificial Sequence
  chemically synthesized
aggttcttttacttttagcaag

SEQ ID NO: 1320201 - DNA, 22 bp, Artificial Sequence
  chemically synthesized
taggttcttttacttttagcaa

SEQ ID NO: 1320202 - DNA, 22 bp, Artificial Sequence
  chemically synthesized
tgaatcagccttgctaaaagta

SEQ ID NO: 1320203 - DNA, 22 bp, Artificial Sequence
  chemically synthesized
gaatcagccttgctaaaagtaa

SEQ ID NO: 1320204 - DNA, 22 bp, Artificial Sequence
  chemically synthesized
aatcagccttgctaaaagtaaa

SEQ ID NO: 1320205 - DNA, 22 bp, Artificial Sequence
  chemically synthesized
tgtactttaggttcttttactt

SEQ ID NO: 1320206 - DNA, 22 bp, Artificial Sequence
  chemically synthesized
gctaaaagtaaaagaacctaaa

SEQ ID NO: 1320207 - DNA, 22 bp, Artificial Sequence
  chemically synthesized
ctaaaagtaaaagaacctaaag

SEQ ID NO: 1320208 - DNA, 22 bp, Artificial Sequence
  chemically synthesized
aaagtaaaagaacctaaagtac

SEQ ID NO: 1320209 - DNA, 22 bp, Artificial Sequence
  chemically synthesized
atcaaatacccctgtgtacttt

SEQ ID NO: 1320210 - DNA, 22 bp, Artificial Sequence
  chemically synthesized
ctcatcaaatacccctgtgtac

SEQ ID NO: 1320211 - DNA, 22 bp, Artificial Sequence
  chemically synthesized
agggctcctcatcaaatacccc

SEQ ID NO: 1320212 - DNA, 22 bp, Artificial Sequence
  chemically synthesized
taagggctcctcatcaaatacc

SEQ ID NO: 1320213 - DNA, 22 bp, Artificial Sequence
  chemically synthesized
aagtacacaggggtatttgatg

SEQ ID NO: 1320214 - DNA, 22 bp, Artificial Sequence
  chemically synthesized
ctaagggctcctcatcaaatac

SEQ ID NO: 1320215 - DNA, 22 bp, Artificial Sequence
  chemically synthesized
cttctaagggctcctcatcaaa

SEQ ID NO: 1320216 - DNA, 22 bp, Artificial Sequence
  chemically synthesized
ggtcaacaagattacttctaag

SEQ ID NO: 1320217 - DNA, 22 bp, Artificial Sequence
  chemically synthesized
gatgaggagcccttagaagtaa

SEQ ID NO: 1320218 - DNA, 22 bp, Artificial Sequence
  chemically synthesized
aggtcaacaagattacttctaa

SEQ ID NO: 1320219 - DNA, 22 bp, Artificial Sequence
  chemically synthesized
atgaggagcccttagaagtaat

SEQ ID NO: 1320220 - DNA, 22 bp, Artificial Sequence
  chemically synthesized
taatatgcttaggtcaacaaga

SEQ ID NO: 1320221 - DNA, 22 bp, Artificial Sequence
  chemically synthesized
gtaatatgcttaggtcaacaag

SEQ ID NO: 1320222 - DNA, 22 bp, Artificial Sequence
  chemically synthesized
tgtaatatgcttaggtcaacaa

SEQ ID NO: 1320223 - DNA, 22 bp, Artificial Sequence
  chemically synthesized
ttgtaatatgcttaggtcaaca

SEQ ID NO: 1320224 - DNA, 22 bp, Artificial Sequence
  chemically synthesized
agaagtaatcttgttgacctaa

SEQ ID NO: 1320225 - DNA, 22 bp, Artificial Sequence
  chemically synthesized
gaagtaatcttgttgacctaag

SEQ ID NO: 1320226 - DNA, 22 bp, Artificial Sequence
  chemically synthesized
aatttttgtaatatgcttaggt

SEQ ID NO: 1320227 - DNA, 22 bp, Artificial Sequence
  chemically synthesized
caatttttgtaatatgcttagg

SEQ ID NO: 1320228 - DNA, 22 bp, Artificial Sequence
  chemically synthesized
atttcaatttttgtaatatgct

SEQ ID NO: 1320229 - DNA, 22 bp, Artificial Sequence
  chemically synthesized
gttgacctaagcatattacaaa

SEQ ID NO: 1320230 - DNA, 22 bp, Artificial Sequence
  chemically synthesized
ttgacctaagcatattacaaaa

SEQ ID NO: 1320231 - DNA, 22 bp, Artificial Sequence
  chemically synthesized
attaatttcaatttttgtaata

SEQ ID NO: 1320232 - DNA, 22 bp, Artificial Sequence
  chemically synthesized
acctaagcatattacaaaaatt

SEQ ID NO: 1320233 - DNA, 22 bp, Artificial Sequence
  chemically synthesized
gctcattaatttcaatttttgt

SEQ ID NO: 1320234 - DNA, 22 bp, Artificial Sequence
  chemically synthesized
agcatattacaaaaattgaaat

SEQ ID NO: 1320235 - DNA, 22 bp, Artificial Sequence
  chemically synthesized
caaaaattgaaattaatgagct

SEQ ID NO: 1320236 - DNA, 22 bp, Artificial Sequence
  chemically synthesized
ccgtgaagaataataattagct

SEQ ID NO: 1320237 - DNA, 22 bp, Artificial Sequence
  chemically synthesized
accgtgaagaataataattagc

SEQ ID NO: 1320238 - DNA, 22 bp, Artificial Sequence
  chemically synthesized
aaattaatgagctaattattat

SEQ ID NO: 1320239 - DNA, 22 bp, Artificial Sequence
  chemically synthesized
tatcttaccgtgaagaataata

SEQ ID NO: 1320240 - DNA, 22 bp, Artificial Sequence
  chemically synthesized
atgagctaattattattcttca

SEQ ID NO: 1320241 - DNA, 22 bp, Artificial Sequence
  chemically synthesized
tgtatcttaccgtgaagaataa

SEQ ID NO: 1320242 - DNA, 22 bp, Artificial Sequence
  chemically synthesized
ctgtatcttaccgtgaagaata

SEQ ID NO: 1320243 - DNA, 22 bp, Artificial Sequence
  chemically synthesized
cttctgtatcttaccgtgaaga

SEQ ID NO: 1320244 - DNA, 22 bp, Artificial Sequence
  chemically synthesized
tacttctgtatcttaccgtgaa

SEQ ID NO: 1320245 - DNA, 22 bp, Artificial Sequence
  chemically synthesized
attattattcttcacggtaaga

SEQ ID NO: 1320246 - DNA, 22 bp, Artificial Sequence
  chemically synthesized
aactctacttctgtatcttacc

SEQ ID NO: 1320247 - DNA, 22 bp, Artificial Sequence
  chemically synthesized
ttattcttcacggtaagataca

SEQ ID NO: 1320248 - DNA, 22 bp, Artificial Sequence
  chemically synthesized
tgaactctacttctgtatctta

SEQ ID NO: 1320249 - DNA, 22 bp, Artificial Sequence
  chemically synthesized
ttcttcacggtaagatacagaa

SEQ ID NO: 1320250 - DNA, 22 bp, Artificial Sequence
  chemically synthesized
tctgaactctacttctgtatct

SEQ ID NO: 1320251 - DNA, 22 bp, Artificial Sequence
  chemically synthesized
ttcacggtaagatacagaagta

SEQ ID NO: 1320252 - DNA, 22 bp, Artificial Sequence
  chemically synthesized
cacggtaagatacagaagtaga

SEQ ID NO: 1320253 - DNA, 22 bp, Artificial Sequence
  chemically synthesized
acggtaagatacagaagtagag

SEQ ID NO: 1320254 - DNA, 22 bp, Artificial Sequence
  chemically synthesized
tagaggcaaaatgtaaatattc

SEQ ID NO: 1320255 - DNA, 22 bp, Artificial Sequence
  chemically synthesized
gtagaggcaaaatgtaaatatt

SEQ ID NO: 1320256 - DNA, 22 bp, Artificial Sequence
  chemically synthesized
tgtagaggcaaaatgtaaatat

SEQ ID NO: 1320257 - DNA, 22 bp, Artificial Sequence
  chemically synthesized
ttgtagaggcaaaatgtaaata

SEQ ID NO: 1320258 - DNA, 22 bp, Artificial Sequence
  chemically synthesized
agagaatatttacattttgcct

SEQ ID NO: 1320259 - DNA, 22 bp, Artificial Sequence
  chemically synthesized
aacgtccttttgtagaggcaaa

SEQ ID NO: 1320260 - DNA, 22 bp, Artificial Sequence
  chemically synthesized
aaacgtccttttgtagaggcaa

SEQ ID NO: 1320261 - DNA, 22 bp, Artificial Sequence
  chemically synthesized
taaacgtccttttgtagaggca

SEQ ID NO: 1320262 - DNA, 22 bp, Artificial Sequence
  chemically synthesized
ttaaacgtccttttgtagaggc

SEQ ID NO: 1320263 - DNA, 22 bp, Artificial Sequence
  chemically synthesized
tttaaacgtccttttgtagagg

SEQ ID NO: 1320264 - DNA, 22 bp, Artificial Sequence
  chemically synthesized
ttttaaacgtccttttgtagag

SEQ ID NO: 1320265 - DNA, 22 bp, Artificial Sequence
  chemically synthesized
tttttaaacgtccttttgtaga

SEQ ID NO: 1320266 - DNA, 22 bp, Artificial Sequence
  chemically synthesized
ttttttaaacgtccttttgtag

SEQ ID NO: 1320267 - DNA, 22 bp, Artificial Sequence
  chemically synthesized
acattttgcctctacaaaagga

SEQ ID NO: 1320268 - DNA, 22 bp, Artificial Sequence
  chemically synthesized
tttttttaaacgtccttttgta

SEQ ID NO: 1320269 - DNA, 22 bp, Artificial Sequence
  chemically synthesized
cattttgcctctacaaaaggac

SEQ ID NO: 1320270 - DNA, 22 bp, Artificial Sequence
  chemically synthesized
tttttttttaaacgtccttttg

SEQ ID NO: 1320271 - DNA, 22 bp, Artificial Sequence
  chemically synthesized
ctttttttttaaacgtcctttt

SEQ ID NO: 1320272 - DNA, 22 bp, Artificial Sequence
  chemically synthesized
tgcctctacaaaaggacgttta

SEQ ID NO: 1320273 - DNA, 22 bp, Artificial Sequence
  chemically synthesized
gcctctacaaaaggacgtttaa

SEQ ID NO: 1320274 - DNA, 22 bp, Artificial Sequence
  chemically synthesized
cctctacaaaaggacgtttaaa

SEQ ID NO: 1320275 - DNA, 22 bp, Artificial Sequence
  chemically synthesized
tacaaaaggacgtttaaaaaaa

SEQ ID NO: 1320276 - DNA, 22 bp, Artificial Sequence
  chemically synthesized
caaaaggacgtttaaaaaaaaa

SEQ ID NO: 1320277 - DNA, 22 bp, Artificial Sequence
  chemically synthesized
ccgagaggcttcttttttttta

SEQ ID NO: 1320278 - DNA, 22 bp, Artificial Sequence
  chemically synthesized
tcccgagaggcttctttttttt

SEQ ID NO: 1320279 - DNA, 22 bp, Artificial Sequence
  chemically synthesized
ctcccgagaggcttcttttttt

SEQ ID NO: 1320280 - DNA, 22 bp, Artificial Sequence
  chemically synthesized
tctcccgagaggcttctttttt

SEQ ID NO: 1320281 - DNA, 22 bp, Artificial Sequence
  chemically synthesized
ttctcccgagaggcttcttttt

SEQ ID NO: 1320282 - DNA, 22 bp, Artificial Sequence
  chemically synthesized
atttttctcccgagaggcttct

SEQ ID NO: 1320283 - DNA, 22 bp, Artificial Sequence
  chemically synthesized
catttttctcccgagaggcttc

SEQ ID NO: 1320284 - DNA, 22 bp, Artificial Sequence
  chemically synthesized
aaaaaaaaagaagcctctcggg

SEQ ID NO: 1320285 - DNA, 22 bp, Artificial Sequence
  chemically synthesized
cttcatttttctcccgagaggc

SEQ ID NO: 1320286 - DNA, 22 bp, Artificial Sequence
  chemically synthesized
aaaaaaaagaagcctctcggga

SEQ ID NO: 1320287 - DNA, 22 bp, Artificial Sequence
  chemically synthesized
tacttcatttttctcccgagag

SEQ ID NO: 1320288 - DNA, 22 bp, Artificial Sequence
  chemically synthesized
ctctacttcatttttctcccga

SEQ ID NO: 1320289 - DNA, 22 bp, Artificial Sequence
  chemically synthesized
gctctacttcatttttctcccg

SEQ ID NO: 1320290 - DNA, 22 bp, Artificial Sequence
  chemically synthesized
tgctctacttcatttttctccc

SEQ ID NO: 1320291 - DNA, 22 bp, Artificial Sequence
  chemically synthesized
tcgggagaaaaatgaagtagag

SEQ ID NO: 1320292 - DNA, 22 bp, Artificial Sequence
  chemically synthesized
agtaagtcctttgctctacttc

SEQ ID NO: 1320293 - DNA, 22 bp, Artificial Sequence
  chemically synthesized
gggagaaaaatgaagtagagca

SEQ ID NO: 1320294 - DNA, 22 bp, Artificial Sequence
  chemically synthesized
gagtaagtcctttgctctactt

SEQ ID NO: 1320295 - DNA, 22 bp, Artificial Sequence
  chemically synthesized
aacttgagtaagtcctttgctc

SEQ ID NO: 1320296 - DNA, 22 bp, Artificial Sequence
  chemically synthesized
aaacttgagtaagtcctttgct

SEQ ID NO: 1320297 - DNA, 22 bp, Artificial Sequence
  chemically synthesized
caaatttaaacttgagtaagtc

SEQ ID NO: 1320298 - DNA, 22 bp, Artificial Sequence
  chemically synthesized
ctgcaaatttaaacttgagtaa

SEQ ID NO: 1320299 - DNA, 22 bp, Artificial Sequence
  chemically synthesized
actcaagtttaaatttgcagta

SEQ ID NO: 1320300 - DNA, 22 bp, Artificial Sequence
  chemically synthesized
ctcaagtttaaatttgcagtaa

SEQ ID NO: 1320301 - DNA, 22 bp, Artificial Sequence
  chemically synthesized
aagtttaaatttgcagtaactc

SEQ ID NO: 1320302 - DNA, 22 bp, Artificial Sequence
  chemically synthesized
tgaaatcaagagacagagttac

SEQ ID NO: 1320303 - DNA, 22 bp, Artificial Sequence
  chemically synthesized
gtgaaatcaagagacagagtta

SEQ ID NO: 1320304 - DNA, 22 bp, Artificial Sequence
  chemically synthesized
aaatttgcagtaactctgtctc

SEQ ID NO: 1320305 - DNA, 22 bp, Artificial Sequence
  chemically synthesized
aatttgcagtaactctgtctct

SEQ ID NO: 1320306 - DNA, 22 bp, Artificial Sequence
  chemically synthesized
atttgtgaaatcaagagacaga

SEQ ID NO: 1320307 - DNA, 22 bp, Artificial Sequence
  chemically synthesized
aatttgtgaaatcaagagacag

SEQ ID NO: 1320308 - DNA, 22 bp, Artificial Sequence
  chemically synthesized
gcagtaactctgtctcttgatt

SEQ ID NO: 1320309 - DNA, 22 bp, Artificial Sequence
  chemically synthesized
cttaatttgtgaaatcaagaga

SEQ ID NO: 1320310 - DNA, 22 bp, Artificial Sequence
  chemically synthesized
cagtaactctgtctcttgattt

SEQ ID NO: 1320311 - DNA, 22 bp, Artificial Sequence
  chemically synthesized
tccttaatttgtgaaatcaaga

SEQ ID NO: 1320312 - DNA, 22 bp, Artificial Sequence
  chemically synthesized
ctccttaatttgtgaaatcaag

SEQ ID NO: 1320313 - DNA, 22 bp, Artificial Sequence
  chemically synthesized
cttctccttaatttgtgaaatc

SEQ ID NO: 1320314 - DNA, 22 bp, Artificial Sequence
  chemically synthesized
ctccttctccttaatttgtgaa

SEQ ID NO: 1320315 - DNA, 22 bp, Artificial Sequence
  chemically synthesized
tgtctcttgatttcacaaatta

SEQ ID NO: 1320316 - DNA, 22 bp, Artificial Sequence
  chemically synthesized
gctccttctccttaatttgtga

SEQ ID NO: 1320317 - DNA, 22 bp, Artificial Sequence
  chemically synthesized
tctcttgatttcacaaattaag

SEQ ID NO: 1320318 - DNA, 22 bp, Artificial Sequence
  chemically synthesized
ttgctccttctccttaatttgt

SEQ ID NO: 1320319 - DNA, 22 bp, Artificial Sequence
  chemically synthesized
cttgctccttctccttaatttg

SEQ ID NO: 1320320 - DNA, 22 bp, Artificial Sequence
  chemically synthesized
ttgatttcacaaattaaggaga

SEQ ID NO: 1320321 - DNA, 22 bp, Artificial Sequence
  chemically synthesized
gatttcacaaattaaggagaag

SEQ ID NO: 1320322 - DNA, 22 bp, Artificial Sequence
  chemically synthesized
atttcacaaattaaggagaagg

SEQ ID NO: 1320323 - DNA, 22 bp, Artificial Sequence
  chemically synthesized
ggaacttcttgctccttctcct

SEQ ID NO: 1320324 - DNA, 22 bp, Artificial Sequence
  chemically synthesized
cacaaattaaggagaaggagca

SEQ ID NO: 1320325 - DNA, 22 bp, Artificial Sequence
  chemically synthesized
acaaattaaggagaaggagcaa

SEQ ID NO: 1320326 - DNA, 22 bp, Artificial Sequence
  chemically synthesized
gatgtactgggaacttcttgct

SEQ ID NO: 1320327 - DNA, 22 bp, Artificial Sequence
  chemically synthesized
aggagaaggagcaagaagttcc

SEQ ID NO: 1320328 - DNA, 22 bp, Artificial Sequence
  chemically synthesized
tatgattggatgtactgggaac

SEQ ID NO: 1320329 - DNA, 22 bp, Artificial Sequence
  chemically synthesized
atagttgtatgattggatgtac

SEQ ID NO: 1320330 - DNA, 22 bp, Artificial Sequence
  chemically synthesized
catagttgtatgattggatgta

SEQ ID NO: 1320331 - DNA, 22 bp, Artificial Sequence
  chemically synthesized
ccagtacatccaatcatacaac

SEQ ID NO: 1320332 - DNA, 22 bp, Artificial Sequence
  chemically synthesized
aatatgtcagggaacttcatag

SEQ ID NO: 1320333 - DNA, 22 bp, Artificial Sequence
  chemically synthesized
aaatatgtcagggaacttcata

SEQ ID NO: 1320334 - DNA, 22 bp, Artificial Sequence
  chemically synthesized
tagatacatacttaaatatgtc

SEQ ID NO: 1320335 - DNA, 22 bp, Artificial Sequence
  chemically synthesized
tgaagttccctgacatatttaa

SEQ ID NO: 1320336 - DNA, 22 bp, Artificial Sequence
  chemically synthesized
atagatacatacttaaatatgt

SEQ ID NO: 1320337 - DNA, 22 bp, Artificial Sequence
  chemically synthesized
tatagatacatacttaaatatg

SEQ ID NO: 1320338 - DNA, 22 bp, Artificial Sequence
  chemically synthesized
ttatagatacatacttaaatat

SEQ ID NO: 1320339 - DNA, 22 bp, Artificial Sequence
  chemically synthesized
cctgacatatttaagtatgtat

SEQ ID NO: 1320340 - DNA, 22 bp, Artificial Sequence
  chemically synthesized
ggggtttttatagatacatact

SEQ ID NO: 1320341 - DNA, 22 bp, Artificial Sequence
  chemically synthesized
aggggtttttatagatacatac

SEQ ID NO: 1320342 - DNA, 22 bp, Artificial Sequence
  chemically synthesized
acatatttaagtatgtatctat

SEQ ID NO: 1320343 - DNA, 22 bp, Artificial Sequence
  chemically synthesized
agtatcttaggggtttttatag

SEQ ID NO: 1320344 - DNA, 22 bp, Artificial Sequence
  chemically synthesized
aagtatgtatctataaaaaccc

SEQ ID NO: 1320345 - DNA, 22 bp, Artificial Sequence
  chemically synthesized
agtatgtatctataaaaacccc

SEQ ID NO: 1320346 - DNA, 22 bp, Artificial Sequence
  chemically synthesized
acatgattgagtatcttagggg

SEQ ID NO: 1320347 - DNA, 22 bp, Artificial Sequence
  chemically synthesized
tgctcacatgattgagtatctt

SEQ ID NO: 1320348 - DNA, 22 bp, Artificial Sequence
  chemically synthesized
taaaaacccctaagatactcaa

SEQ ID NO: 1320349 - DNA, 22 bp, Artificial Sequence
  chemically synthesized
gtgctcacatgattgagtatct

SEQ ID NO: 1320350 - DNA, 22 bp, Artificial Sequence
  chemically synthesized
tgtgctcacatgattgagtatc

SEQ ID NO: 1320351 - DNA, 22 bp, Artificial Sequence
  chemically synthesized
agatactcaatcatgtgagcac

SEQ ID NO: 1320352 - DNA, 22 bp, Artificial Sequence
  chemically synthesized
cacagtaactttgtgctcacat

SEQ ID NO: 1320353 - DNA, 22 bp, Artificial Sequence
  chemically synthesized
aatcatgtgagcacaaagttac

SEQ ID NO: 1320354 - DNA, 22 bp, Artificial Sequence
  chemically synthesized
tggaagattacacagtaacttt

SEQ ID NO: 1320355 - DNA, 22 bp, Artificial Sequence
  chemically synthesized
catctatggaagattacacagt

SEQ ID NO: 1320356 - DNA, 22 bp, Artificial Sequence
  chemically synthesized
acatctatggaagattacacag

SEQ ID NO: 1320357 - DNA, 22 bp, Artificial Sequence
  chemically synthesized
aagtttacatctatggaagatt

SEQ ID NO: 1320358 - DNA, 22 bp, Artificial Sequence
  chemically synthesized
ctgtgtaatcttccatagatgt

SEQ ID NO: 1320359 - DNA, 22 bp, Artificial Sequence
  chemically synthesized
gtggttaaagtttacatctatg

SEQ ID NO: 1320360 - DNA, 22 bp, Artificial Sequence
  chemically synthesized
cgtggttaaagtttacatctat

SEQ ID NO: 1320361 - DNA, 22 bp, Artificial Sequence
  chemically synthesized
tgtaatcttccatagatgtaaa

SEQ ID NO: 1320362 - DNA, 22 bp, Artificial Sequence
  chemically synthesized
cttcgtggttaaagtttacatc

SEQ ID NO: 1320363 - DNA, 22 bp, Artificial Sequence
  chemically synthesized
acttcgtggttaaagtttacat

SEQ ID NO: 1320364 - DNA, 22 bp, Artificial Sequence
  chemically synthesized
ccatagatgtaaactttaacca

SEQ ID NO: 1320365 - DNA, 22 bp, Artificial Sequence
  chemically synthesized
tcacttacttcgtggttaaagt

SEQ ID NO: 1320366 - DNA, 22 bp, Artificial Sequence
  chemically synthesized
catagatgtaaactttaaccac

SEQ ID NO: 1320367 - DNA, 22 bp, Artificial Sequence
  chemically synthesized
tagctatcacttacttcgtggt

SEQ ID NO: 1320368 - DNA, 22 bp, Artificial Sequence
  chemically synthesized
gtagctatcacttacttcgtgg

SEQ ID NO: 1320369 - DNA, 22 bp, Artificial Sequence
  chemically synthesized
tgtagctatcacttacttcgtg

SEQ ID NO: 1320370 - DNA, 22 bp, Artificial Sequence
  chemically synthesized
caagctttgtagctatcactta

SEQ ID NO: 1320371 - DNA, 22 bp, Artificial Sequence
  chemically synthesized
taaccacgaagtaagtgatagc

SEQ ID NO: 1320372 - DNA, 22 bp, Artificial Sequence
  chemically synthesized
acaagctttgtagctatcactt

SEQ ID NO: 1320373 - DNA, 22 bp, Artificial Sequence
  chemically synthesized
aaccacgaagtaagtgatagct

SEQ ID NO: 1320374 - DNA, 22 bp, Artificial Sequence
  chemically synthesized
tacaagctttgtagctatcact

SEQ ID NO: 1320375 - DNA, 22 bp, Artificial Sequence
  chemically synthesized
accacgaagtaagtgatagcta

SEQ ID NO: 1320376 - DNA, 22 bp, Artificial Sequence
  chemically synthesized
ataaacatattttacaagcttt

SEQ ID NO: 1320377 - DNA, 22 bp, Artificial Sequence
  chemically synthesized
aataaacatattttacaagctt

SEQ ID NO: 1320378 - DNA, 22 bp, Artificial Sequence
  chemically synthesized
taataaacatattttacaagct

SEQ ID NO: 1320379 - DNA, 22 bp, Artificial Sequence
  chemically synthesized
ctttaataaacatattttacaa

SEQ ID NO: 1320380 - DNA, 22 bp, Artificial Sequence
  chemically synthesized
cctttaataaacatattttaca

SEQ ID NO: 1320381 - DNA, 22 bp, Artificial Sequence
  chemically synthesized
caaagcttgtaaaatatgttta

SEQ ID NO: 1320382 - DNA, 22 bp, Artificial Sequence
  chemically synthesized
gtaaaatatgtttattaaagga

SEQ ID NO: 1320383 - DNA, 22 bp, Artificial Sequence
  chemically synthesized
taaaatatgtttattaaaggaa

SEQ ID NO: 1320384 - DNA, 22 bp, Artificial Sequence
  chemically synthesized
aaaaaaaatcaatttcctttaa

SEQ ID NO: 1320385 - DNA, 22 bp, Artificial Sequence
  chemically synthesized
actgaaaaaaaatcaatttcct

SEQ ID NO: 1320386 - DNA, 22 bp, Artificial Sequence
  chemically synthesized
gattgactgaaaaaaaatcaat

SEQ ID NO: 1320387 - DNA, 22 bp, Artificial Sequence
  chemically synthesized
attaaaggaaattgattttttt

SEQ ID NO: 1320388 - DNA, 22 bp, Artificial Sequence
  chemically synthesized
tagattgactgaaaaaaaatca

SEQ ID NO: 1320389 - DNA, 22 bp, Artificial Sequence
  chemically synthesized
ttaaaggaaattgatttttttt

SEQ ID NO: 1320390 - DNA, 22 bp, Artificial Sequence
  chemically synthesized
ctctagattgactgaaaaaaaa

SEQ ID NO: 1320391 - DNA, 22 bp, Artificial Sequence
  chemically synthesized
aaggaaattgattttttttcag

SEQ ID NO: 1320392 - DNA, 22 bp, Artificial Sequence
  chemically synthesized
cctctagattgactgaaaaaaa

SEQ ID NO: 1320393 - DNA, 22 bp, Artificial Sequence
  chemically synthesized
attttttttcagtcaatctaga

SEQ ID NO: 1320394 - DNA, 22 bp, Artificial Sequence
  chemically synthesized
cgaagccatttcctctagattg

SEQ ID NO: 1320395 - DNA, 22 bp, Artificial Sequence
  chemically synthesized
tttttcagtcaatctagaggaa

SEQ ID NO: 1320396 - DNA, 22 bp, Artificial Sequence
  chemically synthesized
ttttcagtcaatctagaggaaa

SEQ ID NO: 1320397 - DNA, 22 bp, Artificial Sequence
  chemically synthesized
tttcagtcaatctagaggaaat

SEQ ID NO: 1320398 - DNA, 22 bp, Artificial Sequence
  chemically synthesized
ttcagtcaatctagaggaaatg

SEQ ID NO: 1320399 - DNA, 22 bp, Artificial Sequence
  chemically synthesized
tcagtcaatctagaggaaatgg

SEQ ID NO: 1320400 - DNA, 22 bp, Artificial Sequence
  chemically synthesized
cagtcaatctagaggaaatggc

SEQ ID NO: 1320401 - DNA, 22 bp, Artificial Sequence
  chemically synthesized
agtcaatctagaggaaatggct

SEQ ID NO: 1320402 - DNA, 22 bp, Artificial Sequence
  chemically synthesized
catgtatctccgaagccatttc

SEQ ID NO: 1320403 - DNA, 22 bp, Artificial Sequence
  chemically synthesized
gaggaaatggcttcggagatac

SEQ ID NO: 1320404 - DNA, 22 bp, Artificial Sequence
  chemically synthesized
cggagatacatggaatttgttt

SEQ ID NO: 1320405 - DNA, 22 bp, Artificial Sequence
  chemically synthesized
ggagatacatggaatttgtttg

SEQ ID NO: 1320406 - DNA, 22 bp, Artificial Sequence
  chemically synthesized
tgagatggccagtcgaagcaaa

SEQ ID NO: 1320407 - DNA, 22 bp, Artificial Sequence
  chemically synthesized
gtgagatggccagtcgaagcaa

SEQ ID NO: 1320408 - DNA, 22 bp, Artificial Sequence
  chemically synthesized
tgtgagatggccagtcgaagca

SEQ ID NO: 1320409 - DNA, 22 bp, Artificial Sequence
  chemically synthesized
gtttgcttcgactggccatctc

SEQ ID NO: 1320410 - DNA, 22 bp, Artificial Sequence
  chemically synthesized
tttgcttcgactggccatctca

SEQ ID NO: 1320411 - DNA, 22 bp, Artificial Sequence
  chemically synthesized
gcttcgactggccatctcacaa

SEQ ID NO: 1320412 - DNA, 22 bp, Artificial Sequence
  chemically synthesized
cttcgactggccatctcacaaa

SEQ ID NO: 1320413 - DNA, 22 bp, Artificial Sequence
  chemically synthesized
taagtccaatgagctttgtgag

SEQ ID NO: 1320414 - DNA, 22 bp, Artificial Sequence
  chemically synthesized
cgactggccatctcacaaagct

SEQ ID NO: 1320415 - DNA, 22 bp, Artificial Sequence
  chemically synthesized
gactggccatctcacaaagctc

SEQ ID NO: 1320416 - DNA, 22 bp, Artificial Sequence
  chemically synthesized
ttataagtccaatgagctttgt

SEQ ID NO: 1320417 - DNA, 22 bp, Artificial Sequence
  chemically synthesized
gccatctcacaaagctcattgg

SEQ ID NO: 1320418 - DNA, 22 bp, Artificial Sequence
  chemically synthesized
aattattataagtccaatgagc

SEQ ID NO: 1320419 - DNA, 22 bp, Artificial Sequence
  chemically synthesized
actaaattattataagtccaat

SEQ ID NO: 1320420 - DNA, 22 bp, Artificial Sequence
  chemically synthesized
acaaagctcattggacttataa

SEQ ID NO: 1320421 - DNA, 22 bp, Artificial Sequence
  chemically synthesized
attggacttataataatttagt

SEQ ID NO: 1320422 - DNA, 22 bp, Artificial Sequence
  chemically synthesized
gacttataataatttagttaac

SEQ ID NO: 1320423 - DNA, 22 bp, Artificial Sequence
  chemically synthesized
ataataatttagttaacaccat

SEQ ID NO: 1320424 - DNA, 22 bp, Artificial Sequence
  chemically synthesized
taataatttagttaacaccata

SEQ ID NO: 1320425 - DNA, 22 bp, Artificial Sequence
  chemically synthesized
tggagacatgaatatggtgtta

SEQ ID NO: 1320426 - DNA, 22 bp, Artificial Sequence
  chemically synthesized
atggagacatgaatatggtgtt

SEQ ID NO: 1320427 - DNA, 22 bp, Artificial Sequence
  chemically synthesized
tatggagacatgaatatggtgt

SEQ ID NO: 1320428 - DNA, 22 bp, Artificial Sequence
  chemically synthesized
ttatggagacatgaatatggtg

SEQ ID NO: 1320429 - DNA, 22 bp, Artificial Sequence
  chemically synthesized
agttaacaccatattcatgtct

SEQ ID NO: 1320430 - DNA, 22 bp, Artificial Sequence
  chemically synthesized
gttaacaccatattcatgtctc

SEQ ID NO: 1320431 - DNA, 22 bp, Artificial Sequence
  chemically synthesized
tgagggtttttatggagacatg

SEQ ID NO: 1320432 - DNA, 22 bp, Artificial Sequence
  chemically synthesized
atgagggtttttatggagacat

SEQ ID NO: 1320433 - DNA, 22 bp, Artificial Sequence
  chemically synthesized
acaccatattcatgtctccata

SEQ ID NO: 1320434 - DNA, 22 bp, Artificial Sequence
  chemically synthesized
atgtctccataaaaaccctcat

SEQ ID NO: 1320435 - DNA, 22 bp, Artificial Sequence
  chemically synthesized
gtatatatacgtggcttatgag

SEQ ID NO: 1320436 - DNA, 22 bp, Artificial Sequence
  chemically synthesized
ggtatatatacgtggcttatga

SEQ ID NO: 1320437 - DNA, 22 bp, Artificial Sequence
  chemically synthesized
cataaaaaccctcataagccac

SEQ ID NO: 1320438 - DNA, 22 bp, Artificial Sequence
  chemically synthesized
tggtatatatacgtggcttatg

SEQ ID NO: 1320439 - DNA, 22 bp, Artificial Sequence
  chemically synthesized
ataagccacgtatatataccaa

SEQ ID NO: 1320440 - DNA, 22 bp, Artificial Sequence
  chemically synthesized
tgggtaaatacatgtatgtaat

SEQ ID NO: 1320441 - DNA, 22 bp, Artificial Sequence
  chemically synthesized
tagctgtgggtaaatacatgta

SEQ ID NO: 1320442 - DNA, 22 bp, Artificial Sequence
  chemically synthesized
gtagctgtgggtaaatacatgt

SEQ ID NO: 1320443 - DNA, 22 bp, Artificial Sequence
  chemically synthesized
tatttgtagctgtgggtaaata

SEQ ID NO: 1320444 - DNA, 22 bp, Artificial Sequence
  chemically synthesized
catacatgtatttacccacagc

SEQ ID NO: 1320445 - DNA, 22 bp, Artificial Sequence
  chemically synthesized
acatagactatatttgtagctg

SEQ ID NO: 1320446 - DNA, 22 bp, Artificial Sequence
  chemically synthesized
acccacagctacaaatatagtc

SEQ ID NO: 1320447 - DNA, 22 bp, Artificial Sequence
  chemically synthesized
cccacagctacaaatatagtct

SEQ ID NO: 1320448 - DNA, 22 bp, Artificial Sequence
  chemically synthesized
atatgaaactcacatagactat

SEQ ID NO: 1320449 - DNA, 22 bp, Artificial Sequence
  chemically synthesized
aatatgaaactcacatagacta

SEQ ID NO: 1320450 - DNA, 22 bp, Artificial Sequence
  chemically synthesized
caaatatagtctatgtgagttt

SEQ ID NO: 1320451 - DNA, 22 bp, Artificial Sequence
  chemically synthesized
tcatttaatatgaaactcacat

SEQ ID NO: 1320452 - DNA, 22 bp, Artificial Sequence
  chemically synthesized
tactatcatttaatatgaaact

SEQ ID NO: 1320453 - DNA, 22 bp, Artificial Sequence
  chemically synthesized
tatactatcatttaatatgaaa

SEQ ID NO: 1320454 - DNA, 22 bp, Artificial Sequence
  chemically synthesized
tgtgagtttcatattaaatgat

SEQ ID NO: 1320455 - DNA, 22 bp, Artificial Sequence
  chemically synthesized
catattaaatgatagtatagaa

SEQ ID NO: 1320456 - DNA, 22 bp, Artificial Sequence
  chemically synthesized
atattaaatgatagtatagaat

SEQ ID NO: 1320457 - DNA, 22 bp, Artificial Sequence
  chemically synthesized
aatgatagtatagaatattatt

SEQ ID NO: 1320458 - DNA, 22 bp, Artificial Sequence
  chemically synthesized
taataatatagtatagaataga

SEQ ID NO: 1320459 - DNA, 22 bp, Artificial Sequence
  chemically synthesized
tataataatatagtatagaata

SEQ ID NO: 1320460 - DNA, 22 bp, Artificial Sequence
  chemically synthesized
ttctattctatactatattatt

SEQ ID NO: 1320461 - DNA, 22 bp, Artificial Sequence
  chemically synthesized
tattctatactatattattata

SEQ ID NO: 1320462 - DNA, 22 bp, Artificial Sequence
  chemically synthesized
ttctatactatattattataga

SEQ ID NO: 1320463 - DNA, 22 bp, Artificial Sequence
  chemically synthesized
tatactatattattatagaata

SEQ ID NO: 1320464 - DNA, 22 bp, Artificial Sequence
  chemically synthesized
tactatattattatagaatatt

SEQ ID NO: 1320465 - DNA, 22 bp, Artificial Sequence
  chemically synthesized
taatatagaatagaatattcta

SEQ ID NO: 1320466 - DNA, 22 bp, Artificial Sequence
  chemically synthesized
tattattatagaatattctatt

SEQ ID NO: 1320467 - DNA, 22 bp, Artificial Sequence
  chemically synthesized
ttatagaatattctattctata

SEQ ID NO: 1320468 - DNA, 22 bp, Artificial Sequence
  chemically synthesized
tagaatattctattctatatta

SEQ ID NO: 1320469 - DNA, 22 bp, Artificial Sequence
  chemically synthesized
tatataatatatatgttataat

SEQ ID NO: 1320470 - DNA, 22 bp, Artificial Sequence
  chemically synthesized
tattctatattataacatatat

SEQ ID NO: 1320471 - DNA, 22 bp, Artificial Sequence
  chemically synthesized
ttctatattataacatatatat

SEQ ID NO: 1320472 - DNA, 22 bp, Artificial Sequence
  chemically synthesized
tatattataacatatatattat

SEQ ID NO: 1320473 - DNA, 22 bp, Artificial Sequence
  chemically synthesized
tattataacatatatattatat

SEQ ID NO: 1320474 - DNA, 22 bp, Artificial Sequence
  chemically synthesized
taacatatatattatatataac

SEQ ID NO: 1320475 - DNA, 22 bp, Artificial Sequence
  chemically synthesized
aagaaatgtatatatataatat

SEQ ID NO: 1320476 - DNA, 22 bp, Artificial Sequence
  chemically synthesized
tatataactcgatattatatat

SEQ ID NO: 1320477 - DNA, 22 bp, Artificial Sequence
  chemically synthesized
ctaaagaaatgtatatatataa

SEQ ID NO: 1320478 - DNA, 22 bp, Artificial Sequence
  chemically synthesized
gatattatatatatacatttct

SEQ ID NO: 1320479 - DNA, 22 bp, Artificial Sequence
  chemically synthesized
tatatatacatttctttaggag

SEQ ID NO: 1320480 - DNA, 22 bp, Artificial Sequence
  chemically synthesized
gacacagagcagccatgagtat

SEQ ID NO: 1320481 - DNA, 22 bp, Artificial Sequence
  chemically synthesized
ctttaggagatactcatggctg

SEQ ID NO: 1320482 - DNA, 22 bp, Artificial Sequence
  chemically synthesized
tttaggagatactcatggctgc

SEQ ID NO: 1320483 - DNA, 22 bp, Artificial Sequence
  chemically synthesized
taggagatactcatggctgctc

SEQ ID NO: 1320484 - DNA, 22 bp, Artificial Sequence
  chemically synthesized
aggagatactcatggctgctct

SEQ ID NO: 1320485 - DNA, 22 bp, Artificial Sequence
  chemically synthesized
ggagatactcatggctgctctg

SEQ ID NO: 1320486 - DNA, 22 bp, Artificial Sequence
  chemically synthesized
ccaaatgtagttggacacagag

SEQ ID NO: 1320487 - DNA, 22 bp, Artificial Sequence
  chemically synthesized
atggctgctctgtgtccaacta

SEQ ID NO: 1320488 - DNA, 22 bp, Artificial Sequence
  chemically synthesized
ctctgtgtccaactacatttgg

SEQ ID NO: 1320489 - DNA, 22 bp, Artificial Sequence
  chemically synthesized
tgtgtccaactacatttgggag

SEQ ID NO: 1320490 - DNA, 22 bp, Artificial Sequence
  chemically synthesized
agtaagaggtgactcccaaatg

SEQ ID NO: 1320491 - DNA, 22 bp, Artificial Sequence
  chemically synthesized
tgtccaactacatttgggagtc

SEQ ID NO: 1320492 - DNA, 22 bp, Artificial Sequence
  chemically synthesized
catttgggagtcacctcttact

SEQ ID NO: 1320493 - DNA, 22 bp, Artificial Sequence
  chemically synthesized
gggagtcacctcttactgaatc

SEQ ID NO: 1320494 - DNA, 22 bp, Artificial Sequence
  chemically synthesized
ggagtcacctcttactgaatcc

SEQ ID NO: 1320495 - DNA, 22 bp, Artificial Sequence
  chemically synthesized
caagtgacccagtatataaaag

SEQ ID NO: 1320496 - DNA, 22 bp, Artificial Sequence
  chemically synthesized
gcaagtgacccagtatataaaa

SEQ ID NO: 1320497 - DNA, 22 bp, Artificial Sequence
  chemically synthesized
ttactgaatccttttatatact

SEQ ID NO: 1320498 - DNA, 22 bp, Artificial Sequence
  chemically synthesized
tgcaagtgacccagtatataaa

SEQ ID NO: 1320499 - DNA, 22 bp, Artificial Sequence
  chemically synthesized
actgaatccttttatatactgg

SEQ ID NO: 1320500 - DNA, 22 bp, Artificial Sequence
  chemically synthesized
ctgaatccttttatatactggg

SEQ ID NO: 1320501 - DNA, 22 bp, Artificial Sequence
  chemically synthesized
aatccttttatatactgggtca

SEQ ID NO: 1320502 - DNA, 22 bp, Artificial Sequence
  chemically synthesized
agcctttgcaagtgacccagta

SEQ ID NO: 1320503 - DNA, 22 bp, Artificial Sequence
  chemically synthesized
aattaagcctttgcaagtgacc

SEQ ID NO: 1320504 - DNA, 22 bp, Artificial Sequence
  chemically synthesized
ttatatactgggtcacttgcaa

SEQ ID NO: 1320505 - DNA, 22 bp, Artificial Sequence
  chemically synthesized
tatatactgggtcacttgcaaa

SEQ ID NO: 1320506 - DNA, 22 bp, Artificial Sequence
  chemically synthesized
atatactgggtcacttgcaaag

SEQ ID NO: 1320507 - DNA, 22 bp, Artificial Sequence
  chemically synthesized
tatactgggtcacttgcaaagg

SEQ ID NO: 1320508 - DNA, 22 bp, Artificial Sequence
  chemically synthesized
ggtcacttgcaaaggcttaatt

SEQ ID NO: 1320509 - DNA, 22 bp, Artificial Sequence
  chemically synthesized
gcaaaggcttaattgagcattt

SEQ ID NO: 1320510 - DNA, 22 bp, Artificial Sequence
  chemically synthesized
caaaggcttaattgagcatttg

SEQ ID NO: 1320511 - DNA, 22 bp, Artificial Sequence
  chemically synthesized
tggcatatgatagtcaaatgct

SEQ ID NO: 1320512 - DNA, 22 bp, Artificial Sequence
  chemically synthesized
tgtggcatatgatagtcaaatg

SEQ ID NO: 1320513 - DNA, 22 bp, Artificial Sequence
  chemically synthesized
aattgagcatttgactatcata

SEQ ID NO: 1320514 - DNA, 22 bp, Artificial Sequence
  chemically synthesized
attgagcatttgactatcatat

SEQ ID NO: 1320515 - DNA, 22 bp, Artificial Sequence
  chemically synthesized
agcatttgactatcatatgcca

SEQ ID NO: 1320516 - DNA, 22 bp, Artificial Sequence
  chemically synthesized
gactatcatatgccacagaatg

SEQ ID NO: 1320517 - DNA, 22 bp, Artificial Sequence
  chemically synthesized
tagtgtccgatccattctgtgg

SEQ ID NO: 1320518 - DNA, 22 bp, Artificial Sequence
  chemically synthesized
actatcatatgccacagaatgg

SEQ ID NO: 1320519 - DNA, 22 bp, Artificial Sequence
  chemically synthesized
atagtgtccgatccattctgtg

SEQ ID NO: 1320520 - DNA, 22 bp, Artificial Sequence
  chemically synthesized
tttatagtgtccgatccattct

SEQ ID NO: 1320521 - DNA, 22 bp, Artificial Sequence
  chemically synthesized
tcatatgccacagaatggatcg

SEQ ID NO: 1320522 - DNA, 22 bp, Artificial Sequence
  chemically synthesized
atttatagtgtccgatccattc

SEQ ID NO: 1320523 - DNA, 22 bp, Artificial Sequence
  chemically synthesized
tatttatagtgtccgatccatt

SEQ ID NO: 1320524 - DNA, 22 bp, Artificial Sequence
  chemically synthesized
tgttttatttatagtgtccgat

SEQ ID NO: 1320525 - DNA, 22 bp, Artificial Sequence
  chemically synthesized
gtgttttatttatagtgtccga

SEQ ID NO: 1320526 - DNA, 22 bp, Artificial Sequence
  chemically synthesized
tgtgttttatttatagtgtccg

SEQ ID NO: 1320527 - DNA, 22 bp, Artificial Sequence
  chemically synthesized
ttgtgttttatttatagtgtcc

SEQ ID NO: 1320528 - DNA, 22 bp, Artificial Sequence
  chemically synthesized
ttttgtgttttatttatagtgt

SEQ ID NO: 1320529 - DNA, 22 bp, Artificial Sequence
  chemically synthesized
tcttttgtgttttatttatagt

SEQ ID NO: 1320530 - DNA, 22 bp, Artificial Sequence
  chemically synthesized
taaataaaacacaaaagagagt

SEQ ID NO: 1320531 - DNA, 22 bp, Artificial Sequence
  chemically synthesized
agaagatgaagcccagaaaaga

SEQ ID NO: 1320532 - DNA, 22 bp, Artificial Sequence
  chemically synthesized
aagaagatgaagcccagaaaag

SEQ ID NO: 1320533 - DNA, 22 bp, Artificial Sequence
  chemically synthesized
taagaagatgaagcccagaaaa

SEQ ID NO: 1320534 - DNA, 22 bp, Artificial Sequence
  chemically synthesized
ttaagaagatgaagcccagaaa

SEQ ID NO: 1320535 - DNA, 22 bp, Artificial Sequence
  chemically synthesized
tttaagaagatgaagcccagaa

SEQ ID NO: 1320536 - DNA, 22 bp, Artificial Sequence
  chemically synthesized
ttttaagaagatgaagcccaga

SEQ ID NO: 1320537 - DNA, 22 bp, Artificial Sequence
  chemically synthesized
atttttttaagaagatgaagcc

SEQ ID NO: 1320538 - DNA, 22 bp, Artificial Sequence
  chemically synthesized
gtcttttctgggcttcatcttc

SEQ ID NO: 1320539 - DNA, 22 bp, Artificial Sequence
  chemically synthesized
tcttttctgggcttcatcttct

SEQ ID NO: 1320540 - DNA, 22 bp, Artificial Sequence
  chemically synthesized
ttctgggcttcatcttcttaaa

SEQ ID NO: 1320541 - DNA, 22 bp, Artificial Sequence
  chemically synthesized
atagctgatttttttaagaaga

SEQ ID NO: 1320542 - DNA, 22 bp, Artificial Sequence
  chemically synthesized
tctgggcttcatcttcttaaaa

SEQ ID NO: 1320543 - DNA, 22 bp, Artificial Sequence
  chemically synthesized
ctgggcttcatcttcttaaaaa

SEQ ID NO: 1320544 - DNA, 22 bp, Artificial Sequence
  chemically synthesized
tgggcttcatcttcttaaaaaa

SEQ ID NO: 1320545 - DNA, 22 bp, Artificial Sequence
  chemically synthesized
tctaatagctgatttttttaag

SEQ ID NO: 1320546 - DNA, 22 bp, Artificial Sequence
  chemically synthesized
ggcttcatcttcttaaaaaaat

SEQ ID NO: 1320547 - DNA, 22 bp, Artificial Sequence
  chemically synthesized
gtctaatagctgatttttttaa

SEQ ID NO: 1320548 - DNA, 22 bp, Artificial Sequence
  chemically synthesized
catcttcttaaaaaaatcagct

SEQ ID NO: 1320549 - DNA, 22 bp, Artificial Sequence
  chemically synthesized
atcttcttaaaaaaatcagcta

SEQ ID NO: 1320550 - DNA, 22 bp, Artificial Sequence
  chemically synthesized
cttaaaaaaatcagctattaga

SEQ ID NO: 1320551 - DNA, 22 bp, Artificial Sequence
  chemically synthesized
gacatatgcttgtctaatagct

SEQ ID NO: 1320552 - DNA, 22 bp, Artificial Sequence
  chemically synthesized
ttaaaaaaatcagctattagac

SEQ ID NO: 1320553 - DNA, 22 bp, Artificial Sequence
  chemically synthesized
aaaaaaatcagctattagacaa

SEQ ID NO: 1320554 - DNA, 22 bp, Artificial Sequence
  chemically synthesized
aaaaaatcagctattagacaag

SEQ ID NO: 1320555 - DNA, 22 bp, Artificial Sequence
  chemically synthesized
atatatataattagacatatgc

SEQ ID NO: 1320556 - DNA, 22 bp, Artificial Sequence
  chemically synthesized
gatatatataattagacatatg

SEQ ID NO: 1320557 - DNA, 22 bp, Artificial Sequence
  chemically synthesized
ttagacaagcatatgtctaatt

SEQ ID NO: 1320558 - DNA, 22 bp, Artificial Sequence
  chemically synthesized
gacaagcatatgtctaattata

SEQ ID NO: 1320559 - DNA, 22 bp, Artificial Sequence
  chemically synthesized
attatatatatcaagcatatgt

SEQ ID NO: 1320560 - DNA, 22 bp, Artificial Sequence
  chemically synthesized
atatatataatatgacatatgc

SEQ ID NO: 1320561 - DNA, 22 bp, Artificial Sequence
  chemically synthesized
gatatatataatatgacatatg

SEQ ID NO: 1320562 - DNA, 22 bp, Artificial Sequence
  chemically synthesized
tatatatcaagcatatgtcata

SEQ ID NO: 1320563 - DNA, 22 bp, Artificial Sequence
  chemically synthesized
acatatataacttgatatatat

SEQ ID NO: 1320564 - DNA, 22 bp, Artificial Sequence
  chemically synthesized
aacatatataacttgatatata

SEQ ID NO: 1320565 - DNA, 22 bp, Artificial Sequence
  chemically synthesized
tatatatcaagttatatatgtt

SEQ ID NO: 1320566 - DNA, 22 bp, Artificial Sequence
  chemically synthesized
cagtatatgtatgatgtttaac

SEQ ID NO: 1320567 - DNA, 22 bp, Artificial Sequence
  chemically synthesized
cctacagtatatgtatgatgtt

SEQ ID NO: 1320568 - DNA, 22 bp, Artificial Sequence
  chemically synthesized
tatatgttaaacatcatacata

SEQ ID NO: 1320569 - DNA, 22 bp, Artificial Sequence
  chemically synthesized
aacatcatacatatactgtagg

SEQ ID NO: 1320570 - DNA, 22 bp, Artificial Sequence
  chemically synthesized
tgaccacaaaaagctacctaca

SEQ ID NO: 1320571 - DNA, 22 bp, Artificial Sequence
  chemically synthesized
gtgaccacaaaaagctacctac

SEQ ID NO: 1320572 - DNA, 22 bp, Artificial Sequence
  chemically synthesized
tgtgaccacaaaaagctaccta

SEQ ID NO: 1320573 - DNA, 22 bp, Artificial Sequence
  chemically synthesized
taggtagctttttgtggtcaca

SEQ ID NO: 1320574 - DNA, 22 bp, Artificial Sequence
  chemically synthesized
tttgtggtcacaaagctttact

SEQ ID NO: 1320575 - DNA, 22 bp, Artificial Sequence
  chemically synthesized
ttgtggtcacaaagctttacta

SEQ ID NO: 1320576 - DNA, 22 bp, Artificial Sequence
  chemically synthesized
tgtggtcacaaagctttactat

SEQ ID NO: 1320577 - DNA, 22 bp, Artificial Sequence
  chemically synthesized
gtggtcacaaagctttactatt

SEQ ID NO: 1320578 - DNA, 22 bp, Artificial Sequence
  chemically synthesized
tggtcacaaagctttactatta

SEQ ID NO: 1320579 - DNA, 22 bp, Artificial Sequence
  chemically synthesized
aagaagtacataaaaataataa

SEQ ID NO: 1320580 - DNA, 22 bp, Artificial Sequence
  chemically synthesized
tcaagaagtacataaaaataat

SEQ ID NO: 1320581 - DNA, 22 bp, Artificial Sequence
  chemically synthesized
ctcaagaagtacataaaaataa

SEQ ID NO: 1320582 - DNA, 22 bp, Artificial Sequence
  chemically synthesized
tctcaagaagtacataaaaata

SEQ ID NO: 1320583 - DNA, 22 bp, Artificial Sequence
  chemically synthesized
ttctcaagaagtacataaaaat

SEQ ID NO: 1320584 - DNA, 22 bp, Artificial Sequence
  chemically synthesized
tactattattatttttatgtac

SEQ ID NO: 1320585 - DNA, 22 bp, Artificial Sequence
  chemically synthesized
actattattatttttatgtact

SEQ ID NO: 1320586 - DNA, 22 bp, Artificial Sequence
  chemically synthesized
ctattattatttttatgtactt

SEQ ID NO: 1320587 - DNA, 22 bp, Artificial Sequence
  chemically synthesized
ttattatttttatgtacttctt

SEQ ID NO: 1320588 - DNA, 22 bp, Artificial Sequence
  chemically synthesized
ttatttttatgtacttcttgag

SEQ ID NO: 1320589 - DNA, 22 bp, Artificial Sequence
  chemically synthesized
tagatagccttttctcaagaag

SEQ ID NO: 1320590 - DNA, 22 bp, Artificial Sequence
  chemically synthesized
tttttatgtacttcttgagaaa

SEQ ID NO: 1320591 - DNA, 22 bp, Artificial Sequence
  chemically synthesized
ttatagatagccttttctcaag

SEQ ID NO: 1320592 - DNA, 22 bp, Artificial Sequence
  chemically synthesized
ttatgtacttcttgagaaaagg

SEQ ID NO: 1320593 - DNA, 22 bp, Artificial Sequence
  chemically synthesized
tatgtacttcttgagaaaaggc

SEQ ID NO: 1320594 - DNA, 22 bp, Artificial Sequence
  chemically synthesized
atgtacttcttgagaaaaggct

SEQ ID NO: 1320595 - DNA, 22 bp, Artificial Sequence
  chemically synthesized
tgtacttcttgagaaaaggcta

SEQ ID NO: 1320596 - DNA, 22 bp, Artificial Sequence
  chemically synthesized
tcctgttatagatagccttttc

SEQ ID NO: 1320597 - DNA, 22 bp, Artificial Sequence
  chemically synthesized
aaattatcctgttatagatagc

SEQ ID NO: 1320598 - DNA, 22 bp, Artificial Sequence
  chemically synthesized
cttgagaaaaggctatctataa

SEQ ID NO: 1320599 - DNA, 22 bp, Artificial Sequence
  chemically synthesized
aaaattatcctgttatagatag

SEQ ID NO: 1320600 - DNA, 22 bp, Artificial Sequence
  chemically synthesized
ttgagaaaaggctatctataac

SEQ ID NO: 1320601 - DNA, 22 bp, Artificial Sequence
  chemically synthesized
gagaaaaggctatctataacag

SEQ ID NO: 1320602 - DNA, 22 bp, Artificial Sequence
  chemically synthesized
cttaaaattatcctgttataga

SEQ ID NO: 1320603 - DNA, 22 bp, Artificial Sequence
  chemically synthesized
agaaaaggctatctataacagg

SEQ ID NO: 1320604 - DNA, 22 bp, Artificial Sequence
  chemically synthesized
acttaaaattatcctgttatag

SEQ ID NO: 1320605 - DNA, 22 bp, Artificial Sequence
  chemically synthesized
tacttaaaattatcctgttata

SEQ ID NO: 1320606 - DNA, 22 bp, Artificial Sequence
  chemically synthesized
ttacttaaaattatcctgttat

SEQ ID NO: 1320607 - DNA, 22 bp, Artificial Sequence
  chemically synthesized
tttacttaaaattatcctgtta

SEQ ID NO: 1320608 - DNA, 22 bp, Artificial Sequence
  chemically synthesized
ttttacttaaaattatcctgtt

SEQ ID NO: 1320609 - DNA, 22 bp, Artificial Sequence
  chemically synthesized
tttttacttaaaattatcctgt

SEQ ID NO: 1320610 - DNA, 22 bp, Artificial Sequence
  chemically synthesized
agctttttttacttaaaattat

SEQ ID NO: 1320611 - DNA, 22 bp, Artificial Sequence
  chemically synthesized
tctataacaggataattttaag

SEQ ID NO: 1320612 - DNA, 22 bp, Artificial Sequence
  chemically synthesized
aagctttttttacttaaaatta

SEQ ID NO: 1320613 - DNA, 22 bp, Artificial Sequence
  chemically synthesized
taacaggataattttaagtaaa

SEQ ID NO: 1320614 - DNA, 22 bp, Artificial Sequence
  chemically synthesized
aaagatttaagctttttttact

SEQ ID NO: 1320615 - DNA, 22 bp, Artificial Sequence
  chemically synthesized
actgaaagatttaagctttttt

SEQ ID NO: 1320616 - DNA, 22 bp, Artificial Sequence
  chemically synthesized
taagtaaaaaaagcttaaatct

SEQ ID NO: 1320617 - DNA, 22 bp, Artificial Sequence
  chemically synthesized
aagtaaaaaaagcttaaatctt

SEQ ID NO: 1320618 - DNA, 22 bp, Artificial Sequence
  chemically synthesized
agtaaaaaaagcttaaatcttt

SEQ ID NO: 1320619 - DNA, 22 bp, Artificial Sequence
  chemically synthesized
aaatctttcagtcaatgttcat

SEQ ID NO: 1320620 - DNA, 22 bp, Artificial Sequence
  chemically synthesized
tgaggataatatatgaacattg

SEQ ID NO: 1320621 - DNA, 22 bp, Artificial Sequence
  chemically synthesized
aatctttcagtcaatgttcata

SEQ ID NO: 1320622 - DNA, 22 bp, Artificial Sequence
  chemically synthesized
atgaggataatatatgaacatt

SEQ ID NO: 1320623 - DNA, 22 bp, Artificial Sequence
  chemically synthesized
ttatgaggataatatatgaaca

SEQ ID NO: 1320624 - DNA, 22 bp, Artificial Sequence
  chemically synthesized
ttcttatgaggataatatatga

SEQ ID NO: 1320625 - DNA, 22 bp, Artificial Sequence
  chemically synthesized
tcagtcaatgttcatatattat

SEQ ID NO: 1320626 - DNA, 22 bp, Artificial Sequence
  chemically synthesized
cagtcaatgttcatatattatc

SEQ ID NO: 1320627 - DNA, 22 bp, Artificial Sequence
  chemically synthesized
agtcaatgttcatatattatcc

SEQ ID NO: 1320628 - DNA, 22 bp, Artificial Sequence
  chemically synthesized
acacaaattgttcttatgagga

SEQ ID NO: 1320629 - DNA, 22 bp, Artificial Sequence
  chemically synthesized
atatattatcctcataagaaca

SEQ ID NO: 1320630 - DNA, 22 bp, Artificial Sequence
  chemically synthesized
tcctcataagaacaatttgtgt

SEQ ID NO: 1320631 - DNA, 22 bp, Artificial Sequence
  chemically synthesized
ataagaacaatttgtgttaggt

SEQ ID NO: 1320632 - DNA, 22 bp, Artificial Sequence
  chemically synthesized
aaatagaaaagaatacctaaca

SEQ ID NO: 1320633 - DNA, 22 bp, Artificial Sequence
  chemically synthesized
aaaatagaaaagaatacctaac

SEQ ID NO: 1320634 - DNA, 22 bp, Artificial Sequence
  chemically synthesized
taaaatagaaaagaatacctaa

SEQ ID NO: 1320635 - DNA, 22 bp, Artificial Sequence
  chemically synthesized
ctttaaaatagaaaagaatacc

SEQ ID NO: 1320636 - DNA, 22 bp, Artificial Sequence
  chemically synthesized
tctactttaaaatagaaaagaa

SEQ ID NO: 1320637 - DNA, 22 bp, Artificial Sequence
  chemically synthesized
atctactttaaaatagaaaaga

SEQ ID NO: 1320638 - DNA, 22 bp, Artificial Sequence
  chemically synthesized
gtgttaggtattcttttctatt

SEQ ID NO: 1320639 - DNA, 22 bp, Artificial Sequence
  chemically synthesized
tatctactttaaaatagaaaag

SEQ ID NO: 1320640 - DNA, 22 bp, Artificial Sequence
  chemically synthesized
tgttaggtattcttttctattt

SEQ ID NO: 1320641 - DNA, 22 bp, Artificial Sequence
  chemically synthesized
tattttatctactttaaaatag

SEQ ID NO: 1320642 - DNA, 22 bp, Artificial Sequence
  chemically synthesized
ggtattcttttctattttaaag

SEQ ID NO: 1320643 - DNA, 22 bp, Artificial Sequence
  chemically synthesized
tacctatattttatctacttta

SEQ ID NO: 1320644 - DNA, 22 bp, Artificial Sequence
  chemically synthesized
gtacctatattttatctacttt

SEQ ID NO: 1320645 - DNA, 22 bp, Artificial Sequence
  chemically synthesized
ttttctattttaaagtagataa

SEQ ID NO: 1320646 - DNA, 22 bp, Artificial Sequence
  chemically synthesized
ttctattttaaagtagataaaa

SEQ ID NO: 1320647 - DNA, 22 bp, Artificial Sequence
  chemically synthesized
tctattttaaagtagataaaat

SEQ ID NO: 1320648 - DNA, 22 bp, Artificial Sequence
  chemically synthesized
ctattttaaagtagataaaata

SEQ ID NO: 1320649 - DNA, 22 bp, Artificial Sequence
  chemically synthesized
tattttaaagtagataaaatat

SEQ ID NO: 1320650 - DNA, 22 bp, Artificial Sequence
  chemically synthesized
ttttaaagtagataaaatatag

SEQ ID NO: 1320651 - DNA, 22 bp, Artificial Sequence
  chemically synthesized
acatgtttgtacctatatttta

SEQ ID NO: 1320652 - DNA, 22 bp, Artificial Sequence
  chemically synthesized
aacatgtttgtacctatatttt

SEQ ID NO: 1320653 - DNA, 22 bp, Artificial Sequence
  chemically synthesized
taaagtagataaaatataggta

SEQ ID NO: 1320654 - DNA, 22 bp, Artificial Sequence
  chemically synthesized
aaagtagataaaatataggtac

SEQ ID NO: 1320655 - DNA, 22 bp, Artificial Sequence
  chemically synthesized
cttaacatgtttgtacctatat

SEQ ID NO: 1320656 - DNA, 22 bp, Artificial Sequence
  chemically synthesized
aagtagataaaatataggtaca

SEQ ID NO: 1320657 - DNA, 22 bp, Artificial Sequence
  chemically synthesized
agacaaattacttaacatgttt

SEQ ID NO: 1320658 - DNA, 22 bp, Artificial Sequence
  chemically synthesized
gtacctcagacaaattacttaa

SEQ ID NO: 1320659 - DNA, 22 bp, Artificial Sequence
  chemically synthesized
tagtacctcagacaaattactt

SEQ ID NO: 1320660 - DNA, 22 bp, Artificial Sequence
  chemically synthesized
gccatacctctagtacctcaga

SEQ ID NO: 1320661 - DNA, 22 bp, Artificial Sequence
  chemically synthesized
tcgccatacctctagtacctca

SEQ ID NO: 1320662 - DNA, 22 bp, Artificial Sequence
  chemically synthesized
agtaatttgtctgaggtactag

SEQ ID NO: 1320663 - DNA, 22 bp, Artificial Sequence
  chemically synthesized
ctcgccatacctctagtacctc

SEQ ID NO: 1320664 - DNA, 22 bp, Artificial Sequence
  chemically synthesized
gtctgaggtactagaggtatgg

SEQ ID NO: 1320665 - DNA, 22 bp, Artificial Sequence
  chemically synthesized
tctgaggtactagaggtatggc

SEQ ID NO: 1320666 - DNA, 22 bp, Artificial Sequence
  chemically synthesized
agatcagcttctcgccatacct

SEQ ID NO: 1320667 - DNA, 22 bp, Artificial Sequence
  chemically synthesized
gagatcagcttctcgccatacc

SEQ ID NO: 1320668 - DNA, 22 bp, Artificial Sequence
  chemically synthesized
aggtactagaggtatggcgaga

SEQ ID NO: 1320669 - DNA, 22 bp, Artificial Sequence
  chemically synthesized
gcttgagatcagcttctcgcca

SEQ ID NO: 1320670 - DNA, 22 bp, Artificial Sequence
  chemically synthesized
ggcttgagatcagcttctcgcc

SEQ ID NO: 1320671 - DNA, 22 bp, Artificial Sequence
  chemically synthesized
tggcttgagatcagcttctcgc

SEQ ID NO: 1320672 - DNA, 22 bp, Artificial Sequence
  chemically synthesized
gaggtatggcgagaagctgatc

SEQ ID NO: 1320673 - DNA, 22 bp, Artificial Sequence
  chemically synthesized
cattttggcttgagatcagctt

SEQ ID NO: 1320674 - DNA, 22 bp, Artificial Sequence
  chemically synthesized
acattttggcttgagatcagct

SEQ ID NO: 1320675 - DNA, 22 bp, Artificial Sequence
  chemically synthesized
tacattttggcttgagatcagc

SEQ ID NO: 1320676 - DNA, 22 bp, Artificial Sequence
  chemically synthesized
atctcaagccaaaatgtaaagg

SEQ ID NO: 1320677 - DNA, 22 bp, Artificial Sequence
  chemically synthesized
aagccaaaatgtaaaggcctat

SEQ ID NO: 1320678 - DNA, 22 bp, Artificial Sequence
  chemically synthesized
tgtttttctgattctcctatta

SEQ ID NO: 1320679 - DNA, 22 bp, Artificial Sequence
  chemically synthesized
atagaaccaaaataataggaga

SEQ ID NO: 1320680 - DNA, 22 bp, Artificial Sequence
  chemically synthesized
tcatagaaccaaaataatagga

SEQ ID NO: 1320681 - DNA, 22 bp, Artificial Sequence
  chemically synthesized
tctcatagaaccaaaataatag

SEQ ID NO: 1320682 - DNA, 22 bp, Artificial Sequence
  chemically synthesized
ttctgattctcctattattttg

SEQ ID NO: 1320683 - DNA, 22 bp, Artificial Sequence
  chemically synthesized
tctgattctcctattattttgg

SEQ ID NO: 1320684 - DNA, 22 bp, Artificial Sequence
  chemically synthesized
ctgattctcctattattttggt

SEQ ID NO: 1320685 - DNA, 22 bp, Artificial Sequence
  chemically synthesized
tgattctcctattattttggtt

SEQ ID NO: 1320686 - DNA, 22 bp, Artificial Sequence
  chemically synthesized
attctcctattattttggttct

SEQ ID NO: 1320687 - DNA, 22 bp, Artificial Sequence
  chemically synthesized
acattctctcatagaaccaaaa

SEQ ID NO: 1320688 - DNA, 22 bp, Artificial Sequence
  chemically synthesized
aacattctctcatagaaccaaa

SEQ ID NO: 1320689 - DNA, 22 bp, Artificial Sequence
  chemically synthesized
taacattctctcatagaaccaa

SEQ ID NO: 1320690 - DNA, 22 bp, Artificial Sequence
  chemically synthesized
tcctattattttggttctatga

SEQ ID NO: 1320691 - DNA, 22 bp, Artificial Sequence
  chemically synthesized
tttaacattctctcatagaacc

SEQ ID NO: 1320692 - DNA, 22 bp, Artificial Sequence
  chemically synthesized
ctttaacattctctcatagaac

SEQ ID NO: 1320693 - DNA, 22 bp, Artificial Sequence
  chemically synthesized
ctattattttggttctatgaga

SEQ ID NO: 1320694 - DNA, 22 bp, Artificial Sequence
  chemically synthesized
tctttaacattctctcatagaa

SEQ ID NO: 1320695 - DNA, 22 bp, Artificial Sequence
  chemically synthesized
ttattttggttctatgagagaa

SEQ ID NO: 1320696 - DNA, 22 bp, Artificial Sequence
  chemically synthesized
tgttttctttaacattctctca

SEQ ID NO: 1320697 - DNA, 22 bp, Artificial Sequence
  chemically synthesized
ttttggttctatgagagaatgt

SEQ ID NO: 1320698 - DNA, 22 bp, Artificial Sequence
  chemically synthesized
tggttctatgagagaatgttaa

SEQ ID NO: 1320699 - DNA, 22 bp, Artificial Sequence
  chemically synthesized
ggttctatgagagaatgttaaa

SEQ ID NO: 1320700 - DNA, 22 bp, Artificial Sequence
  chemically synthesized
gttctatgagagaatgttaaag

SEQ ID NO: 1320701 - DNA, 22 bp, Artificial Sequence
  chemically synthesized
tatgagagaatgttaaagaaaa

SEQ ID NO: 1320702 - DNA, 22 bp, Artificial Sequence
  chemically synthesized
ggaaaaagttatgttttcttta

SEQ ID NO: 1320703 - DNA, 22 bp, Artificial Sequence
  chemically synthesized
tgagagaatgttaaagaaaaca

SEQ ID NO: 1320704 - DNA, 22 bp, Artificial Sequence
  chemically synthesized
agagttgggaaaaagttatgtt

SEQ ID NO: 1320705 - DNA, 22 bp, Artificial Sequence
  chemically synthesized
gactgagagttgggaaaaagtt

SEQ ID NO: 1320706 - DNA, 22 bp, Artificial Sequence
  chemically synthesized
aagaaaacataactttttccca

SEQ ID NO: 1320707 - DNA, 22 bp, Artificial Sequence
  chemically synthesized
agtcctggactgagagttggga

SEQ ID NO: 1320708 - DNA, 22 bp, Artificial Sequence
  chemically synthesized
tcagtcctggactgagagttgg

SEQ ID NO: 1320709 - DNA, 22 bp, Artificial Sequence
  chemically synthesized
ctcagtcctggactgagagttg

SEQ ID NO: 1320710 - DNA, 22 bp, Artificial Sequence
  chemically synthesized
agatttctcagtcctggactga

SEQ ID NO: 1320711 - DNA, 22 bp, Artificial Sequence
  chemically synthesized
tttcccaactctcagtccagga

SEQ ID NO: 1320712 - DNA, 22 bp, Artificial Sequence
  chemically synthesized
gagatttctcagtcctggactg

SEQ ID NO: 1320713 - DNA, 22 bp, Artificial Sequence
  chemically synthesized
ttcccaactctcagtccaggac

SEQ ID NO: 1320714 - DNA, 22 bp, Artificial Sequence
  chemically synthesized
tcccaactctcagtccaggact

SEQ ID NO: 1320715 - DNA, 22 bp, Artificial Sequence
  chemically synthesized
cccaactctcagtccaggactg

SEQ ID NO: 1320716 - DNA, 22 bp, Artificial Sequence
  chemically synthesized
ccaactctcagtccaggactga

SEQ ID NO: 1320717 - DNA, 22 bp, Artificial Sequence
  chemically synthesized
gtgtttgagatttctcagtcct

SEQ ID NO: 1320718 - DNA, 22 bp, Artificial Sequence
  chemically synthesized
agtgtttgagatttctcagtcc

SEQ ID NO: 1320719 - DNA, 22 bp, Artificial Sequence
  chemically synthesized
tcagtccaggactgagaaatct

SEQ ID NO: 1320720 - DNA, 22 bp, Artificial Sequence
  chemically synthesized
agtccaggactgagaaatctca

SEQ ID NO: 1320721 - DNA, 22 bp, Artificial Sequence
  chemically synthesized
atatgcttagtgtttgagattt

SEQ ID NO: 1320722 - DNA, 22 bp, Artificial Sequence
  chemically synthesized
acaaactcatatgcttagtgtt

SEQ ID NO: 1320723 - DNA, 22 bp, Artificial Sequence
  chemically synthesized
agaaatctcaaacactaagcat

SEQ ID NO: 1320724 - DNA, 22 bp, Artificial Sequence
  chemically synthesized
gctcacaaactcatatgcttag

SEQ ID NO: 1320725 - DNA, 22 bp, Artificial Sequence
  chemically synthesized
cgctcacaaactcatatgctta

SEQ ID NO: 1320726 - DNA, 22 bp, Artificial Sequence
  chemically synthesized
aaacactaagcatatgagtttg

SEQ ID NO: 1320727 - DNA, 22 bp, Artificial Sequence
  chemically synthesized
tgtgcaaaccttcgctcacaaa

SEQ ID NO: 1320728 - DNA, 22 bp, Artificial Sequence
  chemically synthesized
atgtgcaaaccttcgctcacaa

SEQ ID NO: 1320729 - DNA, 22 bp, Artificial Sequence
  chemically synthesized
agcatatgagtttgtgagcgaa

SEQ ID NO: 1320730 - DNA, 22 bp, Artificial Sequence
  chemically synthesized
gtgagcgaaggtttgcacataa

SEQ ID NO: 1320731 - DNA, 22 bp, Artificial Sequence
  chemically synthesized
tgagcgaaggtttgcacataaa

SEQ ID NO: 1320732 - DNA, 22 bp, Artificial Sequence
  chemically synthesized
ccataaatgtgagtatatacat

SEQ ID NO: 1320733 - DNA, 22 bp, Artificial Sequence
  chemically synthesized
gcacataaatgtatatactcac

SEQ ID NO: 1320734 - DNA, 22 bp, Artificial Sequence
  chemically synthesized
cacataaatgtatatactcaca

SEQ ID NO: 1320735 - DNA, 22 bp, Artificial Sequence
  chemically synthesized
agtacagatcatatattcccat

SEQ ID NO: 1320736 - DNA, 22 bp, Artificial Sequence
  chemically synthesized
aagtacagatcatatattccca

SEQ ID NO: 1320737 - DNA, 22 bp, Artificial Sequence
  chemically synthesized
acatttatgggaatatatgatc

SEQ ID NO: 1320738 - DNA, 22 bp, Artificial Sequence
  chemically synthesized
tggcttaagtacagatcatata

SEQ ID NO: 1320739 - DNA, 22 bp, Artificial Sequence
  chemically synthesized
atggcttaagtacagatcatat

SEQ ID NO: 1320740 - DNA, 22 bp, Artificial Sequence
  chemically synthesized
atgggaatatatgatctgtact

SEQ ID NO: 1320741 - DNA, 22 bp, Artificial Sequence
  chemically synthesized
gtttatggcttaagtacagatc

SEQ ID NO: 1320742 - DNA, 22 bp, Artificial Sequence
  chemically synthesized
tgggaatatatgatctgtactt

SEQ ID NO: 1320743 - DNA, 22 bp, Artificial Sequence
  chemically synthesized
agtttatggcttaagtacagat

SEQ ID NO: 1320744 - DNA, 22 bp, Artificial Sequence
  chemically synthesized
aatttagtttatggcttaagta

SEQ ID NO: 1320745 - DNA, 22 bp, Artificial Sequence
  chemically synthesized
aaatttagtttatggcttaagt

SEQ ID NO: 1320746 - DNA, 22 bp, Artificial Sequence
  chemically synthesized
taaatttagtttatggcttaag

SEQ ID NO: 1320747 - DNA, 22 bp, Artificial Sequence
  chemically synthesized
taaattttaaatttagtttatg

SEQ ID NO: 1320748 - DNA, 22 bp, Artificial Sequence
  chemically synthesized
tacttaagccataaactaaatt

SEQ ID NO: 1320749 - DNA, 22 bp, Artificial Sequence
  chemically synthesized
aactataaattttaaatttagt

SEQ ID NO: 1320750 - DNA, 22 bp, Artificial Sequence
  chemically synthesized
aaactataaattttaaatttag

SEQ ID NO: 1320751 - DNA, 22 bp, Artificial Sequence
  chemically synthesized
aagccataaactaaatttaaaa

SEQ ID NO: 1320752 - DNA, 22 bp, Artificial Sequence
  chemically synthesized
agccataaactaaatttaaaat

SEQ ID NO: 1320753 - DNA, 22 bp, Artificial Sequence
  chemically synthesized
aaatatcatgtttaaactataa

SEQ ID NO: 1320754 - DNA, 22 bp, Artificial Sequence
  chemically synthesized
gaaatatcatgtttaaactata

SEQ ID NO: 1320755 - DNA, 22 bp, Artificial Sequence
  chemically synthesized
aatttaaaatttatagtttaaa

SEQ ID NO: 1320756 - DNA, 22 bp, Artificial Sequence
  chemically synthesized
tgaaatatcatgtttaaactat

SEQ ID NO: 1320757 - DNA, 22 bp, Artificial Sequence
  chemically synthesized
aaaatttatagtttaaacatga

SEQ ID NO: 1320758 - DNA, 22 bp, Artificial Sequence
  chemically synthesized
aaatttatagtttaaacatgat

SEQ ID NO: 1320759 - DNA, 22 bp, Artificial Sequence
  chemically synthesized
gaattttgaaatatcatgttta

SEQ ID NO: 1320760 - DNA, 22 bp, Artificial Sequence
  chemically synthesized
ctagaattttgaaatatcatgt

SEQ ID NO: 1320761 - DNA, 22 bp, Artificial Sequence
  chemically synthesized
actagaattttgaaatatcatg

SEQ ID NO: 1320762 - DNA, 22 bp, Artificial Sequence
  chemically synthesized
tactagaattttgaaatatcat

SEQ ID NO: 1320763 - DNA, 22 bp, Artificial Sequence
  chemically synthesized
atagtttaaacatgatatttca

SEQ ID NO: 1320764 - DNA, 22 bp, Artificial Sequence
  chemically synthesized
tagtttaaacatgatatttcaa

SEQ ID NO: 1320765 - DNA, 22 bp, Artificial Sequence
  chemically synthesized
ctttactagaattttgaaatat

SEQ ID NO: 1320766 - DNA, 22 bp, Artificial Sequence
  chemically synthesized
aaacatgatatttcaaaattct

SEQ ID NO: 1320767 - DNA, 22 bp, Artificial Sequence
  chemically synthesized
aacatgatatttcaaaattcta

SEQ ID NO: 1320768 - DNA, 22 bp, Artificial Sequence
  chemically synthesized
caaaattctagtaaagcagaca

SEQ ID NO: 1320769 - DNA, 22 bp, Artificial Sequence
  chemically synthesized
aaaattctagtaaagcagacac

SEQ ID NO: 1320770 - DNA, 22 bp, Artificial Sequence
  chemically synthesized
tagtaaagcagacacacacttc

SEQ ID NO: 1320771 - DNA, 22 bp, Artificial Sequence
  chemically synthesized
gtaaagcagacacacacttcta

SEQ ID NO: 1320772 - DNA, 22 bp, Artificial Sequence
  chemically synthesized
ctatttacttttctatttatat

SEQ ID NO: 1320773 - DNA, 22 bp, Artificial Sequence
  chemically synthesized
tatttacttttctatttatatt

SEQ ID NO: 1320774 - DNA, 22 bp, Artificial Sequence
  chemically synthesized
tttacttttctatttatattta

SEQ ID NO: 1320775 - DNA, 22 bp, Artificial Sequence
  chemically synthesized
acttttctatttatatttatgt

SEQ ID NO: 1320776 - DNA, 22 bp, Artificial Sequence
  chemically synthesized
cttttctatttatatttatgta

SEQ ID NO: 1320777 - DNA, 22 bp, Artificial Sequence
  chemically synthesized
ttctatttatatttatgtatct

SEQ ID NO: 1320778 - DNA, 22 bp, Artificial Sequence
  chemically synthesized
tctatttatatttatgtatctt

SEQ ID NO: 1320779 - DNA, 22 bp, Artificial Sequence
  chemically synthesized
ctatttatatttatgtatcttc

SEQ ID NO: 1320780 - DNA, 22 bp, Artificial Sequence
  chemically synthesized
tatttatatttatgtatcttct

SEQ ID NO: 1320781 - DNA, 22 bp, Artificial Sequence
  chemically synthesized
tttatatttatgtatcttctgg

SEQ ID NO: 1320782 - DNA, 22 bp, Artificial Sequence
  chemically synthesized
atatttatgtatcttctggtcc

SEQ ID NO: 1320783 - DNA, 22 bp, Artificial Sequence
  chemically synthesized
tatttatgtatcttctggtcct

SEQ ID NO: 1320784 - DNA, 22 bp, Artificial Sequence
  chemically synthesized
ataaaatagtaaaaggaccaga

SEQ ID NO: 1320785 - DNA, 22 bp, Artificial Sequence
  chemically synthesized
gataaaatagtaaaaggaccag

SEQ ID NO: 1320786 - DNA, 22 bp, Artificial Sequence
  chemically synthesized
atgtatcttctggtccttttac

SEQ ID NO: 1320787 - DNA, 22 bp, Artificial Sequence
  chemically synthesized
tgtatcttctggtccttttact

SEQ ID NO: 1320788 - DNA, 22 bp, Artificial Sequence
  chemically synthesized
aagtatcttgataaaatagtaa

SEQ ID NO: 1320789 - DNA, 22 bp, Artificial Sequence
  chemically synthesized
caagtatcttgataaaatagta

SEQ ID NO: 1320790 - DNA, 22 bp, Artificial Sequence
  chemically synthesized
tcaagtatcttgataaaatagt

SEQ ID NO: 1320791 - DNA, 22 bp, Artificial Sequence
  chemically synthesized
ctggtccttttactattttatc

SEQ ID NO: 1320792 - DNA, 22 bp, Artificial Sequence
  chemically synthesized
tggtccttttactattttatca

SEQ ID NO: 1320793 - DNA, 22 bp, Artificial Sequence
  chemically synthesized
ctttcaagtatcttgataaaat

SEQ ID NO: 1320794 - DNA, 22 bp, Artificial Sequence
  chemically synthesized
gtccttttactattttatcaag

SEQ ID NO: 1320795 - DNA, 22 bp, Artificial Sequence
  chemically synthesized
ttactattttatcaagatactt

SEQ ID NO: 1320796 - DNA, 22 bp, Artificial Sequence
  chemically synthesized
tactattttatcaagatacttg

SEQ ID NO: 1320797 - DNA, 22 bp, Artificial Sequence
  chemically synthesized
actattttatcaagatacttga

SEQ ID NO: 1320798 - DNA, 22 bp, Artificial Sequence
  chemically synthesized
ctattttatcaagatacttgaa

SEQ ID NO: 1320799 - DNA, 22 bp, Artificial Sequence
  chemically synthesized
agtatccctgctttcaagtatc

SEQ ID NO: 1320800 - DNA, 22 bp, Artificial Sequence
  chemically synthesized
ttttatcaagatacttgaaagc

SEQ ID NO: 1320801 - DNA, 22 bp, Artificial Sequence
  chemically synthesized
gttaagtatccctgctttcaag

SEQ ID NO: 1320802 - DNA, 22 bp, Artificial Sequence
  chemically synthesized
ggttaagtatccctgctttcaa

SEQ ID NO: 1320803 - DNA, 22 bp, Artificial Sequence
  chemically synthesized
tatcaagatacttgaaagcagg

SEQ ID NO: 1320804 - DNA, 22 bp, Artificial Sequence
  chemically synthesized
tggttaagtatccctgctttca

SEQ ID NO: 1320805 - DNA, 22 bp, Artificial Sequence
  chemically synthesized
atcaagatacttgaaagcaggg

SEQ ID NO: 1320806 - DNA, 22 bp, Artificial Sequence
  chemically synthesized
ttggttaagtatccctgctttc

SEQ ID NO: 1320807 - DNA, 22 bp, Artificial Sequence
  chemically synthesized
tcaagatacttgaaagcaggga

SEQ ID NO: 1320808 - DNA, 22 bp, Artificial Sequence
  chemically synthesized
aaccagcttttggttaagtatc

SEQ ID NO: 1320809 - DNA, 22 bp, Artificial Sequence
  chemically synthesized
gaaagcagggatacttaaccaa

SEQ ID NO: 1320810 - DNA, 22 bp, Artificial Sequence
  chemically synthesized
ctaaaccagcttttggttaagt

SEQ ID NO: 1320811 - DNA, 22 bp, Artificial Sequence
  chemically synthesized
aaagcagggatacttaaccaaa

SEQ ID NO: 1320812 - DNA, 22 bp, Artificial Sequence
  chemically synthesized
ataatccattcctaaaccagct

SEQ ID NO: 1320813 - DNA, 22 bp, Artificial Sequence
  chemically synthesized
aaccaaaagctggtttaggaat

SEQ ID NO: 1320814 - DNA, 22 bp, Artificial Sequence
  chemically synthesized
accaaaagctggtttaggaatg

SEQ ID NO: 1320815 - DNA, 22 bp, Artificial Sequence
  chemically synthesized
ataagccattcataatccattc

SEQ ID NO: 1320816 - DNA, 22 bp, Artificial Sequence
  chemically synthesized
gtttaggaatggattatgaatg

SEQ ID NO: 1320817 - DNA, 22 bp, Artificial Sequence
  chemically synthesized
aggaatggattatgaatggctt

SEQ ID NO: 1320818 - DNA, 22 bp, Artificial Sequence
  chemically synthesized
caatccattcataagccattca

SEQ ID NO: 1320819 - DNA, 22 bp, Artificial Sequence
  chemically synthesized
ggaatggattatgaatggctta

SEQ ID NO: 1320820 - DNA, 22 bp, Artificial Sequence
  chemically synthesized
ctgcaatccattcataagccat

SEQ ID NO: 1320821 - DNA, 22 bp, Artificial Sequence
  chemically synthesized
aaatgctcctgcaatccattca

SEQ ID NO: 1320822 - DNA, 22 bp, Artificial Sequence
  chemically synthesized
tgaatggcttatgaatggattg

SEQ ID NO: 1320823 - DNA, 22 bp, Artificial Sequence
  chemically synthesized
atgaatggattgcaggagcatt

SEQ ID NO: 1320824 - DNA, 22 bp, Artificial Sequence
  chemically synthesized
tgaatggattgcaggagcattt

SEQ ID NO: 1320825 - DNA, 22 bp, Artificial Sequence
  chemically synthesized
cataaaaatccagcagttcaaa

SEQ ID NO: 1320826 - DNA, 22 bp, Artificial Sequence
  chemically synthesized
acataaaaatccagcagttcaa

SEQ ID NO: 1320827 - DNA, 22 bp, Artificial Sequence
  chemically synthesized
tacataaaaatccagcagttca

SEQ ID NO: 1320828 - DNA, 22 bp, Artificial Sequence
  chemically synthesized
ttacataaaaatccagcagttc

SEQ ID NO: 1320829 - DNA, 22 bp, Artificial Sequence
  chemically synthesized
caggagcatttgaactgctgga

SEQ ID NO: 1320830 - DNA, 22 bp, Artificial Sequence
  chemically synthesized
catacaaccttttacataaaaa

SEQ ID NO: 1320831 - DNA, 22 bp, Artificial Sequence
  chemically synthesized
gaactgctggatttttatgtaa

SEQ ID NO: 1320832 - DNA, 22 bp, Artificial Sequence
  chemically synthesized
acatacaaccttttacataaaa

SEQ ID NO: 1320833 - DNA, 22 bp, Artificial Sequence
  chemically synthesized
aactgctggatttttatgtaaa

SEQ ID NO: 1320834 - DNA, 22 bp, Artificial Sequence
  chemically synthesized
tacatacaaccttttacataaa

SEQ ID NO: 1320835 - DNA, 22 bp, Artificial Sequence
  chemically synthesized
ctggatttttatgtaaaaggtt

SEQ ID NO: 1320836 - DNA, 22 bp, Artificial Sequence
  chemically synthesized
gatttttatgtaaaaggttgta

SEQ ID NO: 1320837 - DNA, 22 bp, Artificial Sequence
  chemically synthesized
ttatgtaaaaggttgtatgtaa

SEQ ID NO: 1320838 - DNA, 22 bp, Artificial Sequence
  chemically synthesized
tatgtaaaaggttgtatgtaaa

SEQ ID NO: 1320839 - DNA, 22 bp, Artificial Sequence
  chemically synthesized
atgtaaaaggttgtatgtaaag

SEQ ID NO: 1320840 - DNA, 22 bp, Artificial Sequence
  chemically synthesized
tgtaaaaggttgtatgtaaagg

SEQ ID NO: 1320841 - DNA, 22 bp, Artificial Sequence
  chemically synthesized
agaaaaatacacagtgaatatc

SEQ ID NO: 1320842 - DNA, 22 bp, Artificial Sequence
  chemically synthesized
tatgtaaaggatattcactgtg

SEQ ID NO: 1320843 - DNA, 22 bp, Artificial Sequence
  chemically synthesized
ctcagaaaaatacacagtgaat

SEQ ID NO: 1320844 - DNA, 22 bp, Artificial Sequence
  chemically synthesized
tgggactcctcagaaaaataca

SEQ ID NO: 1320845 - DNA, 22 bp, Artificial Sequence
  chemically synthesized
actgtgtatttttctgaggagt

SEQ ID NO: 1320846 - DNA, 22 bp, Artificial Sequence
  chemically synthesized
ataaaagctgtgggactcctca

SEQ ID NO: 1320847 - DNA, 22 bp, Artificial Sequence
  chemically synthesized
tgtatttttctgaggagtccca

SEQ ID NO: 1320848 - DNA, 22 bp, Artificial Sequence
  chemically synthesized
tcagtctgataaaagctgtggg

SEQ ID NO: 1320849 - DNA, 22 bp, Artificial Sequence
  chemically synthesized
ttctgaggagtcccacagcttt

SEQ ID NO: 1320850 - DNA, 22 bp, Artificial Sequence
  chemically synthesized
gtcagtctgataaaagctgtgg

SEQ ID NO: 1320851 - DNA, 22 bp, Artificial Sequence
  chemically synthesized
tctgaggagtcccacagctttt

SEQ ID NO: 1320852 - DNA, 22 bp, Artificial Sequence
  chemically synthesized
tgtcagtctgataaaagctgtg

SEQ ID NO: 1320853 - DNA, 22 bp, Artificial Sequence
  chemically synthesized
ctgaggagtcccacagctttta

SEQ ID NO: 1320854 - DNA, 22 bp, Artificial Sequence
  chemically synthesized
tgaggagtcccacagcttttat

SEQ ID NO: 1320855 - DNA, 22 bp, Artificial Sequence
  chemically synthesized
aggagtcccacagcttttatca

SEQ ID NO: 1320856 - DNA, 22 bp, Artificial Sequence
  chemically synthesized
atgcatcctttgtcagtctgat

SEQ ID NO: 1320857 - DNA, 22 bp, Artificial Sequence
  chemically synthesized
gttcatgcatcctttgtcagtc

SEQ ID NO: 1320858 - DNA, 22 bp, Artificial Sequence
  chemically synthesized
agttcatgcatcctttgtcagt

SEQ ID NO: 1320859 - DNA, 22 bp, Artificial Sequence
  chemically synthesized
tttagttcatgcatcctttgtc

SEQ ID NO: 1320860 - DNA, 22 bp, Artificial Sequence
  chemically synthesized
gtttagttcatgcatcctttgt

SEQ ID NO: 1320861 - DNA, 22 bp, Artificial Sequence
  chemically synthesized
ttatcagactgacaaaggatgc

SEQ ID NO: 1320862 - DNA, 22 bp, Artificial Sequence
  chemically synthesized
tatcagactgacaaaggatgca

SEQ ID NO: 1320863 - DNA, 22 bp, Artificial Sequence
  chemically synthesized
atcagactgacaaaggatgcat

SEQ ID NO: 1320864 - DNA, 22 bp, Artificial Sequence
  chemically synthesized
tcagactgacaaaggatgcatg

SEQ ID NO: 1320865 - DNA, 22 bp, Artificial Sequence
  chemically synthesized
atttgtttagttcatgcatcct

SEQ ID NO: 1320866 - DNA, 22 bp, Artificial Sequence
  chemically synthesized
aatttgtttagttcatgcatcc

SEQ ID NO: 1320867 - DNA, 22 bp, Artificial Sequence
  chemically synthesized
taatttgtttagttcatgcatc

SEQ ID NO: 1320868 - DNA, 22 bp, Artificial Sequence
  chemically synthesized
ttaatttgtttagttcatgcat

SEQ ID NO: 1320869 - DNA, 22 bp, Artificial Sequence
  chemically synthesized
tttaatttgtttagttcatgca

SEQ ID NO: 1320870 - DNA, 22 bp, Artificial Sequence
  chemically synthesized
ctttttaatttgtttagttcat

SEQ ID NO: 1320871 - DNA, 22 bp, Artificial Sequence
  chemically synthesized
acaaaggatgcatgaactaaac

SEQ ID NO: 1320872 - DNA, 22 bp, Artificial Sequence
  chemically synthesized
attgctttttaatttgtttagt

SEQ ID NO: 1320873 - DNA, 22 bp, Artificial Sequence
  chemically synthesized
aattgctttttaatttgtttag

SEQ ID NO: 1320874 - DNA, 22 bp, Artificial Sequence
  chemically synthesized
taaagaccttaattgcttttta

SEQ ID NO: 1320875 - DNA, 22 bp, Artificial Sequence
  chemically synthesized
aacaaattaaaaagcaattaag

SEQ ID NO: 1320876 - DNA, 22 bp, Artificial Sequence
  chemically synthesized
tgtatagaggttataaagacct

SEQ ID NO: 1320877 - DNA, 22 bp, Artificial Sequence
  chemically synthesized
aaaagcaattaaggtctttata

SEQ ID NO: 1320878 - DNA, 22 bp, Artificial Sequence
  chemically synthesized
tatgtatagaggttataaagac

SEQ ID NO: 1320879 - DNA, 22 bp, Artificial Sequence
  chemically synthesized
ctatgtatagaggttataaaga

SEQ ID NO: 1320880 - DNA, 22 bp, Artificial Sequence
  chemically synthesized
tctatgtatagaggttataaag

SEQ ID NO: 1320881 - DNA, 22 bp, Artificial Sequence
  chemically synthesized
aggtctttataacctctataca

SEQ ID NO: 1320882 - DNA, 22 bp, Artificial Sequence
  chemically synthesized
tataacctctatacatagaaag

SEQ ID NO: 1320883 - DNA, 22 bp, Artificial Sequence
  chemically synthesized
ataacctctatacatagaaagt

SEQ ID NO: 1320884 - DNA, 22 bp, Artificial Sequence
  chemically synthesized
taacctctatacatagaaagtt

SEQ ID NO: 1320885 - DNA, 22 bp, Artificial Sequence
  chemically synthesized
tatacatagaaagttctatgtt

SEQ ID NO: 1320886 - DNA, 22 bp, Artificial Sequence
  chemically synthesized
tacatagaaagttctatgtttt

SEQ ID NO: 1320887 - DNA, 22 bp, Artificial Sequence
  chemically synthesized
gaaataaaaagtagaaaaaaca

SEQ ID NO: 1320888 - DNA, 22 bp, Artificial Sequence
  chemically synthesized
tccagctggaaataaaaagtag

SEQ ID NO: 1320889 - DNA, 22 bp, Artificial Sequence
  chemically synthesized
gtccagctggaaataaaaagta

SEQ ID NO: 1320890 - DNA, 22 bp, Artificial Sequence
  chemically synthesized
tatgttttttctactttttatt

SEQ ID NO: 1320891 - DNA, 22 bp, Artificial Sequence
  chemically synthesized
tgttttttctactttttatttc

SEQ ID NO: 1320892 - DNA, 22 bp, Artificial Sequence
  chemically synthesized
tttgtccagctggaaataaaaa

SEQ ID NO: 1320893 - DNA, 22 bp, Artificial Sequence
  chemically synthesized
tttctactttttatttccagct

SEQ ID NO: 1320894 - DNA, 22 bp, Artificial Sequence
  chemically synthesized
ttctactttttatttccagctg

SEQ ID NO: 1320895 - DNA, 22 bp, Artificial Sequence
  chemically synthesized
tctactttttatttccagctgg

SEQ ID NO: 1320896 - DNA, 22 bp, Artificial Sequence
  chemically synthesized
ctactttttatttccagctgga

SEQ ID NO: 1320897 - DNA, 22 bp, Artificial Sequence
  chemically synthesized
tactttttatttccagctggac

SEQ ID NO: 1320898 - DNA, 22 bp, Artificial Sequence
  chemically synthesized
caagacattatttgtccagctg

SEQ ID NO: 1320899 - DNA, 22 bp, Artificial Sequence
  chemically synthesized
ctttttatttccagctggacaa

SEQ ID NO: 1320900 - DNA, 22 bp, Artificial Sequence
  chemically synthesized
acaagacattatttgtccagct

SEQ ID NO: 1320901 - DNA, 22 bp, Artificial Sequence
  chemically synthesized
tacaagacattatttgtccagc

SEQ ID NO: 1320902 - DNA, 22 bp, Artificial Sequence
  chemically synthesized
ttacaagacattatttgtccag

SEQ ID NO: 1320903 - DNA, 22 bp, Artificial Sequence
  chemically synthesized
tttatttccagctggacaaata

SEQ ID NO: 1320904 - DNA, 22 bp, Artificial Sequence
  chemically synthesized
ttatttccagctggacaaataa

SEQ ID NO: 1320905 - DNA, 22 bp, Artificial Sequence
  chemically synthesized
tatttccagctggacaaataat

SEQ ID NO: 1320906 - DNA, 22 bp, Artificial Sequence
  chemically synthesized
atttccagctggacaaataatg

SEQ ID NO: 1320907 - DNA, 22 bp, Artificial Sequence
  chemically synthesized
tttccagctggacaaataatgt

SEQ ID NO: 1320908 - DNA, 22 bp, Artificial Sequence
  chemically synthesized
aacttttacaagacattatttg

SEQ ID NO: 1320909 - DNA, 22 bp, Artificial Sequence
  chemically synthesized
ccagctggacaaataatgtctt

SEQ ID NO: 1320910 - DNA, 22 bp, Artificial Sequence
  chemically synthesized
cagctggacaaataatgtcttg

SEQ ID NO: 1320911 - DNA, 22 bp, Artificial Sequence
  chemically synthesized
gacaaataatgtcttgtaaaag

SEQ ID NO: 1320912 - DNA, 22 bp, Artificial Sequence
  chemically synthesized
aagggagaaaacagtgaactaa

SEQ ID NO: 1320913 - DNA, 22 bp, Artificial Sequence
  chemically synthesized
gaagggagaaaacagtgaacta

SEQ ID NO: 1320914 - DNA, 22 bp, Artificial Sequence
  chemically synthesized
gtaaaagtttagttcactgttt

SEQ ID NO: 1320915 - DNA, 22 bp, Artificial Sequence
  chemically synthesized
taaaagtttagttcactgtttt

SEQ ID NO: 1320916 - DNA, 22 bp, Artificial Sequence
  chemically synthesized
ggggcttgaagggagaaaacag

SEQ ID NO: 1320917 - DNA, 22 bp, Artificial Sequence
  chemically synthesized
actgggggcttgaagggagaaa

SEQ ID NO: 1320918 - DNA, 22 bp, Artificial Sequence
  chemically synthesized
cactgggggcttgaagggagaa

SEQ ID NO: 1320919 - DNA, 22 bp, Artificial Sequence
  chemically synthesized
agttcactgttttctcccttca

SEQ ID NO: 1320920 - DNA, 22 bp, Artificial Sequence
  chemically synthesized
gttcactgttttctcccttcaa

SEQ ID NO: 1320921 - DNA, 22 bp, Artificial Sequence
  chemically synthesized
cttcactgggggcttgaaggga

SEQ ID NO: 1320922 - DNA, 22 bp, Artificial Sequence
  chemically synthesized
actgttttctcccttcaagccc

SEQ ID NO: 1320923 - DNA, 22 bp, Artificial Sequence
  chemically synthesized
ctacttcactgggggcttgaag

SEQ ID NO: 1320924 - DNA, 22 bp, Artificial Sequence
  chemically synthesized
ttttctcccttcaagcccccag

SEQ ID NO: 1320925 - DNA, 22 bp, Artificial Sequence
  chemically synthesized
tctcccttcaagcccccagtga

SEQ ID NO: 1320926 - DNA, 22 bp, Artificial Sequence
  chemically synthesized
ctcccttcaagcccccagtgaa

SEQ ID NO: 1320927 - DNA, 22 bp, Artificial Sequence
  chemically synthesized
tcccttcaagcccccagtgaag

SEQ ID NO: 1320928 - DNA, 22 bp, Artificial Sequence
  chemically synthesized
ccttcaagcccccagtgaagta

SEQ ID NO: 1320929 - DNA, 22 bp, Artificial Sequence
  chemically synthesized
caagcccccagtgaagtaggag

SEQ ID NO: 1320930 - DNA, 22 bp, Artificial Sequence
  chemically synthesized
aagcccccagtgaagtaggaga

SEQ ID NO: 1320931 - DNA, 22 bp, Artificial Sequence
  chemically synthesized
aatagataacatcatctcctac

SEQ ID NO: 1320932 - DNA, 22 bp, Artificial Sequence
  chemically synthesized
cagcccgtactaaatagataac

SEQ ID NO: 1320933 - DNA, 22 bp, Artificial Sequence
  chemically synthesized
tctccagcccgtactaaataga

SEQ ID NO: 1320934 - DNA, 22 bp, Artificial Sequence
  chemically synthesized
ttatctccagcccgtactaaat

SEQ ID NO: 1320935 - DNA, 22 bp, Artificial Sequence
  chemically synthesized
attatctccagcccgtactaaa

SEQ ID NO: 1320936 - DNA, 22 bp, Artificial Sequence
  chemically synthesized
acaatttattatctccagcccg

SEQ ID NO: 1320937 - DNA, 22 bp, Artificial Sequence
  chemically synthesized
tctatttagtacgggctggaga

SEQ ID NO: 1320938 - DNA, 22 bp, Artificial Sequence
  chemically synthesized
ttcacaatttattatctccagc

SEQ ID NO: 1320939 - DNA, 22 bp, Artificial Sequence
  chemically synthesized
gttcacaatttattatctccag

SEQ ID NO: 1320940 - DNA, 22 bp, Artificial Sequence
  chemically synthesized
tttagtacgggctggagataat

SEQ ID NO: 1320941 - DNA, 22 bp, Artificial Sequence
  chemically synthesized
tgttcacaatttattatctcca

SEQ ID NO: 1320942 - DNA, 22 bp, Artificial Sequence
  chemically synthesized
agtacgggctggagataataaa

SEQ ID NO: 1320943 - DNA, 22 bp, Artificial Sequence
  chemically synthesized
gtacgggctggagataataaat

SEQ ID NO: 1320944 - DNA, 22 bp, Artificial Sequence
  chemically synthesized
actttgttcacaatttattatc

SEQ ID NO: 1320945 - DNA, 22 bp, Artificial Sequence
  chemically synthesized
cactttgttcacaatttattat

SEQ ID NO: 1320946 - DNA, 22 bp, Artificial Sequence
  chemically synthesized
ttcactttgttcacaatttatt

SEQ ID NO: 1320947 - DNA, 22 bp, Artificial Sequence
  chemically synthesized
ttcttcactttgttcacaattt

SEQ ID NO: 1320948 - DNA, 22 bp, Artificial Sequence
  chemically synthesized
gagataataaattgtgaacaaa

SEQ ID NO: 1320949 - DNA, 22 bp, Artificial Sequence
  chemically synthesized
atgactattcttcactttgttc

SEQ ID NO: 1320950 - DNA, 22 bp, Artificial Sequence
  chemically synthesized
catgactattcttcactttgtt

SEQ ID NO: 1320951 - DNA, 22 bp, Artificial Sequence
  chemically synthesized
tgaacaaagtgaagaatagtca

SEQ ID NO: 1320952 - DNA, 22 bp, Artificial Sequence
  chemically synthesized
taaagcagccttcatgactatt

SEQ ID NO: 1320953 - DNA, 22 bp, Artificial Sequence
  chemically synthesized
tgtaaagcagccttcatgacta

SEQ ID NO: 1320954 - DNA, 22 bp, Artificial Sequence
  chemically synthesized
caattctgtaaagcagccttca

SEQ ID NO: 1320955 - DNA, 22 bp, Artificial Sequence
  chemically synthesized
cctccaattctgtaaagcagcc

SEQ ID NO: 1320956 - DNA, 22 bp, Artificial Sequence
  chemically synthesized
ctttacagaattggaggtaatt

SEQ ID NO: 1320957 - DNA, 22 bp, Artificial Sequence
  chemically synthesized
tacagaattggaggtaatttgg

SEQ ID NO: 1320958 - DNA, 22 bp, Artificial Sequence
  chemically synthesized
acagaattggaggtaatttggt

SEQ ID NO: 1320959 - DNA, 22 bp, Artificial Sequence
  chemically synthesized
cagaattggaggtaatttggtg

SEQ ID NO: 1320960 - DNA, 22 bp, Artificial Sequence
  chemically synthesized
cagtaaataaaagacaccaaat

SEQ ID NO: 1320961 - DNA, 22 bp, Artificial Sequence
  chemically synthesized
gctgcagtaaataaaagacacc

SEQ ID NO: 1320962 - DNA, 22 bp, Artificial Sequence
  chemically synthesized
agctgcagtaaataaaagacac

SEQ ID NO: 1320963 - DNA, 22 bp, Artificial Sequence
  chemically synthesized
gaggtaatttggtgtcttttat

SEQ ID NO: 1320964 - DNA, 22 bp, Artificial Sequence
  chemically synthesized
tagctgcagtaaataaaagaca

SEQ ID NO: 1320965 - DNA, 22 bp, Artificial Sequence
  chemically synthesized
ttagctgcagtaaataaaagac

SEQ ID NO: 1320966 - DNA, 22 bp, Artificial Sequence
  chemically synthesized
ggtgtcttttatttactgcagc

SEQ ID NO: 1320967 - DNA, 22 bp, Artificial Sequence
  chemically synthesized
aagaaccttttagctgcagtaa

SEQ ID NO: 1320968 - DNA, 22 bp, Artificial Sequence
  chemically synthesized
gtgtcttttatttactgcagct

SEQ ID NO: 1320969 - DNA, 22 bp, Artificial Sequence
  chemically synthesized
gaagaaccttttagctgcagta

SEQ ID NO: 1320970 - DNA, 22 bp, Artificial Sequence
  chemically synthesized
tgaagaaccttttagctgcagt

SEQ ID NO: 1320971 - DNA, 22 bp, Artificial Sequence
  chemically synthesized
ttttgaagaaccttttagctgc

SEQ ID NO: 1320972 - DNA, 22 bp, Artificial Sequence
  chemically synthesized
attttgaagaaccttttagctg

SEQ ID NO: 1320973 - DNA, 22 bp, Artificial Sequence
  chemically synthesized
ttatttactgcagctaaaaggt

SEQ ID NO: 1320974 - DNA, 22 bp, Artificial Sequence
  chemically synthesized
tatttactgcagctaaaaggtt

SEQ ID NO: 1320975 - DNA, 22 bp, Artificial Sequence
  chemically synthesized
atttactgcagctaaaaggttc

SEQ ID NO: 1320976 - DNA, 22 bp, Artificial Sequence
  chemically synthesized
tttactgcagctaaaaggttct

SEQ ID NO: 1320977 - DNA, 22 bp, Artificial Sequence
  chemically synthesized
tgcttattttgaagaacctttt

SEQ ID NO: 1320978 - DNA, 22 bp, Artificial Sequence
  chemically synthesized
actgcagctaaaaggttcttca

SEQ ID NO: 1320979 - DNA, 22 bp, Artificial Sequence
  chemically synthesized
ctgcagctaaaaggttcttcaa

SEQ ID NO: 1320980 - DNA, 22 bp, Artificial Sequence
  chemically synthesized
cagctaaaaggttcttcaaaat

SEQ ID NO: 1320981 - DNA, 22 bp, Artificial Sequence
  chemically synthesized
aagcaaagattatgcttatttt

SEQ ID NO: 1320982 - DNA, 22 bp, Artificial Sequence
  chemically synthesized
aaaggttcttcaaaataagcat

SEQ ID NO: 1320983 - DNA, 22 bp, Artificial Sequence
  chemically synthesized
ttcaaaataagcataatctttg

SEQ ID NO: 1320984 - DNA, 22 bp, Artificial Sequence
  chemically synthesized
caaaataagcataatctttgct

SEQ ID NO: 1320985 - DNA, 22 bp, Artificial Sequence
  chemically synthesized
aaaataagcataatctttgctt

SEQ ID NO: 1320986 - DNA, 22 bp, Artificial Sequence
  chemically synthesized
gaagaaacacatgtagctgaag

SEQ ID NO: 1320987 - DNA, 22 bp, Artificial Sequence
  chemically synthesized
gaaaatctggaagaaacacatg

SEQ ID NO: 1320988 - DNA, 22 bp, Artificial Sequence
  chemically synthesized
tgcttcagctacatgtgtttct

SEQ ID NO: 1320989 - DNA, 22 bp, Artificial Sequence
  chemically synthesized
gcttcagctacatgtgtttctt

SEQ ID NO: 1320990 - DNA, 22 bp, Artificial Sequence
  chemically synthesized
cttcagctacatgtgtttcttc

SEQ ID NO: 1320991 - DNA, 22 bp, Artificial Sequence
  chemically synthesized
cagctacatgtgtttcttccag

SEQ ID NO: 1320992 - DNA, 22 bp, Artificial Sequence
  chemically synthesized
agctacatgtgtttcttccaga

SEQ ID NO: 1320993 - DNA, 22 bp, Artificial Sequence
  chemically synthesized
catgtgtttcttccagattttc

SEQ ID NO: 1320994 - DNA, 22 bp, Artificial Sequence
  chemically synthesized
cttccagattttctaatgctct

SEQ ID NO: 1320995 - DNA, 22 bp, Artificial Sequence
  chemically synthesized
ttccagattttctaatgctctt

SEQ ID NO: 1320996 - DNA, 22 bp, Artificial Sequence
  chemically synthesized
ccagattttctaatgctcttcc

SEQ ID NO: 1320997 - DNA, 22 bp, Artificial Sequence
  chemically synthesized
cagattttctaatgctcttcca

SEQ ID NO: 1320998 - DNA, 22 bp, Artificial Sequence
  chemically synthesized
tctaatgctcttccacatcact

SEQ ID NO: 1320999 - DNA, 22 bp, Artificial Sequence
  chemically synthesized
ctaatgctcttccacatcactg

SEQ ID NO: 1321000 - DNA, 22 bp, Artificial Sequence
  chemically synthesized
taatgctcttccacatcactgt

SEQ ID NO: 1321001 - DNA, 22 bp, Artificial Sequence
  chemically synthesized
atgctcttccacatcactgttt

SEQ ID NO: 1321002 - DNA, 22 bp, Artificial Sequence
  chemically synthesized
ttccacatcactgttttcttgg

SEQ ID NO: 1321003 - DNA, 22 bp, Artificial Sequence
  chemically synthesized
ccacatcactgttttcttggtt

SEQ ID NO: 1321004 - DNA, 22 bp, Artificial Sequence
  chemically synthesized
cacatcactgttttcttggttc

SEQ ID NO: 1321005 - DNA, 22 bp, Artificial Sequence
  chemically synthesized
aaatgtaaagggtgaaccaaga

SEQ ID NO: 1321006 - DNA, 22 bp, Artificial Sequence
  chemically synthesized
tctaaaatgtaaagggtgaacc

SEQ ID NO: 1321007 - DNA, 22 bp, Artificial Sequence
  chemically synthesized
atctaaaatgtaaagggtgaac

SEQ ID NO: 1321008 - DNA, 22 bp, Artificial Sequence
  chemically synthesized
ttttcttggttcaccctttaca

SEQ ID NO: 1321009 - DNA, 22 bp, Artificial Sequence
  chemically synthesized
tcttggttcaccctttacattt

SEQ ID NO: 1321010 - DNA, 22 bp, Artificial Sequence
  chemically synthesized
cttggttcaccctttacatttt

SEQ ID NO: 1321011 - DNA, 22 bp, Artificial Sequence
  chemically synthesized
ttggttcaccctttacatttta

SEQ ID NO: 1321012 - DNA, 22 bp, Artificial Sequence
  chemically synthesized
tggaatatttatctaaaatgta

SEQ ID NO: 1321013 - DNA, 22 bp, Artificial Sequence
  chemically synthesized
ggttcaccctttacattttaga

SEQ ID NO: 1321014 - DNA, 22 bp, Artificial Sequence
  chemically synthesized
gttcaccctttacattttagat

SEQ ID NO: 1321015 - DNA, 22 bp, Artificial Sequence
  chemically synthesized
actgtggaatatttatctaaaa

SEQ ID NO: 1321016 - DNA, 22 bp, Artificial Sequence
  chemically synthesized
accctttacattttagataaat

SEQ ID NO: 1321017 - DNA, 22 bp, Artificial Sequence
  chemically synthesized
tacattttagataaatattcca

SEQ ID NO: 1321018 - DNA, 22 bp, Artificial Sequence
  chemically synthesized
acattttagataaatattccac

SEQ ID NO: 1321019 - DNA, 22 bp, Artificial Sequence
  chemically synthesized
cattttagataaatattccaca

SEQ ID NO: 1321020 - DNA, 22 bp, Artificial Sequence
  chemically synthesized
tagataaatattccacagtgag

SEQ ID NO: 1321021 - DNA, 22 bp, Artificial Sequence
  chemically synthesized
agataaatattccacagtgaga

SEQ ID NO: 1321022 - DNA, 22 bp, Artificial Sequence
  chemically synthesized
ggatcaggaaggtctcactgtg

SEQ ID NO: 1321023 - DNA, 22 bp, Artificial Sequence
  chemically synthesized
gataaatattccacagtgagac

SEQ ID NO: 1321024 - DNA, 22 bp, Artificial Sequence
  chemically synthesized
gggatcaggaaggtctcactgt

SEQ ID NO: 1321025 - DNA, 22 bp, Artificial Sequence
  chemically synthesized
aggtttgggatcaggaaggtct

SEQ ID NO: 1321026 - DNA, 22 bp, Artificial Sequence
  chemically synthesized
attcaggtttgggatcaggaag

SEQ ID NO: 1321027 - DNA, 22 bp, Artificial Sequence
  chemically synthesized
cacagtgagaccttcctgatcc

SEQ ID NO: 1321028 - DNA, 22 bp, Artificial Sequence
  chemically synthesized
aattcaggtttgggatcaggaa

SEQ ID NO: 1321029 - DNA, 22 bp, Artificial Sequence
  chemically synthesized
tttaattcaggtttgggatcag

SEQ ID NO: 1321030 - DNA, 22 bp, Artificial Sequence
  chemically synthesized
atttaattcaggtttgggatca

SEQ ID NO: 1321031 - DNA, 22 bp, Artificial Sequence
  chemically synthesized
cctgatcccaaacctgaattaa

SEQ ID NO: 1321032 - DNA, 22 bp, Artificial Sequence
  chemically synthesized
ctgatcccaaacctgaattaaa

SEQ ID NO: 1321033 - DNA, 22 bp, Artificial Sequence
  chemically synthesized
atcccaaacctgaattaaataa

SEQ ID NO: 1321034 - DNA, 22 bp, Artificial Sequence
  chemically synthesized
aattaaataaatactcttacgc

SEQ ID NO: 1321035 - DNA, 22 bp, Artificial Sequence
  chemically synthesized
aataaatactcttacgctctct

SEQ ID NO: 1321036 - DNA, 22 bp, Artificial Sequence
  chemically synthesized
aataaaaataagtgcatgagag

SEQ ID NO: 1321037 - DNA, 22 bp, Artificial Sequence
  chemically synthesized
taaataaaaataagtgcatgag

SEQ ID NO: 1321038 - DNA, 22 bp, Artificial Sequence
  chemically synthesized
ctaaataaaaataagtgcatga

SEQ ID NO: 1321039 - DNA, 22 bp, Artificial Sequence
  chemically synthesized
tctaaataaaaataagtgcatg

SEQ ID NO: 1321040 - DNA, 22 bp, Artificial Sequence
  chemically synthesized
ttacgctctctcatgcacttat

SEQ ID NO: 1321041 - DNA, 22 bp, Artificial Sequence
  chemically synthesized
acgctctctcatgcacttattt

SEQ ID NO: 1321042 - DNA, 22 bp, Artificial Sequence
  chemically synthesized
cgctctctcatgcacttatttt

SEQ ID NO: 1321043 - DNA, 22 bp, Artificial Sequence
  chemically synthesized
tctcatgcacttatttttattt

SEQ ID NO: 1321044 - DNA, 22 bp, Artificial Sequence
  chemically synthesized
tgataaattttctaaataaaaa

SEQ ID NO: 1321045 - DNA, 22 bp, Artificial Sequence
  chemically synthesized
tcatgcacttatttttatttag

SEQ ID NO: 1321046 - DNA, 22 bp, Artificial Sequence
  chemically synthesized
atgcacttatttttatttagaa

SEQ ID NO: 1321047 - DNA, 22 bp, Artificial Sequence
  chemically synthesized
atttttatttagaaaatttatc

SEQ ID NO: 1321048 - DNA, 22 bp, Artificial Sequence
  chemically synthesized
tttttatttagaaaatttatca

SEQ ID NO: 1321049 - DNA, 22 bp, Artificial Sequence
  chemically synthesized
ttatttagaaaatttatcataa

SEQ ID NO: 1321050 - DNA, 22 bp, Artificial Sequence
  chemically synthesized
tatttagaaaatttatcataat

SEQ ID NO: 1321051 - DNA, 22 bp, Artificial Sequence
  chemically synthesized
atttagaaaatttatcataatt

SEQ ID NO: 1321052 - DNA, 22 bp, Artificial Sequence
  chemically synthesized
tttagaaaatttatcataattc

SEQ ID NO: 1321053 - DNA, 22 bp, Artificial Sequence
  chemically synthesized
agaaaatttatcataattcttg

SEQ ID NO: 1321054 - DNA, 22 bp, Artificial Sequence
  chemically synthesized
gaaaatttatcataattcttga

SEQ ID NO: 1321055 - DNA, 22 bp, Artificial Sequence
  chemically synthesized
gacaagcatatgtaagtagtca

SEQ ID NO: 1321056 - DNA, 22 bp, Artificial Sequence
  chemically synthesized
atcataattcttgactacttac

SEQ ID NO: 1321057 - DNA, 22 bp, Artificial Sequence
  chemically synthesized
tcataattcttgactacttaca

SEQ ID NO: 1321058 - DNA, 22 bp, Artificial Sequence
  chemically synthesized
ttagacaagcatatgtaagtag

SEQ ID NO: 1321059 - DNA, 22 bp, Artificial Sequence
  chemically synthesized
ttgactacttacatatgcttgt

SEQ ID NO: 1321060 - DNA, 22 bp, Artificial Sequence
  chemically synthesized
gactacttacatatgcttgtct

SEQ ID NO: 1321061 - DNA, 22 bp, Artificial Sequence
  chemically synthesized
actacttacatatgcttgtcta

SEQ ID NO: 1321062 - DNA, 22 bp, Artificial Sequence
  chemically synthesized
aaaaaatcagctattagacaag

SEQ ID NO: 1321063 - DNA, 22 bp, Artificial Sequence
  chemically synthesized
aaaaaaatcagctattagacaa

SEQ ID NO: 1321064 - DNA, 22 bp, Artificial Sequence
  chemically synthesized
cttacatatgcttgtctaatag

SEQ ID NO: 1321065 - DNA, 22 bp, Artificial Sequence
  chemically synthesized
ttaaaaaaatcagctattagac

SEQ ID NO: 1321066 - DNA, 22 bp, Artificial Sequence
  chemically synthesized
cttaaaaaaatcagctattaga

SEQ ID NO: 1321067 - DNA, 22 bp, Artificial Sequence
  chemically synthesized
acatatgcttgtctaatagctg

SEQ ID NO: 1321068 - DNA, 22 bp, Artificial Sequence
  chemically synthesized
catatgcttgtctaatagctga

SEQ ID NO: 1321069 - DNA, 22 bp, Artificial Sequence
  chemically synthesized
atcttcttaaaaaaatcagcta

SEQ ID NO: 1321070 - DNA, 22 bp, Artificial Sequence
  chemically synthesized
catcttcttaaaaaaatcagct

SEQ ID NO: 1321071 - DNA, 22 bp, Artificial Sequence
  chemically synthesized
gtctaatagctgatttttttaa

SEQ ID NO: 1321072 - DNA, 22 bp, Artificial Sequence
  chemically synthesized
ggcttcatcttcttaaaaaaat

SEQ ID NO: 1321073 - DNA, 22 bp, Artificial Sequence
  chemically synthesized
tctaatagctgatttttttaag

SEQ ID NO: 1321074 - DNA, 22 bp, Artificial Sequence
  chemically synthesized
tgggcttcatcttcttaaaaaa

SEQ ID NO: 1321075 - DNA, 22 bp, Artificial Sequence
  chemically synthesized
ctgggcttcatcttcttaaaaa

SEQ ID NO: 1321076 - DNA, 22 bp, Artificial Sequence
  chemically synthesized
tctgggcttcatcttcttaaaa

SEQ ID NO: 1321077 - DNA, 22 bp, Artificial Sequence
  chemically synthesized
atagctgatttttttaagaaga

SEQ ID NO: 1321078 - DNA, 22 bp, Artificial Sequence
  chemically synthesized
ttctgggcttcatcttcttaaa

SEQ ID NO: 1321079 - DNA, 22 bp, Artificial Sequence
  chemically synthesized
tcttttctgggcttcatcttct

SEQ ID NO: 1321080 - DNA, 22 bp, Artificial Sequence
  chemically synthesized
gtcttttctgggcttcatcttc

SEQ ID NO: 1321081 - DNA, 22 bp, Artificial Sequence
  chemically synthesized
atttttttaagaagatgaagcc

SEQ ID NO: 1321082 - DNA, 22 bp, Artificial Sequence
  chemically synthesized
ttttaagaagatgaagcccaga

SEQ ID NO: 1321083 - DNA, 22 bp, Artificial Sequence
  chemically synthesized
tttaagaagatgaagcccagaa

SEQ ID NO: 1321084 - DNA, 22 bp, Artificial Sequence
  chemically synthesized
ttaagaagatgaagcccagaaa

SEQ ID NO: 1321085 - DNA, 22 bp, Artificial Sequence
  chemically synthesized
taagaagatgaagcccagaaaa

SEQ ID NO: 1321086 - DNA, 22 bp, Artificial Sequence
  chemically synthesized
aagaagatgaagcccagaaaag

SEQ ID NO: 1321087 - DNA, 22 bp, Artificial Sequence
  chemically synthesized
agaagatgaagcccagaaaaga

SEQ ID NO: 1321088 - DNA, 22 bp, Artificial Sequence
  chemically synthesized
taaataaaacacaaaagagagt

SEQ ID NO: 1321089 - DNA, 22 bp, Artificial Sequence
  chemically synthesized
tcttttgtgttttatttatagt

SEQ ID NO: 1321090 - DNA, 22 bp, Artificial Sequence
  chemically synthesized
ttttgtgttttatttatagtgt

SEQ ID NO: 1321091 - DNA, 22 bp, Artificial Sequence
  chemically synthesized
ttgtgttttatttatagtgtcc

SEQ ID NO: 1321092 - DNA, 22 bp, Artificial Sequence
  chemically synthesized
tgtgttttatttatagtgtccg

SEQ ID NO: 1321093 - DNA, 22 bp, Artificial Sequence
  chemically synthesized
gtgttttatttatagtgtccga

SEQ ID NO: 1321094 - DNA, 22 bp, Artificial Sequence
  chemically synthesized
tgttttatttatagtgtccgat

SEQ ID NO: 1321095 - DNA, 22 bp, Artificial Sequence
  chemically synthesized
tatttatagtgtccgatccatt

SEQ ID NO: 1321096 - DNA, 22 bp, Artificial Sequence
  chemically synthesized
atttatagtgtccgatccattc

SEQ ID NO: 1321097 - DNA, 22 bp, Artificial Sequence
  chemically synthesized
tcatatgccacagaatggatcg

SEQ ID NO: 1321098 - DNA, 22 bp, Artificial Sequence
  chemically synthesized
tttatagtgtccgatccattct

SEQ ID NO: 1321099 - DNA, 22 bp, Artificial Sequence
  chemically synthesized
atagtgtccgatccattctgtg

SEQ ID NO: 1321100 - DNA, 22 bp, Artificial Sequence
  chemically synthesized
actgtcatatgccacagaatgg

SEQ ID NO: 1321101 - DNA, 22 bp, Artificial Sequence
  chemically synthesized
tagtgtccgatccattctgtgg

SEQ ID NO: 1321102 - DNA, 22 bp, Artificial Sequence
  chemically synthesized
gactgtcatatgccacagaatg

SEQ ID NO: 1321103 - DNA, 22 bp, Artificial Sequence
  chemically synthesized
agcatttgactgtcatatgcca

SEQ ID NO: 1321104 - DNA, 22 bp, Artificial Sequence
  chemically synthesized
attgagcatttgactgtcatat

SEQ ID NO: 1321105 - DNA, 22 bp, Artificial Sequence
  chemically synthesized
aattgagcatttgactgtcata

SEQ ID NO: 1321106 - DNA, 22 bp, Artificial Sequence
  chemically synthesized
tgtggcatatgacagtcaaatg

SEQ ID NO: 1321107 - DNA, 22 bp, Artificial Sequence
  chemically synthesized
tggcatatgacagtcaaatgct

SEQ ID NO: 1321108 - DNA, 22 bp, Artificial Sequence
  chemically synthesized
caaaggcttaattgagcatttg

SEQ ID NO: 1321109 - DNA, 22 bp, Artificial Sequence
  chemically synthesized
gcaaaggcttaattgagcattt

SEQ ID NO: 1321110 - DNA, 22 bp, Artificial Sequence
  chemically synthesized
ggtcacttgcaaaggcttaatt

SEQ ID NO: 1321111 - DNA, 22 bp, Artificial Sequence
  chemically synthesized
tatactgggtcacttgcaaagg

SEQ ID NO: 1321112 - DNA, 22 bp, Artificial Sequence
  chemically synthesized
atatactgggtcacttgcaaag

SEQ ID NO: 1321113 - DNA, 22 bp, Artificial Sequence
  chemically synthesized
tatatactgggtcacttgcaaa

SEQ ID NO: 1321114 - DNA, 22 bp, Artificial Sequence
  chemically synthesized
ttatatactgggtcacttgcaa

SEQ ID NO: 1321115 - DNA, 22 bp, Artificial Sequence
  chemically synthesized
aattaagcctttgcaagtgacc

SEQ ID NO: 1321116 - DNA, 22 bp, Artificial Sequence
  chemically synthesized
agcctttgcaagtgacccagta

SEQ ID NO: 1321117 - DNA, 22 bp, Artificial Sequence
  chemically synthesized
aatccttttatatactgggtca

SEQ ID NO: 1321118 - DNA, 22 bp, Artificial Sequence
  chemically synthesized
tgcaagtgacccagtatataaa

SEQ ID NO: 1321119 - DNA, 22 bp, Artificial Sequence
  chemically synthesized
atactgaatccttttatatact

SEQ ID NO: 1321120 - DNA, 22 bp, Artificial Sequence
  chemically synthesized
gcaagtgacccagtatataaaa

SEQ ID NO: 1321121 - DNA, 22 bp, Artificial Sequence
  chemically synthesized
caagtgacccagtatataaaag

SEQ ID NO: 1321122 - DNA, 22 bp, Artificial Sequence
  chemically synthesized
ggagtcacctcatactgaatcc

SEQ ID NO: 1321123 - DNA, 22 bp, Artificial Sequence
  chemically synthesized
gggagtcacctcatactgaatc

SEQ ID NO: 1321124 - DNA, 22 bp, Artificial Sequence
  chemically synthesized
catttgggagtcacctcatact

SEQ ID NO: 1321125 - DNA, 22 bp, Artificial Sequence
  chemically synthesized
tgtccaactacatttgggagtc

SEQ ID NO: 1321126 - DNA, 22 bp, Artificial Sequence
  chemically synthesized
agtatgaggtgactcccaaatg

SEQ ID NO: 1321127 - DNA, 22 bp, Artificial Sequence
  chemically synthesized
tgtgtccaactacatttgggag

SEQ ID NO: 1321128 - DNA, 22 bp, Artificial Sequence
  chemically synthesized
ctctgtgtccaactacatttgg

SEQ ID NO: 1321129 - DNA, 22 bp, Artificial Sequence
  chemically synthesized
atggctgctctgtgtccaacta

SEQ ID NO: 1321130 - DNA, 22 bp, Artificial Sequence
  chemically synthesized
ccaaatgtagttggacacagag

SEQ ID NO: 1321131 - DNA, 22 bp, Artificial Sequence
  chemically synthesized
ggagatattcatggctgctctg

SEQ ID NO: 1321132 - DNA, 22 bp, Artificial Sequence
  chemically synthesized
aggagatattcatggctgctct

SEQ ID NO: 1321133 - DNA, 22 bp, Artificial Sequence
  chemically synthesized
taggagatattcatggctgctc

SEQ ID NO: 1321134 - DNA, 22 bp, Artificial Sequence
  chemically synthesized
tttaggagatattcatggctgc

SEQ ID NO: 1321135 - DNA, 22 bp, Artificial Sequence
  chemically synthesized
ctttaggagatattcatggctg

SEQ ID NO: 1321136 - DNA, 22 bp, Artificial Sequence
  chemically synthesized
gacacagagcagccatgaatat

SEQ ID NO: 1321137 - DNA, 22 bp, Artificial Sequence
  chemically synthesized
tggaacatttctttaggagata

SEQ ID NO: 1321138 - DNA, 22 bp, Artificial Sequence
  chemically synthesized
agcctgtggaacatttctttag

SEQ ID NO: 1321139 - DNA, 22 bp, Artificial Sequence
  chemically synthesized
cagcctgtggaacatttcttta

SEQ ID NO: 1321140 - DNA, 22 bp, Artificial Sequence
  chemically synthesized
atttcagcctgtggaacatttc

SEQ ID NO: 1321141 - DNA, 22 bp, Artificial Sequence
  chemically synthesized
aatttcagcctgtggaacattt

SEQ ID NO: 1321142 - DNA, 22 bp, Artificial Sequence
  chemically synthesized
ctaaagaaatgttccacaggct

SEQ ID NO: 1321143 - DNA, 22 bp, Artificial Sequence
  chemically synthesized
tgccttaatttcagcctgtgga

SEQ ID NO: 1321144 - DNA, 22 bp, Artificial Sequence
  chemically synthesized
aagaaatgttccacaggctgaa

SEQ ID NO: 1321145 - DNA, 22 bp, Artificial Sequence
  chemically synthesized
gagattatgccttaatttcagc

SEQ ID NO: 1321146 - DNA, 22 bp, Artificial Sequence
  chemically synthesized
tagagattatgccttaatttca

SEQ ID NO: 1321147 - DNA, 22 bp, Artificial Sequence
  chemically synthesized
ctagagattatgccttaatttc

SEQ ID NO: 1321148 - DNA, 22 bp, Artificial Sequence
  chemically synthesized
tctagagattatgccttaattt

SEQ ID NO: 1321149 - DNA, 22 bp, Artificial Sequence
  chemically synthesized
ttctagagattatgccttaatt

SEQ ID NO: 1321150 - DNA, 22 bp, Artificial Sequence
  chemically synthesized
cacaggctgaaattaaggcata

SEQ ID NO: 1321151 - DNA, 22 bp, Artificial Sequence
  chemically synthesized
aaaaacatttttctagagatta

SEQ ID NO: 1321152 - DNA, 22 bp, Artificial Sequence
  chemically synthesized
aaattaaggcataatctctaga

SEQ ID NO: 1321153 - DNA, 22 bp, Artificial Sequence
  chemically synthesized
aaaaaacatttttctagagatt

SEQ ID NO: 1321154 - DNA, 22 bp, Artificial Sequence
  chemically synthesized
taaaaaacatttttctagagat

SEQ ID NO: 1321155 - DNA, 22 bp, Artificial Sequence
  chemically synthesized
ttaaaaaacatttttctagaga

SEQ ID NO: 1321156 - DNA, 22 bp, Artificial Sequence
  chemically synthesized
aggcataatctctagaaaaatg

SEQ ID NO: 1321157 - DNA, 22 bp, Artificial Sequence
  chemically synthesized
taaagcacaacttttaaaaaac

SEQ ID NO: 1321158 - DNA, 22 bp, Artificial Sequence
  chemically synthesized
tagaaaaatgttttttaaaagt

SEQ ID NO: 1321159 - DNA, 22 bp, Artificial Sequence
  chemically synthesized
gaaaaatgttttttaaaagttg

SEQ ID NO: 1321160 - DNA, 22 bp, Artificial Sequence
  chemically synthesized
tttaaaagttgtgctttataat

SEQ ID NO: 1321161 - DNA, 22 bp, Artificial Sequence
  chemically synthesized
ttaaaagttgtgctttataata

SEQ ID NO: 1321162 - DNA, 22 bp, Artificial Sequence
  chemically synthesized
taaaagttgtgctttataatat

SEQ ID NO: 1321163 - DNA, 22 bp, Artificial Sequence
  chemically synthesized
aaaagttgtgctttataatatc

SEQ ID NO: 1321164 - DNA, 22 bp, Artificial Sequence
  chemically synthesized
catgataaatgtgatattataa

SEQ ID NO: 1321165 - DNA, 22 bp, Artificial Sequence
  chemically synthesized
aaagttgtgctttataatatca

SEQ ID NO: 1321166 - DNA, 22 bp, Artificial Sequence
  chemically synthesized
ccatgataaatgtgatattata

SEQ ID NO: 1321167 - DNA, 22 bp, Artificial Sequence
  chemically synthesized
tgctttataatatcacatttat

SEQ ID NO: 1321168 - DNA, 22 bp, Artificial Sequence
  chemically synthesized
tataatatcacatttatcatgg

SEQ ID NO: 1321169 - DNA, 22 bp, Artificial Sequence
  chemically synthesized
ataatatcacatttatcatgga

SEQ ID NO: 1321170 - DNA, 22 bp, Artificial Sequence
  chemically synthesized
taatatcacatttatcatggaa

SEQ ID NO: 1321171 - DNA, 22 bp, Artificial Sequence
  chemically synthesized
atacataatgatcagatatatt

SEQ ID NO: 1321172 - DNA, 22 bp, Artificial Sequence
  chemically synthesized
ttgatacataatgatcagatat

SEQ ID NO: 1321173 - DNA, 22 bp, Artificial Sequence
  chemically synthesized
atcatggaaatatatctgatca

SEQ ID NO: 1321174 - DNA, 22 bp, Artificial Sequence
  chemically synthesized
tcatggaaatatatctgatcat

SEQ ID NO: 1321175 - DNA, 22 bp, Artificial Sequence
  chemically synthesized
ttattgatacataatgatcaga

SEQ ID NO: 1321176 - DNA, 22 bp, Artificial Sequence
  chemically synthesized
tgttattgatacataatgatca

SEQ ID NO: 1321177 - DNA, 22 bp, Artificial Sequence
  chemically synthesized
ctgttattgatacataatgatc

SEQ ID NO: 1321178 - DNA, 22 bp, Artificial Sequence
  chemically synthesized
atcattatgtatcaataacaga

SEQ ID NO: 1321179 - DNA, 22 bp, Artificial Sequence
  chemically synthesized
tgtatcaataacagaaatgtgt

SEQ ID NO: 1321180 - DNA, 22 bp, Artificial Sequence
  chemically synthesized
aagaaaatagtaaagcacacat

SEQ ID NO: 1321181 - DNA, 22 bp, Artificial Sequence
  chemically synthesized
gcaaaacctaaagaaaatagta

SEQ ID NO: 1321182 - DNA, 22 bp, Artificial Sequence
  chemically synthesized
agcaaaacctaaagaaaatagt

SEQ ID NO: 1321183 - DNA, 22 bp, Artificial Sequence
  chemically synthesized
tagcaaaacctaaagaaaatag

SEQ ID NO: 1321184 - DNA, 22 bp, Artificial Sequence
  chemically synthesized
tactattttctttaggttttgc

SEQ ID NO: 1321185 - DNA, 22 bp, Artificial Sequence
  chemically synthesized
actattttctttaggttttgct

SEQ ID NO: 1321186 - DNA, 22 bp, Artificial Sequence
  chemically synthesized
gtagtaagttttagcaaaacct

SEQ ID NO: 1321187 - DNA, 22 bp, Artificial Sequence
  chemically synthesized
ctattttctttaggttttgcta

SEQ ID NO: 1321188 - DNA, 22 bp, Artificial Sequence
  chemically synthesized
ggtagtaagttttagcaaaacc

SEQ ID NO: 1321189 - DNA, 22 bp, Artificial Sequence
  chemically synthesized
ttttctttaggttttgctaaaa

SEQ ID NO: 1321190 - DNA, 22 bp, Artificial Sequence
  chemically synthesized
tctttaggttttgctaaaactt

SEQ ID NO: 1321191 - DNA, 22 bp, Artificial Sequence
  chemically synthesized
ctttaggttttgctaaaactta

SEQ ID NO: 1321192 - DNA, 22 bp, Artificial Sequence
  chemically synthesized
tttaggttttgctaaaacttac

SEQ ID NO: 1321193 - DNA, 22 bp, Artificial Sequence
  chemically synthesized
aggatatttggtagtaagtttt

SEQ ID NO: 1321194 - DNA, 22 bp, Artificial Sequence
  chemically synthesized
taggttttgctaaaacttacta

SEQ ID NO: 1321195 - DNA, 22 bp, Artificial Sequence
  chemically synthesized
caggatatttggtagtaagttt

SEQ ID NO: 1321196 - DNA, 22 bp, Artificial Sequence
  chemically synthesized
aggttttgctaaaacttactac

SEQ ID NO: 1321197 - DNA, 22 bp, Artificial Sequence
  chemically synthesized
ggttttgctaaaacttactacc

SEQ ID NO: 1321198 - DNA, 22 bp, Artificial Sequence
  chemically synthesized
atttcaggatatttggtagtaa

SEQ ID NO: 1321199 - DNA, 22 bp, Artificial Sequence
  chemically synthesized
tgctaaaacttactaccaaata

SEQ ID NO: 1321200 - DNA, 22 bp, Artificial Sequence
  chemically synthesized
gctaaaacttactaccaaatat

SEQ ID NO: 1321201 - DNA, 22 bp, Artificial Sequence
  chemically synthesized
ctaaaacttactaccaaatatc

SEQ ID NO: 1321202 - DNA, 22 bp, Artificial Sequence
  chemically synthesized
aaacttactaccaaatatcctg

SEQ ID NO: 1321203 - DNA, 22 bp, Artificial Sequence
  chemically synthesized
aagtgaaattaatttcaggata

SEQ ID NO: 1321204 - DNA, 22 bp, Artificial Sequence
  chemically synthesized
aaagtgaaattaatttcaggat

SEQ ID NO: 1321205 - DNA, 22 bp, Artificial Sequence
  chemically synthesized
taaagtgaaattaatttcagga

SEQ ID NO: 1321206 - DNA, 22 bp, Artificial Sequence
  chemically synthesized
actaccaaatatcctgaaatta

SEQ ID NO: 1321207 - DNA, 22 bp, Artificial Sequence
  chemically synthesized
ctaccaaatatcctgaaattaa

SEQ ID NO: 1321208 - DNA, 22 bp, Artificial Sequence
  chemically synthesized
gctttaaagtgaaattaatttc

SEQ ID NO: 1321209 - DNA, 22 bp, Artificial Sequence
  chemically synthesized
ccaaatatcctgaaattaattt

SEQ ID NO: 1321210 - DNA, 22 bp, Artificial Sequence
  chemically synthesized
agctttaaagtgaaattaattt

SEQ ID NO: 1321211 - DNA, 22 bp, Artificial Sequence
  chemically synthesized
tttagctttaaagtgaaattaa

SEQ ID NO: 1321212 - DNA, 22 bp, Artificial Sequence
  chemically synthesized
atttagctttaaagtgaaatta

SEQ ID NO: 1321213 - DNA, 22 bp, Artificial Sequence
  chemically synthesized
aaattaatttcactttaaagct

SEQ ID NO: 1321214 - DNA, 22 bp, Artificial Sequence
  chemically synthesized
atttcactttaaagctaaataa

SEQ ID NO: 1321215 - DNA, 22 bp, Artificial Sequence
  chemically synthesized
cactttaaagctaaataaattg

SEQ ID NO: 1321216 - DNA, 22 bp, Artificial Sequence
  chemically synthesized
gtgtatatagaccaatttattt

SEQ ID NO: 1321217 - DNA, 22 bp, Artificial Sequence
  chemically synthesized
actttaaagctaaataaattgg

SEQ ID NO: 1321218 - DNA, 22 bp, Artificial Sequence
  chemically synthesized
agtgtatatagaccaatttatt

SEQ ID NO: 1321219 - DNA, 22 bp, Artificial Sequence
  chemically synthesized
tagtgtatatagaccaatttat

SEQ ID NO: 1321220 - DNA, 22 bp, Artificial Sequence
  chemically synthesized
taaagctaaataaattggtcta

SEQ ID NO: 1321221 - DNA, 22 bp, Artificial Sequence
  chemically synthesized
aaagctaaataaattggtctat

SEQ ID NO: 1321222 - DNA, 22 bp, Artificial Sequence
  chemically synthesized
aagctaaataaattggtctata

SEQ ID NO: 1321223 - DNA, 22 bp, Artificial Sequence
  chemically synthesized
tgactttagtgtatatagacca

SEQ ID NO: 1321224 - DNA, 22 bp, Artificial Sequence
  chemically synthesized
atgactttagtgtatatagacc

SEQ ID NO: 1321225 - DNA, 22 bp, Artificial Sequence
  chemically synthesized
aataaattggtctatatacact

SEQ ID NO: 1321226 - DNA, 22 bp, Artificial Sequence
  chemically synthesized
acttatgactttagtgtatata

SEQ ID NO: 1321227 - DNA, 22 bp, Artificial Sequence
  chemically synthesized
gtctatatacactaaagtcata

SEQ ID NO: 1321228 - DNA, 22 bp, Artificial Sequence
  chemically synthesized
aaagaaaatgttcacttatgac

SEQ ID NO: 1321229 - DNA, 22 bp, Artificial Sequence
  chemically synthesized
tatacactaaagtcataagtga

SEQ ID NO: 1321230 - DNA, 22 bp, Artificial Sequence
  chemically synthesized
ctaaaagaaaatgttcacttat

SEQ ID NO: 1321231 - DNA, 22 bp, Artificial Sequence
  chemically synthesized
tctactaaaagaaaatgttcac

SEQ ID NO: 1321232 - DNA, 22 bp, Artificial Sequence
  chemically synthesized
aagtcataagtgaacattttct

SEQ ID NO: 1321233 - DNA, 22 bp, Artificial Sequence
  chemically synthesized
tataattgtctactaaaagaaa

SEQ ID NO: 1321234 - DNA, 22 bp, Artificial Sequence
  chemically synthesized
gtataattgtctactaaaagaa

SEQ ID NO: 1321235 - DNA, 22 bp, Artificial Sequence
  chemically synthesized
tgtataattgtctactaaaaga

SEQ ID NO: 1321236 - DNA, 22 bp, Artificial Sequence
  chemically synthesized
ttgtataattgtctactaaaag

SEQ ID NO: 1321237 - DNA, 22 bp, Artificial Sequence
  chemically synthesized
tttgtataattgtctactaaaa

SEQ ID NO: 1321238 - DNA, 22 bp, Artificial Sequence
  chemically synthesized
ttttgtataattgtctactaaa

SEQ ID NO: 1321239 - DNA, 22 bp, Artificial Sequence
  chemically synthesized
tcttttagtagacaattataca

SEQ ID NO: 1321240 - DNA, 22 bp, Artificial Sequence
  chemically synthesized
cttttagtagacaattatacaa

SEQ ID NO: 1321241 - DNA, 22 bp, Artificial Sequence
  chemically synthesized
ttttagtagacaattatacaaa

SEQ ID NO: 1321242 - DNA, 22 bp, Artificial Sequence
  chemically synthesized
ttagtagacaattatacaaaaa

SEQ ID NO: 1321243 - DNA, 22 bp, Artificial Sequence
  chemically synthesized
tagtagacaattatacaaaaaa

SEQ ID NO: 1321244 - DNA, 22 bp, Artificial Sequence
  chemically synthesized
agtagacaattatacaaaaaaa

SEQ ID NO: 1321245 - DNA, 22 bp, Artificial Sequence
  chemically synthesized
aggaaaagggaatttttttgta

SEQ ID NO: 1321246 - DNA, 22 bp, Artificial Sequence
  chemically synthesized
gtagacaattatacaaaaaaat

SEQ ID NO: 1321247 - DNA, 22 bp, Artificial Sequence
  chemically synthesized
caggaaaagggaatttttttgt

SEQ ID NO: 1321248 - DNA, 22 bp, Artificial Sequence
  chemically synthesized
tacaaaaaaattcccttttcct

SEQ ID NO: 1321249 - DNA, 22 bp, Artificial Sequence
  chemically synthesized
agagacaagaaatgccttcagg

SEQ ID NO: 1321250 - DNA, 22 bp, Artificial Sequence
  chemically synthesized
cagagacaagaaatgccttcag

SEQ ID NO: 1321251 - DNA, 22 bp, Artificial Sequence
  chemically synthesized
tcagagacaagaaatgccttca

SEQ ID NO: 1321252 - DNA, 22 bp, Artificial Sequence
  chemically synthesized
ttttcagagacaagaaatgcct

SEQ ID NO: 1321253 - DNA, 22 bp, Artificial Sequence
  chemically synthesized
ccttttcctgaaggcatttctt

SEQ ID NO: 1321254 - DNA, 22 bp, Artificial Sequence
  chemically synthesized
attttcagagacaagaaatgcc

SEQ ID NO: 1321255 - DNA, 22 bp, Artificial Sequence
  chemically synthesized
ttattttcagagacaagaaatg

SEQ ID NO: 1321256 - DNA, 22 bp, Artificial Sequence
  chemically synthesized
ttcctgaaggcatttcttgtct

SEQ ID NO: 1321257 - DNA, 22 bp, Artificial Sequence
  chemically synthesized
tcctgaaggcatttcttgtctc

SEQ ID NO: 1321258 - DNA, 22 bp, Artificial Sequence
  chemically synthesized
cctgaaggcatttcttgtctct

SEQ ID NO: 1321259 - DNA, 22 bp, Artificial Sequence
  chemically synthesized
ctgaaggcatttcttgtctctg

SEQ ID NO: 1321260 - DNA, 22 bp, Artificial Sequence
  chemically synthesized
aaggcatttcttgtctctgaaa

SEQ ID NO: 1321261 - DNA, 22 bp, Artificial Sequence
  chemically synthesized
taaaattcttattttcagagac

SEQ ID NO: 1321262 - DNA, 22 bp, Artificial Sequence
  chemically synthesized
cttgtctctgaaaataagaatt

SEQ ID NO: 1321263 - DNA, 22 bp, Artificial Sequence
  chemically synthesized
ttgtctctgaaaataagaattt

SEQ ID NO: 1321264 - DNA, 22 bp, Artificial Sequence
  chemically synthesized
gtctctgaaaataagaatttta

SEQ ID NO: 1321265 - DNA, 22 bp, Artificial Sequence
  chemically synthesized
tctctgaaaataagaattttat

SEQ ID NO: 1321266 - DNA, 22 bp, Artificial Sequence
  chemically synthesized
tgaaaataagaattttataatt

SEQ ID NO: 1321267 - DNA, 22 bp, Artificial Sequence
  chemically synthesized
aaaataagaattttataattgg

SEQ ID NO: 1321268 - DNA, 22 bp, Artificial Sequence
  chemically synthesized
tataattggtcttattttccgt

SEQ ID NO: 1321269 - DNA, 22 bp, Artificial Sequence
  chemically synthesized
ataattggtcttattttccgtt

SEQ ID NO: 1321270 - DNA, 22 bp, Artificial Sequence
  chemically synthesized
gaagccaaagaaaacggaaaat

SEQ ID NO: 1321271 - DNA, 22 bp, Artificial Sequence
  chemically synthesized
taattggtcttattttccgttt

SEQ ID NO: 1321272 - DNA, 22 bp, Artificial Sequence
  chemically synthesized
gtcttattttccgttttctttg

SEQ ID NO: 1321273 - DNA, 22 bp, Artificial Sequence
  chemically synthesized
ggacccctagaagccaaagaaa

SEQ ID NO: 1321274 - DNA, 22 bp, Artificial Sequence
  chemically synthesized
tgggacccctagaagccaaaga

SEQ ID NO: 1321275 - DNA, 22 bp, Artificial Sequence
  chemically synthesized
attttccgttttctttggcttc

SEQ ID NO: 1321276 - DNA, 22 bp, Artificial Sequence
  chemically synthesized
ttttccgttttctttggcttct

SEQ ID NO: 1321277 - DNA, 22 bp, Artificial Sequence
  chemically synthesized
ttctgggacccctagaagccaa

SEQ ID NO: 1321278 - DNA, 22 bp, Artificial Sequence
  chemically synthesized
tccgttttctttggcttctagg

SEQ ID NO: 1321279 - DNA, 22 bp, Artificial Sequence
  chemically synthesized
ccgttttctttggcttctaggg

SEQ ID NO: 1321280 - DNA, 22 bp, Artificial Sequence
  chemically synthesized
cgttttctttggcttctagggg

SEQ ID NO: 1321281 - DNA, 22 bp, Artificial Sequence
  chemically synthesized
gtatgttattctgggaccccta

SEQ ID NO: 1321282 - DNA, 22 bp, Artificial Sequence
  chemically synthesized
tctttggcttctaggggtccca

SEQ ID NO: 1321283 - DNA, 22 bp, Artificial Sequence
  chemically synthesized
ctttggcttctaggggtcccag

SEQ ID NO: 1321284 - DNA, 22 bp, Artificial Sequence
  chemically synthesized
tttggcttctaggggtcccaga

SEQ ID NO: 1321285 - DNA, 22 bp, Artificial Sequence
  chemically synthesized
attcgtatgttattctgggacc

SEQ ID NO: 1321286 - DNA, 22 bp, Artificial Sequence
  chemically synthesized
tggcttctaggggtcccagaat

SEQ ID NO: 1321287 - DNA, 22 bp, Artificial Sequence
  chemically synthesized
ggcttctaggggtcccagaata

SEQ ID NO: 1321288 - DNA, 22 bp, Artificial Sequence
  chemically synthesized
gcttctaggggtcccagaataa

SEQ ID NO: 1321289 - DNA, 22 bp, Artificial Sequence
  chemically synthesized
ctaggggtcccagaataacata

SEQ ID NO: 1321290 - DNA, 22 bp, Artificial Sequence
  chemically synthesized
taggggtcccagaataacatac

SEQ ID NO: 1321291 - DNA, 22 bp, Artificial Sequence
  chemically synthesized
ggggtcccagaataacatacga

SEQ ID NO: 1321292 - DNA, 22 bp, Artificial Sequence
  chemically synthesized
agaagataaataattgattcgt

SEQ ID NO: 1321293 - DNA, 22 bp, Artificial Sequence
  chemically synthesized
gctaagaagataaataattgat

SEQ ID NO: 1321294 - DNA, 22 bp, Artificial Sequence
  chemically synthesized
agggtgttggctaagaagataa

SEQ ID NO: 1321295 - DNA, 22 bp, Artificial Sequence
  chemically synthesized
gattaagggtgttggctaagaa

SEQ ID NO: 1321296 - DNA, 22 bp, Artificial Sequence
  chemically synthesized
ggattaagggtgttggctaaga

SEQ ID NO: 1321297 - DNA, 22 bp, Artificial Sequence
  chemically synthesized
cttggattaagggtgttggcta

SEQ ID NO: 1321298 - DNA, 22 bp, Artificial Sequence
  chemically synthesized
tttatcttcttagccaacaccc

SEQ ID NO: 1321299 - DNA, 22 bp, Artificial Sequence
  chemically synthesized
atcttcttagccaacaccctta

SEQ ID NO: 1321300 - DNA, 22 bp, Artificial Sequence
  chemically synthesized
tcttcttagccaacacccttaa

SEQ ID NO: 1321301 - DNA, 22 bp, Artificial Sequence
  chemically synthesized
cttagccaacacccttaatcca

SEQ ID NO: 1321302 - DNA, 22 bp, Artificial Sequence
  chemically synthesized
ttagccaacacccttaatccaa

SEQ ID NO: 1321303 - DNA, 22 bp, Artificial Sequence
  chemically synthesized
agccaacacccttaatccaagc

SEQ ID NO: 1321304 - DNA, 22 bp, Artificial Sequence
  chemically synthesized
gccaacacccttaatccaagca

SEQ ID NO: 1321305 - DNA, 22 bp, Artificial Sequence
  chemically synthesized
aatccaagcaactgacctcttt

SEQ ID NO: 1321306 - DNA, 22 bp, Artificial Sequence
  chemically synthesized
atccaagcaactgacctctttt

SEQ ID NO: 1321307 - DNA, 22 bp, Artificial Sequence
  chemically synthesized
aaagtaatgtaatcaaagcaaa

SEQ ID NO: 1321308 - DNA, 22 bp, Artificial Sequence
  chemically synthesized
acctcttttgctttgattacat

SEQ ID NO: 1321309 - DNA, 22 bp, Artificial Sequence
  chemically synthesized
ttttgctttgattacattactt

SEQ ID NO: 1321310 - DNA, 22 bp, Artificial Sequence
  chemically synthesized
ttgctttgattacattactttc

SEQ ID NO: 1321311 - DNA, 22 bp, Artificial Sequence
  chemically synthesized
tgagaatgtattgaaagtaatg

SEQ ID NO: 1321312 - DNA, 22 bp, Artificial Sequence
  chemically synthesized
tgctttgattacattactttca

SEQ ID NO: 1321313 - DNA, 22 bp, Artificial Sequence
  chemically synthesized
gctttgattacattactttcaa

SEQ ID NO: 1321314 - DNA, 22 bp, Artificial Sequence
  chemically synthesized
ctttgattacattactttcaat

SEQ ID NO: 1321315 - DNA, 22 bp, Artificial Sequence
  chemically synthesized
tgattacattactttcaataca

SEQ ID NO: 1321316 - DNA, 22 bp, Artificial Sequence
  chemically synthesized
gattacattactttcaatacat

SEQ ID NO: 1321317 - DNA, 22 bp, Artificial Sequence
  chemically synthesized
attacattactttcaatacatt

SEQ ID NO: 1321318 - DNA, 22 bp, Artificial Sequence
  chemically synthesized
gtgaggttatgagaatgtattg

SEQ ID NO: 1321319 - DNA, 22 bp, Artificial Sequence
  chemically synthesized
cattactttcaatacattctca

SEQ ID NO: 1321320 - DNA, 22 bp, Artificial Sequence
  chemically synthesized
ttggtgaggttatgagaatgta

SEQ ID NO: 1321321 - DNA, 22 bp, Artificial Sequence
  chemically synthesized
attggtgaggttatgagaatgt

SEQ ID NO: 1321322 - DNA, 22 bp, Artificial Sequence
  chemically synthesized
tattggtgaggttatgagaatg

SEQ ID NO: 1321323 - DNA, 22 bp, Artificial Sequence
  chemically synthesized
tttattggtgaggttatgagaa

SEQ ID NO: 1321324 - DNA, 22 bp, Artificial Sequence
  chemically synthesized
ctttcaatacattctcataacc

SEQ ID NO: 1321325 - DNA, 22 bp, Artificial Sequence
  chemically synthesized
tcaatacattctcataacctca

SEQ ID NO: 1321326 - DNA, 22 bp, Artificial Sequence
  chemically synthesized
caatacattctcataacctcac

SEQ ID NO: 1321327 - DNA, 22 bp, Artificial Sequence
  chemically synthesized
aatacattctcataacctcacc

SEQ ID NO: 1321328 - DNA, 22 bp, Artificial Sequence
  chemically synthesized
tcaaatagctctttattggtga

SEQ ID NO: 1321329 - DNA, 22 bp, Artificial Sequence
  chemically synthesized
tcataacctcaccaataaagag

SEQ ID NO: 1321330 - DNA, 22 bp, Artificial Sequence
  chemically synthesized
atctgtcaaatagctctttatt

SEQ ID NO: 1321331 - DNA, 22 bp, Artificial Sequence
  chemically synthesized
ataacctcaccaataaagagct

SEQ ID NO: 1321332 - DNA, 22 bp, Artificial Sequence
  chemically synthesized
accaataaagagctatttgaca

SEQ ID NO: 1321333 - DNA, 22 bp, Artificial Sequence
  chemically synthesized
atcacattcatctgtcaaatag

SEQ ID NO: 1321334 - DNA, 22 bp, Artificial Sequence
  chemically synthesized
gatcacattcatctgtcaaata

SEQ ID NO: 1321335 - DNA, 22 bp, Artificial Sequence
  chemically synthesized
tttgacagatgaatgtgatcaa

SEQ ID NO: 1321336 - DNA, 22 bp, Artificial Sequence
  chemically synthesized
gacagatgaatgtgatcaagac

SEQ ID NO: 1321337 - DNA, 22 bp, Artificial Sequence
  chemically synthesized
taagcaaagggtgtcttgatca

SEQ ID NO: 1321338 - DNA, 22 bp, Artificial Sequence
  chemically synthesized
acagatgaatgtgatcaagaca

SEQ ID NO: 1321339 - DNA, 22 bp, Artificial Sequence
  chemically synthesized
aagaattgtaagcaaagggtgt

SEQ ID NO: 1321340 - DNA, 22 bp, Artificial Sequence
  chemically synthesized
ttgaagaattgtaagcaaaggg

SEQ ID NO: 1321341 - DNA, 22 bp, Artificial Sequence
  chemically synthesized
tgcttacaattcttcaatagca

SEQ ID NO: 1321342 - DNA, 22 bp, Artificial Sequence
  chemically synthesized
aaagcagtagtatgctattgaa

SEQ ID NO: 1321343 - DNA, 22 bp, Artificial Sequence
  chemically synthesized
gcttacaattcttcaatagcat

SEQ ID NO: 1321344 - DNA, 22 bp, Artificial Sequence
  chemically synthesized
aaaagcagtagtatgctattga

SEQ ID NO: 1321345 - DNA, 22 bp, Artificial Sequence
  chemically synthesized
cttacaattcttcaatagcata

SEQ ID NO: 1321346 - DNA, 22 bp, Artificial Sequence
  chemically synthesized
acaattcttcaatagcatacta

SEQ ID NO: 1321347 - DNA, 22 bp, Artificial Sequence
  chemically synthesized
tcttaaaagcagtagtatgcta

SEQ ID NO: 1321348 - DNA, 22 bp, Artificial Sequence
  chemically synthesized
caattcttcaatagcatactac

SEQ ID NO: 1321349 - DNA, 22 bp, Artificial Sequence
  chemically synthesized
ttcaatagcatactactgcttt

SEQ ID NO: 1321350 - DNA, 22 bp, Artificial Sequence
  chemically synthesized
caatagcatactactgctttta

SEQ ID NO: 1321351 - DNA, 22 bp, Artificial Sequence
  chemically synthesized
ggatatctatcttaaaagcagt

SEQ ID NO: 1321352 - DNA, 22 bp, Artificial Sequence
  chemically synthesized
aatagcatactactgcttttaa

SEQ ID NO: 1321353 - DNA, 22 bp, Artificial Sequence
  chemically synthesized
agttcggatatctatcttaaaa

SEQ ID NO: 1321354 - DNA, 22 bp, Artificial Sequence
  chemically synthesized
ctgagttcggatatctatctta

SEQ ID NO: 1321355 - DNA, 22 bp, Artificial Sequence
  chemically synthesized
ctgcttttaagatagatatccg

SEQ ID NO: 1321356 - DNA, 22 bp, Artificial Sequence
  chemically synthesized
cttttaagatagatatccgaac

SEQ ID NO: 1321357 - DNA, 22 bp, Artificial Sequence
  chemically synthesized
ttaagatagatatccgaactca

SEQ ID NO: 1321358 - DNA, 22 bp, Artificial Sequence
  chemically synthesized
taagatagatatccgaactcag

SEQ ID NO: 1321359 - DNA, 22 bp, Artificial Sequence
  chemically synthesized
aagatagatatccgaactcagg

SEQ ID NO: 1321360 - DNA, 22 bp, Artificial Sequence
  chemically synthesized
agatagatatccgaactcagga

SEQ ID NO: 1321361 - DNA, 22 bp, Artificial Sequence
  chemically synthesized
aagaaatgaaagctcctgagtt

SEQ ID NO: 1321362 - DNA, 22 bp, Artificial Sequence
  chemically synthesized
attcaagaaatgaaagctcctg

SEQ ID NO: 1321363 - DNA, 22 bp, Artificial Sequence
  chemically synthesized
cattcaagaaatgaaagctcct

SEQ ID NO: 1321364 - DNA, 22 bp, Artificial Sequence
  chemically synthesized
ttcattcaagaaatgaaagctc

SEQ ID NO: 1321365 - DNA, 22 bp, Artificial Sequence
  chemically synthesized
aggagctttcatttcttgaatg

SEQ ID NO: 1321366 - DNA, 22 bp, Artificial Sequence
  chemically synthesized
cacagaagcctcttcattcaag

SEQ ID NO: 1321367 - DNA, 22 bp, Artificial Sequence
  chemically synthesized
tcatttcttgaatgaagaggct

SEQ ID NO: 1321368 - DNA, 22 bp, Artificial Sequence
  chemically synthesized
catttcttgaatgaagaggctt

SEQ ID NO: 1321369 - DNA, 22 bp, Artificial Sequence
  chemically synthesized
atttcttgaatgaagaggcttc

SEQ ID NO: 1321370 - DNA, 22 bp, Artificial Sequence
  chemically synthesized
cttgaatgaagaggcttctgtg

SEQ ID NO: 1321371 - DNA, 22 bp, Artificial Sequence
  chemically synthesized
ttgaatgaagaggcttctgtgt

SEQ ID NO: 1321372 - DNA, 22 bp, Artificial Sequence
  chemically synthesized
gaatgaagaggcttctgtgtag

SEQ ID NO: 1321373 - DNA, 22 bp, Artificial Sequence
  chemically synthesized
aatgaagaggcttctgtgtagt

SEQ ID NO: 1321374 - DNA, 22 bp, Artificial Sequence
  chemically synthesized
caagacgaggaggaactacaca

SEQ ID NO: 1321375 - DNA, 22 bp, Artificial Sequence
  chemically synthesized
cggtgctacaagacgaggagga

SEQ ID NO: 1321376 - DNA, 22 bp, Artificial Sequence
  chemically synthesized
ctgtgtagttcctcctcgtctt

SEQ ID NO: 1321377 - DNA, 22 bp, Artificial Sequence
  chemically synthesized
tgtgtagttcctcctcgtcttg

SEQ ID NO: 1321378 - DNA, 22 bp, Artificial Sequence
  chemically synthesized
tgtagttcctcctcgtcttgta

SEQ ID NO: 1321379 - DNA, 22 bp, Artificial Sequence
  chemically synthesized
ctcctcgtcttgtagcaccgta

SEQ ID NO: 1321380 - DNA, 22 bp, Artificial Sequence
  chemically synthesized
ctcgtcttgtagcaccgtaatt

SEQ ID NO: 1321381 - DNA, 22 bp, Artificial Sequence
  chemically synthesized
gtcttgtagcaccgtaattttc

SEQ ID NO: 1321382 - DNA, 22 bp, Artificial Sequence
  chemically synthesized
gtagcaccgtaattttcttttt

SEQ ID NO: 1321383 - DNA, 22 bp, Artificial Sequence
  chemically synthesized
tagcaccgtaattttctttttt

SEQ ID NO: 1321384 - DNA, 22 bp, Artificial Sequence
  chemically synthesized
tcttttttatttatttatttta

SEQ ID NO: 1321385 - DNA, 22 bp, Artificial Sequence
  chemically synthesized
cttttttatttatttattttat

SEQ ID NO: 1321386 - DNA, 22 bp, Artificial Sequence
  chemically synthesized
ttttttatttatttattttatt

SEQ ID NO: 1321387 - DNA, 22 bp, Artificial Sequence
  chemically synthesized
ttttatttatttattttatttt

SEQ ID NO: 1321388 - DNA, 22 bp, Artificial Sequence
  chemically synthesized
tttatttatttattttatttta

SEQ ID NO: 1321389 - DNA, 22 bp, Artificial Sequence
  chemically synthesized
ttatttatttattttattttat

SEQ ID NO: 1321390 - DNA, 22 bp, Artificial Sequence
  chemically synthesized
aaaaataaataaataaaataaa

SEQ ID NO: 1321391 - DNA, 22 bp, Artificial Sequence
  chemically synthesized
tatttatttattttattttatt

SEQ ID NO: 1321392 - DNA, 22 bp, Artificial Sequence
  chemically synthesized
atttatttattttattttattt

SEQ ID NO: 1321393 - DNA, 22 bp, Artificial Sequence
  chemically synthesized
tttatttattttattttattta

SEQ ID NO: 1321394 - DNA, 22 bp, Artificial Sequence
  chemically synthesized
atttattttattttatttattt

SEQ ID NO: 1321395 - DNA, 22 bp, Artificial Sequence
  chemically synthesized
catctcaaaaataaataaataa

SEQ ID NO: 1321396 - DNA, 22 bp, Artificial Sequence
  chemically synthesized
tttattttattttatttattta

SEQ ID NO: 1321397 - DNA, 22 bp, Artificial Sequence
  chemically synthesized
attttattttatttatttattt

SEQ ID NO: 1321398 - DNA, 22 bp, Artificial Sequence
  chemically synthesized
ttttattttatttatttatttt

SEQ ID NO: 1321399 - DNA, 22 bp, Artificial Sequence
  chemically synthesized
tattttatttatttatttttga

SEQ ID NO: 1321400 - DNA, 22 bp, Artificial Sequence
  chemically synthesized
attttatttatttatttttgag

SEQ ID NO: 1321401 - DNA, 22 bp, Artificial Sequence
  chemically synthesized
ttttatttatttatttttgaga

SEQ ID NO: 1321402 - DNA, 22 bp, Artificial Sequence
  chemically synthesized
tatttatttatttttgagatgg

SEQ ID NO: 1321403 - DNA, 22 bp, Artificial Sequence
  chemically synthesized
atttatttatttttgagatgga

SEQ ID NO: 1321404 - DNA, 22 bp, Artificial Sequence
  chemically synthesized
tttatttatttttgagatggag

SEQ ID NO: 1321405 - DNA, 22 bp, Artificial Sequence
  chemically synthesized
atttatttttgagatggagtct

SEQ ID NO: 1321406 - DNA, 22 bp, Artificial Sequence
  chemically synthesized
ggcgacagagcaagactccatc

SEQ ID NO: 1321407 - DNA, 22 bp, Artificial Sequence
  chemically synthesized
tttatttttgagatggagtctt

SEQ ID NO: 1321408 - DNA, 22 bp, Artificial Sequence
  chemically synthesized
atttttgagatggagtcttgct

SEQ ID NO: 1321409 - DNA, 22 bp, Artificial Sequence
  chemically synthesized
tttttgagatggagtcttgctc

SEQ ID NO: 1321410 - DNA, 22 bp, Artificial Sequence
  chemically synthesized
cagcctgggcgacagagcaaga

SEQ ID NO: 1321411 - DNA, 22 bp, Artificial Sequence
  chemically synthesized
ttgagatggagtcttgctctgt

SEQ ID NO: 1321412 - DNA, 22 bp, Artificial Sequence
  chemically synthesized
tgagatggagtcttgctctgtc

SEQ ID NO: 1321413 - DNA, 22 bp, Artificial Sequence
  chemically synthesized
gagatggagtcttgctctgtcg

SEQ ID NO: 1321414 - DNA, 22 bp, Artificial Sequence
  chemically synthesized
agatggagtcttgctctgtcgc

SEQ ID NO: 1321415 - DNA, 22 bp, Artificial Sequence
  chemically synthesized
cactccagcctgggcgacagag

SEQ ID NO: 1321416 - DNA, 22 bp, Artificial Sequence
  chemically synthesized
gctctgtcgcccaggctggagt

SEQ ID NO: 1321417 - DNA, 22 bp, Artificial Sequence
  chemically synthesized
ctctgtcgcccaggctggagtg

SEQ ID NO: 1321418 - DNA, 22 bp, Artificial Sequence
  chemically synthesized
agatcgtgacactgcactccag

SEQ ID NO: 1321419 - DNA, 22 bp, Artificial Sequence
  chemically synthesized
tgtcgcccaggctggagtgcag

SEQ ID NO: 1321420 - DNA, 22 bp, Artificial Sequence
  chemically synthesized
tcgcccaggctggagtgcagtg

SEQ ID NO: 1321421 - DNA, 22 bp, Artificial Sequence
  chemically synthesized
cagtgagctgagatcgtgacac

SEQ ID NO: 1321422 - DNA, 22 bp, Artificial Sequence
  chemically synthesized
gagtgcagtgtcacgatctcag

SEQ ID NO: 1321423 - DNA, 22 bp, Artificial Sequence
  chemically synthesized
aacccaggaggtggaggttgca

SEQ ID NO: 1321424 - DNA, 22 bp, Artificial Sequence
  chemically synthesized
gaacccaggaggtggaggttgc

SEQ ID NO: 1321425 - DNA, 22 bp, Artificial Sequence
  chemically synthesized
agctcactgcaacctccacctc

SEQ ID NO: 1321426 - DNA, 22 bp, Artificial Sequence
  chemically synthesized
actgcaacctccacctcctggg

SEQ ID NO: 1321427 - DNA, 22 bp, Artificial Sequence
  chemically synthesized
gagaatcgcttgaacccaggag

SEQ ID NO: 1321428 - DNA, 22 bp, Artificial Sequence
  chemically synthesized
caacctccacctcctgggttca

SEQ ID NO: 1321429 - DNA, 22 bp, Artificial Sequence
  chemically synthesized
aggctggagaatcgcttgaacc

SEQ ID NO: 1321430 - DNA, 22 bp, Artificial Sequence
  chemically synthesized
cacctcctgggttcaagcgatt

SEQ ID NO: 1321431 - DNA, 22 bp, Artificial Sequence
  chemically synthesized
ggaggctgaggctggagaatcg

SEQ ID NO: 1321432 - DNA, 22 bp, Artificial Sequence
  chemically synthesized
ctgggttcaagcgattctccag

SEQ ID NO: 1321433 - DNA, 22 bp, Artificial Sequence
  chemically synthesized
gggaggctgaggctggagaatc

SEQ ID NO: 1321434 - DNA, 22 bp, Artificial Sequence
  chemically synthesized
ggttcaagcgattctccagcct

SEQ ID NO: 1321435 - DNA, 22 bp, Artificial Sequence
  chemically synthesized
cttgggaggctgaggctggaga

SEQ ID NO: 1321436 - DNA, 22 bp, Artificial Sequence
  chemically synthesized
gctacttgggaggctgaggctg

SEQ ID NO: 1321437 - DNA, 22 bp, Artificial Sequence
  chemically synthesized
aagcgattctccagcctcagcc

SEQ ID NO: 1321438 - DNA, 22 bp, Artificial Sequence
  chemically synthesized
taatcctagctacttgggaggc

SEQ ID NO: 1321439 - DNA, 22 bp, Artificial Sequence
  chemically synthesized
tccagcctcagcctcccaagta

SEQ ID NO: 1321440 - DNA, 22 bp, Artificial Sequence
  chemically synthesized
cagcctcagcctcccaagtagc

SEQ ID NO: 1321441 - DNA, 22 bp, Artificial Sequence
  chemically synthesized
agcctcccaagtagctaggatt

SEQ ID NO: 1321442 - DNA, 22 bp, Artificial Sequence
  chemically synthesized
ccaagtagctaggattataggt

SEQ ID NO: 1321443 - DNA, 22 bp, Artificial Sequence
  chemically synthesized
gccggacgtggtggcgggcacc

SEQ ID NO: 1321444 - DNA, 22 bp, Artificial Sequence
  chemically synthesized
ggattataggtgcccgccacca

SEQ ID NO: 1321445 - DNA, 22 bp, Artificial Sequence
  chemically synthesized
taggtgcccgccaccacgtccg

SEQ ID NO: 1321446 - DNA, 22 bp, Artificial Sequence
  chemically synthesized
aatacaaaaaattagccggacg

SEQ ID NO: 1321447 - DNA, 22 bp, Artificial Sequence
  chemically synthesized
aaatacaaaaaattagccggac

SEQ ID NO: 1321448 - DNA, 22 bp, Artificial Sequence
  chemically synthesized
taaatacaaaaaattagccgga

SEQ ID NO: 1321449 - DNA, 22 bp, Artificial Sequence
  chemically synthesized
ctttaaatacaaaaaattagcc

SEQ ID NO: 1321450 - DNA, 22 bp, Artificial Sequence
  chemically synthesized
tgctttaaatacaaaaaattag

SEQ ID NO: 1321451 - DNA, 22 bp, Artificial Sequence
  chemically synthesized
atctctgctttaaatacaaaaa

SEQ ID NO: 1321452 - DNA, 22 bp, Artificial Sequence
  chemically synthesized
catctctgctttaaatacaaaa

SEQ ID NO: 1321453 - DNA, 22 bp, Artificial Sequence
  chemically synthesized
attttttgtatttaaagcagag

SEQ ID NO: 1321454 - DNA, 22 bp, Artificial Sequence
  chemically synthesized
tttgtatttaaagcagagatga

SEQ ID NO: 1321455 - DNA, 22 bp, Artificial Sequence
  chemically synthesized
ttgtatttaaagcagagatgaa

SEQ ID NO: 1321456 - DNA, 22 bp, Artificial Sequence
  chemically synthesized
tgtatttaaagcagagatgaag

SEQ ID NO: 1321457 - DNA, 22 bp, Artificial Sequence
  chemically synthesized
gtatttaaagcagagatgaagt

SEQ ID NO: 1321458 - DNA, 22 bp, Artificial Sequence
  chemically synthesized
tatttaaagcagagatgaagtt

SEQ ID NO: 1321459 - DNA, 22 bp, Artificial Sequence
  chemically synthesized
tccaacatagtgaaacttcatc

SEQ ID NO: 1321460 - DNA, 22 bp, Artificial Sequence
  chemically synthesized
aaagcagagatgaagtttcact

SEQ ID NO: 1321461 - DNA, 22 bp, Artificial Sequence
  chemically synthesized
aagcagagatgaagtttcacta

SEQ ID NO: 1321462 - DNA, 22 bp, Artificial Sequence
  chemically synthesized
gagaccagcctatccaacatag

SEQ ID NO: 1321463 - DNA, 22 bp, Artificial Sequence
  chemically synthesized
cactatgttggataggctggtc

SEQ ID NO: 1321464 - DNA, 22 bp, Artificial Sequence
  chemically synthesized
actatgttggataggctggtct

SEQ ID NO: 1321465 - DNA, 22 bp, Artificial Sequence
  chemically synthesized
aggtcaggagttcgagaccagc

SEQ ID NO: 1321466 - DNA, 22 bp, Artificial Sequence
  chemically synthesized
tgttggataggctggtctcgaa

SEQ ID NO: 1321467 - DNA, 22 bp, Artificial Sequence
  chemically synthesized
gataggctggtctcgaactcct

SEQ ID NO: 1321468 - DNA, 22 bp, Artificial Sequence
  chemically synthesized
gtctcgaactcctgacctcagg

SEQ ID NO: 1321469 - DNA, 22 bp, Artificial Sequence
  chemically synthesized
gaactcctgacctcaggtgatc

SEQ ID NO: 1321470 - DNA, 22 bp, Artificial Sequence
  chemically synthesized
ggaggccgaggcgggtggatca

SEQ ID NO: 1321471 - DNA, 22 bp, Artificial Sequence
  chemically synthesized
ctgacctcaggtgatccacccg

SEQ ID NO: 1321472 - DNA, 22 bp, Artificial Sequence
  chemically synthesized
gggaggccgaggcgggtggatc

SEQ ID NO: 1321473 - DNA, 22 bp, Artificial Sequence
  chemically synthesized
tgggaggccgaggcgggtggat

SEQ ID NO: 1321474 - DNA, 22 bp, Artificial Sequence
  chemically synthesized
acctcaggtgatccacccgcct

SEQ ID NO: 1321475 - DNA, 22 bp, Artificial Sequence
  chemically synthesized
aggtgatccacccgcctcggcc

SEQ ID NO: 1321476 - DNA, 22 bp, Artificial Sequence
  chemically synthesized
taatcccaacactttgggaggc

SEQ ID NO: 1321477 - DNA, 22 bp, Artificial Sequence
  chemically synthesized
acgcctgtaatcccaacacttt

SEQ ID NO: 1321478 - DNA, 22 bp, Artificial Sequence
  chemically synthesized
ggcctcccaaagtgttgggatt

SEQ ID NO: 1321479 - DNA, 22 bp, Artificial Sequence
  chemically synthesized
ccaaagtgttgggattacaggc

SEQ ID NO: 1321480 - DNA, 22 bp, Artificial Sequence
  chemically synthesized
ggcacagtggctcacgcctgta

SEQ ID NO: 1321481 - DNA, 22 bp, Artificial Sequence
  chemically synthesized
caggctgggcacagtggctcac

SEQ ID NO: 1321482 - DNA, 22 bp, Artificial Sequence
  chemically synthesized
ggattacaggcgtgagccactg

SEQ ID NO: 1321483 - DNA, 22 bp, Artificial Sequence
  chemically synthesized
caggcgtgagccactgtgccca

SEQ ID NO: 1321484 - DNA, 22 bp, Artificial Sequence
  chemically synthesized
agaagaaaattacaggctgggc

SEQ ID NO: 1321485 - DNA, 22 bp, Artificial Sequence
  chemically synthesized
tatctaagaagaaaattacagg

SEQ ID NO: 1321486 - DNA, 22 bp, Artificial Sequence
  chemically synthesized
tgcccagcctgtaattttcttc

SEQ ID NO: 1321487 - DNA, 22 bp, Artificial Sequence
  chemically synthesized
taattttcttcttagatatagt

SEQ ID NO: 1321488 - DNA, 22 bp, Artificial Sequence
  chemically synthesized
tcttcttagatatagttaccct

SEQ ID NO: 1321489 - DNA, 22 bp, Artificial Sequence
  chemically synthesized
cttcttagatatagttaccctg

SEQ ID NO: 1321490 - DNA, 22 bp, Artificial Sequence
  chemically synthesized
ttcttagatatagttaccctgg

SEQ ID NO: 1321491 - DNA, 22 bp, Artificial Sequence
  chemically synthesized
cttagatatagttaccctggcc

SEQ ID NO: 1321492 - DNA, 22 bp, Artificial Sequence
  chemically synthesized
ttagatatagttaccctggcct

SEQ ID NO: 1321493 - DNA, 22 bp, Artificial Sequence
  chemically synthesized
agatatagttaccctggccttt

SEQ ID NO: 1321494 - DNA, 22 bp, Artificial Sequence
  chemically synthesized
gatatagttaccctggcctttc

SEQ ID NO: 1321495 - DNA, 22 bp, Artificial Sequence
  chemically synthesized
tgggaaggaacagaaaggccag

SEQ ID NO: 1321496 - DNA, 22 bp, Artificial Sequence
  chemically synthesized
ttgtgggaaggaacagaaaggc

SEQ ID NO: 1321497 - DNA, 22 bp, Artificial Sequence
  chemically synthesized
ctattgtgggaaggaacagaaa

SEQ ID NO: 1321498 - DNA, 22 bp, Artificial Sequence
  chemically synthesized
ccctggcctttctgttccttcc

SEQ ID NO: 1321499 - DNA, 22 bp, Artificial Sequence
  chemically synthesized
gcctttctgttccttcccacaa

SEQ ID NO: 1321500 - DNA, 22 bp, Artificial Sequence
  chemically synthesized
tgcaaagctcctattgtgggaa

SEQ ID NO: 1321501 - DNA, 22 bp, Artificial Sequence
  chemically synthesized
atgcaaagctcctattgtggga

SEQ ID NO: 1321502 - DNA, 22 bp, Artificial Sequence
  chemically synthesized
tctgttccttcccacaatagga

SEQ ID NO: 1321503 - DNA, 22 bp, Artificial Sequence
  chemically synthesized
ctgttccttcccacaataggag

SEQ ID NO: 1321504 - DNA, 22 bp, Artificial Sequence
  chemically synthesized
tgttccttcccacaataggagc

SEQ ID NO: 1321505 - DNA, 22 bp, Artificial Sequence
  chemically synthesized
ttccttcccacaataggagctt

SEQ ID NO: 1321506 - DNA, 22 bp, Artificial Sequence
  chemically synthesized
cttcccacaataggagctttgc

SEQ ID NO: 1321507 - DNA, 22 bp, Artificial Sequence
  chemically synthesized
cccacaataggagctttgcata

SEQ ID NO: 1321508 - DNA, 22 bp, Artificial Sequence
  chemically synthesized
gagtaaagagcttatgcaaagc

SEQ ID NO: 1321509 - DNA, 22 bp, Artificial Sequence
  chemically synthesized
ccacaataggagctttgcataa

SEQ ID NO: 1321510 - DNA, 22 bp, Artificial Sequence
  chemically synthesized
ttggagtaaagagcttatgcaa

SEQ ID NO: 1321511 - DNA, 22 bp, Artificial Sequence
  chemically synthesized
tgttggagtaaagagcttatgc

SEQ ID NO: 1321512 - DNA, 22 bp, Artificial Sequence
  chemically synthesized
ttctgttggagtaaagagctta

SEQ ID NO: 1321513 - DNA, 22 bp, Artificial Sequence
  chemically synthesized
tgcataagctctttactccaac

SEQ ID NO: 1321514 - DNA, 22 bp, Artificial Sequence
  chemically synthesized
gcataagctctttactccaaca

SEQ ID NO: 1321515 - DNA, 22 bp, Artificial Sequence
  chemically synthesized
cataagctctttactccaacag

SEQ ID NO: 1321516 - DNA, 22 bp, Artificial Sequence
  chemically synthesized
tttactccaacagaataggctt

SEQ ID NO: 1321517 - DNA, 22 bp, Artificial Sequence
  chemically synthesized
tactccaacagaataggcttcc

SEQ ID NO: 1321518 - DNA, 22 bp, Artificial Sequence
  chemically synthesized
actccaacagaataggcttcct

SEQ ID NO: 1321519 - DNA, 22 bp, Artificial Sequence
  chemically synthesized
ctccaacagaataggcttcctt

SEQ ID NO: 1321520 - DNA, 22 bp, Artificial Sequence
  chemically synthesized
agaaagagaatatcaaggaagc

SEQ ID NO: 1321521 - DNA, 22 bp, Artificial Sequence
  chemically synthesized
caacagaataggcttccttgat

SEQ ID NO: 1321522 - DNA, 22 bp, Artificial Sequence
  chemically synthesized
tattcagaaagagaatatcaag

SEQ ID NO: 1321523 - DNA, 22 bp, Artificial Sequence
  chemically synthesized
tctgtattcagaaagagaatat

SEQ ID NO: 1321524 - DNA, 22 bp, Artificial Sequence
  chemically synthesized
cattatctgtattcagaaagag

SEQ ID NO: 1321525 - DNA, 22 bp, Artificial Sequence
  chemically synthesized
acattatctgtattcagaaaga

SEQ ID NO: 1321526 - DNA, 22 bp, Artificial Sequence
  chemically synthesized
ccttgatattctctttctgaat

SEQ ID NO: 1321527 - DNA, 22 bp, Artificial Sequence
  chemically synthesized
cttgatattctctttctgaata

SEQ ID NO: 1321528 - DNA, 22 bp, Artificial Sequence
  chemically synthesized
gatattctctttctgaatacag

SEQ ID NO: 1321529 - DNA, 22 bp, Artificial Sequence
  chemically synthesized
atattctctttctgaatacaga

SEQ ID NO: 1321530 - DNA, 22 bp, Artificial Sequence
  chemically synthesized
tctttctgaatacagataatgt

SEQ ID NO: 1321531 - DNA, 22 bp, Artificial Sequence
  chemically synthesized
tttctgaatacagataatgtaa

SEQ ID NO: 1321532 - DNA, 22 bp, Artificial Sequence
  chemically synthesized
tctgaatacagataatgtaaat

SEQ ID NO: 1321533 - DNA, 22 bp, Artificial Sequence
  chemically synthesized
ctgaatacagataatgtaaata

SEQ ID NO: 1321534 - DNA, 22 bp, Artificial Sequence
  chemically synthesized
tgaatacagataatgtaaatat

SEQ ID NO: 1321535 - DNA, 22 bp, Artificial Sequence
  chemically synthesized
caacgtaaagtaatatttacat

SEQ ID NO: 1321536 - DNA, 22 bp, Artificial Sequence
  chemically synthesized
acaacgtaaagtaatatttaca

SEQ ID NO: 1321537 - DNA, 22 bp, Artificial Sequence
  chemically synthesized
aatacagataatgtaaatatta

SEQ ID NO: 1321538 - DNA, 22 bp, Artificial Sequence
  chemically synthesized
atatttacaacgtaaagtaata

SEQ ID NO: 1321539 - DNA, 22 bp, Artificial Sequence
  chemically synthesized
agtcagagaaatgttaatattt

SEQ ID NO: 1321540 - DNA, 22 bp, Artificial Sequence
  chemically synthesized
ctttacgttgtaaatattaaca

SEQ ID NO: 1321541 - DNA, 22 bp, Artificial Sequence
  chemically synthesized
tacgttgtaaatattaacattt

SEQ ID NO: 1321542 - DNA, 22 bp, Artificial Sequence
  chemically synthesized
acgttgtaaatattaacatttc

SEQ ID NO: 1321543 - DNA, 22 bp, Artificial Sequence
  chemically synthesized
cgttgtaaatattaacatttct

SEQ ID NO: 1321544 - DNA, 22 bp, Artificial Sequence
  chemically synthesized
taaatattaacatttctctgac

SEQ ID NO: 1321545 - DNA, 22 bp, Artificial Sequence
  chemically synthesized
acatttctctgactgagtgtac

SEQ ID NO: 1321546 - DNA, 22 bp, Artificial Sequence
  chemically synthesized
tcaatggggaagacgtacactc

SEQ ID NO: 1321547 - DNA, 22 bp, Artificial Sequence
  chemically synthesized
ctgtcaatggggaagacgtaca

SEQ ID NO: 1321548 - DNA, 22 bp, Artificial Sequence
  chemically synthesized
ctctgactgagtgtacgtcttc

SEQ ID NO: 1321549 - DNA, 22 bp, Artificial Sequence
  chemically synthesized
actgtcaatggggaagacgtac

SEQ ID NO: 1321550 - DNA, 22 bp, Artificial Sequence
  chemically synthesized
tctgactgagtgtacgtcttcc

SEQ ID NO: 1321551 - DNA, 22 bp, Artificial Sequence
  chemically synthesized
tgactgagtgtacgtcttcccc

SEQ ID NO: 1321552 - DNA, 22 bp, Artificial Sequence
  chemically synthesized
actgagtgtacgtcttccccat

SEQ ID NO: 1321553 - DNA, 22 bp, Artificial Sequence
  chemically synthesized
tgaaacttactgtcaatgggga

SEQ ID NO: 1321554 - DNA, 22 bp, Artificial Sequence
  chemically synthesized
agtgtacgtcttccccattgac

SEQ ID NO: 1321555 - DNA, 22 bp, Artificial Sequence
  chemically synthesized
gtgaaacttactgtcaatgggg

SEQ ID NO: 1321556 - DNA, 22 bp, Artificial Sequence
  chemically synthesized
tccttgtgaaacttactgtcaa

SEQ ID NO: 1321557 - DNA, 22 bp, Artificial Sequence
  chemically synthesized
ctatccttgtgaaacttactgt

SEQ ID NO: 1321558 - DNA, 22 bp, Artificial Sequence
  chemically synthesized
cctatccttgtgaaacttactg

SEQ ID NO: 1321559 - DNA, 22 bp, Artificial Sequence
  chemically synthesized
ccccattgacagtaagtttcac

SEQ ID NO: 1321560 - DNA, 22 bp, Artificial Sequence
  chemically synthesized
cccattgacagtaagtttcaca

SEQ ID NO: 1321561 - DNA, 22 bp, Artificial Sequence
  chemically synthesized
acagtaagtttcacaaggatag

SEQ ID NO: 1321562 - DNA, 22 bp, Artificial Sequence
  chemically synthesized
aaaacatgtttcctatccttgt

SEQ ID NO: 1321563 - DNA, 22 bp, Artificial Sequence
  chemically synthesized
cacaaggataggaaacatgttt

SEQ ID NO: 1321564 - DNA, 22 bp, Artificial Sequence
  chemically synthesized
acaaggataggaaacatgtttt

SEQ ID NO: 1321565 - DNA, 22 bp, Artificial Sequence
  chemically synthesized
tcagtttttgtcttgttactgt

SEQ ID NO: 1321566 - DNA, 22 bp, Artificial Sequence
  chemically synthesized
cagtttttgtcttgttactgtt

SEQ ID NO: 1321567 - DNA, 22 bp, Artificial Sequence
  chemically synthesized
agtttttgtcttgttactgttt

SEQ ID NO: 1321568 - DNA, 22 bp, Artificial Sequence
  chemically synthesized
ttgtcttgttactgttttgttt

SEQ ID NO: 1321569 - DNA, 22 bp, Artificial Sequence
  chemically synthesized
tgtcttgttactgttttgtttt

SEQ ID NO: 1321570 - DNA, 22 bp, Artificial Sequence
  chemically synthesized
gagtatgatgagaaaacaaaac

SEQ ID NO: 1321571 - DNA, 22 bp, Artificial Sequence
  chemically synthesized
gtcttgttactgttttgttttc

SEQ ID NO: 1321572 - DNA, 22 bp, Artificial Sequence
  chemically synthesized
tcttgttactgttttgttttct

SEQ ID NO: 1321573 - DNA, 22 bp, Artificial Sequence
  chemically synthesized
ctggagtatgatgagaaaacaa

SEQ ID NO: 1321574 - DNA, 22 bp, Artificial Sequence
  chemically synthesized
gttactgttttgttttctcatc

SEQ ID NO: 1321575 - DNA, 22 bp, Artificial Sequence
  chemically synthesized
ttactgttttgttttctcatca

SEQ ID NO: 1321576 - DNA, 22 bp, Artificial Sequence
  chemically synthesized
gttgctggagtatgatgagaaa

SEQ ID NO: 1321577 - DNA, 22 bp, Artificial Sequence
  chemically synthesized
ctgttttgttttctcatcatac

SEQ ID NO: 1321578 - DNA, 22 bp, Artificial Sequence
  chemically synthesized
ttttgttttctcatcatactcc

SEQ ID NO: 1321579 - DNA, 22 bp, Artificial Sequence
  chemically synthesized
tgttttctcatcatactccagc

SEQ ID NO: 1321580 - DNA, 22 bp, Artificial Sequence
  chemically synthesized
gttttctcatcatactccagca

SEQ ID NO: 1321581 - DNA, 22 bp, Artificial Sequence
  chemically synthesized
ttttctcatcatactccagcaa

SEQ ID NO: 1321582 - DNA, 22 bp, Artificial Sequence
  chemically synthesized
tctcatcatactccagcaacta

SEQ ID NO: 1321583 - DNA, 22 bp, Artificial Sequence
  chemically synthesized
ctcatcatactccagcaactag

SEQ ID NO: 1321584 - DNA, 22 bp, Artificial Sequence
  chemically synthesized
tcatcatactccagcaactagc

SEQ ID NO: 1321585 - DNA, 22 bp, Artificial Sequence
  chemically synthesized
atcatactccagcaactagcac

SEQ ID NO: 1321586 - DNA, 22 bp, Artificial Sequence
  chemically synthesized
aaaacagtacataaaaggtgct

SEQ ID NO: 1321587 - DNA, 22 bp, Artificial Sequence
  chemically synthesized
cagcaactagcaccttttatgt

SEQ ID NO: 1321588 - DNA, 22 bp, Artificial Sequence
  chemically synthesized
attaaaaacagtacataaaagg

SEQ ID NO: 1321589 - DNA, 22 bp, Artificial Sequence
  chemically synthesized
aattaaaaacagtacataaaag

SEQ ID NO: 1321590 - DNA, 22 bp, Artificial Sequence
  chemically synthesized
taattaaaaacagtacataaaa

SEQ ID NO: 1321591 - DNA, 22 bp, Artificial Sequence
  chemically synthesized
aaattttaattaaaaacagtac

SEQ ID NO: 1321592 - DNA, 22 bp, Artificial Sequence
  chemically synthesized
gcaccttttatgtactgttttt

SEQ ID NO: 1321593 - DNA, 22 bp, Artificial Sequence
  chemically synthesized
attcaaattttaattaaaaaca

SEQ ID NO: 1321594 - DNA, 22 bp, Artificial Sequence
  chemically synthesized
ttatgtactgtttttaattaaa

SEQ ID NO: 1321595 - DNA, 22 bp, Artificial Sequence
  chemically synthesized
actcattcaaattttaattaaa

SEQ ID NO: 1321596 - DNA, 22 bp, Artificial Sequence
  chemically synthesized
tatgtactgtttttaattaaaa

SEQ ID NO: 1321597 - DNA, 22 bp, Artificial Sequence
  chemically synthesized
atgtactgtttttaattaaaat

SEQ ID NO: 1321598 - DNA, 22 bp, Artificial Sequence
  chemically synthesized
tgtactgtttttaattaaaatt

SEQ ID NO: 1321599 - DNA, 22 bp, Artificial Sequence
  chemically synthesized
gttcactcattcaaattttaat

SEQ ID NO: 1321600 - DNA, 22 bp, Artificial Sequence
  chemically synthesized
agttcactcattcaaattttaa

SEQ ID NO: 1321601 - DNA, 22 bp, Artificial Sequence
  chemically synthesized
tagttcactcattcaaatttta

SEQ ID NO: 1321602 - DNA, 22 bp, Artificial Sequence
  chemically synthesized
tttttaattaaaatttgaatga

SEQ ID NO: 1321603 - DNA, 22 bp, Artificial Sequence
  chemically synthesized
atgttttagttcactcattcaa

SEQ ID NO: 1321604 - DNA, 22 bp, Artificial Sequence
  chemically synthesized
ttaattaaaatttgaatgagtg

SEQ ID NO: 1321605 - DNA, 22 bp, Artificial Sequence
  chemically synthesized
taattaaaatttgaatgagtga

SEQ ID NO: 1321606 - DNA, 22 bp, Artificial Sequence
  chemically synthesized
aattaaaatttgaatgagtgaa

SEQ ID NO: 1321607 - DNA, 22 bp, Artificial Sequence
  chemically synthesized
attaaaatttgaatgagtgaac

SEQ ID NO: 1321608 - DNA, 22 bp, Artificial Sequence
  chemically synthesized
aggcctgatgttttagttcact

SEQ ID NO: 1321609 - DNA, 22 bp, Artificial Sequence
  chemically synthesized
aaatttgaatgagtgaactaaa

SEQ ID NO: 1321610 - DNA, 22 bp, Artificial Sequence
  chemically synthesized
aaggcctgatgttttagttcac

SEQ ID NO: 1321611 - DNA, 22 bp, Artificial Sequence
  chemically synthesized
gaatgagtgaactaaaacatca

SEQ ID NO: 1321612 - DNA, 22 bp, Artificial Sequence
  chemically synthesized
aatgagtgaactaaaacatcag

SEQ ID NO: 1321613 - DNA, 22 bp, Artificial Sequence
  chemically synthesized
aaacatcaggccttaaatctgc

SEQ ID NO: 1321614 - DNA, 22 bp, Artificial Sequence
  chemically synthesized
gagccaaatatgtatgcagatt

SEQ ID NO: 1321615 - DNA, 22 bp, Artificial Sequence
  chemically synthesized
actagagccaaatatgtatgca

SEQ ID NO: 1321616 - DNA, 22 bp, Artificial Sequence
  chemically synthesized
aaatctgcatacatatttggct

SEQ ID NO: 1321617 - DNA, 22 bp, Artificial Sequence
  chemically synthesized
aatctgcatacatatttggctc

SEQ ID NO: 1321618 - DNA, 22 bp, Artificial Sequence
  chemically synthesized
catacatatttggctctagtca

SEQ ID NO: 1321619 - DNA, 22 bp, Artificial Sequence
  chemically synthesized
ggctctagtcaattatatatat

SEQ ID NO: 1321620 - DNA, 22 bp, Artificial Sequence
  chemically synthesized
gctctagtcaattatatatata

SEQ ID NO: 1321621 - DNA, 22 bp, Artificial Sequence
  chemically synthesized
gtgaaaataaagaagtatatat

SEQ ID NO: 1321622 - DNA, 22 bp, Artificial Sequence
  chemically synthesized
tagtcaattatatatatacttc

SEQ ID NO: 1321623 - DNA, 22 bp, Artificial Sequence
  chemically synthesized
gtcaattatatatatacttctt

SEQ ID NO: 1321624 - DNA, 22 bp, Artificial Sequence
  chemically synthesized
tatatatacttctttattttca

SEQ ID NO: 1321625 - DNA, 22 bp, Artificial Sequence
  chemically synthesized
ctttattttcactaatttggtt

SEQ ID NO: 1321626 - DNA, 22 bp, Artificial Sequence
  chemically synthesized
tttattttcactaatttggttg

SEQ ID NO: 1321627 - DNA, 22 bp, Artificial Sequence
  chemically synthesized
tattttcactaatttggttgca

SEQ ID NO: 1321628 - DNA, 22 bp, Artificial Sequence
  chemically synthesized
attttcactaatttggttgcac

SEQ ID NO: 1321629 - DNA, 22 bp, Artificial Sequence
  chemically synthesized
ttttcactaatttggttgcaca

SEQ ID NO: 1321630 - DNA, 22 bp, Artificial Sequence
  chemically synthesized
gagacataataaaatgtgcaac

SEQ ID NO: 1321631 - DNA, 22 bp, Artificial Sequence
  chemically synthesized
tcactaatttggttgcacattt

SEQ ID NO: 1321632 - DNA, 22 bp, Artificial Sequence
  chemically synthesized
ggagacataataaaatgtgcaa

SEQ ID NO: 1321633 - DNA, 22 bp, Artificial Sequence
  chemically synthesized
cactaatttggttgcacatttt

SEQ ID NO: 1321634 - DNA, 22 bp, Artificial Sequence
  chemically synthesized
actaatttggttgcacatttta

SEQ ID NO: 1321635 - DNA, 22 bp, Artificial Sequence
  chemically synthesized
atttggttgcacattttattat

SEQ ID NO: 1321636 - DNA, 22 bp, Artificial Sequence
  chemically synthesized
ggttgcacattttattatgtct

SEQ ID NO: 1321637 - DNA, 22 bp, Artificial Sequence
  chemically synthesized
acaatgatttggagacataata

SEQ ID NO: 1321638 - DNA, 22 bp, Artificial Sequence
  chemically synthesized
gttgcacattttattatgtctc

SEQ ID NO: 1321639 - DNA, 22 bp, Artificial Sequence
  chemically synthesized
cacaatgatttggagacataat

SEQ ID NO: 1321640 - DNA, 22 bp, Artificial Sequence
  chemically synthesized
tcacaatgatttggagacataa

SEQ ID NO: 1321641 - DNA, 22 bp, Artificial Sequence
  chemically synthesized
cacattttattatgtctccaaa

SEQ ID NO: 1321642 - DNA, 22 bp, Artificial Sequence
  chemically synthesized
tctttcacaatgatttggagac

SEQ ID NO: 1321643 - DNA, 22 bp, Artificial Sequence
  chemically synthesized
ctgtctttcacaatgatttgga

SEQ ID NO: 1321644 - DNA, 22 bp, Artificial Sequence
  chemically synthesized
actgtctttcacaatgatttgg

SEQ ID NO: 1321645 - DNA, 22 bp, Artificial Sequence
  chemically synthesized
tattatgtctccaaatcattgt

SEQ ID NO: 1321646 - DNA, 22 bp, Artificial Sequence
  chemically synthesized
attatgtctccaaatcattgtg

SEQ ID NO: 1321647 - DNA, 22 bp, Artificial Sequence
  chemically synthesized
cttactgtctttcacaatgatt

SEQ ID NO: 1321648 - DNA, 22 bp, Artificial Sequence
  chemically synthesized
ttatgtctccaaatcattgtga

SEQ ID NO: 1321649 - DNA, 22 bp, Artificial Sequence
  chemically synthesized
gcttactgtctttcacaatgat

SEQ ID NO: 1321650 - DNA, 22 bp, Artificial Sequence
  chemically synthesized
tgcttactgtctttcacaatga

SEQ ID NO: 1321651 - DNA, 22 bp, Artificial Sequence
  chemically synthesized
ttgcttactgtctttcacaatg

SEQ ID NO: 1321652 - DNA, 22 bp, Artificial Sequence
  chemically synthesized
tgtctccaaatcattgtgaaag

SEQ ID NO: 1321653 - DNA, 22 bp, Artificial Sequence
  chemically synthesized
caaatcattgtgaaagacagta

SEQ ID NO: 1321654 - DNA, 22 bp, Artificial Sequence
  chemically synthesized
tcagtttttgcttactgtcttt

SEQ ID NO: 1321655 - DNA, 22 bp, Artificial Sequence
  chemically synthesized
gtcagtttttgcttactgtctt

SEQ ID NO: 1321656 - DNA, 22 bp, Artificial Sequence
  chemically synthesized
atttgtcagtttttgcttactg

SEQ ID NO: 1321657 - DNA, 22 bp, Artificial Sequence
  chemically synthesized
tgaaagacagtaagcaaaaact

SEQ ID NO: 1321658 - DNA, 22 bp, Artificial Sequence
  chemically synthesized
tactaatttgtcagtttttgct

SEQ ID NO: 1321659 - DNA, 22 bp, Artificial Sequence
  chemically synthesized
caagattgtactaatttgtcag

SEQ ID NO: 1321660 - DNA, 22 bp, Artificial Sequence
  chemically synthesized
taatacatgaattccaagattg

SEQ ID NO: 1321661 - DNA, 22 bp, Artificial Sequence
  chemically synthesized
acaaattagtacaatcttggaa

SEQ ID NO: 1321662 - DNA, 22 bp, Artificial Sequence
  chemically synthesized
ataatacatgaattccaagatt

SEQ ID NO: 1321663 - DNA, 22 bp, Artificial Sequence
  chemically synthesized
tataatacatgaattccaagat

SEQ ID NO: 1321664 - DNA, 22 bp, Artificial Sequence
  chemically synthesized
ttataatacatgaattccaaga

SEQ ID NO: 1321665 - DNA, 22 bp, Artificial Sequence
  chemically synthesized
gtacaatcttggaattcatgta

SEQ ID NO: 1321666 - DNA, 22 bp, Artificial Sequence
  chemically synthesized
aaccagccttttataatacatg

SEQ ID NO: 1321667 - DNA, 22 bp, Artificial Sequence
  chemically synthesized
ggaattcatgtattataaaagg

SEQ ID NO: 1321668 - DNA, 22 bp, Artificial Sequence
  chemically synthesized
gaattcatgtattataaaaggc

SEQ ID NO: 1321669 - DNA, 22 bp, Artificial Sequence
  chemically synthesized
atgtattataaaaggctggttc

SEQ ID NO: 1321670 - DNA, 22 bp, Artificial Sequence
  chemically synthesized
agtaaaacaatctgaaccagcc

SEQ ID NO: 1321671 - DNA, 22 bp, Artificial Sequence
  chemically synthesized
caattgagtaaaacaatctgaa

SEQ ID NO: 1321672 - DNA, 22 bp, Artificial Sequence
  chemically synthesized
taaaaggctggttcagattgtt

SEQ ID NO: 1321673 - DNA, 22 bp, Artificial Sequence
  chemically synthesized
gttcagattgttttactcaatt

SEQ ID NO: 1321674 - DNA, 22 bp, Artificial Sequence
  chemically synthesized
agattgttttactcaattgtaa

SEQ ID NO: 1321675 - DNA, 22 bp, Artificial Sequence
  chemically synthesized
aatcaaaacatgttacaattga

SEQ ID NO: 1321676 - DNA, 22 bp, Artificial Sequence
  chemically synthesized
caatcaaaacatgttacaattg

SEQ ID NO: 1321677 - DNA, 22 bp, Artificial Sequence
  chemically synthesized
ttttactcaattgtaacatgtt

SEQ ID NO: 1321678 - DNA, 22 bp, Artificial Sequence
  chemically synthesized
tactcaattgtaacatgttttg

SEQ ID NO: 1321679 - DNA, 22 bp, Artificial Sequence
  chemically synthesized
caccgtttcaatcaaaacatgt

SEQ ID NO: 1321680 - DNA, 22 bp, Artificial Sequence
  chemically synthesized
actcaattgtaacatgttttga

SEQ ID NO: 1321681 - DNA, 22 bp, Artificial Sequence
  chemically synthesized
acaccgtttcaatcaaaacatg

SEQ ID NO: 1321682 - DNA, 22 bp, Artificial Sequence
  chemically synthesized
ctcaattgtaacatgttttgat

SEQ ID NO: 1321683 - DNA, 22 bp, Artificial Sequence
  chemically synthesized
tacaccgtttcaatcaaaacat

SEQ ID NO: 1321684 - DNA, 22 bp, Artificial Sequence
  chemically synthesized
aattgtaacatgttttgattga

SEQ ID NO: 1321685 - DNA, 22 bp, Artificial Sequence
  chemically synthesized
ttttacaccgtttcaatcaaaa

SEQ ID NO: 1321686 - DNA, 22 bp, Artificial Sequence
  chemically synthesized
ctgttttacaccgtttcaatca

SEQ ID NO: 1321687 - DNA, 22 bp, Artificial Sequence
  chemically synthesized
cctgttttacaccgtttcaatc

SEQ ID NO: 1321688 - DNA, 22 bp, Artificial Sequence
  chemically synthesized
taacatgttttgattgaaacgg

SEQ ID NO: 1321689 - DNA, 22 bp, Artificial Sequence
  chemically synthesized
tcctgttttacaccgtttcaat

SEQ ID NO: 1321690 - DNA, 22 bp, Artificial Sequence
  chemically synthesized
ttcctgttttacaccgtttcaa

SEQ ID NO: 1321691 - DNA, 22 bp, Artificial Sequence
  chemically synthesized
tttcctgttttacaccgtttca

SEQ ID NO: 1321692 - DNA, 22 bp, Artificial Sequence
  chemically synthesized
tgattgaaacggtgtaaaacag

SEQ ID NO: 1321693 - DNA, 22 bp, Artificial Sequence
  chemically synthesized
gataattttttcctgttttaca

SEQ ID NO: 1321694 - DNA, 22 bp, Artificial Sequence
  chemically synthesized
gattgaaacggtgtaaaacagg

SEQ ID NO: 1321695 - DNA, 22 bp, Artificial Sequence
  chemically synthesized
attgaaacggtgtaaaacagga

SEQ ID NO: 1321696 - DNA, 22 bp, Artificial Sequence
  chemically synthesized
tagataattttttcctgtttta

SEQ ID NO: 1321697 - DNA, 22 bp, Artificial Sequence
  chemically synthesized
aaacggtgtaaaacaggaaaaa

SEQ ID NO: 1321698 - DNA, 22 bp, Artificial Sequence
  chemically synthesized
gttctagataattttttcctgt

SEQ ID NO: 1321699 - DNA, 22 bp, Artificial Sequence
  chemically synthesized
ggttctagataattttttcctg

SEQ ID NO: 1321700 - DNA, 22 bp, Artificial Sequence
  chemically synthesized
tctagaaccaaacttttattgc

SEQ ID NO: 1321701 - DNA, 22 bp, Artificial Sequence
  chemically synthesized
catagccaacatgcaataaaag

SEQ ID NO: 1321702 - DNA, 22 bp, Artificial Sequence
  chemically synthesized
ccatagccaacatgcaataaaa

SEQ ID NO: 1321703 - DNA, 22 bp, Artificial Sequence
  chemically synthesized
tccatagccaacatgcaataaa

SEQ ID NO: 1321704 - DNA, 22 bp, Artificial Sequence
  chemically synthesized
ttccatagccaacatgcaataa

SEQ ID NO: 1321705 - DNA, 22 bp, Artificial Sequence
  chemically synthesized
gaaccaaacttttattgcatgt

SEQ ID NO: 1321706 - DNA, 22 bp, Artificial Sequence
  chemically synthesized
tacttttccatagccaacatgc

SEQ ID NO: 1321707 - DNA, 22 bp, Artificial Sequence
  chemically synthesized
gtacttttccatagccaacatg

SEQ ID NO: 1321708 - DNA, 22 bp, Artificial Sequence
  chemically synthesized
tttgtacttttccatagccaac

SEQ ID NO: 1321709 - DNA, 22 bp, Artificial Sequence
  chemically synthesized
ttattgcatgttggctatggaa

SEQ ID NO: 1321710 - DNA, 22 bp, Artificial Sequence
  chemically synthesized
ttatttgtacttttccatagcc

SEQ ID NO: 1321711 - DNA, 22 bp, Artificial Sequence
  chemically synthesized
tattgcatgttggctatggaaa

SEQ ID NO: 1321712 - DNA, 22 bp, Artificial Sequence
  chemically synthesized
attgcatgttggctatggaaaa

SEQ ID NO: 1321713 - DNA, 22 bp, Artificial Sequence
  chemically synthesized
ttgcatgttggctatggaaaag

SEQ ID NO: 1321714 - DNA, 22 bp, Artificial Sequence
  chemically synthesized
gttattatttgtacttttccat

SEQ ID NO: 1321715 - DNA, 22 bp, Artificial Sequence
  chemically synthesized
agttattatttgtacttttcca

SEQ ID NO: 1321716 - DNA, 22 bp, Artificial Sequence
  chemically synthesized
catgttggctatggaaaagtac

SEQ ID NO: 1321717 - DNA, 22 bp, Artificial Sequence
  chemically synthesized
cgtcttagttattatttgtact

SEQ ID NO: 1321718 - DNA, 22 bp, Artificial Sequence
  chemically synthesized
gctatggaaaagtacaaataat

SEQ ID NO: 1321719 - DNA, 22 bp, Artificial Sequence
  chemically synthesized
attacgtcttagttattatttg

SEQ ID NO: 1321720 - DNA, 22 bp, Artificial Sequence
  chemically synthesized
tggaaaagtacaaataataact

SEQ ID NO: 1321721 - DNA, 22 bp, Artificial Sequence
  chemically synthesized
gttgattacgtcttagttatta

SEQ ID NO: 1321722 - DNA, 22 bp, Artificial Sequence
  chemically synthesized
tggcctagttgattacgtctta

SEQ ID NO: 1321723 - DNA, 22 bp, Artificial Sequence
  chemically synthesized
atcaagattatggcctagttga

SEQ ID NO: 1321724 - DNA, 22 bp, Artificial Sequence
  chemically synthesized
agacgtaatcaactaggccata

SEQ ID NO: 1321725 - DNA, 22 bp, Artificial Sequence
  chemically synthesized
aaaactcatcaagattatggcc

SEQ ID NO: 1321726 - DNA, 22 bp, Artificial Sequence
  chemically synthesized
ggccataatcttgatgagtttt

SEQ ID NO: 1321727 - DNA, 22 bp, Artificial Sequence
  chemically synthesized
tatataatataatcaaatctga

SEQ ID NO: 1321728 - DNA, 22 bp, Artificial Sequence
  chemically synthesized
gatgagttttcagatttgatta

SEQ ID NO: 1321729 - DNA, 22 bp, Artificial Sequence
  chemically synthesized
atgagttttcagatttgattat

SEQ ID NO: 1321730 - DNA, 22 bp, Artificial Sequence
  chemically synthesized
tatctatatataatataatcaa

SEQ ID NO: 1321731 - DNA, 22 bp, Artificial Sequence
  chemically synthesized
atatctatatataatataatca

SEQ ID NO: 1321732 - DNA, 22 bp, Artificial Sequence
  chemically synthesized
tatatctatatataatataatc

SEQ ID NO: 1321733 - DNA, 22 bp, Artificial Sequence
  chemically synthesized
ttttatatctatatataatata

SEQ ID NO: 1321734 - DNA, 22 bp, Artificial Sequence
  chemically synthesized
tcagatttgattatattatata

SEQ ID NO: 1321735 - DNA, 22 bp, Artificial Sequence
  chemically synthesized
attttatatctatatataatat

SEQ ID NO: 1321736 - DNA, 22 bp, Artificial Sequence
  chemically synthesized
cagatttgattatattatatat

SEQ ID NO: 1321737 - DNA, 22 bp, Artificial Sequence
  chemically synthesized
tattttatatctatatataata

SEQ ID NO: 1321738 - DNA, 22 bp, Artificial Sequence
  chemically synthesized
agatttgattatattatatata

SEQ ID NO: 1321739 - DNA, 22 bp, Artificial Sequence
  chemically synthesized
ctttattttatatctatatata

SEQ ID NO: 1321740 - DNA, 22 bp, Artificial Sequence
  chemically synthesized
gattatattatatatagatata

SEQ ID NO: 1321741 - DNA, 22 bp, Artificial Sequence
  chemically synthesized
attcctttattttatatctata

SEQ ID NO: 1321742 - DNA, 22 bp, Artificial Sequence
  chemically synthesized
attatattatatatagatataa

SEQ ID NO: 1321743 - DNA, 22 bp, Artificial Sequence
  chemically synthesized
tattatatatagatataaaata

SEQ ID NO: 1321744 - DNA, 22 bp, Artificial Sequence
  chemically synthesized
aaatattaattcctttatttta

SEQ ID NO: 1321745 - DNA, 22 bp, Artificial Sequence
  chemically synthesized
tatatagatataaaataaagga

SEQ ID NO: 1321746 - DNA, 22 bp, Artificial Sequence
  chemically synthesized
ttaaaatattaattcctttatt

SEQ ID NO: 1321747 - DNA, 22 bp, Artificial Sequence
  chemically synthesized
attaaaatattaattcctttat

SEQ ID NO: 1321748 - DNA, 22 bp, Artificial Sequence
  chemically synthesized
tattaaaatattaattccttta

SEQ ID NO: 1321749 - DNA, 22 bp, Artificial Sequence
  chemically synthesized
attttattaaaatattaattcc

SEQ ID NO: 1321750 - DNA, 22 bp, Artificial Sequence
  chemically synthesized
attgattttattaaaatattaa

SEQ ID NO: 1321751 - DNA, 22 bp, Artificial Sequence
  chemically synthesized
cattgattttattaaaatatta

SEQ ID NO: 1321752 - DNA, 22 bp, Artificial Sequence
  chemically synthesized
aagtttcattgattttattaaa

SEQ ID NO: 1321753 - DNA, 22 bp, Artificial Sequence
  chemically synthesized
atattttaataaaatcaatgaa

SEQ ID NO: 1321754 - DNA, 22 bp, Artificial Sequence
  chemically synthesized
taaaatatattgaagtttcatt

SEQ ID NO: 1321755 - DNA, 22 bp, Artificial Sequence
  chemically synthesized
taataaaatcaatgaaacttca

SEQ ID NO: 1321756 - DNA, 22 bp, Artificial Sequence
  chemically synthesized
aataaaatcaatgaaacttcaa

SEQ ID NO: 1321757 - DNA, 22 bp, Artificial Sequence
  chemically synthesized
ttgtaaaatatattgaagtttc

SEQ ID NO: 1321758 - DNA, 22 bp, Artificial Sequence
  chemically synthesized
ataaaatcaatgaaacttcaat

SEQ ID NO: 1321759 - DNA, 22 bp, Artificial Sequence
  chemically synthesized
aaatctattgtaaaatatattg

SEQ ID NO: 1321760 - DNA, 22 bp, Artificial Sequence
  chemically synthesized
aaaatctattgtaaaatatatt

SEQ ID NO: 1321761 - DNA, 22 bp, Artificial Sequence
  chemically synthesized
caatatattttacaatagattt

SEQ ID NO: 1321762 - DNA, 22 bp, Artificial Sequence
  chemically synthesized
aatatattttacaatagatttt

SEQ ID NO: 1321763 - DNA, 22 bp, Artificial Sequence
  chemically synthesized
tacaatagattttaaatactat

SEQ ID NO: 1321764 - DNA, 22 bp, Artificial Sequence
  chemically synthesized
acaatagattttaaatactatg

SEQ ID NO: 1321765 - DNA, 22 bp, Artificial Sequence
  chemically synthesized
ataaaaaatcaacatagtattt

SEQ ID NO: 1321766 - DNA, 22 bp, Artificial Sequence
  chemically synthesized
caatagattttaaatactatgt

SEQ ID NO: 1321767 - DNA, 22 bp, Artificial Sequence
  chemically synthesized
cataaaaaatcaacatagtatt

SEQ ID NO: 1321768 - DNA, 22 bp, Artificial Sequence
  chemically synthesized
tcataaaaaatcaacatagtat

SEQ ID NO: 1321769 - DNA, 22 bp, Artificial Sequence
  chemically synthesized
aactttcataaaaaatcaacat

SEQ ID NO: 1321770 - DNA, 22 bp, Artificial Sequence
  chemically synthesized
tgaactttcataaaaaatcaac

SEQ ID NO: 1321771 - DNA, 22 bp, Artificial Sequence
  chemically synthesized
taaatactatgttgatttttta

SEQ ID NO: 1321772 - DNA, 22 bp, Artificial Sequence
  chemically synthesized
aaatactatgttgattttttat

SEQ ID NO: 1321773 - DNA, 22 bp, Artificial Sequence
  chemically synthesized
aatactatgttgattttttatg

SEQ ID NO: 1321774 - DNA, 22 bp, Artificial Sequence
  chemically synthesized
atgttctgaactttcataaaaa

SEQ ID NO: 1321775 - DNA, 22 bp, Artificial Sequence
  chemically synthesized
gatgttctgaactttcataaaa

SEQ ID NO: 1321776 - DNA, 22 bp, Artificial Sequence
  chemically synthesized
tgatgttctgaactttcataaa

SEQ ID NO: 1321777 - DNA, 22 bp, Artificial Sequence
  chemically synthesized
ttgatgttctgaactttcataa

SEQ ID NO: 1321778 - DNA, 22 bp, Artificial Sequence
  chemically synthesized
tttgatgttctgaactttcata

SEQ ID NO: 1321779 - DNA, 22 bp, Artificial Sequence
  chemically synthesized
tgttgattttttatgaaagttc

SEQ ID NO: 1321780 - DNA, 22 bp, Artificial Sequence
  chemically synthesized
gtctttttgatgttctgaactt

SEQ ID NO: 1321781 - DNA, 22 bp, Artificial Sequence
  chemically synthesized
attttttatgaaagttcagaac

SEQ ID NO: 1321782 - DNA, 22 bp, Artificial Sequence
  chemically synthesized
tttatgaaagttcagaacatca

SEQ ID NO: 1321783 - DNA, 22 bp, Artificial Sequence
  chemically synthesized
cattagtctttttgatgttctg

SEQ ID NO: 1321784 - DNA, 22 bp, Artificial Sequence
  chemically synthesized
ttatgaaagttcagaacatcaa

SEQ ID NO: 1321785 - DNA, 22 bp, Artificial Sequence
  chemically synthesized
tatgaaagttcagaacatcaaa

SEQ ID NO: 1321786 - DNA, 22 bp, Artificial Sequence
  chemically synthesized
atgaaagttcagaacatcaaaa

SEQ ID NO: 1321787 - DNA, 22 bp, Artificial Sequence
  chemically synthesized
tgaaagttcagaacatcaaaaa

SEQ ID NO: 1321788 - DNA, 22 bp, Artificial Sequence
  chemically synthesized
tgttgcattagtctttttgatg

SEQ ID NO: 1321789 - DNA, 22 bp, Artificial Sequence
  chemically synthesized
atgttgcattagtctttttgat

SEQ ID NO: 1321790 - DNA, 22 bp, Artificial Sequence
  chemically synthesized
agaacatcaaaaagactaatgc

SEQ ID NO: 1321791 - DNA, 22 bp, Artificial Sequence
  chemically synthesized
atggcaaatttatgttgcatta

SEQ ID NO: 1321792 - DNA, 22 bp, Artificial Sequence
  chemically synthesized
atgcaacataaatttgccatga

SEQ ID NO: 1321793 - DNA, 22 bp, Artificial Sequence
  chemically synthesized
aggtgcgtataaactcatggca

SEQ ID NO: 1321794 - DNA, 22 bp, Artificial Sequence
  chemically synthesized
aaggtgcgtataaactcatggc

SEQ ID NO: 1321795 - DNA, 22 bp, Artificial Sequence
  chemically synthesized
taaggtgcgtataaactcatgg

SEQ ID NO: 1321796 - DNA, 22 bp, Artificial Sequence
  chemically synthesized
ttaaggtgcgtataaactcatg

SEQ ID NO: 1321797 - DNA, 22 bp, Artificial Sequence
  chemically synthesized
ttttaaggtgcgtataaactca

SEQ ID NO: 1321798 - DNA, 22 bp, Artificial Sequence
  chemically synthesized
cttttaaggtgcgtataaactc

SEQ ID NO: 1321799 - DNA, 22 bp, Artificial Sequence
  chemically synthesized
gccatgagtttatacgcacctt

SEQ ID NO: 1321800 - DNA, 22 bp, Artificial Sequence
  chemically synthesized
ccatgagtttatacgcacctta

SEQ ID NO: 1321801 - DNA, 22 bp, Artificial Sequence
  chemically synthesized
cgaacatttcttttaaggtgcg

SEQ ID NO: 1321802 - DNA, 22 bp, Artificial Sequence
  chemically synthesized
atacgcaccttaaaagaaatgt

SEQ ID NO: 1321803 - DNA, 22 bp, Artificial Sequence
  chemically synthesized
tacgcaccttaaaagaaatgtt

SEQ ID NO: 1321804 - DNA, 22 bp, Artificial Sequence
  chemically synthesized
aaaagaaatgttcgcagattct

SEQ ID NO: 1321805 - DNA, 22 bp, Artificial Sequence
  chemically synthesized
aaagaaatgttcgcagattcta

SEQ ID NO: 1321806 - DNA, 22 bp, Artificial Sequence
  chemically synthesized
gcagattctacttgtatcatga

SEQ ID NO: 1321807 - DNA, 22 bp, Artificial Sequence
  chemically synthesized
tgtcacaaaagcaacccatcat

SEQ ID NO: 1321808 - DNA, 22 bp, Artificial Sequence
  chemically synthesized
tacttgtatcatgatgggttgc

SEQ ID NO: 1321809 - DNA, 22 bp, Artificial Sequence
  chemically synthesized
cttgtatcatgatgggttgctt

SEQ ID NO: 1321810 - DNA, 22 bp, Artificial Sequence
  chemically synthesized
gtatcatgatgggttgcttttg

SEQ ID NO: 1321811 - DNA, 22 bp, Artificial Sequence
  chemically synthesized
tatcatgatgggttgcttttgt

SEQ ID NO: 1321812 - DNA, 22 bp, Artificial Sequence
  chemically synthesized
aatagttatgtcacaaaagcaa

SEQ ID NO: 1321813 - DNA, 22 bp, Artificial Sequence
  chemically synthesized
caatagttatgtcacaaaagca

SEQ ID NO: 1321814 - DNA, 22 bp, Artificial Sequence
  chemically synthesized
tcaatagttatgtcacaaaagc

SEQ ID NO: 1321815 - DNA, 22 bp, Artificial Sequence
  chemically synthesized
cttttgtgacataactattgaa

SEQ ID NO: 1321816 - DNA, 22 bp, Artificial Sequence
  chemically synthesized
ttgtgacataactattgaaaat

SEQ ID NO: 1321817 - DNA, 22 bp, Artificial Sequence
  chemically synthesized
tgtgacataactattgaaaatg

SEQ ID NO: 1321818 - DNA, 22 bp, Artificial Sequence
  chemically synthesized
gtgacataactattgaaaatgt

SEQ ID NO: 1321819 - DNA, 22 bp, Artificial Sequence
  chemically synthesized
tgacataactattgaaaatgtg

SEQ ID NO: 1321820 - DNA, 22 bp, Artificial Sequence
  chemically synthesized
cagaaaaaaaaaacacacattt

SEQ ID NO: 1321821 - DNA, 22 bp, Artificial Sequence
  chemically synthesized
tactgcagaaaaaaaaaacaca

SEQ ID NO: 1321822 - DNA, 22 bp, Artificial Sequence
  chemically synthesized
ttgaaaatgtgtgttttttttt

SEQ ID NO: 1321823 - DNA, 22 bp, Artificial Sequence
  chemically synthesized
aaaatgtgtgttttttttttct

SEQ ID NO: 1321824 - DNA, 22 bp, Artificial Sequence
  chemically synthesized
aatgtgaagattgtactgcaga

SEQ ID NO: 1321825 - DNA, 22 bp, Artificial Sequence
  chemically synthesized
tttttttctgcagtacaatctt

SEQ ID NO: 1321826 - DNA, 22 bp, Artificial Sequence
  chemically synthesized
aatctgaatgtgaagattgtac

SEQ ID NO: 1321827 - DNA, 22 bp, Artificial Sequence
  chemically synthesized
ttttttctgcagtacaatcttc

SEQ ID NO: 1321828 - DNA, 22 bp, Artificial Sequence
  chemically synthesized
tttttctgcagtacaatcttca

SEQ ID NO: 1321829 - DNA, 22 bp, Artificial Sequence
  chemically synthesized
ttttctgcagtacaatcttcac

SEQ ID NO: 1321830 - DNA, 22 bp, Artificial Sequence
  chemically synthesized
tttctgcagtacaatcttcaca

SEQ ID NO: 1321831 - DNA, 22 bp, Artificial Sequence
  chemically synthesized
ttctgcagtacaatcttcacat

SEQ ID NO: 1321832 - DNA, 22 bp, Artificial Sequence
  chemically synthesized
tctgcagtacaatcttcacatt

SEQ ID NO: 1321833 - DNA, 22 bp, Artificial Sequence
  chemically synthesized
caattaaatctgaatgtgaaga

SEQ ID NO: 1321834 - DNA, 22 bp, Artificial Sequence
  chemically synthesized
ctgcagtacaatcttcacattc

SEQ ID NO: 1321835 - DNA, 22 bp, Artificial Sequence
  chemically synthesized
tgcagtacaatcttcacattca

SEQ ID NO: 1321836 - DNA, 22 bp, Artificial Sequence
  chemically synthesized
cagtacaatcttcacattcaga

SEQ ID NO: 1321837 - DNA, 22 bp, Artificial Sequence
  chemically synthesized
agattacaattaaatctgaatg

SEQ ID NO: 1321838 - DNA, 22 bp, Artificial Sequence
  chemically synthesized
gctaagattacaattaaatctg

SEQ ID NO: 1321839 - DNA, 22 bp, Artificial Sequence
  chemically synthesized
cacattcagatttaattgtaat

SEQ ID NO: 1321840 - DNA, 22 bp, Artificial Sequence
  chemically synthesized
acattcagatttaattgtaatc

SEQ ID NO: 1321841 - DNA, 22 bp, Artificial Sequence
  chemically synthesized
agatttaattgtaatcttagcc

SEQ ID NO: 1321842 - DNA, 22 bp, Artificial Sequence
  chemically synthesized
tgagcaaaagttggctaagatt

SEQ ID NO: 1321843 - DNA, 22 bp, Artificial Sequence
  chemically synthesized
tatgagcaaaagttggctaaga

SEQ ID NO: 1321844 - DNA, 22 bp, Artificial Sequence
  chemically synthesized
ctatgagcaaaagttggctaag

SEQ ID NO: 1321845 - DNA, 22 bp, Artificial Sequence
  chemically synthesized
aattgtaatcttagccaacttt

SEQ ID NO: 1321846 - DNA, 22 bp, Artificial Sequence
  chemically synthesized
attgtaatcttagccaactttt

SEQ ID NO: 1321847 - DNA, 22 bp, Artificial Sequence
  chemically synthesized
atccttctatgagcaaaagttg

SEQ ID NO: 1321848 - DNA, 22 bp, Artificial Sequence
  chemically synthesized
taatcttagccaacttttgctc

SEQ ID NO: 1321849 - DNA, 22 bp, Artificial Sequence
  chemically synthesized
agccaacttttgctcatagaag

SEQ ID NO: 1321850 - DNA, 22 bp, Artificial Sequence
  chemically synthesized
gccaacttttgctcatagaagg

SEQ ID NO: 1321851 - DNA, 22 bp, Artificial Sequence
  chemically synthesized
ttgctcatagaaggattaatca

SEQ ID NO: 1321852 - DNA, 22 bp, Artificial Sequence
  chemically synthesized
tgctcatagaaggattaatcat

SEQ ID NO: 1321853 - DNA, 22 bp, Artificial Sequence
  chemically synthesized
gctcatagaaggattaatcata

SEQ ID NO: 1321854 - DNA, 22 bp, Artificial Sequence
  chemically synthesized
ctcatagaaggattaatcatat

SEQ ID NO: 1321855 - DNA, 22 bp, Artificial Sequence
  chemically synthesized
atagaaggattaatcatatgac

SEQ ID NO: 1321856 - DNA, 22 bp, Artificial Sequence
  chemically synthesized
tgtgtaaacaaaaagtcatatg

SEQ ID NO: 1321857 - DNA, 22 bp, Artificial Sequence
  chemically synthesized
atcatatgactttttgtttaca

SEQ ID NO: 1321858 - DNA, 22 bp, Artificial Sequence
  chemically synthesized
caggtgattgtgtgtaaacaaa

SEQ ID NO: 1321859 - DNA, 22 bp, Artificial Sequence
  chemically synthesized
tacaggtgattgtgtgtaaaca

SEQ ID NO: 1321860 - DNA, 22 bp, Artificial Sequence
  chemically synthesized
ctacaggtgattgtgtgtaaac

SEQ ID NO: 1321861 - DNA, 22 bp, Artificial Sequence
  chemically synthesized
tctacaggtgattgtgtgtaaa

SEQ ID NO: 1321862 - DNA, 22 bp, Artificial Sequence
  chemically synthesized
ctttctacaggtgattgtgtgt

SEQ ID NO: 1321863 - DNA, 22 bp, Artificial Sequence
  chemically synthesized
tttgtttacacacaatcacctg

SEQ ID NO: 1321864 - DNA, 22 bp, Artificial Sequence
  chemically synthesized
ttgtttacacacaatcacctgt

SEQ ID NO: 1321865 - DNA, 22 bp, Artificial Sequence
  chemically synthesized
tgtttacacacaatcacctgta

SEQ ID NO: 1321866 - DNA, 22 bp, Artificial Sequence
  chemically synthesized
gtttacacacaatcacctgtag

SEQ ID NO: 1321867 - DNA, 22 bp, Artificial Sequence
  chemically synthesized
tttacacacaatcacctgtaga

SEQ ID NO: 1321868 - DNA, 22 bp, Artificial Sequence
  chemically synthesized
acacacaatcacctgtagaaag

SEQ ID NO: 1321869 - DNA, 22 bp, Artificial Sequence
  chemically synthesized
cacacaatcacctgtagaaagc

SEQ ID NO: 1321870 - DNA, 22 bp, Artificial Sequence
  chemically synthesized
tagaaagcagttatcattctat

SEQ ID NO: 1321871 - DNA, 22 bp, Artificial Sequence
  chemically synthesized
aatgaatgaagaaatgaataga

SEQ ID NO: 1321872 - DNA, 22 bp, Artificial Sequence
  chemically synthesized
ttgaatgaatgaagaaatgaat

SEQ ID NO: 1321873 - DNA, 22 bp, Artificial Sequence
  chemically synthesized
tcattctattcatttcttcatt

SEQ ID NO: 1321874 - DNA, 22 bp, Artificial Sequence
  chemically synthesized
tattcatttcttcattcattca

SEQ ID NO: 1321875 - DNA, 22 bp, Artificial Sequence
  chemically synthesized
ttcatttcttcattcattcaac

SEQ ID NO: 1321876 - DNA, 22 bp, Artificial Sequence
  chemically synthesized
atttcttcattcattcaacaac

SEQ ID NO: 1321877 - DNA, 22 bp, Artificial Sequence
  chemically synthesized
cttcattcattcaacaacactg

SEQ ID NO: 1321878 - DNA, 22 bp, Artificial Sequence
  chemically synthesized
ttcattcattcaacaacactga

SEQ ID NO: 1321879 - DNA, 22 bp, Artificial Sequence
  chemically synthesized
cattcattcaacaacactgact

SEQ ID NO: 1321880 - DNA, 22 bp, Artificial Sequence
  chemically synthesized
attcattcaacaacactgactt

SEQ ID NO: 1321881 - DNA, 22 bp, Artificial Sequence
  chemically synthesized
attcaacaacactgacttttat

SEQ ID NO: 1321882 - DNA, 22 bp, Artificial Sequence
  chemically synthesized
gcatagagtagcataaaagtca

SEQ ID NO: 1321883 - DNA, 22 bp, Artificial Sequence
  chemically synthesized
aacaacactgacttttatgcta

SEQ ID NO: 1321884 - DNA, 22 bp, Artificial Sequence
  chemically synthesized
agggcctggcatagagtagcat

SEQ ID NO: 1321885 - DNA, 22 bp, Artificial Sequence
  chemically synthesized
actcagggcctggcatagagta

SEQ ID NO: 1321886 - DNA, 22 bp, Artificial Sequence
  chemically synthesized
acttttatgctactctatgcca

SEQ ID NO: 1321887 - DNA, 22 bp, Artificial Sequence
  chemically synthesized
ttatgctactctatgccaggcc

SEQ ID NO: 1321888 - DNA, 22 bp, Artificial Sequence
  chemically synthesized
tatgctactctatgccaggccc

SEQ ID NO: 1321889 - DNA, 22 bp, Artificial Sequence
  chemically synthesized
atgctactctatgccaggccct

SEQ ID NO: 1321890 - DNA, 22 bp, Artificial Sequence
  chemically synthesized
tgctactctatgccaggccctg

SEQ ID NO: 1321891 - DNA, 22 bp, Artificial Sequence
  chemically synthesized
ccagaactcactcagggcctgg

SEQ ID NO: 1321892 - DNA, 22 bp, Artificial Sequence
  chemically synthesized
ctctatgccaggccctgagtga

SEQ ID NO: 1321893 - DNA, 22 bp, Artificial Sequence
  chemically synthesized
gtatctcccagaactcactcag

SEQ ID NO: 1321894 - DNA, 22 bp, Artificial Sequence
  chemically synthesized
tatgccaggccctgagtgagtt

SEQ ID NO: 1321895 - DNA, 22 bp, Artificial Sequence
  chemically synthesized
tgccaggccctgagtgagttct

SEQ ID NO: 1321896 - DNA, 22 bp, Artificial Sequence
  chemically synthesized
agtgtatattagtatctcccag

SEQ ID NO: 1321897 - DNA, 22 bp, Artificial Sequence
  chemically synthesized
aagtgtatattagtatctccca

SEQ ID NO: 1321898 - DNA, 22 bp, Artificial Sequence
  chemically synthesized
agtgagttctgggagatactaa

SEQ ID NO: 1321899 - DNA, 22 bp, Artificial Sequence
  chemically synthesized
tgggagatactaatatacactt

SEQ ID NO: 1321900 - DNA, 22 bp, Artificial Sequence
  chemically synthesized
atggcagaacttaagtgtatat

SEQ ID NO: 1321901 - DNA, 22 bp, Artificial Sequence
  chemically synthesized
ggagatactaatatacacttaa

SEQ ID NO: 1321902 - DNA, 22 bp, Artificial Sequence
  chemically synthesized
attgatggcagaacttaagtgt

SEQ ID NO: 1321903 - DNA, 22 bp, Artificial Sequence
  chemically synthesized
taagttcattgatggcagaact

SEQ ID NO: 1321904 - DNA, 22 bp, Artificial Sequence
  chemically synthesized
atatacacttaagttctgccat

SEQ ID NO: 1321905 - DNA, 22 bp, Artificial Sequence
  chemically synthesized
aaaagactgtaagttcattgat

SEQ ID NO: 1321906 - DNA, 22 bp, Artificial Sequence
  chemically synthesized
aagttctgccatcaatgaactt

SEQ ID NO: 1321907 - DNA, 22 bp, Artificial Sequence
  chemically synthesized
tcaaaagactgtaagttcattg

SEQ ID NO: 1321908 - DNA, 22 bp, Artificial Sequence
  chemically synthesized
agttctgccatcaatgaactta

SEQ ID NO: 1321909 - DNA, 22 bp, Artificial Sequence
  chemically synthesized
ctcaaaagactgtaagttcatt

SEQ ID NO: 1321910 - DNA, 22 bp, Artificial Sequence
  chemically synthesized
tctcaaaagactgtaagttcat

SEQ ID NO: 1321911 - DNA, 22 bp, Artificial Sequence
  chemically synthesized
tgccatcaatgaacttacagtc

SEQ ID NO: 1321912 - DNA, 22 bp, Artificial Sequence
  chemically synthesized
tctttctcaaaagactgtaagt

SEQ ID NO: 1321913 - DNA, 22 bp, Artificial Sequence
  chemically synthesized
gtctttctcaaaagactgtaag

SEQ ID NO: 1321914 - DNA, 22 bp, Artificial Sequence
  chemically synthesized
ccatcaatgaacttacagtctt

SEQ ID NO: 1321915 - DNA, 22 bp, Artificial Sequence
  chemically synthesized
ccttgtctttctcaaaagactg

SEQ ID NO: 1321916 - DNA, 22 bp, Artificial Sequence
  chemically synthesized
ttgccttgtctttctcaaaaga

SEQ ID NO: 1321917 - DNA, 22 bp, Artificial Sequence
  chemically synthesized
aaactattgccttgtctttctc

SEQ ID NO: 1321918 - DNA, 22 bp, Artificial Sequence
  chemically synthesized
acagtcttttgagaaagacaag

SEQ ID NO: 1321919 - DNA, 22 bp, Artificial Sequence
  chemically synthesized
cagtcttttgagaaagacaagg

SEQ ID NO: 1321920 - DNA, 22 bp, Artificial Sequence
  chemically synthesized
ttgagaaagacaaggcaatagt

SEQ ID NO: 1321921 - DNA, 22 bp, Artificial Sequence
  chemically synthesized
tgagaaagacaaggcaatagtt

SEQ ID NO: 1321922 - DNA, 22 bp, Artificial Sequence
  chemically synthesized
gagaaagacaaggcaatagttt

SEQ ID NO: 1321923 - DNA, 22 bp, Artificial Sequence
  chemically synthesized
agaaagacaaggcaatagtttc

SEQ ID NO: 1321924 - DNA, 22 bp, Artificial Sequence
  chemically synthesized
tcaagtcatgctgaaactattg

SEQ ID NO: 1321925 - DNA, 22 bp, Artificial Sequence
  chemically synthesized
gtcaagtcatgctgaaactatt

SEQ ID NO: 1321926 - DNA, 22 bp, Artificial Sequence
  chemically synthesized
agatttgtcaagtcatgctgaa

SEQ ID NO: 1321927 - DNA, 22 bp, Artificial Sequence
  chemically synthesized
aagatttgtcaagtcatgctga

SEQ ID NO: 1321928 - DNA, 22 bp, Artificial Sequence
  chemically synthesized
ttaagatttgtcaagtcatgct

SEQ ID NO: 1321929 - DNA, 22 bp, Artificial Sequence
  chemically synthesized
cttaagatttgtcaagtcatgc

SEQ ID NO: 1321930 - DNA, 22 bp, Artificial Sequence
  chemically synthesized
tcttaagatttgtcaagtcatg

SEQ ID NO: 1321931 - DNA, 22 bp, Artificial Sequence
  chemically synthesized
ttcttaagatttgtcaagtcat

SEQ ID NO: 1321932 - DNA, 22 bp, Artificial Sequence
  chemically synthesized
tttcttaagatttgtcaagtca

SEQ ID NO: 1321933 - DNA, 22 bp, Artificial Sequence
  chemically synthesized
ttttcttaagatttgtcaagtc

SEQ ID NO: 1321934 - DNA, 22 bp, Artificial Sequence
  chemically synthesized
ttttttcttaagatttgtcaag

SEQ ID NO: 1321935 - DNA, 22 bp, Artificial Sequence
  chemically synthesized
cagcatgacttgacaaatctta

SEQ ID NO: 1321936 - DNA, 22 bp, Artificial Sequence
  chemically synthesized
gctcttttttcttaagatttgt

SEQ ID NO: 1321937 - DNA, 22 bp, Artificial Sequence
  chemically synthesized
agcatgacttgacaaatcttaa

SEQ ID NO: 1321938 - DNA, 22 bp, Artificial Sequence
  chemically synthesized
tggctcttttttcttaagattt

SEQ ID NO: 1321939 - DNA, 22 bp, Artificial Sequence
  chemically synthesized
tctggctcttttttcttaagat

SEQ ID NO: 1321940 - DNA, 22 bp, Artificial Sequence
  chemically synthesized
ctctggctcttttttcttaaga

SEQ ID NO: 1321941 - DNA, 22 bp, Artificial Sequence
  chemically synthesized
tgtttctctggctcttttttct

SEQ ID NO: 1321942 - DNA, 22 bp, Artificial Sequence
  chemically synthesized
gacaaatcttaagaaaaaagag

SEQ ID NO: 1321943 - DNA, 22 bp, Artificial Sequence
  chemically synthesized
acaaatcttaagaaaaaagagc

SEQ ID NO: 1321944 - DNA, 22 bp, Artificial Sequence
  chemically synthesized
tatgtttctctggctctttttt

SEQ ID NO: 1321945 - DNA, 22 bp, Artificial Sequence
  chemically synthesized
ctatgtttctctggctcttttt

SEQ ID NO: 1321946 - DNA, 22 bp, Artificial Sequence
  chemically synthesized
tctatgtttctctggctctttt

SEQ ID NO: 1321947 - DNA, 22 bp, Artificial Sequence
  chemically synthesized
tttctatgtttctctggctctt

SEQ ID NO: 1321948 - DNA, 22 bp, Artificial Sequence
  chemically synthesized
aagaaaaaagagccagagaaac

SEQ ID NO: 1321949 - DNA, 22 bp, Artificial Sequence
  chemically synthesized
agaaaaaagagccagagaaaca

SEQ ID NO: 1321950 - DNA, 22 bp, Artificial Sequence
  chemically synthesized
gatccctctttctatgtttctc

SEQ ID NO: 1321951 - DNA, 22 bp, Artificial Sequence
  chemically synthesized
agatccctctttctatgtttct

SEQ ID NO: 1321952 - DNA, 22 bp, Artificial Sequence
  chemically synthesized
atttagatccctctttctatgt

SEQ ID NO: 1321953 - DNA, 22 bp, Artificial Sequence
  chemically synthesized
gcctaatttagatccctctttc

SEQ ID NO: 1321954 - DNA, 22 bp, Artificial Sequence
  chemically synthesized
tagcctaatttagatccctctt

SEQ ID NO: 1321955 - DNA, 22 bp, Artificial Sequence
  chemically synthesized
ctagcctaatttagatccctct

SEQ ID NO: 1321956 - DNA, 22 bp, Artificial Sequence
  chemically synthesized
ttctagcctaatttagatccct

SEQ ID NO: 1321957 - DNA, 22 bp, Artificial Sequence
  chemically synthesized
cttctagcctaatttagatccc

SEQ ID NO: 1321958 - DNA, 22 bp, Artificial Sequence
  chemically synthesized
tttcttctagcctaatttagat

SEQ ID NO: 1321959 - DNA, 22 bp, Artificial Sequence
  chemically synthesized
ctatttcttctagcctaattta

SEQ ID NO: 1321960 - DNA, 22 bp, Artificial Sequence
  chemically synthesized
gctatttcttctagcctaattt

SEQ ID NO: 1321961 - DNA, 22 bp, Artificial Sequence
  chemically synthesized
cttgctatttcttctagcctaa

SEQ ID NO: 1321962 - DNA, 22 bp, Artificial Sequence
  chemically synthesized
ctccttgctatttcttctagcc

SEQ ID NO: 1321963 - DNA, 22 bp, Artificial Sequence
  chemically synthesized
tatctactccttgctatttctt

SEQ ID NO: 1321964 - DNA, 22 bp, Artificial Sequence
  chemically synthesized
aattaggctagaagaaatagca

SEQ ID NO: 1321965 - DNA, 22 bp, Artificial Sequence
  chemically synthesized
cctgtatctactccttgctatt

SEQ ID NO: 1321966 - DNA, 22 bp, Artificial Sequence
  chemically synthesized
ggctagaagaaatagcaaggag

SEQ ID NO: 1321967 - DNA, 22 bp, Artificial Sequence
  chemically synthesized
ctccctgtatctactccttgct

SEQ ID NO: 1321968 - DNA, 22 bp, Artificial Sequence
  chemically synthesized
cctccctgtatctactccttgc

SEQ ID NO: 1321969 - DNA, 22 bp, Artificial Sequence
  chemically synthesized
gaagaaatagcaaggagtagat

SEQ ID NO: 1321970 - DNA, 22 bp, Artificial Sequence
  chemically synthesized
ggacacccttcctccctgtatc

SEQ ID NO: 1321971 - DNA, 22 bp, Artificial Sequence
  chemically synthesized
tgtctgggacacccttcctccc

SEQ ID NO: 1321972 - DNA, 22 bp, Artificial Sequence
  chemically synthesized
tgtgtctgggacacccttcctc

SEQ ID NO: 1321973 - DNA, 22 bp, Artificial Sequence
  chemically synthesized
ctgtgtctgggacacccttcct

SEQ ID NO: 1321974 - DNA, 22 bp, Artificial Sequence
  chemically synthesized
tatagcacatgcatatttctgt

SEQ ID NO: 1321975 - DNA, 22 bp, Artificial Sequence
  chemically synthesized
atatagcacatgcatatttctg

SEQ ID NO: 1321976 - DNA, 22 bp, Artificial Sequence
  chemically synthesized
tatatagcacatgcatatttct

SEQ ID NO: 1321977 - DNA, 22 bp, Artificial Sequence
  chemically synthesized
tgtaattttatatagcacatgc

SEQ ID NO: 1321978 - DNA, 22 bp, Artificial Sequence
  chemically synthesized
aatatattatgtaattttatat

SEQ ID NO: 1321979 - DNA, 22 bp, Artificial Sequence
  chemically synthesized
aaatatattatgtaattttata

SEQ ID NO: 1321980 - DNA, 22 bp, Artificial Sequence
  chemically synthesized
ttaaatatattatgtaatttta

SEQ ID NO: 1321981 - DNA, 22 bp, Artificial Sequence
  chemically synthesized
cttaaatatattatgtaatttt

SEQ ID NO: 1321982 - DNA, 22 bp, Artificial Sequence
  chemically synthesized
tcttaaatatattatgtaattt

SEQ ID NO: 1321983 - DNA, 22 bp, Artificial Sequence
  chemically synthesized
tttcttaaatatattatgtaat

SEQ ID NO: 1321984 - DNA, 22 bp, Artificial Sequence
  chemically synthesized
ctctttcttaaatatattatgt

SEQ ID NO: 1321985 - DNA, 22 bp, Artificial Sequence
  chemically synthesized
gctctttcttaaatatattatg

SEQ ID NO: 1321986 - DNA, 22 bp, Artificial Sequence
  chemically synthesized
tataaaattacataatatattt

SEQ ID NO: 1321987 - DNA, 22 bp, Artificial Sequence
  chemically synthesized
ttgctctttcttaaatatatta

SEQ ID NO: 1321988 - DNA, 22 bp, Artificial Sequence
  chemically synthesized
cttgctctttcttaaatatatt

SEQ ID NO: 1321989 - DNA, 22 bp, Artificial Sequence
  chemically synthesized
cataatatatttaagaaagagc

SEQ ID NO: 1321990 - DNA, 22 bp, Artificial Sequence
  chemically synthesized
aagaaagagcaagaaggccggg

SEQ ID NO: 1321991 - DNA, 22 bp, Artificial Sequence
  chemically synthesized
agaaagagcaagaaggccgggc

SEQ ID NO: 1321992 - DNA, 22 bp, Artificial Sequence
  chemically synthesized
caggcgtgagccaccgcgcccg

SEQ ID NO: 1321993 - DNA, 22 bp, Artificial Sequence
  chemically synthesized
ggattacaggcgtgagccaccg

SEQ ID NO: 1321994 - DNA, 22 bp, Artificial Sequence
  chemically synthesized
ccaaagtgctgggattacaggc

SEQ ID NO: 1321995 - DNA, 22 bp, Artificial Sequence
  chemically synthesized
acgcctgtaatcccagcacttt

SEQ ID NO: 1321996 - DNA, 22 bp, Artificial Sequence
  chemically synthesized
ccatggactcccaaagtgctgg

SEQ ID NO: 1321997 - DNA, 22 bp, Artificial Sequence
  chemically synthesized
taatcccagcactttgggagtc

SEQ ID NO: 1321998 - DNA, 22 bp, Artificial Sequence
  chemically synthesized
aggtgatccacctgccatggac

SEQ ID NO: 1321999 - DNA, 22 bp, Artificial Sequence
  chemically synthesized
acctcaggtgatccacctgcca

SEQ ID NO: 1322000 - DNA, 22 bp, Artificial Sequence
  chemically synthesized
tgggagtccatggcaggtggat

SEQ ID NO: 1322001 - DNA, 22 bp, Artificial Sequence
  chemically synthesized
gggagtccatggcaggtggatc

SEQ ID NO: 1322002 - DNA, 22 bp, Artificial Sequence
  chemically synthesized
ctgacctcaggtgatccacctg

SEQ ID NO: 1322003 - DNA, 22 bp, Artificial Sequence
  chemically synthesized
ggagtccatggcaggtggatca

SEQ ID NO: 1322004 - DNA, 22 bp, Artificial Sequence
  chemically synthesized
aactcctgacctcaggtgatcc

SEQ ID NO: 1322005 - DNA, 22 bp, Artificial Sequence
  chemically synthesized
gaactcctgacctcaggtgatc

SEQ ID NO: 1322006 - DNA, 22 bp, Artificial Sequence
  chemically synthesized
gtcttgaactcctgacctcagg

SEQ ID NO: 1322007 - DNA, 22 bp, Artificial Sequence
  chemically synthesized
gccaggctggtcttgaactcct

SEQ ID NO: 1322008 - DNA, 22 bp, Artificial Sequence
  chemically synthesized
aggtcaggagttcaagaccagc

SEQ ID NO: 1322009 - DNA, 22 bp, Artificial Sequence
  chemically synthesized
atcatgttggccaggctggtct

SEQ ID NO: 1322010 - DNA, 22 bp, Artificial Sequence
  chemically synthesized
catcatgttggccaggctggtc

SEQ ID NO: 1322011 - DNA, 22 bp, Artificial Sequence
  chemically synthesized
aagaccagcctggccaacatga

SEQ ID NO: 1322012 - DNA, 22 bp, Artificial Sequence
  chemically synthesized
ggagagatggggtttcatcatg

SEQ ID NO: 1322013 - DNA, 22 bp, Artificial Sequence
  chemically synthesized
aggagagatggggtttcatcat

SEQ ID NO: 1322014 - DNA, 22 bp, Artificial Sequence
  chemically synthesized
taggagagatggggtttcatca

SEQ ID NO: 1322015 - DNA, 22 bp, Artificial Sequence
  chemically synthesized
ttaggagagatggggtttcatc

SEQ ID NO: 1322016 - DNA, 22 bp, Artificial Sequence
  chemically synthesized
gccaacatgatgaaaccccatc

SEQ ID NO: 1322017 - DNA, 22 bp, Artificial Sequence
  chemically synthesized
tatttttaggagagatggggtt

SEQ ID NO: 1322018 - DNA, 22 bp, Artificial Sequence
  chemically synthesized
gtatttttaggagagatggggt

SEQ ID NO: 1322019 - DNA, 22 bp, Artificial Sequence
  chemically synthesized
tgtatttttaggagagatgggg

SEQ ID NO: 1322020 - DNA, 22 bp, Artificial Sequence
  chemically synthesized
ttgtatttttaggagagatggg

SEQ ID NO: 1322021 - DNA, 22 bp, Artificial Sequence
  chemically synthesized
tttgtatttttaggagagatgg

SEQ ID NO: 1322022 - DNA, 22 bp, Artificial Sequence
  chemically synthesized
attttttgtatttttaggagag

SEQ ID NO: 1322023 - DNA, 22 bp, Artificial Sequence
  chemically synthesized
tcctaaaaatacaaaaaattag

SEQ ID NO: 1322024 - DNA, 22 bp, Artificial Sequence
  chemically synthesized
ccacgatgcccagctaattttt

SEQ ID NO: 1322025 - DNA, 22 bp, Artificial Sequence
  chemically synthesized
ctaaaaatacaaaaaattagct

SEQ ID NO: 1322026 - DNA, 22 bp, Artificial Sequence
  chemically synthesized
aaaatacaaaaaattagctggg

SEQ ID NO: 1322027 - DNA, 22 bp, Artificial Sequence
  chemically synthesized
gtgactgccacgatgcccagct

SEQ ID NO: 1322028 - DNA, 22 bp, Artificial Sequence
  chemically synthesized
ctggtgactgccacgatgccca

SEQ ID NO: 1322029 - DNA, 22 bp, Artificial Sequence
  chemically synthesized
ggattactggtgactgccacga

SEQ ID NO: 1322030 - DNA, 22 bp, Artificial Sequence
  chemically synthesized
gctgggcatcgtggcagtcacc

SEQ ID NO: 1322031 - DNA, 22 bp, Artificial Sequence
  chemically synthesized
ggcatcgtggcagtcaccagta

SEQ ID NO: 1322032 - DNA, 22 bp, Artificial Sequence
  chemically synthesized
ccgagtagctgggattactggt

SEQ ID NO: 1322033 - DNA, 22 bp, Artificial Sequence
  chemically synthesized
agcctcccgagtagctgggatt

SEQ ID NO: 1322034 - DNA, 22 bp, Artificial Sequence
  chemically synthesized
ctcagcctcccgagtagctggg

SEQ ID NO: 1322035 - DNA, 22 bp, Artificial Sequence
  chemically synthesized
cctcctcagcctcccgagtagc

SEQ ID NO: 1322036 - DNA, 22 bp, Artificial Sequence
  chemically synthesized
tccctcctcagcctcccgagta

SEQ ID NO: 1322037 - DNA, 22 bp, Artificial Sequence
  chemically synthesized
aagcgattctccctcctcagcc

SEQ ID NO: 1322038 - DNA, 22 bp, Artificial Sequence
  chemically synthesized
ctcgggaggctgaggagggaga

SEQ ID NO: 1322039 - DNA, 22 bp, Artificial Sequence
  chemically synthesized
gggaggctgaggagggagaatc

SEQ ID NO: 1322040 - DNA, 22 bp, Artificial Sequence
  chemically synthesized
ccaggttcaagcgattctccct

SEQ ID NO: 1322041 - DNA, 22 bp, Artificial Sequence
  chemically synthesized
cacctcccaggttcaagcgatt

SEQ ID NO: 1322042 - DNA, 22 bp, Artificial Sequence
  chemically synthesized
ccacctcccaggttcaagcgat

SEQ ID NO: 1322043 - DNA, 22 bp, Artificial Sequence
  chemically synthesized
aggagggagaatcgcttgaacc

SEQ ID NO: 1322044 - DNA, 22 bp, Artificial Sequence
  chemically synthesized
caacttccacctcccaggttca

SEQ ID NO: 1322045 - DNA, 22 bp, Artificial Sequence
  chemically synthesized
actgcaacttccacctcccagg

SEQ ID NO: 1322046 - DNA, 22 bp, Artificial Sequence
  chemically synthesized
agctcactgcaacttccacctc

SEQ ID NO: 1322047 - DNA, 22 bp, Artificial Sequence
  chemically synthesized
gaacctgggaggtggaagttgc

SEQ ID NO: 1322048 - DNA, 22 bp, Artificial Sequence
  chemically synthesized
aacctgggaggtggaagttgca

SEQ ID NO: 1322049 - DNA, 22 bp, Artificial Sequence
  chemically synthesized
ggaggtggaagttgcagtgagc

SEQ ID NO: 1322050 - DNA, 22 bp, Artificial Sequence
  chemically synthesized
gagtgcaatggcacaatctcag

SEQ ID NO: 1322051 - DNA, 22 bp, Artificial Sequence
  chemically synthesized
cctggagtgcaatggcacaatc

SEQ ID NO: 1322052 - DNA, 22 bp, Artificial Sequence
  chemically synthesized
cagtgagctgagattgtgccat

SEQ ID NO: 1322053 - DNA, 22 bp, Artificial Sequence
  chemically synthesized
tcgccctgcctggagtgcaatg

SEQ ID NO: 1322054 - DNA, 22 bp, Artificial Sequence
  chemically synthesized
tgtcgccctgcctggagtgcaa

SEQ ID NO: 1322055 - DNA, 22 bp, Artificial Sequence
  chemically synthesized
agattgtgccattgcactccag

SEQ ID NO: 1322056 - DNA, 22 bp, Artificial Sequence
  chemically synthesized
ctctgtcgccctgcctggagtg

SEQ ID NO: 1322057 - DNA, 22 bp, Artificial Sequence
  chemically synthesized
gctctgtcgccctgcctggagt

SEQ ID NO: 1322058 - DNA, 22 bp, Artificial Sequence
  chemically synthesized
tgccattgcactccaggcaggg

SEQ ID NO: 1322059 - DNA, 22 bp, Artificial Sequence
  chemically synthesized
cactccaggcagggcgacagag

SEQ ID NO: 1322060 - DNA, 22 bp, Artificial Sequence
  chemically synthesized
agatggagtcttgctctgtcgc

SEQ ID NO: 1322061 - DNA, 22 bp, Artificial Sequence
  chemically synthesized
gagatggagtcttgctctgtcg

SEQ ID NO: 1322062 - DNA, 22 bp, Artificial Sequence
  chemically synthesized
tgagatggagtcttgctctgtc

SEQ ID NO: 1322063 - DNA, 22 bp, Artificial Sequence
  chemically synthesized
ttgagatggagtcttgctctgt

SEQ ID NO: 1322064 - DNA, 22 bp, Artificial Sequence
  chemically synthesized
caggcagggcgacagagcaaga

SEQ ID NO: 1322065 - DNA, 22 bp, Artificial Sequence
  chemically synthesized
tttgagatggagtcttgctctg

SEQ ID NO: 1322066 - DNA, 22 bp, Artificial Sequence
  chemically synthesized
ttttgagatggagtcttgctct

SEQ ID NO: 1322067 - DNA, 22 bp, Artificial Sequence
  chemically synthesized
tttttgagatggagtcttgctc

SEQ ID NO: 1322068 - DNA, 22 bp, Artificial Sequence
  chemically synthesized
ttttttgagatggagtcttgct

SEQ ID NO: 1322069 - DNA, 22 bp, Artificial Sequence
  chemically synthesized
tttttttgagatggagtcttgc

SEQ ID NO: 1322070 - DNA, 22 bp, Artificial Sequence
  chemically synthesized
ttttttttgagatggagtcttg

SEQ ID NO: 1322071 - DNA, 22 bp, Artificial Sequence
  chemically synthesized
tttttttttgagatggagtctt

SEQ ID NO: 1322072 - DNA, 22 bp, Artificial Sequence
  chemically synthesized
ttttttttttgagatggagtct

SEQ ID NO: 1322073 - DNA, 22 bp, Artificial Sequence
  chemically synthesized
tttttttttttgagatggagtc

SEQ ID NO: 1322074 - DNA, 22 bp, Artificial Sequence
  chemically synthesized
ttttttttttttgagatggagt

SEQ ID NO: 1322075 - DNA, 22 bp, Artificial Sequence
  chemically synthesized
tttttttttttttgagatggag

SEQ ID NO: 1322076 - DNA, 22 bp, Artificial Sequence
  chemically synthesized
tttttttttttttttgagatgg

SEQ ID NO: 1322077 - DNA, 22 bp, Artificial Sequence
  chemically synthesized
ctttttttttttttttgagatg

SEQ ID NO: 1322078 - DNA, 22 bp, Artificial Sequence
  chemically synthesized
tctttttttttttttttgagat

SEQ ID NO: 1322079 - DNA, 22 bp, Artificial Sequence
  chemically synthesized
ttctttttttttttttttgaga

SEQ ID NO: 1322080 - DNA, 22 bp, Artificial Sequence
  chemically synthesized
tttctttttttttttttttgag

SEQ ID NO: 1322081 - DNA, 22 bp, Artificial Sequence
  chemically synthesized
ttttctttttttttttttttga

SEQ ID NO: 1322082 - DNA, 22 bp, Artificial Sequence
  chemically synthesized
tttttctttttttttttttttg

SEQ ID NO: 1322083 - DNA, 22 bp, Artificial Sequence
  chemically synthesized
ttttttcttttttttttttttt

SEQ ID NO: 1322084 - DNA, 22 bp, Artificial Sequence
  chemically synthesized
ttttttttcttttttttttttt

SEQ ID NO: 1322085 - DNA, 22 bp, Artificial Sequence
  chemically synthesized
cttttttttctttttttttttt

SEQ ID NO: 1322086 - DNA, 22 bp, Artificial Sequence
  chemically synthesized
tcttttttttcttttttttttt

SEQ ID NO: 1322087 - DNA, 22 bp, Artificial Sequence
  chemically synthesized
catctcaaaaaaaaaaaaaaag

SEQ ID NO: 1322088 - DNA, 22 bp, Artificial Sequence
  chemically synthesized
tttcttttttttcttttttttt

SEQ ID NO: 1322089 - DNA, 22 bp, Artificial Sequence
  chemically synthesized
ctctttcttttttttctttttt

SEQ ID NO: 1322090 - DNA, 22 bp, Artificial Sequence
  chemically synthesized
gctctttcttttttttcttttt

SEQ ID NO: 1322091 - DNA, 22 bp, Artificial Sequence
  chemically synthesized
aaaaaaaaaaaaaaagaaaaaa

SEQ ID NO: 1322092 - DNA, 22 bp, Artificial Sequence
  chemically synthesized
ttgctctttcttttttttcttt

SEQ ID NO: 1322093 - DNA, 22 bp, Artificial Sequence
  chemically synthesized
cttgctctttcttttttttctt

SEQ ID NO: 1322094 - DNA, 22 bp, Artificial Sequence
  chemically synthesized
catgaaatttcttgctctttct

SEQ ID NO: 1322095 - DNA, 22 bp, Artificial Sequence
  chemically synthesized
atcccaactacatgaaatttct

SEQ ID NO: 1322096 - DNA, 22 bp, Artificial Sequence
  chemically synthesized
gatcccaactacatgaaatttc

SEQ ID NO: 1322097 - DNA, 22 bp, Artificial Sequence
  chemically synthesized
aaaatgcccttgatcccaacta

SEQ ID NO: 1322098 - DNA, 22 bp, Artificial Sequence
  chemically synthesized
cctcaaaatgcccttgatccca

SEQ ID NO: 1322099 - DNA, 22 bp, Artificial Sequence
  chemically synthesized
acctcaaaatgcccttgatccc

SEQ ID NO: 1322100 - DNA, 22 bp, Artificial Sequence
  chemically synthesized
catgtagttgggatcaagggca

SEQ ID NO: 1322101 - DNA, 22 bp, Artificial Sequence
  chemically synthesized
cttacctcaaaatgcccttgat

SEQ ID NO: 1322102 - DNA, 22 bp, Artificial Sequence
  chemically synthesized
atgtagttgggatcaagggcat

SEQ ID NO: 1322103 - DNA, 22 bp, Artificial Sequence
  chemically synthesized
acttacctcaaaatgcccttga

SEQ ID NO: 1322104 - DNA, 22 bp, Artificial Sequence
  chemically synthesized
tcttacttacctcaaaatgccc

SEQ ID NO: 1322105 - DNA, 22 bp, Artificial Sequence
  chemically synthesized
ggatcaagggcattttgaggta

SEQ ID NO: 1322106 - DNA, 22 bp, Artificial Sequence
  chemically synthesized
aaatctgtcttacttacctcaa

SEQ ID NO: 1322107 - DNA, 22 bp, Artificial Sequence
  chemically synthesized
acctaaaatctgtcttacttac

SEQ ID NO: 1322108 - DNA, 22 bp, Artificial Sequence
  chemically synthesized
aacctaaaatctgtcttactta

SEQ ID NO: 1322109 - DNA, 22 bp, Artificial Sequence
  chemically synthesized
taacctaaaatctgtcttactt

SEQ ID NO: 1322110 - DNA, 22 bp, Artificial Sequence
  chemically synthesized
tgaggtaagtaagacagatttt

SEQ ID NO: 1322111 - DNA, 22 bp, Artificial Sequence
  chemically synthesized
cccctttaacctaaaatctgtc

SEQ ID NO: 1322112 - DNA, 22 bp, Artificial Sequence
  chemically synthesized
gaggtaagtaagacagatttta

SEQ ID NO: 1322113 - DNA, 22 bp, Artificial Sequence
  chemically synthesized
aggtaagtaagacagattttag

SEQ ID NO: 1322114 - DNA, 22 bp, Artificial Sequence
  chemically synthesized
gctacccctttaacctaaaatc

SEQ ID NO: 1322115 - DNA, 22 bp, Artificial Sequence
  chemically synthesized
ggctacccctttaacctaaaat

SEQ ID NO: 1322116 - DNA, 22 bp, Artificial Sequence
  chemically synthesized
aaaatcttggctacccctttaa

SEQ ID NO: 1322117 - DNA, 22 bp, Artificial Sequence
  chemically synthesized
aaaaatcttggctaccccttta

SEQ ID NO: 1322118 - DNA, 22 bp, Artificial Sequence
  chemically synthesized
gaatttaaaaatcttggctacc

SEQ ID NO: 1322119 - DNA, 22 bp, Artificial Sequence
  chemically synthesized
taggttaaaggggtagccaaga

SEQ ID NO: 1322120 - DNA, 22 bp, Artificial Sequence
  chemically synthesized
agaatttaaaaatcttggctac

SEQ ID NO: 1322121 - DNA, 22 bp, Artificial Sequence
  chemically synthesized
aggttaaaggggtagccaagat

SEQ ID NO: 1322122 - DNA, 22 bp, Artificial Sequence
  chemically synthesized
ggttaaaggggtagccaagatt

SEQ ID NO: 1322123 - DNA, 22 bp, Artificial Sequence
  chemically synthesized
aaggggtagccaagatttttaa

SEQ ID NO: 1322124 - DNA, 22 bp, Artificial Sequence
  chemically synthesized
aaatatgtttagaatttaaaaa

SEQ ID NO: 1322125 - DNA, 22 bp, Artificial Sequence
  chemically synthesized
caaatatgtttagaatttaaaa

SEQ ID NO: 1322126 - DNA, 22 bp, Artificial Sequence
  chemically synthesized
tcaaatatgtttagaatttaaa

SEQ ID NO: 1322127 - DNA, 22 bp, Artificial Sequence
  chemically synthesized
ctttcaaatatgtttagaattt

SEQ ID NO: 1322128 - DNA, 22 bp, Artificial Sequence
  chemically synthesized
cctttcaaatatgtttagaatt

SEQ ID NO: 1322129 - DNA, 22 bp, Artificial Sequence
  chemically synthesized
tcctttcaaatatgtttagaat

SEQ ID NO: 1322130 - DNA, 22 bp, Artificial Sequence
  chemically synthesized
ttcctttcaaatatgtttagaa

SEQ ID NO: 1322131 - DNA, 22 bp, Artificial Sequence
  chemically synthesized
tttcctttcaaatatgtttaga

SEQ ID NO: 1322132 - DNA, 22 bp, Artificial Sequence
  chemically synthesized
ttaaattctaaacatatttgaa

SEQ ID NO: 1322133 - DNA, 22 bp, Artificial Sequence
  chemically synthesized
tgattttttcctttcaaatatg

SEQ ID NO: 1322134 - DNA, 22 bp, Artificial Sequence
  chemically synthesized
taaattctaaacatatttgaaa

SEQ ID NO: 1322135 - DNA, 22 bp, Artificial Sequence
  chemically synthesized
aaattctaaacatatttgaaag

SEQ ID NO: 1322136 - DNA, 22 bp, Artificial Sequence
  chemically synthesized
aattctaaacatatttgaaagg

SEQ ID NO: 1322137 - DNA, 22 bp, Artificial Sequence
  chemically synthesized
gattatgattttttcctttcaa

SEQ ID NO: 1322138 - DNA, 22 bp, Artificial Sequence
  chemically synthesized
taaacatatttgaaaggaaaaa

SEQ ID NO: 1322139 - DNA, 22 bp, Artificial Sequence
  chemically synthesized
aacatatttgaaaggaaaaaat

SEQ ID NO: 1322140 - DNA, 22 bp, Artificial Sequence
  chemically synthesized
gaaaggaaaaaatcataatcta

SEQ ID NO: 1322141 - DNA, 22 bp, Artificial Sequence
  chemically synthesized
aaaggaaaaaatcataatctaa

SEQ ID NO: 1322142 - DNA, 22 bp, Artificial Sequence
  chemically synthesized
taataaagagtaataaaaaatt

SEQ ID NO: 1322143 - DNA, 22 bp, Artificial Sequence
  chemically synthesized
gtaataaagagtaataaaaaat

SEQ ID NO: 1322144 - DNA, 22 bp, Artificial Sequence
  chemically synthesized
tgtaataaagagtaataaaaaa

SEQ ID NO: 1322145 - DNA, 22 bp, Artificial Sequence
  chemically synthesized
ttgtaataaagagtaataaaaa

SEQ ID NO: 1322146 - DNA, 22 bp, Artificial Sequence
  chemically synthesized
tttttgtaataaagagtaataa

SEQ ID NO: 1322147 - DNA, 22 bp, Artificial Sequence
  chemically synthesized
gtttttgtaataaagagtaata

SEQ ID NO: 1322148 - DNA, 22 bp, Artificial Sequence
  chemically synthesized
attttttattactctttattac

SEQ ID NO: 1322149 - DNA, 22 bp, Artificial Sequence
  chemically synthesized
tttattactctttattacaaaa

SEQ ID NO: 1322150 - DNA, 22 bp, Artificial Sequence
  chemically synthesized
ttattactctttattacaaaaa

SEQ ID NO: 1322151 - DNA, 22 bp, Artificial Sequence
  chemically synthesized
aaaccaaatttgtttttgtaat

SEQ ID NO: 1322152 - DNA, 22 bp, Artificial Sequence
  chemically synthesized
tattactctttattacaaaaac

SEQ ID NO: 1322153 - DNA, 22 bp, Artificial Sequence
  chemically synthesized
aaaaccaaatttgtttttgtaa

SEQ ID NO: 1322154 - DNA, 22 bp, Artificial Sequence
  chemically synthesized
attactctttattacaaaaaca

SEQ ID NO: 1322155 - DNA, 22 bp, Artificial Sequence
  chemically synthesized
taaaaccaaatttgtttttgta

SEQ ID NO: 1322156 - DNA, 22 bp, Artificial Sequence
  chemically synthesized
ttactctttattacaaaaacaa

SEQ ID NO: 1322157 - DNA, 22 bp, Artificial Sequence
  chemically synthesized
ctctttattacaaaaacaaatt

SEQ ID NO: 1322158 - DNA, 22 bp, Artificial Sequence
  chemically synthesized
atctttaaaaccaaatttgttt

SEQ ID NO: 1322159 - DNA, 22 bp, Artificial Sequence
  chemically synthesized
tttattacaaaaacaaatttgg

SEQ ID NO: 1322160 - DNA, 22 bp, Artificial Sequence
  chemically synthesized
ttgatctttaaaaccaaatttg

SEQ ID NO: 1322161 - DNA, 22 bp, Artificial Sequence
  chemically synthesized
tattacaaaaacaaatttggtt

SEQ ID NO: 1322162 - DNA, 22 bp, Artificial Sequence
  chemically synthesized
attgatctttaaaaccaaattt

SEQ ID NO: 1322163 - DNA, 22 bp, Artificial Sequence
  chemically synthesized
attacaaaaacaaatttggttt

SEQ ID NO: 1322164 - DNA, 22 bp, Artificial Sequence
  chemically synthesized
ttacaaaaacaaatttggtttt

SEQ ID NO: 1322165 - DNA, 22 bp, Artificial Sequence
  chemically synthesized
caaaaacaaatttggttttaaa

SEQ ID NO: 1322166 - DNA, 22 bp, Artificial Sequence
  chemically synthesized
aaaatgtagtttattgatcttt

SEQ ID NO: 1322167 - DNA, 22 bp, Artificial Sequence
  chemically synthesized
tattaaaaatgtagtttattga

SEQ ID NO: 1322168 - DNA, 22 bp, Artificial Sequence
  chemically synthesized
ggttttaaagatcaataaacta

SEQ ID NO: 1322169 - DNA, 22 bp, Artificial Sequence
  chemically synthesized
gtattaaaaatgtagtttattg

SEQ ID NO: 1322170 - DNA, 22 bp, Artificial Sequence
  chemically synthesized
gttttaaagatcaataaactac

SEQ ID NO: 1322171 - DNA, 22 bp, Artificial Sequence
  chemically synthesized
tgtattaaaaatgtagtttatt

SEQ ID NO: 1322172 - DNA, 22 bp, Artificial Sequence
  chemically synthesized
ctttgtattaaaaatgtagttt

SEQ ID NO: 1322173 - DNA, 22 bp, Artificial Sequence
  chemically synthesized
taaagatcaataaactacattt

SEQ ID NO: 1322174 - DNA, 22 bp, Artificial Sequence
  chemically synthesized
aaagatcaataaactacatttt

SEQ ID NO: 1322175 - DNA, 22 bp, Artificial Sequence
  chemically synthesized
aagatcaataaactacattttt

SEQ ID NO: 1322176 - DNA, 22 bp, Artificial Sequence
  chemically synthesized
tatatactactttgtattaaaa

SEQ ID NO: 1322177 - DNA, 22 bp, Artificial Sequence
  chemically synthesized
catttttaatacaaagtagtat

SEQ ID NO: 1322178 - DNA, 22 bp, Artificial Sequence
  chemically synthesized
catgcatattgtatatactact

SEQ ID NO: 1322179 - DNA, 22 bp, Artificial Sequence
  chemically synthesized
ttaatacaaagtagtatataca

SEQ ID NO: 1322180 - DNA, 22 bp, Artificial Sequence
  chemically synthesized
taatacaaagtagtatatacaa

SEQ ID NO: 1322181 - DNA, 22 bp, Artificial Sequence
  chemically synthesized
aatacaaagtagtatatacaat

SEQ ID NO: 1322182 - DNA, 22 bp, Artificial Sequence
  chemically synthesized
atacaaagtagtatatacaata

SEQ ID NO: 1322183 - DNA, 22 bp, Artificial Sequence
  chemically synthesized
aaatagcaaaaggtaattacat

SEQ ID NO: 1322184 - DNA, 22 bp, Artificial Sequence
  chemically synthesized
gaaatagcaaaaggtaattaca

SEQ ID NO: 1322185 - DNA, 22 bp, Artificial Sequence
  chemically synthesized
ccttttgctatttcaagctttg

SEQ ID NO: 1322186 - DNA, 22 bp, Artificial Sequence
  chemically synthesized
tatgcacacagagcaaagcttg

SEQ ID NO: 1322187 - DNA, 22 bp, Artificial Sequence
  chemically synthesized
gtatgcacacagagcaaagctt

SEQ ID NO: 1322188 - DNA, 22 bp, Artificial Sequence
  chemically synthesized
ttgctatttcaagctttgctct

SEQ ID NO: 1322189 - DNA, 22 bp, Artificial Sequence
  chemically synthesized
tgctatttcaagctttgctctg

SEQ ID NO: 1322190 - DNA, 22 bp, Artificial Sequence
  chemically synthesized
gctatttcaagctttgctctgt

SEQ ID NO: 1322191 - DNA, 22 bp, Artificial Sequence
  chemically synthesized
ctatttcaagctttgctctgtg

SEQ ID NO: 1322192 - DNA, 22 bp, Artificial Sequence
  chemically synthesized
tttcaagctttgctctgtgtgc

SEQ ID NO: 1322193 - DNA, 22 bp, Artificial Sequence
  chemically synthesized
atatatttgtatgcacacagag

SEQ ID NO: 1322194 - DNA, 22 bp, Artificial Sequence
  chemically synthesized
caagctttgctctgtgtgcata

SEQ ID NO: 1322195 - DNA, 22 bp, Artificial Sequence
  chemically synthesized
aagctttgctctgtgtgcatac

SEQ ID NO: 1322196 - DNA, 22 bp, Artificial Sequence
  chemically synthesized
tgctctgtgtgcatacaaatat

SEQ ID NO: 1322197 - DNA, 22 bp, Artificial Sequence
  chemically synthesized
gctctgtgtgcatacaaatata

SEQ ID NO: 1322198 - DNA, 22 bp, Artificial Sequence
  chemically synthesized
ctctgtgtgcatacaaatatat

SEQ ID NO: 1322199 - DNA, 22 bp, Artificial Sequence
  chemically synthesized
tatatgtgtattgatatatttg

SEQ ID NO: 1322200 - DNA, 22 bp, Artificial Sequence
  chemically synthesized
tgtgtgcatacaaatatatcaa

SEQ ID NO: 1322201 - DNA, 22 bp, Artificial Sequence
  chemically synthesized
tgtgcatacaaatatatcaata

SEQ ID NO: 1322202 - DNA, 22 bp, Artificial Sequence
  chemically synthesized
aaaattatatatgtgtattgat

SEQ ID NO: 1322203 - DNA, 22 bp, Artificial Sequence
  chemically synthesized
aaaaattatatatgtgtattga

SEQ ID NO: 1322204 - DNA, 22 bp, Artificial Sequence
  chemically synthesized
taaaaattatatatgtgtattg

SEQ ID NO: 1322205 - DNA, 22 bp, Artificial Sequence
  chemically synthesized
tgtattttaaaaattatatatg

SEQ ID NO: 1322206 - DNA, 22 bp, Artificial Sequence
  chemically synthesized
atgtattttaaaaattatatat

SEQ ID NO: 1322207 - DNA, 22 bp, Artificial Sequence
  chemically synthesized
tatgtattttaaaaattatata

SEQ ID NO: 1322208 - DNA, 22 bp, Artificial Sequence
  chemically synthesized
agattttatgtattttaaaaat

SEQ ID NO: 1322209 - DNA, 22 bp, Artificial Sequence
  chemically synthesized
tacacattaagattttatgtat

SEQ ID NO: 1322210 - DNA, 22 bp, Artificial Sequence
  chemically synthesized
ttaaaatacataaaatcttaat

SEQ ID NO: 1322211 - DNA, 22 bp, Artificial Sequence
  chemically synthesized
taaaatacataaaatcttaatg

SEQ ID NO: 1322212 - DNA, 22 bp, Artificial Sequence
  chemically synthesized
aaaatacataaaatcttaatgt

SEQ ID NO: 1322213 - DNA, 22 bp, Artificial Sequence
  chemically synthesized
aaatacataaaatcttaatgtg

SEQ ID NO: 1322214 - DNA, 22 bp, Artificial Sequence
  chemically synthesized
tcatatgtgtgttgtacacatt

SEQ ID NO: 1322215 - DNA, 22 bp, Artificial Sequence
  chemically synthesized
aaaacgttgtcatatgtgtgtt

SEQ ID NO: 1322216 - DNA, 22 bp, Artificial Sequence
  chemically synthesized
aatgtgtacaacacacatatga

SEQ ID NO: 1322217 - DNA, 22 bp, Artificial Sequence
  chemically synthesized
atgtgtacaacacacatatgac

SEQ ID NO: 1322218 - DNA, 22 bp, Artificial Sequence
  chemically synthesized
aatattcaaaacgttgtcatat

SEQ ID NO: 1322219 - DNA, 22 bp, Artificial Sequence
  chemically synthesized
aaatattcaaaacgttgtcata

SEQ ID NO: 1322220 - DNA, 22 bp, Artificial Sequence
  chemically synthesized
tttaaatattcaaaacgttgtc

SEQ ID NO: 1322221 - DNA, 22 bp, Artificial Sequence
  chemically synthesized
gtttaaatattcaaaacgttgt

SEQ ID NO: 1322222 - DNA, 22 bp, Artificial Sequence
  chemically synthesized
tgtttaaatattcaaaacgttg

SEQ ID NO: 1322223 - DNA, 22 bp, Artificial Sequence
  chemically synthesized
ttgtttaaatattcaaaacgtt

SEQ ID NO: 1322224 - DNA, 22 bp, Artificial Sequence
  chemically synthesized
cttttgtttaaatattcaaaac

SEQ ID NO: 1322225 - DNA, 22 bp, Artificial Sequence
  chemically synthesized
gcttttgtttaaatattcaaaa

SEQ ID NO: 1322226 - DNA, 22 bp, Artificial Sequence
  chemically synthesized
gcaagtcatttgcttttgttta

SEQ ID NO: 1322227 - DNA, 22 bp, Artificial Sequence
  chemically synthesized
agcaagtcatttgcttttgttt

SEQ ID NO: 1322228 - DNA, 22 bp, Artificial Sequence
  chemically synthesized
tgaatatttaaacaaaagcaaa

SEQ ID NO: 1322229 - DNA, 22 bp, Artificial Sequence
  chemically synthesized
gaatatttaaacaaaagcaaat

SEQ ID NO: 1322230 - DNA, 22 bp, Artificial Sequence
  chemically synthesized
aatatttaaacaaaagcaaatg

SEQ ID NO: 1322231 - DNA, 22 bp, Artificial Sequence
  chemically synthesized
caatttagcaagtcatttgctt

SEQ ID NO: 1322232 - DNA, 22 bp, Artificial Sequence
  chemically synthesized
gcaatttagcaagtcatttgct

SEQ ID NO: 1322233 - DNA, 22 bp, Artificial Sequence
  chemically synthesized
aaacaaaagcaaatgacttgct

SEQ ID NO: 1322234 - DNA, 22 bp, Artificial Sequence
  chemically synthesized
aacaaaagcaaatgacttgcta

SEQ ID NO: 1322235 - DNA, 22 bp, Artificial Sequence
  chemically synthesized
catatgtacatatttgcaattt

SEQ ID NO: 1322236 - DNA, 22 bp, Artificial Sequence
  chemically synthesized
ccatatgtacatatttgcaatt

SEQ ID NO: 1322237 - DNA, 22 bp, Artificial Sequence
  chemically synthesized
tccatatgtacatatttgcaat

SEQ ID NO: 1322238 - DNA, 22 bp, Artificial Sequence
  chemically synthesized
ttttccatatgtacatatttgc

SEQ ID NO: 1322239 - DNA, 22 bp, Artificial Sequence
  chemically synthesized
gctaaattgcaaatatgtacat

SEQ ID NO: 1322240 - DNA, 22 bp, Artificial Sequence
  chemically synthesized
ctaaattgcaaatatgtacata

SEQ ID NO: 1322241 - DNA, 22 bp, Artificial Sequence
  chemically synthesized
aattgcaaatatgtacatatgg

SEQ ID NO: 1322242 - DNA, 22 bp, Artificial Sequence
  chemically synthesized
caaatatgtacatatggaaaat

SEQ ID NO: 1322243 - DNA, 22 bp, Artificial Sequence
  chemically synthesized
catgagcaaatatatctatttt

SEQ ID NO: 1322244 - DNA, 22 bp, Artificial Sequence
  chemically synthesized
aaaagcagttgcatgagcaaat

SEQ ID NO: 1322245 - DNA, 22 bp, Artificial Sequence
  chemically synthesized
aaaaagcagttgcatgagcaaa

SEQ ID NO: 1322246 - DNA, 22 bp, Artificial Sequence
  chemically synthesized
taaaaagcagttgcatgagcaa

SEQ ID NO: 1322247 - DNA, 22 bp, Artificial Sequence
  chemically synthesized
gctcatgcaactgctttttaaa

SEQ ID NO: 1322248 - DNA, 22 bp, Artificial Sequence
  chemically synthesized
ctcatgcaactgctttttaaaa

SEQ ID NO: 1322249 - DNA, 22 bp, Artificial Sequence
  chemically synthesized
atgcaactgctttttaaaattc

SEQ ID NO: 1322250 - DNA, 22 bp, Artificial Sequence
  chemically synthesized
gcagaagtaatggaattttaaa

SEQ ID NO: 1322251 - DNA, 22 bp, Artificial Sequence
  chemically synthesized
ggcagaagtaatggaattttaa

SEQ ID NO: 1322252 - DNA, 22 bp, Artificial Sequence
  chemically synthesized
atttggcagaagtaatggaatt

SEQ ID NO: 1322253 - DNA, 22 bp, Artificial Sequence
  chemically synthesized
gatttggcagaagtaatggaat

SEQ ID NO: 1322254 - DNA, 22 bp, Artificial Sequence
  chemically synthesized
ctttttaaaattccattacttc

SEQ ID NO: 1322255 - DNA, 22 bp, Artificial Sequence
  chemically synthesized
cttgatttggcagaagtaatgg

SEQ ID NO: 1322256 - DNA, 22 bp, Artificial Sequence
  chemically synthesized
tttaaaattccattacttctgc

SEQ ID NO: 1322257 - DNA, 22 bp, Artificial Sequence
  chemically synthesized
ttaaaattccattacttctgcc

SEQ ID NO: 1322258 - DNA, 22 bp, Artificial Sequence
  chemically synthesized
taaaattccattacttctgcca

SEQ ID NO: 1322259 - DNA, 22 bp, Artificial Sequence
  chemically synthesized
aaaattccattacttctgccaa

SEQ ID NO: 1322260 - DNA, 22 bp, Artificial Sequence
  chemically synthesized
aaattccattacttctgccaaa

SEQ ID NO: 1322261 - DNA, 22 bp, Artificial Sequence
  chemically synthesized
cattacttctgccaaatcaagc

SEQ ID NO: 1322262 - DNA, 22 bp, Artificial Sequence
  chemically synthesized
cttctgccaaatcaagcaacac

SEQ ID NO: 1322263 - DNA, 22 bp, Artificial Sequence
  chemically synthesized
taccacccgtgtgagtgttgct

SEQ ID NO: 1322264 - DNA, 22 bp, Artificial Sequence
  chemically synthesized
ctgccaaatcaagcaacactca

SEQ ID NO: 1322265 - DNA, 22 bp, Artificial Sequence
  chemically synthesized
ataccacccgtgtgagtgttgc

SEQ ID NO: 1322266 - DNA, 22 bp, Artificial Sequence
  chemically synthesized
tgccaaatcaagcaacactcac

SEQ ID NO: 1322267 - DNA, 22 bp, Artificial Sequence
  chemically synthesized
ccaaatcaagcaacactcacac

SEQ ID NO: 1322268 - DNA, 22 bp, Artificial Sequence
  chemically synthesized
tgtacttataccacccgtgtga

SEQ ID NO: 1322269 - DNA, 22 bp, Artificial Sequence
  chemically synthesized
tgtgtacttataccacccgtgt

SEQ ID NO: 1322270 - DNA, 22 bp, Artificial Sequence
  chemically synthesized
ctgtgtacttataccacccgtg

SEQ ID NO: 1322271 - DNA, 22 bp, Artificial Sequence
  chemically synthesized
tttctgtgtacttataccaccc

SEQ ID NO: 1322272 - DNA, 22 bp, Artificial Sequence
  chemically synthesized
gctatttctgtgtacttatacc

SEQ ID NO: 1322273 - DNA, 22 bp, Artificial Sequence
  chemically synthesized
ttcgctatttctgtgtacttat

SEQ ID NO: 1322274 - DNA, 22 bp, Artificial Sequence
  chemically synthesized
acacgggtggtataagtacaca

SEQ ID NO: 1322275 - DNA, 22 bp, Artificial Sequence
  chemically synthesized
tgttgttcgctatttctgtgta

SEQ ID NO: 1322276 - DNA, 22 bp, Artificial Sequence
  chemically synthesized
atgttgttcgctatttctgtgt

SEQ ID NO: 1322277 - DNA, 22 bp, Artificial Sequence
  chemically synthesized
acatttatgttgttcgctattt

SEQ ID NO: 1322278 - DNA, 22 bp, Artificial Sequence
  chemically synthesized
tgaatgctaacatttatgttgt

SEQ ID NO: 1322279 - DNA, 22 bp, Artificial Sequence
  chemically synthesized
atctatgaatgctaacatttat

SEQ ID NO: 1322280 - DNA, 22 bp, Artificial Sequence
  chemically synthesized
ccataaaaggctgatctatgaa

SEQ ID NO: 1322281 - DNA, 22 bp, Artificial Sequence
  chemically synthesized
cattcccataaaaggctgatct

SEQ ID NO: 1322282 - DNA, 22 bp, Artificial Sequence
  chemically synthesized
gcattcatagatcagcctttta

SEQ ID NO: 1322283 - DNA, 22 bp, Artificial Sequence
  chemically synthesized
atagatcagccttttatgggaa

SEQ ID NO: 1322284 - DNA, 22 bp, Artificial Sequence
  chemically synthesized
tacatgaaaaattacattccca

SEQ ID NO: 1322285 - DNA, 22 bp, Artificial Sequence
  chemically synthesized
ttatgggaatgtaatttttcat

SEQ ID NO: 1322286 - DNA, 22 bp, Artificial Sequence
  chemically synthesized
agtgaattgtacatgaaaaatt

SEQ ID NO: 1322287 - DNA, 22 bp, Artificial Sequence
  chemically synthesized
tatgggaatgtaatttttcatg

SEQ ID NO: 1322288 - DNA, 22 bp, Artificial Sequence
  chemically synthesized
atgggaatgtaatttttcatgt

SEQ ID NO: 1322289 - DNA, 22 bp, Artificial Sequence
  chemically synthesized
tgggaatgtaatttttcatgta

SEQ ID NO: 1322290 - DNA, 22 bp, Artificial Sequence
  chemically synthesized
atatgttgagtgaattgtacat

SEQ ID NO: 1322291 - DNA, 22 bp, Artificial Sequence
  chemically synthesized
aatatgttgagtgaattgtaca

SEQ ID NO: 1322292 - DNA, 22 bp, Artificial Sequence
  chemically synthesized
taatatgttgagtgaattgtac

SEQ ID NO: 1322293 - DNA, 22 bp, Artificial Sequence
  chemically synthesized
ttttaatatgttgagtgaattg

SEQ ID NO: 1322294 - DNA, 22 bp, Artificial Sequence
  chemically synthesized
ttcatgtacaattcactcaaca

SEQ ID NO: 1322295 - DNA, 22 bp, Artificial Sequence
  chemically synthesized
tcatgtacaattcactcaacat

SEQ ID NO: 1322296 - DNA, 22 bp, Artificial Sequence
  chemically synthesized
catgtacaattcactcaacata

SEQ ID NO: 1322297 - DNA, 22 bp, Artificial Sequence
  chemically synthesized
atgtacaattcactcaacatat

SEQ ID NO: 1322298 - DNA, 22 bp, Artificial Sequence
  chemically synthesized
actcaacatattaaaacaatct

SEQ ID NO: 1322299 - DNA, 22 bp, Artificial Sequence
  chemically synthesized
aacatattaaaacaatcttttt

SEQ ID NO: 1322300 - DNA, 22 bp, Artificial Sequence
  chemically synthesized
aaacaatctttttatgtccctt

SEQ ID NO: 1322301 - DNA, 22 bp, Artificial Sequence
  chemically synthesized
ataaaaccataacaagggacat

SEQ ID NO: 1322302 - DNA, 22 bp, Artificial Sequence
  chemically synthesized
tctgataaaaccataacaaggg

SEQ ID NO: 1322303 - DNA, 22 bp, Artificial Sequence
  chemically synthesized
gtctgataaaaccataacaagg

SEQ ID NO: 1322304 - DNA, 22 bp, Artificial Sequence
  chemically synthesized
cttgtctgataaaaccataaca

SEQ ID NO: 1322305 - DNA, 22 bp, Artificial Sequence
  chemically synthesized
tttatgtcccttgttatggttt

SEQ ID NO: 1322306 - DNA, 22 bp, Artificial Sequence
  chemically synthesized
ttatgtcccttgttatggtttt

SEQ ID NO: 1322307 - DNA, 22 bp, Artificial Sequence
  chemically synthesized
tgcttgtctgataaaaccataa

SEQ ID NO: 1322308 - DNA, 22 bp, Artificial Sequence
  chemically synthesized
tatgtcccttgttatggtttta

SEQ ID NO: 1322309 - DNA, 22 bp, Artificial Sequence
  chemically synthesized
atgtcccttgttatggttttat

SEQ ID NO: 1322310 - DNA, 22 bp, Artificial Sequence
  chemically synthesized
tgtcccttgttatggttttatc

SEQ ID NO: 1322311 - DNA, 22 bp, Artificial Sequence
  chemically synthesized
ttctgcttgtctgataaaacca

SEQ ID NO: 1322312 - DNA, 22 bp, Artificial Sequence
  chemically synthesized
aaattgttctgcttgtctgata

SEQ ID NO: 1322313 - DNA, 22 bp, Artificial Sequence
  chemically synthesized
gaaattgttctgcttgtctgat

SEQ ID NO: 1322314 - DNA, 22 bp, Artificial Sequence
  chemically synthesized
gttatggttttatcagacaagc

SEQ ID NO: 1322315 - DNA, 22 bp, Artificial Sequence
  chemically synthesized
ttatggttttatcagacaagca

SEQ ID NO: 1322316 - DNA, 22 bp, Artificial Sequence
  chemically synthesized
ccttgaaattgttctgcttgtc

SEQ ID NO: 1322317 - DNA, 22 bp, Artificial Sequence
  chemically synthesized
tggttttatcagacaagcagaa

SEQ ID NO: 1322318 - DNA, 22 bp, Artificial Sequence
  chemically synthesized
ggttcccttgaaattgttctgc

SEQ ID NO: 1322319 - DNA, 22 bp, Artificial Sequence
  chemically synthesized
aggttcccttgaaattgttctg

SEQ ID NO: 1322320 - DNA, 22 bp, Artificial Sequence
  chemically synthesized
tatcagacaagcagaacaattt

SEQ ID NO: 1322321 - DNA, 22 bp, Artificial Sequence
  chemically synthesized
atcagacaagcagaacaatttc

SEQ ID NO: 1322322 - DNA, 22 bp, Artificial Sequence
  chemically synthesized
ttaggttcccttgaaattgttc

SEQ ID NO: 1322323 - DNA, 22 bp, Artificial Sequence
  chemically synthesized
tcagacaagcagaacaatttca

SEQ ID NO: 1322324 - DNA, 22 bp, Artificial Sequence
  chemically synthesized
ctcttaggttcccttgaaattg

SEQ ID NO: 1322325 - DNA, 22 bp, Artificial Sequence
  chemically synthesized
atagtctactcttaggttccct

SEQ ID NO: 1322326 - DNA, 22 bp, Artificial Sequence
  chemically synthesized
atattgatagtctactcttagg

SEQ ID NO: 1322327 - DNA, 22 bp, Artificial Sequence
  chemically synthesized
caagggaacctaagagtagact

SEQ ID NO: 1322328 - DNA, 22 bp, Artificial Sequence
  chemically synthesized
aagggaacctaagagtagacta

SEQ ID NO: 1322329 - DNA, 22 bp, Artificial Sequence
  chemically synthesized
agagtagactatcaatattagt

SEQ ID NO: 1322330 - DNA, 22 bp, Artificial Sequence
  chemically synthesized
taaacacaacatgagcaatgac

SEQ ID NO: 1322331 - DNA, 22 bp, Artificial Sequence
  chemically synthesized
tcaatattagtcattgctcatg

SEQ ID NO: 1322332 - DNA, 22 bp, Artificial Sequence
  chemically synthesized
ctgtaaacacaacatgagcaat

SEQ ID NO: 1322333 - DNA, 22 bp, Artificial Sequence
  chemically synthesized
cctgtaaacacaacatgagcaa

SEQ ID NO: 1322334 - DNA, 22 bp, Artificial Sequence
  chemically synthesized
gtcattgctcatgttgtgttta

SEQ ID NO: 1322335 - DNA, 22 bp, Artificial Sequence
  chemically synthesized
gtgaacttcctgtaaacacaac

SEQ ID NO: 1322336 - DNA, 22 bp, Artificial Sequence
  chemically synthesized
ctcatgttgtgtttacaggaag

SEQ ID NO: 1322337 - DNA, 22 bp, Artificial Sequence
  chemically synthesized
atgttgtgtttacaggaagttc

SEQ ID NO: 1322338 - DNA, 22 bp, Artificial Sequence
  chemically synthesized
tgtttacaggaagttcactaat

SEQ ID NO: 1322339 - DNA, 22 bp, Artificial Sequence
  chemically synthesized
acaggaagttcactaatttaca

SEQ ID NO: 1322340 - DNA, 22 bp, Artificial Sequence
  chemically synthesized
atataaatcgaatgtaaattag

SEQ ID NO: 1322341 - DNA, 22 bp, Artificial Sequence
  chemically synthesized
caggaagttcactaatttacat

SEQ ID NO: 1322342 - DNA, 22 bp, Artificial Sequence
  chemically synthesized
ttaatataaatcgaatgtaaat

SEQ ID NO: 1322343 - DNA, 22 bp, Artificial Sequence
  chemically synthesized
attattaatataaatcgaatgt

SEQ ID NO: 1322344 - DNA, 22 bp, Artificial Sequence
  chemically synthesized
gattattaatataaatcgaatg

SEQ ID NO: 1322345 - DNA, 22 bp, Artificial Sequence
  chemically synthesized
ttgattattaatataaatcgaa

SEQ ID NO: 1322346 - DNA, 22 bp, Artificial Sequence
  chemically synthesized
actaatttacattcgatttata

SEQ ID NO: 1322347 - DNA, 22 bp, Artificial Sequence
  chemically synthesized
atttacattcgatttatattaa

SEQ ID NO: 1322348 - DNA, 22 bp, Artificial Sequence
  chemically synthesized
cactcttgattattaatataaa

SEQ ID NO: 1322349 - DNA, 22 bp, Artificial Sequence
  chemically synthesized
acattcgatttatattaataat

SEQ ID NO: 1322350 - DNA, 22 bp, Artificial Sequence
  chemically synthesized
cattcgatttatattaataatc

SEQ ID NO: 1322351 - DNA, 22 bp, Artificial Sequence
  chemically synthesized
cagttccactcttgattattaa

SEQ ID NO: 1322352 - DNA, 22 bp, Artificial Sequence
  chemically synthesized
gatttatattaataatcaagag

SEQ ID NO: 1322353 - DNA, 22 bp, Artificial Sequence
  chemically synthesized
attgcagttccactcttgatta

SEQ ID NO: 1322354 - DNA, 22 bp, Artificial Sequence
  chemically synthesized
cattgcagttccactcttgatt

SEQ ID NO: 1322355 - DNA, 22 bp, Artificial Sequence
  chemically synthesized
atattaataatcaagagtggaa

SEQ ID NO: 1322356 - DNA, 22 bp, Artificial Sequence
  chemically synthesized
tattaataatcaagagtggaac

SEQ ID NO: 1322357 - DNA, 22 bp, Artificial Sequence
  chemically synthesized
cacttcattgcagttccactct

SEQ ID NO: 1322358 - DNA, 22 bp, Artificial Sequence
  chemically synthesized
gcacttcattgcagttccactc

SEQ ID NO: 1322359 - DNA, 22 bp, Artificial Sequence
  chemically synthesized
ataatcaagagtggaactgcaa

SEQ ID NO: 1322360 - DNA, 22 bp, Artificial Sequence
  chemically synthesized
aaaagaaagtttgcacttcatt

SEQ ID NO: 1322361 - DNA, 22 bp, Artificial Sequence
  chemically synthesized
caatgaagtgcaaactttcttt

SEQ ID NO: 1322362 - DNA, 22 bp, Artificial Sequence
  chemically synthesized
cagaaaagagaattaaaaagaa

SEQ ID NO: 1322363 - DNA, 22 bp, Artificial Sequence
  chemically synthesized
tacactacagaaaagagaatta

SEQ ID NO: 1322364 - DNA, 22 bp, Artificial Sequence
  chemically synthesized
gtacactacagaaaagagaatt

SEQ ID NO: 1322365 - DNA, 22 bp, Artificial Sequence
  chemically synthesized
tctttttaattctcttttctgt

SEQ ID NO: 1322366 - DNA, 22 bp, Artificial Sequence
  chemically synthesized
ctttttaattctcttttctgta

SEQ ID NO: 1322367 - DNA, 22 bp, Artificial Sequence
  chemically synthesized
tttttaattctcttttctgtag

SEQ ID NO: 1322368 - DNA, 22 bp, Artificial Sequence
  chemically synthesized
tttaattctcttttctgtagtg

SEQ ID NO: 1322369 - DNA, 22 bp, Artificial Sequence
  chemically synthesized
ttaattctcttttctgtagtgt

SEQ ID NO: 1322370 - DNA, 22 bp, Artificial Sequence
  chemically synthesized
taattctcttttctgtagtgta

SEQ ID NO: 1322371 - DNA, 22 bp, Artificial Sequence
  chemically synthesized
aattctcttttctgtagtgtac

SEQ ID NO: 1322372 - DNA, 22 bp, Artificial Sequence
  chemically synthesized
atacatgagtttgtacactaca

SEQ ID NO: 1322373 - DNA, 22 bp, Artificial Sequence
  chemically synthesized
attctcttttctgtagtgtaca

SEQ ID NO: 1322374 - DNA, 22 bp, Artificial Sequence
  chemically synthesized
ctgatacatgagtttgtacact

SEQ ID NO: 1322375 - DNA, 22 bp, Artificial Sequence
  chemically synthesized
tcttttctgtagtgtacaaact

SEQ ID NO: 1322376 - DNA, 22 bp, Artificial Sequence
  chemically synthesized
ttttctgtagtgtacaaactca

SEQ ID NO: 1322377 - DNA, 22 bp, Artificial Sequence
  chemically synthesized
ttctgtagtgtacaaactcatg

SEQ ID NO: 1322378 - DNA, 22 bp, Artificial Sequence
  chemically synthesized
tctgtagtgtacaaactcatgt

SEQ ID NO: 1322379 - DNA, 22 bp, Artificial Sequence
  chemically synthesized
ctgtagtgtacaaactcatgta

SEQ ID NO: 1322380 - DNA, 22 bp, Artificial Sequence
  chemically synthesized
tgtagtgtacaaactcatgtat

SEQ ID NO: 1322381 - DNA, 22 bp, Artificial Sequence
  chemically synthesized
tagtgtacaaactcatgtatca

SEQ ID NO: 1322382 - DNA, 22 bp, Artificial Sequence
  chemically synthesized
atagcccccaaagctactgata

SEQ ID NO: 1322383 - DNA, 22 bp, Artificial Sequence
  chemically synthesized
atgtatcagtagctttgggggc

SEQ ID NO: 1322384 - DNA, 22 bp, Artificial Sequence
  chemically synthesized
gaggtagtgctaatagccccca

SEQ ID NO: 1322385 - DNA, 22 bp, Artificial Sequence
  chemically synthesized
tggaggtagtgctaatagcccc

SEQ ID NO: 1322386 - DNA, 22 bp, Artificial Sequence
  chemically synthesized
tattctggaggtagtgctaata

SEQ ID NO: 1322387 - DNA, 22 bp, Artificial Sequence
  chemically synthesized
atattctggaggtagtgctaat

SEQ ID NO: 1322388 - DNA, 22 bp, Artificial Sequence
  chemically synthesized
tgggggctattagcactacctc

SEQ ID NO: 1322389 - DNA, 22 bp, Artificial Sequence
  chemically synthesized
gggggctattagcactacctcc

SEQ ID NO: 1322390 - DNA, 22 bp, Artificial Sequence
  chemically synthesized
ggggctattagcactacctcca

SEQ ID NO: 1322391 - DNA, 22 bp, Artificial Sequence
  chemically synthesized
ttagcactacctccagaatata

SEQ ID NO: 1322392 - DNA, 22 bp, Artificial Sequence
  chemically synthesized
aaatatgacaggtttatattct

SEQ ID NO: 1322393 - DNA, 22 bp, Artificial Sequence
  chemically synthesized
gcactacctccagaatataaac

SEQ ID NO: 1322394 - DNA, 22 bp, Artificial Sequence
  chemically synthesized
aaaatatgacaggtttatattc

SEQ ID NO: 1322395 - DNA, 22 bp, Artificial Sequence
  chemically synthesized
cctccagaatataaacctgtca

SEQ ID NO: 1322396 - DNA, 22 bp, Artificial Sequence
  chemically synthesized
cagaatataaacctgtcatatt

SEQ ID NO: 1322397 - DNA, 22 bp, Artificial Sequence
  chemically synthesized
aaatgaggcaaatttaaaatat

SEQ ID NO: 1322398 - DNA, 22 bp, Artificial Sequence
  chemically synthesized
tgaaatgaggcaaatttaaaat

SEQ ID NO: 1322399 - DNA, 22 bp, Artificial Sequence
  chemically synthesized
ctgaaatgaggcaaatttaaaa

SEQ ID NO: 1322400 - DNA, 22 bp, Artificial Sequence
  chemically synthesized
tcatattttaaatttgcctcat

SEQ ID NO: 1322401 - DNA, 22 bp, Artificial Sequence
  chemically synthesized
taaatttgcctcatttcagaag

SEQ ID NO: 1322402 - DNA, 22 bp, Artificial Sequence
  chemically synthesized
aaatttgcctcatttcagaagt

SEQ ID NO: 1322403 - DNA, 22 bp, Artificial Sequence
  chemically synthesized
aatttgcctcatttcagaagtt

SEQ ID NO: 1322404 - DNA, 22 bp, Artificial Sequence
  chemically synthesized
aatataagaagacaaaacttct

SEQ ID NO: 1322405 - DNA, 22 bp, Artificial Sequence
  chemically synthesized
gaatataagaagacaaaacttc

SEQ ID NO: 1322406 - DNA, 22 bp, Artificial Sequence
  chemically synthesized
gcctcatttcagaagttttgtc

SEQ ID NO: 1322407 - DNA, 22 bp, Artificial Sequence
  chemically synthesized
tgaatataagaagacaaaactt

SEQ ID NO: 1322408 - DNA, 22 bp, Artificial Sequence
  chemically synthesized
cctcatttcagaagttttgtct

SEQ ID NO: 1322409 - DNA, 22 bp, Artificial Sequence
  chemically synthesized
ctttgaatataagaagacaaaa

SEQ ID NO: 1322410 - DNA, 22 bp, Artificial Sequence
  chemically synthesized
atttcagaagttttgtcttctt

SEQ ID NO: 1322411 - DNA, 22 bp, Artificial Sequence
  chemically synthesized
cagaagttttgtcttcttatat

SEQ ID NO: 1322412 - DNA, 22 bp, Artificial Sequence
  chemically synthesized
agaagttttgtcttcttatatt

SEQ ID NO: 1322413 - DNA, 22 bp, Artificial Sequence
  chemically synthesized
tgtcttcttatattcaaaggag

SEQ ID NO: 1322414 - DNA, 22 bp, Artificial Sequence
  chemically synthesized
ataccaagcatgctcctttgaa

SEQ ID NO: 1322415 - DNA, 22 bp, Artificial Sequence
  chemically synthesized
gtcttcttatattcaaaggagc

SEQ ID NO: 1322416 - DNA, 22 bp, Artificial Sequence
  chemically synthesized
tcttcttatattcaaaggagca

SEQ ID NO: 1322417 - DNA, 22 bp, Artificial Sequence
  chemically synthesized
cttatattcaaaggagcatgct

SEQ ID NO: 1322418 - DNA, 22 bp, Artificial Sequence
  chemically synthesized
tgactcataccaagcatgctcc

SEQ ID NO: 1322419 - DNA, 22 bp, Artificial Sequence
  chemically synthesized
ttatattcaaaggagcatgctt

SEQ ID NO: 1322420 - DNA, 22 bp, Artificial Sequence
  chemically synthesized
atattcaaaggagcatgcttgg

SEQ ID NO: 1322421 - DNA, 22 bp, Artificial Sequence
  chemically synthesized
tattcaaaggagcatgcttggt

SEQ ID NO: 1322422 - DNA, 22 bp, Artificial Sequence
  chemically synthesized
atactgtgactcataccaagca

SEQ ID NO: 1322423 - DNA, 22 bp, Artificial Sequence
  chemically synthesized
aaaggagcatgcttggtatgag

SEQ ID NO: 1322424 - DNA, 22 bp, Artificial Sequence
  chemically synthesized
aatgcagaagttgatactgtga

SEQ ID NO: 1322425 - DNA, 22 bp, Artificial Sequence
  chemically synthesized
ggtatgagtcacagtatcaact

SEQ ID NO: 1322426 - DNA, 22 bp, Artificial Sequence
  chemically synthesized
gtatgagtcacagtatcaactt

SEQ ID NO: 1322427 - DNA, 22 bp, Artificial Sequence
  chemically synthesized
gaaaacattcaatgcagaagtt

SEQ ID NO: 1322428 - DNA, 22 bp, Artificial Sequence
  chemically synthesized
agaaaacattcaatgcagaagt

SEQ ID NO: 1322429 - DNA, 22 bp, Artificial Sequence
  chemically synthesized
agatggcttagaaaacattcaa

SEQ ID NO: 1322430 - DNA, 22 bp, Artificial Sequence
  chemically synthesized
gagatggcttagaaaacattca

SEQ ID NO: 1322431 - DNA, 22 bp, Artificial Sequence
  chemically synthesized
tgagatggcttagaaaacattc

SEQ ID NO: 1322432 - DNA, 22 bp, Artificial Sequence
  chemically synthesized
ctgcattgaatgttttctaagc

SEQ ID NO: 1322433 - DNA, 22 bp, Artificial Sequence
  chemically synthesized
tgcattgaatgttttctaagcc

SEQ ID NO: 1322434 - DNA, 22 bp, Artificial Sequence
  chemically synthesized
cattgaatgttttctaagccat

SEQ ID NO: 1322435 - DNA, 22 bp, Artificial Sequence
  chemically synthesized
tatgcattttgagatggcttag

SEQ ID NO: 1322436 - DNA, 22 bp, Artificial Sequence
  chemically synthesized
gtatgcattttgagatggctta

SEQ ID NO: 1322437 - DNA, 22 bp, Artificial Sequence
  chemically synthesized
aatgttttctaagccatctcaa

SEQ ID NO: 1322438 - DNA, 22 bp, Artificial Sequence
  chemically synthesized
acaatttgtatgcattttgaga

SEQ ID NO: 1322439 - DNA, 22 bp, Artificial Sequence
  chemically synthesized
taacaatttgtatgcattttga

SEQ ID NO: 1322440 - DNA, 22 bp, Artificial Sequence
  chemically synthesized
tctaagccatctcaaaatgcat

SEQ ID NO: 1322441 - DNA, 22 bp, Artificial Sequence
  chemically synthesized
ctaacaatttgtatgcattttg

SEQ ID NO: 1322442 - DNA, 22 bp, Artificial Sequence
  chemically synthesized
ctaagccatctcaaaatgcata

SEQ ID NO: 1322443 - DNA, 22 bp, Artificial Sequence
  chemically synthesized
taagccatctcaaaatgcatac

SEQ ID NO: 1322444 - DNA, 22 bp, Artificial Sequence
  chemically synthesized
agccatctcaaaatgcatacaa

SEQ ID NO: 1322445 - DNA, 22 bp, Artificial Sequence
  chemically synthesized
atttctaacaatttgtatgcat

SEQ ID NO: 1322446 - DNA, 22 bp, Artificial Sequence
  chemically synthesized
agattgatttctaacaatttgt

SEQ ID NO: 1322447 - DNA, 22 bp, Artificial Sequence
  chemically synthesized
aaaatgcatacaaattgttaga

SEQ ID NO: 1322448 - DNA, 22 bp, Artificial Sequence
  chemically synthesized
gataaataaattgagattgatt

SEQ ID NO: 1322449 - DNA, 22 bp, Artificial Sequence
  chemically synthesized
ttagaaatcaatctcaatttat

SEQ ID NO: 1322450 - DNA, 22 bp, Artificial Sequence
  chemically synthesized
gaaatcaatctcaatttattta

SEQ ID NO: 1322451 - DNA, 22 bp, Artificial Sequence
  chemically synthesized
gatatcatgtaaatatgttaga

SEQ ID NO: 1322452 - DNA, 22 bp, Artificial Sequence
  chemically synthesized
ggatatcatgtaaatatgttag

SEQ ID NO: 1322453 - DNA, 22 bp, Artificial Sequence
  chemically synthesized
aatttatttatctaacatattt

SEQ ID NO: 1322454 - DNA, 22 bp, Artificial Sequence
  chemically synthesized
tggatatcatgtaaatatgtta

SEQ ID NO: 1322455 - DNA, 22 bp, Artificial Sequence
  chemically synthesized
ttggatatcatgtaaatatgtt

SEQ ID NO: 1322456 - DNA, 22 bp, Artificial Sequence
  chemically synthesized
atttatctaacatatttacatg

SEQ ID NO: 1322457 - DNA, 22 bp, Artificial Sequence
  chemically synthesized
atttttggatatcatgtaaata

SEQ ID NO: 1322458 - DNA, 22 bp, Artificial Sequence
  chemically synthesized
tttatctaacatatttacatga

SEQ ID NO: 1322459 - DNA, 22 bp, Artificial Sequence
  chemically synthesized
catttttggatatcatgtaaat

SEQ ID NO: 1322460 - DNA, 22 bp, Artificial Sequence
  chemically synthesized
atctaacatatttacatgatat

SEQ ID NO: 1322461 - DNA, 22 bp, Artificial Sequence
  chemically synthesized
tctaacatatttacatgatatc

SEQ ID NO: 1322462 - DNA, 22 bp, Artificial Sequence
  chemically synthesized
tcttcatttttggatatcatgt

SEQ ID NO: 1322463 - DNA, 22 bp, Artificial Sequence
  chemically synthesized
acatatttacatgatatccaaa

SEQ ID NO: 1322464 - DNA, 22 bp, Artificial Sequence
  chemically synthesized
tcctgtcttcatttttggatat

SEQ ID NO: 1322465 - DNA, 22 bp, Artificial Sequence
  chemically synthesized
tctatcctgtcttcatttttgg

SEQ ID NO: 1322466 - DNA, 22 bp, Artificial Sequence
  chemically synthesized
acatgatatccaaaaatgaaga

SEQ ID NO: 1322467 - DNA, 22 bp, Artificial Sequence
  chemically synthesized
ttatctatcctgtcttcatttt

SEQ ID NO: 1322468 - DNA, 22 bp, Artificial Sequence
  chemically synthesized
catgatatccaaaaatgaagac

SEQ ID NO: 1322469 - DNA, 22 bp, Artificial Sequence
  chemically synthesized
tattatctatcctgtcttcatt

SEQ ID NO: 1322470 - DNA, 22 bp, Artificial Sequence
  chemically synthesized
ctattatctatcctgtcttcat

SEQ ID NO: 1322471 - DNA, 22 bp, Artificial Sequence
  chemically synthesized
gatttctattatctatcctgtc

SEQ ID NO: 1322472 - DNA, 22 bp, Artificial Sequence
  chemically synthesized
tattagatttctattatctatc

SEQ ID NO: 1322473 - DNA, 22 bp, Artificial Sequence
  chemically synthesized
atattagatttctattatctat

SEQ ID NO: 1322474 - DNA, 22 bp, Artificial Sequence
  chemically synthesized
caggtttatattagatttctat

SEQ ID NO: 1322475 - DNA, 22 bp, Artificial Sequence
  chemically synthesized
acaggtttatattagatttcta

SEQ ID NO: 1322476 - DNA, 22 bp, Artificial Sequence
  chemically synthesized
aaatagcttacaggtttatatt

SEQ ID NO: 1322477 - DNA, 22 bp, Artificial Sequence
  chemically synthesized
ttaaaatagcttacaggtttat

SEQ ID NO: 1322478 - DNA, 22 bp, Artificial Sequence
  chemically synthesized
atgttgttaaaatagcttacag

SEQ ID NO: 1322479 - DNA, 22 bp, Artificial Sequence
  chemically synthesized
gatgttgttaaaatagcttaca

SEQ ID NO: 1322480 - DNA, 22 bp, Artificial Sequence
  chemically synthesized
atataaacctgtaagctatttt

SEQ ID NO: 1322481 - DNA, 22 bp, Artificial Sequence
  chemically synthesized
taagctattttaacaacatcaa

SEQ ID NO: 1322482 - DNA, 22 bp, Artificial Sequence
  chemically synthesized
agggacaccatacatttgatgt

SEQ ID NO: 1322483 - DNA, 22 bp, Artificial Sequence
  chemically synthesized
aagggacaccatacatttgatg

SEQ ID NO: 1322484 - DNA, 22 bp, Artificial Sequence
  chemically synthesized
ttaagggacaccatacatttga

SEQ ID NO: 1322485 - DNA, 22 bp, Artificial Sequence
  chemically synthesized
ttttaacaacatcaaatgtatg

SEQ ID NO: 1322486 - DNA, 22 bp, Artificial Sequence
  chemically synthesized
taacaacatcaaatgtatggtg

SEQ ID NO: 1322487 - DNA, 22 bp, Artificial Sequence
  chemically synthesized
aacaacatcaaatgtatggtgt

SEQ ID NO: 1322488 - DNA, 22 bp, Artificial Sequence
  chemically synthesized
acaacatcaaatgtatggtgtc

SEQ ID NO: 1322489 - DNA, 22 bp, Artificial Sequence
  chemically synthesized
gcactcttaagggacaccatac

SEQ ID NO: 1322490 - DNA, 22 bp, Artificial Sequence
  chemically synthesized
agcactcttaagggacaccata

SEQ ID NO: 1322491 - DNA, 22 bp, Artificial Sequence
  chemically synthesized
atttagcactcttaagggacac

SEQ ID NO: 1322492 - DNA, 22 bp, Artificial Sequence
  chemically synthesized
gatttagcactcttaagggaca

SEQ ID NO: 1322493 - DNA, 22 bp, Artificial Sequence
  chemically synthesized
gaagaagtagtgtttgatttag

SEQ ID NO: 1322494 - DNA, 22 bp, Artificial Sequence
  chemically synthesized
tggaagaagtagtgtttgattt

SEQ ID NO: 1322495 - DNA, 22 bp, Artificial Sequence
  chemically synthesized
aagagtgctaaatcaaacacta

SEQ ID NO: 1322496 - DNA, 22 bp, Artificial Sequence
  chemically synthesized
agagtgctaaatcaaacactac

SEQ ID NO: 1322497 - DNA, 22 bp, Artificial Sequence
  chemically synthesized
aatcaaacactacttcttccag

SEQ ID NO: 1322498 - DNA, 22 bp, Artificial Sequence
  chemically synthesized
cttcttccagaatttttttttt

SEQ ID NO: 1322499 - DNA, 22 bp, Artificial Sequence
  chemically synthesized
cttccagaattttttttttttt

SEQ ID NO: 1322500 - DNA, 22 bp, Artificial Sequence
  chemically synthesized
ttccagaatttttttttttttt

SEQ ID NO: 1322501 - DNA, 22 bp, Artificial Sequence
  chemically synthesized
ccagaatttttttttttttttt

SEQ ID NO: 1322502 - DNA, 22 bp, Artificial Sequence
  chemically synthesized
aaaaaaaaaaaaaaaaaaaaaa

SEQ ID NO: 1322503 - DNA, 22 bp, Artificial Sequence
  chemically synthesized
cagaattttttttttttttttt

SEQ ID NO: 1322504 - DNA, 22 bp, Artificial Sequence
  chemically synthesized
catctcaaaaaaaaaaaaaaaa

SEQ ID NO: 1322505 - DNA, 22 bp, Artificial Sequence
  chemically synthesized
tttttttttttttttttttttt

SEQ ID NO: 1322506 - DNA, 22 bp, Artificial Sequence
  chemically synthesized
tttttttttttttttttttttt

SEQ ID NO: 1322507 - DNA, 22 bp, Artificial Sequence
  chemically synthesized
tttttttttttttttttttttt

SEQ ID NO: 1322508 - DNA, 22 bp, Artificial Sequence
  chemically synthesized
tttttttttttttttttttttt

SEQ ID NO: 1322509 - DNA, 22 bp, Artificial Sequence
  chemically synthesized
tttttttttttttttttttttg

SEQ ID NO: 1322510 - DNA, 22 bp, Artificial Sequence
  chemically synthesized
ttttttttttttttttttttga

SEQ ID NO: 1322511 - DNA, 22 bp, Artificial Sequence
  chemically synthesized
tttttttttttttttttttgag

SEQ ID NO: 1322512 - DNA, 22 bp, Artificial Sequence
  chemically synthesized
ttttttttttttttttttgaga

SEQ ID NO: 1322513 - DNA, 22 bp, Artificial Sequence
  chemically synthesized
tttttttttttttttttgagat

SEQ ID NO: 1322514 - DNA, 22 bp, Artificial Sequence
  chemically synthesized
ttttttttttttttttgagatg

SEQ ID NO: 1322515 - DNA, 22 bp, Artificial Sequence
  chemically synthesized
tttttttttttttttgagatgg

SEQ ID NO: 1322516 - DNA, 22 bp, Artificial Sequence
  chemically synthesized
ttttttttttttttgagatgga

SEQ ID NO: 1322517 - DNA, 22 bp, Artificial Sequence
  chemically synthesized
tttttttttttttgagatggag

SEQ ID NO: 1322518 - DNA, 22 bp, Artificial Sequence
  chemically synthesized
ttttttttttttgagatggagt

SEQ ID NO: 1322519 - DNA, 22 bp, Artificial Sequence
  chemically synthesized
tttttttttttgagatggagtc

SEQ ID NO: 1322520 - DNA, 22 bp, Artificial Sequence
  chemically synthesized
ttttttttttgagatggagtct

SEQ ID NO: 1322521 - DNA, 22 bp, Artificial Sequence
  chemically synthesized
ggtgacagagcgagactccatc

SEQ ID NO: 1322522 - DNA, 22 bp, Artificial Sequence
  chemically synthesized
tttttttttgagatggagtctc

SEQ ID NO: 1322523 - DNA, 22 bp, Artificial Sequence
  chemically synthesized
ttttttttgagatggagtctcg

SEQ ID NO: 1322524 - DNA, 22 bp, Artificial Sequence
  chemically synthesized
tttttttgagatggagtctcgc

SEQ ID NO: 1322525 - DNA, 22 bp, Artificial Sequence
  chemically synthesized
ttttttgagatggagtctcgct

SEQ ID NO: 1322526 - DNA, 22 bp, Artificial Sequence
  chemically synthesized
tttttgagatggagtctcgctc

SEQ ID NO: 1322527 - DNA, 22 bp, Artificial Sequence
  chemically synthesized
ttttgagatggagtctcgctct

SEQ ID NO: 1322528 - DNA, 22 bp, Artificial Sequence
  chemically synthesized
tttgagatggagtctcgctctg

SEQ ID NO: 1322529 - DNA, 22 bp, Artificial Sequence
  chemically synthesized
cagcctgggtgacagagcgaga

SEQ ID NO: 1322530 - DNA, 22 bp, Artificial Sequence
  chemically synthesized
ttgagatggagtctcgctctgt

SEQ ID NO: 1322531 - DNA, 22 bp, Artificial Sequence
  chemically synthesized
tgagatggagtctcgctctgtc

SEQ ID NO: 1322532 - DNA, 22 bp, Artificial Sequence
  chemically synthesized
gagatggagtctcgctctgtca

SEQ ID NO: 1322533 - DNA, 22 bp, Artificial Sequence
  chemically synthesized
agatggagtctcgctctgtcac

SEQ ID NO: 1322534 - DNA, 22 bp, Artificial Sequence
  chemically synthesized
cactccagcctgggtgacagag

SEQ ID NO: 1322535 - DNA, 22 bp, Artificial Sequence
  chemically synthesized
gctctgtcacccaggctggagt

SEQ ID NO: 1322536 - DNA, 22 bp, Artificial Sequence
  chemically synthesized
tgtcacccaggctggagtgcag

SEQ ID NO: 1322537 - DNA, 22 bp, Artificial Sequence
  chemically synthesized
tcacccaggctggagtgcagtg

SEQ ID NO: 1322538 - DNA, 22 bp, Artificial Sequence
  chemically synthesized
cagtgagccgagatcgcaccac

SEQ ID NO: 1322539 - DNA, 22 bp, Artificial Sequence
  chemically synthesized
gagtgcagtggtgcgatctcgg

SEQ ID NO: 1322540 - DNA, 22 bp, Artificial Sequence
  chemically synthesized
ggctcactgcaacctccgcctc

SEQ ID NO: 1322541 - DNA, 22 bp, Artificial Sequence
  chemically synthesized
actgcaacctccgcctcttggg

SEQ ID NO: 1322542 - DNA, 22 bp, Artificial Sequence
  chemically synthesized
caacctccgcctcttgggctca

SEQ ID NO: 1322543 - DNA, 22 bp, Artificial Sequence
  chemically synthesized
aggcaggagaatggcgtgagcc

SEQ ID NO: 1322544 - DNA, 22 bp, Artificial Sequence
  chemically synthesized
cgcctcttgggctcacgccatt

SEQ ID NO: 1322545 - DNA, 22 bp, Artificial Sequence
  chemically synthesized
gaggctgaggcaggagaatggc

SEQ ID NO: 1322546 - DNA, 22 bp, Artificial Sequence
  chemically synthesized
ttgggctcacgccattctcctg

SEQ ID NO: 1322547 - DNA, 22 bp, Artificial Sequence
  chemically synthesized
tggaggctgaggcaggagaatg

SEQ ID NO: 1322548 - DNA, 22 bp, Artificial Sequence
  chemically synthesized
gggctcacgccattctcctgcc

SEQ ID NO: 1322549 - DNA, 22 bp, Artificial Sequence
  chemically synthesized
ggctcacgccattctcctgcct

SEQ ID NO: 1322550 - DNA, 22 bp, Artificial Sequence
  chemically synthesized
ctctggaggctgaggcaggaga

SEQ ID NO: 1322551 - DNA, 22 bp, Artificial Sequence
  chemically synthesized
acgccattctcctgcctcagcc

SEQ ID NO: 1322552 - DNA, 22 bp, Artificial Sequence
  chemically synthesized
tagacccagctactctggaggc

SEQ ID NO: 1322553 - DNA, 22 bp, Artificial Sequence
  chemically synthesized
tcctgcctcagcctccagagta

SEQ ID NO: 1322554 - DNA, 22 bp, Artificial Sequence
  chemically synthesized
ctgcctcagcctccagagtagc

SEQ ID NO: 1322555 - DNA, 22 bp, Artificial Sequence
  chemically synthesized
cctcagcctccagagtagctgg

SEQ ID NO: 1322556 - DNA, 22 bp, Artificial Sequence
  chemically synthesized
agcctccagagtagctgggtct

SEQ ID NO: 1322557 - DNA, 22 bp, Artificial Sequence
  chemically synthesized
cagagtagctgggtctacaggc

SEQ ID NO: 1322558 - DNA, 22 bp, Artificial Sequence
  chemically synthesized
gccgggcgtggtggcaggcgcc

SEQ ID NO: 1322559 - DNA, 22 bp, Artificial Sequence
  chemically synthesized
ggtctacaggcgcctgccacca

SEQ ID NO: 1322560 - DNA, 22 bp, Artificial Sequence
  chemically synthesized
caggcgcctgccaccacgcccg

SEQ ID NO: 1322561 - DNA, 22 bp, Artificial Sequence
  chemically synthesized
aaaatacaaaaagttagccggg

SEQ ID NO: 1322562 - DNA, 22 bp, Artificial Sequence
  chemically synthesized
ctaaaaatacaaaaagttagcc

SEQ ID NO: 1322563 - DNA, 22 bp, Artificial Sequence
  chemically synthesized
ccaccacgcccggctaactttt

SEQ ID NO: 1322564 - DNA, 22 bp, Artificial Sequence
  chemically synthesized
tactaaaaatacaaaaagttag

SEQ ID NO: 1322565 - DNA, 22 bp, Artificial Sequence
  chemically synthesized
actttttgtatttttagtagag

SEQ ID NO: 1322566 - DNA, 22 bp, Artificial Sequence
  chemically synthesized
tttgtatttttagtagagacgg

SEQ ID NO: 1322567 - DNA, 22 bp, Artificial Sequence
  chemically synthesized
ttgtatttttagtagagacggg

SEQ ID NO: 1322568 - DNA, 22 bp, Artificial Sequence
  chemically synthesized
acatggtgaaaccccgtctcta

SEQ ID NO: 1322569 - DNA, 22 bp, Artificial Sequence
  chemically synthesized
tgtatttttagtagagacgggg

SEQ ID NO: 1322570 - DNA, 22 bp, Artificial Sequence
  chemically synthesized
gtatttttagtagagacggggt

SEQ ID NO: 1322571 - DNA, 22 bp, Artificial Sequence
  chemically synthesized
tatttttagtagagacggggtt

SEQ ID NO: 1322572 - DNA, 22 bp, Artificial Sequence
  chemically synthesized
gctaacatggtgaaaccccgtc

SEQ ID NO: 1322573 - DNA, 22 bp, Artificial Sequence
  chemically synthesized
ttagtagagacggggtttcacc

SEQ ID NO: 1322574 - DNA, 22 bp, Artificial Sequence
  chemically synthesized
tagtagagacggggtttcacca

SEQ ID NO: 1322575 - DNA, 22 bp, Artificial Sequence
  chemically synthesized
agtagagacggggtttcaccat

SEQ ID NO: 1322576 - DNA, 22 bp, Artificial Sequence
  chemically synthesized
gtagagacggggtttcaccatg

SEQ ID NO: 1322577 - DNA, 22 bp, Artificial Sequence
  chemically synthesized
caccatgttagccaggatggtc

SEQ ID NO: 1322578 - DNA, 22 bp, Artificial Sequence
  chemically synthesized
accatgttagccaggatggtct

SEQ ID NO: 1322579 - DNA, 22 bp, Artificial Sequence
  chemically synthesized
gccaggatggtctcgatctcct

SEQ ID NO: 1322580 - DNA, 22 bp, Artificial Sequence
  chemically synthesized
gatctcctgacctcgtgatcca

SEQ ID NO: 1322581 - DNA, 22 bp, Artificial Sequence
  chemically synthesized
ggaggccaaggtgggtggatca

SEQ ID NO: 1322582 - DNA, 22 bp, Artificial Sequence
  chemically synthesized
gggaggccaaggtgggtggatc

SEQ ID NO: 1322583 - DNA, 22 bp, Artificial Sequence
  chemically synthesized
tgggaggccaaggtgggtggat

SEQ ID NO: 1322584 - DNA, 22 bp, Artificial Sequence
  chemically synthesized
ctgacctcgtgatccacccacc

SEQ ID NO: 1322585 - DNA, 22 bp, Artificial Sequence
  chemically synthesized
acctcgtgatccacccaccttg

SEQ ID NO: 1322586 - DNA, 22 bp, Artificial Sequence
  chemically synthesized
gtgatccacccaccttggcctc

SEQ ID NO: 1322587 - DNA, 22 bp, Artificial Sequence
  chemically synthesized
acgccagtaatcccagcacttt

SEQ ID NO: 1322588 - DNA, 22 bp, Artificial Sequence
  chemically synthesized
ggcctcccaaagtgctgggatt

SEQ ID NO: 1322589 - DNA, 22 bp, Artificial Sequence
  chemically synthesized
gcctcccaaagtgctgggatta

SEQ ID NO: 1322590 - DNA, 22 bp, Artificial Sequence
  chemically synthesized
ccaaagtgctgggattactggc

SEQ ID NO: 1322591 - DNA, 22 bp, Artificial Sequence
  chemically synthesized
ggattactggcgtgagccaccg

SEQ ID NO: 1322592 - DNA, 22 bp, Artificial Sequence
  chemically synthesized
gaagaaggccgggcgcggtggc

SEQ ID NO: 1322593 - DNA, 22 bp, Artificial Sequence
  chemically synthesized
tggaagaaggccgggcgcggtg

SEQ ID NO: 1322594 - DNA, 22 bp, Artificial Sequence
  chemically synthesized
ctggcgtgagccaccgcgcccg

SEQ ID NO: 1322595 - DNA, 22 bp, Artificial Sequence
  chemically synthesized
gcgtgagccaccgcgcccggcc

SEQ ID NO: 1322596 - DNA, 22 bp, Artificial Sequence
  chemically synthesized
ccaaaaattctggaagaaggcc

SEQ ID NO: 1322597 - DNA, 22 bp, Artificial Sequence
  chemically synthesized
catctcccaaaaattctggaag

SEQ ID NO: 1322598 - DNA, 22 bp, Artificial Sequence
  chemically synthesized
acatctcccaaaaattctggaa

SEQ ID NO: 1322599 - DNA, 22 bp, Artificial Sequence
  chemically synthesized
tacatctcccaaaaattctgga

SEQ ID NO: 1322600 - DNA, 22 bp, Artificial Sequence
  chemically synthesized
ttttacatctcccaaaaattct

SEQ ID NO: 1322601 - DNA, 22 bp, Artificial Sequence
  chemically synthesized
attttacatctcccaaaaattc

SEQ ID NO: 1322602 - DNA, 22 bp, Artificial Sequence
  chemically synthesized
tattttacatctcccaaaaatt

SEQ ID NO: 1322603 - DNA, 22 bp, Artificial Sequence
  chemically synthesized
tttattttacatctcccaaaaa

SEQ ID NO: 1322604 - DNA, 22 bp, Artificial Sequence
  chemically synthesized
cttccagaatttttgggagatg

SEQ ID NO: 1322605 - DNA, 22 bp, Artificial Sequence
  chemically synthesized
ttccagaatttttgggagatgt

SEQ ID NO: 1322606 - DNA, 22 bp, Artificial Sequence
  chemically synthesized
ccagaatttttgggagatgtaa

SEQ ID NO: 1322607 - DNA, 22 bp, Artificial Sequence
  chemically synthesized
cagaatttttgggagatgtaaa

SEQ ID NO: 1322608 - DNA, 22 bp, Artificial Sequence
  chemically synthesized
aatcatctctttattttacatc

SEQ ID NO: 1322609 - DNA, 22 bp, Artificial Sequence
  chemically synthesized
aaatcatctctttattttacat

SEQ ID NO: 1322610 - DNA, 22 bp, Artificial Sequence
  chemically synthesized
taaatcatctctttattttaca

SEQ ID NO: 1322611 - DNA, 22 bp, Artificial Sequence
  chemically synthesized
ttaaatcatctctttattttac

SEQ ID NO: 1322612 - DNA, 22 bp, Artificial Sequence
  chemically synthesized
tttaaatcatctctttatttta

SEQ ID NO: 1322613 - DNA, 22 bp, Artificial Sequence
  chemically synthesized
ttgggagatgtaaaataaagag

SEQ ID NO: 1322614 - DNA, 22 bp, Artificial Sequence
  chemically synthesized
tgggagatgtaaaataaagaga

SEQ ID NO: 1322615 - DNA, 22 bp, Artificial Sequence
  chemically synthesized
gggagatgtaaaataaagagat

SEQ ID NO: 1322616 - DNA, 22 bp, Artificial Sequence
  chemically synthesized
ggagatgtaaaataaagagatg

SEQ ID NO: 1322617 - DNA, 22 bp, Artificial Sequence
  chemically synthesized
acaaagagctttttaaatcatc

SEQ ID NO: 1322618 - DNA, 22 bp, Artificial Sequence
  chemically synthesized
aaatatgcattcacaaagagct

SEQ ID NO: 1322619 - DNA, 22 bp, Artificial Sequence
  chemically synthesized
aaaaagctctttgtgaatgcat

SEQ ID NO: 1322620 - DNA, 22 bp, Artificial Sequence
  chemically synthesized
aaaagctctttgtgaatgcata

SEQ ID NO: 1322621 - DNA, 22 bp, Artificial Sequence
  chemically synthesized
tttgtgaatgcatattttaatc

SEQ ID NO: 1322622 - DNA, 22 bp, Artificial Sequence
  chemically synthesized
tgtgaatgcatattttaatctt

SEQ ID NO: 1322623 - DNA, 22 bp, Artificial Sequence
  chemically synthesized
gtgaatgcatattttaatcttt

SEQ ID NO: 1322624 - DNA, 22 bp, Artificial Sequence
  chemically synthesized
cagagccagagtaaagattaaa

SEQ ID NO: 1322625 - DNA, 22 bp, Artificial Sequence
  chemically synthesized
tgaatgcatattttaatcttta

SEQ ID NO: 1322626 - DNA, 22 bp, Artificial Sequence
  chemically synthesized
taaaatctccagagccagagta

SEQ ID NO: 1322627 - DNA, 22 bp, Artificial Sequence
  chemically synthesized
tataaaatctccagagccagag

SEQ ID NO: 1322628 - DNA, 22 bp, Artificial Sequence
  chemically synthesized
taatctttactctggctctgga

SEQ ID NO: 1322629 - DNA, 22 bp, Artificial Sequence
  chemically synthesized
aatctttactctggctctggag

SEQ ID NO: 1322630 - DNA, 22 bp, Artificial Sequence
  chemically synthesized
cctctataaaatctccagagcc

SEQ ID NO: 1322631 - DNA, 22 bp, Artificial Sequence
  chemically synthesized
atctttactctggctctggaga

SEQ ID NO: 1322632 - DNA, 22 bp, Artificial Sequence
  chemically synthesized
cctacctctataaaatctccag

SEQ ID NO: 1322633 - DNA, 22 bp, Artificial Sequence
  chemically synthesized
acctacctctataaaatctcca

SEQ ID NO: 1322634 - DNA, 22 bp, Artificial Sequence
  chemically synthesized
tactctggctctggagatttta

SEQ ID NO: 1322635 - DNA, 22 bp, Artificial Sequence
  chemically synthesized
actctggctctggagattttat

SEQ ID NO: 1322636 - DNA, 22 bp, Artificial Sequence
  chemically synthesized
ctctggctctggagattttata

SEQ ID NO: 1322637 - DNA, 22 bp, Artificial Sequence
  chemically synthesized
gtttacctacctctataaaatc

SEQ ID NO: 1322638 - DNA, 22 bp, Artificial Sequence
  chemically synthesized
agtttacctacctctataaaat

SEQ ID NO: 1322639 - DNA, 22 bp, Artificial Sequence
  chemically synthesized
tggctctggagattttatagag

SEQ ID NO: 1322640 - DNA, 22 bp, Artificial Sequence
  chemically synthesized
tagtttacctacctctataaaa

SEQ ID NO: 1322641 - DNA, 22 bp, Artificial Sequence
  chemically synthesized
gctctggagattttatagaggt

SEQ ID NO: 1322642 - DNA, 22 bp, Artificial Sequence
  chemically synthesized
tggagattttatagaggtaggt

SEQ ID NO: 1322643 - DNA, 22 bp, Artificial Sequence
  chemically synthesized
gagattttatagaggtaggtaa

SEQ ID NO: 1322644 - DNA, 22 bp, Artificial Sequence
  chemically synthesized
gaaacacaactttagtttacct

SEQ ID NO: 1322645 - DNA, 22 bp, Artificial Sequence
  chemically synthesized
agaaacacaactttagtttacc

SEQ ID NO: 1322646 - DNA, 22 bp, Artificial Sequence
  chemically synthesized
tatagaggtaggtaaactaaag

SEQ ID NO: 1322647 - DNA, 22 bp, Artificial Sequence
  chemically synthesized
atagaggtaggtaaactaaagt

SEQ ID NO: 1322648 - DNA, 22 bp, Artificial Sequence
  chemically synthesized
tttagaaacacaactttagttt

SEQ ID NO: 1322649 - DNA, 22 bp, Artificial Sequence
  chemically synthesized
tagaggtaggtaaactaaagtt

SEQ ID NO: 1322650 - DNA, 22 bp, Artificial Sequence
  chemically synthesized
cagaaacattatttagaaacac

SEQ ID NO: 1322651 - DNA, 22 bp, Artificial Sequence
  chemically synthesized
acagaaacattatttagaaaca

SEQ ID NO: 1322652 - DNA, 22 bp, Artificial Sequence
  chemically synthesized
aagttgtgtttctaaataatgt

SEQ ID NO: 1322653 - DNA, 22 bp, Artificial Sequence
  chemically synthesized
tgtttctaaataatgtttctgt

SEQ ID NO: 1322654 - DNA, 22 bp, Artificial Sequence
  chemically synthesized
aaaatatatcttacagaaacat

SEQ ID NO: 1322655 - DNA, 22 bp, Artificial Sequence
  chemically synthesized
aaaaatatatcttacagaaaca

SEQ ID NO: 1322656 - DNA, 22 bp, Artificial Sequence
  chemically synthesized
ctaaataatgtttctgtaagat

SEQ ID NO: 1322657 - DNA, 22 bp, Artificial Sequence
  chemically synthesized
taaataatgtttctgtaagata

SEQ ID NO: 1322658 - DNA, 22 bp, Artificial Sequence
  chemically synthesized
aataatgtttctgtaagatata

SEQ ID NO: 1322659 - DNA, 22 bp, Artificial Sequence
  chemically synthesized
tagatttaaaaatatatcttac

SEQ ID NO: 1322660 - DNA, 22 bp, Artificial Sequence
  chemically synthesized
atagatttaaaaatatatctta

SEQ ID NO: 1322661 - DNA, 22 bp, Artificial Sequence
  chemically synthesized
acttatagatttaaaaatatat

SEQ ID NO: 1322662 - DNA, 22 bp, Artificial Sequence
  chemically synthesized
aacttatagatttaaaaatata

SEQ ID NO: 1322663 - DNA, 22 bp, Artificial Sequence
  chemically synthesized
taacttatagatttaaaaatat

SEQ ID NO: 1322664 - DNA, 22 bp, Artificial Sequence
  chemically synthesized
ctgtaagatatatttttaaatc

SEQ ID NO: 1322665 - DNA, 22 bp, Artificial Sequence
  chemically synthesized
tgtaagatatatttttaaatct

SEQ ID NO: 1322666 - DNA, 22 bp, Artificial Sequence
  chemically synthesized
taagatatatttttaaatctat

SEQ ID NO: 1322667 - DNA, 22 bp, Artificial Sequence
  chemically synthesized
aaacattttaacttatagattt

SEQ ID NO: 1322668 - DNA, 22 bp, Artificial Sequence
  chemically synthesized
tgaaacattttaacttatagat

SEQ ID NO: 1322669 - DNA, 22 bp, Artificial Sequence
  chemically synthesized
tctgaaacattttaacttatag

SEQ ID NO: 1322670 - DNA, 22 bp, Artificial Sequence
  chemically synthesized
tctctctgaaacattttaactt

SEQ ID NO: 1322671 - DNA, 22 bp, Artificial Sequence
  chemically synthesized
ttaaatctataagttaaaatgt

SEQ ID NO: 1322672 - DNA, 22 bp, Artificial Sequence
  chemically synthesized
taaatctataagttaaaatgtt

SEQ ID NO: 1322673 - DNA, 22 bp, Artificial Sequence
  chemically synthesized
aaatctataagttaaaatgttt

SEQ ID NO: 1322674 - DNA, 22 bp, Artificial Sequence
  chemically synthesized
aatctataagttaaaatgtttc

SEQ ID NO: 1322675 - DNA, 22 bp, Artificial Sequence
  chemically synthesized
taagttaaaatgtttcagagag

SEQ ID NO: 1322676 - DNA, 22 bp, Artificial Sequence
  chemically synthesized
aaacagatcgcattatctctct

SEQ ID NO: 1322677 - DNA, 22 bp, Artificial Sequence
  chemically synthesized
caaacagatcgcattatctctc

SEQ ID NO: 1322678 - DNA, 22 bp, Artificial Sequence
  chemically synthesized
aaatgtttcagagagataatgc

SEQ ID NO: 1322679 - DNA, 22 bp, Artificial Sequence
  chemically synthesized
cagagagataatgcgatctgtt

SEQ ID NO: 1322680 - DNA, 22 bp, Artificial Sequence
  chemically synthesized
agagagataatgcgatctgttt

SEQ ID NO: 1322681 - DNA, 22 bp, Artificial Sequence
  chemically synthesized
caaaatatagcatggcttcaaa

SEQ ID NO: 1322682 - DNA, 22 bp, Artificial Sequence
  chemically synthesized
tttgaagccatgctatattttg

SEQ ID NO: 1322683 - DNA, 22 bp, Artificial Sequence
  chemically synthesized
gaagccatgctatattttggag

SEQ ID NO: 1322684 - DNA, 22 bp, Artificial Sequence
  chemically synthesized
aagccatgctatattttggaga

SEQ ID NO: 1322685 - DNA, 22 bp, Artificial Sequence
  chemically synthesized
tattttggagacgacttttttt

SEQ ID NO: 1322686 - DNA, 22 bp, Artificial Sequence
  chemically synthesized
aaaaaaataaaaaaaaaaaaag

SEQ ID NO: 1322687 - DNA, 22 bp, Artificial Sequence
  chemically synthesized
tggagacgactttttttttttt

SEQ ID NO: 1322688 - DNA, 22 bp, Artificial Sequence
  chemically synthesized
ggagacgacttttttttttttt

SEQ ID NO: 1322689 - DNA, 22 bp, Artificial Sequence
  chemically synthesized
tctcaaaaaaataaaaaaaaaa

SEQ ID NO: 1322690 - DNA, 22 bp, Artificial Sequence
  chemically synthesized
gagacgacttttttttttttta

SEQ ID NO: 1322691 - DNA, 22 bp, Artificial Sequence
  chemically synthesized
tgtctcaaaaaaataaaaaaaa

SEQ ID NO: 1322692 - DNA, 22 bp, Artificial Sequence
  chemically synthesized
tttttttttttatttttttgag

SEQ ID NO: 1322693 - DNA, 22 bp, Artificial Sequence
  chemically synthesized
ttttttttttatttttttgaga

SEQ ID NO: 1322694 - DNA, 22 bp, Artificial Sequence
  chemically synthesized
tttttttttatttttttgagac

SEQ ID NO: 1322695 - DNA, 22 bp, Artificial Sequence
  chemically synthesized
ttttttttatttttttgagaca

SEQ ID NO: 1322696 - DNA, 22 bp, Artificial Sequence
  chemically synthesized
tttttttatttttttgagacag

SEQ ID NO: 1322697 - DNA, 22 bp, Artificial Sequence
  chemically synthesized
ttttttatttttttgagacaga

SEQ ID NO: 1322698 - DNA, 22 bp, Artificial Sequence
  chemically synthesized
tttttatttttttgagacagag

SEQ ID NO: 1322699 - DNA, 22 bp, Artificial Sequence
  chemically synthesized
ttttatttttttgagacagagt

SEQ ID NO: 1322700 - DNA, 22 bp, Artificial Sequence
  chemically synthesized
tttatttttttgagacagagtt

SEQ ID NO: 1322701 - DNA, 22 bp, Artificial Sequence
  chemically synthesized
ttatttttttgagacagagttt

SEQ ID NO: 1322702 - DNA, 22 bp, Artificial Sequence
  chemically synthesized
tatttttttgagacagagtttt

SEQ ID NO: 1322703 - DNA, 22 bp, Artificial Sequence
  chemically synthesized
ggtgacaagagcaaaactctgt

SEQ ID NO: 1322704 - DNA, 22 bp, Artificial Sequence
  chemically synthesized
atttttttgagacagagttttg

SEQ ID NO: 1322705 - DNA, 22 bp, Artificial Sequence
  chemically synthesized
tttttttgagacagagttttgc

SEQ ID NO: 1322706 - DNA, 22 bp, Artificial Sequence
  chemically synthesized
ttttgagacagagttttgctct

SEQ ID NO: 1322707 - DNA, 22 bp, Artificial Sequence
  chemically synthesized
tttgagacagagttttgctctt

SEQ ID NO: 1322708 - DNA, 22 bp, Artificial Sequence
  chemically synthesized
ttgagacagagttttgctcttg

SEQ ID NO: 1322709 - DNA, 22 bp, Artificial Sequence
  chemically synthesized
cagcctgggtgacaagagcaaa

SEQ ID NO: 1322710 - DNA, 22 bp, Artificial Sequence
  chemically synthesized
tgagacagagttttgctcttgt

SEQ ID NO: 1322711 - DNA, 22 bp, Artificial Sequence
  chemically synthesized
gagacagagttttgctcttgtc

SEQ ID NO: 1322712 - DNA, 22 bp, Artificial Sequence
  chemically synthesized
agacagagttttgctcttgtca

SEQ ID NO: 1322713 - DNA, 22 bp, Artificial Sequence
  chemically synthesized
cactccagcctgggtgacaaga

SEQ ID NO: 1322714 - DNA, 22 bp, Artificial Sequence
  chemically synthesized
tgctcttgtcacccaggctgga

SEQ ID NO: 1322715 - DNA, 22 bp, Artificial Sequence
  chemically synthesized
gctcttgtcacccaggctggag

SEQ ID NO: 1322716 - DNA, 22 bp, Artificial Sequence
  chemically synthesized
ctcttgtcacccaggctggagt

SEQ ID NO: 1322717 - DNA, 22 bp, Artificial Sequence
  chemically synthesized
ttgtcacccaggctggagtgca

SEQ ID NO: 1322718 - DNA, 22 bp, Artificial Sequence
  chemically synthesized
gtcacccaggctggagtgcaat

SEQ ID NO: 1322719 - DNA, 22 bp, Artificial Sequence
  chemically synthesized
tcacccaggctggagtgcaatg

SEQ ID NO: 1322720 - DNA, 22 bp, Artificial Sequence
  chemically synthesized
cagtgagccaagatggtgccat

SEQ ID NO: 1322721 - DNA, 22 bp, Artificial Sequence
  chemically synthesized
gagtgcaatggcaccatcttgg

SEQ ID NO: 1322722 - DNA, 22 bp, Artificial Sequence
  chemically synthesized
ggaggcagaggttgcagtgagc

SEQ ID NO: 1322723 - DNA, 22 bp, Artificial Sequence
  chemically synthesized
aatctgggaggcagaggttgca

SEQ ID NO: 1322724 - DNA, 22 bp, Artificial Sequence
  chemically synthesized
gaatctgggaggcagaggttgc

SEQ ID NO: 1322725 - DNA, 22 bp, Artificial Sequence
  chemically synthesized
tgaatctgggaggcagaggttg

SEQ ID NO: 1322726 - DNA, 22 bp, Artificial Sequence
  chemically synthesized
ggctcactgcaacctctgcctc

SEQ ID NO: 1322727 - DNA, 22 bp, Artificial Sequence
  chemically synthesized
gctcactgcaacctctgcctcc

SEQ ID NO: 1322728 - DNA, 22 bp, Artificial Sequence
  chemically synthesized
actgcaacctctgcctcccaga

SEQ ID NO: 1322729 - DNA, 22 bp, Artificial Sequence
  chemically synthesized
caacctctgcctcccagattca

SEQ ID NO: 1322730 - DNA, 22 bp, Artificial Sequence
  chemically synthesized
aggcaggagaatctttgaatct

SEQ ID NO: 1322731 - DNA, 22 bp, Artificial Sequence
  chemically synthesized
tgcctcccagattcaaagattc

SEQ ID NO: 1322732 - DNA, 22 bp, Artificial Sequence
  chemically synthesized
cctcccagattcaaagattctc

SEQ ID NO: 1322733 - DNA, 22 bp, Artificial Sequence
  chemically synthesized
ggaggctgaggcaggagaatct

SEQ ID NO: 1322734 - DNA, 22 bp, Artificial Sequence
  chemically synthesized
gggaggctgaggcaggagaatc

SEQ ID NO: 1322735 - DNA, 22 bp, Artificial Sequence
  chemically synthesized
ccagattcaaagattctcctgc

SEQ ID NO: 1322736 - DNA, 22 bp, Artificial Sequence
  chemically synthesized
cttgggaggctgaggcaggaga

SEQ ID NO: 1322737 - DNA, 22 bp, Artificial Sequence
  chemically synthesized
aaagattctcctgcctcagcct

SEQ ID NO: 1322738 - DNA, 22 bp, Artificial Sequence
  chemically synthesized
taatcccagctacttgggaggc

SEQ ID NO: 1322739 - DNA, 22 bp, Artificial Sequence
  chemically synthesized
gtaatcccagctacttgggagg

SEQ ID NO: 1322740 - DNA, 22 bp, Artificial Sequence
  chemically synthesized
tcctgcctcagcctcccaagta

SEQ ID NO: 1322741 - DNA, 22 bp, Artificial Sequence
  chemically synthesized
ctgcctcagcctcccaagtagc

SEQ ID NO: 1322742 - DNA, 22 bp, Artificial Sequence
  chemically synthesized
cctcagcctcccaagtagctgg

SEQ ID NO: 1322743 - DNA, 22 bp, Artificial Sequence
  chemically synthesized
agcctcccaagtagctgggatt

SEQ ID NO: 1322744 - DNA, 22 bp, Artificial Sequence
  chemically synthesized
ccaagtagctgggattacaagc

SEQ ID NO: 1322745 - DNA, 22 bp, Artificial Sequence
  chemically synthesized
gccaggtgtggtggtgcatgct

SEQ ID NO: 1322746 - DNA, 22 bp, Artificial Sequence
  chemically synthesized
ggattacaagcatgcaccacca

SEQ ID NO: 1322747 - DNA, 22 bp, Artificial Sequence
  chemically synthesized
caagcatgcaccaccacacctg

SEQ ID NO: 1322748 - DNA, 22 bp, Artificial Sequence
  chemically synthesized
aaaatacaaacgattagccagg

SEQ ID NO: 1322749 - DNA, 22 bp, Artificial Sequence
  chemically synthesized
ctaaaaatacaaacgattagcc

SEQ ID NO: 1322750 - DNA, 22 bp, Artificial Sequence
  chemically synthesized
tactaaaaatacaaacgattag

SEQ ID NO: 1322751 - DNA, 22 bp, Artificial Sequence
  chemically synthesized
gctaatcgtttgtatttttagt

SEQ ID NO: 1322752 - DNA, 22 bp, Artificial Sequence
  chemically synthesized
atcgtttgtatttttagtagag

SEQ ID NO: 1322753 - DNA, 22 bp, Artificial Sequence
  chemically synthesized
gtatttttagtagagatggggt

SEQ ID NO: 1322754 - DNA, 22 bp, Artificial Sequence
  chemically synthesized
tatttttagtagagatggggtt

SEQ ID NO: 1322755 - DNA, 22 bp, Artificial Sequence
  chemically synthesized
gcccacatggtgaaaccccatc

SEQ ID NO: 1322756 - DNA, 22 bp, Artificial Sequence
  chemically synthesized
ttagtagagatggggtttcacc

SEQ ID NO: 1322757 - DNA, 22 bp, Artificial Sequence
  chemically synthesized
tagtagagatggggtttcacca

SEQ ID NO: 1322758 - DNA, 22 bp, Artificial Sequence
  chemically synthesized
agtagagatggggtttcaccat

SEQ ID NO: 1322759 - DNA, 22 bp, Artificial Sequence
  chemically synthesized
gtagagatggggtttcaccatg

SEQ ID NO: 1322760 - DNA, 22 bp, Artificial Sequence
  chemically synthesized
gagaccagcctggcccacatgg

SEQ ID NO: 1322761 - DNA, 22 bp, Artificial Sequence
  chemically synthesized
caccatgtgggccaggctggtc

SEQ ID NO: 1322762 - DNA, 22 bp, Artificial Sequence
  chemically synthesized
accatgtgggccaggctggtct

SEQ ID NO: 1322763 - DNA, 22 bp, Artificial Sequence
  chemically synthesized
aggccaggagttcgagaccagc

SEQ ID NO: 1322764 - DNA, 22 bp, Artificial Sequence
  chemically synthesized
gaggccaggagttcgagaccag

SEQ ID NO: 1322765 - DNA, 22 bp, Artificial Sequence
  chemically synthesized
gtctcgaactcctggcctcaag

SEQ ID NO: 1322766 - DNA, 22 bp, Artificial Sequence
  chemically synthesized
aggcgagtaaatcgcttgaggc

SEQ ID NO: 1322767 - DNA, 22 bp, Artificial Sequence
  chemically synthesized
gaactcctggcctcaagcgatt

SEQ ID NO: 1322768 - DNA, 22 bp, Artificial Sequence
  chemically synthesized
ggaggctgaggcgagtaaatcg

SEQ ID NO: 1322769 - DNA, 22 bp, Artificial Sequence
  chemically synthesized
ctggcctcaagcgatttactcg

SEQ ID NO: 1322770 - DNA, 22 bp, Artificial Sequence
  chemically synthesized
gggaggctgaggcgagtaaatc

SEQ ID NO: 1322771 - DNA, 22 bp, Artificial Sequence
  chemically synthesized
tgggaggctgaggcgagtaaat

SEQ ID NO: 1322772 - DNA, 22 bp, Artificial Sequence
  chemically synthesized
gcctcaagcgatttactcgcct

SEQ ID NO: 1322773 - DNA, 22 bp, Artificial Sequence
  chemically synthesized
aagcgatttactcgcctcagcc

SEQ ID NO: 1322774 - DNA, 22 bp, Artificial Sequence
  chemically synthesized
taatcccagcactttgggaggc

SEQ ID NO: 1322775 - DNA, 22 bp, Artificial Sequence
  chemically synthesized
actcgcctcagcctcccaaagt

SEQ ID NO: 1322776 - DNA, 22 bp, Artificial Sequence
  chemically synthesized
ctcgcctcagcctcccaaagtg

SEQ ID NO: 1322777 - DNA, 22 bp, Artificial Sequence
  chemically synthesized
gcctcagcctcccaaagtgctg

SEQ ID NO: 1322778 - DNA, 22 bp, Artificial Sequence
  chemically synthesized
gcgcctataatcccagcacttt

SEQ ID NO: 1322779 - DNA, 22 bp, Artificial Sequence
  chemically synthesized
agcctcccaaagtgctgggatt

SEQ ID NO: 1322780 - DNA, 22 bp, Artificial Sequence
  chemically synthesized
ccaaagtgctgggattataggc

SEQ ID NO: 1322781 - DNA, 22 bp, Artificial Sequence
  chemically synthesized
gccaggtgcggtggctcgcgcc

SEQ ID NO: 1322782 - DNA, 22 bp, Artificial Sequence
  chemically synthesized
ggccaggtgcggtggctcgcgc

SEQ ID NO: 1322783 - DNA, 22 bp, Artificial Sequence
  chemically synthesized
tggccaggtgcggtggctcgcg

SEQ ID NO: 1322784 - DNA, 22 bp, Artificial Sequence
  chemically synthesized
ggattataggcgcgagccaccg

SEQ ID NO: 1322785 - DNA, 22 bp, Artificial Sequence
  chemically synthesized
tccctttggccaggtgcggtgg

SEQ ID NO: 1322786 - DNA, 22 bp, Artificial Sequence
  chemically synthesized
taggcgcgagccaccgcacctg

SEQ ID NO: 1322787 - DNA, 22 bp, Artificial Sequence
  chemically synthesized
aagaaatattgtccctttggcc

SEQ ID NO: 1322788 - DNA, 22 bp, Artificial Sequence
  chemically synthesized
acctaaagaaatattgtccctt

SEQ ID NO: 1322789 - DNA, 22 bp, Artificial Sequence
  chemically synthesized
gacctaaagaaatattgtccct

SEQ ID NO: 1322790 - DNA, 22 bp, Artificial Sequence
  chemically synthesized
tgacctaaagaaatattgtccc

SEQ ID NO: 1322791 - DNA, 22 bp, Artificial Sequence
  chemically synthesized
cctttgacctaaagaaatattg

SEQ ID NO: 1322792 - DNA, 22 bp, Artificial Sequence
  chemically synthesized
ccctttgacctaaagaaatatt

SEQ ID NO: 1322793 - DNA, 22 bp, Artificial Sequence
  chemically synthesized
gccaaagggacaatatttcttt

SEQ ID NO: 1322794 - DNA, 22 bp, Artificial Sequence
  chemically synthesized
tccctttgacctaaagaaatat

SEQ ID NO: 1322795 - DNA, 22 bp, Artificial Sequence
  chemically synthesized
taaactttccctttgacctaaa

SEQ ID NO: 1322796 - DNA, 22 bp, Artificial Sequence
  chemically synthesized
ttgtaaactttccctttgacct

SEQ ID NO: 1322797 - DNA, 22 bp, Artificial Sequence
  chemically synthesized
gttgtaaactttccctttgacc

SEQ ID NO: 1322798 - DNA, 22 bp, Artificial Sequence
  chemically synthesized
ctttaggtcaaagggaaagttt

SEQ ID NO: 1322799 - DNA, 22 bp, Artificial Sequence
  chemically synthesized
tttaggtcaaagggaaagttta

SEQ ID NO: 1322800 - DNA, 22 bp, Artificial Sequence
  chemically synthesized
cgtggtttgttgtaaactttcc

SEQ ID NO: 1322801 - DNA, 22 bp, Artificial Sequence
  chemically synthesized
taggtcaaagggaaagtttaca

SEQ ID NO: 1322802 - DNA, 22 bp, Artificial Sequence
  chemically synthesized
aggtcaaagggaaagtttacaa

SEQ ID NO: 1322803 - DNA, 22 bp, Artificial Sequence
  chemically synthesized
ggtcaaagggaaagtttacaac

SEQ ID NO: 1322804 - DNA, 22 bp, Artificial Sequence
  chemically synthesized
tgtggttacgtggtttgttgta

SEQ ID NO: 1322805 - DNA, 22 bp, Artificial Sequence
  chemically synthesized
gtgtggttacgtggtttgttgt

SEQ ID NO: 1322806 - DNA, 22 bp, Artificial Sequence
  chemically synthesized
cagtttgtgtggttacgtggtt

SEQ ID NO: 1322807 - DNA, 22 bp, Artificial Sequence
  chemically synthesized
gcagtttgtgtggttacgtggt

SEQ ID NO: 1322808 - DNA, 22 bp, Artificial Sequence
  chemically synthesized
ttgcagtttgtgtggttacgtg

SEQ ID NO: 1322809 - DNA, 22 bp, Artificial Sequence
  chemically synthesized
acaacaaaccacgtaaccacac

SEQ ID NO: 1322810 - DNA, 22 bp, Artificial Sequence
  chemically synthesized
ttcttgcagtttgtgtggttac

SEQ ID NO: 1322811 - DNA, 22 bp, Artificial Sequence
  chemically synthesized
caacaaaccacgtaaccacaca

SEQ ID NO: 1322812 - DNA, 22 bp, Artificial Sequence
  chemically synthesized
gttcttgcagtttgtgtggtta

SEQ ID NO: 1322813 - DNA, 22 bp, Artificial Sequence
  chemically synthesized
agaagggaaatatttgttcttg

SEQ ID NO: 1322814 - DNA, 22 bp, Artificial Sequence
  chemically synthesized
aggcagctcagaagggaaatat

SEQ ID NO: 1322815 - DNA, 22 bp, Artificial Sequence
  chemically synthesized
caagaacaaatatttcccttct

SEQ ID NO: 1322816 - DNA, 22 bp, Artificial Sequence
  chemically synthesized
ctaaggcagctcagaagggaaa

SEQ ID NO: 1322817 - DNA, 22 bp, Artificial Sequence
  chemically synthesized
gctaaggcagctcagaagggaa

SEQ ID NO: 1322818 - DNA, 22 bp, Artificial Sequence
  chemically synthesized
tgctaaggcagctcagaaggga

SEQ ID NO: 1322819 - DNA, 22 bp, Artificial Sequence
  chemically synthesized
ccagataccctttgctaaggca

SEQ ID NO: 1322820 - DNA, 22 bp, Artificial Sequence
  chemically synthesized
cccttctgagctgccttagcaa

SEQ ID NO: 1322821 - DNA, 22 bp, Artificial Sequence
  chemically synthesized
ccttctgagctgccttagcaaa

SEQ ID NO: 1322822 - DNA, 22 bp, Artificial Sequence
  chemically synthesized
ctgagctgccttagcaaagggt

SEQ ID NO: 1322823 - DNA, 22 bp, Artificial Sequence
  chemically synthesized
atattcccagataccctttgct

SEQ ID NO: 1322824 - DNA, 22 bp, Artificial Sequence
  chemically synthesized
tgagctgccttagcaaagggta

SEQ ID NO: 1322825 - DNA, 22 bp, Artificial Sequence
  chemically synthesized
gatattcccagataccctttgc

SEQ ID NO: 1322826 - DNA, 22 bp, Artificial Sequence
  chemically synthesized
agctgccttagcaaagggtatc

SEQ ID NO: 1322827 - DNA, 22 bp, Artificial Sequence
  chemically synthesized
tttgatattcccagataccctt

SEQ ID NO: 1322828 - DNA, 22 bp, Artificial Sequence
  chemically synthesized
tgtttgatattcccagataccc

SEQ ID NO: 1322829 - DNA, 22 bp, Artificial Sequence
  chemically synthesized
ccttagcaaagggtatctggga

SEQ ID NO: 1322830 - DNA, 22 bp, Artificial Sequence
  chemically synthesized
agcaaagggtatctgggaatat

SEQ ID NO: 1322831 - DNA, 22 bp, Artificial Sequence
  chemically synthesized
gcaaagggtatctgggaatatc

SEQ ID NO: 1322832 - DNA, 22 bp, Artificial Sequence
  chemically synthesized
tgaatcattctgtttgatattc

SEQ ID NO: 1322833 - DNA, 22 bp, Artificial Sequence
  chemically synthesized
atgaatcattctgtttgatatt

SEQ ID NO: 1322834 - DNA, 22 bp, Artificial Sequence
  chemically synthesized
cttatgaatcattctgtttgat

SEQ ID NO: 1322835 - DNA, 22 bp, Artificial Sequence
  chemically synthesized
gcttatgaatcattctgtttga

SEQ ID NO: 1322836 - DNA, 22 bp, Artificial Sequence
  chemically synthesized
ggaatatcaaacagaatgattc

SEQ ID NO: 1322837 - DNA, 22 bp, Artificial Sequence
  chemically synthesized
taatttgcttatgaatcattct

SEQ ID NO: 1322838 - DNA, 22 bp, Artificial Sequence
  chemically synthesized
gacattataatttgcttatgaa

SEQ ID NO: 1322839 - DNA, 22 bp, Artificial Sequence
  chemically synthesized
tggacattataatttgcttatg

SEQ ID NO: 1322840 - DNA, 22 bp, Artificial Sequence
  chemically synthesized
aatattctggacattataattt

SEQ ID NO: 1322841 - DNA, 22 bp, Artificial Sequence
  chemically synthesized
gaatattctggacattataatt

SEQ ID NO: 1322842 - DNA, 22 bp, Artificial Sequence
  chemically synthesized
ataagcaaattataatgtccag

SEQ ID NO: 1322843 - DNA, 22 bp, Artificial Sequence
  chemically synthesized
aaaatttgaatattctggacat

SEQ ID NO: 1322844 - DNA, 22 bp, Artificial Sequence
  chemically synthesized
atattgaaaatttgaatattct

SEQ ID NO: 1322845 - DNA, 22 bp, Artificial Sequence
  chemically synthesized
gatattgaaaatttgaatattc

SEQ ID NO: 1322846 - DNA, 22 bp, Artificial Sequence
  chemically synthesized
taatgtccagaatattcaaatt

SEQ ID NO: 1322847 - DNA, 22 bp, Artificial Sequence
  chemically synthesized
gtaaaacacaaacttgatattg

SEQ ID NO: 1322848 - DNA, 22 bp, Artificial Sequence
  chemically synthesized
ctggtaaaacacaaacttgata

SEQ ID NO: 1322849 - DNA, 22 bp, Artificial Sequence
  chemically synthesized
aaattttcaatatcaagtttgt

SEQ ID NO: 1322850 - DNA, 22 bp, Artificial Sequence
  chemically synthesized
tgctggtaaaacacaaacttga

SEQ ID NO: 1322851 - DNA, 22 bp, Artificial Sequence
  chemically synthesized
attctgctggtaaaacacaaac

SEQ ID NO: 1322852 - DNA, 22 bp, Artificial Sequence
  chemically synthesized
gattctgctggtaaaacacaaa

SEQ ID NO: 1322853 - DNA, 22 bp, Artificial Sequence
  chemically synthesized
tcaatatcaagtttgtgtttta

SEQ ID NO: 1322854 - DNA, 22 bp, Artificial Sequence
  chemically synthesized
tgattctgctggtaaaacacaa

SEQ ID NO: 1322855 - DNA, 22 bp, Artificial Sequence
  chemically synthesized
caatatcaagtttgtgttttac

SEQ ID NO: 1322856 - DNA, 22 bp, Artificial Sequence
  chemically synthesized
aatatcaagtttgtgttttacc

SEQ ID NO: 1322857 - DNA, 22 bp, Artificial Sequence
  chemically synthesized
taattttgattctgctggtaaa

SEQ ID NO: 1322858 - DNA, 22 bp, Artificial Sequence
  chemically synthesized
ataattttgattctgctggtaa

SEQ ID NO: 1322859 - DNA, 22 bp, Artificial Sequence
  chemically synthesized
ttataattttgattctgctggt

SEQ ID NO: 1322860 - DNA, 22 bp, Artificial Sequence
  chemically synthesized
cttataattttgattctgctgg

SEQ ID NO: 1322861 - DNA, 22 bp, Artificial Sequence
  chemically synthesized
gtgttttaccagcagaatcaaa

SEQ ID NO: 1322862 - DNA, 22 bp, Artificial Sequence
  chemically synthesized
tgttttaccagcagaatcaaaa

SEQ ID NO: 1322863 - DNA, 22 bp, Artificial Sequence
  chemically synthesized
gataatttcttataattttgat

SEQ ID NO: 1322864 - DNA, 22 bp, Artificial Sequence
  chemically synthesized
taccagcagaatcaaaattata

SEQ ID NO: 1322865 - DNA, 22 bp, Artificial Sequence
  chemically synthesized
accagcagaatcaaaattataa

SEQ ID NO: 1322866 - DNA, 22 bp, Artificial Sequence
  chemically synthesized
ccagcagaatcaaaattataag

SEQ ID NO: 1322867 - DNA, 22 bp, Artificial Sequence
  chemically synthesized
agaccaaactcgataatttctt

SEQ ID NO: 1322868 - DNA, 22 bp, Artificial Sequence
  chemically synthesized
tactgagaccaaactcgataat

SEQ ID NO: 1322869 - DNA, 22 bp, Artificial Sequence
  chemically synthesized
taagaaattatcgagtttggtc

SEQ ID NO: 1322870 - DNA, 22 bp, Artificial Sequence
  chemically synthesized
tagcacatagaactatactgag

SEQ ID NO: 1322871 - DNA, 22 bp, Artificial Sequence
  chemically synthesized
tcgagtttggtctcagtatagt

SEQ ID NO: 1322872 - DNA, 22 bp, Artificial Sequence
  chemically synthesized
atagcacatagaactatactga

SEQ ID NO: 1322873 - DNA, 22 bp, Artificial Sequence
  chemically synthesized
ggtctcagtatagttctatgtg

SEQ ID NO: 1322874 - DNA, 22 bp, Artificial Sequence
  chemically synthesized
gtctcagtatagttctatgtgc

SEQ ID NO: 1322875 - DNA, 22 bp, Artificial Sequence
  chemically synthesized
gaggatccttatagcacataga

SEQ ID NO: 1322876 - DNA, 22 bp, Artificial Sequence
  chemically synthesized
tggaggatccttatagcacata

SEQ ID NO: 1322877 - DNA, 22 bp, Artificial Sequence
  chemically synthesized
agtatagttctatgtgctataa

SEQ ID NO: 1322878 - DNA, 22 bp, Artificial Sequence
  chemically synthesized
cattctggaggatccttatagc

SEQ ID NO: 1322879 - DNA, 22 bp, Artificial Sequence
  chemically synthesized
acattctggaggatccttatag

SEQ ID NO: 1322880 - DNA, 22 bp, Artificial Sequence
  chemically synthesized
tacattctggaggatccttata

SEQ ID NO: 1322881 - DNA, 22 bp, Artificial Sequence
  chemically synthesized
ttacattctggaggatccttat

SEQ ID NO: 1322882 - DNA, 22 bp, Artificial Sequence
  chemically synthesized
tttacattctggaggatcctta

SEQ ID NO: 1322883 - DNA, 22 bp, Artificial Sequence
  chemically synthesized
tatgtgctataaggatcctcca

SEQ ID NO: 1322884 - DNA, 22 bp, Artificial Sequence
  chemically synthesized
ttttttacattctggaggatcc

SEQ ID NO: 1322885 - DNA, 22 bp, Artificial Sequence
  chemically synthesized
tgtgctataaggatcctccaga

SEQ ID NO: 1322886 - DNA, 22 bp, Artificial Sequence
  chemically synthesized
taaggatcctccagaatgtaaa

SEQ ID NO: 1322887 - DNA, 22 bp, Artificial Sequence
  chemically synthesized
agaacaggtattattttttaca

SEQ ID NO: 1322888 - DNA, 22 bp, Artificial Sequence
  chemically synthesized
gagaacaggtattattttttac

SEQ ID NO: 1322889 - DNA, 22 bp, Artificial Sequence
  chemically synthesized
ttgagaacaggtattatttttt

SEQ ID NO: 1322890 - DNA, 22 bp, Artificial Sequence
  chemically synthesized
cagaatgtaaaaaataatacct

SEQ ID NO: 1322891 - DNA, 22 bp, Artificial Sequence
  chemically synthesized
aataagattcttgagaacaggt

SEQ ID NO: 1322892 - DNA, 22 bp, Artificial Sequence
  chemically synthesized
ttaaataagattcttgagaaca

SEQ ID NO: 1322893 - DNA, 22 bp, Artificial Sequence
  chemically synthesized
aactgttaaataagattcttga

SEQ ID NO: 1322894 - DNA, 22 bp, Artificial Sequence
  chemically synthesized
tcaactgttaaataagattctt

SEQ ID NO: 1322895 - DNA, 22 bp, Artificial Sequence
  chemically synthesized
tctcaactgttaaataagattc

SEQ ID NO: 1322896 - DNA, 22 bp, Artificial Sequence
  chemically synthesized
attctctcaactgttaaataag

SEQ ID NO: 1322897 - DNA, 22 bp, Artificial Sequence
  chemically synthesized
ttctcaagaatcttatttaaca

SEQ ID NO: 1322898 - DNA, 22 bp, Artificial Sequence
  chemically synthesized
tcaagaatcttatttaacagtt

SEQ ID NO: 1322899 - DNA, 22 bp, Artificial Sequence
  chemically synthesized
aagaatcttatttaacagttga

SEQ ID NO: 1322900 - DNA, 22 bp, Artificial Sequence
  chemically synthesized
agatccagctcattctctcaac

SEQ ID NO: 1322901 - DNA, 22 bp, Artificial Sequence
  chemically synthesized
ttcagatccagctcattctctc

SEQ ID NO: 1322902 - DNA, 22 bp, Artificial Sequence
  chemically synthesized
atttaacagttgagagaatgag

SEQ ID NO: 1322903 - DNA, 22 bp, Artificial Sequence
  chemically synthesized
attcagatccagctcattctct

SEQ ID NO: 1322904 - DNA, 22 bp, Artificial Sequence
  chemically synthesized
tttaacagttgagagaatgagc

SEQ ID NO: 1322905 - DNA, 22 bp, Artificial Sequence
  chemically synthesized
tattcagatccagctcattctc

SEQ ID NO: 1322906 - DNA, 22 bp, Artificial Sequence
  chemically synthesized
aacagttgagagaatgagctgg

SEQ ID NO: 1322907 - DNA, 22 bp, Artificial Sequence
  chemically synthesized
acagttgagagaatgagctgga

SEQ ID NO: 1322908 - DNA, 22 bp, Artificial Sequence
  chemically synthesized
tgtgttttattcagatccagct

SEQ ID NO: 1322909 - DNA, 22 bp, Artificial Sequence
  chemically synthesized
atgtgttttattcagatccagc

SEQ ID NO: 1322910 - DNA, 22 bp, Artificial Sequence
  chemically synthesized
agagaatgagctggatctgaat

SEQ ID NO: 1322911 - DNA, 22 bp, Artificial Sequence
  chemically synthesized
agaatcatagtttatgtgtttt

SEQ ID NO: 1322912 - DNA, 22 bp, Artificial Sequence
  chemically synthesized
gatctgaataaaacacataaac

SEQ ID NO: 1322913 - DNA, 22 bp, Artificial Sequence
  chemically synthesized
aataaaacacataaactatgat

SEQ ID NO: 1322914 - DNA, 22 bp, Artificial Sequence
  chemically synthesized
aggtgataaaagtctaagaatc

SEQ ID NO: 1322915 - DNA, 22 bp, Artificial Sequence
  chemically synthesized
tgaggtgataaaagtctaagaa

SEQ ID NO: 1322916 - DNA, 22 bp, Artificial Sequence
  chemically synthesized
tgattcttagacttttatcacc

SEQ ID NO: 1322917 - DNA, 22 bp, Artificial Sequence
  chemically synthesized
gcatatctctgaggtgataaaa

SEQ ID NO: 1322918 - DNA, 22 bp, Artificial Sequence
  chemically synthesized
ctagcatatctctgaggtgata

SEQ ID NO: 1322919 - DNA, 22 bp, Artificial Sequence
  chemically synthesized
cctagcatatctctgaggtgat

SEQ ID NO: 1322920 - DNA, 22 bp, Artificial Sequence
  chemically synthesized
tcctagcatatctctgaggtga

SEQ ID NO: 1322921 - DNA, 22 bp, Artificial Sequence
  chemically synthesized
ttagacttttatcacctcagag

SEQ ID NO: 1322922 - DNA, 22 bp, Artificial Sequence
  chemically synthesized
agacttttatcacctcagagat

SEQ ID NO: 1322923 - DNA, 22 bp, Artificial Sequence
  chemically synthesized
gacttttatcacctcagagata

SEQ ID NO: 1322924 - DNA, 22 bp, Artificial Sequence
  chemically synthesized
ttatcacctcagagatatgcta

SEQ ID NO: 1322925 - DNA, 22 bp, Artificial Sequence
  chemically synthesized
tatcacctcagagatatgctag

SEQ ID NO: 1322926 - DNA, 22 bp, Artificial Sequence
  chemically synthesized
atcacctcagagatatgctagg

SEQ ID NO: 1322927 - DNA, 22 bp, Artificial Sequence
  chemically synthesized
tcacctcagagatatgctagga

SEQ ID NO: 1322928 - DNA, 22 bp, Artificial Sequence
  chemically synthesized
aaaaatacagtattttcctagc

SEQ ID NO: 1322929 - DNA, 22 bp, Artificial Sequence
  chemically synthesized
aaaaaatacagtattttcctag

SEQ ID NO: 1322930 - DNA, 22 bp, Artificial Sequence
  chemically synthesized
ttaaaaaatacagtattttcct

SEQ ID NO: 1322931 - DNA, 22 bp, Artificial Sequence
  chemically synthesized
agagatatgctaggaaaatact

SEQ ID NO: 1322932 - DNA, 22 bp, Artificial Sequence
  chemically synthesized
aagggattcttaaaaaatacag

SEQ ID NO: 1322933 - DNA, 22 bp, Artificial Sequence
  chemically synthesized
aaagggattcttaaaaaataca

SEQ ID NO: 1322934 - DNA, 22 bp, Artificial Sequence
  chemically synthesized
taaagggattcttaaaaaatac

SEQ ID NO: 1322935 - DNA, 22 bp, Artificial Sequence
  chemically synthesized
ttaaagggattcttaaaaaata

SEQ ID NO: 1322936 - DNA, 22 bp, Artificial Sequence
  chemically synthesized
ggaaaatactgtattttttaag

SEQ ID NO: 1322937 - DNA, 22 bp, Artificial Sequence
  chemically synthesized
aggaaagtttttaaagggattc

SEQ ID NO: 1322938 - DNA, 22 bp, Artificial Sequence
  chemically synthesized
aaggaaagtttttaaagggatt

SEQ ID NO: 1322939 - DNA, 22 bp, Artificial Sequence
  chemically synthesized
tattttttaagaatccctttaa

SEQ ID NO: 1322940 - DNA, 22 bp, Artificial Sequence
  chemically synthesized
taaggaaagtttttaaagggat

SEQ ID NO: 1322941 - DNA, 22 bp, Artificial Sequence
  chemically synthesized
ctttaaggaaagtttttaaagg

SEQ ID NO: 1322942 - DNA, 22 bp, Artificial Sequence
  chemically synthesized
tttaagaatccctttaaaaact

SEQ ID NO: 1322943 - DNA, 22 bp, Artificial Sequence
  chemically synthesized
ttaagaatccctttaaaaactt

SEQ ID NO: 1322944 - DNA, 22 bp, Artificial Sequence
  chemically synthesized
ttgctttaaggaaagtttttaa

SEQ ID NO: 1322945 - DNA, 22 bp, Artificial Sequence
  chemically synthesized
taagaatccctttaaaaacttt

SEQ ID NO: 1322946 - DNA, 22 bp, Artificial Sequence
  chemically synthesized
aagaatccctttaaaaactttc

SEQ ID NO: 1322947 - DNA, 22 bp, Artificial Sequence
  chemically synthesized
agaatccctttaaaaactttcc

SEQ ID NO: 1322948 - DNA, 22 bp, Artificial Sequence
  chemically synthesized
tgttattgctttaaggaaagtt

SEQ ID NO: 1322949 - DNA, 22 bp, Artificial Sequence
  chemically synthesized
gtgttattgctttaaggaaagt

SEQ ID NO: 1322950 - DNA, 22 bp, Artificial Sequence
  chemically synthesized
taaaaactttccttaaagcaat

SEQ ID NO: 1322951 - DNA, 22 bp, Artificial Sequence
  chemically synthesized
aaaaactttccttaaagcaata

SEQ ID NO: 1322952 - DNA, 22 bp, Artificial Sequence
  chemically synthesized
gaatgcttgtgttattgcttta

SEQ ID NO: 1322953 - DNA, 22 bp, Artificial Sequence
  chemically synthesized
aaaactttccttaaagcaataa

SEQ ID NO: 1322954 - DNA, 22 bp, Artificial Sequence
  chemically synthesized
tccttaaagcaataacacaagc

SEQ ID NO: 1322955 - DNA, 22 bp, Artificial Sequence
  chemically synthesized
ccttaaagcaataacacaagca

SEQ ID NO: 1322956 - DNA, 22 bp, Artificial Sequence
  chemically synthesized
cttaaagcaataacacaagcat

SEQ ID NO: 1322957 - DNA, 22 bp, Artificial Sequence
  chemically synthesized
aaagcaataacacaagcattct

SEQ ID NO: 1322958 - DNA, 22 bp, Artificial Sequence
  chemically synthesized
aagcaataacacaagcattcta

SEQ ID NO: 1322959 - DNA, 22 bp, Artificial Sequence
  chemically synthesized
tgtggaaccatctagaatgctt

SEQ ID NO: 1322960 - DNA, 22 bp, Artificial Sequence
  chemically synthesized
tatgtggaaccatctagaatgc

SEQ ID NO: 1322961 - DNA, 22 bp, Artificial Sequence
  chemically synthesized
ctatgtggaaccatctagaatg

SEQ ID NO: 1322962 - DNA, 22 bp, Artificial Sequence
  chemically synthesized
cttctatgtggaaccatctaga

SEQ ID NO: 1322963 - DNA, 22 bp, Artificial Sequence
  chemically synthesized
tgcttctatgtggaaccatcta

SEQ ID NO: 1322964 - DNA, 22 bp, Artificial Sequence
  chemically synthesized
ctgcttctatgtggaaccatct

SEQ ID NO: 1322965 - DNA, 22 bp, Artificial Sequence
  chemically synthesized
tctgcttctatgtggaaccatc

SEQ ID NO: 1322966 - DNA, 22 bp, Artificial Sequence
  chemically synthesized
ttctgcttctatgtggaaccat

SEQ ID NO: 1322967 - DNA, 22 bp, Artificial Sequence
  chemically synthesized
tttctgcttctatgtggaacca

SEQ ID NO: 1322968 - DNA, 22 bp, Artificial Sequence
  chemically synthesized
ttttctgcttctatgtggaacc

SEQ ID NO: 1322969 - DNA, 22 bp, Artificial Sequence
  chemically synthesized
tttttctgcttctatgtggaac

SEQ ID NO: 1322970 - DNA, 22 bp, Artificial Sequence
  chemically synthesized
tattttttttctgcttctatgt

SEQ ID NO: 1322971 - DNA, 22 bp, Artificial Sequence
  chemically synthesized
tagatggttccacatagaagca

SEQ ID NO: 1322972 - DNA, 22 bp, Artificial Sequence
  chemically synthesized
gtattttttttctgcttctatg

SEQ ID NO: 1322973 - DNA, 22 bp, Artificial Sequence
  chemically synthesized
gatggttccacatagaagcaga

SEQ ID NO: 1322974 - DNA, 22 bp, Artificial Sequence
  chemically synthesized
ttgtattttttttctgcttcta

SEQ ID NO: 1322975 - DNA, 22 bp, Artificial Sequence
  chemically synthesized
cttgtattttttttctgcttct

SEQ ID NO: 1322976 - DNA, 22 bp, Artificial Sequence
  chemically synthesized
tcttgtattttttttctgcttc

SEQ ID NO: 1322977 - DNA, 22 bp, Artificial Sequence
  chemically synthesized
tttcttgtattttttttctgct

SEQ ID NO: 1322978 - DNA, 22 bp, Artificial Sequence
  chemically synthesized
ctttcttgtattttttttctgc

SEQ ID NO: 1322979 - DNA, 22 bp, Artificial Sequence
  chemically synthesized
tctttcttgtattttttttctg

SEQ ID NO: 1322980 - DNA, 22 bp, Artificial Sequence
  chemically synthesized
cacatagaagcagaaaaaaaat

SEQ ID NO: 1322981 - DNA, 22 bp, Artificial Sequence
  chemically synthesized
tatagagctttctttcttgtat

SEQ ID NO: 1322982 - DNA, 22 bp, Artificial Sequence
  chemically synthesized
gttatatagagctttctttctt

SEQ ID NO: 1322983 - DNA, 22 bp, Artificial Sequence
  chemically synthesized
aatcagggattggttatataga

SEQ ID NO: 1322984 - DNA, 22 bp, Artificial Sequence
  chemically synthesized
aaatcagggattggttatatag

SEQ ID NO: 1322985 - DNA, 22 bp, Artificial Sequence
  chemically synthesized
taaatcagggattggttatata

SEQ ID NO: 1322986 - DNA, 22 bp, Artificial Sequence
  chemically synthesized
acaattttaaatcagggattgg

SEQ ID NO: 1322987 - DNA, 22 bp, Artificial Sequence
  chemically synthesized
cacaattttaaatcagggattg

SEQ ID NO: 1322988 - DNA, 22 bp, Artificial Sequence
  chemically synthesized
tttcacaattttaaatcaggga

SEQ ID NO: 1322989 - DNA, 22 bp, Artificial Sequence
  chemically synthesized
tatataaccaatccctgattta

SEQ ID NO: 1322990 - DNA, 22 bp, Artificial Sequence
  chemically synthesized
tataaccaatccctgatttaaa

SEQ ID NO: 1322991 - DNA, 22 bp, Artificial Sequence
  chemically synthesized
agattgtttcacaattttaaat

SEQ ID NO: 1322992 - DNA, 22 bp, Artificial Sequence
  chemically synthesized
gagattgtttcacaattttaaa

SEQ ID NO: 1322993 - DNA, 22 bp, Artificial Sequence
  chemically synthesized
tttgagattgtttcacaatttt

SEQ ID NO: 1322994 - DNA, 22 bp, Artificial Sequence
  chemically synthesized
gacctatttgagattgtttcac

SEQ ID NO: 1322995 - DNA, 22 bp, Artificial Sequence
  chemically synthesized
atttaaaattgtgaaacaatct

SEQ ID NO: 1322996 - DNA, 22 bp, Artificial Sequence
  chemically synthesized
aaaattgtgaaacaatctcaaa

SEQ ID NO: 1322997 - DNA, 22 bp, Artificial Sequence
  chemically synthesized
aaattgtgaaacaatctcaaat

SEQ ID NO: 1322998 - DNA, 22 bp, Artificial Sequence
  chemically synthesized
tgaaacaatctcaaataggtcc

SEQ ID NO: 1322999 - DNA, 22 bp, Artificial Sequence
  chemically synthesized
gtaatgaaatgggactggacct

SEQ ID NO: 1323000 - DNA, 22 bp, Artificial Sequence
  chemically synthesized
ggtaatgaaatgggactggacc

SEQ ID NO: 1323001 - DNA, 22 bp, Artificial Sequence
  chemically synthesized
aaataggtccagtcccatttca

SEQ ID NO: 1323002 - DNA, 22 bp, Artificial Sequence
  chemically synthesized
tagatgtttggtaatgaaatgg

SEQ ID NO: 1323003 - DNA, 22 bp, Artificial Sequence
  chemically synthesized
gtagatgtttggtaatgaaatg

SEQ ID NO: 1323004 - DNA, 22 bp, Artificial Sequence
  chemically synthesized
cattaccaaacatctacaagtt

SEQ ID NO: 1323005 - DNA, 22 bp, Artificial Sequence
  chemically synthesized
attaccaaacatctacaagttt

SEQ ID NO: 1323006 - DNA, 22 bp, Artificial Sequence
  chemically synthesized
ccaaacatctacaagtttatgc

SEQ ID NO: 1323007 - DNA, 22 bp, Artificial Sequence
  chemically synthesized
caagtttatgctctgggtttac

SEQ ID NO: 1323008 - DNA, 22 bp, Artificial Sequence
  chemically synthesized
atgctctgggtttaccatcttt

SEQ ID NO: 1323009 - DNA, 22 bp, Artificial Sequence
  chemically synthesized
tgctctgggtttaccatctttt

SEQ ID NO: 1323010 - DNA, 22 bp, Artificial Sequence
  chemically synthesized
gggaggagatatcaaaagatgg

SEQ ID NO: 1323011 - DNA, 22 bp, Artificial Sequence
  chemically synthesized
tgggtttaccatcttttgatat

SEQ ID NO: 1323012 - DNA, 22 bp, Artificial Sequence
  chemically synthesized
ggtttaccatcttttgatatct

SEQ ID NO: 1323013 - DNA, 22 bp, Artificial Sequence
  chemically synthesized
gtattagggaggagatatcaaa

SEQ ID NO: 1323014 - DNA, 22 bp, Artificial Sequence
  chemically synthesized
actggtattagggaggagatat

SEQ ID NO: 1323015 - DNA, 22 bp, Artificial Sequence
  chemically synthesized
accatcttttgatatctcctcc

SEQ ID NO: 1323016 - DNA, 22 bp, Artificial Sequence
  chemically synthesized
cactggtattagggaggagata

SEQ ID NO: 1323017 - DNA, 22 bp, Artificial Sequence
  chemically synthesized
ccatcttttgatatctcctccc

SEQ ID NO: 1323018 - DNA, 22 bp, Artificial Sequence
  chemically synthesized
tcactggtattagggaggagat

SEQ ID NO: 1323019 - DNA, 22 bp, Artificial Sequence
  chemically synthesized
ttgatatctcctccctaatacc

SEQ ID NO: 1323020 - DNA, 22 bp, Artificial Sequence
  chemically synthesized
tgatatctcctccctaatacca

SEQ ID NO: 1323021 - DNA, 22 bp, Artificial Sequence
  chemically synthesized
gatatctcctccctaataccag

SEQ ID NO: 1323022 - DNA, 22 bp, Artificial Sequence
  chemically synthesized
atatctcctccctaataccagt

SEQ ID NO: 1323023 - DNA, 22 bp, Artificial Sequence
  chemically synthesized
catatccctttcactggtatta

SEQ ID NO: 1323024 - DNA, 22 bp, Artificial Sequence
  chemically synthesized
ccatatccctttcactggtatt

SEQ ID NO: 1323025 - DNA, 22 bp, Artificial Sequence
  chemically synthesized
ctccctaataccagtgaaaggg

SEQ ID NO: 1323026 - DNA, 22 bp, Artificial Sequence
  chemically synthesized
cctaataccagtgaaagggata

SEQ ID NO: 1323027 - DNA, 22 bp, Artificial Sequence
  chemically synthesized
ataccagtgaaagggatatgga

SEQ ID NO: 1323028 - DNA, 22 bp, Artificial Sequence
  chemically synthesized
tatcaacaaatttccatatccc

SEQ ID NO: 1323029 - DNA, 22 bp, Artificial Sequence
  chemically synthesized
cagtaacatctgtatcaacaaa

SEQ ID NO: 1323030 - DNA, 22 bp, Artificial Sequence
  chemically synthesized
tacagtaacatctgtatcaaca

SEQ ID NO: 1323031 - DNA, 22 bp, Artificial Sequence
  chemically synthesized
attctacagtaacatctgtatc

SEQ ID NO: 1323032 - DNA, 22 bp, Artificial Sequence
  chemically synthesized
gttgatacagatgttactgtag

SEQ ID NO: 1323033 - DNA, 22 bp, Artificial Sequence
  chemically synthesized
tcagtattaattctacagtaac

SEQ ID NO: 1323034 - DNA, 22 bp, Artificial Sequence
  chemically synthesized
ttgatacagatgttactgtaga

SEQ ID NO: 1323035 - DNA, 22 bp, Artificial Sequence
  chemically synthesized
atacagatgttactgtagaatt

SEQ ID NO: 1323036 - DNA, 22 bp, Artificial Sequence
  chemically synthesized
atcactgtcagtattaattcta

SEQ ID NO: 1323037 - DNA, 22 bp, Artificial Sequence
  chemically synthesized
actgatcactgtcagtattaat

SEQ ID NO: 1323038 - DNA, 22 bp, Artificial Sequence
  chemically synthesized
cactgatcactgtcagtattaa

SEQ ID NO: 1323039 - DNA, 22 bp, Artificial Sequence
  chemically synthesized
ctgtagaattaatactgacagt

SEQ ID NO: 1323040 - DNA, 22 bp, Artificial Sequence
  chemically synthesized
tagaattaatactgacagtgat

SEQ ID NO: 1323041 - DNA, 22 bp, Artificial Sequence
  chemically synthesized
atactgacagtgatcagtgaaa

SEQ ID NO: 1323042 - DNA, 22 bp, Artificial Sequence
  chemically synthesized
ccaccccaatgtaaatttcact

SEQ ID NO: 1323043 - DNA, 22 bp, Artificial Sequence
  chemically synthesized
acagtgatcagtgaaatttaca

SEQ ID NO: 1323044 - DNA, 22 bp, Artificial Sequence
  chemically synthesized
attaccaccccaatgtaaattt

SEQ ID NO: 1323045 - DNA, 22 bp, Artificial Sequence
  chemically synthesized
ataactaattaccaccccaatg

SEQ ID NO: 1323046 - DNA, 22 bp, Artificial Sequence
  chemically synthesized
aatcattaataactaattacca

SEQ ID NO: 1323047 - DNA, 22 bp, Artificial Sequence
  chemically synthesized
aaatcattaataactaattacc

SEQ ID NO: 1323048 - DNA, 22 bp, Artificial Sequence
  chemically synthesized
taaatcattaataactaattac

SEQ ID NO: 1323049 - DNA, 22 bp, Artificial Sequence
  chemically synthesized
acattggggtggtaattagtta

SEQ ID NO: 1323050 - DNA, 22 bp, Artificial Sequence
  chemically synthesized
cattggggtggtaattagttat

SEQ ID NO: 1323051 - DNA, 22 bp, Artificial Sequence
  chemically synthesized
gggtggtaattagttattaatg

SEQ ID NO: 1323052 - DNA, 22 bp, Artificial Sequence
  chemically synthesized
taaaaattttaaatcattaata

SEQ ID NO: 1323053 - DNA, 22 bp, Artificial Sequence
  chemically synthesized
gttattaatgatttaaaatttt

SEQ ID NO: 1323054 - DNA, 22 bp, Artificial Sequence
  chemically synthesized
ttaatgatttaaaatttttaca

SEQ ID NO: 1323055 - DNA, 22 bp, Artificial Sequence
  chemically synthesized
atgatttaaaatttttacagtg

SEQ ID NO: 1323056 - DNA, 22 bp, Artificial Sequence
  chemically synthesized
gaagacagtaaaggtgacactg

SEQ ID NO: 1323057 - DNA, 22 bp, Artificial Sequence
  chemically synthesized
aaaatttttacagtgtcacctt

SEQ ID NO: 1323058 - DNA, 22 bp, Artificial Sequence
  chemically synthesized
aaatttttacagtgtcaccttt

SEQ ID NO: 1323059 - DNA, 22 bp, Artificial Sequence
  chemically synthesized
ttacagtgtcacctttactgtc

SEQ ID NO: 1323060 - DNA, 22 bp, Artificial Sequence
  chemically synthesized
tacagtgtcacctttactgtct

SEQ ID NO: 1323061 - DNA, 22 bp, Artificial Sequence
  chemically synthesized
acagtgtcacctttactgtctt

SEQ ID NO: 1323062 - DNA, 22 bp, Artificial Sequence
  chemically synthesized
cagtgtcacctttactgtcttc

SEQ ID NO: 1323063 - DNA, 22 bp, Artificial Sequence
  chemically synthesized
gacacacatcgttagaagacag

SEQ ID NO: 1323064 - DNA, 22 bp, Artificial Sequence
  chemically synthesized
ggacacacatcgttagaagaca

SEQ ID NO: 1323065 - DNA, 22 bp, Artificial Sequence
  chemically synthesized
tggacacacatcgttagaagac

SEQ ID NO: 1323066 - DNA, 22 bp, Artificial Sequence
  chemically synthesized
ttttggacacacatcgttagaa

SEQ ID NO: 1323067 - DNA, 22 bp, Artificial Sequence
  chemically synthesized
tactgtcttctaacgatgtgtg

SEQ ID NO: 1323068 - DNA, 22 bp, Artificial Sequence
  chemically synthesized
actgtcttctaacgatgtgtgt

SEQ ID NO: 1323069 - DNA, 22 bp, Artificial Sequence
  chemically synthesized
ctgtcttctaacgatgtgtgtc

SEQ ID NO: 1323070 - DNA, 22 bp, Artificial Sequence
  chemically synthesized
tcttctaacgatgtgtgtccaa

SEQ ID NO: 1323071 - DNA, 22 bp, Artificial Sequence
  chemically synthesized
ctaacgatgtgtgtccaaaaca

SEQ ID NO: 1323072 - DNA, 22 bp, Artificial Sequence
  chemically synthesized
atgtataaatactgttttggac

SEQ ID NO: 1323073 - DNA, 22 bp, Artificial Sequence
  chemically synthesized
taacgatgtgtgtccaaaacag

SEQ ID NO: 1323074 - DNA, 22 bp, Artificial Sequence
  chemically synthesized
acgatgtgtgtccaaaacagta

SEQ ID NO: 1323075 - DNA, 22 bp, Artificial Sequence
  chemically synthesized
atacatgagactcttttttttt

SEQ ID NO: 1323076 - DNA, 22 bp, Artificial Sequence
  chemically synthesized
tacatgagactctttttttttt

SEQ ID NO: 1323077 - DNA, 22 bp, Artificial Sequence
  chemically synthesized
aaaaaaaaaaaaaaaaaaaaaa

SEQ ID NO: 1323078 - DNA, 22 bp, Artificial Sequence
  chemically synthesized
tctcaaaaaaaaaaaaaaaaaa

SEQ ID NO: 1323079 - DNA, 22 bp, Artificial Sequence
  chemically synthesized
tgtctcaaaaaaaaaaaaaaaa

SEQ ID NO: 1323080 - DNA, 22 bp, Artificial Sequence
  chemically synthesized
tttttttttttttttttttttt

SEQ ID NO: 1323081 - DNA, 22 bp, Artificial Sequence
  chemically synthesized
ttttttttttttttttttttga

SEQ ID NO: 1323082 - DNA, 22 bp, Artificial Sequence
  chemically synthesized
tttttttttttttttttttgag

SEQ ID NO: 1323083 - DNA, 22 bp, Artificial Sequence
  chemically synthesized
ttttttttttttttttttgaga

SEQ ID NO: 1323084 - DNA, 22 bp, Artificial Sequence
  chemically synthesized
tttttttttttttttttgagac

SEQ ID NO: 1323085 - DNA, 22 bp, Artificial Sequence
  chemically synthesized
ttttttttttttttttgagaca

SEQ ID NO: 1323086 - DNA, 22 bp, Artificial Sequence
  chemically synthesized
tttttttttttttttgagacag

SEQ ID NO: 1323087 - DNA, 22 bp, Artificial Sequence
  chemically synthesized
ttttttttttttttgagacaga

SEQ ID NO: 1323088 - DNA, 22 bp, Artificial Sequence
  chemically synthesized
tttttttttttttgagacagag

SEQ ID NO: 1323089 - DNA, 22 bp, Artificial Sequence
  chemically synthesized
ttttttttttttgagacagagt

SEQ ID NO: 1323090 - DNA, 22 bp, Artificial Sequence
  chemically synthesized
tttttttttttgagacagagtc

SEQ ID NO: 1323091 - DNA, 22 bp, Artificial Sequence
  chemically synthesized
ttttttttttgagacagagtct

SEQ ID NO: 1323092 - DNA, 22 bp, Artificial Sequence
  chemically synthesized
tttttttttgagacagagtctc

SEQ ID NO: 1323093 - DNA, 22 bp, Artificial Sequence
  chemically synthesized
ttttttttgagacagagtctca

SEQ ID NO: 1323094 - DNA, 22 bp, Artificial Sequence
  chemically synthesized
tttttttgagacagagtctcac

SEQ ID NO: 1323095 - DNA, 22 bp, Artificial Sequence
  chemically synthesized
ttttttgagacagagtctcact

SEQ ID NO: 1323096 - DNA, 22 bp, Artificial Sequence
  chemically synthesized
ggcgacagagtgagtgagactc

SEQ ID NO: 1323097 - DNA, 22 bp, Artificial Sequence
  chemically synthesized
tttttgagacagagtctcactc

SEQ ID NO: 1323098 - DNA, 22 bp, Artificial Sequence
  chemically synthesized
ttttgagacagagtctcactca

SEQ ID NO: 1323099 - DNA, 22 bp, Artificial Sequence
  chemically synthesized
tttgagacagagtctcactcac

SEQ ID NO: 1323100 - DNA, 22 bp, Artificial Sequence
  chemically synthesized
ttgagacagagtctcactcact

SEQ ID NO: 1323101 - DNA, 22 bp, Artificial Sequence
  chemically synthesized
tgagacagagtctcactcactc

SEQ ID NO: 1323102 - DNA, 22 bp, Artificial Sequence
  chemically synthesized
gagacagagtctcactcactct

SEQ ID NO: 1323103 - DNA, 22 bp, Artificial Sequence
  chemically synthesized
agacagagtctcactcactctg

SEQ ID NO: 1323104 - DNA, 22 bp, Artificial Sequence
  chemically synthesized
caggctgggcgacagagtgagt

SEQ ID NO: 1323105 - DNA, 22 bp, Artificial Sequence
  chemically synthesized
ccctccaggctgggcgacagag

SEQ ID NO: 1323106 - DNA, 22 bp, Artificial Sequence
  chemically synthesized
actcactctgtcgcccagcctg

SEQ ID NO: 1323107 - DNA, 22 bp, Artificial Sequence
  chemically synthesized
actctgtcgcccagcctggagg

SEQ ID NO: 1323108 - DNA, 22 bp, Artificial Sequence
  chemically synthesized
tgtcgcccagcctggagggcag

SEQ ID NO: 1323109 - DNA, 22 bp, Artificial Sequence
  chemically synthesized
tcgcccagcctggagggcagtg

SEQ ID NO: 1323110 - DNA, 22 bp, Artificial Sequence
  chemically synthesized
cagtgagcccagatcacaccac

SEQ ID NO: 1323111 - DNA, 22 bp, Artificial Sequence
  chemically synthesized
gagggcagtggtgtgatctggg

SEQ ID NO: 1323112 - DNA, 22 bp, Artificial Sequence
  chemically synthesized
ggaggcagaggttgcagtgagc

SEQ ID NO: 1323113 - DNA, 22 bp, Artificial Sequence
  chemically synthesized
agcctgggaggcagaggttgca

SEQ ID NO: 1323114 - DNA, 22 bp, Artificial Sequence
  chemically synthesized
gagcctgggaggcagaggttgc

SEQ ID NO: 1323115 - DNA, 22 bp, Artificial Sequence
  chemically synthesized
cttgagcctgggaggcagaggt

SEQ ID NO: 1323116 - DNA, 22 bp, Artificial Sequence
  chemically synthesized
ggctcactgcaacctctgcctc

SEQ ID NO: 1323117 - DNA, 22 bp, Artificial Sequence
  chemically synthesized
actgcaacctctgcctcccagg

SEQ ID NO: 1323118 - DNA, 22 bp, Artificial Sequence
  chemically synthesized
caacctctgcctcccaggctca

SEQ ID NO: 1323119 - DNA, 22 bp, Artificial Sequence
  chemically synthesized
aggcaggagaattgcttgagcc

SEQ ID NO: 1323120 - DNA, 22 bp, Artificial Sequence
  chemically synthesized
tgcctcccaggctcaagcaatt

SEQ ID NO: 1323121 - DNA, 22 bp, Artificial Sequence
  chemically synthesized
cctcccaggctcaagcaattct

SEQ ID NO: 1323122 - DNA, 22 bp, Artificial Sequence
  chemically synthesized
ggaggctgaggcaggagaattg

SEQ ID NO: 1323123 - DNA, 22 bp, Artificial Sequence
  chemically synthesized
ccaggctcaagcaattctcctg

SEQ ID NO: 1323124 - DNA, 22 bp, Artificial Sequence
  chemically synthesized
gggaggctgaggcaggagaatt

SEQ ID NO: 1323125 - DNA, 22 bp, Artificial Sequence
  chemically synthesized
cttgggaggctgaggcaggaga

SEQ ID NO: 1323126 - DNA, 22 bp, Artificial Sequence
  chemically synthesized
aagcaattctcctgcctcagcc

SEQ ID NO: 1323127 - DNA, 22 bp, Artificial Sequence
  chemically synthesized
agctgcttgggaggctgaggca

SEQ ID NO: 1323128 - DNA, 22 bp, Artificial Sequence
  chemically synthesized
taatctcagctgcttgggaggc

SEQ ID NO: 1323129 - DNA, 22 bp, Artificial Sequence
  chemically synthesized
tcctgcctcagcctcccaagca

SEQ ID NO: 1323130 - DNA, 22 bp, Artificial Sequence
  chemically synthesized
ctgcctcagcctcccaagcagc

SEQ ID NO: 1323131 - DNA, 22 bp, Artificial Sequence
  chemically synthesized
cctcagcctcccaagcagctga

SEQ ID NO: 1323132 - DNA, 22 bp, Artificial Sequence
  chemically synthesized
agcctcccaagcagctgagatt

SEQ ID NO: 1323133 - DNA, 22 bp, Artificial Sequence
  chemically synthesized
ccaagcagctgagattacaggc

SEQ ID NO: 1323134 - DNA, 22 bp, Artificial Sequence
  chemically synthesized
gccgggcgtggtggccagtgcc

SEQ ID NO: 1323135 - DNA, 22 bp, Artificial Sequence
  chemically synthesized
agattacaggcactggccacca

SEQ ID NO: 1323136 - DNA, 22 bp, Artificial Sequence
  chemically synthesized
caggcactggccaccacgcccg

SEQ ID NO: 1323137 - DNA, 22 bp, Artificial Sequence
  chemically synthesized
aaaatacaaaaattagccgggc

SEQ ID NO: 1323138 - DNA, 22 bp, Artificial Sequence
  chemically synthesized
ctaaaaatacaaaaattagccg

SEQ ID NO: 1323139 - DNA, 22 bp, Artificial Sequence
  chemically synthesized
gccaccacgcccggctaatttt

SEQ ID NO: 1323140 - DNA, 22 bp, Artificial Sequence
  chemically synthesized
tactaaaaatacaaaaattagc

SEQ ID NO: 1323141 - DNA, 22 bp, Artificial Sequence
  chemically synthesized
atttttgtatttttagtagaga

SEQ ID NO: 1323142 - DNA, 22 bp, Artificial Sequence
  chemically synthesized
ttgtatttttagtagagacggg

SEQ ID NO: 1323143 - DNA, 22 bp, Artificial Sequence
  chemically synthesized
tgtatttttagtagagacgggg

SEQ ID NO: 1323144 - DNA, 22 bp, Artificial Sequence
  chemically synthesized
gtatttttagtagagacggggt

SEQ ID NO: 1323145 - DNA, 22 bp, Artificial Sequence
  chemically synthesized
tatttttagtagagacggggtt

SEQ ID NO: 1323146 - DNA, 22 bp, Artificial Sequence
  chemically synthesized
gccagcatgatgaaaccccgtc

SEQ ID NO: 1323147 - DNA, 22 bp, Artificial Sequence
  chemically synthesized
ttagtagagacggggtttcatc

SEQ ID NO: 1323148 - DNA, 22 bp, Artificial Sequence
  chemically synthesized
tagtagagacggggtttcatca

SEQ ID NO: 1323149 - DNA, 22 bp, Artificial Sequence
  chemically synthesized
agtagagacggggtttcatcat

SEQ ID NO: 1323150 - DNA, 22 bp, Artificial Sequence
  chemically synthesized
gtagagacggggtttcatcatg

SEQ ID NO: 1323151 - DNA, 22 bp, Artificial Sequence
  chemically synthesized
agaccagcctggccagcatgat

SEQ ID NO: 1323152 - DNA, 22 bp, Artificial Sequence
  chemically synthesized
gagaccagcctggccagcatga

SEQ ID NO: 1323153 - DNA, 22 bp, Artificial Sequence
  chemically synthesized
catcatgctggccaggctggtc

SEQ ID NO: 1323154 - DNA, 22 bp, Artificial Sequence
  chemically synthesized
atcatgctggccaggctggtct

SEQ ID NO: 1323155 - DNA, 22 bp, Artificial Sequence
  chemically synthesized
aggtcaggagtttgagaccagc

SEQ ID NO: 1323156 - DNA, 22 bp, Artificial Sequence
  chemically synthesized
cctgaggtcaggagtttgagac

SEQ ID NO: 1323157 - DNA, 22 bp, Artificial Sequence
  chemically synthesized
gccaggctggtctcaaactcct

SEQ ID NO: 1323158 - DNA, 22 bp, Artificial Sequence
  chemically synthesized
gtctcaaactcctgacctcagg

SEQ ID NO: 1323159 - DNA, 22 bp, Artificial Sequence
  chemically synthesized
aggggatgaattacctgaggtc

SEQ ID NO: 1323160 - DNA, 22 bp, Artificial Sequence
  chemically synthesized
aaactcctgacctcaggtaatt

SEQ ID NO: 1323161 - DNA, 22 bp, Artificial Sequence
  chemically synthesized
ggaggctgaggggatgaattac

SEQ ID NO: 1323162 - DNA, 22 bp, Artificial Sequence
  chemically synthesized
gggaggctgaggggatgaatta

SEQ ID NO: 1323163 - DNA, 22 bp, Artificial Sequence
  chemically synthesized
ctgacctcaggtaattcatccc

SEQ ID NO: 1323164 - DNA, 22 bp, Artificial Sequence
  chemically synthesized
tgggaggctgaggggatgaatt

SEQ ID NO: 1323165 - DNA, 22 bp, Artificial Sequence
  chemically synthesized
acctcaggtaattcatcccctc

SEQ ID NO: 1323166 - DNA, 22 bp, Artificial Sequence
  chemically synthesized
aggtaattcatcccctcagcct

SEQ ID NO: 1323167 - DNA, 22 bp, Artificial Sequence
  chemically synthesized
taatcccagcactttgggaggc

SEQ ID NO: 1323168 - DNA, 22 bp, Artificial Sequence
  chemically synthesized
atcccctcagcctcccaaagtg

SEQ ID NO: 1323169 - DNA, 22 bp, Artificial Sequence
  chemically synthesized
acacctgtaatcccagcacttt

SEQ ID NO: 1323170 - DNA, 22 bp, Artificial Sequence
  chemically synthesized
agcctcccaaagtgctgggatt

SEQ ID NO: 1323171 - DNA, 22 bp, Artificial Sequence
  chemically synthesized
ccaaagtgctgggattacaggt

SEQ ID NO: 1323172 - DNA, 22 bp, Artificial Sequence
  chemically synthesized
ggcatggtggctcacacctgta

SEQ ID NO: 1323173 - DNA, 22 bp, Artificial Sequence
  chemically synthesized
ggattacaggtgtgagccacca

SEQ ID NO: 1323174 - DNA, 22 bp, Artificial Sequence
  chemically synthesized
gtggggctgggcatggtggctc

SEQ ID NO: 1323175 - DNA, 22 bp, Artificial Sequence
  chemically synthesized
ctggtggggctgggcatggtgg

SEQ ID NO: 1323176 - DNA, 22 bp, Artificial Sequence
  chemically synthesized
caggtgtgagccaccatgccca

SEQ ID NO: 1323177 - DNA, 22 bp, Artificial Sequence
  chemically synthesized
aaatgttactggtggggctggg

SEQ ID NO: 1323178 - DNA, 22 bp, Artificial Sequence
  chemically synthesized
aaaatgttactggtggggctgg

SEQ ID NO: 1323179 - DNA, 22 bp, Artificial Sequence
  chemically synthesized
agcccttaaaatgttactggtg

SEQ ID NO: 1323180 - DNA, 22 bp, Artificial Sequence
  chemically synthesized
ttgagcccttaaaatgttactg

SEQ ID NO: 1323181 - DNA, 22 bp, Artificial Sequence
  chemically synthesized
taagggctcaatagtcacatat

SEQ ID NO: 1323182 - DNA, 22 bp, Artificial Sequence
  chemically synthesized
aagggctcaatagtcacatatg

SEQ ID NO: 1323183 - DNA, 22 bp, Artificial Sequence
  chemically synthesized
agggctcaatagtcacatatgg

SEQ ID NO: 1323184 - DNA, 22 bp, Artificial Sequence
  chemically synthesized
aatagtcacatatggctattgg

SEQ ID NO: 1323185 - DNA, 22 bp, Artificial Sequence
  chemically synthesized
tcatgaccaatatagtagccaa

SEQ ID NO: 1323186 - DNA, 22 bp, Artificial Sequence
  chemically synthesized
tatctatcatgaccaatatagt

SEQ ID NO: 1323187 - DNA, 22 bp, Artificial Sequence
  chemically synthesized
tgtatctatcatgaccaatata

SEQ ID NO: 1323188 - DNA, 22 bp, Artificial Sequence
  chemically synthesized
ttggctactatattggtcatga

SEQ ID NO: 1323189 - DNA, 22 bp, Artificial Sequence
  chemically synthesized
gctactatattggtcatgatag

SEQ ID NO: 1323190 - DNA, 22 bp, Artificial Sequence
  chemically synthesized
ctatattggtcatgatagatac

SEQ ID NO: 1323191 - DNA, 22 bp, Artificial Sequence
  chemically synthesized
tattggtcatgatagatacaga

SEQ ID NO: 1323192 - DNA, 22 bp, Artificial Sequence
  chemically synthesized
caatagaaatgttctgtatcta

SEQ ID NO: 1323193 - DNA, 22 bp, Artificial Sequence
  chemically synthesized
tgcaatagaaatgttctgtatc

SEQ ID NO: 1323194 - DNA, 22 bp, Artificial Sequence
  chemically synthesized
ctgcaatagaaatgttctgtat

SEQ ID NO: 1323195 - DNA, 22 bp, Artificial Sequence
  chemically synthesized
tctgcaatagaaatgttctgta

SEQ ID NO: 1323196 - DNA, 22 bp, Artificial Sequence
  chemically synthesized
gtcatgatagatacagaacatt

SEQ ID NO: 1323197 - DNA, 22 bp, Artificial Sequence
  chemically synthesized
atagaactttctgcaatagaaa

SEQ ID NO: 1323198 - DNA, 22 bp, Artificial Sequence
  chemically synthesized
agatagtgctaatagaactttc

SEQ ID NO: 1323199 - DNA, 22 bp, Artificial Sequence
  chemically synthesized
ctcagatagtgctaatagaact

SEQ ID NO: 1323200 - DNA, 22 bp, Artificial Sequence
  chemically synthesized
ctattgcagaaagttctattag

SEQ ID NO: 1323201 - DNA, 22 bp, Artificial Sequence
  chemically synthesized
tattgcagaaagttctattagc

SEQ ID NO: 1323202 - DNA, 22 bp, Artificial Sequence
  chemically synthesized
ttgcagaaagttctattagcac

SEQ ID NO: 1323203 - DNA, 22 bp, Artificial Sequence
  chemically synthesized
tattgctcagatagtgctaata

SEQ ID NO: 1323204 - DNA, 22 bp, Artificial Sequence
  chemically synthesized
cagaaagttctattagcactat

SEQ ID NO: 1323205 - DNA, 22 bp, Artificial Sequence
  chemically synthesized
tattagcactatctgagcaata

SEQ ID NO: 1323206 - DNA, 22 bp, Artificial Sequence
  chemically synthesized
ttagcactatctgagcaatata

SEQ ID NO: 1323207 - DNA, 22 bp, Artificial Sequence
  chemically synthesized
gcactatctgagcaatataact

SEQ ID NO: 1323208 - DNA, 22 bp, Artificial Sequence
  chemically synthesized
gtgacaataaaaagttatattg

SEQ ID NO: 1323209 - DNA, 22 bp, Artificial Sequence
  chemically synthesized
agtgacaataaaaagttatatt

SEQ ID NO: 1323210 - DNA, 22 bp, Artificial Sequence
  chemically synthesized
ttagtgacaataaaaagttata

SEQ ID NO: 1323211 - DNA, 22 bp, Artificial Sequence
  chemically synthesized
tctgagcaatataactttttat

SEQ ID NO: 1323212 - DNA, 22 bp, Artificial Sequence
  chemically synthesized
ctcttagtgacaataaaaagtt

SEQ ID NO: 1323213 - DNA, 22 bp, Artificial Sequence
  chemically synthesized
agcaatataactttttattgtc

SEQ ID NO: 1323214 - DNA, 22 bp, Artificial Sequence
  chemically synthesized
ggtaagttcctcttagtgacaa

SEQ ID NO: 1323215 - DNA, 22 bp, Artificial Sequence
  chemically synthesized
tttattgtcactaagaggaact

SEQ ID NO: 1323216 - DNA, 22 bp, Artificial Sequence
  chemically synthesized
ttattgtcactaagaggaactt

SEQ ID NO: 1323217 - DNA, 22 bp, Artificial Sequence
  chemically synthesized
tattgtcactaagaggaactta

SEQ ID NO: 1323218 - DNA, 22 bp, Artificial Sequence
  chemically synthesized
attgtcactaagaggaacttac

SEQ ID NO: 1323219 - DNA, 22 bp, Artificial Sequence
  chemically synthesized
ttgtcactaagaggaacttacc

SEQ ID NO: 1323220 - DNA, 22 bp, Artificial Sequence
  chemically synthesized
tcactaagaggaacttacctag

SEQ ID NO: 1323221 - DNA, 22 bp, Artificial Sequence
  chemically synthesized
agaggaacttacctagttattt

SEQ ID NO: 1323222 - DNA, 22 bp, Artificial Sequence
  chemically synthesized
gcagaccagagtaaataactag

SEQ ID NO: 1323223 - DNA, 22 bp, Artificial Sequence
  chemically synthesized
acctagttatttactctggtct

SEQ ID NO: 1323224 - DNA, 22 bp, Artificial Sequence
  chemically synthesized
cctagttatttactctggtctg

SEQ ID NO: 1323225 - DNA, 22 bp, Artificial Sequence
  chemically synthesized
gttatttactctggtctgctag

SEQ ID NO: 1323226 - DNA, 22 bp, Artificial Sequence
  chemically synthesized
caggtaaaatcatactagcaga

SEQ ID NO: 1323227 - DNA, 22 bp, Artificial Sequence
  chemically synthesized
acaggtaaaatcatactagcag

SEQ ID NO: 1323228 - DNA, 22 bp, Artificial Sequence
  chemically synthesized
tttactctggtctgctagtatg

SEQ ID NO: 1323229 - DNA, 22 bp, Artificial Sequence
  chemically synthesized
actctggtctgctagtatgatt

SEQ ID NO: 1323230 - DNA, 22 bp, Artificial Sequence
  chemically synthesized
ctctggtctgctagtatgattt

SEQ ID NO: 1323231 - DNA, 22 bp, Artificial Sequence
  chemically synthesized
tatttacaggtaaaatcatact

SEQ ID NO: 1323232 - DNA, 22 bp, Artificial Sequence
  chemically synthesized
tggtctgctagtatgattttac

SEQ ID NO: 1323233 - DNA, 22 bp, Artificial Sequence
  chemically synthesized
gtctgctagtatgattttacct

SEQ ID NO: 1323234 - DNA, 22 bp, Artificial Sequence
  chemically synthesized
tattatatttacaggtaaaatc

SEQ ID NO: 1323235 - DNA, 22 bp, Artificial Sequence
  chemically synthesized
ctagtatgattttacctgtaaa

SEQ ID NO: 1323236 - DNA, 22 bp, Artificial Sequence
  chemically synthesized
gtatgattttacctgtaaatat

SEQ ID NO: 1323237 - DNA, 22 bp, Artificial Sequence
  chemically synthesized
cagtccaaatatgctgtattat

SEQ ID NO: 1323238 - DNA, 22 bp, Artificial Sequence
  chemically synthesized
tacctgtaaatataatacagca

SEQ ID NO: 1323239 - DNA, 22 bp, Artificial Sequence
  chemically synthesized
acctgtaaatataatacagcat

SEQ ID NO: 1323240 - DNA, 22 bp, Artificial Sequence
  chemically synthesized
cctgtaaatataatacagcata

SEQ ID NO: 1323241 - DNA, 22 bp, Artificial Sequence
  chemically synthesized
taaatataatacagcatatttg

SEQ ID NO: 1323242 - DNA, 22 bp, Artificial Sequence
  chemically synthesized
tgtgttgcagtccaaatatgct

SEQ ID NO: 1323243 - DNA, 22 bp, Artificial Sequence
  chemically synthesized
aattatgtgttgcagtccaaat

SEQ ID NO: 1323244 - DNA, 22 bp, Artificial Sequence
  chemically synthesized
ggaaagattcaattatgtgttg

SEQ ID NO: 1323245 - DNA, 22 bp, Artificial Sequence
  chemically synthesized
tctgggaaagattcaattatgt

SEQ ID NO: 1323246 - DNA, 22 bp, Artificial Sequence
  chemically synthesized
ggactgcaacacataattgaat

SEQ ID NO: 1323247 - DNA, 22 bp, Artificial Sequence
  chemically synthesized
gactgcaacacataattgaatc

SEQ ID NO: 1323248 - DNA, 22 bp, Artificial Sequence
  chemically synthesized
tcctatctgggaaagattcaat

SEQ ID NO: 1323249 - DNA, 22 bp, Artificial Sequence
  chemically synthesized
tgtcctatctgggaaagattca

SEQ ID NO: 1323250 - DNA, 22 bp, Artificial Sequence
  chemically synthesized
caacacataattgaatctttcc

SEQ ID NO: 1323251 - DNA, 22 bp, Artificial Sequence
  chemically synthesized
aatctttcccagataggacaga

SEQ ID NO: 1323252 - DNA, 22 bp, Artificial Sequence
  chemically synthesized
tcccagataggacagaatatat

SEQ ID NO: 1323253 - DNA, 22 bp, Artificial Sequence
  chemically synthesized
cccagataggacagaatatatg

SEQ ID NO: 1323254 - DNA, 22 bp, Artificial Sequence
  chemically synthesized
ccagataggacagaatatatgt

SEQ ID NO: 1323255 - DNA, 22 bp, Artificial Sequence
  chemically synthesized
aacagaacaaatacatatattc

SEQ ID NO: 1323256 - DNA, 22 bp, Artificial Sequence
  chemically synthesized
tgaacagaacaaatacatatat

SEQ ID NO: 1323257 - DNA, 22 bp, Artificial Sequence
  chemically synthesized
ctgaacagaacaaatacatata

SEQ ID NO: 1323258 - DNA, 22 bp, Artificial Sequence
  chemically synthesized
tctgaacagaacaaatacatat

SEQ ID NO: 1323259 - DNA, 22 bp, Artificial Sequence
  chemically synthesized
ggatgaatctttctgaacagaa

SEQ ID NO: 1323260 - DNA, 22 bp, Artificial Sequence
  chemically synthesized
aactgggatgaatctttctgaa

SEQ ID NO: 1323261 - DNA, 22 bp, Artificial Sequence
  chemically synthesized
cgctaaactgggatgaatcttt

SEQ ID NO: 1323262 - DNA, 22 bp, Artificial Sequence
  chemically synthesized
gttctgttcagaaagattcatc

SEQ ID NO: 1323263 - DNA, 22 bp, Artificial Sequence
  chemically synthesized
ccgctaaactgggatgaatctt

SEQ ID NO: 1323264 - DNA, 22 bp, Artificial Sequence
  chemically synthesized
ttctgttcagaaagattcatcc

SEQ ID NO: 1323265 - DNA, 22 bp, Artificial Sequence
  chemically synthesized
ttccgctaaactgggatgaatc

SEQ ID NO: 1323266 - DNA, 22 bp, Artificial Sequence
  chemically synthesized
tgttcagaaagattcatcccag

SEQ ID NO: 1323267 - DNA, 22 bp, Artificial Sequence
  chemically synthesized
tcttccgctaaactgggatgaa

SEQ ID NO: 1323268 - DNA, 22 bp, Artificial Sequence
  chemically synthesized
ctcttccgctaaactgggatga

SEQ ID NO: 1323269 - DNA, 22 bp, Artificial Sequence
  chemically synthesized
ttcagaaagattcatcccagtt

SEQ ID NO: 1323270 - DNA, 22 bp, Artificial Sequence
  chemically synthesized
tctcttccgctaaactgggatg

SEQ ID NO: 1323271 - DNA, 22 bp, Artificial Sequence
  chemically synthesized
agaaagattcatcccagtttag

SEQ ID NO: 1323272 - DNA, 22 bp, Artificial Sequence
  chemically synthesized
gttttctcttccgctaaactgg

SEQ ID NO: 1323273 - DNA, 22 bp, Artificial Sequence
  chemically synthesized
cgttttctcttccgctaaactg

SEQ ID NO: 1323274 - DNA, 22 bp, Artificial Sequence
  chemically synthesized
aggcttcgttttctcttccgct

SEQ ID NO: 1323275 - DNA, 22 bp, Artificial Sequence
  chemically synthesized
atcccagtttagcggaagagaa

SEQ ID NO: 1323276 - DNA, 22 bp, Artificial Sequence
  chemically synthesized
taggtgttgaggcttcgttttc

SEQ ID NO: 1323277 - DNA, 22 bp, Artificial Sequence
  chemically synthesized
agcggaagagaaaacgaagcct

SEQ ID NO: 1323278 - DNA, 22 bp, Artificial Sequence
  chemically synthesized
ttataggtgttgaggcttcgtt

SEQ ID NO: 1323279 - DNA, 22 bp, Artificial Sequence
  chemically synthesized
gcggaagagaaaacgaagcctc

SEQ ID NO: 1323280 - DNA, 22 bp, Artificial Sequence
  chemically synthesized
aaaagctattataggtgttgag

SEQ ID NO: 1323281 - DNA, 22 bp, Artificial Sequence
  chemically synthesized
aaaaagctattataggtgttga

SEQ ID NO: 1323282 - DNA, 22 bp, Artificial Sequence
  chemically synthesized
tgatatttaaaaagctattata

SEQ ID NO: 1323283 - DNA, 22 bp, Artificial Sequence
  chemically synthesized
gtgatatttaaaaagctattat

SEQ ID NO: 1323284 - DNA, 22 bp, Artificial Sequence
  chemically synthesized
tgtgatatttaaaaagctatta

SEQ ID NO: 1323285 - DNA, 22 bp, Artificial Sequence
  chemically synthesized
aacacctataatagctttttaa

SEQ ID NO: 1323286 - DNA, 22 bp, Artificial Sequence
  chemically synthesized
taatagctttttaaatatcaca

SEQ ID NO: 1323287 - DNA, 22 bp, Artificial Sequence
  chemically synthesized
atagataagcaccagttttgtg

SEQ ID NO: 1323288 - DNA, 22 bp, Artificial Sequence
  chemically synthesized
gatagataagcaccagttttgt

SEQ ID NO: 1323289 - DNA, 22 bp, Artificial Sequence
  chemically synthesized
tgatagataagcaccagttttg

SEQ ID NO: 1323290 - DNA, 22 bp, Artificial Sequence
  chemically synthesized
tttaaatatcacaaaactggtg

SEQ ID NO: 1323291 - DNA, 22 bp, Artificial Sequence
  chemically synthesized
ttaaatatcacaaaactggtgc

SEQ ID NO: 1323292 - DNA, 22 bp, Artificial Sequence
  chemically synthesized
tttgatagataagcaccagttt

SEQ ID NO: 1323293 - DNA, 22 bp, Artificial Sequence
  chemically synthesized
taaatatcacaaaactggtgct

SEQ ID NO: 1323294 - DNA, 22 bp, Artificial Sequence
  chemically synthesized
aaatatcacaaaactggtgctt

SEQ ID NO: 1323295 - DNA, 22 bp, Artificial Sequence
  chemically synthesized
aatatcacaaaactggtgctta

SEQ ID NO: 1323296 - DNA, 22 bp, Artificial Sequence
  chemically synthesized
tcagtattctttgatagataag

SEQ ID NO: 1323297 - DNA, 22 bp, Artificial Sequence
  chemically synthesized
gtgcttatctatcaaagaatac

SEQ ID NO: 1323298 - DNA, 22 bp, Artificial Sequence
  chemically synthesized
atggcattgtcagtattctttg

SEQ ID NO: 1323299 - DNA, 22 bp, Artificial Sequence
  chemically synthesized
aatggcattgtcagtattcttt

SEQ ID NO: 1323300 - DNA, 22 bp, Artificial Sequence
  chemically synthesized
taatggcattgtcagtattctt

SEQ ID NO: 1323301 - DNA, 22 bp, Artificial Sequence
  chemically synthesized
atctatcaaagaatactgacaa

SEQ ID NO: 1323302 - DNA, 22 bp, Artificial Sequence
  chemically synthesized
tctatcaaagaatactgacaat

SEQ ID NO: 1323303 - DNA, 22 bp, Artificial Sequence
  chemically synthesized
tcaaagaatactgacaatgcca

SEQ ID NO: 1323304 - DNA, 22 bp, Artificial Sequence
  chemically synthesized
acaatgccattaaaattgttgt

SEQ ID NO: 1323305 - DNA, 22 bp, Artificial Sequence
  chemically synthesized
tatacagcgcagagaacaacaa

SEQ ID NO: 1323306 - DNA, 22 bp, Artificial Sequence
  chemically synthesized
atatacagcgcagagaacaaca

SEQ ID NO: 1323307 - DNA, 22 bp, Artificial Sequence
  chemically synthesized
aaattgttgttctctgcgctgt

SEQ ID NO: 1323308 - DNA, 22 bp, Artificial Sequence
  chemically synthesized
agtatatttatatacagcgcag

SEQ ID NO: 1323309 - DNA, 22 bp, Artificial Sequence
  chemically synthesized
ttcagtatatttatatacagcg

SEQ ID NO: 1323310 - DNA, 22 bp, Artificial Sequence
  chemically synthesized
ttgttctctgcgctgtatataa

SEQ ID NO: 1323311 - DNA, 22 bp, Artificial Sequence
  chemically synthesized
ttctctgcgctgtatataaata

SEQ ID NO: 1323312 - DNA, 22 bp, Artificial Sequence
  chemically synthesized
tctgcgctgtatataaatatac

SEQ ID NO: 1323313 - DNA, 22 bp, Artificial Sequence
  chemically synthesized
tgcgctgtatataaatatactg

SEQ ID NO: 1323314 - DNA, 22 bp, Artificial Sequence
  chemically synthesized
accaatattattcagtatattt

SEQ ID NO: 1323315 - DNA, 22 bp, Artificial Sequence
  chemically synthesized
cgctgtatataaatatactgaa

SEQ ID NO: 1323316 - DNA, 22 bp, Artificial Sequence
  chemically synthesized
tatataaatatactgaataata

SEQ ID NO: 1323317 - DNA, 22 bp, Artificial Sequence
  chemically synthesized
ggcatacccatattaaccaata

SEQ ID NO: 1323318 - DNA, 22 bp, Artificial Sequence
  chemically synthesized
ctaggcatacccatattaacca

SEQ ID NO: 1323319 - DNA, 22 bp, Artificial Sequence
  chemically synthesized
ctcctaggcatacccatattaa

SEQ ID NO: 1323320 - DNA, 22 bp, Artificial Sequence
  chemically synthesized
aataatattggttaatatgggt

SEQ ID NO: 1323321 - DNA, 22 bp, Artificial Sequence
  chemically synthesized
gctcctaggcatacccatatta

SEQ ID NO: 1323322 - DNA, 22 bp, Artificial Sequence
  chemically synthesized
gcaacttgctcctaggcatacc

SEQ ID NO: 1323323 - DNA, 22 bp, Artificial Sequence
  chemically synthesized
gttaatatgggtatgcctagga

SEQ ID NO: 1323324 - DNA, 22 bp, Artificial Sequence
  chemically synthesized
atatgggtatgcctaggagcaa

SEQ ID NO: 1323325 - DNA, 22 bp, Artificial Sequence
  chemically synthesized
aaagaaagttagcaacttgctc

SEQ ID NO: 1323326 - DNA, 22 bp, Artificial Sequence
  chemically synthesized
taattcaaagaaagttagcaac

SEQ ID NO: 1323327 - DNA, 22 bp, Artificial Sequence
  chemically synthesized
ggagcaagttgctaactttctt

SEQ ID NO: 1323328 - DNA, 22 bp, Artificial Sequence
  chemically synthesized
caccatgagaaactataattca

SEQ ID NO: 1323329 - DNA, 22 bp, Artificial Sequence
  chemically synthesized
ctaactttctttgaattatagt

SEQ ID NO: 1323330 - DNA, 22 bp, Artificial Sequence
  chemically synthesized
acaccatgagaaactataattc

SEQ ID NO: 1323331 - DNA, 22 bp, Artificial Sequence
  chemically synthesized
actttctttgaattatagtttc

SEQ ID NO: 1323332 - DNA, 22 bp, Artificial Sequence
  chemically synthesized
gtttacaccatgagaaactata

SEQ ID NO: 1323333 - DNA, 22 bp, Artificial Sequence
  chemically synthesized
tctttgaattatagtttctcat

SEQ ID NO: 1323334 - DNA, 22 bp, Artificial Sequence
  chemically synthesized
ctttgaattatagtttctcatg

SEQ ID NO: 1323335 - DNA, 22 bp, Artificial Sequence
  chemically synthesized
tttgaattatagtttctcatgg

SEQ ID NO: 1323336 - DNA, 22 bp, Artificial Sequence
  chemically synthesized
tgaattatagtttctcatggtg

SEQ ID NO: 1323337 - DNA, 22 bp, Artificial Sequence
  chemically synthesized
gaattatagtttctcatggtgt

SEQ ID NO: 1323338 - DNA, 22 bp, Artificial Sequence
  chemically synthesized
aattatagtttctcatggtgta

SEQ ID NO: 1323339 - DNA, 22 bp, Artificial Sequence
  chemically synthesized
aagcagaattggtttacaccat

SEQ ID NO: 1323340 - DNA, 22 bp, Artificial Sequence
  chemically synthesized
tagtttctcatggtgtaaacca

SEQ ID NO: 1323341 - DNA, 22 bp, Artificial Sequence
  chemically synthesized
ctcatggtgtaaaccaattctg

SEQ ID NO: 1323342 - DNA, 22 bp, Artificial Sequence
  chemically synthesized
tcatggtgtaaaccaattctgc

SEQ ID NO: 1323343 - DNA, 22 bp, Artificial Sequence
  chemically synthesized
atggtgtaaaccaattctgctt

SEQ ID NO: 1323344 - DNA, 22 bp, Artificial Sequence
  chemically synthesized
tgcttgaatgggtctgctgtca

SEQ ID NO: 1323345 - DNA, 22 bp, Artificial Sequence
  chemically synthesized
taccacatccaatgacagcaga

SEQ ID NO: 1323346 - DNA, 22 bp, Artificial Sequence
  chemically synthesized
ataccacatccaatgacagcag

SEQ ID NO: 1323347 - DNA, 22 bp, Artificial Sequence
  chemically synthesized
cttgaatgggtctgctgtcatt

SEQ ID NO: 1323348 - DNA, 22 bp, Artificial Sequence
  chemically synthesized
tataccacatccaatgacagca

SEQ ID NO: 1323349 - DNA, 22 bp, Artificial Sequence
  chemically synthesized
ttataccacatccaatgacagc

SEQ ID NO: 1323350 - DNA, 22 bp, Artificial Sequence
  chemically synthesized
gaatgggtctgctgtcattgga

SEQ ID NO: 1323351 - DNA, 22 bp, Artificial Sequence
  chemically synthesized
aatgggtctgctgtcattggat

SEQ ID NO: 1323352 - DNA, 22 bp, Artificial Sequence
  chemically synthesized
acaatttttataccacatccaa

SEQ ID NO: 1323353 - DNA, 22 bp, Artificial Sequence
  chemically synthesized
ctcacaatttttataccacatc

SEQ ID NO: 1323354 - DNA, 22 bp, Artificial Sequence
  chemically synthesized
ctgtcattggatgtggtataaa

SEQ ID NO: 1323355 - DNA, 22 bp, Artificial Sequence
  chemically synthesized
agctcctcacaatttttatacc

SEQ ID NO: 1323356 - DNA, 22 bp, Artificial Sequence
  chemically synthesized
tcattggatgtggtataaaaat

SEQ ID NO: 1323357 - DNA, 22 bp, Artificial Sequence
  chemically synthesized
tgctaagctcctcacaattttt

SEQ ID NO: 1323358 - DNA, 22 bp, Artificial Sequence
  chemically synthesized
gatgtggtataaaaattgtgag

SEQ ID NO: 1323359 - DNA, 22 bp, Artificial Sequence
  chemically synthesized
tggttatgctaagctcctcaca

SEQ ID NO: 1323360 - DNA, 22 bp, Artificial Sequence
  chemically synthesized
ggttatggttatgctaagctcc

SEQ ID NO: 1323361 - DNA, 22 bp, Artificial Sequence
  chemically synthesized
ccctaggttatggttatgctaa

SEQ ID NO: 1323362 - DNA, 22 bp, Artificial Sequence
  chemically synthesized
gccctaggttatggttatgcta

SEQ ID NO: 1323363 - DNA, 22 bp, Artificial Sequence
  chemically synthesized
tgaggagcttagcataaccata

SEQ ID NO: 1323364 - DNA, 22 bp, Artificial Sequence
  chemically synthesized
ggtttgccctaggttatggtta

SEQ ID NO: 1323365 - DNA, 22 bp, Artificial Sequence
  chemically synthesized
gggtttgccctaggttatggtt

SEQ ID NO: 1323366 - DNA, 22 bp, Artificial Sequence
  chemically synthesized
agcataaccataacctagggca

SEQ ID NO: 1323367 - DNA, 22 bp, Artificial Sequence
  chemically synthesized
gcataaccataacctagggcaa

SEQ ID NO: 1323368 - DNA, 22 bp, Artificial Sequence
  chemically synthesized
agagaagggcttgggtttgccc

SEQ ID NO: 1323369 - DNA, 22 bp, Artificial Sequence
  chemically synthesized
aagagaagggcttgggtttgcc

SEQ ID NO: 1323370 - DNA, 22 bp, Artificial Sequence
  chemically synthesized
cttaagagaagggcttgggttt

SEQ ID NO: 1323371 - DNA, 22 bp, Artificial Sequence
  chemically synthesized
gggcaaacccaagcccttctct

SEQ ID NO: 1323372 - DNA, 22 bp, Artificial Sequence
  chemically synthesized
gtgccgtgctacttaagagaag

SEQ ID NO: 1323373 - DNA, 22 bp, Artificial Sequence
  chemically synthesized
agtgccgtgctacttaagagaa

SEQ ID NO: 1323374 - DNA, 22 bp, Artificial Sequence
  chemically synthesized
tagtgccgtgctacttaagaga

SEQ ID NO: 1323375 - DNA, 22 bp, Artificial Sequence
  chemically synthesized
taagtctttagtgccgtgctac

SEQ ID NO: 1323376 - DNA, 22 bp, Artificial Sequence
  chemically synthesized
ctcttaagtagcacggcactaa

SEQ ID NO: 1323377 - DNA, 22 bp, Artificial Sequence
  chemically synthesized
tcttaagtagcacggcactaaa

SEQ ID NO: 1323378 - DNA, 22 bp, Artificial Sequence
  chemically synthesized
aagttataagtctttagtgccg

SEQ ID NO: 1323379 - DNA, 22 bp, Artificial Sequence
  chemically synthesized
ttaagtagcacggcactaaaga

SEQ ID NO: 1323380 - DNA, 22 bp, Artificial Sequence
  chemically synthesized
aagtagcacggcactaaagact

SEQ ID NO: 1323381 - DNA, 22 bp, Artificial Sequence
  chemically synthesized
agtagcacggcactaaagactt

SEQ ID NO: 1323382 - DNA, 22 bp, Artificial Sequence
  chemically synthesized
aaaagcactcaagttataagtc

SEQ ID NO: 1323383 - DNA, 22 bp, Artificial Sequence
  chemically synthesized
gaaaagcactcaagttataagt

SEQ ID NO: 1323384 - DNA, 22 bp, Artificial Sequence
  chemically synthesized
tgaaaagcactcaagttataag

SEQ ID NO: 1323385 - DNA, 22 bp, Artificial Sequence
  chemically synthesized
aagacttataacttgagtgctt

SEQ ID NO: 1323386 - DNA, 22 bp, Artificial Sequence
  chemically synthesized
cacacacctttgaaaagcactc

SEQ ID NO: 1323387 - DNA, 22 bp, Artificial Sequence
  chemically synthesized
ataacttgagtgcttttcaaag

SEQ ID NO: 1323388 - DNA, 22 bp, Artificial Sequence
  chemically synthesized
taacttgagtgcttttcaaagg

SEQ ID NO: 1323389 - DNA, 22 bp, Artificial Sequence
  chemically synthesized
gagtgcttttcaaaggtgtgtg

SEQ ID NO: 1323390 - DNA, 22 bp, Artificial Sequence
  chemically synthesized
agtgcttttcaaaggtgtgtgg

SEQ ID NO: 1323391 - DNA, 22 bp, Artificial Sequence
  chemically synthesized
ttcaaaggtgtgtggaggctgt

SEQ ID NO: 1323392 - DNA, 22 bp, Artificial Sequence
  chemically synthesized
tcaaaggtgtgtggaggctgta

SEQ ID NO: 1323393 - DNA, 22 bp, Artificial Sequence
  chemically synthesized
caaaggtgtgtggaggctgtat

SEQ ID NO: 1323394 - DNA, 22 bp, Artificial Sequence
  chemically synthesized
aaaggtgtgtggaggctgtatc

SEQ ID NO: 1323395 - DNA, 22 bp, Artificial Sequence
  chemically synthesized
tatcctctttactgctccttcc

SEQ ID NO: 1323396 - DNA, 22 bp, Artificial Sequence
  chemically synthesized
catataacacagggaaggagca

SEQ ID NO: 1323397 - DNA, 22 bp, Artificial Sequence
  chemically synthesized
acatataacacagggaaggagc

SEQ ID NO: 1323398 - DNA, 22 bp, Artificial Sequence
  chemically synthesized
tttacatataacacagggaagg

SEQ ID NO: 1323399 - DNA, 22 bp, Artificial Sequence
  chemically synthesized
tttactgctccttccctgtgtt

SEQ ID NO: 1323400 - DNA, 22 bp, Artificial Sequence
  chemically synthesized
tactgctccttccctgtgttat

SEQ ID NO: 1323401 - DNA, 22 bp, Artificial Sequence
  chemically synthesized
actgctccttccctgtgttata

SEQ ID NO: 1323402 - DNA, 22 bp, Artificial Sequence
  chemically synthesized
ctgctccttccctgtgttatat

SEQ ID NO: 1323403 - DNA, 22 bp, Artificial Sequence
  chemically synthesized
ctccttccctgtgttatatgta

SEQ ID NO: 1323404 - DNA, 22 bp, Artificial Sequence
  chemically synthesized
aataaacattgtttacatataa

SEQ ID NO: 1323405 - DNA, 22 bp, Artificial Sequence
  chemically synthesized
cttccctgtgttatatgtaaac

SEQ ID NO: 1323406 - DNA, 22 bp, Artificial Sequence
  chemically synthesized
taaataaacattgtttacatat

SEQ ID NO: 1323407 - DNA, 22 bp, Artificial Sequence
  chemically synthesized
ctaaataaacattgtttacata

SEQ ID NO: 1323408 - DNA, 22 bp, Artificial Sequence
  chemically synthesized
ccctgtgttatatgtaaacaat

SEQ ID NO: 1323409 - DNA, 22 bp, Artificial Sequence
  chemically synthesized
cctgtgttatatgtaaacaatg

SEQ ID NO: 1323410 - DNA, 22 bp, Artificial Sequence
  chemically synthesized
tttctaaataaacattgtttac

SEQ ID NO: 1323411 - DNA, 22 bp, Artificial Sequence
  chemically synthesized
tgtttctaaataaacattgttt

SEQ ID NO: 1323412 - DNA, 22 bp, Artificial Sequence
  chemically synthesized
tgttatatgtaaacaatgttta

SEQ ID NO: 1323413 - DNA, 22 bp, Artificial Sequence
  chemically synthesized
tatgtaaacaatgtttatttag

SEQ ID NO: 1323414 - DNA, 22 bp, Artificial Sequence
  chemically synthesized
cagcaccagggaacaagcattc

SEQ ID NO: 1323415 - DNA, 22 bp, Artificial Sequence
  chemically synthesized
atttagaaacagaatgcttgtt

SEQ ID NO: 1323416 - DNA, 22 bp, Artificial Sequence
  chemically synthesized
gcagcaccagggaacaagcatt

SEQ ID NO: 1323417 - DNA, 22 bp, Artificial Sequence
  chemically synthesized
tttagaaacagaatgcttgttc

SEQ ID NO: 1323418 - DNA, 22 bp, Artificial Sequence
  chemically synthesized
tgcagcaccagggaacaagcat

SEQ ID NO: 1323419 - DNA, 22 bp, Artificial Sequence
  chemically synthesized
tttgcagcaccagggaacaagc

SEQ ID NO: 1323420 - DNA, 22 bp, Artificial Sequence
  chemically synthesized
agaaacagaatgcttgttccct

SEQ ID NO: 1323421 - DNA, 22 bp, Artificial Sequence
  chemically synthesized
ctttgcagcaccagggaacaag

SEQ ID NO: 1323422 - DNA, 22 bp, Artificial Sequence
  chemically synthesized
gaaacagaatgcttgttccctg

SEQ ID NO: 1323423 - DNA, 22 bp, Artificial Sequence
  chemically synthesized
tttctttgcagcaccagggaac

SEQ ID NO: 1323424 - DNA, 22 bp, Artificial Sequence
  chemically synthesized
gagtgctgtttctttgcagcac

SEQ ID NO: 1323425 - DNA, 22 bp, Artificial Sequence
  chemically synthesized
gttccctggtgctgcaaagaaa

SEQ ID NO: 1323426 - DNA, 22 bp, Artificial Sequence
  chemically synthesized
ttccctggtgctgcaaagaaac

SEQ ID NO: 1323427 - DNA, 22 bp, Artificial Sequence
  chemically synthesized
tgttcgagtgctgtttctttgc

SEQ ID NO: 1323428 - DNA, 22 bp, Artificial Sequence
  chemically synthesized
atgttcgagtgctgtttctttg

SEQ ID NO: 1323429 - DNA, 22 bp, Artificial Sequence
  chemically synthesized
cctggtgctgcaaagaaacagc

SEQ ID NO: 1323430 - DNA, 22 bp, Artificial Sequence
  chemically synthesized
aatttatgttcgagtgctgttt

SEQ ID NO: 1323431 - DNA, 22 bp, Artificial Sequence
  chemically synthesized
gtgctgcaaagaaacagcactc

SEQ ID NO: 1323432 - DNA, 22 bp, Artificial Sequence
  chemically synthesized
caaagaaacagcactcgaacat

SEQ ID NO: 1323433 - DNA, 22 bp, Artificial Sequence
  chemically synthesized
agagagttaaatttatgttcga

SEQ ID NO: 1323434 - DNA, 22 bp, Artificial Sequence
  chemically synthesized
ctgagagagttaaatttatgtt

SEQ ID NO: 1323435 - DNA, 22 bp, Artificial Sequence
  chemically synthesized
gctgagagagttaaatttatgt

SEQ ID NO: 1323436 - DNA, 22 bp, Artificial Sequence
  chemically synthesized
gaacataaatttaactctctca

SEQ ID NO: 1323437 - DNA, 22 bp, Artificial Sequence
  chemically synthesized
caaaaagtaaaaatgaccttgc

SEQ ID NO: 1323438 - DNA, 22 bp, Artificial Sequence
  chemically synthesized
aactctctcagcaaggtcattt

SEQ ID NO: 1323439 - DNA, 22 bp, Artificial Sequence
  chemically synthesized
tgcaaaaagtaaaaatgacctt

SEQ ID NO: 1323440 - DNA, 22 bp, Artificial Sequence
  chemically synthesized
actctctcagcaaggtcatttt

SEQ ID NO: 1323441 - DNA, 22 bp, Artificial Sequence
  chemically synthesized
ctgcaaaaagtaaaaatgacct

SEQ ID NO: 1323442 - DNA, 22 bp, Artificial Sequence
  chemically synthesized
tctgcaaaaagtaaaaatgacc

SEQ ID NO: 1323443 - DNA, 22 bp, Artificial Sequence
  chemically synthesized
tctcagcaaggtcatttttact

SEQ ID NO: 1323444 - DNA, 22 bp, Artificial Sequence
  chemically synthesized
tcagcaaggtcatttttacttt

SEQ ID NO: 1323445 - DNA, 22 bp, Artificial Sequence
  chemically synthesized
agcaaggtcatttttacttttt

SEQ ID NO: 1323446 - DNA, 22 bp, Artificial Sequence
  chemically synthesized
gcgagtgtaccctttctgcaaa

SEQ ID NO: 1323447 - DNA, 22 bp, Artificial Sequence
  chemically synthesized
ctggcgagtgtaccctttctgc

SEQ ID NO: 1323448 - DNA, 22 bp, Artificial Sequence
  chemically synthesized
ttactttttgcagaaagggtac

SEQ ID NO: 1323449 - DNA, 22 bp, Artificial Sequence
  chemically synthesized
tactttttgcagaaagggtaca

SEQ ID NO: 1323450 - DNA, 22 bp, Artificial Sequence
  chemically synthesized
actttttgcagaaagggtacac

SEQ ID NO: 1323451 - DNA, 22 bp, Artificial Sequence
  chemically synthesized
ctttttgcagaaagggtacact

SEQ ID NO: 1323452 - DNA, 22 bp, Artificial Sequence
  chemically synthesized
tttgcagaaagggtacactcgc

SEQ ID NO: 1323453 - DNA, 22 bp, Artificial Sequence
  chemically synthesized
ttgcagaaagggtacactcgcc

SEQ ID NO: 1323454 - DNA, 22 bp, Artificial Sequence
  chemically synthesized
tgcagaaagggtacactcgcca

SEQ ID NO: 1323455 - DNA, 22 bp, Artificial Sequence
  chemically synthesized
gcagaaagggtacactcgccag

SEQ ID NO: 1323456 - DNA, 22 bp, Artificial Sequence
  chemically synthesized
gtggcaaaactgctggcgagtg

SEQ ID NO: 1323457 - DNA, 22 bp, Artificial Sequence
  chemically synthesized
cagaaagggtacactcgccagc

SEQ ID NO: 1323458 - DNA, 22 bp, Artificial Sequence
  chemically synthesized
tcgtggcaaaactgctggcgag

SEQ ID NO: 1323459 - DNA, 22 bp, Artificial Sequence
  chemically synthesized
ggtgtactctcgtggcaaaact

SEQ ID NO: 1323460 - DNA, 22 bp, Artificial Sequence
  chemically synthesized
ttcggtgtactctcgtggcaaa

SEQ ID NO: 1323461 - DNA, 22 bp, Artificial Sequence
  chemically synthesized
gttcggtgtactctcgtggcaa

SEQ ID NO: 1323462 - DNA, 22 bp, Artificial Sequence
  chemically synthesized
tgttcggtgtactctcgtggca

SEQ ID NO: 1323463 - DNA, 22 bp, Artificial Sequence
  chemically synthesized
gccagcagttttgccacgagag

SEQ ID NO: 1323464 - DNA, 22 bp, Artificial Sequence
  chemically synthesized
ctttgttcggtgtactctcgtg

SEQ ID NO: 1323465 - DNA, 22 bp, Artificial Sequence
  chemically synthesized
tctcctttgttcggtgtactct

SEQ ID NO: 1323466 - DNA, 22 bp, Artificial Sequence
  chemically synthesized
tgccacgagagtacaccgaaca

SEQ ID NO: 1323467 - DNA, 22 bp, Artificial Sequence
  chemically synthesized
gccacgagagtacaccgaacaa

SEQ ID NO: 1323468 - DNA, 22 bp, Artificial Sequence
  chemically synthesized
ccacgagagtacaccgaacaaa

SEQ ID NO: 1323469 - DNA, 22 bp, Artificial Sequence
  chemically synthesized
taaatgaccctgtctcctttgt

SEQ ID NO: 1323470 - DNA, 22 bp, Artificial Sequence
  chemically synthesized
ataacctgacatgtttactcta

SEQ ID NO: 1323471 - DNA, 22 bp, Artificial Sequence
  chemically synthesized
taacctgacatgtttactctac

SEQ ID NO: 1323472 - DNA, 22 bp, Artificial Sequence
  chemically synthesized
acatgtttactctactgctgtg

SEQ ID NO: 1323473 - DNA, 22 bp, Artificial Sequence
  chemically synthesized
cagccaatggaaaccggacaca

SEQ ID NO: 1323474 - DNA, 22 bp, Artificial Sequence
  chemically synthesized
actctactgctgtgtccggttt

SEQ ID NO: 1323475 - DNA, 22 bp, Artificial Sequence
  chemically synthesized
ctctactgctgtgtccggtttc

SEQ ID NO: 1323476 - DNA, 22 bp, Artificial Sequence
  chemically synthesized
ttccagccaatggaaaccggac

SEQ ID NO: 1323477 - DNA, 22 bp, Artificial Sequence
  chemically synthesized
tactgctgtgtccggtttccat

SEQ ID NO: 1323478 - DNA, 22 bp, Artificial Sequence
  chemically synthesized
ctgctgtgtccggtttccattg

SEQ ID NO: 1323479 - DNA, 22 bp, Artificial Sequence
  chemically synthesized
ctgtgtccggtttccattggct

SEQ ID NO: 1323480 - DNA, 22 bp, Artificial Sequence
  chemically synthesized
tgtccggtttccattggctgga

SEQ ID NO: 1323481 - DNA, 22 bp, Artificial Sequence
  chemically synthesized
ccattggctggaacaggaccac

SEQ ID NO: 1323482 - DNA, 22 bp, Artificial Sequence
  chemically synthesized
cattggctggaacaggaccaca

SEQ ID NO: 1323483 - DNA, 22 bp, Artificial Sequence
  chemically synthesized
gctggaacaggaccacacattc

SEQ ID NO: 1323484 - DNA, 22 bp, Artificial Sequence
  chemically synthesized
gaacaggaccacacattctgta

SEQ ID NO: 1323485 - DNA, 22 bp, Artificial Sequence
  chemically synthesized
gccaatcgggacaaatacagaa

SEQ ID NO: 1323486 - DNA, 22 bp, Artificial Sequence
  chemically synthesized
ctagccaatcgggacaaataca

SEQ ID NO: 1323487 - DNA, 22 bp, Artificial Sequence
  chemically synthesized
agttgctagccaatcgggacaa

SEQ ID NO: 1323488 - DNA, 22 bp, Artificial Sequence
  chemically synthesized
taagttgctagccaatcgggac

SEQ ID NO: 1323489 - DNA, 22 bp, Artificial Sequence
  chemically synthesized
tgtatttgtcccgattggctag

SEQ ID NO: 1323490 - DNA, 22 bp, Artificial Sequence
  chemically synthesized
tatttgtcccgattggctagca

SEQ ID NO: 1323491 - DNA, 22 bp, Artificial Sequence
  chemically synthesized
aaaagttctaagttgctagcca

SEQ ID NO: 1323492 - DNA, 22 bp, Artificial Sequence
  chemically synthesized
gaaaagttctaagttgctagcc

SEQ ID NO: 1323493 - DNA, 22 bp, Artificial Sequence
  chemically synthesized
tgaaaagttctaagttgctagc

SEQ ID NO: 1323494 - DNA, 22 bp, Artificial Sequence
  chemically synthesized
ttgaaaagttctaagttgctag

SEQ ID NO: 1323495 - DNA, 22 bp, Artificial Sequence
  chemically synthesized
gtcccgattggctagcaactta

SEQ ID NO: 1323496 - DNA, 22 bp, Artificial Sequence
  chemically synthesized
tcccgattggctagcaacttag

SEQ ID NO: 1323497 - DNA, 22 bp, Artificial Sequence
  chemically synthesized
ttttgaaaagttctaagttgct

SEQ ID NO: 1323498 - DNA, 22 bp, Artificial Sequence
  chemically synthesized
tctcttttgaaaagttctaagt

SEQ ID NO: 1323499 - DNA, 22 bp, Artificial Sequence
  chemically synthesized
gtctcttttgaaaagttctaag

SEQ ID NO: 1323500 - DNA, 22 bp, Artificial Sequence
  chemically synthesized
tgtctcttttgaaaagttctaa

SEQ ID NO: 1323501 - DNA, 22 bp, Artificial Sequence
  chemically synthesized
gctagcaacttagaacttttca

SEQ ID NO: 1323502 - DNA, 22 bp, Artificial Sequence
  chemically synthesized
cctttgtctcttttgaaaagtt

SEQ ID NO: 1323503 - DNA, 22 bp, Artificial Sequence
  chemically synthesized
tgcctttgtctcttttgaaaag

SEQ ID NO: 1323504 - DNA, 22 bp, Artificial Sequence
  chemically synthesized
gcaacttagaacttttcaaaag

SEQ ID NO: 1323505 - DNA, 22 bp, Artificial Sequence
  chemically synthesized
ctctgcctttgtctcttttgaa

SEQ ID NO: 1323506 - DNA, 22 bp, Artificial Sequence
  chemically synthesized
tcctctgcctttgtctcttttg

SEQ ID NO: 1323507 - DNA, 22 bp, Artificial Sequence
  chemically synthesized
agaacttttcaaaagagacaaa

SEQ ID NO: 1323508 - DNA, 22 bp, Artificial Sequence
  chemically synthesized
ttctcctctgcctttgtctctt

SEQ ID NO: 1323509 - DNA, 22 bp, Artificial Sequence
  chemically synthesized
gaacttttcaaaagagacaaag

SEQ ID NO: 1323510 - DNA, 22 bp, Artificial Sequence
  chemically synthesized
gttctcctctgcctttgtctct

SEQ ID NO: 1323511 - DNA, 22 bp, Artificial Sequence
  chemically synthesized
tgttctcctctgcctttgtctc

SEQ ID NO: 1323512 - DNA, 22 bp, Artificial Sequence
  chemically synthesized
ctttgttctcctctgcctttgt

SEQ ID NO: 1323513 - DNA, 22 bp, Artificial Sequence
  chemically synthesized
cctttgttctcctctgcctttg

SEQ ID NO: 1323514 - DNA, 22 bp, Artificial Sequence
  chemically synthesized
ttcaaaagagacaaaggcagag

SEQ ID NO: 1323515 - DNA, 22 bp, Artificial Sequence
  chemically synthesized
tcaaaagagacaaaggcagagg

SEQ ID NO: 1323516 - DNA, 22 bp, Artificial Sequence
  chemically synthesized
caaaagagacaaaggcagagga

SEQ ID NO: 1323517 - DNA, 22 bp, Artificial Sequence
  chemically synthesized
cttcctttgttctcctctgcct

SEQ ID NO: 1323518 - DNA, 22 bp, Artificial Sequence
  chemically synthesized
aaaagagacaaaggcagaggag

SEQ ID NO: 1323519 - DNA, 22 bp, Artificial Sequence
  chemically synthesized
ctccttcctttgttctcctctg

SEQ ID NO: 1323520 - DNA, 22 bp, Artificial Sequence
  chemically synthesized
cctccttcctttgttctcctct

SEQ ID NO: 1323521 - DNA, 22 bp, Artificial Sequence
  chemically synthesized
cttcctccttcctttgttctcc

SEQ ID NO: 1323522 - DNA, 22 bp, Artificial Sequence
  chemically synthesized
tggaaacaagttacttcctcct

SEQ ID NO: 1323523 - DNA, 22 bp, Artificial Sequence
  chemically synthesized
gtggaaacaagttacttcctcc

SEQ ID NO: 1323524 - DNA, 22 bp, Artificial Sequence
  chemically synthesized
agcaagtaacttgtggaaacaa

SEQ ID NO: 1323525 - DNA, 22 bp, Artificial Sequence
  chemically synthesized
tcagcaagtaacttgtggaaac

SEQ ID NO: 1323526 - DNA, 22 bp, Artificial Sequence
  chemically synthesized
ctcagcaagtaacttgtggaaa

SEQ ID NO: 1323527 - DNA, 22 bp, Artificial Sequence
  chemically synthesized
tctcagcaagtaacttgtggaa

SEQ ID NO: 1323528 - DNA, 22 bp, Artificial Sequence
  chemically synthesized
cctttctcagcaagtaacttgt

SEQ ID NO: 1323529 - DNA, 22 bp, Artificial Sequence
  chemically synthesized
acctttctcagcaagtaacttg

SEQ ID NO: 1323530 - DNA, 22 bp, Artificial Sequence
  chemically synthesized
tacctttctcagcaagtaactt

SEQ ID NO: 1323531 - DNA, 22 bp, Artificial Sequence
  chemically synthesized
ttacctttctcagcaagtaact

SEQ ID NO: 1323532 - DNA, 22 bp, Artificial Sequence
  chemically synthesized
gtttccacaagttacttgctga

SEQ ID NO: 1323533 - DNA, 22 bp, Artificial Sequence
  chemically synthesized
tttccacaagttacttgctgag

SEQ ID NO: 1323534 - DNA, 22 bp, Artificial Sequence
  chemically synthesized
ccacaagttacttgctgagaaa

SEQ ID NO: 1323535 - DNA, 22 bp, Artificial Sequence
  chemically synthesized
cacaagttacttgctgagaaag

SEQ ID NO: 1323536 - DNA, 22 bp, Artificial Sequence
  chemically synthesized
aaggtgtttttacctttctcag

SEQ ID NO: 1323537 - DNA, 22 bp, Artificial Sequence
  chemically synthesized
gaaggtgtttttacctttctca

SEQ ID NO: 1323538 - DNA, 22 bp, Artificial Sequence
  chemically synthesized
tttgaaggtgtttttacctttc

SEQ ID NO: 1323539 - DNA, 22 bp, Artificial Sequence
  chemically synthesized
atttgaaggtgtttttaccttt

SEQ ID NO: 1323540 - DNA, 22 bp, Artificial Sequence
  chemically synthesized
cttgctgagaaaggtaaaaaca

SEQ ID NO: 1323541 - DNA, 22 bp, Artificial Sequence
  chemically synthesized
cttatttgaaggtgtttttacc

SEQ ID NO: 1323542 - DNA, 22 bp, Artificial Sequence
  chemically synthesized
ccttatttgaaggtgtttttac

SEQ ID NO: 1323543 - DNA, 22 bp, Artificial Sequence
  chemically synthesized
gctgagaaaggtaaaaacacct

SEQ ID NO: 1323544 - DNA, 22 bp, Artificial Sequence
  chemically synthesized
ttccttatttgaaggtgttttt

SEQ ID NO: 1323545 - DNA, 22 bp, Artificial Sequence
  chemically synthesized
ctgagaaaggtaaaaacacctt

SEQ ID NO: 1323546 - DNA, 22 bp, Artificial Sequence
  chemically synthesized
ctcttccttatttgaaggtgtt

SEQ ID NO: 1323547 - DNA, 22 bp, Artificial Sequence
  chemically synthesized
agaaaggtaaaaacaccttcaa

SEQ ID NO: 1323548 - DNA, 22 bp, Artificial Sequence
  chemically synthesized
ttcctcttccttatttgaaggt

SEQ ID NO: 1323549 - DNA, 22 bp, Artificial Sequence
  chemically synthesized
ggtcatagcctgttcctcttcc

SEQ ID NO: 1323550 - DNA, 22 bp, Artificial Sequence
  chemically synthesized
caaataaggaagaggaacaggc

SEQ ID NO: 1323551 - DNA, 22 bp, Artificial Sequence
  chemically synthesized
aaataaggaagaggaacaggct

SEQ ID NO: 1323552 - DNA, 22 bp, Artificial Sequence
  chemically synthesized
gtccaagcacgcattaggtcat

SEQ ID NO: 1323553 - DNA, 22 bp, Artificial Sequence
  chemically synthesized
tactggtccaagcacgcattag

SEQ ID NO: 1323554 - DNA, 22 bp, Artificial Sequence
  chemically synthesized
atactggtccaagcacgcatta

SEQ ID NO: 1323555 - DNA, 22 bp, Artificial Sequence
  chemically synthesized
tgacctaatgcgtgcttggacc

SEQ ID NO: 1323556 - DNA, 22 bp, Artificial Sequence
  chemically synthesized
gcatgcttatactggtccaagc

SEQ ID NO: 1323557 - DNA, 22 bp, Artificial Sequence
  chemically synthesized
ccctggcatgcttatactggtc

SEQ ID NO: 1323558 - DNA, 22 bp, Artificial Sequence
  chemically synthesized
atgcgtgcttggaccagtataa

SEQ ID NO: 1323559 - DNA, 22 bp, Artificial Sequence
  chemically synthesized
gccctggcatgcttatactggt

SEQ ID NO: 1323560 - DNA, 22 bp, Artificial Sequence
  chemically synthesized
aatatttgccctggcatgctta

SEQ ID NO: 1323561 - DNA, 22 bp, Artificial Sequence
  chemically synthesized
ggaccagtataagcatgccagg

SEQ ID NO: 1323562 - DNA, 22 bp, Artificial Sequence
  chemically synthesized
gaccagtataagcatgccaggg

SEQ ID NO: 1323563 - DNA, 22 bp, Artificial Sequence
  chemically synthesized
gcctaaatatttgccctggcat

SEQ ID NO: 1323564 - DNA, 22 bp, Artificial Sequence
  chemically synthesized
agcctaaatatttgccctggca

SEQ ID NO: 1323565 - DNA, 22 bp, Artificial Sequence
  chemically synthesized
ccacaatttagcctaaatattt

SEQ ID NO: 1323566 - DNA, 22 bp, Artificial Sequence
  chemically synthesized
gttcccacaatttagcctaaat

SEQ ID NO: 1323567 - DNA, 22 bp, Artificial Sequence
  chemically synthesized
agttcccacaatttagcctaaa

SEQ ID NO: 1323568 - DNA, 22 bp, Artificial Sequence
  chemically synthesized
ttagttcccacaatttagccta

SEQ ID NO: 1323569 - DNA, 22 bp, Artificial Sequence
  chemically synthesized
tgttcttagttcccacaattta

SEQ ID NO: 1323570 - DNA, 22 bp, Artificial Sequence
  chemically synthesized
atgttcttagttcccacaattt

SEQ ID NO: 1323571 - DNA, 22 bp, Artificial Sequence
  chemically synthesized
tatgttcttagttcccacaatt

SEQ ID NO: 1323572 - DNA, 22 bp, Artificial Sequence
  chemically synthesized
aggctaaattgtgggaactaag

SEQ ID NO: 1323573 - DNA, 22 bp, Artificial Sequence
  chemically synthesized
ggctaaattgtgggaactaaga

SEQ ID NO: 1323574 - DNA, 22 bp, Artificial Sequence
  chemically synthesized
aattgtgggaactaagaacata

SEQ ID NO: 1323575 - DNA, 22 bp, Artificial Sequence
  chemically synthesized
tgggaactaagaacataaagta

SEQ ID NO: 1323576 - DNA, 22 bp, Artificial Sequence
  chemically synthesized
agaacataaagtacattgattt

SEQ ID NO: 1323577 - DNA, 22 bp, Artificial Sequence
  chemically synthesized
gccgtaataaagaaatcaatgt

SEQ ID NO: 1323578 - DNA, 22 bp, Artificial Sequence
  chemically synthesized
ctagccgtaataaagaaatcaa

SEQ ID NO: 1323579 - DNA, 22 bp, Artificial Sequence
  chemically synthesized
aatatctactagccgtaataaa

SEQ ID NO: 1323580 - DNA, 22 bp, Artificial Sequence
  chemically synthesized
aaatatctactagccgtaataa

SEQ ID NO: 1323581 - DNA, 22 bp, Artificial Sequence
  chemically synthesized
ttaaatatctactagccgtaat

SEQ ID NO: 1323582 - DNA, 22 bp, Artificial Sequence
  chemically synthesized
atttctttattacggctagtag

SEQ ID NO: 1323583 - DNA, 22 bp, Artificial Sequence
  chemically synthesized
acattcttaaatatctactagc

SEQ ID NO: 1323584 - DNA, 22 bp, Artificial Sequence
  chemically synthesized
ctttattacggctagtagatat

SEQ ID NO: 1323585 - DNA, 22 bp, Artificial Sequence
  chemically synthesized
tttattacggctagtagatatt

SEQ ID NO: 1323586 - DNA, 22 bp, Artificial Sequence
  chemically synthesized
tattacggctagtagatattta

SEQ ID NO: 1323587 - DNA, 22 bp, Artificial Sequence
  chemically synthesized
tgctaacattcttaaatatcta

SEQ ID NO: 1323588 - DNA, 22 bp, Artificial Sequence
  chemically synthesized
attacggctagtagatatttaa

SEQ ID NO: 1323589 - DNA, 22 bp, Artificial Sequence
  chemically synthesized
ttacggctagtagatatttaag

SEQ ID NO: 1323590 - DNA, 22 bp, Artificial Sequence
  chemically synthesized
cggctagtagatatttaagaat

SEQ ID NO: 1323591 - DNA, 22 bp, Artificial Sequence
  chemically synthesized
aacgacctgtgctaacattctt

SEQ ID NO: 1323592 - DNA, 22 bp, Artificial Sequence
  chemically synthesized
gtagatatttaagaatgttagc

SEQ ID NO: 1323593 - DNA, 22 bp, Artificial Sequence
  chemically synthesized
ttaaacgacctgtgctaacatt

SEQ ID NO: 1323594 - DNA, 22 bp, Artificial Sequence
  chemically synthesized
attaaacgacctgtgctaacat

SEQ ID NO: 1323595 - DNA, 22 bp, Artificial Sequence
  chemically synthesized
aagaatgttagcacaggtcgtt

SEQ ID NO: 1323596 - DNA, 22 bp, Artificial Sequence
  chemically synthesized
agaatgttagcacaggtcgttt

SEQ ID NO: 1323597 - DNA, 22 bp, Artificial Sequence
  chemically synthesized
gaagcaaaatttattaaacgac

SEQ ID NO: 1323598 - DNA, 22 bp, Artificial Sequence
  chemically synthesized
ctagaagcaaaatttattaaac

SEQ ID NO: 1323599 - DNA, 22 bp, Artificial Sequence
  chemically synthesized
gcacaggtcgtttaataaattt

SEQ ID NO: 1323600 - DNA, 22 bp, Artificial Sequence
  chemically synthesized
aataaattttgcttctaggaga

SEQ ID NO: 1323601 - DNA, 22 bp, Artificial Sequence
  chemically synthesized
ataaattttgcttctaggagac

SEQ ID NO: 1323602 - DNA, 22 bp, Artificial Sequence
  chemically synthesized
aatgggaataaatagtaacgtc

SEQ ID NO: 1323603 - DNA, 22 bp, Artificial Sequence
  chemically synthesized
tgcttctaggagacgttactat

SEQ ID NO: 1323604 - DNA, 22 bp, Artificial Sequence
  chemically synthesized
gcttctaggagacgttactatt

SEQ ID NO: 1323605 - DNA, 22 bp, Artificial Sequence
  chemically synthesized
cttctaggagacgttactattt

SEQ ID NO: 1323606 - DNA, 22 bp, Artificial Sequence
  chemically synthesized
ctaggagacgttactatttatt

SEQ ID NO: 1323607 - DNA, 22 bp, Artificial Sequence
  chemically synthesized
taggagacgttactatttattc

SEQ ID NO: 1323608 - DNA, 22 bp, Artificial Sequence
  chemically synthesized
cccatctaaatgggaataaata

SEQ ID NO: 1323609 - DNA, 22 bp, Artificial Sequence
  chemically synthesized
ggagacgttactatttattccc

SEQ ID NO: 1323610 - DNA, 22 bp, Artificial Sequence
  chemically synthesized
ctacccatctaaatgggaataa

SEQ ID NO: 1323611 - DNA, 22 bp, Artificial Sequence
  chemically synthesized
cctacccatctaaatgggaata

SEQ ID NO: 1323612 - DNA, 22 bp, Artificial Sequence
  chemically synthesized
tcctacccatctaaatgggaat

SEQ ID NO: 1323613 - DNA, 22 bp, Artificial Sequence
  chemically synthesized
ctatttattcccatttagatgg

SEQ ID NO: 1323614 - DNA, 22 bp, Artificial Sequence
  chemically synthesized
tttattcccatttagatgggta

SEQ ID NO: 1323615 - DNA, 22 bp, Artificial Sequence
  chemically synthesized
caaagaaactttcctacccatc

SEQ ID NO: 1323616 - DNA, 22 bp, Artificial Sequence
  chemically synthesized
attcccatttagatgggtagga

SEQ ID NO: 1323617 - DNA, 22 bp, Artificial Sequence
  chemically synthesized
ttcccatttagatgggtaggaa

SEQ ID NO: 1323618 - DNA, 22 bp, Artificial Sequence
  chemically synthesized
tccaaagaaactttcctaccca

SEQ ID NO: 1323619 - DNA, 22 bp, Artificial Sequence
  chemically synthesized
tctccaaagaaactttcctacc

SEQ ID NO: 1323620 - DNA, 22 bp, Artificial Sequence
  chemically synthesized
ccatttagatgggtaggaaagt

SEQ ID NO: 1323621 - DNA, 22 bp, Artificial Sequence
  chemically synthesized
ctctccaaagaaactttcctac

SEQ ID NO: 1323622 - DNA, 22 bp, Artificial Sequence
  chemically synthesized
agatgggtaggaaagtttcttt

SEQ ID NO: 1323623 - DNA, 22 bp, Artificial Sequence
  chemically synthesized
gatgggtaggaaagtttctttg

SEQ ID NO: 1323624 - DNA, 22 bp, Artificial Sequence
  chemically synthesized
caggtgtaaaaagtagaggttt

SEQ ID NO: 1323625 - DNA, 22 bp, Artificial Sequence
  chemically synthesized
gcaggtgtaaaaagtagaggtt

SEQ ID NO: 1323626 - DNA, 22 bp, Artificial Sequence
  chemically synthesized
ctttggagagaaacctctactt

SEQ ID NO: 1323627 - DNA, 22 bp, Artificial Sequence
  chemically synthesized
tttggagagaaacctctacttt

SEQ ID NO: 1323628 - DNA, 22 bp, Artificial Sequence
  chemically synthesized
ttgcaggtgtaaaaagtagagg

SEQ ID NO: 1323629 - DNA, 22 bp, Artificial Sequence
  chemically synthesized
tggagagaaacctctacttttt

SEQ ID NO: 1323630 - DNA, 22 bp, Artificial Sequence
  chemically synthesized
ggagagaaacctctacttttta

SEQ ID NO: 1323631 - DNA, 22 bp, Artificial Sequence
  chemically synthesized
gagagaaacctctactttttac

SEQ ID NO: 1323632 - DNA, 22 bp, Artificial Sequence
  chemically synthesized
agctcttgcaggtgtaaaaagt

SEQ ID NO: 1323633 - DNA, 22 bp, Artificial Sequence
  chemically synthesized
caacctgagctcttgcaggtgt

SEQ ID NO: 1323634 - DNA, 22 bp, Artificial Sequence
  chemically synthesized
acaacctgagctcttgcaggtg

SEQ ID NO: 1323635 - DNA, 22 bp, Artificial Sequence
  chemically synthesized
tactttttacacctgcaagagc

SEQ ID NO: 1323636 - DNA, 22 bp, Artificial Sequence
  chemically synthesized
ctttttacacctgcaagagctc

SEQ ID NO: 1323637 - DNA, 22 bp, Artificial Sequence
  chemically synthesized
tttacacctgcaagagctcagg

SEQ ID NO: 1323638 - DNA, 22 bp, Artificial Sequence
  chemically synthesized
ttacacctgcaagagctcaggt

SEQ ID NO: 1323639 - DNA, 22 bp, Artificial Sequence
  chemically synthesized
tacacctgcaagagctcaggtt

SEQ ID NO: 1323640 - DNA, 22 bp, Artificial Sequence
  chemically synthesized
acacctgcaagagctcaggttg

SEQ ID NO: 1323641 - DNA, 22 bp, Artificial Sequence
  chemically synthesized
cacctgcaagagctcaggttgt

SEQ ID NO: 1323642 - DNA, 22 bp, Artificial Sequence
  chemically synthesized
caagagctcaggttgtaagtgg

SEQ ID NO: 1323643 - DNA, 22 bp, Artificial Sequence
  chemically synthesized
aaaaagaaatacagccacttac

SEQ ID NO: 1323644 - DNA, 22 bp, Artificial Sequence
  chemically synthesized
gaaaaagaaatacagccactta

SEQ ID NO: 1323645 - DNA, 22 bp, Artificial Sequence
  chemically synthesized
tgaaaaagaaatacagccactt

SEQ ID NO: 1323646 - DNA, 22 bp, Artificial Sequence
  chemically synthesized
aggttgtaagtggctgtatttc

SEQ ID NO: 1323647 - DNA, 22 bp, Artificial Sequence
  chemically synthesized
tgacctttgaaaaagaaataca

SEQ ID NO: 1323648 - DNA, 22 bp, Artificial Sequence
  chemically synthesized
taagtggctgtatttctttttc

SEQ ID NO: 1323649 - DNA, 22 bp, Artificial Sequence
  chemically synthesized
tatttctttttcaaaggtcaca

SEQ ID NO: 1323650 - DNA, 22 bp, Artificial Sequence
  chemically synthesized
ctttttcaaaggtcacagctct

SEQ ID NO: 1323651 - DNA, 22 bp, Artificial Sequence
  chemically synthesized
tttttcaaaggtcacagctctt

SEQ ID NO: 1323652 - DNA, 22 bp, Artificial Sequence
  chemically synthesized
tttcaaaggtcacagctcttgt

SEQ ID NO: 1323653 - DNA, 22 bp, Artificial Sequence
  chemically synthesized
ttcaaaggtcacagctcttgtt

SEQ ID NO: 1323654 - DNA, 22 bp, Artificial Sequence
  chemically synthesized
tcaaaggtcacagctcttgttg

SEQ ID NO: 1323655 - DNA, 22 bp, Artificial Sequence
  chemically synthesized
caaaggtcacagctcttgttgg

SEQ ID NO: 1323656 - DNA, 22 bp, Artificial Sequence
  chemically synthesized
aggagagaccgcccaacaagag

SEQ ID NO: 1323657 - DNA, 22 bp, Artificial Sequence
  chemically synthesized
aaaggtcacagctcttgttggg

SEQ ID NO: 1323658 - DNA, 22 bp, Artificial Sequence
  chemically synthesized
ttgttgggcggtctctcctcag

SEQ ID NO: 1323659 - DNA, 22 bp, Artificial Sequence
  chemically synthesized
gaaatggaggagctgaggagag

SEQ ID NO: 1323660 - DNA, 22 bp, Artificial Sequence
  chemically synthesized
gttgggcggtctctcctcagct

SEQ ID NO: 1323661 - DNA, 22 bp, Artificial Sequence
  chemically synthesized
ttgggcggtctctcctcagctc

SEQ ID NO: 1323662 - DNA, 22 bp, Artificial Sequence
  chemically synthesized
ggcggtctctcctcagctcctc

SEQ ID NO: 1323663 - DNA, 22 bp, Artificial Sequence
  chemically synthesized
gatcctggaaatggaggagctg

SEQ ID NO: 1323664 - DNA, 22 bp, Artificial Sequence
  chemically synthesized
ctagatcctggaaatggaggag

SEQ ID NO: 1323665 - DNA, 22 bp, Artificial Sequence
  chemically synthesized
tcctcagctcctccatttccag

SEQ ID NO: 1323666 - DNA, 22 bp, Artificial Sequence
  chemically synthesized
ctcagctcctccatttccagga

SEQ ID NO: 1323667 - DNA, 22 bp, Artificial Sequence
  chemically synthesized
agctcctccatttccaggatct

SEQ ID NO: 1323668 - DNA, 22 bp, Artificial Sequence
  chemically synthesized
ctccatttccaggatctagtaa

SEQ ID NO: 1323669 - DNA, 22 bp, Artificial Sequence
  chemically synthesized
catttccaggatctagtaattg

SEQ ID NO: 1323670 - DNA, 22 bp, Artificial Sequence
  chemically synthesized
ccaggatctagtaattgctccc

SEQ ID NO: 1323671 - DNA, 22 bp, Artificial Sequence
  chemically synthesized
caggatctagtaattgctccct

SEQ ID NO: 1323672 - DNA, 22 bp, Artificial Sequence
  chemically synthesized
aaaaaggtaaaatgtgagggag

SEQ ID NO: 1323673 - DNA, 22 bp, Artificial Sequence
  chemically synthesized
gtaattgctccctcacatttta

SEQ ID NO: 1323674 - DNA, 22 bp, Artificial Sequence
  chemically synthesized
ggcctaaaaaaggtaaaatgtg

SEQ ID NO: 1323675 - DNA, 22 bp, Artificial Sequence
  chemically synthesized
ctccctcacattttaccttttt

SEQ ID NO: 1323676 - DNA, 22 bp, Artificial Sequence
  chemically synthesized
cctcacattttaccttttttag

SEQ ID NO: 1323677 - DNA, 22 bp, Artificial Sequence
  chemically synthesized
acattttaccttttttaggcct

SEQ ID NO: 1323678 - DNA, 22 bp, Artificial Sequence
  chemically synthesized
taccttttttaggcctagtggt

SEQ ID NO: 1323679 - DNA, 22 bp, Artificial Sequence
  chemically synthesized
accttttttaggcctagtggtg

SEQ ID NO: 1323680 - DNA, 22 bp, Artificial Sequence
  chemically synthesized
ccttttttaggcctagtggtgg

SEQ ID NO: 1323681 - DNA, 22 bp, Artificial Sequence
  chemically synthesized
ttttaggcctagtggtgggtta

SEQ ID NO: 1323682 - DNA, 22 bp, Artificial Sequence
  chemically synthesized
tttaggcctagtggtgggttat

SEQ ID NO: 1323683 - DNA, 22 bp, Artificial Sequence
  chemically synthesized
ttaggcctagtggtgggttatg

SEQ ID NO: 1323684 - DNA, 22 bp, Artificial Sequence
  chemically synthesized
taggcctagtggtgggttatgt

SEQ ID NO: 1323685 - DNA, 22 bp, Artificial Sequence
  chemically synthesized
aggcctagtggtgggttatgtc

SEQ ID NO: 1323686 - DNA, 22 bp, Artificial Sequence
  chemically synthesized
ggcctagtggtgggttatgtct

SEQ ID NO: 1323687 - DNA, 22 bp, Artificial Sequence
  chemically synthesized
gggacaatagaaagacataacc

SEQ ID NO: 1323688 - DNA, 22 bp, Artificial Sequence
  chemically synthesized
tggggacaatagaaagacataa

SEQ ID NO: 1323689 - DNA, 22 bp, Artificial Sequence
  chemically synthesized
gtggtgggttatgtctttctat

SEQ ID NO: 1323690 - DNA, 22 bp, Artificial Sequence
  chemically synthesized
gctctggggacaatagaaagac

SEQ ID NO: 1323691 - DNA, 22 bp, Artificial Sequence
  chemically synthesized
tgtctttctattgtccccagag

SEQ ID NO: 1323692 - DNA, 22 bp, Artificial Sequence
  chemically synthesized
tctattgtccccagagccaggg

SEQ ID NO: 1323693 - DNA, 22 bp, Artificial Sequence
  chemically synthesized
ctattgtccccagagccagggg

SEQ ID NO: 1323694 - DNA, 22 bp, Artificial Sequence
  chemically synthesized
tgatgcaggtggcccctggctc

SEQ ID NO: 1323695 - DNA, 22 bp, Artificial Sequence
  chemically synthesized
tattgtccccagagccaggggc

SEQ ID NO: 1323696 - DNA, 22 bp, Artificial Sequence
  chemically synthesized
ttgtccccagagccaggggcca

SEQ ID NO: 1323697 - DNA, 22 bp, Artificial Sequence
  chemically synthesized
tccccagagccaggggccacct

SEQ ID NO: 1323698 - DNA, 22 bp, Artificial Sequence
  chemically synthesized
atgaatactgtgatgcaggtgg

SEQ ID NO: 1323699 - DNA, 22 bp, Artificial Sequence
  chemically synthesized
agggaaactaatgaatactgtg

SEQ ID NO: 1323700 - DNA, 22 bp, Artificial Sequence
  chemically synthesized
catcacagtattcattagtttc

SEQ ID NO: 1323701 - DNA, 22 bp, Artificial Sequence
  chemically synthesized
tgggtagggttaagggaaacta

SEQ ID NO: 1323702 - DNA, 22 bp, Artificial Sequence
  chemically synthesized
aaagttgtgggtagggttaagg

SEQ ID NO: 1323703 - DNA, 22 bp, Artificial Sequence
  chemically synthesized
attagtttcccttaaccctacc

SEQ ID NO: 1323704 - DNA, 22 bp, Artificial Sequence
  chemically synthesized
gtttcccttaaccctacccaca

SEQ ID NO: 1323705 - DNA, 22 bp, Artificial Sequence
  chemically synthesized
cccttaaccctacccacaactt

SEQ ID NO: 1323706 - DNA, 22 bp, Artificial Sequence
  chemically synthesized
ccttaaccctacccacaacttt

SEQ ID NO: 1323707 - DNA, 22 bp, Artificial Sequence
  chemically synthesized
aaccctacccacaactttgaat

SEQ ID NO: 1323708 - DNA, 22 bp, Artificial Sequence
  chemically synthesized
accctacccacaactttgaata

SEQ ID NO: 1323709 - DNA, 22 bp, Artificial Sequence
  chemically synthesized
cccacaactttgaatattgttt

SEQ ID NO: 1323710 - DNA, 22 bp, Artificial Sequence
  chemically synthesized
tgagaggcaataagaaacaata

SEQ ID NO: 1323711 - DNA, 22 bp, Artificial Sequence
  chemically synthesized
tgaatattgtttcttattgcct

SEQ ID NO: 1323712 - DNA, 22 bp, Artificial Sequence
  chemically synthesized
gaatattgtttcttattgcctc

SEQ ID NO: 1323713 - DNA, 22 bp, Artificial Sequence
  chemically synthesized
aatattgtttcttattgcctct

SEQ ID NO: 1323714 - DNA, 22 bp, Artificial Sequence
  chemically synthesized
aaatgggtaaactatgagaggc

SEQ ID NO: 1323715 - DNA, 22 bp, Artificial Sequence
  chemically synthesized
tttcttattgcctctcatagtt

SEQ ID NO: 1323716 - DNA, 22 bp, Artificial Sequence
  chemically synthesized
cttattgcctctcatagtttac

SEQ ID NO: 1323717 - DNA, 22 bp, Artificial Sequence
  chemically synthesized
ttattgcctctcatagtttacc

SEQ ID NO: 1323718 - DNA, 22 bp, Artificial Sequence
  chemically synthesized
attgcctctcatagtttaccca

SEQ ID NO: 1323719 - DNA, 22 bp, Artificial Sequence
  chemically synthesized
ttgcctctcatagtttacccat

SEQ ID NO: 1323720 - DNA, 22 bp, Artificial Sequence
  chemically synthesized
cctctcatagtttacccatttt

SEQ ID NO: 1323721 - DNA, 22 bp, Artificial Sequence
  chemically synthesized
tcatagtttacccattttagca

SEQ ID NO: 1323722 - DNA, 22 bp, Artificial Sequence
  chemically synthesized
atagtttacccattttagcatg

SEQ ID NO: 1323723 - DNA, 22 bp, Artificial Sequence
  chemically synthesized
acccattttagcatgccgtgtg

SEQ ID NO: 1323724 - DNA, 22 bp, Artificial Sequence
  chemically synthesized
cccattttagcatgccgtgtgt

SEQ ID NO: 1323725 - DNA, 22 bp, Artificial Sequence
  chemically synthesized
tagcatgccgtgtgtttgtttt

SEQ ID NO: 1323726 - DNA, 22 bp, Artificial Sequence
  chemically synthesized
agcatgccgtgtgtttgttttc

SEQ ID NO: 1323727 - DNA, 22 bp, Artificial Sequence
  chemically synthesized
gcatgccgtgtgtttgttttct

SEQ ID NO: 1323728 - DNA, 22 bp, Artificial Sequence
  chemically synthesized
tcagagatcagcaagaaaacaa

SEQ ID NO: 1323729 - DNA, 22 bp, Artificial Sequence
  chemically synthesized
tctatcagagatcagcaagaaa

SEQ ID NO: 1323730 - DNA, 22 bp, Artificial Sequence
  chemically synthesized
atctatcagagatcagcaagaa

SEQ ID NO: 1323731 - DNA, 22 bp, Artificial Sequence
  chemically synthesized
gatgcttatctatcagagatca

SEQ ID NO: 1323732 - DNA, 22 bp, Artificial Sequence
  chemically synthesized
gttttcttgctgatctctgata

SEQ ID NO: 1323733 - DNA, 22 bp, Artificial Sequence
  chemically synthesized
tggatgcttatctatcagagat

SEQ ID NO: 1323734 - DNA, 22 bp, Artificial Sequence
  chemically synthesized
ttttcttgctgatctctgatag

SEQ ID NO: 1323735 - DNA, 22 bp, Artificial Sequence
  chemically synthesized
tcttgctgatctctgatagata

SEQ ID NO: 1323736 - DNA, 22 bp, Artificial Sequence
  chemically synthesized
cttgctgatctctgatagataa

SEQ ID NO: 1323737 - DNA, 22 bp, Artificial Sequence
  chemically synthesized
ttgctgatctctgatagataag

SEQ ID NO: 1323738 - DNA, 22 bp, Artificial Sequence
  chemically synthesized
gctgatctctgatagataagca

SEQ ID NO: 1323739 - DNA, 22 bp, Artificial Sequence
  chemically synthesized
ctgatctctgatagataagcat

SEQ ID NO: 1323740 - DNA, 22 bp, Artificial Sequence
  chemically synthesized
atctctgatagataagcatcca

SEQ ID NO: 1323741 - DNA, 22 bp, Artificial Sequence
  chemically synthesized
tgatagataagcatccagagat

SEQ ID NO: 1323742 - DNA, 22 bp, Artificial Sequence
  chemically synthesized
atagataagcatccagagatga

SEQ ID NO: 1323743 - DNA, 22 bp, Artificial Sequence
  chemically synthesized
atagcagacatatcatcatctc

SEQ ID NO: 1323744 - DNA, 22 bp, Artificial Sequence
  chemically synthesized
attaatagcagacatatcatca

SEQ ID NO: 1323745 - DNA, 22 bp, Artificial Sequence
  chemically synthesized
aattaatagcagacatatcatc

SEQ ID NO: 1323746 - DNA, 22 bp, Artificial Sequence
  chemically synthesized
atatggagtgacgaacaaatcc

SEQ ID NO: 1323747 - DNA, 22 bp, Artificial Sequence
  chemically synthesized
ctattaattaaggatttgttcg

SEQ ID NO: 1323748 - DNA, 22 bp, Artificial Sequence
  chemically synthesized
ttaattaaggatttgttcgtca

SEQ ID NO: 1323749 - DNA, 22 bp, Artificial Sequence
  chemically synthesized
actcatatggagtgacgaacaa

SEQ ID NO: 1323750 - DNA, 22 bp, Artificial Sequence
  chemically synthesized
attaaggatttgttcgtcactc

SEQ ID NO: 1323751 - DNA, 22 bp, Artificial Sequence
  chemically synthesized
ttaactcatatggagtgacgaa

SEQ ID NO: 1323752 - DNA, 22 bp, Artificial Sequence
  chemically synthesized
attaactcatatggagtgacga

SEQ ID NO: 1323753 - DNA, 22 bp, Artificial Sequence
  chemically synthesized
tattaactcatatggagtgacg

SEQ ID NO: 1323754 - DNA, 22 bp, Artificial Sequence
  chemically synthesized
ttattaactcatatggagtgac

SEQ ID NO: 1323755 - DNA, 22 bp, Artificial Sequence
  chemically synthesized
aggatttgttcgtcactccata

SEQ ID NO: 1323756 - DNA, 22 bp, Artificial Sequence
  chemically synthesized
gacttttattaactcatatgga

SEQ ID NO: 1323757 - DNA, 22 bp, Artificial Sequence
  chemically synthesized
ggacttttattaactcatatgg

SEQ ID NO: 1323758 - DNA, 22 bp, Artificial Sequence
  chemically synthesized
tggacttttattaactcatatg

SEQ ID NO: 1323759 - DNA, 22 bp, Artificial Sequence
  chemically synthesized
gttcgtcactccatatgagtta

SEQ ID NO: 1323760 - DNA, 22 bp, Artificial Sequence
  chemically synthesized
ttcgtcactccatatgagttaa

SEQ ID NO: 1323761 - DNA, 22 bp, Artificial Sequence
  chemically synthesized
gtcactccatatgagttaataa

SEQ ID NO: 1323762 - DNA, 22 bp, Artificial Sequence
  chemically synthesized
agtcatattttggacttttatt

SEQ ID NO: 1323763 - DNA, 22 bp, Artificial Sequence
  chemically synthesized
aagtcatattttggacttttat

SEQ ID NO: 1323764 - DNA, 22 bp, Artificial Sequence
  chemically synthesized
catatgagttaataaaagtcca

SEQ ID NO: 1323765 - DNA, 22 bp, Artificial Sequence
  chemically synthesized
taagtcatattttggactttta

SEQ ID NO: 1323766 - DNA, 22 bp, Artificial Sequence
  chemically synthesized
attttaagtcatattttggact

SEQ ID NO: 1323767 - DNA, 22 bp, Artificial Sequence
  chemically synthesized
ttaattttaagtcatattttgg

SEQ ID NO: 1323768 - DNA, 22 bp, Artificial Sequence
  chemically synthesized
gttaattttaagtcatattttg

SEQ ID NO: 1323769 - DNA, 22 bp, Artificial Sequence
  chemically synthesized
ataaaagtccaaaatatgactt

SEQ ID NO: 1323770 - DNA, 22 bp, Artificial Sequence
  chemically synthesized
atacaaaatttgttaattttaa

SEQ ID NO: 1323771 - DNA, 22 bp, Artificial Sequence
  chemically synthesized
aaaattaacaaattttgtatga

SEQ ID NO: 1323772 - DNA, 22 bp, Artificial Sequence
  chemically synthesized
aaattaacaaattttgtatgaa

SEQ ID NO: 1323773 - DNA, 22 bp, Artificial Sequence
  chemically synthesized
acaaattttgtatgaacttgtg

SEQ ID NO: 1323774 - DNA, 22 bp, Artificial Sequence
  chemically synthesized
gatagatatggaacaaccacaa

SEQ ID NO: 1323775 - DNA, 22 bp, Artificial Sequence
  chemically synthesized
tagatagatatggaacaaccac

SEQ ID NO: 1323776 - DNA, 22 bp, Artificial Sequence
  chemically synthesized
tgtatgaacttgtggttgttcc

SEQ ID NO: 1323777 - DNA, 22 bp, Artificial Sequence
  chemically synthesized
ctagatagatatggaacaacca

SEQ ID NO: 1323778 - DNA, 22 bp, Artificial Sequence
  chemically synthesized
gtatgaacttgtggttgttcca

SEQ ID NO: 1323779 - DNA, 22 bp, Artificial Sequence
  chemically synthesized
tatgaacttgtggttgttccat

SEQ ID NO: 1323780 - DNA, 22 bp, Artificial Sequence
  chemically synthesized
gtggttgttccatatctatcta

SEQ ID NO: 1323781 - DNA, 22 bp, Artificial Sequence
  chemically synthesized
gagatatgtttctagatagata

SEQ ID NO: 1323782 - DNA, 22 bp, Artificial Sequence
  chemically synthesized
tggttgttccatatctatctag

SEQ ID NO: 1323783 - DNA, 22 bp, Artificial Sequence
  chemically synthesized
tagagatatgtttctagataga

SEQ ID NO: 1323784 - DNA, 22 bp, Artificial Sequence
  chemically synthesized
ttctagagatatgtttctagat

SEQ ID NO: 1323785 - DNA, 22 bp, Artificial Sequence
  chemically synthesized
ttccatatctatctagaaacat

SEQ ID NO: 1323786 - DNA, 22 bp, Artificial Sequence
  chemically synthesized
catatctatctagaaacatatc

SEQ ID NO: 1323787 - DNA, 22 bp, Artificial Sequence
  chemically synthesized
tctagaaacatatctctagaat

SEQ ID NO: 1323788 - DNA, 22 bp, Artificial Sequence
  chemically synthesized
gaaacatatctctagaatagtt

SEQ ID NO: 1323789 - DNA, 22 bp, Artificial Sequence
  chemically synthesized
gacatgaaatgagaactattct

SEQ ID NO: 1323790 - DNA, 22 bp, Artificial Sequence
  chemically synthesized
atctcgacatgaaatgagaact

SEQ ID NO: 1323791 - DNA, 22 bp, Artificial Sequence
  chemically synthesized
aatctcgacatgaaatgagaac

SEQ ID NO: 1323792 - DNA, 22 bp, Artificial Sequence
  chemically synthesized
tagaatagttctcatttcatgt

SEQ ID NO: 1323793 - DNA, 22 bp, Artificial Sequence
  chemically synthesized
gaatagttctcatttcatgtcg

SEQ ID NO: 1323794 - DNA, 22 bp, Artificial Sequence
  chemically synthesized
aatatcttaatctcgacatgaa

SEQ ID NO: 1323795 - DNA, 22 bp, Artificial Sequence
  chemically synthesized
tatactaaatatcttaatctcg

SEQ ID NO: 1323796 - DNA, 22 bp, Artificial Sequence
  chemically synthesized
tcatttcatgtcgagattaaga

SEQ ID NO: 1323797 - DNA, 22 bp, Artificial Sequence
  chemically synthesized
atttcatgtcgagattaagata

SEQ ID NO: 1323798 - DNA, 22 bp, Artificial Sequence
  chemically synthesized
catgtcgagattaagatattta

SEQ ID NO: 1323799 - DNA, 22 bp, Artificial Sequence
  chemically synthesized
atgtcgagattaagatatttag

SEQ ID NO: 1323800 - DNA, 22 bp, Artificial Sequence
  chemically synthesized
atgccactatatactaaatatc

SEQ ID NO: 1323801 - DNA, 22 bp, Artificial Sequence
  chemically synthesized
agatatttagtatatagtggca

SEQ ID NO: 1323802 - DNA, 22 bp, Artificial Sequence
  chemically synthesized
agtatatagtggcattaactct

SEQ ID NO: 1323803 - DNA, 22 bp, Artificial Sequence
  chemically synthesized
gtatatagtggcattaactctt

SEQ ID NO: 1323804 - DNA, 22 bp, Artificial Sequence
  chemically synthesized
atgggcaagatgaagagttaat

SEQ ID NO: 1323805 - DNA, 22 bp, Artificial Sequence
  chemically synthesized
aatgggcaagatgaagagttaa

SEQ ID NO: 1323806 - DNA, 22 bp, Artificial Sequence
  chemically synthesized
taatgggcaagatgaagagtta

SEQ ID NO: 1323807 - DNA, 22 bp, Artificial Sequence
  chemically synthesized
cctttaatgggcaagatgaaga

SEQ ID NO: 1323808 - DNA, 22 bp, Artificial Sequence
  chemically synthesized
gcctttaatgggcaagatgaag

SEQ ID NO: 1323809 - DNA, 22 bp, Artificial Sequence
  chemically synthesized
tgcctttaatgggcaagatgaa

SEQ ID NO: 1323810 - DNA, 22 bp, Artificial Sequence
  chemically synthesized
ttttgcctttaatgggcaagat

SEQ ID NO: 1323811 - DNA, 22 bp, Artificial Sequence
  chemically synthesized
actcttcatcttgcccattaaa

SEQ ID NO: 1323812 - DNA, 22 bp, Artificial Sequence
  chemically synthesized
ttcatcttgcccattaaaggca

SEQ ID NO: 1323813 - DNA, 22 bp, Artificial Sequence
  chemically synthesized
catcttgcccattaaaggcaaa

SEQ ID NO: 1323814 - DNA, 22 bp, Artificial Sequence
  chemically synthesized
atcttgcccattaaaggcaaaa

SEQ ID NO: 1323815 - DNA, 22 bp, Artificial Sequence
  chemically synthesized
aaaaacaatctgttttgccttt

SEQ ID NO: 1323816 - DNA, 22 bp, Artificial Sequence
  chemically synthesized
gcccattaaaggcaaaacagat

SEQ ID NO: 1323817 - DNA, 22 bp, Artificial Sequence
  chemically synthesized
cccattaaaggcaaaacagatt

SEQ ID NO: 1323818 - DNA, 22 bp, Artificial Sequence
  chemically synthesized
aagaaataattaaaaaacaatc

SEQ ID NO: 1323819 - DNA, 22 bp, Artificial Sequence
  chemically synthesized
aaggcaaaacagattgtttttt

SEQ ID NO: 1323820 - DNA, 22 bp, Artificial Sequence
  chemically synthesized
gaagaaataattaaaaaacaat

SEQ ID NO: 1323821 - DNA, 22 bp, Artificial Sequence
  chemically synthesized
catttgaagaaataattaaaaa

SEQ ID NO: 1323822 - DNA, 22 bp, Artificial Sequence
  chemically synthesized
ttttttaattatttcttcaaat

SEQ ID NO: 1323823 - DNA, 22 bp, Artificial Sequence
  chemically synthesized
tgaaaggaagttccatttgaag

SEQ ID NO: 1323824 - DNA, 22 bp, Artificial Sequence
  chemically synthesized
tttaattatttcttcaaatgga

SEQ ID NO: 1323825 - DNA, 22 bp, Artificial Sequence
  chemically synthesized
atgaaaggaagttccatttgaa

SEQ ID NO: 1323826 - DNA, 22 bp, Artificial Sequence
  chemically synthesized
ttaattatttcttcaaatggaa

SEQ ID NO: 1323827 - DNA, 22 bp, Artificial Sequence
  chemically synthesized
tatgaaaggaagttccatttga

SEQ ID NO: 1323828 - DNA, 22 bp, Artificial Sequence
  chemically synthesized
taattatttcttcaaatggaac

SEQ ID NO: 1323829 - DNA, 22 bp, Artificial Sequence
  chemically synthesized
aattatttcttcaaatggaact

SEQ ID NO: 1323830 - DNA, 22 bp, Artificial Sequence
  chemically synthesized
attatttcttcaaatggaactt

SEQ ID NO: 1323831 - DNA, 22 bp, Artificial Sequence
  chemically synthesized
tctttatgaaaggaagttccat

SEQ ID NO: 1323832 - DNA, 22 bp, Artificial Sequence
  chemically synthesized
tttcttcaaatggaacttcctt

SEQ ID NO: 1323833 - DNA, 22 bp, Artificial Sequence
  chemically synthesized
cttcaaatggaacttcctttca

SEQ ID NO: 1323834 - DNA, 22 bp, Artificial Sequence
  chemically synthesized
ttcaaatggaacttcctttcat

SEQ ID NO: 1323835 - DNA, 22 bp, Artificial Sequence
  chemically synthesized
caaatggaacttcctttcataa

SEQ ID NO: 1323836 - DNA, 22 bp, Artificial Sequence
  chemically synthesized
aaatggaacttcctttcataaa

SEQ ID NO: 1323837 - DNA, 22 bp, Artificial Sequence
  chemically synthesized
cagtacacgttgtctttatgaa

SEQ ID NO: 1323838 - DNA, 22 bp, Artificial Sequence
  chemically synthesized
acagtacacgttgtctttatga

SEQ ID NO: 1323839 - DNA, 22 bp, Artificial Sequence
  chemically synthesized
cctttcataaagacaacgtgta

SEQ ID NO: 1323840 - DNA, 22 bp, Artificial Sequence
  chemically synthesized
ctttcataaagacaacgtgtac

SEQ ID NO: 1323841 - DNA, 22 bp, Artificial Sequence
  chemically synthesized
tcataaagacaacgtgtactgt

SEQ ID NO: 1323842 - DNA, 22 bp, Artificial Sequence
  chemically synthesized
cataaagacaacgtgtactgta

SEQ ID NO: 1323843 - DNA, 22 bp, Artificial Sequence
  chemically synthesized
ataaagacaacgtgtactgtaa

SEQ ID NO: 1323844 - DNA, 22 bp, Artificial Sequence
  chemically synthesized
taaaaaacagtaaagaatgctt

SEQ ID NO: 1323845 - DNA, 22 bp, Artificial Sequence
  chemically synthesized
gctgtaaaaaacagtaaagaat

SEQ ID NO: 1323846 - DNA, 22 bp, Artificial Sequence
  chemically synthesized
ggctgtaaaaaacagtaaagaa

SEQ ID NO: 1323847 - DNA, 22 bp, Artificial Sequence
  chemically synthesized
ttggctgtaaaaaacagtaaag

SEQ ID NO: 1323848 - DNA, 22 bp, Artificial Sequence
  chemically synthesized
cttggctgtaaaaaacagtaaa

SEQ ID NO: 1323849 - DNA, 22 bp, Artificial Sequence
  chemically synthesized
tcttggctgtaaaaaacagtaa

SEQ ID NO: 1323850 - DNA, 22 bp, Artificial Sequence
  chemically synthesized
ttcttggctgtaaaaaacagta

SEQ ID NO: 1323851 - DNA, 22 bp, Artificial Sequence
  chemically synthesized
taagcattctttactgtttttt

SEQ ID NO: 1323852 - DNA, 22 bp, Artificial Sequence
  chemically synthesized
tgtcgatttttcttggctgtaa

SEQ ID NO: 1323853 - DNA, 22 bp, Artificial Sequence
  chemically synthesized
tttactgttttttacagccaag

SEQ ID NO: 1323854 - DNA, 22 bp, Artificial Sequence
  chemically synthesized
tactgttttttacagccaagaa

SEQ ID NO: 1323855 - DNA, 22 bp, Artificial Sequence
  chemically synthesized
actgttttttacagccaagaaa

SEQ ID NO: 1323856 - DNA, 22 bp, Artificial Sequence
  chemically synthesized
ctgttttttacagccaagaaaa

SEQ ID NO: 1323857 - DNA, 22 bp, Artificial Sequence
  chemically synthesized
ttttttacagccaagaaaaatc

SEQ ID NO: 1323858 - DNA, 22 bp, Artificial Sequence
  chemically synthesized
tttacagccaagaaaaatcgac

SEQ ID NO: 1323859 - DNA, 22 bp, Artificial Sequence
  chemically synthesized
ttacagccaagaaaaatcgaca

SEQ ID NO: 1323860 - DNA, 22 bp, Artificial Sequence
  chemically synthesized
tacagccaagaaaaatcgacat

SEQ ID NO: 1323861 - DNA, 22 bp, Artificial Sequence
  chemically synthesized
acagccaagaaaaatcgacata

SEQ ID NO: 1323862 - DNA, 22 bp, Artificial Sequence
  chemically synthesized
cagccaagaaaaatcgacatag

SEQ ID NO: 1323863 - DNA, 22 bp, Artificial Sequence
  chemically synthesized
tgacaaatcaataggtgtgtaa

SEQ ID NO: 1323864 - DNA, 22 bp, Artificial Sequence
  chemically synthesized
atgacaaatcaataggtgtgta

SEQ ID NO: 1323865 - DNA, 22 bp, Artificial Sequence
  chemically synthesized
acatcttatgacaaatcaatag

SEQ ID NO: 1323866 - DNA, 22 bp, Artificial Sequence
  chemically synthesized
gttgacatcttatgacaaatca

SEQ ID NO: 1323867 - DNA, 22 bp, Artificial Sequence
  chemically synthesized
acacacctattgatttgtcata

SEQ ID NO: 1323868 - DNA, 22 bp, Artificial Sequence
  chemically synthesized
tagttgacatcttatgacaaat

SEQ ID NO: 1323869 - DNA, 22 bp, Artificial Sequence
  chemically synthesized
cacacctattgatttgtcataa

SEQ ID NO: 1323870 - DNA, 22 bp, Artificial Sequence
  chemically synthesized
tctagttgacatcttatgacaa

SEQ ID NO: 1323871 - DNA, 22 bp, Artificial Sequence
  chemically synthesized
ttctctagttgacatcttatga

SEQ ID NO: 1323872 - DNA, 22 bp, Artificial Sequence
  chemically synthesized
gttctctagttgacatcttatg

SEQ ID NO: 1323873 - DNA, 22 bp, Artificial Sequence
  chemically synthesized
tgttctctagttgacatcttat

SEQ ID NO: 1323874 - DNA, 22 bp, Artificial Sequence
  chemically synthesized
ttgttctctagttgacatctta

SEQ ID NO: 1323875 - DNA, 22 bp, Artificial Sequence
  chemically synthesized
ttgatttgtcataagatgtcaa

SEQ ID NO: 1323876 - DNA, 22 bp, Artificial Sequence
  chemically synthesized
tttgttctctagttgacatctt

SEQ ID NO: 1323877 - DNA, 22 bp, Artificial Sequence
  chemically synthesized
ttttgttctctagttgacatct

SEQ ID NO: 1323878 - DNA, 22 bp, Artificial Sequence
  chemically synthesized
tttttgttctctagttgacatc

SEQ ID NO: 1323879 - DNA, 22 bp, Artificial Sequence
  chemically synthesized
atttgtcataagatgtcaacta

SEQ ID NO: 1323880 - DNA, 22 bp, Artificial Sequence
  chemically synthesized
gtcataagatgtcaactagaga

SEQ ID NO: 1323881 - DNA, 22 bp, Artificial Sequence
  chemically synthesized
ggttttttttgttctctagttg

SEQ ID NO: 1323882 - DNA, 22 bp, Artificial Sequence
  chemically synthesized
tcataagatgtcaactagagaa

SEQ ID NO: 1323883 - DNA, 22 bp, Artificial Sequence
  chemically synthesized
gggttttttttgttctctagtt

SEQ ID NO: 1323884 - DNA, 22 bp, Artificial Sequence
  chemically synthesized
tttgggttttttttgttctcta

SEQ ID NO: 1323885 - DNA, 22 bp, Artificial Sequence
  chemically synthesized
atctgtttgggttttttttgtt

SEQ ID NO: 1323886 - DNA, 22 bp, Artificial Sequence
  chemically synthesized
tccattaatctgtttgggtttt

SEQ ID NO: 1323887 - DNA, 22 bp, Artificial Sequence
  chemically synthesized
gtccattaatctgtttgggttt

SEQ ID NO: 1323888 - DNA, 22 bp, Artificial Sequence
  chemically synthesized
gagaacaaaaaaaacccaaaca

SEQ ID NO: 1323889 - DNA, 22 bp, Artificial Sequence
  chemically synthesized
ttgtccattaatctgtttgggt

SEQ ID NO: 1323890 - DNA, 22 bp, Artificial Sequence
  chemically synthesized
acactcttgtccattaatctgt

SEQ ID NO: 1323891 - DNA, 22 bp, Artificial Sequence
  chemically synthesized
caattaacactcttgtccatta

SEQ ID NO: 1323892 - DNA, 22 bp, Artificial Sequence
  chemically synthesized
tatatcattgcaattaacactc

SEQ ID NO: 1323893 - DNA, 22 bp, Artificial Sequence
  chemically synthesized
atatatcattgcaattaacact

SEQ ID NO: 1323894 - DNA, 22 bp, Artificial Sequence
  chemically synthesized
tatatatcattgcaattaacac

SEQ ID NO: 1323895 - DNA, 22 bp, Artificial Sequence
  chemically synthesized
ttatatatcattgcaattaaca

SEQ ID NO: 1323896 - DNA, 22 bp, Artificial Sequence
  chemically synthesized
atggacaagagtgttaattgca

SEQ ID NO: 1323897 - DNA, 22 bp, Artificial Sequence
  chemically synthesized
tttatatatcattgcaattaac

SEQ ID NO: 1323898 - DNA, 22 bp, Artificial Sequence
  chemically synthesized
ttttatatatcattgcaattaa

SEQ ID NO: 1323899 - DNA, 22 bp, Artificial Sequence
  chemically synthesized
gcttttttatatatcattgcaa

SEQ ID NO: 1323900 - DNA, 22 bp, Artificial Sequence
  chemically synthesized
ggcttttttatatatcattgca

SEQ ID NO: 1323901 - DNA, 22 bp, Artificial Sequence
  chemically synthesized
tggcttttttatatatcattgc

SEQ ID NO: 1323902 - DNA, 22 bp, Artificial Sequence
  chemically synthesized
tgtaattttggcttttttatat

SEQ ID NO: 1323903 - DNA, 22 bp, Artificial Sequence
  chemically synthesized
attgcaatgatatataaaaaag

SEQ ID NO: 1323904 - DNA, 22 bp, Artificial Sequence
  chemically synthesized
ttatgtaattttggctttttta

SEQ ID NO: 1323905 - DNA, 22 bp, Artificial Sequence
  chemically synthesized
caatgatatataaaaaagccaa

SEQ ID NO: 1323906 - DNA, 22 bp, Artificial Sequence
  chemically synthesized
gagctattatgtaattttggct

SEQ ID NO: 1323907 - DNA, 22 bp, Artificial Sequence
  chemically synthesized
cgttagagctattatgtaattt

SEQ ID NO: 1323908 - DNA, 22 bp, Artificial Sequence
  chemically synthesized
ttacgttagagctattatgtaa

SEQ ID NO: 1323909 - DNA, 22 bp, Artificial Sequence
  chemically synthesized
cgtgtcagagctattacgttag

SEQ ID NO: 1323910 - DNA, 22 bp, Artificial Sequence
  chemically synthesized
cataatagctctaacgtaatag

SEQ ID NO: 1323911 - DNA, 22 bp, Artificial Sequence
  chemically synthesized
tgttgcgtgtcagagctattac

SEQ ID NO: 1323912 - DNA, 22 bp, Artificial Sequence
  chemically synthesized
atgttgcgtgtcagagctatta

SEQ ID NO: 1323913 - DNA, 22 bp, Artificial Sequence
  chemically synthesized
ttatgttgcgtgtcagagctat

SEQ ID NO: 1323914 - DNA, 22 bp, Artificial Sequence
  chemically synthesized
cttatgttgcgtgtcagagcta

SEQ ID NO: 1323915 - DNA, 22 bp, Artificial Sequence
  chemically synthesized
taacgtaatagctctgacacgc

SEQ ID NO: 1323916 - DNA, 22 bp, Artificial Sequence
  chemically synthesized
tcttcttatgttgcgtgtcaga

SEQ ID NO: 1323917 - DNA, 22 bp, Artificial Sequence
  chemically synthesized
atcttcttatgttgcgtgtcag

SEQ ID NO: 1323918 - DNA, 22 bp, Artificial Sequence
  chemically synthesized
acgtaatagctctgacacgcaa

SEQ ID NO: 1323919 - DNA, 22 bp, Artificial Sequence
  chemically synthesized
tatcttcttatgttgcgtgtca

SEQ ID NO: 1323920 - DNA, 22 bp, Artificial Sequence
  chemically synthesized
tttatcttcttatgttgcgtgt

SEQ ID NO: 1323921 - DNA, 22 bp, Artificial Sequence
  chemically synthesized
attctttatcttcttatgttgc

SEQ ID NO: 1323922 - DNA, 22 bp, Artificial Sequence
  chemically synthesized
tgacacgcaacataagaagata

SEQ ID NO: 1323923 - DNA, 22 bp, Artificial Sequence
  chemically synthesized
acacgcaacataagaagataaa

SEQ ID NO: 1323924 - DNA, 22 bp, Artificial Sequence
  chemically synthesized
tagatagttcattctttatctt

SEQ ID NO: 1323925 - DNA, 22 bp, Artificial Sequence
  chemically synthesized
cctatagatagttcattcttta

SEQ ID NO: 1323926 - DNA, 22 bp, Artificial Sequence
  chemically synthesized
aatattacctatagatagttca

SEQ ID NO: 1323927 - DNA, 22 bp, Artificial Sequence
  chemically synthesized
aaatattacctatagatagttc

SEQ ID NO: 1323928 - DNA, 22 bp, Artificial Sequence
  chemically synthesized
taaatattacctatagatagtt

SEQ ID NO: 1323929 - DNA, 22 bp, Artificial Sequence
  chemically synthesized
ttaaatattacctatagatagt

SEQ ID NO: 1323930 - DNA, 22 bp, Artificial Sequence
  chemically synthesized
catatatttttaaatattacct

SEQ ID NO: 1323931 - DNA, 22 bp, Artificial Sequence
  chemically synthesized
tacatatatttttaaatattac

SEQ ID NO: 1323932 - DNA, 22 bp, Artificial Sequence
  chemically synthesized
ctacatatatttttaaatatta

SEQ ID NO: 1323933 - DNA, 22 bp, Artificial Sequence
  chemically synthesized
tctataggtaatatttaaaaat

SEQ ID NO: 1323934 - DNA, 22 bp, Artificial Sequence
  chemically synthesized
atggtttctacatatattttta

SEQ ID NO: 1323935 - DNA, 22 bp, Artificial Sequence
  chemically synthesized
taggtaatatttaaaaatatat

SEQ ID NO: 1323936 - DNA, 22 bp, Artificial Sequence
  chemically synthesized
aatggtttctacatatattttt

SEQ ID NO: 1323937 - DNA, 22 bp, Artificial Sequence
  chemically synthesized
aaaaatatatgtagaaaccatt

SEQ ID NO: 1323938 - DNA, 22 bp, Artificial Sequence
  chemically synthesized
aaaatatatgtagaaaccatta

SEQ ID NO: 1323939 - DNA, 22 bp, Artificial Sequence
  chemically synthesized
agtcaacaatgccttaatggtt

SEQ ID NO: 1323940 - DNA, 22 bp, Artificial Sequence
  chemically synthesized
gagtcaacaatgccttaatggt

SEQ ID NO: 1323941 - DNA, 22 bp, Artificial Sequence
  chemically synthesized
cagtgtccttgagtcaacaatg

SEQ ID NO: 1323942 - DNA, 22 bp, Artificial Sequence
  chemically synthesized
ccagtgtccttgagtcaacaat

SEQ ID NO: 1323943 - DNA, 22 bp, Artificial Sequence
  chemically synthesized
ttccagtgtccttgagtcaaca

SEQ ID NO: 1323944 - DNA, 22 bp, Artificial Sequence
  chemically synthesized
aggcattgttgactcaaggaca

SEQ ID NO: 1323945 - DNA, 22 bp, Artificial Sequence
  chemically synthesized
ggccagcatctcttccagtgtc

SEQ ID NO: 1323946 - DNA, 22 bp, Artificial Sequence
  chemically synthesized
ttgactcaaggacactggaaga

SEQ ID NO: 1323947 - DNA, 22 bp, Artificial Sequence
  chemically synthesized
actcaaggacactggaagagat

SEQ ID NO: 1323948 - DNA, 22 bp, Artificial Sequence
  chemically synthesized
gattgggccagcatctcttcca

SEQ ID NO: 1323949 - DNA, 22 bp, Artificial Sequence
  chemically synthesized
ggattgggccagcatctcttcc

SEQ ID NO: 1323950 - DNA, 22 bp, Artificial Sequence
  chemically synthesized
aaggacactggaagagatgctg

SEQ ID NO: 1323951 - DNA, 22 bp, Artificial Sequence
  chemically synthesized
tttggattgggccagcatctct

SEQ ID NO: 1323952 - DNA, 22 bp, Artificial Sequence
  chemically synthesized
gaagagatgctggcccaatcca

SEQ ID NO: 1323953 - DNA, 22 bp, Artificial Sequence
  chemically synthesized
aaccagcatctgtttggattgg

SEQ ID NO: 1323954 - DNA, 22 bp, Artificial Sequence
  chemically synthesized
aaaccagcatctgtttggattg

SEQ ID NO: 1323955 - DNA, 22 bp, Artificial Sequence
  chemically synthesized
taaaccagcatctgtttggatt

SEQ ID NO: 1323956 - DNA, 22 bp, Artificial Sequence
  chemically synthesized
gcccaatccaaacagatgctgg

SEQ ID NO: 1323957 - DNA, 22 bp, Artificial Sequence
  chemically synthesized
taagaatagtccagtcatttta

SEQ ID NO: 1323958 - DNA, 22 bp, Artificial Sequence
  chemically synthesized
gtaagaatagtccagtcatttt

SEQ ID NO: 1323959 - DNA, 22 bp, Artificial Sequence
  chemically synthesized
gtttaaaatgactggactattc

SEQ ID NO: 1323960 - DNA, 22 bp, Artificial Sequence
  chemically synthesized
gtgtgccccttgtaagaatagt

SEQ ID NO: 1323961 - DNA, 22 bp, Artificial Sequence
  chemically synthesized
aaaatgactggactattcttac

SEQ ID NO: 1323962 - DNA, 22 bp, Artificial Sequence
  chemically synthesized
aaatgactggactattcttaca

SEQ ID NO: 1323963 - DNA, 22 bp, Artificial Sequence
  chemically synthesized
agttggtgtgccccttgtaaga

SEQ ID NO: 1323964 - DNA, 22 bp, Artificial Sequence
  chemically synthesized
gactattcttacaaggggcaca

SEQ ID NO: 1323965 - DNA, 22 bp, Artificial Sequence
  chemically synthesized
atactgagttggtgtgcccctt

SEQ ID NO: 1323966 - DNA, 22 bp, Artificial Sequence
  chemically synthesized
ttcttacaaggggcacaccaac

SEQ ID NO: 1323967 - DNA, 22 bp, Artificial Sequence
  chemically synthesized
ttacaaggggcacaccaactca

SEQ ID NO: 1323968 - DNA, 22 bp, Artificial Sequence
  chemically synthesized
tagaactgatactgagttggtg

SEQ ID NO: 1323969 - DNA, 22 bp, Artificial Sequence
  chemically synthesized
acaaggggcacaccaactcagt

SEQ ID NO: 1323970 - DNA, 22 bp, Artificial Sequence
  chemically synthesized
caaggggcacaccaactcagta

SEQ ID NO: 1323971 - DNA, 22 bp, Artificial Sequence
  chemically synthesized
ctgtagaactgatactgagttg

SEQ ID NO: 1323972 - DNA, 22 bp, Artificial Sequence
  chemically synthesized
gctgtagaactgatactgagtt

SEQ ID NO: 1323973 - DNA, 22 bp, Artificial Sequence
  chemically synthesized
tgctgtagaactgatactgagt

SEQ ID NO: 1323974 - DNA, 22 bp, Artificial Sequence
  chemically synthesized
tcatatggttttgctgtagaac

SEQ ID NO: 1323975 - DNA, 22 bp, Artificial Sequence
  chemically synthesized
tgtcatatggttttgctgtaga

SEQ ID NO: 1323976 - DNA, 22 bp, Artificial Sequence
  chemically synthesized
agtatcagttctacagcaaaac

SEQ ID NO: 1323977 - DNA, 22 bp, Artificial Sequence
  chemically synthesized
cataatattctgtcatatggtt

SEQ ID NO: 1323978 - DNA, 22 bp, Artificial Sequence
  chemically synthesized
ctccataatattctgtcatatg

SEQ ID NO: 1323979 - DNA, 22 bp, Artificial Sequence
  chemically synthesized
tacagcaaaaccatatgacaga

SEQ ID NO: 1323980 - DNA, 22 bp, Artificial Sequence
  chemically synthesized
cagcaaaaccatatgacagaat

SEQ ID NO: 1323981 - DNA, 22 bp, Artificial Sequence
  chemically synthesized
cattgctccataatattctgtc

SEQ ID NO: 1323982 - DNA, 22 bp, Artificial Sequence
  chemically synthesized
acattgctccataatattctgt

SEQ ID NO: 1323983 - DNA, 22 bp, Artificial Sequence
  chemically synthesized
cttacattgctccataatattc

SEQ ID NO: 1323984 - DNA, 22 bp, Artificial Sequence
  chemically synthesized
atcattacttacattgctccat

SEQ ID NO: 1323985 - DNA, 22 bp, Artificial Sequence
  chemically synthesized
aatcattacttacattgctcca

SEQ ID NO: 1323986 - DNA, 22 bp, Artificial Sequence
  chemically synthesized
taaaacttaatcattacttaca

SEQ ID NO: 1323987 - DNA, 22 bp, Artificial Sequence
  chemically synthesized
tggagcaatgtaagtaatgatt

SEQ ID NO: 1323988 - DNA, 22 bp, Artificial Sequence
  chemically synthesized
cattgtaaaacttaatcattac

SEQ ID NO: 1323989 - DNA, 22 bp, Artificial Sequence
  chemically synthesized
gcattgtaaaacttaatcatta

SEQ ID NO: 1323990 - DNA, 22 bp, Artificial Sequence
  chemically synthesized
tgcattgtaaaacttaatcatt

SEQ ID NO: 1323991 - DNA, 22 bp, Artificial Sequence
  chemically synthesized
actttgcattgtaaaacttaat

SEQ ID NO: 1323992 - DNA, 22 bp, Artificial Sequence
  chemically synthesized
gtgtctaactttgcattgtaaa

SEQ ID NO: 1323993 - DNA, 22 bp, Artificial Sequence
  chemically synthesized
ggtgtctaactttgcattgtaa

SEQ ID NO: 1323994 - DNA, 22 bp, Artificial Sequence
  chemically synthesized
tggtgtctaactttgcattgta

SEQ ID NO: 1323995 - DNA, 22 bp, Artificial Sequence
  chemically synthesized
ttggtgtctaactttgcattgt

SEQ ID NO: 1323996 - DNA, 22 bp, Artificial Sequence
  chemically synthesized
tttggtgtctaactttgcattg

SEQ ID NO: 1323997 - DNA, 22 bp, Artificial Sequence
  chemically synthesized
agttttacaatgcaaagttaga

SEQ ID NO: 1323998 - DNA, 22 bp, Artificial Sequence
  chemically synthesized
gatattttttggtgtctaactt

SEQ ID NO: 1323999 - DNA, 22 bp, Artificial Sequence
  chemically synthesized
tacaatgcaaagttagacacca

SEQ ID NO: 1324000 - DNA, 22 bp, Artificial Sequence
  chemically synthesized
acaatgcaaagttagacaccaa

SEQ ID NO: 1324001 - DNA, 22 bp, Artificial Sequence
  chemically synthesized
caatgcaaagttagacaccaaa

SEQ ID NO: 1324002 - DNA, 22 bp, Artificial Sequence
  chemically synthesized
ataaagttagatattttttggt

SEQ ID NO: 1324003 - DNA, 22 bp, Artificial Sequence
  chemically synthesized
aataaagttagatattttttgg

SEQ ID NO: 1324004 - DNA, 22 bp, Artificial Sequence
  chemically synthesized
cttaataaagttagatattttt

SEQ ID NO: 1324005 - DNA, 22 bp, Artificial Sequence
  chemically synthesized
ccttaataaagttagatatttt

SEQ ID NO: 1324006 - DNA, 22 bp, Artificial Sequence
  chemically synthesized
tccttaataaagttagatattt

SEQ ID NO: 1324007 - DNA, 22 bp, Artificial Sequence
  chemically synthesized
ttccttaataaagttagatatt

SEQ ID NO: 1324008 - DNA, 22 bp, Artificial Sequence
  chemically synthesized
tttccttaataaagttagatat

SEQ ID NO: 1324009 - DNA, 22 bp, Artificial Sequence
  chemically synthesized
gacaccaaaaaatatctaactt

SEQ ID NO: 1324010 - DNA, 22 bp, Artificial Sequence
  chemically synthesized
ttttttccttaataaagttaga

SEQ ID NO: 1324011 - DNA, 22 bp, Artificial Sequence
  chemically synthesized
attttttccttaataaagttag

SEQ ID NO: 1324012 - DNA, 22 bp, Artificial Sequence
  chemically synthesized
aacagtttattttttccttaat

SEQ ID NO: 1324013 - DNA, 22 bp, Artificial Sequence
  chemically synthesized
taaacagtttattttttcctta

SEQ ID NO: 1324014 - DNA, 22 bp, Artificial Sequence
  chemically synthesized
tctaaacagtttattttttcct

SEQ ID NO: 1324015 - DNA, 22 bp, Artificial Sequence
  chemically synthesized
ctctaaacagtttattttttcc

SEQ ID NO: 1324016 - DNA, 22 bp, Artificial Sequence
  chemically synthesized
tctctaaacagtttattttttc

SEQ ID NO: 1324017 - DNA, 22 bp, Artificial Sequence
  chemically synthesized
actttattaaggaaaaaataaa

SEQ ID NO: 1324018 - DNA, 22 bp, Artificial Sequence
  chemically synthesized
tattaaggaaaaaataaactgt

SEQ ID NO: 1324019 - DNA, 22 bp, Artificial Sequence
  chemically synthesized
attaaggaaaaaataaactgtt

SEQ ID NO: 1324020 - DNA, 22 bp, Artificial Sequence
  chemically synthesized
ttaaggaaaaaataaactgttt

SEQ ID NO: 1324021 - DNA, 22 bp, Artificial Sequence
  chemically synthesized
aggaaaaaataaactgtttaga

SEQ ID NO: 1324022 - DNA, 22 bp, Artificial Sequence
  chemically synthesized
aaacatcctttctctaaacagt

SEQ ID NO: 1324023 - DNA, 22 bp, Artificial Sequence
  chemically synthesized
tttagagaaaggatgttttagc

SEQ ID NO: 1324024 - DNA, 22 bp, Artificial Sequence
  chemically synthesized
agagaaaggatgttttagctgt

SEQ ID NO: 1324025 - DNA, 22 bp, Artificial Sequence
  chemically synthesized
gagaaaggatgttttagctgtg

SEQ ID NO: 1324026 - DNA, 22 bp, Artificial Sequence
  chemically synthesized
aaacagagggaaagccacccac

SEQ ID NO: 1324027 - DNA, 22 bp, Artificial Sequence
  chemically synthesized
aaaacagagggaaagccaccca

SEQ ID NO: 1324028 - DNA, 22 bp, Artificial Sequence
  chemically synthesized
taaaacagagggaaagccaccc

SEQ ID NO: 1324029 - DNA, 22 bp, Artificial Sequence
  chemically synthesized
tagctgtgggtggctttccctc

SEQ ID NO: 1324030 - DNA, 22 bp, Artificial Sequence
  chemically synthesized
agctgtgggtggctttccctct

SEQ ID NO: 1324031 - DNA, 22 bp, Artificial Sequence
  chemically synthesized
gctgtgggtggctttccctctg

SEQ ID NO: 1324032 - DNA, 22 bp, Artificial Sequence
  chemically synthesized
tgggtggctttccctctgtttt

SEQ ID NO: 1324033 - DNA, 22 bp, Artificial Sequence
  chemically synthesized
aaagtataattttaaaacagag

SEQ ID NO: 1324034 - DNA, 22 bp, Artificial Sequence
  chemically synthesized
aaaagtataattttaaaacaga

SEQ ID NO: 1324035 - DNA, 22 bp, Artificial Sequence
  chemically synthesized
taaaagtataattttaaaacag

SEQ ID NO: 1324036 - DNA, 22 bp, Artificial Sequence
  chemically synthesized
tccctctgttttaaaattatac

SEQ ID NO: 1324037 - DNA, 22 bp, Artificial Sequence
  chemically synthesized
ccctctgttttaaaattatact

SEQ ID NO: 1324038 - DNA, 22 bp, Artificial Sequence
  chemically synthesized
cctctgttttaaaattatactt

SEQ ID NO: 1324039 - DNA, 22 bp, Artificial Sequence
  chemically synthesized
aagaaattttaaaagtataatt

SEQ ID NO: 1324040 - DNA, 22 bp, Artificial Sequence
  chemically synthesized
aaagaaattttaaaagtataat

SEQ ID NO: 1324041 - DNA, 22 bp, Artificial Sequence
  chemically synthesized
tgttttaaaattatacttttaa

SEQ ID NO: 1324042 - DNA, 22 bp, Artificial Sequence
  chemically synthesized
ttttaaaattatacttttaaaa

SEQ ID NO: 1324043 - DNA, 22 bp, Artificial Sequence
  chemically synthesized
taaaattatacttttaaaattt

SEQ ID NO: 1324044 - DNA, 22 bp, Artificial Sequence
  chemically synthesized
aaaattatacttttaaaatttc

SEQ ID NO: 1324045 - DNA, 22 bp, Artificial Sequence
  chemically synthesized
aaattatacttttaaaatttct

SEQ ID NO: 1324046 - DNA, 22 bp, Artificial Sequence
  chemically synthesized
tacttttaaaatttctttaaat

SEQ ID NO: 1324047 - DNA, 22 bp, Artificial Sequence
  chemically synthesized
ttaaaatttctttaaatatcat

SEQ ID NO: 1324048 - DNA, 22 bp, Artificial Sequence
  chemically synthesized
acaaagaaatacatgatattta

SEQ ID NO: 1324049 - DNA, 22 bp, Artificial Sequence
  chemically synthesized
taaaatttctttaaatatcatg

SEQ ID NO: 1324050 - DNA, 22 bp, Artificial Sequence
  chemically synthesized
aacaaagaaatacatgatattt

SEQ ID NO: 1324051 - DNA, 22 bp, Artificial Sequence
  chemically synthesized
aaaatttctttaaatatcatgt

SEQ ID NO: 1324052 - DNA, 22 bp, Artificial Sequence
  chemically synthesized
taacaaagaaatacatgatatt

SEQ ID NO: 1324053 - DNA, 22 bp, Artificial Sequence
  chemically synthesized
aaatttctttaaatatcatgta

SEQ ID NO: 1324054 - DNA, 22 bp, Artificial Sequence
  chemically synthesized
catctttaacaaagaaatacat

SEQ ID NO: 1324055 - DNA, 22 bp, Artificial Sequence
  chemically synthesized
ctttaaatatcatgtatttctt

SEQ ID NO: 1324056 - DNA, 22 bp, Artificial Sequence
  chemically synthesized
ccatctttaacaaagaaataca

SEQ ID NO: 1324057 - DNA, 22 bp, Artificial Sequence
  chemically synthesized
tttaaatatcatgtatttcttt

SEQ ID NO: 1324058 - DNA, 22 bp, Artificial Sequence
  chemically synthesized
taaatatcatgtatttctttgt

SEQ ID NO: 1324059 - DNA, 22 bp, Artificial Sequence
  chemically synthesized
aaatatcatgtatttctttgtt

SEQ ID NO: 1324060 - DNA, 22 bp, Artificial Sequence
  chemically synthesized
aatatcatgtatttctttgtta

SEQ ID NO: 1324061 - DNA, 22 bp, Artificial Sequence
  chemically synthesized
atcgtttccatctttaacaaag

SEQ ID NO: 1324062 - DNA, 22 bp, Artificial Sequence
  chemically synthesized
catcgtttccatctttaacaaa

SEQ ID NO: 1324063 - DNA, 22 bp, Artificial Sequence
  chemically synthesized
ctttgttaaagatggaaacgat

SEQ ID NO: 1324064 - DNA, 22 bp, Artificial Sequence
  chemically synthesized
tttgttaaagatggaaacgatg

SEQ ID NO: 1324065 - DNA, 22 bp, Artificial Sequence
  chemically synthesized
tgttaaagatggaaacgatgaa

SEQ ID NO: 1324066 - DNA, 22 bp, Artificial Sequence
  chemically synthesized
gttaaagatggaaacgatgaag

SEQ ID NO: 1324067 - DNA, 22 bp, Artificial Sequence
  chemically synthesized
ttaaagatggaaacgatgaagc

SEQ ID NO: 1324068 - DNA, 22 bp, Artificial Sequence
  chemically synthesized
aagatggaaacgatgaagccgg

SEQ ID NO: 1324069 - DNA, 22 bp, Artificial Sequence
  chemically synthesized
caagcgtgagccaccgtgcccg

SEQ ID NO: 1324070 - DNA, 22 bp, Artificial Sequence
  chemically synthesized
ggattacaagcgtgagccaccg

SEQ ID NO: 1324071 - DNA, 22 bp, Artificial Sequence
  chemically synthesized
ccaaagtgctgggattacaagc

SEQ ID NO: 1324072 - DNA, 22 bp, Artificial Sequence
  chemically synthesized
cctcccaaagtgctgggattac

SEQ ID NO: 1324073 - DNA, 22 bp, Artificial Sequence
  chemically synthesized
tgcctcccaaagtgctgggatt

SEQ ID NO: 1324074 - DNA, 22 bp, Artificial Sequence
  chemically synthesized
acgcttgtaatcccagcacttt

SEQ ID NO: 1324075 - DNA, 22 bp, Artificial Sequence
  chemically synthesized
cctctgcctcccaaagtgctgg

SEQ ID NO: 1324076 - DNA, 22 bp, Artificial Sequence
  chemically synthesized
gtaatcccagcactttgggagg

SEQ ID NO: 1324077 - DNA, 22 bp, Artificial Sequence
  chemically synthesized
taatcccagcactttgggaggc

SEQ ID NO: 1324078 - DNA, 22 bp, Artificial Sequence
  chemically synthesized
aggtgatccacctgcctctgcc

SEQ ID NO: 1324079 - DNA, 22 bp, Artificial Sequence
  chemically synthesized
gcctcaggtgatccacctgcct

SEQ ID NO: 1324080 - DNA, 22 bp, Artificial Sequence
  chemically synthesized
tgggaggcagaggcaggtggat

SEQ ID NO: 1324081 - DNA, 22 bp, Artificial Sequence
  chemically synthesized
gggaggcagaggcaggtggatc

SEQ ID NO: 1324082 - DNA, 22 bp, Artificial Sequence
  chemically synthesized
ctggcctcaggtgatccacctg

SEQ ID NO: 1324083 - DNA, 22 bp, Artificial Sequence
  chemically synthesized
ggaggcagaggcaggtggatca

SEQ ID NO: 1324084 - DNA, 22 bp, Artificial Sequence
  chemically synthesized
gaactcctggcctcaggtgatc

SEQ ID NO: 1324085 - DNA, 22 bp, Artificial Sequence
  chemically synthesized
gtctcgaactcctggcctcagg

SEQ ID NO: 1324086 - DNA, 22 bp, Artificial Sequence
  chemically synthesized
gtcaggctggtctcgaactcct

SEQ ID NO: 1324087 - DNA, 22 bp, Artificial Sequence
  chemically synthesized
ggtcaggctggtctcgaactcc

SEQ ID NO: 1324088 - DNA, 22 bp, Artificial Sequence
  chemically synthesized
tggtcaggctggtctcgaactc

SEQ ID NO: 1324089 - DNA, 22 bp, Artificial Sequence
  chemically synthesized
aggccaggagttcgagaccagc

SEQ ID NO: 1324090 - DNA, 22 bp, Artificial Sequence
  chemically synthesized
gccattttggtcaggctggtct

SEQ ID NO: 1324091 - DNA, 22 bp, Artificial Sequence
  chemically synthesized
cgccattttggtcaggctggtc

SEQ ID NO: 1324092 - DNA, 22 bp, Artificial Sequence
  chemically synthesized
gagaccagcctgaccaaaatgg

SEQ ID NO: 1324093 - DNA, 22 bp, Artificial Sequence
  chemically synthesized
gtagtacagatggggtttcgcc

SEQ ID NO: 1324094 - DNA, 22 bp, Artificial Sequence
  chemically synthesized
accaaaatggcgaaaccccatc

SEQ ID NO: 1324095 - DNA, 22 bp, Artificial Sequence
  chemically synthesized
tattagtagtacagatggggtt

SEQ ID NO: 1324096 - DNA, 22 bp, Artificial Sequence
  chemically synthesized
atattagtagtacagatggggt

SEQ ID NO: 1324097 - DNA, 22 bp, Artificial Sequence
  chemically synthesized
tatattagtagtacagatgggg

SEQ ID NO: 1324098 - DNA, 22 bp, Artificial Sequence
  chemically synthesized
attttatattagtagtacagat

SEQ ID NO: 1324099 - DNA, 22 bp, Artificial Sequence
  chemically synthesized
actaattttatattagtagtac

SEQ ID NO: 1324100 - DNA, 22 bp, Artificial Sequence
  chemically synthesized
tactactaatataaaattagtc

SEQ ID NO: 1324101 - DNA, 22 bp, Artificial Sequence
  chemically synthesized
ctaatataaaattagtcaggga

SEQ ID NO: 1324102 - DNA, 22 bp, Artificial Sequence
  chemically synthesized
atataaaattagtcagggatgg

SEQ ID NO: 1324103 - DNA, 22 bp, Artificial Sequence
  chemically synthesized
ggatgacaggcatgcgccacca

SEQ ID NO: 1324104 - DNA, 22 bp, Artificial Sequence
  chemically synthesized
gtcagggatggtggcgcatgcc

SEQ ID NO: 1324105 - DNA, 22 bp, Artificial Sequence
  chemically synthesized
ccgagtatctgggatgacaggc

SEQ ID NO: 1324106 - DNA, 22 bp, Artificial Sequence
  chemically synthesized
cccgagtatctgggatgacagg

SEQ ID NO: 1324107 - DNA, 22 bp, Artificial Sequence
  chemically synthesized
agcttcccgagtatctgggatg

SEQ ID NO: 1324108 - DNA, 22 bp, Artificial Sequence
  chemically synthesized
cctcagcttcccgagtatctgg

SEQ ID NO: 1324109 - DNA, 22 bp, Artificial Sequence
  chemically synthesized
ctgcctcagcttcccgagtatc

SEQ ID NO: 1324110 - DNA, 22 bp, Artificial Sequence
  chemically synthesized
tcctgcctcagcttcccgagta

SEQ ID NO: 1324111 - DNA, 22 bp, Artificial Sequence
  chemically synthesized
tcatcccagatactcgggaagc

SEQ ID NO: 1324112 - DNA, 22 bp, Artificial Sequence
  chemically synthesized
aagcgattctcctgcctcagct

SEQ ID NO: 1324113 - DNA, 22 bp, Artificial Sequence
  chemically synthesized
ggttcaagcgattctcctgcct

SEQ ID NO: 1324114 - DNA, 22 bp, Artificial Sequence
  chemically synthesized
gggaagctgaggcaggagaatc

SEQ ID NO: 1324115 - DNA, 22 bp, Artificial Sequence
  chemically synthesized
ctgggttcaagcgattctcctg

SEQ ID NO: 1324116 - DNA, 22 bp, Artificial Sequence
  chemically synthesized
cgcctcctgggttcaagcgatt

SEQ ID NO: 1324117 - DNA, 22 bp, Artificial Sequence
  chemically synthesized
aggcaggagaatcgcttgaacc

SEQ ID NO: 1324118 - DNA, 22 bp, Artificial Sequence
  chemically synthesized
caatctccgcctcctgggttca

SEQ ID NO: 1324119 - DNA, 22 bp, Artificial Sequence
  chemically synthesized
actgcaatctccgcctcctggg

SEQ ID NO: 1324120 - DNA, 22 bp, Artificial Sequence
  chemically synthesized
gctcactgcaatctccgcctcc

SEQ ID NO: 1324121 - DNA, 22 bp, Artificial Sequence
  chemically synthesized
ggctcactgcaatctccgcctc

SEQ ID NO: 1324122 - DNA, 22 bp, Artificial Sequence
  chemically synthesized
gaacccaggaggcggagattgc

SEQ ID NO: 1324123 - DNA, 22 bp, Artificial Sequence
  chemically synthesized
aacccaggaggcggagattgca

SEQ ID NO: 1324124 - DNA, 22 bp, Artificial Sequence
  chemically synthesized
tgcaatcttggctcactgcaat

SEQ ID NO: 1324125 - DNA, 22 bp, Artificial Sequence
  chemically synthesized
gagggcaactgtgcaatcttgg

SEQ ID NO: 1324126 - DNA, 22 bp, Artificial Sequence
  chemically synthesized
cagtgagccaagattgcacagt

SEQ ID NO: 1324127 - DNA, 22 bp, Artificial Sequence
  chemically synthesized
tcacccaggctagagggcaact

SEQ ID NO: 1324128 - DNA, 22 bp, Artificial Sequence
  chemically synthesized
gtcacccaggctagagggcaac

SEQ ID NO: 1324129 - DNA, 22 bp, Artificial Sequence
  chemically synthesized
ttgtcacccaggctagagggca

SEQ ID NO: 1324130 - DNA, 22 bp, Artificial Sequence
  chemically synthesized
ctcttgtcacccaggctagagg

SEQ ID NO: 1324131 - DNA, 22 bp, Artificial Sequence
  chemically synthesized
gctcttgtcacccaggctagag

SEQ ID NO: 1324132 - DNA, 22 bp, Artificial Sequence
  chemically synthesized
tgctcttgtcacccaggctaga

SEQ ID NO: 1324133 - DNA, 22 bp, Artificial Sequence
  chemically synthesized
cacagttgccctctagcctggg

SEQ ID NO: 1324134 - DNA, 22 bp, Artificial Sequence
  chemically synthesized
ccctctagcctgggtgacaaga

SEQ ID NO: 1324135 - DNA, 22 bp, Artificial Sequence
  chemically synthesized
agacggagttttgctcttgtca

SEQ ID NO: 1324136 - DNA, 22 bp, Artificial Sequence
  chemically synthesized
gagacggagttttgctcttgtc

SEQ ID NO: 1324137 - DNA, 22 bp, Artificial Sequence
  chemically synthesized
tgagacggagttttgctcttgt

SEQ ID NO: 1324138 - DNA, 22 bp, Artificial Sequence
  chemically synthesized
tagcctgggtgacaagagcaaa

SEQ ID NO: 1324139 - DNA, 22 bp, Artificial Sequence
  chemically synthesized
ttgagacggagttttgctcttg

SEQ ID NO: 1324140 - DNA, 22 bp, Artificial Sequence
  chemically synthesized
tttgagacggagttttgctctt

SEQ ID NO: 1324141 - DNA, 22 bp, Artificial Sequence
  chemically synthesized
gcctgggtgacaagagcaaaac

SEQ ID NO: 1324142 - DNA, 22 bp, Artificial Sequence
  chemically synthesized
ttttttgagacggagttttgct

SEQ ID NO: 1324143 - DNA, 22 bp, Artificial Sequence
  chemically synthesized
gttttttgagacggagttttgc

SEQ ID NO: 1324144 - DNA, 22 bp, Artificial Sequence
  chemically synthesized
tgttttttgagacggagttttg

SEQ ID NO: 1324145 - DNA, 22 bp, Artificial Sequence
  chemically synthesized
ggtgacaagagcaaaactccgt

SEQ ID NO: 1324146 - DNA, 22 bp, Artificial Sequence
  chemically synthesized
ttgttttttgagacggagtttt

SEQ ID NO: 1324147 - DNA, 22 bp, Artificial Sequence
  chemically synthesized
tttgttttttgagacggagttt

SEQ ID NO: 1324148 - DNA, 22 bp, Artificial Sequence
  chemically synthesized
ttttttgttttttgagacggag

SEQ ID NO: 1324149 - DNA, 22 bp, Artificial Sequence
  chemically synthesized
gttttttgttttttgagacgga

SEQ ID NO: 1324150 - DNA, 22 bp, Artificial Sequence
  chemically synthesized
tgttttttgttttttgagacgg

SEQ ID NO: 1324151 - DNA, 22 bp, Artificial Sequence
  chemically synthesized
ttgttttttgttttttgagacg

SEQ ID NO: 1324152 - DNA, 22 bp, Artificial Sequence
  chemically synthesized
tttgttttttgttttttgagac

SEQ ID NO: 1324153 - DNA, 22 bp, Artificial Sequence
  chemically synthesized
attttttgttttttgttttttg

SEQ ID NO: 1324154 - DNA, 22 bp, Artificial Sequence
  chemically synthesized
cattttttgttttttgtttttt

SEQ ID NO: 1324155 - DNA, 22 bp, Artificial Sequence
  chemically synthesized
tcattttttgttttttgttttt

SEQ ID NO: 1324156 - DNA, 22 bp, Artificial Sequence
  chemically synthesized
cgtctcaaaaaacaaaaaacaa

SEQ ID NO: 1324157 - DNA, 22 bp, Artificial Sequence
  chemically synthesized
atggttttcattttttgttttt

SEQ ID NO: 1324158 - DNA, 22 bp, Artificial Sequence
  chemically synthesized
ctcatggttttcattttttgtt

SEQ ID NO: 1324159 - DNA, 22 bp, Artificial Sequence
  chemically synthesized
aaaaaacaaaaaacaaaaaatg

SEQ ID NO: 1324160 - DNA, 22 bp, Artificial Sequence
  chemically synthesized
ttactcatggttttcatttttt

SEQ ID NO: 1324161 - DNA, 22 bp, Artificial Sequence
  chemically synthesized
attactcatggttttcattttt

SEQ ID NO: 1324162 - DNA, 22 bp, Artificial Sequence
  chemically synthesized
atttattactcatggttttcat

SEQ ID NO: 1324163 - DNA, 22 bp, Artificial Sequence
  chemically synthesized
catttattactcatggttttca

SEQ ID NO: 1324164 - DNA, 22 bp, Artificial Sequence
  chemically synthesized
tcatttattactcatggttttc

SEQ ID NO: 1324165 - DNA, 22 bp, Artificial Sequence
  chemically synthesized
attttcatttattactcatggt

SEQ ID NO: 1324166 - DNA, 22 bp, Artificial Sequence
  chemically synthesized
attgattttcatttattactca

SEQ ID NO: 1324167 - DNA, 22 bp, Artificial Sequence
  chemically synthesized
agttaattgattttcatttatt

SEQ ID NO: 1324168 - DNA, 22 bp, Artificial Sequence
  chemically synthesized
tgagttaattgattttcattta

SEQ ID NO: 1324169 - DNA, 22 bp, Artificial Sequence
  chemically synthesized
atacactctgagttaattgatt

SEQ ID NO: 1324170 - DNA, 22 bp, Artificial Sequence
  chemically synthesized
cattaatacactctgagttaat

SEQ ID NO: 1324171 - DNA, 22 bp, Artificial Sequence
  chemically synthesized
atacacatataattccattaat

SEQ ID NO: 1324172 - DNA, 22 bp, Artificial Sequence
  chemically synthesized
actcagagtgtattaatggaat

SEQ ID NO: 1324173 - DNA, 22 bp, Artificial Sequence
  chemically synthesized
gatacacatataattccattaa

SEQ ID NO: 1324174 - DNA, 22 bp, Artificial Sequence
  chemically synthesized
agagtgtattaatggaattata

SEQ ID NO: 1324175 - DNA, 22 bp, Artificial Sequence
  chemically synthesized
tacttgatacacatataattcc

SEQ ID NO: 1324176 - DNA, 22 bp, Artificial Sequence
  chemically synthesized
aatattgtacttgatacacata

SEQ ID NO: 1324177 - DNA, 22 bp, Artificial Sequence
  chemically synthesized
atggaattatatgtgtatcaag

SEQ ID NO: 1324178 - DNA, 22 bp, Artificial Sequence
  chemically synthesized
gttaaatattgtacttgataca

SEQ ID NO: 1324179 - DNA, 22 bp, Artificial Sequence
  chemically synthesized
agttaaatattgtacttgatac

SEQ ID NO: 1324180 - DNA, 22 bp, Artificial Sequence
  chemically synthesized
taatttagttaaatattgtact

SEQ ID NO: 1324181 - DNA, 22 bp, Artificial Sequence
  chemically synthesized
tatgtgtatcaagtacaatatt

SEQ ID NO: 1324182 - DNA, 22 bp, Artificial Sequence
  chemically synthesized
caattataatttagttaaatat

SEQ ID NO: 1324183 - DNA, 22 bp, Artificial Sequence
  chemically synthesized
acaattataatttagttaaata

SEQ ID NO: 1324184 - DNA, 22 bp, Artificial Sequence
  chemically synthesized
tacaattataatttagttaaat

SEQ ID NO: 1324185 - DNA, 22 bp, Artificial Sequence
  chemically synthesized
aggagttttacaattataattt

SEQ ID NO: 1324186 - DNA, 22 bp, Artificial Sequence
  chemically synthesized
aactaaattataattgtaaaac

SEQ ID NO: 1324187 - DNA, 22 bp, Artificial Sequence
  chemically synthesized
actaaattataattgtaaaact

SEQ ID NO: 1324188 - DNA, 22 bp, Artificial Sequence
  chemically synthesized
tccaaattcaggagttttacaa

SEQ ID NO: 1324189 - DNA, 22 bp, Artificial Sequence
  chemically synthesized
tatccaaattcaggagttttac

SEQ ID NO: 1324190 - DNA, 22 bp, Artificial Sequence
  chemically synthesized
aattataattgtaaaactcctg

SEQ ID NO: 1324191 - DNA, 22 bp, Artificial Sequence
  chemically synthesized
taattgtaaaactcctgaattt

SEQ ID NO: 1324192 - DNA, 22 bp, Artificial Sequence
  chemically synthesized
agatattctatccaaattcagg

SEQ ID NO: 1324193 - DNA, 22 bp, Artificial Sequence
  chemically synthesized
tgagatattctatccaaattca

SEQ ID NO: 1324194 - DNA, 22 bp, Artificial Sequence
  chemically synthesized
ctgagatattctatccaaattc

SEQ ID NO: 1324195 - DNA, 22 bp, Artificial Sequence
  chemically synthesized
taaaactcctgaatttggatag

SEQ ID NO: 1324196 - DNA, 22 bp, Artificial Sequence
  chemically synthesized
ctgaatttggatagaatatctc

SEQ ID NO: 1324197 - DNA, 22 bp, Artificial Sequence
  chemically synthesized
aatttggatagaatatctcaga

SEQ ID NO: 1324198 - DNA, 22 bp, Artificial Sequence
  chemically synthesized
gtaggggtagatttctgagata

SEQ ID NO: 1324199 - DNA, 22 bp, Artificial Sequence
  chemically synthesized
ggatagaatatctcagaaatct

SEQ ID NO: 1324200 - DNA, 22 bp, Artificial Sequence
  chemically synthesized
gatagaatatctcagaaatcta

SEQ ID NO: 1324201 - DNA, 22 bp, Artificial Sequence
  chemically synthesized
acatgaaaaaattggtaggggt

SEQ ID NO: 1324202 - DNA, 22 bp, Artificial Sequence
  chemically synthesized
agaaatctacccctaccaattt

SEQ ID NO: 1324203 - DNA, 22 bp, Artificial Sequence
  chemically synthesized
cccctaccaattttttcatgtt

SEQ ID NO: 1324204 - DNA, 22 bp, Artificial Sequence
  chemically synthesized
gaagaggtgatattaacatgaa

SEQ ID NO: 1324205 - DNA, 22 bp, Artificial Sequence
  chemically synthesized
agaagaggtgatattaacatga

SEQ ID NO: 1324206 - DNA, 22 bp, Artificial Sequence
  chemically synthesized
tagaagaggtgatattaacatg

SEQ ID NO: 1324207 - DNA, 22 bp, Artificial Sequence
  chemically synthesized
ccaattttttcatgttaatatc

SEQ ID NO: 1324208 - DNA, 22 bp, Artificial Sequence
  chemically synthesized
tttcatgttaatatcacctctt

SEQ ID NO: 1324209 - DNA, 22 bp, Artificial Sequence
  chemically synthesized
atgagattttagaagaggtgat

SEQ ID NO: 1324210 - DNA, 22 bp, Artificial Sequence
  chemically synthesized
ttcatgttaatatcacctcttc

SEQ ID NO: 1324211 - DNA, 22 bp, Artificial Sequence
  chemically synthesized
tcatgttaatatcacctcttct

SEQ ID NO: 1324212 - DNA, 22 bp, Artificial Sequence
  chemically synthesized
catgttaatatcacctcttcta

SEQ ID NO: 1324213 - DNA, 22 bp, Artificial Sequence
  chemically synthesized
atgttaatatcacctcttctaa

SEQ ID NO: 1324214 - DNA, 22 bp, Artificial Sequence
  chemically synthesized
ggagctgatgagattttagaag

SEQ ID NO: 1324215 - DNA, 22 bp, Artificial Sequence
  chemically synthesized
atatcacctcttctaaaatctc

SEQ ID NO: 1324216 - DNA, 22 bp, Artificial Sequence
  chemically synthesized
ctaggagctgatgagattttag

SEQ ID NO: 1324217 - DNA, 22 bp, Artificial Sequence
  chemically synthesized
cctaggagctgatgagatttta

SEQ ID NO: 1324218 - DNA, 22 bp, Artificial Sequence
  chemically synthesized
ggcatttcctaggagctgatga

SEQ ID NO: 1324219 - DNA, 22 bp, Artificial Sequence
  chemically synthesized
ttctaaaatctcatcagctcct

SEQ ID NO: 1324220 - DNA, 22 bp, Artificial Sequence
  chemically synthesized
ctaaaatctcatcagctcctag

SEQ ID NO: 1324221 - DNA, 22 bp, Artificial Sequence
  chemically synthesized
taaaatctcatcagctcctagg

SEQ ID NO: 1324222 - DNA, 22 bp, Artificial Sequence
  chemically synthesized
aaatctcatcagctcctaggaa

SEQ ID NO: 1324223 - DNA, 22 bp, Artificial Sequence
  chemically synthesized
aaatctaggcatttcctaggag

SEQ ID NO: 1324224 - DNA, 22 bp, Artificial Sequence
  chemically synthesized
aaaatctaggcatttcctagga

SEQ ID NO: 1324225 - DNA, 22 bp, Artificial Sequence
  chemically synthesized
taaaatctaggcatttcctagg

SEQ ID NO: 1324226 - DNA, 22 bp, Artificial Sequence
  chemically synthesized
ttaaaatctaggcatttcctag

SEQ ID NO: 1324227 - DNA, 22 bp, Artificial Sequence
  chemically synthesized
tttaaaatctaggcatttccta

SEQ ID NO: 1324228 - DNA, 22 bp, Artificial Sequence
  chemically synthesized
atcagctcctaggaaatgccta

SEQ ID NO: 1324229 - DNA, 22 bp, Artificial Sequence
  chemically synthesized
ctttttaaaatctaggcatttc

SEQ ID NO: 1324230 - DNA, 22 bp, Artificial Sequence
  chemically synthesized
tagttgctttttaaaatctagg

SEQ ID NO: 1324231 - DNA, 22 bp, Artificial Sequence
  chemically synthesized
ctaggaaatgcctagattttaa

SEQ ID NO: 1324232 - DNA, 22 bp, Artificial Sequence
  chemically synthesized
ggaaatgcctagattttaaaaa

SEQ ID NO: 1324233 - DNA, 22 bp, Artificial Sequence
  chemically synthesized
tccataggttatagttgctttt

SEQ ID NO: 1324234 - DNA, 22 bp, Artificial Sequence
  chemically synthesized
gattttaaaaagcaactataac

SEQ ID NO: 1324235 - DNA, 22 bp, Artificial Sequence
  chemically synthesized
taaaaagcaactataacctatg

SEQ ID NO: 1324236 - DNA, 22 bp, Artificial Sequence
  chemically synthesized
aaaaagcaactataacctatgg

SEQ ID NO: 1324237 - DNA, 22 bp, Artificial Sequence
  chemically synthesized
aaaagcaactataacctatgga

SEQ ID NO: 1324238 - DNA, 22 bp, Artificial Sequence
  chemically synthesized
taacctatggataggatggtcc

SEQ ID NO: 1324239 - DNA, 22 bp, Artificial Sequence
  chemically synthesized
gtggccacacagggaccatcct

SEQ ID NO: 1324240 - DNA, 22 bp, Artificial Sequence
  chemically synthesized
ctagtggccacacagggaccat

SEQ ID NO: 1324241 - DNA, 22 bp, Artificial Sequence
  chemically synthesized
cctagtggccacacagggacca

SEQ ID NO: 1324242 - DNA, 22 bp, Artificial Sequence
  chemically synthesized
tggataggatggtccctgtgtg

SEQ ID NO: 1324243 - DNA, 22 bp, Artificial Sequence
  chemically synthesized
cagcagcttcctagtggccaca

SEQ ID NO: 1324244 - DNA, 22 bp, Artificial Sequence
  chemically synthesized
ccagcagcttcctagtggccac

SEQ ID NO: 1324245 - DNA, 22 bp, Artificial Sequence
  chemically synthesized
ttccagcagcttcctagtggcc

SEQ ID NO: 1324246 - DNA, 22 bp, Artificial Sequence
  chemically synthesized
tcttccagcagcttcctagtgg

SEQ ID NO: 1324247 - DNA, 22 bp, Artificial Sequence
  chemically synthesized
ctcttccagcagcttcctagtg

SEQ ID NO: 1324248 - DNA, 22 bp, Artificial Sequence
  chemically synthesized
tctcttccagcagcttcctagt

SEQ ID NO: 1324249 - DNA, 22 bp, Artificial Sequence
  chemically synthesized
tttctcttccagcagcttccta

SEQ ID NO: 1324250 - DNA, 22 bp, Artificial Sequence
  chemically synthesized
tctttctcttccagcagcttcc

SEQ ID NO: 1324251 - DNA, 22 bp, Artificial Sequence
  chemically synthesized
tgtggccactaggaagctgctg

SEQ ID NO: 1324252 - DNA, 22 bp, Artificial Sequence
  chemically synthesized
tatctctctttctcttccagca

SEQ ID NO: 1324253 - DNA, 22 bp, Artificial Sequence
  chemically synthesized
ggaagctgctggaagagaaaga

SEQ ID NO: 1324254 - DNA, 22 bp, Artificial Sequence
  chemically synthesized
cagaatatactatatctctctt

SEQ ID NO: 1324255 - DNA, 22 bp, Artificial Sequence
  chemically synthesized
ctggaagagaaagagagatata

SEQ ID NO: 1324256 - DNA, 22 bp, Artificial Sequence
  chemically synthesized
gaagagaaagagagatatagta

SEQ ID NO: 1324257 - DNA, 22 bp, Artificial Sequence
  chemically synthesized
tcacatggctacagaatatact

SEQ ID NO: 1324258 - DNA, 22 bp, Artificial Sequence
  chemically synthesized
gtcacatggctacagaatatac

SEQ ID NO: 1324259 - DNA, 22 bp, Artificial Sequence
  chemically synthesized
gtcccacacttgtcacatggct

SEQ ID NO: 1324260 - DNA, 22 bp, Artificial Sequence
  chemically synthesized
tggtcccacacttgtcacatgg

SEQ ID NO: 1324261 - DNA, 22 bp, Artificial Sequence
  chemically synthesized
ctggtcccacacttgtcacatg

SEQ ID NO: 1324262 - DNA, 22 bp, Artificial Sequence
  chemically synthesized
ttctggtcccacacttgtcaca

SEQ ID NO: 1324263 - DNA, 22 bp, Artificial Sequence
  chemically synthesized
ctcttctggtcccacacttgtc

SEQ ID NO: 1324264 - DNA, 22 bp, Artificial Sequence
  chemically synthesized
tgtagccatgtgacaagtgtgg

SEQ ID NO: 1324265 - DNA, 22 bp, Artificial Sequence
  chemically synthesized
tagccatgtgacaagtgtggga

SEQ ID NO: 1324266 - DNA, 22 bp, Artificial Sequence
  chemically synthesized
actgctcttctggtcccacact

SEQ ID NO: 1324267 - DNA, 22 bp, Artificial Sequence
  chemically synthesized
actaactgctcttctggtccca

SEQ ID NO: 1324268 - DNA, 22 bp, Artificial Sequence
  chemically synthesized
tcctcactaactgctcttctgg

SEQ ID NO: 1324269 - DNA, 22 bp, Artificial Sequence
  chemically synthesized
tgcaaaattatcctcactaact

SEQ ID NO: 1324270 - DNA, 22 bp, Artificial Sequence
  chemically synthesized
aaatgctgtgcaaaattatcct

SEQ ID NO: 1324271 - DNA, 22 bp, Artificial Sequence
  chemically synthesized
caaatgctgtgcaaaattatcc

SEQ ID NO: 1324272 - DNA, 22 bp, Artificial Sequence
  chemically synthesized
gtgaggataattttgcacagca

SEQ ID NO: 1324273 - DNA, 22 bp, Artificial Sequence
  chemically synthesized
atgtaagaatttcaaatgctgt

SEQ ID NO: 1324274 - DNA, 22 bp, Artificial Sequence
  chemically synthesized
aatgtaagaatttcaaatgctg

SEQ ID NO: 1324275 - DNA, 22 bp, Artificial Sequence
  chemically synthesized
taatgtaagaatttcaaatgct

SEQ ID NO: 1324276 - DNA, 22 bp, Artificial Sequence
  chemically synthesized
tgcacagcatttgaaattctta

SEQ ID NO: 1324277 - DNA, 22 bp, Artificial Sequence
  chemically synthesized
gcacagcatttgaaattcttac

SEQ ID NO: 1324278 - DNA, 22 bp, Artificial Sequence
  chemically synthesized
cacagcatttgaaattcttaca

SEQ ID NO: 1324279 - DNA, 22 bp, Artificial Sequence
  chemically synthesized
ccaacaaagtatctttaatgta

SEQ ID NO: 1324280 - DNA, 22 bp, Artificial Sequence
  chemically synthesized
gaaattcttacattaaagatac

SEQ ID NO: 1324281 - DNA, 22 bp, Artificial Sequence
  chemically synthesized
aaattcttacattaaagatact

SEQ ID NO: 1324282 - DNA, 22 bp, Artificial Sequence
  chemically synthesized
cgattgccaacaaagtatcttt

SEQ ID NO: 1324283 - DNA, 22 bp, Artificial Sequence
  chemically synthesized
ttacattaaagatactttgttg

SEQ ID NO: 1324284 - DNA, 22 bp, Artificial Sequence
  chemically synthesized
acattaaagatactttgttggc

SEQ ID NO: 1324285 - DNA, 22 bp, Artificial Sequence
  chemically synthesized
cattaaagatactttgttggca

SEQ ID NO: 1324286 - DNA, 22 bp, Artificial Sequence
  chemically synthesized
aagatactttgttggcaatcgc

SEQ ID NO: 1324287 - DNA, 22 bp, Artificial Sequence
  chemically synthesized
tgttggcaatcgcagcgtttat

SEQ ID NO: 1324288 - DNA, 22 bp, Artificial Sequence
  chemically synthesized
gttggcaatcgcagcgtttatt

SEQ ID NO: 1324289 - DNA, 22 bp, Artificial Sequence
  chemically synthesized
ttggcaatcgcagcgtttattt

SEQ ID NO: 1324290 - DNA, 22 bp, Artificial Sequence
  chemically synthesized
gcaatcgcagcgtttatttgtt

SEQ ID NO: 1324291 - DNA, 22 bp, Artificial Sequence
  chemically synthesized
tatgtaaaaccaaataaacaaa

SEQ ID NO: 1324292 - DNA, 22 bp, Artificial Sequence
  chemically synthesized
atatgtaaaaccaaataaacaa

SEQ ID NO: 1324293 - DNA, 22 bp, Artificial Sequence
  chemically synthesized
tttatatgtaaaaccaaataaa

SEQ ID NO: 1324294 - DNA, 22 bp, Artificial Sequence
  chemically synthesized
atttatatgtaaaaccaaataa

SEQ ID NO: 1324295 - DNA, 22 bp, Artificial Sequence
  chemically synthesized
tatttatatgtaaaaccaaata

SEQ ID NO: 1324296 - DNA, 22 bp, Artificial Sequence
  chemically synthesized
ttatttatatgtaaaaccaaat

SEQ ID NO: 1324297 - DNA, 22 bp, Artificial Sequence
  chemically synthesized
atttgtttatttggttttacat

SEQ ID NO: 1324298 - DNA, 22 bp, Artificial Sequence
  chemically synthesized
tttgtttatttggttttacata

SEQ ID NO: 1324299 - DNA, 22 bp, Artificial Sequence
  chemically synthesized
gtttatttggttttacatataa

SEQ ID NO: 1324300 - DNA, 22 bp, Artificial Sequence
  chemically synthesized
tttatttggttttacatataaa
